United States Patent 11,492,591 (UNIVERSAL DONOR STEM CELLS AND RELATED METHODS) - sequence listing, part 14

SEQ ID NO: 435457 - DNA, 20 bp, Artificial
  CRISPR gRNA sequence
gccctgttctcccgtgttca

SEQ ID NO: 435458 - DNA, 20 bp, Artificial
  CRISPR gRNA sequence
ttctcccgtgttcacagaat

SEQ ID NO: 435459 - DNA, 20 bp, Artificial
  CRISPR gRNA sequence
tctcccgtgttcacagaatt

SEQ ID NO: 435460 - DNA, 20 bp, Artificial
  CRISPR gRNA sequence
attgggccacaattctctcc

SEQ ID NO: 435461 - DNA, 20 bp, Artificial
  CRISPR gRNA sequence
ttgggccacaattctctcct

SEQ ID NO: 435462 - DNA, 20 bp, Artificial
  CRISPR gRNA sequence
tgggccacaattctctccta

SEQ ID NO: 435463 - DNA, 20 bp, Artificial
  CRISPR gRNA sequence
gccacaattctctcctaggg

SEQ ID NO: 435464 - DNA, 20 bp, Artificial
  CRISPR gRNA sequence
tcctagggcagtgtttctga

SEQ ID NO: 435465 - DNA, 20 bp, Artificial
  CRISPR gRNA sequence
agggcagtgtttctgaaagt

SEQ ID NO: 435466 - DNA, 20 bp, Artificial
  CRISPR gRNA sequence
gggcagtgtttctgaaagtg

SEQ ID NO: 435467 - DNA, 20 bp, Artificial
  CRISPR gRNA sequence
gtttctgaaagtgaggttct

SEQ ID NO: 435468 - DNA, 20 bp, Artificial
  CRISPR gRNA sequence
tgaaagtgaggttctgagac

SEQ ID NO: 435469 - DNA, 20 bp, Artificial
  CRISPR gRNA sequence
ggttctgagaccagccactt

SEQ ID NO: 435470 - DNA, 20 bp, Artificial
  CRISPR gRNA sequence
cagccacttcagcaacactt

SEQ ID NO: 435471 - DNA, 20 bp, Artificial
  CRISPR gRNA sequence
agcaacacttgagaacttgt

SEQ ID NO: 435472 - DNA, 20 bp, Artificial
  CRISPR gRNA sequence
tgagaacttgttagaaataa

SEQ ID NO: 435473 - DNA, 20 bp, Artificial
  CRISPR gRNA sequence
ttgttagaaataaaagttct

SEQ ID NO: 435474 - DNA, 20 bp, Artificial
  CRISPR gRNA sequence
tgttagaaataaaagttctc

SEQ ID NO: 435475 - DNA, 20 bp, Artificial
  CRISPR gRNA sequence
aaagttctcaggctctacca

SEQ ID NO: 435476 - DNA, 20 bp, Artificial
  CRISPR gRNA sequence
aagttctcaggctctaccac

SEQ ID NO: 435477 - DNA, 20 bp, Artificial
  CRISPR gRNA sequence
ggctctaccacaggccaact

SEQ ID NO: 435478 - DNA, 20 bp, Artificial
  CRISPR gRNA sequence
ctaccacaggccaactgagt

SEQ ID NO: 435479 - DNA, 20 bp, Artificial
  CRISPR gRNA sequence
taccacaggccaactgagtc

SEQ ID NO: 435480 - DNA, 20 bp, Artificial
  CRISPR gRNA sequence
gccaactgagtcaggaactc

SEQ ID NO: 435481 - DNA, 20 bp, Artificial
  CRISPR gRNA sequence
aactgagtcaggaactctag

SEQ ID NO: 435482 - DNA, 20 bp, Artificial
  CRISPR gRNA sequence
agtcaggaactctagcagtt

SEQ ID NO: 435483 - DNA, 20 bp, Artificial
  CRISPR gRNA sequence
ggaactctagcagttgagcc

SEQ ID NO: 435484 - DNA, 20 bp, Artificial
  CRISPR gRNA sequence
ccagcaatctgtgttttcgc

SEQ ID NO: 435485 - DNA, 20 bp, Artificial
  CRISPR gRNA sequence
cagcaatctgtgttttcgca

SEQ ID NO: 435486 - DNA, 20 bp, Artificial
  CRISPR gRNA sequence
tgtgttttcgcaaggcttcc

SEQ ID NO: 435487 - DNA, 20 bp, Artificial
  CRISPR gRNA sequence
aggcttcccagtgattctga

SEQ ID NO: 435488 - DNA, 20 bp, Artificial
  CRISPR gRNA sequence
ttctgatggccttcacatct

SEQ ID NO: 435489 - DNA, 20 bp, Artificial
  CRISPR gRNA sequence
tgatggccttcacatctgag

SEQ ID NO: 435490 - DNA, 20 bp, Artificial
  CRISPR gRNA sequence
acatctgagaagcattgtca

SEQ ID NO: 435491 - DNA, 20 bp, Artificial
  CRISPR gRNA sequence
acagcgaatcatcctccaaa

SEQ ID NO: 435492 - DNA, 20 bp, Artificial
  CRISPR gRNA sequence
cagcgaatcatcctccaaac

SEQ ID NO: 435493 - DNA, 20 bp, Artificial
  CRISPR gRNA sequence
tcatcctccaaacaggactg

SEQ ID NO: 435494 - DNA, 20 bp, Artificial
  CRISPR gRNA sequence
tcctccaaacaggactgcag

SEQ ID NO: 435495 - DNA, 20 bp, Artificial
  CRISPR gRNA sequence
tccaaacaggactgcagcag

SEQ ID NO: 435496 - DNA, 20 bp, Artificial
  CRISPR gRNA sequence
tagcttcctctttattctgt

SEQ ID NO: 435497 - DNA, 20 bp, Artificial
  CRISPR gRNA sequence
cctctttattctgtaagaca

SEQ ID NO: 435498 - DNA, 20 bp, Artificial
  CRISPR gRNA sequence
attctgtaagacatggcttg

SEQ ID NO: 435499 - DNA, 20 bp, Artificial
  CRISPR gRNA sequence
ggcttgcagttttcctgaaa

SEQ ID NO: 435500 - DNA, 20 bp, Artificial
  CRISPR gRNA sequence
cttgcagttttcctgaaatg

SEQ ID NO: 435501 - DNA, 20 bp, Artificial
  CRISPR gRNA sequence
agtaacctcactcaccgctt

SEQ ID NO: 435502 - DNA, 20 bp, Artificial
  CRISPR gRNA sequence
ctcactcaccgcttgagtct

SEQ ID NO: 435503 - DNA, 20 bp, Artificial
  CRISPR gRNA sequence
gctctccttctctctctatg

SEQ ID NO: 435504 - DNA, 20 bp, Artificial
  CRISPR gRNA sequence
ctctccttctctctctatgc

SEQ ID NO: 435505 - DNA, 20 bp, Artificial
  CRISPR gRNA sequence
tctccttctctctctatgca

SEQ ID NO: 435506 - DNA, 20 bp, Artificial
  CRISPR gRNA sequence
ctctctctatgcagggtcct

SEQ ID NO: 435507 - DNA, 20 bp, Artificial
  CRISPR gRNA sequence
tctctatgcagggtcctcag

SEQ ID NO: 435508 - DNA, 20 bp, Artificial
  CRISPR gRNA sequence
ctatgcagggtcctcagaag

SEQ ID NO: 435509 - DNA, 20 bp, Artificial
  CRISPR gRNA sequence
gggtcctcagaagtggaata

SEQ ID NO: 435510 - DNA, 20 bp, Artificial
  CRISPR gRNA sequence
gtcctcagaagtggaataca

SEQ ID NO: 435511 - DNA, 20 bp, Artificial
  CRISPR gRNA sequence
ctcagaagtggaatacagag

SEQ ID NO: 435512 - DNA, 20 bp, Artificial
  CRISPR gRNA sequence
cagaagtggaatacagagcg

SEQ ID NO: 435513 - DNA, 20 bp, Artificial
  CRISPR gRNA sequence
agaagtggaatacagagcgg

SEQ ID NO: 435514 - DNA, 20 bp, Artificial
  CRISPR gRNA sequence
gtggaatacagagcggaggt

SEQ ID NO: 435515 - DNA, 20 bp, Artificial
  CRISPR gRNA sequence
aatacagagcggaggtcggt

SEQ ID NO: 435516 - DNA, 20 bp, Artificial
  CRISPR gRNA sequence
tctgccctgcttctacaccc

SEQ ID NO: 435517 - DNA, 20 bp, Artificial
  CRISPR gRNA sequence
cttctacaccccagccgccc

SEQ ID NO: 435518 - DNA, 20 bp, Artificial
  CRISPR gRNA sequence
ttctacaccccagccgcccc

SEQ ID NO: 435519 - DNA, 20 bp, Artificial
  CRISPR gRNA sequence
tctacaccccagccgcccca

SEQ ID NO: 435520 - DNA, 20 bp, Artificial
  CRISPR gRNA sequence
ggaacctcgtgcccgtctgc

SEQ ID NO: 435521 - DNA, 20 bp, Artificial
  CRISPR gRNA sequence
gaacctcgtgcccgtctgct

SEQ ID NO: 435522 - DNA, 20 bp, Artificial
  CRISPR gRNA sequence
aacctcgtgcccgtctgctg

SEQ ID NO: 435523 - DNA, 20 bp, Artificial
  CRISPR gRNA sequence
cgtgcccgtctgctggggca

SEQ ID NO: 435524 - DNA, 20 bp, Artificial
  CRISPR gRNA sequence
gtgcccgtctgctggggcaa

SEQ ID NO: 435525 - DNA, 20 bp, Artificial
  CRISPR gRNA sequence
gcccgtctgctggggcaaag

SEQ ID NO: 435526 - DNA, 20 bp, Artificial
  CRISPR gRNA sequence
gcctgtcctgtgtttgaatg

SEQ ID NO: 435527 - DNA, 20 bp, Artificial
  CRISPR gRNA sequence
tgtgtttgaatgtggcaacg

SEQ ID NO: 435528 - DNA, 20 bp, Artificial
  CRISPR gRNA sequence
gaatgtggcaacgtggtgct

SEQ ID NO: 435529 - DNA, 20 bp, Artificial
  CRISPR gRNA sequence
aatgtggcaacgtggtgctc

SEQ ID NO: 435530 - DNA, 20 bp, Artificial
  CRISPR gRNA sequence
gtggtgctcaggactgatga

SEQ ID NO: 435531 - DNA, 20 bp, Artificial
  CRISPR gRNA sequence
tggtgctcaggactgatgaa

SEQ ID NO: 435532 - DNA, 20 bp, Artificial
  CRISPR gRNA sequence
ggtgctcaggactgatgaaa

SEQ ID NO: 435533 - DNA, 20 bp, Artificial
  CRISPR gRNA sequence
atgaaagggatgtgaattat

SEQ ID NO: 435534 - DNA, 20 bp, Artificial
  CRISPR gRNA sequence
gatgtgaattattggacatc

SEQ ID NO: 435535 - DNA, 20 bp, Artificial
  CRISPR gRNA sequence
attattggacatccagatac

SEQ ID NO: 435536 - DNA, 20 bp, Artificial
  CRISPR gRNA sequence
acatccagatactggctaaa

SEQ ID NO: 435537 - DNA, 20 bp, Artificial
  CRISPR gRNA sequence
catccagatactggctaaat

SEQ ID NO: 435538 - DNA, 20 bp, Artificial
  CRISPR gRNA sequence
atccagatactggctaaatg

SEQ ID NO: 435539 - DNA, 20 bp, Artificial
  CRISPR gRNA sequence
gctaaatggggatttccgca

SEQ ID NO: 435540 - DNA, 20 bp, Artificial
  CRISPR gRNA sequence
ctaaatggggatttccgcaa

SEQ ID NO: 435541 - DNA, 20 bp, Artificial
  CRISPR gRNA sequence
aaatggggatttccgcaaag

SEQ ID NO: 435542 - DNA, 20 bp, Artificial
  CRISPR gRNA sequence
aggagatgtgtccctgacca

SEQ ID NO: 435543 - DNA, 20 bp, Artificial
  CRISPR gRNA sequence
gagatgtgtccctgaccata

SEQ ID NO: 435544 - DNA, 20 bp, Artificial
  CRISPR gRNA sequence
gaccatagagaatgtgactc

SEQ ID NO: 435545 - DNA, 20 bp, Artificial
  CRISPR gRNA sequence
catagagaatgtgactctag

SEQ ID NO: 435546 - DNA, 20 bp, Artificial
  CRISPR gRNA sequence
gagaatgtgactctagcaga

SEQ ID NO: 435547 - DNA, 20 bp, Artificial
  CRISPR gRNA sequence
aatgtgactctagcagacag

SEQ ID NO: 435548 - DNA, 20 bp, Artificial
  CRISPR gRNA sequence
atgtgactctagcagacagt

SEQ ID NO: 435549 - DNA, 20 bp, Artificial
  CRISPR gRNA sequence
acagtgggatctactgctgc

SEQ ID NO: 435550 - DNA, 20 bp, Artificial
  CRISPR gRNA sequence
ctgctgccggatccaaatcc

SEQ ID NO: 435551 - DNA, 20 bp, Artificial
  CRISPR gRNA sequence
tgctgccggatccaaatccc

SEQ ID NO: 435552 - DNA, 20 bp, Artificial
  CRISPR gRNA sequence
atgatgaaaaatttaacctg

SEQ ID NO: 435553 - DNA, 20 bp, Artificial
  CRISPR gRNA sequence
tgaaaaatttaacctgaagt

SEQ ID NO: 435554 - DNA, 20 bp, Artificial
  CRISPR gRNA sequence
cctgaagttggtcatcaaac

SEQ ID NO: 435555 - DNA, 20 bp, Artificial
  CRISPR gRNA sequence
ctgaagttggtcatcaaacc

SEQ ID NO: 435556 - DNA, 20 bp, Artificial
  CRISPR gRNA sequence
agttggtcatcaaaccaggt

SEQ ID NO: 435557 - DNA, 20 bp, Artificial
  CRISPR gRNA sequence
tggtcatcaaaccaggtgag

SEQ ID NO: 435558 - DNA, 20 bp, Artificial
  CRISPR gRNA sequence
tgcatgccatctttatgaat

SEQ ID NO: 435559 - DNA, 20 bp, Artificial
  CRISPR gRNA sequence
ttatgaataagatttatctg

SEQ ID NO: 435560 - DNA, 20 bp, Artificial
  CRISPR gRNA sequence
tttatctgtggatcatatta

SEQ ID NO: 435561 - DNA, 20 bp, Artificial
  CRISPR gRNA sequence
ttatctgtggatcatattaa

SEQ ID NO: 435562 - DNA, 20 bp, Artificial
  CRISPR gRNA sequence
atctctgacttccctaatta

SEQ ID NO: 435563 - DNA, 20 bp, Artificial
  CRISPR gRNA sequence
gacttccctaattatagccc

SEQ ID NO: 435564 - DNA, 20 bp, Artificial
  CRISPR gRNA sequence
cttccctaattatagccctg

SEQ ID NO: 435565 - DNA, 20 bp, Artificial
  CRISPR gRNA sequence
ttccctaattatagccctgg

SEQ ID NO: 435566 - DNA, 20 bp, Artificial
  CRISPR gRNA sequence
ccctaattatagccctggag

SEQ ID NO: 435567 - DNA, 20 bp, Artificial
  CRISPR gRNA sequence
cctaattatagccctggagg

SEQ ID NO: 435568 - DNA, 20 bp, Artificial
  CRISPR gRNA sequence
ctaattatagccctggagga

SEQ ID NO: 435569 - DNA, 20 bp, Artificial
  CRISPR gRNA sequence
agccctggaggagggccact

SEQ ID NO: 435570 - DNA, 20 bp, Artificial
  CRISPR gRNA sequence
aggagggccactaagaccta

SEQ ID NO: 435571 - DNA, 20 bp, Artificial
  CRISPR gRNA sequence
cactaagacctaaagtttaa

SEQ ID NO: 435572 - DNA, 20 bp, Artificial
  CRISPR gRNA sequence
actaagacctaaagtttaac

SEQ ID NO: 435573 - DNA, 20 bp, Artificial
  CRISPR gRNA sequence
taaagtttaacaggccccat

SEQ ID NO: 435574 - DNA, 20 bp, Artificial
  CRISPR gRNA sequence
caggccccattggtgatgct

SEQ ID NO: 435575 - DNA, 20 bp, Artificial
  CRISPR gRNA sequence
tctctctgttttaaaactca

SEQ ID NO: 435576 - DNA, 20 bp, Artificial
  CRISPR gRNA sequence
ctctctgttttaaaactcat

SEQ ID NO: 435577 - DNA, 20 bp, Artificial
  CRISPR gRNA sequence
ttaaaactcatgggtgtgcc

SEQ ID NO: 435578 - DNA, 20 bp, Artificial
  CRISPR gRNA sequence
taaaactcatgggtgtgcct

SEQ ID NO: 435579 - DNA, 20 bp, Artificial
  CRISPR gRNA sequence
ctcatgggtgtgcctgggcg

SEQ ID NO: 435580 - DNA, 20 bp, Artificial
  CRISPR gRNA sequence
atgggtgtgcctgggcgtgg

SEQ ID NO: 435581 - DNA, 20 bp, Artificial
  CRISPR gRNA sequence
gtggctcacacctctaatcc

SEQ ID NO: 435582 - DNA, 20 bp, Artificial
  CRISPR gRNA sequence
cacctctaatcccagcactt

SEQ ID NO: 435583 - DNA, 20 bp, Artificial
  CRISPR gRNA sequence
acctctaatcccagcacttt

SEQ ID NO: 435584 - DNA, 20 bp, Artificial
  CRISPR gRNA sequence
ctctaatcccagcactttgg

SEQ ID NO: 435585 - DNA, 20 bp, Artificial
  CRISPR gRNA sequence
tctaatcccagcactttggg

SEQ ID NO: 435586 - DNA, 20 bp, Artificial
  CRISPR gRNA sequence
tcccagcactttgggaggct

SEQ ID NO: 435587 - DNA, 20 bp, Artificial
  CRISPR gRNA sequence
cccagcactttgggaggctg

SEQ ID NO: 435588 - DNA, 20 bp, Artificial
  CRISPR gRNA sequence
gcactttgggaggctgaggc

SEQ ID NO: 435589 - DNA, 20 bp, Artificial
  CRISPR gRNA sequence
ctttgggaggctgaggccgg

SEQ ID NO: 435590 - DNA, 20 bp, Artificial
  CRISPR gRNA sequence
ggctgaggccggtggatcat

SEQ ID NO: 435591 - DNA, 20 bp, Artificial
  CRISPR gRNA sequence
gctgaggccggtggatcatg

SEQ ID NO: 435592 - DNA, 20 bp, Artificial
  CRISPR gRNA sequence
aggccggtggatcatgaggt

SEQ ID NO: 435593 - DNA, 20 bp, Artificial
  CRISPR gRNA sequence
ggccggtggatcatgaggtc

SEQ ID NO: 435594 - DNA, 20 bp, Artificial
  CRISPR gRNA sequence
gatcatgaggtcaggaattc

SEQ ID NO: 435595 - DNA, 20 bp, Artificial
  CRISPR gRNA sequence
tgaggtcaggaattcgagac

SEQ ID NO: 435596 - DNA, 20 bp, Artificial
  CRISPR gRNA sequence
tcaggaattcgagaccagcc

SEQ ID NO: 435597 - DNA, 20 bp, Artificial
  CRISPR gRNA sequence
cgagaccagcctggccaaca

SEQ ID NO: 435598 - DNA, 20 bp, Artificial
  CRISPR gRNA sequence
ccactaaaaatacaaaaaat

SEQ ID NO: 435599 - DNA, 20 bp, Artificial
  CRISPR gRNA sequence
taaaaatacaaaaaattagc

SEQ ID NO: 435600 - DNA, 20 bp, Artificial
  CRISPR gRNA sequence
aaaaatacaaaaaattagcc

SEQ ID NO: 435601 - DNA, 20 bp, Artificial
  CRISPR gRNA sequence
tacaaaaaattagccaggca

SEQ ID NO: 435602 - DNA, 20 bp, Artificial
  CRISPR gRNA sequence
aaattagccaggcatggtta

SEQ ID NO: 435603 - DNA, 20 bp, Artificial
  CRISPR gRNA sequence
aattagccaggcatggttac

SEQ ID NO: 435604 - DNA, 20 bp, Artificial
  CRISPR gRNA sequence
ttagccaggcatggttacgg

SEQ ID NO: 435605 - DNA, 20 bp, Artificial
  CRISPR gRNA sequence
gttacgggagcctgtaattc

SEQ ID NO: 435606 - DNA, 20 bp, Artificial
  CRISPR gRNA sequence
agcctgtaattctagctact

SEQ ID NO: 435607 - DNA, 20 bp, Artificial
  CRISPR gRNA sequence
gcctgtaattctagctactt

SEQ ID NO: 435608 - DNA, 20 bp, Artificial
  CRISPR gRNA sequence
cctgtaattctagctacttg

SEQ ID NO: 435609 - DNA, 20 bp, Artificial
  CRISPR gRNA sequence
ctgtaattctagctacttgg

SEQ ID NO: 435610 - DNA, 20 bp, Artificial
  CRISPR gRNA sequence
tgtaattctagctacttggg

SEQ ID NO: 435611 - DNA, 20 bp, Artificial
  CRISPR gRNA sequence
tctagctacttggggggctg

SEQ ID NO: 435612 - DNA, 20 bp, Artificial
  CRISPR gRNA sequence
agctacttggggggctgaag

SEQ ID NO: 435613 - DNA, 20 bp, Artificial
  CRISPR gRNA sequence
gctacttggggggctgaagc

SEQ ID NO: 435614 - DNA, 20 bp, Artificial
  CRISPR gRNA sequence
tacttggggggctgaagcag

SEQ ID NO: 435615 - DNA, 20 bp, Artificial
  CRISPR gRNA sequence
gcaggagaatcacttgaacc

SEQ ID NO: 435616 - DNA, 20 bp, Artificial
  CRISPR gRNA sequence
caggagaatcacttgaacct

SEQ ID NO: 435617 - DNA, 20 bp, Artificial
  CRISPR gRNA sequence
ggagaatcacttgaacctgg

SEQ ID NO: 435618 - DNA, 20 bp, Artificial
  CRISPR gRNA sequence
aatcacttgaacctgggagt

SEQ ID NO: 435619 - DNA, 20 bp, Artificial
  CRISPR gRNA sequence
tcacttgaacctgggagtcg

SEQ ID NO: 435620 - DNA, 20 bp, Artificial
  CRISPR gRNA sequence
cacttgaacctgggagtcgg

SEQ ID NO: 435621 - DNA, 20 bp, Artificial
  CRISPR gRNA sequence
aacctgggagtcggaggttg

SEQ ID NO: 435622 - DNA, 20 bp, Artificial
  CRISPR gRNA sequence
tgggagtcggaggttgtggt

SEQ ID NO: 435623 - DNA, 20 bp, Artificial
  CRISPR gRNA sequence
gtcggaggttgtggtaagcc

SEQ ID NO: 435624 - DNA, 20 bp, Artificial
  CRISPR gRNA sequence
aagatctcgccattgtactc

SEQ ID NO: 435625 - DNA, 20 bp, Artificial
  CRISPR gRNA sequence
ctcgccattgtactccagcc

SEQ ID NO: 435626 - DNA, 20 bp, Artificial
  CRISPR gRNA sequence
tgtactccagcctggctgac

SEQ ID NO: 435627 - DNA, 20 bp, Artificial
  CRISPR gRNA sequence
gtactccagcctggctgaca

SEQ ID NO: 435628 - DNA, 20 bp, Artificial
  CRISPR gRNA sequence
tactccagcctggctgacaa

SEQ ID NO: 435629 - DNA, 20 bp, Artificial
  CRISPR gRNA sequence
ctctgtctcaaaaaaaaaaa

SEQ ID NO: 435630 - DNA, 20 bp, Artificial
  CRISPR gRNA sequence
tctcaaaaaaaaaaaaagaa

SEQ ID NO: 435631 - DNA, 20 bp, Artificial
  CRISPR gRNA sequence
aaaaaaaaaaaagaaaagaa

SEQ ID NO: 435632 - DNA, 20 bp, Artificial
  CRISPR gRNA sequence
aaaaaaagaaaagaaaagaa

SEQ ID NO: 435633 - DNA, 20 bp, Artificial
  CRISPR gRNA sequence
aaaagaaaagccaaaactca

SEQ ID NO: 435634 - DNA, 20 bp, Artificial
  CRISPR gRNA sequence
aaagaaaagccaaaactcat

SEQ ID NO: 435635 - DNA, 20 bp, Artificial
  CRISPR gRNA sequence
gaaaagccaaaactcatggg

SEQ ID NO: 435636 - DNA, 20 bp, Artificial
  CRISPR gRNA sequence
aaactcatgggtggaatgta

SEQ ID NO: 435637 - DNA, 20 bp, Artificial
  CRISPR gRNA sequence
tcatgggtggaatgtataga

SEQ ID NO: 435638 - DNA, 20 bp, Artificial
  CRISPR gRNA sequence
catgggtggaatgtatagat

SEQ ID NO: 435639 - DNA, 20 bp, Artificial
  CRISPR gRNA sequence
ggaatgtatagatgggatga

SEQ ID NO: 435640 - DNA, 20 bp, Artificial
  CRISPR gRNA sequence
gaatgtatagatgggatgaa

SEQ ID NO: 435641 - DNA, 20 bp, Artificial
  CRISPR gRNA sequence
tatagatgggatgaaaggcc

SEQ ID NO: 435642 - DNA, 20 bp, Artificial
  CRISPR gRNA sequence
atgggatgaaaggcctagat

SEQ ID NO: 435643 - DNA, 20 bp, Artificial
  CRISPR gRNA sequence
ggatgaaaggcctagatcag

SEQ ID NO: 435644 - DNA, 20 bp, Artificial
  CRISPR gRNA sequence
gaaaggcctagatcagtggt

SEQ ID NO: 435645 - DNA, 20 bp, Artificial
  CRISPR gRNA sequence
aaggcctagatcagtggtta

SEQ ID NO: 435646 - DNA, 20 bp, Artificial
  CRISPR gRNA sequence
ttagagaccctgactctcat

SEQ ID NO: 435647 - DNA, 20 bp, Artificial
  CRISPR gRNA sequence
tgactctcattagaatcaca

SEQ ID NO: 435648 - DNA, 20 bp, Artificial
  CRISPR gRNA sequence
actctcattagaatcacata

SEQ ID NO: 435649 - DNA, 20 bp, Artificial
  CRISPR gRNA sequence
tctcattagaatcacataga

SEQ ID NO: 435650 - DNA, 20 bp, Artificial
  CRISPR gRNA sequence
agagagtttttaaacaacta

SEQ ID NO: 435651 - DNA, 20 bp, Artificial
  CRISPR gRNA sequence
ttttaaacaactatagatgc

SEQ ID NO: 435652 - DNA, 20 bp, Artificial
  CRISPR gRNA sequence
tttaaacaactatagatgcc

SEQ ID NO: 435653 - DNA, 20 bp, Artificial
  CRISPR gRNA sequence
acaactatagatgccaggta

SEQ ID NO: 435654 - DNA, 20 bp, Artificial
  CRISPR gRNA sequence
actatagatgccaggtacag

SEQ ID NO: 435655 - DNA, 20 bp, Artificial
  CRISPR gRNA sequence
gcctataatcccaatacttt

SEQ ID NO: 435656 - DNA, 20 bp, Artificial
  CRISPR gRNA sequence
ctataatcccaatactttga

SEQ ID NO: 435657 - DNA, 20 bp, Artificial
  CRISPR gRNA sequence
tataatcccaatactttgag

SEQ ID NO: 435658 - DNA, 20 bp, Artificial
  CRISPR gRNA sequence
cccaatactttgagaggctg

SEQ ID NO: 435659 - DNA, 20 bp, Artificial
  CRISPR gRNA sequence
aatactttgagaggctgaag

SEQ ID NO: 435660 - DNA, 20 bp, Artificial
  CRISPR gRNA sequence
atactttgagaggctgaagc

SEQ ID NO: 435661 - DNA, 20 bp, Artificial
  CRISPR gRNA sequence
actttgagaggctgaagcag

SEQ ID NO: 435662 - DNA, 20 bp, Artificial
  CRISPR gRNA sequence
ctttgagaggctgaagcagg

SEQ ID NO: 435663 - DNA, 20 bp, Artificial
  CRISPR gRNA sequence
ctgaagcaggaggatcactt

SEQ ID NO: 435664 - DNA, 20 bp, Artificial
  CRISPR gRNA sequence
tgaagcaggaggatcacttg

SEQ ID NO: 435665 - DNA, 20 bp, Artificial
  CRISPR gRNA sequence
gcaggaggatcacttgaggt

SEQ ID NO: 435666 - DNA, 20 bp, Artificial
  CRISPR gRNA sequence
caggaggatcacttgaggtc

SEQ ID NO: 435667 - DNA, 20 bp, Artificial
  CRISPR gRNA sequence
ggaggatcacttgaggtcag

SEQ ID NO: 435668 - DNA, 20 bp, Artificial
  CRISPR gRNA sequence
tcacttgaggtcaggagttt

SEQ ID NO: 435669 - DNA, 20 bp, Artificial
  CRISPR gRNA sequence
tgaggtcaggagtttgagac

SEQ ID NO: 435670 - DNA, 20 bp, Artificial
  CRISPR gRNA sequence
tcaggagtttgagaccagcc

SEQ ID NO: 435671 - DNA, 20 bp, Artificial
  CRISPR gRNA sequence
ccagcctggctgatatactg

SEQ ID NO: 435672 - DNA, 20 bp, Artificial
  CRISPR gRNA sequence
ggctacccctatctcttaaa

SEQ ID NO: 435673 - DNA, 20 bp, Artificial
  CRISPR gRNA sequence
tacccctatctcttaaaaag

SEQ ID NO: 435674 - DNA, 20 bp, Artificial
  CRISPR gRNA sequence
ccctatctcttaaaaagcag

SEQ ID NO: 435675 - DNA, 20 bp, Artificial
  CRISPR gRNA sequence
aaaaccccactaccaaaaac

SEQ ID NO: 435676 - DNA, 20 bp, Artificial
  CRISPR gRNA sequence
aaccccactaccaaaaacca

SEQ ID NO: 435677 - DNA, 20 bp, Artificial
  CRISPR gRNA sequence
ctaccaaaaaccagagaaat

SEQ ID NO: 435678 - DNA, 20 bp, Artificial
  CRISPR gRNA sequence
accagagaaatcagcatctc

SEQ ID NO: 435679 - DNA, 20 bp, Artificial
  CRISPR gRNA sequence
cagagaaatcagcatctctg

SEQ ID NO: 435680 - DNA, 20 bp, Artificial
  CRISPR gRNA sequence
agagaaatcagcatctctgg

SEQ ID NO: 435681 - DNA, 20 bp, Artificial
  CRISPR gRNA sequence
gaaatcagcatctctggagg

SEQ ID NO: 435682 - DNA, 20 bp, Artificial
  CRISPR gRNA sequence
catctctggaggtagatgct

SEQ ID NO: 435683 - DNA, 20 bp, Artificial
  CRISPR gRNA sequence
tggaggtagatgctaagcat

SEQ ID NO: 435684 - DNA, 20 bp, Artificial
  CRISPR gRNA sequence
tgctaagcattagcttttta

SEQ ID NO: 435685 - DNA, 20 bp, Artificial
  CRISPR gRNA sequence
ctaagcattagctttttaca

SEQ ID NO: 435686 - DNA, 20 bp, Artificial
  CRISPR gRNA sequence
gctttttacagagtctacct

SEQ ID NO: 435687 - DNA, 20 bp, Artificial
  CRISPR gRNA sequence
ctttttacagagtctacctc

SEQ ID NO: 435688 - DNA, 20 bp, Artificial
  CRISPR gRNA sequence
tacctcaggtgattttaccc

SEQ ID NO: 435689 - DNA, 20 bp, Artificial
  CRISPR gRNA sequence
acctcaggtgattttacccc

SEQ ID NO: 435690 - DNA, 20 bp, Artificial
  CRISPR gRNA sequence
aggtgattttaccccaggtg

SEQ ID NO: 435691 - DNA, 20 bp, Artificial
  CRISPR gRNA sequence
gattttaccccaggtgcagc

SEQ ID NO: 435692 - DNA, 20 bp, Artificial
  CRISPR gRNA sequence
taccccaggtgcagccagca

SEQ ID NO: 435693 - DNA, 20 bp, Artificial
  CRISPR gRNA sequence
cagccagcatggtgaactgc

SEQ ID NO: 435694 - DNA, 20 bp, Artificial
  CRISPR gRNA sequence
agccagcatggtgaactgct

SEQ ID NO: 435695 - DNA, 20 bp, Artificial
  CRISPR gRNA sequence
gctgggttatgcatgtatgc

SEQ ID NO: 435696 - DNA, 20 bp, Artificial
  CRISPR gRNA sequence
ctgggttatgcatgtatgct

SEQ ID NO: 435697 - DNA, 20 bp, Artificial
  CRISPR gRNA sequence
gggttatgcatgtatgctgg

SEQ ID NO: 435698 - DNA, 20 bp, Artificial
  CRISPR gRNA sequence
ggttatgcatgtatgctggg

SEQ ID NO: 435699 - DNA, 20 bp, Artificial
  CRISPR gRNA sequence
catgtatgctgggaggtgaa

SEQ ID NO: 435700 - DNA, 20 bp, Artificial
  CRISPR gRNA sequence
gctgggaggtgaacagactt

SEQ ID NO: 435701 - DNA, 20 bp, Artificial
  CRISPR gRNA sequence
tataacatgtactttgtgcc

SEQ ID NO: 435702 - DNA, 20 bp, Artificial
  CRISPR gRNA sequence
acatgtactttgtgcccaga

SEQ ID NO: 435703 - DNA, 20 bp, Artificial
  CRISPR gRNA sequence
atgtactttgtgcccagata

SEQ ID NO: 435704 - DNA, 20 bp, Artificial
  CRISPR gRNA sequence
ctttgtgcccagatagagct

SEQ ID NO: 435705 - DNA, 20 bp, Artificial
  CRISPR gRNA sequence
catctaactctgcctcttac

SEQ ID NO: 435706 - DNA, 20 bp, Artificial
  CRISPR gRNA sequence
cttactagctatataatcct

SEQ ID NO: 435707 - DNA, 20 bp, Artificial
  CRISPR gRNA sequence
ctagctatataatcctgagc

SEQ ID NO: 435708 - DNA, 20 bp, Artificial
  CRISPR gRNA sequence
gcaagttattgaaacgctgt

SEQ ID NO: 435709 - DNA, 20 bp, Artificial
  CRISPR gRNA sequence
tgacaataataccgatcatg

SEQ ID NO: 435710 - DNA, 20 bp, Artificial
  CRISPR gRNA sequence
gacaataataccgatcatgt

SEQ ID NO: 435711 - DNA, 20 bp, Artificial
  CRISPR gRNA sequence
ataccgatcatgtgggccat

SEQ ID NO: 435712 - DNA, 20 bp, Artificial
  CRISPR gRNA sequence
ccgatcatgtgggccattag

SEQ ID NO: 435713 - DNA, 20 bp, Artificial
  CRISPR gRNA sequence
cgatcatgtgggccattaga

SEQ ID NO: 435714 - DNA, 20 bp, Artificial
  CRISPR gRNA sequence
atgtgataatattttattaa

SEQ ID NO: 435715 - DNA, 20 bp, Artificial
  CRISPR gRNA sequence
tattttattaaaagccttta

SEQ ID NO: 435716 - DNA, 20 bp, Artificial
  CRISPR gRNA sequence
attttattaaaagcctttat

SEQ ID NO: 435717 - DNA, 20 bp, Artificial
  CRISPR gRNA sequence
tattaaaagcctttataggt

SEQ ID NO: 435718 - DNA, 20 bp, Artificial
  CRISPR gRNA sequence
attaaaagcctttataggtt

SEQ ID NO: 435719 - DNA, 20 bp, Artificial
  CRISPR gRNA sequence
ctctaaaatccaaaactttt

SEQ ID NO: 435720 - DNA, 20 bp, Artificial
  CRISPR gRNA sequence
ggacactgacatgacattca

SEQ ID NO: 435721 - DNA, 20 bp, Artificial
  CRISPR gRNA sequence
gacactgacatgacattcaa

SEQ ID NO: 435722 - DNA, 20 bp, Artificial
  CRISPR gRNA sequence
tgacatgacattcaaaggaa

SEQ ID NO: 435723 - DNA, 20 bp, Artificial
  CRISPR gRNA sequence
cattcaaaggaaaagctcat

SEQ ID NO: 435724 - DNA, 20 bp, Artificial
  CRISPR gRNA sequence
ggaaaagctcattggaacat

SEQ ID NO: 435725 - DNA, 20 bp, Artificial
  CRISPR gRNA sequence
agctcattggaacataagta

SEQ ID NO: 435726 - DNA, 20 bp, Artificial
  CRISPR gRNA sequence
gctcattggaacataagtat

SEQ ID NO: 435727 - DNA, 20 bp, Artificial
  CRISPR gRNA sequence
cattggaacataagtatagg

SEQ ID NO: 435728 - DNA, 20 bp, Artificial
  CRISPR gRNA sequence
aaaataaaaaaataaaaaca

SEQ ID NO: 435729 - DNA, 20 bp, Artificial
  CRISPR gRNA sequence
taaaaaaataaaaacatggc

SEQ ID NO: 435730 - DNA, 20 bp, Artificial
  CRISPR gRNA sequence
aaaaaaataaaaacatggct

SEQ ID NO: 435731 - DNA, 20 bp, Artificial
  CRISPR gRNA sequence
aataaaaacatggctgggcg

SEQ ID NO: 435732 - DNA, 20 bp, Artificial
  CRISPR gRNA sequence
aaaaacatggctgggcgtgg

SEQ ID NO: 435733 - DNA, 20 bp, Artificial
  CRISPR gRNA sequence
gtggctcatgcctataatcc

SEQ ID NO: 435734 - DNA, 20 bp, Artificial
  CRISPR gRNA sequence
tgcctataatcccagcactt

SEQ ID NO: 435735 - DNA, 20 bp, Artificial
  CRISPR gRNA sequence
gcctataatcccagcacttt

SEQ ID NO: 435736 - DNA, 20 bp, Artificial
  CRISPR gRNA sequence
ctataatcccagcactttgg

SEQ ID NO: 435737 - DNA, 20 bp, Artificial
  CRISPR gRNA sequence
tataatcccagcactttggg

SEQ ID NO: 435738 - DNA, 20 bp, Artificial
  CRISPR gRNA sequence
tcccagcactttgggaggct

SEQ ID NO: 435739 - DNA, 20 bp, Artificial
  CRISPR gRNA sequence
cccagcactttgggaggctg

SEQ ID NO: 435740 - DNA, 20 bp, Artificial
  CRISPR gRNA sequence
agcactttgggaggctgagg

SEQ ID NO: 435741 - DNA, 20 bp, Artificial
  CRISPR gRNA sequence
gcactttgggaggctgaggt

SEQ ID NO: 435742 - DNA, 20 bp, Artificial
  CRISPR gRNA sequence
ctttgggaggctgaggtggg

SEQ ID NO: 435743 - DNA, 20 bp, Artificial
  CRISPR gRNA sequence
ctgaggtgggtggatcacct

SEQ ID NO: 435744 - DNA, 20 bp, Artificial
  CRISPR gRNA sequence
tgaggtgggtggatcacctg

SEQ ID NO: 435745 - DNA, 20 bp, Artificial
  CRISPR gRNA sequence
gtgggtggatcacctgaggt

SEQ ID NO: 435746 - DNA, 20 bp, Artificial
  CRISPR gRNA sequence
tgggtggatcacctgaggtc

SEQ ID NO: 435747 - DNA, 20 bp, Artificial
  CRISPR gRNA sequence
ggtggatcacctgaggtcgg

SEQ ID NO: 435748 - DNA, 20 bp, Artificial
  CRISPR gRNA sequence
tcacctgaggtcgggagttc

SEQ ID NO: 435749 - DNA, 20 bp, Artificial
  CRISPR gRNA sequence
tgaggtcgggagttcgagac

SEQ ID NO: 435750 - DNA, 20 bp, Artificial
  CRISPR gRNA sequence
cgagaccagtctgaccaaca

SEQ ID NO: 435751 - DNA, 20 bp, Artificial
  CRISPR gRNA sequence
agaccagtctgaccaacatg

SEQ ID NO: 435752 - DNA, 20 bp, Artificial
  CRISPR gRNA sequence
ctctactaaaaatacaaaat

SEQ ID NO: 435753 - DNA, 20 bp, Artificial
  CRISPR gRNA sequence
actaaaaatacaaaattagc

SEQ ID NO: 435754 - DNA, 20 bp, Artificial
  CRISPR gRNA sequence
ctaaaaatacaaaattagcc

SEQ ID NO: 435755 - DNA, 20 bp, Artificial
  CRISPR gRNA sequence
aatacaaaattagccaggtg

SEQ ID NO: 435756 - DNA, 20 bp, Artificial
  CRISPR gRNA sequence
ggtgtggttgcacatgcctg

SEQ ID NO: 435757 - DNA, 20 bp, Artificial
  CRISPR gRNA sequence
gttgcacatgcctgtagtcc

SEQ ID NO: 435758 - DNA, 20 bp, Artificial
  CRISPR gRNA sequence
tgcctgtagtcccagctact

SEQ ID NO: 435759 - DNA, 20 bp, Artificial
  CRISPR gRNA sequence
gcctgtagtcccagctactc

SEQ ID NO: 435760 - DNA, 20 bp, Artificial
  CRISPR gRNA sequence
ctgtagtcccagctactcag

SEQ ID NO: 435761 - DNA, 20 bp, Artificial
  CRISPR gRNA sequence
tcccagctactcaggagtct

SEQ ID NO: 435762 - DNA, 20 bp, Artificial
  CRISPR gRNA sequence
cccagctactcaggagtctg

SEQ ID NO: 435763 - DNA, 20 bp, Artificial
  CRISPR gRNA sequence
agctactcaggagtctgagg

SEQ ID NO: 435764 - DNA, 20 bp, Artificial
  CRISPR gRNA sequence
gctactcaggagtctgaggc

SEQ ID NO: 435765 - DNA, 20 bp, Artificial
  CRISPR gRNA sequence
tactcaggagtctgaggcag

SEQ ID NO: 435766 - DNA, 20 bp, Artificial
  CRISPR gRNA sequence
gcaggagaattgcttgaacc

SEQ ID NO: 435767 - DNA, 20 bp, Artificial
  CRISPR gRNA sequence
caggagaattgcttgaaccc

SEQ ID NO: 435768 - DNA, 20 bp, Artificial
  CRISPR gRNA sequence
ggagaattgcttgaacccag

SEQ ID NO: 435769 - DNA, 20 bp, Artificial
  CRISPR gRNA sequence
gagaattgcttgaacccagg

SEQ ID NO: 435770 - DNA, 20 bp, Artificial
  CRISPR gRNA sequence
aattgcttgaacccaggagg

SEQ ID NO: 435771 - DNA, 20 bp, Artificial
  CRISPR gRNA sequence
ttgcttgaacccaggaggcg

SEQ ID NO: 435772 - DNA, 20 bp, Artificial
  CRISPR gRNA sequence
tgcttgaacccaggaggcgg

SEQ ID NO: 435773 - DNA, 20 bp, Artificial
  CRISPR gRNA sequence
aacccaggaggcggaggttg

SEQ ID NO: 435774 - DNA, 20 bp, Artificial
  CRISPR gRNA sequence
caggaggcggaggttgcagt

SEQ ID NO: 435775 - DNA, 20 bp, Artificial
  CRISPR gRNA sequence
ggcggaggttgcagtgagcc

SEQ ID NO: 435776 - DNA, 20 bp, Artificial
  CRISPR gRNA sequence
gagattatgccattgcactc

SEQ ID NO: 435777 - DNA, 20 bp, Artificial
  CRISPR gRNA sequence
tatgccattgcactccagcc

SEQ ID NO: 435778 - DNA, 20 bp, Artificial
  CRISPR gRNA sequence
atgccattgcactccagcct

SEQ ID NO: 435779 - DNA, 20 bp, Artificial
  CRISPR gRNA sequence
tgcactccagcctgggcaac

SEQ ID NO: 435780 - DNA, 20 bp, Artificial
  CRISPR gRNA sequence
cactccagcctgggcaacaa

SEQ ID NO: 435781 - DNA, 20 bp, Artificial
  CRISPR gRNA sequence
tctaaaacatttctgatctc

SEQ ID NO: 435782 - DNA, 20 bp, Artificial
  CRISPR gRNA sequence
atttctgatctcaagcattt

SEQ ID NO: 435783 - DNA, 20 bp, Artificial
  CRISPR gRNA sequence
tgatctcaagcatttcagat

SEQ ID NO: 435784 - DNA, 20 bp, Artificial
  CRISPR gRNA sequence
gatctcaagcatttcagata

SEQ ID NO: 435785 - DNA, 20 bp, Artificial
  CRISPR gRNA sequence
tctcaagcatttcagataag

SEQ ID NO: 435786 - DNA, 20 bp, Artificial
  CRISPR gRNA sequence
gagtcttcaacctgtaatta

SEQ ID NO: 435787 - DNA, 20 bp, Artificial
  CRISPR gRNA sequence
tgtaattatggccatttgtg

SEQ ID NO: 435788 - DNA, 20 bp, Artificial
  CRISPR gRNA sequence
atggccatttgtgtggctgt

SEQ ID NO: 435789 - DNA, 20 bp, Artificial
  CRISPR gRNA sequence
ttagttccgctattaataat

SEQ ID NO: 435790 - DNA, 20 bp, Artificial
  CRISPR gRNA sequence
ttacctttgtcaaacatttg

SEQ ID NO: 435791 - DNA, 20 bp, Artificial
  CRISPR gRNA sequence
tgtgtgatacactctcaacg

SEQ ID NO: 435792 - DNA, 20 bp, Artificial
  CRISPR gRNA sequence
gtgtgatacactctcaacgt

SEQ ID NO: 435793 - DNA, 20 bp, Artificial
  CRISPR gRNA sequence
acactctcaacgtaggtatc

SEQ ID NO: 435794 - DNA, 20 bp, Artificial
  CRISPR gRNA sequence
cactctcaacgtaggtatcc

SEQ ID NO: 435795 - DNA, 20 bp, Artificial
  CRISPR gRNA sequence
tctcaacgtaggtatccagg

SEQ ID NO: 435796 - DNA, 20 bp, Artificial
  CRISPR gRNA sequence
ctcaacgtaggtatccaggc

SEQ ID NO: 435797 - DNA, 20 bp, Artificial
  CRISPR gRNA sequence
cgtaggtatccaggcaggtt

SEQ ID NO: 435798 - DNA, 20 bp, Artificial
  CRISPR gRNA sequence
aggtatccaggcaggtttgg

SEQ ID NO: 435799 - DNA, 20 bp, Artificial
  CRISPR gRNA sequence
tccaggcaggtttggaagct

SEQ ID NO: 435800 - DNA, 20 bp, Artificial
  CRISPR gRNA sequence
ccaggcaggtttggaagctg

SEQ ID NO: 435801 - DNA, 20 bp, Artificial
  CRISPR gRNA sequence
caggcaggtttggaagctga

SEQ ID NO: 435802 - DNA, 20 bp, Artificial
  CRISPR gRNA sequence
cccctttgattccctgaaat

SEQ ID NO: 435803 - DNA, 20 bp, Artificial
  CRISPR gRNA sequence
tgaaataagctttctgctct

SEQ ID NO: 435804 - DNA, 20 bp, Artificial
  CRISPR gRNA sequence
ccttatgttgtttctgacat

SEQ ID NO: 435805 - DNA, 20 bp, Artificial
  CRISPR gRNA sequence
tgttgtttctgacattagcc

SEQ ID NO: 435806 - DNA, 20 bp, Artificial
  CRISPR gRNA sequence
gttgtttctgacattagcca

SEQ ID NO: 435807 - DNA, 20 bp, Artificial
  CRISPR gRNA sequence
aggtcacccctgcaccgact

SEQ ID NO: 435808 - DNA, 20 bp, Artificial
  CRISPR gRNA sequence
tcacccctgcaccgactcgg

SEQ ID NO: 435809 - DNA, 20 bp, Artificial
  CRISPR gRNA sequence
acccctgcaccgactcggca

SEQ ID NO: 435810 - DNA, 20 bp, Artificial
  CRISPR gRNA sequence
ccctgcaccgactcggcaga

SEQ ID NO: 435811 - DNA, 20 bp, Artificial
  CRISPR gRNA sequence
tcggcagagagacttcactg

SEQ ID NO: 435812 - DNA, 20 bp, Artificial
  CRISPR gRNA sequence
gacttcactgcagcctttcc

SEQ ID NO: 435813 - DNA, 20 bp, Artificial
  CRISPR gRNA sequence
acttcactgcagcctttcca

SEQ ID NO: 435814 - DNA, 20 bp, Artificial
  CRISPR gRNA sequence
tttccaaggatgcttaccac

SEQ ID NO: 435815 - DNA, 20 bp, Artificial
  CRISPR gRNA sequence
ttccaaggatgcttaccacc

SEQ ID NO: 435816 - DNA, 20 bp, Artificial
  CRISPR gRNA sequence
tccaaggatgcttaccacca

SEQ ID NO: 435817 - DNA, 20 bp, Artificial
  CRISPR gRNA sequence
ccaaggatgcttaccaccag

SEQ ID NO: 435818 - DNA, 20 bp, Artificial
  CRISPR gRNA sequence
atgcttaccaccaggggaca

SEQ ID NO: 435819 - DNA, 20 bp, Artificial
  CRISPR gRNA sequence
taccaccaggggacatggcc

SEQ ID NO: 435820 - DNA, 20 bp, Artificial
  CRISPR gRNA sequence
accaccaggggacatggccc

SEQ ID NO: 435821 - DNA, 20 bp, Artificial
  CRISPR gRNA sequence
atggcccaggtaactatgca

SEQ ID NO: 435822 - DNA, 20 bp, Artificial
  CRISPR gRNA sequence
tggcccaggtaactatgcat

SEQ ID NO: 435823 - DNA, 20 bp, Artificial
  CRISPR gRNA sequence
ggcccaggtaactatgcatg

SEQ ID NO: 435824 - DNA, 20 bp, Artificial
  CRISPR gRNA sequence
ccaggtaactatgcatgggg

SEQ ID NO: 435825 - DNA, 20 bp, Artificial
  CRISPR gRNA sequence
aggtaactatgcatggggca

SEQ ID NO: 435826 - DNA, 20 bp, Artificial
  CRISPR gRNA sequence
ggtaactatgcatggggcag

SEQ ID NO: 435827 - DNA, 20 bp, Artificial
  CRISPR gRNA sequence
taactatgcatggggcagag

SEQ ID NO: 435828 - DNA, 20 bp, Artificial
  CRISPR gRNA sequence
aactatgcatggggcagagg

SEQ ID NO: 435829 - DNA, 20 bp, Artificial
  CRISPR gRNA sequence
actatgcatggggcagagga

SEQ ID NO: 435830 - DNA, 20 bp, Artificial
  CRISPR gRNA sequence
ggggcagaggagggaatctt

SEQ ID NO: 435831 - DNA, 20 bp, Artificial
  CRISPR gRNA sequence
cagaggagggaatctttagc

SEQ ID NO: 435832 - DNA, 20 bp, Artificial
  CRISPR gRNA sequence
tctttagctggctctgaatt

SEQ ID NO: 435833 - DNA, 20 bp, Artificial
  CRISPR gRNA sequence
tttagctggctctgaattca

SEQ ID NO: 435834 - DNA, 20 bp, Artificial
  CRISPR gRNA sequence
ttagctggctctgaattcag

SEQ ID NO: 435835 - DNA, 20 bp, Artificial
  CRISPR gRNA sequence
aattcagaggattttgaatg

SEQ ID NO: 435836 - DNA, 20 bp, Artificial
  CRISPR gRNA sequence
attcagaggattttgaatgt

SEQ ID NO: 435837 - DNA, 20 bp, Artificial
  CRISPR gRNA sequence
gattttgaatgtgggaaaaa

SEQ ID NO: 435838 - DNA, 20 bp, Artificial
  CRISPR gRNA sequence
tgaatgtgggaaaaaaagat

SEQ ID NO: 435839 - DNA, 20 bp, Artificial
  CRISPR gRNA sequence
gggaaaaaaagatgagaaaa

SEQ ID NO: 435840 - DNA, 20 bp, Artificial
  CRISPR gRNA sequence
aaaagatgagaaaacagtgt

SEQ ID NO: 435841 - DNA, 20 bp, Artificial
  CRISPR gRNA sequence
aagatgagaaaacagtgtga

SEQ ID NO: 435842 - DNA, 20 bp, Artificial
  CRISPR gRNA sequence
atgagaaaacagtgtgagag

SEQ ID NO: 435843 - DNA, 20 bp, Artificial
  CRISPR gRNA sequence
gagaaaacagtgtgagagtg

SEQ ID NO: 435844 - DNA, 20 bp, Artificial
  CRISPR gRNA sequence
agaaaacagtgtgagagtgg

SEQ ID NO: 435845 - DNA, 20 bp, Artificial
  CRISPR gRNA sequence
acagtgtgagagtggaggca

SEQ ID NO: 435846 - DNA, 20 bp, Artificial
  CRISPR gRNA sequence
atatctccgtgcacctgaaa

SEQ ID NO: 435847 - DNA, 20 bp, Artificial
  CRISPR gRNA sequence
cacctgaaatagtgtttgaa

SEQ ID NO: 435848 - DNA, 20 bp, Artificial
  CRISPR gRNA sequence
cctgaaatagtgtttgaaaa

SEQ ID NO: 435849 - DNA, 20 bp, Artificial
  CRISPR gRNA sequence
ctgaaatagtgtttgaaaag

SEQ ID NO: 435850 - DNA, 20 bp, Artificial
  CRISPR gRNA sequence
tgaaatagtgtttgaaaaga

SEQ ID NO: 435851 - DNA, 20 bp, Artificial
  CRISPR gRNA sequence
aatagtgtttgaaaagaggg

SEQ ID NO: 435852 - DNA, 20 bp, Artificial
  CRISPR gRNA sequence
agtgtttgaaaagagggaag

SEQ ID NO: 435853 - DNA, 20 bp, Artificial
  CRISPR gRNA sequence
gtttgaaaagagggaagtgg

SEQ ID NO: 435854 - DNA, 20 bp, Artificial
  CRISPR gRNA sequence
ttgaaaagagggaagtggtg

SEQ ID NO: 435855 - DNA, 20 bp, Artificial
  CRISPR gRNA sequence
tggtggagacacacctgtgc

SEQ ID NO: 435856 - DNA, 20 bp, Artificial
  CRISPR gRNA sequence
ggtggagacacacctgtgct

SEQ ID NO: 435857 - DNA, 20 bp, Artificial
  CRISPR gRNA sequence
gacacacctgtgctgggaaa

SEQ ID NO: 435858 - DNA, 20 bp, Artificial
  CRISPR gRNA sequence
cacctgtgctgggaaaaaga

SEQ ID NO: 435859 - DNA, 20 bp, Artificial
  CRISPR gRNA sequence
gtgctgggaaaaagatggtc

SEQ ID NO: 435860 - DNA, 20 bp, Artificial
  CRISPR gRNA sequence
gggaaaaagatggtctggct

SEQ ID NO: 435861 - DNA, 20 bp, Artificial
  CRISPR gRNA sequence
ggaaaaagatggtctggctt

SEQ ID NO: 435862 - DNA, 20 bp, Artificial
  CRISPR gRNA sequence
tattttacttaaattttaac

SEQ ID NO: 435863 - DNA, 20 bp, Artificial
  CRISPR gRNA sequence
cttaaattttaactggaaaa

SEQ ID NO: 435864 - DNA, 20 bp, Artificial
  CRISPR gRNA sequence
aaaaaagttaataaacttta

SEQ ID NO: 435865 - DNA, 20 bp, Artificial
  CRISPR gRNA sequence
ccacattttctgactgaccc

SEQ ID NO: 435866 - DNA, 20 bp, Artificial
  CRISPR gRNA sequence
ttttctgactgaccctggac

SEQ ID NO: 435867 - DNA, 20 bp, Artificial
  CRISPR gRNA sequence
gaccctggactggtgatgtt

SEQ ID NO: 435868 - DNA, 20 bp, Artificial
  CRISPR gRNA sequence
ggtgatgtttggtcatgaac

SEQ ID NO: 435869 - DNA, 20 bp, Artificial
  CRISPR gRNA sequence
gtttggtcatgaactggtgt

SEQ ID NO: 435870 - DNA, 20 bp, Artificial
  CRISPR gRNA sequence
aactggtgtcagtctgtgtt

SEQ ID NO: 435871 - DNA, 20 bp, Artificial
  CRISPR gRNA sequence
actggtgtcagtctgtgttt

SEQ ID NO: 435872 - DNA, 20 bp, Artificial
  CRISPR gRNA sequence
gtgtttgggaactgacacat

SEQ ID NO: 435873 - DNA, 20 bp, Artificial
  CRISPR gRNA sequence
tgggaactgacacattggat

SEQ ID NO: 435874 - DNA, 20 bp, Artificial
  CRISPR gRNA sequence
gggaactgacacattggatt

SEQ ID NO: 435875 - DNA, 20 bp, Artificial
  CRISPR gRNA sequence
acattggattaggtgatttc

SEQ ID NO: 435876 - DNA, 20 bp, Artificial
  CRISPR gRNA sequence
cattggattaggtgatttct

SEQ ID NO: 435877 - DNA, 20 bp, Artificial
  CRISPR gRNA sequence
gtgatttctaggatgccttc

SEQ ID NO: 435878 - DNA, 20 bp, Artificial
  CRISPR gRNA sequence
tttctaggatgccttctagc

SEQ ID NO: 435879 - DNA, 20 bp, Artificial
  CRISPR gRNA sequence
gatgccttctagctagaata

SEQ ID NO: 435880 - DNA, 20 bp, Artificial
  CRISPR gRNA sequence
ataaagcccatcaccttccc

SEQ ID NO: 435881 - DNA, 20 bp, Artificial
  CRISPR gRNA sequence
ccatcaccttccctggattc

SEQ ID NO: 435882 - DNA, 20 bp, Artificial
  CRISPR gRNA sequence
ccttccctggattccagcca

SEQ ID NO: 435883 - DNA, 20 bp, Artificial
  CRISPR gRNA sequence
ccctggattccagccacaga

SEQ ID NO: 435884 - DNA, 20 bp, Artificial
  CRISPR gRNA sequence
gattccagccacagaaagaa

SEQ ID NO: 435885 - DNA, 20 bp, Artificial
  CRISPR gRNA sequence
gttaaattcttcatgtaatt

SEQ ID NO: 435886 - DNA, 20 bp, Artificial
  CRISPR gRNA sequence
aattcttcatgtaattcagc

SEQ ID NO: 435887 - DNA, 20 bp, Artificial
  CRISPR gRNA sequence
attcttcatgtaattcagca

SEQ ID NO: 435888 - DNA, 20 bp, Artificial
  CRISPR gRNA sequence
taattcagcaaggacgtact

SEQ ID NO: 435889 - DNA, 20 bp, Artificial
  CRISPR gRNA sequence
aattcagcaaggacgtactc

SEQ ID NO: 435890 - DNA, 20 bp, Artificial
  CRISPR gRNA sequence
attcagcaaggacgtactca

SEQ ID NO: 435891 - DNA, 20 bp, Artificial
  CRISPR gRNA sequence
aggacgtactcagggtgctc

SEQ ID NO: 435892 - DNA, 20 bp, Artificial
  CRISPR gRNA sequence
acgtactcagggtgctccag

SEQ ID NO: 435893 - DNA, 20 bp, Artificial
  CRISPR gRNA sequence
gtactcagggtgctccagaa

SEQ ID NO: 435894 - DNA, 20 bp, Artificial
  CRISPR gRNA sequence
ggtgctccagaagagaacac

SEQ ID NO: 435895 - DNA, 20 bp, Artificial
  CRISPR gRNA sequence
gtgctccagaagagaacact

SEQ ID NO: 435896 - DNA, 20 bp, Artificial
  CRISPR gRNA sequence
agaagagaacactgggcata

SEQ ID NO: 435897 - DNA, 20 bp, Artificial
  CRISPR gRNA sequence
agagaacactgggcataaag

SEQ ID NO: 435898 - DNA, 20 bp, Artificial
  CRISPR gRNA sequence
gaacactgggcataaagcag

SEQ ID NO: 435899 - DNA, 20 bp, Artificial
  CRISPR gRNA sequence
ctgggcataaagcagaagtc

SEQ ID NO: 435900 - DNA, 20 bp, Artificial
  CRISPR gRNA sequence
gtcaagtcacattgatcatg

SEQ ID NO: 435901 - DNA, 20 bp, Artificial
  CRISPR gRNA sequence
tcaagtcacattgatcatga

SEQ ID NO: 435902 - DNA, 20 bp, Artificial
  CRISPR gRNA sequence
tgatcatgaaggttaatttt

SEQ ID NO: 435903 - DNA, 20 bp, Artificial
  CRISPR gRNA sequence
gatcatgaaggttaatttta

SEQ ID NO: 435904 - DNA, 20 bp, Artificial
  CRISPR gRNA sequence
aattttaaggtatttcttgt

SEQ ID NO: 435905 - DNA, 20 bp, Artificial
  CRISPR gRNA sequence
ggtatttcttgtcagtgtcc

SEQ ID NO: 435906 - DNA, 20 bp, Artificial
  CRISPR gRNA sequence
ctggtctcttctaaactctc

SEQ ID NO: 435907 - DNA, 20 bp, Artificial
  CRISPR gRNA sequence
ggtctcttctaaactctctg

SEQ ID NO: 435908 - DNA, 20 bp, Artificial
  CRISPR gRNA sequence
ttttttttcttctgtaaaat

SEQ ID NO: 435909 - DNA, 20 bp, Artificial
  CRISPR gRNA sequence
tttttttcttctgtaaaatg

SEQ ID NO: 435910 - DNA, 20 bp, Artificial
  CRISPR gRNA sequence
cttctgtaaaatgaggttaa

SEQ ID NO: 435911 - DNA, 20 bp, Artificial
  CRISPR gRNA sequence
ttctgtaaaatgaggttaat

SEQ ID NO: 435912 - DNA, 20 bp, Artificial
  CRISPR gRNA sequence
gtaaaatgaggttaataggt

SEQ ID NO: 435913 - DNA, 20 bp, Artificial
  CRISPR gRNA sequence
atctcataaatcacacctta

SEQ ID NO: 435914 - DNA, 20 bp, Artificial
  CRISPR gRNA sequence
tctcataaatcacaccttat

SEQ ID NO: 435915 - DNA, 20 bp, Artificial
  CRISPR gRNA sequence
acaccttatgggctttaaat

SEQ ID NO: 435916 - DNA, 20 bp, Artificial
  CRISPR gRNA sequence
tgaccacaatttgtacatgt

SEQ ID NO: 435917 - DNA, 20 bp, Artificial
  CRISPR gRNA sequence
gctgttgtcgttaatattat

SEQ ID NO: 435918 - DNA, 20 bp, Artificial
  CRISPR gRNA sequence
tgtcgttaatattataagat

SEQ ID NO: 435919 - DNA, 20 bp, Artificial
  CRISPR gRNA sequence
gtcgttaatattataagatc

SEQ ID NO: 435920 - DNA, 20 bp, Artificial
  CRISPR gRNA sequence
cgttaatattataagatcag

SEQ ID NO: 435921 - DNA, 20 bp, Artificial
  CRISPR gRNA sequence
gttaatattataagatcagg

SEQ ID NO: 435922 - DNA, 20 bp, Artificial
  CRISPR gRNA sequence
tattataagatcaggaggca

SEQ ID NO: 435923 - DNA, 20 bp, Artificial
  CRISPR gRNA sequence
ataagatcaggaggcacagt

SEQ ID NO: 435924 - DNA, 20 bp, Artificial
  CRISPR gRNA sequence
caggaggcacagtgagattg

SEQ ID NO: 435925 - DNA, 20 bp, Artificial
  CRISPR gRNA sequence
gcacagtgagattgtggtta

SEQ ID NO: 435926 - DNA, 20 bp, Artificial
  CRISPR gRNA sequence
agattgtggttaaagtactt

SEQ ID NO: 435927 - DNA, 20 bp, Artificial
  CRISPR gRNA sequence
tggttaaagtacttcagtga

SEQ ID NO: 435928 - DNA, 20 bp, Artificial
  CRISPR gRNA sequence
ggttaaagtacttcagtgac

SEQ ID NO: 435929 - DNA, 20 bp, Artificial
  CRISPR gRNA sequence
taaagtacttcagtgacagg

SEQ ID NO: 435930 - DNA, 20 bp, Artificial
  CRISPR gRNA sequence
tacttcagtgacaggtggaa

SEQ ID NO: 435931 - DNA, 20 bp, Artificial
  CRISPR gRNA sequence
acttcagtgacaggtggaat

SEQ ID NO: 435932 - DNA, 20 bp, Artificial
  CRISPR gRNA sequence
ggtggaatgggttctaattt

SEQ ID NO: 435933 - DNA, 20 bp, Artificial
  CRISPR gRNA sequence
ctaatttcagctgttcttga

SEQ ID NO: 435934 - DNA, 20 bp, Artificial
  CRISPR gRNA sequence
tcttgatagctctgtgacct

SEQ ID NO: 435935 - DNA, 20 bp, Artificial
  CRISPR gRNA sequence
atagctctgtgacctcagtc

SEQ ID NO: 435936 - DNA, 20 bp, Artificial
  CRISPR gRNA sequence
caagttgctcaaattctctg

SEQ ID NO: 435937 - DNA, 20 bp, Artificial
  CRISPR gRNA sequence
tgctcaaattctctgaagct

SEQ ID NO: 435938 - DNA, 20 bp, Artificial
  CRISPR gRNA sequence
agtttgctcatctctacaat

SEQ ID NO: 435939 - DNA, 20 bp, Artificial
  CRISPR gRNA sequence
gtttgctcatctctacaatg

SEQ ID NO: 435940 - DNA, 20 bp, Artificial
  CRISPR gRNA sequence
ctctacaatgaggataattc

SEQ ID NO: 435941 - DNA, 20 bp, Artificial
  CRISPR gRNA sequence
aattccagtgcccatgtcat

SEQ ID NO: 435942 - DNA, 20 bp, Artificial
  CRISPR gRNA sequence
attccagtgcccatgtcatg

SEQ ID NO: 435943 - DNA, 20 bp, Artificial
  CRISPR gRNA sequence
ccagtgcccatgtcatgagg

SEQ ID NO: 435944 - DNA, 20 bp, Artificial
  CRISPR gRNA sequence
gataatgtatgtaaaatgct

SEQ ID NO: 435945 - DNA, 20 bp, Artificial
  CRISPR gRNA sequence
tgtatgtaaaatgctcagca

SEQ ID NO: 435946 - DNA, 20 bp, Artificial
  CRISPR gRNA sequence
aaaatgctcagcatagtacc

SEQ ID NO: 435947 - DNA, 20 bp, Artificial
  CRISPR gRNA sequence
catagtacctggcccataaa

SEQ ID NO: 435948 - DNA, 20 bp, Artificial
  CRISPR gRNA sequence
tcaactgtttattattacta

SEQ ID NO: 435949 - DNA, 20 bp, Artificial
  CRISPR gRNA sequence
tttattattactatagttac

SEQ ID NO: 435950 - DNA, 20 bp, Artificial
  CRISPR gRNA sequence
attactatagttactggttt

SEQ ID NO: 435951 - DNA, 20 bp, Artificial
  CRISPR gRNA sequence
ttactggttttagctctcca

SEQ ID NO: 435952 - DNA, 20 bp, Artificial
  CRISPR gRNA sequence
gttttagctctccaaagttt

SEQ ID NO: 435953 - DNA, 20 bp, Artificial
  CRISPR gRNA sequence
ctctccaaagtttcagtctt

SEQ ID NO: 435954 - DNA, 20 bp, Artificial
  CRISPR gRNA sequence
ccaaagtttcagtctttggt

SEQ ID NO: 435955 - DNA, 20 bp, Artificial
  CRISPR gRNA sequence
ttcagtctttggttagtctt

SEQ ID NO: 435956 - DNA, 20 bp, Artificial
  CRISPR gRNA sequence
tttggttagtctttagtgat

SEQ ID NO: 435957 - DNA, 20 bp, Artificial
  CRISPR gRNA sequence
ggttagtctttagtgattgg

SEQ ID NO: 435958 - DNA, 20 bp, Artificial
  CRISPR gRNA sequence
gccaacatcttttatgcaat

SEQ ID NO: 435959 - DNA, 20 bp, Artificial
  CRISPR gRNA sequence
caacatcttttatgcaatta

SEQ ID NO: 435960 - DNA, 20 bp, Artificial
  CRISPR gRNA sequence
acatcttttatgcaattaga

SEQ ID NO: 435961 - DNA, 20 bp, Artificial
  CRISPR gRNA sequence
catcttttatgcaattagag

SEQ ID NO: 435962 - DNA, 20 bp, Artificial
  CRISPR gRNA sequence
attagagaggaaactaaata

SEQ ID NO: 435963 - DNA, 20 bp, Artificial
  CRISPR gRNA sequence
agagaggaaactaaatatgg

SEQ ID NO: 435964 - DNA, 20 bp, Artificial
  CRISPR gRNA sequence
gagaggaaactaaatatggt

SEQ ID NO: 435965 - DNA, 20 bp, Artificial
  CRISPR gRNA sequence
agaggaaactaaatatggtg

SEQ ID NO: 435966 - DNA, 20 bp, Artificial
  CRISPR gRNA sequence
gaaactaaatatggtgggga

SEQ ID NO: 435967 - DNA, 20 bp, Artificial
  CRISPR gRNA sequence
ggtggggacagaaaataata

SEQ ID NO: 435968 - DNA, 20 bp, Artificial
  CRISPR gRNA sequence
agaaaataataaagttatac

SEQ ID NO: 435969 - DNA, 20 bp, Artificial
  CRISPR gRNA sequence
tatgccattgttatatttta

SEQ ID NO: 435970 - DNA, 20 bp, Artificial
  CRISPR gRNA sequence
tttaaagaatcttacaacca

SEQ ID NO: 435971 - DNA, 20 bp, Artificial
  CRISPR gRNA sequence
gaatcttacaaccatagtgc

SEQ ID NO: 435972 - DNA, 20 bp, Artificial
  CRISPR gRNA sequence
tcttacaaccatagtgctag

SEQ ID NO: 435973 - DNA, 20 bp, Artificial
  CRISPR gRNA sequence
cttacaaccatagtgctaga

SEQ ID NO: 435974 - DNA, 20 bp, Artificial
  CRISPR gRNA sequence
ttacaaccatagtgctagaa

SEQ ID NO: 435975 - DNA, 20 bp, Artificial
  CRISPR gRNA sequence
atagtgctagaagggacttc

SEQ ID NO: 435976 - DNA, 20 bp, Artificial
  CRISPR gRNA sequence
tagtgctagaagggacttca

SEQ ID NO: 435977 - DNA, 20 bp, Artificial
  CRISPR gRNA sequence
agtgctagaagggacttcaa

SEQ ID NO: 435978 - DNA, 20 bp, Artificial
  CRISPR gRNA sequence
aagggacttcaagggtcatt

SEQ ID NO: 435979 - DNA, 20 bp, Artificial
  CRISPR gRNA sequence
cactttcccatcctgtgctt

SEQ ID NO: 435980 - DNA, 20 bp, Artificial
  CRISPR gRNA sequence
ttttttttttttttttaatt

SEQ ID NO: 435981 - DNA, 20 bp, Artificial
  CRISPR gRNA sequence
ttttttttttttaattgaga

SEQ ID NO: 435982 - DNA, 20 bp, Artificial
  CRISPR gRNA sequence
ttttttttttaattgagacg

SEQ ID NO: 435983 - DNA, 20 bp, Artificial
  CRISPR gRNA sequence
cggagtcttgctctgtcacc

SEQ ID NO: 435984 - DNA, 20 bp, Artificial
  CRISPR gRNA sequence
tcttgctctgtcacccagac

SEQ ID NO: 435985 - DNA, 20 bp, Artificial
  CRISPR gRNA sequence
ttgctctgtcacccagacta

SEQ ID NO: 435986 - DNA, 20 bp, Artificial
  CRISPR gRNA sequence
ctgtcacccagactagagtg

SEQ ID NO: 435987 - DNA, 20 bp, Artificial
  CRISPR gRNA sequence
tcacccagactagagtgcag

SEQ ID NO: 435988 - DNA, 20 bp, Artificial
  CRISPR gRNA sequence
agagtgcagtggcgcaatct

SEQ ID NO: 435989 - DNA, 20 bp, Artificial
  CRISPR gRNA sequence
gcgcaatctcggctcactgc

SEQ ID NO: 435990 - DNA, 20 bp, Artificial
  CRISPR gRNA sequence
tcactgcaagttccgcctcc

SEQ ID NO: 435991 - DNA, 20 bp, Artificial
  CRISPR gRNA sequence
cactgcaagttccgcctcct

SEQ ID NO: 435992 - DNA, 20 bp, Artificial
  CRISPR gRNA sequence
ttcacgccattctcctgcct

SEQ ID NO: 435993 - DNA, 20 bp, Artificial
  CRISPR gRNA sequence
ttctcctgcctcagcctccc

SEQ ID NO: 435994 - DNA, 20 bp, Artificial
  CRISPR gRNA sequence
tcctgcctcagcctcccaag

SEQ ID NO: 435995 - DNA, 20 bp, Artificial
  CRISPR gRNA sequence
gcctcagcctcccaagtagc

SEQ ID NO: 435996 - DNA, 20 bp, Artificial
  CRISPR gRNA sequence
cctcagcctcccaagtagct

SEQ ID NO: 435997 - DNA, 20 bp, Artificial
  CRISPR gRNA sequence
ctcccaagtagctgggacta

SEQ ID NO: 435998 - DNA, 20 bp, Artificial
  CRISPR gRNA sequence
tcccaagtagctgggactac

SEQ ID NO: 435999 - DNA, 20 bp, Artificial
  CRISPR gRNA sequence
gactacaggcgcccaccatc

SEQ ID NO: 436000 - DNA, 20 bp, Artificial
  CRISPR gRNA sequence
caggcgcccaccatcaagcc

SEQ ID NO: 436001 - DNA, 20 bp, Artificial
  CRISPR gRNA sequence
ttttttcttttttgtatttt

SEQ ID NO: 436002 - DNA, 20 bp, Artificial
  CRISPR gRNA sequence
tttcttttttgtatttttag

SEQ ID NO: 436003 - DNA, 20 bp, Artificial
  CRISPR gRNA sequence
tcttttttgtatttttagta

SEQ ID NO: 436004 - DNA, 20 bp, Artificial
  CRISPR gRNA sequence
ttttgtatttttagtagaga

SEQ ID NO: 436005 - DNA, 20 bp, Artificial
  CRISPR gRNA sequence
ttgtatttttagtagagaca

SEQ ID NO: 436006 - DNA, 20 bp, Artificial
  CRISPR gRNA sequence
gagacagagtttcaccgtgt

SEQ ID NO: 436007 - DNA, 20 bp, Artificial
  CRISPR gRNA sequence
cagagtttcaccgtgttagc

SEQ ID NO: 436008 - DNA, 20 bp, Artificial
  CRISPR gRNA sequence
agagtttcaccgtgttagcc

SEQ ID NO: 436009 - DNA, 20 bp, Artificial
  CRISPR gRNA sequence
tttcaccgtgttagccagga

SEQ ID NO: 436010 - DNA, 20 bp, Artificial
  CRISPR gRNA sequence
accttgtgatcctcccgcct

SEQ ID NO: 436011 - DNA, 20 bp, Artificial
  CRISPR gRNA sequence
cctcccgcctcggcctccca

SEQ ID NO: 436012 - DNA, 20 bp, Artificial
  CRISPR gRNA sequence
gcctcggcctcccaaagtgc

SEQ ID NO: 436013 - DNA, 20 bp, Artificial
  CRISPR gRNA sequence
cctcggcctcccaaagtgct

SEQ ID NO: 436014 - DNA, 20 bp, Artificial
  CRISPR gRNA sequence
agtgctgggattacacgcgt

SEQ ID NO: 436015 - DNA, 20 bp, Artificial
  CRISPR gRNA sequence
cacgcgtgagccaccgcgcc

SEQ ID NO: 436016 - DNA, 20 bp, Artificial
  CRISPR gRNA sequence
cgtgagccaccgcgcccggc

SEQ ID NO: 436017 - DNA, 20 bp, Artificial
  CRISPR gRNA sequence
tttactacatcaccactgaa

SEQ ID NO: 436018 - DNA, 20 bp, Artificial
  CRISPR gRNA sequence
ttactacatcaccactgaat

SEQ ID NO: 436019 - DNA, 20 bp, Artificial
  CRISPR gRNA sequence
cactgaatgggcatttgctg

SEQ ID NO: 436020 - DNA, 20 bp, Artificial
  CRISPR gRNA sequence
gaatgggcatttgctgtaga

SEQ ID NO: 436021 - DNA, 20 bp, Artificial
  CRISPR gRNA sequence
atgggcatttgctgtagacg

SEQ ID NO: 436022 - DNA, 20 bp, Artificial
  CRISPR gRNA sequence
gacggagttcactccctgtc

SEQ ID NO: 436023 - DNA, 20 bp, Artificial
  CRISPR gRNA sequence
acggagttcactccctgtcg

SEQ ID NO: 436024 - DNA, 20 bp, Artificial
  CRISPR gRNA sequence
gagttcactccctgtcgagg

SEQ ID NO: 436025 - DNA, 20 bp, Artificial
  CRISPR gRNA sequence
ccttatacttgtctctacca

SEQ ID NO: 436026 - DNA, 20 bp, Artificial
  CRISPR gRNA sequence
atacttgtctctaccacaga

SEQ ID NO: 436027 - DNA, 20 bp, Artificial
  CRISPR gRNA sequence
cttgtctctaccacagacag

SEQ ID NO: 436028 - DNA, 20 bp, Artificial
  CRISPR gRNA sequence
gacagaagtcttctttcctt

SEQ ID NO: 436029 - DNA, 20 bp, Artificial
  CRISPR gRNA sequence
tttccttttttttttttttt

SEQ ID NO: 436030 - DNA, 20 bp, Artificial
  CRISPR gRNA sequence
ctttttttttttttttgaga

SEQ ID NO: 436031 - DNA, 20 bp, Artificial
  CRISPR gRNA sequence
ttttttttttttttgagacg

SEQ ID NO: 436032 - DNA, 20 bp, Artificial
  CRISPR gRNA sequence
cggagtctcactctctcacc

SEQ ID NO: 436033 - DNA, 20 bp, Artificial
  CRISPR gRNA sequence
ggagtctcactctctcaccc

SEQ ID NO: 436034 - DNA, 20 bp, Artificial
  CRISPR gRNA sequence
tctcactctctcacccaggc

SEQ ID NO: 436035 - DNA, 20 bp, Artificial
  CRISPR gRNA sequence
tcactctctcacccaggctg

SEQ ID NO: 436036 - DNA, 20 bp, Artificial
  CRISPR gRNA sequence
ggagtgcaatgacacgatct

SEQ ID NO: 436037 - DNA, 20 bp, Artificial
  CRISPR gRNA sequence
tcactgcaaactctgcctcc

SEQ ID NO: 436038 - DNA, 20 bp, Artificial
  CRISPR gRNA sequence
cactgcaaactctgcctccc

SEQ ID NO: 436039 - DNA, 20 bp, Artificial
  CRISPR gRNA sequence
ttcatgccattctcctgcct

SEQ ID NO: 436040 - DNA, 20 bp, Artificial
  CRISPR gRNA sequence
ttctcctgcctcagcctccc

SEQ ID NO: 436041 - DNA, 20 bp, Artificial
  CRISPR gRNA sequence
tcctgcctcagcctcccaag

SEQ ID NO: 436042 - DNA, 20 bp, Artificial
  CRISPR gRNA sequence
gcctcagcctcccaagtagc

SEQ ID NO: 436043 - DNA, 20 bp, Artificial
  CRISPR gRNA sequence
cctcagcctcccaagtagct

SEQ ID NO: 436044 - DNA, 20 bp, Artificial
  CRISPR gRNA sequence
ctcccaagtagctgggatta

SEQ ID NO: 436045 - DNA, 20 bp, Artificial
  CRISPR gRNA sequence
gctaatttttgtatttttat

SEQ ID NO: 436046 - DNA, 20 bp, Artificial
  CRISPR gRNA sequence
taatttttgtatttttatta

SEQ ID NO: 436047 - DNA, 20 bp, Artificial
  CRISPR gRNA sequence
ttttgtatttttattagaga

SEQ ID NO: 436048 - DNA, 20 bp, Artificial
  CRISPR gRNA sequence
tttgtatttttattagagac

SEQ ID NO: 436049 - DNA, 20 bp, Artificial
  CRISPR gRNA sequence
ttgtatttttattagagacg

SEQ ID NO: 436050 - DNA, 20 bp, Artificial
  CRISPR gRNA sequence
ttagagacggggtttcacca

SEQ ID NO: 436051 - DNA, 20 bp, Artificial
  CRISPR gRNA sequence
gagacggggtttcaccatgg

SEQ ID NO: 436052 - DNA, 20 bp, Artificial
  CRISPR gRNA sequence
tttcaccatggtggccatgc

SEQ ID NO: 436053 - DNA, 20 bp, Artificial
  CRISPR gRNA sequence
tggtctcgaactcctaacct

SEQ ID NO: 436054 - DNA, 20 bp, Artificial
  CRISPR gRNA sequence
ggtctcgaactcctaacctc

SEQ ID NO: 436055 - DNA, 20 bp, Artificial
  CRISPR gRNA sequence
ctcaggtgatccctctgcct

SEQ ID NO: 436056 - DNA, 20 bp, Artificial
  CRISPR gRNA sequence
ccctctgcctcggcctccca

SEQ ID NO: 436057 - DNA, 20 bp, Artificial
  CRISPR gRNA sequence
gcctcggcctcccaaagcgc

SEQ ID NO: 436058 - DNA, 20 bp, Artificial
  CRISPR gRNA sequence
cctcggcctcccaaagcgct

SEQ ID NO: 436059 - DNA, 20 bp, Artificial
  CRISPR gRNA sequence
ctcccaaagcgctgggatta

SEQ ID NO: 436060 - DNA, 20 bp, Artificial
  CRISPR gRNA sequence
tcccaaagcgctgggattac

SEQ ID NO: 436061 - DNA, 20 bp, Artificial
  CRISPR gRNA sequence
agcgctgggattacaggtgt

SEQ ID NO: 436062 - DNA, 20 bp, Artificial
  CRISPR gRNA sequence
caggtgtaagccaccacgcc

SEQ ID NO: 436063 - DNA, 20 bp, Artificial
  CRISPR gRNA sequence
accacgcccagccttccctt

SEQ ID NO: 436064 - DNA, 20 bp, Artificial
  CRISPR gRNA sequence
tccctttagtttttgtttgt

SEQ ID NO: 436065 - DNA, 20 bp, Artificial
  CRISPR gRNA sequence
gtttgttagttccttccctc

SEQ ID NO: 436066 - DNA, 20 bp, Artificial
  CRISPR gRNA sequence
tttgttagttccttccctct

SEQ ID NO: 436067 - DNA, 20 bp, Artificial
  CRISPR gRNA sequence
ttgttagttccttccctcta

SEQ ID NO: 436068 - DNA, 20 bp, Artificial
  CRISPR gRNA sequence
tccctctagggcaacaaaaa

SEQ ID NO: 436069 - DNA, 20 bp, Artificial
  CRISPR gRNA sequence
ccctctagggcaacaaaaat

SEQ ID NO: 436070 - DNA, 20 bp, Artificial
  CRISPR gRNA sequence
gggcaacaaaaatgggaata

SEQ ID NO: 436071 - DNA, 20 bp, Artificial
  CRISPR gRNA sequence
ggcaacaaaaatgggaatat

SEQ ID NO: 436072 - DNA, 20 bp, Artificial
  CRISPR gRNA sequence
gaataatacctcgaacctct

SEQ ID NO: 436073 - DNA, 20 bp, Artificial
  CRISPR gRNA sequence
ctcgaacctctgagcttctc

SEQ ID NO: 436074 - DNA, 20 bp, Artificial
  CRISPR gRNA sequence
tcgaacctctgagcttctca

SEQ ID NO: 436075 - DNA, 20 bp, Artificial
  CRISPR gRNA sequence
cgaacctctgagcttctcaa

SEQ ID NO: 436076 - DNA, 20 bp, Artificial
  CRISPR gRNA sequence
agcttctcaagggcctgact

SEQ ID NO: 436077 - DNA, 20 bp, Artificial
  CRISPR gRNA sequence
aatattgaaacaaccaaaaa

SEQ ID NO: 436078 - DNA, 20 bp, Artificial
  CRISPR gRNA sequence
atattgaaacaaccaaaaat

SEQ ID NO: 436079 - DNA, 20 bp, Artificial
  CRISPR gRNA sequence
tgaaacaaccaaaaataggt

SEQ ID NO: 436080 - DNA, 20 bp, Artificial
  CRISPR gRNA sequence
aacaaccaaaaataggtcag

SEQ ID NO: 436081 - DNA, 20 bp, Artificial
  CRISPR gRNA sequence
ataggtcagtagctcctaaa

SEQ ID NO: 436082 - DNA, 20 bp, Artificial
  CRISPR gRNA sequence
taggtcagtagctcctaaat

SEQ ID NO: 436083 - DNA, 20 bp, Artificial
  CRISPR gRNA sequence
tgaaatgaatgaatatttaa

SEQ ID NO: 436084 - DNA, 20 bp, Artificial
  CRISPR gRNA sequence
atatgtaacattatgtaaat

SEQ ID NO: 436085 - DNA, 20 bp, Artificial
  CRISPR gRNA sequence
acattatgtaaattggctgc

SEQ ID NO: 436086 - DNA, 20 bp, Artificial
  CRISPR gRNA sequence
tggcaaaccaactctaaatg

SEQ ID NO: 436087 - DNA, 20 bp, Artificial
  CRISPR gRNA sequence
ggcaaaccaactctaaatgt

SEQ ID NO: 436088 - DNA, 20 bp, Artificial
  CRISPR gRNA sequence
ccaactctaaatgtgggatg

SEQ ID NO: 436089 - DNA, 20 bp, Artificial
  CRISPR gRNA sequence
caactctaaatgtgggatgt

SEQ ID NO: 436090 - DNA, 20 bp, Artificial
  CRISPR gRNA sequence
actctaaatgtgggatgtgg

SEQ ID NO: 436091 - DNA, 20 bp, Artificial
  CRISPR gRNA sequence
gggagcatttaatataaaaa

SEQ ID NO: 436092 - DNA, 20 bp, Artificial
  CRISPR gRNA sequence
ggagcatttaatataaaaat

SEQ ID NO: 436093 - DNA, 20 bp, Artificial
  CRISPR gRNA sequence
gagcatttaatataaaaatg

SEQ ID NO: 436094 - DNA, 20 bp, Artificial
  CRISPR gRNA sequence
atttaatataaaaatggggc

SEQ ID NO: 436095 - DNA, 20 bp, Artificial
  CRISPR gRNA sequence
tttaatataaaaatggggct

SEQ ID NO: 436096 - DNA, 20 bp, Artificial
  CRISPR gRNA sequence
tataaaaatggggctgggca

SEQ ID NO: 436097 - DNA, 20 bp, Artificial
  CRISPR gRNA sequence
aaaaatggggctgggcacag

SEQ ID NO: 436098 - DNA, 20 bp, Artificial
  CRISPR gRNA sequence
gtggctcacatgtgtaatcc

SEQ ID NO: 436099 - DNA, 20 bp, Artificial
  CRISPR gRNA sequence
catgtgtaatcccagcacta

SEQ ID NO: 436100 - DNA, 20 bp, Artificial
  CRISPR gRNA sequence
atgtgtaatcccagcactat

SEQ ID NO: 436101 - DNA, 20 bp, Artificial
  CRISPR gRNA sequence
gtgtaatcccagcactatgg

SEQ ID NO: 436102 - DNA, 20 bp, Artificial
  CRISPR gRNA sequence
tgtaatcccagcactatggg

SEQ ID NO: 436103 - DNA, 20 bp, Artificial
  CRISPR gRNA sequence
tcccagcactatgggaggcc

SEQ ID NO: 436104 - DNA, 20 bp, Artificial
  CRISPR gRNA sequence
cccagcactatgggaggcca

SEQ ID NO: 436105 - DNA, 20 bp, Artificial
  CRISPR gRNA sequence
agcactatgggaggccaagg

SEQ ID NO: 436106 - DNA, 20 bp, Artificial
  CRISPR gRNA sequence
gcactatgggaggccaaggc

SEQ ID NO: 436107 - DNA, 20 bp, Artificial
  CRISPR gRNA sequence
ctatgggaggccaaggcagg

SEQ ID NO: 436108 - DNA, 20 bp, Artificial
  CRISPR gRNA sequence
ggccaaggcaggcagatcac

SEQ ID NO: 436109 - DNA, 20 bp, Artificial
  CRISPR gRNA sequence
ccaaggcaggcagatcactg

SEQ ID NO: 436110 - DNA, 20 bp, Artificial
  CRISPR gRNA sequence
gcaggcagatcactggagct

SEQ ID NO: 436111 - DNA, 20 bp, Artificial
  CRISPR gRNA sequence
caggcagatcactggagctc

SEQ ID NO: 436112 - DNA, 20 bp, Artificial
  CRISPR gRNA sequence
ggcagatcactggagctcag

SEQ ID NO: 436113 - DNA, 20 bp, Artificial
  CRISPR gRNA sequence
tcactggagctcaggagttc

SEQ ID NO: 436114 - DNA, 20 bp, Artificial
  CRISPR gRNA sequence
ggagctcaggagttcaagac

SEQ ID NO: 436115 - DNA, 20 bp, Artificial
  CRISPR gRNA sequence
tcaggagttcaagaccagcc

SEQ ID NO: 436116 - DNA, 20 bp, Artificial
  CRISPR gRNA sequence
caggagttcaagaccagcct

SEQ ID NO: 436117 - DNA, 20 bp, Artificial
  CRISPR gRNA sequence
caagaccagcctgggcaaca

SEQ ID NO: 436118 - DNA, 20 bp, Artificial
  CRISPR gRNA sequence
ggcaaaaccccatctctact

SEQ ID NO: 436119 - DNA, 20 bp, Artificial
  CRISPR gRNA sequence
ctactaagaatacaaaaaat

SEQ ID NO: 436120 - DNA, 20 bp, Artificial
  CRISPR gRNA sequence
tactaagaatacaaaaaatt

SEQ ID NO: 436121 - DNA, 20 bp, Artificial
  CRISPR gRNA sequence
agaatacaaaaaattaggct

SEQ ID NO: 436122 - DNA, 20 bp, Artificial
  CRISPR gRNA sequence
acaaaaaattaggctgagtg

SEQ ID NO: 436123 - DNA, 20 bp, Artificial
  CRISPR gRNA sequence
aaaaattaggctgagtgcag

SEQ ID NO: 436124 - DNA, 20 bp, Artificial
  CRISPR gRNA sequence
gtggctcacacctgtaatcc

SEQ ID NO: 436125 - DNA, 20 bp, Artificial
  CRISPR gRNA sequence
cacctgtaatcccagcactt

SEQ ID NO: 436126 - DNA, 20 bp, Artificial
  CRISPR gRNA sequence
acctgtaatcccagcacttt

SEQ ID NO: 436127 - DNA, 20 bp, Artificial
  CRISPR gRNA sequence
ctgtaatcccagcactttgg

SEQ ID NO: 436128 - DNA, 20 bp, Artificial
  CRISPR gRNA sequence
tgtaatcccagcactttggg

SEQ ID NO: 436129 - DNA, 20 bp, Artificial
  CRISPR gRNA sequence
tcccagcactttgggaggcc

SEQ ID NO: 436130 - DNA, 20 bp, Artificial
  CRISPR gRNA sequence
cccagcactttgggaggcca

SEQ ID NO: 436131 - DNA, 20 bp, Artificial
  CRISPR gRNA sequence
agcactttgggaggccaagg

SEQ ID NO: 436132 - DNA, 20 bp, Artificial
  CRISPR gRNA sequence
ctttgggaggccaaggcaga

SEQ ID NO: 436133 - DNA, 20 bp, Artificial
  CRISPR gRNA sequence
ccaaggcagatggatcacct

SEQ ID NO: 436134 - DNA, 20 bp, Artificial
  CRISPR gRNA sequence
caaggcagatggatcacctg

SEQ ID NO: 436135 - DNA, 20 bp, Artificial
  CRISPR gRNA sequence
gcagatggatcacctgaggt

SEQ ID NO: 436136 - DNA, 20 bp, Artificial
  CRISPR gRNA sequence
cagatggatcacctgaggtc

SEQ ID NO: 436137 - DNA, 20 bp, Artificial
  CRISPR gRNA sequence
gatggatcacctgaggtcag

SEQ ID NO: 436138 - DNA, 20 bp, Artificial
  CRISPR gRNA sequence
tcacctgaggtcaggagttt

SEQ ID NO: 436139 - DNA, 20 bp, Artificial
  CRISPR gRNA sequence
ctgaggtcaggagtttaagc

SEQ ID NO: 436140 - DNA, 20 bp, Artificial
  CRISPR gRNA sequence
gtcaggagtttaagccagcc

SEQ ID NO: 436141 - DNA, 20 bp, Artificial
  CRISPR gRNA sequence
gagtttaagccagcctggcc

SEQ ID NO: 436142 - DNA, 20 bp, Artificial
  CRISPR gRNA sequence
ttaagccagcctggccaaga

SEQ ID NO: 436143 - DNA, 20 bp, Artificial
  CRISPR gRNA sequence
tctactaaaaatacaaaaat

SEQ ID NO: 436144 - DNA, 20 bp, Artificial
  CRISPR gRNA sequence
ctaaaaatacaaaaattagc

SEQ ID NO: 436145 - DNA, 20 bp, Artificial
  CRISPR gRNA sequence
atacaaaaattagctggtca

SEQ ID NO: 436146 - DNA, 20 bp, Artificial
  CRISPR gRNA sequence
caaaaattagctggtcatgg

SEQ ID NO: 436147 - DNA, 20 bp, Artificial
  CRISPR gRNA sequence
gtggtgcatgcctataattc

SEQ ID NO: 436148 - DNA, 20 bp, Artificial
  CRISPR gRNA sequence
tgcctataattccagctact

SEQ ID NO: 436149 - DNA, 20 bp, Artificial
  CRISPR gRNA sequence
gcctataattccagctactc

SEQ ID NO: 436150 - DNA, 20 bp, Artificial
  CRISPR gRNA sequence
ctataattccagctactcag

SEQ ID NO: 436151 - DNA, 20 bp, Artificial
  CRISPR gRNA sequence
tataattccagctactcagg

SEQ ID NO: 436152 - DNA, 20 bp, Artificial
  CRISPR gRNA sequence
ttccagctactcaggaggct

SEQ ID NO: 436153 - DNA, 20 bp, Artificial
  CRISPR gRNA sequence
tccagctactcaggaggctg

SEQ ID NO: 436154 - DNA, 20 bp, Artificial
  CRISPR gRNA sequence
agctactcaggaggctgagg

SEQ ID NO: 436155 - DNA, 20 bp, Artificial
  CRISPR gRNA sequence
gctactcaggaggctgaggc

SEQ ID NO: 436156 - DNA, 20 bp, Artificial
  CRISPR gRNA sequence
tactcaggaggctgaggcag

SEQ ID NO: 436157 - DNA, 20 bp, Artificial
  CRISPR gRNA sequence
ctgaggcaggagaattgtct

SEQ ID NO: 436158 - DNA, 20 bp, Artificial
  CRISPR gRNA sequence
gcaggagaattgtctgagcc

SEQ ID NO: 436159 - DNA, 20 bp, Artificial
  CRISPR gRNA sequence
caggagaattgtctgagcct

SEQ ID NO: 436160 - DNA, 20 bp, Artificial
  CRISPR gRNA sequence
ggagaattgtctgagcctgg

SEQ ID NO: 436161 - DNA, 20 bp, Artificial
  CRISPR gRNA sequence
gagaattgtctgagcctggg

SEQ ID NO: 436162 - DNA, 20 bp, Artificial
  CRISPR gRNA sequence
gaattgtctgagcctgggag

SEQ ID NO: 436163 - DNA, 20 bp, Artificial
  CRISPR gRNA sequence
gagcctgggaggagtgaacc

SEQ ID NO: 436164 - DNA, 20 bp, Artificial
  CRISPR gRNA sequence
gagatctcaccactgtcctg

SEQ ID NO: 436165 - DNA, 20 bp, Artificial
  CRISPR gRNA sequence
ctcaccactgtcctgaagcc

SEQ ID NO: 436166 - DNA, 20 bp, Artificial
  CRISPR gRNA sequence
ctgtcctgaagcctggaaaa

SEQ ID NO: 436167 - DNA, 20 bp, Artificial
  CRISPR gRNA sequence
gtcctgaagcctggaaaaca

SEQ ID NO: 436168 - DNA, 20 bp, Artificial
  CRISPR gRNA sequence
tgaagcctggaaaacagagc

SEQ ID NO: 436169 - DNA, 20 bp, Artificial
  CRISPR gRNA sequence
aaaaaaaaaaaaaaaaaaaa

SEQ ID NO: 436170 - DNA, 20 bp, Artificial
  CRISPR gRNA sequence
aaaaaaaaaaaaaaaatagc

SEQ ID NO: 436171 - DNA, 20 bp, Artificial
  CRISPR gRNA sequence
aaaaaaaaaaaaaaatagcc

SEQ ID NO: 436172 - DNA, 20 bp, Artificial
  CRISPR gRNA sequence
aaaaaaaaaatagccgggca

SEQ ID NO: 436173 - DNA, 20 bp, Artificial
  CRISPR gRNA sequence
aaaaaaatagccgggcatgg

SEQ ID NO: 436174 - DNA, 20 bp, Artificial
  CRISPR gRNA sequence
ggcatggtggcatgtgcctg

SEQ ID NO: 436175 - DNA, 20 bp, Artificial
  CRISPR gRNA sequence
gtggcatgtgcctgtagtcc

SEQ ID NO: 436176 - DNA, 20 bp, Artificial
  CRISPR gRNA sequence
tgcctgtagtcccagctact

SEQ ID NO: 436177 - DNA, 20 bp, Artificial
  CRISPR gRNA sequence
ctgtagtcccagctacttgg

SEQ ID NO: 436178 - DNA, 20 bp, Artificial
  CRISPR gRNA sequence
tgtagtcccagctacttggc

SEQ ID NO: 436179 - DNA, 20 bp, Artificial
  CRISPR gRNA sequence
gtagtcccagctacttggca

SEQ ID NO: 436180 - DNA, 20 bp, Artificial
  CRISPR gRNA sequence
cccagctacttggcagggct

SEQ ID NO: 436181 - DNA, 20 bp, Artificial
  CRISPR gRNA sequence
ccagctacttggcagggctg

SEQ ID NO: 436182 - DNA, 20 bp, Artificial
  CRISPR gRNA sequence
gctacttggcagggctgagg

SEQ ID NO: 436183 - DNA, 20 bp, Artificial
  CRISPR gRNA sequence
ctacttggcagggctgaggc

SEQ ID NO: 436184 - DNA, 20 bp, Artificial
  CRISPR gRNA sequence
cttggcagggctgaggcagg

SEQ ID NO: 436185 - DNA, 20 bp, Artificial
  CRISPR gRNA sequence
gcaggaagattgcttgaact

SEQ ID NO: 436186 - DNA, 20 bp, Artificial
  CRISPR gRNA sequence
caggaagattgcttgaactc

SEQ ID NO: 436187 - DNA, 20 bp, Artificial
  CRISPR gRNA sequence
ggaagattgcttgaactcag

SEQ ID NO: 436188 - DNA, 20 bp, Artificial
  CRISPR gRNA sequence
gaagattgcttgaactcagg

SEQ ID NO: 436189 - DNA, 20 bp, Artificial
  CRISPR gRNA sequence
ttgcttgaactcaggaggtt

SEQ ID NO: 436190 - DNA, 20 bp, Artificial
  CRISPR gRNA sequence
tgcttgaactcaggaggttg

SEQ ID NO: 436191 - DNA, 20 bp, Artificial
  CRISPR gRNA sequence
caggaggttgaggattcact

SEQ ID NO: 436192 - DNA, 20 bp, Artificial
  CRISPR gRNA sequence
ggttgaggattcactgagcc

SEQ ID NO: 436193 - DNA, 20 bp, Artificial
  CRISPR gRNA sequence
gaggattcactgagccgagt

SEQ ID NO: 436194 - DNA, 20 bp, Artificial
  CRISPR gRNA sequence
gtgccactgtactccaaacc

SEQ ID NO: 436195 - DNA, 20 bp, Artificial
  CRISPR gRNA sequence
tgccactgtactccaaacct

SEQ ID NO: 436196 - DNA, 20 bp, Artificial
  CRISPR gRNA sequence
tgtactccaaacctgggcaa

SEQ ID NO: 436197 - DNA, 20 bp, Artificial
  CRISPR gRNA sequence
tactccaaacctgggcaaca

SEQ ID NO: 436198 - DNA, 20 bp, Artificial
  CRISPR gRNA sequence
ccaaacctgggcaacagagc

SEQ ID NO: 436199 - DNA, 20 bp, Artificial
  CRISPR gRNA sequence
aacagagcgagaccctttct

SEQ ID NO: 436200 - DNA, 20 bp, Artificial
  CRISPR gRNA sequence
agaaaaaaaaaaaaaaaaaa

SEQ ID NO: 436201 - DNA, 20 bp, Artificial
  CRISPR gRNA sequence
aaaaaaaaaaaaaaaaaatg

SEQ ID NO: 436202 - DNA, 20 bp, Artificial
  CRISPR gRNA sequence
aaaaaaaaaaaaaaatggag

SEQ ID NO: 436203 - DNA, 20 bp, Artificial
  CRISPR gRNA sequence
aaaaaaaaaaaaatggagta

SEQ ID NO: 436204 - DNA, 20 bp, Artificial
  CRISPR gRNA sequence
aaatggagtagagcctttaa

SEQ ID NO: 436205 - DNA, 20 bp, Artificial
  CRISPR gRNA sequence
ggagtagagcctttaaaagt

SEQ ID NO: 436206 - DNA, 20 bp, Artificial
  CRISPR gRNA sequence
agtagagcctttaaaagtaa

SEQ ID NO: 436207 - DNA, 20 bp, Artificial
  CRISPR gRNA sequence
cctttaaaagtaagagatcc

SEQ ID NO: 436208 - DNA, 20 bp, Artificial
  CRISPR gRNA sequence
ctttaaaagtaagagatcca

SEQ ID NO: 436209 - DNA, 20 bp, Artificial
  CRISPR gRNA sequence
tttaaaagtaagagatccaa

SEQ ID NO: 436210 - DNA, 20 bp, Artificial
  CRISPR gRNA sequence
aagtaagagatccaagggcc

SEQ ID NO: 436211 - DNA, 20 bp, Artificial
  CRISPR gRNA sequence
aagggcctggaatttgaaca

SEQ ID NO: 436212 - DNA, 20 bp, Artificial
  CRISPR gRNA sequence
tgcaacttgtcttctacctg

SEQ ID NO: 436213 - DNA, 20 bp, Artificial
  CRISPR gRNA sequence
gcaacttgtcttctacctga

SEQ ID NO: 436214 - DNA, 20 bp, Artificial
  CRISPR gRNA sequence
aacttgtcttctacctgaag

SEQ ID NO: 436215 - DNA, 20 bp, Artificial
  CRISPR gRNA sequence
tgtcttctacctgaaggagt

SEQ ID NO: 436216 - DNA, 20 bp, Artificial
  CRISPR gRNA sequence
gtcttctacctgaaggagta

SEQ ID NO: 436217 - DNA, 20 bp, Artificial
  CRISPR gRNA sequence
ctacctgaaggagtaaggac

SEQ ID NO: 436218 - DNA, 20 bp, Artificial
  CRISPR gRNA sequence
tacctgaaggagtaaggact

SEQ ID NO: 436219 - DNA, 20 bp, Artificial
  CRISPR gRNA sequence
aaggagtaaggactgggtca

SEQ ID NO: 436220 - DNA, 20 bp, Artificial
  CRISPR gRNA sequence
aggagtaaggactgggtcac

SEQ ID NO: 436221 - DNA, 20 bp, Artificial
  CRISPR gRNA sequence
gtaaggactgggtcacaggt

SEQ ID NO: 436222 - DNA, 20 bp, Artificial
  CRISPR gRNA sequence
ctgggtcacaggtgagtcct

SEQ ID NO: 436223 - DNA, 20 bp, Artificial
  CRISPR gRNA sequence
cacaggtgagtcctcagctc

SEQ ID NO: 436224 - DNA, 20 bp, Artificial
  CRISPR gRNA sequence
caggtgagtcctcagctcta

SEQ ID NO: 436225 - DNA, 20 bp, Artificial
  CRISPR gRNA sequence
gtgagtcctcagctctagag

SEQ ID NO: 436226 - DNA, 20 bp, Artificial
  CRISPR gRNA sequence
agtagatctgctttaaatcc

SEQ ID NO: 436227 - DNA, 20 bp, Artificial
  CRISPR gRNA sequence
atcctagctttcccaattaa

SEQ ID NO: 436228 - DNA, 20 bp, Artificial
  CRISPR gRNA sequence
aattaatagctgtgtgatct

SEQ ID NO: 436229 - DNA, 20 bp, Artificial
  CRISPR gRNA sequence
attaatagctgtgtgatctt

SEQ ID NO: 436230 - DNA, 20 bp, Artificial
  CRISPR gRNA sequence
tagctgtgtgatcttgggca

SEQ ID NO: 436231 - DNA, 20 bp, Artificial
  CRISPR gRNA sequence
ctgtgtgatcttgggcaaag

SEQ ID NO: 436232 - DNA, 20 bp, Artificial
  CRISPR gRNA sequence
cttgggcaaagtggctctct

SEQ ID NO: 436233 - DNA, 20 bp, Artificial
  CRISPR gRNA sequence
caaagtggctctctcagact

SEQ ID NO: 436234 - DNA, 20 bp, Artificial
  CRISPR gRNA sequence
cagtatcttcatctgaaaaa

SEQ ID NO: 436235 - DNA, 20 bp, Artificial
  CRISPR gRNA sequence
agtatcttcatctgaaaaat

SEQ ID NO: 436236 - DNA, 20 bp, Artificial
  CRISPR gRNA sequence
gtatcttcatctgaaaaatg

SEQ ID NO: 436237 - DNA, 20 bp, Artificial
  CRISPR gRNA sequence
catctgaaaaatggggaaaa

SEQ ID NO: 436238 - DNA, 20 bp, Artificial
  CRISPR gRNA sequence
ctgaaaaatggggaaaatag

SEQ ID NO: 436239 - DNA, 20 bp, Artificial
  CRISPR gRNA sequence
atagtagtacctacttattg

SEQ ID NO: 436240 - DNA, 20 bp, Artificial
  CRISPR gRNA sequence
agtacctacttattgtggtt

SEQ ID NO: 436241 - DNA, 20 bp, Artificial
  CRISPR gRNA sequence
gtacctacttattgtggttg

SEQ ID NO: 436242 - DNA, 20 bp, Artificial
  CRISPR gRNA sequence
attgtggttgaggattaaat

SEQ ID NO: 436243 - DNA, 20 bp, Artificial
  CRISPR gRNA sequence
taaatgagattgtatgtata

SEQ ID NO: 436244 - DNA, 20 bp, Artificial
  CRISPR gRNA sequence
gattgtatgtatatggtgct

SEQ ID NO: 436245 - DNA, 20 bp, Artificial
  CRISPR gRNA sequence
atggtgctaagcaccatgtc

SEQ ID NO: 436246 - DNA, 20 bp, Artificial
  CRISPR gRNA sequence
caccatgtctggcacctaat

SEQ ID NO: 436247 - DNA, 20 bp, Artificial
  CRISPR gRNA sequence
ggcacctaataagtaccaaa

SEQ ID NO: 436248 - DNA, 20 bp, Artificial
  CRISPR gRNA sequence
cctaataagtaccaaataga

SEQ ID NO: 436249 - DNA, 20 bp, Artificial
  CRISPR gRNA sequence
tactaaatttatacactgtt

SEQ ID NO: 436250 - DNA, 20 bp, Artificial
  CRISPR gRNA sequence
actaaatttatacactgtta

SEQ ID NO: 436251 - DNA, 20 bp, Artificial
  CRISPR gRNA sequence
tccgctgctacctgccccac

SEQ ID NO: 436252 - DNA, 20 bp, Artificial
  CRISPR gRNA sequence
ccgctgctacctgccccacc

SEQ ID NO: 436253 - DNA, 20 bp, Artificial
  CRISPR gRNA sequence
ctgccccaccaggcaaatct

SEQ ID NO: 436254 - DNA, 20 bp, Artificial
  CRISPR gRNA sequence
caggcaaatcttggtttctc

SEQ ID NO: 436255 - DNA, 20 bp, Artificial
  CRISPR gRNA sequence
caaatcttggtttctccaga

SEQ ID NO: 436256 - DNA, 20 bp, Artificial
  CRISPR gRNA sequence
ttcaactgtcccatccatct

SEQ ID NO: 436257 - DNA, 20 bp, Artificial
  CRISPR gRNA sequence
actgtcccatccatcttggt

SEQ ID NO: 436258 - DNA, 20 bp, Artificial
  CRISPR gRNA sequence
gtcccatccatcttggttgg

SEQ ID NO: 436259 - DNA, 20 bp, Artificial
  CRISPR gRNA sequence
ggccaaatctgtgtgaaaaa

SEQ ID NO: 436260 - DNA, 20 bp, Artificial
  CRISPR gRNA sequence
aaaaagctgtaatgacacaa

SEQ ID NO: 436261 - DNA, 20 bp, Artificial
  CRISPR gRNA sequence
gattttactgatcattttca

SEQ ID NO: 436262 - DNA, 20 bp, Artificial
  CRISPR gRNA sequence
atcattttcatagcaaaatg

SEQ ID NO: 436263 - DNA, 20 bp, Artificial
  CRISPR gRNA sequence
agcaaaatgaagtttttaaa

SEQ ID NO: 436264 - DNA, 20 bp, Artificial
  CRISPR gRNA sequence
aaatgaagtttttaaaaagt

SEQ ID NO: 436265 - DNA, 20 bp, Artificial
  CRISPR gRNA sequence
ttagttttaccatttttatc

SEQ ID NO: 436266 - DNA, 20 bp, Artificial
  CRISPR gRNA sequence
ttatcaagaaaaataattat

SEQ ID NO: 436267 - DNA, 20 bp, Artificial
  CRISPR gRNA sequence
tatcaagaaaaataattata

SEQ ID NO: 436268 - DNA, 20 bp, Artificial
  CRISPR gRNA sequence
tcaagaaaaataattataag

SEQ ID NO: 436269 - DNA, 20 bp, Artificial
  CRISPR gRNA sequence
aattataaggagtctgaaac

SEQ ID NO: 436270 - DNA, 20 bp, Artificial
  CRISPR gRNA sequence
ttaaaatcttatgtgcactt

SEQ ID NO: 436271 - DNA, 20 bp, Artificial
  CRISPR gRNA sequence
acttaagattcatgtttact

SEQ ID NO: 436272 - DNA, 20 bp, Artificial
  CRISPR gRNA sequence
taagattcatgtttacttag

SEQ ID NO: 436273 - DNA, 20 bp, Artificial
  CRISPR gRNA sequence
tacttagcagttgtactgat

SEQ ID NO: 436274 - DNA, 20 bp, Artificial
  CRISPR gRNA sequence
acttagcagttgtactgatg

SEQ ID NO: 436275 - DNA, 20 bp, Artificial
  CRISPR gRNA sequence
cttagcagttgtactgatga

SEQ ID NO: 436276 - DNA, 20 bp, Artificial
  CRISPR gRNA sequence
ttttttttatttttttgata

SEQ ID NO: 436277 - DNA, 20 bp, Artificial
  CRISPR gRNA sequence
ttttttatttttttgatatg

SEQ ID NO: 436278 - DNA, 20 bp, Artificial
  CRISPR gRNA sequence
atggagtcttgctctgtcac

SEQ ID NO: 436279 - DNA, 20 bp, Artificial
  CRISPR gRNA sequence
tggagtcttgctctgtcacc

SEQ ID NO: 436280 - DNA, 20 bp, Artificial
  CRISPR gRNA sequence
gtcttgctctgtcaccaggc

SEQ ID NO: 436281 - DNA, 20 bp, Artificial
  CRISPR gRNA sequence
cttgctctgtcaccaggctg

SEQ ID NO: 436282 - DNA, 20 bp, Artificial
  CRISPR gRNA sequence
gtcaccaggctggagtgcaa

SEQ ID NO: 436283 - DNA, 20 bp, Artificial
  CRISPR gRNA sequence
ggagtgcaatggtgtgatct

SEQ ID NO: 436284 - DNA, 20 bp, Artificial
  CRISPR gRNA sequence
tcactgcaacctccacctcc

SEQ ID NO: 436285 - DNA, 20 bp, Artificial
  CRISPR gRNA sequence
cactgcaacctccacctcct

SEQ ID NO: 436286 - DNA, 20 bp, Artificial
  CRISPR gRNA sequence
aacctccacctcctgggttc

SEQ ID NO: 436287 - DNA, 20 bp, Artificial
  CRISPR gRNA sequence
ttcaagcgattccactgcct

SEQ ID NO: 436288 - DNA, 20 bp, Artificial
  CRISPR gRNA sequence
ttccactgcctcagcctcct

SEQ ID NO: 436289 - DNA, 20 bp, Artificial
  CRISPR gRNA sequence
cactgcctcagcctcctgag

SEQ ID NO: 436290 - DNA, 20 bp, Artificial
  CRISPR gRNA sequence
gcctcagcctcctgagtagc

SEQ ID NO: 436291 - DNA, 20 bp, Artificial
  CRISPR gRNA sequence
cctcagcctcctgagtagct

SEQ ID NO: 436292 - DNA, 20 bp, Artificial
  CRISPR gRNA sequence
ctcctgagtagctgggacta

SEQ ID NO: 436293 - DNA, 20 bp, Artificial
  CRISPR gRNA sequence
tcctgagtagctgggactac

SEQ ID NO: 436294 - DNA, 20 bp, Artificial
  CRISPR gRNA sequence
caggcgtacaccaccacgcc

SEQ ID NO: 436295 - DNA, 20 bp, Artificial
  CRISPR gRNA sequence
ccggctaattttttgtattt

SEQ ID NO: 436296 - DNA, 20 bp, Artificial
  CRISPR gRNA sequence
gctaattttttgtattttag

SEQ ID NO: 436297 - DNA, 20 bp, Artificial
  CRISPR gRNA sequence
taattttttgtattttagta

SEQ ID NO: 436298 - DNA, 20 bp, Artificial
  CRISPR gRNA sequence
tttttgtattttagtagaga

SEQ ID NO: 436299 - DNA, 20 bp, Artificial
  CRISPR gRNA sequence
ttttgtattttagtagagat

SEQ ID NO: 436300 - DNA, 20 bp, Artificial
  CRISPR gRNA sequence
tttgtattttagtagagatg

SEQ ID NO: 436301 - DNA, 20 bp, Artificial
  CRISPR gRNA sequence
gagatggggtttcaccatat

SEQ ID NO: 436302 - DNA, 20 bp, Artificial
  CRISPR gRNA sequence
tggggtttcaccatattggc

SEQ ID NO: 436303 - DNA, 20 bp, Artificial
  CRISPR gRNA sequence
ggggtttcaccatattggcc

SEQ ID NO: 436304 - DNA, 20 bp, Artificial
  CRISPR gRNA sequence
tttcaccatattggccagga

SEQ ID NO: 436305 - DNA, 20 bp, Artificial
  CRISPR gRNA sequence
cctcgtgatctgcctgccct

SEQ ID NO: 436306 - DNA, 20 bp, Artificial
  CRISPR gRNA sequence
tgcctgccctcggcctccca

SEQ ID NO: 436307 - DNA, 20 bp, Artificial
  CRISPR gRNA sequence
ccctcggcctcccaaagtgc

SEQ ID NO: 436308 - DNA, 20 bp, Artificial
  CRISPR gRNA sequence
cctcggcctcccaaagtgct

SEQ ID NO: 436309 - DNA, 20 bp, Artificial
  CRISPR gRNA sequence
ctcccaaagtgctgggatta

SEQ ID NO: 436310 - DNA, 20 bp, Artificial
  CRISPR gRNA sequence
tcccaaagtgctgggattac

SEQ ID NO: 436311 - DNA, 20 bp, Artificial
  CRISPR gRNA sequence
agtgctgggattacaggtgt

SEQ ID NO: 436312 - DNA, 20 bp, Artificial
  CRISPR gRNA sequence
acaggtgtgagccactgcac

SEQ ID NO: 436313 - DNA, 20 bp, Artificial
  CRISPR gRNA sequence
caggtgtgagccactgcacc

SEQ ID NO: 436314 - DNA, 20 bp, Artificial
  CRISPR gRNA sequence
gagccactgcaccaggcctg

SEQ ID NO: 436315 - DNA, 20 bp, Artificial
  CRISPR gRNA sequence
ttatattttaaatttttttc

SEQ ID NO: 436316 - DNA, 20 bp, Artificial
  CRISPR gRNA sequence
ttaaatttttttctggtaat

SEQ ID NO: 436317 - DNA, 20 bp, Artificial
  CRISPR gRNA sequence
taaatttttttctggtaatt

SEQ ID NO: 436318 - DNA, 20 bp, Artificial
  CRISPR gRNA sequence
aaatttttttctggtaatta

SEQ ID NO: 436319 - DNA, 20 bp, Artificial
  CRISPR gRNA sequence
ttttctggtaattagggcaa

SEQ ID NO: 436320 - DNA, 20 bp, Artificial
  CRISPR gRNA sequence
gtaattagggcaaaagtaat

SEQ ID NO: 436321 - DNA, 20 bp, Artificial
  CRISPR gRNA sequence
ctttttttcttcaataattt

SEQ ID NO: 436322 - DNA, 20 bp, Artificial
  CRISPR gRNA sequence
tttttttcttcaataatttt

SEQ ID NO: 436323 - DNA, 20 bp, Artificial
  CRISPR gRNA sequence
ttcttcaataattttaggct

SEQ ID NO: 436324 - DNA, 20 bp, Artificial
  CRISPR gRNA sequence
tcttcaataattttaggctg

SEQ ID NO: 436325 - DNA, 20 bp, Artificial
  CRISPR gRNA sequence
cctttataatatttaaacta

SEQ ID NO: 436326 - DNA, 20 bp, Artificial
  CRISPR gRNA sequence
taaactatagtttgctaaac

SEQ ID NO: 436327 - DNA, 20 bp, Artificial
  CRISPR gRNA sequence
tagtttgctaaaccagcatt

SEQ ID NO: 436328 - DNA, 20 bp, Artificial
  CRISPR gRNA sequence
tcaaaccctttatacacatt

SEQ ID NO: 436329 - DNA, 20 bp, Artificial
  CRISPR gRNA sequence
caaaccctttatacacatta

SEQ ID NO: 436330 - DNA, 20 bp, Artificial
  CRISPR gRNA sequence
tttatacacattaaggcttc

SEQ ID NO: 436331 - DNA, 20 bp, Artificial
  CRISPR gRNA sequence
atacacattaaggcttccag

SEQ ID NO: 436332 - DNA, 20 bp, Artificial
  CRISPR gRNA sequence
tacacattaaggcttccaga

SEQ ID NO: 436333 - DNA, 20 bp, Artificial
  CRISPR gRNA sequence
ttaaggcttccagaaggtga

SEQ ID NO: 436334 - DNA, 20 bp, Artificial
  CRISPR gRNA sequence
agaaggtgacagtgacattt

SEQ ID NO: 436335 - DNA, 20 bp, Artificial
  CRISPR gRNA sequence
aggtgacagtgacatttaag

SEQ ID NO: 436336 - DNA, 20 bp, Artificial
  CRISPR gRNA sequence
aagtttcaacatctctgact

SEQ ID NO: 436337 - DNA, 20 bp, Artificial
  CRISPR gRNA sequence
tctgactcagccataaaaat

SEQ ID NO: 436338 - DNA, 20 bp, Artificial
  CRISPR gRNA sequence
actcagccataaaaatgagt

SEQ ID NO: 436339 - DNA, 20 bp, Artificial
  CRISPR gRNA sequence
taaaaatgagtaagcatgct

SEQ ID NO: 436340 - DNA, 20 bp, Artificial
  CRISPR gRNA sequence
aagcatgcttagttttccaa

SEQ ID NO: 436341 - DNA, 20 bp, Artificial
  CRISPR gRNA sequence
atgcttagttttccaaaagc

SEQ ID NO: 436342 - DNA, 20 bp, Artificial
  CRISPR gRNA sequence
gctggcaatgtacttatttt

SEQ ID NO: 436343 - DNA, 20 bp, Artificial
  CRISPR gRNA sequence
atgtacttatttttagaatt

SEQ ID NO: 436344 - DNA, 20 bp, Artificial
  CRISPR gRNA sequence
ttttagaattcagtgttcat

SEQ ID NO: 436345 - DNA, 20 bp, Artificial
  CRISPR gRNA sequence
tttagaattcagtgttcatg

SEQ ID NO: 436346 - DNA, 20 bp, Artificial
  CRISPR gRNA sequence
gaattcagtgttcatgaggt

SEQ ID NO: 436347 - DNA, 20 bp, Artificial
  CRISPR gRNA sequence
aattcagtgttcatgaggtc

SEQ ID NO: 436348 - DNA, 20 bp, Artificial
  CRISPR gRNA sequence
attcagtgttcatgaggtca

SEQ ID NO: 436349 - DNA, 20 bp, Artificial
  CRISPR gRNA sequence
cctgctctgtcccctgtgcc

SEQ ID NO: 436350 - DNA, 20 bp, Artificial
  CRISPR gRNA sequence
tgctctgtcccctgtgccta

SEQ ID NO: 436351 - DNA, 20 bp, Artificial
  CRISPR gRNA sequence
ctgtcccctgtgcctagagt

SEQ ID NO: 436352 - DNA, 20 bp, Artificial
  CRISPR gRNA sequence
tgtcccctgtgcctagagta

SEQ ID NO: 436353 - DNA, 20 bp, Artificial
  CRISPR gRNA sequence
gtcccctgtgcctagagtaa

SEQ ID NO: 436354 - DNA, 20 bp, Artificial
  CRISPR gRNA sequence
ctgtgcctagagtaagggca

SEQ ID NO: 436355 - DNA, 20 bp, Artificial
  CRISPR gRNA sequence
aagggcatagtgcatattca

SEQ ID NO: 436356 - DNA, 20 bp, Artificial
  CRISPR gRNA sequence
catagtgcatattcatggaa

SEQ ID NO: 436357 - DNA, 20 bp, Artificial
  CRISPR gRNA sequence
tgcatattcatggaatggat

SEQ ID NO: 436358 - DNA, 20 bp, Artificial
  CRISPR gRNA sequence
atattcatggaatggatcag

SEQ ID NO: 436359 - DNA, 20 bp, Artificial
  CRISPR gRNA sequence
atggaatggatcagcagatg

SEQ ID NO: 436360 - DNA, 20 bp, Artificial
  CRISPR gRNA sequence
tgaagaaataaacaaatgaa

SEQ ID NO: 436361 - DNA, 20 bp, Artificial
  CRISPR gRNA sequence
gaagaaataaacaaatgaac

SEQ ID NO: 436362 - DNA, 20 bp, Artificial
  CRISPR gRNA sequence
gaaataaacaaatgaacagg

SEQ ID NO: 436363 - DNA, 20 bp, Artificial
  CRISPR gRNA sequence
aaataaacaaatgaacagga

SEQ ID NO: 436364 - DNA, 20 bp, Artificial
  CRISPR gRNA sequence
aaacaaatgaacaggaagga

SEQ ID NO: 436365 - DNA, 20 bp, Artificial
  CRISPR gRNA sequence
aaatgaacaggaaggaaaga

SEQ ID NO: 436366 - DNA, 20 bp, Artificial
  CRISPR gRNA sequence
gaacaggaaggaaagatggt

SEQ ID NO: 436367 - DNA, 20 bp, Artificial
  CRISPR gRNA sequence
caggaaggaaagatggtgag

SEQ ID NO: 436368 - DNA, 20 bp, Artificial
  CRISPR gRNA sequence
aggaaggaaagatggtgagt

SEQ ID NO: 436369 - DNA, 20 bp, Artificial
  CRISPR gRNA sequence
aaggaaagatggtgagtggg

SEQ ID NO: 436370 - DNA, 20 bp, Artificial
  CRISPR gRNA sequence
aaagatggtgagtgggtggc

SEQ ID NO: 436371 - DNA, 20 bp, Artificial
  CRISPR gRNA sequence
aagatggtgagtgggtggct

SEQ ID NO: 436372 - DNA, 20 bp, Artificial
  CRISPR gRNA sequence
cgtgaccctcttcataatga

SEQ ID NO: 436373 - DNA, 20 bp, Artificial
  CRISPR gRNA sequence
ctcttcataatgacagcact

SEQ ID NO: 436374 - DNA, 20 bp, Artificial
  CRISPR gRNA sequence
tcttcataatgacagcactg

SEQ ID NO: 436375 - DNA, 20 bp, Artificial
  CRISPR gRNA sequence
cataatgacagcactgaggt

SEQ ID NO: 436376 - DNA, 20 bp, Artificial
  CRISPR gRNA sequence
ataatgacagcactgaggta

SEQ ID NO: 436377 - DNA, 20 bp, Artificial
  CRISPR gRNA sequence
taatgacagcactgaggtaa

SEQ ID NO: 436378 - DNA, 20 bp, Artificial
  CRISPR gRNA sequence
gacagcactgaggtaagggc

SEQ ID NO: 436379 - DNA, 20 bp, Artificial
  CRISPR gRNA sequence
cactgaggtaagggctggtg

SEQ ID NO: 436380 - DNA, 20 bp, Artificial
  CRISPR gRNA sequence
actgaggtaagggctggtga

SEQ ID NO: 436381 - DNA, 20 bp, Artificial
  CRISPR gRNA sequence
gaggtaagggctggtgaagg

SEQ ID NO: 436382 - DNA, 20 bp, Artificial
  CRISPR gRNA sequence
ctggtgaaggcagtataatt

SEQ ID NO: 436383 - DNA, 20 bp, Artificial
  CRISPR gRNA sequence
ataattaagaatgtgcattt

SEQ ID NO: 436384 - DNA, 20 bp, Artificial
  CRISPR gRNA sequence
taattaagaatgtgcattta

SEQ ID NO: 436385 - DNA, 20 bp, Artificial
  CRISPR gRNA sequence
aatgtgcatttaaggctatg

SEQ ID NO: 436386 - DNA, 20 bp, Artificial
  CRISPR gRNA sequence
aaggctatgcagacctaaat

SEQ ID NO: 436387 - DNA, 20 bp, Artificial
  CRISPR gRNA sequence
gctatgcagacctaaattgg

SEQ ID NO: 436388 - DNA, 20 bp, Artificial
  CRISPR gRNA sequence
ctatgcagacctaaattgga

SEQ ID NO: 436389 - DNA, 20 bp, Artificial
  CRISPR gRNA sequence
aggccattttgtcatttgct

SEQ ID NO: 436390 - DNA, 20 bp, Artificial
  CRISPR gRNA sequence
tttgctaagtcatgtgacct

SEQ ID NO: 436391 - DNA, 20 bp, Artificial
  CRISPR gRNA sequence
ttgctaagtcatgtgacctt

SEQ ID NO: 436392 - DNA, 20 bp, Artificial
  CRISPR gRNA sequence
taagtcatgtgaccttgggt

SEQ ID NO: 436393 - DNA, 20 bp, Artificial
  CRISPR gRNA sequence
cacttcacttccctaatttt

SEQ ID NO: 436394 - DNA, 20 bp, Artificial
  CRISPR gRNA sequence
cagtttcttcatctgtgcaa

SEQ ID NO: 436395 - DNA, 20 bp, Artificial
  CRISPR gRNA sequence
agtttcttcatctgtgcaat

SEQ ID NO: 436396 - DNA, 20 bp, Artificial
  CRISPR gRNA sequence
catctgtgcaatgggactaa

SEQ ID NO: 436397 - DNA, 20 bp, Artificial
  CRISPR gRNA sequence
gggactaacagtctctactt

SEQ ID NO: 436398 - DNA, 20 bp, Artificial
  CRISPR gRNA sequence
actaacagtctctactttag

SEQ ID NO: 436399 - DNA, 20 bp, Artificial
  CRISPR gRNA sequence
cagtctctactttagaagcg

SEQ ID NO: 436400 - DNA, 20 bp, Artificial
  CRISPR gRNA sequence
actttagaagcgtagttcta

SEQ ID NO: 436401 - DNA, 20 bp, Artificial
  CRISPR gRNA sequence
tagaagcgtagttctaaagt

SEQ ID NO: 436402 - DNA, 20 bp, Artificial
  CRISPR gRNA sequence
gttctaaagtaagtgcttct

SEQ ID NO: 436403 - DNA, 20 bp, Artificial
  CRISPR gRNA sequence
cttctaagtatctctaaaat

SEQ ID NO: 436404 - DNA, 20 bp, Artificial
  CRISPR gRNA sequence
aaaatgagcttcttcactga

SEQ ID NO: 436405 - DNA, 20 bp, Artificial
  CRISPR gRNA sequence
aatgagcttcttcactgaaa

SEQ ID NO: 436406 - DNA, 20 bp, Artificial
  CRISPR gRNA sequence
cttcactgaaagagtttatt

SEQ ID NO: 436407 - DNA, 20 bp, Artificial
  CRISPR gRNA sequence
tgaaagagtttatttagcac

SEQ ID NO: 436408 - DNA, 20 bp, Artificial
  CRISPR gRNA sequence
gaaagagtttatttagcaca

SEQ ID NO: 436409 - DNA, 20 bp, Artificial
  CRISPR gRNA sequence
agtttatttagcacaaggcc

SEQ ID NO: 436410 - DNA, 20 bp, Artificial
  CRISPR gRNA sequence
ctcctattacattgtgacca

SEQ ID NO: 436411 - DNA, 20 bp, Artificial
  CRISPR gRNA sequence
cagtgattattttcatttgt

SEQ ID NO: 436412 - DNA, 20 bp, Artificial
  CRISPR gRNA sequence
aaccctgtctcccttctcat

SEQ ID NO: 436413 - DNA, 20 bp, Artificial
  CRISPR gRNA sequence
agtaaatgcaaaacttattt

SEQ ID NO: 436414 - DNA, 20 bp, Artificial
  CRISPR gRNA sequence
gcaaaacttatttaagaaaa

SEQ ID NO: 436415 - DNA, 20 bp, Artificial
  CRISPR gRNA sequence
aaaacttatttaagaaaatg

SEQ ID NO: 436416 - DNA, 20 bp, Artificial
  CRISPR gRNA sequence
aaacttatttaagaaaatgg

SEQ ID NO: 436417 - DNA, 20 bp, Artificial
  CRISPR gRNA sequence
ttatttaagaaaatggaggc

SEQ ID NO: 436418 - DNA, 20 bp, Artificial
  CRISPR gRNA sequence
tatttaagaaaatggaggct

SEQ ID NO: 436419 - DNA, 20 bp, Artificial
  CRISPR gRNA sequence
aagaaaatggaggctgggca

SEQ ID NO: 436420 - DNA, 20 bp, Artificial
  CRISPR gRNA sequence
aatggaggctgggcacggca

SEQ ID NO: 436421 - DNA, 20 bp, Artificial
  CRISPR gRNA sequence
ggaggctgggcacggcacgg

SEQ ID NO: 436422 - DNA, 20 bp, Artificial
  CRISPR gRNA sequence
gtggctcacgcctgtaatcc

SEQ ID NO: 436423 - DNA, 20 bp, Artificial
  CRISPR gRNA sequence
cgcctgtaatcccagcactt

SEQ ID NO: 436424 - DNA, 20 bp, Artificial
  CRISPR gRNA sequence
gcctgtaatcccagcacttt

SEQ ID NO: 436425 - DNA, 20 bp, Artificial
  CRISPR gRNA sequence
ctgtaatcccagcactttgg

SEQ ID NO: 436426 - DNA, 20 bp, Artificial
  CRISPR gRNA sequence
tgtaatcccagcactttggg

SEQ ID NO: 436427 - DNA, 20 bp, Artificial
  CRISPR gRNA sequence
tcccagcactttgggaggcc

SEQ ID NO: 436428 - DNA, 20 bp, Artificial
  CRISPR gRNA sequence
cccagcactttgggaggccg

SEQ ID NO: 436429 - DNA, 20 bp, Artificial
  CRISPR gRNA sequence
agcactttgggaggccgagg

SEQ ID NO: 436430 - DNA, 20 bp, Artificial
  CRISPR gRNA sequence
gcactttgggaggccgaggc

SEQ ID NO: 436431 - DNA, 20 bp, Artificial
  CRISPR gRNA sequence
ctttgggaggccgaggcggg

SEQ ID NO: 436432 - DNA, 20 bp, Artificial
  CRISPR gRNA sequence
ccgaggcgggtggatcactt

SEQ ID NO: 436433 - DNA, 20 bp, Artificial
  CRISPR gRNA sequence
cgaggcgggtggatcacttg

SEQ ID NO: 436434 - DNA, 20 bp, Artificial
  CRISPR gRNA sequence
gcgggtggatcacttgaggt

SEQ ID NO: 436435 - DNA, 20 bp, Artificial
  CRISPR gRNA sequence
cgggtggatcacttgaggtc

SEQ ID NO: 436436 - DNA, 20 bp, Artificial
  CRISPR gRNA sequence
ggtggatcacttgaggtcag

SEQ ID NO: 436437 - DNA, 20 bp, Artificial
  CRISPR gRNA sequence
tcacttgaggtcaggagttc

SEQ ID NO: 436438 - DNA, 20 bp, Artificial
  CRISPR gRNA sequence
tgaggtcaggagttcgagac

SEQ ID NO: 436439 - DNA, 20 bp, Artificial
  CRISPR gRNA sequence
tcaggagttcgagactagcc

SEQ ID NO: 436440 - DNA, 20 bp, Artificial
  CRISPR gRNA sequence
cgagactagcctggccaaca

SEQ ID NO: 436441 - DNA, 20 bp, Artificial
  CRISPR gRNA sequence
tctactaaaaatacaaaaat

SEQ ID NO: 436442 - DNA, 20 bp, Artificial
  CRISPR gRNA sequence
atacaaaaattagctgtgtg

SEQ ID NO: 436443 - DNA, 20 bp, Artificial
  CRISPR gRNA sequence
caaaaattagctgtgtgtgg

SEQ ID NO: 436444 - DNA, 20 bp, Artificial
  CRISPR gRNA sequence
tgtgtggtggtgtgcccctg

SEQ ID NO: 436445 - DNA, 20 bp, Artificial
  CRISPR gRNA sequence
gtggtgtgcccctgtagtcc

SEQ ID NO: 436446 - DNA, 20 bp, Artificial
  CRISPR gRNA sequence
gcccctgtagtcccagctac

SEQ ID NO: 436447 - DNA, 20 bp, Artificial
  CRISPR gRNA sequence
cccctgtagtcccagctacc

SEQ ID NO: 436448 - DNA, 20 bp, Artificial
  CRISPR gRNA sequence
ccctgtagtcccagctacca

SEQ ID NO: 436449 - DNA, 20 bp, Artificial
  CRISPR gRNA sequence
ctgtagtcccagctaccagg

SEQ ID NO: 436450 - DNA, 20 bp, Artificial
  CRISPR gRNA sequence
tgtagtcccagctaccaggg

SEQ ID NO: 436451 - DNA, 20 bp, Artificial
  CRISPR gRNA sequence
tcccagctaccagggaggct

SEQ ID NO: 436452 - DNA, 20 bp, Artificial
  CRISPR gRNA sequence
cccagctaccagggaggctg

SEQ ID NO: 436453 - DNA, 20 bp, Artificial
  CRISPR gRNA sequence
agctaccagggaggctgagg

SEQ ID NO: 436454 - DNA, 20 bp, Artificial
  CRISPR gRNA sequence
gctaccagggaggctgaggc

SEQ ID NO: 436455 - DNA, 20 bp, Artificial
  CRISPR gRNA sequence
taccagggaggctgaggcag

SEQ ID NO: 436456 - DNA, 20 bp, Artificial
  CRISPR gRNA sequence
gcaggagaatcgcttgaact

SEQ ID NO: 436457 - DNA, 20 bp, Artificial
  CRISPR gRNA sequence
caggagaatcgcttgaactc

SEQ ID NO: 436458 - DNA, 20 bp, Artificial
  CRISPR gRNA sequence
ggagaatcgcttgaactcag

SEQ ID NO: 436459 - DNA, 20 bp, Artificial
  CRISPR gRNA sequence
aatcgcttgaactcaggaga

SEQ ID NO: 436460 - DNA, 20 bp, Artificial
  CRISPR gRNA sequence
tcgcttgaactcaggagatg

SEQ ID NO: 436461 - DNA, 20 bp, Artificial
  CRISPR gRNA sequence
cgcttgaactcaggagatgg

SEQ ID NO: 436462 - DNA, 20 bp, Artificial
  CRISPR gRNA sequence
aactcaggagatggaggttg

SEQ ID NO: 436463 - DNA, 20 bp, Artificial
  CRISPR gRNA sequence
caggagatggaggttgcagt

SEQ ID NO: 436464 - DNA, 20 bp, Artificial
  CRISPR gRNA sequence
gagatggaggttgcagtgag

SEQ ID NO: 436465 - DNA, 20 bp, Artificial
  CRISPR gRNA sequence
gatggaggttgcagtgagca

SEQ ID NO: 436466 - DNA, 20 bp, Artificial
  CRISPR gRNA sequence
gagatcatgctactgcactc

SEQ ID NO: 436467 - DNA, 20 bp, Artificial
  CRISPR gRNA sequence
catgctactgcactccagcc

SEQ ID NO: 436468 - DNA, 20 bp, Artificial
  CRISPR gRNA sequence
atgctactgcactccagcct

SEQ ID NO: 436469 - DNA, 20 bp, Artificial
  CRISPR gRNA sequence
ctgcactccagcctgggtga

SEQ ID NO: 436470 - DNA, 20 bp, Artificial
  CRISPR gRNA sequence
gcactccagcctgggtgata

SEQ ID NO: 436471 - DNA, 20 bp, Artificial
  CRISPR gRNA sequence
tccagcctgggtgatagagt

SEQ ID NO: 436472 - DNA, 20 bp, Artificial
  CRISPR gRNA sequence
gtgagattctgtctcgcaaa

SEQ ID NO: 436473 - DNA, 20 bp, Artificial
  CRISPR gRNA sequence
tgtctcgcaaaaagaaaaaa

SEQ ID NO: 436474 - DNA, 20 bp, Artificial
  CRISPR gRNA sequence
gcaaaaagaaaaaaaagaaa

SEQ ID NO: 436475 - DNA, 20 bp, Artificial
  CRISPR gRNA sequence
gaaaaaaaagaaaaagaaca

SEQ ID NO: 436476 - DNA, 20 bp, Artificial
  CRISPR gRNA sequence
aaaaaaagaaaaagaacatg

SEQ ID NO: 436477 - DNA, 20 bp, Artificial
  CRISPR gRNA sequence
aaaaaagaaaaagaacatgg

SEQ ID NO: 436478 - DNA, 20 bp, Artificial
  CRISPR gRNA sequence
gaaaaagaacatggaggttg

SEQ ID NO: 436479 - DNA, 20 bp, Artificial
  CRISPR gRNA sequence
aagaacatggaggttgcagt

SEQ ID NO: 436480 - DNA, 20 bp, Artificial
  CRISPR gRNA sequence
catggaggttgcagtgagtt

SEQ ID NO: 436481 - DNA, 20 bp, Artificial
  CRISPR gRNA sequence
gagattgtgccactgcactc

SEQ ID NO: 436482 - DNA, 20 bp, Artificial
  CRISPR gRNA sequence
tgtgccactgcactccagcc

SEQ ID NO: 436483 - DNA, 20 bp, Artificial
  CRISPR gRNA sequence
gtgccactgcactccagcct

SEQ ID NO: 436484 - DNA, 20 bp, Artificial
  CRISPR gRNA sequence
ctgcactccagcctgggcaa

SEQ ID NO: 436485 - DNA, 20 bp, Artificial
  CRISPR gRNA sequence
gcactccagcctgggcaaca

SEQ ID NO: 436486 - DNA, 20 bp, Artificial
  CRISPR gRNA sequence
tccagcctgggcaacagagt

SEQ ID NO: 436487 - DNA, 20 bp, Artificial
  CRISPR gRNA sequence
actgtctcaaaaaaacaaaa

SEQ ID NO: 436488 - DNA, 20 bp, Artificial
  CRISPR gRNA sequence
gtctcaaaaaaacaaaaaag

SEQ ID NO: 436489 - DNA, 20 bp, Artificial
  CRISPR gRNA sequence
tctcaaaaaaacaaaaaaga

SEQ ID NO: 436490 - DNA, 20 bp, Artificial
  CRISPR gRNA sequence
gttgtcttttaaaatctaat

SEQ ID NO: 436491 - DNA, 20 bp, Artificial
  CRISPR gRNA sequence
ctaattagaatataatgcct

SEQ ID NO: 436492 - DNA, 20 bp, Artificial
  CRISPR gRNA sequence
taattagaatataatgcctg

SEQ ID NO: 436493 - DNA, 20 bp, Artificial
  CRISPR gRNA sequence
agaatataatgcctgaggcc

SEQ ID NO: 436494 - DNA, 20 bp, Artificial
  CRISPR gRNA sequence
ataatgcctgaggccaagcc

SEQ ID NO: 436495 - DNA, 20 bp, Artificial
  CRISPR gRNA sequence
gtcgttcacacctgtaatcc

SEQ ID NO: 436496 - DNA, 20 bp, Artificial
  CRISPR gRNA sequence
cacctgtaatcccagcattt

SEQ ID NO: 436497 - DNA, 20 bp, Artificial
  CRISPR gRNA sequence
acctgtaatcccagcatttt

SEQ ID NO: 436498 - DNA, 20 bp, Artificial
  CRISPR gRNA sequence
ctgtaatcccagcattttgg

SEQ ID NO: 436499 - DNA, 20 bp, Artificial
  CRISPR gRNA sequence
tgtaatcccagcattttggg

SEQ ID NO: 436500 - DNA, 20 bp, Artificial
  CRISPR gRNA sequence
tcccagcattttgggaggct

SEQ ID NO: 436501 - DNA, 20 bp, Artificial
  CRISPR gRNA sequence
cccagcattttgggaggctg

SEQ ID NO: 436502 - DNA, 20 bp, Artificial
  CRISPR gRNA sequence
agcattttgggaggctgagg

SEQ ID NO: 436503 - DNA, 20 bp, Artificial
  CRISPR gRNA sequence
gcattttgggaggctgaggt

SEQ ID NO: 436504 - DNA, 20 bp, Artificial
  CRISPR gRNA sequence
ttttgggaggctgaggtggg

SEQ ID NO: 436505 - DNA, 20 bp, Artificial
  CRISPR gRNA sequence
ctgaggtgggcagatcacct

SEQ ID NO: 436506 - DNA, 20 bp, Artificial
  CRISPR gRNA sequence
tgaggtgggcagatcacctg

SEQ ID NO: 436507 - DNA, 20 bp, Artificial
  CRISPR gRNA sequence
gtgggcagatcacctgaggt

SEQ ID NO: 436508 - DNA, 20 bp, Artificial
  CRISPR gRNA sequence
tgggcagatcacctgaggtc

SEQ ID NO: 436509 - DNA, 20 bp, Artificial
  CRISPR gRNA sequence
ggcagatcacctgaggtcag

SEQ ID NO: 436510 - DNA, 20 bp, Artificial
  CRISPR gRNA sequence
tgaggtcaggagttcacaac

SEQ ID NO: 436511 - DNA, 20 bp, Artificial
  CRISPR gRNA sequence
tcaggagttcacaaccagcc

SEQ ID NO: 436512 - DNA, 20 bp, Artificial
  CRISPR gRNA sequence
cacaaccagcctggtcaaca

SEQ ID NO: 436513 - DNA, 20 bp, Artificial
  CRISPR gRNA sequence
tctactaaaaatacaaaaat

SEQ ID NO: 436514 - DNA, 20 bp, Artificial
  CRISPR gRNA sequence
ctaaaaatacaaaaattagc

SEQ ID NO: 436515 - DNA, 20 bp, Artificial
  CRISPR gRNA sequence
taaaaatacaaaaattagct

SEQ ID NO: 436516 - DNA, 20 bp, Artificial
  CRISPR gRNA sequence
atacaaaaattagctgggcg

SEQ ID NO: 436517 - DNA, 20 bp, Artificial
  CRISPR gRNA sequence
caaaaattagctgggcgtgg

SEQ ID NO: 436518 - DNA, 20 bp, Artificial
  CRISPR gRNA sequence
ggcgtggtggtgcatgcatg

SEQ ID NO: 436519 - DNA, 20 bp, Artificial
  CRISPR gRNA sequence
gtggtgcatgcatgtagtcc

SEQ ID NO: 436520 - DNA, 20 bp, Artificial
  CRISPR gRNA sequence
tgcatgtagtcccagctact

SEQ ID NO: 436521 - DNA, 20 bp, Artificial
  CRISPR gRNA sequence
gcatgtagtcccagctactt

SEQ ID NO: 436522 - DNA, 20 bp, Artificial
  CRISPR gRNA sequence
atgtagtcccagctacttgg

SEQ ID NO: 436523 - DNA, 20 bp, Artificial
  CRISPR gRNA sequence
tgtagtcccagctacttggg

SEQ ID NO: 436524 - DNA, 20 bp, Artificial
  CRISPR gRNA sequence
tcccagctacttgggaggat

SEQ ID NO: 436525 - DNA, 20 bp, Artificial
  CRISPR gRNA sequence
cccagctacttgggaggatg

SEQ ID NO: 436526 - DNA, 20 bp, Artificial
  CRISPR gRNA sequence
ccagctacttgggaggatga

SEQ ID NO: 436527 - DNA, 20 bp, Artificial
  CRISPR gRNA sequence
tacttgggaggatgagggat

SEQ ID NO: 436528 - DNA, 20 bp, Artificial
  CRISPR gRNA sequence
gggatgagaattgcttgaac

SEQ ID NO: 436529 - DNA, 20 bp, Artificial
  CRISPR gRNA sequence
ggatgagaattgcttgaacc

SEQ ID NO: 436530 - DNA, 20 bp, Artificial
  CRISPR gRNA sequence
gatgagaattgcttgaacca

SEQ ID NO: 436531 - DNA, 20 bp, Artificial
  CRISPR gRNA sequence
tgagaattgcttgaaccagg

SEQ ID NO: 436532 - DNA, 20 bp, Artificial
  CRISPR gRNA sequence
gagaattgcttgaaccaggg

SEQ ID NO: 436533 - DNA, 20 bp, Artificial
  CRISPR gRNA sequence
ttgcttgaaccagggaggcc

SEQ ID NO: 436534 - DNA, 20 bp, Artificial
  CRISPR gRNA sequence
tgcttgaaccagggaggccg

SEQ ID NO: 436535 - DNA, 20 bp, Artificial
  CRISPR gRNA sequence
aaccagggaggccgaggttg

SEQ ID NO: 436536 - DNA, 20 bp, Artificial
  CRISPR gRNA sequence
agggaggccgaggttgcggt

SEQ ID NO: 436537 - DNA, 20 bp, Artificial
  CRISPR gRNA sequence
ggccgaggttgcggtgagct

SEQ ID NO: 436538 - DNA, 20 bp, Artificial
  CRISPR gRNA sequence
gagattatgccactgcactc

SEQ ID NO: 436539 - DNA, 20 bp, Artificial
  CRISPR gRNA sequence
tatgccactgcactccagcc

SEQ ID NO: 436540 - DNA, 20 bp, Artificial
  CRISPR gRNA sequence
atgccactgcactccagcct

SEQ ID NO: 436541 - DNA, 20 bp, Artificial
  CRISPR gRNA sequence
ctgcactccagcctgggtga

SEQ ID NO: 436542 - DNA, 20 bp, Artificial
  CRISPR gRNA sequence
gcactccagcctgggtgaca

SEQ ID NO: 436543 - DNA, 20 bp, Artificial
  CRISPR gRNA sequence
taaataaataaataatgcct

SEQ ID NO: 436544 - DNA, 20 bp, Artificial
  CRISPR gRNA sequence
ctgagtcttatcaatattgc

SEQ ID NO: 436545 - DNA, 20 bp, Artificial
  CRISPR gRNA sequence
tcaatattgctagatgtttg

SEQ ID NO: 436546 - DNA, 20 bp, Artificial
  CRISPR gRNA sequence
tagatgtttgtagaactcat

SEQ ID NO: 436547 - DNA, 20 bp, Artificial
  CRISPR gRNA sequence
agatgtttgtagaactcatt

SEQ ID NO: 436548 - DNA, 20 bp, Artificial
  CRISPR gRNA sequence
gatgtttgtagaactcatta

SEQ ID NO: 436549 - DNA, 20 bp, Artificial
  CRISPR gRNA sequence
agggtcctgtgaaaaaaaca

SEQ ID NO: 436550 - DNA, 20 bp, Artificial
  CRISPR gRNA sequence
aacaaagcacatatttaatg

SEQ ID NO: 436551 - DNA, 20 bp, Artificial
  CRISPR gRNA sequence
acaaagcacatatttaatgt

SEQ ID NO: 436552 - DNA, 20 bp, Artificial
  CRISPR gRNA sequence
atatttaatgtaggacttcc

SEQ ID NO: 436553 - DNA, 20 bp, Artificial
  CRISPR gRNA sequence
tttaatgtaggacttcctgg

SEQ ID NO: 436554 - DNA, 20 bp, Artificial
  CRISPR gRNA sequence
aatgtaggacttcctggcag

SEQ ID NO: 436555 - DNA, 20 bp, Artificial
  CRISPR gRNA sequence
gaagtctctatttcataaaa

SEQ ID NO: 436556 - DNA, 20 bp, Artificial
  CRISPR gRNA sequence
ctctatttcataaaacagta

SEQ ID NO: 436557 - DNA, 20 bp, Artificial
  CRISPR gRNA sequence
aaacagtacggttcattatc

SEQ ID NO: 436558 - DNA, 20 bp, Artificial
  CRISPR gRNA sequence
attatctagatgaaaaaatg

SEQ ID NO: 436559 - DNA, 20 bp, Artificial
  CRISPR gRNA sequence
gaaaaaatgtggccatccta

SEQ ID NO: 436560 - DNA, 20 bp, Artificial
  CRISPR gRNA sequence
gccatcctaaagttgattcc

SEQ ID NO: 436561 - DNA, 20 bp, Artificial
  CRISPR gRNA sequence
ccatcctaaagttgattcct

SEQ ID NO: 436562 - DNA, 20 bp, Artificial
  CRISPR gRNA sequence
aaagttgattcctgggtgtt

SEQ ID NO: 436563 - DNA, 20 bp, Artificial
  CRISPR gRNA sequence
tctccattaattattgtgac

SEQ ID NO: 436564 - DNA, 20 bp, Artificial
  CRISPR gRNA sequence
attaattattgtgacaagta

SEQ ID NO: 436565 - DNA, 20 bp, Artificial
  CRISPR gRNA sequence
taattattgtgacaagtacg

SEQ ID NO: 436566 - DNA, 20 bp, Artificial
  CRISPR gRNA sequence
ttattgtgacaagtacggag

SEQ ID NO: 436567 - DNA, 20 bp, Artificial
  CRISPR gRNA sequence
ggagtagaattcatttcaaa

SEQ ID NO: 436568 - DNA, 20 bp, Artificial
  CRISPR gRNA sequence
gagtagaattcatttcaaat

SEQ ID NO: 436569 - DNA, 20 bp, Artificial
  CRISPR gRNA sequence
attcatttcaaataggatta

SEQ ID NO: 436570 - DNA, 20 bp, Artificial
  CRISPR gRNA sequence
ttcatttcaaataggattat

SEQ ID NO: 436571 - DNA, 20 bp, Artificial
  CRISPR gRNA sequence
ataggattataggcatcatt

SEQ ID NO: 436572 - DNA, 20 bp, Artificial
  CRISPR gRNA sequence
attaagattttttaaaaact

SEQ ID NO: 436573 - DNA, 20 bp, Artificial
  CRISPR gRNA sequence
ttttttaaaaacttagataa

SEQ ID NO: 436574 - DNA, 20 bp, Artificial
  CRISPR gRNA sequence
aacgttcttaactatactat

SEQ ID NO: 436575 - DNA, 20 bp, Artificial
  CRISPR gRNA sequence
tctctctctctctcttttta

SEQ ID NO: 436576 - DNA, 20 bp, Artificial
  CRISPR gRNA sequence
ctctctctctctttttatag

SEQ ID NO: 436577 - DNA, 20 bp, Artificial
  CRISPR gRNA sequence
ctctctctctttttatagca

SEQ ID NO: 436578 - DNA, 20 bp, Artificial
  CRISPR gRNA sequence
ctctttttatagcagagaca

SEQ ID NO: 436579 - DNA, 20 bp, Artificial
  CRISPR gRNA sequence
tatagcagagacacagacac

SEQ ID NO: 436580 - DNA, 20 bp, Artificial
  CRISPR gRNA sequence
atagcagagacacagacact

SEQ ID NO: 436581 - DNA, 20 bp, Artificial
  CRISPR gRNA sequence
tagcagagacacagacactg

SEQ ID NO: 436582 - DNA, 20 bp, Artificial
  CRISPR gRNA sequence
gcagagacacagacactggg

SEQ ID NO: 436583 - DNA, 20 bp, Artificial
  CRISPR gRNA sequence
cctccctgatataaatctaa

SEQ ID NO: 436584 - DNA, 20 bp, Artificial
  CRISPR gRNA sequence
cctgatataaatctaacagt

SEQ ID NO: 436585 - DNA, 20 bp, Artificial
  CRISPR gRNA sequence
cagtaagtaactttttttgt

SEQ ID NO: 436586 - DNA, 20 bp, Artificial
  CRISPR gRNA sequence
gagctatgttgtactcaact

SEQ ID NO: 436587 - DNA, 20 bp, Artificial
  CRISPR gRNA sequence
gctatgttgtactcaacttg

SEQ ID NO: 436588 - DNA, 20 bp, Artificial
  CRISPR gRNA sequence
ctatgttgtactcaacttgg

SEQ ID NO: 436589 - DNA, 20 bp, Artificial
  CRISPR gRNA sequence
tatgttgtactcaacttgga

SEQ ID NO: 436590 - DNA, 20 bp, Artificial
  CRISPR gRNA sequence
atgttgtactcaacttggag

SEQ ID NO: 436591 - DNA, 20 bp, Artificial
  CRISPR gRNA sequence
tcaacttggaggggaaatca

SEQ ID NO: 436592 - DNA, 20 bp, Artificial
  CRISPR gRNA sequence
tggaggggaaatcatggctt

SEQ ID NO: 436593 - DNA, 20 bp, Artificial
  CRISPR gRNA sequence
cttcatgcccaccttgtcct

SEQ ID NO: 436594 - DNA, 20 bp, Artificial
  CRISPR gRNA sequence
ttcatgcccaccttgtcctt

SEQ ID NO: 436595 - DNA, 20 bp, Artificial
  CRISPR gRNA sequence
tcatgcccaccttgtccttg

SEQ ID NO: 436596 - DNA, 20 bp, Artificial
  CRISPR gRNA sequence
caccttgtccttggggtaaa

SEQ ID NO: 436597 - DNA, 20 bp, Artificial
  CRISPR gRNA sequence
tccttggggtaaaaagcctt

SEQ ID NO: 436598 - DNA, 20 bp, Artificial
  CRISPR gRNA sequence
taaaaagccttaagttccct

SEQ ID NO: 436599 - DNA, 20 bp, Artificial
  CRISPR gRNA sequence
gccttaagttcccttagctt

SEQ ID NO: 436600 - DNA, 20 bp, Artificial
  CRISPR gRNA sequence
ttcccttagcttcagattcc

SEQ ID NO: 436601 - DNA, 20 bp, Artificial
  CRISPR gRNA sequence
tcccttagcttcagattcct

SEQ ID NO: 436602 - DNA, 20 bp, Artificial
  CRISPR gRNA sequence
ctgtaacatgttgatgatga

SEQ ID NO: 436603 - DNA, 20 bp, Artificial
  CRISPR gRNA sequence
tgatgacagttctaacctca

SEQ ID NO: 436604 - DNA, 20 bp, Artificial
  CRISPR gRNA sequence
gatgacagttctaacctcat

SEQ ID NO: 436605 - DNA, 20 bp, Artificial
  CRISPR gRNA sequence
ctcataggcctgctgtaatg

SEQ ID NO: 436606 - DNA, 20 bp, Artificial
  CRISPR gRNA sequence
tcataggcctgctgtaatga

SEQ ID NO: 436607 - DNA, 20 bp, Artificial
  CRISPR gRNA sequence
ggactgacatgatgtgtgta

SEQ ID NO: 436608 - DNA, 20 bp, Artificial
  CRISPR gRNA sequence
catgatgtgtgtaaagtgcc

SEQ ID NO: 436609 - DNA, 20 bp, Artificial
  CRISPR gRNA sequence
tgtgtaaagtgcctggcata

SEQ ID NO: 436610 - DNA, 20 bp, Artificial
  CRISPR gRNA sequence
taaagtgcctggcatatagt

SEQ ID NO: 436611 - DNA, 20 bp, Artificial
  CRISPR gRNA sequence
aagtgcctggcatatagtaa

SEQ ID NO: 436612 - DNA, 20 bp, Artificial
  CRISPR gRNA sequence
gtaagagcttgaaaaccaca

SEQ ID NO: 436613 - DNA, 20 bp, Artificial
  CRISPR gRNA sequence
agagcttgaaaaccacaaag

SEQ ID NO: 436614 - DNA, 20 bp, Artificial
  CRISPR gRNA sequence
aaaccacaaagaagaaacat

SEQ ID NO: 436615 - DNA, 20 bp, Artificial
  CRISPR gRNA sequence
tttcacaactgtctaccctg

SEQ ID NO: 436616 - DNA, 20 bp, Artificial
  CRISPR gRNA sequence
cacaactgtctaccctgtgg

SEQ ID NO: 436617 - DNA, 20 bp, Artificial
  CRISPR gRNA sequence
acaactgtctaccctgtgga

SEQ ID NO: 436618 - DNA, 20 bp, Artificial
  CRISPR gRNA sequence
tctaccctgtggaaggttca

SEQ ID NO: 436619 - DNA, 20 bp, Artificial
  CRISPR gRNA sequence
tcaaagattcttcatctccc

SEQ ID NO: 436620 - DNA, 20 bp, Artificial
  CRISPR gRNA sequence
tgcttccattgcaatcctaa

SEQ ID NO: 436621 - DNA, 20 bp, Artificial
  CRISPR gRNA sequence
gcttccattgcaatcctaat

SEQ ID NO: 436622 - DNA, 20 bp, Artificial
  CRISPR gRNA sequence
ccattgcaatcctaatggga

SEQ ID NO: 436623 - DNA, 20 bp, Artificial
  CRISPR gRNA sequence
attgcaatcctaatgggaaa

SEQ ID NO: 436624 - DNA, 20 bp, Artificial
  CRISPR gRNA sequence
taaatttatctctttaaata

SEQ ID NO: 436625 - DNA, 20 bp, Artificial
  CRISPR gRNA sequence
tttatctctttaaatatggc

SEQ ID NO: 436626 - DNA, 20 bp, Artificial
  CRISPR gRNA sequence
ctttaaatatggcaagacac

SEQ ID NO: 436627 - DNA, 20 bp, Artificial
  CRISPR gRNA sequence
aaatatggcaagacaccagt

SEQ ID NO: 436628 - DNA, 20 bp, Artificial
  CRISPR gRNA sequence
aatatggcaagacaccagtc

SEQ ID NO: 436629 - DNA, 20 bp, Artificial
  CRISPR gRNA sequence
acaccagtcaggaatattca

SEQ ID NO: 436630 - DNA, 20 bp, Artificial
  CRISPR gRNA sequence
agtcaggaatattcaaagtg

SEQ ID NO: 436631 - DNA, 20 bp, Artificial
  CRISPR gRNA sequence
tcaggaatattcaaagtgaa

SEQ ID NO: 436632 - DNA, 20 bp, Artificial
  CRISPR gRNA sequence
caggaatattcaaagtgaag

SEQ ID NO: 436633 - DNA, 20 bp, Artificial
  CRISPR gRNA sequence
aggttttttttttttttttt

SEQ ID NO: 436634 - DNA, 20 bp, Artificial
  CRISPR gRNA sequence
tttttttttttttttttaga

SEQ ID NO: 436635 - DNA, 20 bp, Artificial
  CRISPR gRNA sequence
agaatttcgctcttgttgcc

SEQ ID NO: 436636 - DNA, 20 bp, Artificial
  CRISPR gRNA sequence
gaatttcgctcttgttgccc

SEQ ID NO: 436637 - DNA, 20 bp, Artificial
  CRISPR gRNA sequence
ttcgctcttgttgcccaggc

SEQ ID NO: 436638 - DNA, 20 bp, Artificial
  CRISPR gRNA sequence
cgctcttgttgcccaggctg

SEQ ID NO: 436639 - DNA, 20 bp, Artificial
  CRISPR gRNA sequence
tgttgcccaggctggagtgc

SEQ ID NO: 436640 - DNA, 20 bp, Artificial
  CRISPR gRNA sequence
gttgcccaggctggagtgca

SEQ ID NO: 436641 - DNA, 20 bp, Artificial
  CRISPR gRNA sequence
ttgcccaggctggagtgcaa

SEQ ID NO: 436642 - DNA, 20 bp, Artificial
  CRISPR gRNA sequence
ggagtgcaagggtgtgatcc

SEQ ID NO: 436643 - DNA, 20 bp, Artificial
  CRISPR gRNA sequence
tcacctcaacctccgcctcc

SEQ ID NO: 436644 - DNA, 20 bp, Artificial
  CRISPR gRNA sequence
cacctcaacctccgcctccc

SEQ ID NO: 436645 - DNA, 20 bp, Artificial
  CRISPR gRNA sequence
aacctccgcctcccgggttc

SEQ ID NO: 436646 - DNA, 20 bp, Artificial
  CRISPR gRNA sequence
ttcaagcgattctcctgcct

SEQ ID NO: 436647 - DNA, 20 bp, Artificial
  CRISPR gRNA sequence
ttctcctgcctcagccttcc

SEQ ID NO: 436648 - DNA, 20 bp, Artificial
  CRISPR gRNA sequence
tcctgcctcagccttccgag

SEQ ID NO: 436649 - DNA, 20 bp, Artificial
  CRISPR gRNA sequence
gcctcagccttccgagtagc

SEQ ID NO: 436650 - DNA, 20 bp, Artificial
  CRISPR gRNA sequence
cctcagccttccgagtagct

SEQ ID NO: 436651 - DNA, 20 bp, Artificial
  CRISPR gRNA sequence
cttccgagtagctgggatta

SEQ ID NO: 436652 - DNA, 20 bp, Artificial
  CRISPR gRNA sequence
ttccgagtagctgggattac

SEQ ID NO: 436653 - DNA, 20 bp, Artificial
  CRISPR gRNA sequence
gtagctgggattacaggcat

SEQ ID NO: 436654 - DNA, 20 bp, Artificial
  CRISPR gRNA sequence
caggcatgagccaccacacc

SEQ ID NO: 436655 - DNA, 20 bp, Artificial
  CRISPR gRNA sequence
ccggctaatttttttatttt

SEQ ID NO: 436656 - DNA, 20 bp, Artificial
  CRISPR gRNA sequence
gctaatttttttatttttag

SEQ ID NO: 436657 - DNA, 20 bp, Artificial
  CRISPR gRNA sequence
taatttttttatttttagta

SEQ ID NO: 436658 - DNA, 20 bp, Artificial
  CRISPR gRNA sequence
ttttttatttttagtagaga

SEQ ID NO: 436659 - DNA, 20 bp, Artificial
  CRISPR gRNA sequence
ttttatttttagtagagacg

SEQ ID NO: 436660 - DNA, 20 bp, Artificial
  CRISPR gRNA sequence
gagacggagtttcaccacat

SEQ ID NO: 436661 - DNA, 20 bp, Artificial
  CRISPR gRNA sequence
cggagtttcaccacattggc

SEQ ID NO: 436662 - DNA, 20 bp, Artificial
  CRISPR gRNA sequence
ggagtttcaccacattggcc

SEQ ID NO: 436663 - DNA, 20 bp, Artificial
  CRISPR gRNA sequence
tgatcttgaactcctgacct

SEQ ID NO: 436664 - DNA, 20 bp, Artificial
  CRISPR gRNA sequence
gatcttgaactcctgacctc

SEQ ID NO: 436665 - DNA, 20 bp, Artificial
  CRISPR gRNA sequence
ctcaggtgatccacctgcct

SEQ ID NO: 436666 - DNA, 20 bp, Artificial
  CRISPR gRNA sequence
ccacctgcctcggcctccca

SEQ ID NO: 436667 - DNA, 20 bp, Artificial
  CRISPR gRNA sequence
cctcggcctcccaaagtgct

SEQ ID NO: 436668 - DNA, 20 bp, Artificial
  CRISPR gRNA sequence
ctcccaaagtgctgagattg

SEQ ID NO: 436669 - DNA, 20 bp, Artificial
  CRISPR gRNA sequence
tcccaaagtgctgagattgc

SEQ ID NO: 436670 - DNA, 20 bp, Artificial
  CRISPR gRNA sequence
agtgctgagattgcaggcgt

SEQ ID NO: 436671 - DNA, 20 bp, Artificial
  CRISPR gRNA sequence
gagattgcaggcgtgagcca

SEQ ID NO: 436672 - DNA, 20 bp, Artificial
  CRISPR gRNA sequence
caggcgtgagccatggcacc

SEQ ID NO: 436673 - DNA, 20 bp, Artificial
  CRISPR gRNA sequence
ctggcctaattttgtatttt

SEQ ID NO: 436674 - DNA, 20 bp, Artificial
  CRISPR gRNA sequence
gcctaattttgtatttttag

SEQ ID NO: 436675 - DNA, 20 bp, Artificial
  CRISPR gRNA sequence
ctaattttgtatttttagta

SEQ ID NO: 436676 - DNA, 20 bp, Artificial
  CRISPR gRNA sequence
ttttgtatttttagtagaga

SEQ ID NO: 436677 - DNA, 20 bp, Artificial
  CRISPR gRNA sequence
tttgtatttttagtagagac

SEQ ID NO: 436678 - DNA, 20 bp, Artificial
  CRISPR gRNA sequence
ttgtatttttagtagagaca

SEQ ID NO: 436679 - DNA, 20 bp, Artificial
  CRISPR gRNA sequence
gagacagggtttctccatgt

SEQ ID NO: 436680 - DNA, 20 bp, Artificial
  CRISPR gRNA sequence
cagggtttctccatgttggt

SEQ ID NO: 436681 - DNA, 20 bp, Artificial
  CRISPR gRNA sequence
agggtttctccatgttggtc

SEQ ID NO: 436682 - DNA, 20 bp, Artificial
  CRISPR gRNA sequence
tttctccatgttggtcaggc

SEQ ID NO: 436683 - DNA, 20 bp, Artificial
  CRISPR gRNA sequence
tggtcttgaactcctgacct

SEQ ID NO: 436684 - DNA, 20 bp, Artificial
  CRISPR gRNA sequence
ggtcttgaactcctgacctc

SEQ ID NO: 436685 - DNA, 20 bp, Artificial
  CRISPR gRNA sequence
ctcaggtgatccgcccaact

SEQ ID NO: 436686 - DNA, 20 bp, Artificial
  CRISPR gRNA sequence
ccgcccaacttggcctccca

SEQ ID NO: 436687 - DNA, 20 bp, Artificial
  CRISPR gRNA sequence
aacttggcctcccaaagtgc

SEQ ID NO: 436688 - DNA, 20 bp, Artificial
  CRISPR gRNA sequence
acttggcctcccaaagtgct

SEQ ID NO: 436689 - DNA, 20 bp, Artificial
  CRISPR gRNA sequence
ctcccaaagtgctgggatta

SEQ ID NO: 436690 - DNA, 20 bp, Artificial
  CRISPR gRNA sequence
tcccaaagtgctgggattac

SEQ ID NO: 436691 - DNA, 20 bp, Artificial
  CRISPR gRNA sequence
agtgctgggattacaggcat

SEQ ID NO: 436692 - DNA, 20 bp, Artificial
  CRISPR gRNA sequence
gggattacaggcatgagcca

SEQ ID NO: 436693 - DNA, 20 bp, Artificial
  CRISPR gRNA sequence
caggcatgagccatggtgcc

SEQ ID NO: 436694 - DNA, 20 bp, Artificial
  CRISPR gRNA sequence
catgagccatggtgcccagc

SEQ ID NO: 436695 - DNA, 20 bp, Artificial
  CRISPR gRNA sequence
tatgtatttaactataaata

SEQ ID NO: 436696 - DNA, 20 bp, Artificial
  CRISPR gRNA sequence
tactgtccctgctaccttct

SEQ ID NO: 436697 - DNA, 20 bp, Artificial
  CRISPR gRNA sequence
ctgctaccttctcagaataa

SEQ ID NO: 436698 - DNA, 20 bp, Artificial
  CRISPR gRNA sequence
tctcagaataaaagaaaaac

SEQ ID NO: 436699 - DNA, 20 bp, Artificial
  CRISPR gRNA sequence
agaataaaagaaaaactggc

SEQ ID NO: 436700 - DNA, 20 bp, Artificial
  CRISPR gRNA sequence
gaataaaagaaaaactggct

SEQ ID NO: 436701 - DNA, 20 bp, Artificial
  CRISPR gRNA sequence
aaagaaaaactggctgggcg

SEQ ID NO: 436702 - DNA, 20 bp, Artificial
  CRISPR gRNA sequence
gtgactcacgtctgtaatcc

SEQ ID NO: 436703 - DNA, 20 bp, Artificial
  CRISPR gRNA sequence
cgtctgtaatcccagcactt

SEQ ID NO: 436704 - DNA, 20 bp, Artificial
  CRISPR gRNA sequence
gtctgtaatcccagcacttt

SEQ ID NO: 436705 - DNA, 20 bp, Artificial
  CRISPR gRNA sequence
ctgtaatcccagcactttgg

SEQ ID NO: 436706 - DNA, 20 bp, Artificial
  CRISPR gRNA sequence
tgtaatcccagcactttggg

SEQ ID NO: 436707 - DNA, 20 bp, Artificial
  CRISPR gRNA sequence
tcccagcactttgggaggct

SEQ ID NO: 436708 - DNA, 20 bp, Artificial
  CRISPR gRNA sequence
cagcactttgggaggctaag

SEQ ID NO: 436709 - DNA, 20 bp, Artificial
  CRISPR gRNA sequence
agcactttgggaggctaagt

SEQ ID NO: 436710 - DNA, 20 bp, Artificial
  CRISPR gRNA sequence
gcactttgggaggctaagta

SEQ ID NO: 436711 - DNA, 20 bp, Artificial
  CRISPR gRNA sequence
ctttgggaggctaagtaggg

SEQ ID NO: 436712 - DNA, 20 bp, Artificial
  CRISPR gRNA sequence
aagtagggtggatcacctgt

SEQ ID NO: 436713 - DNA, 20 bp, Artificial
  CRISPR gRNA sequence
agtagggtggatcacctgtc

SEQ ID NO: 436714 - DNA, 20 bp, Artificial
  CRISPR gRNA sequence
gtagggtggatcacctgtca

SEQ ID NO: 436715 - DNA, 20 bp, Artificial
  CRISPR gRNA sequence
tagggtggatcacctgtcag

SEQ ID NO: 436716 - DNA, 20 bp, Artificial
  CRISPR gRNA sequence
ggatcacctgtcaggggttt

SEQ ID NO: 436717 - DNA, 20 bp, Artificial
  CRISPR gRNA sequence
acctgtcaggggtttgagac

SEQ ID NO: 436718 - DNA, 20 bp, Artificial
  CRISPR gRNA sequence
tcaggggtttgagaccagcc

SEQ ID NO: 436719 - DNA, 20 bp, Artificial
  CRISPR gRNA sequence
tgagaccagcctggtcaaca

SEQ ID NO: 436720 - DNA, 20 bp, Artificial
  CRISPR gRNA sequence
ctactaaaaatacaaaaaat

SEQ ID NO: 436721 - DNA, 20 bp, Artificial
  CRISPR gRNA sequence
taaaaatacaaaaaattagc

SEQ ID NO: 436722 - DNA, 20 bp, Artificial
  CRISPR gRNA sequence
aaaaatacaaaaaattagcc

SEQ ID NO: 436723 - DNA, 20 bp, Artificial
  CRISPR gRNA sequence
tacaaaaaattagccaggta

SEQ ID NO: 436724 - DNA, 20 bp, Artificial
  CRISPR gRNA sequence
aaaaaattagccaggtatgg

SEQ ID NO: 436725 - DNA, 20 bp, Artificial
  CRISPR gRNA sequence
tatggtggtgtgtgcctgtg

SEQ ID NO: 436726 - DNA, 20 bp, Artificial
  CRISPR gRNA sequence
ggtgtgtgcctgtgtagtct

SEQ ID NO: 436727 - DNA, 20 bp, Artificial
  CRISPR gRNA sequence
cctgtgtagtctcagctact

SEQ ID NO: 436728 - DNA, 20 bp, Artificial
  CRISPR gRNA sequence
ctgtgtagtctcagctactc

SEQ ID NO: 436729 - DNA, 20 bp, Artificial
  CRISPR gRNA sequence
gtgtagtctcagctactcag

SEQ ID NO: 436730 - DNA, 20 bp, Artificial
  CRISPR gRNA sequence
tgtagtctcagctactcagg

SEQ ID NO: 436731 - DNA, 20 bp, Artificial
  CRISPR gRNA sequence
tctcagctactcaggaggct

SEQ ID NO: 436732 - DNA, 20 bp, Artificial
  CRISPR gRNA sequence
agctactcaggaggctgaga

SEQ ID NO: 436733 - DNA, 20 bp, Artificial
  CRISPR gRNA sequence
gctactcaggaggctgagac

SEQ ID NO: 436734 - DNA, 20 bp, Artificial
  CRISPR gRNA sequence
tactcaggaggctgagacag

SEQ ID NO: 436735 - DNA, 20 bp, Artificial
  CRISPR gRNA sequence
acaggagaatcgcttgaatc

SEQ ID NO: 436736 - DNA, 20 bp, Artificial
  CRISPR gRNA sequence
caggagaatcgcttgaatcc

SEQ ID NO: 436737 - DNA, 20 bp, Artificial
  CRISPR gRNA sequence
ggagaatcgcttgaatccag

SEQ ID NO: 436738 - DNA, 20 bp, Artificial
  CRISPR gRNA sequence
gagaatcgcttgaatccagg

SEQ ID NO: 436739 - DNA, 20 bp, Artificial
  CRISPR gRNA sequence
aatcgcttgaatccaggagg

SEQ ID NO: 436740 - DNA, 20 bp, Artificial
  CRISPR gRNA sequence
tcgcttgaatccaggaggtg

SEQ ID NO: 436741 - DNA, 20 bp, Artificial
  CRISPR gRNA sequence
cgcttgaatccaggaggtgg

SEQ ID NO: 436742 - DNA, 20 bp, Artificial
  CRISPR gRNA sequence
aatccaggaggtggaggttg

SEQ ID NO: 436743 - DNA, 20 bp, Artificial
  CRISPR gRNA sequence
caggaggtggaggttgcagt

SEQ ID NO: 436744 - DNA, 20 bp, Artificial
  CRISPR gRNA sequence
ggtggaggttgcagtgagct

SEQ ID NO: 436745 - DNA, 20 bp, Artificial
  CRISPR gRNA sequence
gtggaggttgcagtgagctg

SEQ ID NO: 436746 - DNA, 20 bp, Artificial
  CRISPR gRNA sequence
gaggtcgcgccactgcacac

SEQ ID NO: 436747 - DNA, 20 bp, Artificial
  CRISPR gRNA sequence
cgcgccactgcacaccagcc

SEQ ID NO: 436748 - DNA, 20 bp, Artificial
  CRISPR gRNA sequence
gcgccactgcacaccagcct

SEQ ID NO: 436749 - DNA, 20 bp, Artificial
  CRISPR gRNA sequence
tgcacaccagcctgggcaac

SEQ ID NO: 436750 - DNA, 20 bp, Artificial
  CRISPR gRNA sequence
cacaccagcctgggcaacaa

SEQ ID NO: 436751 - DNA, 20 bp, Artificial
  CRISPR gRNA sequence
agagcgaaattccctcataa

SEQ ID NO: 436752 - DNA, 20 bp, Artificial
  CRISPR gRNA sequence
cctcataaaagaaaaaccac

SEQ ID NO: 436753 - DNA, 20 bp, Artificial
  CRISPR gRNA sequence
cataaaagaaaaaccactag

SEQ ID NO: 436754 - DNA, 20 bp, Artificial
  CRISPR gRNA sequence
ataaaagaaaaaccactaga

SEQ ID NO: 436755 - DNA, 20 bp, Artificial
  CRISPR gRNA sequence
aagaaaaaccactagaaggc

SEQ ID NO: 436756 - DNA, 20 bp, Artificial
  CRISPR gRNA sequence
accactagaaggcaagcttg

SEQ ID NO: 436757 - DNA, 20 bp, Artificial
  CRISPR gRNA sequence
caatgacttaaaaattcttt

SEQ ID NO: 436758 - DNA, 20 bp, Artificial
  CRISPR gRNA sequence
aatgacttaaaaattctttg

SEQ ID NO: 436759 - DNA, 20 bp, Artificial
  CRISPR gRNA sequence
tgacttaaaaattctttgag

SEQ ID NO: 436760 - DNA, 20 bp, Artificial
  CRISPR gRNA sequence
gacttaaaaattctttgagg

SEQ ID NO: 436761 - DNA, 20 bp, Artificial
  CRISPR gRNA sequence
taaaaattctttgaggaggc

SEQ ID NO: 436762 - DNA, 20 bp, Artificial
  CRISPR gRNA sequence
aaaaattctttgaggaggcc

SEQ ID NO: 436763 - DNA, 20 bp, Artificial
  CRISPR gRNA sequence
ttctttgaggaggccgggca

SEQ ID NO: 436764 - DNA, 20 bp, Artificial
  CRISPR gRNA sequence
gtgtctcatgcctgtaatcc

SEQ ID NO: 436765 - DNA, 20 bp, Artificial
  CRISPR gRNA sequence
tgcctgtaatcccagcactt

SEQ ID NO: 436766 - DNA, 20 bp, Artificial
  CRISPR gRNA sequence
gcctgtaatcccagcacttt

SEQ ID NO: 436767 - DNA, 20 bp, Artificial
  CRISPR gRNA sequence
ctgtaatcccagcactttag

SEQ ID NO: 436768 - DNA, 20 bp, Artificial
  CRISPR gRNA sequence
tgtaatcccagcactttagg

SEQ ID NO: 436769 - DNA, 20 bp, Artificial
  CRISPR gRNA sequence
tcccagcactttaggaggcc

SEQ ID NO: 436770 - DNA, 20 bp, Artificial
  CRISPR gRNA sequence
cccagcactttaggaggcca

SEQ ID NO: 436771 - DNA, 20 bp, Artificial
  CRISPR gRNA sequence
agcactttaggaggccaagg

SEQ ID NO: 436772 - DNA, 20 bp, Artificial
  CRISPR gRNA sequence
actttaggaggccaaggtgg

SEQ ID NO: 436773 - DNA, 20 bp, Artificial
  CRISPR gRNA sequence
ctttaggaggccaaggtgga

SEQ ID NO: 436774 - DNA, 20 bp, Artificial
  CRISPR gRNA sequence
ccaaggtggaaggaatgctt

SEQ ID NO: 436775 - DNA, 20 bp, Artificial
  CRISPR gRNA sequence
gtggaaggaatgcttgagac

SEQ ID NO: 436776 - DNA, 20 bp, Artificial
  CRISPR gRNA sequence
tggaaggaatgcttgagacc

SEQ ID NO: 436777 - DNA, 20 bp, Artificial
  CRISPR gRNA sequence
gaaggaatgcttgagaccag

SEQ ID NO: 436778 - DNA, 20 bp, Artificial
  CRISPR gRNA sequence
atgcttgagaccaggagttt

SEQ ID NO: 436779 - DNA, 20 bp, Artificial
  CRISPR gRNA sequence
tgagaccaggagtttgagac

SEQ ID NO: 436780 - DNA, 20 bp, Artificial
  CRISPR gRNA sequence
ccaggagtttgagactagcc

SEQ ID NO: 436781 - DNA, 20 bp, Artificial
  CRISPR gRNA sequence
caggagtttgagactagcct

SEQ ID NO: 436782 - DNA, 20 bp, Artificial
  CRISPR gRNA sequence
tgagactagcctgggccaca

SEQ ID NO: 436783 - DNA, 20 bp, Artificial
  CRISPR gRNA sequence
aaaaaatattttttaaaatt

SEQ ID NO: 436784 - DNA, 20 bp, Artificial
  CRISPR gRNA sequence
aatattttttaaaatttggc

SEQ ID NO: 436785 - DNA, 20 bp, Artificial
  CRISPR gRNA sequence
atattttttaaaatttggcc

SEQ ID NO: 436786 - DNA, 20 bp, Artificial
  CRISPR gRNA sequence
ttttaaaatttggccaggca

SEQ ID NO: 436787 - DNA, 20 bp, Artificial
  CRISPR gRNA sequence
ggcatggtgctgcaaacctg

SEQ ID NO: 436788 - DNA, 20 bp, Artificial
  CRISPR gRNA sequence
gtgctgcaaacctgtagttc

SEQ ID NO: 436789 - DNA, 20 bp, Artificial
  CRISPR gRNA sequence
aacctgtagttccagctact

SEQ ID NO: 436790 - DNA, 20 bp, Artificial
  CRISPR gRNA sequence
acctgtagttccagctactt

SEQ ID NO: 436791 - DNA, 20 bp, Artificial
  CRISPR gRNA sequence
ctgtagttccagctacttgg

SEQ ID NO: 436792 - DNA, 20 bp, Artificial
  CRISPR gRNA sequence
tgtagttccagctacttggg

SEQ ID NO: 436793 - DNA, 20 bp, Artificial
  CRISPR gRNA sequence
ttccagctacttgggaggct

SEQ ID NO: 436794 - DNA, 20 bp, Artificial
  CRISPR gRNA sequence
tccagctacttgggaggctg

SEQ ID NO: 436795 - DNA, 20 bp, Artificial
  CRISPR gRNA sequence
agctacttgggaggctgagg

SEQ ID NO: 436796 - DNA, 20 bp, Artificial
  CRISPR gRNA sequence
gctacttgggaggctgaggc

SEQ ID NO: 436797 - DNA, 20 bp, Artificial
  CRISPR gRNA sequence
tacttgggaggctgaggcag

SEQ ID NO: 436798 - DNA, 20 bp, Artificial
  CRISPR gRNA sequence
acttgggaggctgaggcagg

SEQ ID NO: 436799 - DNA, 20 bp, Artificial
  CRISPR gRNA sequence
ctgaggcaggaggatcactt

SEQ ID NO: 436800 - DNA, 20 bp, Artificial
  CRISPR gRNA sequence
gcaggaggatcacttgagcc

SEQ ID NO: 436801 - DNA, 20 bp, Artificial
  CRISPR gRNA sequence
ggaggatcacttgagcccag

SEQ ID NO: 436802 - DNA, 20 bp, Artificial
  CRISPR gRNA sequence
gaggatcacttgagcccagt

SEQ ID NO: 436803 - DNA, 20 bp, Artificial
  CRISPR gRNA sequence
tcacttgagcccagtaggtt

SEQ ID NO: 436804 - DNA, 20 bp, Artificial
  CRISPR gRNA sequence
cacttgagcccagtaggttg

SEQ ID NO: 436805 - DNA, 20 bp, Artificial
  CRISPR gRNA sequence
cagtaggttgaggctgcatt

SEQ ID NO: 436806 - DNA, 20 bp, Artificial
  CRISPR gRNA sequence
catgcccctgcactccatcc

SEQ ID NO: 436807 - DNA, 20 bp, Artificial
  CRISPR gRNA sequence
atgcccctgcactccatcct

SEQ ID NO: 436808 - DNA, 20 bp, Artificial
  CRISPR gRNA sequence
ctgcactccatcctaggtga

SEQ ID NO: 436809 - DNA, 20 bp, Artificial
  CRISPR gRNA sequence
tgcactccatcctaggtgac

SEQ ID NO: 436810 - DNA, 20 bp, Artificial
  CRISPR gRNA sequence
gcactccatcctaggtgaca

SEQ ID NO: 436811 - DNA, 20 bp, Artificial
  CRISPR gRNA sequence
tccatcctaggtgacagggc

SEQ ID NO: 436812 - DNA, 20 bp, Artificial
  CRISPR gRNA sequence
ccatcctaggtgacagggca

SEQ ID NO: 436813 - DNA, 20 bp, Artificial
  CRISPR gRNA sequence
aaaaaaaaaaaaaattactt

SEQ ID NO: 436814 - DNA, 20 bp, Artificial
  CRISPR gRNA sequence
aaaaaaaaaaaaattacttg

SEQ ID NO: 436815 - DNA, 20 bp, Artificial
  CRISPR gRNA sequence
aaaaaaaaaaaattacttga

SEQ ID NO: 436816 - DNA, 20 bp, Artificial
  CRISPR gRNA sequence
aaattacttgagggcatatc

SEQ ID NO: 436817 - DNA, 20 bp, Artificial
  CRISPR gRNA sequence
aattacttgagggcatatcc

SEQ ID NO: 436818 - DNA, 20 bp, Artificial
  CRISPR gRNA sequence
ttacttgagggcatatccag

SEQ ID NO: 436819 - DNA, 20 bp, Artificial
  CRISPR gRNA sequence
gagcccacatttatttgact

SEQ ID NO: 436820 - DNA, 20 bp, Artificial
  CRISPR gRNA sequence
gtgtattcacaactgatgct

SEQ ID NO: 436821 - DNA, 20 bp, Artificial
  CRISPR gRNA sequence
cttctctctttgcaatcaaa

SEQ ID NO: 436822 - DNA, 20 bp, Artificial
  CRISPR gRNA sequence
gcaatcaaacagtgcttttt

SEQ ID NO: 436823 - DNA, 20 bp, Artificial
  CRISPR gRNA sequence
caatcaaacagtgcttttta

SEQ ID NO: 436824 - DNA, 20 bp, Artificial
  CRISPR gRNA sequence
aatgcacaatatcttgcata

SEQ ID NO: 436825 - DNA, 20 bp, Artificial
  CRISPR gRNA sequence
atgcacaatatcttgcatat

SEQ ID NO: 436826 - DNA, 20 bp, Artificial
  CRISPR gRNA sequence
atataggactcctgttattg

SEQ ID NO: 436827 - DNA, 20 bp, Artificial
  CRISPR gRNA sequence
tataggactcctgttattgc

SEQ ID NO: 436828 - DNA, 20 bp, Artificial
  CRISPR gRNA sequence
taggactcctgttattgcag

SEQ ID NO: 436829 - DNA, 20 bp, Artificial
  CRISPR gRNA sequence
gtaaatgtatattgaataaa

SEQ ID NO: 436830 - DNA, 20 bp, Artificial
  CRISPR gRNA sequence
aatgtatattgaataaatgg

SEQ ID NO: 436831 - DNA, 20 bp, Artificial
  CRISPR gRNA sequence
gtgtgtgtgttttgtataaa

SEQ ID NO: 436832 - DNA, 20 bp, Artificial
  CRISPR gRNA sequence
tgtgtgtgttttgtataaat

SEQ ID NO: 436833 - DNA, 20 bp, Artificial
  CRISPR gRNA sequence
gtgtgtgttttgtataaatg

SEQ ID NO: 436834 - DNA, 20 bp, Artificial
  CRISPR gRNA sequence
aaatggggtctcaatattat

SEQ ID NO: 436835 - DNA, 20 bp, Artificial
  CRISPR gRNA sequence
aatggggtctcaatattatt

SEQ ID NO: 436836 - DNA, 20 bp, Artificial
  CRISPR gRNA sequence
gggtctcaatattattaggc

SEQ ID NO: 436837 - DNA, 20 bp, Artificial
  CRISPR gRNA sequence
ttaggctggtccctaactcc

SEQ ID NO: 436838 - DNA, 20 bp, Artificial
  CRISPR gRNA sequence
ggtccctaactcctggtctc

SEQ ID NO: 436839 - DNA, 20 bp, Artificial
  CRISPR gRNA sequence
ctcaagtgatcctcccatct

SEQ ID NO: 436840 - DNA, 20 bp, Artificial
  CRISPR gRNA sequence
cctcccatctcagcttccca

SEQ ID NO: 436841 - DNA, 20 bp, Artificial
  CRISPR gRNA sequence
atctcagcttcccaaagtgc

SEQ ID NO: 436842 - DNA, 20 bp, Artificial
  CRISPR gRNA sequence
tctcagcttcccaaagtgct

SEQ ID NO: 436843 - DNA, 20 bp, Artificial
  CRISPR gRNA sequence
ttcccaaagtgctgggatta

SEQ ID NO: 436844 - DNA, 20 bp, Artificial
  CRISPR gRNA sequence
tcccaaagtgctgggattat

SEQ ID NO: 436845 - DNA, 20 bp, Artificial
  CRISPR gRNA sequence
agtgctgggattataggtgt

SEQ ID NO: 436846 - DNA, 20 bp, Artificial
  CRISPR gRNA sequence
tgggattataggtgtgagcc

SEQ ID NO: 436847 - DNA, 20 bp, Artificial
  CRISPR gRNA sequence
ttaatttattatttattttt

SEQ ID NO: 436848 - DNA, 20 bp, Artificial
  CRISPR gRNA sequence
tttattatttatttttgaga

SEQ ID NO: 436849 - DNA, 20 bp, Artificial
  CRISPR gRNA sequence
tattatttatttttgagatg

SEQ ID NO: 436850 - DNA, 20 bp, Artificial
  CRISPR gRNA sequence
ggagttttgctcttgtcgcc

SEQ ID NO: 436851 - DNA, 20 bp, Artificial
  CRISPR gRNA sequence
gagttttgctcttgtcgccc

SEQ ID NO: 436852 - DNA, 20 bp, Artificial
  CRISPR gRNA sequence
tttgctcttgtcgcccaggc

SEQ ID NO: 436853 - DNA, 20 bp, Artificial
  CRISPR gRNA sequence
tgctcttgtcgcccaggctg

SEQ ID NO: 436854 - DNA, 20 bp, Artificial
  CRISPR gRNA sequence
tcgcccaggctggagtacaa

SEQ ID NO: 436855 - DNA, 20 bp, Artificial
  CRISPR gRNA sequence
ggagtacaatggcacaacct

SEQ ID NO: 436856 - DNA, 20 bp, Artificial
  CRISPR gRNA sequence
tcactgcaacctctgcctcc

SEQ ID NO: 436857 - DNA, 20 bp, Artificial
  CRISPR gRNA sequence
cactgcaacctctgcctcct

SEQ ID NO: 436858 - DNA, 20 bp, Artificial
  CRISPR gRNA sequence
aacctctgcctcctgggttc

SEQ ID NO: 436859 - DNA, 20 bp, Artificial
  CRISPR gRNA sequence
ttcaagcgattgtcctgcct

SEQ ID NO: 436860 - DNA, 20 bp, Artificial
  CRISPR gRNA sequence
tcctgcctcagcctcccaaa

SEQ ID NO: 436861 - DNA, 20 bp, Artificial
  CRISPR gRNA sequence
gcctcagcctcccaaatagc

SEQ ID NO: 436862 - DNA, 20 bp, Artificial
  CRISPR gRNA sequence
cctcagcctcccaaatagct

SEQ ID NO: 436863 - DNA, 20 bp, Artificial
  CRISPR gRNA sequence
ctcccaaatagctgggacta

SEQ ID NO: 436864 - DNA, 20 bp, Artificial
  CRISPR gRNA sequence
tcccaaatagctgggactat

SEQ ID NO: 436865 - DNA, 20 bp, Artificial
  CRISPR gRNA sequence
taggtgcccgccaccacacc

SEQ ID NO: 436866 - DNA, 20 bp, Artificial
  CRISPR gRNA sequence
ctggctaatttttgtatttt

SEQ ID NO: 436867 - DNA, 20 bp, Artificial
  CRISPR gRNA sequence
gctaatttttgtatttttag

SEQ ID NO: 436868 - DNA, 20 bp, Artificial
  CRISPR gRNA sequence
taatttttgtatttttagta

SEQ ID NO: 436869 - DNA, 20 bp, Artificial
  CRISPR gRNA sequence
ttttgtatttttagtagaga

SEQ ID NO: 436870 - DNA, 20 bp, Artificial
  CRISPR gRNA sequence
tttgtatttttagtagagat

SEQ ID NO: 436871 - DNA, 20 bp, Artificial
  CRISPR gRNA sequence
ttgtatttttagtagagatg

SEQ ID NO: 436872 - DNA, 20 bp, Artificial
  CRISPR gRNA sequence
gagatggggtttcaccatgt

SEQ ID NO: 436873 - DNA, 20 bp, Artificial
  CRISPR gRNA sequence
tggggtttcaccatgttggc

SEQ ID NO: 436874 - DNA, 20 bp, Artificial
  CRISPR gRNA sequence
ggggtttcaccatgttggcc

SEQ ID NO: 436875 - DNA, 20 bp, Artificial
  CRISPR gRNA sequence
tttcaccatgttggccaggc

SEQ ID NO: 436876 - DNA, 20 bp, Artificial
  CRISPR gRNA sequence
acctcgtgatctgcctgcct

SEQ ID NO: 436877 - DNA, 20 bp, Artificial
  CRISPR gRNA sequence
ctgcctgccttggcctccca

SEQ ID NO: 436878 - DNA, 20 bp, Artificial
  CRISPR gRNA sequence
gccttggcctcccaaagtgc

SEQ ID NO: 436879 - DNA, 20 bp, Artificial
  CRISPR gRNA sequence
ccttggcctcccaaagtgct

SEQ ID NO: 436880 - DNA, 20 bp, Artificial
  CRISPR gRNA sequence
ctcccaaagtgctgggacta

SEQ ID NO: 436881 - DNA, 20 bp, Artificial
  CRISPR gRNA sequence
tcccaaagtgctgggactac

SEQ ID NO: 436882 - DNA, 20 bp, Artificial
  CRISPR gRNA sequence
agtgctgggactacaggcgt

SEQ ID NO: 436883 - DNA, 20 bp, Artificial
  CRISPR gRNA sequence
caggcgtgagccaccgcacc

SEQ ID NO: 436884 - DNA, 20 bp, Artificial
  CRISPR gRNA sequence
tggcctaatcattgttttta

SEQ ID NO: 436885 - DNA, 20 bp, Artificial
  CRISPR gRNA sequence
gcctaatcattgtttttaaa

SEQ ID NO: 436886 - DNA, 20 bp, Artificial
  CRISPR gRNA sequence
ctaatcattgtttttaaaga

SEQ ID NO: 436887 - DNA, 20 bp, Artificial
  CRISPR gRNA sequence
attgtttttaaagagagaaa

SEQ ID NO: 436888 - DNA, 20 bp, Artificial
  CRISPR gRNA sequence
tgtttttaaagagagaaaaa

SEQ ID NO: 436889 - DNA, 20 bp, Artificial
  CRISPR gRNA sequence
tttttaaagagagaaaaaga

SEQ ID NO: 436890 - DNA, 20 bp, Artificial
  CRISPR gRNA sequence
agagaaaaagagagaaccca

SEQ ID NO: 436891 - DNA, 20 bp, Artificial
  CRISPR gRNA sequence
gaacccatagactgaaattt

SEQ ID NO: 436892 - DNA, 20 bp, Artificial
  CRISPR gRNA sequence
atagactgaaattttagaaa

SEQ ID NO: 436893 - DNA, 20 bp, Artificial
  CRISPR gRNA sequence
tagactgaaattttagaaac

SEQ ID NO: 436894 - DNA, 20 bp, Artificial
  CRISPR gRNA sequence
gaaacaggatttattttgtg

SEQ ID NO: 436895 - DNA, 20 bp, Artificial
  CRISPR gRNA sequence
gatttattttgtgtggctct

SEQ ID NO: 436896 - DNA, 20 bp, Artificial
  CRISPR gRNA sequence
tttgtgtggctctcagttat

SEQ ID NO: 436897 - DNA, 20 bp, Artificial
  CRISPR gRNA sequence
ctctcagttatcagaaaatc

SEQ ID NO: 436898 - DNA, 20 bp, Artificial
  CRISPR gRNA sequence
tatcagaaaatcaagttaac

SEQ ID NO: 436899 - DNA, 20 bp, Artificial
  CRISPR gRNA sequence
tcagaaaatcaagttaacta

SEQ ID NO: 436900 - DNA, 20 bp, Artificial
  CRISPR gRNA sequence
aatcaagttaactagagcaa

SEQ ID NO: 436901 - DNA, 20 bp, Artificial
  CRISPR gRNA sequence
aactagagcaatagcaataa

SEQ ID NO: 436902 - DNA, 20 bp, Artificial
  CRISPR gRNA sequence
attgaacatttattatgtac

SEQ ID NO: 436903 - DNA, 20 bp, Artificial
  CRISPR gRNA sequence
ttgaacatttattatgtacc

SEQ ID NO: 436904 - DNA, 20 bp, Artificial
  CRISPR gRNA sequence
tatgtaccaggccctgtact

SEQ ID NO: 436905 - DNA, 20 bp, Artificial
  CRISPR gRNA sequence
attttatattttctctcact

SEQ ID NO: 436906 - DNA, 20 bp, Artificial
  CRISPR gRNA sequence
tagttttcctgataactcta

SEQ ID NO: 436907 - DNA, 20 bp, Artificial
  CRISPR gRNA sequence
agttttcctgataactctac

SEQ ID NO: 436908 - DNA, 20 bp, Artificial
  CRISPR gRNA sequence
gataactctacaggattact

SEQ ID NO: 436909 - DNA, 20 bp, Artificial
  CRISPR gRNA sequence
ctacaggattactcagccct

SEQ ID NO: 436910 - DNA, 20 bp, Artificial
  CRISPR gRNA sequence
caggattactcagcccttag

SEQ ID NO: 436911 - DNA, 20 bp, Artificial
  CRISPR gRNA sequence
gattactcagcccttagtgg

SEQ ID NO: 436912 - DNA, 20 bp, Artificial
  CRISPR gRNA sequence
ttactcagcccttagtggca

SEQ ID NO: 436913 - DNA, 20 bp, Artificial
  CRISPR gRNA sequence
tcagcccttagtggcagagc

SEQ ID NO: 436914 - DNA, 20 bp, Artificial
  CRISPR gRNA sequence
cagcccttagtggcagagct

SEQ ID NO: 436915 - DNA, 20 bp, Artificial
  CRISPR gRNA sequence
tttttttttttttttttttt

SEQ ID NO: 436916 - DNA, 20 bp, Artificial
  CRISPR gRNA sequence
ttttttttttttttttgaga

SEQ ID NO: 436917 - DNA, 20 bp, Artificial
  CRISPR gRNA sequence
ttttttttttttttgagatg

SEQ ID NO: 436918 - DNA, 20 bp, Artificial
  CRISPR gRNA sequence
tggagtctcgctctgttgcc

SEQ ID NO: 436919 - DNA, 20 bp, Artificial
  CRISPR gRNA sequence
ggagtctcgctctgttgccc

SEQ ID NO: 436920 - DNA, 20 bp, Artificial
  CRISPR gRNA sequence
tctcgctctgttgcccaggt

SEQ ID NO: 436921 - DNA, 20 bp, Artificial
  CRISPR gRNA sequence
ctgttgcccaggttggcgtg

SEQ ID NO: 436922 - DNA, 20 bp, Artificial
  CRISPR gRNA sequence
ttgcccaggttggcgtgcag

SEQ ID NO: 436923 - DNA, 20 bp, Artificial
  CRISPR gRNA sequence
cagtggcatgatctcaactc

SEQ ID NO: 436924 - DNA, 20 bp, Artificial
  CRISPR gRNA sequence
tgatctcaactcgagtactc

SEQ ID NO: 436925 - DNA, 20 bp, Artificial
  CRISPR gRNA sequence
gtactccagtctttgcctcc

SEQ ID NO: 436926 - DNA, 20 bp, Artificial
  CRISPR gRNA sequence
tactccagtctttgcctcct

SEQ ID NO: 436927 - DNA, 20 bp, Artificial
  CRISPR gRNA sequence
agtctttgcctcctgggttt

SEQ ID NO: 436928 - DNA, 20 bp, Artificial
  CRISPR gRNA sequence
tttaagtgattctcctgcct

SEQ ID NO: 436929 - DNA, 20 bp, Artificial
  CRISPR gRNA sequence
tcctgcctcagcctccccac

SEQ ID NO: 436930 - DNA, 20 bp, Artificial
  CRISPR gRNA sequence
gcctcagcctccccactagc

SEQ ID NO: 436931 - DNA, 20 bp, Artificial
  CRISPR gRNA sequence
cctcagcctccccactagct

SEQ ID NO: 436932 - DNA, 20 bp, Artificial
  CRISPR gRNA sequence
ctccccactagctaggatta

SEQ ID NO: 436933 - DNA, 20 bp, Artificial
  CRISPR gRNA sequence
tccccactagctaggattac

SEQ ID NO: 436934 - DNA, 20 bp, Artificial
  CRISPR gRNA sequence
caggcatgtgttaccacgcc

SEQ ID NO: 436935 - DNA, 20 bp, Artificial
  CRISPR gRNA sequence
atgtgttaccacgcctggct

SEQ ID NO: 436936 - DNA, 20 bp, Artificial
  CRISPR gRNA sequence
ctggctaagttttgtatttt

SEQ ID NO: 436937 - DNA, 20 bp, Artificial
  CRISPR gRNA sequence
gctaagttttgtatttttag

SEQ ID NO: 436938 - DNA, 20 bp, Artificial
  CRISPR gRNA sequence
taagttttgtatttttagta

SEQ ID NO: 436939 - DNA, 20 bp, Artificial
  CRISPR gRNA sequence
ttttgtatttttagtagaga

SEQ ID NO: 436940 - DNA, 20 bp, Artificial
  CRISPR gRNA sequence
tttgtatttttagtagagac

SEQ ID NO: 436941 - DNA, 20 bp, Artificial
  CRISPR gRNA sequence
ttgtatttttagtagagacg

SEQ ID NO: 436942 - DNA, 20 bp, Artificial
  CRISPR gRNA sequence
cggggtttcaccatgttgtc

SEQ ID NO: 436943 - DNA, 20 bp, Artificial
  CRISPR gRNA sequence
ggggtttcaccatgttgtcc

SEQ ID NO: 436944 - DNA, 20 bp, Artificial
  CRISPR gRNA sequence
tttcaccatgttgtccaggc

SEQ ID NO: 436945 - DNA, 20 bp, Artificial
  CRISPR gRNA sequence
tggtctcaaactcctgatgt

SEQ ID NO: 436946 - DNA, 20 bp, Artificial
  CRISPR gRNA sequence
ggtctcaaactcctgatgtc

SEQ ID NO: 436947 - DNA, 20 bp, Artificial
  CRISPR gRNA sequence
tgtcaggtgatccgcctgcc

SEQ ID NO: 436948 - DNA, 20 bp, Artificial
  CRISPR gRNA sequence
gtcaggtgatccgcctgcct

SEQ ID NO: 436949 - DNA, 20 bp, Artificial
  CRISPR gRNA sequence
ccgcctgcctaggcctccca

SEQ ID NO: 436950 - DNA, 20 bp, Artificial
  CRISPR gRNA sequence
gcctaggcctcccaaagtgc

SEQ ID NO: 436951 - DNA, 20 bp, Artificial
  CRISPR gRNA sequence
cctaggcctcccaaagtgct

SEQ ID NO: 436952 - DNA, 20 bp, Artificial
  CRISPR gRNA sequence
ctcccaaagtgctgggatta

SEQ ID NO: 436953 - DNA, 20 bp, Artificial
  CRISPR gRNA sequence
tcccaaagtgctgggattac

SEQ ID NO: 436954 - DNA, 20 bp, Artificial
  CRISPR gRNA sequence
agtgctgggattacaggcat

SEQ ID NO: 436955 - DNA, 20 bp, Artificial
  CRISPR gRNA sequence
caggcattagccaccgcgcc

SEQ ID NO: 436956 - DNA, 20 bp, Artificial
  CRISPR gRNA sequence
ttagccaccgcgcccggcct

SEQ ID NO: 436957 - DNA, 20 bp, Artificial
  CRISPR gRNA sequence
agccaccgcgcccggcctca

SEQ ID NO: 436958 - DNA, 20 bp, Artificial
  CRISPR gRNA sequence
accgcgcccggcctcagagc

SEQ ID NO: 436959 - DNA, 20 bp, Artificial
  CRISPR gRNA sequence
ccgcgcccggcctcagagct

SEQ ID NO: 436960 - DNA, 20 bp, Artificial
  CRISPR gRNA sequence
gatttgaatccacgaccgtc

SEQ ID NO: 436961 - DNA, 20 bp, Artificial
  CRISPR gRNA sequence
tccacgaccgtctggctgta

SEQ ID NO: 436962 - DNA, 20 bp, Artificial
  CRISPR gRNA sequence
accgtctggctgtaaagtct

SEQ ID NO: 436963 - DNA, 20 bp, Artificial
  CRISPR gRNA sequence
cactgtctttttgtgaaaaa

SEQ ID NO: 436964 - DNA, 20 bp, Artificial
  CRISPR gRNA sequence
tgtgaaaaatagacgtttca

SEQ ID NO: 436965 - DNA, 20 bp, Artificial
  CRISPR gRNA sequence
aaaaatagacgtttcatagc

SEQ ID NO: 436966 - DNA, 20 bp, Artificial
  CRISPR gRNA sequence
taaactactctaaaactctc

SEQ ID NO: 436967 - DNA, 20 bp, Artificial
  CRISPR gRNA sequence
aaactactctaaaactctct

SEQ ID NO: 436968 - DNA, 20 bp, Artificial
  CRISPR gRNA sequence
aactactctaaaactctctg

SEQ ID NO: 436969 - DNA, 20 bp, Artificial
  CRISPR gRNA sequence
taaaactctctggggaatct

SEQ ID NO: 436970 - DNA, 20 bp, Artificial
  CRISPR gRNA sequence
aaaactctctggggaatctt

SEQ ID NO: 436971 - DNA, 20 bp, Artificial
  CRISPR gRNA sequence
aaactctctggggaatctta

SEQ ID NO: 436972 - DNA, 20 bp, Artificial
  CRISPR gRNA sequence
aactctctggggaatcttag

SEQ ID NO: 436973 - DNA, 20 bp, Artificial
  CRISPR gRNA sequence
ttaggggatcttgaaccaac

SEQ ID NO: 436974 - DNA, 20 bp, Artificial
  CRISPR gRNA sequence
accaacaagactccactcta

SEQ ID NO: 436975 - DNA, 20 bp, Artificial
  CRISPR gRNA sequence
cactctaaagccaatttttg

SEQ ID NO: 436976 - DNA, 20 bp, Artificial
  CRISPR gRNA sequence
actctaaagccaatttttgc

SEQ ID NO: 436977 - DNA, 20 bp, Artificial
  CRISPR gRNA sequence
ctctaaagccaatttttgca

SEQ ID NO: 436978 - DNA, 20 bp, Artificial
  CRISPR gRNA sequence
tctaaagccaatttttgcag

SEQ ID NO: 436979 - DNA, 20 bp, Artificial
  CRISPR gRNA sequence
aaagccaatttttgcagggg

SEQ ID NO: 436980 - DNA, 20 bp, Artificial
  CRISPR gRNA sequence
aagccaatttttgcaggggc

SEQ ID NO: 436981 - DNA, 20 bp, Artificial
  CRISPR gRNA sequence
agccaatttttgcaggggca

SEQ ID NO: 436982 - DNA, 20 bp, Artificial
  CRISPR gRNA sequence
aatttttgcaggggcaggga

SEQ ID NO: 436983 - DNA, 20 bp, Artificial
  CRISPR gRNA sequence
atttttgcaggggcagggaa

SEQ ID NO: 436984 - DNA, 20 bp, Artificial
  CRISPR gRNA sequence
tttttgcaggggcagggaaa

SEQ ID NO: 436985 - DNA, 20 bp, Artificial
  CRISPR gRNA sequence
aggggcagggaaagggtctt

SEQ ID NO: 436986 - DNA, 20 bp, Artificial
  CRISPR gRNA sequence
gggcagggaaagggtcttaa

SEQ ID NO: 436987 - DNA, 20 bp, Artificial
  CRISPR gRNA sequence
cttttttttttttttttttt

SEQ ID NO: 436988 - DNA, 20 bp, Artificial
  CRISPR gRNA sequence
ttttttttttttttttttaa

SEQ ID NO: 436989 - DNA, 20 bp, Artificial
  CRISPR gRNA sequence
ctccttctctacccacaaca

SEQ ID NO: 436990 - DNA, 20 bp, Artificial
  CRISPR gRNA sequence
cttctctacccacaacacag

SEQ ID NO: 436991 - DNA, 20 bp, Artificial
  CRISPR gRNA sequence
ttctctacccacaacacaga

SEQ ID NO: 436992 - DNA, 20 bp, Artificial
  CRISPR gRNA sequence
tctctacccacaacacagaa

SEQ ID NO: 436993 - DNA, 20 bp, Artificial
  CRISPR gRNA sequence
ttgtttccttgctaactcca

SEQ ID NO: 436994 - DNA, 20 bp, Artificial
  CRISPR gRNA sequence
tgtttccttgctaactccaa

SEQ ID NO: 436995 - DNA, 20 bp, Artificial
  CRISPR gRNA sequence
ccttgctaactccaaaggtt

SEQ ID NO: 436996 - DNA, 20 bp, Artificial
  CRISPR gRNA sequence
cttgctaactccaaaggtta

SEQ ID NO: 436997 - DNA, 20 bp, Artificial
  CRISPR gRNA sequence
ttgctaactccaaaggttaa

SEQ ID NO: 436998 - DNA, 20 bp, Artificial
  CRISPR gRNA sequence
gctaactccaaaggttaagg

SEQ ID NO: 436999 - DNA, 20 bp, Artificial
  CRISPR gRNA sequence
ggttaagggagaccctttct

SEQ ID NO: 437000 - DNA, 20 bp, Artificial
  CRISPR gRNA sequence
gttaagggagaccctttctt

SEQ ID NO: 437001 - DNA, 20 bp, Artificial
  CRISPR gRNA sequence
agggagaccctttcttgggt

SEQ ID NO: 437002 - DNA, 20 bp, Artificial
  CRISPR gRNA sequence
accctttcttgggttggctt

SEQ ID NO: 437003 - DNA, 20 bp, Artificial
  CRISPR gRNA sequence
tcttgggttggcttgagtgt

SEQ ID NO: 437004 - DNA, 20 bp, Artificial
  CRISPR gRNA sequence
ttggcttgagtgttggctac

SEQ ID NO: 437005 - DNA, 20 bp, Artificial
  CRISPR gRNA sequence
tggcttgagtgttggctaca

SEQ ID NO: 437006 - DNA, 20 bp, Artificial
  CRISPR gRNA sequence
gagtgttggctacaaggtga

SEQ ID NO: 437007 - DNA, 20 bp, Artificial
  CRISPR gRNA sequence
ggctacaaggtgacagatca

SEQ ID NO: 437008 - DNA, 20 bp, Artificial
  CRISPR gRNA sequence
gctacaaggtgacagatcaa

SEQ ID NO: 437009 - DNA, 20 bp, Artificial
  CRISPR gRNA sequence
gacagatcaaaggtgatttg

SEQ ID NO: 437010 - DNA, 20 bp, Artificial
  CRISPR gRNA sequence
acagatcaaaggtgatttga

SEQ ID NO: 437011 - DNA, 20 bp, Artificial
  CRISPR gRNA sequence
caaaggtgatttgaaggact

SEQ ID NO: 437012 - DNA, 20 bp, Artificial
  CRISPR gRNA sequence
gccatcctgtgatgttgtaa

SEQ ID NO: 437013 - DNA, 20 bp, Artificial
  CRISPR gRNA sequence
ccatcctgtgatgttgtaaa

SEQ ID NO: 437014 - DNA, 20 bp, Artificial
  CRISPR gRNA sequence
catcctgtgatgttgtaaaa

SEQ ID NO: 437015 - DNA, 20 bp, Artificial
  CRISPR gRNA sequence
ctgtgatgttgtaaaaggga

SEQ ID NO: 437016 - DNA, 20 bp, Artificial
  CRISPR gRNA sequence
ggtccaattcacaaatcttg

SEQ ID NO: 437017 - DNA, 20 bp, Artificial
  CRISPR gRNA sequence
aatcttgaagctgattacac

SEQ ID NO: 437018 - DNA, 20 bp, Artificial
  CRISPR gRNA sequence
ctgattacacaagcgatttc

SEQ ID NO: 437019 - DNA, 20 bp, Artificial
  CRISPR gRNA sequence
aaatcctgtttgtgtttcca

SEQ ID NO: 437020 - DNA, 20 bp, Artificial
  CRISPR gRNA sequence
tccatagcaaatatccacat

SEQ ID NO: 437021 - DNA, 20 bp, Artificial
  CRISPR gRNA sequence
aaatatccacattggccaat

SEQ ID NO: 437022 - DNA, 20 bp, Artificial
  CRISPR gRNA sequence
ccacattggccaatgagtta

SEQ ID NO: 437023 - DNA, 20 bp, Artificial
  CRISPR gRNA sequence
cacattggccaatgagttac

SEQ ID NO: 437024 - DNA, 20 bp, Artificial
  CRISPR gRNA sequence
gccaatgagttacgggactc

SEQ ID NO: 437025 - DNA, 20 bp, Artificial
  CRISPR gRNA sequence
tgagttacgggactctagat

SEQ ID NO: 437026 - DNA, 20 bp, Artificial
  CRISPR gRNA sequence
ctagattggccaatgactta

SEQ ID NO: 437027 - DNA, 20 bp, Artificial
  CRISPR gRNA sequence
tagattggccaatgacttac

SEQ ID NO: 437028 - DNA, 20 bp, Artificial
  CRISPR gRNA sequence
gccaatgacttacgggactc

SEQ ID NO: 437029 - DNA, 20 bp, Artificial
  CRISPR gRNA sequence
caatgacttacgggactctg

SEQ ID NO: 437030 - DNA, 20 bp, Artificial
  CRISPR gRNA sequence
cgggactctggagcaaccat

SEQ ID NO: 437031 - DNA, 20 bp, Artificial
  CRISPR gRNA sequence
ctctggagcaaccatcagaa

SEQ ID NO: 437032 - DNA, 20 bp, Artificial
  CRISPR gRNA sequence
tctggagcaaccatcagaat

SEQ ID NO: 437033 - DNA, 20 bp, Artificial
  CRISPR gRNA sequence
atcagaataggcatctacat

SEQ ID NO: 437034 - DNA, 20 bp, Artificial
  CRISPR gRNA sequence
cagaataggcatctacatcg

SEQ ID NO: 437035 - DNA, 20 bp, Artificial
  CRISPR gRNA sequence
aataggcatctacatcggag

SEQ ID NO: 437036 - DNA, 20 bp, Artificial
  CRISPR gRNA sequence
ataggcatctacatcggagc

SEQ ID NO: 437037 - DNA, 20 bp, Artificial
  CRISPR gRNA sequence
taggcatctacatcggagca

SEQ ID NO: 437038 - DNA, 20 bp, Artificial
  CRISPR gRNA sequence
atcggagcagggatctgtgc

SEQ ID NO: 437039 - DNA, 20 bp, Artificial
  CRISPR gRNA sequence
tcggagcagggatctgtgct

SEQ ID NO: 437040 - DNA, 20 bp, Artificial
  CRISPR gRNA sequence
agcagggatctgtgctgggc

SEQ ID NO: 437041 - DNA, 20 bp, Artificial
  CRISPR gRNA sequence
gatctgtgctgggctggctc

SEQ ID NO: 437042 - DNA, 20 bp, Artificial
  CRISPR gRNA sequence
ctggctctggctcttatctt

SEQ ID NO: 437043 - DNA, 20 bp, Artificial
  CRISPR gRNA sequence
gcgctttaattttcaaatgt

SEQ ID NO: 437044 - DNA, 20 bp, Artificial
  CRISPR gRNA sequence
ccctctgataacaaattctt

SEQ ID NO: 437045 - DNA, 20 bp, Artificial
  CRISPR gRNA sequence
ctgataacaaattcttcagt

SEQ ID NO: 437046 - DNA, 20 bp, Artificial
  CRISPR gRNA sequence
acaaattcttcagtgagaac

SEQ ID NO: 437047 - DNA, 20 bp, Artificial
  CRISPR gRNA sequence
agtgagaaccagtaaaaacc

SEQ ID NO: 437048 - DNA, 20 bp, Artificial
  CRISPR gRNA sequence
agaaccagtaaaaacctaga

SEQ ID NO: 437049 - DNA, 20 bp, Artificial
  CRISPR gRNA sequence
caaattcatgtttataccca

SEQ ID NO: 437050 - DNA, 20 bp, Artificial
  CRISPR gRNA sequence
tgtttatacccaaagatgat

SEQ ID NO: 437051 - DNA, 20 bp, Artificial
  CRISPR gRNA sequence
catccaaatcctaacaataa

SEQ ID NO: 437052 - DNA, 20 bp, Artificial
  CRISPR gRNA sequence
atttaatatttattgtgtgt

SEQ ID NO: 437053 - DNA, 20 bp, Artificial
  CRISPR gRNA sequence
tttaatatttattgtgtgtc

SEQ ID NO: 437054 - DNA, 20 bp, Artificial
  CRISPR gRNA sequence
aatatttattgtgtgtcagg

SEQ ID NO: 437055 - DNA, 20 bp, Artificial
  CRISPR gRNA sequence
tatcatcattactgtcttat

SEQ ID NO: 437056 - DNA, 20 bp, Artificial
  CRISPR gRNA sequence
tcattactgtcttatgagat

SEQ ID NO: 437057 - DNA, 20 bp, Artificial
  CRISPR gRNA sequence
cattactgtcttatgagata

SEQ ID NO: 437058 - DNA, 20 bp, Artificial
  CRISPR gRNA sequence
ctgtcttatgagataaggaa

SEQ ID NO: 437059 - DNA, 20 bp, Artificial
  CRISPR gRNA sequence
atagtaccatccccatttta

SEQ ID NO: 437060 - DNA, 20 bp, Artificial
  CRISPR gRNA sequence
accatccccattttacagtg

SEQ ID NO: 437061 - DNA, 20 bp, Artificial
  CRISPR gRNA sequence
ccatccccattttacagtga

SEQ ID NO: 437062 - DNA, 20 bp, Artificial
  CRISPR gRNA sequence
catccccattttacagtgaa

SEQ ID NO: 437063 - DNA, 20 bp, Artificial
  CRISPR gRNA sequence
ccccattttacagtgaaggg

SEQ ID NO: 437064 - DNA, 20 bp, Artificial
  CRISPR gRNA sequence
ttttacagtgaagggaagtc

SEQ ID NO: 437065 - DNA, 20 bp, Artificial
  CRISPR gRNA sequence
cagtgaagggaagtcaagct

SEQ ID NO: 437066 - DNA, 20 bp, Artificial
  CRISPR gRNA sequence
gtgaagggaagtcaagctta

SEQ ID NO: 437067 - DNA, 20 bp, Artificial
  CRISPR gRNA sequence
agggaagtcaagcttagagt

SEQ ID NO: 437068 - DNA, 20 bp, Artificial
  CRISPR gRNA sequence
ttagagtaagctgccttccc

SEQ ID NO: 437069 - DNA, 20 bp, Artificial
  CRISPR gRNA sequence
tagagtaagctgccttcccg

SEQ ID NO: 437070 - DNA, 20 bp, Artificial
  CRISPR gRNA sequence
ccttcccgaggtttcaacat

SEQ ID NO: 437071 - DNA, 20 bp, Artificial
  CRISPR gRNA sequence
gaggtttcaacatcagtacc

SEQ ID NO: 437072 - DNA, 20 bp, Artificial
  CRISPR gRNA sequence
gtttcaacatcagtacctgg

SEQ ID NO: 437073 - DNA, 20 bp, Artificial
  CRISPR gRNA sequence
acatcagtacctggcagaac

SEQ ID NO: 437074 - DNA, 20 bp, Artificial
  CRISPR gRNA sequence
gcagaaccggaaatcaaatc

SEQ ID NO: 437075 - DNA, 20 bp, Artificial
  CRISPR gRNA sequence
cagaaccggaaatcaaatcc

SEQ ID NO: 437076 - DNA, 20 bp, Artificial
  CRISPR gRNA sequence
aaccggaaatcaaatccagg

SEQ ID NO: 437077 - DNA, 20 bp, Artificial
  CRISPR gRNA sequence
accggaaatcaaatccaggc

SEQ ID NO: 437078 - DNA, 20 bp, Artificial
  CRISPR gRNA sequence
aaatccaggcaggctgattc

SEQ ID NO: 437079 - DNA, 20 bp, Artificial
  CRISPR gRNA sequence
ctttaattcatgaatatgtc

SEQ ID NO: 437080 - DNA, 20 bp, Artificial
  CRISPR gRNA sequence
tttaattcatgaatatgtct

SEQ ID NO: 437081 - DNA, 20 bp, Artificial
  CRISPR gRNA sequence
tctgtgcacttttctgttat

SEQ ID NO: 437082 - DNA, 20 bp, Artificial
  CRISPR gRNA sequence
cttttctgttattggtttct

SEQ ID NO: 437083 - DNA, 20 bp, Artificial
  CRISPR gRNA sequence
ttttctgttattggtttctc

SEQ ID NO: 437084 - DNA, 20 bp, Artificial
  CRISPR gRNA sequence
gtttctcaggcatacctctc

SEQ ID NO: 437085 - DNA, 20 bp, Artificial
  CRISPR gRNA sequence
tctcaggcatacctctctgg

SEQ ID NO: 437086 - DNA, 20 bp, Artificial
  CRISPR gRNA sequence
caggcatacctctctggcag

SEQ ID NO: 437087 - DNA, 20 bp, Artificial
  CRISPR gRNA sequence
cctctctggcagtagactgc

SEQ ID NO: 437088 - DNA, 20 bp, Artificial
  CRISPR gRNA sequence
actgcaagtccctttaacac

SEQ ID NO: 437089 - DNA, 20 bp, Artificial
  CRISPR gRNA sequence
ctgcaagtccctttaacact

SEQ ID NO: 437090 - DNA, 20 bp, Artificial
  CRISPR gRNA sequence
ctttaacactgggtcgtgac

SEQ ID NO: 437091 - DNA, 20 bp, Artificial
  CRISPR gRNA sequence
tttaacactgggtcgtgact

SEQ ID NO: 437092 - DNA, 20 bp, Artificial
  CRISPR gRNA sequence
ttaacactgggtcgtgactg

SEQ ID NO: 437093 - DNA, 20 bp, Artificial
  CRISPR gRNA sequence
cactgggtcgtgactggggt

SEQ ID NO: 437094 - DNA, 20 bp, Artificial
  CRISPR gRNA sequence
ctgggtcgtgactggggtta

SEQ ID NO: 437095 - DNA, 20 bp, Artificial
  CRISPR gRNA sequence
gagaatgttttcctccatca

SEQ ID NO: 437096 - DNA, 20 bp, Artificial
  CRISPR gRNA sequence
ttttcctccatcatggtact

SEQ ID NO: 437097 - DNA, 20 bp, Artificial
  CRISPR gRNA sequence
ccatcatggtacttagcaca

SEQ ID NO: 437098 - DNA, 20 bp, Artificial
  CRISPR gRNA sequence
cttagcacatagctttttct

SEQ ID NO: 437099 - DNA, 20 bp, Artificial
  CRISPR gRNA sequence
tcccttttttttttttaaac

SEQ ID NO: 437100 - DNA, 20 bp, Artificial
  CRISPR gRNA sequence
aacaaacaaaaacaaaaaaa

SEQ ID NO: 437101 - DNA, 20 bp, Artificial
  CRISPR gRNA sequence
acaaacaaaaacaaaaaaac

SEQ ID NO: 437102 - DNA, 20 bp, Artificial
  CRISPR gRNA sequence
caaaaacaaaaaaacaggcc

SEQ ID NO: 437103 - DNA, 20 bp, Artificial
  CRISPR gRNA sequence
acaaaaaaacaggcccggcg

SEQ ID NO: 437104 - DNA, 20 bp, Artificial
  CRISPR gRNA sequence
aaaaaacaggcccggcgcag

SEQ ID NO: 437105 - DNA, 20 bp, Artificial
  CRISPR gRNA sequence
gtggctcacgcctgtaatcc

SEQ ID NO: 437106 - DNA, 20 bp, Artificial
  CRISPR gRNA sequence
cgcctgtaatcccagcactt

SEQ ID NO: 437107 - DNA, 20 bp, Artificial
  CRISPR gRNA sequence
gcctgtaatcccagcacttt

SEQ ID NO: 437108 - DNA, 20 bp, Artificial
  CRISPR gRNA sequence
ctgtaatcccagcactttgg

SEQ ID NO: 437109 - DNA, 20 bp, Artificial
  CRISPR gRNA sequence
tgtaatcccagcactttggg

SEQ ID NO: 437110 - DNA, 20 bp, Artificial
  CRISPR gRNA sequence
tcccagcactttgggaggct

SEQ ID NO: 437111 - DNA, 20 bp, Artificial
  CRISPR gRNA sequence
cccagcactttgggaggctg

SEQ ID NO: 437112 - DNA, 20 bp, Artificial
  CRISPR gRNA sequence
ccagcactttgggaggctga

SEQ ID NO: 437113 - DNA, 20 bp, Artificial
  CRISPR gRNA sequence
cagcactttgggaggctgag

SEQ ID NO: 437114 - DNA, 20 bp, Artificial
  CRISPR gRNA sequence
agcactttgggaggctgagg

SEQ ID NO: 437115 - DNA, 20 bp, Artificial
  CRISPR gRNA sequence
gcactttgggaggctgaggg

SEQ ID NO: 437116 - DNA, 20 bp, Artificial
  CRISPR gRNA sequence
ctttgggaggctgagggggg

SEQ ID NO: 437117 - DNA, 20 bp, Artificial
  CRISPR gRNA sequence
ctgaggggggtggatcattt

SEQ ID NO: 437118 - DNA, 20 bp, Artificial
  CRISPR gRNA sequence
tgaggggggtggatcatttg

SEQ ID NO: 437119 - DNA, 20 bp, Artificial
  CRISPR gRNA sequence
gggggtggatcatttgaggt

SEQ ID NO: 437120 - DNA, 20 bp, Artificial
  CRISPR gRNA sequence
ggggtggatcatttgaggtc

SEQ ID NO: 437121 - DNA, 20 bp, Artificial
  CRISPR gRNA sequence
ggtggatcatttgaggtcag

SEQ ID NO: 437122 - DNA, 20 bp, Artificial
  CRISPR gRNA sequence
tcatttgaggtcaggagttc

SEQ ID NO: 437123 - DNA, 20 bp, Artificial
  CRISPR gRNA sequence
tgaggtcaggagttcgagac

SEQ ID NO: 437124 - DNA, 20 bp, Artificial
  CRISPR gRNA sequence
tcaggagttcgagaccagct

SEQ ID NO: 437125 - DNA, 20 bp, Artificial
  CRISPR gRNA sequence
cgagaccagcttggccaaca

SEQ ID NO: 437126 - DNA, 20 bp, Artificial
  CRISPR gRNA sequence
accagcttggccaacatggt

SEQ ID NO: 437127 - DNA, 20 bp, Artificial
  CRISPR gRNA sequence
ctctactaaaaatacaaaat

SEQ ID NO: 437128 - DNA, 20 bp, Artificial
  CRISPR gRNA sequence
actaaaaatacaaaattagc

SEQ ID NO: 437129 - DNA, 20 bp, Artificial
  CRISPR gRNA sequence
ctaaaaatacaaaattagcc

SEQ ID NO: 437130 - DNA, 20 bp, Artificial
  CRISPR gRNA sequence
aatacaaaattagccgggtg

SEQ ID NO: 437131 - DNA, 20 bp, Artificial
  CRISPR gRNA sequence
acaaaattagccgggtgtgg

SEQ ID NO: 437132 - DNA, 20 bp, Artificial
  CRISPR gRNA sequence
gtggcgcatgcctgtaatcc

SEQ ID NO: 437133 - DNA, 20 bp, Artificial
  CRISPR gRNA sequence
tgcctgtaatcccagctact

SEQ ID NO: 437134 - DNA, 20 bp, Artificial
  CRISPR gRNA sequence
gcctgtaatcccagctactc

SEQ ID NO: 437135 - DNA, 20 bp, Artificial
  CRISPR gRNA sequence
ctgtaatcccagctactcag

SEQ ID NO: 437136 - DNA, 20 bp, Artificial
  CRISPR gRNA sequence
tgtaatcccagctactcagg

SEQ ID NO: 437137 - DNA, 20 bp, Artificial
  CRISPR gRNA sequence
tcccagctactcaggaggct

SEQ ID NO: 437138 - DNA, 20 bp, Artificial
  CRISPR gRNA sequence
cccagctactcaggaggctg

SEQ ID NO: 437139 - DNA, 20 bp, Artificial
  CRISPR gRNA sequence
agctactcaggaggctgagg

SEQ ID NO: 437140 - DNA, 20 bp, Artificial
  CRISPR gRNA sequence
ctactcaggaggctgaggca

SEQ ID NO: 437141 - DNA, 20 bp, Artificial
  CRISPR gRNA sequence
tactcaggaggctgaggcag

SEQ ID NO: 437142 - DNA, 20 bp, Artificial
  CRISPR gRNA sequence
gcagaggaatcactcaaacc

SEQ ID NO: 437143 - DNA, 20 bp, Artificial
  CRISPR gRNA sequence
gaggaatcactcaaacctgg

SEQ ID NO: 437144 - DNA, 20 bp, Artificial
  CRISPR gRNA sequence
aggaatcactcaaacctggt

SEQ ID NO: 437145 - DNA, 20 bp, Artificial
  CRISPR gRNA sequence
aatcactcaaacctggtagg

SEQ ID NO: 437146 - DNA, 20 bp, Artificial
  CRISPR gRNA sequence
tcactcaaacctggtaggtg

SEQ ID NO: 437147 - DNA, 20 bp, Artificial
  CRISPR gRNA sequence
cactcaaacctggtaggtgg

SEQ ID NO: 437148 - DNA, 20 bp, Artificial
  CRISPR gRNA sequence
aacctggtaggtggaggtta

SEQ ID NO: 437149 - DNA, 20 bp, Artificial
  CRISPR gRNA sequence
tggtaggtggaggttacagt

SEQ ID NO: 437150 - DNA, 20 bp, Artificial
  CRISPR gRNA sequence
ggtggaggttacagtgagct

SEQ ID NO: 437151 - DNA, 20 bp, Artificial
  CRISPR gRNA sequence
cagatcatgccactgcactc

SEQ ID NO: 437152 - DNA, 20 bp, Artificial
  CRISPR gRNA sequence
catgccactgcactccagcc

SEQ ID NO: 437153 - DNA, 20 bp, Artificial
  CRISPR gRNA sequence
atgccactgcactccagcct

SEQ ID NO: 437154 - DNA, 20 bp, Artificial
  CRISPR gRNA sequence
ctgcactccagcctgggtga

SEQ ID NO: 437155 - DNA, 20 bp, Artificial
  CRISPR gRNA sequence
gcactccagcctgggtgaca

SEQ ID NO: 437156 - DNA, 20 bp, Artificial
  CRISPR gRNA sequence
tccagcctgggtgacagagt

SEQ ID NO: 437157 - DNA, 20 bp, Artificial
  CRISPR gRNA sequence
tgagactgtcttaaaaaaaa

SEQ ID NO: 437158 - DNA, 20 bp, Artificial
  CRISPR gRNA sequence
gtaataaaatataaataaat

SEQ ID NO: 437159 - DNA, 20 bp, Artificial
  CRISPR gRNA sequence
aaataaataaataaatacaa

SEQ ID NO: 437160 - DNA, 20 bp, Artificial
  CRISPR gRNA sequence
aaataaataaatacaatggc

SEQ ID NO: 437161 - DNA, 20 bp, Artificial
  CRISPR gRNA sequence
aataaataaatacaatggcc

SEQ ID NO: 437162 - DNA, 20 bp, Artificial
  CRISPR gRNA sequence
ataaatacaatggccaggtg

SEQ ID NO: 437163 - DNA, 20 bp, Artificial
  CRISPR gRNA sequence
aatacaatggccaggtgcag

SEQ ID NO: 437164 - DNA, 20 bp, Artificial
  CRISPR gRNA sequence
gcctgtattttcaacacttt

SEQ ID NO: 437165 - DNA, 20 bp, Artificial
  CRISPR gRNA sequence
tgtattttcaacactttcgg

SEQ ID NO: 437166 - DNA, 20 bp, Artificial
  CRISPR gRNA sequence
tttcaacactttcggaagct

SEQ ID NO: 437167 - DNA, 20 bp, Artificial
  CRISPR gRNA sequence
ttcaacactttcggaagctg

SEQ ID NO: 437168 - DNA, 20 bp, Artificial
  CRISPR gRNA sequence
acactttcggaagctgaggt

SEQ ID NO: 437169 - DNA, 20 bp, Artificial
  CRISPR gRNA sequence
actttcggaagctgaggtga

SEQ ID NO: 437170 - DNA, 20 bp, Artificial
  CRISPR gRNA sequence
ctttcggaagctgaggtgag

SEQ ID NO: 437171 - DNA, 20 bp, Artificial
  CRISPR gRNA sequence
ggaagctgaggtgagaggat

SEQ ID NO: 437172 - DNA, 20 bp, Artificial
  CRISPR gRNA sequence
ctgaggtgagaggatcagtt

SEQ ID NO: 437173 - DNA, 20 bp, Artificial
  CRISPR gRNA sequence
gtgagaggatcagttgagcc

SEQ ID NO: 437174 - DNA, 20 bp, Artificial
  CRISPR gRNA sequence
tgagaggatcagttgagccc

SEQ ID NO: 437175 - DNA, 20 bp, Artificial
  CRISPR gRNA sequence
agaggatcagttgagcccag

SEQ ID NO: 437176 - DNA, 20 bp, Artificial
  CRISPR gRNA sequence
tcagttgagcccaggagttt

SEQ ID NO: 437177 - DNA, 20 bp, Artificial
  CRISPR gRNA sequence
gagcccaggagtttgagacc

SEQ ID NO: 437178 - DNA, 20 bp, Artificial
  CRISPR gRNA sequence
caggagtttgagaccaagat

SEQ ID NO: 437179 - DNA, 20 bp, Artificial
  CRISPR gRNA sequence
gtttgagaccaagatcagcc

SEQ ID NO: 437180 - DNA, 20 bp, Artificial
  CRISPR gRNA sequence
tttgagaccaagatcagcct

SEQ ID NO: 437181 - DNA, 20 bp, Artificial
  CRISPR gRNA sequence
gagaccaagatcagcctggg

SEQ ID NO: 437182 - DNA, 20 bp, Artificial
  CRISPR gRNA sequence
caagatcagcctgggcagca

SEQ ID NO: 437183 - DNA, 20 bp, Artificial
  CRISPR gRNA sequence
gatcagcctgggcagcaaag

SEQ ID NO: 437184 - DNA, 20 bp, Artificial
  CRISPR gRNA sequence
atcagcctgggcagcaaagc

SEQ ID NO: 437185 - DNA, 20 bp, Artificial
  CRISPR gRNA sequence
aacgtaataataataataat

SEQ ID NO: 437186 - DNA, 20 bp, Artificial
  CRISPR gRNA sequence
taataataataataatgagc

SEQ ID NO: 437187 - DNA, 20 bp, Artificial
  CRISPR gRNA sequence
aataataataataatgagct

SEQ ID NO: 437188 - DNA, 20 bp, Artificial
  CRISPR gRNA sequence
taataataatgagctgggca

SEQ ID NO: 437189 - DNA, 20 bp, Artificial
  CRISPR gRNA sequence
taataatgagctgggcatgg

SEQ ID NO: 437190 - DNA, 20 bp, Artificial
  CRISPR gRNA sequence
ggcatggtggcacacacctg

SEQ ID NO: 437191 - DNA, 20 bp, Artificial
  CRISPR gRNA sequence
cacctgtagtcccatctact

SEQ ID NO: 437192 - DNA, 20 bp, Artificial
  CRISPR gRNA sequence
acctgtagtcccatctactc

SEQ ID NO: 437193 - DNA, 20 bp, Artificial
  CRISPR gRNA sequence
ctgtagtcccatctactcag

SEQ ID NO: 437194 - DNA, 20 bp, Artificial
  CRISPR gRNA sequence
tgtagtcccatctactcagg

SEQ ID NO: 437195 - DNA, 20 bp, Artificial
  CRISPR gRNA sequence
tcccatctactcaggaggct

SEQ ID NO: 437196 - DNA, 20 bp, Artificial
  CRISPR gRNA sequence
cccatctactcaggaggctg

SEQ ID NO: 437197 - DNA, 20 bp, Artificial
  CRISPR gRNA sequence
atctactcaggaggctgagg

SEQ ID NO: 437198 - DNA, 20 bp, Artificial
  CRISPR gRNA sequence
tctactcaggaggctgaggt

SEQ ID NO: 437199 - DNA, 20 bp, Artificial
  CRISPR gRNA sequence
tactcaggaggctgaggtgg

SEQ ID NO: 437200 - DNA, 20 bp, Artificial
  CRISPR gRNA sequence
actcaggaggctgaggtggg

SEQ ID NO: 437201 - DNA, 20 bp, Artificial
  CRISPR gRNA sequence
ctgaggtgggaggatcactt

SEQ ID NO: 437202 - DNA, 20 bp, Artificial
  CRISPR gRNA sequence
gtgggaggatcacttgagct

SEQ ID NO: 437203 - DNA, 20 bp, Artificial
  CRISPR gRNA sequence
tgggaggatcacttgagctc

SEQ ID NO: 437204 - DNA, 20 bp, Artificial
  CRISPR gRNA sequence
ggaggatcacttgagctcag

SEQ ID NO: 437205 - DNA, 20 bp, Artificial
  CRISPR gRNA sequence
gaggatcacttgagctcagg

SEQ ID NO: 437206 - DNA, 20 bp, Artificial
  CRISPR gRNA sequence
cacttgagctcaggaggctg

SEQ ID NO: 437207 - DNA, 20 bp, Artificial
  CRISPR gRNA sequence
tgagctcaggaggctgcagt

SEQ ID NO: 437208 - DNA, 20 bp, Artificial
  CRISPR gRNA sequence
gctcaggaggctgcagtgag

SEQ ID NO: 437209 - DNA, 20 bp, Artificial
  CRISPR gRNA sequence
tgcatcattgcactccaccc

SEQ ID NO: 437210 - DNA, 20 bp, Artificial
  CRISPR gRNA sequence
gcatcattgcactccaccct

SEQ ID NO: 437211 - DNA, 20 bp, Artificial
  CRISPR gRNA sequence
ttgcactccaccctgggcaa

SEQ ID NO: 437212 - DNA, 20 bp, Artificial
  CRISPR gRNA sequence
tccaccctgggcaacagaat

SEQ ID NO: 437213 - DNA, 20 bp, Artificial
  CRISPR gRNA sequence
ccctgggcaacagaataaga

SEQ ID NO: 437214 - DNA, 20 bp, Artificial
  CRISPR gRNA sequence
tctccaaaaaaaaaaaaaaa

SEQ ID NO: 437215 - DNA, 20 bp, Artificial
  CRISPR gRNA sequence
ccaaaaaaaaaaaaaaaaag

SEQ ID NO: 437216 - DNA, 20 bp, Artificial
  CRISPR gRNA sequence
aaaaaaaaagaagtgtgttg

SEQ ID NO: 437217 - DNA, 20 bp, Artificial
  CRISPR gRNA sequence
ttgaagttgatgaattttga

SEQ ID NO: 437218 - DNA, 20 bp, Artificial
  CRISPR gRNA sequence
gaagttgatgaattttgatg

SEQ ID NO: 437219 - DNA, 20 bp, Artificial
  CRISPR gRNA sequence
tgaattttgatggagaatta

SEQ ID NO: 437220 - DNA, 20 bp, Artificial
  CRISPR gRNA sequence
attttgatggagaattacag

SEQ ID NO: 437221 - DNA, 20 bp, Artificial
  CRISPR gRNA sequence
ttttgatggagaattacagt

SEQ ID NO: 437222 - DNA, 20 bp, Artificial
  CRISPR gRNA sequence
tgatggagaattacagtagg

SEQ ID NO: 437223 - DNA, 20 bp, Artificial
  CRISPR gRNA sequence
aggaagccatcatcacaatc

SEQ ID NO: 437224 - DNA, 20 bp, Artificial
  CRISPR gRNA sequence
aatcaagatctaaatacttc

SEQ ID NO: 437225 - DNA, 20 bp, Artificial
  CRISPR gRNA sequence
ctcgcacacttttgtttttt

SEQ ID NO: 437226 - DNA, 20 bp, Artificial
  CRISPR gRNA sequence
cgcacacttttgtttttttg

SEQ ID NO: 437227 - DNA, 20 bp, Artificial
  CRISPR gRNA sequence
cacttttgtttttttggaga

SEQ ID NO: 437228 - DNA, 20 bp, Artificial
  CRISPR gRNA sequence
gtttttttggagatggacgc

SEQ ID NO: 437229 - DNA, 20 bp, Artificial
  CRISPR gRNA sequence
ttttttggagatggacgctg

SEQ ID NO: 437230 - DNA, 20 bp, Artificial
  CRISPR gRNA sequence
tggagatggacgctggagtg

SEQ ID NO: 437231 - DNA, 20 bp, Artificial
  CRISPR gRNA sequence
agatggacgctggagtgcag

SEQ ID NO: 437232 - DNA, 20 bp, Artificial
  CRISPR gRNA sequence
ggagtgcagtggcacgatct

SEQ ID NO: 437233 - DNA, 20 bp, Artificial
  CRISPR gRNA sequence
tcactgtaacctctgcctcc

SEQ ID NO: 437234 - DNA, 20 bp, Artificial
  CRISPR gRNA sequence
cactgtaacctctgcctccc

SEQ ID NO: 437235 - DNA, 20 bp, Artificial
  CRISPR gRNA sequence
aacctctgcctcccgggttc

SEQ ID NO: 437236 - DNA, 20 bp, Artificial
  CRISPR gRNA sequence
ttcaagtgtttctcctgact

SEQ ID NO: 437237 - DNA, 20 bp, Artificial
  CRISPR gRNA sequence
gtttctcctgactcagcttc

SEQ ID NO: 437238 - DNA, 20 bp, Artificial
  CRISPR gRNA sequence
ttctcctgactcagcttcca

SEQ ID NO: 437239 - DNA, 20 bp, Artificial
  CRISPR gRNA sequence
tcctgactcagcttccagag

SEQ ID NO: 437240 - DNA, 20 bp, Artificial
  CRISPR gRNA sequence
gactcagcttccagagtagc

SEQ ID NO: 437241 - DNA, 20 bp, Artificial
  CRISPR gRNA sequence
actcagcttccagagtagct

SEQ ID NO: 437242 - DNA, 20 bp, Artificial
  CRISPR gRNA sequence
ttccagagtagctgggacta

SEQ ID NO: 437243 - DNA, 20 bp, Artificial
  CRISPR gRNA sequence
tccagagtagctgggactac

SEQ ID NO: 437244 - DNA, 20 bp, Artificial
  CRISPR gRNA sequence
caggcatgtaccaccacgcc

SEQ ID NO: 437245 - DNA, 20 bp, Artificial
  CRISPR gRNA sequence
ctggctaatttttatatttt

SEQ ID NO: 437246 - DNA, 20 bp, Artificial
  CRISPR gRNA sequence
gctaatttttatatttttag

SEQ ID NO: 437247 - DNA, 20 bp, Artificial
  CRISPR gRNA sequence
taatttttatatttttagta

SEQ ID NO: 437248 - DNA, 20 bp, Artificial
  CRISPR gRNA sequence
ttttatatttttagtagaga

SEQ ID NO: 437249 - DNA, 20 bp, Artificial
  CRISPR gRNA sequence
tttatatttttagtagagac

SEQ ID NO: 437250 - DNA, 20 bp, Artificial
  CRISPR gRNA sequence
ttatatttttagtagagaca

SEQ ID NO: 437251 - DNA, 20 bp, Artificial
  CRISPR gRNA sequence
gagacagggtttcaccatgt

SEQ ID NO: 437252 - DNA, 20 bp, Artificial
  CRISPR gRNA sequence
agacagggtttcaccatgtt

SEQ ID NO: 437253 - DNA, 20 bp, Artificial
  CRISPR gRNA sequence
agggtttcaccatgttgggc

SEQ ID NO: 437254 - DNA, 20 bp, Artificial
  CRISPR gRNA sequence
acctcgacctcccaatgttt

SEQ ID NO: 437255 - DNA, 20 bp, Artificial
  CRISPR gRNA sequence
cctcgacctcccaatgtttt

SEQ ID NO: 437256 - DNA, 20 bp, Artificial
  CRISPR gRNA sequence
ctcccaatgttttgggatta

SEQ ID NO: 437257 - DNA, 20 bp, Artificial
  CRISPR gRNA sequence
tcccaatgttttgggattac

SEQ ID NO: 437258 - DNA, 20 bp, Artificial
  CRISPR gRNA sequence
tgttttgggattacaggcgt

SEQ ID NO: 437259 - DNA, 20 bp, Artificial
  CRISPR gRNA sequence
caggcgtgagccactgtgcc

SEQ ID NO: 437260 - DNA, 20 bp, Artificial
  CRISPR gRNA sequence
gtgtctattttattttcttt

SEQ ID NO: 437261 - DNA, 20 bp, Artificial
  CRISPR gRNA sequence
tgtctattttattttctttt

SEQ ID NO: 437262 - DNA, 20 bp, Artificial
  CRISPR gRNA sequence
gtctattttattttctttta

SEQ ID NO: 437263 - DNA, 20 bp, Artificial
  CRISPR gRNA sequence
tattttattttcttttaggg

SEQ ID NO: 437264 - DNA, 20 bp, Artificial
  CRISPR gRNA sequence
tttcttttagggcagaaacc

SEQ ID NO: 437265 - DNA, 20 bp, Artificial
  CRISPR gRNA sequence
gaaaccaagtccttatgccc

SEQ ID NO: 437266 - DNA, 20 bp, Artificial
  CRISPR gRNA sequence
aaccaagtccttatgcccca

SEQ ID NO: 437267 - DNA, 20 bp, Artificial
  CRISPR gRNA sequence
ccccagagcgtaatatgaca

SEQ ID NO: 437268 - DNA, 20 bp, Artificial
  CRISPR gRNA sequence
cagagcgtaatatgacatag

SEQ ID NO: 437269 - DNA, 20 bp, Artificial
  CRISPR gRNA sequence
ctttcttactaatacacaaa

SEQ ID NO: 437270 - DNA, 20 bp, Artificial
  CRISPR gRNA sequence
tttcttactaatacacaaac

SEQ ID NO: 437271 - DNA, 20 bp, Artificial
  CRISPR gRNA sequence
ttcttactaatacacaaaca

SEQ ID NO: 437272 - DNA, 20 bp, Artificial
  CRISPR gRNA sequence
acaaacagggactgtgtgtg

SEQ ID NO: 437273 - DNA, 20 bp, Artificial
  CRISPR gRNA sequence
aaacagggactgtgtgtgta

SEQ ID NO: 437274 - DNA, 20 bp, Artificial
  CRISPR gRNA sequence
agggactgtgtgtgtagagt

SEQ ID NO: 437275 - DNA, 20 bp, Artificial
  CRISPR gRNA sequence
tgtagagtgagcaatcacct

SEQ ID NO: 437276 - DNA, 20 bp, Artificial
  CRISPR gRNA sequence
agtgagcaatcacctcagat

SEQ ID NO: 437277 - DNA, 20 bp, Artificial
  CRISPR gRNA sequence
caatcacctcagattagctc

SEQ ID NO: 437278 - DNA, 20 bp, Artificial
  CRISPR gRNA sequence
ctcagattagctcaagacta

SEQ ID NO: 437279 - DNA, 20 bp, Artificial
  CRISPR gRNA sequence
tcagattagctcaagactaa

SEQ ID NO: 437280 - DNA, 20 bp, Artificial
  CRISPR gRNA sequence
cagattagctcaagactaaa

SEQ ID NO: 437281 - DNA, 20 bp, Artificial
  CRISPR gRNA sequence
caagactaaagggtgttcct

SEQ ID NO: 437282 - DNA, 20 bp, Artificial
  CRISPR gRNA sequence
aagggtgttcctaagatata

SEQ ID NO: 437283 - DNA, 20 bp, Artificial
  CRISPR gRNA sequence
agggtgttcctaagatatat

SEQ ID NO: 437284 - DNA, 20 bp, Artificial
  CRISPR gRNA sequence
cctaagatatatgggacttc

SEQ ID NO: 437285 - DNA, 20 bp, Artificial
  CRISPR gRNA sequence
ctaagatatatgggacttct

SEQ ID NO: 437286 - DNA, 20 bp, Artificial
  CRISPR gRNA sequence
taagatatatgggacttcta

SEQ ID NO: 437287 - DNA, 20 bp, Artificial
  CRISPR gRNA sequence
gggacttctagggctaaaac

SEQ ID NO: 437288 - DNA, 20 bp, Artificial
  CRISPR gRNA sequence
ttctagggctaaaactggaa

SEQ ID NO: 437289 - DNA, 20 bp, Artificial
  CRISPR gRNA sequence
ggctaaaactggaacagtcc

SEQ ID NO: 437290 - DNA, 20 bp, Artificial
  CRISPR gRNA sequence
gaacagtccaagaaaaacat

SEQ ID NO: 437291 - DNA, 20 bp, Artificial
  CRISPR gRNA sequence
agtccaagaaaaacatgagt

SEQ ID NO: 437292 - DNA, 20 bp, Artificial
  CRISPR gRNA sequence
gttggtccccccactaactg

SEQ ID NO: 437293 - DNA, 20 bp, Artificial
  CRISPR gRNA sequence
cccccactaactgtggactg

SEQ ID NO: 437294 - DNA, 20 bp, Artificial
  CRISPR gRNA sequence
aactgtggactgaagctgcc

SEQ ID NO: 437295 - DNA, 20 bp, Artificial
  CRISPR gRNA sequence
aattctcgtaactaccctat

SEQ ID NO: 437296 - DNA, 20 bp, Artificial
  CRISPR gRNA sequence
ctcgtaactaccctatgaga

SEQ ID NO: 437297 - DNA, 20 bp, Artificial
  CRISPR gRNA sequence
tcgtaactaccctatgagat

SEQ ID NO: 437298 - DNA, 20 bp, Artificial
  CRISPR gRNA sequence
aggtactaatatgtttctaa

SEQ ID NO: 437299 - DNA, 20 bp, Artificial
  CRISPR gRNA sequence
gtactaatatgtttctaatg

SEQ ID NO: 437300 - DNA, 20 bp, Artificial
  CRISPR gRNA sequence
atatgtttctaatggagaat

SEQ ID NO: 437301 - DNA, 20 bp, Artificial
  CRISPR gRNA sequence
atggagaatcagcatgctaa

SEQ ID NO: 437302 - DNA, 20 bp, Artificial
  CRISPR gRNA sequence
tggagaatcagcatgctaaa

SEQ ID NO: 437303 - DNA, 20 bp, Artificial
  CRISPR gRNA sequence
gaatcagcatgctaaaaggt

SEQ ID NO: 437304 - DNA, 20 bp, Artificial
  CRISPR gRNA sequence
aatcagcatgctaaaaggtt

SEQ ID NO: 437305 - DNA, 20 bp, Artificial
  CRISPR gRNA sequence
gtcacttgcctgcatttaca

SEQ ID NO: 437306 - DNA, 20 bp, Artificial
  CRISPR gRNA sequence
gcatttacacagttaattga

SEQ ID NO: 437307 - DNA, 20 bp, Artificial
  CRISPR gRNA sequence
cacagttaattgatagatac

SEQ ID NO: 437308 - DNA, 20 bp, Artificial
  CRISPR gRNA sequence
atagatactggatttgaaac

SEQ ID NO: 437309 - DNA, 20 bp, Artificial
  CRISPR gRNA sequence
tagatactggatttgaaacc

SEQ ID NO: 437310 - DNA, 20 bp, Artificial
  CRISPR gRNA sequence
tgtcctgctcctcatcttta

SEQ ID NO: 437311 - DNA, 20 bp, Artificial
  CRISPR gRNA sequence
ctttatggtttctgcgatta

SEQ ID NO: 437312 - DNA, 20 bp, Artificial
  CRISPR gRNA sequence
tttctgcgattatggttaaa

SEQ ID NO: 437313 - DNA, 20 bp, Artificial
  CRISPR gRNA sequence
ttatggttaaatggattatt

SEQ ID NO: 437314 - DNA, 20 bp, Artificial
  CRISPR gRNA sequence
ttaaatggattattcagaaa

SEQ ID NO: 437315 - DNA, 20 bp, Artificial
  CRISPR gRNA sequence
ctaccccacccacacttacc

SEQ ID NO: 437316 - DNA, 20 bp, Artificial
  CRISPR gRNA sequence
taccccacccacacttacct

SEQ ID NO: 437317 - DNA, 20 bp, Artificial
  CRISPR gRNA sequence
cacacttacctgggtttatt

SEQ ID NO: 437318 - DNA, 20 bp, Artificial
  CRISPR gRNA sequence
cacttacctgggtttattca

SEQ ID NO: 437319 - DNA, 20 bp, Artificial
  CRISPR gRNA sequence
tacctgggtttattcagaga

SEQ ID NO: 437320 - DNA, 20 bp, Artificial
  CRISPR gRNA sequence
ggtttattcagagatagcca

SEQ ID NO: 437321 - DNA, 20 bp, Artificial
  CRISPR gRNA sequence
atatatatatttattattat

SEQ ID NO: 437322 - DNA, 20 bp, Artificial
  CRISPR gRNA sequence
tatatatatttattattatt

SEQ ID NO: 437323 - DNA, 20 bp, Artificial
  CRISPR gRNA sequence
tatatttattattattggga

SEQ ID NO: 437324 - DNA, 20 bp, Artificial
  CRISPR gRNA sequence
tatttattattattgggaca

SEQ ID NO: 437325 - DNA, 20 bp, Artificial
  CRISPR gRNA sequence
cagagtcttactctgtcacc

SEQ ID NO: 437326 - DNA, 20 bp, Artificial
  CRISPR gRNA sequence
agagtcttactctgtcacct

SEQ ID NO: 437327 - DNA, 20 bp, Artificial
  CRISPR gRNA sequence
agtcttactctgtcacctgg

SEQ ID NO: 437328 - DNA, 20 bp, Artificial
  CRISPR gRNA sequence
ttactctgtcacctgggagc

SEQ ID NO: 437329 - DNA, 20 bp, Artificial
  CRISPR gRNA sequence
gtcacctgggagctggacta

SEQ ID NO: 437330 - DNA, 20 bp, Artificial
  CRISPR gRNA sequence
acctgggagctggactacag

SEQ ID NO: 437331 - DNA, 20 bp, Artificial
  CRISPR gRNA sequence
ggactacagtggtgtgatct

SEQ ID NO: 437332 - DNA, 20 bp, Artificial
  CRISPR gRNA sequence
tcacttcaacctctgcctcc

SEQ ID NO: 437333 - DNA, 20 bp, Artificial
  CRISPR gRNA sequence
cacttcaacctctgcctcct

SEQ ID NO: 437334 - DNA, 20 bp, Artificial
  CRISPR gRNA sequence
aacctctgcctcctgggttc

SEQ ID NO: 437335 - DNA, 20 bp, Artificial
  CRISPR gRNA sequence
ttcaagcaattcttgtgcct

SEQ ID NO: 437336 - DNA, 20 bp, Artificial
  CRISPR gRNA sequence
ttcttgtgcctcagcctccc

SEQ ID NO: 437337 - DNA, 20 bp, Artificial
  CRISPR gRNA sequence
ttgtgcctcagcctcccaag

SEQ ID NO: 437338 - DNA, 20 bp, Artificial
  CRISPR gRNA sequence
cctcagcctcccaagtagct

SEQ ID NO: 437339 - DNA, 20 bp, Artificial
  CRISPR gRNA sequence
ctcccaagtagctgagatta

SEQ ID NO: 437340 - DNA, 20 bp, Artificial
  CRISPR gRNA sequence
tcccaagtagctgagattac

SEQ ID NO: 437341 - DNA, 20 bp, Artificial
  CRISPR gRNA sequence
caggcatatgccaccacacc

SEQ ID NO: 437342 - DNA, 20 bp, Artificial
  CRISPR gRNA sequence
catatgccaccacacctggc

SEQ ID NO: 437343 - DNA, 20 bp, Artificial
  CRISPR gRNA sequence
tttttttttttttttttttt

SEQ ID NO: 437344 - DNA, 20 bp, Artificial
  CRISPR gRNA sequence
ttttttttttttttttttgg

SEQ ID NO: 437345 - DNA, 20 bp, Artificial
  CRISPR gRNA sequence
ttttttttttttttttggta

SEQ ID NO: 437346 - DNA, 20 bp, Artificial
  CRISPR gRNA sequence
ttttttttttttggtagaga

SEQ ID NO: 437347 - DNA, 20 bp, Artificial
  CRISPR gRNA sequence
tttttttttttggtagagac

SEQ ID NO: 437348 - DNA, 20 bp, Artificial
  CRISPR gRNA sequence
ttttttttttggtagagaca

SEQ ID NO: 437349 - DNA, 20 bp, Artificial
  CRISPR gRNA sequence
cagggttttgccatgttgcc

SEQ ID NO: 437350 - DNA, 20 bp, Artificial
  CRISPR gRNA sequence
tgccatgttgcccagaaaat

SEQ ID NO: 437351 - DNA, 20 bp, Artificial
  CRISPR gRNA sequence
aaaattggtctcaatctcct

SEQ ID NO: 437352 - DNA, 20 bp, Artificial
  CRISPR gRNA sequence
tggtctcaatctcctgagct

SEQ ID NO: 437353 - DNA, 20 bp, Artificial
  CRISPR gRNA sequence
ggtctcaatctcctgagctc

SEQ ID NO: 437354 - DNA, 20 bp, Artificial
  CRISPR gRNA sequence
ctcaggtgatcctcctactt

SEQ ID NO: 437355 - DNA, 20 bp, Artificial
  CRISPR gRNA sequence
cctcctacttcagcctccca

SEQ ID NO: 437356 - DNA, 20 bp, Artificial
  CRISPR gRNA sequence
acttcagcctcccaaagtgc

SEQ ID NO: 437357 - DNA, 20 bp, Artificial
  CRISPR gRNA sequence
cttcagcctcccaaagtgct

SEQ ID NO: 437358 - DNA, 20 bp, Artificial
  CRISPR gRNA sequence
ctcccaaagtgctgggatta

SEQ ID NO: 437359 - DNA, 20 bp, Artificial
  CRISPR gRNA sequence
tcccaaagtgctgggattac

SEQ ID NO: 437360 - DNA, 20 bp, Artificial
  CRISPR gRNA sequence
aatatatacatatttaaaaa

SEQ ID NO: 437361 - DNA, 20 bp, Artificial
  CRISPR gRNA sequence
tatatacatatttaaaaata

SEQ ID NO: 437362 - DNA, 20 bp, Artificial
  CRISPR gRNA sequence
atatacatatttaaaaatag

SEQ ID NO: 437363 - DNA, 20 bp, Artificial
  CRISPR gRNA sequence
catatttaaaaatagaggct

SEQ ID NO: 437364 - DNA, 20 bp, Artificial
  CRISPR gRNA sequence
ttaaaaatagaggctgagca

SEQ ID NO: 437365 - DNA, 20 bp, Artificial
  CRISPR gRNA sequence
aaaatagaggctgagcacgg

SEQ ID NO: 437366 - DNA, 20 bp, Artificial
  CRISPR gRNA sequence
gtggcttacgcctgtaatcc

SEQ ID NO: 437367 - DNA, 20 bp, Artificial
  CRISPR gRNA sequence
cgcctgtaatcctagcactt

SEQ ID NO: 437368 - DNA, 20 bp, Artificial
  CRISPR gRNA sequence
gcctgtaatcctagcacttt

SEQ ID NO: 437369 - DNA, 20 bp, Artificial
  CRISPR gRNA sequence
ctgtaatcctagcactttgg

SEQ ID NO: 437370 - DNA, 20 bp, Artificial
  CRISPR gRNA sequence
tgtaatcctagcactttggg

SEQ ID NO: 437371 - DNA, 20 bp, Artificial
  CRISPR gRNA sequence
tcctagcactttgggaggcc

SEQ ID NO: 437372 - DNA, 20 bp, Artificial
  CRISPR gRNA sequence
cctagcactttgggaggccg

SEQ ID NO: 437373 - DNA, 20 bp, Artificial
  CRISPR gRNA sequence
gcactttgggaggccgaggt

SEQ ID NO: 437374 - DNA, 20 bp, Artificial
  CRISPR gRNA sequence
ctttgggaggccgaggtgag

SEQ ID NO: 437375 - DNA, 20 bp, Artificial
  CRISPR gRNA sequence
ccgaggtgagtggataacct

SEQ ID NO: 437376 - DNA, 20 bp, Artificial
  CRISPR gRNA sequence
cgaggtgagtggataacctg

SEQ ID NO: 437377 - DNA, 20 bp, Artificial
  CRISPR gRNA sequence
gtgagtggataacctgaggc

SEQ ID NO: 437378 - DNA, 20 bp, Artificial
  CRISPR gRNA sequence
tgagtggataacctgaggct

SEQ ID NO: 437379 - DNA, 20 bp, Artificial
  CRISPR gRNA sequence
agtggataacctgaggctgg

SEQ ID NO: 437380 - DNA, 20 bp, Artificial
  CRISPR gRNA sequence
taacctgaggctgggagttt

SEQ ID NO: 437381 - DNA, 20 bp, Artificial
  CRISPR gRNA sequence
tgaggctgggagtttgagac

SEQ ID NO: 437382 - DNA, 20 bp, Artificial
  CRISPR gRNA sequence
tgagaccagcctgaccaacg

SEQ ID NO: 437383 - DNA, 20 bp, Artificial
  CRISPR gRNA sequence
agaccagcctgaccaacgtg

SEQ ID NO: 437384 - DNA, 20 bp, Artificial
  CRISPR gRNA sequence
ctctactaaaaatacaaaat

SEQ ID NO: 437385 - DNA, 20 bp, Artificial
  CRISPR gRNA sequence
actaaaaatacaaaattagc

SEQ ID NO: 437386 - DNA, 20 bp, Artificial
  CRISPR gRNA sequence
ctaaaaatacaaaattagcc

SEQ ID NO: 437387 - DNA, 20 bp, Artificial
  CRISPR gRNA sequence
aatacaaaattagccgggca

SEQ ID NO: 437388 - DNA, 20 bp, Artificial
  CRISPR gRNA sequence
atacaaaattagccgggcat

SEQ ID NO: 437389 - DNA, 20 bp, Artificial
  CRISPR gRNA sequence
tacaaaattagccgggcatg

SEQ ID NO: 437390 - DNA, 20 bp, Artificial
  CRISPR gRNA sequence
acaaaattagccgggcatgg

SEQ ID NO: 437391 - DNA, 20 bp, Artificial
  CRISPR gRNA sequence
ggggcacatgcctataattc

SEQ ID NO: 437392 - DNA, 20 bp, Artificial
  CRISPR gRNA sequence
tgcctataattccagctact

SEQ ID NO: 437393 - DNA, 20 bp, Artificial
  CRISPR gRNA sequence
gcctataattccagctactc

SEQ ID NO: 437394 - DNA, 20 bp, Artificial
  CRISPR gRNA sequence
tataattccagctactcggg

SEQ ID NO: 437395 - DNA, 20 bp, Artificial
  CRISPR gRNA sequence
ttccagctactcgggaagct

SEQ ID NO: 437396 - DNA, 20 bp, Artificial
  CRISPR gRNA sequence
tccagctactcgggaagctg

SEQ ID NO: 437397 - DNA, 20 bp, Artificial
  CRISPR gRNA sequence
agctactcgggaagctgagg

SEQ ID NO: 437398 - DNA, 20 bp, Artificial
  CRISPR gRNA sequence
gctactcgggaagctgaggt

SEQ ID NO: 437399 - DNA, 20 bp, Artificial
  CRISPR gRNA sequence
tactcgggaagctgaggtgg

SEQ ID NO: 437400 - DNA, 20 bp, Artificial
  CRISPR gRNA sequence
ctgaggtgggagaatcactt

SEQ ID NO: 437401 - DNA, 20 bp, Artificial
  CRISPR gRNA sequence
gtgggagaatcacttgagcc

SEQ ID NO: 437402 - DNA, 20 bp, Artificial
  CRISPR gRNA sequence
tgggagaatcacttgagccc

SEQ ID NO: 437403 - DNA, 20 bp, Artificial
  CRISPR gRNA sequence
ggagaatcacttgagcccag

SEQ ID NO: 437404 - DNA, 20 bp, Artificial
  CRISPR gRNA sequence
gagaatcacttgagcccagg

SEQ ID NO: 437405 - DNA, 20 bp, Artificial
  CRISPR gRNA sequence
aatcacttgagcccaggagg

SEQ ID NO: 437406 - DNA, 20 bp, Artificial
  CRISPR gRNA sequence
tcacttgagcccaggaggcg

SEQ ID NO: 437407 - DNA, 20 bp, Artificial
  CRISPR gRNA sequence
cacttgagcccaggaggcgg

SEQ ID NO: 437408 - DNA, 20 bp, Artificial
  CRISPR gRNA sequence
agcccaggaggcggaggttg

SEQ ID NO: 437409 - DNA, 20 bp, Artificial
  CRISPR gRNA sequence
caggaggcggaggttgcagt

SEQ ID NO: 437410 - DNA, 20 bp, Artificial
  CRISPR gRNA sequence
ggcggaggttgcagtgagct

SEQ ID NO: 437411 - DNA, 20 bp, Artificial
  CRISPR gRNA sequence
gagatcgtgccattgcactc

SEQ ID NO: 437412 - DNA, 20 bp, Artificial
  CRISPR gRNA sequence
cgtgccattgcactccagcc

SEQ ID NO: 437413 - DNA, 20 bp, Artificial
  CRISPR gRNA sequence
gtgccattgcactccagcct

SEQ ID NO: 437414 - DNA, 20 bp, Artificial
  CRISPR gRNA sequence
tgcactccagcctgggcaac

SEQ ID NO: 437415 - DNA, 20 bp, Artificial
  CRISPR gRNA sequence
cactccagcctgggcaacaa

SEQ ID NO: 437416 - DNA, 20 bp, Artificial
  CRISPR gRNA sequence
aaaataaaataaaataaaaa

SEQ ID NO: 437417 - DNA, 20 bp, Artificial
  CRISPR gRNA sequence
aataaaataaaaatagaaat

SEQ ID NO: 437418 - DNA, 20 bp, Artificial
  CRISPR gRNA sequence
gagatcttgctatgttgctc

SEQ ID NO: 437419 - DNA, 20 bp, Artificial
  CRISPR gRNA sequence
tcttgctatgttgctcaagc

SEQ ID NO: 437420 - DNA, 20 bp, Artificial
  CRISPR gRNA sequence
tcaagctggtctcaaactcc

SEQ ID NO: 437421 - DNA, 20 bp, Artificial
  CRISPR gRNA sequence
caagctggtctcaaactcct

SEQ ID NO: 437422 - DNA, 20 bp, Artificial
  CRISPR gRNA sequence
cttaaataatcctcccacct

SEQ ID NO: 437423 - DNA, 20 bp, Artificial
  CRISPR gRNA sequence
acctcagcctcccaaaatgt

SEQ ID NO: 437424 - DNA, 20 bp, Artificial
  CRISPR gRNA sequence
cctcagcctcccaaaatgtt

SEQ ID NO: 437425 - DNA, 20 bp, Artificial
  CRISPR gRNA sequence
ctcccaaaatgttgggatta

SEQ ID NO: 437426 - DNA, 20 bp, Artificial
  CRISPR gRNA sequence
tcccaaaatgttgggattat

SEQ ID NO: 437427 - DNA, 20 bp, Artificial
  CRISPR gRNA sequence
aatgttgggattataggcat

SEQ ID NO: 437428 - DNA, 20 bp, Artificial
  CRISPR gRNA sequence
taggcatgagtcattgcact

SEQ ID NO: 437429 - DNA, 20 bp, Artificial
  CRISPR gRNA sequence
cattgcacttagcctcactt

SEQ ID NO: 437430 - DNA, 20 bp, Artificial
  CRISPR gRNA sequence
tcacttgagtatttccaaaa

SEQ ID NO: 437431 - DNA, 20 bp, Artificial
  CRISPR gRNA sequence
tgagtatttccaaaacagac

SEQ ID NO: 437432 - DNA, 20 bp, Artificial
  CRISPR gRNA sequence
gagtatttccaaaacagact

SEQ ID NO: 437433 - DNA, 20 bp, Artificial
  CRISPR gRNA sequence
agtatttccaaaacagacta

SEQ ID NO: 437434 - DNA, 20 bp, Artificial
  CRISPR gRNA sequence
aaaacagactagggattgtt

SEQ ID NO: 437435 - DNA, 20 bp, Artificial
  CRISPR gRNA sequence
aaacagactagggattgtta

SEQ ID NO: 437436 - DNA, 20 bp, Artificial
  CRISPR gRNA sequence
acagactagggattgttaag

SEQ ID NO: 437437 - DNA, 20 bp, Artificial
  CRISPR gRNA sequence
tacttttttgacttctgcca

SEQ ID NO: 437438 - DNA, 20 bp, Artificial
  CRISPR gRNA sequence
ttgacttctgccatggctca

SEQ ID NO: 437439 - DNA, 20 bp, Artificial
  CRISPR gRNA sequence
atggctcaaagtaaaacttt

SEQ ID NO: 437440 - DNA, 20 bp, Artificial
  CRISPR gRNA sequence
agctttactattatatatat

SEQ ID NO: 437441 - DNA, 20 bp, Artificial
  CRISPR gRNA sequence
ctttactattatatatatta

SEQ ID NO: 437442 - DNA, 20 bp, Artificial
  CRISPR gRNA sequence
tgaccataatttatacatat

SEQ ID NO: 437443 - DNA, 20 bp, Artificial
  CRISPR gRNA sequence
atacatattagcacttattc

SEQ ID NO: 437444 - DNA, 20 bp, Artificial
  CRISPR gRNA sequence
cacttattctagtttgtata

SEQ ID NO: 437445 - DNA, 20 bp, Artificial
  CRISPR gRNA sequence
cttattctagtttgtataaa

SEQ ID NO: 437446 - DNA, 20 bp, Artificial
  CRISPR gRNA sequence
ctagtttgtataaagagtga

SEQ ID NO: 437447 - DNA, 20 bp, Artificial
  CRISPR gRNA sequence
tagtttgtataaagagtgat

SEQ ID NO: 437448 - DNA, 20 bp, Artificial
  CRISPR gRNA sequence
gtataaagagtgatgggatc

SEQ ID NO: 437449 - DNA, 20 bp, Artificial
  CRISPR gRNA sequence
ataaagagtgatgggatcta

SEQ ID NO: 437450 - DNA, 20 bp, Artificial
  CRISPR gRNA sequence
taaagagtgatgggatctag

SEQ ID NO: 437451 - DNA, 20 bp, Artificial
  CRISPR gRNA sequence
tatgccactccaaaaaaaca

SEQ ID NO: 437452 - DNA, 20 bp, Artificial
  CRISPR gRNA sequence
tccaaaaaaacatggctact

SEQ ID NO: 437453 - DNA, 20 bp, Artificial
  CRISPR gRNA sequence
aaaaaaacatggctactgag

SEQ ID NO: 437454 - DNA, 20 bp, Artificial
  CRISPR gRNA sequence
aacatggctactgagaagta

SEQ ID NO: 437455 - DNA, 20 bp, Artificial
  CRISPR gRNA sequence
ggctactgagaagtacagat

SEQ ID NO: 437456 - DNA, 20 bp, Artificial
  CRISPR gRNA sequence
actgagaagtacagataaga

SEQ ID NO: 437457 - DNA, 20 bp, Artificial
  CRISPR gRNA sequence
ctgagaagtacagataagaa

SEQ ID NO: 437458 - DNA, 20 bp, Artificial
  CRISPR gRNA sequence
ttcatttccaatcttttccc

SEQ ID NO: 437459 - DNA, 20 bp, Artificial
  CRISPR gRNA sequence
atttccaatcttttccctgg

SEQ ID NO: 437460 - DNA, 20 bp, Artificial
  CRISPR gRNA sequence
atcttttccctggaagttgc

SEQ ID NO: 437461 - DNA, 20 bp, Artificial
  CRISPR gRNA sequence
cttttccctggaagttgctg

SEQ ID NO: 437462 - DNA, 20 bp, Artificial
  CRISPR gRNA sequence
ctggagaaaatattaaaatc

SEQ ID NO: 437463 - DNA, 20 bp, Artificial
  CRISPR gRNA sequence
tggagaaaatattaaaatca

SEQ ID NO: 437464 - DNA, 20 bp, Artificial
  CRISPR gRNA sequence
aaatattaaaatcaaggtga

SEQ ID NO: 437465 - DNA, 20 bp, Artificial
  CRISPR gRNA sequence
aatcaaggtgacagcttttt

SEQ ID NO: 437466 - DNA, 20 bp, Artificial
  CRISPR gRNA sequence
cccacaatcttccatctttc

SEQ ID NO: 437467 - DNA, 20 bp, Artificial
  CRISPR gRNA sequence
atctttctagtgtactctct

SEQ ID NO: 437468 - DNA, 20 bp, Artificial
  CRISPR gRNA sequence
tcctaactgatgaaatatga

SEQ ID NO: 437469 - DNA, 20 bp, Artificial
  CRISPR gRNA sequence
cctaactgatgaaatatgaa

SEQ ID NO: 437470 - DNA, 20 bp, Artificial
  CRISPR gRNA sequence
ctaactgatgaaatatgaaa

SEQ ID NO: 437471 - DNA, 20 bp, Artificial
  CRISPR gRNA sequence
gctttttaatctccattgcc

SEQ ID NO: 437472 - DNA, 20 bp, Artificial
  CRISPR gRNA sequence
ctttttaatctccattgcct

SEQ ID NO: 437473 - DNA, 20 bp, Artificial
  CRISPR gRNA sequence
taatctccattgcctaggcc

SEQ ID NO: 437474 - DNA, 20 bp, Artificial
  CRISPR gRNA sequence
tctttttatccctttcttct

SEQ ID NO: 437475 - DNA, 20 bp, Artificial
  CRISPR gRNA sequence
tctgtttatgctattttcat

SEQ ID NO: 437476 - DNA, 20 bp, Artificial
  CRISPR gRNA sequence
gtttatgctattttcattag

SEQ ID NO: 437477 - DNA, 20 bp, Artificial
  CRISPR gRNA sequence
cattagcagaatatatgttc

SEQ ID NO: 437478 - DNA, 20 bp, Artificial
  CRISPR gRNA sequence
ctagtccatgcattcctctc

SEQ ID NO: 437479 - DNA, 20 bp, Artificial
  CRISPR gRNA sequence
tccatgcattcctctccagc

SEQ ID NO: 437480 - DNA, 20 bp, Artificial
  CRISPR gRNA sequence
catttctcaactcgttctca

SEQ ID NO: 437481 - DNA, 20 bp, Artificial
  CRISPR gRNA sequence
tctcacagccatatttttca

SEQ ID NO: 437482 - DNA, 20 bp, Artificial
  CRISPR gRNA sequence
ctcacagccatatttttcaa

SEQ ID NO: 437483 - DNA, 20 bp, Artificial
  CRISPR gRNA sequence
cacagccatatttttcaaag

SEQ ID NO: 437484 - DNA, 20 bp, Artificial
  CRISPR gRNA sequence
ctccttgacccaccatcatc

SEQ ID NO: 437485 - DNA, 20 bp, Artificial
  CRISPR gRNA sequence
atcatctagtttctgctcca

SEQ ID NO: 437486 - DNA, 20 bp, Artificial
  CRISPR gRNA sequence
gtttctgctccaaagcacaa

SEQ ID NO: 437487 - DNA, 20 bp, Artificial
  CRISPR gRNA sequence
gctccaaagcacaacggaaa

SEQ ID NO: 437488 - DNA, 20 bp, Artificial
  CRISPR gRNA sequence
aaagcacaacggaaatggtc

SEQ ID NO: 437489 - DNA, 20 bp, Artificial
  CRISPR gRNA sequence
tcaagctcaccactgacctt

SEQ ID NO: 437490 - DNA, 20 bp, Artificial
  CRISPR gRNA sequence
ttttctaaattaaatattaa

SEQ ID NO: 437491 - DNA, 20 bp, Artificial
  CRISPR gRNA sequence
ttatcttttttttttttttt

SEQ ID NO: 437492 - DNA, 20 bp, Artificial
  CRISPR gRNA sequence
ctttttttttttttttgaga

SEQ ID NO: 437493 - DNA, 20 bp, Artificial
  CRISPR gRNA sequence
ttttttttttttttgagaca

SEQ ID NO: 437494 - DNA, 20 bp, Artificial
  CRISPR gRNA sequence
agagtttcactcttgttgct

SEQ ID NO: 437495 - DNA, 20 bp, Artificial
  CRISPR gRNA sequence
gagtttcactcttgttgctt

SEQ ID NO: 437496 - DNA, 20 bp, Artificial
  CRISPR gRNA sequence
ttcactcttgttgcttaggc

SEQ ID NO: 437497 - DNA, 20 bp, Artificial
  CRISPR gRNA sequence
cactcttgttgcttaggctg

SEQ ID NO: 437498 - DNA, 20 bp, Artificial
  CRISPR gRNA sequence
ttgcttaggctggagtgcaa

SEQ ID NO: 437499 - DNA, 20 bp, Artificial
  CRISPR gRNA sequence
ggagtgcaatggtgcaatct

SEQ ID NO: 437500 - DNA, 20 bp, Artificial
  CRISPR gRNA sequence
cactgcaacctctgcctccc

SEQ ID NO: 437501 - DNA, 20 bp, Artificial
  CRISPR gRNA sequence
actgcaacctctgcctcccc

SEQ ID NO: 437502 - DNA, 20 bp, Artificial
  CRISPR gRNA sequence
acctctgcctccccgggttc

SEQ ID NO: 437503 - DNA, 20 bp, Artificial
  CRISPR gRNA sequence
ttcaagtgattctcccccct

SEQ ID NO: 437504 - DNA, 20 bp, Artificial
  CRISPR gRNA sequence
ttctcccccctcagcctcct

SEQ ID NO: 437505 - DNA, 20 bp, Artificial
  CRISPR gRNA sequence
tcccccctcagcctcctgag

SEQ ID NO: 437506 - DNA, 20 bp, Artificial
  CRISPR gRNA sequence
ccctcagcctcctgagtagc

SEQ ID NO: 437507 - DNA, 20 bp, Artificial
  CRISPR gRNA sequence
cctcagcctcctgagtagct

SEQ ID NO: 437508 - DNA, 20 bp, Artificial
  CRISPR gRNA sequence
catgcatgtgccgccatgcc

SEQ ID NO: 437509 - DNA, 20 bp, Artificial
  CRISPR gRNA sequence
cctggctaattttgtatttt

SEQ ID NO: 437510 - DNA, 20 bp, Artificial
  CRISPR gRNA sequence
ggctaattttgtatttttag

SEQ ID NO: 437511 - DNA, 20 bp, Artificial
  CRISPR gRNA sequence
ctaattttgtatttttagta

SEQ ID NO: 437512 - DNA, 20 bp, Artificial
  CRISPR gRNA sequence
ttttgtatttttagtagaga

SEQ ID NO: 437513 - DNA, 20 bp, Artificial
  CRISPR gRNA sequence
tttgtatttttagtagagac

SEQ ID NO: 437514 - DNA, 20 bp, Artificial
  CRISPR gRNA sequence
ttgtatttttagtagagacg

SEQ ID NO: 437515 - DNA, 20 bp, Artificial
  CRISPR gRNA sequence
tgtatttttagtagagacgg

SEQ ID NO: 437516 - DNA, 20 bp, Artificial
  CRISPR gRNA sequence
agacgggggtttcaccatgt

SEQ ID NO: 437517 - DNA, 20 bp, Artificial
  CRISPR gRNA sequence
gggggtttcaccatgttggc

SEQ ID NO: 437518 - DNA, 20 bp, Artificial
  CRISPR gRNA sequence
ggggtttcaccatgttggcc

SEQ ID NO: 437519 - DNA, 20 bp, Artificial
  CRISPR gRNA sequence
tttcaccatgttggccaggc

SEQ ID NO: 437520 - DNA, 20 bp, Artificial
  CRISPR gRNA sequence
tggtctcaaactcttgacct

SEQ ID NO: 437521 - DNA, 20 bp, Artificial
  CRISPR gRNA sequence
ctcagatgatctgcccgcct

SEQ ID NO: 437522 - DNA, 20 bp, Artificial
  CRISPR gRNA sequence
ctgcccgccttggcctccca

SEQ ID NO: 437523 - DNA, 20 bp, Artificial
  CRISPR gRNA sequence
gccttggcctcccaaagtgc

SEQ ID NO: 437524 - DNA, 20 bp, Artificial
  CRISPR gRNA sequence
ccttggcctcccaaagtgct

SEQ ID NO: 437525 - DNA, 20 bp, Artificial
  CRISPR gRNA sequence
ctcccaaagtgctgggatta

SEQ ID NO: 437526 - DNA, 20 bp, Artificial
  CRISPR gRNA sequence
tcccaaagtgctgggattat

SEQ ID NO: 437527 - DNA, 20 bp, Artificial
  CRISPR gRNA sequence
agtgctgggattataggcgt

SEQ ID NO: 437528 - DNA, 20 bp, Artificial
  CRISPR gRNA sequence
taggcgtgagccaccgttcc

SEQ ID NO: 437529 - DNA, 20 bp, Artificial
  CRISPR gRNA sequence
tgatacctttatctttatta

SEQ ID NO: 437530 - DNA, 20 bp, Artificial
  CRISPR gRNA sequence
tttaaattgatcactcattc

SEQ ID NO: 437531 - DNA, 20 bp, Artificial
  CRISPR gRNA sequence
aattgatcactcattctaga

SEQ ID NO: 437532 - DNA, 20 bp, Artificial
  CRISPR gRNA sequence
ctagaaagtcctccttctct

SEQ ID NO: 437533 - DNA, 20 bp, Artificial
  CRISPR gRNA sequence
ctctttgatccattgctttt

SEQ ID NO: 437534 - DNA, 20 bp, Artificial
  CRISPR gRNA sequence
atcttcttctgcctgatcct

SEQ ID NO: 437535 - DNA, 20 bp, Artificial
  CRISPR gRNA sequence
ctgcctgatccttagatgtt

SEQ ID NO: 437536 - DNA, 20 bp, Artificial
  CRISPR gRNA sequence
ccttagatgttgagattcct

SEQ ID NO: 437537 - DNA, 20 bp, Artificial
  CRISPR gRNA sequence
cttagatgttgagattcctt

SEQ ID NO: 437538 - DNA, 20 bp, Artificial
  CRISPR gRNA sequence
ttagatgttgagattcctta

SEQ ID NO: 437539 - DNA, 20 bp, Artificial
  CRISPR gRNA sequence
atgttgagattccttagggc

SEQ ID NO: 437540 - DNA, 20 bp, Artificial
  CRISPR gRNA sequence
tgttgagattccttagggct

SEQ ID NO: 437541 - DNA, 20 bp, Artificial
  CRISPR gRNA sequence
agattccttagggctgggta

SEQ ID NO: 437542 - DNA, 20 bp, Artificial
  CRISPR gRNA sequence
ttccttagggctgggtatgg

SEQ ID NO: 437543 - DNA, 20 bp, Artificial
  CRISPR gRNA sequence
gtggtgcacgcctatcgtcc

SEQ ID NO: 437544 - DNA, 20 bp, Artificial
  CRISPR gRNA sequence
cgcctatcgtcccagctact

SEQ ID NO: 437545 - DNA, 20 bp, Artificial
  CRISPR gRNA sequence
gcctatcgtcccagctactc

SEQ ID NO: 437546 - DNA, 20 bp, Artificial
  CRISPR gRNA sequence
ctatcgtcccagctactcag

SEQ ID NO: 437547 - DNA, 20 bp, Artificial
  CRISPR gRNA sequence
cccagctactcaggagaatg

SEQ ID NO: 437548 - DNA, 20 bp, Artificial
  CRISPR gRNA sequence
agctactcaggagaatgaag

SEQ ID NO: 437549 - DNA, 20 bp, Artificial
  CRISPR gRNA sequence
gctactcaggagaatgaagc

SEQ ID NO: 437550 - DNA, 20 bp, Artificial
  CRISPR gRNA sequence
actcaggagaatgaagcagg

SEQ ID NO: 437551 - DNA, 20 bp, Artificial
  CRISPR gRNA sequence
atgaagcaggaagatcactt

SEQ ID NO: 437552 - DNA, 20 bp, Artificial
  CRISPR gRNA sequence
gcaggaagatcacttgagcc

SEQ ID NO: 437553 - DNA, 20 bp, Artificial
  CRISPR gRNA sequence
caggaagatcacttgagccc

SEQ ID NO: 437554 - DNA, 20 bp, Artificial
  CRISPR gRNA sequence
ggaagatcacttgagcccag

SEQ ID NO: 437555 - DNA, 20 bp, Artificial
  CRISPR gRNA sequence
tcacttgagcccaggagttt

SEQ ID NO: 437556 - DNA, 20 bp, Artificial
  CRISPR gRNA sequence
cacttgagcccaggagtttg

SEQ ID NO: 437557 - DNA, 20 bp, Artificial
  CRISPR gRNA sequence
atgatcttgctgctgcattc

SEQ ID NO: 437558 - DNA, 20 bp, Artificial
  CRISPR gRNA sequence
cttgctgctgcattctagcc

SEQ ID NO: 437559 - DNA, 20 bp, Artificial
  CRISPR gRNA sequence
ttgctgctgcattctagcct

SEQ ID NO: 437560 - DNA, 20 bp, Artificial
  CRISPR gRNA sequence
gcattctagcctgggtgaca

SEQ ID NO: 437561 - DNA, 20 bp, Artificial
  CRISPR gRNA sequence
ctagcctgggtgacacagca

SEQ ID NO: 437562 - DNA, 20 bp, Artificial
  CRISPR gRNA sequence
tagcctgggtgacacagcac

SEQ ID NO: 437563 - DNA, 20 bp, Artificial
  CRISPR gRNA sequence
agcctgggtgacacagcaca

SEQ ID NO: 437564 - DNA, 20 bp, Artificial
  CRISPR gRNA sequence
cctgggtgacacagcacagg

SEQ ID NO: 437565 - DNA, 20 bp, Artificial
  CRISPR gRNA sequence
agcacagggagaccctgtct

SEQ ID NO: 437566 - DNA, 20 bp, Artificial
  CRISPR gRNA sequence
cacagggagaccctgtctca

SEQ ID NO: 437567 - DNA, 20 bp, Artificial
  CRISPR gRNA sequence
gtctcagagaaaaacaacaa

SEQ ID NO: 437568 - DNA, 20 bp, Artificial
  CRISPR gRNA sequence
tcagagaaaaacaacaacag

SEQ ID NO: 437569 - DNA, 20 bp, Artificial
  CRISPR gRNA sequence
acaacaacagaagattcctg

SEQ ID NO: 437570 - DNA, 20 bp, Artificial
  CRISPR gRNA sequence
cttcctccaacatacatcta

SEQ ID NO: 437571 - DNA, 20 bp, Artificial
  CRISPR gRNA sequence
tcattattctgcatctcttt

SEQ ID NO: 437572 - DNA, 20 bp, Artificial
  CRISPR gRNA sequence
ttttggccattccttactcc

SEQ ID NO: 437573 - DNA, 20 bp, Artificial
  CRISPR gRNA sequence
taaaacccaaatcaatgtct

SEQ ID NO: 437574 - DNA, 20 bp, Artificial
  CRISPR gRNA sequence
aaatcaatgtctgagcacaa

SEQ ID NO: 437575 - DNA, 20 bp, Artificial
  CRISPR gRNA sequence
tgcctataatcctaacactt

SEQ ID NO: 437576 - DNA, 20 bp, Artificial
  CRISPR gRNA sequence
gcctataatcctaacacttc

SEQ ID NO: 437577 - DNA, 20 bp, Artificial
  CRISPR gRNA sequence
ctataatcctaacacttcgg

SEQ ID NO: 437578 - DNA, 20 bp, Artificial
  CRISPR gRNA sequence
tataatcctaacacttcggg

SEQ ID NO: 437579 - DNA, 20 bp, Artificial
  CRISPR gRNA sequence
tcctaacacttcgggaggcc

SEQ ID NO: 437580 - DNA, 20 bp, Artificial
  CRISPR gRNA sequence
aacacttcgggaggccaaga

SEQ ID NO: 437581 - DNA, 20 bp, Artificial
  CRISPR gRNA sequence
acacttcgggaggccaagac

SEQ ID NO: 437582 - DNA, 20 bp, Artificial
  CRISPR gRNA sequence
acttcgggaggccaagacag

SEQ ID NO: 437583 - DNA, 20 bp, Artificial
  CRISPR gRNA sequence
ttcgggaggccaagacagga

SEQ ID NO: 437584 - DNA, 20 bp, Artificial
  CRISPR gRNA sequence
ccaagacaggagagtcactt

SEQ ID NO: 437585 - DNA, 20 bp, Artificial
  CRISPR gRNA sequence
caagacaggagagtcacttg

SEQ ID NO: 437586 - DNA, 20 bp, Artificial
  CRISPR gRNA sequence
acaggagagtcacttgaggc

SEQ ID NO: 437587 - DNA, 20 bp, Artificial
  CRISPR gRNA sequence
caggagagtcacttgaggcc

SEQ ID NO: 437588 - DNA, 20 bp, Artificial
  CRISPR gRNA sequence
ggagagtcacttgaggccag

SEQ ID NO: 437589 - DNA, 20 bp, Artificial
  CRISPR gRNA sequence
tcacttgaggccaggagttt

SEQ ID NO: 437590 - DNA, 20 bp, Artificial
  CRISPR gRNA sequence
tgaggccaggagtttgagac

SEQ ID NO: 437591 - DNA, 20 bp, Artificial
  CRISPR gRNA sequence
ccaggagtttgagactagcc

SEQ ID NO: 437592 - DNA, 20 bp, Artificial
  CRISPR gRNA sequence
caggagtttgagactagcct

SEQ ID NO: 437593 - DNA, 20 bp, Artificial
  CRISPR gRNA sequence
actagcctgggcaacatatt

SEQ ID NO: 437594 - DNA, 20 bp, Artificial
  CRISPR gRNA sequence
gcaacatattgagattcacc

SEQ ID NO: 437595 - DNA, 20 bp, Artificial
  CRISPR gRNA sequence
caacatattgagattcaccc

SEQ ID NO: 437596 - DNA, 20 bp, Artificial
  CRISPR gRNA sequence
atattgagattcacccaggc

SEQ ID NO: 437597 - DNA, 20 bp, Artificial
  CRISPR gRNA sequence
attgagattcacccaggctg

SEQ ID NO: 437598 - DNA, 20 bp, Artificial
  CRISPR gRNA sequence
gattcacccaggctggagtg

SEQ ID NO: 437599 - DNA, 20 bp, Artificial
  CRISPR gRNA sequence
tcacccaggctggagtgcag

SEQ ID NO: 437600 - DNA, 20 bp, Artificial
  CRISPR gRNA sequence
ggagtgcagtggtgtgatca

SEQ ID NO: 437601 - DNA, 20 bp, Artificial
  CRISPR gRNA sequence
cactgcaacctctacctccc

SEQ ID NO: 437602 - DNA, 20 bp, Artificial
  CRISPR gRNA sequence
aacctctacctcccgagttc

SEQ ID NO: 437603 - DNA, 20 bp, Artificial
  CRISPR gRNA sequence
ttcaagcaactctcctgcct

SEQ ID NO: 437604 - DNA, 20 bp, Artificial
  CRISPR gRNA sequence
actctcctgcctcagcctcc

SEQ ID NO: 437605 - DNA, 20 bp, Artificial
  CRISPR gRNA sequence
ctcctgcctcagcctccaag

SEQ ID NO: 437606 - DNA, 20 bp, Artificial
  CRISPR gRNA sequence
tgcctcagcctccaagtagc

SEQ ID NO: 437607 - DNA, 20 bp, Artificial
  CRISPR gRNA sequence
gcctcagcctccaagtagct

SEQ ID NO: 437608 - DNA, 20 bp, Artificial
  CRISPR gRNA sequence
cctccaagtagctaggacca

SEQ ID NO: 437609 - DNA, 20 bp, Artificial
  CRISPR gRNA sequence
ctccaagtagctaggaccac

SEQ ID NO: 437610 - DNA, 20 bp, Artificial
  CRISPR gRNA sequence
ctaggaccacgggcatgtgc

SEQ ID NO: 437611 - DNA, 20 bp, Artificial
  CRISPR gRNA sequence
cgggcatgtgccagcatacc

SEQ ID NO: 437612 - DNA, 20 bp, Artificial
  CRISPR gRNA sequence
catgtgccagcatacctggc

SEQ ID NO: 437613 - DNA, 20 bp, Artificial
  CRISPR gRNA sequence
ctggctagtttttgtatttt

SEQ ID NO: 437614 - DNA, 20 bp, Artificial
  CRISPR gRNA sequence
gctagtttttgtatttttag

SEQ ID NO: 437615 - DNA, 20 bp, Artificial
  CRISPR gRNA sequence
tagtttttgtatttttagta

SEQ ID NO: 437616 - DNA, 20 bp, Artificial
  CRISPR gRNA sequence
tttgtatttttagtagagat

SEQ ID NO: 437617 - DNA, 20 bp, Artificial
  CRISPR gRNA sequence
ttgtatttttagtagagatg

SEQ ID NO: 437618 - DNA, 20 bp, Artificial
  CRISPR gRNA sequence
tgaggttttaccatgttgcc

SEQ ID NO: 437619 - DNA, 20 bp, Artificial
  CRISPR gRNA sequence
gaggttttaccatgttgccc

SEQ ID NO: 437620 - DNA, 20 bp, Artificial
  CRISPR gRNA sequence
ttttaccatgttgcccaggc

SEQ ID NO: 437621 - DNA, 20 bp, Artificial
  CRISPR gRNA sequence
caggctggtctcgaactccc

SEQ ID NO: 437622 - DNA, 20 bp, Artificial
  CRISPR gRNA sequence
ggtctcgaactcccaagctc

SEQ ID NO: 437623 - DNA, 20 bp, Artificial
  CRISPR gRNA sequence
tccacctgccttgcctccca

SEQ ID NO: 437624 - DNA, 20 bp, Artificial
  CRISPR gRNA sequence
tgccttgcctcccaaagtgc

SEQ ID NO: 437625 - DNA, 20 bp, Artificial
  CRISPR gRNA sequence
gccttgcctcccaaagtgct

SEQ ID NO: 437626 - DNA, 20 bp, Artificial
  CRISPR gRNA sequence
ctcccaaagtgctaggatta

SEQ ID NO: 437627 - DNA, 20 bp, Artificial
  CRISPR gRNA sequence
tcccaaagtgctaggattac

SEQ ID NO: 437628 - DNA, 20 bp, Artificial
  CRISPR gRNA sequence
agtgctaggattacaggcgt

SEQ ID NO: 437629 - DNA, 20 bp, Artificial
  CRISPR gRNA sequence
caggcgtgagccactgcatc

SEQ ID NO: 437630 - DNA, 20 bp, Artificial
  CRISPR gRNA sequence
aaacattaaaaaaaattatc

SEQ ID NO: 437631 - DNA, 20 bp, Artificial
  CRISPR gRNA sequence
taaaaaaaattatccagctg

SEQ ID NO: 437632 - DNA, 20 bp, Artificial
  CRISPR gRNA sequence
aaaaaattatccagctgtgg

SEQ ID NO: 437633 - DNA, 20 bp, Artificial
  CRISPR gRNA sequence
gctgtggtagtgtgcaccta

SEQ ID NO: 437634 - DNA, 20 bp, Artificial
  CRISPR gRNA sequence
gtagtgtgcacctatagttc

SEQ ID NO: 437635 - DNA, 20 bp, Artificial
  CRISPR gRNA sequence
cacctatagttctagctact

SEQ ID NO: 437636 - DNA, 20 bp, Artificial
  CRISPR gRNA sequence
ctatagttctagctactcag

SEQ ID NO: 437637 - DNA, 20 bp, Artificial
  CRISPR gRNA sequence
gttctagctactcagaagct

SEQ ID NO: 437638 - DNA, 20 bp, Artificial
  CRISPR gRNA sequence
tagctactcagaagctgaga

SEQ ID NO: 437639 - DNA, 20 bp, Artificial
  CRISPR gRNA sequence
agctactcagaagctgagat

SEQ ID NO: 437640 - DNA, 20 bp, Artificial
  CRISPR gRNA sequence
tactcagaagctgagatggg

SEQ ID NO: 437641 - DNA, 20 bp, Artificial
  CRISPR gRNA sequence
ctgagatgggtagatccctt

SEQ ID NO: 437642 - DNA, 20 bp, Artificial
  CRISPR gRNA sequence
atgggtagatcccttgagcc

SEQ ID NO: 437643 - DNA, 20 bp, Artificial
  CRISPR gRNA sequence
tgggtagatcccttgagccc

SEQ ID NO: 437644 - DNA, 20 bp, Artificial
  CRISPR gRNA sequence
ggtagatcccttgagcccag

SEQ ID NO: 437645 - DNA, 20 bp, Artificial
  CRISPR gRNA sequence
cccttgagcccaggagttca

SEQ ID NO: 437646 - DNA, 20 bp, Artificial
  CRISPR gRNA sequence
caggagttcaaagttgcaat

SEQ ID NO: 437647 - DNA, 20 bp, Artificial
  CRISPR gRNA sequence
atgatcttactactgcattc

SEQ ID NO: 437648 - DNA, 20 bp, Artificial
  CRISPR gRNA sequence
cttactactgcattccagcc

SEQ ID NO: 437649 - DNA, 20 bp, Artificial
  CRISPR gRNA sequence
ctgcattccagcctggccaa

SEQ ID NO: 437650 - DNA, 20 bp, Artificial
  CRISPR gRNA sequence
gcattccagcctggccaaca

SEQ ID NO: 437651 - DNA, 20 bp, Artificial
  CRISPR gRNA sequence
tccagcctggccaacagagc

SEQ ID NO: 437652 - DNA, 20 bp, Artificial
  CRISPR gRNA sequence
aaaaaaaaaaaaaaaaaaaa

SEQ ID NO: 437653 - DNA, 20 bp, Artificial
  CRISPR gRNA sequence
aaaaaaaaaaaaaaaaagaa

SEQ ID NO: 437654 - DNA, 20 bp, Artificial
  CRISPR gRNA sequence
aaaaaaaaaaaagaaaagaa

SEQ ID NO: 437655 - DNA, 20 bp, Artificial
  CRISPR gRNA sequence
aaaaaaaagaaaagaaaaga

SEQ ID NO: 437656 - DNA, 20 bp, Artificial
  CRISPR gRNA sequence
aaaaaaagaaaagaaaagaa

SEQ ID NO: 437657 - DNA, 20 bp, Artificial
  CRISPR gRNA sequence
agaaaagaaaggaaaatttt

SEQ ID NO: 437658 - DNA, 20 bp, Artificial
  CRISPR gRNA sequence
aatttttgaaactgcatccc

SEQ ID NO: 437659 - DNA, 20 bp, Artificial
  CRISPR gRNA sequence
ttttgaaactgcatccccag

SEQ ID NO: 437660 - DNA, 20 bp, Artificial
  CRISPR gRNA sequence
atccccagaagacaccttga

SEQ ID NO: 437661 - DNA, 20 bp, Artificial
  CRISPR gRNA sequence
caccttgaaagaccttgatc

SEQ ID NO: 437662 - DNA, 20 bp, Artificial
  CRISPR gRNA sequence
ccttgaaagaccttgatcca

SEQ ID NO: 437663 - DNA, 20 bp, Artificial
  CRISPR gRNA sequence
cttgaaagaccttgatccag

SEQ ID NO: 437664 - DNA, 20 bp, Artificial
  CRISPR gRNA sequence
gaccttgatccagaggtacc

SEQ ID NO: 437665 - DNA, 20 bp, Artificial
  CRISPR gRNA sequence
ttgatccagaggtacccagt

SEQ ID NO: 437666 - DNA, 20 bp, Artificial
  CRISPR gRNA sequence
ggtacccagtaagccacacc

SEQ ID NO: 437667 - DNA, 20 bp, Artificial
  CRISPR gRNA sequence
tggattcctgacccacaaca

SEQ ID NO: 437668 - DNA, 20 bp, Artificial
  CRISPR gRNA sequence
acccacaacacagaaatgat

SEQ ID NO: 437669 - DNA, 20 bp, Artificial
  CRISPR gRNA sequence
acagaaatgatgagataacg

SEQ ID NO: 437670 - DNA, 20 bp, Artificial
  CRISPR gRNA sequence
tgagataacgtagttgtttt

SEQ ID NO: 437671 - DNA, 20 bp, Artificial
  CRISPR gRNA sequence
gataacgtagttgttttcag

SEQ ID NO: 437672 - DNA, 20 bp, Artificial
  CRISPR gRNA sequence
ataacgtagttgttttcagc

SEQ ID NO: 437673 - DNA, 20 bp, Artificial
  CRISPR gRNA sequence
tagttgttttcagcgggtaa

SEQ ID NO: 437674 - DNA, 20 bp, Artificial
  CRISPR gRNA sequence
aaaagaaacccaaaacaaat

SEQ ID NO: 437675 - DNA, 20 bp, Artificial
  CRISPR gRNA sequence
aaagaaacccaaaacaaata

SEQ ID NO: 437676 - DNA, 20 bp, Artificial
  CRISPR gRNA sequence
ggatcacatctctgcccttc

SEQ ID NO: 437677 - DNA, 20 bp, Artificial
  CRISPR gRNA sequence
gatcacatctctgcccttca

SEQ ID NO: 437678 - DNA, 20 bp, Artificial
  CRISPR gRNA sequence
tctgcccttcaaggaaatct

SEQ ID NO: 437679 - DNA, 20 bp, Artificial
  CRISPR gRNA sequence
ctgcccttcaaggaaatcta

SEQ ID NO: 437680 - DNA, 20 bp, Artificial
  CRISPR gRNA sequence
aggaaatctaaggtttccta

SEQ ID NO: 437681 - DNA, 20 bp, Artificial
  CRISPR gRNA sequence
ggaaatctaaggtttcctac

SEQ ID NO: 437682 - DNA, 20 bp, Artificial
  CRISPR gRNA sequence
ctaaggtttcctacaggtct

SEQ ID NO: 437683 - DNA, 20 bp, Artificial
  CRISPR gRNA sequence
acaggtcttagaataaaatc

SEQ ID NO: 437684 - DNA, 20 bp, Artificial
  CRISPR gRNA sequence
aaaatccagactcctgatta

SEQ ID NO: 437685 - DNA, 20 bp, Artificial
  CRISPR gRNA sequence
tccagactcctgattatggc

SEQ ID NO: 437686 - DNA, 20 bp, Artificial
  CRISPR gRNA sequence
gactcctgattatggctgga

SEQ ID NO: 437687 - DNA, 20 bp, Artificial
  CRISPR gRNA sequence
actcctgattatggctggaa

SEQ ID NO: 437688 - DNA, 20 bp, Artificial
  CRISPR gRNA sequence
tatggctggaaaggtcttat

SEQ ID NO: 437689 - DNA, 20 bp, Artificial
  CRISPR gRNA sequence
tggaaaggtcttattggacc

SEQ ID NO: 437690 - DNA, 20 bp, Artificial
  CRISPR gRNA sequence
ggtcttattggacctagccc

SEQ ID NO: 437691 - DNA, 20 bp, Artificial
  CRISPR gRNA sequence
cctagccccagcctaccttt

SEQ ID NO: 437692 - DNA, 20 bp, Artificial
  CRISPR gRNA sequence
ctacctttcagaccttatct

SEQ ID NO: 437693 - DNA, 20 bp, Artificial
  CRISPR gRNA sequence
tacctttcagaccttatctt

SEQ ID NO: 437694 - DNA, 20 bp, Artificial
  CRISPR gRNA sequence
cttgggccgctcccttaatc

SEQ ID NO: 437695 - DNA, 20 bp, Artificial
  CRISPR gRNA sequence
ccttaatccagccacgtttt

SEQ ID NO: 437696 - DNA, 20 bp, Artificial
  CRISPR gRNA sequence
tccagccacgttttcagttt

SEQ ID NO: 437697 - DNA, 20 bp, Artificial
  CRISPR gRNA sequence
ccagccacgttttcagtttc

SEQ ID NO: 437698 - DNA, 20 bp, Artificial
  CRISPR gRNA sequence
cgttttcagtttcaggtact

SEQ ID NO: 437699 - DNA, 20 bp, Artificial
  CRISPR gRNA sequence
ttcagtttcaggtactcagc

SEQ ID NO: 437700 - DNA, 20 bp, Artificial
  CRISPR gRNA sequence
gtactcagcaagatctttac

SEQ ID NO: 437701 - DNA, 20 bp, Artificial
  CRISPR gRNA sequence
tactcagcaagatctttaca

SEQ ID NO: 437702 - DNA, 20 bp, Artificial
  CRISPR gRNA sequence
actcagcaagatctttacaa

SEQ ID NO: 437703 - DNA, 20 bp, Artificial
  CRISPR gRNA sequence
ctcagcaagatctttacaag

SEQ ID NO: 437704 - DNA, 20 bp, Artificial
  CRISPR gRNA sequence
tacaaggggctccctcatcc

SEQ ID NO: 437705 - DNA, 20 bp, Artificial
  CRISPR gRNA sequence
tcatcctggaatgctccttc

SEQ ID NO: 437706 - DNA, 20 bp, Artificial
  CRISPR gRNA sequence
gctccttctggctctttact

SEQ ID NO: 437707 - DNA, 20 bp, Artificial
  CRISPR gRNA sequence
tttacttggctgactcattt

SEQ ID NO: 437708 - DNA, 20 bp, Artificial
  CRISPR gRNA sequence
ggctgactcatttcagaaac

SEQ ID NO: 437709 - DNA, 20 bp, Artificial
  CRISPR gRNA sequence
tcatttcagaaacgagctta

SEQ ID NO: 437710 - DNA, 20 bp, Artificial
  CRISPR gRNA sequence
cgagcttaaagttcatctct

SEQ ID NO: 437711 - DNA, 20 bp, Artificial
  CRISPR gRNA sequence
gagcttaaagttcatctctg

SEQ ID NO: 437712 - DNA, 20 bp, Artificial
  CRISPR gRNA sequence
agcttaaagttcatctctga

SEQ ID NO: 437713 - DNA, 20 bp, Artificial
  CRISPR gRNA sequence
tatctgtttcactatgatgt

SEQ ID NO: 437714 - DNA, 20 bp, Artificial
  CRISPR gRNA sequence
gttgttgttttttttttttt

SEQ ID NO: 437715 - DNA, 20 bp, Artificial
  CRISPR gRNA sequence
ttgtttttttttttttgaga

SEQ ID NO: 437716 - DNA, 20 bp, Artificial
  CRISPR gRNA sequence
gtttttttttttttgagacg

SEQ ID NO: 437717 - DNA, 20 bp, Artificial
  CRISPR gRNA sequence
ggagtttcgctctcgttgcc

SEQ ID NO: 437718 - DNA, 20 bp, Artificial
  CRISPR gRNA sequence
gagtttcgctctcgttgccc

SEQ ID NO: 437719 - DNA, 20 bp, Artificial
  CRISPR gRNA sequence
ttcgctctcgttgcccaggc

SEQ ID NO: 437720 - DNA, 20 bp, Artificial
  CRISPR gRNA sequence
cgctctcgttgcccaggctg

SEQ ID NO: 437721 - DNA, 20 bp, Artificial
  CRISPR gRNA sequence
ttgcccaggctggagtgcaa

SEQ ID NO: 437722 - DNA, 20 bp, Artificial
  CRISPR gRNA sequence
ggagtgcaatggcgcaatct

SEQ ID NO: 437723 - DNA, 20 bp, Artificial
  CRISPR gRNA sequence
tcaccgcaacctccgtctcc

SEQ ID NO: 437724 - DNA, 20 bp, Artificial
  CRISPR gRNA sequence
caccgcaacctccgtctccc

SEQ ID NO: 437725 - DNA, 20 bp, Artificial
  CRISPR gRNA sequence
ttcatgtgattctcctgcct

SEQ ID NO: 437726 - DNA, 20 bp, Artificial
  CRISPR gRNA sequence
ttctcctgcctcagcctccc

SEQ ID NO: 437727 - DNA, 20 bp, Artificial
  CRISPR gRNA sequence
tcctgcctcagcctcccgag

SEQ ID NO: 437728 - DNA, 20 bp, Artificial
  CRISPR gRNA sequence
gcctcagcctcccgagtagc

SEQ ID NO: 437729 - DNA, 20 bp, Artificial
  CRISPR gRNA sequence
cctcagcctcccgagtagct

SEQ ID NO: 437730 - DNA, 20 bp, Artificial
  CRISPR gRNA sequence
ctcccgagtagctgggatta

SEQ ID NO: 437731 - DNA, 20 bp, Artificial
  CRISPR gRNA sequence
tcccgagtagctgggattac

SEQ ID NO: 437732 - DNA, 20 bp, Artificial
  CRISPR gRNA sequence
agtagctgggattacaggca

SEQ ID NO: 437733 - DNA, 20 bp, Artificial
  CRISPR gRNA sequence
gtagctgggattacaggcat

SEQ ID NO: 437734 - DNA, 20 bp, Artificial
  CRISPR gRNA sequence
caggcatgggccaccacatc

SEQ ID NO: 437735 - DNA, 20 bp, Artificial
  CRISPR gRNA sequence
tccagctaattttgtatttt

SEQ ID NO: 437736 - DNA, 20 bp, Artificial
  CRISPR gRNA sequence
agctaattttgtatttttag

SEQ ID NO: 437737 - DNA, 20 bp, Artificial
  CRISPR gRNA sequence
ctaattttgtatttttagta

SEQ ID NO: 437738 - DNA, 20 bp, Artificial
  CRISPR gRNA sequence
ttttgtatttttagtagaga

SEQ ID NO: 437739 - DNA, 20 bp, Artificial
  CRISPR gRNA sequence
tttgtatttttagtagagac

SEQ ID NO: 437740 - DNA, 20 bp, Artificial
  CRISPR gRNA sequence
ttgtatttttagtagagacg

SEQ ID NO: 437741 - DNA, 20 bp, Artificial
  CRISPR gRNA sequence
gagacggggtttctccatgt

SEQ ID NO: 437742 - DNA, 20 bp, Artificial
  CRISPR gRNA sequence
cggggtttctccatgttggt

SEQ ID NO: 437743 - DNA, 20 bp, Artificial
  CRISPR gRNA sequence
ggggtttctccatgttggtc

SEQ ID NO: 437744 - DNA, 20 bp, Artificial
  CRISPR gRNA sequence
tttctccatgttggtcaggc

SEQ ID NO: 437745 - DNA, 20 bp, Artificial
  CRISPR gRNA sequence
catgttggtcaggctggtct

SEQ ID NO: 437746 - DNA, 20 bp, Artificial
  CRISPR gRNA sequence
atgttggtcaggctggtctt

SEQ ID NO: 437747 - DNA, 20 bp, Artificial
  CRISPR gRNA sequence
ggtcaggctggtcttgggtc

SEQ ID NO: 437748 - DNA, 20 bp, Artificial
  CRISPR gRNA sequence
gtcaggctggtcttgggtct

SEQ ID NO: 437749 - DNA, 20 bp, Artificial
  CRISPR gRNA sequence
tcaggctggtcttgggtctg

SEQ ID NO: 437750 - DNA, 20 bp, Artificial
  CRISPR gRNA sequence
actgttttcttttatttctt

SEQ ID NO: 437751 - DNA, 20 bp, Artificial
  CRISPR gRNA sequence
tttatttctttggtctccca

SEQ ID NO: 437752 - DNA, 20 bp, Artificial
  CRISPR gRNA sequence
ttatttctttggtctcccac

SEQ ID NO: 437753 - DNA, 20 bp, Artificial
  CRISPR gRNA sequence
atttctttggtctcccacag

SEQ ID NO: 437754 - DNA, 20 bp, Artificial
  CRISPR gRNA sequence
ttctttggtctcccacagga

SEQ ID NO: 437755 - DNA, 20 bp, Artificial
  CRISPR gRNA sequence
ggtctcccacaggagagcgt

SEQ ID NO: 437756 - DNA, 20 bp, Artificial
  CRISPR gRNA sequence
gagcgtgagcttcgtgaaat

SEQ ID NO: 437757 - DNA, 20 bp, Artificial
  CRISPR gRNA sequence
agcgtgagcttcgtgaaatt

SEQ ID NO: 437758 - DNA, 20 bp, Artificial
  CRISPR gRNA sequence
gcgtgagcttcgtgaaatta

SEQ ID NO: 437759 - DNA, 20 bp, Artificial
  CRISPR gRNA sequence
tgttcctgtgttccttgtgc

SEQ ID NO: 437760 - DNA, 20 bp, Artificial
  CRISPR gRNA sequence
gttcctgtgttccttgtgcc

SEQ ID NO: 437761 - DNA, 20 bp, Artificial
  CRISPR gRNA sequence
ccttgtgccaggcaaactgc

SEQ ID NO: 437762 - DNA, 20 bp, Artificial
  CRISPR gRNA sequence
caggcaaactgccagacaca

SEQ ID NO: 437763 - DNA, 20 bp, Artificial
  CRISPR gRNA sequence
gcaaactgccagacacatag

SEQ ID NO: 437764 - DNA, 20 bp, Artificial
  CRISPR gRNA sequence
aaactgccagacacatagta

SEQ ID NO: 437765 - DNA, 20 bp, Artificial
  CRISPR gRNA sequence
aactgccagacacatagtag

SEQ ID NO: 437766 - DNA, 20 bp, Artificial
  CRISPR gRNA sequence
tctcataatatttgttaaat

SEQ ID NO: 437767 - DNA, 20 bp, Artificial
  CRISPR gRNA sequence
tttattattattttctaaca

SEQ ID NO: 437768 - DNA, 20 bp, Artificial
  CRISPR gRNA sequence
cacagtccatataactatct

SEQ ID NO: 437769 - DNA, 20 bp, Artificial
  CRISPR gRNA sequence
acagtccatataactatcta

SEQ ID NO: 437770 - DNA, 20 bp, Artificial
  CRISPR gRNA sequence
aactatctaaggcacacgtt

SEQ ID NO: 437771 - DNA, 20 bp, Artificial
  CRISPR gRNA sequence
ctatctaaggcacacgttga

SEQ ID NO: 437772 - DNA, 20 bp, Artificial
  CRISPR gRNA sequence
agtttcatttaactcaatct

SEQ ID NO: 437773 - DNA, 20 bp, Artificial
  CRISPR gRNA sequence
catttaactcaatctgagat

SEQ ID NO: 437774 - DNA, 20 bp, Artificial
  CRISPR gRNA sequence
aactcaatctgagatgagac

SEQ ID NO: 437775 - DNA, 20 bp, Artificial
  CRISPR gRNA sequence
ccctaaactatgcgtgcttc

SEQ ID NO: 437776 - DNA, 20 bp, Artificial
  CRISPR gRNA sequence
ttttatgaatgcatttttat

SEQ ID NO: 437777 - DNA, 20 bp, Artificial
  CRISPR gRNA sequence
ggcttttgtttcccccttac

SEQ ID NO: 437778 - DNA, 20 bp, Artificial
  CRISPR gRNA sequence
gcttttgtttcccccttact

SEQ ID NO: 437779 - DNA, 20 bp, Artificial
  CRISPR gRNA sequence
cttttgtttcccccttacta

SEQ ID NO: 437780 - DNA, 20 bp, Artificial
  CRISPR gRNA sequence
cccttactagggtattctca

SEQ ID NO: 437781 - DNA, 20 bp, Artificial
  CRISPR gRNA sequence
actagggtattctcatagca

SEQ ID NO: 437782 - DNA, 20 bp, Artificial
  CRISPR gRNA sequence
tagggtattctcatagcaaa

SEQ ID NO: 437783 - DNA, 20 bp, Artificial
  CRISPR gRNA sequence
ggtattctcatagcaaagag

SEQ ID NO: 437784 - DNA, 20 bp, Artificial
  CRISPR gRNA sequence
ctcatagcaaagagaagata

SEQ ID NO: 437785 - DNA, 20 bp, Artificial
  CRISPR gRNA sequence
aaagagaagatacagaattt

SEQ ID NO: 437786 - DNA, 20 bp, Artificial
  CRISPR gRNA sequence
aagagaagatacagaattta

SEQ ID NO: 437787 - DNA, 20 bp, Artificial
  CRISPR gRNA sequence
gaagatacagaatttaaggt

SEQ ID NO: 437788 - DNA, 20 bp, Artificial
  CRISPR gRNA sequence
agaatttaaggtaagaataa

SEQ ID NO: 437789 - DNA, 20 bp, Artificial
  CRISPR gRNA sequence
ttaaggtaagaataatggaa

SEQ ID NO: 437790 - DNA, 20 bp, Artificial
  CRISPR gRNA sequence
taaggtaagaataatggaat

SEQ ID NO: 437791 - DNA, 20 bp, Artificial
  CRISPR gRNA sequence
aaggtaagaataatggaatg

SEQ ID NO: 437792 - DNA, 20 bp, Artificial
  CRISPR gRNA sequence
taagaataatggaatggggt

SEQ ID NO: 437793 - DNA, 20 bp, Artificial
  CRISPR gRNA sequence
aagaataatggaatggggtt

SEQ ID NO: 437794 - DNA, 20 bp, Artificial
  CRISPR gRNA sequence
taatggaatggggttgggaa

SEQ ID NO: 437795 - DNA, 20 bp, Artificial
  CRISPR gRNA sequence
aatggaatggggttgggaaa

SEQ ID NO: 437796 - DNA, 20 bp, Artificial
  CRISPR gRNA sequence
gaatggggttgggaaaaggt

SEQ ID NO: 437797 - DNA, 20 bp, Artificial
  CRISPR gRNA sequence
ttgggaaaaggtgagaatct

SEQ ID NO: 437798 - DNA, 20 bp, Artificial
  CRISPR gRNA sequence
ggaaaaggtgagaatcttgg

SEQ ID NO: 437799 - DNA, 20 bp, Artificial
  CRISPR gRNA sequence
acatgtctgatcttttctct

SEQ ID NO: 437800 - DNA, 20 bp, Artificial
  CRISPR gRNA sequence
ttctctgagaaatcctgtcc

SEQ ID NO: 437801 - DNA, 20 bp, Artificial
  CRISPR gRNA sequence
tctctgagaaatcctgtcct

SEQ ID NO: 437802 - DNA, 20 bp, Artificial
  CRISPR gRNA sequence
ctctgagaaatcctgtcctg

SEQ ID NO: 437803 - DNA, 20 bp, Artificial
  CRISPR gRNA sequence
aaatcctgtcctggggcttt

SEQ ID NO: 437804 - DNA, 20 bp, Artificial
  CRISPR gRNA sequence
gtcctggggctttgagatct

SEQ ID NO: 437805 - DNA, 20 bp, Artificial
  CRISPR gRNA sequence
tttatacttccttctttctc

SEQ ID NO: 437806 - DNA, 20 bp, Artificial
  CRISPR gRNA sequence
ttatacttccttctttctct

SEQ ID NO: 437807 - DNA, 20 bp, Artificial
  CRISPR gRNA sequence
cttccttctttctctaggtc

SEQ ID NO: 437808 - DNA, 20 bp, Artificial
  CRISPR gRNA sequence
tttctctaggtctagttatg

SEQ ID NO: 437809 - DNA, 20 bp, Artificial
  CRISPR gRNA sequence
tgtgtacttcctgacacctc

SEQ ID NO: 437810 - DNA, 20 bp, Artificial
  CRISPR gRNA sequence
cctgacacctctagcttctt

SEQ ID NO: 437811 - DNA, 20 bp, Artificial
  CRISPR gRNA sequence
ctctagcttctttagttcta

SEQ ID NO: 437812 - DNA, 20 bp, Artificial
  CRISPR gRNA sequence
gcttctttagttctaaagtt

SEQ ID NO: 437813 - DNA, 20 bp, Artificial
  CRISPR gRNA sequence
cttctttagttctaaagtta

SEQ ID NO: 437814 - DNA, 20 bp, Artificial
  CRISPR gRNA sequence
ttagttctaaagttaaggta

SEQ ID NO: 437815 - DNA, 20 bp, Artificial
  CRISPR gRNA sequence
cttattcatctcgatattaa

SEQ ID NO: 437816 - DNA, 20 bp, Artificial
  CRISPR gRNA sequence
ccactgaactgaaacatcaa

SEQ ID NO: 437817 - DNA, 20 bp, Artificial
  CRISPR gRNA sequence
aactgaaacatcaacggatt

SEQ ID NO: 437818 - DNA, 20 bp, Artificial
  CRISPR gRNA sequence
gattgagctcctattatatc

SEQ ID NO: 437819 - DNA, 20 bp, Artificial
  CRISPR gRNA sequence
attgagctcctattatatcc

SEQ ID NO: 437820 - DNA, 20 bp, Artificial
  CRISPR gRNA sequence
ttgagctcctattatatcca

SEQ ID NO: 437821 - DNA, 20 bp, Artificial
  CRISPR gRNA sequence
ctcctattatatccagggtc

SEQ ID NO: 437822 - DNA, 20 bp, Artificial
  CRISPR gRNA sequence
tcctattatatccagggtct

SEQ ID NO: 437823 - DNA, 20 bp, Artificial
  CRISPR gRNA sequence
tccagggtctgggctgcact

SEQ ID NO: 437824 - DNA, 20 bp, Artificial
  CRISPR gRNA sequence
ccagggtctgggctgcactt

SEQ ID NO: 437825 - DNA, 20 bp, Artificial
  CRISPR gRNA sequence
tgggctgcacttaggcgtta

SEQ ID NO: 437826 - DNA, 20 bp, Artificial
  CRISPR gRNA sequence
gctgcacttaggcgttacag

SEQ ID NO: 437827 - DNA, 20 bp, Artificial
  CRISPR gRNA sequence
cacttaggcgttacagaagt

SEQ ID NO: 437828 - DNA, 20 bp, Artificial
  CRISPR gRNA sequence
taggcgttacagaagtgagc

SEQ ID NO: 437829 - DNA, 20 bp, Artificial
  CRISPR gRNA sequence
acagaagtgagcaagaaacc

SEQ ID NO: 437830 - DNA, 20 bp, Artificial
  CRISPR gRNA sequence
agaaacccagtatctgttct

SEQ ID NO: 437831 - DNA, 20 bp, Artificial
  CRISPR gRNA sequence
gttctcagcatttctgtaaa

SEQ ID NO: 437832 - DNA, 20 bp, Artificial
  CRISPR gRNA sequence
cagcatttctgtaaacagcc

SEQ ID NO: 437833 - DNA, 20 bp, Artificial
  CRISPR gRNA sequence
agcatttctgtaaacagccc

SEQ ID NO: 437834 - DNA, 20 bp, Artificial
  CRISPR gRNA sequence
agcccaggcattttcaactt

SEQ ID NO: 437835 - DNA, 20 bp, Artificial
  CRISPR gRNA sequence
tttcaactttagtttcctat

SEQ ID NO: 437836 - DNA, 20 bp, Artificial
  CRISPR gRNA sequence
agtttcctattagaatcacc

SEQ ID NO: 437837 - DNA, 20 bp, Artificial
  CRISPR gRNA sequence
gtttcctattagaatcaccc

SEQ ID NO: 437838 - DNA, 20 bp, Artificial
  CRISPR gRNA sequence
ttagaatcacccaggcactg

SEQ ID NO: 437839 - DNA, 20 bp, Artificial
  CRISPR gRNA sequence
ggcactgaagtgtactaatg

SEQ ID NO: 437840 - DNA, 20 bp, Artificial
  CRISPR gRNA sequence
gcactgaagtgtactaatgc

SEQ ID NO: 437841 - DNA, 20 bp, Artificial
  CRISPR gRNA sequence
cactgaagtgtactaatgca

SEQ ID NO: 437842 - DNA, 20 bp, Artificial
  CRISPR gRNA sequence
tactaatgcagggccaaccc

SEQ ID NO: 437843 - DNA, 20 bp, Artificial
  CRISPR gRNA sequence
ctaatgcagggccaacccca

SEQ ID NO: 437844 - DNA, 20 bp, Artificial
  CRISPR gRNA sequence
caaccccagagcaactgaat

SEQ ID NO: 437845 - DNA, 20 bp, Artificial
  CRISPR gRNA sequence
agcaactgaatcagaatctc

SEQ ID NO: 437846 - DNA, 20 bp, Artificial
  CRISPR gRNA sequence
gcaactgaatcagaatctct

SEQ ID NO: 437847 - DNA, 20 bp, Artificial
  CRISPR gRNA sequence
caactgaatcagaatctctg

SEQ ID NO: 437848 - DNA, 20 bp, Artificial
  CRISPR gRNA sequence
aatcagaatctctggggatg

SEQ ID NO: 437849 - DNA, 20 bp, Artificial
  CRISPR gRNA sequence
aatctctggggatgaagcct

SEQ ID NO: 437850 - DNA, 20 bp, Artificial
  CRISPR gRNA sequence
ctggggatgaagcctaagca

SEQ ID NO: 437851 - DNA, 20 bp, Artificial
  CRISPR gRNA sequence
aagcatagaaattgttctaa

SEQ ID NO: 437852 - DNA, 20 bp, Artificial
  CRISPR gRNA sequence
aaattgttctaaaagctctc

SEQ ID NO: 437853 - DNA, 20 bp, Artificial
  CRISPR gRNA sequence
aattgttctaaaagctctcc

SEQ ID NO: 437854 - DNA, 20 bp, Artificial
  CRISPR gRNA sequence
aaaagctctccaggtgattc

SEQ ID NO: 437855 - DNA, 20 bp, Artificial
  CRISPR gRNA sequence
ctccaggtgattctagtgaa

SEQ ID NO: 437856 - DNA, 20 bp, Artificial
  CRISPR gRNA sequence
aggtgattctagtgaacagt

SEQ ID NO: 437857 - DNA, 20 bp, Artificial
  CRISPR gRNA sequence
ggtgattctagtgaacagtc

SEQ ID NO: 437858 - DNA, 20 bp, Artificial
  CRISPR gRNA sequence
gtgattctagtgaacagtca

SEQ ID NO: 437859 - DNA, 20 bp, Artificial
  CRISPR gRNA sequence
tctagtgaacagtcagggct

SEQ ID NO: 437860 - DNA, 20 bp, Artificial
  CRISPR gRNA sequence
cagtcagggctgagaactgc

SEQ ID NO: 437861 - DNA, 20 bp, Artificial
  CRISPR gRNA sequence
tgagaactgctagtctgtta

SEQ ID NO: 437862 - DNA, 20 bp, Artificial
  CRISPR gRNA sequence
acccacacatccatttcaaa

SEQ ID NO: 437863 - DNA, 20 bp, Artificial
  CRISPR gRNA sequence
cccacacatccatttcaaat

SEQ ID NO: 437864 - DNA, 20 bp, Artificial
  CRISPR gRNA sequence
acatccatttcaaataggta

SEQ ID NO: 437865 - DNA, 20 bp, Artificial
  CRISPR gRNA sequence
gtatggcttacataacttac

SEQ ID NO: 437866 - DNA, 20 bp, Artificial
  CRISPR gRNA sequence
ttacataacttactagattt

SEQ ID NO: 437867 - DNA, 20 bp, Artificial
  CRISPR gRNA sequence
cttactagattttagacttt

SEQ ID NO: 437868 - DNA, 20 bp, Artificial
  CRISPR gRNA sequence
tttagacttttagtgatgtt

SEQ ID NO: 437869 - DNA, 20 bp, Artificial
  CRISPR gRNA sequence
agtgatgtttggcacatgaa

SEQ ID NO: 437870 - DNA, 20 bp, Artificial
  CRISPR gRNA sequence
tgaatggaatacaatatatt

SEQ ID NO: 437871 - DNA, 20 bp, Artificial
  CRISPR gRNA sequence
ttggattacaaaaatgattc

SEQ ID NO: 437872 - DNA, 20 bp, Artificial
  CRISPR gRNA sequence
tggattacaaaaatgattct

SEQ ID NO: 437873 - DNA, 20 bp, Artificial
  CRISPR gRNA sequence
ttacaaaaatgattctgggc

SEQ ID NO: 437874 - DNA, 20 bp, Artificial
  CRISPR gRNA sequence
tacaaaaatgattctgggct

SEQ ID NO: 437875 - DNA, 20 bp, Artificial
  CRISPR gRNA sequence
tgattctgggctaggtgctg

SEQ ID NO: 437876 - DNA, 20 bp, Artificial
  CRISPR gRNA sequence
gtgctgtggcttacgcctat

SEQ ID NO: 437877 - DNA, 20 bp, Artificial
  CRISPR gRNA sequence
gtggcttacgcctataagcc

SEQ ID NO: 437878 - DNA, 20 bp, Artificial
  CRISPR gRNA sequence
cgcctataagcccagcactt

SEQ ID NO: 437879 - DNA, 20 bp, Artificial
  CRISPR gRNA sequence
gcctataagcccagcacttt

SEQ ID NO: 437880 - DNA, 20 bp, Artificial
  CRISPR gRNA sequence
ctataagcccagcactttgg

SEQ ID NO: 437881 - DNA, 20 bp, Artificial
  CRISPR gRNA sequence
tataagcccagcactttggg

SEQ ID NO: 437882 - DNA, 20 bp, Artificial
  CRISPR gRNA sequence
gcccagcactttgggaggct

SEQ ID NO: 437883 - DNA, 20 bp, Artificial
  CRISPR gRNA sequence
cccagcactttgggaggctg

SEQ ID NO: 437884 - DNA, 20 bp, Artificial
  CRISPR gRNA sequence
agcactttgggaggctgagg

SEQ ID NO: 437885 - DNA, 20 bp, Artificial
  CRISPR gRNA sequence
gcactttgggaggctgaggt

SEQ ID NO: 437886 - DNA, 20 bp, Artificial
  CRISPR gRNA sequence
actttgggaggctgaggtgg

SEQ ID NO: 437887 - DNA, 20 bp, Artificial
  CRISPR gRNA sequence
ctttgggaggctgaggtggg

SEQ ID NO: 437888 - DNA, 20 bp, Artificial
  CRISPR gRNA sequence
ctgaggtgggaggatcacat

SEQ ID NO: 437889 - DNA, 20 bp, Artificial
  CRISPR gRNA sequence
gtgggaggatcacatgagcc

SEQ ID NO: 437890 - DNA, 20 bp, Artificial
  CRISPR gRNA sequence
tgggaggatcacatgagccc

SEQ ID NO: 437891 - DNA, 20 bp, Artificial
  CRISPR gRNA sequence
ggaggatcacatgagcccag

SEQ ID NO: 437892 - DNA, 20 bp, Artificial
  CRISPR gRNA sequence
tcacatgagcccaggagttc

SEQ ID NO: 437893 - DNA, 20 bp, Artificial
  CRISPR gRNA sequence
tgagcccaggagttcaagac

SEQ ID NO: 437894 - DNA, 20 bp, Artificial
  CRISPR gRNA sequence
ccaggagttcaagaccagcc

SEQ ID NO: 437895 - DNA, 20 bp, Artificial
  CRISPR gRNA sequence
caggagttcaagaccagcct

SEQ ID NO: 437896 - DNA, 20 bp, Artificial
  CRISPR gRNA sequence
accagcctgggcaacatgat

SEQ ID NO: 437897 - DNA, 20 bp, Artificial
  CRISPR gRNA sequence
acctcttctctacaaaaaaa

SEQ ID NO: 437898 - DNA, 20 bp, Artificial
  CRISPR gRNA sequence
ctacaaaaaaatggaaacat

SEQ ID NO: 437899 - DNA, 20 bp, Artificial
  CRISPR gRNA sequence
tacaaaaaaatggaaacatt

SEQ ID NO: 437900 - DNA, 20 bp, Artificial
  CRISPR gRNA sequence
aaaaaaatggaaacattagg

SEQ ID NO: 437901 - DNA, 20 bp, Artificial
  CRISPR gRNA sequence
aaaatggaaacattaggtgg

SEQ ID NO: 437902 - DNA, 20 bp, Artificial
  CRISPR gRNA sequence
aaatggaaacattaggtgga

SEQ ID NO: 437903 - DNA, 20 bp, Artificial
  CRISPR gRNA sequence
acattaggtggaaggattgc

SEQ ID NO: 437904 - DNA, 20 bp, Artificial
  CRISPR gRNA sequence
attaggtggaaggattgctg

SEQ ID NO: 437905 - DNA, 20 bp, Artificial
  CRISPR gRNA sequence
gtggaaggattgctggagca

SEQ ID NO: 437906 - DNA, 20 bp, Artificial
  CRISPR gRNA sequence
tggaaggattgctggagcac

SEQ ID NO: 437907 - DNA, 20 bp, Artificial
  CRISPR gRNA sequence
gaaggattgctggagcacag

SEQ ID NO: 437908 - DNA, 20 bp, Artificial
  CRISPR gRNA sequence
ttgctggagcacaggagatg

SEQ ID NO: 437909 - DNA, 20 bp, Artificial
  CRISPR gRNA sequence
tgctggagcacaggagatga

SEQ ID NO: 437910 - DNA, 20 bp, Artificial
  CRISPR gRNA sequence
caggagatgaaggctgcaat

SEQ ID NO: 437911 - DNA, 20 bp, Artificial
  CRISPR gRNA sequence
tgtgccactgcattcccacc

SEQ ID NO: 437912 - DNA, 20 bp, Artificial
  CRISPR gRNA sequence
gtgccactgcattcccacct

SEQ ID NO: 437913 - DNA, 20 bp, Artificial
  CRISPR gRNA sequence
ctgcattcccacctgggtga

SEQ ID NO: 437914 - DNA, 20 bp, Artificial
  CRISPR gRNA sequence
gcattcccacctgggtgaca

SEQ ID NO: 437915 - DNA, 20 bp, Artificial
  CRISPR gRNA sequence
tcccacctgggtgacagaga

SEQ ID NO: 437916 - DNA, 20 bp, Artificial
  CRISPR gRNA sequence
ctgggtgacagagaaagacc

SEQ ID NO: 437917 - DNA, 20 bp, Artificial
  CRISPR gRNA sequence
tgtccattgaatgctatcta

SEQ ID NO: 437918 - DNA, 20 bp, Artificial
  CRISPR gRNA sequence
aatttttttttttttttttt

SEQ ID NO: 437919 - DNA, 20 bp, Artificial
  CRISPR gRNA sequence
ttttttttttttttttgaga

SEQ ID NO: 437920 - DNA, 20 bp, Artificial
  CRISPR gRNA sequence
ttttttttttttttgagacg

SEQ ID NO: 437921 - DNA, 20 bp, Artificial
  CRISPR gRNA sequence
tttttttttgagacggagtc

SEQ ID NO: 437922 - DNA, 20 bp, Artificial
  CRISPR gRNA sequence
cggagtctggctctgtcacc

SEQ ID NO: 437923 - DNA, 20 bp, Artificial
  CRISPR gRNA sequence
ggagtctggctctgtcaccc

SEQ ID NO: 437924 - DNA, 20 bp, Artificial
  CRISPR gRNA sequence
tctggctctgtcacccaggc

SEQ ID NO: 437925 - DNA, 20 bp, Artificial
  CRISPR gRNA sequence
tggctctgtcacccaggctg

SEQ ID NO: 437926 - DNA, 20 bp, Artificial
  CRISPR gRNA sequence
ctgtcacccaggctggagtg

SEQ ID NO: 437927 - DNA, 20 bp, Artificial
  CRISPR gRNA sequence
tcacccaggctggagtgcag

SEQ ID NO: 437928 - DNA, 20 bp, Artificial
  CRISPR gRNA sequence
ggagtgcagtggcacaacct

SEQ ID NO: 437929 - DNA, 20 bp, Artificial
  CRISPR gRNA sequence
tcactataacctctgcttct

SEQ ID NO: 437930 - DNA, 20 bp, Artificial
  CRISPR gRNA sequence
cactataacctctgcttctc

SEQ ID NO: 437931 - DNA, 20 bp, Artificial
  CRISPR gRNA sequence
aacctctgcttctcgggttc

SEQ ID NO: 437932 - DNA, 20 bp, Artificial
  CRISPR gRNA sequence
gttcaagcgattctctgcat

SEQ ID NO: 437933 - DNA, 20 bp, Artificial
  CRISPR gRNA sequence
attctctgcattagcctccc

SEQ ID NO: 437934 - DNA, 20 bp, Artificial
  CRISPR gRNA sequence
ctctgcattagcctcccaag

SEQ ID NO: 437935 - DNA, 20 bp, Artificial
  CRISPR gRNA sequence
gcattagcctcccaagtagc

SEQ ID NO: 437936 - DNA, 20 bp, Artificial
  CRISPR gRNA sequence
cattagcctcccaagtagct

SEQ ID NO: 437937 - DNA, 20 bp, Artificial
  CRISPR gRNA sequence
ctcccaagtagctgggatta

SEQ ID NO: 437938 - DNA, 20 bp, Artificial
  CRISPR gRNA sequence
tcccaagtagctgggattac

SEQ ID NO: 437939 - DNA, 20 bp, Artificial
  CRISPR gRNA sequence
acaggtgcatgccaccacgc

SEQ ID NO: 437940 - DNA, 20 bp, Artificial
  CRISPR gRNA sequence
tggctaattttttgtatgtt

SEQ ID NO: 437941 - DNA, 20 bp, Artificial
  CRISPR gRNA sequence
ctaattttttgtatgtttag

SEQ ID NO: 437942 - DNA, 20 bp, Artificial
  CRISPR gRNA sequence
aattttttgtatgtttagta

SEQ ID NO: 437943 - DNA, 20 bp, Artificial
  CRISPR gRNA sequence
ttttgtatgtttagtagaga

SEQ ID NO: 437944 - DNA, 20 bp, Artificial
  CRISPR gRNA sequence
tttgtatgtttagtagagac

SEQ ID NO: 437945 - DNA, 20 bp, Artificial
  CRISPR gRNA sequence
ttgtatgtttagtagagacg

SEQ ID NO: 437946 - DNA, 20 bp, Artificial
  CRISPR gRNA sequence
gagacggggtttcactatgt

SEQ ID NO: 437947 - DNA, 20 bp, Artificial
  CRISPR gRNA sequence
cggggtttcactatgttggc

SEQ ID NO: 437948 - DNA, 20 bp, Artificial
  CRISPR gRNA sequence
ggggtttcactatgttggcc

SEQ ID NO: 437949 - DNA, 20 bp, Artificial
  CRISPR gRNA sequence
tttcactatgttggccaggc

SEQ ID NO: 437950 - DNA, 20 bp, Artificial
  CRISPR gRNA sequence
ctcctgacctcgtgatctgc

SEQ ID NO: 437951 - DNA, 20 bp, Artificial
  CRISPR gRNA sequence
tcctgacctcgtgatctgcc

SEQ ID NO: 437952 - DNA, 20 bp, Artificial
  CRISPR gRNA sequence
acctcgtgatctgccaggct

SEQ ID NO: 437953 - DNA, 20 bp, Artificial
  CRISPR gRNA sequence
ctgccaggctcagcctccca

SEQ ID NO: 437954 - DNA, 20 bp, Artificial
  CRISPR gRNA sequence
ggctcagcctcccaaagtgc

SEQ ID NO: 437955 - DNA, 20 bp, Artificial
  CRISPR gRNA sequence
gctcagcctcccaaagtgct

SEQ ID NO: 437956 - DNA, 20 bp, Artificial
  CRISPR gRNA sequence
ctcccaaagtgctgggatta

SEQ ID NO: 437957 - DNA, 20 bp, Artificial
  CRISPR gRNA sequence
tcccaaagtgctgggattac

SEQ ID NO: 437958 - DNA, 20 bp, Artificial
  CRISPR gRNA sequence
agtgctgggattacaggcgt

SEQ ID NO: 437959 - DNA, 20 bp, Artificial
  CRISPR gRNA sequence
gggattacaggcgtgagcca

SEQ ID NO: 437960 - DNA, 20 bp, Artificial
  CRISPR gRNA sequence
caggcgtgagccacggcgcc

SEQ ID NO: 437961 - DNA, 20 bp, Artificial
  CRISPR gRNA sequence
tctaaatgtgtacataattg

SEQ ID NO: 437962 - DNA, 20 bp, Artificial
  CRISPR gRNA sequence
ttgatacttcacctaaactt

SEQ ID NO: 437963 - DNA, 20 bp, Artificial
  CRISPR gRNA sequence
aaacttcagcctgcacctcc

SEQ ID NO: 437964 - DNA, 20 bp, Artificial
  CRISPR gRNA sequence
gagaaataaaaatattctct

SEQ ID NO: 437965 - DNA, 20 bp, Artificial
  CRISPR gRNA sequence
acaatgctgttgttatacct

SEQ ID NO: 437966 - DNA, 20 bp, Artificial
  CRISPR gRNA sequence
cctaagaaaattaaaattaa

SEQ ID NO: 437967 - DNA, 20 bp, Artificial
  CRISPR gRNA sequence
ttttctcaattgtttcccca

SEQ ID NO: 437968 - DNA, 20 bp, Artificial
  CRISPR gRNA sequence
agtattttattgctatttct

SEQ ID NO: 437969 - DNA, 20 bp, Artificial
  CRISPR gRNA sequence
tcttggcttttccacttgtt

SEQ ID NO: 437970 - DNA, 20 bp, Artificial
  CRISPR gRNA sequence
acttgttcagcatctgatca

SEQ ID NO: 437971 - DNA, 20 bp, Artificial
  CRISPR gRNA sequence
caaagatcatgcactatatt

SEQ ID NO: 437972 - DNA, 20 bp, Artificial
  CRISPR gRNA sequence
atatttagttgctgtctctt

SEQ ID NO: 437973 - DNA, 20 bp, Artificial
  CRISPR gRNA sequence
tatttagttgctgtctcttt

SEQ ID NO: 437974 - DNA, 20 bp, Artificial
  CRISPR gRNA sequence
tagttgctgtctctttggga

SEQ ID NO: 437975 - DNA, 20 bp, Artificial
  CRISPR gRNA sequence
taactctattccgtgttacc

SEQ ID NO: 437976 - DNA, 20 bp, Artificial
  CRISPR gRNA sequence
aactctattccgtgttacct

SEQ ID NO: 437977 - DNA, 20 bp, Artificial
  CRISPR gRNA sequence
accgcaacactttatttcca

SEQ ID NO: 437978 - DNA, 20 bp, Artificial
  CRISPR gRNA sequence
tttccacagcctcatctctt

SEQ ID NO: 437979 - DNA, 20 bp, Artificial
  CRISPR gRNA sequence
tttggccaacctccctccct

SEQ ID NO: 437980 - DNA, 20 bp, Artificial
  CRISPR gRNA sequence
ttggccaacctccctccctc

SEQ ID NO: 437981 - DNA, 20 bp, Artificial
  CRISPR gRNA sequence
caacctccctccctcaggat

SEQ ID NO: 437982 - DNA, 20 bp, Artificial
  CRISPR gRNA sequence
tccctcaggattggcaaatg

SEQ ID NO: 437983 - DNA, 20 bp, Artificial
  CRISPR gRNA sequence
ctcaggattggcaaatgcag

SEQ ID NO: 437984 - DNA, 20 bp, Artificial
  CRISPR gRNA sequence
aggattggcaaatgcagtag

SEQ ID NO: 437985 - DNA, 20 bp, Artificial
  CRISPR gRNA sequence
gattggcaaatgcagtagca

SEQ ID NO: 437986 - DNA, 20 bp, Artificial
  CRISPR gRNA sequence
attggcaaatgcagtagcag

SEQ ID NO: 437987 - DNA, 20 bp, Artificial
  CRISPR gRNA sequence
ttggcaaatgcagtagcaga

SEQ ID NO: 437988 - DNA, 20 bp, Artificial
  CRISPR gRNA sequence
agtagcagagggaattcgct

SEQ ID NO: 437989 - DNA, 20 bp, Artificial
  CRISPR gRNA sequence
agcagagggaattcgctcag

SEQ ID NO: 437990 - DNA, 20 bp, Artificial
  CRISPR gRNA sequence
agaaaacatctataccattg

SEQ ID NO: 437991 - DNA, 20 bp, Artificial
  CRISPR gRNA sequence
aaaacatctataccattgaa

SEQ ID NO: 437992 - DNA, 20 bp, Artificial
  CRISPR gRNA sequence
cattgaagagaacgtatatg

SEQ ID NO: 437993 - DNA, 20 bp, Artificial
  CRISPR gRNA sequence
tgaagagaacgtatatgaag

SEQ ID NO: 437994 - DNA, 20 bp, Artificial
  CRISPR gRNA sequence
aagagaacgtatatgaagtg

SEQ ID NO: 437995 - DNA, 20 bp, Artificial
  CRISPR gRNA sequence
agagaacgtatatgaagtgg

SEQ ID NO: 437996 - DNA, 20 bp, Artificial
  CRISPR gRNA sequence
agaacgtatatgaagtggag

SEQ ID NO: 437997 - DNA, 20 bp, Artificial
  CRISPR gRNA sequence
atgaagtggaggagcccaat

SEQ ID NO: 437998 - DNA, 20 bp, Artificial
  CRISPR gRNA sequence
aatgagtattattgctatgt

SEQ ID NO: 437999 - DNA, 20 bp, Artificial
  CRISPR gRNA sequence
gagtattattgctatgtcag

SEQ ID NO: 438000 - DNA, 20 bp, Artificial
  CRISPR gRNA sequence
tattattgctatgtcagcag

SEQ ID NO: 438001 - DNA, 20 bp, Artificial
  CRISPR gRNA sequence
attattgctatgtcagcagc

SEQ ID NO: 438002 - DNA, 20 bp, Artificial
  CRISPR gRNA sequence
attgctatgtcagcagcagg

SEQ ID NO: 438003 - DNA, 20 bp, Artificial
  CRISPR gRNA sequence
gcagcaaccctcacaacctt

SEQ ID NO: 438004 - DNA, 20 bp, Artificial
  CRISPR gRNA sequence
cagcaaccctcacaaccttt

SEQ ID NO: 438005 - DNA, 20 bp, Artificial
  CRISPR gRNA sequence
gttgtcgctttgcaatgcca

SEQ ID NO: 438006 - DNA, 20 bp, Artificial
  CRISPR gRNA sequence
gatccaaccaccttattttt

SEQ ID NO: 438007 - DNA, 20 bp, Artificial
  CRISPR gRNA sequence
aaccaccttatttttgagct

SEQ ID NO: 438008 - DNA, 20 bp, Artificial
  CRISPR gRNA sequence
gcttggtgttttgtcttttt

SEQ ID NO: 438009 - DNA, 20 bp, Artificial
  CRISPR gRNA sequence
ttgtctttttcagaaactat

SEQ ID NO: 438010 - DNA, 20 bp, Artificial
  CRISPR gRNA sequence
tatgagctgtgtcacctgac

SEQ ID NO: 438011 - DNA, 20 bp, Artificial
  CRISPR gRNA sequence
ctgtgtcacctgactggttt

SEQ ID NO: 438012 - DNA, 20 bp, Artificial
  CRISPR gRNA sequence
gtgtcacctgactggttttg

SEQ ID NO: 438013 - DNA, 20 bp, Artificial
  CRISPR gRNA sequence
tgtcacctgactggttttgg

SEQ ID NO: 438014 - DNA, 20 bp, Artificial
  CRISPR gRNA sequence
ggaggttctgtccactgcta

SEQ ID NO: 438015 - DNA, 20 bp, Artificial
  CRISPR gRNA sequence
aggttctgtccactgctatg

SEQ ID NO: 438016 - DNA, 20 bp, Artificial
  CRISPR gRNA sequence
ttctgtccactgctatggag

SEQ ID NO: 438017 - DNA, 20 bp, Artificial
  CRISPR gRNA sequence
ctgtccactgctatggagca

SEQ ID NO: 438018 - DNA, 20 bp, Artificial
  CRISPR gRNA sequence
gagcagagttttcccatttt

SEQ ID NO: 438019 - DNA, 20 bp, Artificial
  CRISPR gRNA sequence
cagagttttcccattttcag

SEQ ID NO: 438020 - DNA, 20 bp, Artificial
  CRISPR gRNA sequence
tcagaagataatgactcaca

SEQ ID NO: 438021 - DNA, 20 bp, Artificial
  CRISPR gRNA sequence
cagaagataatgactcacat

SEQ ID NO: 438022 - DNA, 20 bp, Artificial
  CRISPR gRNA sequence
gactcacatgggaattgaac

SEQ ID NO: 438023 - DNA, 20 bp, Artificial
  CRISPR gRNA sequence
actcacatgggaattgaact

SEQ ID NO: 438024 - DNA, 20 bp, Artificial
  CRISPR gRNA sequence
ggacctgcactgaacttaaa

SEQ ID NO: 438025 - DNA, 20 bp, Artificial
  CRISPR gRNA sequence
gacctgcactgaacttaaac

SEQ ID NO: 438026 - DNA, 20 bp, Artificial
  CRISPR gRNA sequence
atgtcattgcctctgtattt

SEQ ID NO: 438027 - DNA, 20 bp, Artificial
  CRISPR gRNA sequence
tgcctctgtatttaagccaa

SEQ ID NO: 438028 - DNA, 20 bp, Artificial
  CRISPR gRNA sequence
cctctgtatttaagccaaca

SEQ ID NO: 438029 - DNA, 20 bp, Artificial
  CRISPR gRNA sequence
gccaacagagttacccaacc

SEQ ID NO: 438030 - DNA, 20 bp, Artificial
  CRISPR gRNA sequence
caacagagttacccaaccca

SEQ ID NO: 438031 - DNA, 20 bp, Artificial
  CRISPR gRNA sequence
aacccagagactgttaatca

SEQ ID NO: 438032 - DNA, 20 bp, Artificial
  CRISPR gRNA sequence
agactgttaatcatggatgt

SEQ ID NO: 438033 - DNA, 20 bp, Artificial
  CRISPR gRNA sequence
actgttaatcatggatgtta

SEQ ID NO: 438034 - DNA, 20 bp, Artificial
  CRISPR gRNA sequence
catggatgttagagctcaaa

SEQ ID NO: 438035 - DNA, 20 bp, Artificial
  CRISPR gRNA sequence
atggatgttagagctcaaac

SEQ ID NO: 438036 - DNA, 20 bp, Artificial
  CRISPR gRNA sequence
aaacgggcttttatatacac

SEQ ID NO: 438037 - DNA, 20 bp, Artificial
  CRISPR gRNA sequence
aacgggcttttatatacact

SEQ ID NO: 438038 - DNA, 20 bp, Artificial
  CRISPR gRNA sequence
tacactaggaattcttgacg

SEQ ID NO: 438039 - DNA, 20 bp, Artificial
  CRISPR gRNA sequence
acactaggaattcttgacgt

SEQ ID NO: 438040 - DNA, 20 bp, Artificial
  CRISPR gRNA sequence
cactaggaattcttgacgtg

SEQ ID NO: 438041 - DNA, 20 bp, Artificial
  CRISPR gRNA sequence
aattcttgacgtggggtctc

SEQ ID NO: 438042 - DNA, 20 bp, Artificial
  CRISPR gRNA sequence
ttcttgacgtggggtctctg

SEQ ID NO: 438043 - DNA, 20 bp, Artificial
  CRISPR gRNA sequence
acgtggggtctctggagctc

SEQ ID NO: 438044 - DNA, 20 bp, Artificial
  CRISPR gRNA sequence
cgtggggtctctggagctcc

SEQ ID NO: 438045 - DNA, 20 bp, Artificial
  CRISPR gRNA sequence
ctctggagctccaggaaatt

SEQ ID NO: 438046 - DNA, 20 bp, Artificial
  CRISPR gRNA sequence
tctggagctccaggaaattc

SEQ ID NO: 438047 - DNA, 20 bp, Artificial
  CRISPR gRNA sequence
atcatatgtccatgaaactt

SEQ ID NO: 438048 - DNA, 20 bp, Artificial
  CRISPR gRNA sequence
ccatgaaacttcagataaac

SEQ ID NO: 438049 - DNA, 20 bp, Artificial
  CRISPR gRNA sequence
catgaaacttcagataaact

SEQ ID NO: 438050 - DNA, 20 bp, Artificial
  CRISPR gRNA sequence
atgaaacttcagataaacta

SEQ ID NO: 438051 - DNA, 20 bp, Artificial
  CRISPR gRNA sequence
tcagataaactagggaaaac

SEQ ID NO: 438052 - DNA, 20 bp, Artificial
  CRISPR gRNA sequence
cagataaactagggaaaact

SEQ ID NO: 438053 - DNA, 20 bp, Artificial
  CRISPR gRNA sequence
actagggaaaactgggtgct

SEQ ID NO: 438054 - DNA, 20 bp, Artificial
  CRISPR gRNA sequence
ctagggaaaactgggtgctg

SEQ ID NO: 438055 - DNA, 20 bp, Artificial
  CRISPR gRNA sequence
aaaactgggtgctgaggtga

SEQ ID NO: 438056 - DNA, 20 bp, Artificial
  CRISPR gRNA sequence
aggtgaaagcataacttttt

SEQ ID NO: 438057 - DNA, 20 bp, Artificial
  CRISPR gRNA sequence
aaagcataacttttttggca

SEQ ID NO: 438058 - DNA, 20 bp, Artificial
  CRISPR gRNA sequence
cataacttttttggcacaga

SEQ ID NO: 438059 - DNA, 20 bp, Artificial
  CRISPR gRNA sequence
tttttggcacagaaagtcta

SEQ ID NO: 438060 - DNA, 20 bp, Artificial
  CRISPR gRNA sequence
ttttggcacagaaagtctaa

SEQ ID NO: 438061 - DNA, 20 bp, Artificial
  CRISPR gRNA sequence
tttggcacagaaagtctaaa

SEQ ID NO: 438062 - DNA, 20 bp, Artificial
  CRISPR gRNA sequence
ttggcacagaaagtctaaag

SEQ ID NO: 438063 - DNA, 20 bp, Artificial
  CRISPR gRNA sequence
aaaggggccactgattttca

SEQ ID NO: 438064 - DNA, 20 bp, Artificial
  CRISPR gRNA sequence
aggggccactgattttcaaa

SEQ ID NO: 438065 - DNA, 20 bp, Artificial
  CRISPR gRNA sequence
cctttttgttttttgttttt

SEQ ID NO: 438066 - DNA, 20 bp, Artificial
  CRISPR gRNA sequence
tttgttttttgtttttgaga

SEQ ID NO: 438067 - DNA, 20 bp, Artificial
  CRISPR gRNA sequence
tgttttttgtttttgagatg

SEQ ID NO: 438068 - DNA, 20 bp, Artificial
  CRISPR gRNA sequence
tggagtcttgctctgttgcc

SEQ ID NO: 438069 - DNA, 20 bp, Artificial
  CRISPR gRNA sequence
ggagtcttgctctgttgccc

SEQ ID NO: 438070 - DNA, 20 bp, Artificial
  CRISPR gRNA sequence
tcttgctctgttgcccaggc

SEQ ID NO: 438071 - DNA, 20 bp, Artificial
  CRISPR gRNA sequence
ttgctctgttgcccaggctg

SEQ ID NO: 438072 - DNA, 20 bp, Artificial
  CRISPR gRNA sequence
ttgcccaggctggagtgcaa

SEQ ID NO: 438073 - DNA, 20 bp, Artificial
  CRISPR gRNA sequence
ggagtgcaatggcacaatct

SEQ ID NO: 438074 - DNA, 20 bp, Artificial
  CRISPR gRNA sequence
gcacaatctcggctcactgc

SEQ ID NO: 438075 - DNA, 20 bp, Artificial
  CRISPR gRNA sequence
tcactgcaagctccgcctcc

SEQ ID NO: 438076 - DNA, 20 bp, Artificial
  CRISPR gRNA sequence
cactgcaagctccgcctcct

SEQ ID NO: 438077 - DNA, 20 bp, Artificial
  CRISPR gRNA sequence
aagctccgcctcctgggttc

SEQ ID NO: 438078 - DNA, 20 bp, Artificial
  CRISPR gRNA sequence
ttcaagcgattctcctgcct

SEQ ID NO: 438079 - DNA, 20 bp, Artificial
  CRISPR gRNA sequence
ttctcctgcctcagcctcct

SEQ ID NO: 438080 - DNA, 20 bp, Artificial
  CRISPR gRNA sequence
tcctgcctcagcctcctgag

SEQ ID NO: 438081 - DNA, 20 bp, Artificial
  CRISPR gRNA sequence
gcctcagcctcctgagtggc

SEQ ID NO: 438082 - DNA, 20 bp, Artificial
  CRISPR gRNA sequence
cctcagcctcctgagtggct

SEQ ID NO: 438083 - DNA, 20 bp, Artificial
  CRISPR gRNA sequence
ctcctgagtggctgggatta

SEQ ID NO: 438084 - DNA, 20 bp, Artificial
  CRISPR gRNA sequence
tcctgagtggctgggattac

SEQ ID NO: 438085 - DNA, 20 bp, Artificial
  CRISPR gRNA sequence
caggcatgcaccaccatgcc

SEQ ID NO: 438086 - DNA, 20 bp, Artificial
  CRISPR gRNA sequence
cagctaatttgttgtatttt

SEQ ID NO: 438087 - DNA, 20 bp, Artificial
  CRISPR gRNA sequence
ctaatttgttgtatttttag

SEQ ID NO: 438088 - DNA, 20 bp, Artificial
  CRISPR gRNA sequence
aatttgttgtatttttagta

SEQ ID NO: 438089 - DNA, 20 bp, Artificial
  CRISPR gRNA sequence
tgttgtatttttagtagaga

SEQ ID NO: 438090 - DNA, 20 bp, Artificial
  CRISPR gRNA sequence
gttgtatttttagtagagac

SEQ ID NO: 438091 - DNA, 20 bp, Artificial
  CRISPR gRNA sequence
ttgtatttttagtagagaca

SEQ ID NO: 438092 - DNA, 20 bp, Artificial
  CRISPR gRNA sequence
gagacagggtttcaccatgt

SEQ ID NO: 438093 - DNA, 20 bp, Artificial
  CRISPR gRNA sequence
cagggtttcaccatgttggc

SEQ ID NO: 438094 - DNA, 20 bp, Artificial
  CRISPR gRNA sequence
tttcaccatgttggccagtg

SEQ ID NO: 438095 - DNA, 20 bp, Artificial
  CRISPR gRNA sequence
acctcatgatttgcctgcct

SEQ ID NO: 438096 - DNA, 20 bp, Artificial
  CRISPR gRNA sequence
ttgcctgcctcggcctccca

SEQ ID NO: 438097 - DNA, 20 bp, Artificial
  CRISPR gRNA sequence
gcctcggcctcccaaagcac

SEQ ID NO: 438098 - DNA, 20 bp, Artificial
  CRISPR gRNA sequence
cctcggcctcccaaagcact

SEQ ID NO: 438099 - DNA, 20 bp, Artificial
  CRISPR gRNA sequence
ctcccaaagcactgggatta

SEQ ID NO: 438100 - DNA, 20 bp, Artificial
  CRISPR gRNA sequence
tcccaaagcactgggattac

SEQ ID NO: 438101 - DNA, 20 bp, Artificial
  CRISPR gRNA sequence
agcactgggattacaggcgt

SEQ ID NO: 438102 - DNA, 20 bp, Artificial
  CRISPR gRNA sequence
caggcgtgagccaccacatc

SEQ ID NO: 438103 - DNA, 20 bp, Artificial
  CRISPR gRNA sequence
cgtgagccaccacatccagc

SEQ ID NO: 438104 - DNA, 20 bp, Artificial
  CRISPR gRNA sequence
atccagccagtgatccttaa

SEQ ID NO: 438105 - DNA, 20 bp, Artificial
  CRISPR gRNA sequence
ccagtgatccttaaaagatt

SEQ ID NO: 438106 - DNA, 20 bp, Artificial
  CRISPR gRNA sequence
agtgatccttaaaagattaa

SEQ ID NO: 438107 - DNA, 20 bp, Artificial
  CRISPR gRNA sequence
ttaaaagattaagagatgac

SEQ ID NO: 438108 - DNA, 20 bp, Artificial
  CRISPR gRNA sequence
agattaagagatgactggac

SEQ ID NO: 438109 - DNA, 20 bp, Artificial
  CRISPR gRNA sequence
gattaagagatgactggacc

SEQ ID NO: 438110 - DNA, 20 bp, Artificial
  CRISPR gRNA sequence
ccaggtctaccttgatcttg

SEQ ID NO: 438111 - DNA, 20 bp, Artificial
  CRISPR gRNA sequence
cttgatcttgaagattccct

SEQ ID NO: 438112 - DNA, 20 bp, Artificial
  CRISPR gRNA sequence
gaagattcccttggaatgtt

SEQ ID NO: 438113 - DNA, 20 bp, Artificial
  CRISPR gRNA sequence
tcccttggaatgttgagatt

SEQ ID NO: 438114 - DNA, 20 bp, Artificial
  CRISPR gRNA sequence
cccttggaatgttgagattt

SEQ ID NO: 438115 - DNA, 20 bp, Artificial
  CRISPR gRNA sequence
gttgagatttaggcttattt

SEQ ID NO: 438116 - DNA, 20 bp, Artificial
  CRISPR gRNA sequence
agcactgcctgcccaactgt

SEQ ID NO: 438117 - DNA, 20 bp, Artificial
  CRISPR gRNA sequence
gcctgcccaactgtcagtgc

SEQ ID NO: 438118 - DNA, 20 bp, Artificial
  CRISPR gRNA sequence
caactgtcagtgccagtgca

SEQ ID NO: 438119 - DNA, 20 bp, Artificial
  CRISPR gRNA sequence
cttcttttgtctcccttatg

SEQ ID NO: 438120 - DNA, 20 bp, Artificial
  CRISPR gRNA sequence
cccttatgaagactgccctg

SEQ ID NO: 438121 - DNA, 20 bp, Artificial
  CRISPR gRNA sequence
ccttatgaagactgccctgc

SEQ ID NO: 438122 - DNA, 20 bp, Artificial
  CRISPR gRNA sequence
cttatgaagactgccctgca

SEQ ID NO: 438123 - DNA, 20 bp, Artificial
  CRISPR gRNA sequence
gaagactgccctgcagggct

SEQ ID NO: 438124 - DNA, 20 bp, Artificial
  CRISPR gRNA sequence
tgccctgcagggctgagatg

SEQ ID NO: 438125 - DNA, 20 bp, Artificial
  CRISPR gRNA sequence
cctgcagggctgagatgtgg

SEQ ID NO: 438126 - DNA, 20 bp, Artificial
  CRISPR gRNA sequence
ctgcagggctgagatgtggc

SEQ ID NO: 438127 - DNA, 20 bp, Artificial
  CRISPR gRNA sequence
gcagggctgagatgtggcag

SEQ ID NO: 438128 - DNA, 20 bp, Artificial
  CRISPR gRNA sequence
tgagatgtggcaggagctcc

SEQ ID NO: 438129 - DNA, 20 bp, Artificial
  CRISPR gRNA sequence
gagatgtggcaggagctccc

SEQ ID NO: 438130 - DNA, 20 bp, Artificial
  CRISPR gRNA sequence
agatgtggcaggagctccca

SEQ ID NO: 438131 - DNA, 20 bp, Artificial
  CRISPR gRNA sequence
ggagctcccagggaaaaacg

SEQ ID NO: 438132 - DNA, 20 bp, Artificial
  CRISPR gRNA sequence
aaaaacgaagtgcatttgat

SEQ ID NO: 438133 - DNA, 20 bp, Artificial
  CRISPR gRNA sequence
tgcatttgattggtgtgtat

SEQ ID NO: 438134 - DNA, 20 bp, Artificial
  CRISPR gRNA sequence
ttgattggtgtgtattggcc

SEQ ID NO: 438135 - DNA, 20 bp, Artificial
  CRISPR gRNA sequence
tttgcttgttgtgtgcttga

SEQ ID NO: 438136 - DNA, 20 bp, Artificial
  CRISPR gRNA sequence
ctgaccaacttctgtattcg

SEQ ID NO: 438137 - DNA, 20 bp, Artificial
  CRISPR gRNA sequence
tgtattcgtggaccaaactg

SEQ ID NO: 438138 - DNA, 20 bp, Artificial
  CRISPR gRNA sequence
aactgaagctatatttttca

SEQ ID NO: 438139 - DNA, 20 bp, Artificial
  CRISPR gRNA sequence
tgaagctatatttttcacag

SEQ ID NO: 438140 - DNA, 20 bp, Artificial
  CRISPR gRNA sequence
agctatatttttcacagaag

SEQ ID NO: 438141 - DNA, 20 bp, Artificial
  CRISPR gRNA sequence
tatatttttcacagaagaag

SEQ ID NO: 438142 - DNA, 20 bp, Artificial
  CRISPR gRNA sequence
atttttcacagaagaagaag

SEQ ID NO: 438143 - DNA, 20 bp, Artificial
  CRISPR gRNA sequence
cacagaagaagaagcagtga

SEQ ID NO: 438144 - DNA, 20 bp, Artificial
  CRISPR gRNA sequence
acagaagaagaagcagtgac

SEQ ID NO: 438145 - DNA, 20 bp, Artificial
  CRISPR gRNA sequence
cagaagaagaagcagtgacg

SEQ ID NO: 438146 - DNA, 20 bp, Artificial
  CRISPR gRNA sequence
gggacacaaattctgttgcc

SEQ ID NO: 438147 - DNA, 20 bp, Artificial
  CRISPR gRNA sequence
acacaaattctgttgcctgg

SEQ ID NO: 438148 - DNA, 20 bp, Artificial
  CRISPR gRNA sequence
aaattctgttgcctggtgga

SEQ ID NO: 438149 - DNA, 20 bp, Artificial
  CRISPR gRNA sequence
ttctgttgcctggtggaaag

SEQ ID NO: 438150 - DNA, 20 bp, Artificial
  CRISPR gRNA sequence
tctgttgcctggtggaaaga

SEQ ID NO: 438151 - DNA, 20 bp, Artificial
  CRISPR gRNA sequence
tgcctggtggaaagaaggca

SEQ ID NO: 438152 - DNA, 20 bp, Artificial
  CRISPR gRNA sequence
gcctggtggaaagaaggcaa

SEQ ID NO: 438153 - DNA, 20 bp, Artificial
  CRISPR gRNA sequence
ggaaagaaggcaaaggcctt

SEQ ID NO: 438154 - DNA, 20 bp, Artificial
  CRISPR gRNA sequence
ccttcagcaatctatattac

SEQ ID NO: 438155 - DNA, 20 bp, Artificial
  CRISPR gRNA sequence
gcaatctatattaccagcgc

SEQ ID NO: 438156 - DNA, 20 bp, Artificial
  CRISPR gRNA sequence
accagcgctggatcctttga

SEQ ID NO: 438157 - DNA, 20 bp, Artificial
  CRISPR gRNA sequence
cagcgctggatcctttgaca

SEQ ID NO: 438158 - DNA, 20 bp, Artificial
  CRISPR gRNA sequence
gcgctggatcctttgacaga

SEQ ID NO: 438159 - DNA, 20 bp, Artificial
  CRISPR gRNA sequence
ctggatcctttgacagagag

SEQ ID NO: 438160 - DNA, 20 bp, Artificial
  CRISPR gRNA sequence
ggtccctaaacttaaatttc

SEQ ID NO: 438161 - DNA, 20 bp, Artificial
  CRISPR gRNA sequence
cctaaacttaaatttcaaga

SEQ ID NO: 438162 - DNA, 20 bp, Artificial
  CRISPR gRNA sequence
acttaaatttcaagacggta

SEQ ID NO: 438163 - DNA, 20 bp, Artificial
  CRISPR gRNA sequence
cttaaatttcaagacggtat

SEQ ID NO: 438164 - DNA, 20 bp, Artificial
  CRISPR gRNA sequence
ttattgttgccccctgcgcc

SEQ ID NO: 438165 - DNA, 20 bp, Artificial
  CRISPR gRNA sequence
gcacaattctgacacacaat

SEQ ID NO: 438166 - DNA, 20 bp, Artificial
  CRISPR gRNA sequence
tgtttgtttgtttgtttttt

SEQ ID NO: 438167 - DNA, 20 bp, Artificial
  CRISPR gRNA sequence
tgtttgtttgttttttgaga

SEQ ID NO: 438168 - DNA, 20 bp, Artificial
  CRISPR gRNA sequence
gatagaatctcgctctgtct

SEQ ID NO: 438169 - DNA, 20 bp, Artificial
  CRISPR gRNA sequence
cgctctgtctgagttcattg

SEQ ID NO: 438170 - DNA, 20 bp, Artificial
  CRISPR gRNA sequence
tctgagttcattgtagattc

SEQ ID NO: 438171 - DNA, 20 bp, Artificial
  CRISPR gRNA sequence
tcattgtagattctggatat

SEQ ID NO: 438172 - DNA, 20 bp, Artificial
  CRISPR gRNA sequence
tctggatattagccctttgt

SEQ ID NO: 438173 - DNA, 20 bp, Artificial
  CRISPR gRNA sequence
atattagccctttgtcagat

SEQ ID NO: 438174 - DNA, 20 bp, Artificial
  CRISPR gRNA sequence
ttagccctttgtcagatgag

SEQ ID NO: 438175 - DNA, 20 bp, Artificial
  CRISPR gRNA sequence
tagccctttgtcagatgagt

SEQ ID NO: 438176 - DNA, 20 bp, Artificial
  CRISPR gRNA sequence
tctgacaaagggctaatatc

SEQ ID NO: 438177 - DNA, 20 bp, Artificial
  CRISPR gRNA sequence
agtaagttccaattgtgtgt

SEQ ID NO: 438178 - DNA, 20 bp, Artificial
  CRISPR gRNA sequence
ttagggaccactctctgtca

SEQ ID NO: 438179 - DNA, 20 bp, Artificial
  CRISPR gRNA sequence
gccttctttccaccaggcaa

SEQ ID NO: 438180 - DNA, 20 bp, Artificial
  CRISPR gRNA sequence
atatagcttcagtttggtcc

SEQ ID NO: 438181 - DNA, 20 bp, Artificial
  CRISPR gRNA sequence
cctaaatctcaacattccaa

SEQ ID NO: 438182 - DNA, 20 bp, Artificial
  CRISPR gRNA sequence
cagtcatctcttaatctttt

SEQ ID NO: 438183 - DNA, 20 bp, Artificial
  CRISPR gRNA sequence
aatcttttaaggatcactgg

SEQ ID NO: 438184 - DNA, 20 bp, Artificial
  CRISPR gRNA sequence
ggcaggcaaatcatgaggtc

SEQ ID NO: 438185 - DNA, 20 bp, Artificial
  CRISPR gRNA sequence
cactcaggaggctgaggcag

SEQ ID NO: 438186 - DNA, 20 bp, Artificial
  CRISPR gRNA sequence
ctcaaaaacaaaaaacaaaa

SEQ ID NO: 438187 - DNA, 20 bp, Artificial
  CRISPR gRNA sequence
ttcatggacatatgatgtgc

SEQ ID NO: 438188 - DNA, 20 bp, Artificial
  CRISPR gRNA sequence
agctccagagaccccacgtc

SEQ ID NO: 438189 - DNA, 20 bp, Artificial
  CRISPR gRNA sequence
acatccatgattaacagtct

SEQ ID NO: 438190 - DNA, 20 bp, Artificial
  CRISPR gRNA sequence
catgattaacagtctctggg

SEQ ID NO: 438191 - DNA, 20 bp, Artificial
  CRISPR gRNA sequence
ggtcccagttcaattcccat

SEQ ID NO: 438192 - DNA, 20 bp, Artificial
  CRISPR gRNA sequence
caagctcaaaaataaggtgg

SEQ ID NO: 438193 - DNA, 20 bp, Artificial
  CRISPR gRNA sequence
agcgacaacccaaaggttgt

SEQ ID NO: 438194 - DNA, 20 bp, Artificial
  CRISPR gRNA sequence
gtatagatgttttcttctga

SEQ ID NO: 438195 - DNA, 20 bp, Artificial
  CRISPR gRNA sequence
gtggaaataaagtgttgcgg

SEQ ID NO: 438196 - DNA, 20 bp, Artificial
  CRISPR gRNA sequence
taagcatttcccaggtaaca

SEQ ID NO: 438197 - DNA, 20 bp, Artificial
  CRISPR gRNA sequence
atttcccaggtaacacggaa

SEQ ID NO: 438198 - DNA, 20 bp, Artificial
  CRISPR gRNA sequence
gtaacacggaatagagttaa

SEQ ID NO: 438199 - DNA, 20 bp, Artificial
  CRISPR gRNA sequence
aacagcattgtgatagctaa

SEQ ID NO: 438200 - DNA, 20 bp, Artificial
  CRISPR gRNA sequence
gcctggcagatcacgaggtc

SEQ ID NO: 438201 - DNA, 20 bp, Artificial
  CRISPR gRNA sequence
ctacttgggaggctaatgca

SEQ ID NO: 438202 - DNA, 20 bp, Artificial
  CRISPR gRNA sequence
ttgtgccactgcactccagc

SEQ ID NO: 438203 - DNA, 20 bp, Artificial
  CRISPR gRNA sequence
ttgttttgttttgtttgatg

SEQ ID NO: 438204 - DNA, 20 bp, Artificial
  CRISPR gRNA sequence
tctttctctgtcacccaggt

SEQ ID NO: 438205 - DNA, 20 bp, Artificial
  CRISPR gRNA sequence
gtaagccacagcacctagcc

SEQ ID NO: 438206 - DNA, 20 bp, Artificial
  CRISPR gRNA sequence
gtaagccatacctatttgaa

SEQ ID NO: 438207 - DNA, 20 bp, Artificial
  CRISPR gRNA sequence
tacctatttgaaatggatgt

SEQ ID NO: 438208 - DNA, 20 bp, Artificial
  CRISPR gRNA sequence
tcaggaacgaaggtcaagac

SEQ ID NO: 438209 - DNA, 20 bp, Artificial
  CRISPR gRNA sequence
tctcagccctgactgttcac

SEQ ID NO: 438210 - DNA, 20 bp, Artificial
  CRISPR gRNA sequence
agattctgattcagttgctc

SEQ ID NO: 438211 - DNA, 20 bp, Artificial
  CRISPR gRNA sequence
gcattagtacacttcagtgc

SEQ ID NO: 438212 - DNA, 20 bp, Artificial
  CRISPR gRNA sequence
agaaatgctgagaacagata

SEQ ID NO: 438213 - DNA, 20 bp, Artificial
  CRISPR gRNA sequence
gcctaagtgcagcccagacc

SEQ ID NO: 438214 - DNA, 20 bp, Artificial
  CRISPR gRNA sequence
gaaaaaccattaatatcgag

SEQ ID NO: 438215 - DNA, 20 bp, Artificial
  CRISPR gRNA sequence
gaataagcatgttgtattat

SEQ ID NO: 438216 - DNA, 20 bp, Artificial
  CRISPR gRNA sequence
cagatctcaaagccccagga

SEQ ID NO: 438217 - DNA, 20 bp, Artificial
  CRISPR gRNA sequence
agagaaaagatcagacatgt

SEQ ID NO: 438218 - DNA, 20 bp, Artificial
  CRISPR gRNA sequence
ctgtatcttctctttgctat

SEQ ID NO: 438219 - DNA, 20 bp, Artificial
  CRISPR gRNA sequence
aaatctggtctcatctcaga

SEQ ID NO: 438220 - DNA, 20 bp, Artificial
  CRISPR gRNA sequence
aggaacacaggaacataaaa

SEQ ID NO: 438221 - DNA, 20 bp, Artificial
  CRISPR gRNA sequence
tactaaaaatacaaaattag

SEQ ID NO: 438222 - DNA, 20 bp, Artificial
  CRISPR gRNA sequence
tactcgggaggctgaggcag

SEQ ID NO: 438223 - DNA, 20 bp, Artificial
  CRISPR gRNA sequence
atagtgaaacagataataga

SEQ ID NO: 438224 - DNA, 20 bp, Artificial
  CRISPR gRNA sequence
actttaagctcgtttctgaa

SEQ ID NO: 438225 - DNA, 20 bp, Artificial
  CRISPR gRNA sequence
aagagccagaaggagcattc

SEQ ID NO: 438226 - DNA, 20 bp, Artificial
  CRISPR gRNA sequence
agccccttgtaaagatcttg

SEQ ID NO: 438227 - DNA, 20 bp, Artificial
  CRISPR gRNA sequence
acctgaaactgaaaacgtgg

SEQ ID NO: 438228 - DNA, 20 bp, Artificial
  CRISPR gRNA sequence
agacctttccagccataatc

SEQ ID NO: 438229 - DNA, 20 bp, Artificial
  CRISPR gRNA sequence
ttccagccataatcaggagt

SEQ ID NO: 438230 - DNA, 20 bp, Artificial
  CRISPR gRNA sequence
agatgtgatccttatttgtt

SEQ ID NO: 438231 - DNA, 20 bp, Artificial
  CRISPR gRNA sequence
tatctcatcatttctgtgtt

SEQ ID NO: 438232 - DNA, 20 bp, Artificial
  CRISPR gRNA sequence
tcatttctgtgttgtgggtc

SEQ ID NO: 438233 - DNA, 20 bp, Artificial
  CRISPR gRNA sequence
aggaatccaggtgtggctta

SEQ ID NO: 438234 - DNA, 20 bp, Artificial
  CRISPR gRNA sequence
gtgtggcttactgggtacct

SEQ ID NO: 438235 - DNA, 20 bp, Artificial
  CRISPR gRNA sequence
ggtctttcaaggtgtcttct

SEQ ID NO: 438236 - DNA, 20 bp, Artificial
  CRISPR gRNA sequence
ttttttttttttttttgaga

SEQ ID NO: 438237 - DNA, 20 bp, Artificial
  CRISPR gRNA sequence
tcttgctctgttggccaggc

SEQ ID NO: 438238 - DNA, 20 bp, Artificial
  CRISPR gRNA sequence
actttgaactcctgggctca

SEQ ID NO: 438239 - DNA, 20 bp, Artificial
  CRISPR gRNA sequence
ggatctacccatctcagctt

SEQ ID NO: 438240 - DNA, 20 bp, Artificial
  CRISPR gRNA sequence
ataggtgcacactaccacag

SEQ ID NO: 438241 - DNA, 20 bp, Artificial
  CRISPR gRNA sequence
ttttttttaatgtttttggg

SEQ ID NO: 438242 - DNA, 20 bp, Artificial
  CRISPR gRNA sequence
cactttgggaggcaaggcag

SEQ ID NO: 438243 - DNA, 20 bp, Artificial
  CRISPR gRNA sequence
caggtggatttcttgagctt

SEQ ID NO: 438244 - DNA, 20 bp, Artificial
  CRISPR gRNA sequence
ctacttggaggctgaggcag

SEQ ID NO: 438245 - DNA, 20 bp, Artificial
  CRISPR gRNA sequence
tcacaccactgcactccagc

SEQ ID NO: 438246 - DNA, 20 bp, Artificial
  CRISPR gRNA sequence
accactgcactccagcctgg

SEQ ID NO: 438247 - DNA, 20 bp, Artificial
  CRISPR gRNA sequence
gtcttggcctcccgaagtgt

SEQ ID NO: 438248 - DNA, 20 bp, Artificial
  CRISPR gRNA sequence
cattgtgctcagacattgat

SEQ ID NO: 438249 - DNA, 20 bp, Artificial
  CRISPR gRNA sequence
cattgatttgggttttaata

SEQ ID NO: 438250 - DNA, 20 bp, Artificial
  CRISPR gRNA sequence
tttaatattggattcgaagg

SEQ ID NO: 438251 - DNA, 20 bp, Artificial
  CRISPR gRNA sequence
aagtagaaataatggtgtct

SEQ ID NO: 438252 - DNA, 20 bp, Artificial
  CRISPR gRNA sequence
aataatggtgtcttggagta

SEQ ID NO: 438253 - DNA, 20 bp, Artificial
  CRISPR gRNA sequence
aggaatggccaaaagagatg

SEQ ID NO: 438254 - DNA, 20 bp, Artificial
  CRISPR gRNA sequence
gtatgttggaggaagactgc

SEQ ID NO: 438255 - DNA, 20 bp, Artificial
  CRISPR gRNA sequence
gttgttgtttttctctgaga

SEQ ID NO: 438256 - DNA, 20 bp, Artificial
  CRISPR gRNA sequence
ctgtgctgtgtcacccaggc

SEQ ID NO: 438257 - DNA, 20 bp, Artificial
  CRISPR gRNA sequence
gatcttcctgcttcattctc

SEQ ID NO: 438258 - DNA, 20 bp, Artificial
  CRISPR gRNA sequence
caccaccatacccagcccta

SEQ ID NO: 438259 - DNA, 20 bp, Artificial
  CRISPR gRNA sequence
cctaaggaatctcaacatct

SEQ ID NO: 438260 - DNA, 20 bp, Artificial
  CRISPR gRNA sequence
agaagaagatctgaaaagca

SEQ ID NO: 438261 - DNA, 20 bp, Artificial
  CRISPR gRNA sequence
aaaagcaatggatcaaagag

SEQ ID NO: 438262 - DNA, 20 bp, Artificial
  CRISPR gRNA sequence
ccaagagaaggaggactttc

SEQ ID NO: 438263 - DNA, 20 bp, Artificial
  CRISPR gRNA sequence
gagaaggaggactttctaga

SEQ ID NO: 438264 - DNA, 20 bp, Artificial
  CRISPR gRNA sequence
cgggcagatcatctgaggtc

SEQ ID NO: 438265 - DNA, 20 bp, Artificial
  CRISPR gRNA sequence
tactcaggaggctgaggggg

SEQ ID NO: 438266 - DNA, 20 bp, Artificial
  CRISPR gRNA sequence
tgcactccagcctaagcaac

SEQ ID NO: 438267 - DNA, 20 bp, Artificial
  CRISPR gRNA sequence
ggagcagaaactagatgatg

SEQ ID NO: 438268 - DNA, 20 bp, Artificial
  CRISPR gRNA sequence
aactagatgatggtgggtca

SEQ ID NO: 438269 - DNA, 20 bp, Artificial
  CRISPR gRNA sequence
tggtgggtcaaggagtgtag

SEQ ID NO: 438270 - DNA, 20 bp, Artificial
  CRISPR gRNA sequence
tgaaaaatatggctgtgaga

SEQ ID NO: 438271 - DNA, 20 bp, Artificial
  CRISPR gRNA sequence
agaaatgggactagctggag

SEQ ID NO: 438272 - DNA, 20 bp, Artificial
  CRISPR gRNA sequence
agagagatgactcagaagaa

SEQ ID NO: 438273 - DNA, 20 bp, Artificial
  CRISPR gRNA sequence
cagaagaaagggataaaaag

SEQ ID NO: 438274 - DNA, 20 bp, Artificial
  CRISPR gRNA sequence
gttttgagcagcagtgaggt

SEQ ID NO: 438275 - DNA, 20 bp, Artificial
  CRISPR gRNA sequence
aggtatggatggtcatctca

SEQ ID NO: 438276 - DNA, 20 bp, Artificial
  CRISPR gRNA sequence
tggaagattgtggggcatta

SEQ ID NO: 438277 - DNA, 20 bp, Artificial
  CRISPR gRNA sequence
tctcagtagccatgtttttt

SEQ ID NO: 438278 - DNA, 20 bp, Artificial
  CRISPR gRNA sequence
ccatcactctttatacaaac

SEQ ID NO: 438279 - DNA, 20 bp, Artificial
  CRISPR gRNA sequence
tggcagaagtcaaaaaagta

SEQ ID NO: 438280 - DNA, 20 bp, Artificial
  CRISPR gRNA sequence
attttgggaggctgaggtgg

SEQ ID NO: 438281 - DNA, 20 bp, Artificial
  CRISPR gRNA sequence
tgggaggattatttaagccc

SEQ ID NO: 438282 - DNA, 20 bp, Artificial
  CRISPR gRNA sequence
attttatttattttttgaga

SEQ ID NO: 438283 - DNA, 20 bp, Artificial
  CRISPR gRNA sequence
ttcactcttgttgcccaggc

SEQ ID NO: 438284 - DNA, 20 bp, Artificial
  CRISPR gRNA sequence
gattctcccacctcagcttc

SEQ ID NO: 438285 - DNA, 20 bp, Artificial
  CRISPR gRNA sequence
acctcagcttcccgagtagc

SEQ ID NO: 438286 - DNA, 20 bp, Artificial
  CRISPR gRNA sequence
acctcggcctcccaaagtgc

SEQ ID NO: 438287 - DNA, 20 bp, Artificial
  CRISPR gRNA sequence
actttgggaggctgaagtag

SEQ ID NO: 438288 - DNA, 20 bp, Artificial
  CRISPR gRNA sequence
tacttgggaggctgaggcac

SEQ ID NO: 438289 - DNA, 20 bp, Artificial
  CRISPR gRNA sequence
gtagtccagctcccaggtga

SEQ ID NO: 438290 - DNA, 20 bp, Artificial
  CRISPR gRNA sequence
caaaaattccatggctatct

SEQ ID NO: 438291 - DNA, 20 bp, Artificial
  CRISPR gRNA sequence
ctgaataaacccaggtaagt

SEQ ID NO: 438292 - DNA, 20 bp, Artificial
  CRISPR gRNA sequence
taaacccaggtaagtgtggg

SEQ ID NO: 438293 - DNA, 20 bp, Artificial
  CRISPR gRNA sequence
gggtggggtagtttcttttt

SEQ ID NO: 438294 - DNA, 20 bp, Artificial
  CRISPR gRNA sequence
acatattagtacctatctca

SEQ ID NO: 438295 - DNA, 20 bp, Artificial
  CRISPR gRNA sequence
ctatctcatagggtagttac

SEQ ID NO: 438296 - DNA, 20 bp, Artificial
  CRISPR gRNA sequence
agacacaattataaaagtgt

SEQ ID NO: 438297 - DNA, 20 bp, Artificial
  CRISPR gRNA sequence
acattgggaggtcgaggtgg

SEQ ID NO: 438298 - DNA, 20 bp, Artificial
  CRISPR gRNA sequence
agtcccagctactctggaag

SEQ ID NO: 438299 - DNA, 20 bp, Artificial
  CRISPR gRNA sequence
acaaaagtgtgcgaggtttt

SEQ ID NO: 438300 - DNA, 20 bp, Artificial
  CRISPR gRNA sequence
gactgtcttattctgttgcc

SEQ ID NO: 438301 - DNA, 20 bp, Artificial
  CRISPR gRNA sequence
tcttattctgttgcccaggg

SEQ ID NO: 438302 - DNA, 20 bp, Artificial
  CRISPR gRNA sequence
gatcctcccacctcagcctc

SEQ ID NO: 438303 - DNA, 20 bp, Artificial
  CRISPR gRNA sequence
ttattattacgttgtagagg

SEQ ID NO: 438304 - DNA, 20 bp, Artificial
  CRISPR gRNA sequence
tctcactctgtcacccaggc

SEQ ID NO: 438305 - DNA, 20 bp, Artificial
  CRISPR gRNA sequence
gtaacctccacctaccaggt

SEQ ID NO: 438306 - DNA, 20 bp, Artificial
  CRISPR gRNA sequence
gattcctctgcctcagcctc

SEQ ID NO: 438307 - DNA, 20 bp, Artificial
  CRISPR gRNA sequence
gcctcagcctcctgagtagc

SEQ ID NO: 438308 - DNA, 20 bp, Artificial
  CRISPR gRNA sequence
ttttgtatttttagtagaga

SEQ ID NO: 438309 - DNA, 20 bp, Artificial
  CRISPR gRNA sequence
ccctcagcctcccaaagtgc

SEQ ID NO: 438310 - DNA, 20 bp, Artificial
  CRISPR gRNA sequence
tgctagtttaaaaaaaaaaa

SEQ ID NO: 438311 - DNA, 20 bp, Artificial
  CRISPR gRNA sequence
taacaaacctagacatattc

SEQ ID NO: 438312 - DNA, 20 bp, Artificial
  CRISPR gRNA sequence
aattaaagaaattagtttac

SEQ ID NO: 438313 - DNA, 20 bp, Artificial
  CRISPR gRNA sequence
gtttactggaatcagcctgc

SEQ ID NO: 438314 - DNA, 20 bp, Artificial
  CRISPR gRNA sequence
acttcccttcactgtaaaat

SEQ ID NO: 438315 - DNA, 20 bp, Artificial
  CRISPR gRNA sequence
taaaaattagccattattgt

SEQ ID NO: 438316 - DNA, 20 bp, Artificial
  CRISPR gRNA sequence
ttagccattattgttaggat

SEQ ID NO: 438317 - DNA, 20 bp, Artificial
  CRISPR gRNA sequence
gttaggatttggatggacaa

SEQ ID NO: 438318 - DNA, 20 bp, Artificial
  CRISPR gRNA sequence
ggtatttagtctaatcatct

SEQ ID NO: 438319 - DNA, 20 bp, Artificial
  CRISPR gRNA sequence
aatcatctttgggtataaac

SEQ ID NO: 438320 - DNA, 20 bp, Artificial
  CRISPR gRNA sequence
gtttttactggttctcactg

SEQ ID NO: 438321 - DNA, 20 bp, Artificial
  CRISPR gRNA sequence
gcctattctgatggttgctc

SEQ ID NO: 438322 - DNA, 20 bp, Artificial
  CRISPR gRNA sequence
ccgtaagtcattggccaatc

SEQ ID NO: 438323 - DNA, 20 bp, Artificial
  CRISPR gRNA sequence
cccgtaactcattggccaat

SEQ ID NO: 438324 - DNA, 20 bp, Artificial
  CRISPR gRNA sequence
atttgctatggaaacacaaa

SEQ ID NO: 438325 - DNA, 20 bp, Artificial
  CRISPR gRNA sequence
tgtaatcagcttcaagattt

SEQ ID NO: 438326 - DNA, 20 bp, Artificial
  CRISPR gRNA sequence
ccatcccttttacaacatca

SEQ ID NO: 438327 - DNA, 20 bp, Artificial
  CRISPR gRNA sequence
tttacaacatcacaggatgg

SEQ ID NO: 438328 - DNA, 20 bp, Artificial
  CRISPR gRNA sequence
acactcaagccaacccaaga

SEQ ID NO: 438329 - DNA, 20 bp, Artificial
  CRISPR gRNA sequence
aaagggtctcccttaacctt

SEQ ID NO: 438330 - DNA, 20 bp, Artificial
  CRISPR gRNA sequence
aaaatgtgcccttctgtgtt

SEQ ID NO: 438331 - DNA, 20 bp, Artificial
  CRISPR gRNA sequence
gcccctgcaaaaattggctt

SEQ ID NO: 438332 - DNA, 20 bp, Artificial
  CRISPR gRNA sequence
tgcaaaaattggctttagag

SEQ ID NO: 438333 - DNA, 20 bp, Artificial
  CRISPR gRNA sequence
agatcccctaagattcccca

SEQ ID NO: 438334 - DNA, 20 bp, Artificial
  CRISPR gRNA sequence
taagattccccagagagttt

SEQ ID NO: 438335 - DNA, 20 bp, Artificial
  CRISPR gRNA sequence
gactttacagccagacggtc

SEQ ID NO: 438336 - DNA, 20 bp, Artificial
  CRISPR gRNA sequence
actttgggaggcctaggcag

SEQ ID NO: 438337 - DNA, 20 bp, Artificial
  CRISPR gRNA sequence
caggcggatcacctgacatc

SEQ ID NO: 438338 - DNA, 20 bp, Artificial
  CRISPR gRNA sequence
tagtggggaggctgaggcag

SEQ ID NO: 438339 - DNA, 20 bp, Artificial
  CRISPR gRNA sequence
taaacccaggaggcaaagac

SEQ ID NO: 438340 - DNA, 20 bp, Artificial
  CRISPR gRNA sequence
ggaggcaaagactggagtac

SEQ ID NO: 438341 - DNA, 20 bp, Artificial
  CRISPR gRNA sequence
cccagctctgccactaaggg

SEQ ID NO: 438342 - DNA, 20 bp, Artificial
  CRISPR gRNA sequence
ctaagggctgagtaatcctg

SEQ ID NO: 438343 - DNA, 20 bp, Artificial
  CRISPR gRNA sequence
tgtttctaaaatttcagtct

SEQ ID NO: 438344 - DNA, 20 bp, Artificial
  CRISPR gRNA sequence
ggcaggcagatcacgaggtc

SEQ ID NO: 438345 - DNA, 20 bp, Artificial
  CRISPR gRNA sequence
actttgggaagctgagatgg

SEQ ID NO: 438346 - DNA, 20 bp, Artificial
  CRISPR gRNA sequence
tgggaggatcacttgagacc

SEQ ID NO: 438347 - DNA, 20 bp, Artificial
  CRISPR gRNA sequence
ttataagcatttttaaaaca

SEQ ID NO: 438348 - DNA, 20 bp, Artificial
  CRISPR gRNA sequence
cacattactcctgcaataac

SEQ ID NO: 438349 - DNA, 20 bp, Artificial
  CRISPR gRNA sequence
caagatgctgagcatcagtt

SEQ ID NO: 438350 - DNA, 20 bp, Artificial
  CRISPR gRNA sequence
gtgaatacacaagcaagaaa

SEQ ID NO: 438351 - DNA, 20 bp, Artificial
  CRISPR gRNA sequence
agtcaaataaatgtgggctc

SEQ ID NO: 438352 - DNA, 20 bp, Artificial
  CRISPR gRNA sequence
caaggccttgccctgtcacc

SEQ ID NO: 438353 - DNA, 20 bp, Artificial
  CRISPR gRNA sequence
ccttgccctgtcacctagga

SEQ ID NO: 438354 - DNA, 20 bp, Artificial
  CRISPR gRNA sequence
aaaaatattttttgtagaga

SEQ ID NO: 438355 - DNA, 20 bp, Artificial
  CRISPR gRNA sequence
accttggcctcctaaagtgc

SEQ ID NO: 438356 - DNA, 20 bp, Artificial
  CRISPR gRNA sequence
cactgtgcccggcctcctca

SEQ ID NO: 438357 - DNA, 20 bp, Artificial
  CRISPR gRNA sequence
tagtggtttttcttttatga

SEQ ID NO: 438358 - DNA, 20 bp, Artificial
  CRISPR gRNA sequence
ctcactgcaacctccacctc

SEQ ID NO: 438359 - DNA, 20 bp, Artificial
  CRISPR gRNA sequence
gattctcctgtctcagcctc

SEQ ID NO: 438360 - DNA, 20 bp, Artificial
  CRISPR gRNA sequence
ttttgtatttttagtagaga

SEQ ID NO: 438361 - DNA, 20 bp, Artificial
  CRISPR gRNA sequence
tacttagcctcccaaagtgc

SEQ ID NO: 438362 - DNA, 20 bp, Artificial
  CRISPR gRNA sequence
aaagtgctgggattacagac

SEQ ID NO: 438363 - DNA, 20 bp, Artificial
  CRISPR gRNA sequence
actttgggaggccaagttgg

SEQ ID NO: 438364 - DNA, 20 bp, Artificial
  CRISPR gRNA sequence
tgggcggatcacctgaggtc

SEQ ID NO: 438365 - DNA, 20 bp, Artificial
  CRISPR gRNA sequence
actttgggaggccgaggcag

SEQ ID NO: 438366 - DNA, 20 bp, Artificial
  CRISPR gRNA sequence
caggtggatcacctgaggtc

SEQ ID NO: 438367 - DNA, 20 bp, Artificial
  CRISPR gRNA sequence
actaaaaataaaaaaattag

SEQ ID NO: 438368 - DNA, 20 bp, Artificial
  CRISPR gRNA sequence
tactcggaaggctgaggcag

SEQ ID NO: 438369 - DNA, 20 bp, Artificial
  CRISPR gRNA sequence
aggcggaggttgaggtgagc

SEQ ID NO: 438370 - DNA, 20 bp, Artificial
  CRISPR gRNA sequence
aaaaaaaaaacctcttcact

SEQ ID NO: 438371 - DNA, 20 bp, Artificial
  CRISPR gRNA sequence
atttaaatactctttcccat

SEQ ID NO: 438372 - DNA, 20 bp, Artificial
  CRISPR gRNA sequence
aggattgcaatggaagcaag

SEQ ID NO: 438373 - DNA, 20 bp, Artificial
  CRISPR gRNA sequence
aatggtattctagggagatg

SEQ ID NO: 438374 - DNA, 20 bp, Artificial
  CRISPR gRNA sequence
aagaatctttgaaccttcca

SEQ ID NO: 438375 - DNA, 20 bp, Artificial
  CRISPR gRNA sequence
ggtagacagttgtgaaattg

SEQ ID NO: 438376 - DNA, 20 bp, Artificial
  CRISPR gRNA sequence
tcatcaacatgttacagccc

SEQ ID NO: 438377 - DNA, 20 bp, Artificial
  CRISPR gRNA sequence
gccatgatttcccctccaag

SEQ ID NO: 438378 - DNA, 20 bp, Artificial
  CRISPR gRNA sequence
tgcctataatcctatttgaa

SEQ ID NO: 438379 - DNA, 20 bp, Artificial
  CRISPR gRNA sequence
acaaaatttactgaacaccc

SEQ ID NO: 438380 - DNA, 20 bp, Artificial
  CRISPR gRNA sequence
gaacacccaggaatcaactt

SEQ ID NO: 438381 - DNA, 20 bp, Artificial
  CRISPR gRNA sequence
gtttttttcacaggacccta

SEQ ID NO: 438382 - DNA, 20 bp, Artificial
  CRISPR gRNA sequence
tttatttatttatttagaca

SEQ ID NO: 438383 - DNA, 20 bp, Artificial
  CRISPR gRNA sequence
tttcactctgtcacccaggc

SEQ ID NO: 438384 - DNA, 20 bp, Artificial
  CRISPR gRNA sequence
acctcagcctcccaaaatgc

SEQ ID NO: 438385 - DNA, 20 bp, Artificial
  CRISPR gRNA sequence
tctcactctgttgcccaggc

SEQ ID NO: 438386 - DNA, 20 bp, Artificial
  CRISPR gRNA sequence
ttttttttctttttgcgaga

SEQ ID NO: 438387 - DNA, 20 bp, Artificial
  CRISPR gRNA sequence
tctcactctatcacccaggc

SEQ ID NO: 438388 - DNA, 20 bp, Artificial
  CRISPR gRNA sequence
ctcactgcaacctccatctc

SEQ ID NO: 438389 - DNA, 20 bp, Artificial
  CRISPR gRNA sequence
ttttgtatttttagtagaga

SEQ ID NO: 438390 - DNA, 20 bp, Artificial
  CRISPR gRNA sequence
gcctcggcctcccaaagtgc

SEQ ID NO: 438391 - DNA, 20 bp, Artificial
  CRISPR gRNA sequence
tttactcatgagaagggaga

SEQ ID NO: 438392 - DNA, 20 bp, Artificial
  CRISPR gRNA sequence
ctcagtgctgtcattatgaa

SEQ ID NO: 438393 - DNA, 20 bp, Artificial
  CRISPR gRNA sequence
ttcatctgctgatccattcc

SEQ ID NO: 438394 - DNA, 20 bp, Artificial
  CRISPR gRNA sequence
aggccctgacctcatgaaca

SEQ ID NO: 438395 - DNA, 20 bp, Artificial
  CRISPR gRNA sequence
atgcttactcatttttatgg

SEQ ID NO: 438396 - DNA, 20 bp, Artificial
  CRISPR gRNA sequence
tggaagccttaatgtgtata

SEQ ID NO: 438397 - DNA, 20 bp, Artificial
  CRISPR gRNA sequence
tactcaggaggctgaggcag

SEQ ID NO: 438398 - DNA, 20 bp, Artificial
  CRISPR gRNA sequence
agtacaactgctaagtaaac

SEQ ID NO: 438399 - DNA, 20 bp, Artificial
  CRISPR gRNA sequence
agatttggccaccaaccaag

SEQ ID NO: 438400 - DNA, 20 bp, Artificial
  CRISPR gRNA sequence
agatggatgggacagttgaa

SEQ ID NO: 438401 - DNA, 20 bp, Artificial
  CRISPR gRNA sequence
ccatttttcagatgaagata

SEQ ID NO: 438402 - DNA, 20 bp, Artificial
  CRISPR gRNA sequence
cagctattaattgggaaagc

SEQ ID NO: 438403 - DNA, 20 bp, Artificial
  CRISPR gRNA sequence
tgtgttcaaattccaggccc

SEQ ID NO: 438404 - DNA, 20 bp, Artificial
  CRISPR gRNA sequence
ttttttttttttttctgaga

SEQ ID NO: 438405 - DNA, 20 bp, Artificial
  CRISPR gRNA sequence
ctcgctctgttgcccaggtt

SEQ ID NO: 438406 - DNA, 20 bp, Artificial
  CRISPR gRNA sequence
agtggcaccaactcggctca

SEQ ID NO: 438407 - DNA, 20 bp, Artificial
  CRISPR gRNA sequence
ctcagtgaatcctcaacctc

SEQ ID NO: 438408 - DNA, 20 bp, Artificial
  CRISPR gRNA sequence
tttttttttttttttttttt

SEQ ID NO: 438409 - DNA, 20 bp, Artificial
  CRISPR gRNA sequence
ttttttttttttttttggga

SEQ ID NO: 438410 - DNA, 20 bp, Artificial
  CRISPR gRNA sequence
aattctcctgcctcagcctc

SEQ ID NO: 438411 - DNA, 20 bp, Artificial
  CRISPR gRNA sequence
gcctcagcctcctgagtagc

SEQ ID NO: 438412 - DNA, 20 bp, Artificial
  CRISPR gRNA sequence
tttgtatttttagtagagac

SEQ ID NO: 438413 - DNA, 20 bp, Artificial
  CRISPR gRNA sequence
gccttggcctcccaaagtgc

SEQ ID NO: 438414 - DNA, 20 bp, Artificial
  CRISPR gRNA sequence
ttttgtattcttagtagaga

SEQ ID NO: 438415 - DNA, 20 bp, Artificial
  CRISPR gRNA sequence
gccttggcctcccatagtgc

SEQ ID NO: 438416 - DNA, 20 bp, Artificial
  CRISPR gRNA sequence
atgctcccacatcccacatt

SEQ ID NO: 438417 - DNA, 20 bp, Artificial
  CRISPR gRNA sequence
gctttgggaggccgaggcag

SEQ ID NO: 438418 - DNA, 20 bp, Artificial
  CRISPR gRNA sequence
cagagggatcacctgaggtt

SEQ ID NO: 438419 - DNA, 20 bp, Artificial
  CRISPR gRNA sequence
tacttgggaggctgaggcag

SEQ ID NO: 438420 - DNA, 20 bp, Artificial
  CRISPR gRNA sequence
aatggcatgaacctgggagg

SEQ ID NO: 438421 - DNA, 20 bp, Artificial
  CRISPR gRNA sequence
tcgtgtcattgcactccagc

SEQ ID NO: 438422 - DNA, 20 bp, Artificial
  CRISPR gRNA sequence
ttgcactccagcctgggtga

SEQ ID NO: 438423 - DNA, 20 bp, Artificial
  CRISPR gRNA sequence
ggaaatgcaccacctcgaca

SEQ ID NO: 438424 - DNA, 20 bp, Artificial
  CRISPR gRNA sequence
actttgggaggccgaggcgg

SEQ ID NO: 438425 - DNA, 20 bp, Artificial
  CRISPR gRNA sequence
tacttgggaggctgaggcag

SEQ ID NO: 438426 - DNA, 20 bp, Artificial
  CRISPR gRNA sequence
ttgcgccactgcactctagt

SEQ ID NO: 438427 - DNA, 20 bp, Artificial
  CRISPR gRNA sequence
aaaaaaaaagtactgaagca

SEQ ID NO: 438428 - DNA, 20 bp, Artificial
  CRISPR gRNA sequence
actatagtaataataaacag

SEQ ID NO: 438429 - DNA, 20 bp, Artificial
  CRISPR gRNA sequence
ccacctcatgacatgggcac

SEQ ID NO: 438430 - DNA, 20 bp, Artificial
  CRISPR gRNA sequence
gatgagcaaactgagcttca

SEQ ID NO: 438431 - DNA, 20 bp, Artificial
  CRISPR gRNA sequence
tacaaattgtggtcagacat

SEQ ID NO: 438432 - DNA, 20 bp, Artificial
  CRISPR gRNA sequence
aaaaaaaaaatggagctcca

SEQ ID NO: 438433 - DNA, 20 bp, Artificial
  CRISPR gRNA sequence
gtgttctcttctggagcacc

SEQ ID NO: 438434 - DNA, 20 bp, Artificial
  CRISPR gRNA sequence
gcaccctgagtacgtccttg

SEQ ID NO: 438435 - DNA, 20 bp, Artificial
  CRISPR gRNA sequence
cgtccttgctgaattacatg

SEQ ID NO: 438436 - DNA, 20 bp, Artificial
  CRISPR gRNA sequence
ttaactattctttctgtggc

SEQ ID NO: 438437 - DNA, 20 bp, Artificial
  CRISPR gRNA sequence
atgaccaaacatcaccagtc

SEQ ID NO: 438438 - DNA, 20 bp, Artificial
  CRISPR gRNA sequence
tttcccacattcaaaatcct

SEQ ID NO: 438439 - DNA, 20 bp, Artificial
  CRISPR gRNA sequence
gctgcagtgaagtctctctg

SEQ ID NO: 438440 - DNA, 20 bp, Artificial
  CRISPR gRNA sequence
tctctctgccgagtcggtgc

SEQ ID NO: 438441 - DNA, 20 bp, Artificial
  CRISPR gRNA sequence
gctaatgtcagaaacaacat

SEQ ID NO: 438442 - DNA, 20 bp, Artificial
  CRISPR gRNA sequence
agagcagaaagcttatttca

SEQ ID NO: 438443 - DNA, 20 bp, Artificial
  CRISPR gRNA sequence
ccctcagcttccaaacctgc

SEQ ID NO: 438444 - DNA, 20 bp, Artificial
  CRISPR gRNA sequence
cctgcctggatacctacgtt

SEQ ID NO: 438445 - DNA, 20 bp, Artificial
  CRISPR gRNA sequence
gatcagaaatgttttagatt

SEQ ID NO: 438446 - DNA, 20 bp, Artificial
  CRISPR gRNA sequence
ttttttttttttttttgaaa

SEQ ID NO: 438447 - DNA, 20 bp, Artificial
  CRISPR gRNA sequence
tttgctcttgttgcccaggc

SEQ ID NO: 438448 - DNA, 20 bp, Artificial
  CRISPR gRNA sequence
ctcactgcaacctccgcctc

SEQ ID NO: 438449 - DNA, 20 bp, Artificial
  CRISPR gRNA sequence
aattctcctgcctcagactc

SEQ ID NO: 438450 - DNA, 20 bp, Artificial
  CRISPR gRNA sequence
ttttgtatttttagtagaga

SEQ ID NO: 438451 - DNA, 20 bp, Artificial
  CRISPR gRNA sequence
acctcagcctcccaaagtgc

SEQ ID NO: 438452 - DNA, 20 bp, Artificial
  CRISPR gRNA sequence
tgttccaatgagcttttcct

SEQ ID NO: 438453 - DNA, 20 bp, Artificial
  CRISPR gRNA sequence
atgtcagtgtccaaaaagtt

SEQ ID NO: 438454 - DNA, 20 bp, Artificial
  CRISPR gRNA sequence
aggttttagattttcagatt

SEQ ID NO: 438455 - DNA, 20 bp, Artificial
  CRISPR gRNA sequence
cagcgtttcaataacttgct

SEQ ID NO: 438456 - DNA, 20 bp, Artificial
  CRISPR gRNA sequence
attatatagctagtaagagg

SEQ ID NO: 438457 - DNA, 20 bp, Artificial
  CRISPR gRNA sequence
ttcaccatgctggctgcacc

SEQ ID NO: 438458 - DNA, 20 bp, Artificial
  CRISPR gRNA sequence
atttctctggtttttggtag

SEQ ID NO: 438459 - DNA, 20 bp, Artificial
  CRISPR gRNA sequence
tcttctgctttttaagagat

SEQ ID NO: 438460 - DNA, 20 bp, Artificial
  CRISPR gRNA sequence
gcttcagcctctcaaagtat

SEQ ID NO: 438461 - DNA, 20 bp, Artificial
  CRISPR gRNA sequence
actctctatgtgattctaat

SEQ ID NO: 438462 - DNA, 20 bp, Artificial
  CRISPR gRNA sequence
tatgtgattctaatgagagt

SEQ ID NO: 438463 - DNA, 20 bp, Artificial
  CRISPR gRNA sequence
cccatctatacattccaccc

SEQ ID NO: 438464 - DNA, 20 bp, Artificial
  CRISPR gRNA sequence
ttctttttttttttttgaga

SEQ ID NO: 438465 - DNA, 20 bp, Artificial
  CRISPR gRNA sequence
ttcacccttgtcagccaggc

SEQ ID NO: 438466 - DNA, 20 bp, Artificial
  CRISPR gRNA sequence
gcttcagccccccaagtagc

SEQ ID NO: 438467 - DNA, 20 bp, Artificial
  CRISPR gRNA sequence
ctatgttggccaggctggtc

SEQ ID NO: 438468 - DNA, 20 bp, Artificial
  CRISPR gRNA sequence
gcctcagcctcccaaagtgc

SEQ ID NO: 438469 - DNA, 20 bp, Artificial
  CRISPR gRNA sequence
caccacgcccaggcacaccc

SEQ ID NO: 438470 - DNA, 20 bp, Artificial
  CRISPR gRNA sequence
ttttcatcattcattatgcc

SEQ ID NO: 438471 - DNA, 20 bp, Artificial
  CRISPR gRNA sequence
tcattcattatgcctgggat

SEQ ID NO: 438472 - DNA, 20 bp, Artificial
  CRISPR gRNA sequence
cagtagatcccactgtctgc

SEQ ID NO: 438473 - DNA, 20 bp, Artificial
  CRISPR gRNA sequence
aatccccatttagccagtat

SEQ ID NO: 438474 - DNA, 20 bp, Artificial
  CRISPR gRNA sequence
acgaggttccctggggcggc

SEQ ID NO: 438475 - DNA, 20 bp, Artificial
  CRISPR gRNA sequence
ggagagccaagactcaagcg

SEQ ID NO: 438476 - DNA, 20 bp, Artificial
  CRISPR gRNA sequence
aaactgcaagccatgtctta

SEQ ID NO: 438477 - DNA, 20 bp, Artificial
  CRISPR gRNA sequence
tactgctgcagtcctgtttg

SEQ ID NO: 438478 - DNA, 20 bp, Artificial
  CRISPR gRNA sequence
ttctcagatgtgaaggccat

SEQ ID NO: 438479 - DNA, 20 bp, Artificial
  CRISPR gRNA sequence
agattgctgggctcaactgc

SEQ ID NO: 438480 - DNA, 20 bp, Artificial
  CRISPR gRNA sequence
tcagaaacactgccctagga

SEQ ID NO: 438481 - DNA, 20 bp, Artificial
  CRISPR gRNA sequence
atacaaacccttggttaaat

SEQ ID NO: 438482 - DNA, 20 bp, Artificial
  CRISPR gRNA sequence
tgtgtatttgaaactactca

SEQ ID NO: 438483 - DNA, 20 bp, Artificial
  CRISPR gRNA sequence
gggaaaagtcaagctgggaa

SEQ ID NO: 438484 - DNA, 20 bp, Artificial
  CRISPR gRNA sequence
ctgcctcctctttttgattc

SEQ ID NO: 438485 - DNA, 20 bp, Artificial
  CRISPR gRNA sequence
attcctgaataagatggcta

SEQ ID NO: 438486 - DNA, 20 bp, Artificial
  CRISPR gRNA sequence
cccccttttttatgtgaaaa

SEQ ID NO: 438487 - DNA, 20 bp, Artificial
  CRISPR gRNA sequence
aaaaagtggccgggcacacg

SEQ ID NO: 438488 - DNA, 20 bp, Artificial
  CRISPR gRNA sequence
tgggcagattacttgaggcc

SEQ ID NO: 438489 - DNA, 20 bp, Artificial
  CRISPR gRNA sequence
ctaaaaattaaaaacattag

SEQ ID NO: 438490 - DNA, 20 bp, Artificial
  CRISPR gRNA sequence
tactccggtgcctaaggcag

SEQ ID NO: 438491 - DNA, 20 bp, Artificial
  CRISPR gRNA sequence
ctgcactccagcctgggcaa

SEQ ID NO: 438492 - DNA, 20 bp, Artificial
  CRISPR gRNA sequence
gttttaactctccaaatgga

SEQ ID NO: 438493 - DNA, 20 bp, Artificial
  CRISPR gRNA sequence
atgagcagtagccgccccca

SEQ ID NO: 438494 - DNA, 20 bp, Artificial
  CRISPR gRNA sequence
tgagtgctagctcagcacac

SEQ ID NO: 438495 - DNA, 20 bp, Artificial
  CRISPR gRNA sequence
gttctctttatgtgccatga

SEQ ID NO: 438496 - DNA, 20 bp, Artificial
  CRISPR gRNA sequence
gacagacatcagaacactta

SEQ ID NO: 438497 - DNA, 20 bp, Artificial
  CRISPR gRNA sequence
agacctggcagtgttactat

SEQ ID NO: 438498 - DNA, 20 bp, Artificial
  CRISPR gRNA sequence
aatcactggcaatcagacac

SEQ ID NO: 438499 - DNA, 20 bp, Artificial
  CRISPR gRNA sequence
ggctactgctcatgtgattg

SEQ ID NO: 438500 - DNA, 20 bp, Artificial
  CRISPR gRNA sequence
agaagtacccagtccatttg

SEQ ID NO: 438501 - DNA, 20 bp, Artificial
  CRISPR gRNA sequence
acttacaagtaagtctcggc

SEQ ID NO: 438502 - DNA, 20 bp, Artificial
  CRISPR gRNA sequence
agaggacaagggagagatac

SEQ ID NO: 438503 - DNA, 20 bp, Artificial
  CRISPR gRNA sequence
acctaaatgtccgtcgatga

SEQ ID NO: 438504 - DNA, 20 bp, Artificial
  CRISPR gRNA sequence
aaatgtccgtcgatgaggga

SEQ ID NO: 438505 - DNA, 20 bp, Artificial
  CRISPR gRNA sequence
atataatcatgatacaaaca

SEQ ID NO: 438506 - DNA, 20 bp, Artificial
  CRISPR gRNA sequence
tctgacaaaacatactggta

SEQ ID NO: 438507 - DNA, 20 bp, Artificial
  CRISPR gRNA sequence
ttattaaagaaaaaaagttg

SEQ ID NO: 438508 - DNA, 20 bp, Artificial
  CRISPR gRNA sequence
tgtgtgcattgtcggggagc

SEQ ID NO: 438509 - DNA, 20 bp, Artificial
  CRISPR gRNA sequence
agctctaggaaaaggaacca

SEQ ID NO: 438510 - DNA, 20 bp, Artificial
  CRISPR gRNA sequence
aaaggaaccagggaatggta

SEQ ID NO: 438511 - DNA, 20 bp, Artificial
  CRISPR gRNA sequence
agggaatggtaaagagttgg

SEQ ID NO: 438512 - DNA, 20 bp, Artificial
  CRISPR gRNA sequence
tttctttttttcaattgaga

SEQ ID NO: 438513 - DNA, 20 bp, Artificial
  CRISPR gRNA sequence
tctcactctattgcccaggc

SEQ ID NO: 438514 - DNA, 20 bp, Artificial
  CRISPR gRNA sequence
gattctcctgccttaggcac

SEQ ID NO: 438515 - DNA, 20 bp, Artificial
  CRISPR gRNA sequence
gccttaggcaccggagtagc

SEQ ID NO: 438516 - DNA, 20 bp, Artificial
  CRISPR gRNA sequence
tttttaatttttagtagaga

SEQ ID NO: 438517 - DNA, 20 bp, Artificial
  CRISPR gRNA sequence
atctcagcctcccaaagtgc

SEQ ID NO: 438518 - DNA, 20 bp, Artificial
  CRISPR gRNA sequence
tcatacacctttgatagtgt

SEQ ID NO: 438519 - DNA, 20 bp, Artificial
  CRISPR gRNA sequence
tttgaatgtttttactgtag

SEQ ID NO: 438520 - DNA, 20 bp, Artificial
  CRISPR gRNA sequence
aaatcaaaagaaaatatata

SEQ ID NO: 438521 - DNA, 20 bp, Artificial
  CRISPR gRNA sequence
tatatatagtttttttttaa

SEQ ID NO: 438522 - DNA, 20 bp, Artificial
  CRISPR gRNA sequence
cagatttaaaggggacaagg

SEQ ID NO: 438523 - DNA, 20 bp, Artificial
  CRISPR gRNA sequence
gggggcagaggaaaaatatg

SEQ ID NO: 438524 - DNA, 20 bp, Artificial
  CRISPR gRNA sequence
attagataacacagacaaaa

SEQ ID NO: 438525 - DNA, 20 bp, Artificial
  CRISPR gRNA sequence
ataacgcatttgtgtctggc

SEQ ID NO: 438526 - DNA, 20 bp, Artificial
  CRISPR gRNA sequence
tctgcattgcacagctgacc

SEQ ID NO: 438527 - DNA, 20 bp, Artificial
  CRISPR gRNA sequence
atcctgtagccatcttattc

SEQ ID NO: 438528 - DNA, 20 bp, Artificial
  CRISPR gRNA sequence
agcttgacttttccctttga

SEQ ID NO: 438529 - DNA, 20 bp, Artificial
  CRISPR gRNA sequence
tgacttttccctttgactga

SEQ ID NO: 438530 - DNA, 20 bp, Artificial
  CRISPR gRNA sequence
tccctttgactgaatgagtt

SEQ ID NO: 438531 - DNA, 20 bp, Artificial
  CRISPR gRNA sequence
ttaaaccttaaaacaactcc

SEQ ID NO: 438532 - DNA, 20 bp, Artificial
  CRISPR gRNA sequence
cacaagatccttatttaacc

SEQ ID NO: 438533 - DNA, 20 bp, Artificial
  CRISPR gRNA sequence
gccctgttctcccgtgttca

SEQ ID NO: 438534 - DNA, 20 bp, Artificial
  CRISPR gRNA sequence
caggctctaccacaggccaa

SEQ ID NO: 438535 - DNA, 20 bp, Artificial
  CRISPR gRNA sequence
atctgagaagcattgtcaca

SEQ ID NO: 438536 - DNA, 20 bp, Artificial
  CRISPR gRNA sequence
ggcttgcagttttcctgaaa

SEQ ID NO: 438537 - DNA, 20 bp, Artificial
  CRISPR gRNA sequence
ggagtaacctcactcaccgc

SEQ ID NO: 438538 - DNA, 20 bp, Artificial
  CRISPR gRNA sequence
gctctccttctctctctatg

SEQ ID NO: 438539 - DNA, 20 bp, Artificial
  CRISPR gRNA sequence
ctatgcagggtcctcagaag

SEQ ID NO: 438540 - DNA, 20 bp, Artificial
  CRISPR gRNA sequence
aatacagagcggaggtcggt

SEQ ID NO: 438541 - DNA, 20 bp, Artificial
  CRISPR gRNA sequence
caaaggagcctgtcctgtgt

SEQ ID NO: 438542 - DNA, 20 bp, Artificial
  CRISPR gRNA sequence
tggtgctcaggactgatgaa

SEQ ID NO: 438543 - DNA, 20 bp, Artificial
  CRISPR gRNA sequence
tcaggactgatgaaagggat

SEQ ID NO: 438544 - DNA, 20 bp, Artificial
  CRISPR gRNA sequence
catccagatactggctaaat

SEQ ID NO: 438545 - DNA, 20 bp, Artificial
  CRISPR gRNA sequence
gagatgtgtccctgaccata

SEQ ID NO: 438546 - DNA, 20 bp, Artificial
  CRISPR gRNA sequence
aatgtgactctagcagacag

SEQ ID NO: 438547 - DNA, 20 bp, Artificial
  CRISPR gRNA sequence
gacagtgggatctactgctg

SEQ ID NO: 438548 - DNA, 20 bp, Artificial
  CRISPR gRNA sequence
ggatccaaatcccaggcata

SEQ ID NO: 438549 - DNA, 20 bp, Artificial
  CRISPR gRNA sequence
gaagttggtcatcaaaccag

SEQ ID NO: 438550 - DNA, 20 bp, Artificial
  CRISPR gRNA sequence
gacatttgcatgccatcttt

SEQ ID NO: 438551 - DNA, 20 bp, Artificial
  CRISPR gRNA sequence
tttatgaataagatttatct

SEQ ID NO: 438552 - DNA, 20 bp, Artificial
  CRISPR gRNA sequence
ttctctctgttttaaaactc

SEQ ID NO: 438553 - DNA, 20 bp, Artificial
  CRISPR gRNA sequence
actttgggaggctgaggccg

SEQ ID NO: 438554 - DNA, 20 bp, Artificial
  CRISPR gRNA sequence
ggccggtggatcatgaggtc

SEQ ID NO: 438555 - DNA, 20 bp, Artificial
  CRISPR gRNA sequence
tacttggggggctgaagcag

SEQ ID NO: 438556 - DNA, 20 bp, Artificial
  CRISPR gRNA sequence
caggagaatcacttgaacct

SEQ ID NO: 438557 - DNA, 20 bp, Artificial
  CRISPR gRNA sequence
tgtactccagcctggctgac

SEQ ID NO: 438558 - DNA, 20 bp, Artificial
  CRISPR gRNA sequence
gaaaagaaaagccaaaactc

SEQ ID NO: 438559 - DNA, 20 bp, Artificial
  CRISPR gRNA sequence
gaaaagccaaaactcatggg

SEQ ID NO: 438560 - DNA, 20 bp, Artificial
  CRISPR gRNA sequence
tcatgggtggaatgtataga

SEQ ID NO: 438561 - DNA, 20 bp, Artificial
  CRISPR gRNA sequence
ttagagaccctgactctcat

SEQ ID NO: 438562 - DNA, 20 bp, Artificial
  CRISPR gRNA sequence
actctcattagaatcacata

SEQ ID NO: 438563 - DNA, 20 bp, Artificial
  CRISPR gRNA sequence
actttgagaggctgaagcag

SEQ ID NO: 438564 - DNA, 20 bp, Artificial
  CRISPR gRNA sequence
caggaggatcacttgaggtc

SEQ ID NO: 438565 - DNA, 20 bp, Artificial
  CRISPR gRNA sequence
tgctaagcattagcttttta

SEQ ID NO: 438566 - DNA, 20 bp, Artificial
  CRISPR gRNA sequence
gcagccagcatggtgaactg

SEQ ID NO: 438567 - DNA, 20 bp, Artificial
  CRISPR gRNA sequence
tactttgtgcccagatagag

SEQ ID NO: 438568 - DNA, 20 bp, Artificial
  CRISPR gRNA sequence
ccgatcatgtgggccattag

SEQ ID NO: 438569 - DNA, 20 bp, Artificial
  CRISPR gRNA sequence
cagcactttgggaggctgag

SEQ ID NO: 438570 - DNA, 20 bp, Artificial
  CRISPR gRNA sequence
actttgggaggctgaggtgg

SEQ ID NO: 438571 - DNA, 20 bp, Artificial
  CRISPR gRNA sequence
tgggtggatcacctgaggtc

SEQ ID NO: 438572 - DNA, 20 bp, Artificial
  CRISPR gRNA sequence
gcctgtagtcccagctactc

SEQ ID NO: 438573 - DNA, 20 bp, Artificial
  CRISPR gRNA sequence
tactcaggagtctgaggcag

SEQ ID NO: 438574 - DNA, 20 bp, Artificial
  CRISPR gRNA sequence
gatctcaagcatttcagata

SEQ ID NO: 438575 - DNA, 20 bp, Artificial
  CRISPR gRNA sequence
ttagttccgctattaataat

SEQ ID NO: 438576 - DNA, 20 bp, Artificial
  CRISPR gRNA sequence
tccaggcaggtttggaagct

SEQ ID NO: 438577 - DNA, 20 bp, Artificial
  CRISPR gRNA sequence
gacttcactgcagcctttcc

SEQ ID NO: 438578 - DNA, 20 bp, Artificial
  CRISPR gRNA sequence
actatgcatggggcagagga

SEQ ID NO: 438579 - DNA, 20 bp, Artificial
  CRISPR gRNA sequence
gagggaatctttagctggct

SEQ ID NO: 438580 - DNA, 20 bp, Artificial
  CRISPR gRNA sequence
tttagctggctctgaattca

SEQ ID NO: 438581 - DNA, 20 bp, Artificial
  CRISPR gRNA sequence
ggctctgaattcagaggatt

SEQ ID NO: 438582 - DNA, 20 bp, Artificial
  CRISPR gRNA sequence
aaaagatgagaaaacagtgt

SEQ ID NO: 438583 - DNA, 20 bp, Artificial
  CRISPR gRNA sequence
aacagtgtgagagtggaggc

SEQ ID NO: 438584 - DNA, 20 bp, Artificial
  CRISPR gRNA sequence
gggaaaaagatggtctggct

SEQ ID NO: 438585 - DNA, 20 bp, Artificial
  CRISPR gRNA sequence
ttacttaaatattaactaaa

SEQ ID NO: 438586 - DNA, 20 bp, Artificial
  CRISPR gRNA sequence
tgtgtttgggaactgacaca

SEQ ID NO: 438587 - DNA, 20 bp, Artificial
  CRISPR gRNA sequence
acattggattaggtgatttc

SEQ ID NO: 438588 - DNA, 20 bp, Artificial
  CRISPR gRNA sequence
tttctaggatgccttctagc

SEQ ID NO: 438589 - DNA, 20 bp, Artificial
  CRISPR gRNA sequence
aataaagcccatcaccttcc

SEQ ID NO: 438590 - DNA, 20 bp, Artificial
  CRISPR gRNA sequence
ccctggattccagccacaga

SEQ ID NO: 438591 - DNA, 20 bp, Artificial
  CRISPR gRNA sequence
taattcagcaaggacgtact

SEQ ID NO: 438592 - DNA, 20 bp, Artificial
  CRISPR gRNA sequence
ctgtaaaatgaggttaatag

SEQ ID NO: 438593 - DNA, 20 bp, Artificial
  CRISPR gRNA sequence
taaagtacttcagtgacagg

SEQ ID NO: 438594 - DNA, 20 bp, Artificial
  CRISPR gRNA sequence
gtacttcagtgacaggtgga

SEQ ID NO: 438595 - DNA, 20 bp, Artificial
  CRISPR gRNA sequence
agtttgctcatctctacaat

SEQ ID NO: 438596 - DNA, 20 bp, Artificial
  CRISPR gRNA sequence
tatgccattgttatatttta

SEQ ID NO: 438597 - DNA, 20 bp, Artificial
  CRISPR gRNA sequence
atagtgctagaagggacttc

SEQ ID NO: 438598 - DNA, 20 bp, Artificial
  CRISPR gRNA sequence
ttttttttttttaattgaga

SEQ ID NO: 438599 - DNA, 20 bp, Artificial
  CRISPR gRNA sequence
tcttgctctgtcacccagac

SEQ ID NO: 438600 - DNA, 20 bp, Artificial
  CRISPR gRNA sequence
ctcactgcaagttccgcctc

SEQ ID NO: 438601 - DNA, 20 bp, Artificial
  CRISPR gRNA sequence
ttttgtatttttagtagaga

SEQ ID NO: 438602 - DNA, 20 bp, Artificial
  CRISPR gRNA sequence
cagagtttcaccgtgttagc

SEQ ID NO: 438603 - DNA, 20 bp, Artificial
  CRISPR gRNA sequence
gcctcggcctcccaaagtgc

SEQ ID NO: 438604 - DNA, 20 bp, Artificial
  CRISPR gRNA sequence
tactttttactacatcacca

SEQ ID NO: 438605 - DNA, 20 bp, Artificial
  CRISPR gRNA sequence
gaatgggcatttgctgtaga

SEQ ID NO: 438606 - DNA, 20 bp, Artificial
  CRISPR gRNA sequence
ctttttttttttttttgaga

SEQ ID NO: 438607 - DNA, 20 bp, Artificial
  CRISPR gRNA sequence
tctcactctctcacccaggc

SEQ ID NO: 438608 - DNA, 20 bp, Artificial
  CRISPR gRNA sequence
gcctcagcctcccaagtagc

SEQ ID NO: 438609 - DNA, 20 bp, Artificial
  CRISPR gRNA sequence
ttttgtatttttattagaga

SEQ ID NO: 438610 - DNA, 20 bp, Artificial
  CRISPR gRNA sequence
gcctcggcctcccaaagcgc

SEQ ID NO: 438611 - DNA, 20 bp, Artificial
  CRISPR gRNA sequence
ccctctagggcaacaaaaat

SEQ ID NO: 438612 - DNA, 20 bp, Artificial
  CRISPR gRNA sequence
ggcaacaaaaatgggaatat

SEQ ID NO: 438613 - DNA, 20 bp, Artificial
  CRISPR gRNA sequence
aaataaaataaaaaattgaa

SEQ ID NO: 438614 - DNA, 20 bp, Artificial
  CRISPR gRNA sequence
aaaataaaaaattgaaatga

SEQ ID NO: 438615 - DNA, 20 bp, Artificial
  CRISPR gRNA sequence
tggcaaaccaactctaaatg

SEQ ID NO: 438616 - DNA, 20 bp, Artificial
  CRISPR gRNA sequence
caggcagatcactggagctc

SEQ ID NO: 438617 - DNA, 20 bp, Artificial
  CRISPR gRNA sequence
ggcaaaaccccatctctact

SEQ ID NO: 438618 - DNA, 20 bp, Artificial
  CRISPR gRNA sequence
taagaatacaaaaaattagg

SEQ ID NO: 438619 - DNA, 20 bp, Artificial
  CRISPR gRNA sequence
actttgggaggccaaggcag

SEQ ID NO: 438620 - DNA, 20 bp, Artificial
  CRISPR gRNA sequence
cagatggatcacctgaggtc

SEQ ID NO: 438621 - DNA, 20 bp, Artificial
  CRISPR gRNA sequence
tactcaggaggctgaggcag

SEQ ID NO: 438622 - DNA, 20 bp, Artificial
  CRISPR gRNA sequence
gagaattgtctgagcctggg

SEQ ID NO: 438623 - DNA, 20 bp, Artificial
  CRISPR gRNA sequence
ttgcttgaactcaggaggtt

SEQ ID NO: 438624 - DNA, 20 bp, Artificial
  CRISPR gRNA sequence
gaggttgaggattcactgag

SEQ ID NO: 438625 - DNA, 20 bp, Artificial
  CRISPR gRNA sequence
agaaaaaaaaaaaaaaaaaa

SEQ ID NO: 438626 - DNA, 20 bp, Artificial
  CRISPR gRNA sequence
aagtaagagatccaagggcc

SEQ ID NO: 438627 - DNA, 20 bp, Artificial
  CRISPR gRNA sequence
gcaacttgtcttctacctga

SEQ ID NO: 438628 - DNA, 20 bp, Artificial
  CRISPR gRNA sequence
tctacctgaaggagtaagga

SEQ ID NO: 438629 - DNA, 20 bp, Artificial
  CRISPR gRNA sequence
gagtaaggactgggtcacag

SEQ ID NO: 438630 - DNA, 20 bp, Artificial
  CRISPR gRNA sequence
cacaggtgagtcctcagctc

SEQ ID NO: 438631 - DNA, 20 bp, Artificial
  CRISPR gRNA sequence
agtacctacttattgtggtt

SEQ ID NO: 438632 - DNA, 20 bp, Artificial
  CRISPR gRNA sequence
tatcaagaaaaataattata

SEQ ID NO: 438633 - DNA, 20 bp, Artificial
  CRISPR gRNA sequence
taattataaggagtctgaaa

SEQ ID NO: 438634 - DNA, 20 bp, Artificial
  CRISPR gRNA sequence
tacttagcagttgtactgat

SEQ ID NO: 438635 - DNA, 20 bp, Artificial
  CRISPR gRNA sequence
ttttttttatttttttgata

SEQ ID NO: 438636 - DNA, 20 bp, Artificial
  CRISPR gRNA sequence
gtcttgctctgtcaccaggc

SEQ ID NO: 438637 - DNA, 20 bp, Artificial
  CRISPR gRNA sequence
ctcactgcaacctccacctc

SEQ ID NO: 438638 - DNA, 20 bp, Artificial
  CRISPR gRNA sequence
gattccactgcctcagcctc

SEQ ID NO: 438639 - DNA, 20 bp, Artificial
  CRISPR gRNA sequence
tttttgtattttagtagaga

SEQ ID NO: 438640 - DNA, 20 bp, Artificial
  CRISPR gRNA sequence
tggggtttcaccatattggc

SEQ ID NO: 438641 - DNA, 20 bp, Artificial
  CRISPR gRNA sequence
ccctcggcctcccaaagtgc

SEQ ID NO: 438642 - DNA, 20 bp, Artificial
  CRISPR gRNA sequence
tctctgactcagccataaaa

SEQ ID NO: 438643 - DNA, 20 bp, Artificial
  CRISPR gRNA sequence
gctggcaatgtacttatttt

SEQ ID NO: 438644 - DNA, 20 bp, Artificial
  CRISPR gRNA sequence
cctgctctgtcccctgtgcc

SEQ ID NO: 438645 - DNA, 20 bp, Artificial
  CRISPR gRNA sequence
aagggcatagtgcatattca

SEQ ID NO: 438646 - DNA, 20 bp, Artificial
  CRISPR gRNA sequence
gcatagtgcatattcatgga

SEQ ID NO: 438647 - DNA, 20 bp, Artificial
  CRISPR gRNA sequence
atgaacaggaaggaaagatg

SEQ ID NO: 438648 - DNA, 20 bp, Artificial
  CRISPR gRNA sequence
acaggaaggaaagatggtga

SEQ ID NO: 438649 - DNA, 20 bp, Artificial
  CRISPR gRNA sequence
ctggtgaaggcagtataatt

SEQ ID NO: 438650 - DNA, 20 bp, Artificial
  CRISPR gRNA sequence
atttgctaagtcatgtgacc

SEQ ID NO: 438651 - DNA, 20 bp, Artificial
  CRISPR gRNA sequence
aaaatgagcttcttcactga

SEQ ID NO: 438652 - DNA, 20 bp, Artificial
  CRISPR gRNA sequence
gcaaccctgtctcccttctc

SEQ ID NO: 438653 - DNA, 20 bp, Artificial
  CRISPR gRNA sequence
cagcactttgggaggccgag

SEQ ID NO: 438654 - DNA, 20 bp, Artificial
  CRISPR gRNA sequence
actttgggaggccgaggcgg

SEQ ID NO: 438655 - DNA, 20 bp, Artificial
  CRISPR gRNA sequence
cgggtggatcacttgaggtc

SEQ ID NO: 438656 - DNA, 20 bp, Artificial
  CRISPR gRNA sequence
taccagggaggctgaggcag

SEQ ID NO: 438657 - DNA, 20 bp, Artificial
  CRISPR gRNA sequence
tcatgctactgcactccagc

SEQ ID NO: 438658 - DNA, 20 bp, Artificial
  CRISPR gRNA sequence
ctgcactccagcctgggtga

SEQ ID NO: 438659 - DNA, 20 bp, Artificial
  CRISPR gRNA sequence
aaaagaacatggaggttgca

SEQ ID NO: 438660 - DNA, 20 bp, Artificial
  CRISPR gRNA sequence
ctgcactccagcctgggcaa

SEQ ID NO: 438661 - DNA, 20 bp, Artificial
  CRISPR gRNA sequence
aaaaaacaaaaaagaaggaa

SEQ ID NO: 438662 - DNA, 20 bp, Artificial
  CRISPR gRNA sequence
gttgtcttttaaaatctaat

SEQ ID NO: 438663 - DNA, 20 bp, Artificial
  CRISPR gRNA sequence
tgggcagatcacctgaggtc

SEQ ID NO: 438664 - DNA, 20 bp, Artificial
  CRISPR gRNA sequence
atgtagtcccagctacttgg

SEQ ID NO: 438665 - DNA, 20 bp, Artificial
  CRISPR gRNA sequence
cccagctacttgggaggatg

SEQ ID NO: 438666 - DNA, 20 bp, Artificial
  CRISPR gRNA sequence
tacttgggaggatgagggat

SEQ ID NO: 438667 - DNA, 20 bp, Artificial
  CRISPR gRNA sequence
ttatgccactgcactccagc

SEQ ID NO: 438668 - DNA, 20 bp, Artificial
  CRISPR gRNA sequence
ctgcactccagcctgggtga

SEQ ID NO: 438669 - DNA, 20 bp, Artificial
  CRISPR gRNA sequence
aataaataaataaataatgc

SEQ ID NO: 438670 - DNA, 20 bp, Artificial
  CRISPR gRNA sequence
tagatgtttgtagaactcat

SEQ ID NO: 438671 - DNA, 20 bp, Artificial
  CRISPR gRNA sequence
ggccatcctaaagttgattc

SEQ ID NO: 438672 - DNA, 20 bp, Artificial
  CRISPR gRNA sequence
attaattattgtgacaagta

SEQ ID NO: 438673 - DNA, 20 bp, Artificial
  CRISPR gRNA sequence
ttattgtgacaagtacggag

SEQ ID NO: 438674 - DNA, 20 bp, Artificial
  CRISPR gRNA sequence
ggagtagaattcatttcaaa

SEQ ID NO: 438675 - DNA, 20 bp, Artificial
  CRISPR gRNA sequence
cttcatgcccaccttgtcct

SEQ ID NO: 438676 - DNA, 20 bp, Artificial
  CRISPR gRNA sequence
tcaaagattcttcatctccc

SEQ ID NO: 438677 - DNA, 20 bp, Artificial
  CRISPR gRNA sequence
ccattgcaatcctaatggga

SEQ ID NO: 438678 - DNA, 20 bp, Artificial
  CRISPR gRNA sequence
aatatggcaagacaccagtc

SEQ ID NO: 438679 - DNA, 20 bp, Artificial
  CRISPR gRNA sequence
tttttttttttttttttaga

SEQ ID NO: 438680 - DNA, 20 bp, Artificial
  CRISPR gRNA sequence
ttcgctcttgttgcccaggc

SEQ ID NO: 438681 - DNA, 20 bp, Artificial
  CRISPR gRNA sequence
tgttgcccaggctggagtgc

SEQ ID NO: 438682 - DNA, 20 bp, Artificial
  CRISPR gRNA sequence
ctcacctcaacctccgcctc

SEQ ID NO: 438683 - DNA, 20 bp, Artificial
  CRISPR gRNA sequence
gattctcctgcctcagcctt

SEQ ID NO: 438684 - DNA, 20 bp, Artificial
  CRISPR gRNA sequence
gcctcagccttccgagtagc

SEQ ID NO: 438685 - DNA, 20 bp, Artificial
  CRISPR gRNA sequence
ttttttatttttagtagaga

SEQ ID NO: 438686 - DNA, 20 bp, Artificial
  CRISPR gRNA sequence
ttttgtatttttagtagaga

SEQ ID NO: 438687 - DNA, 20 bp, Artificial
  CRISPR gRNA sequence
aacttggcctcccaaagtgc

SEQ ID NO: 438688 - DNA, 20 bp, Artificial
  CRISPR gRNA sequence
tactgtccctgctaccttct

SEQ ID NO: 438689 - DNA, 20 bp, Artificial
  CRISPR gRNA sequence
cagcactttgggaggctaag

SEQ ID NO: 438690 - DNA, 20 bp, Artificial
  CRISPR gRNA sequence
actttgggaggctaagtagg

SEQ ID NO: 438691 - DNA, 20 bp, Artificial
  CRISPR gRNA sequence
agtagggtggatcacctgtc

SEQ ID NO: 438692 - DNA, 20 bp, Artificial
  CRISPR gRNA sequence
tactcaggaggctgagacag

SEQ ID NO: 438693 - DNA, 20 bp, Artificial
  CRISPR gRNA sequence
ggctgagacaggagaatcgc

SEQ ID NO: 438694 - DNA, 20 bp, Artificial
  CRISPR gRNA sequence
ctttaggaggccaaggtgga

SEQ ID NO: 438695 - DNA, 20 bp, Artificial
  CRISPR gRNA sequence
tggaaggaatgcttgagacc

SEQ ID NO: 438696 - DNA, 20 bp, Artificial
  CRISPR gRNA sequence
tacttgggaggctgaggcag

SEQ ID NO: 438697 - DNA, 20 bp, Artificial
  CRISPR gRNA sequence
tataggactcctgttattgc

SEQ ID NO: 438698 - DNA, 20 bp, Artificial
  CRISPR gRNA sequence
tattgcaggagtaatgtgta

SEQ ID NO: 438699 - DNA, 20 bp, Artificial
  CRISPR gRNA sequence
aatcaatttgtaaatgtata

SEQ ID NO: 438700 - DNA, 20 bp, Artificial
  CRISPR gRNA sequence
gtgtgtgtgttttgtataaa

SEQ ID NO: 438701 - DNA, 20 bp, Artificial
  CRISPR gRNA sequence
atctcagcttcccaaagtgc

SEQ ID NO: 438702 - DNA, 20 bp, Artificial
  CRISPR gRNA sequence
tttattatttatttttgaga

SEQ ID NO: 438703 - DNA, 20 bp, Artificial
  CRISPR gRNA sequence
tttgctcttgtcgcccaggc

SEQ ID NO: 438704 - DNA, 20 bp, Artificial
  CRISPR gRNA sequence
ctcactgcaacctctgcctc

SEQ ID NO: 438705 - DNA, 20 bp, Artificial
  CRISPR gRNA sequence
ttttgtatttttagtagaga

SEQ ID NO: 438706 - DNA, 20 bp, Artificial
  CRISPR gRNA sequence
atagactgaaattttagaaa

SEQ ID NO: 438707 - DNA, 20 bp, Artificial
  CRISPR gRNA sequence
tagttttcctgataactcta

SEQ ID NO: 438708 - DNA, 20 bp, Artificial
  CRISPR gRNA sequence
cagcccttagtggcagagct

SEQ ID NO: 438709 - DNA, 20 bp, Artificial
  CRISPR gRNA sequence
ttttttttttttttttgaga

SEQ ID NO: 438710 - DNA, 20 bp, Artificial
  CRISPR gRNA sequence
tgcagtggcatgatctcaac

SEQ ID NO: 438711 - DNA, 20 bp, Artificial
  CRISPR gRNA sequence
agtactccagtctttgcctc

SEQ ID NO: 438712 - DNA, 20 bp, Artificial
  CRISPR gRNA sequence
gcctcagcctccccactagc

SEQ ID NO: 438713 - DNA, 20 bp, Artificial
  CRISPR gRNA sequence
ttttgtatttttagtagaga

SEQ ID NO: 438714 - DNA, 20 bp, Artificial
  CRISPR gRNA sequence
gcctaggcctcccaaagtgc

SEQ ID NO: 438715 - DNA, 20 bp, Artificial
  CRISPR gRNA sequence
accgcgcccggcctcagagc

SEQ ID NO: 438716 - DNA, 20 bp, Artificial
  CRISPR gRNA sequence
cccggcctcagagctgggat

SEQ ID NO: 438717 - DNA, 20 bp, Artificial
  CRISPR gRNA sequence
tggctgtaaagtcttggcta

SEQ ID NO: 438718 - DNA, 20 bp, Artificial
  CRISPR gRNA sequence
aactactctaaaactctctg

SEQ ID NO: 438719 - DNA, 20 bp, Artificial
  CRISPR gRNA sequence
aaactctctggggaatctta

SEQ ID NO: 438720 - DNA, 20 bp, Artificial
  CRISPR gRNA sequence
aatttttgcaggggcaggga

SEQ ID NO: 438721 - DNA, 20 bp, Artificial
  CRISPR gRNA sequence
aggttaagggagaccctttc

SEQ ID NO: 438722 - DNA, 20 bp, Artificial
  CRISPR gRNA sequence
agaccctttcttgggttggc

SEQ ID NO: 438723 - DNA, 20 bp, Artificial
  CRISPR gRNA sequence
ccatcctgtgatgttgtaaa

SEQ ID NO: 438724 - DNA, 20 bp, Artificial
  CRISPR gRNA sequence
gcaaatatccacattggcca

SEQ ID NO: 438725 - DNA, 20 bp, Artificial
  CRISPR gRNA sequence
cgggactctggagcaaccat

SEQ ID NO: 438726 - DNA, 20 bp, Artificial
  CRISPR gRNA sequence
ataggcatctacatcggagc

SEQ ID NO: 438727 - DNA, 20 bp, Artificial
  CRISPR gRNA sequence
cattactgtcttatgagata

SEQ ID NO: 438728 - DNA, 20 bp, Artificial
  CRISPR gRNA sequence
cagtgaagggaagtcaagct

SEQ ID NO: 438729 - DNA, 20 bp, Artificial
  CRISPR gRNA sequence
taaactaatttctttaattc

SEQ ID NO: 438730 - DNA, 20 bp, Artificial
  CRISPR gRNA sequence
gactgcaagtccctttaaca

SEQ ID NO: 438731 - DNA, 20 bp, Artificial
  CRISPR gRNA sequence
ctttaacactgggtcgtgac

SEQ ID NO: 438732 - DNA, 20 bp, Artificial
  CRISPR gRNA sequence
ctgggtcgtgactggggtta

SEQ ID NO: 438733 - DNA, 20 bp, Artificial
  CRISPR gRNA sequence
cagcactttgggaggctgag

SEQ ID NO: 438734 - DNA, 20 bp, Artificial
  CRISPR gRNA sequence
actttgggaggctgaggggg

SEQ ID NO: 438735 - DNA, 20 bp, Artificial
  CRISPR gRNA sequence
ggggtggatcatttgaggtc

SEQ ID NO: 438736 - DNA, 20 bp, Artificial
  CRISPR gRNA sequence
tactaaaaatacaaaattag

SEQ ID NO: 438737 - DNA, 20 bp, Artificial
  CRISPR gRNA sequence
tactcaggaggctgaggcag

SEQ ID NO: 438738 - DNA, 20 bp, Artificial
  CRISPR gRNA sequence
tcatgccactgcactccagc

SEQ ID NO: 438739 - DNA, 20 bp, Artificial
  CRISPR gRNA sequence
ctgcactccagcctgggtga

SEQ ID NO: 438740 - DNA, 20 bp, Artificial
  CRISPR gRNA sequence
actttcggaagctgaggtga

SEQ ID NO: 438741 - DNA, 20 bp, Artificial
  CRISPR gRNA sequence
tgagaggatcagttgagccc

SEQ ID NO: 438742 - DNA, 20 bp, Artificial
  CRISPR gRNA sequence
gatcagcctgggcagcaaag

SEQ ID NO: 438743 - DNA, 20 bp, Artificial
  CRISPR gRNA sequence
tactcaggaggctgaggtgg

SEQ ID NO: 438744 - DNA, 20 bp, Artificial
  CRISPR gRNA sequence
ttgcactccaccctgggcaa

SEQ ID NO: 438745 - DNA, 20 bp, Artificial
  CRISPR gRNA sequence
aaagaagtgtgttgaagttg

SEQ ID NO: 438746 - DNA, 20 bp, Artificial
  CRISPR gRNA sequence
gaagttgatgaattttgatg

SEQ ID NO: 438747 - DNA, 20 bp, Artificial
  CRISPR gRNA sequence
gtttttttggagatggacgc

SEQ ID NO: 438748 - DNA, 20 bp, Artificial
  CRISPR gRNA sequence
ctcactgtaacctctgcctc

SEQ ID NO: 438749 - DNA, 20 bp, Artificial
  CRISPR gRNA sequence
gtttctcctgactcagcttc

SEQ ID NO: 438750 - DNA, 20 bp, Artificial
  CRISPR gRNA sequence
ttttatatttttagtagaga

SEQ ID NO: 438751 - DNA, 20 bp, Artificial
  CRISPR gRNA sequence
acctcgacctcccaatgttt

SEQ ID NO: 438752 - DNA, 20 bp, Artificial
  CRISPR gRNA sequence
acaaacagggactgtgtgtg

SEQ ID NO: 438753 - DNA, 20 bp, Artificial
  CRISPR gRNA sequence
ctcagattagctcaagacta

SEQ ID NO: 438754 - DNA, 20 bp, Artificial
  CRISPR gRNA sequence
tggaacagtccaagaaaaac

SEQ ID NO: 438755 - DNA, 20 bp, Artificial
  CRISPR gRNA sequence
gtactaatatgtttctaatg

SEQ ID NO: 438756 - DNA, 20 bp, Artificial
  CRISPR gRNA sequence
acacagttaattgatagata

SEQ ID NO: 438757 - DNA, 20 bp, Artificial
  CRISPR gRNA sequence
gtttctgcgattatggttaa

SEQ ID NO: 438758 - DNA, 20 bp, Artificial
  CRISPR gRNA sequence
actaccccacccacacttac

SEQ ID NO: 438759 - DNA, 20 bp, Artificial
  CRISPR gRNA sequence
ggtttattcagagatagcca

SEQ ID NO: 438760 - DNA, 20 bp, Artificial
  CRISPR gRNA sequence
cagagatagccatggaattt

SEQ ID NO: 438761 - DNA, 20 bp, Artificial
  CRISPR gRNA sequence
ggaatttttgaattgatcac

SEQ ID NO: 438762 - DNA, 20 bp, Artificial
  CRISPR gRNA sequence
tatatttattattattggga

SEQ ID NO: 438763 - DNA, 20 bp, Artificial
  CRISPR gRNA sequence
ctcacttcaacctctgcctc

SEQ ID NO: 438764 - DNA, 20 bp, Artificial
  CRISPR gRNA sequence
ttttttttttttggtagaga

SEQ ID NO: 438765 - DNA, 20 bp, Artificial
  CRISPR gRNA sequence
acttcagcctcccaaagtgc

SEQ ID NO: 438766 - DNA, 20 bp, Artificial
  CRISPR gRNA sequence
gtgctgggattacaggcgtg

SEQ ID NO: 438767 - DNA, 20 bp, Artificial
  CRISPR gRNA sequence
tagcactttgggaggccgag

SEQ ID NO: 438768 - DNA, 20 bp, Artificial
  CRISPR gRNA sequence
actttgggaggccgaggtga

SEQ ID NO: 438769 - DNA, 20 bp, Artificial
  CRISPR gRNA sequence
tgagtggataacctgaggct

SEQ ID NO: 438770 - DNA, 20 bp, Artificial
  CRISPR gRNA sequence
tactcgggaagctgaggtgg

SEQ ID NO: 438771 - DNA, 20 bp, Artificial
  CRISPR gRNA sequence
tgcactccagcctgggcaac

SEQ ID NO: 438772 - DNA, 20 bp, Artificial
  CRISPR gRNA sequence
acctcagcctcccaaaatgt

SEQ ID NO: 438773 - DNA, 20 bp, Artificial
  CRISPR gRNA sequence
aaaatgttgggattataggc

SEQ ID NO: 438774 - DNA, 20 bp, Artificial
  CRISPR gRNA sequence
gtcattgcacttagcctcac

SEQ ID NO: 438775 - DNA, 20 bp, Artificial
  CRISPR gRNA sequence
gagtatttccaaaacagact

SEQ ID NO: 438776 - DNA, 20 bp, Artificial
  CRISPR gRNA sequence
cacttattctagtttgtata

SEQ ID NO: 438777 - DNA, 20 bp, Artificial
  CRISPR gRNA sequence
ctagtttgtataaagagtga

SEQ ID NO: 438778 - DNA, 20 bp, Artificial
  CRISPR gRNA sequence
cttctttttatccctttctt

SEQ ID NO: 438779 - DNA, 20 bp, Artificial
  CRISPR gRNA sequence
gtttatgctattttcattag

SEQ ID NO: 438780 - DNA, 20 bp, Artificial
  CRISPR gRNA sequence
ctcacagccatatttttcaa

SEQ ID NO: 438781 - DNA, 20 bp, Artificial
  CRISPR gRNA sequence
ctttttttttttttttgaga

SEQ ID NO: 438782 - DNA, 20 bp, Artificial
  CRISPR gRNA sequence
ttcactcttgttgcttaggc

SEQ ID NO: 438783 - DNA, 20 bp, Artificial
  CRISPR gRNA sequence
tcactgcaacctctgcctcc

SEQ ID NO: 438784 - DNA, 20 bp, Artificial
  CRISPR gRNA sequence
gattctcccccctcagcctc

SEQ ID NO: 438785 - DNA, 20 bp, Artificial
  CRISPR gRNA sequence
ccctcagcctcctgagtagc

SEQ ID NO: 438786 - DNA, 20 bp, Artificial
  CRISPR gRNA sequence
tttgtatttttagtagagac

SEQ ID NO: 438787 - DNA, 20 bp, Artificial
  CRISPR gRNA sequence
gccttggcctcccaaagtgc

SEQ ID NO: 438788 - DNA, 20 bp, Artificial
  CRISPR gRNA sequence
gatgttgagattccttaggg

SEQ ID NO: 438789 - DNA, 20 bp, Artificial
  CRISPR gRNA sequence
ctatcgtcccagctactcag

SEQ ID NO: 438790 - DNA, 20 bp, Artificial
  CRISPR gRNA sequence
caggaagatcacttgagccc

SEQ ID NO: 438791 - DNA, 20 bp, Artificial
  CRISPR gRNA sequence
tcttgctgctgcattctagc

SEQ ID NO: 438792 - DNA, 20 bp, Artificial
  CRISPR gRNA sequence
ctcatttctttattcctcct

SEQ ID NO: 438793 - DNA, 20 bp, Artificial
  CRISPR gRNA sequence
acttcgggaggccaagacag

SEQ ID NO: 438794 - DNA, 20 bp, Artificial
  CRISPR gRNA sequence
caggagagtcacttgaggcc

SEQ ID NO: 438795 - DNA, 20 bp, Artificial
  CRISPR gRNA sequence
atattgagattcacccaggc

SEQ ID NO: 438796 - DNA, 20 bp, Artificial
  CRISPR gRNA sequence
ctcactgcaacctctacctc

SEQ ID NO: 438797 - DNA, 20 bp, Artificial
  CRISPR gRNA sequence
tgccttgcctcccaaagtgc

SEQ ID NO: 438798 - DNA, 20 bp, Artificial
  CRISPR gRNA sequence
ctagctactcagaagctgag

SEQ ID NO: 438799 - DNA, 20 bp, Artificial
  CRISPR gRNA sequence
tgggtagatcccttgagccc

SEQ ID NO: 438800 - DNA, 20 bp, Artificial
  CRISPR gRNA sequence
aggtacccagtaagccacac

SEQ ID NO: 438801 - DNA, 20 bp, Artificial
  CRISPR gRNA sequence
agataacgtagttgttttca

SEQ ID NO: 438802 - DNA, 20 bp, Artificial
  CRISPR gRNA sequence
aaaagaaacccaaaacaaat

SEQ ID NO: 438803 - DNA, 20 bp, Artificial
  CRISPR gRNA sequence
ctaaggtttcctacaggtct

SEQ ID NO: 438804 - DNA, 20 bp, Artificial
  CRISPR gRNA sequence
tacaaggggctccctcatcc

SEQ ID NO: 438805 - DNA, 20 bp, Artificial
  CRISPR gRNA sequence
cgagcttaaagttcatctct

SEQ ID NO: 438806 - DNA, 20 bp, Artificial
  CRISPR gRNA sequence
ttgtttttttttttttgaga

SEQ ID NO: 438807 - DNA, 20 bp, Artificial
  CRISPR gRNA sequence
ttcgctctcgttgcccaggc

SEQ ID NO: 438808 - DNA, 20 bp, Artificial
  CRISPR gRNA sequence
ctcaccgcaacctccgtctc

SEQ ID NO: 438809 - DNA, 20 bp, Artificial
  CRISPR gRNA sequence
gattctcctgcctcagcctc

SEQ ID NO: 438810 - DNA, 20 bp, Artificial
  CRISPR gRNA sequence
gcctcagcctcccgagtagc

SEQ ID NO: 438811 - DNA, 20 bp, Artificial
  CRISPR gRNA sequence
ttttgtatttttagtagaga

SEQ ID NO: 438812 - DNA, 20 bp, Artificial
  CRISPR gRNA sequence
ccatgttggtcaggctggtc

SEQ ID NO: 438813 - DNA, 20 bp, Artificial
  CRISPR gRNA sequence
ggtcaggctggtcttgggtc

SEQ ID NO: 438814 - DNA, 20 bp, Artificial
  CRISPR gRNA sequence
aactatctaaggcacacgtt

SEQ ID NO: 438815 - DNA, 20 bp, Artificial
  CRISPR gRNA sequence
tttcttgtctcatttatttt

SEQ ID NO: 438816 - DNA, 20 bp, Artificial
  CRISPR gRNA sequence
ggcttttgtttcccccttac

SEQ ID NO: 438817 - DNA, 20 bp, Artificial
  CRISPR gRNA sequence
ctcatagcaaagagaagata

SEQ ID NO: 438818 - DNA, 20 bp, Artificial
  CRISPR gRNA sequence
gaagatacagaatttaaggt

SEQ ID NO: 438819 - DNA, 20 bp, Artificial
  CRISPR gRNA sequence
agaatttaaggtaagaataa

SEQ ID NO: 438820 - DNA, 20 bp, Artificial
  CRISPR gRNA sequence
ttaaggtaagaataatggaa

SEQ ID NO: 438821 - DNA, 20 bp, Artificial
  CRISPR gRNA sequence
gaatggggttgggaaaaggt

SEQ ID NO: 438822 - DNA, 20 bp, Artificial
  CRISPR gRNA sequence
ctgtcctggggctttgagat

SEQ ID NO: 438823 - DNA, 20 bp, Artificial
  CRISPR gRNA sequence
ttagttctaaagttaaggta

SEQ ID NO: 438824 - DNA, 20 bp, Artificial
  CRISPR gRNA sequence
tccactgaactgaaacatca

SEQ ID NO: 438825 - DNA, 20 bp, Artificial
  CRISPR gRNA sequence
gattgagctcctattatatc

SEQ ID NO: 438826 - DNA, 20 bp, Artificial
  CRISPR gRNA sequence
tttcaactttagtttcctat

SEQ ID NO: 438827 - DNA, 20 bp, Artificial
  CRISPR gRNA sequence
cagggccaaccccagagcaa

SEQ ID NO: 438828 - DNA, 20 bp, Artificial
  CRISPR gRNA sequence
caaccccagagcaactgaat

SEQ ID NO: 438829 - DNA, 20 bp, Artificial
  CRISPR gRNA sequence
gcaactgaatcagaatctct

SEQ ID NO: 438830 - DNA, 20 bp, Artificial
  CRISPR gRNA sequence
cttttagtgatgtttggcac

SEQ ID NO: 438831 - DNA, 20 bp, Artificial
  CRISPR gRNA sequence
agtgatgtttggcacatgaa

SEQ ID NO: 438832 - DNA, 20 bp, Artificial
  CRISPR gRNA sequence
atgaatggaatacaatatat

SEQ ID NO: 438833 - DNA, 20 bp, Artificial
  CRISPR gRNA sequence
actttgggaggctgaggtgg

SEQ ID NO: 438834 - DNA, 20 bp, Artificial
  CRISPR gRNA sequence
tgggaggatcacatgagccc

SEQ ID NO: 438835 - DNA, 20 bp, Artificial
  CRISPR gRNA sequence
aaaatggaaacattaggtgg

SEQ ID NO: 438836 - DNA, 20 bp, Artificial
  CRISPR gRNA sequence
ttgtgccactgcattcccac

SEQ ID NO: 438837 - DNA, 20 bp, Artificial
  CRISPR gRNA sequence
aaaacaaaaacctctgtcca

SEQ ID NO: 438838 - DNA, 20 bp, Artificial
  CRISPR gRNA sequence
ttttttttttttttttgaga

SEQ ID NO: 438839 - DNA, 20 bp, Artificial
  CRISPR gRNA sequence
tctggctctgtcacccaggc

SEQ ID NO: 438840 - DNA, 20 bp, Artificial
  CRISPR gRNA sequence
ctcactataacctctgcttc

SEQ ID NO: 438841 - DNA, 20 bp, Artificial
  CRISPR gRNA sequence
gcattagcctcccaagtagc

SEQ ID NO: 438842 - DNA, 20 bp, Artificial
  CRISPR gRNA sequence
ttttgtatgtttagtagaga

SEQ ID NO: 438843 - DNA, 20 bp, Artificial
  CRISPR gRNA sequence
ggctcagcctcccaaagtgc

SEQ ID NO: 438844 - DNA, 20 bp, Artificial
  CRISPR gRNA sequence
tttggccaacctccctccct

SEQ ID NO: 438845 - DNA, 20 bp, Artificial
  CRISPR gRNA sequence
ttggcaaatgcagtagcaga

SEQ ID NO: 438846 - DNA, 20 bp, Artificial
  CRISPR gRNA sequence
atatgaagtggaggagccca

SEQ ID NO: 438847 - DNA, 20 bp, Artificial
  CRISPR gRNA sequence
ggcagcaaccctcacaacct

SEQ ID NO: 438848 - DNA, 20 bp, Artificial
  CRISPR gRNA sequence
ttctgtccactgctatggag

SEQ ID NO: 438849 - DNA, 20 bp, Artificial
  CRISPR gRNA sequence
cagaagataatgactcacat

SEQ ID NO: 438850 - DNA, 20 bp, Artificial
  CRISPR gRNA sequence
tgcctctgtatttaagccaa

SEQ ID NO: 438851 - DNA, 20 bp, Artificial
  CRISPR gRNA sequence
caacccagagactgttaatc

SEQ ID NO: 438852 - DNA, 20 bp, Artificial
  CRISPR gRNA sequence
aacgggcttttatatacact

SEQ ID NO: 438853 - DNA, 20 bp, Artificial
  CRISPR gRNA sequence
tacactaggaattcttgacg

SEQ ID NO: 438854 - DNA, 20 bp, Artificial
  CRISPR gRNA sequence
ttcagataaactagggaaaa

SEQ ID NO: 438855 - DNA, 20 bp, Artificial
  CRISPR gRNA sequence
tttgttttttgtttttgaga

SEQ ID NO: 438856 - DNA, 20 bp, Artificial
  CRISPR gRNA sequence
tcttgctctgttgcccaggc

SEQ ID NO: 438857 - DNA, 20 bp, Artificial
  CRISPR gRNA sequence
ctcactgcaagctccgcctc

SEQ ID NO: 438858 - DNA, 20 bp, Artificial
  CRISPR gRNA sequence
gattctcctgcctcagcctc

SEQ ID NO: 438859 - DNA, 20 bp, Artificial
  CRISPR gRNA sequence
gcctcagcctcctgagtggc

SEQ ID NO: 438860 - DNA, 20 bp, Artificial
  CRISPR gRNA sequence
tgttgtatttttagtagaga

SEQ ID NO: 438861 - DNA, 20 bp, Artificial
  CRISPR gRNA sequence
gcctcggcctcccaaagcac

SEQ ID NO: 438862 - DNA, 20 bp, Artificial
  CRISPR gRNA sequence
cttgatcttgaagattccct

SEQ ID NO: 438863 - DNA, 20 bp, Artificial
  CRISPR gRNA sequence
agcaatctatattaccagcg

SEQ ID NO: 438864 - DNA, 20 bp, Artificial
  CRISPR gRNA sequence
cagcgctggatcctttgaca

SEQ ID NO: 438865 - DNA, 20 bp, Artificial
  CRISPR gRNA sequence
tgtttgtttgttttttgaga

SEQ ID NO: 438866 - DNA, 20 bp, Artificial
  CRISPR gRNA sequence
gagatagaatctcgctctgt

SEQ ID NO: 438867 - DNA, 20 bp, Artificial
  CRISPR gRNA sequence
gtctgagttcattgtagatt

SEQ ID NO: 438868 - DNA, 20 bp, Artificial
  CRISPR gRNA sequence
ggatattagccctttgtcag

SEQ ID NO: 438869 - DNA, 20 bp, Artificial
  CRISPR gRNA sequence
ctacaatgaactcagacaga

SEQ ID NO: 438870 - DNA, 20 bp, Artificial
  CRISPR gRNA sequence
agcctataccgtcttgaaat

SEQ ID NO: 438871 - DNA, 20 bp, Artificial
  CRISPR gRNA sequence
aaaggatccagcgctggtaa

SEQ ID NO: 438872 - DNA, 20 bp, Artificial
  CRISPR gRNA sequence
aacagaatttgtgtccccgt

SEQ ID NO: 438873 - DNA, 20 bp, Artificial
  CRISPR gRNA sequence
gcttcttcttctgtgaaaaa

SEQ ID NO: 438874 - DNA, 20 bp, Artificial
  CRISPR gRNA sequence
tcttctgtgaaaaatatagc

SEQ ID NO: 438875 - DNA, 20 bp, Artificial
  CRISPR gRNA sequence
atacacaccaatcaaatgca

SEQ ID NO: 438876 - DNA, 20 bp, Artificial
  CRISPR gRNA sequence
gtggctcacgcctgtaatcc

SEQ ID NO: 438877 - DNA, 20 bp, Artificial
  CRISPR gRNA sequence
ggcaggcaaatcatgaggtc

SEQ ID NO: 438878 - DNA, 20 bp, Artificial
  CRISPR gRNA sequence
tcaggaggctgaggcaggag

SEQ ID NO: 438879 - DNA, 20 bp, Artificial
  CRISPR gRNA sequence
aatcgcttgaacccaggagg

SEQ ID NO: 438880 - DNA, 20 bp, Artificial
  CRISPR gRNA sequence
gaggcggagcttgcagtgag

SEQ ID NO: 438881 - DNA, 20 bp, Artificial
  CRISPR gRNA sequence
gactttctgtgccaaaaaag

SEQ ID NO: 438882 - DNA, 20 bp, Artificial
  CRISPR gRNA sequence
gttatgctttcacctcagca

SEQ ID NO: 438883 - DNA, 20 bp, Artificial
  CRISPR gRNA sequence
cacctcagcacccagttttc

SEQ ID NO: 438884 - DNA, 20 bp, Artificial
  CRISPR gRNA sequence
ccagttttccctagtttatc

SEQ ID NO: 438885 - DNA, 20 bp, Artificial
  CRISPR gRNA sequence
aattcctagtgtatataaaa

SEQ ID NO: 438886 - DNA, 20 bp, Artificial
  CRISPR gRNA sequence
gcccgtttgagctctaacat

SEQ ID NO: 438887 - DNA, 20 bp, Artificial
  CRISPR gRNA sequence
tctctgggttgggtaactct

SEQ ID NO: 438888 - DNA, 20 bp, Artificial
  CRISPR gRNA sequence
aaatacagaggcaatgacat

SEQ ID NO: 438889 - DNA, 20 bp, Artificial
  CRISPR gRNA sequence
accagtcaggtgacacagct

SEQ ID NO: 438890 - DNA, 20 bp, Artificial
  CRISPR gRNA sequence
tacgttctcttcaatggtat

SEQ ID NO: 438891 - DNA, 20 bp, Artificial
  CRISPR gRNA sequence
cacggaatagagttaagaga

SEQ ID NO: 438892 - DNA, 20 bp, Artificial
  CRISPR gRNA sequence
tatttctcggaggtgcaggc

SEQ ID NO: 438893 - DNA, 20 bp, Artificial
  CRISPR gRNA sequence
tgtctgcaattatgtacaca

SEQ ID NO: 438894 - DNA, 20 bp, Artificial
  CRISPR gRNA sequence
cttgggaggctaatgcagag

SEQ ID NO: 438895 - DNA, 20 bp, Artificial
  CRISPR gRNA sequence
aaaaaaaaaaaaaaaattat

SEQ ID NO: 438896 - DNA, 20 bp, Artificial
  CRISPR gRNA sequence
ttagatagcattcaatggac

SEQ ID NO: 438897 - DNA, 20 bp, Artificial
  CRISPR gRNA sequence
agcattcaatggacagaggt

SEQ ID NO: 438898 - DNA, 20 bp, Artificial
  CRISPR gRNA sequence
tcaatggacagaggtttttg

SEQ ID NO: 438899 - DNA, 20 bp, Artificial
  CRISPR gRNA sequence
ggacagaggtttttgttttg

SEQ ID NO: 438900 - DNA, 20 bp, Artificial
  CRISPR gRNA sequence
gctccagcaatccttccacc

SEQ ID NO: 438901 - DNA, 20 bp, Artificial
  CRISPR gRNA sequence
cacctcagcctcccaaagtg

SEQ ID NO: 438902 - DNA, 20 bp, Artificial
  CRISPR gRNA sequence
ctgttcactagaatcacctg

SEQ ID NO: 438903 - DNA, 20 bp, Artificial
  CRISPR gRNA sequence
gagagcttttagaacaattt

SEQ ID NO: 438904 - DNA, 20 bp, Artificial
  CRISPR gRNA sequence
ttttagaacaatttctatgc

SEQ ID NO: 438905 - DNA, 20 bp, Artificial
  CRISPR gRNA sequence
ctatgcttaggcttcatccc

SEQ ID NO: 438906 - DNA, 20 bp, Artificial
  CRISPR gRNA sequence
ttaggcttcatccccagaga

SEQ ID NO: 438907 - DNA, 20 bp, Artificial
  CRISPR gRNA sequence
attagtacacttcagtgcct

SEQ ID NO: 438908 - DNA, 20 bp, Artificial
  CRISPR gRNA sequence
actaaagttgaaaatgcctg

SEQ ID NO: 438909 - DNA, 20 bp, Artificial
  CRISPR gRNA sequence
agaaatgctgagaacagata

SEQ ID NO: 438910 - DNA, 20 bp, Artificial
  CRISPR gRNA sequence
ataataggagctcaatccgt

SEQ ID NO: 438911 - DNA, 20 bp, Artificial
  CRISPR gRNA sequence
tcagatctcaaagccccagg

SEQ ID NO: 438912 - DNA, 20 bp, Artificial
  CRISPR gRNA sequence
acatgttagagtagggactt

SEQ ID NO: 438913 - DNA, 20 bp, Artificial
  CRISPR gRNA sequence
ataggttcactggaagcacg

SEQ ID NO: 438914 - DNA, 20 bp, Artificial
  CRISPR gRNA sequence
ttagggaaatctggtctcat

SEQ ID NO: 438915 - DNA, 20 bp, Artificial
  CRISPR gRNA sequence
gagacctctactatgtgtct

SEQ ID NO: 438916 - DNA, 20 bp, Artificial
  CRISPR gRNA sequence
gagacggaggttgcggtgag

SEQ ID NO: 438917 - DNA, 20 bp, Artificial
  CRISPR gRNA sequence
ccctcagagatgaactttaa

SEQ ID NO: 438918 - DNA, 20 bp, Artificial
  CRISPR gRNA sequence
tacctgaaactgaaaacgtg

SEQ ID NO: 438919 - DNA, 20 bp, Artificial
  CRISPR gRNA sequence
tttccagccataatcaggag

SEQ ID NO: 438920 - DNA, 20 bp, Artificial
  CRISPR gRNA sequence
ttctaagacctgtaggaaac

SEQ ID NO: 438921 - DNA, 20 bp, Artificial
  CRISPR gRNA sequence
agggcagagatgtgatcctt

SEQ ID NO: 438922 - DNA, 20 bp, Artificial
  CRISPR gRNA sequence
agatgtgatccttatttgtt

SEQ ID NO: 438923 - DNA, 20 bp, Artificial
  CRISPR gRNA sequence
ttgtgggtcaggaatccagg

SEQ ID NO: 438924 - DNA, 20 bp, Artificial
  CRISPR gRNA sequence
ttcaaggtgtcttctgggga

SEQ ID NO: 438925 - DNA, 20 bp, Artificial
  CRISPR gRNA sequence
gaatgcagtagtaagatcat

SEQ ID NO: 438926 - DNA, 20 bp, Artificial
  CRISPR gRNA sequence
ggctcaagggatctacccat

SEQ ID NO: 438927 - DNA, 20 bp, Artificial
  CRISPR gRNA sequence
cacagctggataattttttt

SEQ ID NO: 438928 - DNA, 20 bp, Artificial
  CRISPR gRNA sequence
gcactttgggaggcaaggca

SEQ ID NO: 438929 - DNA, 20 bp, Artificial
  CRISPR gRNA sequence
aggcaaggcaggtggatttc

SEQ ID NO: 438930 - DNA, 20 bp, Artificial
  CRISPR gRNA sequence
cttggaggctgaggcaggag

SEQ ID NO: 438931 - DNA, 20 bp, Artificial
  CRISPR gRNA sequence
tgtcttggcctcccgaagtg

SEQ ID NO: 438932 - DNA, 20 bp, Artificial
  CRISPR gRNA sequence
catgagccattgtgctcaga

SEQ ID NO: 438933 - DNA, 20 bp, Artificial
  CRISPR gRNA sequence
cattgtgctcagacattgat

SEQ ID NO: 438934 - DNA, 20 bp, Artificial
  CRISPR gRNA sequence
acattgatttgggttttaat

SEQ ID NO: 438935 - DNA, 20 bp, Artificial
  CRISPR gRNA sequence
agactgcaggaatcttctgt

SEQ ID NO: 438936 - DNA, 20 bp, Artificial
  CRISPR gRNA sequence
ctcctgggctcaagtgatct

SEQ ID NO: 438937 - DNA, 20 bp, Artificial
  CRISPR gRNA sequence
cgggcagatcatctgaggtc

SEQ ID NO: 438938 - DNA, 20 bp, Artificial
  CRISPR gRNA sequence
gaggcagaggttgcagtgag

SEQ ID NO: 438939 - DNA, 20 bp, Artificial
  CRISPR gRNA sequence
tagaaaactgaaggtcagtg

SEQ ID NO: 438940 - DNA, 20 bp, Artificial
  CRISPR gRNA sequence
ggtgagcttgaccatttccg

SEQ ID NO: 438941 - DNA, 20 bp, Artificial
  CRISPR gRNA sequence
tgaagtcttggcctaggcaa

SEQ ID NO: 438942 - DNA, 20 bp, Artificial
  CRISPR gRNA sequence
atcagttaggagaggggcaa

SEQ ID NO: 438943 - DNA, 20 bp, Artificial
  CRISPR gRNA sequence
agagagtacactagaaagat

SEQ ID NO: 438944 - DNA, 20 bp, Artificial
  CRISPR gRNA sequence
attgtggggcattattgagt

SEQ ID NO: 438945 - DNA, 20 bp, Artificial
  CRISPR gRNA sequence
tggggcattattgagtgtca

SEQ ID NO: 438946 - DNA, 20 bp, Artificial
  CRISPR gRNA sequence
catgacttaaaaagctgtca

SEQ ID NO: 438947 - DNA, 20 bp, Artificial
  CRISPR gRNA sequence
ttctccagcaacttccaggg

SEQ ID NO: 438948 - DNA, 20 bp, Artificial
  CRISPR gRNA sequence
ttatctgtacttctcagtag

SEQ ID NO: 438949 - DNA, 20 bp, Artificial
  CRISPR gRNA sequence
tatatgtgtgtgtacaaagc

SEQ ID NO: 438950 - DNA, 20 bp, Artificial
  CRISPR gRNA sequence
atatatataatagtaaagct

SEQ ID NO: 438951 - DNA, 20 bp, Artificial
  CRISPR gRNA sequence
gtgctccttaacaatcccta

SEQ ID NO: 438952 - DNA, 20 bp, Artificial
  CRISPR gRNA sequence
cattttgggaggctgaggtg

SEQ ID NO: 438953 - DNA, 20 bp, Artificial
  CRISPR gRNA sequence
tgggaggattatttaagccc

SEQ ID NO: 438954 - DNA, 20 bp, Artificial
  CRISPR gRNA sequence
tttaagcccaggagtttgag

SEQ ID NO: 438955 - DNA, 20 bp, Artificial
  CRISPR gRNA sequence
attttatttattttttgaga

SEQ ID NO: 438956 - DNA, 20 bp, Artificial
  CRISPR gRNA sequence
aacctccgcctcctgggctc

SEQ ID NO: 438957 - DNA, 20 bp, Artificial
  CRISPR gRNA sequence
ggctcaagtgattctcccac

SEQ ID NO: 438958 - DNA, 20 bp, Artificial
  CRISPR gRNA sequence
ttttgtatttttagtagaga

SEQ ID NO: 438959 - DNA, 20 bp, Artificial
  CRISPR gRNA sequence
cacctcggcctcccaaagtg

SEQ ID NO: 438960 - DNA, 20 bp, Artificial
  CRISPR gRNA sequence
taggaggatcacctgagctc

SEQ ID NO: 438961 - DNA, 20 bp, Artificial
  CRISPR gRNA sequence
ttgggaggctgaggcacaag

SEQ ID NO: 438962 - DNA, 20 bp, Artificial
  CRISPR gRNA sequence
acccaggtaagtgtgggtgg

SEQ ID NO: 438963 - DNA, 20 bp, Artificial
  CRISPR gRNA sequence
aagatgaggagcaggacagt

SEQ ID NO: 438964 - DNA, 20 bp, Artificial
  CRISPR gRNA sequence
agtgacctaaccttttagca

SEQ ID NO: 438965 - DNA, 20 bp, Artificial
  CRISPR gRNA sequence
ttaatgcacgtaaagcactt

SEQ ID NO: 438966 - DNA, 20 bp, Artificial
  CRISPR gRNA sequence
cagttagtggggggaccaac

SEQ ID NO: 438967 - DNA, 20 bp, Artificial
  CRISPR gRNA sequence
tcatgtttttcttggactgt

SEQ ID NO: 438968 - DNA, 20 bp, Artificial
  CRISPR gRNA sequence
tttagtcttgagctaatctg

SEQ ID NO: 438969 - DNA, 20 bp, Artificial
  CRISPR gRNA sequence
gctcactctacacacacagt

SEQ ID NO: 438970 - DNA, 20 bp, Artificial
  CRISPR gRNA sequence
tacgctctggggcataagga

SEQ ID NO: 438971 - DNA, 20 bp, Artificial
  CRISPR gRNA sequence
tccaaaaaaacaaaagtgtg

SEQ ID NO: 438972 - DNA, 20 bp, Artificial
  CRISPR gRNA sequence
gggtactggaagtatttaga

SEQ ID NO: 438973 - DNA, 20 bp, Artificial
  CRISPR gRNA sequence
atttagatcttgattgtgat

SEQ ID NO: 438974 - DNA, 20 bp, Artificial
  CRISPR gRNA sequence
attacgttgtagaggcagga

SEQ ID NO: 438975 - DNA, 20 bp, Artificial
  CRISPR gRNA sequence
ggctcaactgatcctctcac

SEQ ID NO: 438976 - DNA, 20 bp, Artificial
  CRISPR gRNA sequence
ttgtatttatttatttattt

SEQ ID NO: 438977 - DNA, 20 bp, Artificial
  CRISPR gRNA sequence
ctcactgtaacctccaccta

SEQ ID NO: 438978 - DNA, 20 bp, Artificial
  CRISPR gRNA sequence
aacctccacctaccaggttt

SEQ ID NO: 438979 - DNA, 20 bp, Artificial
  CRISPR gRNA sequence
tgcctcagcctcctgagtag

SEQ ID NO: 438980 - DNA, 20 bp, Artificial
  CRISPR gRNA sequence
cccctcagcctcccaaagtg

SEQ ID NO: 438981 - DNA, 20 bp, Artificial
  CRISPR gRNA sequence
ggcgtgagccactgcgccgg

SEQ ID NO: 438982 - DNA, 20 bp, Artificial
  CRISPR gRNA sequence
ccactgcgccgggcctgttt

SEQ ID NO: 438983 - DNA, 20 bp, Artificial
  CRISPR gRNA sequence
cgccgggcctgtttttttgt

SEQ ID NO: 438984 - DNA, 20 bp, Artificial
  CRISPR gRNA sequence
gggcctgtttttttgttttt

SEQ ID NO: 438985 - DNA, 20 bp, Artificial
  CRISPR gRNA sequence
ttttttgtttttgtttgttt

SEQ ID NO: 438986 - DNA, 20 bp, Artificial
  CRISPR gRNA sequence
acagaaaagtgcacagaagg

SEQ ID NO: 438987 - DNA, 20 bp, Artificial
  CRISPR gRNA sequence
gaaggaagtgttttttgttg

SEQ ID NO: 438988 - DNA, 20 bp, Artificial
  CRISPR gRNA sequence
catattcatgaattaaagaa

SEQ ID NO: 438989 - DNA, 20 bp, Artificial
  CRISPR gRNA sequence
agtttactggaatcagcctg

SEQ ID NO: 438990 - DNA, 20 bp, Artificial
  CRISPR gRNA sequence
actggaatcagcctgcctgg

SEQ ID NO: 438991 - DNA, 20 bp, Artificial
  CRISPR gRNA sequence
tgatgttgaaacctcgggaa

SEQ ID NO: 438992 - DNA, 20 bp, Artificial
  CRISPR gRNA sequence
cctcgggaaggcagcttact

SEQ ID NO: 438993 - DNA, 20 bp, Artificial
  CRISPR gRNA sequence
ataaaaattagccattattg

SEQ ID NO: 438994 - DNA, 20 bp, Artificial
  CRISPR gRNA sequence
acatgaatttgcatttctat

SEQ ID NO: 438995 - DNA, 20 bp, Artificial
  CRISPR gRNA sequence
tatttgctatggaaacacaa

SEQ ID NO: 438996 - DNA, 20 bp, Artificial
  CRISPR gRNA sequence
ttaagcagaaaacagctaga

SEQ ID NO: 438997 - DNA, 20 bp, Artificial
  CRISPR gRNA sequence
agctagaaatcgcttgtgta

SEQ ID NO: 438998 - DNA, 20 bp, Artificial
  CRISPR gRNA sequence
aatcgcttgtgtaatcagct

SEQ ID NO: 438999 - DNA, 20 bp, Artificial
  CRISPR gRNA sequence
ctttccctgcccctgcaaaa

SEQ ID NO: 439000 - DNA, 20 bp, Artificial
  CRISPR gRNA sequence
tcttgttggttcaagatccc

SEQ ID NO: 439001 - DNA, 20 bp, Artificial
  CRISPR gRNA sequence
agatcccctaagattcccca

SEQ ID NO: 439002 - DNA, 20 bp, Artificial
  CRISPR gRNA sequence
gattccccagagagttttag

SEQ ID NO: 439003 - DNA, 20 bp, Artificial
  CRISPR gRNA sequence
gtctatttttcacaaaaaga

SEQ ID NO: 439004 - DNA, 20 bp, Artificial
  CRISPR gRNA sequence
agactttacagccagacggt

SEQ ID NO: 439005 - DNA, 20 bp, Artificial
  CRISPR gRNA sequence
caggcggatcacctgacatc

SEQ ID NO: 439006 - DNA, 20 bp, Artificial
  CRISPR gRNA sequence
actaagtgagagaaaatata

SEQ ID NO: 439007 - DNA, 20 bp, Artificial
  CRISPR gRNA sequence
tattgctattgctctagtta

SEQ ID NO: 439008 - DNA, 20 bp, Artificial
  CRISPR gRNA sequence
tgagagccacacaaaataaa

SEQ ID NO: 439009 - DNA, 20 bp, Artificial
  CRISPR gRNA sequence
tctttttctctctttaaaaa

SEQ ID NO: 439010 - DNA, 20 bp, Artificial
  CRISPR gRNA sequence
ttgggaggctgaggcaggac

SEQ ID NO: 439011 - DNA, 20 bp, Artificial
  CRISPR gRNA sequence
ttattcaatatacatttaca

SEQ ID NO: 439012 - DNA, 20 bp, Artificial
  CRISPR gRNA sequence
acatacaggtccttaaaaag

SEQ ID NO: 439013 - DNA, 20 bp, Artificial
  CRISPR gRNA sequence
acaggtccttaaaaagcact

SEQ ID NO: 439014 - DNA, 20 bp, Artificial
  CRISPR gRNA sequence
cctcccaagtagctggaact

SEQ ID NO: 439015 - DNA, 20 bp, Artificial
  CRISPR gRNA sequence
caccttggcctcctaaagtg

SEQ ID NO: 439016 - DNA, 20 bp, Artificial
  CRISPR gRNA sequence
agaatttttaagtcattgct

SEQ ID NO: 439017 - DNA, 20 bp, Artificial
  CRISPR gRNA sequence
ttgctgcaagcttgccttct

SEQ ID NO: 439018 - DNA, 20 bp, Artificial
  CRISPR gRNA sequence
gctcactgcaacctccacct

SEQ ID NO: 439019 - DNA, 20 bp, Artificial
  CRISPR gRNA sequence
aacctccacctcctggattc

SEQ ID NO: 439020 - DNA, 20 bp, Artificial
  CRISPR gRNA sequence
ttttgtatttttagtagaga

SEQ ID NO: 439021 - DNA, 20 bp, Artificial
  CRISPR gRNA sequence
ctacttagcctcccaaagtg

SEQ ID NO: 439022 - DNA, 20 bp, Artificial
  CRISPR gRNA sequence
gacgtgagtcactgcgccca

SEQ ID NO: 439023 - DNA, 20 bp, Artificial
  CRISPR gRNA sequence
ggtagcagggacagtaaaat

SEQ ID NO: 439024 - DNA, 20 bp, Artificial
  CRISPR gRNA sequence
aaaattgaggtttattaagg

SEQ ID NO: 439025 - DNA, 20 bp, Artificial
  CRISPR gRNA sequence
tcggaaggctgaggcaggag

SEQ ID NO: 439026 - DNA, 20 bp, Artificial
  CRISPR gRNA sequence
aatttaaatactctttccca

SEQ ID NO: 439027 - DNA, 20 bp, Artificial
  CRISPR gRNA sequence
gaataagagggacaaaatgc

SEQ ID NO: 439028 - DNA, 20 bp, Artificial
  CRISPR gRNA sequence
aaatgctaatgtttcttctt

SEQ ID NO: 439029 - DNA, 20 bp, Artificial
  CRISPR gRNA sequence
aatctgaagctaagggaact

SEQ ID NO: 439030 - DNA, 20 bp, Artificial
  CRISPR gRNA sequence
ggcatgaaggaagtctaaag

SEQ ID NO: 439031 - DNA, 20 bp, Artificial
  CRISPR gRNA sequence
cacaaaaaaagttacttact

SEQ ID NO: 439032 - DNA, 20 bp, Artificial
  CRISPR gRNA sequence
atagccaatagtatagttaa

SEQ ID NO: 439033 - DNA, 20 bp, Artificial
  CRISPR gRNA sequence
ttaagaacgttttcttttat

SEQ ID NO: 439034 - DNA, 20 bp, Artificial
  CRISPR gRNA sequence
ttcatctagataatgaaccg

SEQ ID NO: 439035 - DNA, 20 bp, Artificial
  CRISPR gRNA sequence
caggaagtcctacattaaat

SEQ ID NO: 439036 - DNA, 20 bp, Artificial
  CRISPR gRNA sequence
agtcctacattaaatatgtg

SEQ ID NO: 439037 - DNA, 20 bp, Artificial
  CRISPR gRNA sequence
cacctcagcctcccaaaatg

SEQ ID NO: 439038 - DNA, 20 bp, Artificial
  CRISPR gRNA sequence
gggattacaggtgtgaacga

SEQ ID NO: 439039 - DNA, 20 bp, Artificial
  CRISPR gRNA sequence
gcctcaggcattatattcta

SEQ ID NO: 439040 - DNA, 20 bp, Artificial
  CRISPR gRNA sequence
caaaaattcatttccttctt

SEQ ID NO: 439041 - DNA, 20 bp, Artificial
  CRISPR gRNA sequence
aacctccatctcctgagttc

SEQ ID NO: 439042 - DNA, 20 bp, Artificial
  CRISPR gRNA sequence
ttttgtatttttagtagaga

SEQ ID NO: 439043 - DNA, 20 bp, Artificial
  CRISPR gRNA sequence
cgcctcggcctcccaaagtg

SEQ ID NO: 439044 - DNA, 20 bp, Artificial
  CRISPR gRNA sequence
cccagcctccattttcttaa

SEQ ID NO: 439045 - DNA, 20 bp, Artificial
  CRISPR gRNA sequence
tagaagcacttactttagaa

SEQ ID NO: 439046 - DNA, 20 bp, Artificial
  CRISPR gRNA sequence
accatctttccttcctgttc

SEQ ID NO: 439047 - DNA, 20 bp, Artificial
  CRISPR gRNA sequence
attctaaaaataagtacatt

SEQ ID NO: 439048 - DNA, 20 bp, Artificial
  CRISPR gRNA sequence
gccagcttttggaaaactaa

SEQ ID NO: 439049 - DNA, 20 bp, Artificial
  CRISPR gRNA sequence
tggaagccttaatgtgtata

SEQ ID NO: 439050 - DNA, 20 bp, Artificial
  CRISPR gRNA sequence
tataaagggtttgactaaat

SEQ ID NO: 439051 - DNA, 20 bp, Artificial
  CRISPR gRNA sequence
taaatgctggtttagcaaac

SEQ ID NO: 439052 - DNA, 20 bp, Artificial
  CRISPR gRNA sequence
gcctaaaattattgaagaaa

SEQ ID NO: 439053 - DNA, 20 bp, Artificial
  CRISPR gRNA sequence
tcaggaggctgaggcagtgg

SEQ ID NO: 439054 - DNA, 20 bp, Artificial
  CRISPR gRNA sequence
aacatgaatcttaagtgcac

SEQ ID NO: 439055 - DNA, 20 bp, Artificial
  CRISPR gRNA sequence
cataagattttaaatgtaaa

SEQ ID NO: 439056 - DNA, 20 bp, Artificial
  CRISPR gRNA sequence
atcaagcactgttgtgtcat

SEQ ID NO: 439057 - DNA, 20 bp, Artificial
  CRISPR gRNA sequence
gtcattacagctttttttca

SEQ ID NO: 439058 - DNA, 20 bp, Artificial
  CRISPR gRNA sequence
caatgttctttctggagaaa

SEQ ID NO: 439059 - DNA, 20 bp, Artificial
  CRISPR gRNA sequence
tacttattaggtgccagaca

SEQ ID NO: 439060 - DNA, 20 bp, Artificial
  CRISPR gRNA sequence
acagctattaattgggaaag

SEQ ID NO: 439061 - DNA, 20 bp, Artificial
  CRISPR gRNA sequence
aaagggtctcgctctgttgc

SEQ ID NO: 439062 - DNA, 20 bp, Artificial
  CRISPR gRNA sequence
ttttttgggatggaatctcg

SEQ ID NO: 439063 - DNA, 20 bp, Artificial
  CRISPR gRNA sequence
atggaatctcgctctgtttt

SEQ ID NO: 439064 - DNA, 20 bp, Artificial
  CRISPR gRNA sequence
tttgtatttttagtagagac

SEQ ID NO: 439065 - DNA, 20 bp, Artificial
  CRISPR gRNA sequence
ggtttcaccatcttggccag

SEQ ID NO: 439066 - DNA, 20 bp, Artificial
  CRISPR gRNA sequence
tgccttggcctcccaaagtg

SEQ ID NO: 439067 - DNA, 20 bp, Artificial
  CRISPR gRNA sequence
ttttgtattcttagtagaga

SEQ ID NO: 439068 - DNA, 20 bp, Artificial
  CRISPR gRNA sequence
tgccttggcctcccatagtg

SEQ ID NO: 439069 - DNA, 20 bp, Artificial
  CRISPR gRNA sequence
tcccacatcccacatttaga

SEQ ID NO: 439070 - DNA, 20 bp, Artificial
  CRISPR gRNA sequence
ggagctactgacctattttt

SEQ ID NO: 439071 - DNA, 20 bp, Artificial
  CRISPR gRNA sequence
ctaaagggaaggctgggcgt

SEQ ID NO: 439072 - DNA, 20 bp, Artificial
  CRISPR gRNA sequence
gtggcttacacctgtaatcc

SEQ ID NO: 439073 - DNA, 20 bp, Artificial
  CRISPR gRNA sequence
aatggcatgaacctgggagg

SEQ ID NO: 439074 - DNA, 20 bp, Artificial
  CRISPR gRNA sequence
acaaaaaagaaaaaaattag

SEQ ID NO: 439075 - DNA, 20 bp, Artificial
  CRISPR gRNA sequence
gaggcggaacttgcagtgag

SEQ ID NO: 439076 - DNA, 20 bp, Artificial
  CRISPR gRNA sequence
tcccttctagcactatggtt

SEQ ID NO: 439077 - DNA, 20 bp, Artificial
  CRISPR gRNA sequence
tattttctgtccccaccata

SEQ ID NO: 439078 - DNA, 20 bp, Artificial
  CRISPR gRNA sequence
tatagtaataataaacagtt

SEQ ID NO: 439079 - DNA, 20 bp, Artificial
  CRISPR gRNA sequence
tgagcattttacatacatta

SEQ ID NO: 439080 - DNA, 20 bp, Artificial
  CRISPR gRNA sequence
tcattgtagagatgagcaaa

SEQ ID NO: 439081 - DNA, 20 bp, Artificial
  CRISPR gRNA sequence
ttgtggtcagacattgggat

SEQ ID NO: 439082 - DNA, 20 bp, Artificial
  CRISPR gRNA sequence
tcttatttaaagcccataag

SEQ ID NO: 439083 - DNA, 20 bp, Artificial
  CRISPR gRNA sequence
aagcccataaggtgtgattt

SEQ ID NO: 439084 - DNA, 20 bp, Artificial
  CRISPR gRNA sequence
aaaaaaaaaatggagctcca

SEQ ID NO: 439085 - DNA, 20 bp, Artificial
  CRISPR gRNA sequence
catgatcaatgtgacttgac

SEQ ID NO: 439086 - DNA, 20 bp, Artificial
  CRISPR gRNA sequence
gctggaatccagggaaggtg

SEQ ID NO: 439087 - DNA, 20 bp, Artificial
  CRISPR gRNA sequence
ttaagtaaaattaaagacta

SEQ ID NO: 439088 - DNA, 20 bp, Artificial
  CRISPR gRNA sequence
tatccatgcctccactctca

SEQ ID NO: 439089 - DNA, 20 bp, Artificial
  CRISPR gRNA sequence
cctctgaattcagagccagc

SEQ ID NO: 439090 - DNA, 20 bp, Artificial
  CRISPR gRNA sequence
atgaaaattatctgagagca

SEQ ID NO: 439091 - DNA, 20 bp, Artificial
  CRISPR gRNA sequence
ttaagaaagagaaatacacc

SEQ ID NO: 439092 - DNA, 20 bp, Artificial
  CRISPR gRNA sequence
gagagtgtatcacacacttc

SEQ ID NO: 439093 - DNA, 20 bp, Artificial
  CRISPR gRNA sequence
atgcagtcatcattgttaca

SEQ ID NO: 439094 - DNA, 20 bp, Artificial
  CRISPR gRNA sequence
ggttgaagactccttatctg

SEQ ID NO: 439095 - DNA, 20 bp, Artificial
  CRISPR gRNA sequence
tctgaaatgcttgagatcag

SEQ ID NO: 439096 - DNA, 20 bp, Artificial
  CRISPR gRNA sequence
atgcttgagatcagaaatgt

SEQ ID NO: 439097 - DNA, 20 bp, Artificial
  CRISPR gRNA sequence
ttttttttttttttttgaaa

SEQ ID NO: 439098 - DNA, 20 bp, Artificial
  CRISPR gRNA sequence
ttttgtatttttagtagaga

SEQ ID NO: 439099 - DNA, 20 bp, Artificial
  CRISPR gRNA sequence
cacctcagcctcccaaagtg

SEQ ID NO: 439100 - DNA, 20 bp, Artificial
  CRISPR gRNA sequence
gcatgagccaccacgcccag

SEQ ID NO: 439101 - DNA, 20 bp, Artificial
  CRISPR gRNA sequence
ctgcctatacttatgttcca

SEQ ID NO: 439102 - DNA, 20 bp, Artificial
  CRISPR gRNA sequence
gaatgtcatgtcagtgtcca

SEQ ID NO: 439103 - DNA, 20 bp, Artificial
  CRISPR gRNA sequence
catgtcagtgtccaaaaagt

SEQ ID NO: 439104 - DNA, 20 bp, Artificial
  CRISPR gRNA sequence
agttttggattttagagcat

SEQ ID NO: 439105 - DNA, 20 bp, Artificial
  CRISPR gRNA sequence
atttcagattttggtgcatt

SEQ ID NO: 439106 - DNA, 20 bp, Artificial
  CRISPR gRNA sequence
gattttggtgcattttaggt

SEQ ID NO: 439107 - DNA, 20 bp, Artificial
  CRISPR gRNA sequence
tgcattttaggttttagatt

SEQ ID NO: 439108 - DNA, 20 bp, Artificial
  CRISPR gRNA sequence
atttgggatgcccaacctat

SEQ ID NO: 439109 - DNA, 20 bp, Artificial
  CRISPR gRNA sequence
ttttatagaagaggagctca

SEQ ID NO: 439110 - DNA, 20 bp, Artificial
  CRISPR gRNA sequence
acagcgtttcaataacttgc

SEQ ID NO: 439111 - DNA, 20 bp, Artificial
  CRISPR gRNA sequence
aggtagactctgtaaaaagc

SEQ ID NO: 439112 - DNA, 20 bp, Artificial
  CRISPR gRNA sequence
ttagcatctacctccagaga

SEQ ID NO: 439113 - DNA, 20 bp, Artificial
  CRISPR gRNA sequence
cctccagagatgctgatttc

SEQ ID NO: 439114 - DNA, 20 bp, Artificial
  CRISPR gRNA sequence
atttctctggtttttggtag

SEQ ID NO: 439115 - DNA, 20 bp, Artificial
  CRISPR gRNA sequence
tttggtagtggggttttttc

SEQ ID NO: 439116 - DNA, 20 bp, Artificial
  CRISPR gRNA sequence
ctcctgacctcaagtgatcc

SEQ ID NO: 439117 - DNA, 20 bp, Artificial
  CRISPR gRNA sequence
tgcttcagcctctcaaagta

SEQ ID NO: 439118 - DNA, 20 bp, Artificial
  CRISPR gRNA sequence
ccactgtacctggcatctat

SEQ ID NO: 439119 - DNA, 20 bp, Artificial
  CRISPR gRNA sequence
tagttgtttaaaaactctct

SEQ ID NO: 439120 - DNA, 20 bp, Artificial
  CRISPR gRNA sequence
cccatctatacattccaccc

SEQ ID NO: 439121 - DNA, 20 bp, Artificial
  CRISPR gRNA sequence
tatacattccacccatgagt

SEQ ID NO: 439122 - DNA, 20 bp, Artificial
  CRISPR gRNA sequence
ttctttttttttttttgaga

SEQ ID NO: 439123 - DNA, 20 bp, Artificial
  CRISPR gRNA sequence
ctggagtacaatggcgagat

SEQ ID NO: 439124 - DNA, 20 bp, Artificial
  CRISPR gRNA sequence
aacctccgactcccaggttc

SEQ ID NO: 439125 - DNA, 20 bp, Artificial
  CRISPR gRNA sequence
ctcccaggttcaagtgattc

SEQ ID NO: 439126 - DNA, 20 bp, Artificial
  CRISPR gRNA sequence
ttttgtatttttagtggaga

SEQ ID NO: 439127 - DNA, 20 bp, Artificial
  CRISPR gRNA sequence
ggcctcagcctcccaaagtg

SEQ ID NO: 439128 - DNA, 20 bp, Artificial
  CRISPR gRNA sequence
caccacgcccaggcacaccc

SEQ ID NO: 439129 - DNA, 20 bp, Artificial
  CRISPR gRNA sequence
ggcatgcaaatgtccactca

SEQ ID NO: 439130 - DNA, 20 bp, Artificial
  CRISPR gRNA sequence
tttttcatcattcattatgc

SEQ ID NO: 439131 - DNA, 20 bp, Artificial
  CRISPR gRNA sequence
agaggaagctactgctgcag

SEQ ID NO: 439132 - DNA, 20 bp, Artificial
  CRISPR gRNA sequence
ctgctgcagtcctgtttgga

SEQ ID NO: 439133 - DNA, 20 bp, Artificial
  CRISPR gRNA sequence
tggaggatgattcgctgtga

SEQ ID NO: 439134 - DNA, 20 bp, Artificial
  CRISPR gRNA sequence
actgggaagccttgcgaaaa

SEQ ID NO: 439135 - DNA, 20 bp, Artificial
  CRISPR gRNA sequence
acggcccgcccatctgggct

SEQ ID NO: 439136 - DNA, 20 bp, Artificial
  CRISPR gRNA sequence
gtatttgaaactactcatgg

SEQ ID NO: 439137 - DNA, 20 bp, Artificial
  CRISPR gRNA sequence
aactactcatggagttgttt

SEQ ID NO: 439138 - DNA, 20 bp, Artificial
  CRISPR gRNA sequence
cacagaaacctgcctcctct

SEQ ID NO: 439139 - DNA, 20 bp, Artificial
  CRISPR gRNA sequence
attcctggtcagctgtgcaa

SEQ ID NO: 439140 - DNA, 20 bp, Artificial
  CRISPR gRNA sequence
tggccagacacaaatgcgtt

SEQ ID NO: 439141 - DNA, 20 bp, Artificial
  CRISPR gRNA sequence
cagacacaaatgcgttatct

SEQ ID NO: 439142 - DNA, 20 bp, Artificial
  CRISPR gRNA sequence
ctgtgttatctaatgtaaaa

SEQ ID NO: 439143 - DNA, 20 bp, Artificial
  CRISPR gRNA sequence
cccttttttatgtgaaaact

SEQ ID NO: 439144 - DNA, 20 bp, Artificial
  CRISPR gRNA sequence
tttggcaaacaaatctccta

SEQ ID NO: 439145 - DNA, 20 bp, Artificial
  CRISPR gRNA sequence
aacattcattatatattttc

SEQ ID NO: 439146 - DNA, 20 bp, Artificial
  CRISPR gRNA sequence
cttttgattttttatgtccc

SEQ ID NO: 439147 - DNA, 20 bp, Artificial
  CRISPR gRNA sequence
cactttgggaggctgagatg

SEQ ID NO: 439148 - DNA, 20 bp, Artificial
  CRISPR gRNA sequence
tgggcagattacttgaggcc

SEQ ID NO: 439149 - DNA, 20 bp, Artificial
  CRISPR gRNA sequence
aatcacttgaacctgggagg

SEQ ID NO: 439150 - DNA, 20 bp, Artificial
  CRISPR gRNA sequence
cattccctggttccttttcc

SEQ ID NO: 439151 - DNA, 20 bp, Artificial
  CRISPR gRNA sequence
ttttgagacattctatacca

SEQ ID NO: 439152 - DNA, 20 bp, Artificial
  CRISPR gRNA sequence
ccagtatgttttgtcagact

SEQ ID NO: 439153 - DNA, 20 bp, Artificial
  CRISPR gRNA sequence
tgtcagactcactgtttgta

SEQ ID NO: 439154 - DNA, 20 bp, Artificial
  CRISPR gRNA sequence
ccctcatcgacggacattta

SEQ ID NO: 439155 - DNA, 20 bp, Artificial
  CRISPR gRNA sequence
gacggacatttaggttgctt

SEQ ID NO: 439156 - DNA, 20 bp, Artificial
  CRISPR gRNA sequence
aaagggaagatgtgaaaaca

SEQ ID NO: 439157 - DNA, 20 bp, Artificial
  CRISPR gRNA sequence
cagaggacacctctgttagg

SEQ ID NO: 439158 - DNA, 20 bp, Artificial
  CRISPR gRNA sequence
ctagctcagcacacccgggt

SEQ ID NO: 439159 - DNA, 20 bp, Artificial
  CRISPR gRNA sequence
acacccgggtgtctgattgc

SEQ ID NO: 439160 - DNA, 20 bp, Artificial
  CRISPR gRNA sequence
ctttatgtgccatgactgag

SEQ ID NO: 439161 - DNA, 20 bp, Artificial
  CRISPR gRNA sequence
agcgttttcttccactgaag

SEQ ID NO: 439162 - DNA, 20 bp, Artificial
  CRISPR gRNA sequence
agtgtggcatgacagagaac

SEQ ID NO: 439163 - DNA, 20 bp, Artificial
  CRISPR gRNA sequence
agtgggggcggctactgctc

SEQ ID NO: 439164 - DNA, 20 bp, Artificial
  CRISPR gRNA sequence
tgacttttcttctgcaagct

SEQ ID NO: 439165 - DNA, 20 bp, Artificial
  CRISPR gRNA sequence
tacaaggatggccattgtaa

SEQ ID NO: 439166 - DNA, 20 bp, Artificial
  CRISPR gRNA sequence
gtaatgttgtttgtaatagc

SEQ ID NO: 439167 - DNA, 20 bp, Artificial
  CRISPR gRNA sequence
gttgcagaataatgcatata

SEQ ID NO: 439168 - DNA, 20 bp, Artificial
  CRISPR gRNA sequence
aatctccgcctcccaggttc

SEQ ID NO: 439169 - DNA, 20 bp, Artificial
  CRISPR gRNA sequence
cgtgcaccaccacacccagc

SEQ ID NO: 439170 - DNA, 20 bp, Artificial
  CRISPR gRNA sequence
tttttaatttttagtagaga

SEQ ID NO: 439171 - DNA, 20 bp, Artificial
  CRISPR gRNA sequence
catctcagcctcccaaagtg

SEQ ID NO: 439172 - DNA, 20 bp, Artificial
  CRISPR gRNA sequence
actttttcatacacctttga

SEQ ID NO: 439173 - DNA, 20 bp, Artificial
  CRISPR gRNA sequence
atacacctttgatagtgttt

SEQ ID NO: 439174 - DNA, 20 bp, Artificial
  CRISPR gRNA sequence
atcaaaagaaaatatataat

SEQ ID NO: 439175 - DNA, 20 bp, Artificial
  CRISPR gRNA sequence
tttatcatatataaaatata

SEQ ID NO: 439176 - DNA, 20 bp, Artificial
  CRISPR gRNA sequence
agacaagtctcaatcatttt

SEQ ID NO: 439177 - DNA, 20 bp, Artificial
  CRISPR gRNA sequence
agtctcaatcattttaggag

SEQ ID NO: 439178 - DNA, 20 bp, Artificial
  CRISPR gRNA sequence
aggtctatgactttctcaga

SEQ ID NO: 439179 - DNA, 20 bp, Artificial
  CRISPR gRNA sequence
cagaagatgattttgagggc

SEQ ID NO: 439180 - DNA, 20 bp, Artificial
  CRISPR gRNA sequence
aggtgggatattgagaagca

SEQ ID NO: 439181 - DNA, 20 bp, Artificial
  CRISPR gRNA sequence
tcaggaatcaaaaagaggag

SEQ ID NO: 439182 - DNA, 20 bp, Artificial
  CRISPR gRNA sequence
caggtttctgtgacccagtt

SEQ ID NO: 439183 - DNA, 20 bp, Artificial
  CRISPR gRNA sequence
tgacttttccctttgactga

SEQ ID NO: 439184 - DNA, 20 bp, Artificial
  CRISPR gRNA sequence
aaccttaaaacaactccatg

SEQ ID NO: 439185 - DNA, 20 bp, Artificial
  CRISPR gRNA sequence
cacaagatccttatttaacc

SEQ ID NO: 439186 - DNA, 20 bp, Artificial
  CRISPR gRNA sequence
gtttgtatttactgtgcact

SEQ ID NO: 439187 - DNA, 20 bp, Artificial
  CRISPR gRNA sequence
gcaagtagcccagatgggcg

SEQ ID NO: 439188 - DNA, 20 bp, Artificial
  CRISPR gRNA sequence
ctggctgaccatgactaatt

SEQ ID NO: 439189 - DNA, 20 bp, Artificial
  CRISPR gRNA sequence
ccatgactaattttctgatt

SEQ ID NO: 439190 - DNA, 20 bp, Artificial
  CRISPR gRNA sequence
gccacaattctctcctaggg

SEQ ID NO: 439191 - DNA, 20 bp, Artificial
  CRISPR gRNA sequence
tagcagttgagcccagcaat

SEQ ID NO: 439192 - DNA, 20 bp, Artificial
  CRISPR gRNA sequence
cccagcaatctgtgttttcg

SEQ ID NO: 439193 - DNA, 20 bp, Artificial
  CRISPR gRNA sequence
tgtgttttcgcaaggcttcc

SEQ ID NO: 439194 - DNA, 20 bp, Artificial
  CRISPR gRNA sequence
cctccaaacaggactgcagc

SEQ ID NO: 439195 - DNA, 20 bp, Artificial
  CRISPR gRNA sequence
ttcctctttattctgtaaga

SEQ ID NO: 439196 - DNA, 20 bp, Artificial
  CRISPR gRNA sequence
ttattctgtaagacatggct

SEQ ID NO: 439197 - DNA, 20 bp, Artificial
  CRISPR gRNA sequence
tgaaatggagtaacctcact

SEQ ID NO: 439198 - DNA, 20 bp, Artificial
  CRISPR gRNA sequence
tcggtcagaatgcctatctg

SEQ ID NO: 439199 - DNA, 20 bp, Artificial
  CRISPR gRNA sequence
ctggggcaaaggagcctgtc

SEQ ID NO: 439200 - DNA, 20 bp, Artificial
  CRISPR gRNA sequence
acatccagatactggctaaa

SEQ ID NO: 439201 - DNA, 20 bp, Artificial
  CRISPR gRNA sequence
tttgcatgccatctttatga

SEQ ID NO: 439202 - DNA, 20 bp, Artificial
  CRISPR gRNA sequence
tctgtggatcatattaaagg

SEQ ID NO: 439203 - DNA, 20 bp, Artificial
  CRISPR gRNA sequence
ggaggagggccactaagacc

SEQ ID NO: 439204 - DNA, 20 bp, Artificial
  CRISPR gRNA sequence
agtgatatttaacaccttct

SEQ ID NO: 439205 - DNA, 20 bp, Artificial
  CRISPR gRNA sequence
actctcattagaatcacata

SEQ ID NO: 439206 - DNA, 20 bp, Artificial
  CRISPR gRNA sequence
caggaggatcacttgaggtc

SEQ ID NO: 439207 - DNA, 20 bp, Artificial
  CRISPR gRNA sequence
tctggaggtagatgctaagc

SEQ ID NO: 439208 - DNA, 20 bp, Artificial
  CRISPR gRNA sequence
ctttttacagagtctacctc

SEQ ID NO: 439209 - DNA, 20 bp, Artificial
  CRISPR gRNA sequence
atgctgggaggtgaacagac

SEQ ID NO: 439210 - DNA, 20 bp, Artificial
  CRISPR gRNA sequence
tactttgtgcccagatagag

SEQ ID NO: 439211 - DNA, 20 bp, Artificial
  CRISPR gRNA sequence
accgatcatgtgggccatta

SEQ ID NO: 439212 - DNA, 20 bp, Artificial
  CRISPR gRNA sequence
tcaggagtctgaggcaggag

SEQ ID NO: 439213 - DNA, 20 bp, Artificial
  CRISPR gRNA sequence
gaggcggaggttgcagtgag

SEQ ID NO: 439214 - DNA, 20 bp, Artificial
  CRISPR gRNA sequence
cctgggcaacaagagcaaaa

SEQ ID NO: 439215 - DNA, 20 bp, Artificial
  CRISPR gRNA sequence
ctctcaacgtaggtatccag

SEQ ID NO: 439216 - DNA, 20 bp, Artificial
  CRISPR gRNA sequence
gcatttttttcttgctgccc

SEQ ID NO: 439217 - DNA, 20 bp, Artificial
  CRISPR gRNA sequence
tgcccctttgattccctgaa

SEQ ID NO: 439218 - DNA, 20 bp, Artificial
  CRISPR gRNA sequence
tcagataattttcatcctta

SEQ ID NO: 439219 - DNA, 20 bp, Artificial
  CRISPR gRNA sequence
cttcactgcagcctttccaa

SEQ ID NO: 439220 - DNA, 20 bp, Artificial
  CRISPR gRNA sequence
ctttagctggctctgaattc

SEQ ID NO: 439221 - DNA, 20 bp, Artificial
  CRISPR gRNA sequence
atatctccgtgcacctgaaa

SEQ ID NO: 439222 - DNA, 20 bp, Artificial
  CRISPR gRNA sequence
ctgtgctgggaaaaagatgg

SEQ ID NO: 439223 - DNA, 20 bp, Artificial
  CRISPR gRNA sequence
tgggaaaaagatggtctggc

SEQ ID NO: 439224 - DNA, 20 bp, Artificial
  CRISPR gRNA sequence
tctgactgaccctggactgg

SEQ ID NO: 439225 - DNA, 20 bp, Artificial
  CRISPR gRNA sequence
ggtcatgaactggtgtcagt

SEQ ID NO: 439226 - DNA, 20 bp, Artificial
  CRISPR gRNA sequence
ctgtgtttgggaactgacac

SEQ ID NO: 439227 - DNA, 20 bp, Artificial
  CRISPR gRNA sequence
gggaactgacacattggatt

SEQ ID NO: 439228 - DNA, 20 bp, Artificial
  CRISPR gRNA sequence
gaataaagcccatcaccttc

SEQ ID NO: 439229 - DNA, 20 bp, Artificial
  CRISPR gRNA sequence
aatctcataaatcacacctt

SEQ ID NO: 439230 - DNA, 20 bp, Artificial
  CRISPR gRNA sequence
tttaaataagaaaatgtcta

SEQ ID NO: 439231 - DNA, 20 bp, Artificial
  CRISPR gRNA sequence
ttataagatcaggaggcaca

SEQ ID NO: 439232 - DNA, 20 bp, Artificial
  CRISPR gRNA sequence
gttgctcaaattctctgaag

SEQ ID NO: 439233 - DNA, 20 bp, Artificial
  CRISPR gRNA sequence
ctggcccataaaaagcactc

SEQ ID NO: 439234 - DNA, 20 bp, Artificial
  CRISPR gRNA sequence
tgtttattattactatagtt

SEQ ID NO: 439235 - DNA, 20 bp, Artificial
  CRISPR gRNA sequence
agttactggttttagctctc

SEQ ID NO: 439236 - DNA, 20 bp, Artificial
  CRISPR gRNA sequence
ttcagtctttggttagtctt

SEQ ID NO: 439237 - DNA, 20 bp, Artificial
  CRISPR gRNA sequence
tttagtctcactttcccatc

SEQ ID NO: 439238 - DNA, 20 bp, Artificial
  CRISPR gRNA sequence
ttttgtatttttagtagaga

SEQ ID NO: 439239 - DNA, 20 bp, Artificial
  CRISPR gRNA sequence
cgcctcggcctcccaaagtg

SEQ ID NO: 439240 - DNA, 20 bp, Artificial
  CRISPR gRNA sequence
cagacagaagtcttctttcc

SEQ ID NO: 439241 - DNA, 20 bp, Artificial
  CRISPR gRNA sequence
tgcctcagcctcccaagtag

SEQ ID NO: 439242 - DNA, 20 bp, Artificial
  CRISPR gRNA sequence
ttttgtatttttattagaga

SEQ ID NO: 439243 - DNA, 20 bp, Artificial
  CRISPR gRNA sequence
tgcctcggcctcccaaagcg

SEQ ID NO: 439244 - DNA, 20 bp, Artificial
  CRISPR gRNA sequence
ccaccacgcccagccttccc

SEQ ID NO: 439245 - DNA, 20 bp, Artificial
  CRISPR gRNA sequence
cgcccagccttccctttagt

SEQ ID NO: 439246 - DNA, 20 bp, Artificial
  CRISPR gRNA sequence
aggaataatacctcgaacct

SEQ ID NO: 439247 - DNA, 20 bp, Artificial
  CRISPR gRNA sequence
attgaaatgaatgaatattt

SEQ ID NO: 439248 - DNA, 20 bp, Artificial
  CRISPR gRNA sequence
cagatggatcacctgaggtc

SEQ ID NO: 439249 - DNA, 20 bp, Artificial
  CRISPR gRNA sequence
cctgaagcctggaaaacaga

SEQ ID NO: 439250 - DNA, 20 bp, Artificial
  CRISPR gRNA sequence
tacttggcagggctgaggca

SEQ ID NO: 439251 - DNA, 20 bp, Artificial
  CRISPR gRNA sequence
tggcagggctgaggcaggaa

SEQ ID NO: 439252 - DNA, 20 bp, Artificial
  CRISPR gRNA sequence
attgcttgaactcaggaggt

SEQ ID NO: 439253 - DNA, 20 bp, Artificial
  CRISPR gRNA sequence
agtcctcagctctagagtag

SEQ ID NO: 439254 - DNA, 20 bp, Artificial
  CRISPR gRNA sequence
agagtagatctgctttaaat

SEQ ID NO: 439255 - DNA, 20 bp, Artificial
  CRISPR gRNA sequence
tagtacctacttattgtggt

SEQ ID NO: 439256 - DNA, 20 bp, Artificial
  CRISPR gRNA sequence
ttattgtggttgaggattaa

SEQ ID NO: 439257 - DNA, 20 bp, Artificial
  CRISPR gRNA sequence
acctgccccaccaggcaaat

SEQ ID NO: 439258 - DNA, 20 bp, Artificial
  CRISPR gRNA sequence
aaaaagctgtaatgacacaa

SEQ ID NO: 439259 - DNA, 20 bp, Artificial
  CRISPR gRNA sequence
agctgtaatgacacaacagt

SEQ ID NO: 439260 - DNA, 20 bp, Artificial
  CRISPR gRNA sequence
tgatcattttcatagcaaaa

SEQ ID NO: 439261 - DNA, 20 bp, Artificial
  CRISPR gRNA sequence
caaaatgaagtttttaaaaa

SEQ ID NO: 439262 - DNA, 20 bp, Artificial
  CRISPR gRNA sequence
ataattataaggagtctgaa

SEQ ID NO: 439263 - DNA, 20 bp, Artificial
  CRISPR gRNA sequence
atttaaaatcttatgtgcac

SEQ ID NO: 439264 - DNA, 20 bp, Artificial
  CRISPR gRNA sequence
atcttatgtgcacttaagat

SEQ ID NO: 439265 - DNA, 20 bp, Artificial
  CRISPR gRNA sequence
aacctccacctcctgggttc

SEQ ID NO: 439266 - DNA, 20 bp, Artificial
  CRISPR gRNA sequence
tttttgtattttagtagaga

SEQ ID NO: 439267 - DNA, 20 bp, Artificial
  CRISPR gRNA sequence
gccctcggcctcccaaagtg

SEQ ID NO: 439268 - DNA, 20 bp, Artificial
  CRISPR gRNA sequence
gtgagccactgcaccaggcc

SEQ ID NO: 439269 - DNA, 20 bp, Artificial
  CRISPR gRNA sequence
tgcctttataatatttaaac

SEQ ID NO: 439270 - DNA, 20 bp, Artificial
  CRISPR gRNA sequence
gtcaaaccctttatacacat

SEQ ID NO: 439271 - DNA, 20 bp, Artificial
  CRISPR gRNA sequence
gaaggtgacagtgacattta

SEQ ID NO: 439272 - DNA, 20 bp, Artificial
  CRISPR gRNA sequence
tcagccataaaaatgagtaa

SEQ ID NO: 439273 - DNA, 20 bp, Artificial
  CRISPR gRNA sequence
cataaaaatgagtaagcatg

SEQ ID NO: 439274 - DNA, 20 bp, Artificial
  CRISPR gRNA sequence
gaggtcagggcctgtgcccc

SEQ ID NO: 439275 - DNA, 20 bp, Artificial
  CRISPR gRNA sequence
gtcacttcacttccctaatt

SEQ ID NO: 439276 - DNA, 20 bp, Artificial
  CRISPR gRNA sequence
tagaagcgtagttctaaagt

SEQ ID NO: 439277 - DNA, 20 bp, Artificial
  CRISPR gRNA sequence
tgcttctaagtatctctaaa

SEQ ID NO: 439278 - DNA, 20 bp, Artificial
  CRISPR gRNA sequence
aaaatgagcttcttcactga

SEQ ID NO: 439279 - DNA, 20 bp, Artificial
  CRISPR gRNA sequence
ctcctattacattgtgacca

SEQ ID NO: 439280 - DNA, 20 bp, Artificial
  CRISPR gRNA sequence
cagggaggctgaggcaggag

SEQ ID NO: 439281 - DNA, 20 bp, Artificial
  CRISPR gRNA sequence
actccagcctgggtgataga

SEQ ID NO: 439282 - DNA, 20 bp, Artificial
  CRISPR gRNA sequence
aacatggaggttgcagtgag

SEQ ID NO: 439283 - DNA, 20 bp, Artificial
  CRISPR gRNA sequence
ttgggaggatgagggatgag

SEQ ID NO: 439284 - DNA, 20 bp, Artificial
  CRISPR gRNA sequence
gaggccgaggttgcggtgag

SEQ ID NO: 439285 - DNA, 20 bp, Artificial
  CRISPR gRNA sequence
tgagtcttatcaatattgct

SEQ ID NO: 439286 - DNA, 20 bp, Artificial
  CRISPR gRNA sequence
aaaaaatgtggccatcctaa

SEQ ID NO: 439287 - DNA, 20 bp, Artificial
  CRISPR gRNA sequence
cggagtagaattcatttcaa

SEQ ID NO: 439288 - DNA, 20 bp, Artificial
  CRISPR gRNA sequence
aaataggattataggcatca

SEQ ID NO: 439289 - DNA, 20 bp, Artificial
  CRISPR gRNA sequence
actcaacttggaggggaaat

SEQ ID NO: 439290 - DNA, 20 bp, Artificial
  CRISPR gRNA sequence
ggtaaaaagccttaagttcc

SEQ ID NO: 439291 - DNA, 20 bp, Artificial
  CRISPR gRNA sequence
aagccttaagttcccttagc

SEQ ID NO: 439292 - DNA, 20 bp, Artificial
  CRISPR gRNA sequence
taaagtgcctggcatatagt

SEQ ID NO: 439293 - DNA, 20 bp, Artificial
  CRISPR gRNA sequence
tgtctaccctgtggaaggtt

SEQ ID NO: 439294 - DNA, 20 bp, Artificial
  CRISPR gRNA sequence
tctccctagaataccattct

SEQ ID NO: 439295 - DNA, 20 bp, Artificial
  CRISPR gRNA sequence
gtcaggaatattcaaagtga

SEQ ID NO: 439296 - DNA, 20 bp, Artificial
  CRISPR gRNA sequence
aacctccgcctcccgggttc

SEQ ID NO: 439297 - DNA, 20 bp, Artificial
  CRISPR gRNA sequence
tgcctcagccttccgagtag

SEQ ID NO: 439298 - DNA, 20 bp, Artificial
  CRISPR gRNA sequence
ttttttatttttagtagaga

SEQ ID NO: 439299 - DNA, 20 bp, Artificial
  CRISPR gRNA sequence
tgcctcggcctcccaaagtg

SEQ ID NO: 439300 - DNA, 20 bp, Artificial
  CRISPR gRNA sequence
ttttgtatttttagtagaga

SEQ ID NO: 439301 - DNA, 20 bp, Artificial
  CRISPR gRNA sequence
caacttggcctcccaaagtg

SEQ ID NO: 439302 - DNA, 20 bp, Artificial
  CRISPR gRNA sequence
ggcatgagccatggtgccca

SEQ ID NO: 439303 - DNA, 20 bp, Artificial
  CRISPR gRNA sequence
agtagggtggatcacctgtc

SEQ ID NO: 439304 - DNA, 20 bp, Artificial
  CRISPR gRNA sequence
tcaggaggctgagacaggag

SEQ ID NO: 439305 - DNA, 20 bp, Artificial
  CRISPR gRNA sequence
aaaagaaaaaccactagaag

SEQ ID NO: 439306 - DNA, 20 bp, Artificial
  CRISPR gRNA sequence
ttaggaggccaaggtggaag

SEQ ID NO: 439307 - DNA, 20 bp, Artificial
  CRISPR gRNA sequence
tggaaggaatgcttgagacc

SEQ ID NO: 439308 - DNA, 20 bp, Artificial
  CRISPR gRNA sequence
aggagcccacatttatttga

SEQ ID NO: 439309 - DNA, 20 bp, Artificial
  CRISPR gRNA sequence
cacatttatttgactcagtt

SEQ ID NO: 439310 - DNA, 20 bp, Artificial
  CRISPR gRNA sequence
cttctctctttgcaatcaaa

SEQ ID NO: 439311 - DNA, 20 bp, Artificial
  CRISPR gRNA sequence
taaggacctgtatgtgccca

SEQ ID NO: 439312 - DNA, 20 bp, Artificial
  CRISPR gRNA sequence
taaatgtatattgaataaat

SEQ ID NO: 439313 - DNA, 20 bp, Artificial
  CRISPR gRNA sequence
agatttaacttccttaaatt

SEQ ID NO: 439314 - DNA, 20 bp, Artificial
  CRISPR gRNA sequence
ccttaaattcattgttttaa

SEQ ID NO: 439315 - DNA, 20 bp, Artificial
  CRISPR gRNA sequence
gtgtgtgtgtgtgtgtgtgt

SEQ ID NO: 439316 - DNA, 20 bp, Artificial
  CRISPR gRNA sequence
gtctcaagtgatcctcccat

SEQ ID NO: 439317 - DNA, 20 bp, Artificial
  CRISPR gRNA sequence
catctcagcttcccaaagtg

SEQ ID NO: 439318 - DNA, 20 bp, Artificial
  CRISPR gRNA sequence
tttattatttatttttgaga

SEQ ID NO: 439319 - DNA, 20 bp, Artificial
  CRISPR gRNA sequence
aacctctgcctcctgggttc

SEQ ID NO: 439320 - DNA, 20 bp, Artificial
  CRISPR gRNA sequence
ttttgtatttttagtagaga

SEQ ID NO: 439321 - DNA, 20 bp, Artificial
  CRISPR gRNA sequence
gccaccgcacctggcctaat

SEQ ID NO: 439322 - DNA, 20 bp, Artificial
  CRISPR gRNA sequence
catagactgaaattttagaa

SEQ ID NO: 439323 - DNA, 20 bp, Artificial
  CRISPR gRNA sequence
tagagcaatagcaataatag

SEQ ID NO: 439324 - DNA, 20 bp, Artificial
  CRISPR gRNA sequence
gcaatagcaataatagctac

SEQ ID NO: 439325 - DNA, 20 bp, Artificial
  CRISPR gRNA sequence
gcattttatattttctctca

SEQ ID NO: 439326 - DNA, 20 bp, Artificial
  CRISPR gRNA sequence
ttagttttcctgataactct

SEQ ID NO: 439327 - DNA, 20 bp, Artificial
  CRISPR gRNA sequence
agtactccagtctttgcctc

SEQ ID NO: 439328 - DNA, 20 bp, Artificial
  CRISPR gRNA sequence
agtctttgcctcctgggttt

SEQ ID NO: 439329 - DNA, 20 bp, Artificial
  CRISPR gRNA sequence
tgcctcagcctccccactag

SEQ ID NO: 439330 - DNA, 20 bp, Artificial
  CRISPR gRNA sequence
gcatgtgttaccacgcctgg

SEQ ID NO: 439331 - DNA, 20 bp, Artificial
  CRISPR gRNA sequence
ttttgtatttttagtagaga

SEQ ID NO: 439332 - DNA, 20 bp, Artificial
  CRISPR gRNA sequence
tgcctaggcctcccaaagtg

SEQ ID NO: 439333 - DNA, 20 bp, Artificial
  CRISPR gRNA sequence
caccgcgcccggcctcagag

SEQ ID NO: 439334 - DNA, 20 bp, Artificial
  CRISPR gRNA sequence
actgtctttttgtgaaaaat

SEQ ID NO: 439335 - DNA, 20 bp, Artificial
  CRISPR gRNA sequence
ccacaacacagaagggcaca

SEQ ID NO: 439336 - DNA, 20 bp, Artificial
  CRISPR gRNA sequence
taagggagaccctttcttgg

SEQ ID NO: 439337 - DNA, 20 bp, Artificial
  CRISPR gRNA sequence
gctacaaggtgacagatcaa

SEQ ID NO: 439338 - DNA, 20 bp, Artificial
  CRISPR gRNA sequence
gtccaattcacaaatcttga

SEQ ID NO: 439339 - DNA, 20 bp, Artificial
  CRISPR gRNA sequence
aatcttgaagctgattacac

SEQ ID NO: 439340 - DNA, 20 bp, Artificial
  CRISPR gRNA sequence
tgattacacaagcgatttct

SEQ ID NO: 439341 - DNA, 20 bp, Artificial
  CRISPR gRNA sequence
acaagcgatttctagctgtt

SEQ ID NO: 439342 - DNA, 20 bp, Artificial
  CRISPR gRNA sequence
ctagctgttttctgcttaaa

SEQ ID NO: 439343 - DNA, 20 bp, Artificial
  CRISPR gRNA sequence
gttttctgcttaaatcctgt

SEQ ID NO: 439344 - DNA, 20 bp, Artificial
  CRISPR gRNA sequence
tggccaatgagttacgggac

SEQ ID NO: 439345 - DNA, 20 bp, Artificial
  CRISPR gRNA sequence
ctggctctggctcttatctt

SEQ ID NO: 439346 - DNA, 20 bp, Artificial
  CRISPR gRNA sequence
gcgctttaattttcaaatgt

SEQ ID NO: 439347 - DNA, 20 bp, Artificial
  CRISPR gRNA sequence
taattttcaaatgtaagtgt

SEQ ID NO: 439348 - DNA, 20 bp, Artificial
  CRISPR gRNA sequence
acctagatagaaatgcaaat

SEQ ID NO: 439349 - DNA, 20 bp, Artificial
  CRISPR gRNA sequence
aaattcatgtttatacccaa

SEQ ID NO: 439350 - DNA, 20 bp, Artificial
  CRISPR gRNA sequence
tgtcaggcagccactgcgtt

SEQ ID NO: 439351 - DNA, 20 bp, Artificial
  CRISPR gRNA sequence
cattttacagtgaagggaag

SEQ ID NO: 439352 - DNA, 20 bp, Artificial
  CRISPR gRNA sequence
cttagagtaagctgccttcc

SEQ ID NO: 439353 - DNA, 20 bp, Artificial
  CRISPR gRNA sequence
ccggaaatcaaatccaggca

SEQ ID NO: 439354 - DNA, 20 bp, Artificial
  CRISPR gRNA sequence
tctttaattcatgaatatgt

SEQ ID NO: 439355 - DNA, 20 bp, Artificial
  CRISPR gRNA sequence
cttctgtgcacttttctgtt

SEQ ID NO: 439356 - DNA, 20 bp, Artificial
  CRISPR gRNA sequence
gggtcgtgactggggttaga

SEQ ID NO: 439357 - DNA, 20 bp, Artificial
  CRISPR gRNA sequence
ctccatcatggtacttagca

SEQ ID NO: 439358 - DNA, 20 bp, Artificial
  CRISPR gRNA sequence
tttgaggtcaggagttcgag

SEQ ID NO: 439359 - DNA, 20 bp, Artificial
  CRISPR gRNA sequence
tgagaggatcagttgagccc

SEQ ID NO: 439360 - DNA, 20 bp, Artificial
  CRISPR gRNA sequence
gctcaggaggctgcagtgag

SEQ ID NO: 439361 - DNA, 20 bp, Artificial
  CRISPR gRNA sequence
acccccaaaacctcgcacac

SEQ ID NO: 439362 - DNA, 20 bp, Artificial
  CRISPR gRNA sequence
aacctctgcctcccgggttc

SEQ ID NO: 439363 - DNA, 20 bp, Artificial
  CRISPR gRNA sequence
ggttcaagtgtttctcctga

SEQ ID NO: 439364 - DNA, 20 bp, Artificial
  CRISPR gRNA sequence
ttttatatttttagtagaga

SEQ ID NO: 439365 - DNA, 20 bp, Artificial
  CRISPR gRNA sequence
atccgtccacctcgacctcc

SEQ ID NO: 439366 - DNA, 20 bp, Artificial
  CRISPR gRNA sequence
cacctcgacctcccaatgtt

SEQ ID NO: 439367 - DNA, 20 bp, Artificial
  CRISPR gRNA sequence
tgtgtagagtgagcaatcac

SEQ ID NO: 439368 - DNA, 20 bp, Artificial
  CRISPR gRNA sequence
aactgtggactgaagctgcc

SEQ ID NO: 439369 - DNA, 20 bp, Artificial
  CRISPR gRNA sequence
accctatgagataggtacta

SEQ ID NO: 439370 - DNA, 20 bp, Artificial
  CRISPR gRNA sequence
tacacagttaattgatagat

SEQ ID NO: 439371 - DNA, 20 bp, Artificial
  CRISPR gRNA sequence
actgtcctgctcctcatctt

SEQ ID NO: 439372 - DNA, 20 bp, Artificial
  CRISPR gRNA sequence
gctcctcatctttatggttt

SEQ ID NO: 439373 - DNA, 20 bp, Artificial
  CRISPR gRNA sequence
ggtttctgcgattatggtta

SEQ ID NO: 439374 - DNA, 20 bp, Artificial
  CRISPR gRNA sequence
actaccccacccacacttac

SEQ ID NO: 439375 - DNA, 20 bp, Artificial
  CRISPR gRNA sequence
tgcctcagcctcccaagtag

SEQ ID NO: 439376 - DNA, 20 bp, Artificial
  CRISPR gRNA sequence
ggcatatgccaccacacctg

SEQ ID NO: 439377 - DNA, 20 bp, Artificial
  CRISPR gRNA sequence
ttttttttttttggtagaga

SEQ ID NO: 439378 - DNA, 20 bp, Artificial
  CRISPR gRNA sequence
tacttcagcctcccaaagtg

SEQ ID NO: 439379 - DNA, 20 bp, Artificial
  CRISPR gRNA sequence
taaaaatagaggctgagcac

SEQ ID NO: 439380 - DNA, 20 bp, Artificial
  CRISPR gRNA sequence
tgagtggataacctgaggct

SEQ ID NO: 439381 - DNA, 20 bp, Artificial
  CRISPR gRNA sequence
ctcaagctggtctcaaactc

SEQ ID NO: 439382 - DNA, 20 bp, Artificial
  CRISPR gRNA sequence
cacctcagcctcccaaaatg

SEQ ID NO: 439383 - DNA, 20 bp, Artificial
  CRISPR gRNA sequence
tgagtatttccaaaacagac

SEQ ID NO: 439384 - DNA, 20 bp, Artificial
  CRISPR gRNA sequence
ccatggctcaaagtaaaact

SEQ ID NO: 439385 - DNA, 20 bp, Artificial
  CRISPR gRNA sequence
ttatacatattagcacttat

SEQ ID NO: 439386 - DNA, 20 bp, Artificial
  CRISPR gRNA sequence
gatgggatctagaggaaatc

SEQ ID NO: 439387 - DNA, 20 bp, Artificial
  CRISPR gRNA sequence
gagaagtacagataagaaag

SEQ ID NO: 439388 - DNA, 20 bp, Artificial
  CRISPR gRNA sequence
gaaaatattaaaatcaaggt

SEQ ID NO: 439389 - DNA, 20 bp, Artificial
  CRISPR gRNA sequence
tcctaactgatgaaatatga

SEQ ID NO: 439390 - DNA, 20 bp, Artificial
  CRISPR gRNA sequence
tctgagtcatctctctcctt

SEQ ID NO: 439391 - DNA, 20 bp, Artificial
  CRISPR gRNA sequence
cactccttgacccaccatca

SEQ ID NO: 439392 - DNA, 20 bp, Artificial
  CRISPR gRNA sequence
ggtcaagctcaccactgacc

SEQ ID NO: 439393 - DNA, 20 bp, Artificial
  CRISPR gRNA sequence
ctttttttttttttttgaga

SEQ ID NO: 439394 - DNA, 20 bp, Artificial
  CRISPR gRNA sequence
ttgagacagagtttcactct

SEQ ID NO: 439395 - DNA, 20 bp, Artificial
  CRISPR gRNA sequence
acctctgcctccccgggttc

SEQ ID NO: 439396 - DNA, 20 bp, Artificial
  CRISPR gRNA sequence
cccctcagcctcctgagtag

SEQ ID NO: 439397 - DNA, 20 bp, Artificial
  CRISPR gRNA sequence
tttgtatttttagtagagac

SEQ ID NO: 439398 - DNA, 20 bp, Artificial
  CRISPR gRNA sequence
cgccttggcctcccaaagtg

SEQ ID NO: 439399 - DNA, 20 bp, Artificial
  CRISPR gRNA sequence
ttctagaaagtcctccttct

SEQ ID NO: 439400 - DNA, 20 bp, Artificial
  CRISPR gRNA sequence
tgacattcttctctttgatc

SEQ ID NO: 439401 - DNA, 20 bp, Artificial
  CRISPR gRNA sequence
ttctgcctgatccttagatg

SEQ ID NO: 439402 - DNA, 20 bp, Artificial
  CRISPR gRNA sequence
caggaagatcacttgagccc

SEQ ID NO: 439403 - DNA, 20 bp, Artificial
  CRISPR gRNA sequence
tctcagagaaaaacaacaac

SEQ ID NO: 439404 - DNA, 20 bp, Artificial
  CRISPR gRNA sequence
cttcctccaacatacatcta

SEQ ID NO: 439405 - DNA, 20 bp, Artificial
  CRISPR gRNA sequence
caggagagtcacttgaggcc

SEQ ID NO: 439406 - DNA, 20 bp, Artificial
  CRISPR gRNA sequence
agactagcctgggcaacata

SEQ ID NO: 439407 - DNA, 20 bp, Artificial
  CRISPR gRNA sequence
ggcatgtgccagcatacctg

SEQ ID NO: 439408 - DNA, 20 bp, Artificial
  CRISPR gRNA sequence
ttttgtatttttagtagaga

SEQ ID NO: 439409 - DNA, 20 bp, Artificial
  CRISPR gRNA sequence
ctgccttgcctcccaaagtg

SEQ ID NO: 439410 - DNA, 20 bp, Artificial
  CRISPR gRNA sequence
aaagaaaagaaaggaaaatt

SEQ ID NO: 439411 - DNA, 20 bp, Artificial
  CRISPR gRNA sequence
gaggtacccagtaagccaca

SEQ ID NO: 439412 - DNA, 20 bp, Artificial
  CRISPR gRNA sequence
cagaaatgatgagataacgt

SEQ ID NO: 439413 - DNA, 20 bp, Artificial
  CRISPR gRNA sequence
ctctgcccttcaaggaaatc

SEQ ID NO: 439414 - DNA, 20 bp, Artificial
  CRISPR gRNA sequence
tcttagaataaaatccagac

SEQ ID NO: 439415 - DNA, 20 bp, Artificial
  CRISPR gRNA sequence
gggccgctcccttaatccag

SEQ ID NO: 439416 - DNA, 20 bp, Artificial
  CRISPR gRNA sequence
tcccttaatccagccacgtt

SEQ ID NO: 439417 - DNA, 20 bp, Artificial
  CRISPR gRNA sequence
ttggctgactcatttcagaa

SEQ ID NO: 439418 - DNA, 20 bp, Artificial
  CRISPR gRNA sequence
ccctgaccaccctctctatt

SEQ ID NO: 439419 - DNA, 20 bp, Artificial
  CRISPR gRNA sequence
attatctgtttcactatgat

SEQ ID NO: 439420 - DNA, 20 bp, Artificial
  CRISPR gRNA sequence
tacatcataatttgaaatta

SEQ ID NO: 439421 - DNA, 20 bp, Artificial
  CRISPR gRNA sequence
atttactatttcctttttgt

SEQ ID NO: 439422 - DNA, 20 bp, Artificial
  CRISPR gRNA sequence
ttgtttttttttttttgaga

SEQ ID NO: 439423 - DNA, 20 bp, Artificial
  CRISPR gRNA sequence
aacctccgtctcccgggttc

SEQ ID NO: 439424 - DNA, 20 bp, Artificial
  CRISPR gRNA sequence
tgcctcagcctcccgagtag

SEQ ID NO: 439425 - DNA, 20 bp, Artificial
  CRISPR gRNA sequence
ttttgtatttttagtagaga

SEQ ID NO: 439426 - DNA, 20 bp, Artificial
  CRISPR gRNA sequence
ggctggtcttgggtctgggg

SEQ ID NO: 439427 - DNA, 20 bp, Artificial
  CRISPR gRNA sequence
ttggtctcccacaggagagc

SEQ ID NO: 439428 - DNA, 20 bp, Artificial
  CRISPR gRNA sequence
aactatctaaggcacacgtt

SEQ ID NO: 439429 - DNA, 20 bp, Artificial
  CRISPR gRNA sequence
ttaactcaatctgagatgag

SEQ ID NO: 439430 - DNA, 20 bp, Artificial
  CRISPR gRNA sequence
accagatttccctaaactat

SEQ ID NO: 439431 - DNA, 20 bp, Artificial
  CRISPR gRNA sequence
tgcgtgcttccagtgaacct

SEQ ID NO: 439432 - DNA, 20 bp, Artificial
  CRISPR gRNA sequence
tattttatgaatgcattttt

SEQ ID NO: 439433 - DNA, 20 bp, Artificial
  CRISPR gRNA sequence
atgaatgcatttttattggc

SEQ ID NO: 439434 - DNA, 20 bp, Artificial
  CRISPR gRNA sequence
ttctctgagaaatcctgtcc

SEQ ID NO: 439435 - DNA, 20 bp, Artificial
  CRISPR gRNA sequence
ctgtcctggggctttgagat

SEQ ID NO: 439436 - DNA, 20 bp, Artificial
  CRISPR gRNA sequence
tgtgtgtacttcctgacacc

SEQ ID NO: 439437 - DNA, 20 bp, Artificial
  CRISPR gRNA sequence
tttatcaccctaataataca

SEQ ID NO: 439438 - DNA, 20 bp, Artificial
  CRISPR gRNA sequence
tgcttattcatctcgatatt

SEQ ID NO: 439439 - DNA, 20 bp, Artificial
  CRISPR gRNA sequence
ttccactgaactgaaacatc

SEQ ID NO: 439440 - DNA, 20 bp, Artificial
  CRISPR gRNA sequence
acagcccaggcattttcaac

SEQ ID NO: 439441 - DNA, 20 bp, Artificial
  CRISPR gRNA sequence
aattgttctaaaagctctcc

SEQ ID NO: 439442 - DNA, 20 bp, Artificial
  CRISPR gRNA sequence
actcctgtcttgaccttcgt

SEQ ID NO: 439443 - DNA, 20 bp, Artificial
  CRISPR gRNA sequence
acacatccatttcaaatagg

SEQ ID NO: 439444 - DNA, 20 bp, Artificial
  CRISPR gRNA sequence
aggtatggcttacataactt

SEQ ID NO: 439445 - DNA, 20 bp, Artificial
  CRISPR gRNA sequence
actagattttagacttttag

SEQ ID NO: 439446 - DNA, 20 bp, Artificial
  CRISPR gRNA sequence
catgaatggaatacaatata

SEQ ID NO: 439447 - DNA, 20 bp, Artificial
  CRISPR gRNA sequence
acaatatatttggattacaa

SEQ ID NO: 439448 - DNA, 20 bp, Artificial
  CRISPR gRNA sequence
aatgattctgggctaggtgc

SEQ ID NO: 439449 - DNA, 20 bp, Artificial
  CRISPR gRNA sequence
aaaaatggaaacattaggtg

SEQ ID NO: 439450 - DNA, 20 bp, Artificial
  CRISPR gRNA sequence
gagatgaaggctgcaatgag

SEQ ID NO: 439451 - DNA, 20 bp, Artificial
  CRISPR gRNA sequence
caacctcggctcactataac

SEQ ID NO: 439452 - DNA, 20 bp, Artificial
  CRISPR gRNA sequence
aacctctgcttctcgggttc

SEQ ID NO: 439453 - DNA, 20 bp, Artificial
  CRISPR gRNA sequence
tgcattagcctcccaagtag

SEQ ID NO: 439454 - DNA, 20 bp, Artificial
  CRISPR gRNA sequence
accacgctggctaatttttt

SEQ ID NO: 439455 - DNA, 20 bp, Artificial
  CRISPR gRNA sequence
ttttgtatgtttagtagaga

SEQ ID NO: 439456 - DNA, 20 bp, Artificial
  CRISPR gRNA sequence
aggctcagcctcccaaagtg

SEQ ID NO: 439457 - DNA, 20 bp, Artificial
  CRISPR gRNA sequence
aaattaatggacattttctc

SEQ ID NO: 439458 - DNA, 20 bp, Artificial
  CRISPR gRNA sequence
atagtattttattgctattt

SEQ ID NO: 439459 - DNA, 20 bp, Artificial
  CRISPR gRNA sequence
tctattccgtgttacctggg

SEQ ID NO: 439460 - DNA, 20 bp, Artificial
  CRISPR gRNA sequence
ctttggccaacctccctccc

SEQ ID NO: 439461 - DNA, 20 bp, Artificial
  CRISPR gRNA sequence
aaccctcacaacctttgggt

SEQ ID NO: 439462 - DNA, 20 bp, Artificial
  CRISPR gRNA sequence
tagatccaaccaccttattt

SEQ ID NO: 439463 - DNA, 20 bp, Artificial
  CRISPR gRNA sequence
aaccaccttatttttgagct

SEQ ID NO: 439464 - DNA, 20 bp, Artificial
  CRISPR gRNA sequence
actatgagctgtgtcacctg

SEQ ID NO: 439465 - DNA, 20 bp, Artificial
  CRISPR gRNA sequence
ttctgtccactgctatggag

SEQ ID NO: 439466 - DNA, 20 bp, Artificial
  CRISPR gRNA sequence
tcatggatgttagagctcaa

SEQ ID NO: 439467 - DNA, 20 bp, Artificial
  CRISPR gRNA sequence
cacagaaagtctaaaggggc

SEQ ID NO: 439468 - DNA, 20 bp, Artificial
  CRISPR gRNA sequence
caaagagatctgtgatccct

SEQ ID NO: 439469 - DNA, 20 bp, Artificial
  CRISPR gRNA sequence
atctgtgatccctttttgtt

SEQ ID NO: 439470 - DNA, 20 bp, Artificial
  CRISPR gRNA sequence
aagctccgcctcctgggttc

SEQ ID NO: 439471 - DNA, 20 bp, Artificial
  CRISPR gRNA sequence
tgcctcagcctcctgagtgg

SEQ ID NO: 439472 - DNA, 20 bp, Artificial
  CRISPR gRNA sequence
tgttgtatttttagtagaga

SEQ ID NO: 439473 - DNA, 20 bp, Artificial
  CRISPR gRNA sequence
gtggtctcaaactcctgacc

SEQ ID NO: 439474 - DNA, 20 bp, Artificial
  CRISPR gRNA sequence
tgcctcggcctcccaaagca

SEQ ID NO: 439475 - DNA, 20 bp, Artificial
  CRISPR gRNA sequence
acatccagccagtgatcctt

SEQ ID NO: 439476 - DNA, 20 bp, Artificial
  CRISPR gRNA sequence
gaccaggtctaccttgatct

SEQ ID NO: 439477 - DNA, 20 bp, Artificial
  CRISPR gRNA sequence
ttgaagattcccttggaatg

SEQ ID NO: 439478 - DNA, 20 bp, Artificial
  CRISPR gRNA sequence
ttcccttggaatgttgagat

SEQ ID NO: 439479 - DNA, 20 bp, Artificial
  CRISPR gRNA sequence
cccagggaaaaacgaagtgc

SEQ ID NO: 439480 - DNA, 20 bp, Artificial
  CRISPR gRNA sequence
atttgattggtgtgtattgg

SEQ ID NO: 439481 - DNA, 20 bp, Artificial
  CRISPR gRNA sequence
attggtgtgtattggccaag

SEQ ID NO: 439482 - DNA, 20 bp, Artificial
  CRISPR gRNA sequence
ttggccaagttttgcttgtt

SEQ ID NO: 439483 - DNA, 20 bp, Artificial
  CRISPR gRNA sequence
aacttaaatttcaagacggt

SEQ ID NO: 439484 - DNA, 20 bp, Artificial
  CRISPR gRNA sequence
gacggtataggcttgatctg

SEQ ID NO: 439485 - DNA, 20 bp, Artificial
  CRISPR gRNA sequence
acttactaaaaatttttttt

SEQ ID NO: 439486 - DNA, 20 bp, Artificial
  CRISPR gRNA sequence
aaaaatttttttttactgtt

SEQ ID NO: 439487 - DNA, 20 bp, Artificial
  CRISPR gRNA sequence
atttttttttactgtttttt

SEQ ID NO: 439488 - DNA, 20 bp, Artificial
  CRISPR gRNA sequence
ttttttactgttttttgttt

SEQ ID NO: 439489 - DNA, 20 bp, Artificial
  CRISPR gRNA sequence
ttactgttttttgtttgttt

SEQ ID NO: 439490 - DNA, 20 bp, Artificial
  CRISPR gRNA sequence
ctcgctctgtctgagttcat

SEQ ID NO: 439491 - DNA, 20 bp, Artificial
  CRISPR gRNA sequence
atctgacaaagggctaatat

SEQ ID NO: 439492 - DNA, 20 bp, Artificial
  CRISPR gRNA sequence
tagtaagttccaattgtgtg

SEQ ID NO: 439493 - DNA, 20 bp, Artificial
  CRISPR gRNA sequence
tgccttctttccaccaggca

SEQ ID NO: 439494 - DNA, 20 bp, Artificial
  CRISPR gRNA sequence
ccactcaggaggctgaggca

SEQ ID NO: 439495 - DNA, 20 bp, Artificial
  CRISPR gRNA sequence
gagctccagagaccccacgt

SEQ ID NO: 439496 - DNA, 20 bp, Artificial
  CRISPR gRNA sequence
ggtaacacggaatagagtta

SEQ ID NO: 439497 - DNA, 20 bp, Artificial
  CRISPR gRNA sequence
tgctgaacaagtggaaaagc

SEQ ID NO: 439498 - DNA, 20 bp, Artificial
  CRISPR gRNA sequence
aaatactatggggaaacaat

SEQ ID NO: 439499 - DNA, 20 bp, Artificial
  CRISPR gRNA sequence
caacagcattgtgatagcta

SEQ ID NO: 439500 - DNA, 20 bp, Artificial
  CRISPR gRNA sequence
gctacttgggaggctaatgc

SEQ ID NO: 439501 - DNA, 20 bp, Artificial
  CRISPR gRNA sequence
cgtaagccacagcacctagc

SEQ ID NO: 439502 - DNA, 20 bp, Artificial
  CRISPR gRNA sequence
ttctcagccctgactgttca

SEQ ID NO: 439503 - DNA, 20 bp, Artificial
  CRISPR gRNA sequence
tgaaaatgcctgggctgttt

SEQ ID NO: 439504 - DNA, 20 bp, Artificial
  CRISPR gRNA sequence
ttcacttcataactagacct

SEQ ID NO: 439505 - DNA, 20 bp, Artificial
  CRISPR gRNA sequence
gccccaggacaggatttctc

SEQ ID NO: 439506 - DNA, 20 bp, Artificial
  CRISPR gRNA sequence
tctgtatcttctctttgcta

SEQ ID NO: 439507 - DNA, 20 bp, Artificial
  CRISPR gRNA sequence
cattcataaaataaatgaga

SEQ ID NO: 439508 - DNA, 20 bp, Artificial
  CRISPR gRNA sequence
agatagttatatggactgtg

SEQ ID NO: 439509 - DNA, 20 bp, Artificial
  CRISPR gRNA sequence
acgctctcctgtgggagacc

SEQ ID NO: 439510 - DNA, 20 bp, Artificial
  CRISPR gRNA sequence
tgtgggagaccaaagaaata

SEQ ID NO: 439511 - DNA, 20 bp, Artificial
  CRISPR gRNA sequence
aagaccagcctgaccaacat

SEQ ID NO: 439512 - DNA, 20 bp, Artificial
  CRISPR gRNA sequence
ctactcgggaggctgaggca

SEQ ID NO: 439513 - DNA, 20 bp, Artificial
  CRISPR gRNA sequence
attggattcgaaggaggaat

SEQ ID NO: 439514 - DNA, 20 bp, Artificial
  CRISPR gRNA sequence
gaaatgagaagataaattaa

SEQ ID NO: 439515 - DNA, 20 bp, Artificial
  CRISPR gRNA sequence
aaggaatggccaaaagagat

SEQ ID NO: 439516 - DNA, 20 bp, Artificial
  CRISPR gRNA sequence
cctgtgctgtgtcacccagg

SEQ ID NO: 439517 - DNA, 20 bp, Artificial
  CRISPR gRNA sequence
gaaaagcaatggatcaaaga

SEQ ID NO: 439518 - DNA, 20 bp, Artificial
  CRISPR gRNA sequence
gccaagagaaggaggacttt

SEQ ID NO: 439519 - DNA, 20 bp, Artificial
  CRISPR gRNA sequence
ctactcaggaggctgagggg

SEQ ID NO: 439520 - DNA, 20 bp, Artificial
  CRISPR gRNA sequence
ggtatctgttaatatttaat

SEQ ID NO: 439521 - DNA, 20 bp, Artificial
  CRISPR gRNA sequence
catttccgttgtgctttgga

SEQ ID NO: 439522 - DNA, 20 bp, Artificial
  CRISPR gRNA sequence
atatggctgtgagaacgagt

SEQ ID NO: 439523 - DNA, 20 bp, Artificial
  CRISPR gRNA sequence
tgctaatgaaaatagcataa

SEQ ID NO: 439524 - DNA, 20 bp, Artificial
  CRISPR gRNA sequence
aaaaggagagagatgactca

SEQ ID NO: 439525 - DNA, 20 bp, Artificial
  CRISPR gRNA sequence
tggtcatctcagagagtaca

SEQ ID NO: 439526 - DNA, 20 bp, Artificial
  CRISPR gRNA sequence
cccatcactctttatacaaa

SEQ ID NO: 439527 - DNA, 20 bp, Artificial
  CRISPR gRNA sequence
ctacttgggaggctgaggca

SEQ ID NO: 439528 - DNA, 20 bp, Artificial
  CRISPR gRNA sequence
taatccatttaaccataatc

SEQ ID NO: 439529 - DNA, 20 bp, Artificial
  CRISPR gRNA sequence
tttagcatgctgattctcca

SEQ ID NO: 439530 - DNA, 20 bp, Artificial
  CRISPR gRNA sequence
cctatctcatagggtagtta

SEQ ID NO: 439531 - DNA, 20 bp, Artificial
  CRISPR gRNA sequence
agtccctgtttgtgtattag

SEQ ID NO: 439532 - DNA, 20 bp, Artificial
  CRISPR gRNA sequence
aggacttggtttctgcccta

SEQ ID NO: 439533 - DNA, 20 bp, Artificial
  CRISPR gRNA sequence
ctactctggaagctgagtca

SEQ ID NO: 439534 - DNA, 20 bp, Artificial
  CRISPR gRNA sequence
aaaaaaaagggataagtaac

SEQ ID NO: 439535 - DNA, 20 bp, Artificial
  CRISPR gRNA sequence
tactgccagagaggtatgcc

SEQ ID NO: 439536 - DNA, 20 bp, Artificial
  CRISPR gRNA sequence
gtatgcctgagaaaccaata

SEQ ID NO: 439537 - DNA, 20 bp, Artificial
  CRISPR gRNA sequence
cctagacatattcatgaatt

SEQ ID NO: 439538 - DNA, 20 bp, Artificial
  CRISPR gRNA sequence
ggtttttactggttctcact

SEQ ID NO: 439539 - DNA, 20 bp, Artificial
  CRISPR gRNA sequence
gaatttgttatcagagggag

SEQ ID NO: 439540 - DNA, 20 bp, Artificial
  CRISPR gRNA sequence
gaaacacaaacaggatttaa

SEQ ID NO: 439541 - DNA, 20 bp, Artificial
  CRISPR gRNA sequence
aggatttaagcagaaaacag

SEQ ID NO: 439542 - DNA, 20 bp, Artificial
  CRISPR gRNA sequence
agccaacactcaagccaacc

SEQ ID NO: 439543 - DNA, 20 bp, Artificial
  CRISPR gRNA sequence
ctagtggggaggctgaggca

SEQ ID NO: 439544 - DNA, 20 bp, Artificial
  CRISPR gRNA sequence
gttatcaggaaaactaagtg

SEQ ID NO: 439545 - DNA, 20 bp, Artificial
  CRISPR gRNA sequence
atcagttgtgaatacacaag

SEQ ID NO: 439546 - DNA, 20 bp, Artificial
  CRISPR gRNA sequence
acactgtgcccggcctcctc

SEQ ID NO: 439547 - DNA, 20 bp, Artificial
  CRISPR gRNA sequence
aagaccagcctgaccaacat

SEQ ID NO: 439548 - DNA, 20 bp, Artificial
  CRISPR gRNA sequence
ctactcggaaggctgaggca

SEQ ID NO: 439549 - DNA, 20 bp, Artificial
  CRISPR gRNA sequence
taggattgcaatggaagcaa

SEQ ID NO: 439550 - DNA, 20 bp, Artificial
  CRISPR gRNA sequence
gaatggtattctagggagat

SEQ ID NO: 439551 - DNA, 20 bp, Artificial
  CRISPR gRNA sequence
gggtagacagttgtgaaatt

SEQ ID NO: 439552 - DNA, 20 bp, Artificial
  CRISPR gRNA sequence
atttatttatttatttagac

SEQ ID NO: 439553 - DNA, 20 bp, Artificial
  CRISPR gRNA sequence
cttttttttctttttgcgag

SEQ ID NO: 439554 - DNA, 20 bp, Artificial
  CRISPR gRNA sequence
gttagtcccattgcacagat

SEQ ID NO: 439555 - DNA, 20 bp, Artificial
  CRISPR gRNA sequence
agcctcagcctaaaattatt

SEQ ID NO: 439556 - DNA, 20 bp, Artificial
  CRISPR gRNA sequence
aattacttttgccctaatta

SEQ ID NO: 439557 - DNA, 20 bp, Artificial
  CRISPR gRNA sequence
ggagtggcaatgttctttct

SEQ ID NO: 439558 - DNA, 20 bp, Artificial
  CRISPR gRNA sequence
attttttttttttttttttc

SEQ ID NO: 439559 - DNA, 20 bp, Artificial
  CRISPR gRNA sequence
ctacttgggaggctgaggca

SEQ ID NO: 439560 - DNA, 20 bp, Artificial
  CRISPR gRNA sequence
ctcaaaaaaaaaaaaaaagg

SEQ ID NO: 439561 - DNA, 20 bp, Artificial
  CRISPR gRNA sequence
gtctctactaaaaatacaaa

SEQ ID NO: 439562 - DNA, 20 bp, Artificial
  CRISPR gRNA sequence
ctacttgggaggctgaggca

SEQ ID NO: 439563 - DNA, 20 bp, Artificial
  CRISPR gRNA sequence
agatgagcaaactgagcttc

SEQ ID NO: 439564 - DNA, 20 bp, Artificial
  CRISPR gRNA sequence
cctattaacctcattttaca

SEQ ID NO: 439565 - DNA, 20 bp, Artificial
  CRISPR gRNA sequence
agaagagaccaggacactga

SEQ ID NO: 439566 - DNA, 20 bp, Artificial
  CRISPR gRNA sequence
acgtccttgctgaattacat

SEQ ID NO: 439567 - DNA, 20 bp, Artificial
  CRISPR gRNA sequence
tattctagctagaaggcatc

SEQ ID NO: 439568 - DNA, 20 bp, Artificial
  CRISPR gRNA sequence
catcaccagtccagggtcag

SEQ ID NO: 439569 - DNA, 20 bp, Artificial
  CRISPR gRNA sequence
aggggtgaccttggctaatg

SEQ ID NO: 439570 - DNA, 20 bp, Artificial
  CRISPR gRNA sequence
aggatgaaaattatctgaga

SEQ ID NO: 439571 - DNA, 20 bp, Artificial
  CRISPR gRNA sequence
tcagggaatcaaaggggcag

SEQ ID NO: 439572 - DNA, 20 bp, Artificial
  CRISPR gRNA sequence
aaaaaaatgcgaaagacaat

SEQ ID NO: 439573 - DNA, 20 bp, Artificial
  CRISPR gRNA sequence
atgcgaaagacaattaagaa

SEQ ID NO: 439574 - DNA, 20 bp, Artificial
  CRISPR gRNA sequence
cttatctgaaatgcttgaga

SEQ ID NO: 439575 - DNA, 20 bp, Artificial
  CRISPR gRNA sequence
ctgggcacaaagtacatgtt

SEQ ID NO: 439576 - DNA, 20 bp, Artificial
  CRISPR gRNA sequence
tgcttcagccccccaagtag

SEQ ID NO: 439577 - DNA, 20 bp, Artificial
  CRISPR gRNA sequence
aaaactgcaagccatgtctt

SEQ ID NO: 439578 - DNA, 20 bp, Artificial
  CRISPR gRNA sequence
cttctcagatgtgaaggcca

SEQ ID NO: 439579 - DNA, 20 bp, Artificial
  CRISPR gRNA sequence
ctggtctcagaacctcactt

SEQ ID NO: 439580 - DNA, 20 bp, Artificial
  CRISPR gRNA sequence
ttcagaaacactgccctagg

SEQ ID NO: 439581 - DNA, 20 bp, Artificial
  CRISPR gRNA sequence
gggctgatggaaacagacaa

SEQ ID NO: 439582 - DNA, 20 bp, Artificial
  CRISPR gRNA sequence
tttaaggtttaaagttgtga

SEQ ID NO: 439583 - DNA, 20 bp, Artificial
  CRISPR gRNA sequence
gtcaagctgggaactgggtc

SEQ ID NO: 439584 - DNA, 20 bp, Artificial
  CRISPR gRNA sequence
gagccctcaaaatcatcttc

SEQ ID NO: 439585 - DNA, 20 bp, Artificial
  CRISPR gRNA sequence
ctactccggtgcctaaggca

SEQ ID NO: 439586 - DNA, 20 bp, Artificial
  CRISPR gRNA sequence
gactccatctcaattgaaaa

SEQ ID NO: 439587 - DNA, 20 bp, Artificial
  CRISPR gRNA sequence
atctcaattgaaaaaaagaa

SEQ ID NO: 439588 - DNA, 20 bp, Artificial
  CRISPR gRNA sequence
caattgaaaaaaagaaaaag

SEQ ID NO: 439589 - DNA, 20 bp, Artificial
  CRISPR gRNA sequence
gaaaaaaagaaaaagaaaga

SEQ ID NO: 439590 - DNA, 20 bp, Artificial
  CRISPR gRNA sequence
aagaaaaagaaagaaaagaa

SEQ ID NO: 439591 - DNA, 20 bp, Artificial
  CRISPR gRNA sequence
aaaagaaaaagaaaaaaagg

SEQ ID NO: 439592 - DNA, 20 bp, Artificial
  CRISPR gRNA sequence
aaaaagaaaaaaaggaaaga

SEQ ID NO: 439593 - DNA, 20 bp, Artificial
  CRISPR gRNA sequence
gaaaaaaaggaaagaaaaga

SEQ ID NO: 439594 - DNA, 20 bp, Artificial
  CRISPR gRNA sequence
ttttcctagagcttatacat

SEQ ID NO: 439595 - DNA, 20 bp, Artificial
  CRISPR gRNA sequence
gtgaaaacatggagcttgca

SEQ ID NO: 439596 - DNA, 20 bp, Artificial
  CRISPR gRNA sequence
gaggaagcaatacttcagtg

SEQ ID NO: 439597 - DNA, 20 bp, Artificial
  CRISPR gRNA sequence
tagacctggcagtgttacta

SEQ ID NO: 439598 - DNA, 20 bp, Artificial
  CRISPR gRNA sequence
gtctgacaaaacatactggt

SEQ ID NO: 439599 - DNA, 20 bp, Artificial
  CRISPR gRNA sequence
ctcaaaattataatgttatt

SEQ ID NO: 439600 - DNA, 20 bp, Artificial
  CRISPR gRNA sequence
gttattaaagaaaaaaagtt

SEQ ID NO: 439601 - DNA, 20 bp, Artificial
  CRISPR gRNA sequence
aaaggggacataaaaaatca

SEQ ID NO: 439602 - DNA, 20 bp, Artificial
  CRISPR gRNA sequence
agccctgttctcccgtgttc

SEQ ID NO: 439603 - DNA, 20 bp, Artificial
  CRISPR gRNA sequence
cagcaacacttgagaacttg

SEQ ID NO: 439604 - DNA, 20 bp, Artificial
  CRISPR gRNA sequence
gaatacagagcggaggtcgg

SEQ ID NO: 439605 - DNA, 20 bp, Artificial
  CRISPR gRNA sequence
ggagatgtgtccctgaccat

SEQ ID NO: 439606 - DNA, 20 bp, Artificial
  CRISPR gRNA sequence
ctacttggggggctgaagca

SEQ ID NO: 439607 - DNA, 20 bp, Artificial
  CRISPR gRNA sequence
actctgtctcaaaaaaaaaa

SEQ ID NO: 439608 - DNA, 20 bp, Artificial
  CRISPR gRNA sequence
gtctcaaaaaaaaaaaaaga

SEQ ID NO: 439609 - DNA, 20 bp, Artificial
  CRISPR gRNA sequence
aaaaaaaaaaaaagaaaaga

SEQ ID NO: 439610 - DNA, 20 bp, Artificial
  CRISPR gRNA sequence
gttagagaccctgactctca

SEQ ID NO: 439611 - DNA, 20 bp, Artificial
  CRISPR gRNA sequence
cccctatctcttaaaaagca

SEQ ID NO: 439612 - DNA, 20 bp, Artificial
  CRISPR gRNA sequence
aaaccccactaccaaaaacc

SEQ ID NO: 439613 - DNA, 20 bp, Artificial
  CRISPR gRNA sequence
gagaccagtctgaccaacat

SEQ ID NO: 439614 - DNA, 20 bp, Artificial
  CRISPR gRNA sequence
ctactcaggagtctgaggca

SEQ ID NO: 439615 - DNA, 20 bp, Artificial
  CRISPR gRNA sequence
gttagttccgctattaataa

SEQ ID NO: 439616 - DNA, 20 bp, Artificial
  CRISPR gRNA sequence
ttgaatgtgggaaaaaaaga

SEQ ID NO: 439617 - DNA, 20 bp, Artificial
  CRISPR gRNA sequence
atttctaggatgccttctag

SEQ ID NO: 439618 - DNA, 20 bp, Artificial
  CRISPR gRNA sequence
accttccctggattccagcc

SEQ ID NO: 439619 - DNA, 20 bp, Artificial
  CRISPR gRNA sequence
tccctggattccagccacag

SEQ ID NO: 439620 - DNA, 20 bp, Artificial
  CRISPR gRNA sequence
cacaccttatgggctttaaa

SEQ ID NO: 439621 - DNA, 20 bp, Artificial
  CRISPR gRNA sequence
ggaaactaaatatggtgggg

SEQ ID NO: 439622 - DNA, 20 bp, Artificial
  CRISPR gRNA sequence
gtatgccattgttatatttt

SEQ ID NO: 439623 - DNA, 20 bp, Artificial
  CRISPR gRNA sequence
gagcttctcaagggcctgac

SEQ ID NO: 439624 - DNA, 20 bp, Artificial
  CRISPR gRNA sequence
tggcaaaaccccatctctac

SEQ ID NO: 439625 - DNA, 20 bp, Artificial
  CRISPR gRNA sequence
ctactcaggaggctgaggca

SEQ ID NO: 439626 - DNA, 20 bp, Artificial
  CRISPR gRNA sequence
caacagagcgagaccctttc

SEQ ID NO: 439627 - DNA, 20 bp, Artificial
  CRISPR gRNA sequence
ccaggcaaatcttggtttct

SEQ ID NO: 439628 - DNA, 20 bp, Artificial
  CRISPR gRNA sequence
gttagttttaccatttttat

SEQ ID NO: 439629 - DNA, 20 bp, Artificial
  CRISPR gRNA sequence
agctggcaatgtacttattt

SEQ ID NO: 439630 - DNA, 20 bp, Artificial
  CRISPR gRNA sequence
catggaatggatcagcagat

SEQ ID NO: 439631 - DNA, 20 bp, Artificial
  CRISPR gRNA sequence
gctggtgaaggcagtataat

SEQ ID NO: 439632 - DNA, 20 bp, Artificial
  CRISPR gRNA sequence
gagtaaatgcaaaacttatt

SEQ ID NO: 439633 - DNA, 20 bp, Artificial
  CRISPR gRNA sequence
ctaccagggaggctgaggca

SEQ ID NO: 439634 - DNA, 20 bp, Artificial
  CRISPR gRNA sequence
agtgagattctgtctcgcaa

SEQ ID NO: 439635 - DNA, 20 bp, Artificial
  CRISPR gRNA sequence
ctgtctcgcaaaaagaaaaa

SEQ ID NO: 439636 - DNA, 20 bp, Artificial
  CRISPR gRNA sequence
tgttgtcttttaaaatctaa

SEQ ID NO: 439637 - DNA, 20 bp, Artificial
  CRISPR gRNA sequence
ctacttgggaggatgaggga

SEQ ID NO: 439638 - DNA, 20 bp, Artificial
  CRISPR gRNA sequence
attattgtgacaagtacgga

SEQ ID NO: 439639 - DNA, 20 bp, Artificial
  CRISPR gRNA sequence
attttttaaaaacttagata

SEQ ID NO: 439640 - DNA, 20 bp, Artificial
  CRISPR gRNA sequence
aagagcttgaaaaccacaaa

SEQ ID NO: 439641 - DNA, 20 bp, Artificial
  CRISPR gRNA sequence
ttcaaagattcttcatctcc

SEQ ID NO: 439642 - DNA, 20 bp, Artificial
  CRISPR gRNA sequence
ttttttttttttttttttag

SEQ ID NO: 439643 - DNA, 20 bp, Artificial
  CRISPR gRNA sequence
ttactgtccctgctaccttc

SEQ ID NO: 439644 - DNA, 20 bp, Artificial
  CRISPR gRNA sequence
cctgctaccttctcagaata

SEQ ID NO: 439645 - DNA, 20 bp, Artificial
  CRISPR gRNA sequence
ctactcaggaggctgagaca

SEQ ID NO: 439646 - DNA, 20 bp, Artificial
  CRISPR gRNA sequence
aagagcgaaattccctcata

SEQ ID NO: 439647 - DNA, 20 bp, Artificial
  CRISPR gRNA sequence
cctaatcattgtttttaaag

SEQ ID NO: 439648 - DNA, 20 bp, Artificial
  CRISPR gRNA sequence
agaacccatagactgaaatt

SEQ ID NO: 439649 - DNA, 20 bp, Artificial
  CRISPR gRNA sequence
ttttgtgtggctctcagtta

SEQ ID NO: 439650 - DNA, 20 bp, Artificial
  CRISPR gRNA sequence
acgggactctggagcaacca

SEQ ID NO: 439651 - DNA, 20 bp, Artificial
  CRISPR gRNA sequence
gagaaccagtaaaaacctag

SEQ ID NO: 439652 - DNA, 20 bp, Artificial
  CRISPR gRNA sequence
actgggtcgtgactggggtt

SEQ ID NO: 439653 - DNA, 20 bp, Artificial
  CRISPR gRNA sequence
attgcactccaccctgggca

SEQ ID NO: 439654 - DNA, 20 bp, Artificial
  CRISPR gRNA sequence
tgaagttgatgaattttgat

SEQ ID NO: 439655 - DNA, 20 bp, Artificial
  CRISPR gRNA sequence
ctattttattttcttttagg

SEQ ID NO: 439656 - DNA, 20 bp, Artificial
  CRISPR gRNA sequence
gggctaaaactggaacagtc

SEQ ID NO: 439657 - DNA, 20 bp, Artificial
  CRISPR gRNA sequence
ggtactaatatgtttctaat

SEQ ID NO: 439658 - DNA, 20 bp, Artificial
  CRISPR gRNA sequence
attatggttaaatggattat

SEQ ID NO: 439659 - DNA, 20 bp, Artificial
  CRISPR gRNA sequence
gttaaatggattattcagaa

SEQ ID NO: 439660 - DNA, 20 bp, Artificial
  CRISPR gRNA sequence
acagggttttgccatgttgc

SEQ ID NO: 439661 - DNA, 20 bp, Artificial
  CRISPR gRNA sequence
gagaccagcctgaccaacgt

SEQ ID NO: 439662 - DNA, 20 bp, Artificial
  CRISPR gRNA sequence
ctactcgggaagctgaggtg

SEQ ID NO: 439663 - DNA, 20 bp, Artificial
  CRISPR gRNA sequence
taaaataaaataaaataaaa

SEQ ID NO: 439664 - DNA, 20 bp, Artificial
  CRISPR gRNA sequence
tggctactgagaagtacaga

SEQ ID NO: 439665 - DNA, 20 bp, Artificial
  CRISPR gRNA sequence
tcttttccctggaagttgct

SEQ ID NO: 439666 - DNA, 20 bp, Artificial
  CRISPR gRNA sequence
tgtttatgctattttcatta

SEQ ID NO: 439667 - DNA, 20 bp, Artificial
  CRISPR gRNA sequence
ttttaaattgatcactcatt

SEQ ID NO: 439668 - DNA, 20 bp, Artificial
  CRISPR gRNA sequence
cctatcgtcccagctactca

SEQ ID NO: 439669 - DNA, 20 bp, Artificial
  CRISPR gRNA sequence
gcacagggagaccctgtctc

SEQ ID NO: 439670 - DNA, 20 bp, Artificial
  CRISPR gRNA sequence
tggtctcgaactcccaagct

SEQ ID NO: 439671 - DNA, 20 bp, Artificial
  CRISPR gRNA sequence
aaaaaaaaaaaaaaaaaaaa

SEQ ID NO: 439672 - DNA, 20 bp, Artificial
  CRISPR gRNA sequence
aaaaaaaaaaaaaaaaaaga

SEQ ID NO: 439673 - DNA, 20 bp, Artificial
  CRISPR gRNA sequence
aaaaaaaaaaaaagaaaaga

SEQ ID NO: 439674 - DNA, 20 bp, Artificial
  CRISPR gRNA sequence
ctggattcctgacccacaac

SEQ ID NO: 439675 - DNA, 20 bp, Artificial
  CRISPR gRNA sequence
gtagttgttttcagcgggta

SEQ ID NO: 439676 - DNA, 20 bp, Artificial
  CRISPR gRNA sequence
tctaaggtttcctacaggtc

SEQ ID NO: 439677 - DNA, 20 bp, Artificial
  CRISPR gRNA sequence
ctttacttggctgactcatt

SEQ ID NO: 439678 - DNA, 20 bp, Artificial
  CRISPR gRNA sequence
gtctcataatatttgttaaa

SEQ ID NO: 439679 - DNA, 20 bp, Artificial
  CRISPR gRNA sequence
tctcatagcaaagagaagat

SEQ ID NO: 439680 - DNA, 20 bp, Artificial
  CRISPR gRNA sequence
agaagatacagaatttaagg

SEQ ID NO: 439681 - DNA, 20 bp, Artificial
  CRISPR gRNA sequence
ggaatggggttgggaaaagg

SEQ ID NO: 439682 - DNA, 20 bp, Artificial
  CRISPR gRNA sequence
aacatgtctgatcttttctc

SEQ ID NO: 439683 - DNA, 20 bp, Artificial
  CRISPR gRNA sequence
tttagttctaaagttaaggt

SEQ ID NO: 439684 - DNA, 20 bp, Artificial
  CRISPR gRNA sequence
ttaggcgttacagaagtgag

SEQ ID NO: 439685 - DNA, 20 bp, Artificial
  CRISPR gRNA sequence
ttttcaactttagtttccta

SEQ ID NO: 439686 - DNA, 20 bp, Artificial
  CRISPR gRNA sequence
ccaaccccagagcaactgaa

SEQ ID NO: 439687 - DNA, 20 bp, Artificial
  CRISPR gRNA sequence
tctggggatgaagcctaagc

SEQ ID NO: 439688 - DNA, 20 bp, Artificial
  CRISPR gRNA sequence
tgcattcccacctgggtgac

SEQ ID NO: 439689 - DNA, 20 bp, Artificial
  CRISPR gRNA sequence
taaacttcagcctgcacctc

SEQ ID NO: 439690 - DNA, 20 bp, Artificial
  CRISPR gRNA sequence
cacaatgctgttgttatacc

SEQ ID NO: 439691 - DNA, 20 bp, Artificial
  CRISPR gRNA sequence
tagcagagggaattcgctca

SEQ ID NO: 439692 - DNA, 20 bp, Artificial
  CRISPR gRNA sequence
agcttggtgttttgtctttt

SEQ ID NO: 439693 - DNA, 20 bp, Artificial
  CRISPR gRNA sequence
gaaagcataacttttttggc

SEQ ID NO: 439694 - DNA, 20 bp, Artificial
  CRISPR gRNA sequence
ttttgcttgttgtgtgcttg

SEQ ID NO: 439695 - DNA, 20 bp, Artificial
  CRISPR gRNA sequence
ttgtttgtttgttttttgag

SEQ ID NO: 439696 - DNA, 20 bp, Artificial
  CRISPR gRNA sequence
cagagcgagattctatctca

SEQ ID NO: 439697 - DNA, 20 bp, Artificial
  CRISPR gRNA sequence
aaaaaacaaacaaacaaaca

SEQ ID NO: 439698 - DNA, 20 bp, Artificial
  CRISPR gRNA sequence
tctttcaagcacacaacaag

SEQ ID NO: 439699 - DNA, 20 bp, Artificial
  CRISPR gRNA sequence
acagagcaagactccatctc

SEQ ID NO: 439700 - DNA, 20 bp, Artificial
  CRISPR gRNA sequence
aagactccatctcaaaaaca

SEQ ID NO: 439701 - DNA, 20 bp, Artificial
  CRISPR gRNA sequence
tcattatcttctgaaaatgg

SEQ ID NO: 439702 - DNA, 20 bp, Artificial
  CRISPR gRNA sequence
atagcagtggacagaacctc

SEQ ID NO: 439703 - DNA, 20 bp, Artificial
  CRISPR gRNA sequence
ctcatagtttctgaaaaaga

SEQ ID NO: 439704 - DNA, 20 bp, Artificial
  CRISPR gRNA sequence
ttgatgtttcagttcagtgg

SEQ ID NO: 439705 - DNA, 20 bp, Artificial
  CRISPR gRNA sequence
gggagaccaaagaaataaaa

SEQ ID NO: 439706 - DNA, 20 bp, Artificial
  CRISPR gRNA sequence
aaactccgtctcaaaaaaaa

SEQ ID NO: 439707 - DNA, 20 bp, Artificial
  CRISPR gRNA sequence
aaaaaggaaatagtaaatag

SEQ ID NO: 439708 - DNA, 20 bp, Artificial
  CRISPR gRNA sequence
cttgctgagtacctgaaact

SEQ ID NO: 439709 - DNA, 20 bp, Artificial
  CRISPR gRNA sequence
ttgggtttcttttacccgct

SEQ ID NO: 439710 - DNA, 20 bp, Artificial
  CRISPR gRNA sequence
gaccagcctgggcaacatgg

SEQ ID NO: 439711 - DNA, 20 bp, Artificial
  CRISPR gRNA sequence
ctcatctctactaaaaatac

SEQ ID NO: 439712 - DNA, 20 bp, Artificial
  CRISPR gRNA sequence
caaaagagatgcagaataat

SEQ ID NO: 439713 - DNA, 20 bp, Artificial
  CRISPR gRNA sequence
atctgttaatatttaattta

SEQ ID NO: 439714 - DNA, 20 bp, Artificial
  CRISPR gRNA sequence
caattttctgggcaacatgg

SEQ ID NO: 439715 - DNA, 20 bp, Artificial
  CRISPR gRNA sequence
aaaaaaaaaaaaaaaaaaaa

SEQ ID NO: 439716 - DNA, 20 bp, Artificial
  CRISPR gRNA sequence
gtggctcacgcctgtaatcc

SEQ ID NO: 439717 - DNA, 20 bp, Artificial
  CRISPR gRNA sequence
actccagcgtccatctccaa

SEQ ID NO: 439718 - DNA, 20 bp, Artificial
  CRISPR gRNA sequence
tgctaagtaccatgatggag

SEQ ID NO: 439719 - DNA, 20 bp, Artificial
  CRISPR gRNA sequence
taatgatgataaaatgtatg

SEQ ID NO: 439720 - DNA, 20 bp, Artificial
  CRISPR gRNA sequence
tatcagagggagagagaaac

SEQ ID NO: 439721 - DNA, 20 bp, Artificial
  CRISPR gRNA sequence
acacaaacaggatttaagca

SEQ ID NO: 439722 - DNA, 20 bp, Artificial
  CRISPR gRNA sequence
ccccgtctctactaaaaata

SEQ ID NO: 439723 - DNA, 20 bp, Artificial
  CRISPR gRNA sequence
taatcctgtagagttatcag

SEQ ID NO: 439724 - DNA, 20 bp, Artificial
  CRISPR gRNA sequence
ttctctctttttctctcttt

SEQ ID NO: 439725 - DNA, 20 bp, Artificial
  CRISPR gRNA sequence
tccagcctgggcgacaagag

SEQ ID NO: 439726 - DNA, 20 bp, Artificial
  CRISPR gRNA sequence
atattgagaccccatttata

SEQ ID NO: 439727 - DNA, 20 bp, Artificial
  CRISPR gRNA sequence
catataattataagcatttt

SEQ ID NO: 439728 - DNA, 20 bp, Artificial
  CRISPR gRNA sequence
tttatttatagttaaataca

SEQ ID NO: 439729 - DNA, 20 bp, Artificial
  CRISPR gRNA sequence
tctgtctaaaaaaaaaaaaa

SEQ ID NO: 439730 - DNA, 20 bp, Artificial
  CRISPR gRNA sequence
aagtacattgccagcttttg

SEQ ID NO: 439731 - DNA, 20 bp, Artificial
  CRISPR gRNA sequence
cagaaaaaaatttaaaatat

SEQ ID NO: 439732 - DNA, 20 bp, Artificial
  CRISPR gRNA sequence
atttttcttgataaaaatgg

SEQ ID NO: 439733 - DNA, 20 bp, Artificial
  CRISPR gRNA sequence
aatggtaaaactaacttttt

SEQ ID NO: 439734 - DNA, 20 bp, Artificial
  CRISPR gRNA sequence
gagggaaggaactaacaaac

SEQ ID NO: 439735 - DNA, 20 bp, Artificial
  CRISPR gRNA sequence
aaaaaaaaaaaaaaggaaag

SEQ ID NO: 439736 - DNA, 20 bp, Artificial
  CRISPR gRNA sequence
agactgaaactttggagagc

SEQ ID NO: 439737 - DNA, 20 bp, Artificial
  CRISPR gRNA sequence
cctggcatctatagttgttt

SEQ ID NO: 439738 - DNA, 20 bp, Artificial
  CRISPR gRNA sequence
ccaggcacacccatgagttt

SEQ ID NO: 439739 - DNA, 20 bp, Artificial
  CRISPR gRNA sequence
gtgaggttactccatttcag

SEQ ID NO: 439740 - DNA, 20 bp, Artificial
  CRISPR gRNA sequence
gaatcactgggaagccttgc

SEQ ID NO: 439741 - DNA, 20 bp, Artificial
  CRISPR gRNA sequence
ccccccccccttttttatgt

SEQ ID NO: 439742 - DNA, 20 bp, Artificial
  CRISPR gRNA sequence
caaagttaattccattaaaa

SEQ ID NO: 439743 - DNA, 20 bp, Artificial
  CRISPR gRNA sequence
tatatatattttatatatga

SEQ ID NO: 439744 - DNA, 20 bp, Artificial
  CRISPR gRNA sequence
tcatatgactcaactacagt

SEQ ID NO: 439745 - DNA, 20 bp, Artificial
  CRISPR gRNA sequence
gaccagcctgaccaacatgg

SEQ ID NO: 439746 - DNA, 20 bp, Artificial
  CRISPR gRNA sequence
ccctgtctctactaaaaatt

SEQ ID NO: 439747 - DNA, 20 bp, Artificial
  CRISPR gRNA sequence
cacagtcaaagggaagatgt

SEQ ID NO: 439748 - DNA, 20 bp, Artificial
  CRISPR gRNA sequence
gaagcaatacttcagtggaa

SEQ ID NO: 439749 - DNA, 20 bp, Artificial
  CRISPR gRNA sequence
acccagtccatttggagagt

SEQ ID NO: 439750 - DNA, 20 bp, Artificial
  CRISPR gRNA sequence
gatacaaacagtgagtctga

SEQ ID NO: 439751 - DNA, 20 bp, Artificial
  CRISPR gRNA sequence
ttactgtagttgagtcatat

SEQ ID NO: 439752 - DNA, 20 bp, Artificial
  CRISPR gRNA sequence
cttttcacaactttaaacct

SEQ ID NO: 439753 - DNA, 20 bp, Artificial
  CRISPR gRNA sequence
ttaacaccttctctctgttt

SEQ ID NO: 439754 - DNA, 20 bp, Artificial
  CRISPR gRNA sequence
gaccagcctggccaacatag

SEQ ID NO: 439755 - DNA, 20 bp, Artificial
  CRISPR gRNA sequence
aaagaaaagaaaagaaaagc

SEQ ID NO: 439756 - DNA, 20 bp, Artificial
  CRISPR gRNA sequence
atctcttaaaaagcagaaga

SEQ ID NO: 439757 - DNA, 20 bp, Artificial
  CRISPR gRNA sequence
gaagaaaaaaccccactacc

SEQ ID NO: 439758 - DNA, 20 bp, Artificial
  CRISPR gRNA sequence
gcatcccaaatctgaaaatc

SEQ ID NO: 439759 - DNA, 20 bp, Artificial
  CRISPR gRNA sequence
atctgaaatgctctaaaatc

SEQ ID NO: 439760 - DNA, 20 bp, Artificial
  CRISPR gRNA sequence
atactaaaaaataaaaaaat

SEQ ID NO: 439761 - DNA, 20 bp, Artificial
  CRISPR gRNA sequence
tccagcctgggcaacaagag

SEQ ID NO: 439762 - DNA, 20 bp, Artificial
  CRISPR gRNA sequence
aaaaaaaaaaattcaaaatc

SEQ ID NO: 439763 - DNA, 20 bp, Artificial
  CRISPR gRNA sequence
aatgtgggaaaaaaagatga

SEQ ID NO: 439764 - DNA, 20 bp, Artificial
  CRISPR gRNA sequence
gctttaaataagaaaatgtc

SEQ ID NO: 439765 - DNA, 20 bp, Artificial
  CRISPR gRNA sequence
gaccagcctgggcaacatgg

SEQ ID NO: 439766 - DNA, 20 bp, Artificial
  CRISPR gRNA sequence
caccactgtcctgaagcctg

SEQ ID NO: 439767 - DNA, 20 bp, Artificial
  CRISPR gRNA sequence
tcccttctcatgagtaaatg

SEQ ID NO: 439768 - DNA, 20 bp, Artificial
  CRISPR gRNA sequence
acagagtgagactgtctcaa

SEQ ID NO: 439769 - DNA, 20 bp, Artificial
  CRISPR gRNA sequence
actcattagggtcctgtgaa

SEQ ID NO: 439770 - DNA, 20 bp, Artificial
  CRISPR gRNA sequence
tggcagaagtctctatttca

SEQ ID NO: 439771 - DNA, 20 bp, Artificial
  CRISPR gRNA sequence
aggcatcattaagatttttt

SEQ ID NO: 439772 - DNA, 20 bp, Artificial
  CRISPR gRNA sequence
ttttaaaaacttagataaaa

SEQ ID NO: 439773 - DNA, 20 bp, Artificial
  CRISPR gRNA sequence
ctggcatatagtaagagctt

SEQ ID NO: 439774 - DNA, 20 bp, Artificial
  CRISPR gRNA sequence
ctaccttctcagaataaaag

SEQ ID NO: 439775 - DNA, 20 bp, Artificial
  CRISPR gRNA sequence
gcgaaattccctcataaaag

SEQ ID NO: 439776 - DNA, 20 bp, Artificial
  CRISPR gRNA sequence
acactaaatgtaaactactc

SEQ ID NO: 439777 - DNA, 20 bp, Artificial
  CRISPR gRNA sequence
attcttcagtgagaaccagt

SEQ ID NO: 439778 - DNA, 20 bp, Artificial
  CRISPR gRNA sequence
tgttacgaaacacaacaaca

SEQ ID NO: 439779 - DNA, 20 bp, Artificial
  CRISPR gRNA sequence
ttttaaactagcaaacaaac

SEQ ID NO: 439780 - DNA, 20 bp, Artificial
  CRISPR gRNA sequence
tagcaaacaaacaaaaacaa

SEQ ID NO: 439781 - DNA, 20 bp, Artificial
  CRISPR gRNA sequence
ctaaatacttccagtacccc

SEQ ID NO: 439782 - DNA, 20 bp, Artificial
  CRISPR gRNA sequence
atatatgggacttctagggc

SEQ ID NO: 439783 - DNA, 20 bp, Artificial
  CRISPR gRNA sequence
taaaactggaacagtccaag

SEQ ID NO: 439784 - DNA, 20 bp, Artificial
  CRISPR gRNA sequence
tagcctcacttgagtatttc

SEQ ID NO: 439785 - DNA, 20 bp, Artificial
  CRISPR gRNA sequence
acttctgccatggctcaaag

SEQ ID NO: 439786 - DNA, 20 bp, Artificial
  CRISPR gRNA sequence
acacatatatgccactccaa

SEQ ID NO: 439787 - DNA, 20 bp, Artificial
  CRISPR gRNA sequence
tttttaagtcatgacctcac

SEQ ID NO: 439788 - DNA, 20 bp, Artificial
  CRISPR gRNA sequence
atccatacctcactgctgct

SEQ ID NO: 439789 - DNA, 20 bp, Artificial
  CRISPR gRNA sequence
agggagaccctgtctcagag

SEQ ID NO: 439790 - DNA, 20 bp, Artificial
  CRISPR gRNA sequence
tcctccttcgaatccaatat

SEQ ID NO: 439791 - DNA, 20 bp, Artificial
  CRISPR gRNA sequence
tgagccactgcatccagccc

SEQ ID NO: 439792 - DNA, 20 bp, Artificial
  CRISPR gRNA sequence
ttcagcgggtaaaagaaacc

SEQ ID NO: 439793 - DNA, 20 bp, Artificial
  CRISPR gRNA sequence
gagaaagacccagcatcaaa

SEQ ID NO: 439794 - DNA, 20 bp, Artificial
  CRISPR gRNA sequence
agacccagcatcaaacaaaa

SEQ ID NO: 439795 - DNA, 20 bp, Artificial
  CRISPR gRNA sequence
agcatcaaacaaaacaaaac

SEQ ID NO: 439796 - DNA, 20 bp, Artificial
  CRISPR gRNA sequence
cagagggaattcgctcagaa

SEQ ID NO: 439797 - DNA, 20 bp, Artificial
  CRISPR gRNA sequence
gaaacttcagataaactagg

SEQ ID NO: 439798 - DNA, 20 bp, Artificial
  CRISPR gRNA sequence
tgtggcaggagctcccaggg

SEQ ID NO: 439799 - DNA, 20 bp, Artificial
  CRISPR gRNA sequence
cgcaacctactcatctgaca

SEQ ID NO: 439800 - DNA, 20 bp, Artificial
  CRISPR gRNA sequence
gcaacctactcatctgacaa

SEQ ID NO: 439801 - DNA, 20 bp, Artificial
  CRISPR gRNA sequence
ctcatctgacaaagggctaa

SEQ ID NO: 439802 - DNA, 20 bp, Artificial
  CRISPR gRNA sequence
atctgacaaagggctaatat

SEQ ID NO: 439803 - DNA, 20 bp, Artificial
  CRISPR gRNA sequence
acaaagggctaatatccaga

SEQ ID NO: 439804 - DNA, 20 bp, Artificial
  CRISPR gRNA sequence
atatccagaatctacaatga

SEQ ID NO: 439805 - DNA, 20 bp, Artificial
  CRISPR gRNA sequence
caatgaactcagacagagcg

SEQ ID NO: 439806 - DNA, 20 bp, Artificial
  CRISPR gRNA sequence
agacagagcgagattctatc

SEQ ID NO: 439807 - DNA, 20 bp, Artificial
  CRISPR gRNA sequence
tatctcaaaaaacaaacaaa

SEQ ID NO: 439808 - DNA, 20 bp, Artificial
  CRISPR gRNA sequence
tctcaaaaaacaaacaaaca

SEQ ID NO: 439809 - DNA, 20 bp, Artificial
  CRISPR gRNA sequence
aaaaaacaaacaaacaaaca

SEQ ID NO: 439810 - DNA, 20 bp, Artificial
  CRISPR gRNA sequence
ttagtaagttccaattgtgt

SEQ ID NO: 439811 - DNA, 20 bp, Artificial
  CRISPR gRNA sequence
tagtaagttccaattgtgtg

SEQ ID NO: 439812 - DNA, 20 bp, Artificial
  CRISPR gRNA sequence
agtaagttccaattgtgtgt

SEQ ID NO: 439813 - DNA, 20 bp, Artificial
  CRISPR gRNA sequence
gtaagttccaattgtgtgtc

SEQ ID NO: 439814 - DNA, 20 bp, Artificial
  CRISPR gRNA sequence
caattgtgtgtcagaattgt

SEQ ID NO: 439815 - DNA, 20 bp, Artificial
  CRISPR gRNA sequence
tgtgtcagaattgtgctagg

SEQ ID NO: 439816 - DNA, 20 bp, Artificial
  CRISPR gRNA sequence
tgctaggcgcagggggcaac

SEQ ID NO: 439817 - DNA, 20 bp, Artificial
  CRISPR gRNA sequence
ggcgcagggggcaacaataa

SEQ ID NO: 439818 - DNA, 20 bp, Artificial
  CRISPR gRNA sequence
taccgtcttgaaatttaagt

SEQ ID NO: 439819 - DNA, 20 bp, Artificial
  CRISPR gRNA sequence
gaaatttaagtttagggacc

SEQ ID NO: 439820 - DNA, 20 bp, Artificial
  CRISPR gRNA sequence
aaatttaagtttagggacca

SEQ ID NO: 439821 - DNA, 20 bp, Artificial
  CRISPR gRNA sequence
aagtttagggaccactctct

SEQ ID NO: 439822 - DNA, 20 bp, Artificial
  CRISPR gRNA sequence
agtttagggaccactctctg

SEQ ID NO: 439823 - DNA, 20 bp, Artificial
  CRISPR gRNA sequence
agggaccactctctgtcaaa

SEQ ID NO: 439824 - DNA, 20 bp, Artificial
  CRISPR gRNA sequence
gggaccactctctgtcaaag

SEQ ID NO: 439825 - DNA, 20 bp, Artificial
  CRISPR gRNA sequence
tctgtcaaaggatccagcgc

SEQ ID NO: 439826 - DNA, 20 bp, Artificial
  CRISPR gRNA sequence
tgtcaaaggatccagcgctg

SEQ ID NO: 439827 - DNA, 20 bp, Artificial
  CRISPR gRNA sequence
tcaaaggatccagcgctggt

SEQ ID NO: 439828 - DNA, 20 bp, Artificial
  CRISPR gRNA sequence
gtaatatagattgctgaagg

SEQ ID NO: 439829 - DNA, 20 bp, Artificial
  CRISPR gRNA sequence
ctgaaggcctttgccttctt

SEQ ID NO: 439830 - DNA, 20 bp, Artificial
  CRISPR gRNA sequence
aaggcctttgccttctttcc

SEQ ID NO: 439831 - DNA, 20 bp, Artificial
  CRISPR gRNA sequence
tgccttctttccaccaggca

SEQ ID NO: 439832 - DNA, 20 bp, Artificial
  CRISPR gRNA sequence
gccttctttccaccaggcaa

SEQ ID NO: 439833 - DNA, 20 bp, Artificial
  CRISPR gRNA sequence
ccttctttccaccaggcaac

SEQ ID NO: 439834 - DNA, 20 bp, Artificial
  CRISPR gRNA sequence
ctttccaccaggcaacagaa

SEQ ID NO: 439835 - DNA, 20 bp, Artificial
  CRISPR gRNA sequence
tttccaccaggcaacagaat

SEQ ID NO: 439836 - DNA, 20 bp, Artificial
  CRISPR gRNA sequence
tccaccaggcaacagaattt

SEQ ID NO: 439837 - DNA, 20 bp, Artificial
  CRISPR gRNA sequence
ccaccaggcaacagaatttg

SEQ ID NO: 439838 - DNA, 20 bp, Artificial
  CRISPR gRNA sequence
caccaggcaacagaatttgt

SEQ ID NO: 439839 - DNA, 20 bp, Artificial
  CRISPR gRNA sequence
gtgtccccgtcactgcttct

SEQ ID NO: 439840 - DNA, 20 bp, Artificial
  CRISPR gRNA sequence
tgtccccgtcactgcttctt

SEQ ID NO: 439841 - DNA, 20 bp, Artificial
  CRISPR gRNA sequence
cttcttcttctgtgaaaaat

SEQ ID NO: 439842 - DNA, 20 bp, Artificial
  CRISPR gRNA sequence
cttcttctgtgaaaaatata

SEQ ID NO: 439843 - DNA, 20 bp, Artificial
  CRISPR gRNA sequence
ttcttctgtgaaaaatatag

SEQ ID NO: 439844 - DNA, 20 bp, Artificial
  CRISPR gRNA sequence
cttctgtgaaaaatatagct

SEQ ID NO: 439845 - DNA, 20 bp, Artificial
  CRISPR gRNA sequence
ttctgtgaaaaatatagctt

SEQ ID NO: 439846 - DNA, 20 bp, Artificial
  CRISPR gRNA sequence
ctgtgaaaaatatagcttca

SEQ ID NO: 439847 - DNA, 20 bp, Artificial
  CRISPR gRNA sequence
tgtgaaaaatatagcttcag

SEQ ID NO: 439848 - DNA, 20 bp, Artificial
  CRISPR gRNA sequence
tgaaaaatatagcttcagtt

SEQ ID NO: 439849 - DNA, 20 bp, Artificial
  CRISPR gRNA sequence
cagtttggtccacgaataca

SEQ ID NO: 439850 - DNA, 20 bp, Artificial
  CRISPR gRNA sequence
agtttggtccacgaatacag

SEQ ID NO: 439851 - DNA, 20 bp, Artificial
  CRISPR gRNA sequence
ggtccacgaatacagaagtt

SEQ ID NO: 439852 - DNA, 20 bp, Artificial
  CRISPR gRNA sequence
gtccacgaatacagaagttg

SEQ ID NO: 439853 - DNA, 20 bp, Artificial
  CRISPR gRNA sequence
gtcagagatattttctttca

SEQ ID NO: 439854 - DNA, 20 bp, Artificial
  CRISPR gRNA sequence
tctttcaagcacacaacaag

SEQ ID NO: 439855 - DNA, 20 bp, Artificial
  CRISPR gRNA sequence
ctttcaagcacacaacaagc

SEQ ID NO: 439856 - DNA, 20 bp, Artificial
  CRISPR gRNA sequence
tttcaagcacacaacaagca

SEQ ID NO: 439857 - DNA, 20 bp, Artificial
  CRISPR gRNA sequence
tcaagcacacaacaagcaaa

SEQ ID NO: 439858 - DNA, 20 bp, Artificial
  CRISPR gRNA sequence
caagcacacaacaagcaaaa

SEQ ID NO: 439859 - DNA, 20 bp, Artificial
  CRISPR gRNA sequence
aagcacacaacaagcaaaac

SEQ ID NO: 439860 - DNA, 20 bp, Artificial
  CRISPR gRNA sequence
ggccaatacacaccaatcaa

SEQ ID NO: 439861 - DNA, 20 bp, Artificial
  CRISPR gRNA sequence
gccaatacacaccaatcaaa

SEQ ID NO: 439862 - DNA, 20 bp, Artificial
  CRISPR gRNA sequence
cgtttttccctgggagctcc

SEQ ID NO: 439863 - DNA, 20 bp, Artificial
  CRISPR gRNA sequence
gtttttccctgggagctcct

SEQ ID NO: 439864 - DNA, 20 bp, Artificial
  CRISPR gRNA sequence
ttccctgggagctcctgcca

SEQ ID NO: 439865 - DNA, 20 bp, Artificial
  CRISPR gRNA sequence
tccctgggagctcctgccac

SEQ ID NO: 439866 - DNA, 20 bp, Artificial
  CRISPR gRNA sequence
ccctgggagctcctgccaca

SEQ ID NO: 439867 - DNA, 20 bp, Artificial
  CRISPR gRNA sequence
cctgggagctcctgccacat

SEQ ID NO: 439868 - DNA, 20 bp, Artificial
  CRISPR gRNA sequence
ggagctcctgccacatctca

SEQ ID NO: 439869 - DNA, 20 bp, Artificial
  CRISPR gRNA sequence
ctgccacatctcagccctgc

SEQ ID NO: 439870 - DNA, 20 bp, Artificial
  CRISPR gRNA sequence
ccacatctcagccctgcagg

SEQ ID NO: 439871 - DNA, 20 bp, Artificial
  CRISPR gRNA sequence
agccctgcagggcagtcttc

SEQ ID NO: 439872 - DNA, 20 bp, Artificial
  CRISPR gRNA sequence
cagggcagtcttcataaggg

SEQ ID NO: 439873 - DNA, 20 bp, Artificial
  CRISPR gRNA sequence
cataagggagacaaaagaag

SEQ ID NO: 439874 - DNA, 20 bp, Artificial
  CRISPR gRNA sequence
ataagggagacaaaagaagg

SEQ ID NO: 439875 - DNA, 20 bp, Artificial
  CRISPR gRNA sequence
tgcactggcactgacagttg

SEQ ID NO: 439876 - DNA, 20 bp, Artificial
  CRISPR gRNA sequence
gcactgacagttgggcaggc

SEQ ID NO: 439877 - DNA, 20 bp, Artificial
  CRISPR gRNA sequence
acagttgggcaggcagtgct

SEQ ID NO: 439878 - DNA, 20 bp, Artificial
  CRISPR gRNA sequence
ggcaggcagtgctcaaataa

SEQ ID NO: 439879 - DNA, 20 bp, Artificial
  CRISPR gRNA sequence
aaataagcctaaatctcaac

SEQ ID NO: 439880 - DNA, 20 bp, Artificial
  CRISPR gRNA sequence
aatctcaacattccaaggga

SEQ ID NO: 439881 - DNA, 20 bp, Artificial
  CRISPR gRNA sequence
aacattccaagggaatcttc

SEQ ID NO: 439882 - DNA, 20 bp, Artificial
  CRISPR gRNA sequence
caagggaatcttcaagatca

SEQ ID NO: 439883 - DNA, 20 bp, Artificial
  CRISPR gRNA sequence
caagatcaaggtagacctgg

SEQ ID NO: 439884 - DNA, 20 bp, Artificial
  CRISPR gRNA sequence
aagatcaaggtagacctggt

SEQ ID NO: 439885 - DNA, 20 bp, Artificial
  CRISPR gRNA sequence
gtccagtcatctcttaatct

SEQ ID NO: 439886 - DNA, 20 bp, Artificial
  CRISPR gRNA sequence
ttaatcttttaaggatcact

SEQ ID NO: 439887 - DNA, 20 bp, Artificial
  CRISPR gRNA sequence
aatcttttaaggatcactgg

SEQ ID NO: 439888 - DNA, 20 bp, Artificial
  CRISPR gRNA sequence
atcttttaaggatcactggc

SEQ ID NO: 439889 - DNA, 20 bp, Artificial
  CRISPR gRNA sequence
ttaaggatcactggctggat

SEQ ID NO: 439890 - DNA, 20 bp, Artificial
  CRISPR gRNA sequence
taaggatcactggctggatg

SEQ ID NO: 439891 - DNA, 20 bp, Artificial
  CRISPR gRNA sequence
aaggatcactggctggatgt

SEQ ID NO: 439892 - DNA, 20 bp, Artificial
  CRISPR gRNA sequence
aggatcactggctggatgtg

SEQ ID NO: 439893 - DNA, 20 bp, Artificial
  CRISPR gRNA sequence
gctggatgtggtggctcacg

SEQ ID NO: 439894 - DNA, 20 bp, Artificial
  CRISPR gRNA sequence
gatgtggtggctcacgcctg

SEQ ID NO: 439895 - DNA, 20 bp, Artificial
  CRISPR gRNA sequence
acgcctgtaatcccagtgct

SEQ ID NO: 439896 - DNA, 20 bp, Artificial
  CRISPR gRNA sequence
taatcccagtgctttgggag

SEQ ID NO: 439897 - DNA, 20 bp, Artificial
  CRISPR gRNA sequence
tgggaggccgaggcaggcaa

SEQ ID NO: 439898 - DNA, 20 bp, Artificial
  CRISPR gRNA sequence
gggaggccgaggcaggcaaa

SEQ ID NO: 439899 - DNA, 20 bp, Artificial
  CRISPR gRNA sequence
ggaggccgaggcaggcaaat

SEQ ID NO: 439900 - DNA, 20 bp, Artificial
  CRISPR gRNA sequence
gagaccacactggccaacat

SEQ ID NO: 439901 - DNA, 20 bp, Artificial
  CRISPR gRNA sequence
agaccacactggccaacatg

SEQ ID NO: 439902 - DNA, 20 bp, Artificial
  CRISPR gRNA sequence
gccaacatggtgaaaccctg

SEQ ID NO: 439903 - DNA, 20 bp, Artificial
  CRISPR gRNA sequence
tctctactaaaaatacaaca

SEQ ID NO: 439904 - DNA, 20 bp, Artificial
  CRISPR gRNA sequence
tactaaaaatacaacaaatt

SEQ ID NO: 439905 - DNA, 20 bp, Artificial
  CRISPR gRNA sequence
ctaaaaatacaacaaattag

SEQ ID NO: 439906 - DNA, 20 bp, Artificial
  CRISPR gRNA sequence
aaaatacaacaaattagctg

SEQ ID NO: 439907 - DNA, 20 bp, Artificial
  CRISPR gRNA sequence
gctgggcatggtggtgcatg

SEQ ID NO: 439908 - DNA, 20 bp, Artificial
  CRISPR gRNA sequence
ggcatggtggtgcatgcctg

SEQ ID NO: 439909 - DNA, 20 bp, Artificial
  CRISPR gRNA sequence
taatcccagccactcaggag

SEQ ID NO: 439910 - DNA, 20 bp, Artificial
  CRISPR gRNA sequence
aggaggctgaggcaggagaa

SEQ ID NO: 439911 - DNA, 20 bp, Artificial
  CRISPR gRNA sequence
aggcaggagaatcgcttgaa

SEQ ID NO: 439912 - DNA, 20 bp, Artificial
  CRISPR gRNA sequence
gaacccaggaggcggagctt

SEQ ID NO: 439913 - DNA, 20 bp, Artificial
  CRISPR gRNA sequence
aacccaggaggcggagcttg

SEQ ID NO: 439914 - DNA, 20 bp, Artificial
  CRISPR gRNA sequence
gcagtgagccgagattgtgc

SEQ ID NO: 439915 - DNA, 20 bp, Artificial
  CRISPR gRNA sequence
cagtgagccgagattgtgcc

SEQ ID NO: 439916 - DNA, 20 bp, Artificial
  CRISPR gRNA sequence
tgccattgcactccagcctg

SEQ ID NO: 439917 - DNA, 20 bp, Artificial
  CRISPR gRNA sequence
cactccagcctgggcaacag

SEQ ID NO: 439918 - DNA, 20 bp, Artificial
  CRISPR gRNA sequence
cagcctgggcaacagagcaa

SEQ ID NO: 439919 - DNA, 20 bp, Artificial
  CRISPR gRNA sequence
ggcaacagagcaagactcca

SEQ ID NO: 439920 - DNA, 20 bp, Artificial
  CRISPR gRNA sequence
catctcaaaaacaaaaaaca

SEQ ID NO: 439921 - DNA, 20 bp, Artificial
  CRISPR gRNA sequence
aaaaacaaaaaacaaaaagg

SEQ ID NO: 439922 - DNA, 20 bp, Artificial
  CRISPR gRNA sequence
tttgaaaatcagtggcccct

SEQ ID NO: 439923 - DNA, 20 bp, Artificial
  CRISPR gRNA sequence
tgaaaatcagtggccccttt

SEQ ID NO: 439924 - DNA, 20 bp, Artificial
  CRISPR gRNA sequence
gaaaatcagtggccccttta

SEQ ID NO: 439925 - DNA, 20 bp, Artificial
  CRISPR gRNA sequence
aaaatcagtggcccctttag

SEQ ID NO: 439926 - DNA, 20 bp, Artificial
  CRISPR gRNA sequence
tagactttctgtgccaaaaa

SEQ ID NO: 439927 - DNA, 20 bp, Artificial
  CRISPR gRNA sequence
agactttctgtgccaaaaaa

SEQ ID NO: 439928 - DNA, 20 bp, Artificial
  CRISPR gRNA sequence
gactttctgtgccaaaaaag

SEQ ID NO: 439929 - DNA, 20 bp, Artificial
  CRISPR gRNA sequence
tctgtgccaaaaaagttatg

SEQ ID NO: 439930 - DNA, 20 bp, Artificial
  CRISPR gRNA sequence
ctgtgccaaaaaagttatgc

SEQ ID NO: 439931 - DNA, 20 bp, Artificial
  CRISPR gRNA sequence
tgtgccaaaaaagttatgct

SEQ ID NO: 439932 - DNA, 20 bp, Artificial
  CRISPR gRNA sequence
tgccaaaaaagttatgcttt

SEQ ID NO: 439933 - DNA, 20 bp, Artificial
  CRISPR gRNA sequence
tgctttcacctcagcaccca

SEQ ID NO: 439934 - DNA, 20 bp, Artificial
  CRISPR gRNA sequence
tcacctcagcacccagtttt

SEQ ID NO: 439935 - DNA, 20 bp, Artificial
  CRISPR gRNA sequence
cacctcagcacccagttttc

SEQ ID NO: 439936 - DNA, 20 bp, Artificial
  CRISPR gRNA sequence
acctcagcacccagttttcc

SEQ ID NO: 439937 - DNA, 20 bp, Artificial
  CRISPR gRNA sequence
agcacccagttttccctagt

SEQ ID NO: 439938 - DNA, 20 bp, Artificial
  CRISPR gRNA sequence
tccctagtttatctgaagtt

SEQ ID NO: 439939 - DNA, 20 bp, Artificial
  CRISPR gRNA sequence
ccctagtttatctgaagttt

SEQ ID NO: 439940 - DNA, 20 bp, Artificial
  CRISPR gRNA sequence
cctagtttatctgaagtttc

SEQ ID NO: 439941 - DNA, 20 bp, Artificial
  CRISPR gRNA sequence
gtttatctgaagtttcatgg

SEQ ID NO: 439942 - DNA, 20 bp, Artificial
  CRISPR gRNA sequence
atctgaagtttcatggacat

SEQ ID NO: 439943 - DNA, 20 bp, Artificial
  CRISPR gRNA sequence
tctgaagtttcatggacata

SEQ ID NO: 439944 - DNA, 20 bp, Artificial
  CRISPR gRNA sequence
aagtttcatggacatatgat

SEQ ID NO: 439945 - DNA, 20 bp, Artificial
  CRISPR gRNA sequence
catggacatatgatgtgccc

SEQ ID NO: 439946 - DNA, 20 bp, Artificial
  CRISPR gRNA sequence
atggacatatgatgtgcccg

SEQ ID NO: 439947 - DNA, 20 bp, Artificial
  CRISPR gRNA sequence
cctggagctccagagacccc

SEQ ID NO: 439948 - DNA, 20 bp, Artificial
  CRISPR gRNA sequence
ctggagctccagagacccca

SEQ ID NO: 439949 - DNA, 20 bp, Artificial
  CRISPR gRNA sequence
gagctccagagaccccacgt

SEQ ID NO: 439950 - DNA, 20 bp, Artificial
  CRISPR gRNA sequence
cagagaccccacgtcaagaa

SEQ ID NO: 439951 - DNA, 20 bp, Artificial
  CRISPR gRNA sequence
ctagtgtatataaaagcccg

SEQ ID NO: 439952 - DNA, 20 bp, Artificial
  CRISPR gRNA sequence
gtgtatataaaagcccgttt

SEQ ID NO: 439953 - DNA, 20 bp, Artificial
  CRISPR gRNA sequence
gagctctaacatccatgatt

SEQ ID NO: 439954 - DNA, 20 bp, Artificial
  CRISPR gRNA sequence
agctctaacatccatgatta

SEQ ID NO: 439955 - DNA, 20 bp, Artificial
  CRISPR gRNA sequence
taacatccatgattaacagt

SEQ ID NO: 439956 - DNA, 20 bp, Artificial
  CRISPR gRNA sequence
acatccatgattaacagtct

SEQ ID NO: 439957 - DNA, 20 bp, Artificial
  CRISPR gRNA sequence
acagtctctgggttgggtaa

SEQ ID NO: 439958 - DNA, 20 bp, Artificial
  CRISPR gRNA sequence
tgggttgggtaactctgttg

SEQ ID NO: 439959 - DNA, 20 bp, Artificial
  CRISPR gRNA sequence
ggttgggtaactctgttggc

SEQ ID NO: 439960 - DNA, 20 bp, Artificial
  CRISPR gRNA sequence
ggtaactctgttggcttaaa

SEQ ID NO: 439961 - DNA, 20 bp, Artificial
  CRISPR gRNA sequence
tgttggcttaaatacagagg

SEQ ID NO: 439962 - DNA, 20 bp, Artificial
  CRISPR gRNA sequence
ttggcttaaatacagaggca

SEQ ID NO: 439963 - DNA, 20 bp, Artificial
  CRISPR gRNA sequence
gcttaaatacagaggcaatg

SEQ ID NO: 439964 - DNA, 20 bp, Artificial
  CRISPR gRNA sequence
aaatacagaggcaatgacat

SEQ ID NO: 439965 - DNA, 20 bp, Artificial
  CRISPR gRNA sequence
aatacagaggcaatgacatg

SEQ ID NO: 439966 - DNA, 20 bp, Artificial
  CRISPR gRNA sequence
tttaagttcagtgcaggtcc

SEQ ID NO: 439967 - DNA, 20 bp, Artificial
  CRISPR gRNA sequence
aagttcagtgcaggtcccag

SEQ ID NO: 439968 - DNA, 20 bp, Artificial
  CRISPR gRNA sequence
agttcagtgcaggtcccagt

SEQ ID NO: 439969 - DNA, 20 bp, Artificial
  CRISPR gRNA sequence
agtgcaggtcccagttcaat

SEQ ID NO: 439970 - DNA, 20 bp, Artificial
  CRISPR gRNA sequence
aattcccatgtgagtcatta

SEQ ID NO: 439971 - DNA, 20 bp, Artificial
  CRISPR gRNA sequence
ccatgtgagtcattatcttc

SEQ ID NO: 439972 - DNA, 20 bp, Artificial
  CRISPR gRNA sequence
tcttctgaaaatgggaaaac

SEQ ID NO: 439973 - DNA, 20 bp, Artificial
  CRISPR gRNA sequence
ctgaaaatgggaaaactctg

SEQ ID NO: 439974 - DNA, 20 bp, Artificial
  CRISPR gRNA sequence
tgaaaatgggaaaactctgc

SEQ ID NO: 439975 - DNA, 20 bp, Artificial
  CRISPR gRNA sequence
aaaatgggaaaactctgctc

SEQ ID NO: 439976 - DNA, 20 bp, Artificial
  CRISPR gRNA sequence
tgctccatagcagtggacag

SEQ ID NO: 439977 - DNA, 20 bp, Artificial
  CRISPR gRNA sequence
ctccatagcagtggacagaa

SEQ ID NO: 439978 - DNA, 20 bp, Artificial
  CRISPR gRNA sequence
catagcagtggacagaacct

SEQ ID NO: 439979 - DNA, 20 bp, Artificial
  CRISPR gRNA sequence
caaaaccagtcaggtgacac

SEQ ID NO: 439980 - DNA, 20 bp, Artificial
  CRISPR gRNA sequence
atagtttctgaaaaagacaa

SEQ ID NO: 439981 - DNA, 20 bp, Artificial
  CRISPR gRNA sequence
ctgaaaaagacaaaacacca

SEQ ID NO: 439982 - DNA, 20 bp, Artificial
  CRISPR gRNA sequence
tgaaaaagacaaaacaccaa

SEQ ID NO: 439983 - DNA, 20 bp, Artificial
  CRISPR gRNA sequence
aaaaagacaaaacaccaagc

SEQ ID NO: 439984 - DNA, 20 bp, Artificial
  CRISPR gRNA sequence
aaaaataaggtggttggatc

SEQ ID NO: 439985 - DNA, 20 bp, Artificial
  CRISPR gRNA sequence
gatctatggcattgcaaagc

SEQ ID NO: 439986 - DNA, 20 bp, Artificial
  CRISPR gRNA sequence
tggcattgcaaagcgacaac

SEQ ID NO: 439987 - DNA, 20 bp, Artificial
  CRISPR gRNA sequence
caaagcgacaacccaaaggt

SEQ ID NO: 439988 - DNA, 20 bp, Artificial
  CRISPR gRNA sequence
tgagggttgctgcctgctgc

SEQ ID NO: 439989 - DNA, 20 bp, Artificial
  CRISPR gRNA sequence
ctgcctgctgctgacatagc

SEQ ID NO: 439990 - DNA, 20 bp, Artificial
  CRISPR gRNA sequence
cctgctgctgacatagcaat

SEQ ID NO: 439991 - DNA, 20 bp, Artificial
  CRISPR gRNA sequence
ctgctgacatagcaataata

SEQ ID NO: 439992 - DNA, 20 bp, Artificial
  CRISPR gRNA sequence
ctgacatagcaataatactc

SEQ ID NO: 439993 - DNA, 20 bp, Artificial
  CRISPR gRNA sequence
acatagcaataatactcatt

SEQ ID NO: 439994 - DNA, 20 bp, Artificial
  CRISPR gRNA sequence
attgggctcctccacttcat

SEQ ID NO: 439995 - DNA, 20 bp, Artificial
  CRISPR gRNA sequence
ggctcctccacttcatatac

SEQ ID NO: 439996 - DNA, 20 bp, Artificial
  CRISPR gRNA sequence
ctccacttcatatacgttct

SEQ ID NO: 439997 - DNA, 20 bp, Artificial
  CRISPR gRNA sequence
cacttcatatacgttctctt

SEQ ID NO: 439998 - DNA, 20 bp, Artificial
  CRISPR gRNA sequence
catatacgttctcttcaatg

SEQ ID NO: 439999 - DNA, 20 bp, Artificial
  CRISPR gRNA sequence
atatacgttctcttcaatgg

SEQ ID NO: 440000 - DNA, 20 bp, Artificial
  CRISPR gRNA sequence
tcttcaatggtatagatgtt

SEQ ID NO: 440001 - DNA, 20 bp, Artificial
  CRISPR gRNA sequence
ttcaatggtatagatgtttt

SEQ ID NO: 440002 - DNA, 20 bp, Artificial
  CRISPR gRNA sequence
caatggtatagatgttttct

SEQ ID NO: 440003 - DNA, 20 bp, Artificial
  CRISPR gRNA sequence
aatggtatagatgttttctt

SEQ ID NO: 440004 - DNA, 20 bp, Artificial
  CRISPR gRNA sequence
tcttctgagcgaattccctc

SEQ ID NO: 440005 - DNA, 20 bp, Artificial
  CRISPR gRNA sequence
cttctgagcgaattccctct

SEQ ID NO: 440006 - DNA, 20 bp, Artificial
  CRISPR gRNA sequence
ttctgagcgaattccctctg

SEQ ID NO: 440007 - DNA, 20 bp, Artificial
  CRISPR gRNA sequence
ctgagcgaattccctctgct

SEQ ID NO: 440008 - DNA, 20 bp, Artificial
  CRISPR gRNA sequence
tgagcgaattccctctgcta

SEQ ID NO: 440009 - DNA, 20 bp, Artificial
  CRISPR gRNA sequence
agcgaattccctctgctact

SEQ ID NO: 440010 - DNA, 20 bp, Artificial
  CRISPR gRNA sequence
cctctgctactgcatttgcc

SEQ ID NO: 440011 - DNA, 20 bp, Artificial
  CRISPR gRNA sequence
tgctactgcatttgccaatc

SEQ ID NO: 440012 - DNA, 20 bp, Artificial
  CRISPR gRNA sequence
ctactgcatttgccaatcct

SEQ ID NO: 440013 - DNA, 20 bp, Artificial
  CRISPR gRNA sequence
ctgcatttgccaatcctgag

SEQ ID NO: 440014 - DNA, 20 bp, Artificial
  CRISPR gRNA sequence
catttgccaatcctgaggga

SEQ ID NO: 440015 - DNA, 20 bp, Artificial
  CRISPR gRNA sequence
gccaatcctgagggagggag

SEQ ID NO: 440016 - DNA, 20 bp, Artificial
  CRISPR gRNA sequence
ccaatcctgagggagggagg

SEQ ID NO: 440017 - DNA, 20 bp, Artificial
  CRISPR gRNA sequence
agggagggaggttggccaaa

SEQ ID NO: 440018 - DNA, 20 bp, Artificial
  CRISPR gRNA sequence
gccaaagagatgaggctgtg

SEQ ID NO: 440019 - DNA, 20 bp, Artificial
  CRISPR gRNA sequence
tggaaataaagtgttgcggt

SEQ ID NO: 440020 - DNA, 20 bp, Artificial
  CRISPR gRNA sequence
cggttgagttaagcatttcc

SEQ ID NO: 440021 - DNA, 20 bp, Artificial
  CRISPR gRNA sequence
agttaagcatttcccaggta

SEQ ID NO: 440022 - DNA, 20 bp, Artificial
  CRISPR gRNA sequence
agcatttcccaggtaacacg

SEQ ID NO: 440023 - DNA, 20 bp, Artificial
  CRISPR gRNA sequence
cccaggtaacacggaataga

SEQ ID NO: 440024 - DNA, 20 bp, Artificial
  CRISPR gRNA sequence
ccaggtaacacggaatagag

SEQ ID NO: 440025 - DNA, 20 bp, Artificial
  CRISPR gRNA sequence
agagaataggctttcccaaa

SEQ ID NO: 440026 - DNA, 20 bp, Artificial
  CRISPR gRNA sequence
tcccaaagagacagcaacta

SEQ ID NO: 440027 - DNA, 20 bp, Artificial
  CRISPR gRNA sequence
cccaaagagacagcaactaa

SEQ ID NO: 440028 - DNA, 20 bp, Artificial
  CRISPR gRNA sequence
ccaaagagacagcaactaaa

SEQ ID NO: 440029 - DNA, 20 bp, Artificial
  CRISPR gRNA sequence
aatatagtgcatgatctttg

SEQ ID NO: 440030 - DNA, 20 bp, Artificial
  CRISPR gRNA sequence
tgatcagatgctgaacaagt

SEQ ID NO: 440031 - DNA, 20 bp, Artificial
  CRISPR gRNA sequence
gatcagatgctgaacaagtg

SEQ ID NO: 440032 - DNA, 20 bp, Artificial
  CRISPR gRNA sequence
atcagatgctgaacaagtgg

SEQ ID NO: 440033 - DNA, 20 bp, Artificial
  CRISPR gRNA sequence
aacaagtggaaaagccaaga

SEQ ID NO: 440034 - DNA, 20 bp, Artificial
  CRISPR gRNA sequence
tggggaaacaattgagaaaa

SEQ ID NO: 440035 - DNA, 20 bp, Artificial
  CRISPR gRNA sequence
agaaaatgtccattaatttt

SEQ ID NO: 440036 - DNA, 20 bp, Artificial
  CRISPR gRNA sequence
attttaattttcttaggtat

SEQ ID NO: 440037 - DNA, 20 bp, Artificial
  CRISPR gRNA sequence
taattttcttaggtataaca

SEQ ID NO: 440038 - DNA, 20 bp, Artificial
  CRISPR gRNA sequence
aattttcttaggtataacaa

SEQ ID NO: 440039 - DNA, 20 bp, Artificial
  CRISPR gRNA sequence
attttcttaggtataacaac

SEQ ID NO: 440040 - DNA, 20 bp, Artificial
  CRISPR gRNA sequence
tcttaggtataacaacagca

SEQ ID NO: 440041 - DNA, 20 bp, Artificial
  CRISPR gRNA sequence
cttaggtataacaacagcat

SEQ ID NO: 440042 - DNA, 20 bp, Artificial
  CRISPR gRNA sequence
ttaggtataacaacagcatt

SEQ ID NO: 440043 - DNA, 20 bp, Artificial
  CRISPR gRNA sequence
aggtataacaacagcattgt

SEQ ID NO: 440044 - DNA, 20 bp, Artificial
  CRISPR gRNA sequence
ggtataacaacagcattgtg

SEQ ID NO: 440045 - DNA, 20 bp, Artificial
  CRISPR gRNA sequence
tgatagctaagagaatattt

SEQ ID NO: 440046 - DNA, 20 bp, Artificial
  CRISPR gRNA sequence
agagaatatttttatttctc

SEQ ID NO: 440047 - DNA, 20 bp, Artificial
  CRISPR gRNA sequence
ttatttctcggaggtgcagg

SEQ ID NO: 440048 - DNA, 20 bp, Artificial
  CRISPR gRNA sequence
tatttctcggaggtgcaggc

SEQ ID NO: 440049 - DNA, 20 bp, Artificial
  CRISPR gRNA sequence
atttctcggaggtgcaggct

SEQ ID NO: 440050 - DNA, 20 bp, Artificial
  CRISPR gRNA sequence
tttctcggaggtgcaggctg

SEQ ID NO: 440051 - DNA, 20 bp, Artificial
  CRISPR gRNA sequence
ctcggaggtgcaggctgaag

SEQ ID NO: 440052 - DNA, 20 bp, Artificial
  CRISPR gRNA sequence
tcggaggtgcaggctgaagt

SEQ ID NO: 440053 - DNA, 20 bp, Artificial
  CRISPR gRNA sequence
ggaggtgcaggctgaagttt

SEQ ID NO: 440054 - DNA, 20 bp, Artificial
  CRISPR gRNA sequence
aagtttaggtgaagtatcaa

SEQ ID NO: 440055 - DNA, 20 bp, Artificial
  CRISPR gRNA sequence
aggtgaagtatcaagatgtc

SEQ ID NO: 440056 - DNA, 20 bp, Artificial
  CRISPR gRNA sequence
ggtgaagtatcaagatgtct

SEQ ID NO: 440057 - DNA, 20 bp, Artificial
  CRISPR gRNA sequence
caattatgtacacatttaga

SEQ ID NO: 440058 - DNA, 20 bp, Artificial
  CRISPR gRNA sequence
tgtacacatttagattttca

SEQ ID NO: 440059 - DNA, 20 bp, Artificial
  CRISPR gRNA sequence
agattttcaaaaaatgggcc

SEQ ID NO: 440060 - DNA, 20 bp, Artificial
  CRISPR gRNA sequence
gattttcaaaaaatgggccg

SEQ ID NO: 440061 - DNA, 20 bp, Artificial
  CRISPR gRNA sequence
tcaaaaaatgggccgggcgc

SEQ ID NO: 440062 - DNA, 20 bp, Artificial
  CRISPR gRNA sequence
caaaaaatgggccgggcgcc

SEQ ID NO: 440063 - DNA, 20 bp, Artificial
  CRISPR gRNA sequence
aaaaaatgggccgggcgccg

SEQ ID NO: 440064 - DNA, 20 bp, Artificial
  CRISPR gRNA sequence
acgcctgtaatcccagcact

SEQ ID NO: 440065 - DNA, 20 bp, Artificial
  CRISPR gRNA sequence
taatcccagcactttgggag

SEQ ID NO: 440066 - DNA, 20 bp, Artificial
  CRISPR gRNA sequence
tgggaggctgagcctggcag

SEQ ID NO: 440067 - DNA, 20 bp, Artificial
  CRISPR gRNA sequence
gggaggctgagcctggcaga

SEQ ID NO: 440068 - DNA, 20 bp, Artificial
  CRISPR gRNA sequence
ggaggctgagcctggcagat

SEQ ID NO: 440069 - DNA, 20 bp, Artificial
  CRISPR gRNA sequence
agcctggcagatcacgaggt

SEQ ID NO: 440070 - DNA, 20 bp, Artificial
  CRISPR gRNA sequence
gcagatcacgaggtcaggag

SEQ ID NO: 440071 - DNA, 20 bp, Artificial
  CRISPR gRNA sequence
gagaccagcctggccaacat

SEQ ID NO: 440072 - DNA, 20 bp, Artificial
  CRISPR gRNA sequence
gccaacatagtgaaaccccg

SEQ ID NO: 440073 - DNA, 20 bp, Artificial
  CRISPR gRNA sequence
tactaaacatacaaaaaatt

SEQ ID NO: 440074 - DNA, 20 bp, Artificial
  CRISPR gRNA sequence
ctaaacatacaaaaaattag

SEQ ID NO: 440075 - DNA, 20 bp, Artificial
  CRISPR gRNA sequence
aacatacaaaaaattagcca

SEQ ID NO: 440076 - DNA, 20 bp, Artificial
  CRISPR gRNA sequence
gccagcgtggtggcatgcac

SEQ ID NO: 440077 - DNA, 20 bp, Artificial
  CRISPR gRNA sequence
taatcccagctacttgggag

SEQ ID NO: 440078 - DNA, 20 bp, Artificial
  CRISPR gRNA sequence
cttgggaggctaatgcagag

SEQ ID NO: 440079 - DNA, 20 bp, Artificial
  CRISPR gRNA sequence
gggaggctaatgcagagaat

SEQ ID NO: 440080 - DNA, 20 bp, Artificial
  CRISPR gRNA sequence
ggaggctaatgcagagaatc

SEQ ID NO: 440081 - DNA, 20 bp, Artificial
  CRISPR gRNA sequence
atgcagagaatcgcttgaac

SEQ ID NO: 440082 - DNA, 20 bp, Artificial
  CRISPR gRNA sequence
gaacccgagaagcagaggtt

SEQ ID NO: 440083 - DNA, 20 bp, Artificial
  CRISPR gRNA sequence
aacccgagaagcagaggtta

SEQ ID NO: 440084 - DNA, 20 bp, Artificial
  CRISPR gRNA sequence
tagtgagccgaggttgtgcc

SEQ ID NO: 440085 - DNA, 20 bp, Artificial
  CRISPR gRNA sequence
tgccactgcactccagcctg

SEQ ID NO: 440086 - DNA, 20 bp, Artificial
  CRISPR gRNA sequence
cactccagcctgggtgacag

SEQ ID NO: 440087 - DNA, 20 bp, Artificial
  CRISPR gRNA sequence
cagcctgggtgacagagcca

SEQ ID NO: 440088 - DNA, 20 bp, Artificial
  CRISPR gRNA sequence
ggtgacagagccagactccg

SEQ ID NO: 440089 - DNA, 20 bp, Artificial
  CRISPR gRNA sequence
cgtctcaaaaaaaaaaaaaa

SEQ ID NO: 440090 - DNA, 20 bp, Artificial
  CRISPR gRNA sequence
aaaaaaaaaaaaaaaaaatt

SEQ ID NO: 440091 - DNA, 20 bp, Artificial
  CRISPR gRNA sequence
ttaatgctttagatagcatt

SEQ ID NO: 440092 - DNA, 20 bp, Artificial
  CRISPR gRNA sequence
atgctttagatagcattcaa

SEQ ID NO: 440093 - DNA, 20 bp, Artificial
  CRISPR gRNA sequence
tagatagcattcaatggaca

SEQ ID NO: 440094 - DNA, 20 bp, Artificial
  CRISPR gRNA sequence
agatagcattcaatggacag

SEQ ID NO: 440095 - DNA, 20 bp, Artificial
  CRISPR gRNA sequence
gatagcattcaatggacaga

SEQ ID NO: 440096 - DNA, 20 bp, Artificial
  CRISPR gRNA sequence
aatggacagaggtttttgtt

SEQ ID NO: 440097 - DNA, 20 bp, Artificial
  CRISPR gRNA sequence
ttgttttgttttgtttgatg

SEQ ID NO: 440098 - DNA, 20 bp, Artificial
  CRISPR gRNA sequence
tgttttgttttgtttgatgc

SEQ ID NO: 440099 - DNA, 20 bp, Artificial
  CRISPR gRNA sequence
gttttgttttgtttgatgct

SEQ ID NO: 440100 - DNA, 20 bp, Artificial
  CRISPR gRNA sequence
ttttgttttgtttgatgctg

SEQ ID NO: 440101 - DNA, 20 bp, Artificial
  CRISPR gRNA sequence
tgttttgtttgatgctgggt

SEQ ID NO: 440102 - DNA, 20 bp, Artificial
  CRISPR gRNA sequence
gttttgtttgatgctgggtc

SEQ ID NO: 440103 - DNA, 20 bp, Artificial
  CRISPR gRNA sequence
ttttgtttgatgctgggtct

SEQ ID NO: 440104 - DNA, 20 bp, Artificial
  CRISPR gRNA sequence
tgtttgatgctgggtctttc

SEQ ID NO: 440105 - DNA, 20 bp, Artificial
  CRISPR gRNA sequence
gtttgatgctgggtctttct

SEQ ID NO: 440106 - DNA, 20 bp, Artificial
  CRISPR gRNA sequence
tttgatgctgggtctttctc

SEQ ID NO: 440107 - DNA, 20 bp, Artificial
  CRISPR gRNA sequence
gatgctgggtctttctctgt

SEQ ID NO: 440108 - DNA, 20 bp, Artificial
  CRISPR gRNA sequence
atgctgggtctttctctgtc

SEQ ID NO: 440109 - DNA, 20 bp, Artificial
  CRISPR gRNA sequence
ggtctttctctgtcacccag

SEQ ID NO: 440110 - DNA, 20 bp, Artificial
  CRISPR gRNA sequence
tctctgtcacccaggtggga

SEQ ID NO: 440111 - DNA, 20 bp, Artificial
  CRISPR gRNA sequence
ctctgtcacccaggtgggaa

SEQ ID NO: 440112 - DNA, 20 bp, Artificial
  CRISPR gRNA sequence
tctgtcacccaggtgggaat

SEQ ID NO: 440113 - DNA, 20 bp, Artificial
  CRISPR gRNA sequence
tgtcacccaggtgggaatgc

SEQ ID NO: 440114 - DNA, 20 bp, Artificial
  CRISPR gRNA sequence
tcacccaggtgggaatgcag

SEQ ID NO: 440115 - DNA, 20 bp, Artificial
  CRISPR gRNA sequence
attgcagccttcatctcctg

SEQ ID NO: 440116 - DNA, 20 bp, Artificial
  CRISPR gRNA sequence
cagccttcatctcctgtgct

SEQ ID NO: 440117 - DNA, 20 bp, Artificial
  CRISPR gRNA sequence
catctcctgtgctccagcaa

SEQ ID NO: 440118 - DNA, 20 bp, Artificial
  CRISPR gRNA sequence
atctcctgtgctccagcaat

SEQ ID NO: 440119 - DNA, 20 bp, Artificial
  CRISPR gRNA sequence
ctgtgctccagcaatccttc

SEQ ID NO: 440120 - DNA, 20 bp, Artificial
  CRISPR gRNA sequence
tgctccagcaatccttccac

SEQ ID NO: 440121 - DNA, 20 bp, Artificial
  CRISPR gRNA sequence
cagcaatccttccacctaat

SEQ ID NO: 440122 - DNA, 20 bp, Artificial
  CRISPR gRNA sequence
ccacctaatgtttccatttt

SEQ ID NO: 440123 - DNA, 20 bp, Artificial
  CRISPR gRNA sequence
cacctaatgtttccattttt

SEQ ID NO: 440124 - DNA, 20 bp, Artificial
  CRISPR gRNA sequence
atgtttccatttttttgtag

SEQ ID NO: 440125 - DNA, 20 bp, Artificial
  CRISPR gRNA sequence
ccatttttttgtagagaaga

SEQ ID NO: 440126 - DNA, 20 bp, Artificial
  CRISPR gRNA sequence
catttttttgtagagaagag

SEQ ID NO: 440127 - DNA, 20 bp, Artificial
  CRISPR gRNA sequence
ttttgtagagaagaggtctc

SEQ ID NO: 440128 - DNA, 20 bp, Artificial
  CRISPR gRNA sequence
tttgtagagaagaggtctca

SEQ ID NO: 440129 - DNA, 20 bp, Artificial
  CRISPR gRNA sequence
ttgtagagaagaggtctcat

SEQ ID NO: 440130 - DNA, 20 bp, Artificial
  CRISPR gRNA sequence
tgtagagaagaggtctcatc

SEQ ID NO: 440131 - DNA, 20 bp, Artificial
  CRISPR gRNA sequence
gtagagaagaggtctcatca

SEQ ID NO: 440132 - DNA, 20 bp, Artificial
  CRISPR gRNA sequence
tagagaagaggtctcatcat

SEQ ID NO: 440133 - DNA, 20 bp, Artificial
  CRISPR gRNA sequence
atcatgttgcccaggctggt

SEQ ID NO: 440134 - DNA, 20 bp, Artificial
  CRISPR gRNA sequence
cccaggctggtcttgaactc

SEQ ID NO: 440135 - DNA, 20 bp, Artificial
  CRISPR gRNA sequence
gtcttgaactcctgggctca

SEQ ID NO: 440136 - DNA, 20 bp, Artificial
  CRISPR gRNA sequence
gaactcctgggctcatgtga

SEQ ID NO: 440137 - DNA, 20 bp, Artificial
  CRISPR gRNA sequence
aactcctgggctcatgtgat

SEQ ID NO: 440138 - DNA, 20 bp, Artificial
  CRISPR gRNA sequence
ctgggctcatgtgatcctcc

SEQ ID NO: 440139 - DNA, 20 bp, Artificial
  CRISPR gRNA sequence
ggctcatgtgatcctcccac

SEQ ID NO: 440140 - DNA, 20 bp, Artificial
  CRISPR gRNA sequence
atgtgatcctcccacctcag

SEQ ID NO: 440141 - DNA, 20 bp, Artificial
  CRISPR gRNA sequence
ccacctcagcctcccaaagt

SEQ ID NO: 440142 - DNA, 20 bp, Artificial
  CRISPR gRNA sequence
agcctcccaaagtgctgggc

SEQ ID NO: 440143 - DNA, 20 bp, Artificial
  CRISPR gRNA sequence
ccaaagtgctgggcttatag

SEQ ID NO: 440144 - DNA, 20 bp, Artificial
  CRISPR gRNA sequence
ggcttataggcgtaagccac

SEQ ID NO: 440145 - DNA, 20 bp, Artificial
  CRISPR gRNA sequence
ataggcgtaagccacagcac

SEQ ID NO: 440146 - DNA, 20 bp, Artificial
  CRISPR gRNA sequence
taggcgtaagccacagcacc

SEQ ID NO: 440147 - DNA, 20 bp, Artificial
  CRISPR gRNA sequence
gcccagaatcatttttgtaa

SEQ ID NO: 440148 - DNA, 20 bp, Artificial
  CRISPR gRNA sequence
ttgtaatccaaatatattgt

SEQ ID NO: 440149 - DNA, 20 bp, Artificial
  CRISPR gRNA sequence
tgtaatccaaatatattgta

SEQ ID NO: 440150 - DNA, 20 bp, Artificial
  CRISPR gRNA sequence
gtaatccaaatatattgtat

SEQ ID NO: 440151 - DNA, 20 bp, Artificial
  CRISPR gRNA sequence
taatccaaatatattgtatt

SEQ ID NO: 440152 - DNA, 20 bp, Artificial
  CRISPR gRNA sequence
tattccattcatgtgccaaa

SEQ ID NO: 440153 - DNA, 20 bp, Artificial
  CRISPR gRNA sequence
cattcatgtgccaaacatca

SEQ ID NO: 440154 - DNA, 20 bp, Artificial
  CRISPR gRNA sequence
atgtgccaaacatcactaaa

SEQ ID NO: 440155 - DNA, 20 bp, Artificial
  CRISPR gRNA sequence
aaagtctaaaatctagtaag

SEQ ID NO: 440156 - DNA, 20 bp, Artificial
  CRISPR gRNA sequence
aaatctagtaagttatgtaa

SEQ ID NO: 440157 - DNA, 20 bp, Artificial
  CRISPR gRNA sequence
gtaagttatgtaagccatac

SEQ ID NO: 440158 - DNA, 20 bp, Artificial
  CRISPR gRNA sequence
tgtaagccatacctatttga

SEQ ID NO: 440159 - DNA, 20 bp, Artificial
  CRISPR gRNA sequence
tttgaaatggatgtgtgggt

SEQ ID NO: 440160 - DNA, 20 bp, Artificial
  CRISPR gRNA sequence
gaaatggatgtgtgggtgtg

SEQ ID NO: 440161 - DNA, 20 bp, Artificial
  CRISPR gRNA sequence
aaatggatgtgtgggtgtgt

SEQ ID NO: 440162 - DNA, 20 bp, Artificial
  CRISPR gRNA sequence
taacagactagcagttctca

SEQ ID NO: 440163 - DNA, 20 bp, Artificial
  CRISPR gRNA sequence
gcagttctcagccctgactg

SEQ ID NO: 440164 - DNA, 20 bp, Artificial
  CRISPR gRNA sequence
tcagccctgactgttcacta

SEQ ID NO: 440165 - DNA, 20 bp, Artificial
  CRISPR gRNA sequence
agccctgactgttcactaga

SEQ ID NO: 440166 - DNA, 20 bp, Artificial
  CRISPR gRNA sequence
actgttcactagaatcacct

SEQ ID NO: 440167 - DNA, 20 bp, Artificial
  CRISPR gRNA sequence
ttcactagaatcacctggag

SEQ ID NO: 440168 - DNA, 20 bp, Artificial
  CRISPR gRNA sequence
actagaatcacctggagagc

SEQ ID NO: 440169 - DNA, 20 bp, Artificial
  CRISPR gRNA sequence
gaatcacctggagagctttt

SEQ ID NO: 440170 - DNA, 20 bp, Artificial
  CRISPR gRNA sequence
gagagcttttagaacaattt

SEQ ID NO: 440171 - DNA, 20 bp, Artificial
  CRISPR gRNA sequence
ttagaacaatttctatgctt

SEQ ID NO: 440172 - DNA, 20 bp, Artificial
  CRISPR gRNA sequence
tagaacaatttctatgctta

SEQ ID NO: 440173 - DNA, 20 bp, Artificial
  CRISPR gRNA sequence
agaacaatttctatgcttag

SEQ ID NO: 440174 - DNA, 20 bp, Artificial
  CRISPR gRNA sequence
gaacaatttctatgcttagg

SEQ ID NO: 440175 - DNA, 20 bp, Artificial
  CRISPR gRNA sequence
ctatgcttaggcttcatccc

SEQ ID NO: 440176 - DNA, 20 bp, Artificial
  CRISPR gRNA sequence
tatgcttaggcttcatcccc

SEQ ID NO: 440177 - DNA, 20 bp, Artificial
  CRISPR gRNA sequence
tgcttaggcttcatccccag

SEQ ID NO: 440178 - DNA, 20 bp, Artificial
  CRISPR gRNA sequence
aggcttcatccccagagatt

SEQ ID NO: 440179 - DNA, 20 bp, Artificial
  CRISPR gRNA sequence
ggcttcatccccagagattc

SEQ ID NO: 440180 - DNA, 20 bp, Artificial
  CRISPR gRNA sequence
catccccagagattctgatt

SEQ ID NO: 440181 - DNA, 20 bp, Artificial
  CRISPR gRNA sequence
atccccagagattctgattc

SEQ ID NO: 440182 - DNA, 20 bp, Artificial
  CRISPR gRNA sequence
tgattcagttgctctggggt

SEQ ID NO: 440183 - DNA, 20 bp, Artificial
  CRISPR gRNA sequence
attcagttgctctggggttg

SEQ ID NO: 440184 - DNA, 20 bp, Artificial
  CRISPR gRNA sequence
agttgctctggggttggccc

SEQ ID NO: 440185 - DNA, 20 bp, Artificial
  CRISPR gRNA sequence
ctctggggttggccctgcat

SEQ ID NO: 440186 - DNA, 20 bp, Artificial
  CRISPR gRNA sequence
tggggttggccctgcattag

SEQ ID NO: 440187 - DNA, 20 bp, Artificial
  CRISPR gRNA sequence
gggttggccctgcattagta

SEQ ID NO: 440188 - DNA, 20 bp, Artificial
  CRISPR gRNA sequence
gccctgcattagtacacttc

SEQ ID NO: 440189 - DNA, 20 bp, Artificial
  CRISPR gRNA sequence
cattagtacacttcagtgcc

SEQ ID NO: 440190 - DNA, 20 bp, Artificial
  CRISPR gRNA sequence
gtacacttcagtgcctgggt

SEQ ID NO: 440191 - DNA, 20 bp, Artificial
  CRISPR gRNA sequence
cagtgcctgggtgattctaa

SEQ ID NO: 440192 - DNA, 20 bp, Artificial
  CRISPR gRNA sequence
agtgcctgggtgattctaat

SEQ ID NO: 440193 - DNA, 20 bp, Artificial
  CRISPR gRNA sequence
ggtgattctaataggaaact

SEQ ID NO: 440194 - DNA, 20 bp, Artificial
  CRISPR gRNA sequence
taataggaaactaaagttga

SEQ ID NO: 440195 - DNA, 20 bp, Artificial
  CRISPR gRNA sequence
ataggaaactaaagttgaaa

SEQ ID NO: 440196 - DNA, 20 bp, Artificial
  CRISPR gRNA sequence
aagttgaaaatgcctgggct

SEQ ID NO: 440197 - DNA, 20 bp, Artificial
  CRISPR gRNA sequence
aaaatgcctgggctgtttac

SEQ ID NO: 440198 - DNA, 20 bp, Artificial
  CRISPR gRNA sequence
ggctgtttacagaaatgctg

SEQ ID NO: 440199 - DNA, 20 bp, Artificial
  CRISPR gRNA sequence
tttacagaaatgctgagaac

SEQ ID NO: 440200 - DNA, 20 bp, Artificial
  CRISPR gRNA sequence
acagaaatgctgagaacaga

SEQ ID NO: 440201 - DNA, 20 bp, Artificial
  CRISPR gRNA sequence
cagaaatgctgagaacagat

SEQ ID NO: 440202 - DNA, 20 bp, Artificial
  CRISPR gRNA sequence
agaacagatactgggtttct

SEQ ID NO: 440203 - DNA, 20 bp, Artificial
  CRISPR gRNA sequence
ggtttcttgctcacttctgt

SEQ ID NO: 440204 - DNA, 20 bp, Artificial
  CRISPR gRNA sequence
cttgctcacttctgtaacgc

SEQ ID NO: 440205 - DNA, 20 bp, Artificial
  CRISPR gRNA sequence
ttgctcacttctgtaacgcc

SEQ ID NO: 440206 - DNA, 20 bp, Artificial
  CRISPR gRNA sequence
gctcacttctgtaacgccta

SEQ ID NO: 440207 - DNA, 20 bp, Artificial
  CRISPR gRNA sequence
ctcacttctgtaacgcctaa

SEQ ID NO: 440208 - DNA, 20 bp, Artificial
  CRISPR gRNA sequence
acttctgtaacgcctaagtg

SEQ ID NO: 440209 - DNA, 20 bp, Artificial
  CRISPR gRNA sequence
ctgtaacgcctaagtgcagc

SEQ ID NO: 440210 - DNA, 20 bp, Artificial
  CRISPR gRNA sequence
tgtaacgcctaagtgcagcc

SEQ ID NO: 440211 - DNA, 20 bp, Artificial
  CRISPR gRNA sequence
taacgcctaagtgcagccca

SEQ ID NO: 440212 - DNA, 20 bp, Artificial
  CRISPR gRNA sequence
agtgcagcccagaccctgga

SEQ ID NO: 440213 - DNA, 20 bp, Artificial
  CRISPR gRNA sequence
gatataataggagctcaatc

SEQ ID NO: 440214 - DNA, 20 bp, Artificial
  CRISPR gRNA sequence
aatccgttgatgtttcagtt

SEQ ID NO: 440215 - DNA, 20 bp, Artificial
  CRISPR gRNA sequence
atgtttcagttcagtggaaa

SEQ ID NO: 440216 - DNA, 20 bp, Artificial
  CRISPR gRNA sequence
cagttcagtggaaaaaccat

SEQ ID NO: 440217 - DNA, 20 bp, Artificial
  CRISPR gRNA sequence
agttcagtggaaaaaccatt

SEQ ID NO: 440218 - DNA, 20 bp, Artificial
  CRISPR gRNA sequence
agtggaaaaaccattaatat

SEQ ID NO: 440219 - DNA, 20 bp, Artificial
  CRISPR gRNA sequence
atatcgagatgaataagcat

SEQ ID NO: 440220 - DNA, 20 bp, Artificial
  CRISPR gRNA sequence
tattattagggtgataaatt

SEQ ID NO: 440221 - DNA, 20 bp, Artificial
  CRISPR gRNA sequence
ttagggtgataaattctata

SEQ ID NO: 440222 - DNA, 20 bp, Artificial
  CRISPR gRNA sequence
gggtgataaattctatacct

SEQ ID NO: 440223 - DNA, 20 bp, Artificial
  CRISPR gRNA sequence
tataccttaactttagaact

SEQ ID NO: 440224 - DNA, 20 bp, Artificial
  CRISPR gRNA sequence
taccttaactttagaactaa

SEQ ID NO: 440225 - DNA, 20 bp, Artificial
  CRISPR gRNA sequence
aactttagaactaaagaagc

SEQ ID NO: 440226 - DNA, 20 bp, Artificial
  CRISPR gRNA sequence
actttagaactaaagaagct

SEQ ID NO: 440227 - DNA, 20 bp, Artificial
  CRISPR gRNA sequence
tagaactaaagaagctagag

SEQ ID NO: 440228 - DNA, 20 bp, Artificial
  CRISPR gRNA sequence
agaactaaagaagctagagg

SEQ ID NO: 440229 - DNA, 20 bp, Artificial
  CRISPR gRNA sequence
gaactaaagaagctagaggt

SEQ ID NO: 440230 - DNA, 20 bp, Artificial
  CRISPR gRNA sequence
aagaagctagaggtgtcagg

SEQ ID NO: 440231 - DNA, 20 bp, Artificial
  CRISPR gRNA sequence
gaggtgtcaggaagtacaca

SEQ ID NO: 440232 - DNA, 20 bp, Artificial
  CRISPR gRNA sequence
cattttcacttcataactag

SEQ ID NO: 440233 - DNA, 20 bp, Artificial
  CRISPR gRNA sequence
tcacttcataactagaccta

SEQ ID NO: 440234 - DNA, 20 bp, Artificial
  CRISPR gRNA sequence
cacttcataactagacctag

SEQ ID NO: 440235 - DNA, 20 bp, Artificial
  CRISPR gRNA sequence
acttcataactagacctaga

SEQ ID NO: 440236 - DNA, 20 bp, Artificial
  CRISPR gRNA sequence
cataactagacctagagaaa

SEQ ID NO: 440237 - DNA, 20 bp, Artificial
  CRISPR gRNA sequence
ataactagacctagagaaag

SEQ ID NO: 440238 - DNA, 20 bp, Artificial
  CRISPR gRNA sequence
gacctagagaaagaaggaag

SEQ ID NO: 440239 - DNA, 20 bp, Artificial
  CRISPR gRNA sequence
gagaaagaaggaagtataaa

SEQ ID NO: 440240 - DNA, 20 bp, Artificial
  CRISPR gRNA sequence
agatctcaaagccccaggac

SEQ ID NO: 440241 - DNA, 20 bp, Artificial
  CRISPR gRNA sequence
aaagccccaggacaggattt

SEQ ID NO: 440242 - DNA, 20 bp, Artificial
  CRISPR gRNA sequence
ctcagagaaaagatcagaca

SEQ ID NO: 440243 - DNA, 20 bp, Artificial
  CRISPR gRNA sequence
tcagagaaaagatcagacat

SEQ ID NO: 440244 - DNA, 20 bp, Artificial
  CRISPR gRNA sequence
agagaaaagatcagacatgt

SEQ ID NO: 440245 - DNA, 20 bp, Artificial
  CRISPR gRNA sequence
gagtagggacttccaagatt

SEQ ID NO: 440246 - DNA, 20 bp, Artificial
  CRISPR gRNA sequence
ccaagattctcaccttttcc

SEQ ID NO: 440247 - DNA, 20 bp, Artificial
  CRISPR gRNA sequence
caagattctcaccttttccc

SEQ ID NO: 440248 - DNA, 20 bp, Artificial
  CRISPR gRNA sequence
tcaccttttcccaaccccat

SEQ ID NO: 440249 - DNA, 20 bp, Artificial
  CRISPR gRNA sequence
accttttcccaaccccattc

SEQ ID NO: 440250 - DNA, 20 bp, Artificial
  CRISPR gRNA sequence
ttcccaaccccattccatta

SEQ ID NO: 440251 - DNA, 20 bp, Artificial
  CRISPR gRNA sequence
tcccaaccccattccattat

SEQ ID NO: 440252 - DNA, 20 bp, Artificial
  CRISPR gRNA sequence
cccaaccccattccattatt

SEQ ID NO: 440253 - DNA, 20 bp, Artificial
  CRISPR gRNA sequence
ccaaccccattccattattc

SEQ ID NO: 440254 - DNA, 20 bp, Artificial
  CRISPR gRNA sequence
cattattcttaccttaaatt

SEQ ID NO: 440255 - DNA, 20 bp, Artificial
  CRISPR gRNA sequence
ttcttaccttaaattctgta

SEQ ID NO: 440256 - DNA, 20 bp, Artificial
  CRISPR gRNA sequence
ttaccttaaattctgtatct

SEQ ID NO: 440257 - DNA, 20 bp, Artificial
  CRISPR gRNA sequence
accttaaattctgtatcttc

SEQ ID NO: 440258 - DNA, 20 bp, Artificial
  CRISPR gRNA sequence
ccttaaattctgtatcttct

SEQ ID NO: 440259 - DNA, 20 bp, Artificial
  CRISPR gRNA sequence
aaattctgtatcttctcttt

SEQ ID NO: 440260 - DNA, 20 bp, Artificial
  CRISPR gRNA sequence
aattctgtatcttctctttg

SEQ ID NO: 440261 - DNA, 20 bp, Artificial
  CRISPR gRNA sequence
tgtatcttctctttgctatg

SEQ ID NO: 440262 - DNA, 20 bp, Artificial
  CRISPR gRNA sequence
tatcttctctttgctatgag

SEQ ID NO: 440263 - DNA, 20 bp, Artificial
  CRISPR gRNA sequence
ctctttgctatgagaatacc

SEQ ID NO: 440264 - DNA, 20 bp, Artificial
  CRISPR gRNA sequence
tctttgctatgagaataccc

SEQ ID NO: 440265 - DNA, 20 bp, Artificial
  CRISPR gRNA sequence
tttgctatgagaatacccta

SEQ ID NO: 440266 - DNA, 20 bp, Artificial
  CRISPR gRNA sequence
tgctatgagaataccctagt

SEQ ID NO: 440267 - DNA, 20 bp, Artificial
  CRISPR gRNA sequence
gctatgagaataccctagta

SEQ ID NO: 440268 - DNA, 20 bp, Artificial
  CRISPR gRNA sequence
ctatgagaataccctagtaa

SEQ ID NO: 440269 - DNA, 20 bp, Artificial
  CRISPR gRNA sequence
tgagaataccctagtaaggg

SEQ ID NO: 440270 - DNA, 20 bp, Artificial
  CRISPR gRNA sequence
gtaagggggaaacaaaagcc

SEQ ID NO: 440271 - DNA, 20 bp, Artificial
  CRISPR gRNA sequence
ataaaataaatgagacaaga

SEQ ID NO: 440272 - DNA, 20 bp, Artificial
  CRISPR gRNA sequence
actggaagcacgcatagttt

SEQ ID NO: 440273 - DNA, 20 bp, Artificial
  CRISPR gRNA sequence
gaagcacgcatagtttaggg

SEQ ID NO: 440274 - DNA, 20 bp, Artificial
  CRISPR gRNA sequence
agggaaatctggtctcatct

SEQ ID NO: 440275 - DNA, 20 bp, Artificial
  CRISPR gRNA sequence
gggaaatctggtctcatctc

SEQ ID NO: 440276 - DNA, 20 bp, Artificial
  CRISPR gRNA sequence
gtctcatctcagattgagtt

SEQ ID NO: 440277 - DNA, 20 bp, Artificial
  CRISPR gRNA sequence
atctcagattgagttaaatg

SEQ ID NO: 440278 - DNA, 20 bp, Artificial
  CRISPR gRNA sequence
agattgagttaaatgaaact

SEQ ID NO: 440279 - DNA, 20 bp, Artificial
  CRISPR gRNA sequence
agttaaatgaaactctcaac

SEQ ID NO: 440280 - DNA, 20 bp, Artificial
  CRISPR gRNA sequence
aatgaaactctcaacgtgtg

SEQ ID NO: 440281 - DNA, 20 bp, Artificial
  CRISPR gRNA sequence
tcaacgtgtgccttagatag

SEQ ID NO: 440282 - DNA, 20 bp, Artificial
  CRISPR gRNA sequence
aacgtgtgccttagatagtt

SEQ ID NO: 440283 - DNA, 20 bp, Artificial
  CRISPR gRNA sequence
agatagttatatggactgtg

SEQ ID NO: 440284 - DNA, 20 bp, Artificial
  CRISPR gRNA sequence
gatagttatatggactgtgt

SEQ ID NO: 440285 - DNA, 20 bp, Artificial
  CRISPR gRNA sequence
tatggactgtgttagaaaat

SEQ ID NO: 440286 - DNA, 20 bp, Artificial
  CRISPR gRNA sequence
tgttagaaaataataataaa

SEQ ID NO: 440287 - DNA, 20 bp, Artificial
  CRISPR gRNA sequence
gaaaataataataaagatgc

SEQ ID NO: 440288 - DNA, 20 bp, Artificial
  CRISPR gRNA sequence
ttcttatttaacaaatatta

SEQ ID NO: 440289 - DNA, 20 bp, Artificial
  CRISPR gRNA sequence
tcttatttaacaaatattat

SEQ ID NO: 440290 - DNA, 20 bp, Artificial
  CRISPR gRNA sequence
cttatttaacaaatattatg

SEQ ID NO: 440291 - DNA, 20 bp, Artificial
  CRISPR gRNA sequence
ttatttaacaaatattatga

SEQ ID NO: 440292 - DNA, 20 bp, Artificial
  CRISPR gRNA sequence
atttaacaaatattatgaga

SEQ ID NO: 440293 - DNA, 20 bp, Artificial
  CRISPR gRNA sequence
tttaacaaatattatgagac

SEQ ID NO: 440294 - DNA, 20 bp, Artificial
  CRISPR gRNA sequence
aacaaatattatgagacctc

SEQ ID NO: 440295 - DNA, 20 bp, Artificial
  CRISPR gRNA sequence
acaaatattatgagacctct

SEQ ID NO: 440296 - DNA, 20 bp, Artificial
  CRISPR gRNA sequence
tgagacctctactatgtgtc

SEQ ID NO: 440297 - DNA, 20 bp, Artificial
  CRISPR gRNA sequence
tactatgtgtctggcagttt

SEQ ID NO: 440298 - DNA, 20 bp, Artificial
  CRISPR gRNA sequence
ctatgtgtctggcagtttgc

SEQ ID NO: 440299 - DNA, 20 bp, Artificial
  CRISPR gRNA sequence
tgtgtctggcagtttgcctg

SEQ ID NO: 440300 - DNA, 20 bp, Artificial
  CRISPR gRNA sequence
gcagtttgcctggcacaagg

SEQ ID NO: 440301 - DNA, 20 bp, Artificial
  CRISPR gRNA sequence
gcctggcacaaggaacacag

SEQ ID NO: 440302 - DNA, 20 bp, Artificial
  CRISPR gRNA sequence
cctggcacaaggaacacagg

SEQ ID NO: 440303 - DNA, 20 bp, Artificial
  CRISPR gRNA sequence
gcacaaggaacacaggaaca

SEQ ID NO: 440304 - DNA, 20 bp, Artificial
  CRISPR gRNA sequence
tgagccctaatttcacgaag

SEQ ID NO: 440305 - DNA, 20 bp, Artificial
  CRISPR gRNA sequence
atttcacgaagctcacgctc

SEQ ID NO: 440306 - DNA, 20 bp, Artificial
  CRISPR gRNA sequence
cacgaagctcacgctctcct

SEQ ID NO: 440307 - DNA, 20 bp, Artificial
  CRISPR gRNA sequence
acgaagctcacgctctcctg

SEQ ID NO: 440308 - DNA, 20 bp, Artificial
  CRISPR gRNA sequence
acgctctcctgtgggagacc

SEQ ID NO: 440309 - DNA, 20 bp, Artificial
  CRISPR gRNA sequence
tcctgtgggagaccaaagaa

SEQ ID NO: 440310 - DNA, 20 bp, Artificial
  CRISPR gRNA sequence
ctgtgggagaccaaagaaat

SEQ ID NO: 440311 - DNA, 20 bp, Artificial
  CRISPR gRNA sequence
tgggagaccaaagaaataaa

SEQ ID NO: 440312 - DNA, 20 bp, Artificial
  CRISPR gRNA sequence
accaacatggagaaaccccg

SEQ ID NO: 440313 - DNA, 20 bp, Artificial
  CRISPR gRNA sequence
tactaaaaatacaaaattag

SEQ ID NO: 440314 - DNA, 20 bp, Artificial
  CRISPR gRNA sequence
ctaaaaatacaaaattagct

SEQ ID NO: 440315 - DNA, 20 bp, Artificial
  CRISPR gRNA sequence
aaaatacaaaattagctgga

SEQ ID NO: 440316 - DNA, 20 bp, Artificial
  CRISPR gRNA sequence
gctggatgtggtggcccatg

SEQ ID NO: 440317 - DNA, 20 bp, Artificial
  CRISPR gRNA sequence
gatgtggtggcccatgcctg

SEQ ID NO: 440318 - DNA, 20 bp, Artificial
  CRISPR gRNA sequence
taatcccagctactcgggag

SEQ ID NO: 440319 - DNA, 20 bp, Artificial
  CRISPR gRNA sequence
ctcgggaggctgaggcagga

SEQ ID NO: 440320 - DNA, 20 bp, Artificial
  CRISPR gRNA sequence
gggaggctgaggcaggagaa

SEQ ID NO: 440321 - DNA, 20 bp, Artificial
  CRISPR gRNA sequence
aggcaggagaatcacatgaa

SEQ ID NO: 440322 - DNA, 20 bp, Artificial
  CRISPR gRNA sequence
cggtgagccaagattgcgcc

SEQ ID NO: 440323 - DNA, 20 bp, Artificial
  CRISPR gRNA sequence
cgccattgcactccagcctg

SEQ ID NO: 440324 - DNA, 20 bp, Artificial
  CRISPR gRNA sequence
cactccagcctgggcaacga

SEQ ID NO: 440325 - DNA, 20 bp, Artificial
  CRISPR gRNA sequence
cagcctgggcaacgagagcg

SEQ ID NO: 440326 - DNA, 20 bp, Artificial
  CRISPR gRNA sequence
ggcaacgagagcgaaactcc

SEQ ID NO: 440327 - DNA, 20 bp, Artificial
  CRISPR gRNA sequence
cgtctcaaaaaaaaaaaaac

SEQ ID NO: 440328 - DNA, 20 bp, Artificial
  CRISPR gRNA sequence
aaaaaaaaaaaaacaacaac

SEQ ID NO: 440329 - DNA, 20 bp, Artificial
  CRISPR gRNA sequence
caaattatgatgtattataa

SEQ ID NO: 440330 - DNA, 20 bp, Artificial
  CRISPR gRNA sequence
aaattatgatgtattataaa

SEQ ID NO: 440331 - DNA, 20 bp, Artificial
  CRISPR gRNA sequence
tgatgtattataaaggaaac

SEQ ID NO: 440332 - DNA, 20 bp, Artificial
  CRISPR gRNA sequence
taaaggaaaccaacatcata

SEQ ID NO: 440333 - DNA, 20 bp, Artificial
  CRISPR gRNA sequence
agagatgaactttaagctcg

SEQ ID NO: 440334 - DNA, 20 bp, Artificial
  CRISPR gRNA sequence
taagctcgtttctgaaatga

SEQ ID NO: 440335 - DNA, 20 bp, Artificial
  CRISPR gRNA sequence
aagctcgtttctgaaatgag

SEQ ID NO: 440336 - DNA, 20 bp, Artificial
  CRISPR gRNA sequence
agctcgtttctgaaatgagt

SEQ ID NO: 440337 - DNA, 20 bp, Artificial
  CRISPR gRNA sequence
gtttctgaaatgagtcagcc

SEQ ID NO: 440338 - DNA, 20 bp, Artificial
  CRISPR gRNA sequence
ctgaaatgagtcagccaagt

SEQ ID NO: 440339 - DNA, 20 bp, Artificial
  CRISPR gRNA sequence
tgaaatgagtcagccaagta

SEQ ID NO: 440340 - DNA, 20 bp, Artificial
  CRISPR gRNA sequence
aaatgagtcagccaagtaaa

SEQ ID NO: 440341 - DNA, 20 bp, Artificial
  CRISPR gRNA sequence
caggatgagggagccccttg

SEQ ID NO: 440342 - DNA, 20 bp, Artificial
  CRISPR gRNA sequence
gtaaagatcttgctgagtac

SEQ ID NO: 440343 - DNA, 20 bp, Artificial
  CRISPR gRNA sequence
taaagatcttgctgagtacc

SEQ ID NO: 440344 - DNA, 20 bp, Artificial
  CRISPR gRNA sequence
gctgagtacctgaaactgaa

SEQ ID NO: 440345 - DNA, 20 bp, Artificial
  CRISPR gRNA sequence
ctgagtacctgaaactgaaa

SEQ ID NO: 440346 - DNA, 20 bp, Artificial
  CRISPR gRNA sequence
agtacctgaaactgaaaacg

SEQ ID NO: 440347 - DNA, 20 bp, Artificial
  CRISPR gRNA sequence
aaactgaaaacgtggctgga

SEQ ID NO: 440348 - DNA, 20 bp, Artificial
  CRISPR gRNA sequence
aaaacgtggctggattaagg

SEQ ID NO: 440349 - DNA, 20 bp, Artificial
  CRISPR gRNA sequence
gattaagggagcggcccaag

SEQ ID NO: 440350 - DNA, 20 bp, Artificial
  CRISPR gRNA sequence
agggagcggcccaagataag

SEQ ID NO: 440351 - DNA, 20 bp, Artificial
  CRISPR gRNA sequence
aaaggtaggctggggctagg

SEQ ID NO: 440352 - DNA, 20 bp, Artificial
  CRISPR gRNA sequence
gggctaggtccaataagacc

SEQ ID NO: 440353 - DNA, 20 bp, Artificial
  CRISPR gRNA sequence
ggtccaataagacctttcca

SEQ ID NO: 440354 - DNA, 20 bp, Artificial
  CRISPR gRNA sequence
tccagccataatcaggagtc

SEQ ID NO: 440355 - DNA, 20 bp, Artificial
  CRISPR gRNA sequence
ccagccataatcaggagtct

SEQ ID NO: 440356 - DNA, 20 bp, Artificial
  CRISPR gRNA sequence
cagccataatcaggagtctg

SEQ ID NO: 440357 - DNA, 20 bp, Artificial
  CRISPR gRNA sequence
gattttattctaagacctgt

SEQ ID NO: 440358 - DNA, 20 bp, Artificial
  CRISPR gRNA sequence
tattctaagacctgtaggaa

SEQ ID NO: 440359 - DNA, 20 bp, Artificial
  CRISPR gRNA sequence
attctaagacctgtaggaaa

SEQ ID NO: 440360 - DNA, 20 bp, Artificial
  CRISPR gRNA sequence
ttctaagacctgtaggaaac

SEQ ID NO: 440361 - DNA, 20 bp, Artificial
  CRISPR gRNA sequence
taagacctgtaggaaacctt

SEQ ID NO: 440362 - DNA, 20 bp, Artificial
  CRISPR gRNA sequence
agacctgtaggaaaccttag

SEQ ID NO: 440363 - DNA, 20 bp, Artificial
  CRISPR gRNA sequence
taggaaaccttagatttcct

SEQ ID NO: 440364 - DNA, 20 bp, Artificial
  CRISPR gRNA sequence
agatttccttgaagggcaga

SEQ ID NO: 440365 - DNA, 20 bp, Artificial
  CRISPR gRNA sequence
gatttccttgaagggcagag

SEQ ID NO: 440366 - DNA, 20 bp, Artificial
  CRISPR gRNA sequence
ccttgaagggcagagatgtg

SEQ ID NO: 440367 - DNA, 20 bp, Artificial
  CRISPR gRNA sequence
cttgaagggcagagatgtga

SEQ ID NO: 440368 - DNA, 20 bp, Artificial
  CRISPR gRNA sequence
gaagggcagagatgtgatcc

SEQ ID NO: 440369 - DNA, 20 bp, Artificial
  CRISPR gRNA sequence
aagggcagagatgtgatcct

SEQ ID NO: 440370 - DNA, 20 bp, Artificial
  CRISPR gRNA sequence
atttgttttgggtttctttt

SEQ ID NO: 440371 - DNA, 20 bp, Artificial
  CRISPR gRNA sequence
tttgttttgggtttctttta

SEQ ID NO: 440372 - DNA, 20 bp, Artificial
  CRISPR gRNA sequence
gttttgggtttcttttaccc

SEQ ID NO: 440373 - DNA, 20 bp, Artificial
  CRISPR gRNA sequence
ttttgggtttcttttacccg

SEQ ID NO: 440374 - DNA, 20 bp, Artificial
  CRISPR gRNA sequence
tgggtttcttttacccgctg

SEQ ID NO: 440375 - DNA, 20 bp, Artificial
  CRISPR gRNA sequence
gggtttcttttacccgctga

SEQ ID NO: 440376 - DNA, 20 bp, Artificial
  CRISPR gRNA sequence
ggtttcttttacccgctgaa

SEQ ID NO: 440377 - DNA, 20 bp, Artificial
  CRISPR gRNA sequence
cttttacccgctgaaaacaa

SEQ ID NO: 440378 - DNA, 20 bp, Artificial
  CRISPR gRNA sequence
ttttacccgctgaaaacaac

SEQ ID NO: 440379 - DNA, 20 bp, Artificial
  CRISPR gRNA sequence
ttacccgctgaaaacaacta

SEQ ID NO: 440380 - DNA, 20 bp, Artificial
  CRISPR gRNA sequence
tacccgctgaaaacaactac

SEQ ID NO: 440381 - DNA, 20 bp, Artificial
  CRISPR gRNA sequence
acccgctgaaaacaactacg

SEQ ID NO: 440382 - DNA, 20 bp, Artificial
  CRISPR gRNA sequence
cccgctgaaaacaactacgt

SEQ ID NO: 440383 - DNA, 20 bp, Artificial
  CRISPR gRNA sequence
aaaacaactacgttatctca

SEQ ID NO: 440384 - DNA, 20 bp, Artificial
  CRISPR gRNA sequence
cgttatctcatcatttctgt

SEQ ID NO: 440385 - DNA, 20 bp, Artificial
  CRISPR gRNA sequence
tctcatcatttctgtgttgt

SEQ ID NO: 440386 - DNA, 20 bp, Artificial
  CRISPR gRNA sequence
atcatttctgtgttgtgggt

SEQ ID NO: 440387 - DNA, 20 bp, Artificial
  CRISPR gRNA sequence
ctgtgttgtgggtcaggaat

SEQ ID NO: 440388 - DNA, 20 bp, Artificial
  CRISPR gRNA sequence
tgtgttgtgggtcaggaatc

SEQ ID NO: 440389 - DNA, 20 bp, Artificial
  CRISPR gRNA sequence
tgttgtgggtcaggaatcca

SEQ ID NO: 440390 - DNA, 20 bp, Artificial
  CRISPR gRNA sequence
tgggtcaggaatccaggtgt

SEQ ID NO: 440391 - DNA, 20 bp, Artificial
  CRISPR gRNA sequence
actgggtacctctggatcaa

SEQ ID NO: 440392 - DNA, 20 bp, Artificial
  CRISPR gRNA sequence
ctgggtacctctggatcaag

SEQ ID NO: 440393 - DNA, 20 bp, Artificial
  CRISPR gRNA sequence
ggtacctctggatcaaggtc

SEQ ID NO: 440394 - DNA, 20 bp, Artificial
  CRISPR gRNA sequence
tggatcaaggtctttcaagg

SEQ ID NO: 440395 - DNA, 20 bp, Artificial
  CRISPR gRNA sequence
gatcaaggtctttcaaggtg

SEQ ID NO: 440396 - DNA, 20 bp, Artificial
  CRISPR gRNA sequence
tcaaggtgtcttctggggat

SEQ ID NO: 440397 - DNA, 20 bp, Artificial
  CRISPR gRNA sequence
caaggtgtcttctggggatg

SEQ ID NO: 440398 - DNA, 20 bp, Artificial
  CRISPR gRNA sequence
aaggtgtcttctggggatgc

SEQ ID NO: 440399 - DNA, 20 bp, Artificial
  CRISPR gRNA sequence
ctggggatgcagtttcaaaa

SEQ ID NO: 440400 - DNA, 20 bp, Artificial
  CRISPR gRNA sequence
tggggatgcagtttcaaaaa

SEQ ID NO: 440401 - DNA, 20 bp, Artificial
  CRISPR gRNA sequence
gggatgcagtttcaaaaatt

SEQ ID NO: 440402 - DNA, 20 bp, Artificial
  CRISPR gRNA sequence
caaaaatttgaaacttaaaa

SEQ ID NO: 440403 - DNA, 20 bp, Artificial
  CRISPR gRNA sequence
aaaaatttgaaacttaaaat

SEQ ID NO: 440404 - DNA, 20 bp, Artificial
  CRISPR gRNA sequence
gaaacttaaaattttccttt

SEQ ID NO: 440405 - DNA, 20 bp, Artificial
  CRISPR gRNA sequence
aaacttaaaattttcctttc

SEQ ID NO: 440406 - DNA, 20 bp, Artificial
  CRISPR gRNA sequence
aaaattttcctttcttttct

SEQ ID NO: 440407 - DNA, 20 bp, Artificial
  CRISPR gRNA sequence
aaattttcctttcttttctt

SEQ ID NO: 440408 - DNA, 20 bp, Artificial
  CRISPR gRNA sequence
tcctttcttttcttttcttt

SEQ ID NO: 440409 - DNA, 20 bp, Artificial
  CRISPR gRNA sequence
cctttcttttcttttctttt

SEQ ID NO: 440410 - DNA, 20 bp, Artificial
  CRISPR gRNA sequence
ctttcttttcttttcttttt

SEQ ID NO: 440411 - DNA, 20 bp, Artificial
  CRISPR gRNA sequence
tcttttcttttctttttttt

SEQ ID NO: 440412 - DNA, 20 bp, Artificial
  CRISPR gRNA sequence
cttttcttttcttttttttt

SEQ ID NO: 440413 - DNA, 20 bp, Artificial
  CRISPR gRNA sequence
ttttcttttctttttttttt

SEQ ID NO: 440414 - DNA, 20 bp, Artificial
  CRISPR gRNA sequence
ttcttttctttttttttttt

SEQ ID NO: 440415 - DNA, 20 bp, Artificial
  CRISPR gRNA sequence
tcttttcttttttttttttt

SEQ ID NO: 440416 - DNA, 20 bp, Artificial
  CRISPR gRNA sequence
cttttctttttttttttttt

SEQ ID NO: 440417 - DNA, 20 bp, Artificial
  CRISPR gRNA sequence
ttttcttttttttttttttt

SEQ ID NO: 440418 - DNA, 20 bp, Artificial
  CRISPR gRNA sequence
ttcttttttttttttttttt

SEQ ID NO: 440419 - DNA, 20 bp, Artificial
  CRISPR gRNA sequence
tctttttttttttttttttt

SEQ ID NO: 440420 - DNA, 20 bp, Artificial
  CRISPR gRNA sequence
cttttttttttttttttttt

SEQ ID NO: 440421 - DNA, 20 bp, Artificial
  CRISPR gRNA sequence
tttttttttttttttttttt

SEQ ID NO: 440422 - DNA, 20 bp, Artificial
  CRISPR gRNA sequence
tttttttttttttttttttt

SEQ ID NO: 440423 - DNA, 20 bp, Artificial
  CRISPR gRNA sequence
tttttttttttttttttttt

SEQ ID NO: 440424 - DNA, 20 bp, Artificial
  CRISPR gRNA sequence
tttttttttttttttttttt

SEQ ID NO: 440425 - DNA, 20 bp, Artificial
  CRISPR gRNA sequence
tttttttttttttttttttt

SEQ ID NO: 440426 - DNA, 20 bp, Artificial
  CRISPR gRNA sequence
tttttttttttttttttttg

SEQ ID NO: 440427 - DNA, 20 bp, Artificial
  CRISPR gRNA sequence
ttttttttttttttttttga

SEQ ID NO: 440428 - DNA, 20 bp, Artificial
  CRISPR gRNA sequence
tttttttttttttttttgag

SEQ ID NO: 440429 - DNA, 20 bp, Artificial
  CRISPR gRNA sequence
ttttttttttttttttgaga

SEQ ID NO: 440430 - DNA, 20 bp, Artificial
  CRISPR gRNA sequence
tttttttttttttttgagac

SEQ ID NO: 440431 - DNA, 20 bp, Artificial
  CRISPR gRNA sequence
ttttttttttttttgagaca

SEQ ID NO: 440432 - DNA, 20 bp, Artificial
  CRISPR gRNA sequence
tttttttttttttgagacag

SEQ ID NO: 440433 - DNA, 20 bp, Artificial
  CRISPR gRNA sequence
ttttttttttttgagacagg

SEQ ID NO: 440434 - DNA, 20 bp, Artificial
  CRISPR gRNA sequence
tttttttttttgagacaggg

SEQ ID NO: 440435 - DNA, 20 bp, Artificial
  CRISPR gRNA sequence
ttttttttttgagacagggt

SEQ ID NO: 440436 - DNA, 20 bp, Artificial
  CRISPR gRNA sequence
tttttttttgagacagggtc

SEQ ID NO: 440437 - DNA, 20 bp, Artificial
  CRISPR gRNA sequence
ttttttttgagacagggtct

SEQ ID NO: 440438 - DNA, 20 bp, Artificial
  CRISPR gRNA sequence
tttttttgagacagggtctt

SEQ ID NO: 440439 - DNA, 20 bp, Artificial
  CRISPR gRNA sequence
ttttttgagacagggtcttg

SEQ ID NO: 440440 - DNA, 20 bp, Artificial
  CRISPR gRNA sequence
tttttgagacagggtcttgc

SEQ ID NO: 440441 - DNA, 20 bp, Artificial
  CRISPR gRNA sequence
ttttgagacagggtcttgct

SEQ ID NO: 440442 - DNA, 20 bp, Artificial
  CRISPR gRNA sequence
tttgagacagggtcttgctc

SEQ ID NO: 440443 - DNA, 20 bp, Artificial
  CRISPR gRNA sequence
ttgagacagggtcttgctct

SEQ ID NO: 440444 - DNA, 20 bp, Artificial
  CRISPR gRNA sequence
tgagacagggtcttgctctg

SEQ ID NO: 440445 - DNA, 20 bp, Artificial
  CRISPR gRNA sequence
gagacagggtcttgctctgt

SEQ ID NO: 440446 - DNA, 20 bp, Artificial
  CRISPR gRNA sequence
agacagggtcttgctctgtt

SEQ ID NO: 440447 - DNA, 20 bp, Artificial
  CRISPR gRNA sequence
gctctgttggccaggctgga

SEQ ID NO: 440448 - DNA, 20 bp, Artificial
  CRISPR gRNA sequence
ctctgttggccaggctggaa

SEQ ID NO: 440449 - DNA, 20 bp, Artificial
  CRISPR gRNA sequence
tgttggccaggctggaatgc

SEQ ID NO: 440450 - DNA, 20 bp, Artificial
  CRISPR gRNA sequence
ttggccaggctggaatgcag

SEQ ID NO: 440451 - DNA, 20 bp, Artificial
  CRISPR gRNA sequence
gccaggctggaatgcagtag

SEQ ID NO: 440452 - DNA, 20 bp, Artificial
  CRISPR gRNA sequence
gaatgcagtagtaagatcat

SEQ ID NO: 440453 - DNA, 20 bp, Artificial
  CRISPR gRNA sequence
attgcaactttgaactcctg

SEQ ID NO: 440454 - DNA, 20 bp, Artificial
  CRISPR gRNA sequence
caactttgaactcctgggct

SEQ ID NO: 440455 - DNA, 20 bp, Artificial
  CRISPR gRNA sequence
tgaactcctgggctcaaggg

SEQ ID NO: 440456 - DNA, 20 bp, Artificial
  CRISPR gRNA sequence
gaactcctgggctcaaggga

SEQ ID NO: 440457 - DNA, 20 bp, Artificial
  CRISPR gRNA sequence
aactcctgggctcaagggat

SEQ ID NO: 440458 - DNA, 20 bp, Artificial
  CRISPR gRNA sequence
ctgggctcaagggatctacc

SEQ ID NO: 440459 - DNA, 20 bp, Artificial
  CRISPR gRNA sequence
ggctcaagggatctacccat

SEQ ID NO: 440460 - DNA, 20 bp, Artificial
  CRISPR gRNA sequence
aagggatctacccatctcag

SEQ ID NO: 440461 - DNA, 20 bp, Artificial
  CRISPR gRNA sequence
cccatctcagcttctgagta

SEQ ID NO: 440462 - DNA, 20 bp, Artificial
  CRISPR gRNA sequence
agcttctgagtagctagaac

SEQ ID NO: 440463 - DNA, 20 bp, Artificial
  CRISPR gRNA sequence
ctgagtagctagaactatag

SEQ ID NO: 440464 - DNA, 20 bp, Artificial
  CRISPR gRNA sequence
tgagtagctagaactatagg

SEQ ID NO: 440465 - DNA, 20 bp, Artificial
  CRISPR gRNA sequence
agtagctagaactataggtg

SEQ ID NO: 440466 - DNA, 20 bp, Artificial
  CRISPR gRNA sequence
gaactataggtgcacactac

SEQ ID NO: 440467 - DNA, 20 bp, Artificial
  CRISPR gRNA sequence
taggtgcacactaccacagc

SEQ ID NO: 440468 - DNA, 20 bp, Artificial
  CRISPR gRNA sequence
ccacagctggataatttttt

SEQ ID NO: 440469 - DNA, 20 bp, Artificial
  CRISPR gRNA sequence
gataattttttttaatgttt

SEQ ID NO: 440470 - DNA, 20 bp, Artificial
  CRISPR gRNA sequence
tttttaatgtttttgggctg

SEQ ID NO: 440471 - DNA, 20 bp, Artificial
  CRISPR gRNA sequence
ttttaatgtttttgggctgg

SEQ ID NO: 440472 - DNA, 20 bp, Artificial
  CRISPR gRNA sequence
tttaatgtttttgggctgga

SEQ ID NO: 440473 - DNA, 20 bp, Artificial
  CRISPR gRNA sequence
ttaatgtttttgggctggat

SEQ ID NO: 440474 - DNA, 20 bp, Artificial
  CRISPR gRNA sequence
taatgtttttgggctggatg

SEQ ID NO: 440475 - DNA, 20 bp, Artificial
  CRISPR gRNA sequence
aatgtttttgggctggatgc

SEQ ID NO: 440476 - DNA, 20 bp, Artificial
  CRISPR gRNA sequence
atgtttttgggctggatgca

SEQ ID NO: 440477 - DNA, 20 bp, Artificial
  CRISPR gRNA sequence
ttgggctggatgcagtggct

SEQ ID NO: 440478 - DNA, 20 bp, Artificial
  CRISPR gRNA sequence
tgggctggatgcagtggctc

SEQ ID NO: 440479 - DNA, 20 bp, Artificial
  CRISPR gRNA sequence
gggctggatgcagtggctca

SEQ ID NO: 440480 - DNA, 20 bp, Artificial
  CRISPR gRNA sequence
ggctggatgcagtggctcac

SEQ ID NO: 440481 - DNA, 20 bp, Artificial
  CRISPR gRNA sequence
gatgcagtggctcacgcctg

SEQ ID NO: 440482 - DNA, 20 bp, Artificial
  CRISPR gRNA sequence
acgcctgtaatcctagcact

SEQ ID NO: 440483 - DNA, 20 bp, Artificial
  CRISPR gRNA sequence
taatcctagcactttgggag

SEQ ID NO: 440484 - DNA, 20 bp, Artificial
  CRISPR gRNA sequence
gcactttgggaggcaaggca

SEQ ID NO: 440485 - DNA, 20 bp, Artificial
  CRISPR gRNA sequence
tgggaggcaaggcaggtgga

SEQ ID NO: 440486 - DNA, 20 bp, Artificial
  CRISPR gRNA sequence
gggaggcaaggcaggtggat

SEQ ID NO: 440487 - DNA, 20 bp, Artificial
  CRISPR gRNA sequence
ggaggcaaggcaggtggatt

SEQ ID NO: 440488 - DNA, 20 bp, Artificial
  CRISPR gRNA sequence
cttgagcttgggagttcgag

SEQ ID NO: 440489 - DNA, 20 bp, Artificial
  CRISPR gRNA sequence
ttgagcttgggagttcgaga

SEQ ID NO: 440490 - DNA, 20 bp, Artificial
  CRISPR gRNA sequence
gagcttgggagttcgagacc

SEQ ID NO: 440491 - DNA, 20 bp, Artificial
  CRISPR gRNA sequence
agcttgggagttcgagacca

SEQ ID NO: 440492 - DNA, 20 bp, Artificial
  CRISPR gRNA sequence
gggagttcgagaccagcctg

SEQ ID NO: 440493 - DNA, 20 bp, Artificial
  CRISPR gRNA sequence
ggagttcgagaccagcctgg

SEQ ID NO: 440494 - DNA, 20 bp, Artificial
  CRISPR gRNA sequence
gagaccagcctgggcaacat

SEQ ID NO: 440495 - DNA, 20 bp, Artificial
  CRISPR gRNA sequence
ggcaacatggtaaaacctca

SEQ ID NO: 440496 - DNA, 20 bp, Artificial
  CRISPR gRNA sequence
atctctactaaaaatacaaa

SEQ ID NO: 440497 - DNA, 20 bp, Artificial
  CRISPR gRNA sequence
tactaaaaatacaaaaacta

SEQ ID NO: 440498 - DNA, 20 bp, Artificial
  CRISPR gRNA sequence
ctaaaaatacaaaaactagc

SEQ ID NO: 440499 - DNA, 20 bp, Artificial
  CRISPR gRNA sequence
aaaatacaaaaactagccag

SEQ ID NO: 440500 - DNA, 20 bp, Artificial
  CRISPR gRNA sequence
gccaggtatgctggcacatg

SEQ ID NO: 440501 - DNA, 20 bp, Artificial
  CRISPR gRNA sequence
gcacatgcccgtggtcctag

SEQ ID NO: 440502 - DNA, 20 bp, Artificial
  CRISPR gRNA sequence
gctacttggaggctgaggca

SEQ ID NO: 440503 - DNA, 20 bp, Artificial
  CRISPR gRNA sequence
cttggaggctgaggcaggag

SEQ ID NO: 440504 - DNA, 20 bp, Artificial
  CRISPR gRNA sequence
ggaggctgaggcaggagagt

SEQ ID NO: 440505 - DNA, 20 bp, Artificial
  CRISPR gRNA sequence
gaggctgaggcaggagagtt

SEQ ID NO: 440506 - DNA, 20 bp, Artificial
  CRISPR gRNA sequence
aggcaggagagttgcttgaa

SEQ ID NO: 440507 - DNA, 20 bp, Artificial
  CRISPR gRNA sequence
cttgaactcgggaggtagag

SEQ ID NO: 440508 - DNA, 20 bp, Artificial
  CRISPR gRNA sequence
gaactcgggaggtagaggtt

SEQ ID NO: 440509 - DNA, 20 bp, Artificial
  CRISPR gRNA sequence
aactcgggaggtagaggttg

SEQ ID NO: 440510 - DNA, 20 bp, Artificial
  CRISPR gRNA sequence
gggaggtagaggttgcagtg

SEQ ID NO: 440511 - DNA, 20 bp, Artificial
  CRISPR gRNA sequence
cagtgagccatgatcacacc

SEQ ID NO: 440512 - DNA, 20 bp, Artificial
  CRISPR gRNA sequence
cactccagcctgggtgaatc

SEQ ID NO: 440513 - DNA, 20 bp, Artificial
  CRISPR gRNA sequence
cagcctgggtgaatctcaat

SEQ ID NO: 440514 - DNA, 20 bp, Artificial
  CRISPR gRNA sequence
ggtgaatctcaatatgttgc

SEQ ID NO: 440515 - DNA, 20 bp, Artificial
  CRISPR gRNA sequence
aatatgttgcccaggctagt

SEQ ID NO: 440516 - DNA, 20 bp, Artificial
  CRISPR gRNA sequence
cccaggctagtctcaaactc

SEQ ID NO: 440517 - DNA, 20 bp, Artificial
  CRISPR gRNA sequence
gtctcaaactcctggcctca

SEQ ID NO: 440518 - DNA, 20 bp, Artificial
  CRISPR gRNA sequence
aaactcctggcctcaagtga

SEQ ID NO: 440519 - DNA, 20 bp, Artificial
  CRISPR gRNA sequence
ctggcctcaagtgactctcc

SEQ ID NO: 440520 - DNA, 20 bp, Artificial
  CRISPR gRNA sequence
gcctcaagtgactctcctgt

SEQ ID NO: 440521 - DNA, 20 bp, Artificial
  CRISPR gRNA sequence
aagtgactctcctgtcttgg

SEQ ID NO: 440522 - DNA, 20 bp, Artificial
  CRISPR gRNA sequence
tcctgtcttggcctcccgaa

SEQ ID NO: 440523 - DNA, 20 bp, Artificial
  CRISPR gRNA sequence
ctgtcttggcctcccgaagt

SEQ ID NO: 440524 - DNA, 20 bp, Artificial
  CRISPR gRNA sequence
tcttggcctcccgaagtgtt

SEQ ID NO: 440525 - DNA, 20 bp, Artificial
  CRISPR gRNA sequence
ggcctcccgaagtgttagga

SEQ ID NO: 440526 - DNA, 20 bp, Artificial
  CRISPR gRNA sequence
gcctcccgaagtgttaggat

SEQ ID NO: 440527 - DNA, 20 bp, Artificial
  CRISPR gRNA sequence
ccgaagtgttaggattatag

SEQ ID NO: 440528 - DNA, 20 bp, Artificial
  CRISPR gRNA sequence
ggattataggcatgagccat

SEQ ID NO: 440529 - DNA, 20 bp, Artificial
  CRISPR gRNA sequence
taggcatgagccattgtgct

SEQ ID NO: 440530 - DNA, 20 bp, Artificial
  CRISPR gRNA sequence
tgctcagacattgatttggg

SEQ ID NO: 440531 - DNA, 20 bp, Artificial
  CRISPR gRNA sequence
agacattgatttgggtttta

SEQ ID NO: 440532 - DNA, 20 bp, Artificial
  CRISPR gRNA sequence
atttgggttttaatattgga

SEQ ID NO: 440533 - DNA, 20 bp, Artificial
  CRISPR gRNA sequence
gggttttaatattggattcg

SEQ ID NO: 440534 - DNA, 20 bp, Artificial
  CRISPR gRNA sequence
ggttttaatattggattcga

SEQ ID NO: 440535 - DNA, 20 bp, Artificial
  CRISPR gRNA sequence
taatattggattcgaaggag

SEQ ID NO: 440536 - DNA, 20 bp, Artificial
  CRISPR gRNA sequence
aatattggattcgaaggagg

SEQ ID NO: 440537 - DNA, 20 bp, Artificial
  CRISPR gRNA sequence
atattggattcgaaggagga

SEQ ID NO: 440538 - DNA, 20 bp, Artificial
  CRISPR gRNA sequence
gattcgaaggaggaataaag

SEQ ID NO: 440539 - DNA, 20 bp, Artificial
  CRISPR gRNA sequence
gaaggaggaataaagaaatg

SEQ ID NO: 440540 - DNA, 20 bp, Artificial
  CRISPR gRNA sequence
agtagaaataatggtgtctt

SEQ ID NO: 440541 - DNA, 20 bp, Artificial
  CRISPR gRNA sequence
ggagtaaggaatggccaaaa

SEQ ID NO: 440542 - DNA, 20 bp, Artificial
  CRISPR gRNA sequence
gagtaaggaatggccaaaag

SEQ ID NO: 440543 - DNA, 20 bp, Artificial
  CRISPR gRNA sequence
tagatgtatgttggaggaag

SEQ ID NO: 440544 - DNA, 20 bp, Artificial
  CRISPR gRNA sequence
agatgtatgttggaggaaga

SEQ ID NO: 440545 - DNA, 20 bp, Artificial
  CRISPR gRNA sequence
gatgtatgttggaggaagac

SEQ ID NO: 440546 - DNA, 20 bp, Artificial
  CRISPR gRNA sequence
gaggaagactgcaggaatct

SEQ ID NO: 440547 - DNA, 20 bp, Artificial
  CRISPR gRNA sequence
caggaatcttctgttgttgt

SEQ ID NO: 440548 - DNA, 20 bp, Artificial
  CRISPR gRNA sequence
ctgttgttgtttttctctga

SEQ ID NO: 440549 - DNA, 20 bp, Artificial
  CRISPR gRNA sequence
tgttgttgtttttctctgag

SEQ ID NO: 440550 - DNA, 20 bp, Artificial
  CRISPR gRNA sequence
ttgttgtttttctctgagac

SEQ ID NO: 440551 - DNA, 20 bp, Artificial
  CRISPR gRNA sequence
ttgtttttctctgagacagg

SEQ ID NO: 440552 - DNA, 20 bp, Artificial
  CRISPR gRNA sequence
tttttctctgagacagggtc

SEQ ID NO: 440553 - DNA, 20 bp, Artificial
  CRISPR gRNA sequence
ttctctgagacagggtctcc

SEQ ID NO: 440554 - DNA, 20 bp, Artificial
  CRISPR gRNA sequence
tctctgagacagggtctccc

SEQ ID NO: 440555 - DNA, 20 bp, Artificial
  CRISPR gRNA sequence
ctctgagacagggtctccct

SEQ ID NO: 440556 - DNA, 20 bp, Artificial
  CRISPR gRNA sequence
tctgagacagggtctccctg

SEQ ID NO: 440557 - DNA, 20 bp, Artificial
  CRISPR gRNA sequence
tgagacagggtctccctgtg

SEQ ID NO: 440558 - DNA, 20 bp, Artificial
  CRISPR gRNA sequence
agacagggtctccctgtgct

SEQ ID NO: 440559 - DNA, 20 bp, Artificial
  CRISPR gRNA sequence
cctgtgctgtgtcacccagg

SEQ ID NO: 440560 - DNA, 20 bp, Artificial
  CRISPR gRNA sequence
tgctgtgtcacccaggctag

SEQ ID NO: 440561 - DNA, 20 bp, Artificial
  CRISPR gRNA sequence
tgtcacccaggctagaatgc

SEQ ID NO: 440562 - DNA, 20 bp, Artificial
  CRISPR gRNA sequence
gaatgcagcagcaagatcat

SEQ ID NO: 440563 - DNA, 20 bp, Artificial
  CRISPR gRNA sequence
atagcctcaaactcctgggc

SEQ ID NO: 440564 - DNA, 20 bp, Artificial
  CRISPR gRNA sequence
aaactcctgggctcaagtga

SEQ ID NO: 440565 - DNA, 20 bp, Artificial
  CRISPR gRNA sequence
ctgggctcaagtgatcttcc

SEQ ID NO: 440566 - DNA, 20 bp, Artificial
  CRISPR gRNA sequence
ggctcaagtgatcttcctgc

SEQ ID NO: 440567 - DNA, 20 bp, Artificial
  CRISPR gRNA sequence
aagtgatcttcctgcttcat

SEQ ID NO: 440568 - DNA, 20 bp, Artificial
  CRISPR gRNA sequence
cctgcttcattctcctgagt

SEQ ID NO: 440569 - DNA, 20 bp, Artificial
  CRISPR gRNA sequence
ctgcttcattctcctgagta

SEQ ID NO: 440570 - DNA, 20 bp, Artificial
  CRISPR gRNA sequence
cttcattctcctgagtagct

SEQ ID NO: 440571 - DNA, 20 bp, Artificial
  CRISPR gRNA sequence
cattctcctgagtagctggg

SEQ ID NO: 440572 - DNA, 20 bp, Artificial
  CRISPR gRNA sequence
attctcctgagtagctggga

SEQ ID NO: 440573 - DNA, 20 bp, Artificial
  CRISPR gRNA sequence
tcctgagtagctgggacgat

SEQ ID NO: 440574 - DNA, 20 bp, Artificial
  CRISPR gRNA sequence
ctgagtagctgggacgatag

SEQ ID NO: 440575 - DNA, 20 bp, Artificial
  CRISPR gRNA sequence
agtagctgggacgataggcg

SEQ ID NO: 440576 - DNA, 20 bp, Artificial
  CRISPR gRNA sequence
ggacgataggcgtgcaccac

SEQ ID NO: 440577 - DNA, 20 bp, Artificial
  CRISPR gRNA sequence
aggaatctcaacatctaagg

SEQ ID NO: 440578 - DNA, 20 bp, Artificial
  CRISPR gRNA sequence
aacatctaaggatcaggcag

SEQ ID NO: 440579 - DNA, 20 bp, Artificial
  CRISPR gRNA sequence
aggatcaggcagaagaagat

SEQ ID NO: 440580 - DNA, 20 bp, Artificial
  CRISPR gRNA sequence
aaaagcaatggatcaaagag

SEQ ID NO: 440581 - DNA, 20 bp, Artificial
  CRISPR gRNA sequence
cagaagccaagagaaggagg

SEQ ID NO: 440582 - DNA, 20 bp, Artificial
  CRISPR gRNA sequence
agaagccaagagaaggagga

SEQ ID NO: 440583 - DNA, 20 bp, Artificial
  CRISPR gRNA sequence
tctagaatgagtgatcaatt

SEQ ID NO: 440584 - DNA, 20 bp, Artificial
  CRISPR gRNA sequence
ctagaatgagtgatcaattt

SEQ ID NO: 440585 - DNA, 20 bp, Artificial
  CRISPR gRNA sequence
tagaatgagtgatcaattta

SEQ ID NO: 440586 - DNA, 20 bp, Artificial
  CRISPR gRNA sequence
gaatgagtgatcaatttaaa

SEQ ID NO: 440587 - DNA, 20 bp, Artificial
  CRISPR gRNA sequence
aaaaggttgactataataaa

SEQ ID NO: 440588 - DNA, 20 bp, Artificial
  CRISPR gRNA sequence
aaaggttgactataataaag

SEQ ID NO: 440589 - DNA, 20 bp, Artificial
  CRISPR gRNA sequence
actataataaagataaaggt

SEQ ID NO: 440590 - DNA, 20 bp, Artificial
  CRISPR gRNA sequence
taataaagataaaggtatca

SEQ ID NO: 440591 - DNA, 20 bp, Artificial
  CRISPR gRNA sequence
ggaacggtggctcacgccta

SEQ ID NO: 440592 - DNA, 20 bp, Artificial
  CRISPR gRNA sequence
acgcctataatcccagcact

SEQ ID NO: 440593 - DNA, 20 bp, Artificial
  CRISPR gRNA sequence
taatcccagcactttgggag

SEQ ID NO: 440594 - DNA, 20 bp, Artificial
  CRISPR gRNA sequence
tgggaggccaaggcgggcag

SEQ ID NO: 440595 - DNA, 20 bp, Artificial
  CRISPR gRNA sequence
gggaggccaaggcgggcaga

SEQ ID NO: 440596 - DNA, 20 bp, Artificial
  CRISPR gRNA sequence
ggaggccaaggcgggcagat

SEQ ID NO: 440597 - DNA, 20 bp, Artificial
  CRISPR gRNA sequence
aggtcaagagtttgagacca

SEQ ID NO: 440598 - DNA, 20 bp, Artificial
  CRISPR gRNA sequence
gagaccagcctggccaacat

SEQ ID NO: 440599 - DNA, 20 bp, Artificial
  CRISPR gRNA sequence
agaccagcctggccaacatg

SEQ ID NO: 440600 - DNA, 20 bp, Artificial
  CRISPR gRNA sequence
gccaacatggtgaaaccccc

SEQ ID NO: 440601 - DNA, 20 bp, Artificial
  CRISPR gRNA sequence
tactaaaaatacaaaattag

SEQ ID NO: 440602 - DNA, 20 bp, Artificial
  CRISPR gRNA sequence
ctaaaaatacaaaattagcc

SEQ ID NO: 440603 - DNA, 20 bp, Artificial
  CRISPR gRNA sequence
aaaatacaaaattagccagg

SEQ ID NO: 440604 - DNA, 20 bp, Artificial
  CRISPR gRNA sequence
gccaggcatggcggcacatg

SEQ ID NO: 440605 - DNA, 20 bp, Artificial
  CRISPR gRNA sequence
ctcaggaggctgagggggga

SEQ ID NO: 440606 - DNA, 20 bp, Artificial
  CRISPR gRNA sequence
aggaggctgaggggggagaa

SEQ ID NO: 440607 - DNA, 20 bp, Artificial
  CRISPR gRNA sequence
aggggggagaatcacttgaa

SEQ ID NO: 440608 - DNA, 20 bp, Artificial
  CRISPR gRNA sequence
gaacccggggaggcagaggt

SEQ ID NO: 440609 - DNA, 20 bp, Artificial
  CRISPR gRNA sequence
aacccggggaggcagaggtt

SEQ ID NO: 440610 - DNA, 20 bp, Artificial
  CRISPR gRNA sequence
cagtgagccaagattgcacc

SEQ ID NO: 440611 - DNA, 20 bp, Artificial
  CRISPR gRNA sequence
caccattgcactccagccta

SEQ ID NO: 440612 - DNA, 20 bp, Artificial
  CRISPR gRNA sequence
cactccagcctaagcaacaa

SEQ ID NO: 440613 - DNA, 20 bp, Artificial
  CRISPR gRNA sequence
cagcctaagcaacaagagtg

SEQ ID NO: 440614 - DNA, 20 bp, Artificial
  CRISPR gRNA sequence
agcaacaagagtgaaactct

SEQ ID NO: 440615 - DNA, 20 bp, Artificial
  CRISPR gRNA sequence
tgtctcaaaaaaaaaaaaaa

SEQ ID NO: 440616 - DNA, 20 bp, Artificial
  CRISPR gRNA sequence
tctcaaaaaaaaaaaaaaag

SEQ ID NO: 440617 - DNA, 20 bp, Artificial
  CRISPR gRNA sequence
aaaaaaaaaaaaaaagataa

SEQ ID NO: 440618 - DNA, 20 bp, Artificial
  CRISPR gRNA sequence
ttaatatttaatttagaaaa

SEQ ID NO: 440619 - DNA, 20 bp, Artificial
  CRISPR gRNA sequence
atatttaatttagaaaactg

SEQ ID NO: 440620 - DNA, 20 bp, Artificial
  CRISPR gRNA sequence
aatttagaaaactgaaggtc

SEQ ID NO: 440621 - DNA, 20 bp, Artificial
  CRISPR gRNA sequence
atttagaaaactgaaggtca

SEQ ID NO: 440622 - DNA, 20 bp, Artificial
  CRISPR gRNA sequence
agaaaactgaaggtcagtgg

SEQ ID NO: 440623 - DNA, 20 bp, Artificial
  CRISPR gRNA sequence
gaaaactgaaggtcagtggt

SEQ ID NO: 440624 - DNA, 20 bp, Artificial
  CRISPR gRNA sequence
aaggtcagtggtgagcttga

SEQ ID NO: 440625 - DNA, 20 bp, Artificial
  CRISPR gRNA sequence
gaccatttccgttgtgcttt

SEQ ID NO: 440626 - DNA, 20 bp, Artificial
  CRISPR gRNA sequence
accatttccgttgtgctttg

SEQ ID NO: 440627 - DNA, 20 bp, Artificial
  CRISPR gRNA sequence
ccgttgtgctttggagcaga

SEQ ID NO: 440628 - DNA, 20 bp, Artificial
  CRISPR gRNA sequence
cgttgtgctttggagcagaa

SEQ ID NO: 440629 - DNA, 20 bp, Artificial
  CRISPR gRNA sequence
tgctttggagcagaaactag

SEQ ID NO: 440630 - DNA, 20 bp, Artificial
  CRISPR gRNA sequence
tggagcagaaactagatgat

SEQ ID NO: 440631 - DNA, 20 bp, Artificial
  CRISPR gRNA sequence
ggagcagaaactagatgatg

SEQ ID NO: 440632 - DNA, 20 bp, Artificial
  CRISPR gRNA sequence
gagcagaaactagatgatgg

SEQ ID NO: 440633 - DNA, 20 bp, Artificial
  CRISPR gRNA sequence
gatgatggtgggtcaaggag

SEQ ID NO: 440634 - DNA, 20 bp, Artificial
  CRISPR gRNA sequence
ctttgaaaaatatggctgtg

SEQ ID NO: 440635 - DNA, 20 bp, Artificial
  CRISPR gRNA sequence
tgaaaaatatggctgtgaga

SEQ ID NO: 440636 - DNA, 20 bp, Artificial
  CRISPR gRNA sequence
gaaaaatatggctgtgagaa

SEQ ID NO: 440637 - DNA, 20 bp, Artificial
  CRISPR gRNA sequence
aaaaatatggctgtgagaac

SEQ ID NO: 440638 - DNA, 20 bp, Artificial
  CRISPR gRNA sequence
tgagaacgagttgagaaatg

SEQ ID NO: 440639 - DNA, 20 bp, Artificial
  CRISPR gRNA sequence
agaaatgggactagctggag

SEQ ID NO: 440640 - DNA, 20 bp, Artificial
  CRISPR gRNA sequence
gctggagaggaatgcatgga

SEQ ID NO: 440641 - DNA, 20 bp, Artificial
  CRISPR gRNA sequence
gagaggaatgcatggactag

SEQ ID NO: 440642 - DNA, 20 bp, Artificial
  CRISPR gRNA sequence
gaacatatattctgctaatg

SEQ ID NO: 440643 - DNA, 20 bp, Artificial
  CRISPR gRNA sequence
tgctaatgaaaatagcataa

SEQ ID NO: 440644 - DNA, 20 bp, Artificial
  CRISPR gRNA sequence
ctaatgaaaatagcataaac

SEQ ID NO: 440645 - DNA, 20 bp, Artificial
  CRISPR gRNA sequence
atgaaaatagcataaacaga

SEQ ID NO: 440646 - DNA, 20 bp, Artificial
  CRISPR gRNA sequence
agaagaaagggataaaaaga

SEQ ID NO: 440647 - DNA, 20 bp, Artificial
  CRISPR gRNA sequence
ggcctaggcaatggagatta

SEQ ID NO: 440648 - DNA, 20 bp, Artificial
  CRISPR gRNA sequence
gcctaggcaatggagattaa

SEQ ID NO: 440649 - DNA, 20 bp, Artificial
  CRISPR gRNA sequence
ggcaatggagattaaaaagc

SEQ ID NO: 440650 - DNA, 20 bp, Artificial
  CRISPR gRNA sequence
aaaagccctttcatatttca

SEQ ID NO: 440651 - DNA, 20 bp, Artificial
  CRISPR gRNA sequence
tcatatttcatcagttagga

SEQ ID NO: 440652 - DNA, 20 bp, Artificial
  CRISPR gRNA sequence
catatttcatcagttaggag

SEQ ID NO: 440653 - DNA, 20 bp, Artificial
  CRISPR gRNA sequence
atatttcatcagttaggaga

SEQ ID NO: 440654 - DNA, 20 bp, Artificial
  CRISPR gRNA sequence
catcagttaggagaggggca

SEQ ID NO: 440655 - DNA, 20 bp, Artificial
  CRISPR gRNA sequence
atcagttaggagaggggcaa

SEQ ID NO: 440656 - DNA, 20 bp, Artificial
  CRISPR gRNA sequence
ggagaggggcaaagaagttt

SEQ ID NO: 440657 - DNA, 20 bp, Artificial
  CRISPR gRNA sequence
tgagcagcagtgaggtatgg

SEQ ID NO: 440658 - DNA, 20 bp, Artificial
  CRISPR gRNA sequence
gagcagcagtgaggtatgga

SEQ ID NO: 440659 - DNA, 20 bp, Artificial
  CRISPR gRNA sequence
agcagcagtgaggtatggat

SEQ ID NO: 440660 - DNA, 20 bp, Artificial
  CRISPR gRNA sequence
agagagtacactagaaagat

SEQ ID NO: 440661 - DNA, 20 bp, Artificial
  CRISPR gRNA sequence
gaaagatggaagattgtggg

SEQ ID NO: 440662 - DNA, 20 bp, Artificial
  CRISPR gRNA sequence
tggggcattattgagtgtca

SEQ ID NO: 440663 - DNA, 20 bp, Artificial
  CRISPR gRNA sequence
ttgagtgtcagtttgttttt

SEQ ID NO: 440664 - DNA, 20 bp, Artificial
  CRISPR gRNA sequence
agtgtcagtttgtttttgtg

SEQ ID NO: 440665 - DNA, 20 bp, Artificial
  CRISPR gRNA sequence
gtttttgtgaggtcatgact

SEQ ID NO: 440666 - DNA, 20 bp, Artificial
  CRISPR gRNA sequence
tttttgtgaggtcatgactt

SEQ ID NO: 440667 - DNA, 20 bp, Artificial
  CRISPR gRNA sequence
ttgtgaggtcatgacttaaa

SEQ ID NO: 440668 - DNA, 20 bp, Artificial
  CRISPR gRNA sequence
tgtgaggtcatgacttaaaa

SEQ ID NO: 440669 - DNA, 20 bp, Artificial
  CRISPR gRNA sequence
gtgaggtcatgacttaaaaa

SEQ ID NO: 440670 - DNA, 20 bp, Artificial
  CRISPR gRNA sequence
tgaggtcatgacttaaaaag

SEQ ID NO: 440671 - DNA, 20 bp, Artificial
  CRISPR gRNA sequence
aaaaagctgtcaccttgatt

SEQ ID NO: 440672 - DNA, 20 bp, Artificial
  CRISPR gRNA sequence
aaaagctgtcaccttgattt

SEQ ID NO: 440673 - DNA, 20 bp, Artificial
  CRISPR gRNA sequence
tcaccttgattttaatattt

SEQ ID NO: 440674 - DNA, 20 bp, Artificial
  CRISPR gRNA sequence
gattttaatattttctccag

SEQ ID NO: 440675 - DNA, 20 bp, Artificial
  CRISPR gRNA sequence
attttaatattttctccagc

SEQ ID NO: 440676 - DNA, 20 bp, Artificial
  CRISPR gRNA sequence
taatattttctccagcaact

SEQ ID NO: 440677 - DNA, 20 bp, Artificial
  CRISPR gRNA sequence
aatattttctccagcaactt

SEQ ID NO: 440678 - DNA, 20 bp, Artificial
  CRISPR gRNA sequence
atattttctccagcaacttc

SEQ ID NO: 440679 - DNA, 20 bp, Artificial
  CRISPR gRNA sequence
tctccagcaacttccaggga

SEQ ID NO: 440680 - DNA, 20 bp, Artificial
  CRISPR gRNA sequence
ctccagcaacttccagggaa

SEQ ID NO: 440681 - DNA, 20 bp, Artificial
  CRISPR gRNA sequence
tccagcaacttccagggaaa

SEQ ID NO: 440682 - DNA, 20 bp, Artificial
  CRISPR gRNA sequence
cagcaacttccagggaaaag

SEQ ID NO: 440683 - DNA, 20 bp, Artificial
  CRISPR gRNA sequence
ccagggaaaagattggaaat

SEQ ID NO: 440684 - DNA, 20 bp, Artificial
  CRISPR gRNA sequence
cagggaaaagattggaaatg

SEQ ID NO: 440685 - DNA, 20 bp, Artificial
  CRISPR gRNA sequence
gaaatgaaacaggcctttct

SEQ ID NO: 440686 - DNA, 20 bp, Artificial
  CRISPR gRNA sequence
tcttatctgtacttctcagt

SEQ ID NO: 440687 - DNA, 20 bp, Artificial
  CRISPR gRNA sequence
cttatctgtacttctcagta

SEQ ID NO: 440688 - DNA, 20 bp, Artificial
  CRISPR gRNA sequence
ttatctgtacttctcagtag

SEQ ID NO: 440689 - DNA, 20 bp, Artificial
  CRISPR gRNA sequence
atctgtacttctcagtagcc

SEQ ID NO: 440690 - DNA, 20 bp, Artificial
  CRISPR gRNA sequence
tctgtacttctcagtagcca

SEQ ID NO: 440691 - DNA, 20 bp, Artificial
  CRISPR gRNA sequence
tacttctcagtagccatgtt

SEQ ID NO: 440692 - DNA, 20 bp, Artificial
  CRISPR gRNA sequence
ctcagtagccatgttttttt

SEQ ID NO: 440693 - DNA, 20 bp, Artificial
  CRISPR gRNA sequence
tcagtagccatgtttttttg

SEQ ID NO: 440694 - DNA, 20 bp, Artificial
  CRISPR gRNA sequence
agtagccatgtttttttgga

SEQ ID NO: 440695 - DNA, 20 bp, Artificial
  CRISPR gRNA sequence
ttttggagtggcatatatgt

SEQ ID NO: 440696 - DNA, 20 bp, Artificial
  CRISPR gRNA sequence
tttggagtggcatatatgtg

SEQ ID NO: 440697 - DNA, 20 bp, Artificial
  CRISPR gRNA sequence
ttggagtggcatatatgtgt

SEQ ID NO: 440698 - DNA, 20 bp, Artificial
  CRISPR gRNA sequence
tggagtggcatatatgtgtg

SEQ ID NO: 440699 - DNA, 20 bp, Artificial
  CRISPR gRNA sequence
ggagtggcatatatgtgtgt

SEQ ID NO: 440700 - DNA, 20 bp, Artificial
  CRISPR gRNA sequence
gagtggcatatatgtgtgtg

SEQ ID NO: 440701 - DNA, 20 bp, Artificial
  CRISPR gRNA sequence
cctctagatcccatcactct

SEQ ID NO: 440702 - DNA, 20 bp, Artificial
  CRISPR gRNA sequence
ctctagatcccatcactctt

SEQ ID NO: 440703 - DNA, 20 bp, Artificial
  CRISPR gRNA sequence
tagatcccatcactctttat

SEQ ID NO: 440704 - DNA, 20 bp, Artificial
  CRISPR gRNA sequence
gatcccatcactctttatac

SEQ ID NO: 440705 - DNA, 20 bp, Artificial
  CRISPR gRNA sequence
tttatacaaactagaataag

SEQ ID NO: 440706 - DNA, 20 bp, Artificial
  CRISPR gRNA sequence
tatacaaactagaataagtg

SEQ ID NO: 440707 - DNA, 20 bp, Artificial
  CRISPR gRNA sequence
atacaaactagaataagtgc

SEQ ID NO: 440708 - DNA, 20 bp, Artificial
  CRISPR gRNA sequence
tacaaactagaataagtgct

SEQ ID NO: 440709 - DNA, 20 bp, Artificial
  CRISPR gRNA sequence
gaataagtgctaatatgtat

SEQ ID NO: 440710 - DNA, 20 bp, Artificial
  CRISPR gRNA sequence
atatgtataaattatggtca

SEQ ID NO: 440711 - DNA, 20 bp, Artificial
  CRISPR gRNA sequence
tggtcatattatatatatat

SEQ ID NO: 440712 - DNA, 20 bp, Artificial
  CRISPR gRNA sequence
tatatatatatatatatata

SEQ ID NO: 440713 - DNA, 20 bp, Artificial
  CRISPR gRNA sequence
taatatatataatagtaaag

SEQ ID NO: 440714 - DNA, 20 bp, Artificial
  CRISPR gRNA sequence
atatatataatagtaaagct

SEQ ID NO: 440715 - DNA, 20 bp, Artificial
  CRISPR gRNA sequence
aaagttttactttgagccat

SEQ ID NO: 440716 - DNA, 20 bp, Artificial
  CRISPR gRNA sequence
tactttgagccatggcagaa

SEQ ID NO: 440717 - DNA, 20 bp, Artificial
  CRISPR gRNA sequence
actttgagccatggcagaag

SEQ ID NO: 440718 - DNA, 20 bp, Artificial
  CRISPR gRNA sequence
ctttgagccatggcagaagt

SEQ ID NO: 440719 - DNA, 20 bp, Artificial
  CRISPR gRNA sequence
tgagccatggcagaagtcaa

SEQ ID NO: 440720 - DNA, 20 bp, Artificial
  CRISPR gRNA sequence
gagccatggcagaagtcaaa

SEQ ID NO: 440721 - DNA, 20 bp, Artificial
  CRISPR gRNA sequence
agccatggcagaagtcaaaa

SEQ ID NO: 440722 - DNA, 20 bp, Artificial
  CRISPR gRNA sequence
tcagtgctccttaacaatcc

SEQ ID NO: 440723 - DNA, 20 bp, Artificial
  CRISPR gRNA sequence
cttaacaatccctagtctgt

SEQ ID NO: 440724 - DNA, 20 bp, Artificial
  CRISPR gRNA sequence
aacaatccctagtctgtttt

SEQ ID NO: 440725 - DNA, 20 bp, Artificial
  CRISPR gRNA sequence
acaatccctagtctgttttg

SEQ ID NO: 440726 - DNA, 20 bp, Artificial
  CRISPR gRNA sequence
gtctgttttggaaatactca

SEQ ID NO: 440727 - DNA, 20 bp, Artificial
  CRISPR gRNA sequence
ttttggaaatactcaagtga

SEQ ID NO: 440728 - DNA, 20 bp, Artificial
  CRISPR gRNA sequence
tggaaatactcaagtgaggc

SEQ ID NO: 440729 - DNA, 20 bp, Artificial
  CRISPR gRNA sequence
ggaaatactcaagtgaggct

SEQ ID NO: 440730 - DNA, 20 bp, Artificial
  CRISPR gRNA sequence
gaaatactcaagtgaggcta

SEQ ID NO: 440731 - DNA, 20 bp, Artificial
  CRISPR gRNA sequence
aagtgaggctaagtgcaatg

SEQ ID NO: 440732 - DNA, 20 bp, Artificial
  CRISPR gRNA sequence
agtgcaatgactcatgccta

SEQ ID NO: 440733 - DNA, 20 bp, Artificial
  CRISPR gRNA sequence
atgcctataatcccaacatt

SEQ ID NO: 440734 - DNA, 20 bp, Artificial
  CRISPR gRNA sequence
taatcccaacattttgggag

SEQ ID NO: 440735 - DNA, 20 bp, Artificial
  CRISPR gRNA sequence
tgggaggctgaggtgggagg

SEQ ID NO: 440736 - DNA, 20 bp, Artificial
  CRISPR gRNA sequence
gggaggctgaggtgggagga

SEQ ID NO: 440737 - DNA, 20 bp, Artificial
  CRISPR gRNA sequence
ggaggctgaggtgggaggat

SEQ ID NO: 440738 - DNA, 20 bp, Artificial
  CRISPR gRNA sequence
aggtgggaggattatttaag

SEQ ID NO: 440739 - DNA, 20 bp, Artificial
  CRISPR gRNA sequence
tttaagcccaggagtttgag

SEQ ID NO: 440740 - DNA, 20 bp, Artificial
  CRISPR gRNA sequence
aagcccaggagtttgagacc

SEQ ID NO: 440741 - DNA, 20 bp, Artificial
  CRISPR gRNA sequence
agcccaggagtttgagacca

SEQ ID NO: 440742 - DNA, 20 bp, Artificial
  CRISPR gRNA sequence
gagaccagcttgagcaacat

SEQ ID NO: 440743 - DNA, 20 bp, Artificial
  CRISPR gRNA sequence
agaccagcttgagcaacata

SEQ ID NO: 440744 - DNA, 20 bp, Artificial
  CRISPR gRNA sequence
gagcaacatagcaagatctc

SEQ ID NO: 440745 - DNA, 20 bp, Artificial
  CRISPR gRNA sequence
agcaacatagcaagatctca

SEQ ID NO: 440746 - DNA, 20 bp, Artificial
  CRISPR gRNA sequence
atttctatttttattttatt

SEQ ID NO: 440747 - DNA, 20 bp, Artificial
  CRISPR gRNA sequence
ctatttttattttattttat

SEQ ID NO: 440748 - DNA, 20 bp, Artificial
  CRISPR gRNA sequence
tatttttattttattttatt

SEQ ID NO: 440749 - DNA, 20 bp, Artificial
  CRISPR gRNA sequence
tttttattttattttatttt

SEQ ID NO: 440750 - DNA, 20 bp, Artificial
  CRISPR gRNA sequence
ttattttattttattttatt

SEQ ID NO: 440751 - DNA, 20 bp, Artificial
  CRISPR gRNA sequence
tattttattttattttattt

SEQ ID NO: 440752 - DNA, 20 bp, Artificial
  CRISPR gRNA sequence
attttattttattttattta

SEQ ID NO: 440753 - DNA, 20 bp, Artificial
  CRISPR gRNA sequence
ttttattttattttatttat

SEQ ID NO: 440754 - DNA, 20 bp, Artificial
  CRISPR gRNA sequence
tattttattttatttatttt

SEQ ID NO: 440755 - DNA, 20 bp, Artificial
  CRISPR gRNA sequence
attttattttatttattttt

SEQ ID NO: 440756 - DNA, 20 bp, Artificial
  CRISPR gRNA sequence
ttttattttatttatttttt

SEQ ID NO: 440757 - DNA, 20 bp, Artificial
  CRISPR gRNA sequence
tattttatttattttttgag

SEQ ID NO: 440758 - DNA, 20 bp, Artificial
  CRISPR gRNA sequence
attttatttattttttgaga

SEQ ID NO: 440759 - DNA, 20 bp, Artificial
  CRISPR gRNA sequence
ttttatttattttttgagat

SEQ ID NO: 440760 - DNA, 20 bp, Artificial
  CRISPR gRNA sequence
tatttattttttgagatgga

SEQ ID NO: 440761 - DNA, 20 bp, Artificial
  CRISPR gRNA sequence
atttattttttgagatggag

SEQ ID NO: 440762 - DNA, 20 bp, Artificial
  CRISPR gRNA sequence
tttattttttgagatggagt

SEQ ID NO: 440763 - DNA, 20 bp, Artificial
  CRISPR gRNA sequence
attttttgagatggagtttc

SEQ ID NO: 440764 - DNA, 20 bp, Artificial
  CRISPR gRNA sequence
ttttttgagatggagtttca

SEQ ID NO: 440765 - DNA, 20 bp, Artificial
  CRISPR gRNA sequence
tttgagatggagtttcactc

SEQ ID NO: 440766 - DNA, 20 bp, Artificial
  CRISPR gRNA sequence
ttgagatggagtttcactct

SEQ ID NO: 440767 - DNA, 20 bp, Artificial
  CRISPR gRNA sequence
tgagatggagtttcactctt

SEQ ID NO: 440768 - DNA, 20 bp, Artificial
  CRISPR gRNA sequence
gagatggagtttcactcttg

SEQ ID NO: 440769 - DNA, 20 bp, Artificial
  CRISPR gRNA sequence
agatggagtttcactcttgt

SEQ ID NO: 440770 - DNA, 20 bp, Artificial
  CRISPR gRNA sequence
cactcttgttgcccaggctg

SEQ ID NO: 440771 - DNA, 20 bp, Artificial
  CRISPR gRNA sequence
actcttgttgcccaggctgg

SEQ ID NO: 440772 - DNA, 20 bp, Artificial
  CRISPR gRNA sequence
ttgttgcccaggctggagtg

SEQ ID NO: 440773 - DNA, 20 bp, Artificial
  CRISPR gRNA sequence
gttgcccaggctggagtgca

SEQ ID NO: 440774 - DNA, 20 bp, Artificial
  CRISPR gRNA sequence
ttgcccaggctggagtgcaa

SEQ ID NO: 440775 - DNA, 20 bp, Artificial
  CRISPR gRNA sequence
cccaggctggagtgcaatgg

SEQ ID NO: 440776 - DNA, 20 bp, Artificial
  CRISPR gRNA sequence
gagtgcaatggcacgatctc

SEQ ID NO: 440777 - DNA, 20 bp, Artificial
  CRISPR gRNA sequence
agctcactgcaacctccgcc

SEQ ID NO: 440778 - DNA, 20 bp, Artificial
  CRISPR gRNA sequence
actgcaacctccgcctcctg

SEQ ID NO: 440779 - DNA, 20 bp, Artificial
  CRISPR gRNA sequence
caacctccgcctcctgggct

SEQ ID NO: 440780 - DNA, 20 bp, Artificial
  CRISPR gRNA sequence
cgcctcctgggctcaagtga

SEQ ID NO: 440781 - DNA, 20 bp, Artificial
  CRISPR gRNA sequence
ctgggctcaagtgattctcc

SEQ ID NO: 440782 - DNA, 20 bp, Artificial
  CRISPR gRNA sequence
ggctcaagtgattctcccac

SEQ ID NO: 440783 - DNA, 20 bp, Artificial
  CRISPR gRNA sequence
aagtgattctcccacctcag

SEQ ID NO: 440784 - DNA, 20 bp, Artificial
  CRISPR gRNA sequence
tcccacctcagcttcccgag

SEQ ID NO: 440785 - DNA, 20 bp, Artificial
  CRISPR gRNA sequence
ccacctcagcttcccgagta

SEQ ID NO: 440786 - DNA, 20 bp, Artificial
  CRISPR gRNA sequence
agcttcccgagtagctggaa

SEQ ID NO: 440787 - DNA, 20 bp, Artificial
  CRISPR gRNA sequence
cccgagtagctggaattata

SEQ ID NO: 440788 - DNA, 20 bp, Artificial
  CRISPR gRNA sequence
ccgagtagctggaattatag

SEQ ID NO: 440789 - DNA, 20 bp, Artificial
  CRISPR gRNA sequence
gaattataggcatgtgcccc

SEQ ID NO: 440790 - DNA, 20 bp, Artificial
  CRISPR gRNA sequence
taggcatgtgcccccatgcc

SEQ ID NO: 440791 - DNA, 20 bp, Artificial
  CRISPR gRNA sequence
attttgtatttttagtagag

SEQ ID NO: 440792 - DNA, 20 bp, Artificial
  CRISPR gRNA sequence
tgtatttttagtagagatga

SEQ ID NO: 440793 - DNA, 20 bp, Artificial
  CRISPR gRNA sequence
gtatttttagtagagatgag

SEQ ID NO: 440794 - DNA, 20 bp, Artificial
  CRISPR gRNA sequence
tatttttagtagagatgagg

SEQ ID NO: 440795 - DNA, 20 bp, Artificial
  CRISPR gRNA sequence
ttagtagagatgaggtttct

SEQ ID NO: 440796 - DNA, 20 bp, Artificial
  CRISPR gRNA sequence
tagtagagatgaggtttctc

SEQ ID NO: 440797 - DNA, 20 bp, Artificial
  CRISPR gRNA sequence
agtagagatgaggtttctcc

SEQ ID NO: 440798 - DNA, 20 bp, Artificial
  CRISPR gRNA sequence
gtagagatgaggtttctcca

SEQ ID NO: 440799 - DNA, 20 bp, Artificial
  CRISPR gRNA sequence
ctccacgttggtcaggctgg

SEQ ID NO: 440800 - DNA, 20 bp, Artificial
  CRISPR gRNA sequence
tccacgttggtcaggctggt

SEQ ID NO: 440801 - DNA, 20 bp, Artificial
  CRISPR gRNA sequence
cacgttggtcaggctggtct

SEQ ID NO: 440802 - DNA, 20 bp, Artificial
  CRISPR gRNA sequence
gtcaggctggtctcaaactc

SEQ ID NO: 440803 - DNA, 20 bp, Artificial
  CRISPR gRNA sequence
gtctcaaactcccagcctca

SEQ ID NO: 440804 - DNA, 20 bp, Artificial
  CRISPR gRNA sequence
aaactcccagcctcaggtta

SEQ ID NO: 440805 - DNA, 20 bp, Artificial
  CRISPR gRNA sequence
ccagcctcaggttatccact

SEQ ID NO: 440806 - DNA, 20 bp, Artificial
  CRISPR gRNA sequence
aggttatccactcacctcgg

SEQ ID NO: 440807 - DNA, 20 bp, Artificial
  CRISPR gRNA sequence
tccactcacctcggcctccc

SEQ ID NO: 440808 - DNA, 20 bp, Artificial
  CRISPR gRNA sequence
acctcggcctcccaaagtgc

SEQ ID NO: 440809 - DNA, 20 bp, Artificial
  CRISPR gRNA sequence
ggcctcccaaagtgctagga

SEQ ID NO: 440810 - DNA, 20 bp, Artificial
  CRISPR gRNA sequence
ccaaagtgctaggattacag

SEQ ID NO: 440811 - DNA, 20 bp, Artificial
  CRISPR gRNA sequence
ggattacaggcgtaagccac

SEQ ID NO: 440812 - DNA, 20 bp, Artificial
  CRISPR gRNA sequence
caggcgtaagccaccgtgct

SEQ ID NO: 440813 - DNA, 20 bp, Artificial
  CRISPR gRNA sequence
agcctctatttttaaatatg

SEQ ID NO: 440814 - DNA, 20 bp, Artificial
  CRISPR gRNA sequence
tatttttaaatatgtatata

SEQ ID NO: 440815 - DNA, 20 bp, Artificial
  CRISPR gRNA sequence
tttttaaatatgtatatatt

SEQ ID NO: 440816 - DNA, 20 bp, Artificial
  CRISPR gRNA sequence
ttaaatatgtatatattcat

SEQ ID NO: 440817 - DNA, 20 bp, Artificial
  CRISPR gRNA sequence
taaatatgtatatattcatc

SEQ ID NO: 440818 - DNA, 20 bp, Artificial
  CRISPR gRNA sequence
aaatatgtatatattcatca

SEQ ID NO: 440819 - DNA, 20 bp, Artificial
  CRISPR gRNA sequence
aatatgtatatattcatcac

SEQ ID NO: 440820 - DNA, 20 bp, Artificial
  CRISPR gRNA sequence
atcacgcctgtaatcccagc

SEQ ID NO: 440821 - DNA, 20 bp, Artificial
  CRISPR gRNA sequence
taatcccagcactttgggag

SEQ ID NO: 440822 - DNA, 20 bp, Artificial
  CRISPR gRNA sequence
tgggaggctgaagtaggagg

SEQ ID NO: 440823 - DNA, 20 bp, Artificial
  CRISPR gRNA sequence
gggaggctgaagtaggagga

SEQ ID NO: 440824 - DNA, 20 bp, Artificial
  CRISPR gRNA sequence
ggaggctgaagtaggaggat

SEQ ID NO: 440825 - DNA, 20 bp, Artificial
  CRISPR gRNA sequence
aagtaggaggatcacctgag

SEQ ID NO: 440826 - DNA, 20 bp, Artificial
  CRISPR gRNA sequence
agctcaggagattgagacca

SEQ ID NO: 440827 - DNA, 20 bp, Artificial
  CRISPR gRNA sequence
aggagattgagaccaatttt

SEQ ID NO: 440828 - DNA, 20 bp, Artificial
  CRISPR gRNA sequence
agaccaattttctgggcaac

SEQ ID NO: 440829 - DNA, 20 bp, Artificial
  CRISPR gRNA sequence
tctgggcaacatggcaaaac

SEQ ID NO: 440830 - DNA, 20 bp, Artificial
  CRISPR gRNA sequence
ctgggcaacatggcaaaacc

SEQ ID NO: 440831 - DNA, 20 bp, Artificial
  CRISPR gRNA sequence
tgggcaacatggcaaaaccc

SEQ ID NO: 440832 - DNA, 20 bp, Artificial
  CRISPR gRNA sequence
ggcaacatggcaaaaccctg

SEQ ID NO: 440833 - DNA, 20 bp, Artificial
  CRISPR gRNA sequence
tctctaccaaaaaaaaaaaa

SEQ ID NO: 440834 - DNA, 20 bp, Artificial
  CRISPR gRNA sequence
taccaaaaaaaaaaaaaaaa

SEQ ID NO: 440835 - DNA, 20 bp, Artificial
  CRISPR gRNA sequence
ccaaaaaaaaaaaaaaaaaa

SEQ ID NO: 440836 - DNA, 20 bp, Artificial
  CRISPR gRNA sequence
gccaggtgtggtggcatatg

SEQ ID NO: 440837 - DNA, 20 bp, Artificial
  CRISPR gRNA sequence
taatctcagctacttgggag

SEQ ID NO: 440838 - DNA, 20 bp, Artificial
  CRISPR gRNA sequence
agctacttgggaggctgagg

SEQ ID NO: 440839 - DNA, 20 bp, Artificial
  CRISPR gRNA sequence
cttgggaggctgaggcacaa

SEQ ID NO: 440840 - DNA, 20 bp, Artificial
  CRISPR gRNA sequence
gggaggctgaggcacaagaa

SEQ ID NO: 440841 - DNA, 20 bp, Artificial
  CRISPR gRNA sequence
ggaggctgaggcacaagaat

SEQ ID NO: 440842 - DNA, 20 bp, Artificial
  CRISPR gRNA sequence
aggcacaagaattgcttgaa

SEQ ID NO: 440843 - DNA, 20 bp, Artificial
  CRISPR gRNA sequence
cttgaacccaggaggcagag

SEQ ID NO: 440844 - DNA, 20 bp, Artificial
  CRISPR gRNA sequence
gaacccaggaggcagaggtt

SEQ ID NO: 440845 - DNA, 20 bp, Artificial
  CRISPR gRNA sequence
aacccaggaggcagaggttg

SEQ ID NO: 440846 - DNA, 20 bp, Artificial
  CRISPR gRNA sequence
aagtgagccaagatcacacc

SEQ ID NO: 440847 - DNA, 20 bp, Artificial
  CRISPR gRNA sequence
tagtccagctcccaggtgac

SEQ ID NO: 440848 - DNA, 20 bp, Artificial
  CRISPR gRNA sequence
ccaggtgacagagtaagact

SEQ ID NO: 440849 - DNA, 20 bp, Artificial
  CRISPR gRNA sequence
tgtcccaataataataaata

SEQ ID NO: 440850 - DNA, 20 bp, Artificial
  CRISPR gRNA sequence
tcccaataataataaatata

SEQ ID NO: 440851 - DNA, 20 bp, Artificial
  CRISPR gRNA sequence
atgtgatcaattcaaaaatt

SEQ ID NO: 440852 - DNA, 20 bp, Artificial
  CRISPR gRNA sequence
aaaaattccatggctatctc

SEQ ID NO: 440853 - DNA, 20 bp, Artificial
  CRISPR gRNA sequence
catggctatctctgaataaa

SEQ ID NO: 440854 - DNA, 20 bp, Artificial
  CRISPR gRNA sequence
tctctgaataaacccaggta

SEQ ID NO: 440855 - DNA, 20 bp, Artificial
  CRISPR gRNA sequence
tgaataaacccaggtaagtg

SEQ ID NO: 440856 - DNA, 20 bp, Artificial
  CRISPR gRNA sequence
aataaacccaggtaagtgtg

SEQ ID NO: 440857 - DNA, 20 bp, Artificial
  CRISPR gRNA sequence
ctttttctgaataatccatt

SEQ ID NO: 440858 - DNA, 20 bp, Artificial
  CRISPR gRNA sequence
tttttctgaataatccattt

SEQ ID NO: 440859 - DNA, 20 bp, Artificial
  CRISPR gRNA sequence
tttctgaataatccatttaa

SEQ ID NO: 440860 - DNA, 20 bp, Artificial
  CRISPR gRNA sequence
ttctgaataatccatttaac

SEQ ID NO: 440861 - DNA, 20 bp, Artificial
  CRISPR gRNA sequence
tctgaataatccatttaacc

SEQ ID NO: 440862 - DNA, 20 bp, Artificial
  CRISPR gRNA sequence
ctgaataatccatttaacca

SEQ ID NO: 440863 - DNA, 20 bp, Artificial
  CRISPR gRNA sequence
tgaataatccatttaaccat

SEQ ID NO: 440864 - DNA, 20 bp, Artificial
  CRISPR gRNA sequence
aataatccatttaaccataa

SEQ ID NO: 440865 - DNA, 20 bp, Artificial
  CRISPR gRNA sequence
aaccataatcgcagaaacca

SEQ ID NO: 440866 - DNA, 20 bp, Artificial
  CRISPR gRNA sequence
accataatcgcagaaaccat

SEQ ID NO: 440867 - DNA, 20 bp, Artificial
  CRISPR gRNA sequence
gtttcaaatccagtatctat

SEQ ID NO: 440868 - DNA, 20 bp, Artificial
  CRISPR gRNA sequence
caaatccagtatctatcaat

SEQ ID NO: 440869 - DNA, 20 bp, Artificial
  CRISPR gRNA sequence
aaatccagtatctatcaatt

SEQ ID NO: 440870 - DNA, 20 bp, Artificial
  CRISPR gRNA sequence
tcaattaactgtgtaaatgc

SEQ ID NO: 440871 - DNA, 20 bp, Artificial
  CRISPR gRNA sequence
actgtgtaaatgcaggcaag

SEQ ID NO: 440872 - DNA, 20 bp, Artificial
  CRISPR gRNA sequence
tgtaaatgcaggcaagtgac

SEQ ID NO: 440873 - DNA, 20 bp, Artificial
  CRISPR gRNA sequence
accttttagcatgctgattc

SEQ ID NO: 440874 - DNA, 20 bp, Artificial
  CRISPR gRNA sequence
ttagcatgctgattctccat

SEQ ID NO: 440875 - DNA, 20 bp, Artificial
  CRISPR gRNA sequence
tagcatgctgattctccatt

SEQ ID NO: 440876 - DNA, 20 bp, Artificial
  CRISPR gRNA sequence
agcatgctgattctccatta

SEQ ID NO: 440877 - DNA, 20 bp, Artificial
  CRISPR gRNA sequence
gcatgctgattctccattag

SEQ ID NO: 440878 - DNA, 20 bp, Artificial
  CRISPR gRNA sequence
attctccattagaaacatat

SEQ ID NO: 440879 - DNA, 20 bp, Artificial
  CRISPR gRNA sequence
tccattagaaacatattagt

SEQ ID NO: 440880 - DNA, 20 bp, Artificial
  CRISPR gRNA sequence
cattagaaacatattagtac

SEQ ID NO: 440881 - DNA, 20 bp, Artificial
  CRISPR gRNA sequence
gaaacatattagtacctatc

SEQ ID NO: 440882 - DNA, 20 bp, Artificial
  CRISPR gRNA sequence
gtacctatctcatagggtag

SEQ ID NO: 440883 - DNA, 20 bp, Artificial
  CRISPR gRNA sequence
tctcatagggtagttacgag

SEQ ID NO: 440884 - DNA, 20 bp, Artificial
  CRISPR gRNA sequence
atagggtagttacgagaatt

SEQ ID NO: 440885 - DNA, 20 bp, Artificial
  CRISPR gRNA sequence
cgagaatttaatgcacgtaa

SEQ ID NO: 440886 - DNA, 20 bp, Artificial
  CRISPR gRNA sequence
aatgcacgtaaagcacttgg

SEQ ID NO: 440887 - DNA, 20 bp, Artificial
  CRISPR gRNA sequence
atgcacgtaaagcacttggc

SEQ ID NO: 440888 - DNA, 20 bp, Artificial
  CRISPR gRNA sequence
ggcagcttcagtccacagtt

SEQ ID NO: 440889 - DNA, 20 bp, Artificial
  CRISPR gRNA sequence
gcagcttcagtccacagtta

SEQ ID NO: 440890 - DNA, 20 bp, Artificial
  CRISPR gRNA sequence
cagtccacagttagtggggg

SEQ ID NO: 440891 - DNA, 20 bp, Artificial
  CRISPR gRNA sequence
agtccacagttagtgggggg

SEQ ID NO: 440892 - DNA, 20 bp, Artificial
  CRISPR gRNA sequence
gtggggggaccaactcatgt

SEQ ID NO: 440893 - DNA, 20 bp, Artificial
  CRISPR gRNA sequence
atgtttttcttggactgttc

SEQ ID NO: 440894 - DNA, 20 bp, Artificial
  CRISPR gRNA sequence
ttcttggactgttccagttt

SEQ ID NO: 440895 - DNA, 20 bp, Artificial
  CRISPR gRNA sequence
tcttggactgttccagtttt

SEQ ID NO: 440896 - DNA, 20 bp, Artificial
  CRISPR gRNA sequence
cttggactgttccagtttta

SEQ ID NO: 440897 - DNA, 20 bp, Artificial
  CRISPR gRNA sequence
ttggactgttccagttttag

SEQ ID NO: 440898 - DNA, 20 bp, Artificial
  CRISPR gRNA sequence
ggactgttccagttttagcc

SEQ ID NO: 440899 - DNA, 20 bp, Artificial
  CRISPR gRNA sequence
gactgttccagttttagccc

SEQ ID NO: 440900 - DNA, 20 bp, Artificial
  CRISPR gRNA sequence
ttccagttttagccctagaa

SEQ ID NO: 440901 - DNA, 20 bp, Artificial
  CRISPR gRNA sequence
cagttttagccctagaagtc

SEQ ID NO: 440902 - DNA, 20 bp, Artificial
  CRISPR gRNA sequence
tagccctagaagtcccatat

SEQ ID NO: 440903 - DNA, 20 bp, Artificial
  CRISPR gRNA sequence
agccctagaagtcccatata

SEQ ID NO: 440904 - DNA, 20 bp, Artificial
  CRISPR gRNA sequence
gccctagaagtcccatatat

SEQ ID NO: 440905 - DNA, 20 bp, Artificial
  CRISPR gRNA sequence
gaagtcccatatatcttagg

SEQ ID NO: 440906 - DNA, 20 bp, Artificial
  CRISPR gRNA sequence
aggaacaccctttagtcttg

SEQ ID NO: 440907 - DNA, 20 bp, Artificial
  CRISPR gRNA sequence
ggaacaccctttagtcttga

SEQ ID NO: 440908 - DNA, 20 bp, Artificial
  CRISPR gRNA sequence
tagtcttgagctaatctgag

SEQ ID NO: 440909 - DNA, 20 bp, Artificial
  CRISPR gRNA sequence
agtcttgagctaatctgagg

SEQ ID NO: 440910 - DNA, 20 bp, Artificial
  CRISPR gRNA sequence
gtcttgagctaatctgaggt

SEQ ID NO: 440911 - DNA, 20 bp, Artificial
  CRISPR gRNA sequence
gagctaatctgaggtgattg

SEQ ID NO: 440912 - DNA, 20 bp, Artificial
  CRISPR gRNA sequence
agctaatctgaggtgattgc

SEQ ID NO: 440913 - DNA, 20 bp, Artificial
  CRISPR gRNA sequence
atctgaggtgattgctcact

SEQ ID NO: 440914 - DNA, 20 bp, Artificial
  CRISPR gRNA sequence
aggtgattgctcactctaca

SEQ ID NO: 440915 - DNA, 20 bp, Artificial
  CRISPR gRNA sequence
ctcactctacacacacagtc

SEQ ID NO: 440916 - DNA, 20 bp, Artificial
  CRISPR gRNA sequence
actctacacacacagtccct

SEQ ID NO: 440917 - DNA, 20 bp, Artificial
  CRISPR gRNA sequence
tacacacacagtccctgttt

SEQ ID NO: 440918 - DNA, 20 bp, Artificial
  CRISPR gRNA sequence
cacacacagtccctgtttgt

SEQ ID NO: 440919 - DNA, 20 bp, Artificial
  CRISPR gRNA sequence
tttgtgtattagtaagaaag

SEQ ID NO: 440920 - DNA, 20 bp, Artificial
  CRISPR gRNA sequence
gtgtattagtaagaaaggct

SEQ ID NO: 440921 - DNA, 20 bp, Artificial
  CRISPR gRNA sequence
tgtattagtaagaaaggctg

SEQ ID NO: 440922 - DNA, 20 bp, Artificial
  CRISPR gRNA sequence
gtaagaaaggctgctatgtc

SEQ ID NO: 440923 - DNA, 20 bp, Artificial
  CRISPR gRNA sequence
ctatgtcatattacgctctg

SEQ ID NO: 440924 - DNA, 20 bp, Artificial
  CRISPR gRNA sequence
tgtcatattacgctctgggg

SEQ ID NO: 440925 - DNA, 20 bp, Artificial
  CRISPR gRNA sequence
cgctctggggcataaggact

SEQ ID NO: 440926 - DNA, 20 bp, Artificial
  CRISPR gRNA sequence
tggggcataaggacttggtt

SEQ ID NO: 440927 - DNA, 20 bp, Artificial
  CRISPR gRNA sequence
gggcataaggacttggtttc

SEQ ID NO: 440928 - DNA, 20 bp, Artificial
  CRISPR gRNA sequence
ggtttctgccctaaaagaaa

SEQ ID NO: 440929 - DNA, 20 bp, Artificial
  CRISPR gRNA sequence
gtttctgccctaaaagaaaa

SEQ ID NO: 440930 - DNA, 20 bp, Artificial
  CRISPR gRNA sequence
ctgccctaaaagaaaataaa

SEQ ID NO: 440931 - DNA, 20 bp, Artificial
  CRISPR gRNA sequence
tgccctaaaagaaaataaaa

SEQ ID NO: 440932 - DNA, 20 bp, Artificial
  CRISPR gRNA sequence
ccctaaaagaaaataaaata

SEQ ID NO: 440933 - DNA, 20 bp, Artificial
  CRISPR gRNA sequence
aaagaaaataaaatagacac

SEQ ID NO: 440934 - DNA, 20 bp, Artificial
  CRISPR gRNA sequence
taaaagtgtgtgagtggcca

SEQ ID NO: 440935 - DNA, 20 bp, Artificial
  CRISPR gRNA sequence
acgcctgtaatcccaaaaca

SEQ ID NO: 440936 - DNA, 20 bp, Artificial
  CRISPR gRNA sequence
taatcccaaaacattgggag

SEQ ID NO: 440937 - DNA, 20 bp, Artificial
  CRISPR gRNA sequence
ggaggtcgaggtggacggat

SEQ ID NO: 440938 - DNA, 20 bp, Artificial
  CRISPR gRNA sequence
gcccaacatggtgaaaccct

SEQ ID NO: 440939 - DNA, 20 bp, Artificial
  CRISPR gRNA sequence
cccaacatggtgaaaccctg

SEQ ID NO: 440940 - DNA, 20 bp, Artificial
  CRISPR gRNA sequence
tctctactaaaaatataaaa

SEQ ID NO: 440941 - DNA, 20 bp, Artificial
  CRISPR gRNA sequence
tactaaaaatataaaaatta

SEQ ID NO: 440942 - DNA, 20 bp, Artificial
  CRISPR gRNA sequence
ctaaaaatataaaaattagc

SEQ ID NO: 440943 - DNA, 20 bp, Artificial
  CRISPR gRNA sequence
aaaatataaaaattagccag

SEQ ID NO: 440944 - DNA, 20 bp, Artificial
  CRISPR gRNA sequence
gccaggcgtggtggtacatg

SEQ ID NO: 440945 - DNA, 20 bp, Artificial
  CRISPR gRNA sequence
tagtcccagctactctggaa

SEQ ID NO: 440946 - DNA, 20 bp, Artificial
  CRISPR gRNA sequence
ctctggaagctgagtcagga

SEQ ID NO: 440947 - DNA, 20 bp, Artificial
  CRISPR gRNA sequence
tggaagctgagtcaggagaa

SEQ ID NO: 440948 - DNA, 20 bp, Artificial
  CRISPR gRNA sequence
gaagctgagtcaggagaaac

SEQ ID NO: 440949 - DNA, 20 bp, Artificial
  CRISPR gRNA sequence
agtcaggagaaacacttgaa

SEQ ID NO: 440950 - DNA, 20 bp, Artificial
  CRISPR gRNA sequence
gaacccgggaggcagaggtt

SEQ ID NO: 440951 - DNA, 20 bp, Artificial
  CRISPR gRNA sequence
aacccgggaggcagaggtta

SEQ ID NO: 440952 - DNA, 20 bp, Artificial
  CRISPR gRNA sequence
cagtgagctgagatcgtgcc

SEQ ID NO: 440953 - DNA, 20 bp, Artificial
  CRISPR gRNA sequence
agatcgtgccactgcactcc

SEQ ID NO: 440954 - DNA, 20 bp, Artificial
  CRISPR gRNA sequence
cactccagcgtccatctcca

SEQ ID NO: 440955 - DNA, 20 bp, Artificial
  CRISPR gRNA sequence
cagcgtccatctccaaaaaa

SEQ ID NO: 440956 - DNA, 20 bp, Artificial
  CRISPR gRNA sequence
caaaaaaacaaaagtgtgcg

SEQ ID NO: 440957 - DNA, 20 bp, Artificial
  CRISPR gRNA sequence
tgggggtactggaagtattt

SEQ ID NO: 440958 - DNA, 20 bp, Artificial
  CRISPR gRNA sequence
gggggtactggaagtattta

SEQ ID NO: 440959 - DNA, 20 bp, Artificial
  CRISPR gRNA sequence
ggggtactggaagtatttag

SEQ ID NO: 440960 - DNA, 20 bp, Artificial
  CRISPR gRNA sequence
gaagtatttagatcttgatt

SEQ ID NO: 440961 - DNA, 20 bp, Artificial
  CRISPR gRNA sequence
agatcttgattgtgatgatg

SEQ ID NO: 440962 - DNA, 20 bp, Artificial
  CRISPR gRNA sequence
gatcttgattgtgatgatgg

SEQ ID NO: 440963 - DNA, 20 bp, Artificial
  CRISPR gRNA sequence
gattgtgatgatggcttcct

SEQ ID NO: 440964 - DNA, 20 bp, Artificial
  CRISPR gRNA sequence
attgtgatgatggcttccta

SEQ ID NO: 440965 - DNA, 20 bp, Artificial
  CRISPR gRNA sequence
tgatgatggcttcctactgt

SEQ ID NO: 440966 - DNA, 20 bp, Artificial
  CRISPR gRNA sequence
cctactgtaattctccatca

SEQ ID NO: 440967 - DNA, 20 bp, Artificial
  CRISPR gRNA sequence
ctactgtaattctccatcaa

SEQ ID NO: 440968 - DNA, 20 bp, Artificial
  CRISPR gRNA sequence
ctgtaattctccatcaaaat

SEQ ID NO: 440969 - DNA, 20 bp, Artificial
  CRISPR gRNA sequence
taattctccatcaaaattca

SEQ ID NO: 440970 - DNA, 20 bp, Artificial
  CRISPR gRNA sequence
tccatcaaaattcatcaact

SEQ ID NO: 440971 - DNA, 20 bp, Artificial
  CRISPR gRNA sequence
catcaaaattcatcaacttc

SEQ ID NO: 440972 - DNA, 20 bp, Artificial
  CRISPR gRNA sequence
atcaacttcaacacacttct

SEQ ID NO: 440973 - DNA, 20 bp, Artificial
  CRISPR gRNA sequence
caacacacttcttttttttt

SEQ ID NO: 440974 - DNA, 20 bp, Artificial
  CRISPR gRNA sequence
aacacacttctttttttttt

SEQ ID NO: 440975 - DNA, 20 bp, Artificial
  CRISPR gRNA sequence
ctttttttttttttttttgg

SEQ ID NO: 440976 - DNA, 20 bp, Artificial
  CRISPR gRNA sequence
tttttttttttttttttgga

SEQ ID NO: 440977 - DNA, 20 bp, Artificial
  CRISPR gRNA sequence
tttttttttttttttggaga

SEQ ID NO: 440978 - DNA, 20 bp, Artificial
  CRISPR gRNA sequence
ttttttttttttttggagac

SEQ ID NO: 440979 - DNA, 20 bp, Artificial
  CRISPR gRNA sequence
tttttttttttttggagact

SEQ ID NO: 440980 - DNA, 20 bp, Artificial
  CRISPR gRNA sequence
ttttttttttttggagactg

SEQ ID NO: 440981 - DNA, 20 bp, Artificial
  CRISPR gRNA sequence
tttttttttttggagactgt

SEQ ID NO: 440982 - DNA, 20 bp, Artificial
  CRISPR gRNA sequence
ttttttttttggagactgtc

SEQ ID NO: 440983 - DNA, 20 bp, Artificial
  CRISPR gRNA sequence
tttttttttggagactgtct

SEQ ID NO: 440984 - DNA, 20 bp, Artificial
  CRISPR gRNA sequence
ttttttttggagactgtctt

SEQ ID NO: 440985 - DNA, 20 bp, Artificial
  CRISPR gRNA sequence
tttttttggagactgtctta

SEQ ID NO: 440986 - DNA, 20 bp, Artificial
  CRISPR gRNA sequence
ttttttggagactgtcttat

SEQ ID NO: 440987 - DNA, 20 bp, Artificial
  CRISPR gRNA sequence
tttttggagactgtcttatt

SEQ ID NO: 440988 - DNA, 20 bp, Artificial
  CRISPR gRNA sequence
ttttggagactgtcttattc

SEQ ID NO: 440989 - DNA, 20 bp, Artificial
  CRISPR gRNA sequence
tttggagactgtcttattct

SEQ ID NO: 440990 - DNA, 20 bp, Artificial
  CRISPR gRNA sequence
ttggagactgtcttattctg

SEQ ID NO: 440991 - DNA, 20 bp, Artificial
  CRISPR gRNA sequence
tggagactgtcttattctgt

SEQ ID NO: 440992 - DNA, 20 bp, Artificial
  CRISPR gRNA sequence
ggagactgtcttattctgtt

SEQ ID NO: 440993 - DNA, 20 bp, Artificial
  CRISPR gRNA sequence
gagactgtcttattctgttg

SEQ ID NO: 440994 - DNA, 20 bp, Artificial
  CRISPR gRNA sequence
tcttattctgttgcccaggg

SEQ ID NO: 440995 - DNA, 20 bp, Artificial
  CRISPR gRNA sequence
attctgttgcccagggtgga

SEQ ID NO: 440996 - DNA, 20 bp, Artificial
  CRISPR gRNA sequence
ttctgttgcccagggtggag

SEQ ID NO: 440997 - DNA, 20 bp, Artificial
  CRISPR gRNA sequence
tgttgcccagggtggagtgc

SEQ ID NO: 440998 - DNA, 20 bp, Artificial
  CRISPR gRNA sequence
ttgcccagggtggagtgcaa

SEQ ID NO: 440999 - DNA, 20 bp, Artificial
  CRISPR gRNA sequence
cccagggtggagtgcaatga

SEQ ID NO: 441000 - DNA, 20 bp, Artificial
  CRISPR gRNA sequence
actgcagcctcctgagctca

SEQ ID NO: 441001 - DNA, 20 bp, Artificial
  CRISPR gRNA sequence
cagcctcctgagctcaagtg

SEQ ID NO: 441002 - DNA, 20 bp, Artificial
  CRISPR gRNA sequence
ctgagctcaagtgatcctcc

SEQ ID NO: 441003 - DNA, 20 bp, Artificial
  CRISPR gRNA sequence
agctcaagtgatcctcccac

SEQ ID NO: 441004 - DNA, 20 bp, Artificial
  CRISPR gRNA sequence
aagtgatcctcccacctcag

SEQ ID NO: 441005 - DNA, 20 bp, Artificial
  CRISPR gRNA sequence
ccacctcagcctcctgagta

SEQ ID NO: 441006 - DNA, 20 bp, Artificial
  CRISPR gRNA sequence
agcctcctgagtagatggga

SEQ ID NO: 441007 - DNA, 20 bp, Artificial
  CRISPR gRNA sequence
ctgagtagatgggactacag

SEQ ID NO: 441008 - DNA, 20 bp, Artificial
  CRISPR gRNA sequence
agtagatgggactacaggtg

SEQ ID NO: 441009 - DNA, 20 bp, Artificial
  CRISPR gRNA sequence
caggtgtgtgccaccatgcc

SEQ ID NO: 441010 - DNA, 20 bp, Artificial
  CRISPR gRNA sequence
attattattattattacgtt

SEQ ID NO: 441011 - DNA, 20 bp, Artificial
  CRISPR gRNA sequence
ttattattattacgttgtag

SEQ ID NO: 441012 - DNA, 20 bp, Artificial
  CRISPR gRNA sequence
ttattattacgttgtagagg

SEQ ID NO: 441013 - DNA, 20 bp, Artificial
  CRISPR gRNA sequence
ttattacgttgtagaggcag

SEQ ID NO: 441014 - DNA, 20 bp, Artificial
  CRISPR gRNA sequence
ttacgttgtagaggcaggat

SEQ ID NO: 441015 - DNA, 20 bp, Artificial
  CRISPR gRNA sequence
cgttgtagaggcaggatcct

SEQ ID NO: 441016 - DNA, 20 bp, Artificial
  CRISPR gRNA sequence
tagaggcaggatcctgcttt

SEQ ID NO: 441017 - DNA, 20 bp, Artificial
  CRISPR gRNA sequence
ctttgctgcccaggctgatc

SEQ ID NO: 441018 - DNA, 20 bp, Artificial
  CRISPR gRNA sequence
tgctgcccaggctgatcttg

SEQ ID NO: 441019 - DNA, 20 bp, Artificial
  CRISPR gRNA sequence
gctgcccaggctgatcttgg

SEQ ID NO: 441020 - DNA, 20 bp, Artificial
  CRISPR gRNA sequence
ctgcccaggctgatcttggt

SEQ ID NO: 441021 - DNA, 20 bp, Artificial
  CRISPR gRNA sequence
cccaggctgatcttggtctc

SEQ ID NO: 441022 - DNA, 20 bp, Artificial
  CRISPR gRNA sequence
atcttggtctcaaactcctg

SEQ ID NO: 441023 - DNA, 20 bp, Artificial
  CRISPR gRNA sequence
ggtctcaaactcctgggctc

SEQ ID NO: 441024 - DNA, 20 bp, Artificial
  CRISPR gRNA sequence
gtctcaaactcctgggctca

SEQ ID NO: 441025 - DNA, 20 bp, Artificial
  CRISPR gRNA sequence
aaactcctgggctcaactga

SEQ ID NO: 441026 - DNA, 20 bp, Artificial
  CRISPR gRNA sequence
ctgggctcaactgatcctct

SEQ ID NO: 441027 - DNA, 20 bp, Artificial
  CRISPR gRNA sequence
ggctcaactgatcctctcac

SEQ ID NO: 441028 - DNA, 20 bp, Artificial
  CRISPR gRNA sequence
aactgatcctctcacctcag

SEQ ID NO: 441029 - DNA, 20 bp, Artificial
  CRISPR gRNA sequence
atcctctcacctcagcttcc

SEQ ID NO: 441030 - DNA, 20 bp, Artificial
  CRISPR gRNA sequence
tcacctcagcttccgaaagt

SEQ ID NO: 441031 - DNA, 20 bp, Artificial
  CRISPR gRNA sequence
acctcagcttccgaaagtgt

SEQ ID NO: 441032 - DNA, 20 bp, Artificial
  CRISPR gRNA sequence
agcttccgaaagtgttgaaa

SEQ ID NO: 441033 - DNA, 20 bp, Artificial
  CRISPR gRNA sequence
ccgaaagtgttgaaaataca

SEQ ID NO: 441034 - DNA, 20 bp, Artificial
  CRISPR gRNA sequence
cgaaagtgttgaaaatacag

SEQ ID NO: 441035 - DNA, 20 bp, Artificial
  CRISPR gRNA sequence
aaaatacaggcatgagccac

SEQ ID NO: 441036 - DNA, 20 bp, Artificial
  CRISPR gRNA sequence
cacctggccattgtatttat

SEQ ID NO: 441037 - DNA, 20 bp, Artificial
  CRISPR gRNA sequence
gccattgtatttatttattt

SEQ ID NO: 441038 - DNA, 20 bp, Artificial
  CRISPR gRNA sequence
tatttatttatttatttatt

SEQ ID NO: 441039 - DNA, 20 bp, Artificial
  CRISPR gRNA sequence
atttatttatttatttgctt

SEQ ID NO: 441040 - DNA, 20 bp, Artificial
  CRISPR gRNA sequence
tttatttatttatttgctta

SEQ ID NO: 441041 - DNA, 20 bp, Artificial
  CRISPR gRNA sequence
atttatttatttgcttattt

SEQ ID NO: 441042 - DNA, 20 bp, Artificial
  CRISPR gRNA sequence
tttatttatttgcttattta

SEQ ID NO: 441043 - DNA, 20 bp, Artificial
  CRISPR gRNA sequence
atttatttgcttatttattt

SEQ ID NO: 441044 - DNA, 20 bp, Artificial
  CRISPR gRNA sequence
tttatttgcttatttattta

SEQ ID NO: 441045 - DNA, 20 bp, Artificial
  CRISPR gRNA sequence
atttgcttatttatttatat

SEQ ID NO: 441046 - DNA, 20 bp, Artificial
  CRISPR gRNA sequence
tttgcttatttatttatatt

SEQ ID NO: 441047 - DNA, 20 bp, Artificial
  CRISPR gRNA sequence
gcttatttatttatatttta

SEQ ID NO: 441048 - DNA, 20 bp, Artificial
  CRISPR gRNA sequence
cttatttatttatattttat

SEQ ID NO: 441049 - DNA, 20 bp, Artificial
  CRISPR gRNA sequence
atttatttatattttattac

SEQ ID NO: 441050 - DNA, 20 bp, Artificial
  CRISPR gRNA sequence
tttatttatattttattact

SEQ ID NO: 441051 - DNA, 20 bp, Artificial
  CRISPR gRNA sequence
atttatattttattactttt

SEQ ID NO: 441052 - DNA, 20 bp, Artificial
  CRISPR gRNA sequence
tttatattttattacttttt

SEQ ID NO: 441053 - DNA, 20 bp, Artificial
  CRISPR gRNA sequence
atattttattactttttttt

SEQ ID NO: 441054 - DNA, 20 bp, Artificial
  CRISPR gRNA sequence
tattttattacttttttttt

SEQ ID NO: 441055 - DNA, 20 bp, Artificial
  CRISPR gRNA sequence
tattacttttttttttaaga

SEQ ID NO: 441056 - DNA, 20 bp, Artificial
  CRISPR gRNA sequence
attacttttttttttaagac

SEQ ID NO: 441057 - DNA, 20 bp, Artificial
  CRISPR gRNA sequence
ttacttttttttttaagaca

SEQ ID NO: 441058 - DNA, 20 bp, Artificial
  CRISPR gRNA sequence
cttttttttttaagacagtc

SEQ ID NO: 441059 - DNA, 20 bp, Artificial
  CRISPR gRNA sequence
ttttttttaagacagtctca

SEQ ID NO: 441060 - DNA, 20 bp, Artificial
  CRISPR gRNA sequence
tttttttaagacagtctcac

SEQ ID NO: 441061 - DNA, 20 bp, Artificial
  CRISPR gRNA sequence
ttttttaagacagtctcact

SEQ ID NO: 441062 - DNA, 20 bp, Artificial
  CRISPR gRNA sequence
tttttaagacagtctcactc

SEQ ID NO: 441063 - DNA, 20 bp, Artificial
  CRISPR gRNA sequence
ttttaagacagtctcactct

SEQ ID NO: 441064 - DNA, 20 bp, Artificial
  CRISPR gRNA sequence
tttaagacagtctcactctg

SEQ ID NO: 441065 - DNA, 20 bp, Artificial
  CRISPR gRNA sequence
ttaagacagtctcactctgt

SEQ ID NO: 441066 - DNA, 20 bp, Artificial
  CRISPR gRNA sequence
taagacagtctcactctgtc

SEQ ID NO: 441067 - DNA, 20 bp, Artificial
  CRISPR gRNA sequence
aagacagtctcactctgtca

SEQ ID NO: 441068 - DNA, 20 bp, Artificial
  CRISPR gRNA sequence
agacagtctcactctgtcac

SEQ ID NO: 441069 - DNA, 20 bp, Artificial
  CRISPR gRNA sequence
actctgtcacccaggctgga

SEQ ID NO: 441070 - DNA, 20 bp, Artificial
  CRISPR gRNA sequence
tgtcacccaggctggagtgc

SEQ ID NO: 441071 - DNA, 20 bp, Artificial
  CRISPR gRNA sequence
tcacccaggctggagtgcag

SEQ ID NO: 441072 - DNA, 20 bp, Artificial
  CRISPR gRNA sequence
gagtgcagtggcatgatctg

SEQ ID NO: 441073 - DNA, 20 bp, Artificial
  CRISPR gRNA sequence
agctcactgtaacctccacc

SEQ ID NO: 441074 - DNA, 20 bp, Artificial
  CRISPR gRNA sequence
actgtaacctccacctacca

SEQ ID NO: 441075 - DNA, 20 bp, Artificial
  CRISPR gRNA sequence
taacctccacctaccaggtt

SEQ ID NO: 441076 - DNA, 20 bp, Artificial
  CRISPR gRNA sequence
cacctaccaggtttgagtga

SEQ ID NO: 441077 - DNA, 20 bp, Artificial
  CRISPR gRNA sequence
ccaggtttgagtgattcctc

SEQ ID NO: 441078 - DNA, 20 bp, Artificial
  CRISPR gRNA sequence
gagtgattcctctgcctcag

SEQ ID NO: 441079 - DNA, 20 bp, Artificial
  CRISPR gRNA sequence
agtgattcctctgcctcagc

SEQ ID NO: 441080 - DNA, 20 bp, Artificial
  CRISPR gRNA sequence
ctctgcctcagcctcctgag

SEQ ID NO: 441081 - DNA, 20 bp, Artificial
  CRISPR gRNA sequence
tgcctcagcctcctgagtag

SEQ ID NO: 441082 - DNA, 20 bp, Artificial
  CRISPR gRNA sequence
cctcagcctcctgagtagct

SEQ ID NO: 441083 - DNA, 20 bp, Artificial
  CRISPR gRNA sequence
agcctcctgagtagctggga

SEQ ID NO: 441084 - DNA, 20 bp, Artificial
  CRISPR gRNA sequence
ctgagtagctgggattacag

SEQ ID NO: 441085 - DNA, 20 bp, Artificial
  CRISPR gRNA sequence
agtagctgggattacaggca

SEQ ID NO: 441086 - DNA, 20 bp, Artificial
  CRISPR gRNA sequence
ggattacaggcatgcgccac

SEQ ID NO: 441087 - DNA, 20 bp, Artificial
  CRISPR gRNA sequence
caggcatgcgccaccacacc

SEQ ID NO: 441088 - DNA, 20 bp, Artificial
  CRISPR gRNA sequence
attttgtatttttagtagag

SEQ ID NO: 441089 - DNA, 20 bp, Artificial
  CRISPR gRNA sequence
tgtatttttagtagagatgg

SEQ ID NO: 441090 - DNA, 20 bp, Artificial
  CRISPR gRNA sequence
gtatttttagtagagatggg

SEQ ID NO: 441091 - DNA, 20 bp, Artificial
  CRISPR gRNA sequence
tatttttagtagagatgggg

SEQ ID NO: 441092 - DNA, 20 bp, Artificial
  CRISPR gRNA sequence
ttagtagagatggggtctca

SEQ ID NO: 441093 - DNA, 20 bp, Artificial
  CRISPR gRNA sequence
tagtagagatggggtctcac

SEQ ID NO: 441094 - DNA, 20 bp, Artificial
  CRISPR gRNA sequence
agtagagatggggtctcacc

SEQ ID NO: 441095 - DNA, 20 bp, Artificial
  CRISPR gRNA sequence
gtagagatggggtctcacca

SEQ ID NO: 441096 - DNA, 20 bp, Artificial
  CRISPR gRNA sequence
accatgttggccaagctggt

SEQ ID NO: 441097 - DNA, 20 bp, Artificial
  CRISPR gRNA sequence
gccaagctggtctcgaactc

SEQ ID NO: 441098 - DNA, 20 bp, Artificial
  CRISPR gRNA sequence
gtctcgaactcctgacctca

SEQ ID NO: 441099 - DNA, 20 bp, Artificial
  CRISPR gRNA sequence
gaactcctgacctcaaatga

SEQ ID NO: 441100 - DNA, 20 bp, Artificial
  CRISPR gRNA sequence
ctgacctcaaatgatccacc

SEQ ID NO: 441101 - DNA, 20 bp, Artificial
  CRISPR gRNA sequence
acctcaaatgatccaccccc

SEQ ID NO: 441102 - DNA, 20 bp, Artificial
  CRISPR gRNA sequence
aaatgatccacccccctcag

SEQ ID NO: 441103 - DNA, 20 bp, Artificial
  CRISPR gRNA sequence
agcctcccaaagtgctggga

SEQ ID NO: 441104 - DNA, 20 bp, Artificial
  CRISPR gRNA sequence
ccaaagtgctgggattacag

SEQ ID NO: 441105 - DNA, 20 bp, Artificial
  CRISPR gRNA sequence
ggattacaggcgtgagccac

SEQ ID NO: 441106 - DNA, 20 bp, Artificial
  CRISPR gRNA sequence
caggcgtgagccactgcgcc

SEQ ID NO: 441107 - DNA, 20 bp, Artificial
  CRISPR gRNA sequence
cgccgggcctgtttttttgt

SEQ ID NO: 441108 - DNA, 20 bp, Artificial
  CRISPR gRNA sequence
tttttttgtttttgtttgtt

SEQ ID NO: 441109 - DNA, 20 bp, Artificial
  CRISPR gRNA sequence
ttttgtttttgtttgtttgc

SEQ ID NO: 441110 - DNA, 20 bp, Artificial
  CRISPR gRNA sequence
tttgtttttgtttgtttgct

SEQ ID NO: 441111 - DNA, 20 bp, Artificial
  CRISPR gRNA sequence
ttgtttttgtttgtttgcta

SEQ ID NO: 441112 - DNA, 20 bp, Artificial
  CRISPR gRNA sequence
tgtttttgtttgtttgctag

SEQ ID NO: 441113 - DNA, 20 bp, Artificial
  CRISPR gRNA sequence
gtttttgtttgtttgctagt

SEQ ID NO: 441114 - DNA, 20 bp, Artificial
  CRISPR gRNA sequence
tttttgtttgtttgctagtt

SEQ ID NO: 441115 - DNA, 20 bp, Artificial
  CRISPR gRNA sequence
ttgtttgtttgctagtttaa

SEQ ID NO: 441116 - DNA, 20 bp, Artificial
  CRISPR gRNA sequence
tgtttgtttgctagtttaaa

SEQ ID NO: 441117 - DNA, 20 bp, Artificial
  CRISPR gRNA sequence
gtttgtttgctagtttaaaa

SEQ ID NO: 441118 - DNA, 20 bp, Artificial
  CRISPR gRNA sequence
tttgtttgctagtttaaaaa

SEQ ID NO: 441119 - DNA, 20 bp, Artificial
  CRISPR gRNA sequence
gtttgctagtttaaaaaaaa

SEQ ID NO: 441120 - DNA, 20 bp, Artificial
  CRISPR gRNA sequence
tttgctagtttaaaaaaaaa

SEQ ID NO: 441121 - DNA, 20 bp, Artificial
  CRISPR gRNA sequence
gctagtttaaaaaaaaaaaa

SEQ ID NO: 441122 - DNA, 20 bp, Artificial
  CRISPR gRNA sequence
ctagtttaaaaaaaaaaaag

SEQ ID NO: 441123 - DNA, 20 bp, Artificial
  CRISPR gRNA sequence
gtttaaaaaaaaaaaaggga

SEQ ID NO: 441124 - DNA, 20 bp, Artificial
  CRISPR gRNA sequence
aaaaaaaaaaaagggataag

SEQ ID NO: 441125 - DNA, 20 bp, Artificial
  CRISPR gRNA sequence
aaaaaaaaaaagggataagt

SEQ ID NO: 441126 - DNA, 20 bp, Artificial
  CRISPR gRNA sequence
agaaaaagctatgtgctaag

SEQ ID NO: 441127 - DNA, 20 bp, Artificial
  CRISPR gRNA sequence
gaaaaagctatgtgctaagt

SEQ ID NO: 441128 - DNA, 20 bp, Artificial
  CRISPR gRNA sequence
tgtgctaagtaccatgatgg

SEQ ID NO: 441129 - DNA, 20 bp, Artificial
  CRISPR gRNA sequence
agtaccatgatggaggaaaa

SEQ ID NO: 441130 - DNA, 20 bp, Artificial
  CRISPR gRNA sequence
tctaaccccagtcacgaccc

SEQ ID NO: 441131 - DNA, 20 bp, Artificial
  CRISPR gRNA sequence
taaccccagtcacgacccag

SEQ ID NO: 441132 - DNA, 20 bp, Artificial
  CRISPR gRNA sequence
accccagtcacgacccagtg

SEQ ID NO: 441133 - DNA, 20 bp, Artificial
  CRISPR gRNA sequence
aagggacttgcagtctactg

SEQ ID NO: 441134 - DNA, 20 bp, Artificial
  CRISPR gRNA sequence
gcagtctactgccagagagg

SEQ ID NO: 441135 - DNA, 20 bp, Artificial
  CRISPR gRNA sequence
cagtctactgccagagaggt

SEQ ID NO: 441136 - DNA, 20 bp, Artificial
  CRISPR gRNA sequence
ctgccagagaggtatgcctg

SEQ ID NO: 441137 - DNA, 20 bp, Artificial
  CRISPR gRNA sequence
ccagagaggtatgcctgaga

SEQ ID NO: 441138 - DNA, 20 bp, Artificial
  CRISPR gRNA sequence
agaaaccaataacagaaaag

SEQ ID NO: 441139 - DNA, 20 bp, Artificial
  CRISPR gRNA sequence
tttgttgttgtgtttcgtaa

SEQ ID NO: 441140 - DNA, 20 bp, Artificial
  CRISPR gRNA sequence
ttgttgttgtgtttcgtaac

SEQ ID NO: 441141 - DNA, 20 bp, Artificial
  CRISPR gRNA sequence
tgttgttgtgtttcgtaaca

SEQ ID NO: 441142 - DNA, 20 bp, Artificial
  CRISPR gRNA sequence
gttgttgtgtttcgtaacaa

SEQ ID NO: 441143 - DNA, 20 bp, Artificial
  CRISPR gRNA sequence
ttgttgtgtttcgtaacaaa

SEQ ID NO: 441144 - DNA, 20 bp, Artificial
  CRISPR gRNA sequence
ttgtgtttcgtaacaaacct

SEQ ID NO: 441145 - DNA, 20 bp, Artificial
  CRISPR gRNA sequence
tgtttcgtaacaaacctaga

SEQ ID NO: 441146 - DNA, 20 bp, Artificial
  CRISPR gRNA sequence
cgtaacaaacctagacatat

SEQ ID NO: 441147 - DNA, 20 bp, Artificial
  CRISPR gRNA sequence
gtaacaaacctagacatatt

SEQ ID NO: 441148 - DNA, 20 bp, Artificial
  CRISPR gRNA sequence
gacatattcatgaattaaag

SEQ ID NO: 441149 - DNA, 20 bp, Artificial
  CRISPR gRNA sequence
atgaattaaagaaattagtt

SEQ ID NO: 441150 - DNA, 20 bp, Artificial
  CRISPR gRNA sequence
aagaaattagtttactggaa

SEQ ID NO: 441151 - DNA, 20 bp, Artificial
  CRISPR gRNA sequence
gtttactggaatcagcctgc

SEQ ID NO: 441152 - DNA, 20 bp, Artificial
  CRISPR gRNA sequence
actggaatcagcctgcctgg

SEQ ID NO: 441153 - DNA, 20 bp, Artificial
  CRISPR gRNA sequence
ctggaatcagcctgcctgga

SEQ ID NO: 441154 - DNA, 20 bp, Artificial
  CRISPR gRNA sequence
gaatcagcctgcctggattt

SEQ ID NO: 441155 - DNA, 20 bp, Artificial
  CRISPR gRNA sequence
cctggatttgatttccggtt

SEQ ID NO: 441156 - DNA, 20 bp, Artificial
  CRISPR gRNA sequence
gatttgatttccggttctgc

SEQ ID NO: 441157 - DNA, 20 bp, Artificial
  CRISPR gRNA sequence
gatttccggttctgccaggt

SEQ ID NO: 441158 - DNA, 20 bp, Artificial
  CRISPR gRNA sequence
atttccggttctgccaggta

SEQ ID NO: 441159 - DNA, 20 bp, Artificial
  CRISPR gRNA sequence
ccggttctgccaggtactga

SEQ ID NO: 441160 - DNA, 20 bp, Artificial
  CRISPR gRNA sequence
cggttctgccaggtactgat

SEQ ID NO: 441161 - DNA, 20 bp, Artificial
  CRISPR gRNA sequence
tgccaggtactgatgttgaa

SEQ ID NO: 441162 - DNA, 20 bp, Artificial
  CRISPR gRNA sequence
ccaggtactgatgttgaaac

SEQ ID NO: 441163 - DNA, 20 bp, Artificial
  CRISPR gRNA sequence
atgttgaaacctcgggaagg

SEQ ID NO: 441164 - DNA, 20 bp, Artificial
  CRISPR gRNA sequence
aaacctcgggaaggcagctt

SEQ ID NO: 441165 - DNA, 20 bp, Artificial
  CRISPR gRNA sequence
gggaaggcagcttactctaa

SEQ ID NO: 441166 - DNA, 20 bp, Artificial
  CRISPR gRNA sequence
actctaagcttgacttccct

SEQ ID NO: 441167 - DNA, 20 bp, Artificial
  CRISPR gRNA sequence
ctctaagcttgacttccctt

SEQ ID NO: 441168 - DNA, 20 bp, Artificial
  CRISPR gRNA sequence
taagcttgacttcccttcac

SEQ ID NO: 441169 - DNA, 20 bp, Artificial
  CRISPR gRNA sequence
agcttgacttcccttcactg

SEQ ID NO: 441170 - DNA, 20 bp, Artificial
  CRISPR gRNA sequence
gacttcccttcactgtaaaa

SEQ ID NO: 441171 - DNA, 20 bp, Artificial
  CRISPR gRNA sequence
acttcccttcactgtaaaat

SEQ ID NO: 441172 - DNA, 20 bp, Artificial
  CRISPR gRNA sequence
cccttcactgtaaaatgggg

SEQ ID NO: 441173 - DNA, 20 bp, Artificial
  CRISPR gRNA sequence
ccttcactgtaaaatgggga

SEQ ID NO: 441174 - DNA, 20 bp, Artificial
  CRISPR gRNA sequence
cactgtaaaatggggatggt

SEQ ID NO: 441175 - DNA, 20 bp, Artificial
  CRISPR gRNA sequence
actgtaaaatggggatggta

SEQ ID NO: 441176 - DNA, 20 bp, Artificial
  CRISPR gRNA sequence
taaaatggggatggtactat

SEQ ID NO: 441177 - DNA, 20 bp, Artificial
  CRISPR gRNA sequence
ttccttatctcataagacag

SEQ ID NO: 441178 - DNA, 20 bp, Artificial
  CRISPR gRNA sequence
cttatctcataagacagtaa

SEQ ID NO: 441179 - DNA, 20 bp, Artificial
  CRISPR gRNA sequence
atctcataagacagtaatga

SEQ ID NO: 441180 - DNA, 20 bp, Artificial
  CRISPR gRNA sequence
tctcataagacagtaatgat

SEQ ID NO: 441181 - DNA, 20 bp, Artificial
  CRISPR gRNA sequence
ataagacagtaatgatgata

SEQ ID NO: 441182 - DNA, 20 bp, Artificial
  CRISPR gRNA sequence
aacgcagtggctgcctgaca

SEQ ID NO: 441183 - DNA, 20 bp, Artificial
  CRISPR gRNA sequence
acgcagtggctgcctgacac

SEQ ID NO: 441184 - DNA, 20 bp, Artificial
  CRISPR gRNA sequence
cctgacacacaataaatatt

SEQ ID NO: 441185 - DNA, 20 bp, Artificial
  CRISPR gRNA sequence
acacacaataaatattaaat

SEQ ID NO: 441186 - DNA, 20 bp, Artificial
  CRISPR gRNA sequence
aataaaaattagccattatt

SEQ ID NO: 441187 - DNA, 20 bp, Artificial
  CRISPR gRNA sequence
gccattattgttaggatttg

SEQ ID NO: 441188 - DNA, 20 bp, Artificial
  CRISPR gRNA sequence
ttgttaggatttggatggac

SEQ ID NO: 441189 - DNA, 20 bp, Artificial
  CRISPR gRNA sequence
ttaggatttggatggacaaa

SEQ ID NO: 441190 - DNA, 20 bp, Artificial
  CRISPR gRNA sequence
ggatttggatggacaaaagg

SEQ ID NO: 441191 - DNA, 20 bp, Artificial
  CRISPR gRNA sequence
ggatggacaaaagggtattt

SEQ ID NO: 441192 - DNA, 20 bp, Artificial
  CRISPR gRNA sequence
gatggacaaaagggtattta

SEQ ID NO: 441193 - DNA, 20 bp, Artificial
  CRISPR gRNA sequence
agtctaatcatctttgggta

SEQ ID NO: 441194 - DNA, 20 bp, Artificial
  CRISPR gRNA sequence
gtctaatcatctttgggtat

SEQ ID NO: 441195 - DNA, 20 bp, Artificial
  CRISPR gRNA sequence
atcatctttgggtataaaca

SEQ ID NO: 441196 - DNA, 20 bp, Artificial
  CRISPR gRNA sequence
tgggtataaacatgaatttg

SEQ ID NO: 441197 - DNA, 20 bp, Artificial
  CRISPR gRNA sequence
gggtataaacatgaatttgc

SEQ ID NO: 441198 - DNA, 20 bp, Artificial
  CRISPR gRNA sequence
ggtataaacatgaatttgca

SEQ ID NO: 441199 - DNA, 20 bp, Artificial
  CRISPR gRNA sequence
gcatttctatctaggttttt

SEQ ID NO: 441200 - DNA, 20 bp, Artificial
  CRISPR gRNA sequence
catttctatctaggttttta

SEQ ID NO: 441201 - DNA, 20 bp, Artificial
  CRISPR gRNA sequence
ctatctaggtttttactggt

SEQ ID NO: 441202 - DNA, 20 bp, Artificial
  CRISPR gRNA sequence
tatctaggtttttactggtt

SEQ ID NO: 441203 - DNA, 20 bp, Artificial
  CRISPR gRNA sequence
tctaggtttttactggttct

SEQ ID NO: 441204 - DNA, 20 bp, Artificial
  CRISPR gRNA sequence
ggtttttactggttctcact

SEQ ID NO: 441205 - DNA, 20 bp, Artificial
  CRISPR gRNA sequence
ttactggttctcactgaaga

SEQ ID NO: 441206 - DNA, 20 bp, Artificial
  CRISPR gRNA sequence
tactggttctcactgaagaa

SEQ ID NO: 441207 - DNA, 20 bp, Artificial
  CRISPR gRNA sequence
actggttctcactgaagaat

SEQ ID NO: 441208 - DNA, 20 bp, Artificial
  CRISPR gRNA sequence
ctggttctcactgaagaatt

SEQ ID NO: 441209 - DNA, 20 bp, Artificial
  CRISPR gRNA sequence
gttctcactgaagaatttgt

SEQ ID NO: 441210 - DNA, 20 bp, Artificial
  CRISPR gRNA sequence
tcactgaagaatttgttatc

SEQ ID NO: 441211 - DNA, 20 bp, Artificial
  CRISPR gRNA sequence
actgaagaatttgttatcag

SEQ ID NO: 441212 - DNA, 20 bp, Artificial
  CRISPR gRNA sequence
aagaatttgttatcagaggg

SEQ ID NO: 441213 - DNA, 20 bp, Artificial
  CRISPR gRNA sequence
gttatcagagggagagagaa

SEQ ID NO: 441214 - DNA, 20 bp, Artificial
  CRISPR gRNA sequence
ttatcagagggagagagaaa

SEQ ID NO: 441215 - DNA, 20 bp, Artificial
  CRISPR gRNA sequence
tcagagggagagagaaacaa

SEQ ID NO: 441216 - DNA, 20 bp, Artificial
  CRISPR gRNA sequence
acatttgaaaattaaagcgc

SEQ ID NO: 441217 - DNA, 20 bp, Artificial
  CRISPR gRNA sequence
catttgaaaattaaagcgcc

SEQ ID NO: 441218 - DNA, 20 bp, Artificial
  CRISPR gRNA sequence
gaaaattaaagcgccgaaga

SEQ ID NO: 441219 - DNA, 20 bp, Artificial
  CRISPR gRNA sequence
aaaattaaagcgccgaagat

SEQ ID NO: 441220 - DNA, 20 bp, Artificial
  CRISPR gRNA sequence
aagcgccgaagataagagcc

SEQ ID NO: 441221 - DNA, 20 bp, Artificial
  CRISPR gRNA sequence
ctccgatgtagatgcctatt

SEQ ID NO: 441222 - DNA, 20 bp, Artificial
  CRISPR gRNA sequence
cgatgtagatgcctattctg

SEQ ID NO: 441223 - DNA, 20 bp, Artificial
  CRISPR gRNA sequence
ttctgatggttgctccagag

SEQ ID NO: 441224 - DNA, 20 bp, Artificial
  CRISPR gRNA sequence
tgatggttgctccagagtcc

SEQ ID NO: 441225 - DNA, 20 bp, Artificial
  CRISPR gRNA sequence
atggttgctccagagtcccg

SEQ ID NO: 441226 - DNA, 20 bp, Artificial
  CRISPR gRNA sequence
ctccagagtcccgtaagtca

SEQ ID NO: 441227 - DNA, 20 bp, Artificial
  CRISPR gRNA sequence
cagagtcccgtaagtcattg

SEQ ID NO: 441228 - DNA, 20 bp, Artificial
  CRISPR gRNA sequence
gccaatctagagtcccgtaa

SEQ ID NO: 441229 - DNA, 20 bp, Artificial
  CRISPR gRNA sequence
gagtcccgtaactcattggc

SEQ ID NO: 441230 - DNA, 20 bp, Artificial
  CRISPR gRNA sequence
attggccaatgtggatattt

SEQ ID NO: 441231 - DNA, 20 bp, Artificial
  CRISPR gRNA sequence
gccaatgtggatatttgcta

SEQ ID NO: 441232 - DNA, 20 bp, Artificial
  CRISPR gRNA sequence
gctatggaaacacaaacagg

SEQ ID NO: 441233 - DNA, 20 bp, Artificial
  CRISPR gRNA sequence
ctatggaaacacaaacagga

SEQ ID NO: 441234 - DNA, 20 bp, Artificial
  CRISPR gRNA sequence
tggaaacacaaacaggattt

SEQ ID NO: 441235 - DNA, 20 bp, Artificial
  CRISPR gRNA sequence
aagcagaaaacagctagaaa

SEQ ID NO: 441236 - DNA, 20 bp, Artificial
  CRISPR gRNA sequence
agcagaaaacagctagaaat

SEQ ID NO: 441237 - DNA, 20 bp, Artificial
  CRISPR gRNA sequence
gaaatcgcttgtgtaatcag

SEQ ID NO: 441238 - DNA, 20 bp, Artificial
  CRISPR gRNA sequence
gtgtaatcagcttcaagatt

SEQ ID NO: 441239 - DNA, 20 bp, Artificial
  CRISPR gRNA sequence
tgtaatcagcttcaagattt

SEQ ID NO: 441240 - DNA, 20 bp, Artificial
  CRISPR gRNA sequence
caagatttgtgaattggacc

SEQ ID NO: 441241 - DNA, 20 bp, Artificial
  CRISPR gRNA sequence
aagatttgtgaattggacca

SEQ ID NO: 441242 - DNA, 20 bp, Artificial
  CRISPR gRNA sequence
gtgaattggaccatcccttt

SEQ ID NO: 441243 - DNA, 20 bp, Artificial
  CRISPR gRNA sequence
tgaattggaccatccctttt

SEQ ID NO: 441244 - DNA, 20 bp, Artificial
  CRISPR gRNA sequence
gaccatcccttttacaacat

SEQ ID NO: 441245 - DNA, 20 bp, Artificial
  CRISPR gRNA sequence
ttacaacatcacaggatggc

SEQ ID NO: 441246 - DNA, 20 bp, Artificial
  CRISPR gRNA sequence
tacaacatcacaggatggct

SEQ ID NO: 441247 - DNA, 20 bp, Artificial
  CRISPR gRNA sequence
acaacatcacaggatggctg

SEQ ID NO: 441248 - DNA, 20 bp, Artificial
  CRISPR gRNA sequence
caacatcacaggatggctga

SEQ ID NO: 441249 - DNA, 20 bp, Artificial
  CRISPR gRNA sequence
agtccttcaaatcacctttg

SEQ ID NO: 441250 - DNA, 20 bp, Artificial
  CRISPR gRNA sequence
caaatcacctttgatctgtc

SEQ ID NO: 441251 - DNA, 20 bp, Artificial
  CRISPR gRNA sequence
aaatcacctttgatctgtca

SEQ ID NO: 441252 - DNA, 20 bp, Artificial
  CRISPR gRNA sequence
tgatctgtcaccttgtagcc

SEQ ID NO: 441253 - DNA, 20 bp, Artificial
  CRISPR gRNA sequence
gatctgtcaccttgtagcca

SEQ ID NO: 441254 - DNA, 20 bp, Artificial
  CRISPR gRNA sequence
atctgtcaccttgtagccaa

SEQ ID NO: 441255 - DNA, 20 bp, Artificial
  CRISPR gRNA sequence
tcaccttgtagccaacactc

SEQ ID NO: 441256 - DNA, 20 bp, Artificial
  CRISPR gRNA sequence
gtagccaacactcaagccaa

SEQ ID NO: 441257 - DNA, 20 bp, Artificial
  CRISPR gRNA sequence
tagccaacactcaagccaac

SEQ ID NO: 441258 - DNA, 20 bp, Artificial
  CRISPR gRNA sequence
aagccaacccaagaaagggt

SEQ ID NO: 441259 - DNA, 20 bp, Artificial
  CRISPR gRNA sequence
ccttaacctttggagttagc

SEQ ID NO: 441260 - DNA, 20 bp, Artificial
  CRISPR gRNA sequence
aacctttggagttagcaagg

SEQ ID NO: 441261 - DNA, 20 bp, Artificial
  CRISPR gRNA sequence
acctttggagttagcaagga

SEQ ID NO: 441262 - DNA, 20 bp, Artificial
  CRISPR gRNA sequence
tggagttagcaaggaaacaa

SEQ ID NO: 441263 - DNA, 20 bp, Artificial
  CRISPR gRNA sequence
ggagttagcaaggaaacaaa

SEQ ID NO: 441264 - DNA, 20 bp, Artificial
  CRISPR gRNA sequence
gagttagcaaggaaacaaaa

SEQ ID NO: 441265 - DNA, 20 bp, Artificial
  CRISPR gRNA sequence
gcaaggaaacaaaatgtgcc

SEQ ID NO: 441266 - DNA, 20 bp, Artificial
  CRISPR gRNA sequence
ctgtgttgtgggtagagaag

SEQ ID NO: 441267 - DNA, 20 bp, Artificial
  CRISPR gRNA sequence
tgtgttgtgggtagagaagg

SEQ ID NO: 441268 - DNA, 20 bp, Artificial
  CRISPR gRNA sequence
tgttgtgggtagagaaggag

SEQ ID NO: 441269 - DNA, 20 bp, Artificial
  CRISPR gRNA sequence
tgggtagagaaggagctctt

SEQ ID NO: 441270 - DNA, 20 bp, Artificial
  CRISPR gRNA sequence
ttaaaaaaaaaaaaaaaaaa

SEQ ID NO: 441271 - DNA, 20 bp, Artificial
  CRISPR gRNA sequence
aaaaaaaaaaaaaaaaaaag

SEQ ID NO: 441272 - DNA, 20 bp, Artificial
  CRISPR gRNA sequence
aaaaaaaaaaaaaaaaaaga

SEQ ID NO: 441273 - DNA, 20 bp, Artificial
  CRISPR gRNA sequence
ttaagaccctttccctgccc

SEQ ID NO: 441274 - DNA, 20 bp, Artificial
  CRISPR gRNA sequence
aagaccctttccctgcccct

SEQ ID NO: 441275 - DNA, 20 bp, Artificial
  CRISPR gRNA sequence
agaccctttccctgcccctg

SEQ ID NO: 441276 - DNA, 20 bp, Artificial
  CRISPR gRNA sequence
tccctgcccctgcaaaaatt

SEQ ID NO: 441277 - DNA, 20 bp, Artificial
  CRISPR gRNA sequence
ccctgcccctgcaaaaattg

SEQ ID NO: 441278 - DNA, 20 bp, Artificial
  CRISPR gRNA sequence
cctgcccctgcaaaaattgg

SEQ ID NO: 441279 - DNA, 20 bp, Artificial
  CRISPR gRNA sequence
cccctgcaaaaattggcttt

SEQ ID NO: 441280 - DNA, 20 bp, Artificial
  CRISPR gRNA sequence
caaaaattggctttagagtg

SEQ ID NO: 441281 - DNA, 20 bp, Artificial
  CRISPR gRNA sequence
gctttagagtggagtcttgt

SEQ ID NO: 441282 - DNA, 20 bp, Artificial
  CRISPR gRNA sequence
tagagtggagtcttgttggt

SEQ ID NO: 441283 - DNA, 20 bp, Artificial
  CRISPR gRNA sequence
agagtggagtcttgttggtt

SEQ ID NO: 441284 - DNA, 20 bp, Artificial
  CRISPR gRNA sequence
gagtggagtcttgttggttc

SEQ ID NO: 441285 - DNA, 20 bp, Artificial
  CRISPR gRNA sequence
gttggttcaagatcccctaa

SEQ ID NO: 441286 - DNA, 20 bp, Artificial
  CRISPR gRNA sequence
ttggttcaagatcccctaag

SEQ ID NO: 441287 - DNA, 20 bp, Artificial
  CRISPR gRNA sequence
gttcaagatcccctaagatt

SEQ ID NO: 441288 - DNA, 20 bp, Artificial
  CRISPR gRNA sequence
aagatcccctaagattcccc

SEQ ID NO: 441289 - DNA, 20 bp, Artificial
  CRISPR gRNA sequence
agattccccagagagtttta

SEQ ID NO: 441290 - DNA, 20 bp, Artificial
  CRISPR gRNA sequence
cccagagagttttagagtag

SEQ ID NO: 441291 - DNA, 20 bp, Artificial
  CRISPR gRNA sequence
tagagtagtttacatttagt

SEQ ID NO: 441292 - DNA, 20 bp, Artificial
  CRISPR gRNA sequence
agagtagtttacatttagtg

SEQ ID NO: 441293 - DNA, 20 bp, Artificial
  CRISPR gRNA sequence
gagtagtttacatttagtgt

SEQ ID NO: 441294 - DNA, 20 bp, Artificial
  CRISPR gRNA sequence
acatttagtgtcttgctatg

SEQ ID NO: 441295 - DNA, 20 bp, Artificial
  CRISPR gRNA sequence
catttagtgtcttgctatga

SEQ ID NO: 441296 - DNA, 20 bp, Artificial
  CRISPR gRNA sequence
agtgtcttgctatgaaacgt

SEQ ID NO: 441297 - DNA, 20 bp, Artificial
  CRISPR gRNA sequence
gtgtcttgctatgaaacgtc

SEQ ID NO: 441298 - DNA, 20 bp, Artificial
  CRISPR gRNA sequence
gctatgaaacgtctattttt

SEQ ID NO: 441299 - DNA, 20 bp, Artificial
  CRISPR gRNA sequence
ctatgaaacgtctatttttc

SEQ ID NO: 441300 - DNA, 20 bp, Artificial
  CRISPR gRNA sequence
tgaaacgtctatttttcaca

SEQ ID NO: 441301 - DNA, 20 bp, Artificial
  CRISPR gRNA sequence
tttttcacaaaaagacagtg

SEQ ID NO: 441302 - DNA, 20 bp, Artificial
  CRISPR gRNA sequence
ttcacaaaaagacagtgatt

SEQ ID NO: 441303 - DNA, 20 bp, Artificial
  CRISPR gRNA sequence
tcacaaaaagacagtgattc

SEQ ID NO: 441304 - DNA, 20 bp, Artificial
  CRISPR gRNA sequence
cacaaaaagacagtgattca

SEQ ID NO: 441305 - DNA, 20 bp, Artificial
  CRISPR gRNA sequence
acaaaaagacagtgattcaa

SEQ ID NO: 441306 - DNA, 20 bp, Artificial
  CRISPR gRNA sequence
aatagccaagactttacagc

SEQ ID NO: 441307 - DNA, 20 bp, Artificial
  CRISPR gRNA sequence
tacagccagacggtcgtgga

SEQ ID NO: 441308 - DNA, 20 bp, Artificial
  CRISPR gRNA sequence
acagccagacggtcgtggat

SEQ ID NO: 441309 - DNA, 20 bp, Artificial
  CRISPR gRNA sequence
cagccagacggtcgtggatt

SEQ ID NO: 441310 - DNA, 20 bp, Artificial
  CRISPR gRNA sequence
aaatcccagctctgaggccg

SEQ ID NO: 441311 - DNA, 20 bp, Artificial
  CRISPR gRNA sequence
tgaggccgggcgcggtggct

SEQ ID NO: 441312 - DNA, 20 bp, Artificial
  CRISPR gRNA sequence
aggccgggcgcggtggctaa

SEQ ID NO: 441313 - DNA, 20 bp, Artificial
  CRISPR gRNA sequence
atgcctgtaatcccagcact

SEQ ID NO: 441314 - DNA, 20 bp, Artificial
  CRISPR gRNA sequence
taatcccagcactttgggag

SEQ ID NO: 441315 - DNA, 20 bp, Artificial
  CRISPR gRNA sequence
tgggaggcctaggcaggcgg

SEQ ID NO: 441316 - DNA, 20 bp, Artificial
  CRISPR gRNA sequence
gggaggcctaggcaggcgga

SEQ ID NO: 441317 - DNA, 20 bp, Artificial
  CRISPR gRNA sequence
ggaggcctaggcaggcggat

SEQ ID NO: 441318 - DNA, 20 bp, Artificial
  CRISPR gRNA sequence
ggcaggcggatcacctgaca

SEQ ID NO: 441319 - DNA, 20 bp, Artificial
  CRISPR gRNA sequence
acatcaggagtttgagacca

SEQ ID NO: 441320 - DNA, 20 bp, Artificial
  CRISPR gRNA sequence
gagaccagcctggacaacat

SEQ ID NO: 441321 - DNA, 20 bp, Artificial
  CRISPR gRNA sequence
agaccagcctggacaacatg

SEQ ID NO: 441322 - DNA, 20 bp, Artificial
  CRISPR gRNA sequence
gacaacatggtgaaaccccg

SEQ ID NO: 441323 - DNA, 20 bp, Artificial
  CRISPR gRNA sequence
tactaaaaatacaaaactta

SEQ ID NO: 441324 - DNA, 20 bp, Artificial
  CRISPR gRNA sequence
ctaaaaatacaaaacttagc

SEQ ID NO: 441325 - DNA, 20 bp, Artificial
  CRISPR gRNA sequence
aaaatacaaaacttagccag

SEQ ID NO: 441326 - DNA, 20 bp, Artificial
  CRISPR gRNA sequence
agccaggcgtggtaacacat

SEQ ID NO: 441327 - DNA, 20 bp, Artificial
  CRISPR gRNA sequence
gccaggcgtggtaacacatg

SEQ ID NO: 441328 - DNA, 20 bp, Artificial
  CRISPR gRNA sequence
taatcctagctagtggggag

SEQ ID NO: 441329 - DNA, 20 bp, Artificial
  CRISPR gRNA sequence
gctagtggggaggctgaggc

SEQ ID NO: 441330 - DNA, 20 bp, Artificial
  CRISPR gRNA sequence
gtggggaggctgaggcagga

SEQ ID NO: 441331 - DNA, 20 bp, Artificial
  CRISPR gRNA sequence
aggcaggagaatcacttaaa

SEQ ID NO: 441332 - DNA, 20 bp, Artificial
  CRISPR gRNA sequence
aaacccaggaggcaaagact

SEQ ID NO: 441333 - DNA, 20 bp, Artificial
  CRISPR gRNA sequence
aacccaggaggcaaagactg

SEQ ID NO: 441334 - DNA, 20 bp, Artificial
  CRISPR gRNA sequence
gagtactcgagttgagatca

SEQ ID NO: 441335 - DNA, 20 bp, Artificial
  CRISPR gRNA sequence
gagttgagatcatgccactg

SEQ ID NO: 441336 - DNA, 20 bp, Artificial
  CRISPR gRNA sequence
agatcatgccactgcacgcc

SEQ ID NO: 441337 - DNA, 20 bp, Artificial
  CRISPR gRNA sequence
cacgccaacctgggcaacag

SEQ ID NO: 441338 - DNA, 20 bp, Artificial
  CRISPR gRNA sequence
ggcaacagagcgagactcca

SEQ ID NO: 441339 - DNA, 20 bp, Artificial
  CRISPR gRNA sequence
catctcaaaaaaaaaaaaaa

SEQ ID NO: 441340 - DNA, 20 bp, Artificial
  CRISPR gRNA sequence
aaaaaaaaaaaaaaaaaaaa

SEQ ID NO: 441341 - DNA, 20 bp, Artificial
  CRISPR gRNA sequence
ccagctctgccactaagggc

SEQ ID NO: 441342 - DNA, 20 bp, Artificial
  CRISPR gRNA sequence
tgccactaagggctgagtaa

SEQ ID NO: 441343 - DNA, 20 bp, Artificial
  CRISPR gRNA sequence
ccactaagggctgagtaatc

SEQ ID NO: 441344 - DNA, 20 bp, Artificial
  CRISPR gRNA sequence
agggctgagtaatcctgtag

SEQ ID NO: 441345 - DNA, 20 bp, Artificial
  CRISPR gRNA sequence
agtaatcctgtagagttatc

SEQ ID NO: 441346 - DNA, 20 bp, Artificial
  CRISPR gRNA sequence
tagagttatcaggaaaacta

SEQ ID NO: 441347 - DNA, 20 bp, Artificial
  CRISPR gRNA sequence
tcaggaaaactaagtgagag

SEQ ID NO: 441348 - DNA, 20 bp, Artificial
  CRISPR gRNA sequence
agtgagagaaaatataaaat

SEQ ID NO: 441349 - DNA, 20 bp, Artificial
  CRISPR gRNA sequence
agtacagggcctggtacata

SEQ ID NO: 441350 - DNA, 20 bp, Artificial
  CRISPR gRNA sequence
gtacagggcctggtacataa

SEQ ID NO: 441351 - DNA, 20 bp, Artificial
  CRISPR gRNA sequence
gtacataataaatgttcaat

SEQ ID NO: 441352 - DNA, 20 bp, Artificial
  CRISPR gRNA sequence
aatcaatcgtagctattatt

SEQ ID NO: 441353 - DNA, 20 bp, Artificial
  CRISPR gRNA sequence
ttattgctattgctctagtt

SEQ ID NO: 441354 - DNA, 20 bp, Artificial
  CRISPR gRNA sequence
ttgctattgctctagttaac

SEQ ID NO: 441355 - DNA, 20 bp, Artificial
  CRISPR gRNA sequence
ctattgctctagttaacttg

SEQ ID NO: 441356 - DNA, 20 bp, Artificial
  CRISPR gRNA sequence
ttgctctagttaacttgatt

SEQ ID NO: 441357 - DNA, 20 bp, Artificial
  CRISPR gRNA sequence
ctctagttaacttgattttc

SEQ ID NO: 441358 - DNA, 20 bp, Artificial
  CRISPR gRNA sequence
tagttaacttgattttctga

SEQ ID NO: 441359 - DNA, 20 bp, Artificial
  CRISPR gRNA sequence
gttaacttgattttctgata

SEQ ID NO: 441360 - DNA, 20 bp, Artificial
  CRISPR gRNA sequence
acttgattttctgataactg

SEQ ID NO: 441361 - DNA, 20 bp, Artificial
  CRISPR gRNA sequence
gattttctgataactgagag

SEQ ID NO: 441362 - DNA, 20 bp, Artificial
  CRISPR gRNA sequence
attttctgataactgagagc

SEQ ID NO: 441363 - DNA, 20 bp, Artificial
  CRISPR gRNA sequence
tctgataactgagagccaca

SEQ ID NO: 441364 - DNA, 20 bp, Artificial
  CRISPR gRNA sequence
ctgataactgagagccacac

SEQ ID NO: 441365 - DNA, 20 bp, Artificial
  CRISPR gRNA sequence
tgataactgagagccacaca

SEQ ID NO: 441366 - DNA, 20 bp, Artificial
  CRISPR gRNA sequence
ataactgagagccacacaaa

SEQ ID NO: 441367 - DNA, 20 bp, Artificial
  CRISPR gRNA sequence
agagccacacaaaataaatc

SEQ ID NO: 441368 - DNA, 20 bp, Artificial
  CRISPR gRNA sequence
tttctaaaatttcagtctat

SEQ ID NO: 441369 - DNA, 20 bp, Artificial
  CRISPR gRNA sequence
ctaaaatttcagtctatggg

SEQ ID NO: 441370 - DNA, 20 bp, Artificial
  CRISPR gRNA sequence
taaaatttcagtctatgggt

SEQ ID NO: 441371 - DNA, 20 bp, Artificial
  CRISPR gRNA sequence
aaatttcagtctatgggttc

SEQ ID NO: 441372 - DNA, 20 bp, Artificial
  CRISPR gRNA sequence
cagtctatgggttctctctt

SEQ ID NO: 441373 - DNA, 20 bp, Artificial
  CRISPR gRNA sequence
agtctatgggttctctcttt

SEQ ID NO: 441374 - DNA, 20 bp, Artificial
  CRISPR gRNA sequence
tgggttctctctttttctct

SEQ ID NO: 441375 - DNA, 20 bp, Artificial
  CRISPR gRNA sequence
tctctttttctctctttaaa

SEQ ID NO: 441376 - DNA, 20 bp, Artificial
  CRISPR gRNA sequence
tctttttctctctttaaaaa

SEQ ID NO: 441377 - DNA, 20 bp, Artificial
  CRISPR gRNA sequence
tttttctctctttaaaaaca

SEQ ID NO: 441378 - DNA, 20 bp, Artificial
  CRISPR gRNA sequence
tttctctctttaaaaacaat

SEQ ID NO: 441379 - DNA, 20 bp, Artificial
  CRISPR gRNA sequence
ttctctctttaaaaacaatg

SEQ ID NO: 441380 - DNA, 20 bp, Artificial
  CRISPR gRNA sequence
tctctctttaaaaacaatga

SEQ ID NO: 441381 - DNA, 20 bp, Artificial
  CRISPR gRNA sequence
ctctctttaaaaacaatgat

SEQ ID NO: 441382 - DNA, 20 bp, Artificial
  CRISPR gRNA sequence
tctctttaaaaacaatgatt

SEQ ID NO: 441383 - DNA, 20 bp, Artificial
  CRISPR gRNA sequence
tctttaaaaacaatgattag

SEQ ID NO: 441384 - DNA, 20 bp, Artificial
  CRISPR gRNA sequence
tttaaaaacaatgattaggc

SEQ ID NO: 441385 - DNA, 20 bp, Artificial
  CRISPR gRNA sequence
taaaaacaatgattaggcca

SEQ ID NO: 441386 - DNA, 20 bp, Artificial
  CRISPR gRNA sequence
aaaaacaatgattaggccag

SEQ ID NO: 441387 - DNA, 20 bp, Artificial
  CRISPR gRNA sequence
aaaacaatgattaggccagg

SEQ ID NO: 441388 - DNA, 20 bp, Artificial
  CRISPR gRNA sequence
ggccaggtgcggtggctcac

SEQ ID NO: 441389 - DNA, 20 bp, Artificial
  CRISPR gRNA sequence
acgcctgtagtcccagcact

SEQ ID NO: 441390 - DNA, 20 bp, Artificial
  CRISPR gRNA sequence
tagtcccagcactttgggag

SEQ ID NO: 441391 - DNA, 20 bp, Artificial
  CRISPR gRNA sequence
tgggaggccaaggcaggcag

SEQ ID NO: 441392 - DNA, 20 bp, Artificial
  CRISPR gRNA sequence
gggaggccaaggcaggcaga

SEQ ID NO: 441393 - DNA, 20 bp, Artificial
  CRISPR gRNA sequence
ggaggccaaggcaggcagat

SEQ ID NO: 441394 - DNA, 20 bp, Artificial
  CRISPR gRNA sequence
aagaccagcctggccaacat

SEQ ID NO: 441395 - DNA, 20 bp, Artificial
  CRISPR gRNA sequence
gccaacatggtgaaacccca

SEQ ID NO: 441396 - DNA, 20 bp, Artificial
  CRISPR gRNA sequence
tactaaaaatacaaaaatta

SEQ ID NO: 441397 - DNA, 20 bp, Artificial
  CRISPR gRNA sequence
ctaaaaatacaaaaattagc

SEQ ID NO: 441398 - DNA, 20 bp, Artificial
  CRISPR gRNA sequence
aaaatacaaaaattagccag

SEQ ID NO: 441399 - DNA, 20 bp, Artificial
  CRISPR gRNA sequence
gccaggtgtggtggcgggca

SEQ ID NO: 441400 - DNA, 20 bp, Artificial
  CRISPR gRNA sequence
tagtcccagctatttgggag

SEQ ID NO: 441401 - DNA, 20 bp, Artificial
  CRISPR gRNA sequence
tttgggaggctgaggcagga

SEQ ID NO: 441402 - DNA, 20 bp, Artificial
  CRISPR gRNA sequence
gggaggctgaggcaggacaa

SEQ ID NO: 441403 - DNA, 20 bp, Artificial
  CRISPR gRNA sequence
ggaggctgaggcaggacaat

SEQ ID NO: 441404 - DNA, 20 bp, Artificial
  CRISPR gRNA sequence
aggcaggacaatcgcttgaa

SEQ ID NO: 441405 - DNA, 20 bp, Artificial
  CRISPR gRNA sequence
gaacccaggaggcagaggtt

SEQ ID NO: 441406 - DNA, 20 bp, Artificial
  CRISPR gRNA sequence
aacccaggaggcagaggttg

SEQ ID NO: 441407 - DNA, 20 bp, Artificial
  CRISPR gRNA sequence
cagtgagccaaggttgtgcc

SEQ ID NO: 441408 - DNA, 20 bp, Artificial
  CRISPR gRNA sequence
tgccattgtactccagcctg

SEQ ID NO: 441409 - DNA, 20 bp, Artificial
  CRISPR gRNA sequence
tactccagcctgggcgacaa

SEQ ID NO: 441410 - DNA, 20 bp, Artificial
  CRISPR gRNA sequence
cagcctgggcgacaagagca

SEQ ID NO: 441411 - DNA, 20 bp, Artificial
  CRISPR gRNA sequence
ggcgacaagagcaaaactcc

SEQ ID NO: 441412 - DNA, 20 bp, Artificial
  CRISPR gRNA sequence
catctcaaaaataaataata

SEQ ID NO: 441413 - DNA, 20 bp, Artificial
  CRISPR gRNA sequence
aaaaataaataataaattaa

SEQ ID NO: 441414 - DNA, 20 bp, Artificial
  CRISPR gRNA sequence
ataaataaataataattata

SEQ ID NO: 441415 - DNA, 20 bp, Artificial
  CRISPR gRNA sequence
taggccaggctcacacctat

SEQ ID NO: 441416 - DNA, 20 bp, Artificial
  CRISPR gRNA sequence
acacctataatcccagcact

SEQ ID NO: 441417 - DNA, 20 bp, Artificial
  CRISPR gRNA sequence
taatcccagcactttgggaa

SEQ ID NO: 441418 - DNA, 20 bp, Artificial
  CRISPR gRNA sequence
tgggaagctgagatgggagg

SEQ ID NO: 441419 - DNA, 20 bp, Artificial
  CRISPR gRNA sequence
gggaagctgagatgggagga

SEQ ID NO: 441420 - DNA, 20 bp, Artificial
  CRISPR gRNA sequence
ggaagctgagatgggaggat

SEQ ID NO: 441421 - DNA, 20 bp, Artificial
  CRISPR gRNA sequence
agatgggaggatcacttgag

SEQ ID NO: 441422 - DNA, 20 bp, Artificial
  CRISPR gRNA sequence
gagaccaggagttagggacc

SEQ ID NO: 441423 - DNA, 20 bp, Artificial
  CRISPR gRNA sequence
agaccaggagttagggacca

SEQ ID NO: 441424 - DNA, 20 bp, Artificial
  CRISPR gRNA sequence
gggaccagcctaataatatt

SEQ ID NO: 441425 - DNA, 20 bp, Artificial
  CRISPR gRNA sequence
ataatattgagaccccattt

SEQ ID NO: 441426 - DNA, 20 bp, Artificial
  CRISPR gRNA sequence
agaccccatttatacaaaac

SEQ ID NO: 441427 - DNA, 20 bp, Artificial
  CRISPR gRNA sequence
atacaaaacacacacacaca

SEQ ID NO: 441428 - DNA, 20 bp, Artificial
  CRISPR gRNA sequence
tacaaaacacacacacacac

SEQ ID NO: 441429 - DNA, 20 bp, Artificial
  CRISPR gRNA sequence
taagcatttttaaaacaatg

SEQ ID NO: 441430 - DNA, 20 bp, Artificial
  CRISPR gRNA sequence
ttaaaacaatgaatttaagg

SEQ ID NO: 441431 - DNA, 20 bp, Artificial
  CRISPR gRNA sequence
taaaacaatgaatttaagga

SEQ ID NO: 441432 - DNA, 20 bp, Artificial
  CRISPR gRNA sequence
aaaacaatgaatttaaggaa

SEQ ID NO: 441433 - DNA, 20 bp, Artificial
  CRISPR gRNA sequence
aaacaatgaatttaaggaag

SEQ ID NO: 441434 - DNA, 20 bp, Artificial
  CRISPR gRNA sequence
aaggaagttaaatcttccat

SEQ ID NO: 441435 - DNA, 20 bp, Artificial
  CRISPR gRNA sequence
aggaagttaaatcttccatt

SEQ ID NO: 441436 - DNA, 20 bp, Artificial
  CRISPR gRNA sequence
aatcttccatttattcaata

SEQ ID NO: 441437 - DNA, 20 bp, Artificial
  CRISPR gRNA sequence
ccatttattcaatatacatt

SEQ ID NO: 441438 - DNA, 20 bp, Artificial
  CRISPR gRNA sequence
catttattcaatatacattt

SEQ ID NO: 441439 - DNA, 20 bp, Artificial
  CRISPR gRNA sequence
attcaatatacatttacaaa

SEQ ID NO: 441440 - DNA, 20 bp, Artificial
  CRISPR gRNA sequence
ttcaatatacatttacaaat

SEQ ID NO: 441441 - DNA, 20 bp, Artificial
  CRISPR gRNA sequence
aatatacatttacaaattga

SEQ ID NO: 441442 - DNA, 20 bp, Artificial
  CRISPR gRNA sequence
acaaattgattcaatacaca

SEQ ID NO: 441443 - DNA, 20 bp, Artificial
  CRISPR gRNA sequence
caaattgattcaatacacat

SEQ ID NO: 441444 - DNA, 20 bp, Artificial
  CRISPR gRNA sequence
attcaatacacattactcct

SEQ ID NO: 441445 - DNA, 20 bp, Artificial
  CRISPR gRNA sequence
aatacacattactcctgcaa

SEQ ID NO: 441446 - DNA, 20 bp, Artificial
  CRISPR gRNA sequence
ctcctgcaataacaggagtc

SEQ ID NO: 441447 - DNA, 20 bp, Artificial
  CRISPR gRNA sequence
ctgcaataacaggagtccta

SEQ ID NO: 441448 - DNA, 20 bp, Artificial
  CRISPR gRNA sequence
caataacaggagtcctatat

SEQ ID NO: 441449 - DNA, 20 bp, Artificial
  CRISPR gRNA sequence
tatgcaagatattgtgcatt

SEQ ID NO: 441450 - DNA, 20 bp, Artificial
  CRISPR gRNA sequence
tgcattaagcattgtgggca

SEQ ID NO: 441451 - DNA, 20 bp, Artificial
  CRISPR gRNA sequence
agcattgtgggcacatacag

SEQ ID NO: 441452 - DNA, 20 bp, Artificial
  CRISPR gRNA sequence
tgggcacatacaggtcctta

SEQ ID NO: 441453 - DNA, 20 bp, Artificial
  CRISPR gRNA sequence
aaaaagcactgtttgattgc

SEQ ID NO: 441454 - DNA, 20 bp, Artificial
  CRISPR gRNA sequence
aaaagcactgtttgattgca

SEQ ID NO: 441455 - DNA, 20 bp, Artificial
  CRISPR gRNA sequence
tttgattgcaaagagagaag

SEQ ID NO: 441456 - DNA, 20 bp, Artificial
  CRISPR gRNA sequence
gattgcaaagagagaaggag

SEQ ID NO: 441457 - DNA, 20 bp, Artificial
  CRISPR gRNA sequence
attgcaaagagagaaggagc

SEQ ID NO: 441458 - DNA, 20 bp, Artificial
  CRISPR gRNA sequence
caaagagagaaggagcaaat

SEQ ID NO: 441459 - DNA, 20 bp, Artificial
  CRISPR gRNA sequence
agcatcagttgtgaatacac

SEQ ID NO: 441460 - DNA, 20 bp, Artificial
  CRISPR gRNA sequence
tgaatacacaagcaagaaac

SEQ ID NO: 441461 - DNA, 20 bp, Artificial
  CRISPR gRNA sequence
agtcaaataaatgtgggctc

SEQ ID NO: 441462 - DNA, 20 bp, Artificial
  CRISPR gRNA sequence
ctggatatgccctcaagtaa

SEQ ID NO: 441463 - DNA, 20 bp, Artificial
  CRISPR gRNA sequence
gatatgccctcaagtaattt

SEQ ID NO: 441464 - DNA, 20 bp, Artificial
  CRISPR gRNA sequence
aagtaatttttttttttttt

SEQ ID NO: 441465 - DNA, 20 bp, Artificial
  CRISPR gRNA sequence
tttttttttttttttttttg

SEQ ID NO: 441466 - DNA, 20 bp, Artificial
  CRISPR gRNA sequence
ttttttttttttttttttga

SEQ ID NO: 441467 - DNA, 20 bp, Artificial
  CRISPR gRNA sequence
tttttttttttttttttgag

SEQ ID NO: 441468 - DNA, 20 bp, Artificial
  CRISPR gRNA sequence
ttttttttttttttttgaga

SEQ ID NO: 441469 - DNA, 20 bp, Artificial
  CRISPR gRNA sequence
tttttttttttttttgagac

SEQ ID NO: 441470 - DNA, 20 bp, Artificial
  CRISPR gRNA sequence
ttttttttttttttgagaca

SEQ ID NO: 441471 - DNA, 20 bp, Artificial
  CRISPR gRNA sequence
tttttttttttttgagacaa

SEQ ID NO: 441472 - DNA, 20 bp, Artificial
  CRISPR gRNA sequence
ttttttttttttgagacaag

SEQ ID NO: 441473 - DNA, 20 bp, Artificial
  CRISPR gRNA sequence
tttttttttttgagacaagg

SEQ ID NO: 441474 - DNA, 20 bp, Artificial
  CRISPR gRNA sequence
ttttttttttgagacaaggc

SEQ ID NO: 441475 - DNA, 20 bp, Artificial
  CRISPR gRNA sequence
tttttttttgagacaaggcc

SEQ ID NO: 441476 - DNA, 20 bp, Artificial
  CRISPR gRNA sequence
ttttttttgagacaaggcct

SEQ ID NO: 441477 - DNA, 20 bp, Artificial
  CRISPR gRNA sequence
tttttttgagacaaggcctt

SEQ ID NO: 441478 - DNA, 20 bp, Artificial
  CRISPR gRNA sequence
ttttttgagacaaggccttg

SEQ ID NO: 441479 - DNA, 20 bp, Artificial
  CRISPR gRNA sequence
tttttgagacaaggccttgc

SEQ ID NO: 441480 - DNA, 20 bp, Artificial
  CRISPR gRNA sequence
ttttgagacaaggccttgcc

SEQ ID NO: 441481 - DNA, 20 bp, Artificial
  CRISPR gRNA sequence
tttgagacaaggccttgccc

SEQ ID NO: 441482 - DNA, 20 bp, Artificial
  CRISPR gRNA sequence
ttgagacaaggccttgccct

SEQ ID NO: 441483 - DNA, 20 bp, Artificial
  CRISPR gRNA sequence
tgagacaaggccttgccctg

SEQ ID NO: 441484 - DNA, 20 bp, Artificial
  CRISPR gRNA sequence
gagacaaggccttgccctgt

SEQ ID NO: 441485 - DNA, 20 bp, Artificial
  CRISPR gRNA sequence
agacaaggccttgccctgtc

SEQ ID NO: 441486 - DNA, 20 bp, Artificial
  CRISPR gRNA sequence
gccctgtcacctaggatgga

SEQ ID NO: 441487 - DNA, 20 bp, Artificial
  CRISPR gRNA sequence
ccctgtcacctaggatggag

SEQ ID NO: 441488 - DNA, 20 bp, Artificial
  CRISPR gRNA sequence
tcacctaggatggagtgcag

SEQ ID NO: 441489 - DNA, 20 bp, Artificial
  CRISPR gRNA sequence
ggatggagtgcaggggcatg

SEQ ID NO: 441490 - DNA, 20 bp, Artificial
  CRISPR gRNA sequence
aatgcagcctcaacctactg

SEQ ID NO: 441491 - DNA, 20 bp, Artificial
  CRISPR gRNA sequence
aacctactgggctcaagtga

SEQ ID NO: 441492 - DNA, 20 bp, Artificial
  CRISPR gRNA sequence
ctgggctcaagtgatcctcc

SEQ ID NO: 441493 - DNA, 20 bp, Artificial
  CRISPR gRNA sequence
ggctcaagtgatcctcctgc

SEQ ID NO: 441494 - DNA, 20 bp, Artificial
  CRISPR gRNA sequence
aagtgatcctcctgcctcag

SEQ ID NO: 441495 - DNA, 20 bp, Artificial
  CRISPR gRNA sequence
ctgcctcagcctcccaagta

SEQ ID NO: 441496 - DNA, 20 bp, Artificial
  CRISPR gRNA sequence
cctcagcctcccaagtagct

SEQ ID NO: 441497 - DNA, 20 bp, Artificial
  CRISPR gRNA sequence
agcctcccaagtagctggaa

SEQ ID NO: 441498 - DNA, 20 bp, Artificial
  CRISPR gRNA sequence
ccaagtagctggaactacag

SEQ ID NO: 441499 - DNA, 20 bp, Artificial
  CRISPR gRNA sequence
gaactacaggtttgcagcac

SEQ ID NO: 441500 - DNA, 20 bp, Artificial
  CRISPR gRNA sequence
caggtttgcagcaccatgcc

SEQ ID NO: 441501 - DNA, 20 bp, Artificial
  CRISPR gRNA sequence
gcagcaccatgcctggccaa

SEQ ID NO: 441502 - DNA, 20 bp, Artificial
  CRISPR gRNA sequence
cagcaccatgcctggccaaa

SEQ ID NO: 441503 - DNA, 20 bp, Artificial
  CRISPR gRNA sequence
gccaaattttaaaaaatatt

SEQ ID NO: 441504 - DNA, 20 bp, Artificial
  CRISPR gRNA sequence
taaaaaatattttttgtaga

SEQ ID NO: 441505 - DNA, 20 bp, Artificial
  CRISPR gRNA sequence
aaaaaatattttttgtagag

SEQ ID NO: 441506 - DNA, 20 bp, Artificial
  CRISPR gRNA sequence
aaaaatattttttgtagaga

SEQ ID NO: 441507 - DNA, 20 bp, Artificial
  CRISPR gRNA sequence
tttgtagagacagggtgtca

SEQ ID NO: 441508 - DNA, 20 bp, Artificial
  CRISPR gRNA sequence
ttgtagagacagggtgtcac

SEQ ID NO: 441509 - DNA, 20 bp, Artificial
  CRISPR gRNA sequence
tgtagagacagggtgtcact

SEQ ID NO: 441510 - DNA, 20 bp, Artificial
  CRISPR gRNA sequence
gtagagacagggtgtcacta

SEQ ID NO: 441511 - DNA, 20 bp, Artificial
  CRISPR gRNA sequence
tagagacagggtgtcactat

SEQ ID NO: 441512 - DNA, 20 bp, Artificial
  CRISPR gRNA sequence
tgtggcccaggctagtctca

SEQ ID NO: 441513 - DNA, 20 bp, Artificial
  CRISPR gRNA sequence
gtctcaaactcctggtctca

SEQ ID NO: 441514 - DNA, 20 bp, Artificial
  CRISPR gRNA sequence
aaactcctggtctcaagcat

SEQ ID NO: 441515 - DNA, 20 bp, Artificial
  CRISPR gRNA sequence
ctggtctcaagcattccttc

SEQ ID NO: 441516 - DNA, 20 bp, Artificial
  CRISPR gRNA sequence
gtctcaagcattccttccac

SEQ ID NO: 441517 - DNA, 20 bp, Artificial
  CRISPR gRNA sequence
aagcattccttccaccttgg

SEQ ID NO: 441518 - DNA, 20 bp, Artificial
  CRISPR gRNA sequence
cttccaccttggcctcctaa

SEQ ID NO: 441519 - DNA, 20 bp, Artificial
  CRISPR gRNA sequence
ccaccttggcctcctaaagt

SEQ ID NO: 441520 - DNA, 20 bp, Artificial
  CRISPR gRNA sequence
caccttggcctcctaaagtg

SEQ ID NO: 441521 - DNA, 20 bp, Artificial
  CRISPR gRNA sequence
ggcctcctaaagtgctggga

SEQ ID NO: 441522 - DNA, 20 bp, Artificial
  CRISPR gRNA sequence
gcctcctaaagtgctgggat

SEQ ID NO: 441523 - DNA, 20 bp, Artificial
  CRISPR gRNA sequence
ctaaagtgctgggattacag

SEQ ID NO: 441524 - DNA, 20 bp, Artificial
  CRISPR gRNA sequence
aagtgctgggattacaggca

SEQ ID NO: 441525 - DNA, 20 bp, Artificial
  CRISPR gRNA sequence
ggattacaggcatgagacac

SEQ ID NO: 441526 - DNA, 20 bp, Artificial
  CRISPR gRNA sequence
caggcatgagacactgtgcc

SEQ ID NO: 441527 - DNA, 20 bp, Artificial
  CRISPR gRNA sequence
tgcccggcctcctcaaagaa

SEQ ID NO: 441528 - DNA, 20 bp, Artificial
  CRISPR gRNA sequence
ctcaaagaatttttaagtca

SEQ ID NO: 441529 - DNA, 20 bp, Artificial
  CRISPR gRNA sequence
aaagaatttttaagtcattg

SEQ ID NO: 441530 - DNA, 20 bp, Artificial
  CRISPR gRNA sequence
ttaagtcattgctgcaagct

SEQ ID NO: 441531 - DNA, 20 bp, Artificial
  CRISPR gRNA sequence
taagtcattgctgcaagctt

SEQ ID NO: 441532 - DNA, 20 bp, Artificial
  CRISPR gRNA sequence
aagtcattgctgcaagcttg

SEQ ID NO: 441533 - DNA, 20 bp, Artificial
  CRISPR gRNA sequence
agtcattgctgcaagcttgc

SEQ ID NO: 441534 - DNA, 20 bp, Artificial
  CRISPR gRNA sequence
ctgcaagcttgccttctagt

SEQ ID NO: 441535 - DNA, 20 bp, Artificial
  CRISPR gRNA sequence
caagcttgccttctagtggt

SEQ ID NO: 441536 - DNA, 20 bp, Artificial
  CRISPR gRNA sequence
gccttctagtggtttttctt

SEQ ID NO: 441537 - DNA, 20 bp, Artificial
  CRISPR gRNA sequence
ccttctagtggtttttcttt

SEQ ID NO: 441538 - DNA, 20 bp, Artificial
  CRISPR gRNA sequence
ctagtggtttttcttttatg

SEQ ID NO: 441539 - DNA, 20 bp, Artificial
  CRISPR gRNA sequence
tagtggtttttcttttatga

SEQ ID NO: 441540 - DNA, 20 bp, Artificial
  CRISPR gRNA sequence
gtggtttttcttttatgagg

SEQ ID NO: 441541 - DNA, 20 bp, Artificial
  CRISPR gRNA sequence
ttcttttatgagggaatttc

SEQ ID NO: 441542 - DNA, 20 bp, Artificial
  CRISPR gRNA sequence
tcttttatgagggaatttcg

SEQ ID NO: 441543 - DNA, 20 bp, Artificial
  CRISPR gRNA sequence
cttttatgagggaatttcgc

SEQ ID NO: 441544 - DNA, 20 bp, Artificial
  CRISPR gRNA sequence
ttttatgagggaatttcgct

SEQ ID NO: 441545 - DNA, 20 bp, Artificial
  CRISPR gRNA sequence
ttatgagggaatttcgctct

SEQ ID NO: 441546 - DNA, 20 bp, Artificial
  CRISPR gRNA sequence
tatgagggaatttcgctctt

SEQ ID NO: 441547 - DNA, 20 bp, Artificial
  CRISPR gRNA sequence
atgagggaatttcgctcttg

SEQ ID NO: 441548 - DNA, 20 bp, Artificial
  CRISPR gRNA sequence
tgagggaatttcgctcttgt

SEQ ID NO: 441549 - DNA, 20 bp, Artificial
  CRISPR gRNA sequence
cgctcttgttgcccaggctg

SEQ ID NO: 441550 - DNA, 20 bp, Artificial
  CRISPR gRNA sequence
gctcttgttgcccaggctgg

SEQ ID NO: 441551 - DNA, 20 bp, Artificial
  CRISPR gRNA sequence
ttgttgcccaggctggtgtg

SEQ ID NO: 441552 - DNA, 20 bp, Artificial
  CRISPR gRNA sequence
gttgcccaggctggtgtgca

SEQ ID NO: 441553 - DNA, 20 bp, Artificial
  CRISPR gRNA sequence
ttgcccaggctggtgtgcag

SEQ ID NO: 441554 - DNA, 20 bp, Artificial
  CRISPR gRNA sequence
cccaggctggtgtgcagtgg

SEQ ID NO: 441555 - DNA, 20 bp, Artificial
  CRISPR gRNA sequence
gtgtgcagtggcgcgacctc

SEQ ID NO: 441556 - DNA, 20 bp, Artificial
  CRISPR gRNA sequence
agctcactgcaacctccacc

SEQ ID NO: 441557 - DNA, 20 bp, Artificial
  CRISPR gRNA sequence
actgcaacctccacctcctg

SEQ ID NO: 441558 - DNA, 20 bp, Artificial
  CRISPR gRNA sequence
caacctccacctcctggatt

SEQ ID NO: 441559 - DNA, 20 bp, Artificial
  CRISPR gRNA sequence
cacctcctggattcaagcga

SEQ ID NO: 441560 - DNA, 20 bp, Artificial
  CRISPR gRNA sequence
ctggattcaagcgattctcc

SEQ ID NO: 441561 - DNA, 20 bp, Artificial
  CRISPR gRNA sequence
gattcaagcgattctcctgt

SEQ ID NO: 441562 - DNA, 20 bp, Artificial
  CRISPR gRNA sequence
aagcgattctcctgtctcag

SEQ ID NO: 441563 - DNA, 20 bp, Artificial
  CRISPR gRNA sequence
tcctgtctcagcctcctgag

SEQ ID NO: 441564 - DNA, 20 bp, Artificial
  CRISPR gRNA sequence
ctgtctcagcctcctgagta

SEQ ID NO: 441565 - DNA, 20 bp, Artificial
  CRISPR gRNA sequence
tctcagcctcctgagtagct

SEQ ID NO: 441566 - DNA, 20 bp, Artificial
  CRISPR gRNA sequence
agcctcctgagtagctgaga

SEQ ID NO: 441567 - DNA, 20 bp, Artificial
  CRISPR gRNA sequence
ctgagtagctgagactacac

SEQ ID NO: 441568 - DNA, 20 bp, Artificial
  CRISPR gRNA sequence
agtagctgagactacacagg

SEQ ID NO: 441569 - DNA, 20 bp, Artificial
  CRISPR gRNA sequence
agactacacaggcacacacc

SEQ ID NO: 441570 - DNA, 20 bp, Artificial
  CRISPR gRNA sequence
cacaggcacacaccaccata

SEQ ID NO: 441571 - DNA, 20 bp, Artificial
  CRISPR gRNA sequence
gctaattttttgtattttta

SEQ ID NO: 441572 - DNA, 20 bp, Artificial
  CRISPR gRNA sequence
attttttgtatttttagtag

SEQ ID NO: 441573 - DNA, 20 bp, Artificial
  CRISPR gRNA sequence
tttgtatttttagtagagat

SEQ ID NO: 441574 - DNA, 20 bp, Artificial
  CRISPR gRNA sequence
ttgtatttttagtagagatg

SEQ ID NO: 441575 - DNA, 20 bp, Artificial
  CRISPR gRNA sequence
tgtatttttagtagagatgg

SEQ ID NO: 441576 - DNA, 20 bp, Artificial
  CRISPR gRNA sequence
gtatttttagtagagatggg

SEQ ID NO: 441577 - DNA, 20 bp, Artificial
  CRISPR gRNA sequence
tatttttagtagagatgggg

SEQ ID NO: 441578 - DNA, 20 bp, Artificial
  CRISPR gRNA sequence
ttagtagagatggggtttca

SEQ ID NO: 441579 - DNA, 20 bp, Artificial
  CRISPR gRNA sequence
tagtagagatggggtttcac

SEQ ID NO: 441580 - DNA, 20 bp, Artificial
  CRISPR gRNA sequence
agtagagatggggtttcacc

SEQ ID NO: 441581 - DNA, 20 bp, Artificial
  CRISPR gRNA sequence
gtagagatggggtttcacca

SEQ ID NO: 441582 - DNA, 20 bp, Artificial
  CRISPR gRNA sequence
caccatgttgaccaggctgg

SEQ ID NO: 441583 - DNA, 20 bp, Artificial
  CRISPR gRNA sequence
accatgttgaccaggctggt

SEQ ID NO: 441584 - DNA, 20 bp, Artificial
  CRISPR gRNA sequence
accaggctggtctcaaaccc

SEQ ID NO: 441585 - DNA, 20 bp, Artificial
  CRISPR gRNA sequence
gtctcaaacccctgacaggt

SEQ ID NO: 441586 - DNA, 20 bp, Artificial
  CRISPR gRNA sequence
aaacccctgacaggtgatcc

SEQ ID NO: 441587 - DNA, 20 bp, Artificial
  CRISPR gRNA sequence
acaggtgatccaccctactt

SEQ ID NO: 441588 - DNA, 20 bp, Artificial
  CRISPR gRNA sequence
cttagcctcccaaagtgctg

SEQ ID NO: 441589 - DNA, 20 bp, Artificial
  CRISPR gRNA sequence
agcctcccaaagtgctggga

SEQ ID NO: 441590 - DNA, 20 bp, Artificial
  CRISPR gRNA sequence
gcctcccaaagtgctgggat

SEQ ID NO: 441591 - DNA, 20 bp, Artificial
  CRISPR gRNA sequence
ccaaagtgctgggattacag

SEQ ID NO: 441592 - DNA, 20 bp, Artificial
  CRISPR gRNA sequence
ggattacagacgtgagtcac

SEQ ID NO: 441593 - DNA, 20 bp, Artificial
  CRISPR gRNA sequence
cagacgtgagtcactgcgcc

SEQ ID NO: 441594 - DNA, 20 bp, Artificial
  CRISPR gRNA sequence
cgcccagccagtttttcttt

SEQ ID NO: 441595 - DNA, 20 bp, Artificial
  CRISPR gRNA sequence
ttcttttattctgagaaggt

SEQ ID NO: 441596 - DNA, 20 bp, Artificial
  CRISPR gRNA sequence
tcttttattctgagaaggta

SEQ ID NO: 441597 - DNA, 20 bp, Artificial
  CRISPR gRNA sequence
cttttattctgagaaggtag

SEQ ID NO: 441598 - DNA, 20 bp, Artificial
  CRISPR gRNA sequence
ttttattctgagaaggtagc

SEQ ID NO: 441599 - DNA, 20 bp, Artificial
  CRISPR gRNA sequence
ttattctgagaaggtagcag

SEQ ID NO: 441600 - DNA, 20 bp, Artificial
  CRISPR gRNA sequence
tattctgagaaggtagcagg

SEQ ID NO: 441601 - DNA, 20 bp, Artificial
  CRISPR gRNA sequence
attctgagaaggtagcaggg

SEQ ID NO: 441602 - DNA, 20 bp, Artificial
  CRISPR gRNA sequence
ttctgagaaggtagcaggga

SEQ ID NO: 441603 - DNA, 20 bp, Artificial
  CRISPR gRNA sequence
tgagaaggtagcagggacag

SEQ ID NO: 441604 - DNA, 20 bp, Artificial
  CRISPR gRNA sequence
agaaggtagcagggacagta

SEQ ID NO: 441605 - DNA, 20 bp, Artificial
  CRISPR gRNA sequence
aggtttattaaggtatggct

SEQ ID NO: 441606 - DNA, 20 bp, Artificial
  CRISPR gRNA sequence
attaaggtatggctttattt

SEQ ID NO: 441607 - DNA, 20 bp, Artificial
  CRISPR gRNA sequence
ttaaggtatggctttattta

SEQ ID NO: 441608 - DNA, 20 bp, Artificial
  CRISPR gRNA sequence
aggtatggctttatttatag

SEQ ID NO: 441609 - DNA, 20 bp, Artificial
  CRISPR gRNA sequence
tatttatagttaaatacata

SEQ ID NO: 441610 - DNA, 20 bp, Artificial
  CRISPR gRNA sequence
atttatagttaaatacataa

SEQ ID NO: 441611 - DNA, 20 bp, Artificial
  CRISPR gRNA sequence
tttatagttaaatacataaa

SEQ ID NO: 441612 - DNA, 20 bp, Artificial
  CRISPR gRNA sequence
atagttaaatacataaaact

SEQ ID NO: 441613 - DNA, 20 bp, Artificial
  CRISPR gRNA sequence
tagttaaatacataaaactg

SEQ ID NO: 441614 - DNA, 20 bp, Artificial
  CRISPR gRNA sequence
aatacataaaactggctggg

SEQ ID NO: 441615 - DNA, 20 bp, Artificial
  CRISPR gRNA sequence
gctgggcaccatggctcatg

SEQ ID NO: 441616 - DNA, 20 bp, Artificial
  CRISPR gRNA sequence
ggcaccatggctcatgcctg

SEQ ID NO: 441617 - DNA, 20 bp, Artificial
  CRISPR gRNA sequence
atgcctgtaatcccagcact

SEQ ID NO: 441618 - DNA, 20 bp, Artificial
  CRISPR gRNA sequence
taatcccagcactttgggag

SEQ ID NO: 441619 - DNA, 20 bp, Artificial
  CRISPR gRNA sequence
tgggaggccaagttgggcgg

SEQ ID NO: 441620 - DNA, 20 bp, Artificial
  CRISPR gRNA sequence
gggaggccaagttgggcgga

SEQ ID NO: 441621 - DNA, 20 bp, Artificial
  CRISPR gRNA sequence
ggaggccaagttgggcggat

SEQ ID NO: 441622 - DNA, 20 bp, Artificial
  CRISPR gRNA sequence
ggcggatcacctgaggtcag

SEQ ID NO: 441623 - DNA, 20 bp, Artificial
  CRISPR gRNA sequence
aggtcaggagttcaagacca

SEQ ID NO: 441624 - DNA, 20 bp, Artificial
  CRISPR gRNA sequence
aagaccagcctgaccaacat

SEQ ID NO: 441625 - DNA, 20 bp, Artificial
  CRISPR gRNA sequence
accaacatggagaaaccctg

SEQ ID NO: 441626 - DNA, 20 bp, Artificial
  CRISPR gRNA sequence
tctctactaaaaatacaaaa

SEQ ID NO: 441627 - DNA, 20 bp, Artificial
  CRISPR gRNA sequence
tactaaaaatacaaaattag

SEQ ID NO: 441628 - DNA, 20 bp, Artificial
  CRISPR gRNA sequence
ctaaaaatacaaaattaggc

SEQ ID NO: 441629 - DNA, 20 bp, Artificial
  CRISPR gRNA sequence
aaaatacaaaattaggccag

SEQ ID NO: 441630 - DNA, 20 bp, Artificial
  CRISPR gRNA sequence
ggccaggtgccatggctcac

SEQ ID NO: 441631 - DNA, 20 bp, Artificial
  CRISPR gRNA sequence
acgcctgcaatctcagcact

SEQ ID NO: 441632 - DNA, 20 bp, Artificial
  CRISPR gRNA sequence
caatctcagcactttgggag

SEQ ID NO: 441633 - DNA, 20 bp, Artificial
  CRISPR gRNA sequence
agcactttgggaggccgagg

SEQ ID NO: 441634 - DNA, 20 bp, Artificial
  CRISPR gRNA sequence
tgggaggccgaggcaggtgg

SEQ ID NO: 441635 - DNA, 20 bp, Artificial
  CRISPR gRNA sequence
gggaggccgaggcaggtgga

SEQ ID NO: 441636 - DNA, 20 bp, Artificial
  CRISPR gRNA sequence
ggaggccgaggcaggtggat

SEQ ID NO: 441637 - DNA, 20 bp, Artificial
  CRISPR gRNA sequence
aggtcaggagttcaagatca

SEQ ID NO: 441638 - DNA, 20 bp, Artificial
  CRISPR gRNA sequence
aagatcagcctggccaatgt

SEQ ID NO: 441639 - DNA, 20 bp, Artificial
  CRISPR gRNA sequence
gccaatgtggtgaaactccg

SEQ ID NO: 441640 - DNA, 20 bp, Artificial
  CRISPR gRNA sequence
cgtctctactaaaaataaaa

SEQ ID NO: 441641 - DNA, 20 bp, Artificial
  CRISPR gRNA sequence
tactaaaaataaaaaaatta

SEQ ID NO: 441642 - DNA, 20 bp, Artificial
  CRISPR gRNA sequence
ctaaaaataaaaaaattagc

SEQ ID NO: 441643 - DNA, 20 bp, Artificial
  CRISPR gRNA sequence
aaaataaaaaaattagccgg

SEQ ID NO: 441644 - DNA, 20 bp, Artificial
  CRISPR gRNA sequence
gccgggtgtggtggctcatg

SEQ ID NO: 441645 - DNA, 20 bp, Artificial
  CRISPR gRNA sequence
atgcctgtaatcccagctac

SEQ ID NO: 441646 - DNA, 20 bp, Artificial
  CRISPR gRNA sequence
taatcccagctactcggaag

SEQ ID NO: 441647 - DNA, 20 bp, Artificial
  CRISPR gRNA sequence
ctcggaaggctgaggcagga

SEQ ID NO: 441648 - DNA, 20 bp, Artificial
  CRISPR gRNA sequence
ggaaggctgaggcaggagaa

SEQ ID NO: 441649 - DNA, 20 bp, Artificial
  CRISPR gRNA sequence
aggcaggagaatcgcttgaa

SEQ ID NO: 441650 - DNA, 20 bp, Artificial
  CRISPR gRNA sequence
gaacccgggaggcggaggtt

SEQ ID NO: 441651 - DNA, 20 bp, Artificial
  CRISPR gRNA sequence
aacccgggaggcggaggttg

SEQ ID NO: 441652 - DNA, 20 bp, Artificial
  CRISPR gRNA sequence
aggtgagccaggatcacacc

SEQ ID NO: 441653 - DNA, 20 bp, Artificial
  CRISPR gRNA sequence
gcactccagcctgggcaaca

SEQ ID NO: 441654 - DNA, 20 bp, Artificial
  CRISPR gRNA sequence
cactccagcctgggcaacaa

SEQ ID NO: 441655 - DNA, 20 bp, Artificial
  CRISPR gRNA sequence
cagcctgggcaacaagagcg

SEQ ID NO: 441656 - DNA, 20 bp, Artificial
  CRISPR gRNA sequence
ggcaacaagagcgaaattct

SEQ ID NO: 441657 - DNA, 20 bp, Artificial
  CRISPR gRNA sequence
tgtctaaaaaaaaaaaaaaa

SEQ ID NO: 441658 - DNA, 20 bp, Artificial
  CRISPR gRNA sequence
tctaaaaaaaaaaaaaaaaa

SEQ ID NO: 441659 - DNA, 20 bp, Artificial
  CRISPR gRNA sequence
aaaaaaaaaaaaaaaaacct

SEQ ID NO: 441660 - DNA, 20 bp, Artificial
  CRISPR gRNA sequence
ttcactttgaatattcctga

SEQ ID NO: 441661 - DNA, 20 bp, Artificial
  CRISPR gRNA sequence
cactttgaatattcctgact

SEQ ID NO: 441662 - DNA, 20 bp, Artificial
  CRISPR gRNA sequence
actttgaatattcctgactg

SEQ ID NO: 441663 - DNA, 20 bp, Artificial
  CRISPR gRNA sequence
tgaatattcctgactggtgt

SEQ ID NO: 441664 - DNA, 20 bp, Artificial
  CRISPR gRNA sequence
gaatattcctgactggtgtc

SEQ ID NO: 441665 - DNA, 20 bp, Artificial
  CRISPR gRNA sequence
aatattcctgactggtgtct

SEQ ID NO: 441666 - DNA, 20 bp, Artificial
  CRISPR gRNA sequence
ctgactggtgtcttgccata

SEQ ID NO: 441667 - DNA, 20 bp, Artificial
  CRISPR gRNA sequence
actggtgtcttgccatattt

SEQ ID NO: 441668 - DNA, 20 bp, Artificial
  CRISPR gRNA sequence
gtgtcttgccatatttaaag

SEQ ID NO: 441669 - DNA, 20 bp, Artificial
  CRISPR gRNA sequence
gccatatttaaagagataaa

SEQ ID NO: 441670 - DNA, 20 bp, Artificial
  CRISPR gRNA sequence
ccatatttaaagagataaat

SEQ ID NO: 441671 - DNA, 20 bp, Artificial
  CRISPR gRNA sequence
aaagagataaatttaaatac

SEQ ID NO: 441672 - DNA, 20 bp, Artificial
  CRISPR gRNA sequence
aagagataaatttaaatact

SEQ ID NO: 441673 - DNA, 20 bp, Artificial
  CRISPR gRNA sequence
aaatactctttcccattagg

SEQ ID NO: 441674 - DNA, 20 bp, Artificial
  CRISPR gRNA sequence
aatactctttcccattagga

SEQ ID NO: 441675 - DNA, 20 bp, Artificial
  CRISPR gRNA sequence
tttcccattaggattgcaat

SEQ ID NO: 441676 - DNA, 20 bp, Artificial
  CRISPR gRNA sequence
tcccattaggattgcaatgg

SEQ ID NO: 441677 - DNA, 20 bp, Artificial
  CRISPR gRNA sequence
cccattaggattgcaatgga

SEQ ID NO: 441678 - DNA, 20 bp, Artificial
  CRISPR gRNA sequence
ccattaggattgcaatggaa

SEQ ID NO: 441679 - DNA, 20 bp, Artificial
  CRISPR gRNA sequence
ggattgcaatggaagcaaga

SEQ ID NO: 441680 - DNA, 20 bp, Artificial
  CRISPR gRNA sequence
caatggaagcaagaagaatg

SEQ ID NO: 441681 - DNA, 20 bp, Artificial
  CRISPR gRNA sequence
tagggagatgaagaatcttt

SEQ ID NO: 441682 - DNA, 20 bp, Artificial
  CRISPR gRNA sequence
gggagatgaagaatctttga

SEQ ID NO: 441683 - DNA, 20 bp, Artificial
  CRISPR gRNA sequence
tgaaccttccacagggtaga

SEQ ID NO: 441684 - DNA, 20 bp, Artificial
  CRISPR gRNA sequence
gaaccttccacagggtagac

SEQ ID NO: 441685 - DNA, 20 bp, Artificial
  CRISPR gRNA sequence
aaccttccacagggtagaca

SEQ ID NO: 441686 - DNA, 20 bp, Artificial
  CRISPR gRNA sequence
ccacagggtagacagttgtg

SEQ ID NO: 441687 - DNA, 20 bp, Artificial
  CRISPR gRNA sequence
cacagggtagacagttgtga

SEQ ID NO: 441688 - DNA, 20 bp, Artificial
  CRISPR gRNA sequence
tgaaattgaagaataagagg

SEQ ID NO: 441689 - DNA, 20 bp, Artificial
  CRISPR gRNA sequence
aagaataagagggacaaaat

SEQ ID NO: 441690 - DNA, 20 bp, Artificial
  CRISPR gRNA sequence
atgtttcttctttgtggttt

SEQ ID NO: 441691 - DNA, 20 bp, Artificial
  CRISPR gRNA sequence
cttctttgtggttttcaagc

SEQ ID NO: 441692 - DNA, 20 bp, Artificial
  CRISPR gRNA sequence
ttctttgtggttttcaagct

SEQ ID NO: 441693 - DNA, 20 bp, Artificial
  CRISPR gRNA sequence
ctttgtggttttcaagctct

SEQ ID NO: 441694 - DNA, 20 bp, Artificial
  CRISPR gRNA sequence
tttgtggttttcaagctctt

SEQ ID NO: 441695 - DNA, 20 bp, Artificial
  CRISPR gRNA sequence
tgtggttttcaagctcttac

SEQ ID NO: 441696 - DNA, 20 bp, Artificial
  CRISPR gRNA sequence
gtggttttcaagctcttact

SEQ ID NO: 441697 - DNA, 20 bp, Artificial
  CRISPR gRNA sequence
tggttttcaagctcttacta

SEQ ID NO: 441698 - DNA, 20 bp, Artificial
  CRISPR gRNA sequence
tcaagctcttactatatgcc

SEQ ID NO: 441699 - DNA, 20 bp, Artificial
  CRISPR gRNA sequence
caagctcttactatatgcca

SEQ ID NO: 441700 - DNA, 20 bp, Artificial
  CRISPR gRNA sequence
aagctcttactatatgccag

SEQ ID NO: 441701 - DNA, 20 bp, Artificial
  CRISPR gRNA sequence
ttactatatgccaggcactt

SEQ ID NO: 441702 - DNA, 20 bp, Artificial
  CRISPR gRNA sequence
actatatgccaggcacttta

SEQ ID NO: 441703 - DNA, 20 bp, Artificial
  CRISPR gRNA sequence
ctatatgccaggcactttac

SEQ ID NO: 441704 - DNA, 20 bp, Artificial
  CRISPR gRNA sequence
tatgccaggcactttacaca

SEQ ID NO: 441705 - DNA, 20 bp, Artificial
  CRISPR gRNA sequence
tacacacatcatgtcagtcc

SEQ ID NO: 441706 - DNA, 20 bp, Artificial
  CRISPR gRNA sequence
acacacatcatgtcagtcct

SEQ ID NO: 441707 - DNA, 20 bp, Artificial
  CRISPR gRNA sequence
cacacatcatgtcagtcctt

SEQ ID NO: 441708 - DNA, 20 bp, Artificial
  CRISPR gRNA sequence
cattacagcaggcctatgag

SEQ ID NO: 441709 - DNA, 20 bp, Artificial
  CRISPR gRNA sequence
attacagcaggcctatgagg

SEQ ID NO: 441710 - DNA, 20 bp, Artificial
  CRISPR gRNA sequence
cagcaggcctatgaggttag

SEQ ID NO: 441711 - DNA, 20 bp, Artificial
  CRISPR gRNA sequence
tgaggttagaactgtcatca

SEQ ID NO: 441712 - DNA, 20 bp, Artificial
  CRISPR gRNA sequence
gaactgtcatcatcaacatg

SEQ ID NO: 441713 - DNA, 20 bp, Artificial
  CRISPR gRNA sequence
tcatcatcaacatgttacag

SEQ ID NO: 441714 - DNA, 20 bp, Artificial
  CRISPR gRNA sequence
cagcccaggaatctgaagct

SEQ ID NO: 441715 - DNA, 20 bp, Artificial
  CRISPR gRNA sequence
aagctaagggaacttaaggc

SEQ ID NO: 441716 - DNA, 20 bp, Artificial
  CRISPR gRNA sequence
agggaacttaaggcttttta

SEQ ID NO: 441717 - DNA, 20 bp, Artificial
  CRISPR gRNA sequence
aaggctttttaccccaagga

SEQ ID NO: 441718 - DNA, 20 bp, Artificial
  CRISPR gRNA sequence
aggctttttaccccaaggac

SEQ ID NO: 441719 - DNA, 20 bp, Artificial
  CRISPR gRNA sequence
tttaccccaaggacaaggtg

SEQ ID NO: 441720 - DNA, 20 bp, Artificial
  CRISPR gRNA sequence
ttaccccaaggacaaggtgg

SEQ ID NO: 441721 - DNA, 20 bp, Artificial
  CRISPR gRNA sequence
taccccaaggacaaggtggg

SEQ ID NO: 441722 - DNA, 20 bp, Artificial
  CRISPR gRNA sequence
accccaaggacaaggtgggc

SEQ ID NO: 441723 - DNA, 20 bp, Artificial
  CRISPR gRNA sequence
ccccaaggacaaggtgggca

SEQ ID NO: 441724 - DNA, 20 bp, Artificial
  CRISPR gRNA sequence
aagccatgatttcccctcca

SEQ ID NO: 441725 - DNA, 20 bp, Artificial
  CRISPR gRNA sequence
cccctccaagttgagtacaa

SEQ ID NO: 441726 - DNA, 20 bp, Artificial
  CRISPR gRNA sequence
ccctccaagttgagtacaac

SEQ ID NO: 441727 - DNA, 20 bp, Artificial
  CRISPR gRNA sequence
caagttgagtacaacatagc

SEQ ID NO: 441728 - DNA, 20 bp, Artificial
  CRISPR gRNA sequence
agtacaacatagctcacaaa

SEQ ID NO: 441729 - DNA, 20 bp, Artificial
  CRISPR gRNA sequence
acaaaaaaagttacttactg

SEQ ID NO: 441730 - DNA, 20 bp, Artificial
  CRISPR gRNA sequence
cttactgttagatttatatc

SEQ ID NO: 441731 - DNA, 20 bp, Artificial
  CRISPR gRNA sequence
actgttagatttatatcagg

SEQ ID NO: 441732 - DNA, 20 bp, Artificial
  CRISPR gRNA sequence
ctgttagatttatatcaggg

SEQ ID NO: 441733 - DNA, 20 bp, Artificial
  CRISPR gRNA sequence
ttagatttatatcagggagg

SEQ ID NO: 441734 - DNA, 20 bp, Artificial
  CRISPR gRNA sequence
gatttatatcagggaggctc

SEQ ID NO: 441735 - DNA, 20 bp, Artificial
  CRISPR gRNA sequence
atatcagggaggctccccag

SEQ ID NO: 441736 - DNA, 20 bp, Artificial
  CRISPR gRNA sequence
tatcagggaggctccccagt

SEQ ID NO: 441737 - DNA, 20 bp, Artificial
  CRISPR gRNA sequence
cccagtgtctgtgtctctgc

SEQ ID NO: 441738 - DNA, 20 bp, Artificial
  CRISPR gRNA sequence
tgtctctgctataaaaagag

SEQ ID NO: 441739 - DNA, 20 bp, Artificial
  CRISPR gRNA sequence
tgctataaaaagagagagag

SEQ ID NO: 441740 - DNA, 20 bp, Artificial
  CRISPR gRNA sequence
ctataaaaagagagagagag

SEQ ID NO: 441741 - DNA, 20 bp, Artificial
  CRISPR gRNA sequence
taaaaagagagagagagaga

SEQ ID NO: 441742 - DNA, 20 bp, Artificial
  CRISPR gRNA sequence
agaacgttttcttttatcta

SEQ ID NO: 441743 - DNA, 20 bp, Artificial
  CRISPR gRNA sequence
tcttttatctaagtttttaa

SEQ ID NO: 441744 - DNA, 20 bp, Artificial
  CRISPR gRNA sequence
cttttatctaagtttttaaa

SEQ ID NO: 441745 - DNA, 20 bp, Artificial
  CRISPR gRNA sequence
ttttatctaagtttttaaaa

SEQ ID NO: 441746 - DNA, 20 bp, Artificial
  CRISPR gRNA sequence
ttatctaagtttttaaaaaa

SEQ ID NO: 441747 - DNA, 20 bp, Artificial
  CRISPR gRNA sequence
tatctaagtttttaaaaaat

SEQ ID NO: 441748 - DNA, 20 bp, Artificial
  CRISPR gRNA sequence
atctaagtttttaaaaaatc

SEQ ID NO: 441749 - DNA, 20 bp, Artificial
  CRISPR gRNA sequence
tctaagtttttaaaaaatct

SEQ ID NO: 441750 - DNA, 20 bp, Artificial
  CRISPR gRNA sequence
agtttttaaaaaatcttaat

SEQ ID NO: 441751 - DNA, 20 bp, Artificial
  CRISPR gRNA sequence
ttaaaaaatcttaatgatgc

SEQ ID NO: 441752 - DNA, 20 bp, Artificial
  CRISPR gRNA sequence
taaaaaatcttaatgatgcc

SEQ ID NO: 441753 - DNA, 20 bp, Artificial
  CRISPR gRNA sequence
aaaaaatcttaatgatgcct

SEQ ID NO: 441754 - DNA, 20 bp, Artificial
  CRISPR gRNA sequence
aaaaatcttaatgatgccta

SEQ ID NO: 441755 - DNA, 20 bp, Artificial
  CRISPR gRNA sequence
aatgatgcctataatcctat

SEQ ID NO: 441756 - DNA, 20 bp, Artificial
  CRISPR gRNA sequence
atgatgcctataatcctatt

SEQ ID NO: 441757 - DNA, 20 bp, Artificial
  CRISPR gRNA sequence
taatcctatttgaaatgaat

SEQ ID NO: 441758 - DNA, 20 bp, Artificial
  CRISPR gRNA sequence
tttgaaatgaattctactcc

SEQ ID NO: 441759 - DNA, 20 bp, Artificial
  CRISPR gRNA sequence
gaaatgaattctactccgta

SEQ ID NO: 441760 - DNA, 20 bp, Artificial
  CRISPR gRNA sequence
aaatgaattctactccgtac

SEQ ID NO: 441761 - DNA, 20 bp, Artificial
  CRISPR gRNA sequence
tactccgtacttgtcacaat

SEQ ID NO: 441762 - DNA, 20 bp, Artificial
  CRISPR gRNA sequence
ctccgtacttgtcacaataa

SEQ ID NO: 441763 - DNA, 20 bp, Artificial
  CRISPR gRNA sequence
cgtacttgtcacaataatta

SEQ ID NO: 441764 - DNA, 20 bp, Artificial
  CRISPR gRNA sequence
gtcacaataattaatggaga

SEQ ID NO: 441765 - DNA, 20 bp, Artificial
  CRISPR gRNA sequence
tcacaataattaatggagag

SEQ ID NO: 441766 - DNA, 20 bp, Artificial
  CRISPR gRNA sequence
atggagagacagacaaaatt

SEQ ID NO: 441767 - DNA, 20 bp, Artificial
  CRISPR gRNA sequence
actgaacacccaggaatcaa

SEQ ID NO: 441768 - DNA, 20 bp, Artificial
  CRISPR gRNA sequence
ctgaacacccaggaatcaac

SEQ ID NO: 441769 - DNA, 20 bp, Artificial
  CRISPR gRNA sequence
aacacccaggaatcaacttt

SEQ ID NO: 441770 - DNA, 20 bp, Artificial
  CRISPR gRNA sequence
taggatggccacattttttc

SEQ ID NO: 441771 - DNA, 20 bp, Artificial
  CRISPR gRNA sequence
aggatggccacattttttca

SEQ ID NO: 441772 - DNA, 20 bp, Artificial
  CRISPR gRNA sequence
ggatggccacattttttcat

SEQ ID NO: 441773 - DNA, 20 bp, Artificial
  CRISPR gRNA sequence
tttcatctagataatgaacc

SEQ ID NO: 441774 - DNA, 20 bp, Artificial
  CRISPR gRNA sequence
ttcatctagataatgaaccg

SEQ ID NO: 441775 - DNA, 20 bp, Artificial
  CRISPR gRNA sequence
tcatctagataatgaaccgt

SEQ ID NO: 441776 - DNA, 20 bp, Artificial
  CRISPR gRNA sequence
catctagataatgaaccgta

SEQ ID NO: 441777 - DNA, 20 bp, Artificial
  CRISPR gRNA sequence
atctagataatgaaccgtac

SEQ ID NO: 441778 - DNA, 20 bp, Artificial
  CRISPR gRNA sequence
gataatgaaccgtactgttt

SEQ ID NO: 441779 - DNA, 20 bp, Artificial
  CRISPR gRNA sequence
ttttatgaaatagagacttc

SEQ ID NO: 441780 - DNA, 20 bp, Artificial
  CRISPR gRNA sequence
tatgaaatagagacttctgc

SEQ ID NO: 441781 - DNA, 20 bp, Artificial
  CRISPR gRNA sequence
atgaaatagagacttctgcc

SEQ ID NO: 441782 - DNA, 20 bp, Artificial
  CRISPR gRNA sequence
tgaaatagagacttctgcca

SEQ ID NO: 441783 - DNA, 20 bp, Artificial
  CRISPR gRNA sequence
ctgccaggaagtcctacatt

SEQ ID NO: 441784 - DNA, 20 bp, Artificial
  CRISPR gRNA sequence
tgccaggaagtcctacatta

SEQ ID NO: 441785 - DNA, 20 bp, Artificial
  CRISPR gRNA sequence
ccaggaagtcctacattaaa

SEQ ID NO: 441786 - DNA, 20 bp, Artificial
  CRISPR gRNA sequence
cattaaatatgtgctttgtt

SEQ ID NO: 441787 - DNA, 20 bp, Artificial
  CRISPR gRNA sequence
aatatgtgctttgttttttt

SEQ ID NO: 441788 - DNA, 20 bp, Artificial
  CRISPR gRNA sequence
tgtttttttcacaggaccct

SEQ ID NO: 441789 - DNA, 20 bp, Artificial
  CRISPR gRNA sequence
gtttttttcacaggacccta

SEQ ID NO: 441790 - DNA, 20 bp, Artificial
  CRISPR gRNA sequence
tttttttcacaggaccctaa

SEQ ID NO: 441791 - DNA, 20 bp, Artificial
  CRISPR gRNA sequence
ttttcacaggaccctaatga

SEQ ID NO: 441792 - DNA, 20 bp, Artificial
  CRISPR gRNA sequence
tttcacaggaccctaatgag

SEQ ID NO: 441793 - DNA, 20 bp, Artificial
  CRISPR gRNA sequence
ttcacaggaccctaatgagt

SEQ ID NO: 441794 - DNA, 20 bp, Artificial
  CRISPR gRNA sequence
tcacaggaccctaatgagtt

SEQ ID NO: 441795 - DNA, 20 bp, Artificial
  CRISPR gRNA sequence
cacaggaccctaatgagttc

SEQ ID NO: 441796 - DNA, 20 bp, Artificial
  CRISPR gRNA sequence
acaggaccctaatgagttct

SEQ ID NO: 441797 - DNA, 20 bp, Artificial
  CRISPR gRNA sequence
atgagttctacaaacatcta

SEQ ID NO: 441798 - DNA, 20 bp, Artificial
  CRISPR gRNA sequence
tacaaacatctagcaatatt

SEQ ID NO: 441799 - DNA, 20 bp, Artificial
  CRISPR gRNA sequence
caaacatctagcaatattga

SEQ ID NO: 441800 - DNA, 20 bp, Artificial
  CRISPR gRNA sequence
gcaatattgataagactcag

SEQ ID NO: 441801 - DNA, 20 bp, Artificial
  CRISPR gRNA sequence
ataagactcaggcattattt

SEQ ID NO: 441802 - DNA, 20 bp, Artificial
  CRISPR gRNA sequence
aggcattatttatttattta

SEQ ID NO: 441803 - DNA, 20 bp, Artificial
  CRISPR gRNA sequence
tttatttatttatttattta

SEQ ID NO: 441804 - DNA, 20 bp, Artificial
  CRISPR gRNA sequence
atttatttatttatttagac

SEQ ID NO: 441805 - DNA, 20 bp, Artificial
  CRISPR gRNA sequence
tttatttatttatttagaca

SEQ ID NO: 441806 - DNA, 20 bp, Artificial
  CRISPR gRNA sequence
atttatttatttagacacag

SEQ ID NO: 441807 - DNA, 20 bp, Artificial
  CRISPR gRNA sequence
tttatttatttagacacaga

SEQ ID NO: 441808 - DNA, 20 bp, Artificial
  CRISPR gRNA sequence
atttatttagacacagaatt

SEQ ID NO: 441809 - DNA, 20 bp, Artificial
  CRISPR gRNA sequence
tttatttagacacagaattt

SEQ ID NO: 441810 - DNA, 20 bp, Artificial
  CRISPR gRNA sequence
atttagacacagaatttcac

SEQ ID NO: 441811 - DNA, 20 bp, Artificial
  CRISPR gRNA sequence
tttagacacagaatttcact

SEQ ID NO: 441812 - DNA, 20 bp, Artificial
  CRISPR gRNA sequence
agacacagaatttcactctg

SEQ ID NO: 441813 - DNA, 20 bp, Artificial
  CRISPR gRNA sequence
gacacagaatttcactctgt

SEQ ID NO: 441814 - DNA, 20 bp, Artificial
  CRISPR gRNA sequence
cactctgtcacccaggctgg

SEQ ID NO: 441815 - DNA, 20 bp, Artificial
  CRISPR gRNA sequence
actctgtcacccaggctgga

SEQ ID NO: 441816 - DNA, 20 bp, Artificial
  CRISPR gRNA sequence
tgtcacccaggctggagtgc

SEQ ID NO: 441817 - DNA, 20 bp, Artificial
  CRISPR gRNA sequence
tcacccaggctggagtgcag

SEQ ID NO: 441818 - DNA, 20 bp, Artificial
  CRISPR gRNA sequence
gagtgcagtggcataatctc

SEQ ID NO: 441819 - DNA, 20 bp, Artificial
  CRISPR gRNA sequence
agctcaccgcaacctcggcc

SEQ ID NO: 441820 - DNA, 20 bp, Artificial
  CRISPR gRNA sequence
accgcaacctcggcctccct

SEQ ID NO: 441821 - DNA, 20 bp, Artificial
  CRISPR gRNA sequence
ggcctccctggttcaagcaa

SEQ ID NO: 441822 - DNA, 20 bp, Artificial
  CRISPR gRNA sequence
cctggttcaagcaattctca

SEQ ID NO: 441823 - DNA, 20 bp, Artificial
  CRISPR gRNA sequence
gttcaagcaattctcatccc

SEQ ID NO: 441824 - DNA, 20 bp, Artificial
  CRISPR gRNA sequence
aagcaattctcatccctcat

SEQ ID NO: 441825 - DNA, 20 bp, Artificial
  CRISPR gRNA sequence
tcatccctcatcctcccaag

SEQ ID NO: 441826 - DNA, 20 bp, Artificial
  CRISPR gRNA sequence
atccctcatcctcccaagta

SEQ ID NO: 441827 - DNA, 20 bp, Artificial
  CRISPR gRNA sequence
atcctcccaagtagctggga

SEQ ID NO: 441828 - DNA, 20 bp, Artificial
  CRISPR gRNA sequence
ccaagtagctgggactacat

SEQ ID NO: 441829 - DNA, 20 bp, Artificial
  CRISPR gRNA sequence
ggactacatgcatgcaccac

SEQ ID NO: 441830 - DNA, 20 bp, Artificial
  CRISPR gRNA sequence
catgcatgcaccaccacgcc

SEQ ID NO: 441831 - DNA, 20 bp, Artificial
  CRISPR gRNA sequence
atttttgtatttttagtaga

SEQ ID NO: 441832 - DNA, 20 bp, Artificial
  CRISPR gRNA sequence
ttgtatttttagtagagacg

SEQ ID NO: 441833 - DNA, 20 bp, Artificial
  CRISPR gRNA sequence
tgtatttttagtagagacga

SEQ ID NO: 441834 - DNA, 20 bp, Artificial
  CRISPR gRNA sequence
gtatttttagtagagacgag

SEQ ID NO: 441835 - DNA, 20 bp, Artificial
  CRISPR gRNA sequence
tatttttagtagagacgagg

SEQ ID NO: 441836 - DNA, 20 bp, Artificial
  CRISPR gRNA sequence
ttagtagagacgaggccatg

SEQ ID NO: 441837 - DNA, 20 bp, Artificial
  CRISPR gRNA sequence
tagtagagacgaggccatgt

SEQ ID NO: 441838 - DNA, 20 bp, Artificial
  CRISPR gRNA sequence
agtagagacgaggccatgtt

SEQ ID NO: 441839 - DNA, 20 bp, Artificial
  CRISPR gRNA sequence
gtagagacgaggccatgttg

SEQ ID NO: 441840 - DNA, 20 bp, Artificial
  CRISPR gRNA sequence
accaggctggttgtgaactc

SEQ ID NO: 441841 - DNA, 20 bp, Artificial
  CRISPR gRNA sequence
gttgtgaactcctgacctca

SEQ ID NO: 441842 - DNA, 20 bp, Artificial
  CRISPR gRNA sequence
tgaactcctgacctcaggtg

SEQ ID NO: 441843 - DNA, 20 bp, Artificial
  CRISPR gRNA sequence
ctgacctcaggtgatctgcc

SEQ ID NO: 441844 - DNA, 20 bp, Artificial
  CRISPR gRNA sequence
acctcaggtgatctgcccac

SEQ ID NO: 441845 - DNA, 20 bp, Artificial
  CRISPR gRNA sequence
aggtgatctgcccacctcag

SEQ ID NO: 441846 - DNA, 20 bp, Artificial
  CRISPR gRNA sequence
cccacctcagcctcccaaaa

SEQ ID NO: 441847 - DNA, 20 bp, Artificial
  CRISPR gRNA sequence
agcctcccaaaatgctggga

SEQ ID NO: 441848 - DNA, 20 bp, Artificial
  CRISPR gRNA sequence
ccaaaatgctgggattacag

SEQ ID NO: 441849 - DNA, 20 bp, Artificial
  CRISPR gRNA sequence
ggattacaggtgtgaacgac

SEQ ID NO: 441850 - DNA, 20 bp, Artificial
  CRISPR gRNA sequence
caggtgtgaacgaccaggct

SEQ ID NO: 441851 - DNA, 20 bp, Artificial
  CRISPR gRNA sequence
ggcctcaggcattatattct

SEQ ID NO: 441852 - DNA, 20 bp, Artificial
  CRISPR gRNA sequence
gcctcaggcattatattcta

SEQ ID NO: 441853 - DNA, 20 bp, Artificial
  CRISPR gRNA sequence
aggcattatattctaattag

SEQ ID NO: 441854 - DNA, 20 bp, Artificial
  CRISPR gRNA sequence
tattctaattagattttaaa

SEQ ID NO: 441855 - DNA, 20 bp, Artificial
  CRISPR gRNA sequence
taattagattttaaaagaca

SEQ ID NO: 441856 - DNA, 20 bp, Artificial
  CRISPR gRNA sequence
attagattttaaaagacaac

SEQ ID NO: 441857 - DNA, 20 bp, Artificial
  CRISPR gRNA sequence
gattttaaaagacaacaaaa

SEQ ID NO: 441858 - DNA, 20 bp, Artificial
  CRISPR gRNA sequence
taaaagacaacaaaaattca

SEQ ID NO: 441859 - DNA, 20 bp, Artificial
  CRISPR gRNA sequence
aaaagacaacaaaaattcat

SEQ ID NO: 441860 - DNA, 20 bp, Artificial
  CRISPR gRNA sequence
aaagacaacaaaaattcatt

SEQ ID NO: 441861 - DNA, 20 bp, Artificial
  CRISPR gRNA sequence
atttccttcttttttgtttt

SEQ ID NO: 441862 - DNA, 20 bp, Artificial
  CRISPR gRNA sequence
ccttcttttttgtttttttg

SEQ ID NO: 441863 - DNA, 20 bp, Artificial
  CRISPR gRNA sequence
cttcttttttgtttttttga

SEQ ID NO: 441864 - DNA, 20 bp, Artificial
  CRISPR gRNA sequence
cttttttgtttttttgagac

SEQ ID NO: 441865 - DNA, 20 bp, Artificial
  CRISPR gRNA sequence
ttttttgtttttttgagaca

SEQ ID NO: 441866 - DNA, 20 bp, Artificial
  CRISPR gRNA sequence
ttttgtttttttgagacagt

SEQ ID NO: 441867 - DNA, 20 bp, Artificial
  CRISPR gRNA sequence
tttgtttttttgagacagtc

SEQ ID NO: 441868 - DNA, 20 bp, Artificial
  CRISPR gRNA sequence
ttgtttttttgagacagtct

SEQ ID NO: 441869 - DNA, 20 bp, Artificial
  CRISPR gRNA sequence
tgtttttttgagacagtctc

SEQ ID NO: 441870 - DNA, 20 bp, Artificial
  CRISPR gRNA sequence
gtttttttgagacagtctca

SEQ ID NO: 441871 - DNA, 20 bp, Artificial
  CRISPR gRNA sequence
tttttttgagacagtctcac

SEQ ID NO: 441872 - DNA, 20 bp, Artificial
  CRISPR gRNA sequence
ttttgagacagtctcactct

SEQ ID NO: 441873 - DNA, 20 bp, Artificial
  CRISPR gRNA sequence
tttgagacagtctcactctg

SEQ ID NO: 441874 - DNA, 20 bp, Artificial
  CRISPR gRNA sequence
ttgagacagtctcactctgt

SEQ ID NO: 441875 - DNA, 20 bp, Artificial
  CRISPR gRNA sequence
tgagacagtctcactctgtt

SEQ ID NO: 441876 - DNA, 20 bp, Artificial
  CRISPR gRNA sequence
gagacagtctcactctgttg

SEQ ID NO: 441877 - DNA, 20 bp, Artificial
  CRISPR gRNA sequence
agacagtctcactctgttgc

SEQ ID NO: 441878 - DNA, 20 bp, Artificial
  CRISPR gRNA sequence
actctgttgcccaggctgga

SEQ ID NO: 441879 - DNA, 20 bp, Artificial
  CRISPR gRNA sequence
tgttgcccaggctggagtgc

SEQ ID NO: 441880 - DNA, 20 bp, Artificial
  CRISPR gRNA sequence
ttgcccaggctggagtgcag

SEQ ID NO: 441881 - DNA, 20 bp, Artificial
  CRISPR gRNA sequence
cccaggctggagtgcagtgg

SEQ ID NO: 441882 - DNA, 20 bp, Artificial
  CRISPR gRNA sequence
gagtgcagtggcacaatctc

SEQ ID NO: 441883 - DNA, 20 bp, Artificial
  CRISPR gRNA sequence
aactcactgcaacctccatg

SEQ ID NO: 441884 - DNA, 20 bp, Artificial
  CRISPR gRNA sequence
actgcaacctccatgttctt

SEQ ID NO: 441885 - DNA, 20 bp, Artificial
  CRISPR gRNA sequence
caacctccatgttctttttc

SEQ ID NO: 441886 - DNA, 20 bp, Artificial
  CRISPR gRNA sequence
catgttctttttcttttttt

SEQ ID NO: 441887 - DNA, 20 bp, Artificial
  CRISPR gRNA sequence
tttttcttttttttcttttt

SEQ ID NO: 441888 - DNA, 20 bp, Artificial
  CRISPR gRNA sequence
tttcttttttttctttttgc

SEQ ID NO: 441889 - DNA, 20 bp, Artificial
  CRISPR gRNA sequence
ttcttttttttctttttgcg

SEQ ID NO: 441890 - DNA, 20 bp, Artificial
  CRISPR gRNA sequence
tcttttttttctttttgcga

SEQ ID NO: 441891 - DNA, 20 bp, Artificial
  CRISPR gRNA sequence
cttttttttctttttgcgag

SEQ ID NO: 441892 - DNA, 20 bp, Artificial
  CRISPR gRNA sequence
ttttttttctttttgcgaga

SEQ ID NO: 441893 - DNA, 20 bp, Artificial
  CRISPR gRNA sequence
ttttttctttttgcgagaca

SEQ ID NO: 441894 - DNA, 20 bp, Artificial
  CRISPR gRNA sequence
tttttctttttgcgagacag

SEQ ID NO: 441895 - DNA, 20 bp, Artificial
  CRISPR gRNA sequence
ttttctttttgcgagacaga

SEQ ID NO: 441896 - DNA, 20 bp, Artificial
  CRISPR gRNA sequence
tttctttttgcgagacagaa

SEQ ID NO: 441897 - DNA, 20 bp, Artificial
  CRISPR gRNA sequence
ttctttttgcgagacagaat

SEQ ID NO: 441898 - DNA, 20 bp, Artificial
  CRISPR gRNA sequence
tctttttgcgagacagaatc

SEQ ID NO: 441899 - DNA, 20 bp, Artificial
  CRISPR gRNA sequence
ctttttgcgagacagaatct

SEQ ID NO: 441900 - DNA, 20 bp, Artificial
  CRISPR gRNA sequence
tttttgcgagacagaatctc

SEQ ID NO: 441901 - DNA, 20 bp, Artificial
  CRISPR gRNA sequence
tttgcgagacagaatctcac

SEQ ID NO: 441902 - DNA, 20 bp, Artificial
  CRISPR gRNA sequence
ttgcgagacagaatctcact

SEQ ID NO: 441903 - DNA, 20 bp, Artificial
  CRISPR gRNA sequence
tgcgagacagaatctcactc

SEQ ID NO: 441904 - DNA, 20 bp, Artificial
  CRISPR gRNA sequence
gcgagacagaatctcactct

SEQ ID NO: 441905 - DNA, 20 bp, Artificial
  CRISPR gRNA sequence
cgagacagaatctcactcta

SEQ ID NO: 441906 - DNA, 20 bp, Artificial
  CRISPR gRNA sequence
actctatcacccaggctgga

SEQ ID NO: 441907 - DNA, 20 bp, Artificial
  CRISPR gRNA sequence
tatcacccaggctggagtgc

SEQ ID NO: 441908 - DNA, 20 bp, Artificial
  CRISPR gRNA sequence
tcacccaggctggagtgcag

SEQ ID NO: 441909 - DNA, 20 bp, Artificial
  CRISPR gRNA sequence
gagtgcagtagcatgatctc

SEQ ID NO: 441910 - DNA, 20 bp, Artificial
  CRISPR gRNA sequence
tgctcactgcaacctccatc

SEQ ID NO: 441911 - DNA, 20 bp, Artificial
  CRISPR gRNA sequence
ctcactgcaacctccatctc

SEQ ID NO: 441912 - DNA, 20 bp, Artificial
  CRISPR gRNA sequence
actgcaacctccatctcctg

SEQ ID NO: 441913 - DNA, 20 bp, Artificial
  CRISPR gRNA sequence
caacctccatctcctgagtt

SEQ ID NO: 441914 - DNA, 20 bp, Artificial
  CRISPR gRNA sequence
catctcctgagttcaagcga

SEQ ID NO: 441915 - DNA, 20 bp, Artificial
  CRISPR gRNA sequence
ctgagttcaagcgattctcc

SEQ ID NO: 441916 - DNA, 20 bp, Artificial
  CRISPR gRNA sequence
agttcaagcgattctcctgc

SEQ ID NO: 441917 - DNA, 20 bp, Artificial
  CRISPR gRNA sequence
aagcgattctcctgcctcag

SEQ ID NO: 441918 - DNA, 20 bp, Artificial
  CRISPR gRNA sequence
tcctgcctcagcctccctgg

SEQ ID NO: 441919 - DNA, 20 bp, Artificial
  CRISPR gRNA sequence
ctgcctcagcctccctggta

SEQ ID NO: 441920 - DNA, 20 bp, Artificial
  CRISPR gRNA sequence
cctcagcctccctggtagct

SEQ ID NO: 441921 - DNA, 20 bp, Artificial
  CRISPR gRNA sequence
agcctccctggtagctggga

SEQ ID NO: 441922 - DNA, 20 bp, Artificial
  CRISPR gRNA sequence
cctggtagctgggactacag

SEQ ID NO: 441923 - DNA, 20 bp, Artificial
  CRISPR gRNA sequence
gtagctgggactacaggggc

SEQ ID NO: 441924 - DNA, 20 bp, Artificial
  CRISPR gRNA sequence
ggactacaggggcacaccac

SEQ ID NO: 441925 - DNA, 20 bp, Artificial
  CRISPR gRNA sequence
caggggcacaccaccacaca

SEQ ID NO: 441926 - DNA, 20 bp, Artificial
  CRISPR gRNA sequence
atttttgtatttttagtaga

SEQ ID NO: 441927 - DNA, 20 bp, Artificial
  CRISPR gRNA sequence
ttgtatttttagtagagacg

SEQ ID NO: 441928 - DNA, 20 bp, Artificial
  CRISPR gRNA sequence
tgtatttttagtagagacgg

SEQ ID NO: 441929 - DNA, 20 bp, Artificial
  CRISPR gRNA sequence
gtatttttagtagagacggg

SEQ ID NO: 441930 - DNA, 20 bp, Artificial
  CRISPR gRNA sequence
tatttttagtagagacgggg

SEQ ID NO: 441931 - DNA, 20 bp, Artificial
  CRISPR gRNA sequence
ttagtagagacggggtttcg

SEQ ID NO: 441932 - DNA, 20 bp, Artificial
  CRISPR gRNA sequence
tagtagagacggggtttcgc

SEQ ID NO: 441933 - DNA, 20 bp, Artificial
  CRISPR gRNA sequence
agtagagacggggtttcgcc

SEQ ID NO: 441934 - DNA, 20 bp, Artificial
  CRISPR gRNA sequence
gtagagacggggtttcgcca

SEQ ID NO: 441935 - DNA, 20 bp, Artificial
  CRISPR gRNA sequence
cgccatgttggccaggctag

SEQ ID NO: 441936 - DNA, 20 bp, Artificial
  CRISPR gRNA sequence
gccatgttggccaggctagt

SEQ ID NO: 441937 - DNA, 20 bp, Artificial
  CRISPR gRNA sequence
gccaggctagtctcgaactc

SEQ ID NO: 441938 - DNA, 20 bp, Artificial
  CRISPR gRNA sequence
gtctcgaactcctgacctca

SEQ ID NO: 441939 - DNA, 20 bp, Artificial
  CRISPR gRNA sequence
gaactcctgacctcaagtga

SEQ ID NO: 441940 - DNA, 20 bp, Artificial
  CRISPR gRNA sequence
ctgacctcaagtgatccacc

SEQ ID NO: 441941 - DNA, 20 bp, Artificial
  CRISPR gRNA sequence
acctcaagtgatccacccgc

SEQ ID NO: 441942 - DNA, 20 bp, Artificial
  CRISPR gRNA sequence
aagtgatccacccgcctcgg

SEQ ID NO: 441943 - DNA, 20 bp, Artificial
  CRISPR gRNA sequence
ggcctcccaaagtgctggga

SEQ ID NO: 441944 - DNA, 20 bp, Artificial
  CRISPR gRNA sequence
ccaaagtgctgggattacag

SEQ ID NO: 441945 - DNA, 20 bp, Artificial
  CRISPR gRNA sequence
ggattacaggcgtgagccac

SEQ ID NO: 441946 - DNA, 20 bp, Artificial
  CRISPR gRNA sequence
caggcgtgagccaccgtgcc

SEQ ID NO: 441947 - DNA, 20 bp, Artificial
  CRISPR gRNA sequence
cattttcttaaataagtttt

SEQ ID NO: 441948 - DNA, 20 bp, Artificial
  CRISPR gRNA sequence
tcttaaataagttttgcatt

SEQ ID NO: 441949 - DNA, 20 bp, Artificial
  CRISPR gRNA sequence
cttaaataagttttgcattt

SEQ ID NO: 441950 - DNA, 20 bp, Artificial
  CRISPR gRNA sequence
ttaaataagttttgcattta

SEQ ID NO: 441951 - DNA, 20 bp, Artificial
  CRISPR gRNA sequence
aaataagttttgcatttact

SEQ ID NO: 441952 - DNA, 20 bp, Artificial
  CRISPR gRNA sequence
aataagttttgcatttactc

SEQ ID NO: 441953 - DNA, 20 bp, Artificial
  CRISPR gRNA sequence
tgcatttactcatgagaagg

SEQ ID NO: 441954 - DNA, 20 bp, Artificial
  CRISPR gRNA sequence
gcatttactcatgagaaggg

SEQ ID NO: 441955 - DNA, 20 bp, Artificial
  CRISPR gRNA sequence
catttactcatgagaaggga

SEQ ID NO: 441956 - DNA, 20 bp, Artificial
  CRISPR gRNA sequence
actcatgagaagggagacag

SEQ ID NO: 441957 - DNA, 20 bp, Artificial
  CRISPR gRNA sequence
ctcatgagaagggagacagg

SEQ ID NO: 441958 - DNA, 20 bp, Artificial
  CRISPR gRNA sequence
atgagaagggagacagggtt

SEQ ID NO: 441959 - DNA, 20 bp, Artificial
  CRISPR gRNA sequence
ccaacaaatgaaaataatca

SEQ ID NO: 441960 - DNA, 20 bp, Artificial
  CRISPR gRNA sequence
tggtcacaatgtaataggag

SEQ ID NO: 441961 - DNA, 20 bp, Artificial
  CRISPR gRNA sequence
gtgctaaataaactctttca

SEQ ID NO: 441962 - DNA, 20 bp, Artificial
  CRISPR gRNA sequence
tgctaaataaactctttcag

SEQ ID NO: 441963 - DNA, 20 bp, Artificial
  CRISPR gRNA sequence
aataaactctttcagtgaag

SEQ ID NO: 441964 - DNA, 20 bp, Artificial
  CRISPR gRNA sequence
tttcagtgaagaagctcatt

SEQ ID NO: 441965 - DNA, 20 bp, Artificial
  CRISPR gRNA sequence
tcagtgaagaagctcatttt

SEQ ID NO: 441966 - DNA, 20 bp, Artificial
  CRISPR gRNA sequence
cagtgaagaagctcatttta

SEQ ID NO: 441967 - DNA, 20 bp, Artificial
  CRISPR gRNA sequence
agtgaagaagctcattttag

SEQ ID NO: 441968 - DNA, 20 bp, Artificial
  CRISPR gRNA sequence
attttagagatacttagaag

SEQ ID NO: 441969 - DNA, 20 bp, Artificial
  CRISPR gRNA sequence
tagagatacttagaagcact

SEQ ID NO: 441970 - DNA, 20 bp, Artificial
  CRISPR gRNA sequence
agagatacttagaagcactt

SEQ ID NO: 441971 - DNA, 20 bp, Artificial
  CRISPR gRNA sequence
gagatacttagaagcactta

SEQ ID NO: 441972 - DNA, 20 bp, Artificial
  CRISPR gRNA sequence
agaagcacttactttagaac

SEQ ID NO: 441973 - DNA, 20 bp, Artificial
  CRISPR gRNA sequence
gaagcacttactttagaact

SEQ ID NO: 441974 - DNA, 20 bp, Artificial
  CRISPR gRNA sequence
actttagaactacgcttcta

SEQ ID NO: 441975 - DNA, 20 bp, Artificial
  CRISPR gRNA sequence
ctttagaactacgcttctaa

SEQ ID NO: 441976 - DNA, 20 bp, Artificial
  CRISPR gRNA sequence
tagaactacgcttctaaagt

SEQ ID NO: 441977 - DNA, 20 bp, Artificial
  CRISPR gRNA sequence
agaactacgcttctaaagta

SEQ ID NO: 441978 - DNA, 20 bp, Artificial
  CRISPR gRNA sequence
gaactacgcttctaaagtag

SEQ ID NO: 441979 - DNA, 20 bp, Artificial
  CRISPR gRNA sequence
cgcttctaaagtagagactg

SEQ ID NO: 441980 - DNA, 20 bp, Artificial
  CRISPR gRNA sequence
ctaaagtagagactgttagt

SEQ ID NO: 441981 - DNA, 20 bp, Artificial
  CRISPR gRNA sequence
taaagtagagactgttagtc

SEQ ID NO: 441982 - DNA, 20 bp, Artificial
  CRISPR gRNA sequence
aagtagagactgttagtccc

SEQ ID NO: 441983 - DNA, 20 bp, Artificial
  CRISPR gRNA sequence
ttagtcccattgcacagatg

SEQ ID NO: 441984 - DNA, 20 bp, Artificial
  CRISPR gRNA sequence
gtcccattgcacagatgaag

SEQ ID NO: 441985 - DNA, 20 bp, Artificial
  CRISPR gRNA sequence
cacagatgaagaaactgaaa

SEQ ID NO: 441986 - DNA, 20 bp, Artificial
  CRISPR gRNA sequence
aaaattagggaagtgaagtg

SEQ ID NO: 441987 - DNA, 20 bp, Artificial
  CRISPR gRNA sequence
gggaagtgaagtgactaacc

SEQ ID NO: 441988 - DNA, 20 bp, Artificial
  CRISPR gRNA sequence
acccaaggtcacatgactta

SEQ ID NO: 441989 - DNA, 20 bp, Artificial
  CRISPR gRNA sequence
agcaaatgacaaaatggcct

SEQ ID NO: 441990 - DNA, 20 bp, Artificial
  CRISPR gRNA sequence
gcaaatgacaaaatggcctt

SEQ ID NO: 441991 - DNA, 20 bp, Artificial
  CRISPR gRNA sequence
ccaatttaggtctgcatagc

SEQ ID NO: 441992 - DNA, 20 bp, Artificial
  CRISPR gRNA sequence
caatttaggtctgcatagcc

SEQ ID NO: 441993 - DNA, 20 bp, Artificial
  CRISPR gRNA sequence
aggtctgcatagccttaaat

SEQ ID NO: 441994 - DNA, 20 bp, Artificial
  CRISPR gRNA sequence
ggtctgcatagccttaaatg

SEQ ID NO: 441995 - DNA, 20 bp, Artificial
  CRISPR gRNA sequence
catagccttaaatgcacatt

SEQ ID NO: 441996 - DNA, 20 bp, Artificial
  CRISPR gRNA sequence
aaatgcacattcttaattat

SEQ ID NO: 441997 - DNA, 20 bp, Artificial
  CRISPR gRNA sequence
aatgcacattcttaattata

SEQ ID NO: 441998 - DNA, 20 bp, Artificial
  CRISPR gRNA sequence
ttaattatactgccttcacc

SEQ ID NO: 441999 - DNA, 20 bp, Artificial
  CRISPR gRNA sequence
aattatactgccttcaccag

SEQ ID NO: 442000 - DNA, 20 bp, Artificial
  CRISPR gRNA sequence
attatactgccttcaccagc

SEQ ID NO: 442001 - DNA, 20 bp, Artificial
  CRISPR gRNA sequence
tactgccttcaccagccctt

SEQ ID NO: 442002 - DNA, 20 bp, Artificial
  CRISPR gRNA sequence
ccttcaccagcccttacctc

SEQ ID NO: 442003 - DNA, 20 bp, Artificial
  CRISPR gRNA sequence
caccagcccttacctcagtg

SEQ ID NO: 442004 - DNA, 20 bp, Artificial
  CRISPR gRNA sequence
accagcccttacctcagtgc

SEQ ID NO: 442005 - DNA, 20 bp, Artificial
  CRISPR gRNA sequence
acctcagtgctgtcattatg

SEQ ID NO: 442006 - DNA, 20 bp, Artificial
  CRISPR gRNA sequence
cctcagtgctgtcattatga

SEQ ID NO: 442007 - DNA, 20 bp, Artificial
  CRISPR gRNA sequence
agtgctgtcattatgaagag

SEQ ID NO: 442008 - DNA, 20 bp, Artificial
  CRISPR gRNA sequence
tcattatgaagagggtcacg

SEQ ID NO: 442009 - DNA, 20 bp, Artificial
  CRISPR gRNA sequence
tgaagagggtcacgttgccc

SEQ ID NO: 442010 - DNA, 20 bp, Artificial
  CRISPR gRNA sequence
cccagccacccactcaccat

SEQ ID NO: 442011 - DNA, 20 bp, Artificial
  CRISPR gRNA sequence
accatctttccttcctgttc

SEQ ID NO: 442012 - DNA, 20 bp, Artificial
  CRISPR gRNA sequence
tccttcctgttcatttgttt

SEQ ID NO: 442013 - DNA, 20 bp, Artificial
  CRISPR gRNA sequence
ccttcctgttcatttgttta

SEQ ID NO: 442014 - DNA, 20 bp, Artificial
  CRISPR gRNA sequence
cttcctgttcatttgtttat

SEQ ID NO: 442015 - DNA, 20 bp, Artificial
  CRISPR gRNA sequence
cctgttcatttgtttatttc

SEQ ID NO: 442016 - DNA, 20 bp, Artificial
  CRISPR gRNA sequence
ctgttcatttgtttatttct

SEQ ID NO: 442017 - DNA, 20 bp, Artificial
  CRISPR gRNA sequence
ttcatttgtttatttcttca

SEQ ID NO: 442018 - DNA, 20 bp, Artificial
  CRISPR gRNA sequence
atttgtttatttcttcatct

SEQ ID NO: 442019 - DNA, 20 bp, Artificial
  CRISPR gRNA sequence
gtttatttcttcatctgctg

SEQ ID NO: 442020 - DNA, 20 bp, Artificial
  CRISPR gRNA sequence
tttatttcttcatctgctga

SEQ ID NO: 442021 - DNA, 20 bp, Artificial
  CRISPR gRNA sequence
atttcttcatctgctgatcc

SEQ ID NO: 442022 - DNA, 20 bp, Artificial
  CRISPR gRNA sequence
tttcttcatctgctgatcca

SEQ ID NO: 442023 - DNA, 20 bp, Artificial
  CRISPR gRNA sequence
cttcatctgctgatccattc

SEQ ID NO: 442024 - DNA, 20 bp, Artificial
  CRISPR gRNA sequence
ttcatctgctgatccattcc

SEQ ID NO: 442025 - DNA, 20 bp, Artificial
  CRISPR gRNA sequence
catctgctgatccattccat

SEQ ID NO: 442026 - DNA, 20 bp, Artificial
  CRISPR gRNA sequence
atctgctgatccattccatg

SEQ ID NO: 442027 - DNA, 20 bp, Artificial
  CRISPR gRNA sequence
ctgatccattccatgaatat

SEQ ID NO: 442028 - DNA, 20 bp, Artificial
  CRISPR gRNA sequence
atccattccatgaatatgca

SEQ ID NO: 442029 - DNA, 20 bp, Artificial
  CRISPR gRNA sequence
catgaatatgcactatgccc

SEQ ID NO: 442030 - DNA, 20 bp, Artificial
  CRISPR gRNA sequence
tgcccttactctaggcacag

SEQ ID NO: 442031 - DNA, 20 bp, Artificial
  CRISPR gRNA sequence
actctaggcacaggggacag

SEQ ID NO: 442032 - DNA, 20 bp, Artificial
  CRISPR gRNA sequence
ctctaggcacaggggacaga

SEQ ID NO: 442033 - DNA, 20 bp, Artificial
  CRISPR gRNA sequence
taggcacaggggacagagca

SEQ ID NO: 442034 - DNA, 20 bp, Artificial
  CRISPR gRNA sequence
ggcacaggggacagagcagg

SEQ ID NO: 442035 - DNA, 20 bp, Artificial
  CRISPR gRNA sequence
acctcatgaacactgaattc

SEQ ID NO: 442036 - DNA, 20 bp, Artificial
  CRISPR gRNA sequence
atgaacactgaattctaaaa

SEQ ID NO: 442037 - DNA, 20 bp, Artificial
  CRISPR gRNA sequence
aattctaaaaataagtacat

SEQ ID NO: 442038 - DNA, 20 bp, Artificial
  CRISPR gRNA sequence
taaaaataagtacattgcca

SEQ ID NO: 442039 - DNA, 20 bp, Artificial
  CRISPR gRNA sequence
aaaataagtacattgccagc

SEQ ID NO: 442040 - DNA, 20 bp, Artificial
  CRISPR gRNA sequence
ccagcttttggaaaactaag

SEQ ID NO: 442041 - DNA, 20 bp, Artificial
  CRISPR gRNA sequence
ttggaaaactaagcatgctt

SEQ ID NO: 442042 - DNA, 20 bp, Artificial
  CRISPR gRNA sequence
tggaaaactaagcatgctta

SEQ ID NO: 442043 - DNA, 20 bp, Artificial
  CRISPR gRNA sequence
ggaaaactaagcatgcttac

SEQ ID NO: 442044 - DNA, 20 bp, Artificial
  CRISPR gRNA sequence
gaaaactaagcatgcttact

SEQ ID NO: 442045 - DNA, 20 bp, Artificial
  CRISPR gRNA sequence
agcatgcttactcattttta

SEQ ID NO: 442046 - DNA, 20 bp, Artificial
  CRISPR gRNA sequence
actcatttttatggctgagt

SEQ ID NO: 442047 - DNA, 20 bp, Artificial
  CRISPR gRNA sequence
ctcatttttatggctgagtc

SEQ ID NO: 442048 - DNA, 20 bp, Artificial
  CRISPR gRNA sequence
atttttatggctgagtcaga

SEQ ID NO: 442049 - DNA, 20 bp, Artificial
  CRISPR gRNA sequence
ttatggctgagtcagagatg

SEQ ID NO: 442050 - DNA, 20 bp, Artificial
  CRISPR gRNA sequence
tatggctgagtcagagatgt

SEQ ID NO: 442051 - DNA, 20 bp, Artificial
  CRISPR gRNA sequence
atggctgagtcagagatgtt

SEQ ID NO: 442052 - DNA, 20 bp, Artificial
  CRISPR gRNA sequence
tggctgagtcagagatgttg

SEQ ID NO: 442053 - DNA, 20 bp, Artificial
  CRISPR gRNA sequence
agtcagagatgttgaaactt

SEQ ID NO: 442054 - DNA, 20 bp, Artificial
  CRISPR gRNA sequence
aaacttcttaaatgtcactg

SEQ ID NO: 442055 - DNA, 20 bp, Artificial
  CRISPR gRNA sequence
cttaaatgtcactgtcacct

SEQ ID NO: 442056 - DNA, 20 bp, Artificial
  CRISPR gRNA sequence
ttaaatgtcactgtcacctt

SEQ ID NO: 442057 - DNA, 20 bp, Artificial
  CRISPR gRNA sequence
aaatgtcactgtcaccttct

SEQ ID NO: 442058 - DNA, 20 bp, Artificial
  CRISPR gRNA sequence
aatgtcactgtcaccttctg

SEQ ID NO: 442059 - DNA, 20 bp, Artificial
  CRISPR gRNA sequence
tcaccttctggaagccttaa

SEQ ID NO: 442060 - DNA, 20 bp, Artificial
  CRISPR gRNA sequence
ctggaagccttaatgtgtat

SEQ ID NO: 442061 - DNA, 20 bp, Artificial
  CRISPR gRNA sequence
tggaagccttaatgtgtata

SEQ ID NO: 442062 - DNA, 20 bp, Artificial
  CRISPR gRNA sequence
gaagccttaatgtgtataaa

SEQ ID NO: 442063 - DNA, 20 bp, Artificial
  CRISPR gRNA sequence
aatgtgtataaagggtttga

SEQ ID NO: 442064 - DNA, 20 bp, Artificial
  CRISPR gRNA sequence
atgtgtataaagggtttgac

SEQ ID NO: 442065 - DNA, 20 bp, Artificial
  CRISPR gRNA sequence
gactaaatgctggtttagca

SEQ ID NO: 442066 - DNA, 20 bp, Artificial
  CRISPR gRNA sequence
actaaatgctggtttagcaa

SEQ ID NO: 442067 - DNA, 20 bp, Artificial
  CRISPR gRNA sequence
aatgctggtttagcaaacta

SEQ ID NO: 442068 - DNA, 20 bp, Artificial
  CRISPR gRNA sequence
gtttagcaaactatagttta

SEQ ID NO: 442069 - DNA, 20 bp, Artificial
  CRISPR gRNA sequence
agcaaactatagtttaaata

SEQ ID NO: 442070 - DNA, 20 bp, Artificial
  CRISPR gRNA sequence
gcaaactatagtttaaatat

SEQ ID NO: 442071 - DNA, 20 bp, Artificial
  CRISPR gRNA sequence
tagtttaaatattataaagg

SEQ ID NO: 442072 - DNA, 20 bp, Artificial
  CRISPR gRNA sequence
aaatattataaaggcatagc

SEQ ID NO: 442073 - DNA, 20 bp, Artificial
  CRISPR gRNA sequence
aatattataaaggcatagcc

SEQ ID NO: 442074 - DNA, 20 bp, Artificial
  CRISPR gRNA sequence
taaaggcatagcctcagcct

SEQ ID NO: 442075 - DNA, 20 bp, Artificial
  CRISPR gRNA sequence
agcctaaaattattgaagaa

SEQ ID NO: 442076 - DNA, 20 bp, Artificial
  CRISPR gRNA sequence
aaattattgaagaaaaaaag

SEQ ID NO: 442077 - DNA, 20 bp, Artificial
  CRISPR gRNA sequence
ttgaagaaaaaaagattatg

SEQ ID NO: 442078 - DNA, 20 bp, Artificial
  CRISPR gRNA sequence
aagaaaaaaagattatgttc

SEQ ID NO: 442079 - DNA, 20 bp, Artificial
  CRISPR gRNA sequence
tgttccaattacttttgccc

SEQ ID NO: 442080 - DNA, 20 bp, Artificial
  CRISPR gRNA sequence
caattacttttgccctaatt

SEQ ID NO: 442081 - DNA, 20 bp, Artificial
  CRISPR gRNA sequence
cttttgccctaattaccaga

SEQ ID NO: 442082 - DNA, 20 bp, Artificial
  CRISPR gRNA sequence
ttgccctaattaccagaaaa

SEQ ID NO: 442083 - DNA, 20 bp, Artificial
  CRISPR gRNA sequence
tgccctaattaccagaaaaa

SEQ ID NO: 442084 - DNA, 20 bp, Artificial
  CRISPR gRNA sequence
gccctaattaccagaaaaaa

SEQ ID NO: 442085 - DNA, 20 bp, Artificial
  CRISPR gRNA sequence
ccctaattaccagaaaaaaa

SEQ ID NO: 442086 - DNA, 20 bp, Artificial
  CRISPR gRNA sequence
attaccagaaaaaaatttaa

SEQ ID NO: 442087 - DNA, 20 bp, Artificial
  CRISPR gRNA sequence
ccagaaaaaaatttaaaata

SEQ ID NO: 442088 - DNA, 20 bp, Artificial
  CRISPR gRNA sequence
aaaatataaaaaccacaggc

SEQ ID NO: 442089 - DNA, 20 bp, Artificial
  CRISPR gRNA sequence
aaatataaaaaccacaggcc

SEQ ID NO: 442090 - DNA, 20 bp, Artificial
  CRISPR gRNA sequence
gtgcagtggctcacacctgt

SEQ ID NO: 442091 - DNA, 20 bp, Artificial
  CRISPR gRNA sequence
acacctgtaatcccagcact

SEQ ID NO: 442092 - DNA, 20 bp, Artificial
  CRISPR gRNA sequence
taatcccagcactttgggag

SEQ ID NO: 442093 - DNA, 20 bp, Artificial
  CRISPR gRNA sequence
tgggaggccgagggcaggca

SEQ ID NO: 442094 - DNA, 20 bp, Artificial
  CRISPR gRNA sequence
gggaggccgagggcaggcag

SEQ ID NO: 442095 - DNA, 20 bp, Artificial
  CRISPR gRNA sequence
ggaggccgagggcaggcaga

SEQ ID NO: 442096 - DNA, 20 bp, Artificial
  CRISPR gRNA sequence
gccaatatggtgaaacccca

SEQ ID NO: 442097 - DNA, 20 bp, Artificial
  CRISPR gRNA sequence
tactaaaatacaaaaaatta

SEQ ID NO: 442098 - DNA, 20 bp, Artificial
  CRISPR gRNA sequence
ctaaaatacaaaaaattagc

SEQ ID NO: 442099 - DNA, 20 bp, Artificial
  CRISPR gRNA sequence
aaatacaaaaaattagccgg

SEQ ID NO: 442100 - DNA, 20 bp, Artificial
  CRISPR gRNA sequence
gccgggcgtggtggtgtacg

SEQ ID NO: 442101 - DNA, 20 bp, Artificial
  CRISPR gRNA sequence
tagtcccagctactcaggag

SEQ ID NO: 442102 - DNA, 20 bp, Artificial
  CRISPR gRNA sequence
ctcaggaggctgaggcagtg

SEQ ID NO: 442103 - DNA, 20 bp, Artificial
  CRISPR gRNA sequence
aggaggctgaggcagtggaa

SEQ ID NO: 442104 - DNA, 20 bp, Artificial
  CRISPR gRNA sequence
aggcagtggaatcgcttgaa

SEQ ID NO: 442105 - DNA, 20 bp, Artificial
  CRISPR gRNA sequence
gaacccaggaggtggaggtt

SEQ ID NO: 442106 - DNA, 20 bp, Artificial
  CRISPR gRNA sequence
aacccaggaggtggaggttg

SEQ ID NO: 442107 - DNA, 20 bp, Artificial
  CRISPR gRNA sequence
cagtgagccgagatcacacc

SEQ ID NO: 442108 - DNA, 20 bp, Artificial
  CRISPR gRNA sequence
cactccagcctggtgacaga

SEQ ID NO: 442109 - DNA, 20 bp, Artificial
  CRISPR gRNA sequence
cagcctggtgacagagcaag

SEQ ID NO: 442110 - DNA, 20 bp, Artificial
  CRISPR gRNA sequence
gtgacagagcaagactccat

SEQ ID NO: 442111 - DNA, 20 bp, Artificial
  CRISPR gRNA sequence
catatcaaaaaaataaaaaa

SEQ ID NO: 442112 - DNA, 20 bp, Artificial
  CRISPR gRNA sequence
atcagtacaactgctaagta

SEQ ID NO: 442113 - DNA, 20 bp, Artificial
  CRISPR gRNA sequence
ctaagtaaacatgaatctta

SEQ ID NO: 442114 - DNA, 20 bp, Artificial
  CRISPR gRNA sequence
agtaaacatgaatcttaagt

SEQ ID NO: 442115 - DNA, 20 bp, Artificial
  CRISPR gRNA sequence
aagtgcacataagattttaa

SEQ ID NO: 442116 - DNA, 20 bp, Artificial
  CRISPR gRNA sequence
agtgcacataagattttaaa

SEQ ID NO: 442117 - DNA, 20 bp, Artificial
  CRISPR gRNA sequence
taaatgtaaatccagtttca

SEQ ID NO: 442118 - DNA, 20 bp, Artificial
  CRISPR gRNA sequence
aaatgtaaatccagtttcag

SEQ ID NO: 442119 - DNA, 20 bp, Artificial
  CRISPR gRNA sequence
aatgtaaatccagtttcaga

SEQ ID NO: 442120 - DNA, 20 bp, Artificial
  CRISPR gRNA sequence
cagactccttataattattt

SEQ ID NO: 442121 - DNA, 20 bp, Artificial
  CRISPR gRNA sequence
agactccttataattatttt

SEQ ID NO: 442122 - DNA, 20 bp, Artificial
  CRISPR gRNA sequence
cttataattatttttcttga

SEQ ID NO: 442123 - DNA, 20 bp, Artificial
  CRISPR gRNA sequence
ataattatttttcttgataa

SEQ ID NO: 442124 - DNA, 20 bp, Artificial
  CRISPR gRNA sequence
taattatttttcttgataaa

SEQ ID NO: 442125 - DNA, 20 bp, Artificial
  CRISPR gRNA sequence
tttttcttgataaaaatggt

SEQ ID NO: 442126 - DNA, 20 bp, Artificial
  CRISPR gRNA sequence
ttcttgataaaaatggtaaa

SEQ ID NO: 442127 - DNA, 20 bp, Artificial
  CRISPR gRNA sequence
tcttgataaaaatggtaaaa

SEQ ID NO: 442128 - DNA, 20 bp, Artificial
  CRISPR gRNA sequence
cttgataaaaatggtaaaac

SEQ ID NO: 442129 - DNA, 20 bp, Artificial
  CRISPR gRNA sequence
ttgataaaaatggtaaaact

SEQ ID NO: 442130 - DNA, 20 bp, Artificial
  CRISPR gRNA sequence
gataaaaatggtaaaactaa

SEQ ID NO: 442131 - DNA, 20 bp, Artificial
  CRISPR gRNA sequence
ataaaaatggtaaaactaac

SEQ ID NO: 442132 - DNA, 20 bp, Artificial
  CRISPR gRNA sequence
actttttaaaaacttcattt

SEQ ID NO: 442133 - DNA, 20 bp, Artificial
  CRISPR gRNA sequence
tttaaaaacttcattttgct

SEQ ID NO: 442134 - DNA, 20 bp, Artificial
  CRISPR gRNA sequence
ttaaaaacttcattttgcta

SEQ ID NO: 442135 - DNA, 20 bp, Artificial
  CRISPR gRNA sequence
taaaaacttcattttgctat

SEQ ID NO: 442136 - DNA, 20 bp, Artificial
  CRISPR gRNA sequence
aaaaacttcattttgctatg

SEQ ID NO: 442137 - DNA, 20 bp, Artificial
  CRISPR gRNA sequence
aaaacttcattttgctatga

SEQ ID NO: 442138 - DNA, 20 bp, Artificial
  CRISPR gRNA sequence
cattttgctatgaaaatgat

SEQ ID NO: 442139 - DNA, 20 bp, Artificial
  CRISPR gRNA sequence
attttgctatgaaaatgatc

SEQ ID NO: 442140 - DNA, 20 bp, Artificial
  CRISPR gRNA sequence
tgctatgaaaatgatcagta

SEQ ID NO: 442141 - DNA, 20 bp, Artificial
  CRISPR gRNA sequence
gctatgaaaatgatcagtaa

SEQ ID NO: 442142 - DNA, 20 bp, Artificial
  CRISPR gRNA sequence
ctatgaaaatgatcagtaaa

SEQ ID NO: 442143 - DNA, 20 bp, Artificial
  CRISPR gRNA sequence
tgaaaatgatcagtaaaatc

SEQ ID NO: 442144 - DNA, 20 bp, Artificial
  CRISPR gRNA sequence
ttgtgtcattacagcttttt

SEQ ID NO: 442145 - DNA, 20 bp, Artificial
  CRISPR gRNA sequence
tgtcattacagctttttttc

SEQ ID NO: 442146 - DNA, 20 bp, Artificial
  CRISPR gRNA sequence
cagctttttttcacacagat

SEQ ID NO: 442147 - DNA, 20 bp, Artificial
  CRISPR gRNA sequence
tttttcacacagatttggcc

SEQ ID NO: 442148 - DNA, 20 bp, Artificial
  CRISPR gRNA sequence
ttttcacacagatttggcca

SEQ ID NO: 442149 - DNA, 20 bp, Artificial
  CRISPR gRNA sequence
tttcacacagatttggccac

SEQ ID NO: 442150 - DNA, 20 bp, Artificial
  CRISPR gRNA sequence
ttcacacagatttggccacc

SEQ ID NO: 442151 - DNA, 20 bp, Artificial
  CRISPR gRNA sequence
tcacacagatttggccacca

SEQ ID NO: 442152 - DNA, 20 bp, Artificial
  CRISPR gRNA sequence
cacacagatttggccaccaa

SEQ ID NO: 442153 - DNA, 20 bp, Artificial
  CRISPR gRNA sequence
acacagatttggccaccaac

SEQ ID NO: 442154 - DNA, 20 bp, Artificial
  CRISPR gRNA sequence
ggccaccaaccaagatggat

SEQ ID NO: 442155 - DNA, 20 bp, Artificial
  CRISPR gRNA sequence
gccaccaaccaagatggatg

SEQ ID NO: 442156 - DNA, 20 bp, Artificial
  CRISPR gRNA sequence
aagggagtggcaatgttctt

SEQ ID NO: 442157 - DNA, 20 bp, Artificial
  CRISPR gRNA sequence
tttctggagaaaccaagatt

SEQ ID NO: 442158 - DNA, 20 bp, Artificial
  CRISPR gRNA sequence
tctggagaaaccaagatttg

SEQ ID NO: 442159 - DNA, 20 bp, Artificial
  CRISPR gRNA sequence
ctggagaaaccaagatttgc

SEQ ID NO: 442160 - DNA, 20 bp, Artificial
  CRISPR gRNA sequence
tggagaaaccaagatttgcc

SEQ ID NO: 442161 - DNA, 20 bp, Artificial
  CRISPR gRNA sequence
gagaaaccaagatttgcctg

SEQ ID NO: 442162 - DNA, 20 bp, Artificial
  CRISPR gRNA sequence
gcctggtggggcaggtagca

SEQ ID NO: 442163 - DNA, 20 bp, Artificial
  CRISPR gRNA sequence
cctggtggggcaggtagcag

SEQ ID NO: 442164 - DNA, 20 bp, Artificial
  CRISPR gRNA sequence
gtggggcaggtagcagcgga

SEQ ID NO: 442165 - DNA, 20 bp, Artificial
  CRISPR gRNA sequence
aacagtgtataaatttagta

SEQ ID NO: 442166 - DNA, 20 bp, Artificial
  CRISPR gRNA sequence
acagtgtataaatttagtag

SEQ ID NO: 442167 - DNA, 20 bp, Artificial
  CRISPR gRNA sequence
agtagttaccatctatttgg

SEQ ID NO: 442168 - DNA, 20 bp, Artificial
  CRISPR gRNA sequence
gtagttaccatctatttggt

SEQ ID NO: 442169 - DNA, 20 bp, Artificial
  CRISPR gRNA sequence
ccatctatttggtacttatt

SEQ ID NO: 442170 - DNA, 20 bp, Artificial
  CRISPR gRNA sequence
tttggtacttattaggtgcc

SEQ ID NO: 442171 - DNA, 20 bp, Artificial
  CRISPR gRNA sequence
ggtacttattaggtgccaga

SEQ ID NO: 442172 - DNA, 20 bp, Artificial
  CRISPR gRNA sequence
gtacttattaggtgccagac

SEQ ID NO: 442173 - DNA, 20 bp, Artificial
  CRISPR gRNA sequence
attaggtgccagacatggtg

SEQ ID NO: 442174 - DNA, 20 bp, Artificial
  CRISPR gRNA sequence
ttaggtgccagacatggtgc

SEQ ID NO: 442175 - DNA, 20 bp, Artificial
  CRISPR gRNA sequence
ggtgccagacatggtgctta

SEQ ID NO: 442176 - DNA, 20 bp, Artificial
  CRISPR gRNA sequence
agcaccatatacatacaatc

SEQ ID NO: 442177 - DNA, 20 bp, Artificial
  CRISPR gRNA sequence
gcaccatatacatacaatct

SEQ ID NO: 442178 - DNA, 20 bp, Artificial
  CRISPR gRNA sequence
atttaatcctcaaccacaat

SEQ ID NO: 442179 - DNA, 20 bp, Artificial
  CRISPR gRNA sequence
aatcctcaaccacaataagt

SEQ ID NO: 442180 - DNA, 20 bp, Artificial
  CRISPR gRNA sequence
atcctcaaccacaataagta

SEQ ID NO: 442181 - DNA, 20 bp, Artificial
  CRISPR gRNA sequence
aaccacaataagtaggtact

SEQ ID NO: 442182 - DNA, 20 bp, Artificial
  CRISPR gRNA sequence
ctattttccccatttttcag

SEQ ID NO: 442183 - DNA, 20 bp, Artificial
  CRISPR gRNA sequence
ttttccccatttttcagatg

SEQ ID NO: 442184 - DNA, 20 bp, Artificial
  CRISPR gRNA sequence
tccccatttttcagatgaag

SEQ ID NO: 442185 - DNA, 20 bp, Artificial
  CRISPR gRNA sequence
ccccatttttcagatgaaga

SEQ ID NO: 442186 - DNA, 20 bp, Artificial
  CRISPR gRNA sequence
cccatttttcagatgaagat

SEQ ID NO: 442187 - DNA, 20 bp, Artificial
  CRISPR gRNA sequence
ttcagatgaagatactgagt

SEQ ID NO: 442188 - DNA, 20 bp, Artificial
  CRISPR gRNA sequence
tcagatgaagatactgagtc

SEQ ID NO: 442189 - DNA, 20 bp, Artificial
  CRISPR gRNA sequence
cagatgaagatactgagtct

SEQ ID NO: 442190 - DNA, 20 bp, Artificial
  CRISPR gRNA sequence
agatgaagatactgagtctg

SEQ ID NO: 442191 - DNA, 20 bp, Artificial
  CRISPR gRNA sequence
agtctgagagagccactttg

SEQ ID NO: 442192 - DNA, 20 bp, Artificial
  CRISPR gRNA sequence
agagagccactttgcccaag

SEQ ID NO: 442193 - DNA, 20 bp, Artificial
  CRISPR gRNA sequence
tgcccaagatcacacagcta

SEQ ID NO: 442194 - DNA, 20 bp, Artificial
  CRISPR gRNA sequence
gcccaagatcacacagctat

SEQ ID NO: 442195 - DNA, 20 bp, Artificial
  CRISPR gRNA sequence
cccaagatcacacagctatt

SEQ ID NO: 442196 - DNA, 20 bp, Artificial
  CRISPR gRNA sequence
ttaattgggaaagctaggat

SEQ ID NO: 442197 - DNA, 20 bp, Artificial
  CRISPR gRNA sequence
attgggaaagctaggattta

SEQ ID NO: 442198 - DNA, 20 bp, Artificial
  CRISPR gRNA sequence
ggaaagctaggatttaaagc

SEQ ID NO: 442199 - DNA, 20 bp, Artificial
  CRISPR gRNA sequence
ggatttaaagcagatctact

SEQ ID NO: 442200 - DNA, 20 bp, Artificial
  CRISPR gRNA sequence
aaagcagatctactctagag

SEQ ID NO: 442201 - DNA, 20 bp, Artificial
  CRISPR gRNA sequence
aagcagatctactctagagc

SEQ ID NO: 442202 - DNA, 20 bp, Artificial
  CRISPR gRNA sequence
ctctagagctgaggactcac

SEQ ID NO: 442203 - DNA, 20 bp, Artificial
  CRISPR gRNA sequence
tagagctgaggactcacctg

SEQ ID NO: 442204 - DNA, 20 bp, Artificial
  CRISPR gRNA sequence
gagctgaggactcacctgtg

SEQ ID NO: 442205 - DNA, 20 bp, Artificial
  CRISPR gRNA sequence
aggactcacctgtgacccag

SEQ ID NO: 442206 - DNA, 20 bp, Artificial
  CRISPR gRNA sequence
acctgtgacccagtccttac

SEQ ID NO: 442207 - DNA, 20 bp, Artificial
  CRISPR gRNA sequence
tgacccagtccttactcctt

SEQ ID NO: 442208 - DNA, 20 bp, Artificial
  CRISPR gRNA sequence
actccttcaggtagaagaca

SEQ ID NO: 442209 - DNA, 20 bp, Artificial
  CRISPR gRNA sequence
ctccttcaggtagaagacaa

SEQ ID NO: 442210 - DNA, 20 bp, Artificial
  CRISPR gRNA sequence
cttcaggtagaagacaagtt

SEQ ID NO: 442211 - DNA, 20 bp, Artificial
  CRISPR gRNA sequence
caggtagaagacaagttgca

SEQ ID NO: 442212 - DNA, 20 bp, Artificial
  CRISPR gRNA sequence
aggtagaagacaagttgcat

SEQ ID NO: 442213 - DNA, 20 bp, Artificial
  CRISPR gRNA sequence
catttgttctgtgttcaaat

SEQ ID NO: 442214 - DNA, 20 bp, Artificial
  CRISPR gRNA sequence
gttctgtgttcaaattccag

SEQ ID NO: 442215 - DNA, 20 bp, Artificial
  CRISPR gRNA sequence
ttctgtgttcaaattccagg

SEQ ID NO: 442216 - DNA, 20 bp, Artificial
  CRISPR gRNA sequence
tgtgttcaaattccaggccc

SEQ ID NO: 442217 - DNA, 20 bp, Artificial
  CRISPR gRNA sequence
tgttcaaattccaggccctt

SEQ ID NO: 442218 - DNA, 20 bp, Artificial
  CRISPR gRNA sequence
aaattccaggcccttggatc

SEQ ID NO: 442219 - DNA, 20 bp, Artificial
  CRISPR gRNA sequence
caggcccttggatctcttac

SEQ ID NO: 442220 - DNA, 20 bp, Artificial
  CRISPR gRNA sequence
ggatctcttacttttaaagg

SEQ ID NO: 442221 - DNA, 20 bp, Artificial
  CRISPR gRNA sequence
gatctcttacttttaaaggc

SEQ ID NO: 442222 - DNA, 20 bp, Artificial
  CRISPR gRNA sequence
ttacttttaaaggctctact

SEQ ID NO: 442223 - DNA, 20 bp, Artificial
  CRISPR gRNA sequence
acttttaaaggctctactcc

SEQ ID NO: 442224 - DNA, 20 bp, Artificial
  CRISPR gRNA sequence
cttttaaaggctctactcca

SEQ ID NO: 442225 - DNA, 20 bp, Artificial
  CRISPR gRNA sequence
ttaaaggctctactccattt

SEQ ID NO: 442226 - DNA, 20 bp, Artificial
  CRISPR gRNA sequence
taaaggctctactccatttt

SEQ ID NO: 442227 - DNA, 20 bp, Artificial
  CRISPR gRNA sequence
aaaggctctactccattttt

SEQ ID NO: 442228 - DNA, 20 bp, Artificial
  CRISPR gRNA sequence
aaggctctactccatttttt

SEQ ID NO: 442229 - DNA, 20 bp, Artificial
  CRISPR gRNA sequence
tactccattttttttttttt

SEQ ID NO: 442230 - DNA, 20 bp, Artificial
  CRISPR gRNA sequence
ctccattttttttttttttt

SEQ ID NO: 442231 - DNA, 20 bp, Artificial
  CRISPR gRNA sequence
catttttttttttttttttt

SEQ ID NO: 442232 - DNA, 20 bp, Artificial
  CRISPR gRNA sequence
tttttttttttttttctgag

SEQ ID NO: 442233 - DNA, 20 bp, Artificial
  CRISPR gRNA sequence
ttttttttttttttctgaga

SEQ ID NO: 442234 - DNA, 20 bp, Artificial
  CRISPR gRNA sequence
tttttttttttttctgagaa

SEQ ID NO: 442235 - DNA, 20 bp, Artificial
  CRISPR gRNA sequence
ttttttttttttctgagaaa

SEQ ID NO: 442236 - DNA, 20 bp, Artificial
  CRISPR gRNA sequence
tttttttttttctgagaaag

SEQ ID NO: 442237 - DNA, 20 bp, Artificial
  CRISPR gRNA sequence
ttttttttttctgagaaagg

SEQ ID NO: 442238 - DNA, 20 bp, Artificial
  CRISPR gRNA sequence
tttttttttctgagaaaggg

SEQ ID NO: 442239 - DNA, 20 bp, Artificial
  CRISPR gRNA sequence
ttttttttctgagaaagggt

SEQ ID NO: 442240 - DNA, 20 bp, Artificial
  CRISPR gRNA sequence
tttttttctgagaaagggtc

SEQ ID NO: 442241 - DNA, 20 bp, Artificial
  CRISPR gRNA sequence
ttttttctgagaaagggtct

SEQ ID NO: 442242 - DNA, 20 bp, Artificial
  CRISPR gRNA sequence
tttttctgagaaagggtctc

SEQ ID NO: 442243 - DNA, 20 bp, Artificial
  CRISPR gRNA sequence
ttttctgagaaagggtctcg

SEQ ID NO: 442244 - DNA, 20 bp, Artificial
  CRISPR gRNA sequence
tttctgagaaagggtctcgc

SEQ ID NO: 442245 - DNA, 20 bp, Artificial
  CRISPR gRNA sequence
ttctgagaaagggtctcgct

SEQ ID NO: 442246 - DNA, 20 bp, Artificial
  CRISPR gRNA sequence
tctgagaaagggtctcgctc

SEQ ID NO: 442247 - DNA, 20 bp, Artificial
  CRISPR gRNA sequence
ctgagaaagggtctcgctct

SEQ ID NO: 442248 - DNA, 20 bp, Artificial
  CRISPR gRNA sequence
tgagaaagggtctcgctctg

SEQ ID NO: 442249 - DNA, 20 bp, Artificial
  CRISPR gRNA sequence
agaaagggtctcgctctgtt

SEQ ID NO: 442250 - DNA, 20 bp, Artificial
  CRISPR gRNA sequence
gctctgttgcccaggtttgg

SEQ ID NO: 442251 - DNA, 20 bp, Artificial
  CRISPR gRNA sequence
tgttgcccaggtttggagta

SEQ ID NO: 442252 - DNA, 20 bp, Artificial
  CRISPR gRNA sequence
ttgcccaggtttggagtaca

SEQ ID NO: 442253 - DNA, 20 bp, Artificial
  CRISPR gRNA sequence
cccaggtttggagtacagtg

SEQ ID NO: 442254 - DNA, 20 bp, Artificial
  CRISPR gRNA sequence
ggagtacagtggcaccaact

SEQ ID NO: 442255 - DNA, 20 bp, Artificial
  CRISPR gRNA sequence
gagtacagtggcaccaactc

SEQ ID NO: 442256 - DNA, 20 bp, Artificial
  CRISPR gRNA sequence
ggctcagtgaatcctcaacc

SEQ ID NO: 442257 - DNA, 20 bp, Artificial
  CRISPR gRNA sequence
agtgaatcctcaacctcctg

SEQ ID NO: 442258 - DNA, 20 bp, Artificial
  CRISPR gRNA sequence
aacctcctgagttcaagcaa

SEQ ID NO: 442259 - DNA, 20 bp, Artificial
  CRISPR gRNA sequence
ctgagttcaagcaatcttcc

SEQ ID NO: 442260 - DNA, 20 bp, Artificial
  CRISPR gRNA sequence
agttcaagcaatcttcctgc

SEQ ID NO: 442261 - DNA, 20 bp, Artificial
  CRISPR gRNA sequence
aagcaatcttcctgcctcag

SEQ ID NO: 442262 - DNA, 20 bp, Artificial
  CRISPR gRNA sequence
cctgcctcagccctgccaag

SEQ ID NO: 442263 - DNA, 20 bp, Artificial
  CRISPR gRNA sequence
ctgcctcagccctgccaagt

SEQ ID NO: 442264 - DNA, 20 bp, Artificial
  CRISPR gRNA sequence
cctcagccctgccaagtagc

SEQ ID NO: 442265 - DNA, 20 bp, Artificial
  CRISPR gRNA sequence
agccctgccaagtagctggg

SEQ ID NO: 442266 - DNA, 20 bp, Artificial
  CRISPR gRNA sequence
ccaagtagctgggactacag

SEQ ID NO: 442267 - DNA, 20 bp, Artificial
  CRISPR gRNA sequence
ggactacaggcacatgccac

SEQ ID NO: 442268 - DNA, 20 bp, Artificial
  CRISPR gRNA sequence
caggcacatgccaccatgcc

SEQ ID NO: 442269 - DNA, 20 bp, Artificial
  CRISPR gRNA sequence
tttttttttttttttttttt

SEQ ID NO: 442270 - DNA, 20 bp, Artificial
  CRISPR gRNA sequence
tttttttttttttttttttt

SEQ ID NO: 442271 - DNA, 20 bp, Artificial
  CRISPR gRNA sequence
tttttttttttttttttttg

SEQ ID NO: 442272 - DNA, 20 bp, Artificial
  CRISPR gRNA sequence
ttttttttttttttttttgg

SEQ ID NO: 442273 - DNA, 20 bp, Artificial
  CRISPR gRNA sequence
tttttttttttttttttggg

SEQ ID NO: 442274 - DNA, 20 bp, Artificial
  CRISPR gRNA sequence
ttttttttttttttttggga

SEQ ID NO: 442275 - DNA, 20 bp, Artificial
  CRISPR gRNA sequence
tttttttttttttttgggat

SEQ ID NO: 442276 - DNA, 20 bp, Artificial
  CRISPR gRNA sequence
ttttttttttttttgggatg

SEQ ID NO: 442277 - DNA, 20 bp, Artificial
  CRISPR gRNA sequence
tttttttttttttgggatgg

SEQ ID NO: 442278 - DNA, 20 bp, Artificial
  CRISPR gRNA sequence
ttttttttttttgggatgga

SEQ ID NO: 442279 - DNA, 20 bp, Artificial
  CRISPR gRNA sequence
tttttttttttgggatggaa

SEQ ID NO: 442280 - DNA, 20 bp, Artificial
  CRISPR gRNA sequence
ttttttttttgggatggaat

SEQ ID NO: 442281 - DNA, 20 bp, Artificial
  CRISPR gRNA sequence
tttttttttgggatggaatc

SEQ ID NO: 442282 - DNA, 20 bp, Artificial
  CRISPR gRNA sequence
ttttttttgggatggaatct

SEQ ID NO: 442283 - DNA, 20 bp, Artificial
  CRISPR gRNA sequence
tttttttgggatggaatctc

SEQ ID NO: 442284 - DNA, 20 bp, Artificial
  CRISPR gRNA sequence
ttttttgggatggaatctcg

SEQ ID NO: 442285 - DNA, 20 bp, Artificial
  CRISPR gRNA sequence
tttttgggatggaatctcgc

SEQ ID NO: 442286 - DNA, 20 bp, Artificial
  CRISPR gRNA sequence
ttttgggatggaatctcgct

SEQ ID NO: 442287 - DNA, 20 bp, Artificial
  CRISPR gRNA sequence
tttgggatggaatctcgctc

SEQ ID NO: 442288 - DNA, 20 bp, Artificial
  CRISPR gRNA sequence
ttgggatggaatctcgctct

SEQ ID NO: 442289 - DNA, 20 bp, Artificial
  CRISPR gRNA sequence
tgggatggaatctcgctctg

SEQ ID NO: 442290 - DNA, 20 bp, Artificial
  CRISPR gRNA sequence
gggatggaatctcgctctgt

SEQ ID NO: 442291 - DNA, 20 bp, Artificial
  CRISPR gRNA sequence
ggatggaatctcgctctgtt

SEQ ID NO: 442292 - DNA, 20 bp, Artificial
  CRISPR gRNA sequence
gctctgttttccaggcttca

SEQ ID NO: 442293 - DNA, 20 bp, Artificial
  CRISPR gRNA sequence
tgttttccaggcttcaggac

SEQ ID NO: 442294 - DNA, 20 bp, Artificial
  CRISPR gRNA sequence
ttttccaggcttcaggacag

SEQ ID NO: 442295 - DNA, 20 bp, Artificial
  CRISPR gRNA sequence
tccaggcttcaggacagtgg

SEQ ID NO: 442296 - DNA, 20 bp, Artificial
  CRISPR gRNA sequence
ccaggcttcaggacagtggt

SEQ ID NO: 442297 - DNA, 20 bp, Artificial
  CRISPR gRNA sequence
caggcttcaggacagtggtg

SEQ ID NO: 442298 - DNA, 20 bp, Artificial
  CRISPR gRNA sequence
caggacagtggtgagatctc

SEQ ID NO: 442299 - DNA, 20 bp, Artificial
  CRISPR gRNA sequence
aggacagtggtgagatctcg

SEQ ID NO: 442300 - DNA, 20 bp, Artificial
  CRISPR gRNA sequence
ggttcactcctcccaggctc

SEQ ID NO: 442301 - DNA, 20 bp, Artificial
  CRISPR gRNA sequence
actcctcccaggctcagaca

SEQ ID NO: 442302 - DNA, 20 bp, Artificial
  CRISPR gRNA sequence
ctcccaggctcagacaattc

SEQ ID NO: 442303 - DNA, 20 bp, Artificial
  CRISPR gRNA sequence
ccaggctcagacaattctcc

SEQ ID NO: 442304 - DNA, 20 bp, Artificial
  CRISPR gRNA sequence
agacaattctcctgcctcag

SEQ ID NO: 442305 - DNA, 20 bp, Artificial
  CRISPR gRNA sequence
tcctgcctcagcctcctgag

SEQ ID NO: 442306 - DNA, 20 bp, Artificial
  CRISPR gRNA sequence
ctgcctcagcctcctgagta

SEQ ID NO: 442307 - DNA, 20 bp, Artificial
  CRISPR gRNA sequence
cctcagcctcctgagtagct

SEQ ID NO: 442308 - DNA, 20 bp, Artificial
  CRISPR gRNA sequence
agcctcctgagtagctggaa

SEQ ID NO: 442309 - DNA, 20 bp, Artificial
  CRISPR gRNA sequence
ctgagtagctggaattatag

SEQ ID NO: 442310 - DNA, 20 bp, Artificial
  CRISPR gRNA sequence
agtagctggaattataggca

SEQ ID NO: 442311 - DNA, 20 bp, Artificial
  CRISPR gRNA sequence
gaattataggcatgcaccac

SEQ ID NO: 442312 - DNA, 20 bp, Artificial
  CRISPR gRNA sequence
taggcatgcaccaccatgac

SEQ ID NO: 442313 - DNA, 20 bp, Artificial
  CRISPR gRNA sequence
atttttgtatttttagtaga

SEQ ID NO: 442314 - DNA, 20 bp, Artificial
  CRISPR gRNA sequence
ttgtatttttagtagagaca

SEQ ID NO: 442315 - DNA, 20 bp, Artificial
  CRISPR gRNA sequence
tgtatttttagtagagacag

SEQ ID NO: 442316 - DNA, 20 bp, Artificial
  CRISPR gRNA sequence
gtatttttagtagagacagg

SEQ ID NO: 442317 - DNA, 20 bp, Artificial
  CRISPR gRNA sequence
tatttttagtagagacaggg

SEQ ID NO: 442318 - DNA, 20 bp, Artificial
  CRISPR gRNA sequence
ttagtagagacaggggtttc

SEQ ID NO: 442319 - DNA, 20 bp, Artificial
  CRISPR gRNA sequence
tagtagagacaggggtttca

SEQ ID NO: 442320 - DNA, 20 bp, Artificial
  CRISPR gRNA sequence
agtagagacaggggtttcac

SEQ ID NO: 442321 - DNA, 20 bp, Artificial
  CRISPR gRNA sequence
gtagagacaggggtttcacc

SEQ ID NO: 442322 - DNA, 20 bp, Artificial
  CRISPR gRNA sequence
caccatcttggccaggctgg

SEQ ID NO: 442323 - DNA, 20 bp, Artificial
  CRISPR gRNA sequence
accatcttggccaggctggc

SEQ ID NO: 442324 - DNA, 20 bp, Artificial
  CRISPR gRNA sequence
ggccaggctggcttaaactc

SEQ ID NO: 442325 - DNA, 20 bp, Artificial
  CRISPR gRNA sequence
gccaggctggcttaaactcc

SEQ ID NO: 442326 - DNA, 20 bp, Artificial
  CRISPR gRNA sequence
gcttaaactcctgacctcag

SEQ ID NO: 442327 - DNA, 20 bp, Artificial
  CRISPR gRNA sequence
aaactcctgacctcaggtga

SEQ ID NO: 442328 - DNA, 20 bp, Artificial
  CRISPR gRNA sequence
aactcctgacctcaggtgat

SEQ ID NO: 442329 - DNA, 20 bp, Artificial
  CRISPR gRNA sequence
ctgacctcaggtgatccatc

SEQ ID NO: 442330 - DNA, 20 bp, Artificial
  CRISPR gRNA sequence
acctcaggtgatccatctgc

SEQ ID NO: 442331 - DNA, 20 bp, Artificial
  CRISPR gRNA sequence
aggtgatccatctgccttgg

SEQ ID NO: 442332 - DNA, 20 bp, Artificial
  CRISPR gRNA sequence
ccttggcctcccaaagtgct

SEQ ID NO: 442333 - DNA, 20 bp, Artificial
  CRISPR gRNA sequence
ggcctcccaaagtgctggga

SEQ ID NO: 442334 - DNA, 20 bp, Artificial
  CRISPR gRNA sequence
gcctcccaaagtgctgggat

SEQ ID NO: 442335 - DNA, 20 bp, Artificial
  CRISPR gRNA sequence
ccaaagtgctgggattacag

SEQ ID NO: 442336 - DNA, 20 bp, Artificial
  CRISPR gRNA sequence
ggattacaggtgtgagccac

SEQ ID NO: 442337 - DNA, 20 bp, Artificial
  CRISPR gRNA sequence
caggtgtgagccactgcact

SEQ ID NO: 442338 - DNA, 20 bp, Artificial
  CRISPR gRNA sequence
cactcagcctaattttttgt

SEQ ID NO: 442339 - DNA, 20 bp, Artificial
  CRISPR gRNA sequence
agcctaattttttgtattct

SEQ ID NO: 442340 - DNA, 20 bp, Artificial
  CRISPR gRNA sequence
attttttgtattcttagtag

SEQ ID NO: 442341 - DNA, 20 bp, Artificial
  CRISPR gRNA sequence
tttgtattcttagtagagat

SEQ ID NO: 442342 - DNA, 20 bp, Artificial
  CRISPR gRNA sequence
ttgtattcttagtagagatg

SEQ ID NO: 442343 - DNA, 20 bp, Artificial
  CRISPR gRNA sequence
tgtattcttagtagagatgg

SEQ ID NO: 442344 - DNA, 20 bp, Artificial
  CRISPR gRNA sequence
gtattcttagtagagatggg

SEQ ID NO: 442345 - DNA, 20 bp, Artificial
  CRISPR gRNA sequence
tattcttagtagagatgggg

SEQ ID NO: 442346 - DNA, 20 bp, Artificial
  CRISPR gRNA sequence
ttagtagagatggggttttg

SEQ ID NO: 442347 - DNA, 20 bp, Artificial
  CRISPR gRNA sequence
agtagagatggggttttgcc

SEQ ID NO: 442348 - DNA, 20 bp, Artificial
  CRISPR gRNA sequence
gtagagatggggttttgcca

SEQ ID NO: 442349 - DNA, 20 bp, Artificial
  CRISPR gRNA sequence
tgccatgttgcccaggctgg

SEQ ID NO: 442350 - DNA, 20 bp, Artificial
  CRISPR gRNA sequence
gccatgttgcccaggctggt

SEQ ID NO: 442351 - DNA, 20 bp, Artificial
  CRISPR gRNA sequence
ccatgttgcccaggctggtc

SEQ ID NO: 442352 - DNA, 20 bp, Artificial
  CRISPR gRNA sequence
cccaggctggtcttgaactc

SEQ ID NO: 442353 - DNA, 20 bp, Artificial
  CRISPR gRNA sequence
gtcttgaactcctgagctcc

SEQ ID NO: 442354 - DNA, 20 bp, Artificial
  CRISPR gRNA sequence
gaactcctgagctccagtga

SEQ ID NO: 442355 - DNA, 20 bp, Artificial
  CRISPR gRNA sequence
aactcctgagctccagtgat

SEQ ID NO: 442356 - DNA, 20 bp, Artificial
  CRISPR gRNA sequence
ctgagctccagtgatctgcc

SEQ ID NO: 442357 - DNA, 20 bp, Artificial
  CRISPR gRNA sequence
agctccagtgatctgcctgc

SEQ ID NO: 442358 - DNA, 20 bp, Artificial
  CRISPR gRNA sequence
cagtgatctgcctgccttgg

SEQ ID NO: 442359 - DNA, 20 bp, Artificial
  CRISPR gRNA sequence
cctgccttggcctcccatag

SEQ ID NO: 442360 - DNA, 20 bp, Artificial
  CRISPR gRNA sequence
ccttggcctcccatagtgct

SEQ ID NO: 442361 - DNA, 20 bp, Artificial
  CRISPR gRNA sequence
ggcctcccatagtgctggga

SEQ ID NO: 442362 - DNA, 20 bp, Artificial
  CRISPR gRNA sequence
gcctcccatagtgctgggat

SEQ ID NO: 442363 - DNA, 20 bp, Artificial
  CRISPR gRNA sequence
ccatagtgctgggattacac

SEQ ID NO: 442364 - DNA, 20 bp, Artificial
  CRISPR gRNA sequence
ggattacacatgtgagccac

SEQ ID NO: 442365 - DNA, 20 bp, Artificial
  CRISPR gRNA sequence
cacatgtgagccactgtgcc

SEQ ID NO: 442366 - DNA, 20 bp, Artificial
  CRISPR gRNA sequence
tgcccagccccatttttata

SEQ ID NO: 442367 - DNA, 20 bp, Artificial
  CRISPR gRNA sequence
ttatattaaatgctcccaca

SEQ ID NO: 442368 - DNA, 20 bp, Artificial
  CRISPR gRNA sequence
tatattaaatgctcccacat

SEQ ID NO: 442369 - DNA, 20 bp, Artificial
  CRISPR gRNA sequence
atattaaatgctcccacatc

SEQ ID NO: 442370 - DNA, 20 bp, Artificial
  CRISPR gRNA sequence
tattaaatgctcccacatcc

SEQ ID NO: 442371 - DNA, 20 bp, Artificial
  CRISPR gRNA sequence
aatgctcccacatcccacat

SEQ ID NO: 442372 - DNA, 20 bp, Artificial
  CRISPR gRNA sequence
ccacatcccacatttagagt

SEQ ID NO: 442373 - DNA, 20 bp, Artificial
  CRISPR gRNA sequence
agagttggtttgccagcagc

SEQ ID NO: 442374 - DNA, 20 bp, Artificial
  CRISPR gRNA sequence
gagttggtttgccagcagcc

SEQ ID NO: 442375 - DNA, 20 bp, Artificial
  CRISPR gRNA sequence
gtttgccagcagccaattta

SEQ ID NO: 442376 - DNA, 20 bp, Artificial
  CRISPR gRNA sequence
gccagcagccaatttacata

SEQ ID NO: 442377 - DNA, 20 bp, Artificial
  CRISPR gRNA sequence
ccagcagccaatttacataa

SEQ ID NO: 442378 - DNA, 20 bp, Artificial
  CRISPR gRNA sequence
acataatgttacatattata

SEQ ID NO: 442379 - DNA, 20 bp, Artificial
  CRISPR gRNA sequence
cataatgttacatattatag

SEQ ID NO: 442380 - DNA, 20 bp, Artificial
  CRISPR gRNA sequence
catattatagacaaaccatt

SEQ ID NO: 442381 - DNA, 20 bp, Artificial
  CRISPR gRNA sequence
tagacaaaccattaaatatt

SEQ ID NO: 442382 - DNA, 20 bp, Artificial
  CRISPR gRNA sequence
aatattcattcatttcaatt

SEQ ID NO: 442383 - DNA, 20 bp, Artificial
  CRISPR gRNA sequence
attcatttcaattttttatt

SEQ ID NO: 442384 - DNA, 20 bp, Artificial
  CRISPR gRNA sequence
atttcaattttttattttat

SEQ ID NO: 442385 - DNA, 20 bp, Artificial
  CRISPR gRNA sequence
caattttttattttattttc

SEQ ID NO: 442386 - DNA, 20 bp, Artificial
  CRISPR gRNA sequence
aattttttattttattttcc

SEQ ID NO: 442387 - DNA, 20 bp, Artificial
  CRISPR gRNA sequence
tttattttattttcctattt

SEQ ID NO: 442388 - DNA, 20 bp, Artificial
  CRISPR gRNA sequence
ttattttattttcctattta

SEQ ID NO: 442389 - DNA, 20 bp, Artificial
  CRISPR gRNA sequence
tattttattttcctatttag

SEQ ID NO: 442390 - DNA, 20 bp, Artificial
  CRISPR gRNA sequence
attttattttcctatttagg

SEQ ID NO: 442391 - DNA, 20 bp, Artificial
  CRISPR gRNA sequence
ttttattttcctatttagga

SEQ ID NO: 442392 - DNA, 20 bp, Artificial
  CRISPR gRNA sequence
tattttcctatttaggagct

SEQ ID NO: 442393 - DNA, 20 bp, Artificial
  CRISPR gRNA sequence
attttcctatttaggagcta

SEQ ID NO: 442394 - DNA, 20 bp, Artificial
  CRISPR gRNA sequence
ttttcctatttaggagctac

SEQ ID NO: 442395 - DNA, 20 bp, Artificial
  CRISPR gRNA sequence
tcctatttaggagctactga

SEQ ID NO: 442396 - DNA, 20 bp, Artificial
  CRISPR gRNA sequence
cctatttaggagctactgac

SEQ ID NO: 442397 - DNA, 20 bp, Artificial
  CRISPR gRNA sequence
ctatttaggagctactgacc

SEQ ID NO: 442398 - DNA, 20 bp, Artificial
  CRISPR gRNA sequence
tttaggagctactgacctat

SEQ ID NO: 442399 - DNA, 20 bp, Artificial
  CRISPR gRNA sequence
aggagctactgacctatttt

SEQ ID NO: 442400 - DNA, 20 bp, Artificial
  CRISPR gRNA sequence
ggagctactgacctattttt

SEQ ID NO: 442401 - DNA, 20 bp, Artificial
  CRISPR gRNA sequence
ctgacctatttttggttgtt

SEQ ID NO: 442402 - DNA, 20 bp, Artificial
  CRISPR gRNA sequence
acctatttttggttgtttca

SEQ ID NO: 442403 - DNA, 20 bp, Artificial
  CRISPR gRNA sequence
tttttggttgtttcaatatt

SEQ ID NO: 442404 - DNA, 20 bp, Artificial
  CRISPR gRNA sequence
ttggttgtttcaatattttt

SEQ ID NO: 442405 - DNA, 20 bp, Artificial
  CRISPR gRNA sequence
tggttgtttcaatatttttt

SEQ ID NO: 442406 - DNA, 20 bp, Artificial
  CRISPR gRNA sequence
ggttgtttcaatattttttc

SEQ ID NO: 442407 - DNA, 20 bp, Artificial
  CRISPR gRNA sequence
gttgtttcaatattttttct

SEQ ID NO: 442408 - DNA, 20 bp, Artificial
  CRISPR gRNA sequence
tttcaatattttttctcagt

SEQ ID NO: 442409 - DNA, 20 bp, Artificial
  CRISPR gRNA sequence
caatattttttctcagtcag

SEQ ID NO: 442410 - DNA, 20 bp, Artificial
  CRISPR gRNA sequence
aatattttttctcagtcagg

SEQ ID NO: 442411 - DNA, 20 bp, Artificial
  CRISPR gRNA sequence
tttctcagtcaggcccttga

SEQ ID NO: 442412 - DNA, 20 bp, Artificial
  CRISPR gRNA sequence
ttctcagtcaggcccttgag

SEQ ID NO: 442413 - DNA, 20 bp, Artificial
  CRISPR gRNA sequence
tctcagtcaggcccttgaga

SEQ ID NO: 442414 - DNA, 20 bp, Artificial
  CRISPR gRNA sequence
ctcagtcaggcccttgagaa

SEQ ID NO: 442415 - DNA, 20 bp, Artificial
  CRISPR gRNA sequence
tcagtcaggcccttgagaag

SEQ ID NO: 442416 - DNA, 20 bp, Artificial
  CRISPR gRNA sequence
agtcaggcccttgagaagct

SEQ ID NO: 442417 - DNA, 20 bp, Artificial
  CRISPR gRNA sequence
gagaagctcagaggttcgag

SEQ ID NO: 442418 - DNA, 20 bp, Artificial
  CRISPR gRNA sequence
agaagctcagaggttcgagg

SEQ ID NO: 442419 - DNA, 20 bp, Artificial
  CRISPR gRNA sequence
agaggttcgaggtattattc

SEQ ID NO: 442420 - DNA, 20 bp, Artificial
  CRISPR gRNA sequence
gaggtattattcctatattc

SEQ ID NO: 442421 - DNA, 20 bp, Artificial
  CRISPR gRNA sequence
ttcctatattcccatttttg

SEQ ID NO: 442422 - DNA, 20 bp, Artificial
  CRISPR gRNA sequence
ctatattcccatttttgttg

SEQ ID NO: 442423 - DNA, 20 bp, Artificial
  CRISPR gRNA sequence
tattcccatttttgttgccc

SEQ ID NO: 442424 - DNA, 20 bp, Artificial
  CRISPR gRNA sequence
ccatttttgttgccctagag

SEQ ID NO: 442425 - DNA, 20 bp, Artificial
  CRISPR gRNA sequence
ttgttgccctagagggaagg

SEQ ID NO: 442426 - DNA, 20 bp, Artificial
  CRISPR gRNA sequence
tgttgccctagagggaagga

SEQ ID NO: 442427 - DNA, 20 bp, Artificial
  CRISPR gRNA sequence
gttgccctagagggaaggaa

SEQ ID NO: 442428 - DNA, 20 bp, Artificial
  CRISPR gRNA sequence
ttgccctagagggaaggaac

SEQ ID NO: 442429 - DNA, 20 bp, Artificial
  CRISPR gRNA sequence
ccctagagggaaggaactaa

SEQ ID NO: 442430 - DNA, 20 bp, Artificial
  CRISPR gRNA sequence
gagggaaggaactaacaaac

SEQ ID NO: 442431 - DNA, 20 bp, Artificial
  CRISPR gRNA sequence
acaaacaaaaactaaaggga

SEQ ID NO: 442432 - DNA, 20 bp, Artificial
  CRISPR gRNA sequence
aagggaaggctgggcgtggt

SEQ ID NO: 442433 - DNA, 20 bp, Artificial
  CRISPR gRNA sequence
ggcgtggtggcttacacctg

SEQ ID NO: 442434 - DNA, 20 bp, Artificial
  CRISPR gRNA sequence
acacctgtaatcccagcgct

SEQ ID NO: 442435 - DNA, 20 bp, Artificial
  CRISPR gRNA sequence
cacctgtaatcccagcgctt

SEQ ID NO: 442436 - DNA, 20 bp, Artificial
  CRISPR gRNA sequence
taatcccagcgctttgggag

SEQ ID NO: 442437 - DNA, 20 bp, Artificial
  CRISPR gRNA sequence
tgggaggccgaggcagaggg

SEQ ID NO: 442438 - DNA, 20 bp, Artificial
  CRISPR gRNA sequence
gggaggccgaggcagaggga

SEQ ID NO: 442439 - DNA, 20 bp, Artificial
  CRISPR gRNA sequence
ggaggccgaggcagagggat

SEQ ID NO: 442440 - DNA, 20 bp, Artificial
  CRISPR gRNA sequence
aggttaggagttcgagacca

SEQ ID NO: 442441 - DNA, 20 bp, Artificial
  CRISPR gRNA sequence
ggagttcgagaccagcatgg

SEQ ID NO: 442442 - DNA, 20 bp, Artificial
  CRISPR gRNA sequence
gagaccagcatggccaccat

SEQ ID NO: 442443 - DNA, 20 bp, Artificial
  CRISPR gRNA sequence
taataaaaatacaaaaatta

SEQ ID NO: 442444 - DNA, 20 bp, Artificial
  CRISPR gRNA sequence
ataaaaatacaaaaattagc

SEQ ID NO: 442445 - DNA, 20 bp, Artificial
  CRISPR gRNA sequence
gcggggcgtggtggcgcgcg

SEQ ID NO: 442446 - DNA, 20 bp, Artificial
  CRISPR gRNA sequence
taatcccagctacttgggag

SEQ ID NO: 442447 - DNA, 20 bp, Artificial
  CRISPR gRNA sequence
cttgggaggctgaggcagga

SEQ ID NO: 442448 - DNA, 20 bp, Artificial
  CRISPR gRNA sequence
gggaggctgaggcaggagaa

SEQ ID NO: 442449 - DNA, 20 bp, Artificial
  CRISPR gRNA sequence
ggaggctgaggcaggagaat

SEQ ID NO: 442450 - DNA, 20 bp, Artificial
  CRISPR gRNA sequence
aggcaggagaatggcatgaa

SEQ ID NO: 442451 - DNA, 20 bp, Artificial
  CRISPR gRNA sequence
ggaggcagagtttgcagtga

SEQ ID NO: 442452 - DNA, 20 bp, Artificial
  CRISPR gRNA sequence
gcagtgagccaagatcgtgt

SEQ ID NO: 442453 - DNA, 20 bp, Artificial
  CRISPR gRNA sequence
cagtgagccaagatcgtgtc

SEQ ID NO: 442454 - DNA, 20 bp, Artificial
  CRISPR gRNA sequence
cactccagcctgggtgagag

SEQ ID NO: 442455 - DNA, 20 bp, Artificial
  CRISPR gRNA sequence
cagcctgggtgagagagtga

SEQ ID NO: 442456 - DNA, 20 bp, Artificial
  CRISPR gRNA sequence
ggtgagagagtgagactccg

SEQ ID NO: 442457 - DNA, 20 bp, Artificial
  CRISPR gRNA sequence
cgtctcaaaaaaaaaaaaaa

SEQ ID NO: 442458 - DNA, 20 bp, Artificial
  CRISPR gRNA sequence
aaaaaaaaaaaaaaaggaaa

SEQ ID NO: 442459 - DNA, 20 bp, Artificial
  CRISPR gRNA sequence
aaggaaagaagacttctgtc

SEQ ID NO: 442460 - DNA, 20 bp, Artificial
  CRISPR gRNA sequence
ctgtctgtggtagagacaag

SEQ ID NO: 442461 - DNA, 20 bp, Artificial
  CRISPR gRNA sequence
tgtctgtggtagagacaagt

SEQ ID NO: 442462 - DNA, 20 bp, Artificial
  CRISPR gRNA sequence
tctgtggtagagacaagtat

SEQ ID NO: 442463 - DNA, 20 bp, Artificial
  CRISPR gRNA sequence
tggtagagacaagtataagg

SEQ ID NO: 442464 - DNA, 20 bp, Artificial
  CRISPR gRNA sequence
gacagggagtgaactccgtc

SEQ ID NO: 442465 - DNA, 20 bp, Artificial
  CRISPR gRNA sequence
cgtctacagcaaatgcccat

SEQ ID NO: 442466 - DNA, 20 bp, Artificial
  CRISPR gRNA sequence
cagcaaatgcccattcagtg

SEQ ID NO: 442467 - DNA, 20 bp, Artificial
  CRISPR gRNA sequence
agtggtgatgtagtaaaaag

SEQ ID NO: 442468 - DNA, 20 bp, Artificial
  CRISPR gRNA sequence
gccgggcgcggtggctcacg

SEQ ID NO: 442469 - DNA, 20 bp, Artificial
  CRISPR gRNA sequence
acgcgtgtaatcccagcact

SEQ ID NO: 442470 - DNA, 20 bp, Artificial
  CRISPR gRNA sequence
tgggaggccgaggcgggagg

SEQ ID NO: 442471 - DNA, 20 bp, Artificial
  CRISPR gRNA sequence
gggaggccgaggcgggagga

SEQ ID NO: 442472 - DNA, 20 bp, Artificial
  CRISPR gRNA sequence
ggaggccgaggcgggaggat

SEQ ID NO: 442473 - DNA, 20 bp, Artificial
  CRISPR gRNA sequence
gctaacacggtgaaactctg

SEQ ID NO: 442474 - DNA, 20 bp, Artificial
  CRISPR gRNA sequence
acacggtgaaactctgtctc

SEQ ID NO: 442475 - DNA, 20 bp, Artificial
  CRISPR gRNA sequence
tgtctctactaaaaatacaa

SEQ ID NO: 442476 - DNA, 20 bp, Artificial
  CRISPR gRNA sequence
tctctactaaaaatacaaaa

SEQ ID NO: 442477 - DNA, 20 bp, Artificial
  CRISPR gRNA sequence
tactaaaaatacaaaaaaga

SEQ ID NO: 442478 - DNA, 20 bp, Artificial
  CRISPR gRNA sequence
ctaaaaatacaaaaaagaaa

SEQ ID NO: 442479 - DNA, 20 bp, Artificial
  CRISPR gRNA sequence
aaaatacaaaaaagaaaaaa

SEQ ID NO: 442480 - DNA, 20 bp, Artificial
  CRISPR gRNA sequence
gctgggcttgatggtgggcg

SEQ ID NO: 442481 - DNA, 20 bp, Artificial
  CRISPR gRNA sequence
ggcttgatggtgggcgcctg

SEQ ID NO: 442482 - DNA, 20 bp, Artificial
  CRISPR gRNA sequence
gatggtgggcgcctgtagtc

SEQ ID NO: 442483 - DNA, 20 bp, Artificial
  CRISPR gRNA sequence
atggtgggcgcctgtagtcc

SEQ ID NO: 442484 - DNA, 20 bp, Artificial
  CRISPR gRNA sequence
tagtcccagctacttgggag

SEQ ID NO: 442485 - DNA, 20 bp, Artificial
  CRISPR gRNA sequence
cttgggaggctgaggcagga

SEQ ID NO: 442486 - DNA, 20 bp, Artificial
  CRISPR gRNA sequence
gggaggctgaggcaggagaa

SEQ ID NO: 442487 - DNA, 20 bp, Artificial
  CRISPR gRNA sequence
ggaggctgaggcaggagaat

SEQ ID NO: 442488 - DNA, 20 bp, Artificial
  CRISPR gRNA sequence
aggcaggagaatggcgtgaa

SEQ ID NO: 442489 - DNA, 20 bp, Artificial
  CRISPR gRNA sequence
gcagtgagccgagattgcgc

SEQ ID NO: 442490 - DNA, 20 bp, Artificial
  CRISPR gRNA sequence
cagtgagccgagattgcgcc

SEQ ID NO: 442491 - DNA, 20 bp, Artificial
  CRISPR gRNA sequence
cgccactgcactctagtctg

SEQ ID NO: 442492 - DNA, 20 bp, Artificial
  CRISPR gRNA sequence
cactctagtctgggtgacag

SEQ ID NO: 442493 - DNA, 20 bp, Artificial
  CRISPR gRNA sequence
tagtctgggtgacagagcaa

SEQ ID NO: 442494 - DNA, 20 bp, Artificial
  CRISPR gRNA sequence
gtctgggtgacagagcaaga

SEQ ID NO: 442495 - DNA, 20 bp, Artificial
  CRISPR gRNA sequence
ggtgacagagcaagactccg

SEQ ID NO: 442496 - DNA, 20 bp, Artificial
  CRISPR gRNA sequence
cgtctcaattaaaaaaaaaa

SEQ ID NO: 442497 - DNA, 20 bp, Artificial
  CRISPR gRNA sequence
aattaaaaaaaaaaaaaaaa

SEQ ID NO: 442498 - DNA, 20 bp, Artificial
  CRISPR gRNA sequence
aaaaaaaaaaaaaaagtact

SEQ ID NO: 442499 - DNA, 20 bp, Artificial
  CRISPR gRNA sequence
aagcacaggatgggaaagtg

SEQ ID NO: 442500 - DNA, 20 bp, Artificial
  CRISPR gRNA sequence
aatgacccttgaagtccctt

SEQ ID NO: 442501 - DNA, 20 bp, Artificial
  CRISPR gRNA sequence
gaagtcccttctagcactat

SEQ ID NO: 442502 - DNA, 20 bp, Artificial
  CRISPR gRNA sequence
aagtcccttctagcactatg

SEQ ID NO: 442503 - DNA, 20 bp, Artificial
  CRISPR gRNA sequence
ctagcactatggttgtaaga

SEQ ID NO: 442504 - DNA, 20 bp, Artificial
  CRISPR gRNA sequence
tagcactatggttgtaagat

SEQ ID NO: 442505 - DNA, 20 bp, Artificial
  CRISPR gRNA sequence
gcactatggttgtaagattc

SEQ ID NO: 442506 - DNA, 20 bp, Artificial
  CRISPR gRNA sequence
tggttgtaagattctttaaa

SEQ ID NO: 442507 - DNA, 20 bp, Artificial
  CRISPR gRNA sequence
taagattctttaaaatataa

SEQ ID NO: 442508 - DNA, 20 bp, Artificial
  CRISPR gRNA sequence
tttaaaatataacaatggca

SEQ ID NO: 442509 - DNA, 20 bp, Artificial
  CRISPR gRNA sequence
taaaatataacaatggcata

SEQ ID NO: 442510 - DNA, 20 bp, Artificial
  CRISPR gRNA sequence
aaaatataacaatggcatac

SEQ ID NO: 442511 - DNA, 20 bp, Artificial
  CRISPR gRNA sequence
aaatataacaatggcataca

SEQ ID NO: 442512 - DNA, 20 bp, Artificial
  CRISPR gRNA sequence
gtataactttattattttct

SEQ ID NO: 442513 - DNA, 20 bp, Artificial
  CRISPR gRNA sequence
tattattttctgtccccacc

SEQ ID NO: 442514 - DNA, 20 bp, Artificial
  CRISPR gRNA sequence
attattttctgtccccacca

SEQ ID NO: 442515 - DNA, 20 bp, Artificial
  CRISPR gRNA sequence
ttattttctgtccccaccat

SEQ ID NO: 442516 - DNA, 20 bp, Artificial
  CRISPR gRNA sequence
ttttctgtccccaccatatt

SEQ ID NO: 442517 - DNA, 20 bp, Artificial
  CRISPR gRNA sequence
tctgtccccaccatatttag

SEQ ID NO: 442518 - DNA, 20 bp, Artificial
  CRISPR gRNA sequence
ctgtccccaccatatttagt

SEQ ID NO: 442519 - DNA, 20 bp, Artificial
  CRISPR gRNA sequence
tgtccccaccatatttagtt

SEQ ID NO: 442520 - DNA, 20 bp, Artificial
  CRISPR gRNA sequence
tccccaccatatttagtttc

SEQ ID NO: 442521 - DNA, 20 bp, Artificial
  CRISPR gRNA sequence
agtttcctctctaattgcat

SEQ ID NO: 442522 - DNA, 20 bp, Artificial
  CRISPR gRNA sequence
gtttcctctctaattgcata

SEQ ID NO: 442523 - DNA, 20 bp, Artificial
  CRISPR gRNA sequence
cctctctaattgcataaaag

SEQ ID NO: 442524 - DNA, 20 bp, Artificial
  CRISPR gRNA sequence
ctctctaattgcataaaaga

SEQ ID NO: 442525 - DNA, 20 bp, Artificial
  CRISPR gRNA sequence
tctaattgcataaaagatgt

SEQ ID NO: 442526 - DNA, 20 bp, Artificial
  CRISPR gRNA sequence
taattgcataaaagatgttg

SEQ ID NO: 442527 - DNA, 20 bp, Artificial
  CRISPR gRNA sequence
attgcataaaagatgttggc

SEQ ID NO: 442528 - DNA, 20 bp, Artificial
  CRISPR gRNA sequence
cataaaagatgttggctacc

SEQ ID NO: 442529 - DNA, 20 bp, Artificial
  CRISPR gRNA sequence
gctaccaatcactaaagact

SEQ ID NO: 442530 - DNA, 20 bp, Artificial
  CRISPR gRNA sequence
ccaatcactaaagactaacc

SEQ ID NO: 442531 - DNA, 20 bp, Artificial
  CRISPR gRNA sequence
aagactaaccaaagactgaa

SEQ ID NO: 442532 - DNA, 20 bp, Artificial
  CRISPR gRNA sequence
accaaagactgaaactttgg

SEQ ID NO: 442533 - DNA, 20 bp, Artificial
  CRISPR gRNA sequence
aaactttggagagctaaaac

SEQ ID NO: 442534 - DNA, 20 bp, Artificial
  CRISPR gRNA sequence
tggagagctaaaaccagtaa

SEQ ID NO: 442535 - DNA, 20 bp, Artificial
  CRISPR gRNA sequence
ggagagctaaaaccagtaac

SEQ ID NO: 442536 - DNA, 20 bp, Artificial
  CRISPR gRNA sequence
gagagctaaaaccagtaact

SEQ ID NO: 442537 - DNA, 20 bp, Artificial
  CRISPR gRNA sequence
aaaccagtaactatagtaat

SEQ ID NO: 442538 - DNA, 20 bp, Artificial
  CRISPR gRNA sequence
tagtaataataaacagttga

SEQ ID NO: 442539 - DNA, 20 bp, Artificial
  CRISPR gRNA sequence
agtgctttttatgggccagg

SEQ ID NO: 442540 - DNA, 20 bp, Artificial
  CRISPR gRNA sequence
tttatgggccaggtactatg

SEQ ID NO: 442541 - DNA, 20 bp, Artificial
  CRISPR gRNA sequence
ttatgggccaggtactatgc

SEQ ID NO: 442542 - DNA, 20 bp, Artificial
  CRISPR gRNA sequence
tatgggccaggtactatgct

SEQ ID NO: 442543 - DNA, 20 bp, Artificial
  CRISPR gRNA sequence
atgggccaggtactatgctg

SEQ ID NO: 442544 - DNA, 20 bp, Artificial
  CRISPR gRNA sequence
tgggccaggtactatgctga

SEQ ID NO: 442545 - DNA, 20 bp, Artificial
  CRISPR gRNA sequence
tgctgagcattttacataca

SEQ ID NO: 442546 - DNA, 20 bp, Artificial
  CRISPR gRNA sequence
agcattttacatacattatc

SEQ ID NO: 442547 - DNA, 20 bp, Artificial
  CRISPR gRNA sequence
tacatacattatcatgttta

SEQ ID NO: 442548 - DNA, 20 bp, Artificial
  CRISPR gRNA sequence
acatacattatcatgtttat

SEQ ID NO: 442549 - DNA, 20 bp, Artificial
  CRISPR gRNA sequence
catacattatcatgtttata

SEQ ID NO: 442550 - DNA, 20 bp, Artificial
  CRISPR gRNA sequence
tcatgtttatacattacaac

SEQ ID NO: 442551 - DNA, 20 bp, Artificial
  CRISPR gRNA sequence
atacattacaaccacctcat

SEQ ID NO: 442552 - DNA, 20 bp, Artificial
  CRISPR gRNA sequence
tacattacaaccacctcatg

SEQ ID NO: 442553 - DNA, 20 bp, Artificial
  CRISPR gRNA sequence
caaccacctcatgacatggg

SEQ ID NO: 442554 - DNA, 20 bp, Artificial
  CRISPR gRNA sequence
atgacatgggcactggaatt

SEQ ID NO: 442555 - DNA, 20 bp, Artificial
  CRISPR gRNA sequence
gaattatcctcattgtagag

SEQ ID NO: 442556 - DNA, 20 bp, Artificial
  CRISPR gRNA sequence
tcctcattgtagagatgagc

SEQ ID NO: 442557 - DNA, 20 bp, Artificial
  CRISPR gRNA sequence
attgtagagatgagcaaact

SEQ ID NO: 442558 - DNA, 20 bp, Artificial
  CRISPR gRNA sequence
tagagatgagcaaactgagc

SEQ ID NO: 442559 - DNA, 20 bp, Artificial
  CRISPR gRNA sequence
agcttcagagaatttgagca

SEQ ID NO: 442560 - DNA, 20 bp, Artificial
  CRISPR gRNA sequence
cagagaatttgagcaacttg

SEQ ID NO: 442561 - DNA, 20 bp, Artificial
  CRISPR gRNA sequence
agagaatttgagcaacttga

SEQ ID NO: 442562 - DNA, 20 bp, Artificial
  CRISPR gRNA sequence
gagcaacttgactgaggtca

SEQ ID NO: 442563 - DNA, 20 bp, Artificial
  CRISPR gRNA sequence
agcaacttgactgaggtcac

SEQ ID NO: 442564 - DNA, 20 bp, Artificial
  CRISPR gRNA sequence
gactgaggtcacagagctat

SEQ ID NO: 442565 - DNA, 20 bp, Artificial
  CRISPR gRNA sequence
actgaggtcacagagctatc

SEQ ID NO: 442566 - DNA, 20 bp, Artificial
  CRISPR gRNA sequence
aggtcacagagctatcaaga

SEQ ID NO: 442567 - DNA, 20 bp, Artificial
  CRISPR gRNA sequence
tcaagaacagctgaaattag

SEQ ID NO: 442568 - DNA, 20 bp, Artificial
  CRISPR gRNA sequence
aaattagaacccattccacc

SEQ ID NO: 442569 - DNA, 20 bp, Artificial
  CRISPR gRNA sequence
gaacccattccacctgtcac

SEQ ID NO: 442570 - DNA, 20 bp, Artificial
  CRISPR gRNA sequence
cacctgtcactgaagtactt

SEQ ID NO: 442571 - DNA, 20 bp, Artificial
  CRISPR gRNA sequence
tcactgaagtactttaacca

SEQ ID NO: 442572 - DNA, 20 bp, Artificial
  CRISPR gRNA sequence
aagtactttaaccacaatct

SEQ ID NO: 442573 - DNA, 20 bp, Artificial
  CRISPR gRNA sequence
taaccacaatctcactgtgc

SEQ ID NO: 442574 - DNA, 20 bp, Artificial
  CRISPR gRNA sequence
aaccacaatctcactgtgcc

SEQ ID NO: 442575 - DNA, 20 bp, Artificial
  CRISPR gRNA sequence
accacaatctcactgtgcct

SEQ ID NO: 442576 - DNA, 20 bp, Artificial
  CRISPR gRNA sequence
actgtgcctcctgatcttat

SEQ ID NO: 442577 - DNA, 20 bp, Artificial
  CRISPR gRNA sequence
tgcctcctgatcttataata

SEQ ID NO: 442578 - DNA, 20 bp, Artificial
  CRISPR gRNA sequence
ctgatcttataatattaacg

SEQ ID NO: 442579 - DNA, 20 bp, Artificial
  CRISPR gRNA sequence
atcttataatattaacgaca

SEQ ID NO: 442580 - DNA, 20 bp, Artificial
  CRISPR gRNA sequence
ataatattaacgacaacagc

SEQ ID NO: 442581 - DNA, 20 bp, Artificial
  CRISPR gRNA sequence
taatattaacgacaacagct

SEQ ID NO: 442582 - DNA, 20 bp, Artificial
  CRISPR gRNA sequence
acgacaacagctaacatgta

SEQ ID NO: 442583 - DNA, 20 bp, Artificial
  CRISPR gRNA sequence
acatgtacaaattgtggtca

SEQ ID NO: 442584 - DNA, 20 bp, Artificial
  CRISPR gRNA sequence
tggtcagacattgggataaa

SEQ ID NO: 442585 - DNA, 20 bp, Artificial
  CRISPR gRNA sequence
ggataaacgttttagacatt

SEQ ID NO: 442586 - DNA, 20 bp, Artificial
  CRISPR gRNA sequence
tagacattttcttatttaaa

SEQ ID NO: 442587 - DNA, 20 bp, Artificial
  CRISPR gRNA sequence
agacattttcttatttaaag

SEQ ID NO: 442588 - DNA, 20 bp, Artificial
  CRISPR gRNA sequence
gacattttcttatttaaagc

SEQ ID NO: 442589 - DNA, 20 bp, Artificial
  CRISPR gRNA sequence
tcttatttaaagcccataag

SEQ ID NO: 442590 - DNA, 20 bp, Artificial
  CRISPR gRNA sequence
cttatttaaagcccataagg

SEQ ID NO: 442591 - DNA, 20 bp, Artificial
  CRISPR gRNA sequence
ttatttaaagcccataaggt

SEQ ID NO: 442592 - DNA, 20 bp, Artificial
  CRISPR gRNA sequence
atttaaagcccataaggtgt

SEQ ID NO: 442593 - DNA, 20 bp, Artificial
  CRISPR gRNA sequence
tttaaagcccataaggtgtg

SEQ ID NO: 442594 - DNA, 20 bp, Artificial
  CRISPR gRNA sequence
aaagcccataaggtgtgatt

SEQ ID NO: 442595 - DNA, 20 bp, Artificial
  CRISPR gRNA sequence
aagcccataaggtgtgattt

SEQ ID NO: 442596 - DNA, 20 bp, Artificial
  CRISPR gRNA sequence
atgagatttatgacattatg

SEQ ID NO: 442597 - DNA, 20 bp, Artificial
  CRISPR gRNA sequence
tgagatttatgacattatga

SEQ ID NO: 442598 - DNA, 20 bp, Artificial
  CRISPR gRNA sequence
atgacattatgaggtgggac

SEQ ID NO: 442599 - DNA, 20 bp, Artificial
  CRISPR gRNA sequence
tgacattatgaggtgggact

SEQ ID NO: 442600 - DNA, 20 bp, Artificial
  CRISPR gRNA sequence
tgaggtgggactcacctatt

SEQ ID NO: 442601 - DNA, 20 bp, Artificial
  CRISPR gRNA sequence
acctattaacctcattttac

SEQ ID NO: 442602 - DNA, 20 bp, Artificial
  CRISPR gRNA sequence
ttaacctcattttacagaag

SEQ ID NO: 442603 - DNA, 20 bp, Artificial
  CRISPR gRNA sequence
acctcattttacagaagaaa

SEQ ID NO: 442604 - DNA, 20 bp, Artificial
  CRISPR gRNA sequence
attttacagaagaaaaaaaa

SEQ ID NO: 442605 - DNA, 20 bp, Artificial
  CRISPR gRNA sequence
tacagaagaaaaaaaaaatg

SEQ ID NO: 442606 - DNA, 20 bp, Artificial
  CRISPR gRNA sequence
acagaagaaaaaaaaaatgg

SEQ ID NO: 442607 - DNA, 20 bp, Artificial
  CRISPR gRNA sequence
cagaagaaaaaaaaaatgga

SEQ ID NO: 442608 - DNA, 20 bp, Artificial
  CRISPR gRNA sequence
cagagagtttagaagagacc

SEQ ID NO: 442609 - DNA, 20 bp, Artificial
  CRISPR gRNA sequence
agaagagaccaggacactga

SEQ ID NO: 442610 - DNA, 20 bp, Artificial
  CRISPR gRNA sequence
gaagagaccaggacactgac

SEQ ID NO: 442611 - DNA, 20 bp, Artificial
  CRISPR gRNA sequence
acaagaaataccttaaaatt

SEQ ID NO: 442612 - DNA, 20 bp, Artificial
  CRISPR gRNA sequence
aaaattaaccttcatgatca

SEQ ID NO: 442613 - DNA, 20 bp, Artificial
  CRISPR gRNA sequence
aaattaaccttcatgatcaa

SEQ ID NO: 442614 - DNA, 20 bp, Artificial
  CRISPR gRNA sequence
accttcatgatcaatgtgac

SEQ ID NO: 442615 - DNA, 20 bp, Artificial
  CRISPR gRNA sequence
catgatcaatgtgacttgac

SEQ ID NO: 442616 - DNA, 20 bp, Artificial
  CRISPR gRNA sequence
atgatcaatgtgacttgact

SEQ ID NO: 442617 - DNA, 20 bp, Artificial
  CRISPR gRNA sequence
gacttctgctttatgcccag

SEQ ID NO: 442618 - DNA, 20 bp, Artificial
  CRISPR gRNA sequence
acttctgctttatgcccagt

SEQ ID NO: 442619 - DNA, 20 bp, Artificial
  CRISPR gRNA sequence
ctgctttatgcccagtgttc

SEQ ID NO: 442620 - DNA, 20 bp, Artificial
  CRISPR gRNA sequence
tgctttatgcccagtgttct

SEQ ID NO: 442621 - DNA, 20 bp, Artificial
  CRISPR gRNA sequence
ctttatgcccagtgttctct

SEQ ID NO: 442622 - DNA, 20 bp, Artificial
  CRISPR gRNA sequence
tatgcccagtgttctcttct

SEQ ID NO: 442623 - DNA, 20 bp, Artificial
  CRISPR gRNA sequence
atgcccagtgttctcttctg

SEQ ID NO: 442624 - DNA, 20 bp, Artificial
  CRISPR gRNA sequence
tgcccagtgttctcttctgg

SEQ ID NO: 442625 - DNA, 20 bp, Artificial
  CRISPR gRNA sequence
tcttctggagcaccctgagt

SEQ ID NO: 442626 - DNA, 20 bp, Artificial
  CRISPR gRNA sequence
ttctggagcaccctgagtac

SEQ ID NO: 442627 - DNA, 20 bp, Artificial
  CRISPR gRNA sequence
ctggagcaccctgagtacgt

SEQ ID NO: 442628 - DNA, 20 bp, Artificial
  CRISPR gRNA sequence
tggagcaccctgagtacgtc

SEQ ID NO: 442629 - DNA, 20 bp, Artificial
  CRISPR gRNA sequence
gagcaccctgagtacgtcct

SEQ ID NO: 442630 - DNA, 20 bp, Artificial
  CRISPR gRNA sequence
agtacgtccttgctgaatta

SEQ ID NO: 442631 - DNA, 20 bp, Artificial
  CRISPR gRNA sequence
gctgaattacatgaagaatt

SEQ ID NO: 442632 - DNA, 20 bp, Artificial
  CRISPR gRNA sequence
ctgaattacatgaagaattt

SEQ ID NO: 442633 - DNA, 20 bp, Artificial
  CRISPR gRNA sequence
aattacatgaagaatttaac

SEQ ID NO: 442634 - DNA, 20 bp, Artificial
  CRISPR gRNA sequence
catgaagaatttaactattc

SEQ ID NO: 442635 - DNA, 20 bp, Artificial
  CRISPR gRNA sequence
aactattctttctgtggctg

SEQ ID NO: 442636 - DNA, 20 bp, Artificial
  CRISPR gRNA sequence
actattctttctgtggctgg

SEQ ID NO: 442637 - DNA, 20 bp, Artificial
  CRISPR gRNA sequence
ttctttctgtggctggaatc

SEQ ID NO: 442638 - DNA, 20 bp, Artificial
  CRISPR gRNA sequence
tttctgtggctggaatccag

SEQ ID NO: 442639 - DNA, 20 bp, Artificial
  CRISPR gRNA sequence
tctgtggctggaatccaggg

SEQ ID NO: 442640 - DNA, 20 bp, Artificial
  CRISPR gRNA sequence
ctgtggctggaatccaggga

SEQ ID NO: 442641 - DNA, 20 bp, Artificial
  CRISPR gRNA sequence
tgtggctggaatccagggaa

SEQ ID NO: 442642 - DNA, 20 bp, Artificial
  CRISPR gRNA sequence
tggctggaatccagggaagg

SEQ ID NO: 442643 - DNA, 20 bp, Artificial
  CRISPR gRNA sequence
gaatccagggaaggtgatgg

SEQ ID NO: 442644 - DNA, 20 bp, Artificial
  CRISPR gRNA sequence
tattctagctagaaggcatc

SEQ ID NO: 442645 - DNA, 20 bp, Artificial
  CRISPR gRNA sequence
attctagctagaaggcatcc

SEQ ID NO: 442646 - DNA, 20 bp, Artificial
  CRISPR gRNA sequence
ttctagctagaaggcatcct

SEQ ID NO: 442647 - DNA, 20 bp, Artificial
  CRISPR gRNA sequence
tagctagaaggcatcctaga

SEQ ID NO: 442648 - DNA, 20 bp, Artificial
  CRISPR gRNA sequence
gctagaaggcatcctagaaa

SEQ ID NO: 442649 - DNA, 20 bp, Artificial
  CRISPR gRNA sequence
gaaggcatcctagaaatcac

SEQ ID NO: 442650 - DNA, 20 bp, Artificial
  CRISPR gRNA sequence
gaaatcacctaatccaatgt

SEQ ID NO: 442651 - DNA, 20 bp, Artificial
  CRISPR gRNA sequence
atccaatgtgtcagttccca

SEQ ID NO: 442652 - DNA, 20 bp, Artificial
  CRISPR gRNA sequence
ccaaacacagactgacacca

SEQ ID NO: 442653 - DNA, 20 bp, Artificial
  CRISPR gRNA sequence
acaccagttcatgaccaaac

SEQ ID NO: 442654 - DNA, 20 bp, Artificial
  CRISPR gRNA sequence
atgaccaaacatcaccagtc

SEQ ID NO: 442655 - DNA, 20 bp, Artificial
  CRISPR gRNA sequence
cattcaatttagttaatatt

SEQ ID NO: 442656 - DNA, 20 bp, Artificial
  CRISPR gRNA sequence
attcaatttagttaatattt

SEQ ID NO: 442657 - DNA, 20 bp, Artificial
  CRISPR gRNA sequence
aatttagttaatatttaagt

SEQ ID NO: 442658 - DNA, 20 bp, Artificial
  CRISPR gRNA sequence
agttaatatttaagtaaaat

SEQ ID NO: 442659 - DNA, 20 bp, Artificial
  CRISPR gRNA sequence
gttaatatttaagtaaaatt

SEQ ID NO: 442660 - DNA, 20 bp, Artificial
  CRISPR gRNA sequence
atatttaagtaaaattaaag

SEQ ID NO: 442661 - DNA, 20 bp, Artificial
  CRISPR gRNA sequence
aagtaaaattaaagactata

SEQ ID NO: 442662 - DNA, 20 bp, Artificial
  CRISPR gRNA sequence
agtaaaattaaagactataa

SEQ ID NO: 442663 - DNA, 20 bp, Artificial
  CRISPR gRNA sequence
aagactataaagtttattaa

SEQ ID NO: 442664 - DNA, 20 bp, Artificial
  CRISPR gRNA sequence
taaagtttattaactttttt

SEQ ID NO: 442665 - DNA, 20 bp, Artificial
  CRISPR gRNA sequence
attaacttttttccagttaa

SEQ ID NO: 442666 - DNA, 20 bp, Artificial
  CRISPR gRNA sequence
ttaacttttttccagttaaa

SEQ ID NO: 442667 - DNA, 20 bp, Artificial
  CRISPR gRNA sequence
acttttttccagttaaaatt

SEQ ID NO: 442668 - DNA, 20 bp, Artificial
  CRISPR gRNA sequence
ttttccagttaaaatttaag

SEQ ID NO: 442669 - DNA, 20 bp, Artificial
  CRISPR gRNA sequence
tttccagttaaaatttaagt

SEQ ID NO: 442670 - DNA, 20 bp, Artificial
  CRISPR gRNA sequence
ttccagttaaaatttaagta

SEQ ID NO: 442671 - DNA, 20 bp, Artificial
  CRISPR gRNA sequence
tccagttaaaatttaagtaa

SEQ ID NO: 442672 - DNA, 20 bp, Artificial
  CRISPR gRNA sequence
ccagttaaaatttaagtaaa

SEQ ID NO: 442673 - DNA, 20 bp, Artificial
  CRISPR gRNA sequence
cagttaaaatttaagtaaaa

SEQ ID NO: 442674 - DNA, 20 bp, Artificial
  CRISPR gRNA sequence
aaatttaagtaaaataatcc

SEQ ID NO: 442675 - DNA, 20 bp, Artificial
  CRISPR gRNA sequence
aagtaaaataatcctaagcc

SEQ ID NO: 442676 - DNA, 20 bp, Artificial
  CRISPR gRNA sequence
agtaaaataatcctaagcca

SEQ ID NO: 442677 - DNA, 20 bp, Artificial
  CRISPR gRNA sequence
agccagaccatctttttccc

SEQ ID NO: 442678 - DNA, 20 bp, Artificial
  CRISPR gRNA sequence
tttcccagcacaggtgtgtc

SEQ ID NO: 442679 - DNA, 20 bp, Artificial
  CRISPR gRNA sequence
ttcccagcacaggtgtgtct

SEQ ID NO: 442680 - DNA, 20 bp, Artificial
  CRISPR gRNA sequence
tcccagcacaggtgtgtctc

SEQ ID NO: 442681 - DNA, 20 bp, Artificial
  CRISPR gRNA sequence
cccagcacaggtgtgtctcc

SEQ ID NO: 442682 - DNA, 20 bp, Artificial
  CRISPR gRNA sequence
ccagcacaggtgtgtctcca

SEQ ID NO: 442683 - DNA, 20 bp, Artificial
  CRISPR gRNA sequence
caccacttccctcttttcaa

SEQ ID NO: 442684 - DNA, 20 bp, Artificial
  CRISPR gRNA sequence
ccctcttttcaaacactatt

SEQ ID NO: 442685 - DNA, 20 bp, Artificial
  CRISPR gRNA sequence
cctcttttcaaacactattt

SEQ ID NO: 442686 - DNA, 20 bp, Artificial
  CRISPR gRNA sequence
ttttcaaacactatttcagg

SEQ ID NO: 442687 - DNA, 20 bp, Artificial
  CRISPR gRNA sequence
ttcaaacactatttcaggtg

SEQ ID NO: 442688 - DNA, 20 bp, Artificial
  CRISPR gRNA sequence
tcaaacactatttcaggtgc

SEQ ID NO: 442689 - DNA, 20 bp, Artificial
  CRISPR gRNA sequence
caaacactatttcaggtgca

SEQ ID NO: 442690 - DNA, 20 bp, Artificial
  CRISPR gRNA sequence
aaacactatttcaggtgcac

SEQ ID NO: 442691 - DNA, 20 bp, Artificial
  CRISPR gRNA sequence
tttcaggtgcacggagatat

SEQ ID NO: 442692 - DNA, 20 bp, Artificial
  CRISPR gRNA sequence
caggtgcacggagatatcca

SEQ ID NO: 442693 - DNA, 20 bp, Artificial
  CRISPR gRNA sequence
aggtgcacggagatatccat

SEQ ID NO: 442694 - DNA, 20 bp, Artificial
  CRISPR gRNA sequence
cactctcacactgttttctc

SEQ ID NO: 442695 - DNA, 20 bp, Artificial
  CRISPR gRNA sequence
tcacactgttttctcatctt

SEQ ID NO: 442696 - DNA, 20 bp, Artificial
  CRISPR gRNA sequence
acactgttttctcatctttt

SEQ ID NO: 442697 - DNA, 20 bp, Artificial
  CRISPR gRNA sequence
ttttctcatctttttttccc

SEQ ID NO: 442698 - DNA, 20 bp, Artificial
  CRISPR gRNA sequence
tctcatctttttttcccaca

SEQ ID NO: 442699 - DNA, 20 bp, Artificial
  CRISPR gRNA sequence
ctcatctttttttcccacat

SEQ ID NO: 442700 - DNA, 20 bp, Artificial
  CRISPR gRNA sequence
tcatctttttttcccacatt

SEQ ID NO: 442701 - DNA, 20 bp, Artificial
  CRISPR gRNA sequence
atctttttttcccacattca

SEQ ID NO: 442702 - DNA, 20 bp, Artificial
  CRISPR gRNA sequence
tttttcccacattcaaaatc

SEQ ID NO: 442703 - DNA, 20 bp, Artificial
  CRISPR gRNA sequence
ttttcccacattcaaaatcc

SEQ ID NO: 442704 - DNA, 20 bp, Artificial
  CRISPR gRNA sequence
tttcccacattcaaaatcct

SEQ ID NO: 442705 - DNA, 20 bp, Artificial
  CRISPR gRNA sequence
ttcccacattcaaaatcctc

SEQ ID NO: 442706 - DNA, 20 bp, Artificial
  CRISPR gRNA sequence
tcccacattcaaaatcctct

SEQ ID NO: 442707 - DNA, 20 bp, Artificial
  CRISPR gRNA sequence
cccacattcaaaatcctctg

SEQ ID NO: 442708 - DNA, 20 bp, Artificial
  CRISPR gRNA sequence
ccacattcaaaatcctctga

SEQ ID NO: 442709 - DNA, 20 bp, Artificial
  CRISPR gRNA sequence
aaaatcctctgaattcagag

SEQ ID NO: 442710 - DNA, 20 bp, Artificial
  CRISPR gRNA sequence
tgaattcagagccagctaaa

SEQ ID NO: 442711 - DNA, 20 bp, Artificial
  CRISPR gRNA sequence
aattcagagccagctaaaga

SEQ ID NO: 442712 - DNA, 20 bp, Artificial
  CRISPR gRNA sequence
agagccagctaaagattccc

SEQ ID NO: 442713 - DNA, 20 bp, Artificial
  CRISPR gRNA sequence
aagattccctcctctgcccc

SEQ ID NO: 442714 - DNA, 20 bp, Artificial
  CRISPR gRNA sequence
cctcctctgccccatgcata

SEQ ID NO: 442715 - DNA, 20 bp, Artificial
  CRISPR gRNA sequence
ctctgccccatgcatagtta

SEQ ID NO: 442716 - DNA, 20 bp, Artificial
  CRISPR gRNA sequence
tgccccatgcatagttacct

SEQ ID NO: 442717 - DNA, 20 bp, Artificial
  CRISPR gRNA sequence
ccccatgcatagttacctgg

SEQ ID NO: 442718 - DNA, 20 bp, Artificial
  CRISPR gRNA sequence
cctgggccatgtcccctggt

SEQ ID NO: 442719 - DNA, 20 bp, Artificial
  CRISPR gRNA sequence
ggccatgtcccctggtggta

SEQ ID NO: 442720 - DNA, 20 bp, Artificial
  CRISPR gRNA sequence
gtggtaagcatccttggaaa

SEQ ID NO: 442721 - DNA, 20 bp, Artificial
  CRISPR gRNA sequence
ggaaaggctgcagtgaagtc

SEQ ID NO: 442722 - DNA, 20 bp, Artificial
  CRISPR gRNA sequence
gaaaggctgcagtgaagtct

SEQ ID NO: 442723 - DNA, 20 bp, Artificial
  CRISPR gRNA sequence
cagtgaagtctctctgccga

SEQ ID NO: 442724 - DNA, 20 bp, Artificial
  CRISPR gRNA sequence
tctgccgagtcggtgcaggg

SEQ ID NO: 442725 - DNA, 20 bp, Artificial
  CRISPR gRNA sequence
tgccgagtcggtgcaggggt

SEQ ID NO: 442726 - DNA, 20 bp, Artificial
  CRISPR gRNA sequence
ccgagtcggtgcaggggtga

SEQ ID NO: 442727 - DNA, 20 bp, Artificial
  CRISPR gRNA sequence
ggctaatgtcagaaacaaca

SEQ ID NO: 442728 - DNA, 20 bp, Artificial
  CRISPR gRNA sequence
gctaatgtcagaaacaacat

SEQ ID NO: 442729 - DNA, 20 bp, Artificial
  CRISPR gRNA sequence
atgtcagaaacaacataagg

SEQ ID NO: 442730 - DNA, 20 bp, Artificial
  CRISPR gRNA sequence
tctgagagcagaaagcttat

SEQ ID NO: 442731 - DNA, 20 bp, Artificial
  CRISPR gRNA sequence
agagcagaaagcttatttca

SEQ ID NO: 442732 - DNA, 20 bp, Artificial
  CRISPR gRNA sequence
atttcagggaatcaaagggg

SEQ ID NO: 442733 - DNA, 20 bp, Artificial
  CRISPR gRNA sequence
tttcagggaatcaaaggggc

SEQ ID NO: 442734 - DNA, 20 bp, Artificial
  CRISPR gRNA sequence
cagggaatcaaaggggcagc

SEQ ID NO: 442735 - DNA, 20 bp, Artificial
  CRISPR gRNA sequence
agggaatcaaaggggcagca

SEQ ID NO: 442736 - DNA, 20 bp, Artificial
  CRISPR gRNA sequence
agaaagagaaatacaccctc

SEQ ID NO: 442737 - DNA, 20 bp, Artificial
  CRISPR gRNA sequence
agcttccaaacctgcctgga

SEQ ID NO: 442738 - DNA, 20 bp, Artificial
  CRISPR gRNA sequence
ccaaacctgcctggatacct

SEQ ID NO: 442739 - DNA, 20 bp, Artificial
  CRISPR gRNA sequence
caaacctgcctggataccta

SEQ ID NO: 442740 - DNA, 20 bp, Artificial
  CRISPR gRNA sequence
cctggatacctacgttgaga

SEQ ID NO: 442741 - DNA, 20 bp, Artificial
  CRISPR gRNA sequence
gatacctacgttgagagtgt

SEQ ID NO: 442742 - DNA, 20 bp, Artificial
  CRISPR gRNA sequence
cgttgagagtgtatcacaca

SEQ ID NO: 442743 - DNA, 20 bp, Artificial
  CRISPR gRNA sequence
agagtgtatcacacacttca

SEQ ID NO: 442744 - DNA, 20 bp, Artificial
  CRISPR gRNA sequence
caaatgtttgacaaaggtaa

SEQ ID NO: 442745 - DNA, 20 bp, Artificial
  CRISPR gRNA sequence
aaatgtttgacaaaggtaag

SEQ ID NO: 442746 - DNA, 20 bp, Artificial
  CRISPR gRNA sequence
gacaaaggtaagatgcagtc

SEQ ID NO: 442747 - DNA, 20 bp, Artificial
  CRISPR gRNA sequence
acaaaggtaagatgcagtca

SEQ ID NO: 442748 - DNA, 20 bp, Artificial
  CRISPR gRNA sequence
ttacattctgattattaata

SEQ ID NO: 442749 - DNA, 20 bp, Artificial
  CRISPR gRNA sequence
cattctgattattaatagcg

SEQ ID NO: 442750 - DNA, 20 bp, Artificial
  CRISPR gRNA sequence
tgattattaatagcggaact

SEQ ID NO: 442751 - DNA, 20 bp, Artificial
  CRISPR gRNA sequence
attattaatagcggaactaa

SEQ ID NO: 442752 - DNA, 20 bp, Artificial
  CRISPR gRNA sequence
ttaatagcggaactaacagc

SEQ ID NO: 442753 - DNA, 20 bp, Artificial
  CRISPR gRNA sequence
atagcggaactaacagccac

SEQ ID NO: 442754 - DNA, 20 bp, Artificial
  CRISPR gRNA sequence
acagccacacaaatggccat

SEQ ID NO: 442755 - DNA, 20 bp, Artificial
  CRISPR gRNA sequence
caggttgaagactccttatc

SEQ ID NO: 442756 - DNA, 20 bp, Artificial
  CRISPR gRNA sequence
aagactccttatctgaaatg

SEQ ID NO: 442757 - DNA, 20 bp, Artificial
  CRISPR gRNA sequence
cttatctgaaatgcttgaga

SEQ ID NO: 442758 - DNA, 20 bp, Artificial
  CRISPR gRNA sequence
atctgaaatgcttgagatca

SEQ ID NO: 442759 - DNA, 20 bp, Artificial
  CRISPR gRNA sequence
tctgaaatgcttgagatcag

SEQ ID NO: 442760 - DNA, 20 bp, Artificial
  CRISPR gRNA sequence
aaatgcttgagatcagaaat

SEQ ID NO: 442761 - DNA, 20 bp, Artificial
  CRISPR gRNA sequence
gagatcagaaatgttttaga

SEQ ID NO: 442762 - DNA, 20 bp, Artificial
  CRISPR gRNA sequence
agatcagaaatgttttagat

SEQ ID NO: 442763 - DNA, 20 bp, Artificial
  CRISPR gRNA sequence
tagattttgaattttttttt

SEQ ID NO: 442764 - DNA, 20 bp, Artificial
  CRISPR gRNA sequence
agattttgaatttttttttt

SEQ ID NO: 442765 - DNA, 20 bp, Artificial
  CRISPR gRNA sequence
gattttgaattttttttttt

SEQ ID NO: 442766 - DNA, 20 bp, Artificial
  CRISPR gRNA sequence
tgaatttttttttttttttt

SEQ ID NO: 442767 - DNA, 20 bp, Artificial
  CRISPR gRNA sequence
gaattttttttttttttttg

SEQ ID NO: 442768 - DNA, 20 bp, Artificial
  CRISPR gRNA sequence
aattttttttttttttttga

SEQ ID NO: 442769 - DNA, 20 bp, Artificial
  CRISPR gRNA sequence
tttttttttttttgaaacgg

SEQ ID NO: 442770 - DNA, 20 bp, Artificial
  CRISPR gRNA sequence
ttttttttttttgaaacgga

SEQ ID NO: 442771 - DNA, 20 bp, Artificial
  CRISPR gRNA sequence
tttttttttttgaaacggag

SEQ ID NO: 442772 - DNA, 20 bp, Artificial
  CRISPR gRNA sequence
ttttttttttgaaacggagt

SEQ ID NO: 442773 - DNA, 20 bp, Artificial
  CRISPR gRNA sequence
tttttttttgaaacggagtt

SEQ ID NO: 442774 - DNA, 20 bp, Artificial
  CRISPR gRNA sequence
ttttttttgaaacggagttt

SEQ ID NO: 442775 - DNA, 20 bp, Artificial
  CRISPR gRNA sequence
tttttttgaaacggagtttt

SEQ ID NO: 442776 - DNA, 20 bp, Artificial
  CRISPR gRNA sequence
ttttttgaaacggagttttg

SEQ ID NO: 442777 - DNA, 20 bp, Artificial
  CRISPR gRNA sequence
tttttgaaacggagttttgc

SEQ ID NO: 442778 - DNA, 20 bp, Artificial
  CRISPR gRNA sequence
ttttgaaacggagttttgct

SEQ ID NO: 442779 - DNA, 20 bp, Artificial
  CRISPR gRNA sequence
tttgaaacggagttttgctc

SEQ ID NO: 442780 - DNA, 20 bp, Artificial
  CRISPR gRNA sequence
ttgaaacggagttttgctct

SEQ ID NO: 442781 - DNA, 20 bp, Artificial
  CRISPR gRNA sequence
tgaaacggagttttgctctt

SEQ ID NO: 442782 - DNA, 20 bp, Artificial
  CRISPR gRNA sequence
gaaacggagttttgctcttg

SEQ ID NO: 442783 - DNA, 20 bp, Artificial
  CRISPR gRNA sequence
aaacggagttttgctcttgt

SEQ ID NO: 442784 - DNA, 20 bp, Artificial
  CRISPR gRNA sequence
tgctcttgttgcccaggctg

SEQ ID NO: 442785 - DNA, 20 bp, Artificial
  CRISPR gRNA sequence
gctcttgttgcccaggctgg

SEQ ID NO: 442786 - DNA, 20 bp, Artificial
  CRISPR gRNA sequence
ctcttgttgcccaggctgga

SEQ ID NO: 442787 - DNA, 20 bp, Artificial
  CRISPR gRNA sequence
ttgttgcccaggctggagtg

SEQ ID NO: 442788 - DNA, 20 bp, Artificial
  CRISPR gRNA sequence
gttgcccaggctggagtgca

SEQ ID NO: 442789 - DNA, 20 bp, Artificial
  CRISPR gRNA sequence
ttgcccaggctggagtgcaa

SEQ ID NO: 442790 - DNA, 20 bp, Artificial
  CRISPR gRNA sequence
cccaggctggagtgcaatgg

SEQ ID NO: 442791 - DNA, 20 bp, Artificial
  CRISPR gRNA sequence
gagtgcaatggcataatctc

SEQ ID NO: 442792 - DNA, 20 bp, Artificial
  CRISPR gRNA sequence
ggctcactgcaacctccgcc

SEQ ID NO: 442793 - DNA, 20 bp, Artificial
  CRISPR gRNA sequence
actgcaacctccgcctcctg

SEQ ID NO: 442794 - DNA, 20 bp, Artificial
  CRISPR gRNA sequence
caacctccgcctcctgggtt

SEQ ID NO: 442795 - DNA, 20 bp, Artificial
  CRISPR gRNA sequence
cgcctcctgggttcaagcaa

SEQ ID NO: 442796 - DNA, 20 bp, Artificial
  CRISPR gRNA sequence
ctgggttcaagcaattctcc

SEQ ID NO: 442797 - DNA, 20 bp, Artificial
  CRISPR gRNA sequence
ggttcaagcaattctcctgc

SEQ ID NO: 442798 - DNA, 20 bp, Artificial
  CRISPR gRNA sequence
aagcaattctcctgcctcag

SEQ ID NO: 442799 - DNA, 20 bp, Artificial
  CRISPR gRNA sequence
tcctgcctcagactcctgag

SEQ ID NO: 442800 - DNA, 20 bp, Artificial
  CRISPR gRNA sequence
ctgcctcagactcctgagta

SEQ ID NO: 442801 - DNA, 20 bp, Artificial
  CRISPR gRNA sequence
cctcagactcctgagtagct

SEQ ID NO: 442802 - DNA, 20 bp, Artificial
  CRISPR gRNA sequence
agactcctgagtagctggga

SEQ ID NO: 442803 - DNA, 20 bp, Artificial
  CRISPR gRNA sequence
ctgagtagctgggactacag

SEQ ID NO: 442804 - DNA, 20 bp, Artificial
  CRISPR gRNA sequence
agtagctgggactacaggca

SEQ ID NO: 442805 - DNA, 20 bp, Artificial
  CRISPR gRNA sequence
ggactacaggcatgtgcaac

SEQ ID NO: 442806 - DNA, 20 bp, Artificial
  CRISPR gRNA sequence
caggcatgtgcaaccacacc

SEQ ID NO: 442807 - DNA, 20 bp, Artificial
  CRISPR gRNA sequence
gctaattttgtatttttagt

SEQ ID NO: 442808 - DNA, 20 bp, Artificial
  CRISPR gRNA sequence
attttgtatttttagtagag

SEQ ID NO: 442809 - DNA, 20 bp, Artificial
  CRISPR gRNA sequence
tgtatttttagtagagacag

SEQ ID NO: 442810 - DNA, 20 bp, Artificial
  CRISPR gRNA sequence
gtatttttagtagagacagg

SEQ ID NO: 442811 - DNA, 20 bp, Artificial
  CRISPR gRNA sequence
tatttttagtagagacaggg

SEQ ID NO: 442812 - DNA, 20 bp, Artificial
  CRISPR gRNA sequence
ttagtagagacagggtttct

SEQ ID NO: 442813 - DNA, 20 bp, Artificial
  CRISPR gRNA sequence
tagtagagacagggtttctc

SEQ ID NO: 442814 - DNA, 20 bp, Artificial
  CRISPR gRNA sequence
agtagagacagggtttctcc

SEQ ID NO: 442815 - DNA, 20 bp, Artificial
  CRISPR gRNA sequence
gtagagacagggtttctcca

SEQ ID NO: 442816 - DNA, 20 bp, Artificial
  CRISPR gRNA sequence
ctccatgttggtcagactgg

SEQ ID NO: 442817 - DNA, 20 bp, Artificial
  CRISPR gRNA sequence
tccatgttggtcagactggt

SEQ ID NO: 442818 - DNA, 20 bp, Artificial
  CRISPR gRNA sequence
catgttggtcagactggtct

SEQ ID NO: 442819 - DNA, 20 bp, Artificial
  CRISPR gRNA sequence
gtcagactggtctcgaactc

SEQ ID NO: 442820 - DNA, 20 bp, Artificial
  CRISPR gRNA sequence
gtctcgaactcccgacctca

SEQ ID NO: 442821 - DNA, 20 bp, Artificial
  CRISPR gRNA sequence
gaactcccgacctcaggtga

SEQ ID NO: 442822 - DNA, 20 bp, Artificial
  CRISPR gRNA sequence
ccgacctcaggtgatccacc

SEQ ID NO: 442823 - DNA, 20 bp, Artificial
  CRISPR gRNA sequence
aggtgatccacccacctcag

SEQ ID NO: 442824 - DNA, 20 bp, Artificial
  CRISPR gRNA sequence
agcctcccaaagtgctggga

SEQ ID NO: 442825 - DNA, 20 bp, Artificial
  CRISPR gRNA sequence
ccaaagtgctgggattatag

SEQ ID NO: 442826 - DNA, 20 bp, Artificial
  CRISPR gRNA sequence
ggattataggcatgagccac

SEQ ID NO: 442827 - DNA, 20 bp, Artificial
  CRISPR gRNA sequence
taggcatgagccaccacgcc

SEQ ID NO: 442828 - DNA, 20 bp, Artificial
  CRISPR gRNA sequence
ttatttttttattttttagt

SEQ ID NO: 442829 - DNA, 20 bp, Artificial
  CRISPR gRNA sequence
tatttttttattttttagta

SEQ ID NO: 442830 - DNA, 20 bp, Artificial
  CRISPR gRNA sequence
atttttttattttttagtat

SEQ ID NO: 442831 - DNA, 20 bp, Artificial
  CRISPR gRNA sequence
tttttttattttttagtatc

SEQ ID NO: 442832 - DNA, 20 bp, Artificial
  CRISPR gRNA sequence
ttttattttttagtatctgc

SEQ ID NO: 442833 - DNA, 20 bp, Artificial
  CRISPR gRNA sequence
tttattttttagtatctgcc

SEQ ID NO: 442834 - DNA, 20 bp, Artificial
  CRISPR gRNA sequence
ttattttttagtatctgcct

SEQ ID NO: 442835 - DNA, 20 bp, Artificial
  CRISPR gRNA sequence
tattttttagtatctgccta

SEQ ID NO: 442836 - DNA, 20 bp, Artificial
  CRISPR gRNA sequence
attttttagtatctgcctat

SEQ ID NO: 442837 - DNA, 20 bp, Artificial
  CRISPR gRNA sequence
ttttttagtatctgcctata

SEQ ID NO: 442838 - DNA, 20 bp, Artificial
  CRISPR gRNA sequence
tttagtatctgcctatactt

SEQ ID NO: 442839 - DNA, 20 bp, Artificial
  CRISPR gRNA sequence
ttagtatctgcctatactta

SEQ ID NO: 442840 - DNA, 20 bp, Artificial
  CRISPR gRNA sequence
tagtatctgcctatacttat

SEQ ID NO: 442841 - DNA, 20 bp, Artificial
  CRISPR gRNA sequence
agtatctgcctatacttatg

SEQ ID NO: 442842 - DNA, 20 bp, Artificial
  CRISPR gRNA sequence
gtatctgcctatacttatgt

SEQ ID NO: 442843 - DNA, 20 bp, Artificial
  CRISPR gRNA sequence
cctatacttatgttccaatg

SEQ ID NO: 442844 - DNA, 20 bp, Artificial
  CRISPR gRNA sequence
tacttatgttccaatgagct

SEQ ID NO: 442845 - DNA, 20 bp, Artificial
  CRISPR gRNA sequence
atgttccaatgagcttttcc

SEQ ID NO: 442846 - DNA, 20 bp, Artificial
  CRISPR gRNA sequence
tgttccaatgagcttttcct

SEQ ID NO: 442847 - DNA, 20 bp, Artificial
  CRISPR gRNA sequence
caatgagcttttcctttgaa

SEQ ID NO: 442848 - DNA, 20 bp, Artificial
  CRISPR gRNA sequence
ttcctttgaatgtcatgtca

SEQ ID NO: 442849 - DNA, 20 bp, Artificial
  CRISPR gRNA sequence
tcctttgaatgtcatgtcag

SEQ ID NO: 442850 - DNA, 20 bp, Artificial
  CRISPR gRNA sequence
cctttgaatgtcatgtcagt

SEQ ID NO: 442851 - DNA, 20 bp, Artificial
  CRISPR gRNA sequence
ctttgaatgtcatgtcagtg

SEQ ID NO: 442852 - DNA, 20 bp, Artificial
  CRISPR gRNA sequence
tgaatgtcatgtcagtgtcc

SEQ ID NO: 442853 - DNA, 20 bp, Artificial
  CRISPR gRNA sequence
gaatgtcatgtcagtgtcca

SEQ ID NO: 442854 - DNA, 20 bp, Artificial
  CRISPR gRNA sequence
aatgtcatgtcagtgtccaa

SEQ ID NO: 442855 - DNA, 20 bp, Artificial
  CRISPR gRNA sequence
tggattttagagcatttcag

SEQ ID NO: 442856 - DNA, 20 bp, Artificial
  CRISPR gRNA sequence
ggattttagagcatttcaga

SEQ ID NO: 442857 - DNA, 20 bp, Artificial
  CRISPR gRNA sequence
gattttagagcatttcagat

SEQ ID NO: 442858 - DNA, 20 bp, Artificial
  CRISPR gRNA sequence
tagagcatttcagattttgg

SEQ ID NO: 442859 - DNA, 20 bp, Artificial
  CRISPR gRNA sequence
agagcatttcagattttggt

SEQ ID NO: 442860 - DNA, 20 bp, Artificial
  CRISPR gRNA sequence
gagcatttcagattttggtg

SEQ ID NO: 442861 - DNA, 20 bp, Artificial
  CRISPR gRNA sequence
cagattttggtgcattttag

SEQ ID NO: 442862 - DNA, 20 bp, Artificial
  CRISPR gRNA sequence
agattttggtgcattttagg

SEQ ID NO: 442863 - DNA, 20 bp, Artificial
  CRISPR gRNA sequence
tggtgcattttaggttttag

SEQ ID NO: 442864 - DNA, 20 bp, Artificial
  CRISPR gRNA sequence
ggtgcattttaggttttaga

SEQ ID NO: 442865 - DNA, 20 bp, Artificial
  CRISPR gRNA sequence
gtgcattttaggttttagat

SEQ ID NO: 442866 - DNA, 20 bp, Artificial
  CRISPR gRNA sequence
taggttttagattttcagat

SEQ ID NO: 442867 - DNA, 20 bp, Artificial
  CRISPR gRNA sequence
aggttttagattttcagatt

SEQ ID NO: 442868 - DNA, 20 bp, Artificial
  CRISPR gRNA sequence
ggttttagattttcagattt

SEQ ID NO: 442869 - DNA, 20 bp, Artificial
  CRISPR gRNA sequence
tagattttcagatttgggat

SEQ ID NO: 442870 - DNA, 20 bp, Artificial
  CRISPR gRNA sequence
agattttcagatttgggatg

SEQ ID NO: 442871 - DNA, 20 bp, Artificial
  CRISPR gRNA sequence
gattttcagatttgggatgc

SEQ ID NO: 442872 - DNA, 20 bp, Artificial
  CRISPR gRNA sequence
tcagatttgggatgcccaac

SEQ ID NO: 442873 - DNA, 20 bp, Artificial
  CRISPR gRNA sequence
cagatttgggatgcccaacc

SEQ ID NO: 442874 - DNA, 20 bp, Artificial
  CRISPR gRNA sequence
agatttgggatgcccaacct

SEQ ID NO: 442875 - DNA, 20 bp, Artificial
  CRISPR gRNA sequence
gggatgcccaacctataaag

SEQ ID NO: 442876 - DNA, 20 bp, Artificial
  CRISPR gRNA sequence
ggatgcccaacctataaagg

SEQ ID NO: 442877 - DNA, 20 bp, Artificial
  CRISPR gRNA sequence
taaaggcttttaataaaata

SEQ ID NO: 442878 - DNA, 20 bp, Artificial
  CRISPR gRNA sequence
ttaataaaatattatcacat

SEQ ID NO: 442879 - DNA, 20 bp, Artificial
  CRISPR gRNA sequence
taataaaatattatcacata

SEQ ID NO: 442880 - DNA, 20 bp, Artificial
  CRISPR gRNA sequence
aataaaatattatcacataa

SEQ ID NO: 442881 - DNA, 20 bp, Artificial
  CRISPR gRNA sequence
ataaaatattatcacataaa

SEQ ID NO: 442882 - DNA, 20 bp, Artificial
  CRISPR gRNA sequence
tcacataaaatccttctaat

SEQ ID NO: 442883 - DNA, 20 bp, Artificial
  CRISPR gRNA sequence
ctaatggcccacatgatcgg

SEQ ID NO: 442884 - DNA, 20 bp, Artificial
  CRISPR gRNA sequence
taatggcccacatgatcggt

SEQ ID NO: 442885 - DNA, 20 bp, Artificial
  CRISPR gRNA sequence
atggcccacatgatcggtat

SEQ ID NO: 442886 - DNA, 20 bp, Artificial
  CRISPR gRNA sequence
ttgtcatattttatagaaga

SEQ ID NO: 442887 - DNA, 20 bp, Artificial
  CRISPR gRNA sequence
tcatattttatagaagagga

SEQ ID NO: 442888 - DNA, 20 bp, Artificial
  CRISPR gRNA sequence
tatagaagaggagctcacag

SEQ ID NO: 442889 - DNA, 20 bp, Artificial
  CRISPR gRNA sequence
atagaagaggagctcacagc

SEQ ID NO: 442890 - DNA, 20 bp, Artificial
  CRISPR gRNA sequence
tagaagaggagctcacagcg

SEQ ID NO: 442891 - DNA, 20 bp, Artificial
  CRISPR gRNA sequence
acagcgtttcaataacttgc

SEQ ID NO: 442892 - DNA, 20 bp, Artificial
  CRISPR gRNA sequence
caataacttgctcaggatta

SEQ ID NO: 442893 - DNA, 20 bp, Artificial
  CRISPR gRNA sequence
aataacttgctcaggattat

SEQ ID NO: 442894 - DNA, 20 bp, Artificial
  CRISPR gRNA sequence
gctcaggattatatagctag

SEQ ID NO: 442895 - DNA, 20 bp, Artificial
  CRISPR gRNA sequence
ctcaggattatatagctagt

SEQ ID NO: 442896 - DNA, 20 bp, Artificial
  CRISPR gRNA sequence
aggattatatagctagtaag

SEQ ID NO: 442897 - DNA, 20 bp, Artificial
  CRISPR gRNA sequence
tatagctagtaagaggcaga

SEQ ID NO: 442898 - DNA, 20 bp, Artificial
  CRISPR gRNA sequence
gtaagaggcagagttagatg

SEQ ID NO: 442899 - DNA, 20 bp, Artificial
  CRISPR gRNA sequence
gatgtaaactcagctctatc

SEQ ID NO: 442900 - DNA, 20 bp, Artificial
  CRISPR gRNA sequence
agctctatctgggcacaaag

SEQ ID NO: 442901 - DNA, 20 bp, Artificial
  CRISPR gRNA sequence
tatctgggcacaaagtacat

SEQ ID NO: 442902 - DNA, 20 bp, Artificial
  CRISPR gRNA sequence
tctgggcacaaagtacatgt

SEQ ID NO: 442903 - DNA, 20 bp, Artificial
  CRISPR gRNA sequence
ggcacaaagtacatgttata

SEQ ID NO: 442904 - DNA, 20 bp, Artificial
  CRISPR gRNA sequence
tagaaatcttaagtctgttc

SEQ ID NO: 442905 - DNA, 20 bp, Artificial
  CRISPR gRNA sequence
aagtctgttcacctcccagc

SEQ ID NO: 442906 - DNA, 20 bp, Artificial
  CRISPR gRNA sequence
agtctgttcacctcccagca

SEQ ID NO: 442907 - DNA, 20 bp, Artificial
  CRISPR gRNA sequence
ttcacctcccagcatacatg

SEQ ID NO: 442908 - DNA, 20 bp, Artificial
  CRISPR gRNA sequence
acctcccagcatacatgcat

SEQ ID NO: 442909 - DNA, 20 bp, Artificial
  CRISPR gRNA sequence
ccagcatacatgcataaccc

SEQ ID NO: 442910 - DNA, 20 bp, Artificial
  CRISPR gRNA sequence
accatgctggctgcacctgg

SEQ ID NO: 442911 - DNA, 20 bp, Artificial
  CRISPR gRNA sequence
gctgcacctggggtaaaatc

SEQ ID NO: 442912 - DNA, 20 bp, Artificial
  CRISPR gRNA sequence
cacctggggtaaaatcacct

SEQ ID NO: 442913 - DNA, 20 bp, Artificial
  CRISPR gRNA sequence
gggtaaaatcacctgaggta

SEQ ID NO: 442914 - DNA, 20 bp, Artificial
  CRISPR gRNA sequence
aggtagactctgtaaaaagc

SEQ ID NO: 442915 - DNA, 20 bp, Artificial
  CRISPR gRNA sequence
tgtaaaaagctaatgcttag

SEQ ID NO: 442916 - DNA, 20 bp, Artificial
  CRISPR gRNA sequence
taaaaagctaatgcttagca

SEQ ID NO: 442917 - DNA, 20 bp, Artificial
  CRISPR gRNA sequence
atgcttagcatctacctcca

SEQ ID NO: 442918 - DNA, 20 bp, Artificial
  CRISPR gRNA sequence
agcatctacctccagagatg

SEQ ID NO: 442919 - DNA, 20 bp, Artificial
  CRISPR gRNA sequence
gcatctacctccagagatgc

SEQ ID NO: 442920 - DNA, 20 bp, Artificial
  CRISPR gRNA sequence
cctccagagatgctgatttc

SEQ ID NO: 442921 - DNA, 20 bp, Artificial
  CRISPR gRNA sequence
cagagatgctgatttctctg

SEQ ID NO: 442922 - DNA, 20 bp, Artificial
  CRISPR gRNA sequence
atttctctggtttttggtag

SEQ ID NO: 442923 - DNA, 20 bp, Artificial
  CRISPR gRNA sequence
ctctggtttttggtagtggg

SEQ ID NO: 442924 - DNA, 20 bp, Artificial
  CRISPR gRNA sequence
tctggtttttggtagtgggg

SEQ ID NO: 442925 - DNA, 20 bp, Artificial
  CRISPR gRNA sequence
tggtttttggtagtggggtt

SEQ ID NO: 442926 - DNA, 20 bp, Artificial
  CRISPR gRNA sequence
gtttttggtagtggggtttt

SEQ ID NO: 442927 - DNA, 20 bp, Artificial
  CRISPR gRNA sequence
ttggtagtggggttttttct

SEQ ID NO: 442928 - DNA, 20 bp, Artificial
  CRISPR gRNA sequence
tggtagtggggttttttctt

SEQ ID NO: 442929 - DNA, 20 bp, Artificial
  CRISPR gRNA sequence
ggtagtggggttttttcttc

SEQ ID NO: 442930 - DNA, 20 bp, Artificial
  CRISPR gRNA sequence
gtagtggggttttttcttct

SEQ ID NO: 442931 - DNA, 20 bp, Artificial
  CRISPR gRNA sequence
tttcttctgctttttaagag

SEQ ID NO: 442932 - DNA, 20 bp, Artificial
  CRISPR gRNA sequence
ttcttctgctttttaagaga

SEQ ID NO: 442933 - DNA, 20 bp, Artificial
  CRISPR gRNA sequence
tcttctgctttttaagagat

SEQ ID NO: 442934 - DNA, 20 bp, Artificial
  CRISPR gRNA sequence
cttctgctttttaagagata

SEQ ID NO: 442935 - DNA, 20 bp, Artificial
  CRISPR gRNA sequence
ttctgctttttaagagatag

SEQ ID NO: 442936 - DNA, 20 bp, Artificial
  CRISPR gRNA sequence
ctgctttttaagagataggg

SEQ ID NO: 442937 - DNA, 20 bp, Artificial
  CRISPR gRNA sequence
tgctttttaagagatagggg

SEQ ID NO: 442938 - DNA, 20 bp, Artificial
  CRISPR gRNA sequence
ctttttaagagataggggta

SEQ ID NO: 442939 - DNA, 20 bp, Artificial
  CRISPR gRNA sequence
tttaagagataggggtagcc

SEQ ID NO: 442940 - DNA, 20 bp, Artificial
  CRISPR gRNA sequence
ttaagagataggggtagcca

SEQ ID NO: 442941 - DNA, 20 bp, Artificial
  CRISPR gRNA sequence
taagagataggggtagccac

SEQ ID NO: 442942 - DNA, 20 bp, Artificial
  CRISPR gRNA sequence
aagagataggggtagccaca

SEQ ID NO: 442943 - DNA, 20 bp, Artificial
  CRISPR gRNA sequence
agagataggggtagccacag

SEQ ID NO: 442944 - DNA, 20 bp, Artificial
  CRISPR gRNA sequence
gtctcaaactcctgacctca

SEQ ID NO: 442945 - DNA, 20 bp, Artificial
  CRISPR gRNA sequence
aaactcctgacctcaagtga

SEQ ID NO: 442946 - DNA, 20 bp, Artificial
  CRISPR gRNA sequence
ctgacctcaagtgatcctcc

SEQ ID NO: 442947 - DNA, 20 bp, Artificial
  CRISPR gRNA sequence
acctcaagtgatcctcctgc

SEQ ID NO: 442948 - DNA, 20 bp, Artificial
  CRISPR gRNA sequence
aagtgatcctcctgcttcag

SEQ ID NO: 442949 - DNA, 20 bp, Artificial
  CRISPR gRNA sequence
ctgcttcagcctctcaaagt

SEQ ID NO: 442950 - DNA, 20 bp, Artificial
  CRISPR gRNA sequence
cttcagcctctcaaagtatt

SEQ ID NO: 442951 - DNA, 20 bp, Artificial
  CRISPR gRNA sequence
cagcctctcaaagtattggg

SEQ ID NO: 442952 - DNA, 20 bp, Artificial
  CRISPR gRNA sequence
agcctctcaaagtattggga

SEQ ID NO: 442953 - DNA, 20 bp, Artificial
  CRISPR gRNA sequence
tcaaagtattgggattatag

SEQ ID NO: 442954 - DNA, 20 bp, Artificial
  CRISPR gRNA sequence
aaagtattgggattataggc

SEQ ID NO: 442955 - DNA, 20 bp, Artificial
  CRISPR gRNA sequence
ggattataggcatgagccac

SEQ ID NO: 442956 - DNA, 20 bp, Artificial
  CRISPR gRNA sequence
taggcatgagccactgtacc

SEQ ID NO: 442957 - DNA, 20 bp, Artificial
  CRISPR gRNA sequence
tacctggcatctatagttgt

SEQ ID NO: 442958 - DNA, 20 bp, Artificial
  CRISPR gRNA sequence
gcatctatagttgtttaaaa

SEQ ID NO: 442959 - DNA, 20 bp, Artificial
  CRISPR gRNA sequence
tagttgtttaaaaactctct

SEQ ID NO: 442960 - DNA, 20 bp, Artificial
  CRISPR gRNA sequence
tttaaaaactctctatgtga

SEQ ID NO: 442961 - DNA, 20 bp, Artificial
  CRISPR gRNA sequence
aaaaactctctatgtgattc

SEQ ID NO: 442962 - DNA, 20 bp, Artificial
  CRISPR gRNA sequence
aaaactctctatgtgattct

SEQ ID NO: 442963 - DNA, 20 bp, Artificial
  CRISPR gRNA sequence
tctatgtgattctaatgaga

SEQ ID NO: 442964 - DNA, 20 bp, Artificial
  CRISPR gRNA sequence
tatgtgattctaatgagagt

SEQ ID NO: 442965 - DNA, 20 bp, Artificial
  CRISPR gRNA sequence
tgtgattctaatgagagtca

SEQ ID NO: 442966 - DNA, 20 bp, Artificial
  CRISPR gRNA sequence
taatgagagtcagggtctct

SEQ ID NO: 442967 - DNA, 20 bp, Artificial
  CRISPR gRNA sequence
atgagagtcagggtctctaa

SEQ ID NO: 442968 - DNA, 20 bp, Artificial
  CRISPR gRNA sequence
taaccactgatctaggcctt

SEQ ID NO: 442969 - DNA, 20 bp, Artificial
  CRISPR gRNA sequence
accactgatctaggcctttc

SEQ ID NO: 442970 - DNA, 20 bp, Artificial
  CRISPR gRNA sequence
atctaggcctttcatcccat

SEQ ID NO: 442971 - DNA, 20 bp, Artificial
  CRISPR gRNA sequence
ggcctttcatcccatctata

SEQ ID NO: 442972 - DNA, 20 bp, Artificial
  CRISPR gRNA sequence
tcatcccatctatacattcc

SEQ ID NO: 442973 - DNA, 20 bp, Artificial
  CRISPR gRNA sequence
catcccatctatacattcca

SEQ ID NO: 442974 - DNA, 20 bp, Artificial
  CRISPR gRNA sequence
atcccatctatacattccac

SEQ ID NO: 442975 - DNA, 20 bp, Artificial
  CRISPR gRNA sequence
tacattccacccatgagttt

SEQ ID NO: 442976 - DNA, 20 bp, Artificial
  CRISPR gRNA sequence
cacccatgagttttggcttt

SEQ ID NO: 442977 - DNA, 20 bp, Artificial
  CRISPR gRNA sequence
tggcttttcttttcttttct

SEQ ID NO: 442978 - DNA, 20 bp, Artificial
  CRISPR gRNA sequence
ggcttttcttttcttttctt

SEQ ID NO: 442979 - DNA, 20 bp, Artificial
  CRISPR gRNA sequence
gcttttcttttcttttcttt

SEQ ID NO: 442980 - DNA, 20 bp, Artificial
  CRISPR gRNA sequence
ttcttttcttttcttttttt

SEQ ID NO: 442981 - DNA, 20 bp, Artificial
  CRISPR gRNA sequence
tcttttcttttctttttttt

SEQ ID NO: 442982 - DNA, 20 bp, Artificial
  CRISPR gRNA sequence
cttttcttttcttttttttt

SEQ ID NO: 442983 - DNA, 20 bp, Artificial
  CRISPR gRNA sequence
ttttcttttctttttttttt

SEQ ID NO: 442984 - DNA, 20 bp, Artificial
  CRISPR gRNA sequence
ttcttttctttttttttttt

SEQ ID NO: 442985 - DNA, 20 bp, Artificial
  CRISPR gRNA sequence
tcttttcttttttttttttt

SEQ ID NO: 442986 - DNA, 20 bp, Artificial
  CRISPR gRNA sequence
cttttctttttttttttttg

SEQ ID NO: 442987 - DNA, 20 bp, Artificial
  CRISPR gRNA sequence
ttttctttttttttttttga

SEQ ID NO: 442988 - DNA, 20 bp, Artificial
  CRISPR gRNA sequence
ttctttttttttttttgaga

SEQ ID NO: 442989 - DNA, 20 bp, Artificial
  CRISPR gRNA sequence
tctttttttttttttgagac

SEQ ID NO: 442990 - DNA, 20 bp, Artificial
  CRISPR gRNA sequence
ctttttttttttttgagaca

SEQ ID NO: 442991 - DNA, 20 bp, Artificial
  CRISPR gRNA sequence
tttttttttttttgagacag

SEQ ID NO: 442992 - DNA, 20 bp, Artificial
  CRISPR gRNA sequence
tttttttttttgagacagag

SEQ ID NO: 442993 - DNA, 20 bp, Artificial
  CRISPR gRNA sequence
ttttttttttgagacagagt

SEQ ID NO: 442994 - DNA, 20 bp, Artificial
  CRISPR gRNA sequence
tttttttttgagacagagtt

SEQ ID NO: 442995 - DNA, 20 bp, Artificial
  CRISPR gRNA sequence
ttttttttgagacagagttt

SEQ ID NO: 442996 - DNA, 20 bp, Artificial
  CRISPR gRNA sequence
tttttttgagacagagtttc

SEQ ID NO: 442997 - DNA, 20 bp, Artificial
  CRISPR gRNA sequence
ttttttgagacagagtttca

SEQ ID NO: 442998 - DNA, 20 bp, Artificial
  CRISPR gRNA sequence
tttttgagacagagtttcac

SEQ ID NO: 442999 - DNA, 20 bp, Artificial
  CRISPR gRNA sequence
ttttgagacagagtttcacc

SEQ ID NO: 443000 - DNA, 20 bp, Artificial
  CRISPR gRNA sequence
tttgagacagagtttcaccc

SEQ ID NO: 443001 - DNA, 20 bp, Artificial
  CRISPR gRNA sequence
ttgagacagagtttcaccct

SEQ ID NO: 443002 - DNA, 20 bp, Artificial
  CRISPR gRNA sequence
tgagacagagtttcaccctt

SEQ ID NO: 443003 - DNA, 20 bp, Artificial
  CRISPR gRNA sequence
gagacagagtttcacccttg

SEQ ID NO: 443004 - DNA, 20 bp, Artificial
  CRISPR gRNA sequence
agacagagtttcacccttgt

SEQ ID NO: 443005 - DNA, 20 bp, Artificial
  CRISPR gRNA sequence
cacccttgtcagccaggctg

SEQ ID NO: 443006 - DNA, 20 bp, Artificial
  CRISPR gRNA sequence
acccttgtcagccaggctgg

SEQ ID NO: 443007 - DNA, 20 bp, Artificial
  CRISPR gRNA sequence
gtcagccaggctggagtaca

SEQ ID NO: 443008 - DNA, 20 bp, Artificial
  CRISPR gRNA sequence
tcagccaggctggagtacaa

SEQ ID NO: 443009 - DNA, 20 bp, Artificial
  CRISPR gRNA sequence
gagtacaatggcgagatctt

SEQ ID NO: 443010 - DNA, 20 bp, Artificial
  CRISPR gRNA sequence
ggcttaccacaacctccgac

SEQ ID NO: 443011 - DNA, 20 bp, Artificial
  CRISPR gRNA sequence
gcttaccacaacctccgact

SEQ ID NO: 443012 - DNA, 20 bp, Artificial
  CRISPR gRNA sequence
accacaacctccgactccca

SEQ ID NO: 443013 - DNA, 20 bp, Artificial
  CRISPR gRNA sequence
ccacaacctccgactcccag

SEQ ID NO: 443014 - DNA, 20 bp, Artificial
  CRISPR gRNA sequence
cgactcccaggttcaagtga

SEQ ID NO: 443015 - DNA, 20 bp, Artificial
  CRISPR gRNA sequence
ccaggttcaagtgattctcc

SEQ ID NO: 443016 - DNA, 20 bp, Artificial
  CRISPR gRNA sequence
aagtgattctcctgcttcag

SEQ ID NO: 443017 - DNA, 20 bp, Artificial
  CRISPR gRNA sequence
tcctgcttcagccccccaag

SEQ ID NO: 443018 - DNA, 20 bp, Artificial
  CRISPR gRNA sequence
ctgcttcagccccccaagta

SEQ ID NO: 443019 - DNA, 20 bp, Artificial
  CRISPR gRNA sequence
cttcagccccccaagtagct

SEQ ID NO: 443020 - DNA, 20 bp, Artificial
  CRISPR gRNA sequence
cagccccccaagtagctaga

SEQ ID NO: 443021 - DNA, 20 bp, Artificial
  CRISPR gRNA sequence
agccccccaagtagctagaa

SEQ ID NO: 443022 - DNA, 20 bp, Artificial
  CRISPR gRNA sequence
gaattacaggctcccgtaac

SEQ ID NO: 443023 - DNA, 20 bp, Artificial
  CRISPR gRNA sequence
caggctcccgtaaccatgcc

SEQ ID NO: 443024 - DNA, 20 bp, Artificial
  CRISPR gRNA sequence
ccgtaaccatgcctggctaa

SEQ ID NO: 443025 - DNA, 20 bp, Artificial
  CRISPR gRNA sequence
gctaattttttgtattttta

SEQ ID NO: 443026 - DNA, 20 bp, Artificial
  CRISPR gRNA sequence
attttttgtatttttagtgg

SEQ ID NO: 443027 - DNA, 20 bp, Artificial
  CRISPR gRNA sequence
tttgtatttttagtggagac

SEQ ID NO: 443028 - DNA, 20 bp, Artificial
  CRISPR gRNA sequence
ttgtatttttagtggagaca

SEQ ID NO: 443029 - DNA, 20 bp, Artificial
  CRISPR gRNA sequence
tgtatttttagtggagacaa

SEQ ID NO: 443030 - DNA, 20 bp, Artificial
  CRISPR gRNA sequence
gtatttttagtggagacaag

SEQ ID NO: 443031 - DNA, 20 bp, Artificial
  CRISPR gRNA sequence
tatttttagtggagacaagg

SEQ ID NO: 443032 - DNA, 20 bp, Artificial
  CRISPR gRNA sequence
ttagtggagacaaggtttta

SEQ ID NO: 443033 - DNA, 20 bp, Artificial
  CRISPR gRNA sequence
tagtggagacaaggttttac

SEQ ID NO: 443034 - DNA, 20 bp, Artificial
  CRISPR gRNA sequence
agtggagacaaggttttact

SEQ ID NO: 443035 - DNA, 20 bp, Artificial
  CRISPR gRNA sequence
gtggagacaaggttttacta

SEQ ID NO: 443036 - DNA, 20 bp, Artificial
  CRISPR gRNA sequence
tactatgttggccaggctgg

SEQ ID NO: 443037 - DNA, 20 bp, Artificial
  CRISPR gRNA sequence
actatgttggccaggctggt

SEQ ID NO: 443038 - DNA, 20 bp, Artificial
  CRISPR gRNA sequence
ctatgttggccaggctggtc

SEQ ID NO: 443039 - DNA, 20 bp, Artificial
  CRISPR gRNA sequence
tgttggccaggctggtctcg

SEQ ID NO: 443040 - DNA, 20 bp, Artificial
  CRISPR gRNA sequence
gccaggctggtctcgaattc

SEQ ID NO: 443041 - DNA, 20 bp, Artificial
  CRISPR gRNA sequence
gtctcgaattcctgacctca

SEQ ID NO: 443042 - DNA, 20 bp, Artificial
  CRISPR gRNA sequence
gaattcctgacctcatgatc

SEQ ID NO: 443043 - DNA, 20 bp, Artificial
  CRISPR gRNA sequence
ctgacctcatgatccaccgg

SEQ ID NO: 443044 - DNA, 20 bp, Artificial
  CRISPR gRNA sequence
acctcatgatccaccggcct

SEQ ID NO: 443045 - DNA, 20 bp, Artificial
  CRISPR gRNA sequence
atgatccaccggcctcagcc

SEQ ID NO: 443046 - DNA, 20 bp, Artificial
  CRISPR gRNA sequence
agcctcccaaagtgctggga

SEQ ID NO: 443047 - DNA, 20 bp, Artificial
  CRISPR gRNA sequence
ccaaagtgctgggattagag

SEQ ID NO: 443048 - DNA, 20 bp, Artificial
  CRISPR gRNA sequence
ggattagaggtgtgagccac

SEQ ID NO: 443049 - DNA, 20 bp, Artificial
  CRISPR gRNA sequence
gaggtgtgagccaccacgcc

SEQ ID NO: 443050 - DNA, 20 bp, Artificial
  CRISPR gRNA sequence
taaaacagagagaaggtgtt

SEQ ID NO: 443051 - DNA, 20 bp, Artificial
  CRISPR gRNA sequence
aaaacagagagaaggtgtta

SEQ ID NO: 443052 - DNA, 20 bp, Artificial
  CRISPR gRNA sequence
aaacagagagaaggtgttaa

SEQ ID NO: 443053 - DNA, 20 bp, Artificial
  CRISPR gRNA sequence
aatatcactgagcatcacca

SEQ ID NO: 443054 - DNA, 20 bp, Artificial
  CRISPR gRNA sequence
agcatcaccaatggggcctg

SEQ ID NO: 443055 - DNA, 20 bp, Artificial
  CRISPR gRNA sequence
ttaaactttaggtcttagtg

SEQ ID NO: 443056 - DNA, 20 bp, Artificial
  CRISPR gRNA sequence
aactttaggtcttagtggcc

SEQ ID NO: 443057 - DNA, 20 bp, Artificial
  CRISPR gRNA sequence
taggtcttagtggccctcct

SEQ ID NO: 443058 - DNA, 20 bp, Artificial
  CRISPR gRNA sequence
aggtcttagtggccctcctc

SEQ ID NO: 443059 - DNA, 20 bp, Artificial
  CRISPR gRNA sequence
ggtcttagtggccctcctcc

SEQ ID NO: 443060 - DNA, 20 bp, Artificial
  CRISPR gRNA sequence
agtggccctcctccagggct

SEQ ID NO: 443061 - DNA, 20 bp, Artificial
  CRISPR gRNA sequence
gtggccctcctccagggcta

SEQ ID NO: 443062 - DNA, 20 bp, Artificial
  CRISPR gRNA sequence
ctccagggctataattaggg

SEQ ID NO: 443063 - DNA, 20 bp, Artificial
  CRISPR gRNA sequence
cagggctataattagggaag

SEQ ID NO: 443064 - DNA, 20 bp, Artificial
  CRISPR gRNA sequence
taattagggaagtcagagat

SEQ ID NO: 443065 - DNA, 20 bp, Artificial
  CRISPR gRNA sequence
gggaagtcagagatgagaac

SEQ ID NO: 443066 - DNA, 20 bp, Artificial
  CRISPR gRNA sequence
taatatgatccacagataaa

SEQ ID NO: 443067 - DNA, 20 bp, Artificial
  CRISPR gRNA sequence
aatatgatccacagataaat

SEQ ID NO: 443068 - DNA, 20 bp, Artificial
  CRISPR gRNA sequence
atatgatccacagataaatc

SEQ ID NO: 443069 - DNA, 20 bp, Artificial
  CRISPR gRNA sequence
attcataaagatggcatgca

SEQ ID NO: 443070 - DNA, 20 bp, Artificial
  CRISPR gRNA sequence
ttcataaagatggcatgcaa

SEQ ID NO: 443071 - DNA, 20 bp, Artificial
  CRISPR gRNA sequence
ataaagatggcatgcaaatg

SEQ ID NO: 443072 - DNA, 20 bp, Artificial
  CRISPR gRNA sequence
acctggtttgatgaccaact

SEQ ID NO: 443073 - DNA, 20 bp, Artificial
  CRISPR gRNA sequence
gtttgatgaccaacttcagg

SEQ ID NO: 443074 - DNA, 20 bp, Artificial
  CRISPR gRNA sequence
gatgaccaacttcaggttaa

SEQ ID NO: 443075 - DNA, 20 bp, Artificial
  CRISPR gRNA sequence
atgaccaacttcaggttaaa

SEQ ID NO: 443076 - DNA, 20 bp, Artificial
  CRISPR gRNA sequence
caggttaaatttttcatcat

SEQ ID NO: 443077 - DNA, 20 bp, Artificial
  CRISPR gRNA sequence
aggttaaatttttcatcatt

SEQ ID NO: 443078 - DNA, 20 bp, Artificial
  CRISPR gRNA sequence
aatttttcatcattcattat

SEQ ID NO: 443079 - DNA, 20 bp, Artificial
  CRISPR gRNA sequence
ttcatcattcattatgcctg

SEQ ID NO: 443080 - DNA, 20 bp, Artificial
  CRISPR gRNA sequence
tcatcattcattatgcctgg

SEQ ID NO: 443081 - DNA, 20 bp, Artificial
  CRISPR gRNA sequence
catcattcattatgcctggg

SEQ ID NO: 443082 - DNA, 20 bp, Artificial
  CRISPR gRNA sequence
atcattcattatgcctggga

SEQ ID NO: 443083 - DNA, 20 bp, Artificial
  CRISPR gRNA sequence
attatgcctgggatttggat

SEQ ID NO: 443084 - DNA, 20 bp, Artificial
  CRISPR gRNA sequence
tgcctgggatttggatccgg

SEQ ID NO: 443085 - DNA, 20 bp, Artificial
  CRISPR gRNA sequence
ggatttggatccggcagcag

SEQ ID NO: 443086 - DNA, 20 bp, Artificial
  CRISPR gRNA sequence
ggatccggcagcagtagatc

SEQ ID NO: 443087 - DNA, 20 bp, Artificial
  CRISPR gRNA sequence
gatccggcagcagtagatcc

SEQ ID NO: 443088 - DNA, 20 bp, Artificial
  CRISPR gRNA sequence
tctgctagagtcacattctc

SEQ ID NO: 443089 - DNA, 20 bp, Artificial
  CRISPR gRNA sequence
ctagagtcacattctctatg

SEQ ID NO: 443090 - DNA, 20 bp, Artificial
  CRISPR gRNA sequence
gagtcacattctctatggtc

SEQ ID NO: 443091 - DNA, 20 bp, Artificial
  CRISPR gRNA sequence
tctatggtcagggacacatc

SEQ ID NO: 443092 - DNA, 20 bp, Artificial
  CRISPR gRNA sequence
tatggtcagggacacatctc

SEQ ID NO: 443093 - DNA, 20 bp, Artificial
  CRISPR gRNA sequence
tggtcagggacacatctcct

SEQ ID NO: 443094 - DNA, 20 bp, Artificial
  CRISPR gRNA sequence
ctttgcggaaatccccattt

SEQ ID NO: 443095 - DNA, 20 bp, Artificial
  CRISPR gRNA sequence
tgcggaaatccccatttagc

SEQ ID NO: 443096 - DNA, 20 bp, Artificial
  CRISPR gRNA sequence
gcggaaatccccatttagcc

SEQ ID NO: 443097 - DNA, 20 bp, Artificial
  CRISPR gRNA sequence
cggaaatccccatttagcca

SEQ ID NO: 443098 - DNA, 20 bp, Artificial
  CRISPR gRNA sequence
agccagtatctggatgtcca

SEQ ID NO: 443099 - DNA, 20 bp, Artificial
  CRISPR gRNA sequence
gccagtatctggatgtccaa

SEQ ID NO: 443100 - DNA, 20 bp, Artificial
  CRISPR gRNA sequence
gatgtccaataattcacatc

SEQ ID NO: 443101 - DNA, 20 bp, Artificial
  CRISPR gRNA sequence
acatccctttcatcagtcct

SEQ ID NO: 443102 - DNA, 20 bp, Artificial
  CRISPR gRNA sequence
tcatcagtcctgagcaccac

SEQ ID NO: 443103 - DNA, 20 bp, Artificial
  CRISPR gRNA sequence
catcagtcctgagcaccacg

SEQ ID NO: 443104 - DNA, 20 bp, Artificial
  CRISPR gRNA sequence
atcagtcctgagcaccacgt

SEQ ID NO: 443105 - DNA, 20 bp, Artificial
  CRISPR gRNA sequence
agcaccacgttgccacattc

SEQ ID NO: 443106 - DNA, 20 bp, Artificial
  CRISPR gRNA sequence
ccacattcaaacacaggaca

SEQ ID NO: 443107 - DNA, 20 bp, Artificial
  CRISPR gRNA sequence
aaacacaggacaggctcctt

SEQ ID NO: 443108 - DNA, 20 bp, Artificial
  CRISPR gRNA sequence
ctttgccccagcagacgggc

SEQ ID NO: 443109 - DNA, 20 bp, Artificial
  CRISPR gRNA sequence
tgccccagcagacgggcacg

SEQ ID NO: 443110 - DNA, 20 bp, Artificial
  CRISPR gRNA sequence
gccccagcagacgggcacga

SEQ ID NO: 443111 - DNA, 20 bp, Artificial
  CRISPR gRNA sequence
ccccagcagacgggcacgag

SEQ ID NO: 443112 - DNA, 20 bp, Artificial
  CRISPR gRNA sequence
cctggggcggctggggtgta

SEQ ID NO: 443113 - DNA, 20 bp, Artificial
  CRISPR gRNA sequence
gggcggctggggtgtagaag

SEQ ID NO: 443114 - DNA, 20 bp, Artificial
  CRISPR gRNA sequence
gggtgtagaagcagggcaga

SEQ ID NO: 443115 - DNA, 20 bp, Artificial
  CRISPR gRNA sequence
tgaccgacctccgctctgta

SEQ ID NO: 443116 - DNA, 20 bp, Artificial
  CRISPR gRNA sequence
accgacctccgctctgtatt

SEQ ID NO: 443117 - DNA, 20 bp, Artificial
  CRISPR gRNA sequence
cgctctgtattccacttctg

SEQ ID NO: 443118 - DNA, 20 bp, Artificial
  CRISPR gRNA sequence
tgtattccacttctgaggac

SEQ ID NO: 443119 - DNA, 20 bp, Artificial
  CRISPR gRNA sequence
tattccacttctgaggaccc

SEQ ID NO: 443120 - DNA, 20 bp, Artificial
  CRISPR gRNA sequence
cacttctgaggaccctgcat

SEQ ID NO: 443121 - DNA, 20 bp, Artificial
  CRISPR gRNA sequence
ctgaggaccctgcatagaga

SEQ ID NO: 443122 - DNA, 20 bp, Artificial
  CRISPR gRNA sequence
tgaggaccctgcatagagag

SEQ ID NO: 443123 - DNA, 20 bp, Artificial
  CRISPR gRNA sequence
aggaccctgcatagagagag

SEQ ID NO: 443124 - DNA, 20 bp, Artificial
  CRISPR gRNA sequence
catagagagagaaggagagc

SEQ ID NO: 443125 - DNA, 20 bp, Artificial
  CRISPR gRNA sequence
aagcggtgagtgaggttact

SEQ ID NO: 443126 - DNA, 20 bp, Artificial
  CRISPR gRNA sequence
ctccatttcaggaaaactgc

SEQ ID NO: 443127 - DNA, 20 bp, Artificial
  CRISPR gRNA sequence
catttcaggaaaactgcaag

SEQ ID NO: 443128 - DNA, 20 bp, Artificial
  CRISPR gRNA sequence
caggaaaactgcaagccatg

SEQ ID NO: 443129 - DNA, 20 bp, Artificial
  CRISPR gRNA sequence
aggaaaactgcaagccatgt

SEQ ID NO: 443130 - DNA, 20 bp, Artificial
  CRISPR gRNA sequence
caagccatgtcttacagaat

SEQ ID NO: 443131 - DNA, 20 bp, Artificial
  CRISPR gRNA sequence
acagaataaagaggaagcta

SEQ ID NO: 443132 - DNA, 20 bp, Artificial
  CRISPR gRNA sequence
cagaataaagaggaagctac

SEQ ID NO: 443133 - DNA, 20 bp, Artificial
  CRISPR gRNA sequence
ctgctgcagtcctgtttgga

SEQ ID NO: 443134 - DNA, 20 bp, Artificial
  CRISPR gRNA sequence
ctgcagtcctgtttggagga

SEQ ID NO: 443135 - DNA, 20 bp, Artificial
  CRISPR gRNA sequence
cagtcctgtttggaggatga

SEQ ID NO: 443136 - DNA, 20 bp, Artificial
  CRISPR gRNA sequence
tttggaggatgattcgctgt

SEQ ID NO: 443137 - DNA, 20 bp, Artificial
  CRISPR gRNA sequence
ggaggatgattcgctgtgac

SEQ ID NO: 443138 - DNA, 20 bp, Artificial
  CRISPR gRNA sequence
gaggatgattcgctgtgaca

SEQ ID NO: 443139 - DNA, 20 bp, Artificial
  CRISPR gRNA sequence
gctgtgacaatgcttctcag

SEQ ID NO: 443140 - DNA, 20 bp, Artificial
  CRISPR gRNA sequence
tgacaatgcttctcagatgt

SEQ ID NO: 443141 - DNA, 20 bp, Artificial
  CRISPR gRNA sequence
ctcagatgtgaaggccatca

SEQ ID NO: 443142 - DNA, 20 bp, Artificial
  CRISPR gRNA sequence
tcagatgtgaaggccatcag

SEQ ID NO: 443143 - DNA, 20 bp, Artificial
  CRISPR gRNA sequence
agatgtgaaggccatcagaa

SEQ ID NO: 443144 - DNA, 20 bp, Artificial
  CRISPR gRNA sequence
ggaagccttgcgaaaacaca

SEQ ID NO: 443145 - DNA, 20 bp, Artificial
  CRISPR gRNA sequence
gcgaaaacacagattgctgg

SEQ ID NO: 443146 - DNA, 20 bp, Artificial
  CRISPR gRNA sequence
cgaaaacacagattgctggg

SEQ ID NO: 443147 - DNA, 20 bp, Artificial
  CRISPR gRNA sequence
ctgggctcaactgctagagt

SEQ ID NO: 443148 - DNA, 20 bp, Artificial
  CRISPR gRNA sequence
ggctcaactgctagagttcc

SEQ ID NO: 443149 - DNA, 20 bp, Artificial
  CRISPR gRNA sequence
aactgctagagttcctgact

SEQ ID NO: 443150 - DNA, 20 bp, Artificial
  CRISPR gRNA sequence
ctagagttcctgactcagtt

SEQ ID NO: 443151 - DNA, 20 bp, Artificial
  CRISPR gRNA sequence
gagttcctgactcagttggc

SEQ ID NO: 443152 - DNA, 20 bp, Artificial
  CRISPR gRNA sequence
ctgactcagttggcctgtgg

SEQ ID NO: 443153 - DNA, 20 bp, Artificial
  CRISPR gRNA sequence
actcagttggcctgtggtag

SEQ ID NO: 443154 - DNA, 20 bp, Artificial
  CRISPR gRNA sequence
agttggcctgtggtagagcc

SEQ ID NO: 443155 - DNA, 20 bp, Artificial
  CRISPR gRNA sequence
gcctgtggtagagcctgaga

SEQ ID NO: 443156 - DNA, 20 bp, Artificial
  CRISPR gRNA sequence
tggtagagcctgagaacttt

SEQ ID NO: 443157 - DNA, 20 bp, Artificial
  CRISPR gRNA sequence
agaacttttatttctaacaa

SEQ ID NO: 443158 - DNA, 20 bp, Artificial
  CRISPR gRNA sequence
ttatttctaacaagttctca

SEQ ID NO: 443159 - DNA, 20 bp, Artificial
  CRISPR gRNA sequence
tatttctaacaagttctcaa

SEQ ID NO: 443160 - DNA, 20 bp, Artificial
  CRISPR gRNA sequence
atttctaacaagttctcaag

SEQ ID NO: 443161 - DNA, 20 bp, Artificial
  CRISPR gRNA sequence
tttctaacaagttctcaagt

SEQ ID NO: 443162 - DNA, 20 bp, Artificial
  CRISPR gRNA sequence
ctaacaagttctcaagtgtt

SEQ ID NO: 443163 - DNA, 20 bp, Artificial
  CRISPR gRNA sequence
taacaagttctcaagtgttg

SEQ ID NO: 443164 - DNA, 20 bp, Artificial
  CRISPR gRNA sequence
acaagttctcaagtgttgct

SEQ ID NO: 443165 - DNA, 20 bp, Artificial
  CRISPR gRNA sequence
tcaagtgttgctgaagtggc

SEQ ID NO: 443166 - DNA, 20 bp, Artificial
  CRISPR gRNA sequence
aagtgttgctgaagtggctg

SEQ ID NO: 443167 - DNA, 20 bp, Artificial
  CRISPR gRNA sequence
ctgaagtggctggtctcaga

SEQ ID NO: 443168 - DNA, 20 bp, Artificial
  CRISPR gRNA sequence
aagtggctggtctcagaacc

SEQ ID NO: 443169 - DNA, 20 bp, Artificial
  CRISPR gRNA sequence
gtctcagaacctcactttca

SEQ ID NO: 443170 - DNA, 20 bp, Artificial
  CRISPR gRNA sequence
agaacctcactttcagaaac

SEQ ID NO: 443171 - DNA, 20 bp, Artificial
  CRISPR gRNA sequence
actttcagaaacactgccct

SEQ ID NO: 443172 - DNA, 20 bp, Artificial
  CRISPR gRNA sequence
tcagaaacactgccctagga

SEQ ID NO: 443173 - DNA, 20 bp, Artificial
  CRISPR gRNA sequence
cagaaacactgccctaggag

SEQ ID NO: 443174 - DNA, 20 bp, Artificial
  CRISPR gRNA sequence
agaaacactgccctaggaga

SEQ ID NO: 443175 - DNA, 20 bp, Artificial
  CRISPR gRNA sequence
ccctaggagagaattgtggc

SEQ ID NO: 443176 - DNA, 20 bp, Artificial
  CRISPR gRNA sequence
ggagagaattgtggcccaat

SEQ ID NO: 443177 - DNA, 20 bp, Artificial
  CRISPR gRNA sequence
tggcccaattctgtgaacac

SEQ ID NO: 443178 - DNA, 20 bp, Artificial
  CRISPR gRNA sequence
tgtgaacacgggagaacagg

SEQ ID NO: 443179 - DNA, 20 bp, Artificial
  CRISPR gRNA sequence
tgaacacgggagaacagggc

SEQ ID NO: 443180 - DNA, 20 bp, Artificial
  CRISPR gRNA sequence
atggaaacagacaatcagaa

SEQ ID NO: 443181 - DNA, 20 bp, Artificial
  CRISPR gRNA sequence
gtcatggtcagccaggaaac

SEQ ID NO: 443182 - DNA, 20 bp, Artificial
  CRISPR gRNA sequence
ggctacttgcttgttcatca

SEQ ID NO: 443183 - DNA, 20 bp, Artificial
  CRISPR gRNA sequence
cttgcttgttcatcaacaaa

SEQ ID NO: 443184 - DNA, 20 bp, Artificial
  CRISPR gRNA sequence
gcttgttcatcaacaaaggg

SEQ ID NO: 443185 - DNA, 20 bp, Artificial
  CRISPR gRNA sequence
cttgttcatcaacaaaggga

SEQ ID NO: 443186 - DNA, 20 bp, Artificial
  CRISPR gRNA sequence
gttcatcaacaaagggaggc

SEQ ID NO: 443187 - DNA, 20 bp, Artificial
  CRISPR gRNA sequence
ttcatcaacaaagggaggct

SEQ ID NO: 443188 - DNA, 20 bp, Artificial
  CRISPR gRNA sequence
atcaacaaagggaggctctc

SEQ ID NO: 443189 - DNA, 20 bp, Artificial
  CRISPR gRNA sequence
tcctaacatacttctctttt

SEQ ID NO: 443190 - DNA, 20 bp, Artificial
  CRISPR gRNA sequence
ctaacatacttctcttttta

SEQ ID NO: 443191 - DNA, 20 bp, Artificial
  CRISPR gRNA sequence
acatacttctctttttaagc

SEQ ID NO: 443192 - DNA, 20 bp, Artificial
  CRISPR gRNA sequence
ctctttttaagcagcaagtg

SEQ ID NO: 443193 - DNA, 20 bp, Artificial
  CRISPR gRNA sequence
tctttttaagcagcaagtgc

SEQ ID NO: 443194 - DNA, 20 bp, Artificial
  CRISPR gRNA sequence
tttttaagcagcaagtgcac

SEQ ID NO: 443195 - DNA, 20 bp, Artificial
  CRISPR gRNA sequence
tttaagcagcaagtgcacag

SEQ ID NO: 443196 - DNA, 20 bp, Artificial
  CRISPR gRNA sequence
ttaagcagcaagtgcacagt

SEQ ID NO: 443197 - DNA, 20 bp, Artificial
  CRISPR gRNA sequence
taagcagcaagtgcacagta

SEQ ID NO: 443198 - DNA, 20 bp, Artificial
  CRISPR gRNA sequence
aagcagcaagtgcacagtaa

SEQ ID NO: 443199 - DNA, 20 bp, Artificial
  CRISPR gRNA sequence
agcagcaagtgcacagtaaa

SEQ ID NO: 443200 - DNA, 20 bp, Artificial
  CRISPR gRNA sequence
ggttaaataaggatcttgtg

SEQ ID NO: 443201 - DNA, 20 bp, Artificial
  CRISPR gRNA sequence
gttaaataaggatcttgtgt

SEQ ID NO: 443202 - DNA, 20 bp, Artificial
  CRISPR gRNA sequence
aataaggatcttgtgtattt

SEQ ID NO: 443203 - DNA, 20 bp, Artificial
  CRISPR gRNA sequence
gtgtatttgaaactactcat

SEQ ID NO: 443204 - DNA, 20 bp, Artificial
  CRISPR gRNA sequence
tgtatttgaaactactcatg

SEQ ID NO: 443205 - DNA, 20 bp, Artificial
  CRISPR gRNA sequence
gaaactactcatggagttgt

SEQ ID NO: 443206 - DNA, 20 bp, Artificial
  CRISPR gRNA sequence
aaactactcatggagttgtt

SEQ ID NO: 443207 - DNA, 20 bp, Artificial
  CRISPR gRNA sequence
ctcatggagttgttttaagg

SEQ ID NO: 443208 - DNA, 20 bp, Artificial
  CRISPR gRNA sequence
atggagttgttttaaggttt

SEQ ID NO: 443209 - DNA, 20 bp, Artificial
  CRISPR gRNA sequence
ttttaaggtttaaagttgtg

SEQ ID NO: 443210 - DNA, 20 bp, Artificial
  CRISPR gRNA sequence
taaggtttaaagttgtgaaa

SEQ ID NO: 443211 - DNA, 20 bp, Artificial
  CRISPR gRNA sequence
aaggtttaaagttgtgaaaa

SEQ ID NO: 443212 - DNA, 20 bp, Artificial
  CRISPR gRNA sequence
aggtttaaagttgtgaaaag

SEQ ID NO: 443213 - DNA, 20 bp, Artificial
  CRISPR gRNA sequence
aaagttgtgaaaagaaatta

SEQ ID NO: 443214 - DNA, 20 bp, Artificial
  CRISPR gRNA sequence
aagttgtgaaaagaaattaa

SEQ ID NO: 443215 - DNA, 20 bp, Artificial
  CRISPR gRNA sequence
tgaaaagaaattaaattttg

SEQ ID NO: 443216 - DNA, 20 bp, Artificial
  CRISPR gRNA sequence
aattttgggaccccaaactc

SEQ ID NO: 443217 - DNA, 20 bp, Artificial
  CRISPR gRNA sequence
tgggaccccaaactcattca

SEQ ID NO: 443218 - DNA, 20 bp, Artificial
  CRISPR gRNA sequence
gggaccccaaactcattcag

SEQ ID NO: 443219 - DNA, 20 bp, Artificial
  CRISPR gRNA sequence
ggaccccaaactcattcagt

SEQ ID NO: 443220 - DNA, 20 bp, Artificial
  CRISPR gRNA sequence
attcagtcaaagggaaaagt

SEQ ID NO: 443221 - DNA, 20 bp, Artificial
  CRISPR gRNA sequence
agtcaaagggaaaagtcaag

SEQ ID NO: 443222 - DNA, 20 bp, Artificial
  CRISPR gRNA sequence
ggaactgggtcacagaaacc

SEQ ID NO: 443223 - DNA, 20 bp, Artificial
  CRISPR gRNA sequence
ggtcacagaaacctgcctcc

SEQ ID NO: 443224 - DNA, 20 bp, Artificial
  CRISPR gRNA sequence
cctcctctttttgattcctg

SEQ ID NO: 443225 - DNA, 20 bp, Artificial
  CRISPR gRNA sequence
ctctttttgattcctgaata

SEQ ID NO: 443226 - DNA, 20 bp, Artificial
  CRISPR gRNA sequence
tttttgattcctgaataaga

SEQ ID NO: 443227 - DNA, 20 bp, Artificial
  CRISPR gRNA sequence
tttgattcctgaataagatg

SEQ ID NO: 443228 - DNA, 20 bp, Artificial
  CRISPR gRNA sequence
ttgattcctgaataagatgg

SEQ ID NO: 443229 - DNA, 20 bp, Artificial
  CRISPR gRNA sequence
tgattcctgaataagatggc

SEQ ID NO: 443230 - DNA, 20 bp, Artificial
  CRISPR gRNA sequence
gattcctgaataagatggct

SEQ ID NO: 443231 - DNA, 20 bp, Artificial
  CRISPR gRNA sequence
attcctgaataagatggcta

SEQ ID NO: 443232 - DNA, 20 bp, Artificial
  CRISPR gRNA sequence
ctgaataagatggctacagg

SEQ ID NO: 443233 - DNA, 20 bp, Artificial
  CRISPR gRNA sequence
aataagatggctacaggatg

SEQ ID NO: 443234 - DNA, 20 bp, Artificial
  CRISPR gRNA sequence
caggatgaaaggctgcatac

SEQ ID NO: 443235 - DNA, 20 bp, Artificial
  CRISPR gRNA sequence
catacctcccccatattttg

SEQ ID NO: 443236 - DNA, 20 bp, Artificial
  CRISPR gRNA sequence
ccccatattttgcccacaag

SEQ ID NO: 443237 - DNA, 20 bp, Artificial
  CRISPR gRNA sequence
tgcccacaaggaaattcctg

SEQ ID NO: 443238 - DNA, 20 bp, Artificial
  CRISPR gRNA sequence
gcccacaaggaaattcctgg

SEQ ID NO: 443239 - DNA, 20 bp, Artificial
  CRISPR gRNA sequence
cccacaaggaaattcctggt

SEQ ID NO: 443240 - DNA, 20 bp, Artificial
  CRISPR gRNA sequence
ctggtcagctgtgcaatgca

SEQ ID NO: 443241 - DNA, 20 bp, Artificial
  CRISPR gRNA sequence
gtcagctgtgcaatgcagat

SEQ ID NO: 443242 - DNA, 20 bp, Artificial
  CRISPR gRNA sequence
tgcaatgcagattgatagct

SEQ ID NO: 443243 - DNA, 20 bp, Artificial
  CRISPR gRNA sequence
atagctcatctttaccggtg

SEQ ID NO: 443244 - DNA, 20 bp, Artificial
  CRISPR gRNA sequence
atctttaccggtgcggtcac

SEQ ID NO: 443245 - DNA, 20 bp, Artificial
  CRISPR gRNA sequence
taccggtgcggtcaccctgg

SEQ ID NO: 443246 - DNA, 20 bp, Artificial
  CRISPR gRNA sequence
accggtgcggtcaccctggc

SEQ ID NO: 443247 - DNA, 20 bp, Artificial
  CRISPR gRNA sequence
ccggtgcggtcaccctggcc

SEQ ID NO: 443248 - DNA, 20 bp, Artificial
  CRISPR gRNA sequence
gccagacacaaatgcgttat

SEQ ID NO: 443249 - DNA, 20 bp, Artificial
  CRISPR gRNA sequence
tctgattgtttccctacccc

SEQ ID NO: 443250 - DNA, 20 bp, Artificial
  CRISPR gRNA sequence
attgtttccctaccccattt

SEQ ID NO: 443251 - DNA, 20 bp, Artificial
  CRISPR gRNA sequence
tttccctaccccattttgtc

SEQ ID NO: 443252 - DNA, 20 bp, Artificial
  CRISPR gRNA sequence
ccctaccccattttgtctgt

SEQ ID NO: 443253 - DNA, 20 bp, Artificial
  CRISPR gRNA sequence
cctaccccattttgtctgtg

SEQ ID NO: 443254 - DNA, 20 bp, Artificial
  CRISPR gRNA sequence
ccccattttgtctgtgttat

SEQ ID NO: 443255 - DNA, 20 bp, Artificial
  CRISPR gRNA sequence
tgtctgtgttatctaatgta

SEQ ID NO: 443256 - DNA, 20 bp, Artificial
  CRISPR gRNA sequence
gtctgtgttatctaatgtaa

SEQ ID NO: 443257 - DNA, 20 bp, Artificial
  CRISPR gRNA sequence
tctgtgttatctaatgtaaa

SEQ ID NO: 443258 - DNA, 20 bp, Artificial
  CRISPR gRNA sequence
tgttatctaatgtaaaatgc

SEQ ID NO: 443259 - DNA, 20 bp, Artificial
  CRISPR gRNA sequence
tctaatgtaaaatgcagatt

SEQ ID NO: 443260 - DNA, 20 bp, Artificial
  CRISPR gRNA sequence
atgtaaaatgcagattcccc

SEQ ID NO: 443261 - DNA, 20 bp, Artificial
  CRISPR gRNA sequence
cccatatttttcctctgccc

SEQ ID NO: 443262 - DNA, 20 bp, Artificial
  CRISPR gRNA sequence
ttcctctgcccccccccctt

SEQ ID NO: 443263 - DNA, 20 bp, Artificial
  CRISPR gRNA sequence
tcctctgccccccccccttt

SEQ ID NO: 443264 - DNA, 20 bp, Artificial
  CRISPR gRNA sequence
cctctgcccccccccctttt

SEQ ID NO: 443265 - DNA, 20 bp, Artificial
  CRISPR gRNA sequence
ctctgccccccccccttttt

SEQ ID NO: 443266 - DNA, 20 bp, Artificial
  CRISPR gRNA sequence
tgccccccccccttttttat

SEQ ID NO: 443267 - DNA, 20 bp, Artificial
  CRISPR gRNA sequence
ccccccccccttttttatgt

SEQ ID NO: 443268 - DNA, 20 bp, Artificial
  CRISPR gRNA sequence
ttttatgtgaaaactgagtg

SEQ ID NO: 443269 - DNA, 20 bp, Artificial
  CRISPR gRNA sequence
tttatgtgaaaactgagtgc

SEQ ID NO: 443270 - DNA, 20 bp, Artificial
  CRISPR gRNA sequence
ttatgtgaaaactgagtgct

SEQ ID NO: 443271 - DNA, 20 bp, Artificial
  CRISPR gRNA sequence
tatgtgaaaactgagtgctt

SEQ ID NO: 443272 - DNA, 20 bp, Artificial
  CRISPR gRNA sequence
atgtgaaaactgagtgcttc

SEQ ID NO: 443273 - DNA, 20 bp, Artificial
  CRISPR gRNA sequence
tgtgaaaactgagtgcttct

SEQ ID NO: 443274 - DNA, 20 bp, Artificial
  CRISPR gRNA sequence
agtgcttctcaatatcccac

SEQ ID NO: 443275 - DNA, 20 bp, Artificial
  CRISPR gRNA sequence
ctcaatatcccaccttgtcc

SEQ ID NO: 443276 - DNA, 20 bp, Artificial
  CRISPR gRNA sequence
tcaatatcccaccttgtccc

SEQ ID NO: 443277 - DNA, 20 bp, Artificial
  CRISPR gRNA sequence
aatatcccaccttgtcccct

SEQ ID NO: 443278 - DNA, 20 bp, Artificial
  CRISPR gRNA sequence
gtcccctttaaatctggagc

SEQ ID NO: 443279 - DNA, 20 bp, Artificial
  CRISPR gRNA sequence
tcccctttaaatctggagcc

SEQ ID NO: 443280 - DNA, 20 bp, Artificial
  CRISPR gRNA sequence
taaatctggagccctcaaaa

SEQ ID NO: 443281 - DNA, 20 bp, Artificial
  CRISPR gRNA sequence
aaatctggagccctcaaaat

SEQ ID NO: 443282 - DNA, 20 bp, Artificial
  CRISPR gRNA sequence
aatctggagccctcaaaatc

SEQ ID NO: 443283 - DNA, 20 bp, Artificial
  CRISPR gRNA sequence
gagccctcaaaatcatcttc

SEQ ID NO: 443284 - DNA, 20 bp, Artificial
  CRISPR gRNA sequence
aaaatcatcttctgagaaag

SEQ ID NO: 443285 - DNA, 20 bp, Artificial
  CRISPR gRNA sequence
ctgagaaagtcatagacctg

SEQ ID NO: 443286 - DNA, 20 bp, Artificial
  CRISPR gRNA sequence
tgagaaagtcatagacctgt

SEQ ID NO: 443287 - DNA, 20 bp, Artificial
  CRISPR gRNA sequence
agaaagtcatagacctgtct

SEQ ID NO: 443288 - DNA, 20 bp, Artificial
  CRISPR gRNA sequence
tctctcaggtgcctccttaa

SEQ ID NO: 443289 - DNA, 20 bp, Artificial
  CRISPR gRNA sequence
tcaggtgcctccttaacttt

SEQ ID NO: 443290 - DNA, 20 bp, Artificial
  CRISPR gRNA sequence
aggtgcctccttaactttgg

SEQ ID NO: 443291 - DNA, 20 bp, Artificial
  CRISPR gRNA sequence
cttaactttggcaaacaaat

SEQ ID NO: 443292 - DNA, 20 bp, Artificial
  CRISPR gRNA sequence
aactttggcaaacaaatctc

SEQ ID NO: 443293 - DNA, 20 bp, Artificial
  CRISPR gRNA sequence
actttggcaaacaaatctcc

SEQ ID NO: 443294 - DNA, 20 bp, Artificial
  CRISPR gRNA sequence
tggcaaacaaatctcctaaa

SEQ ID NO: 443295 - DNA, 20 bp, Artificial
  CRISPR gRNA sequence
ggcaaacaaatctcctaaaa

SEQ ID NO: 443296 - DNA, 20 bp, Artificial
  CRISPR gRNA sequence
gcaaacaaatctcctaaaat

SEQ ID NO: 443297 - DNA, 20 bp, Artificial
  CRISPR gRNA sequence
ctaaaatgattgagacttgt

SEQ ID NO: 443298 - DNA, 20 bp, Artificial
  CRISPR gRNA sequence
aaatgattgagacttgtctc

SEQ ID NO: 443299 - DNA, 20 bp, Artificial
  CRISPR gRNA sequence
agacttgtctcctcattttc

SEQ ID NO: 443300 - DNA, 20 bp, Artificial
  CRISPR gRNA sequence
gtctcctcattttcctcaaa

SEQ ID NO: 443301 - DNA, 20 bp, Artificial
  CRISPR gRNA sequence
tctcctcattttcctcaaat

SEQ ID NO: 443302 - DNA, 20 bp, Artificial
  CRISPR gRNA sequence
ctcattttcctcaaatgaca

SEQ ID NO: 443303 - DNA, 20 bp, Artificial
  CRISPR gRNA sequence
attttcctcaaatgacaaag

SEQ ID NO: 443304 - DNA, 20 bp, Artificial
  CRISPR gRNA sequence
tcctcaaatgacaaagttaa

SEQ ID NO: 443305 - DNA, 20 bp, Artificial
  CRISPR gRNA sequence
cctcaaatgacaaagttaat

SEQ ID NO: 443306 - DNA, 20 bp, Artificial
  CRISPR gRNA sequence
ctcaaatgacaaagttaatt

SEQ ID NO: 443307 - DNA, 20 bp, Artificial
  CRISPR gRNA sequence
aaatgacaaagttaattcca

SEQ ID NO: 443308 - DNA, 20 bp, Artificial
  CRISPR gRNA sequence
attccattaaaaaaaaacta

SEQ ID NO: 443309 - DNA, 20 bp, Artificial
  CRISPR gRNA sequence
cattaaaaaaaaactatata

SEQ ID NO: 443310 - DNA, 20 bp, Artificial
  CRISPR gRNA sequence
aaaaaaaactatatatattt

SEQ ID NO: 443311 - DNA, 20 bp, Artificial
  CRISPR gRNA sequence
tatatattttatatatgata

SEQ ID NO: 443312 - DNA, 20 bp, Artificial
  CRISPR gRNA sequence
tatatatgataaaacattca

SEQ ID NO: 443313 - DNA, 20 bp, Artificial
  CRISPR gRNA sequence
atatatgataaaacattcat

SEQ ID NO: 443314 - DNA, 20 bp, Artificial
  CRISPR gRNA sequence
tatatgataaaacattcatt

SEQ ID NO: 443315 - DNA, 20 bp, Artificial
  CRISPR gRNA sequence
attatatattttcttttgat

SEQ ID NO: 443316 - DNA, 20 bp, Artificial
  CRISPR gRNA sequence
tatattttcttttgattttt

SEQ ID NO: 443317 - DNA, 20 bp, Artificial
  CRISPR gRNA sequence
tcttttgattttttatgtcc

SEQ ID NO: 443318 - DNA, 20 bp, Artificial
  CRISPR gRNA sequence
cttttgattttttatgtccc

SEQ ID NO: 443319 - DNA, 20 bp, Artificial
  CRISPR gRNA sequence
ttttgattttttatgtcccc

SEQ ID NO: 443320 - DNA, 20 bp, Artificial
  CRISPR gRNA sequence
ttgattttttatgtcccctt

SEQ ID NO: 443321 - DNA, 20 bp, Artificial
  CRISPR gRNA sequence
tgattttttatgtccccttt

SEQ ID NO: 443322 - DNA, 20 bp, Artificial
  CRISPR gRNA sequence
gattttttatgtcccctttg

SEQ ID NO: 443323 - DNA, 20 bp, Artificial
  CRISPR gRNA sequence
attttttatgtcccctttgt

SEQ ID NO: 443324 - DNA, 20 bp, Artificial
  CRISPR gRNA sequence
tttatgtcccctttgttttc

SEQ ID NO: 443325 - DNA, 20 bp, Artificial
  CRISPR gRNA sequence
ttatgtcccctttgttttca

SEQ ID NO: 443326 - DNA, 20 bp, Artificial
  CRISPR gRNA sequence
tatgtcccctttgttttcat

SEQ ID NO: 443327 - DNA, 20 bp, Artificial
  CRISPR gRNA sequence
atgtcccctttgttttcata

SEQ ID NO: 443328 - DNA, 20 bp, Artificial
  CRISPR gRNA sequence
tgtcccctttgttttcatat

SEQ ID NO: 443329 - DNA, 20 bp, Artificial
  CRISPR gRNA sequence
tgttttcatatgactcaact

SEQ ID NO: 443330 - DNA, 20 bp, Artificial
  CRISPR gRNA sequence
gttttcatatgactcaacta

SEQ ID NO: 443331 - DNA, 20 bp, Artificial
  CRISPR gRNA sequence
ttttcatatgactcaactac

SEQ ID NO: 443332 - DNA, 20 bp, Artificial
  CRISPR gRNA sequence
tcatatgactcaactacagt

SEQ ID NO: 443333 - DNA, 20 bp, Artificial
  CRISPR gRNA sequence
catatgactcaactacagta

SEQ ID NO: 443334 - DNA, 20 bp, Artificial
  CRISPR gRNA sequence
atatgactcaactacagtaa

SEQ ID NO: 443335 - DNA, 20 bp, Artificial
  CRISPR gRNA sequence
aactacagtaaaaacattca

SEQ ID NO: 443336 - DNA, 20 bp, Artificial
  CRISPR gRNA sequence
cagtaaaaacattcaaacac

SEQ ID NO: 443337 - DNA, 20 bp, Artificial
  CRISPR gRNA sequence
aaacactatcaaaggtgtat

SEQ ID NO: 443338 - DNA, 20 bp, Artificial
  CRISPR gRNA sequence
tcaaaggtgtatgaaaaagt

SEQ ID NO: 443339 - DNA, 20 bp, Artificial
  CRISPR gRNA sequence
taatcccagcactttgggag

SEQ ID NO: 443340 - DNA, 20 bp, Artificial
  CRISPR gRNA sequence
tgggaggctgagatgggcag

SEQ ID NO: 443341 - DNA, 20 bp, Artificial
  CRISPR gRNA sequence
gggaggctgagatgggcaga

SEQ ID NO: 443342 - DNA, 20 bp, Artificial
  CRISPR gRNA sequence
ggaggctgagatgggcagat

SEQ ID NO: 443343 - DNA, 20 bp, Artificial
  CRISPR gRNA sequence
agatgggcagattacttgag

SEQ ID NO: 443344 - DNA, 20 bp, Artificial
  CRISPR gRNA sequence
cttgaggccatgagtttgag

SEQ ID NO: 443345 - DNA, 20 bp, Artificial
  CRISPR gRNA sequence
gaggccatgagtttgagacc

SEQ ID NO: 443346 - DNA, 20 bp, Artificial
  CRISPR gRNA sequence
aggccatgagtttgagacca

SEQ ID NO: 443347 - DNA, 20 bp, Artificial
  CRISPR gRNA sequence
gagaccagcctgaccaacat

SEQ ID NO: 443348 - DNA, 20 bp, Artificial
  CRISPR gRNA sequence
agaccagcctgaccaacatg

SEQ ID NO: 443349 - DNA, 20 bp, Artificial
  CRISPR gRNA sequence
accaacatggtaaaaccctg

SEQ ID NO: 443350 - DNA, 20 bp, Artificial
  CRISPR gRNA sequence
tctctactaaaaattaaaaa

SEQ ID NO: 443351 - DNA, 20 bp, Artificial
  CRISPR gRNA sequence
tactaaaaattaaaaacatt

SEQ ID NO: 443352 - DNA, 20 bp, Artificial
  CRISPR gRNA sequence
ctaaaaattaaaaacattag

SEQ ID NO: 443353 - DNA, 20 bp, Artificial
  CRISPR gRNA sequence
aaaattaaaaacattagctg

SEQ ID NO: 443354 - DNA, 20 bp, Artificial
  CRISPR gRNA sequence
aaaacattagctgggtgtgg

SEQ ID NO: 443355 - DNA, 20 bp, Artificial
  CRISPR gRNA sequence
gctgggtgtggtggtgcacg

SEQ ID NO: 443356 - DNA, 20 bp, Artificial
  CRISPR gRNA sequence
ggtgtggtggtgcacgcctg

SEQ ID NO: 443357 - DNA, 20 bp, Artificial
  CRISPR gRNA sequence
tgatcccagctactccggtg

SEQ ID NO: 443358 - DNA, 20 bp, Artificial
  CRISPR gRNA sequence
ctccggtgcctaaggcagga

SEQ ID NO: 443359 - DNA, 20 bp, Artificial
  CRISPR gRNA sequence
cggtgcctaaggcaggagaa

SEQ ID NO: 443360 - DNA, 20 bp, Artificial
  CRISPR gRNA sequence
aggcaggagaatcacttgaa

SEQ ID NO: 443361 - DNA, 20 bp, Artificial
  CRISPR gRNA sequence
gaacctgggaggcggagatt

SEQ ID NO: 443362 - DNA, 20 bp, Artificial
  CRISPR gRNA sequence
aacctgggaggcggagattg

SEQ ID NO: 443363 - DNA, 20 bp, Artificial
  CRISPR gRNA sequence
ggaggcggagattgcagtga

SEQ ID NO: 443364 - DNA, 20 bp, Artificial
  CRISPR gRNA sequence
cagtgagccaaaatggtgcc

SEQ ID NO: 443365 - DNA, 20 bp, Artificial
  CRISPR gRNA sequence
cactccagcctgggcaatag

SEQ ID NO: 443366 - DNA, 20 bp, Artificial
  CRISPR gRNA sequence
cagcctgggcaatagagtga

SEQ ID NO: 443367 - DNA, 20 bp, Artificial
  CRISPR gRNA sequence
ggcaatagagtgagactcca

SEQ ID NO: 443368 - DNA, 20 bp, Artificial
  CRISPR gRNA sequence
catctcaattgaaaaaaaga

SEQ ID NO: 443369 - DNA, 20 bp, Artificial
  CRISPR gRNA sequence
aattgaaaaaaagaaaaaga

SEQ ID NO: 443370 - DNA, 20 bp, Artificial
  CRISPR gRNA sequence
aaaaaaagaaaaagaaagaa

SEQ ID NO: 443371 - DNA, 20 bp, Artificial
  CRISPR gRNA sequence
actctcccaactctttacca

SEQ ID NO: 443372 - DNA, 20 bp, Artificial
  CRISPR gRNA sequence
ctctcccaactctttaccat

SEQ ID NO: 443373 - DNA, 20 bp, Artificial
  CRISPR gRNA sequence
tcccaactctttaccattcc

SEQ ID NO: 443374 - DNA, 20 bp, Artificial
  CRISPR gRNA sequence
ccaactctttaccattccct

SEQ ID NO: 443375 - DNA, 20 bp, Artificial
  CRISPR gRNA sequence
tttaccattccctggttcct

SEQ ID NO: 443376 - DNA, 20 bp, Artificial
  CRISPR gRNA sequence
taccattccctggttccttt

SEQ ID NO: 443377 - DNA, 20 bp, Artificial
  CRISPR gRNA sequence
accattccctggttcctttt

SEQ ID NO: 443378 - DNA, 20 bp, Artificial
  CRISPR gRNA sequence
ccattccctggttccttttc

SEQ ID NO: 443379 - DNA, 20 bp, Artificial
  CRISPR gRNA sequence
cctggttccttttcctagag

SEQ ID NO: 443380 - DNA, 20 bp, Artificial
  CRISPR gRNA sequence
gttccttttcctagagctta

SEQ ID NO: 443381 - DNA, 20 bp, Artificial
  CRISPR gRNA sequence
cttttcctagagcttataca

SEQ ID NO: 443382 - DNA, 20 bp, Artificial
  CRISPR gRNA sequence
ttcctagagcttatacatta

SEQ ID NO: 443383 - DNA, 20 bp, Artificial
  CRISPR gRNA sequence
tcctagagcttatacattaa

SEQ ID NO: 443384 - DNA, 20 bp, Artificial
  CRISPR gRNA sequence
cctagagcttatacattaag

SEQ ID NO: 443385 - DNA, 20 bp, Artificial
  CRISPR gRNA sequence
ctagagcttatacattaaga

SEQ ID NO: 443386 - DNA, 20 bp, Artificial
  CRISPR gRNA sequence
gagcttatacattaagaaat

SEQ ID NO: 443387 - DNA, 20 bp, Artificial
  CRISPR gRNA sequence
atacattaagaaatgtccac

SEQ ID NO: 443388 - DNA, 20 bp, Artificial
  CRISPR gRNA sequence
tacattaagaaatgtccaca

SEQ ID NO: 443389 - DNA, 20 bp, Artificial
  CRISPR gRNA sequence
agaaatgtccacatattcct

SEQ ID NO: 443390 - DNA, 20 bp, Artificial
  CRISPR gRNA sequence
ctgctccccgacaatgcaca

SEQ ID NO: 443391 - DNA, 20 bp, Artificial
  CRISPR gRNA sequence
ctccccgacaatgcacacac

SEQ ID NO: 443392 - DNA, 20 bp, Artificial
  CRISPR gRNA sequence
cccgacaatgcacacacaca

SEQ ID NO: 443393 - DNA, 20 bp, Artificial
  CRISPR gRNA sequence
atatatgcattattctgcaa

SEQ ID NO: 443394 - DNA, 20 bp, Artificial
  CRISPR gRNA sequence
ttctgcaactttttttcttt

SEQ ID NO: 443395 - DNA, 20 bp, Artificial
  CRISPR gRNA sequence
tgcaactttttttctttaat

SEQ ID NO: 443396 - DNA, 20 bp, Artificial
  CRISPR gRNA sequence
caactttttttctttaataa

SEQ ID NO: 443397 - DNA, 20 bp, Artificial
  CRISPR gRNA sequence
tttttctttaataacattat

SEQ ID NO: 443398 - DNA, 20 bp, Artificial
  CRISPR gRNA sequence
ttttctttaataacattata

SEQ ID NO: 443399 - DNA, 20 bp, Artificial
  CRISPR gRNA sequence
tttctttaataacattataa

SEQ ID NO: 443400 - DNA, 20 bp, Artificial
  CRISPR gRNA sequence
ttctttaataacattataat

SEQ ID NO: 443401 - DNA, 20 bp, Artificial
  CRISPR gRNA sequence
tctttaataacattataatt

SEQ ID NO: 443402 - DNA, 20 bp, Artificial
  CRISPR gRNA sequence
ctttaataacattataattt

SEQ ID NO: 443403 - DNA, 20 bp, Artificial
  CRISPR gRNA sequence
tttaataacattataatttt

SEQ ID NO: 443404 - DNA, 20 bp, Artificial
  CRISPR gRNA sequence
taataacattataattttga

SEQ ID NO: 443405 - DNA, 20 bp, Artificial
  CRISPR gRNA sequence
aataacattataattttgag

SEQ ID NO: 443406 - DNA, 20 bp, Artificial
  CRISPR gRNA sequence
ataacattataattttgaga

SEQ ID NO: 443407 - DNA, 20 bp, Artificial
  CRISPR gRNA sequence
taattttgagacattctata

SEQ ID NO: 443408 - DNA, 20 bp, Artificial
  CRISPR gRNA sequence
tgagacattctataccagta

SEQ ID NO: 443409 - DNA, 20 bp, Artificial
  CRISPR gRNA sequence
gagacattctataccagtat

SEQ ID NO: 443410 - DNA, 20 bp, Artificial
  CRISPR gRNA sequence
agacattctataccagtatg

SEQ ID NO: 443411 - DNA, 20 bp, Artificial
  CRISPR gRNA sequence
tataccagtatgttttgtca

SEQ ID NO: 443412 - DNA, 20 bp, Artificial
  CRISPR gRNA sequence
taccagtatgttttgtcaga

SEQ ID NO: 443413 - DNA, 20 bp, Artificial
  CRISPR gRNA sequence
tgtcagactcactgtttgta

SEQ ID NO: 443414 - DNA, 20 bp, Artificial
  CRISPR gRNA sequence
gtcagactcactgtttgtat

SEQ ID NO: 443415 - DNA, 20 bp, Artificial
  CRISPR gRNA sequence
tcagactcactgtttgtatc

SEQ ID NO: 443416 - DNA, 20 bp, Artificial
  CRISPR gRNA sequence
actgtttgtatcatgattat

SEQ ID NO: 443417 - DNA, 20 bp, Artificial
  CRISPR gRNA sequence
tttgtatcatgattatatca

SEQ ID NO: 443418 - DNA, 20 bp, Artificial
  CRISPR gRNA sequence
gtatcatgattatatcacat

SEQ ID NO: 443419 - DNA, 20 bp, Artificial
  CRISPR gRNA sequence
tatcatgattatatcacatt

SEQ ID NO: 443420 - DNA, 20 bp, Artificial
  CRISPR gRNA sequence
tatcacatttatttacccac

SEQ ID NO: 443421 - DNA, 20 bp, Artificial
  CRISPR gRNA sequence
atttacccactccctcatcg

SEQ ID NO: 443422 - DNA, 20 bp, Artificial
  CRISPR gRNA sequence
tttacccactccctcatcga

SEQ ID NO: 443423 - DNA, 20 bp, Artificial
  CRISPR gRNA sequence
acccactccctcatcgacgg

SEQ ID NO: 443424 - DNA, 20 bp, Artificial
  CRISPR gRNA sequence
cccactccctcatcgacgga

SEQ ID NO: 443425 - DNA, 20 bp, Artificial
  CRISPR gRNA sequence
cctcatcgacggacatttag

SEQ ID NO: 443426 - DNA, 20 bp, Artificial
  CRISPR gRNA sequence
atcgacggacatttaggttg

SEQ ID NO: 443427 - DNA, 20 bp, Artificial
  CRISPR gRNA sequence
aggttgcttccaagcttttg

SEQ ID NO: 443428 - DNA, 20 bp, Artificial
  CRISPR gRNA sequence
ggttgcttccaagcttttgc

SEQ ID NO: 443429 - DNA, 20 bp, Artificial
  CRISPR gRNA sequence
cttccaagcttttgctatta

SEQ ID NO: 443430 - DNA, 20 bp, Artificial
  CRISPR gRNA sequence
ccaagcttttgctattacaa

SEQ ID NO: 443431 - DNA, 20 bp, Artificial
  CRISPR gRNA sequence
caagcttttgctattacaaa

SEQ ID NO: 443432 - DNA, 20 bp, Artificial
  CRISPR gRNA sequence
ttgctattacaaacaacatt

SEQ ID NO: 443433 - DNA, 20 bp, Artificial
  CRISPR gRNA sequence
tgctattacaaacaacatta

SEQ ID NO: 443434 - DNA, 20 bp, Artificial
  CRISPR gRNA sequence
gctattacaaacaacattac

SEQ ID NO: 443435 - DNA, 20 bp, Artificial
  CRISPR gRNA sequence
ctattacaaacaacattaca

SEQ ID NO: 443436 - DNA, 20 bp, Artificial
  CRISPR gRNA sequence
ttacaaacaacattacaatg

SEQ ID NO: 443437 - DNA, 20 bp, Artificial
  CRISPR gRNA sequence
caaacaacattacaatggcc

SEQ ID NO: 443438 - DNA, 20 bp, Artificial
  CRISPR gRNA sequence
caatggccatccttgtatct

SEQ ID NO: 443439 - DNA, 20 bp, Artificial
  CRISPR gRNA sequence
gtatctctcccttgtcctct

SEQ ID NO: 443440 - DNA, 20 bp, Artificial
  CRISPR gRNA sequence
tatctctcccttgtcctctg

SEQ ID NO: 443441 - DNA, 20 bp, Artificial
  CRISPR gRNA sequence
tcccttgtcctctgtacagc

SEQ ID NO: 443442 - DNA, 20 bp, Artificial
  CRISPR gRNA sequence
ccttgtcctctgtacagcac

SEQ ID NO: 443443 - DNA, 20 bp, Artificial
  CRISPR gRNA sequence
gtcctctgtacagcaccatt

SEQ ID NO: 443444 - DNA, 20 bp, Artificial
  CRISPR gRNA sequence
tcctctgtacagcaccatta

SEQ ID NO: 443445 - DNA, 20 bp, Artificial
  CRISPR gRNA sequence
tgtacagcaccattatgtca

SEQ ID NO: 443446 - DNA, 20 bp, Artificial
  CRISPR gRNA sequence
tacagcaccattatgtcatt

SEQ ID NO: 443447 - DNA, 20 bp, Artificial
  CRISPR gRNA sequence
tgtcattgtaaatatccatg

SEQ ID NO: 443448 - DNA, 20 bp, Artificial
  CRISPR gRNA sequence
taaatatccatgccgagact

SEQ ID NO: 443449 - DNA, 20 bp, Artificial
  CRISPR gRNA sequence
acttgtaagtagtagcagca

SEQ ID NO: 443450 - DNA, 20 bp, Artificial
  CRISPR gRNA sequence
cttgtaagtagtagcagcag

SEQ ID NO: 443451 - DNA, 20 bp, Artificial
  CRISPR gRNA sequence
gtaagtagtagcagcagcag

SEQ ID NO: 443452 - DNA, 20 bp, Artificial
  CRISPR gRNA sequence
taagtagtagcagcagcagc

SEQ ID NO: 443453 - DNA, 20 bp, Artificial
  CRISPR gRNA sequence
gcagaagaaaagtcagagga

SEQ ID NO: 443454 - DNA, 20 bp, Artificial
  CRISPR gRNA sequence
cagaagaaaagtcagaggac

SEQ ID NO: 443455 - DNA, 20 bp, Artificial
  CRISPR gRNA sequence
tgttaggcacagttttaact

SEQ ID NO: 443456 - DNA, 20 bp, Artificial
  CRISPR gRNA sequence
ttaggcacagttttaactct

SEQ ID NO: 443457 - DNA, 20 bp, Artificial
  CRISPR gRNA sequence
ggcacagttttaactctcca

SEQ ID NO: 443458 - DNA, 20 bp, Artificial
  CRISPR gRNA sequence
taactctccaaatggactgg

SEQ ID NO: 443459 - DNA, 20 bp, Artificial
  CRISPR gRNA sequence
aactctccaaatggactggg

SEQ ID NO: 443460 - DNA, 20 bp, Artificial
  CRISPR gRNA sequence
actctccaaatggactgggt

SEQ ID NO: 443461 - DNA, 20 bp, Artificial
  CRISPR gRNA sequence
tccaaatggactgggtactt

SEQ ID NO: 443462 - DNA, 20 bp, Artificial
  CRISPR gRNA sequence
caaatggactgggtacttct

SEQ ID NO: 443463 - DNA, 20 bp, Artificial
  CRISPR gRNA sequence
ggtacttcttccaactgtct

SEQ ID NO: 443464 - DNA, 20 bp, Artificial
  CRISPR gRNA sequence
cttccaactgtctactccac

SEQ ID NO: 443465 - DNA, 20 bp, Artificial
  CRISPR gRNA sequence
ttccaactgtctactccaca

SEQ ID NO: 443466 - DNA, 20 bp, Artificial
  CRISPR gRNA sequence
ccaactgtctactccacaat

SEQ ID NO: 443467 - DNA, 20 bp, Artificial
  CRISPR gRNA sequence
caactgtctactccacaatc

SEQ ID NO: 443468 - DNA, 20 bp, Artificial
  CRISPR gRNA sequence
tctactccacaatcacatga

SEQ ID NO: 443469 - DNA, 20 bp, Artificial
  CRISPR gRNA sequence
ctccacaatcacatgagcag

SEQ ID NO: 443470 - DNA, 20 bp, Artificial
  CRISPR gRNA sequence
cacaatcacatgagcagtag

SEQ ID NO: 443471 - DNA, 20 bp, Artificial
  CRISPR gRNA sequence
agtgctagctcagcacaccc

SEQ ID NO: 443472 - DNA, 20 bp, Artificial
  CRISPR gRNA sequence
gctcagcacacccgggtgtc

SEQ ID NO: 443473 - DNA, 20 bp, Artificial
  CRISPR gRNA sequence
agcacacccgggtgtctgat

SEQ ID NO: 443474 - DNA, 20 bp, Artificial
  CRISPR gRNA sequence
attgccagtgattcttatag

SEQ ID NO: 443475 - DNA, 20 bp, Artificial
  CRISPR gRNA sequence
ccagtgattcttatagtaac

SEQ ID NO: 443476 - DNA, 20 bp, Artificial
  CRISPR gRNA sequence
ttatagtaacactgccaggt

SEQ ID NO: 443477 - DNA, 20 bp, Artificial
  CRISPR gRNA sequence
atagtaacactgccaggtct

SEQ ID NO: 443478 - DNA, 20 bp, Artificial
  CRISPR gRNA sequence
tagtaacactgccaggtcta

SEQ ID NO: 443479 - DNA, 20 bp, Artificial
  CRISPR gRNA sequence
ccaggtctacagtcacatta

SEQ ID NO: 443480 - DNA, 20 bp, Artificial
  CRISPR gRNA sequence
cagtcacattaaaggaaacc

SEQ ID NO: 443481 - DNA, 20 bp, Artificial
  CRISPR gRNA sequence
aaggaaaccaaagttctctg

SEQ ID NO: 443482 - DNA, 20 bp, Artificial
  CRISPR gRNA sequence
tctgtcatgccacactacac

SEQ ID NO: 443483 - DNA, 20 bp, Artificial
  CRISPR gRNA sequence
tgtcatgccacactacacac

SEQ ID NO: 443484 - DNA, 20 bp, Artificial
  CRISPR gRNA sequence
tcatgccacactacacacat

SEQ ID NO: 443485 - DNA, 20 bp, Artificial
  CRISPR gRNA sequence
cacacatcctgtaagtgttc

SEQ ID NO: 443486 - DNA, 20 bp, Artificial
  CRISPR gRNA sequence
taagtgttctgatgtctgtc

SEQ ID NO: 443487 - DNA, 20 bp, Artificial
  CRISPR gRNA sequence
tgatgtctgtcctgtgatat

SEQ ID NO: 443488 - DNA, 20 bp, Artificial
  CRISPR gRNA sequence
atgtctgtcctgtgatatca

SEQ ID NO: 443489 - DNA, 20 bp, Artificial
  CRISPR gRNA sequence
tcctgtgatatcaacaaaga

SEQ ID NO: 443490 - DNA, 20 bp, Artificial
  CRISPR gRNA sequence
tgatatcaacaaagaggaag

SEQ ID NO: 443491 - DNA, 20 bp, Artificial
  CRISPR gRNA sequence
cagtggaagaaaacgctact

SEQ ID NO: 443492 - DNA, 20 bp, Artificial
  CRISPR gRNA sequence
agtggaagaaaacgctactc

SEQ ID NO: 443493 - DNA, 20 bp, Artificial
  CRISPR gRNA sequence
ctcagtcatggcacataaag

SEQ ID NO: 443494 - DNA, 20 bp, Artificial
  CRISPR gRNA sequence
agtcatggcacataaagaga

SEQ ID NO: 443495 - DNA, 20 bp, Artificial
  CRISPR gRNA sequence
ttagagggttctctttatgt

SEQ ID NO: 443496 - DNA, 20 bp, Artificial
  CRISPR gRNA sequence
gagggttctctttatgtgcc

SEQ ID NO: 443497 - DNA, 20 bp, Artificial
  CRISPR gRNA sequence
tctttatgtgccatgactga

SEQ ID NO: 443498 - DNA, 20 bp, Artificial
  CRISPR gRNA sequence
tttatgtgccatgactgagt

SEQ ID NO: 443499 - DNA, 20 bp, Artificial
  CRISPR gRNA sequence
tatgtgccatgactgagtag

SEQ ID NO: 443500 - DNA, 20 bp, Artificial
  CRISPR gRNA sequence
atgtgccatgactgagtagc

SEQ ID NO: 443501 - DNA, 20 bp, Artificial
  CRISPR gRNA sequence
tgtgccatgactgagtagcg

SEQ ID NO: 443502 - DNA, 20 bp, Artificial
  CRISPR gRNA sequence
agtagcgttttcttccactg

SEQ ID NO: 443503 - DNA, 20 bp, Artificial
  CRISPR gRNA sequence
tcttccactgaagtattgct

SEQ ID NO: 443504 - DNA, 20 bp, Artificial
  CRISPR gRNA sequence
cttccactgaagtattgctt

SEQ ID NO: 443505 - DNA, 20 bp, Artificial
  CRISPR gRNA sequence
ttccactgaagtattgcttc

SEQ ID NO: 443506 - DNA, 20 bp, Artificial
  CRISPR gRNA sequence
ccactgaagtattgcttcct

SEQ ID NO: 443507 - DNA, 20 bp, Artificial
  CRISPR gRNA sequence
cactgaagtattgcttcctc

SEQ ID NO: 443508 - DNA, 20 bp, Artificial
  CRISPR gRNA sequence
aagtattgcttcctctttgt

SEQ ID NO: 443509 - DNA, 20 bp, Artificial
  CRISPR gRNA sequence
cttcctctttgttgatatca

SEQ ID NO: 443510 - DNA, 20 bp, Artificial
  CRISPR gRNA sequence
cctctttgttgatatcacag

SEQ ID NO: 443511 - DNA, 20 bp, Artificial
  CRISPR gRNA sequence
ctctttgttgatatcacagg

SEQ ID NO: 443512 - DNA, 20 bp, Artificial
  CRISPR gRNA sequence
tttgttgatatcacaggaca

SEQ ID NO: 443513 - DNA, 20 bp, Artificial
  CRISPR gRNA sequence
tgttgatatcacaggacaga

SEQ ID NO: 443514 - DNA, 20 bp, Artificial
  CRISPR gRNA sequence
gttgatatcacaggacagac

SEQ ID NO: 443515 - DNA, 20 bp, Artificial
  CRISPR gRNA sequence
ttgatatcacaggacagaca

SEQ ID NO: 443516 - DNA, 20 bp, Artificial
  CRISPR gRNA sequence
atatcacaggacagacatca

SEQ ID NO: 443517 - DNA, 20 bp, Artificial
  CRISPR gRNA sequence
acaggatgtgtgtagtgtgg

SEQ ID NO: 443518 - DNA, 20 bp, Artificial
  CRISPR gRNA sequence
caggatgtgtgtagtgtggc

SEQ ID NO: 443519 - DNA, 20 bp, Artificial
  CRISPR gRNA sequence
tggtttcctttaatgtgact

SEQ ID NO: 443520 - DNA, 20 bp, Artificial
  CRISPR gRNA sequence
ggtttcctttaatgtgactg

SEQ ID NO: 443521 - DNA, 20 bp, Artificial
  CRISPR gRNA sequence
gtttcctttaatgtgactgt

SEQ ID NO: 443522 - DNA, 20 bp, Artificial
  CRISPR gRNA sequence
cctttaatgtgactgtagac

SEQ ID NO: 443523 - DNA, 20 bp, Artificial
  CRISPR gRNA sequence
ctttaatgtgactgtagacc

SEQ ID NO: 443524 - DNA, 20 bp, Artificial
  CRISPR gRNA sequence
taatgtgactgtagacctgg

SEQ ID NO: 443525 - DNA, 20 bp, Artificial
  CRISPR gRNA sequence
aatgtgactgtagacctggc

SEQ ID NO: 443526 - DNA, 20 bp, Artificial
  CRISPR gRNA sequence
atgtgactgtagacctggca

SEQ ID NO: 443527 - DNA, 20 bp, Artificial
  CRISPR gRNA sequence
tagacctggcagtgttacta

SEQ ID NO: 443528 - DNA, 20 bp, Artificial
  CRISPR gRNA sequence
gcagtgttactataagaatc

SEQ ID NO: 443529 - DNA, 20 bp, Artificial
  CRISPR gRNA sequence
ctataagaatcactggcaat

SEQ ID NO: 443530 - DNA, 20 bp, Artificial
  CRISPR gRNA sequence
taagaatcactggcaatcag

SEQ ID NO: 443531 - DNA, 20 bp, Artificial
  CRISPR gRNA sequence
gcaatcagacacccgggtgt

SEQ ID NO: 443532 - DNA, 20 bp, Artificial
  CRISPR gRNA sequence
agctagcactcagtgggggc

SEQ ID NO: 443533 - DNA, 20 bp, Artificial
  CRISPR gRNA sequence
gcactcagtgggggcggcta

SEQ ID NO: 443534 - DNA, 20 bp, Artificial
  CRISPR gRNA sequence
agtgggggcggctactgctc

SEQ ID NO: 443535 - DNA, 20 bp, Artificial
  CRISPR gRNA sequence
ctgctcatgtgattgtggag

SEQ ID NO: 443536 - DNA, 20 bp, Artificial
  CRISPR gRNA sequence
ctcatgtgattgtggagtag

SEQ ID NO: 443537 - DNA, 20 bp, Artificial
  CRISPR gRNA sequence
atgtgattgtggagtagaca

SEQ ID NO: 443538 - DNA, 20 bp, Artificial
  CRISPR gRNA sequence
tggagtagacagttggaaga

SEQ ID NO: 443539 - DNA, 20 bp, Artificial
  CRISPR gRNA sequence
gaagaagtacccagtccatt

SEQ ID NO: 443540 - DNA, 20 bp, Artificial
  CRISPR gRNA sequence
ggagagttaaaactgtgcct

SEQ ID NO: 443541 - DNA, 20 bp, Artificial
  CRISPR gRNA sequence
gagagttaaaactgtgccta

SEQ ID NO: 443542 - DNA, 20 bp, Artificial
  CRISPR gRNA sequence
aaactgtgcctaacagaggt

SEQ ID NO: 443543 - DNA, 20 bp, Artificial
  CRISPR gRNA sequence
tgcctaacagaggtgtcctc

SEQ ID NO: 443544 - DNA, 20 bp, Artificial
  CRISPR gRNA sequence
acagaggtgtcctctgactt

SEQ ID NO: 443545 - DNA, 20 bp, Artificial
  CRISPR gRNA sequence
tgacttttcttctgcaagct

SEQ ID NO: 443546 - DNA, 20 bp, Artificial
  CRISPR gRNA sequence
acttttcttctgcaagctcc

SEQ ID NO: 443547 - DNA, 20 bp, Artificial
  CRISPR gRNA sequence
ttcttctgcaagctccatgt

SEQ ID NO: 443548 - DNA, 20 bp, Artificial
  CRISPR gRNA sequence
tcttctgcaagctccatgtt

SEQ ID NO: 443549 - DNA, 20 bp, Artificial
  CRISPR gRNA sequence
cttctgcaagctccatgttt

SEQ ID NO: 443550 - DNA, 20 bp, Artificial
  CRISPR gRNA sequence
ttctgcaagctccatgtttt

SEQ ID NO: 443551 - DNA, 20 bp, Artificial
  CRISPR gRNA sequence
ctgcaagctccatgttttca

SEQ ID NO: 443552 - DNA, 20 bp, Artificial
  CRISPR gRNA sequence
tgcaagctccatgttttcac

SEQ ID NO: 443553 - DNA, 20 bp, Artificial
  CRISPR gRNA sequence
caagctccatgttttcacat

SEQ ID NO: 443554 - DNA, 20 bp, Artificial
  CRISPR gRNA sequence
catgttttcacatcttccct

SEQ ID NO: 443555 - DNA, 20 bp, Artificial
  CRISPR gRNA sequence
tcacatcttccctttgactg

SEQ ID NO: 443556 - DNA, 20 bp, Artificial
  CRISPR gRNA sequence
cacatcttccctttgactgt

SEQ ID NO: 443557 - DNA, 20 bp, Artificial
  CRISPR gRNA sequence
acatcttccctttgactgtg

SEQ ID NO: 443558 - DNA, 20 bp, Artificial
  CRISPR gRNA sequence
ccctttgactgtgtcctgct

SEQ ID NO: 443559 - DNA, 20 bp, Artificial
  CRISPR gRNA sequence
cctttgactgtgtcctgctg

SEQ ID NO: 443560 - DNA, 20 bp, Artificial
  CRISPR gRNA sequence
tgactgtgtcctgctgctgc

SEQ ID NO: 443561 - DNA, 20 bp, Artificial
  CRISPR gRNA sequence
gactgtgtcctgctgctgct

SEQ ID NO: 443562 - DNA, 20 bp, Artificial
  CRISPR gRNA sequence
actgtgtcctgctgctgctg

SEQ ID NO: 443563 - DNA, 20 bp, Artificial
  CRISPR gRNA sequence
tgtcctgctgctgctgctgc

SEQ ID NO: 443564 - DNA, 20 bp, Artificial
  CRISPR gRNA sequence
ctgctgctgctgctactact

SEQ ID NO: 443565 - DNA, 20 bp, Artificial
  CRISPR gRNA sequence
ctgctgctgctactacttac

SEQ ID NO: 443566 - DNA, 20 bp, Artificial
  CRISPR gRNA sequence
ctgctgctactacttacaag

SEQ ID NO: 443567 - DNA, 20 bp, Artificial
  CRISPR gRNA sequence
ctgctactacttacaagtaa

SEQ ID NO: 443568 - DNA, 20 bp, Artificial
  CRISPR gRNA sequence
ctactacttacaagtaagtc

SEQ ID NO: 443569 - DNA, 20 bp, Artificial
  CRISPR gRNA sequence
ctacttacaagtaagtctcg

SEQ ID NO: 443570 - DNA, 20 bp, Artificial
  CRISPR gRNA sequence
cttacaagtaagtctcggca

SEQ ID NO: 443571 - DNA, 20 bp, Artificial
  CRISPR gRNA sequence
acaagtaagtctcggcatgg

SEQ ID NO: 443572 - DNA, 20 bp, Artificial
  CRISPR gRNA sequence
caagtaagtctcggcatgga

SEQ ID NO: 443573 - DNA, 20 bp, Artificial
  CRISPR gRNA sequence
ggcatggatatttacaatga

SEQ ID NO: 443574 - DNA, 20 bp, Artificial
  CRISPR gRNA sequence
acaatgacataatggtgctg

SEQ ID NO: 443575 - DNA, 20 bp, Artificial
  CRISPR gRNA sequence
caatgacataatggtgctgt

SEQ ID NO: 443576 - DNA, 20 bp, Artificial
  CRISPR gRNA sequence
tacagaggacaagggagaga

SEQ ID NO: 443577 - DNA, 20 bp, Artificial
  CRISPR gRNA sequence
taatgttgtttgtaatagca

SEQ ID NO: 443578 - DNA, 20 bp, Artificial
  CRISPR gRNA sequence
tttgtaatagcaaaagcttg

SEQ ID NO: 443579 - DNA, 20 bp, Artificial
  CRISPR gRNA sequence
gtaatagcaaaagcttggaa

SEQ ID NO: 443580 - DNA, 20 bp, Artificial
  CRISPR gRNA sequence
taatagcaaaagcttggaag

SEQ ID NO: 443581 - DNA, 20 bp, Artificial
  CRISPR gRNA sequence
ggaagcaacctaaatgtccg

SEQ ID NO: 443582 - DNA, 20 bp, Artificial
  CRISPR gRNA sequence
gaagcaacctaaatgtccgt

SEQ ID NO: 443583 - DNA, 20 bp, Artificial
  CRISPR gRNA sequence
aatgtccgtcgatgagggag

SEQ ID NO: 443584 - DNA, 20 bp, Artificial
  CRISPR gRNA sequence
acaaaacatactggtataga

SEQ ID NO: 443585 - DNA, 20 bp, Artificial
  CRISPR gRNA sequence
gtatagaatgtctcaaaatt

SEQ ID NO: 443586 - DNA, 20 bp, Artificial
  CRISPR gRNA sequence
aaaattataatgttattaaa

SEQ ID NO: 443587 - DNA, 20 bp, Artificial
  CRISPR gRNA sequence
taatgttattaaagaaaaaa

SEQ ID NO: 443588 - DNA, 20 bp, Artificial
  CRISPR gRNA sequence
ttaaagaaaaaaagttgcag

SEQ ID NO: 443589 - DNA, 20 bp, Artificial
  CRISPR gRNA sequence
aagaaaaaaagttgcagaat

SEQ ID NO: 443590 - DNA, 20 bp, Artificial
  CRISPR gRNA sequence
cagaataatgcatatattag

SEQ ID NO: 443591 - DNA, 20 bp, Artificial
  CRISPR gRNA sequence
ggcttctatttgtgtgtgtg

SEQ ID NO: 443592 - DNA, 20 bp, Artificial
  CRISPR gRNA sequence
ctatttgtgtgtgtgcattg

SEQ ID NO: 443593 - DNA, 20 bp, Artificial
  CRISPR gRNA sequence
tatttgtgtgtgtgcattgt

SEQ ID NO: 443594 - DNA, 20 bp, Artificial
  CRISPR gRNA sequence
tttgtgtgtgtgcattgtcg

SEQ ID NO: 443595 - DNA, 20 bp, Artificial
  CRISPR gRNA sequence
gtgtgtgtgcattgtcgggg

SEQ ID NO: 443596 - DNA, 20 bp, Artificial
  CRISPR gRNA sequence
tgtgtgtgcattgtcgggga

SEQ ID NO: 443597 - DNA, 20 bp, Artificial
  CRISPR gRNA sequence
tcggggagcaggaatatgtg

SEQ ID NO: 443598 - DNA, 20 bp, Artificial
  CRISPR gRNA sequence
cttaatgtataagctctagg

SEQ ID NO: 443599 - DNA, 20 bp, Artificial
  CRISPR gRNA sequence
ttaatgtataagctctagga

SEQ ID NO: 443600 - DNA, 20 bp, Artificial
  CRISPR gRNA sequence
aatgtataagctctaggaaa

SEQ ID NO: 443601 - DNA, 20 bp, Artificial
  CRISPR gRNA sequence
atgtataagctctaggaaaa

SEQ ID NO: 443602 - DNA, 20 bp, Artificial
  CRISPR gRNA sequence
taggaaaaggaaccagggaa

SEQ ID NO: 443603 - DNA, 20 bp, Artificial
  CRISPR gRNA sequence
ggaaaaggaaccagggaatg

SEQ ID NO: 443604 - DNA, 20 bp, Artificial
  CRISPR gRNA sequence
ggagagtaaggcatattttt

SEQ ID NO: 443605 - DNA, 20 bp, Artificial
  CRISPR gRNA sequence
ttcttttcttttctttcctt

SEQ ID NO: 443606 - DNA, 20 bp, Artificial
  CRISPR gRNA sequence
tcttttcttttctttccttt

SEQ ID NO: 443607 - DNA, 20 bp, Artificial
  CRISPR gRNA sequence
cttttcttttctttcctttt

SEQ ID NO: 443608 - DNA, 20 bp, Artificial
  CRISPR gRNA sequence
ttttcttttctttccttttt

SEQ ID NO: 443609 - DNA, 20 bp, Artificial
  CRISPR gRNA sequence
ttcttttctttccttttttt

SEQ ID NO: 443610 - DNA, 20 bp, Artificial
  CRISPR gRNA sequence
tcttttctttcctttttttc

SEQ ID NO: 443611 - DNA, 20 bp, Artificial
  CRISPR gRNA sequence
cttttctttcctttttttct

SEQ ID NO: 443612 - DNA, 20 bp, Artificial
  CRISPR gRNA sequence
ttttctttcctttttttctt

SEQ ID NO: 443613 - DNA, 20 bp, Artificial
  CRISPR gRNA sequence
ttctttcctttttttctttt

SEQ ID NO: 443614 - DNA, 20 bp, Artificial
  CRISPR gRNA sequence
tctttcctttttttcttttt

SEQ ID NO: 443615 - DNA, 20 bp, Artificial
  CRISPR gRNA sequence
ctttcctttttttctttttc

SEQ ID NO: 443616 - DNA, 20 bp, Artificial
  CRISPR gRNA sequence
tttcctttttttctttttct

SEQ ID NO: 443617 - DNA, 20 bp, Artificial
  CRISPR gRNA sequence
tcctttttttctttttcttt

SEQ ID NO: 443618 - DNA, 20 bp, Artificial
  CRISPR gRNA sequence
cctttttttctttttctttt

SEQ ID NO: 443619 - DNA, 20 bp, Artificial
  CRISPR gRNA sequence
ctttttttctttttcttttc

SEQ ID NO: 443620 - DNA, 20 bp, Artificial
  CRISPR gRNA sequence
tttttctttttcttttcttt

SEQ ID NO: 443621 - DNA, 20 bp, Artificial
  CRISPR gRNA sequence
ttttctttttcttttctttc

SEQ ID NO: 443622 - DNA, 20 bp, Artificial
  CRISPR gRNA sequence
tttctttttcttttctttct

SEQ ID NO: 443623 - DNA, 20 bp, Artificial
  CRISPR gRNA sequence
ttctttttcttttctttctt

SEQ ID NO: 443624 - DNA, 20 bp, Artificial
  CRISPR gRNA sequence
tctttttcttttctttcttt

SEQ ID NO: 443625 - DNA, 20 bp, Artificial
  CRISPR gRNA sequence
ctttttcttttctttctttt

SEQ ID NO: 443626 - DNA, 20 bp, Artificial
  CRISPR gRNA sequence
tttttcttttctttcttttt

SEQ ID NO: 443627 - DNA, 20 bp, Artificial
  CRISPR gRNA sequence
tttcttttctttctttttct

SEQ ID NO: 443628 - DNA, 20 bp, Artificial
  CRISPR gRNA sequence
ttcttttctttctttttctt

SEQ ID NO: 443629 - DNA, 20 bp, Artificial
  CRISPR gRNA sequence
tcttttctttctttttcttt

SEQ ID NO: 443630 - DNA, 20 bp, Artificial
  CRISPR gRNA sequence
cttttctttctttttctttt

SEQ ID NO: 443631 - DNA, 20 bp, Artificial
  CRISPR gRNA sequence
ttttctttctttttcttttt

SEQ ID NO: 443632 - DNA, 20 bp, Artificial
  CRISPR gRNA sequence
ttctttctttttcttttttt

SEQ ID NO: 443633 - DNA, 20 bp, Artificial
  CRISPR gRNA sequence
tctttctttttctttttttc

SEQ ID NO: 443634 - DNA, 20 bp, Artificial
  CRISPR gRNA sequence
ctttctttttctttttttca

SEQ ID NO: 443635 - DNA, 20 bp, Artificial
  CRISPR gRNA sequence
tttctttttctttttttcaa

SEQ ID NO: 443636 - DNA, 20 bp, Artificial
  CRISPR gRNA sequence
tctttttctttttttcaatt

SEQ ID NO: 443637 - DNA, 20 bp, Artificial
  CRISPR gRNA sequence
ctttttctttttttcaattg

SEQ ID NO: 443638 - DNA, 20 bp, Artificial
  CRISPR gRNA sequence
tttttctttttttcaattga

SEQ ID NO: 443639 - DNA, 20 bp, Artificial
  CRISPR gRNA sequence
tttctttttttcaattgaga

SEQ ID NO: 443640 - DNA, 20 bp, Artificial
  CRISPR gRNA sequence
ttctttttttcaattgagat

SEQ ID NO: 443641 - DNA, 20 bp, Artificial
  CRISPR gRNA sequence
tctttttttcaattgagatg

SEQ ID NO: 443642 - DNA, 20 bp, Artificial
  CRISPR gRNA sequence
ctttttttcaattgagatgg

SEQ ID NO: 443643 - DNA, 20 bp, Artificial
  CRISPR gRNA sequence
tttttttcaattgagatgga

SEQ ID NO: 443644 - DNA, 20 bp, Artificial
  CRISPR gRNA sequence
tttttcaattgagatggagt

SEQ ID NO: 443645 - DNA, 20 bp, Artificial
  CRISPR gRNA sequence
ttttcaattgagatggagtc

SEQ ID NO: 443646 - DNA, 20 bp, Artificial
  CRISPR gRNA sequence
tttcaattgagatggagtct

SEQ ID NO: 443647 - DNA, 20 bp, Artificial
  CRISPR gRNA sequence
ttcaattgagatggagtctc

SEQ ID NO: 443648 - DNA, 20 bp, Artificial
  CRISPR gRNA sequence
tcaattgagatggagtctca

SEQ ID NO: 443649 - DNA, 20 bp, Artificial
  CRISPR gRNA sequence
caattgagatggagtctcac

SEQ ID NO: 443650 - DNA, 20 bp, Artificial
  CRISPR gRNA sequence
aattgagatggagtctcact

SEQ ID NO: 443651 - DNA, 20 bp, Artificial
  CRISPR gRNA sequence
agatggagtctcactctatt

SEQ ID NO: 443652 - DNA, 20 bp, Artificial
  CRISPR gRNA sequence
actctattgcccaggctgga

SEQ ID NO: 443653 - DNA, 20 bp, Artificial
  CRISPR gRNA sequence
tattgcccaggctggagtgc

SEQ ID NO: 443654 - DNA, 20 bp, Artificial
  CRISPR gRNA sequence
ttgcccaggctggagtgcag

SEQ ID NO: 443655 - DNA, 20 bp, Artificial
  CRISPR gRNA sequence
cccaggctggagtgcagtgg

SEQ ID NO: 443656 - DNA, 20 bp, Artificial
  CRISPR gRNA sequence
gagtgcagtggtggcaccat

SEQ ID NO: 443657 - DNA, 20 bp, Artificial
  CRISPR gRNA sequence
tggctcactgcaatctccgc

SEQ ID NO: 443658 - DNA, 20 bp, Artificial
  CRISPR gRNA sequence
ggctcactgcaatctccgcc

SEQ ID NO: 443659 - DNA, 20 bp, Artificial
  CRISPR gRNA sequence
gctcactgcaatctccgcct

SEQ ID NO: 443660 - DNA, 20 bp, Artificial
  CRISPR gRNA sequence
actgcaatctccgcctccca

SEQ ID NO: 443661 - DNA, 20 bp, Artificial
  CRISPR gRNA sequence
caatctccgcctcccaggtt

SEQ ID NO: 443662 - DNA, 20 bp, Artificial
  CRISPR gRNA sequence
cgcctcccaggttcaagtga

SEQ ID NO: 443663 - DNA, 20 bp, Artificial
  CRISPR gRNA sequence
ccaggttcaagtgattctcc

SEQ ID NO: 443664 - DNA, 20 bp, Artificial
  CRISPR gRNA sequence
aagtgattctcctgccttag

SEQ ID NO: 443665 - DNA, 20 bp, Artificial
  CRISPR gRNA sequence
tcctgccttaggcaccggag

SEQ ID NO: 443666 - DNA, 20 bp, Artificial
  CRISPR gRNA sequence
ctgccttaggcaccggagta

SEQ ID NO: 443667 - DNA, 20 bp, Artificial
  CRISPR gRNA sequence
ccttaggcaccggagtagct

SEQ ID NO: 443668 - DNA, 20 bp, Artificial
  CRISPR gRNA sequence
aggcaccggagtagctggga

SEQ ID NO: 443669 - DNA, 20 bp, Artificial
  CRISPR gRNA sequence
ggcaccggagtagctgggat

SEQ ID NO: 443670 - DNA, 20 bp, Artificial
  CRISPR gRNA sequence
ggatcacaggcgtgcaccac

SEQ ID NO: 443671 - DNA, 20 bp, Artificial
  CRISPR gRNA sequence
atgtttttaatttttagtag

SEQ ID NO: 443672 - DNA, 20 bp, Artificial
  CRISPR gRNA sequence
ttaatttttagtagagacag

SEQ ID NO: 443673 - DNA, 20 bp, Artificial
  CRISPR gRNA sequence
taatttttagtagagacagg

SEQ ID NO: 443674 - DNA, 20 bp, Artificial
  CRISPR gRNA sequence
aatttttagtagagacaggg

SEQ ID NO: 443675 - DNA, 20 bp, Artificial
  CRISPR gRNA sequence
atttttagtagagacagggt

SEQ ID NO: 443676 - DNA, 20 bp, Artificial
  CRISPR gRNA sequence
ttagtagagacagggtttta

SEQ ID NO: 443677 - DNA, 20 bp, Artificial
  CRISPR gRNA sequence
tagtagagacagggttttac

SEQ ID NO: 443678 - DNA, 20 bp, Artificial
  CRISPR gRNA sequence
agtagagacagggttttacc

SEQ ID NO: 443679 - DNA, 20 bp, Artificial
  CRISPR gRNA sequence
gtagagacagggttttacca

SEQ ID NO: 443680 - DNA, 20 bp, Artificial
  CRISPR gRNA sequence
taccatgttggtcaggctgg

SEQ ID NO: 443681 - DNA, 20 bp, Artificial
  CRISPR gRNA sequence
accatgttggtcaggctggt

SEQ ID NO: 443682 - DNA, 20 bp, Artificial
  CRISPR gRNA sequence
ccatgttggtcaggctggtc

SEQ ID NO: 443683 - DNA, 20 bp, Artificial
  CRISPR gRNA sequence
gtcaggctggtctcaaactc

SEQ ID NO: 443684 - DNA, 20 bp, Artificial
  CRISPR gRNA sequence
gtctcaaactcatggcctca

SEQ ID NO: 443685 - DNA, 20 bp, Artificial
  CRISPR gRNA sequence
aaactcatggcctcaagtaa

SEQ ID NO: 443686 - DNA, 20 bp, Artificial
  CRISPR gRNA sequence
atggcctcaagtaatctgcc

SEQ ID NO: 443687 - DNA, 20 bp, Artificial
  CRISPR gRNA sequence
aagtaatctgcccatctcag

SEQ ID NO: 443688 - DNA, 20 bp, Artificial
  CRISPR gRNA sequence
cccatctcagcctcccaaag

SEQ ID NO: 443689 - DNA, 20 bp, Artificial
  CRISPR gRNA sequence
agcctcccaaagtgctggga

SEQ ID NO: 443690 - DNA, 20 bp, Artificial
  CRISPR gRNA sequence
ccaaagtgctgggattacag

SEQ ID NO: 443691 - DNA, 20 bp, Artificial
  CRISPR gRNA sequence
ggattacaggcgtgacccac

SEQ ID NO: 443692 - DNA, 20 bp, Artificial
  CRISPR gRNA sequence
caggcgtgacccaccgtgtg

SEQ ID NO: 443693 - DNA, 20 bp, Artificial
  CRISPR gRNA sequence
tttcatacacctttgatagt

SEQ ID NO: 443694 - DNA, 20 bp, Artificial
  CRISPR gRNA sequence
ttcatacacctttgatagtg

SEQ ID NO: 443695 - DNA, 20 bp, Artificial
  CRISPR gRNA sequence
tcatacacctttgatagtgt

SEQ ID NO: 443696 - DNA, 20 bp, Artificial
  CRISPR gRNA sequence
catacacctttgatagtgtt

SEQ ID NO: 443697 - DNA, 20 bp, Artificial
  CRISPR gRNA sequence
atacacctttgatagtgttt

SEQ ID NO: 443698 - DNA, 20 bp, Artificial
  CRISPR gRNA sequence
tgatagtgtttgaatgtttt

SEQ ID NO: 443699 - DNA, 20 bp, Artificial
  CRISPR gRNA sequence
gatagtgtttgaatgttttt

SEQ ID NO: 443700 - DNA, 20 bp, Artificial
  CRISPR gRNA sequence
atagtgtttgaatgttttta

SEQ ID NO: 443701 - DNA, 20 bp, Artificial
  CRISPR gRNA sequence
gaatgtttttactgtagttg

SEQ ID NO: 443702 - DNA, 20 bp, Artificial
  CRISPR gRNA sequence
aatgtttttactgtagttga

SEQ ID NO: 443703 - DNA, 20 bp, Artificial
  CRISPR gRNA sequence
ttactgtagttgagtcatat

SEQ ID NO: 443704 - DNA, 20 bp, Artificial
  CRISPR gRNA sequence
tactgtagttgagtcatatg

SEQ ID NO: 443705 - DNA, 20 bp, Artificial
  CRISPR gRNA sequence
actgtagttgagtcatatga

SEQ ID NO: 443706 - DNA, 20 bp, Artificial
  CRISPR gRNA sequence
ctgtagttgagtcatatgaa

SEQ ID NO: 443707 - DNA, 20 bp, Artificial
  CRISPR gRNA sequence
tagttgagtcatatgaaaac

SEQ ID NO: 443708 - DNA, 20 bp, Artificial
  CRISPR gRNA sequence
agtcatatgaaaacaaaggg

SEQ ID NO: 443709 - DNA, 20 bp, Artificial
  CRISPR gRNA sequence
tatcatatataaaatatata

SEQ ID NO: 443710 - DNA, 20 bp, Artificial
  CRISPR gRNA sequence
atcatatataaaatatatat

SEQ ID NO: 443711 - DNA, 20 bp, Artificial
  CRISPR gRNA sequence
tcatatataaaatatatata

SEQ ID NO: 443712 - DNA, 20 bp, Artificial
  CRISPR gRNA sequence
ttttttaatggaattaactt

SEQ ID NO: 443713 - DNA, 20 bp, Artificial
  CRISPR gRNA sequence
tttttaatggaattaacttt

SEQ ID NO: 443714 - DNA, 20 bp, Artificial
  CRISPR gRNA sequence
ttttaatggaattaactttg

SEQ ID NO: 443715 - DNA, 20 bp, Artificial
  CRISPR gRNA sequence
tttaatggaattaactttgt

SEQ ID NO: 443716 - DNA, 20 bp, Artificial
  CRISPR gRNA sequence
ttaatggaattaactttgtc

SEQ ID NO: 443717 - DNA, 20 bp, Artificial
  CRISPR gRNA sequence
taatggaattaactttgtca

SEQ ID NO: 443718 - DNA, 20 bp, Artificial
  CRISPR gRNA sequence
aatggaattaactttgtcat

SEQ ID NO: 443719 - DNA, 20 bp, Artificial
  CRISPR gRNA sequence
atggaattaactttgtcatt

SEQ ID NO: 443720 - DNA, 20 bp, Artificial
  CRISPR gRNA sequence
actttgtcatttgaggaaaa

SEQ ID NO: 443721 - DNA, 20 bp, Artificial
  CRISPR gRNA sequence
tgtcatttgaggaaaatgag

SEQ ID NO: 443722 - DNA, 20 bp, Artificial
  CRISPR gRNA sequence
gtcatttgaggaaaatgagg

SEQ ID NO: 443723 - DNA, 20 bp, Artificial
  CRISPR gRNA sequence
tcatttgaggaaaatgagga

SEQ ID NO: 443724 - DNA, 20 bp, Artificial
  CRISPR gRNA sequence
gaggaaaatgaggagacaag

SEQ ID NO: 443725 - DNA, 20 bp, Artificial
  CRISPR gRNA sequence
aggaaaatgaggagacaagt

SEQ ID NO: 443726 - DNA, 20 bp, Artificial
  CRISPR gRNA sequence
aatcattttaggagatttgt

SEQ ID NO: 443727 - DNA, 20 bp, Artificial
  CRISPR gRNA sequence
taggagatttgtttgccaaa

SEQ ID NO: 443728 - DNA, 20 bp, Artificial
  CRISPR gRNA sequence
aggagatttgtttgccaaag

SEQ ID NO: 443729 - DNA, 20 bp, Artificial
  CRISPR gRNA sequence
ggagatttgtttgccaaagt

SEQ ID NO: 443730 - DNA, 20 bp, Artificial
  CRISPR gRNA sequence
gtttgccaaagttaaggagg

SEQ ID NO: 443731 - DNA, 20 bp, Artificial
  CRISPR gRNA sequence
tttgccaaagttaaggaggc

SEQ ID NO: 443732 - DNA, 20 bp, Artificial
  CRISPR gRNA sequence
gccaaagttaaggaggcacc

SEQ ID NO: 443733 - DNA, 20 bp, Artificial
  CRISPR gRNA sequence
ccaaagttaaggaggcacct

SEQ ID NO: 443734 - DNA, 20 bp, Artificial
  CRISPR gRNA sequence
aggaggcacctgagagacag

SEQ ID NO: 443735 - DNA, 20 bp, Artificial
  CRISPR gRNA sequence
agagacaggtctatgacttt

SEQ ID NO: 443736 - DNA, 20 bp, Artificial
  CRISPR gRNA sequence
tgactttctcagaagatgat

SEQ ID NO: 443737 - DNA, 20 bp, Artificial
  CRISPR gRNA sequence
tctcagaagatgattttgag

SEQ ID NO: 443738 - DNA, 20 bp, Artificial
  CRISPR gRNA sequence
ctcagaagatgattttgagg

SEQ ID NO: 443739 - DNA, 20 bp, Artificial
  CRISPR gRNA sequence
tcagaagatgattttgaggg

SEQ ID NO: 443740 - DNA, 20 bp, Artificial
  CRISPR gRNA sequence
agaagatgattttgagggct

SEQ ID NO: 443741 - DNA, 20 bp, Artificial
  CRISPR gRNA sequence
tgagggctccagatttaaag

SEQ ID NO: 443742 - DNA, 20 bp, Artificial
  CRISPR gRNA sequence
gagggctccagatttaaagg

SEQ ID NO: 443743 - DNA, 20 bp, Artificial
  CRISPR gRNA sequence
agggctccagatttaaaggg

SEQ ID NO: 443744 - DNA, 20 bp, Artificial
  CRISPR gRNA sequence
cagatttaaaggggacaagg

SEQ ID NO: 443745 - DNA, 20 bp, Artificial
  CRISPR gRNA sequence
aaaggggacaaggtgggata

SEQ ID NO: 443746 - DNA, 20 bp, Artificial
  CRISPR gRNA sequence
aaggggacaaggtgggatat

SEQ ID NO: 443747 - DNA, 20 bp, Artificial
  CRISPR gRNA sequence
agaagcactcagttttcaca

SEQ ID NO: 443748 - DNA, 20 bp, Artificial
  CRISPR gRNA sequence
agttttcacataaaaaaggg

SEQ ID NO: 443749 - DNA, 20 bp, Artificial
  CRISPR gRNA sequence
tcacataaaaaagggggggg

SEQ ID NO: 443750 - DNA, 20 bp, Artificial
  CRISPR gRNA sequence
cacataaaaaaggggggggg

SEQ ID NO: 443751 - DNA, 20 bp, Artificial
  CRISPR gRNA sequence
acataaaaaagggggggggg

SEQ ID NO: 443752 - DNA, 20 bp, Artificial
  CRISPR gRNA sequence
cattttacattagataacac

SEQ ID NO: 443753 - DNA, 20 bp, Artificial
  CRISPR gRNA sequence
tacattagataacacagaca

SEQ ID NO: 443754 - DNA, 20 bp, Artificial
  CRISPR gRNA sequence
acattagataacacagacaa

SEQ ID NO: 443755 - DNA, 20 bp, Artificial
  CRISPR gRNA sequence
cattagataacacagacaaa

SEQ ID NO: 443756 - DNA, 20 bp, Artificial
  CRISPR gRNA sequence
gataacacagacaaaatggg

SEQ ID NO: 443757 - DNA, 20 bp, Artificial
  CRISPR gRNA sequence
gtgtctggccagggtgaccg

SEQ ID NO: 443758 - DNA, 20 bp, Artificial
  CRISPR gRNA sequence
tgtctggccagggtgaccgc

SEQ ID NO: 443759 - DNA, 20 bp, Artificial
  CRISPR gRNA sequence
gccagggtgaccgcaccggt

SEQ ID NO: 443760 - DNA, 20 bp, Artificial
  CRISPR gRNA sequence
tcaatctgcattgcacagct

SEQ ID NO: 443761 - DNA, 20 bp, Artificial
  CRISPR gRNA sequence
cattgcacagctgaccagga

SEQ ID NO: 443762 - DNA, 20 bp, Artificial
  CRISPR gRNA sequence
cacagctgaccaggaatttc

SEQ ID NO: 443763 - DNA, 20 bp, Artificial
  CRISPR gRNA sequence
accaggaatttccttgtggg

SEQ ID NO: 443764 - DNA, 20 bp, Artificial
  CRISPR gRNA sequence
ccttgtgggcaaaatatggg

SEQ ID NO: 443765 - DNA, 20 bp, Artificial
  CRISPR gRNA sequence
cttgtgggcaaaatatgggg

SEQ ID NO: 443766 - DNA, 20 bp, Artificial
  CRISPR gRNA sequence
gtgggcaaaatatgggggag

SEQ ID NO: 443767 - DNA, 20 bp, Artificial
  CRISPR gRNA sequence
tgggcaaaatatgggggagg

SEQ ID NO: 443768 - DNA, 20 bp, Artificial
  CRISPR gRNA sequence
tcatcctgtagccatcttat

SEQ ID NO: 443769 - DNA, 20 bp, Artificial
  CRISPR gRNA sequence
catcctgtagccatcttatt

SEQ ID NO: 443770 - DNA, 20 bp, Artificial
  CRISPR gRNA sequence
atcctgtagccatcttattc

SEQ ID NO: 443771 - DNA, 20 bp, Artificial
  CRISPR gRNA sequence
tagccatcttattcaggaat

SEQ ID NO: 443772 - DNA, 20 bp, Artificial
  CRISPR gRNA sequence
attcaggaatcaaaaagagg

SEQ ID NO: 443773 - DNA, 20 bp, Artificial
  CRISPR gRNA sequence
ttcaggaatcaaaaagagga

SEQ ID NO: 443774 - DNA, 20 bp, Artificial
  CRISPR gRNA sequence
aggaatcaaaaagaggaggc

SEQ ID NO: 443775 - DNA, 20 bp, Artificial
  CRISPR gRNA sequence
ctgtgacccagttcccagct

SEQ ID NO: 443776 - DNA, 20 bp, Artificial
  CRISPR gRNA sequence
tgtgacccagttcccagctt

SEQ ID NO: 443777 - DNA, 20 bp, Artificial
  CRISPR gRNA sequence
tgacccagttcccagcttga

SEQ ID NO: 443778 - DNA, 20 bp, Artificial
  CRISPR gRNA sequence
ccagcttgacttttcccttt

SEQ ID NO: 443779 - DNA, 20 bp, Artificial
  CRISPR gRNA sequence
gacttttccctttgactgaa

SEQ ID NO: 443780 - DNA, 20 bp, Artificial
  CRISPR gRNA sequence
acttttccctttgactgaat

SEQ ID NO: 443781 - DNA, 20 bp, Artificial
  CRISPR gRNA sequence
ttccctttgactgaatgagt

SEQ ID NO: 443782 - DNA, 20 bp, Artificial
  CRISPR gRNA sequence
tccctttgactgaatgagtt

SEQ ID NO: 443783 - DNA, 20 bp, Artificial
  CRISPR gRNA sequence
ccctttgactgaatgagttt

SEQ ID NO: 443784 - DNA, 20 bp, Artificial
  CRISPR gRNA sequence
cctttgactgaatgagtttg

SEQ ID NO: 443785 - DNA, 20 bp, Artificial
  CRISPR gRNA sequence
tgactgaatgagtttggggt

SEQ ID NO: 443786 - DNA, 20 bp, Artificial
  CRISPR gRNA sequence
gactgaatgagtttggggtc

SEQ ID NO: 443787 - DNA, 20 bp, Artificial
  CRISPR gRNA sequence
actgaatgagtttggggtcc

SEQ ID NO: 443788 - DNA, 20 bp, Artificial
  CRISPR gRNA sequence
aatgagtttggggtcccaaa

SEQ ID NO: 443789 - DNA, 20 bp, Artificial
  CRISPR gRNA sequence
ggggtcccaaaatttaattt

SEQ ID NO: 443790 - DNA, 20 bp, Artificial
  CRISPR gRNA sequence
gggtcccaaaatttaatttc

SEQ ID NO: 443791 - DNA, 20 bp, Artificial
  CRISPR gRNA sequence
aatttcttttcacaacttta

SEQ ID NO: 443792 - DNA, 20 bp, Artificial
  CRISPR gRNA sequence
atttcttttcacaactttaa

SEQ ID NO: 443793 - DNA, 20 bp, Artificial
  CRISPR gRNA sequence
cttttcacaactttaaacct

SEQ ID NO: 443794 - DNA, 20 bp, Artificial
  CRISPR gRNA sequence
ttttcacaactttaaacctt

SEQ ID NO: 443795 - DNA, 20 bp, Artificial
  CRISPR gRNA sequence
ttcacaactttaaaccttaa

SEQ ID NO: 443796 - DNA, 20 bp, Artificial
  CRISPR gRNA sequence
tcacaactttaaaccttaaa

SEQ ID NO: 443797 - DNA, 20 bp, Artificial
  CRISPR gRNA sequence
cacaactttaaaccttaaaa

SEQ ID NO: 443798 - DNA, 20 bp, Artificial
  CRISPR gRNA sequence
acaactttaaaccttaaaac

SEQ ID NO: 443799 - DNA, 20 bp, Artificial
  CRISPR gRNA sequence
taaaccttaaaacaactcca

SEQ ID NO: 443800 - DNA, 20 bp, Artificial
  CRISPR gRNA sequence
aaaccttaaaacaactccat

SEQ ID NO: 443801 - DNA, 20 bp, Artificial
  CRISPR gRNA sequence
aaccttaaaacaactccatg

SEQ ID NO: 443802 - DNA, 20 bp, Artificial
  CRISPR gRNA sequence
aaaacaactccatgagtagt

SEQ ID NO: 443803 - DNA, 20 bp, Artificial
  CRISPR gRNA sequence
aaacaactccatgagtagtt

SEQ ID NO: 443804 - DNA, 20 bp, Artificial
  CRISPR gRNA sequence
catgagtagtttcaaataca

SEQ ID NO: 443805 - DNA, 20 bp, Artificial
  CRISPR gRNA sequence
caaatacacaagatccttat

SEQ ID NO: 443806 - DNA, 20 bp, Artificial
  CRISPR gRNA sequence
aaatacacaagatccttatt

SEQ ID NO: 443807 - DNA, 20 bp, Artificial
  CRISPR gRNA sequence
atttaaccaagggtttgtat

SEQ ID NO: 443808 - DNA, 20 bp, Artificial
  CRISPR gRNA sequence
tttaaccaagggtttgtatt

SEQ ID NO: 443809 - DNA, 20 bp, Artificial
  CRISPR gRNA sequence
aaccaagggtttgtatttac

SEQ ID NO: 443810 - DNA, 20 bp, Artificial
  CRISPR gRNA sequence
accaagggtttgtatttact

SEQ ID NO: 443811 - DNA, 20 bp, Artificial
  CRISPR gRNA sequence
gtatttactgtgcacttgct

SEQ ID NO: 443812 - DNA, 20 bp, Artificial
  CRISPR gRNA sequence
tatttactgtgcacttgctg

SEQ ID NO: 443813 - DNA, 20 bp, Artificial
  CRISPR gRNA sequence
actgtgcacttgctgcttaa

SEQ ID NO: 443814 - DNA, 20 bp, Artificial
  CRISPR gRNA sequence
ctgtgcacttgctgcttaaa

SEQ ID NO: 443815 - DNA, 20 bp, Artificial
  CRISPR gRNA sequence
tgcacttgctgcttaaaaag

SEQ ID NO: 443816 - DNA, 20 bp, Artificial
  CRISPR gRNA sequence
gctgcttaaaaagagaagta

SEQ ID NO: 443817 - DNA, 20 bp, Artificial
  CRISPR gRNA sequence
ctgcttaaaaagagaagtat

SEQ ID NO: 443818 - DNA, 20 bp, Artificial
  CRISPR gRNA sequence
cttaaaaagagaagtatgtt

SEQ ID NO: 443819 - DNA, 20 bp, Artificial
  CRISPR gRNA sequence
aaaaagagaagtatgttagg

SEQ ID NO: 443820 - DNA, 20 bp, Artificial
  CRISPR gRNA sequence
aaaagagaagtatgttagga

SEQ ID NO: 443821 - DNA, 20 bp, Artificial
  CRISPR gRNA sequence
ggagagcctccctttgttga

SEQ ID NO: 443822 - DNA, 20 bp, Artificial
  CRISPR gRNA sequence
cctttgttgatgaacaagca

SEQ ID NO: 443823 - DNA, 20 bp, Artificial
  CRISPR gRNA sequence
tgttgatgaacaagcaagta

SEQ ID NO: 443824 - DNA, 20 bp, Artificial
  CRISPR gRNA sequence
gttgatgaacaagcaagtag

SEQ ID NO: 443825 - DNA, 20 bp, Artificial
  CRISPR gRNA sequence
ttgatgaacaagcaagtagc

SEQ ID NO: 443826 - DNA, 20 bp, Artificial
  CRISPR gRNA sequence
atgaacaagcaagtagccca

SEQ ID NO: 443827 - DNA, 20 bp, Artificial
  CRISPR gRNA sequence
cctggctgaccatgactaat

SEQ ID NO: 443828 - DNA, 20 bp, Artificial
  CRISPR gRNA sequence
ctggctgaccatgactaatt

SEQ ID NO: 443829 - DNA, 20 bp, Artificial
  CRISPR gRNA sequence
gctgaccatgactaattttc

SEQ ID NO: 443830 - DNA, 20 bp, Artificial
  CRISPR gRNA sequence
accatgactaattttctgat

SEQ ID NO: 443831 - DNA, 20 bp, Artificial
  CRISPR gRNA sequence
attttctgattgtctgtttc

SEQ ID NO: 443832 - DNA, 20 bp, Artificial
  CRISPR gRNA sequence
tctgattgtctgtttccatc

SEQ ID NO: 443833 - DNA, 20 bp, Artificial
  CRISPR gRNA sequence
ctgattgtctgtttccatca

SEQ ID NO: 443834 - DNA, 20 bp, Artificial
  CRISPR gRNA sequence
tgattgtctgtttccatcag

SEQ ID NO: 443835 - DNA, 20 bp, Artificial
  CRISPR gRNA sequence
attgtctgtttccatcagcc

SEQ ID NO: 443836 - DNA, 20 bp, Artificial
  CRISPR gRNA sequence
tctgtttccatcagccctgt

SEQ ID NO: 443837 - DNA, 20 bp, Artificial
  CRISPR gRNA sequence
tttccatcagccctgttctc

SEQ ID NO: 443838 - DNA, 20 bp, Artificial
  CRISPR gRNA sequence
ccatcagccctgttctcccg

SEQ ID NO: 443839 - DNA, 20 bp, Artificial
  CRISPR gRNA sequence
catcagccctgttctcccgt

SEQ ID NO: 443840 - DNA, 20 bp, Artificial
  CRISPR gRNA sequence
ttctcccgtgttcacagaat

SEQ ID NO: 443841 - DNA, 20 bp, Artificial
  CRISPR gRNA sequence
tcccgtgttcacagaattgg

SEQ ID NO: 443842 - DNA, 20 bp, Artificial
  CRISPR gRNA sequence
ccgtgttcacagaattgggc

SEQ ID NO: 443843 - DNA, 20 bp, Artificial
  CRISPR gRNA sequence
acagaattgggccacaattc

SEQ ID NO: 443844 - DNA, 20 bp, Artificial
  CRISPR gRNA sequence
ggccacaattctctcctagg

SEQ ID NO: 443845 - DNA, 20 bp, Artificial
  CRISPR gRNA sequence
tctcctagggcagtgtttct

SEQ ID NO: 443846 - DNA, 20 bp, Artificial
  CRISPR gRNA sequence
tcctagggcagtgtttctga

SEQ ID NO: 443847 - DNA, 20 bp, Artificial
  CRISPR gRNA sequence
ctagggcagtgtttctgaaa

SEQ ID NO: 443848 - DNA, 20 bp, Artificial
  CRISPR gRNA sequence
gggcagtgtttctgaaagtg

SEQ ID NO: 443849 - DNA, 20 bp, Artificial
  CRISPR gRNA sequence
ctgaaagtgaggttctgaga

SEQ ID NO: 443850 - DNA, 20 bp, Artificial
  CRISPR gRNA sequence
tgaaagtgaggttctgagac

SEQ ID NO: 443851 - DNA, 20 bp, Artificial
  CRISPR gRNA sequence
aaagtgaggttctgagacca

SEQ ID NO: 443852 - DNA, 20 bp, Artificial
  CRISPR gRNA sequence
tgagaccagccacttcagca

SEQ ID NO: 443853 - DNA, 20 bp, Artificial
  CRISPR gRNA sequence
agaccagccacttcagcaac

SEQ ID NO: 443854 - DNA, 20 bp, Artificial
  CRISPR gRNA sequence
cagcaacacttgagaacttg

SEQ ID NO: 443855 - DNA, 20 bp, Artificial
  CRISPR gRNA sequence
agcaacacttgagaacttgt

SEQ ID NO: 443856 - DNA, 20 bp, Artificial
  CRISPR gRNA sequence
gagaacttgttagaaataaa

SEQ ID NO: 443857 - DNA, 20 bp, Artificial
  CRISPR gRNA sequence
agaacttgttagaaataaaa

SEQ ID NO: 443858 - DNA, 20 bp, Artificial
  CRISPR gRNA sequence
gttagaaataaaagttctca

SEQ ID NO: 443859 - DNA, 20 bp, Artificial
  CRISPR gRNA sequence
ttagaaataaaagttctcag

SEQ ID NO: 443860 - DNA, 20 bp, Artificial
  CRISPR gRNA sequence
gaaataaaagttctcaggct

SEQ ID NO: 443861 - DNA, 20 bp, Artificial
  CRISPR gRNA sequence
tcaggctctaccacaggcca

SEQ ID NO: 443862 - DNA, 20 bp, Artificial
  CRISPR gRNA sequence
aggctctaccacaggccaac

SEQ ID NO: 443863 - DNA, 20 bp, Artificial
  CRISPR gRNA sequence
taccacaggccaactgagtc

SEQ ID NO: 443864 - DNA, 20 bp, Artificial
  CRISPR gRNA sequence
ccacaggccaactgagtcag

SEQ ID NO: 443865 - DNA, 20 bp, Artificial
  CRISPR gRNA sequence
agtcaggaactctagcagtt

SEQ ID NO: 443866 - DNA, 20 bp, Artificial
  CRISPR gRNA sequence
tagcagttgagcccagcaat

SEQ ID NO: 443867 - DNA, 20 bp, Artificial
  CRISPR gRNA sequence
gcagttgagcccagcaatct

SEQ ID NO: 443868 - DNA, 20 bp, Artificial
  CRISPR gRNA sequence
agcccagcaatctgtgtttt

SEQ ID NO: 443869 - DNA, 20 bp, Artificial
  CRISPR gRNA sequence
tgttttcgcaaggcttccca

SEQ ID NO: 443870 - DNA, 20 bp, Artificial
  CRISPR gRNA sequence
tcgcaaggcttcccagtgat

SEQ ID NO: 443871 - DNA, 20 bp, Artificial
  CRISPR gRNA sequence
cgcaaggcttcccagtgatt

SEQ ID NO: 443872 - DNA, 20 bp, Artificial
  CRISPR gRNA sequence
gcaaggcttcccagtgattc

SEQ ID NO: 443873 - DNA, 20 bp, Artificial
  CRISPR gRNA sequence
cccagtgattctgatggcct

SEQ ID NO: 443874 - DNA, 20 bp, Artificial
  CRISPR gRNA sequence
ccagtgattctgatggcctt

SEQ ID NO: 443875 - DNA, 20 bp, Artificial
  CRISPR gRNA sequence
tgatggccttcacatctgag

SEQ ID NO: 443876 - DNA, 20 bp, Artificial
  CRISPR gRNA sequence
atggccttcacatctgagaa

SEQ ID NO: 443877 - DNA, 20 bp, Artificial
  CRISPR gRNA sequence
cacatctgagaagcattgtc

SEQ ID NO: 443878 - DNA, 20 bp, Artificial
  CRISPR gRNA sequence
acatctgagaagcattgtca

SEQ ID NO: 443879 - DNA, 20 bp, Artificial
  CRISPR gRNA sequence
agaagcattgtcacagcgaa

SEQ ID NO: 443880 - DNA, 20 bp, Artificial
  CRISPR gRNA sequence
tcacagcgaatcatcctcca

SEQ ID NO: 443881 - DNA, 20 bp, Artificial
  CRISPR gRNA sequence
caaacaggactgcagcagta

SEQ ID NO: 443882 - DNA, 20 bp, Artificial
  CRISPR gRNA sequence
cagcagtagcttcctcttta

SEQ ID NO: 443883 - DNA, 20 bp, Artificial
  CRISPR gRNA sequence
cctctttattctgtaagaca

SEQ ID NO: 443884 - DNA, 20 bp, Artificial
  CRISPR gRNA sequence
ctctttattctgtaagacat

SEQ ID NO: 443885 - DNA, 20 bp, Artificial
  CRISPR gRNA sequence
tttattctgtaagacatggc

SEQ ID NO: 443886 - DNA, 20 bp, Artificial
  CRISPR gRNA sequence
tattctgtaagacatggctt

SEQ ID NO: 443887 - DNA, 20 bp, Artificial
  CRISPR gRNA sequence
attctgtaagacatggcttg

SEQ ID NO: 443888 - DNA, 20 bp, Artificial
  CRISPR gRNA sequence
ttctgtaagacatggcttgc

SEQ ID NO: 443889 - DNA, 20 bp, Artificial
  CRISPR gRNA sequence
tgtaagacatggcttgcagt

SEQ ID NO: 443890 - DNA, 20 bp, Artificial
  CRISPR gRNA sequence
taagacatggcttgcagttt

SEQ ID NO: 443891 - DNA, 20 bp, Artificial
  CRISPR gRNA sequence
gcagttttcctgaaatggag

SEQ ID NO: 443892 - DNA, 20 bp, Artificial
  CRISPR gRNA sequence
cagttttcctgaaatggagt

SEQ ID NO: 443893 - DNA, 20 bp, Artificial
  CRISPR gRNA sequence
tcctgaaatggagtaacctc

SEQ ID NO: 443894 - DNA, 20 bp, Artificial
  CRISPR gRNA sequence
cctgaaatggagtaacctca

SEQ ID NO: 443895 - DNA, 20 bp, Artificial
  CRISPR gRNA sequence
ctgaaatggagtaacctcac

SEQ ID NO: 443896 - DNA, 20 bp, Artificial
  CRISPR gRNA sequence
aaatggagtaacctcactca

SEQ ID NO: 443897 - DNA, 20 bp, Artificial
  CRISPR gRNA sequence
actcaccgcttgagtcttgg

SEQ ID NO: 443898 - DNA, 20 bp, Artificial
  CRISPR gRNA sequence
accgcttgagtcttggctct

SEQ ID NO: 443899 - DNA, 20 bp, Artificial
  CRISPR gRNA sequence
gagtcttggctctccttctc

SEQ ID NO: 443900 - DNA, 20 bp, Artificial
  CRISPR gRNA sequence
agtcttggctctccttctct

SEQ ID NO: 443901 - DNA, 20 bp, Artificial
  CRISPR gRNA sequence
ggctctccttctctctctat

SEQ ID NO: 443902 - DNA, 20 bp, Artificial
  CRISPR gRNA sequence
gctctccttctctctctatg

SEQ ID NO: 443903 - DNA, 20 bp, Artificial
  CRISPR gRNA sequence
tccttctctctctatgcagg

SEQ ID NO: 443904 - DNA, 20 bp, Artificial
  CRISPR gRNA sequence
cttctctctctatgcagggt

SEQ ID NO: 443905 - DNA, 20 bp, Artificial
  CRISPR gRNA sequence
ctctctctatgcagggtcct

SEQ ID NO: 443906 - DNA, 20 bp, Artificial
  CRISPR gRNA sequence
tctctctatgcagggtcctc

SEQ ID NO: 443907 - DNA, 20 bp, Artificial
  CRISPR gRNA sequence
tctctatgcagggtcctcag

SEQ ID NO: 443908 - DNA, 20 bp, Artificial
  CRISPR gRNA sequence
tctatgcagggtcctcagaa

SEQ ID NO: 443909 - DNA, 20 bp, Artificial
  CRISPR gRNA sequence
tatgcagggtcctcagaagt

SEQ ID NO: 443910 - DNA, 20 bp, Artificial
  CRISPR gRNA sequence
tgcagggtcctcagaagtgg

SEQ ID NO: 443911 - DNA, 20 bp, Artificial
  CRISPR gRNA sequence
agaagtggaatacagagcgg

SEQ ID NO: 443912 - DNA, 20 bp, Artificial
  CRISPR gRNA sequence
tctgccctgcttctacaccc

SEQ ID NO: 443913 - DNA, 20 bp, Artificial
  CRISPR gRNA sequence
ccctgcttctacaccccagc

SEQ ID NO: 443914 - DNA, 20 bp, Artificial
  CRISPR gRNA sequence
cttctacaccccagccgccc

SEQ ID NO: 443915 - DNA, 20 bp, Artificial
  CRISPR gRNA sequence
ctacaccccagccgccccag

SEQ ID NO: 443916 - DNA, 20 bp, Artificial
  CRISPR gRNA sequence
tacaccccagccgccccagg

SEQ ID NO: 443917 - DNA, 20 bp, Artificial
  CRISPR gRNA sequence
caccccagccgccccaggga

SEQ ID NO: 443918 - DNA, 20 bp, Artificial
  CRISPR gRNA sequence
gtgcccgtctgctggggcaa

SEQ ID NO: 443919 - DNA, 20 bp, Artificial
  CRISPR gRNA sequence
ctggggcaaaggagcctgtc

SEQ ID NO: 443920 - DNA, 20 bp, Artificial
  CRISPR gRNA sequence
gggcaaaggagcctgtcctg

SEQ ID NO: 443921 - DNA, 20 bp, Artificial
  CRISPR gRNA sequence
tcctgtgtttgaatgtggca

SEQ ID NO: 443922 - DNA, 20 bp, Artificial
  CRISPR gRNA sequence
tgtttgaatgtggcaacgtg

SEQ ID NO: 443923 - DNA, 20 bp, Artificial
  CRISPR gRNA sequence
gaatgtggcaacgtggtgct

SEQ ID NO: 443924 - DNA, 20 bp, Artificial
  CRISPR gRNA sequence
aatgtggcaacgtggtgctc

SEQ ID NO: 443925 - DNA, 20 bp, Artificial
  CRISPR gRNA sequence
aggactgatgaaagggatgt

SEQ ID NO: 443926 - DNA, 20 bp, Artificial
  CRISPR gRNA sequence
atgaaagggatgtgaattat

SEQ ID NO: 443927 - DNA, 20 bp, Artificial
  CRISPR gRNA sequence
ttggacatccagatactggc

SEQ ID NO: 443928 - DNA, 20 bp, Artificial
  CRISPR gRNA sequence
gacatccagatactggctaa

SEQ ID NO: 443929 - DNA, 20 bp, Artificial
  CRISPR gRNA sequence
gctaaatggggatttccgca

SEQ ID NO: 443930 - DNA, 20 bp, Artificial
  CRISPR gRNA sequence
aatggggatttccgcaaagg

SEQ ID NO: 443931 - DNA, 20 bp, Artificial
  CRISPR gRNA sequence
ccgcaaaggagatgtgtccc

SEQ ID NO: 443932 - DNA, 20 bp, Artificial
  CRISPR gRNA sequence
cgcaaaggagatgtgtccct

SEQ ID NO: 443933 - DNA, 20 bp, Artificial
  CRISPR gRNA sequence
accatagagaatgtgactct

SEQ ID NO: 443934 - DNA, 20 bp, Artificial
  CRISPR gRNA sequence
tagcagacagtgggatctac

SEQ ID NO: 443935 - DNA, 20 bp, Artificial
  CRISPR gRNA sequence
gcagacagtgggatctactg

SEQ ID NO: 443936 - DNA, 20 bp, Artificial
  CRISPR gRNA sequence
ctgctgccggatccaaatcc

SEQ ID NO: 443937 - DNA, 20 bp, Artificial
  CRISPR gRNA sequence
ctgccggatccaaatcccag

SEQ ID NO: 443938 - DNA, 20 bp, Artificial
  CRISPR gRNA sequence
ccggatccaaatcccaggca

SEQ ID NO: 443939 - DNA, 20 bp, Artificial
  CRISPR gRNA sequence
aacctgaagttggtcatcaa

SEQ ID NO: 443940 - DNA, 20 bp, Artificial
  CRISPR gRNA sequence
acctgaagttggtcatcaaa

SEQ ID NO: 443941 - DNA, 20 bp, Artificial
  CRISPR gRNA sequence
aagttggtcatcaaaccagg

SEQ ID NO: 443942 - DNA, 20 bp, Artificial
  CRISPR gRNA sequence
gtcatcaaaccaggtgagtg

SEQ ID NO: 443943 - DNA, 20 bp, Artificial
  CRISPR gRNA sequence
gcatgccatctttatgaata

SEQ ID NO: 443944 - DNA, 20 bp, Artificial
  CRISPR gRNA sequence
catgccatctttatgaataa

SEQ ID NO: 443945 - DNA, 20 bp, Artificial
  CRISPR gRNA sequence
tatgaataagatttatctgt

SEQ ID NO: 443946 - DNA, 20 bp, Artificial
  CRISPR gRNA sequence
atgaataagatttatctgtg

SEQ ID NO: 443947 - DNA, 20 bp, Artificial
  CRISPR gRNA sequence
tgaataagatttatctgtgg

SEQ ID NO: 443948 - DNA, 20 bp, Artificial
  CRISPR gRNA sequence
atctgtggatcatattaaag

SEQ ID NO: 443949 - DNA, 20 bp, Artificial
  CRISPR gRNA sequence
tctgtggatcatattaaagg

SEQ ID NO: 443950 - DNA, 20 bp, Artificial
  CRISPR gRNA sequence
tggatcatattaaaggtact

SEQ ID NO: 443951 - DNA, 20 bp, Artificial
  CRISPR gRNA sequence
aaggtactgattgttctcat

SEQ ID NO: 443952 - DNA, 20 bp, Artificial
  CRISPR gRNA sequence
attgttctcatctctgactt

SEQ ID NO: 443953 - DNA, 20 bp, Artificial
  CRISPR gRNA sequence
ttctcatctctgacttccct

SEQ ID NO: 443954 - DNA, 20 bp, Artificial
  CRISPR gRNA sequence
tcatctctgacttccctaat

SEQ ID NO: 443955 - DNA, 20 bp, Artificial
  CRISPR gRNA sequence
atctctgacttccctaatta

SEQ ID NO: 443956 - DNA, 20 bp, Artificial
  CRISPR gRNA sequence
tgacttccctaattatagcc

SEQ ID NO: 443957 - DNA, 20 bp, Artificial
  CRISPR gRNA sequence
acttccctaattatagccct

SEQ ID NO: 443958 - DNA, 20 bp, Artificial
  CRISPR gRNA sequence
ccctaattatagccctggag

SEQ ID NO: 443959 - DNA, 20 bp, Artificial
  CRISPR gRNA sequence
cctaattatagccctggagg

SEQ ID NO: 443960 - DNA, 20 bp, Artificial
  CRISPR gRNA sequence
attatagccctggaggaggg

SEQ ID NO: 443961 - DNA, 20 bp, Artificial
  CRISPR gRNA sequence
tagccctggaggagggccac

SEQ ID NO: 443962 - DNA, 20 bp, Artificial
  CRISPR gRNA sequence
gaggagggccactaagacct

SEQ ID NO: 443963 - DNA, 20 bp, Artificial
  CRISPR gRNA sequence
agacctaaagtttaacaggc

SEQ ID NO: 443964 - DNA, 20 bp, Artificial
  CRISPR gRNA sequence
aagtttaacaggccccattg

SEQ ID NO: 443965 - DNA, 20 bp, Artificial
  CRISPR gRNA sequence
aacaggccccattggtgatg

SEQ ID NO: 443966 - DNA, 20 bp, Artificial
  CRISPR gRNA sequence
acaggccccattggtgatgc

SEQ ID NO: 443967 - DNA, 20 bp, Artificial
  CRISPR gRNA sequence
gtgatgctcagtgatattta

SEQ ID NO: 443968 - DNA, 20 bp, Artificial
  CRISPR gRNA sequence
agtgatatttaacaccttct

SEQ ID NO: 443969 - DNA, 20 bp, Artificial
  CRISPR gRNA sequence
aacaccttctctctgtttta

SEQ ID NO: 443970 - DNA, 20 bp, Artificial
  CRISPR gRNA sequence
acaccttctctctgttttaa

SEQ ID NO: 443971 - DNA, 20 bp, Artificial
  CRISPR gRNA sequence
ctctctgttttaaaactcat

SEQ ID NO: 443972 - DNA, 20 bp, Artificial
  CRISPR gRNA sequence
tctctgttttaaaactcatg

SEQ ID NO: 443973 - DNA, 20 bp, Artificial
  CRISPR gRNA sequence
tctgttttaaaactcatggg

SEQ ID NO: 443974 - DNA, 20 bp, Artificial
  CRISPR gRNA sequence
tgttttaaaactcatgggtg

SEQ ID NO: 443975 - DNA, 20 bp, Artificial
  CRISPR gRNA sequence
ttttaaaactcatgggtgtg

SEQ ID NO: 443976 - DNA, 20 bp, Artificial
  CRISPR gRNA sequence
taaaactcatgggtgtgcct

SEQ ID NO: 443977 - DNA, 20 bp, Artificial
  CRISPR gRNA sequence
aaaactcatgggtgtgcctg

SEQ ID NO: 443978 - DNA, 20 bp, Artificial
  CRISPR gRNA sequence
aaactcatgggtgtgcctgg

SEQ ID NO: 443979 - DNA, 20 bp, Artificial
  CRISPR gRNA sequence
atgggtgtgcctgggcgtgg

SEQ ID NO: 443980 - DNA, 20 bp, Artificial
  CRISPR gRNA sequence
ggcgtggtggctcacacctc

SEQ ID NO: 443981 - DNA, 20 bp, Artificial
  CRISPR gRNA sequence
acacctctaatcccagcact

SEQ ID NO: 443982 - DNA, 20 bp, Artificial
  CRISPR gRNA sequence
taatcccagcactttgggag

SEQ ID NO: 443983 - DNA, 20 bp, Artificial
  CRISPR gRNA sequence
atcccagcactttgggaggc

SEQ ID NO: 443984 - DNA, 20 bp, Artificial
  CRISPR gRNA sequence
tgggaggctgaggccggtgg

SEQ ID NO: 443985 - DNA, 20 bp, Artificial
  CRISPR gRNA sequence
gggaggctgaggccggtgga

SEQ ID NO: 443986 - DNA, 20 bp, Artificial
  CRISPR gRNA sequence
ggaggctgaggccggtggat

SEQ ID NO: 443987 - DNA, 20 bp, Artificial
  CRISPR gRNA sequence
aggccggtggatcatgaggt

SEQ ID NO: 443988 - DNA, 20 bp, Artificial
  CRISPR gRNA sequence
gagaccagcctggccaacat

SEQ ID NO: 443989 - DNA, 20 bp, Artificial
  CRISPR gRNA sequence
gccaacatagtaaaaccttg

SEQ ID NO: 443990 - DNA, 20 bp, Artificial
  CRISPR gRNA sequence
gtctccactaaaaatacaaa

SEQ ID NO: 443991 - DNA, 20 bp, Artificial
  CRISPR gRNA sequence
tctccactaaaaatacaaaa

SEQ ID NO: 443992 - DNA, 20 bp, Artificial
  CRISPR gRNA sequence
cactaaaaatacaaaaaatt

SEQ ID NO: 443993 - DNA, 20 bp, Artificial
  CRISPR gRNA sequence
aaaatacaaaaaattagcca

SEQ ID NO: 443994 - DNA, 20 bp, Artificial
  CRISPR gRNA sequence
gccaggcatggttacgggag

SEQ ID NO: 443995 - DNA, 20 bp, Artificial
  CRISPR gRNA sequence
cgggagcctgtaattctagc

SEQ ID NO: 443996 - DNA, 20 bp, Artificial
  CRISPR gRNA sequence
taattctagctacttggggg

SEQ ID NO: 443997 - DNA, 20 bp, Artificial
  CRISPR gRNA sequence
tagctacttggggggctgaa

SEQ ID NO: 443998 - DNA, 20 bp, Artificial
  CRISPR gRNA sequence
gctacttggggggctgaagc

SEQ ID NO: 443999 - DNA, 20 bp, Artificial
  CRISPR gRNA sequence
cttggggggctgaagcagga

SEQ ID NO: 444000 - DNA, 20 bp, Artificial
  CRISPR gRNA sequence
ggggggctgaagcaggagaa

SEQ ID NO: 444001 - DNA, 20 bp, Artificial
  CRISPR gRNA sequence
gggggctgaagcaggagaat

SEQ ID NO: 444002 - DNA, 20 bp, Artificial
  CRISPR gRNA sequence
aagcaggagaatcacttgaa

SEQ ID NO: 444003 - DNA, 20 bp, Artificial
  CRISPR gRNA sequence
gaacctgggagtcggaggtt

SEQ ID NO: 444004 - DNA, 20 bp, Artificial
  CRISPR gRNA sequence
aacctgggagtcggaggttg

SEQ ID NO: 444005 - DNA, 20 bp, Artificial
  CRISPR gRNA sequence
ggagtcggaggttgtggtaa

SEQ ID NO: 444006 - DNA, 20 bp, Artificial
  CRISPR gRNA sequence
tggtaagccaagatctcgcc

SEQ ID NO: 444007 - DNA, 20 bp, Artificial
  CRISPR gRNA sequence
gccattgtactccagcctgg

SEQ ID NO: 444008 - DNA, 20 bp, Artificial
  CRISPR gRNA sequence
tactccagcctggctgacaa

SEQ ID NO: 444009 - DNA, 20 bp, Artificial
  CRISPR gRNA sequence
cagcctggctgacaagggtg

SEQ ID NO: 444010 - DNA, 20 bp, Artificial
  CRISPR gRNA sequence
gctgacaagggtgaaactct

SEQ ID NO: 444011 - DNA, 20 bp, Artificial
  CRISPR gRNA sequence
acaagggtgaaactctgtct

SEQ ID NO: 444012 - DNA, 20 bp, Artificial
  CRISPR gRNA sequence
tgtctcaaaaaaaaaaaaag

SEQ ID NO: 444013 - DNA, 20 bp, Artificial
  CRISPR gRNA sequence
tctcaaaaaaaaaaaaagaa

SEQ ID NO: 444014 - DNA, 20 bp, Artificial
  CRISPR gRNA sequence
aaaaaaaaaaaaagaaaaga

SEQ ID NO: 444015 - DNA, 20 bp, Artificial
  CRISPR gRNA sequence
atgggtggaatgtatagatg

SEQ ID NO: 444016 - DNA, 20 bp, Artificial
  CRISPR gRNA sequence
gatcagtggttagagaccct

SEQ ID NO: 444017 - DNA, 20 bp, Artificial
  CRISPR gRNA sequence
gagaccctgactctcattag

SEQ ID NO: 444018 - DNA, 20 bp, Artificial
  CRISPR gRNA sequence
actctcattagaatcacata

SEQ ID NO: 444019 - DNA, 20 bp, Artificial
  CRISPR gRNA sequence
tcattagaatcacatagaga

SEQ ID NO: 444020 - DNA, 20 bp, Artificial
  CRISPR gRNA sequence
attagaatcacatagagagt

SEQ ID NO: 444021 - DNA, 20 bp, Artificial
  CRISPR gRNA sequence
gaatcacatagagagttttt

SEQ ID NO: 444022 - DNA, 20 bp, Artificial
  CRISPR gRNA sequence
ttaaacaactatagatgcca

SEQ ID NO: 444023 - DNA, 20 bp, Artificial
  CRISPR gRNA sequence
taaacaactatagatgccag

SEQ ID NO: 444024 - DNA, 20 bp, Artificial
  CRISPR gRNA sequence
aaacaactatagatgccagg

SEQ ID NO: 444025 - DNA, 20 bp, Artificial
  CRISPR gRNA sequence
aacaactatagatgccaggt

SEQ ID NO: 444026 - DNA, 20 bp, Artificial
  CRISPR gRNA sequence
tagatgccaggtacagtggc

SEQ ID NO: 444027 - DNA, 20 bp, Artificial
  CRISPR gRNA sequence
atgcctataatcccaatact

SEQ ID NO: 444028 - DNA, 20 bp, Artificial
  CRISPR gRNA sequence
taatcccaatactttgagag

SEQ ID NO: 444029 - DNA, 20 bp, Artificial
  CRISPR gRNA sequence
tgagaggctgaagcaggagg

SEQ ID NO: 444030 - DNA, 20 bp, Artificial
  CRISPR gRNA sequence
gagaggctgaagcaggagga

SEQ ID NO: 444031 - DNA, 20 bp, Artificial
  CRISPR gRNA sequence
agaggctgaagcaggaggat

SEQ ID NO: 444032 - DNA, 20 bp, Artificial
  CRISPR gRNA sequence
aagcaggaggatcacttgag

SEQ ID NO: 444033 - DNA, 20 bp, Artificial
  CRISPR gRNA sequence
gaggtcaggagtttgagacc

SEQ ID NO: 444034 - DNA, 20 bp, Artificial
  CRISPR gRNA sequence
aggtcaggagtttgagacca

SEQ ID NO: 444035 - DNA, 20 bp, Artificial
  CRISPR gRNA sequence
gagaccagcctggctgatat

SEQ ID NO: 444036 - DNA, 20 bp, Artificial
  CRISPR gRNA sequence
agaccagcctggctgatata

SEQ ID NO: 444037 - DNA, 20 bp, Artificial
  CRISPR gRNA sequence
gctgatatactgtggctacc

SEQ ID NO: 444038 - DNA, 20 bp, Artificial
  CRISPR gRNA sequence
atatactgtggctaccccta

SEQ ID NO: 444039 - DNA, 20 bp, Artificial
  CRISPR gRNA sequence
tggctacccctatctcttaa

SEQ ID NO: 444040 - DNA, 20 bp, Artificial
  CRISPR gRNA sequence
cccctatctcttaaaaagca

SEQ ID NO: 444041 - DNA, 20 bp, Artificial
  CRISPR gRNA sequence
tctcttaaaaagcagaagaa

SEQ ID NO: 444042 - DNA, 20 bp, Artificial
  CRISPR gRNA sequence
ttaaaaagcagaagaaaaaa

SEQ ID NO: 444043 - DNA, 20 bp, Artificial
  CRISPR gRNA sequence
aaaaagcagaagaaaaaacc

SEQ ID NO: 444044 - DNA, 20 bp, Artificial
  CRISPR gRNA sequence
aaaagcagaagaaaaaaccc

SEQ ID NO: 444045 - DNA, 20 bp, Artificial
  CRISPR gRNA sequence
ccaaaaaccagagaaatcag

SEQ ID NO: 444046 - DNA, 20 bp, Artificial
  CRISPR gRNA sequence
tggaggtagatgctaagcat

SEQ ID NO: 444047 - DNA, 20 bp, Artificial
  CRISPR gRNA sequence
gaggtagatgctaagcatta

SEQ ID NO: 444048 - DNA, 20 bp, Artificial
  CRISPR gRNA sequence
agcattagctttttacagag

SEQ ID NO: 444049 - DNA, 20 bp, Artificial
  CRISPR gRNA sequence
gctttttacagagtctacct

SEQ ID NO: 444050 - DNA, 20 bp, Artificial
  CRISPR gRNA sequence
tttacagagtctacctcagg

SEQ ID NO: 444051 - DNA, 20 bp, Artificial
  CRISPR gRNA sequence
ttacagagtctacctcaggt

SEQ ID NO: 444052 - DNA, 20 bp, Artificial
  CRISPR gRNA sequence
tacagagtctacctcaggtg

SEQ ID NO: 444053 - DNA, 20 bp, Artificial
  CRISPR gRNA sequence
acagagtctacctcaggtga

SEQ ID NO: 444054 - DNA, 20 bp, Artificial
  CRISPR gRNA sequence
cagagtctacctcaggtgat

SEQ ID NO: 444055 - DNA, 20 bp, Artificial
  CRISPR gRNA sequence
cctcaggtgattttacccca

SEQ ID NO: 444056 - DNA, 20 bp, Artificial
  CRISPR gRNA sequence
aggtgattttaccccaggtg

SEQ ID NO: 444057 - DNA, 20 bp, Artificial
  CRISPR gRNA sequence
taccccaggtgcagccagca

SEQ ID NO: 444058 - DNA, 20 bp, Artificial
  CRISPR gRNA sequence
accccaggtgcagccagcat

SEQ ID NO: 444059 - DNA, 20 bp, Artificial
  CRISPR gRNA sequence
ccccaggtgcagccagcatg

SEQ ID NO: 444060 - DNA, 20 bp, Artificial
  CRISPR gRNA sequence
ctgggttatgcatgtatgct

SEQ ID NO: 444061 - DNA, 20 bp, Artificial
  CRISPR gRNA sequence
ggttatgcatgtatgctggg

SEQ ID NO: 444062 - DNA, 20 bp, Artificial
  CRISPR gRNA sequence
tgcatgtatgctgggaggtg

SEQ ID NO: 444063 - DNA, 20 bp, Artificial
  CRISPR gRNA sequence
ggaggtgaacagacttaaga

SEQ ID NO: 444064 - DNA, 20 bp, Artificial
  CRISPR gRNA sequence
aagatttctataacatgtac

SEQ ID NO: 444065 - DNA, 20 bp, Artificial
  CRISPR gRNA sequence
agatttctataacatgtact

SEQ ID NO: 444066 - DNA, 20 bp, Artificial
  CRISPR gRNA sequence
ctataacatgtactttgtgc

SEQ ID NO: 444067 - DNA, 20 bp, Artificial
  CRISPR gRNA sequence
tataacatgtactttgtgcc

SEQ ID NO: 444068 - DNA, 20 bp, Artificial
  CRISPR gRNA sequence
taacatgtactttgtgccca

SEQ ID NO: 444069 - DNA, 20 bp, Artificial
  CRISPR gRNA sequence
tgtgcccagatagagctgag

SEQ ID NO: 444070 - DNA, 20 bp, Artificial
  CRISPR gRNA sequence
gtgcccagatagagctgagt

SEQ ID NO: 444071 - DNA, 20 bp, Artificial
  CRISPR gRNA sequence
tgcccagatagagctgagtt

SEQ ID NO: 444072 - DNA, 20 bp, Artificial
  CRISPR gRNA sequence
agtttacatctaactctgcc

SEQ ID NO: 444073 - DNA, 20 bp, Artificial
  CRISPR gRNA sequence
acatctaactctgcctctta

SEQ ID NO: 444074 - DNA, 20 bp, Artificial
  CRISPR gRNA sequence
catctaactctgcctcttac

SEQ ID NO: 444075 - DNA, 20 bp, Artificial
  CRISPR gRNA sequence
actctgcctcttactagcta

SEQ ID NO: 444076 - DNA, 20 bp, Artificial
  CRISPR gRNA sequence
tgcctcttactagctatata

SEQ ID NO: 444077 - DNA, 20 bp, Artificial
  CRISPR gRNA sequence
cctcttactagctatataat

SEQ ID NO: 444078 - DNA, 20 bp, Artificial
  CRISPR gRNA sequence
ttactagctatataatcctg

SEQ ID NO: 444079 - DNA, 20 bp, Artificial
  CRISPR gRNA sequence
actagctatataatcctgag

SEQ ID NO: 444080 - DNA, 20 bp, Artificial
  CRISPR gRNA sequence
ctagctatataatcctgagc

SEQ ID NO: 444081 - DNA, 20 bp, Artificial
  CRISPR gRNA sequence
gctatataatcctgagcaag

SEQ ID NO: 444082 - DNA, 20 bp, Artificial
  CRISPR gRNA sequence
tataatcctgagcaagttat

SEQ ID NO: 444083 - DNA, 20 bp, Artificial
  CRISPR gRNA sequence
agcaagttattgaaacgctg

SEQ ID NO: 444084 - DNA, 20 bp, Artificial
  CRISPR gRNA sequence
ttgaaacgctgtgagctcct

SEQ ID NO: 444085 - DNA, 20 bp, Artificial
  CRISPR gRNA sequence
aaacgctgtgagctcctctt

SEQ ID NO: 444086 - DNA, 20 bp, Artificial
  CRISPR gRNA sequence
tgagctcctcttctataaaa

SEQ ID NO: 444087 - DNA, 20 bp, Artificial
  CRISPR gRNA sequence
ctcttctataaaatatgaca

SEQ ID NO: 444088 - DNA, 20 bp, Artificial
  CRISPR gRNA sequence
ttctataaaatatgacaata

SEQ ID NO: 444089 - DNA, 20 bp, Artificial
  CRISPR gRNA sequence
ctataaaatatgacaataat

SEQ ID NO: 444090 - DNA, 20 bp, Artificial
  CRISPR gRNA sequence
tataaaatatgacaataata

SEQ ID NO: 444091 - DNA, 20 bp, Artificial
  CRISPR gRNA sequence
taaaatatgacaataatacc

SEQ ID NO: 444092 - DNA, 20 bp, Artificial
  CRISPR gRNA sequence
gaaggattttatgtgataat

SEQ ID NO: 444093 - DNA, 20 bp, Artificial
  CRISPR gRNA sequence
tatgtgataatattttatta

SEQ ID NO: 444094 - DNA, 20 bp, Artificial
  CRISPR gRNA sequence
atgtgataatattttattaa

SEQ ID NO: 444095 - DNA, 20 bp, Artificial
  CRISPR gRNA sequence
tgtgataatattttattaaa

SEQ ID NO: 444096 - DNA, 20 bp, Artificial
  CRISPR gRNA sequence
tattaaaagcctttataggt

SEQ ID NO: 444097 - DNA, 20 bp, Artificial
  CRISPR gRNA sequence
attaaaagcctttataggtt

SEQ ID NO: 444098 - DNA, 20 bp, Artificial
  CRISPR gRNA sequence
ttaaaagcctttataggttg

SEQ ID NO: 444099 - DNA, 20 bp, Artificial
  CRISPR gRNA sequence
aaagcctttataggttgggc

SEQ ID NO: 444100 - DNA, 20 bp, Artificial
  CRISPR gRNA sequence
tataggttgggcatcccaaa

SEQ ID NO: 444101 - DNA, 20 bp, Artificial
  CRISPR gRNA sequence
ataggttgggcatcccaaat

SEQ ID NO: 444102 - DNA, 20 bp, Artificial
  CRISPR gRNA sequence
taggttgggcatcccaaatc

SEQ ID NO: 444103 - DNA, 20 bp, Artificial
  CRISPR gRNA sequence
ggcatcccaaatctgaaaat

SEQ ID NO: 444104 - DNA, 20 bp, Artificial
  CRISPR gRNA sequence
aaaatctaaaacctaaaatg

SEQ ID NO: 444105 - DNA, 20 bp, Artificial
  CRISPR gRNA sequence
aaacctaaaatgcaccaaaa

SEQ ID NO: 444106 - DNA, 20 bp, Artificial
  CRISPR gRNA sequence
aaatgcaccaaaatctgaaa

SEQ ID NO: 444107 - DNA, 20 bp, Artificial
  CRISPR gRNA sequence
aaatgctctaaaatccaaaa

SEQ ID NO: 444108 - DNA, 20 bp, Artificial
  CRISPR gRNA sequence
taaaatccaaaactttttgg

SEQ ID NO: 444109 - DNA, 20 bp, Artificial
  CRISPR gRNA sequence
aaatccaaaactttttggac

SEQ ID NO: 444110 - DNA, 20 bp, Artificial
  CRISPR gRNA sequence
tttggacactgacatgacat

SEQ ID NO: 444111 - DNA, 20 bp, Artificial
  CRISPR gRNA sequence
ttggacactgacatgacatt

SEQ ID NO: 444112 - DNA, 20 bp, Artificial
  CRISPR gRNA sequence
tggacactgacatgacattc

SEQ ID NO: 444113 - DNA, 20 bp, Artificial
  CRISPR gRNA sequence
ggacactgacatgacattca

SEQ ID NO: 444114 - DNA, 20 bp, Artificial
  CRISPR gRNA sequence
gacactgacatgacattcaa

SEQ ID NO: 444115 - DNA, 20 bp, Artificial
  CRISPR gRNA sequence
acatgacattcaaaggaaaa

SEQ ID NO: 444116 - DNA, 20 bp, Artificial
  CRISPR gRNA sequence
aaaggaaaagctcattggaa

SEQ ID NO: 444117 - DNA, 20 bp, Artificial
  CRISPR gRNA sequence
attggaacataagtataggc

SEQ ID NO: 444118 - DNA, 20 bp, Artificial
  CRISPR gRNA sequence
gaacataagtataggcagat

SEQ ID NO: 444119 - DNA, 20 bp, Artificial
  CRISPR gRNA sequence
aaaaataaaaaaataaaaac

SEQ ID NO: 444120 - DNA, 20 bp, Artificial
  CRISPR gRNA sequence
ggcgtggtggctcatgccta

SEQ ID NO: 444121 - DNA, 20 bp, Artificial
  CRISPR gRNA sequence
atgcctataatcccagcact

SEQ ID NO: 444122 - DNA, 20 bp, Artificial
  CRISPR gRNA sequence
taatcccagcactttgggag

SEQ ID NO: 444123 - DNA, 20 bp, Artificial
  CRISPR gRNA sequence
tgggaggctgaggtgggtgg

SEQ ID NO: 444124 - DNA, 20 bp, Artificial
  CRISPR gRNA sequence
gggaggctgaggtgggtgga

SEQ ID NO: 444125 - DNA, 20 bp, Artificial
  CRISPR gRNA sequence
ggaggctgaggtgggtggat

SEQ ID NO: 444126 - DNA, 20 bp, Artificial
  CRISPR gRNA sequence
aggtgggtggatcacctgag

SEQ ID NO: 444127 - DNA, 20 bp, Artificial
  CRISPR gRNA sequence
aggtcgggagttcgagacca

SEQ ID NO: 444128 - DNA, 20 bp, Artificial
  CRISPR gRNA sequence
gagaccagtctgaccaacat

SEQ ID NO: 444129 - DNA, 20 bp, Artificial
  CRISPR gRNA sequence
accaacatggagaaaccctg

SEQ ID NO: 444130 - DNA, 20 bp, Artificial
  CRISPR gRNA sequence
tctctactaaaaatacaaaa

SEQ ID NO: 444131 - DNA, 20 bp, Artificial
  CRISPR gRNA sequence
tactaaaaatacaaaattag

SEQ ID NO: 444132 - DNA, 20 bp, Artificial
  CRISPR gRNA sequence
ctaaaaatacaaaattagcc

SEQ ID NO: 444133 - DNA, 20 bp, Artificial
  CRISPR gRNA sequence
aaaatacaaaattagccagg

SEQ ID NO: 444134 - DNA, 20 bp, Artificial
  CRISPR gRNA sequence
gccaggtgtggttgcacatg

SEQ ID NO: 444135 - DNA, 20 bp, Artificial
  CRISPR gRNA sequence
cacatgcctgtagtcccagc

SEQ ID NO: 444136 - DNA, 20 bp, Artificial
  CRISPR gRNA sequence
tagtcccagctactcaggag

SEQ ID NO: 444137 - DNA, 20 bp, Artificial
  CRISPR gRNA sequence
ctcaggagtctgaggcagga

SEQ ID NO: 444138 - DNA, 20 bp, Artificial
  CRISPR gRNA sequence
aggagtctgaggcaggagaa

SEQ ID NO: 444139 - DNA, 20 bp, Artificial
  CRISPR gRNA sequence
aggcaggagaattgcttgaa

SEQ ID NO: 444140 - DNA, 20 bp, Artificial
  CRISPR gRNA sequence
cttgaacccaggaggcggag

SEQ ID NO: 444141 - DNA, 20 bp, Artificial
  CRISPR gRNA sequence
gaacccaggaggcggaggtt

SEQ ID NO: 444142 - DNA, 20 bp, Artificial
  CRISPR gRNA sequence
aacccaggaggcggaggttg

SEQ ID NO: 444143 - DNA, 20 bp, Artificial
  CRISPR gRNA sequence
cagtgagccgagattatgcc

SEQ ID NO: 444144 - DNA, 20 bp, Artificial
  CRISPR gRNA sequence
tgccattgcactccagcctg

SEQ ID NO: 444145 - DNA, 20 bp, Artificial
  CRISPR gRNA sequence
cactccagcctgggcaacaa

SEQ ID NO: 444146 - DNA, 20 bp, Artificial
  CRISPR gRNA sequence
cagcctgggcaacaagagca

SEQ ID NO: 444147 - DNA, 20 bp, Artificial
  CRISPR gRNA sequence
ggcaacaagagcaaaactcc

SEQ ID NO: 444148 - DNA, 20 bp, Artificial
  CRISPR gRNA sequence
cgtttcaaaaaaaaaaaaaa

SEQ ID NO: 444149 - DNA, 20 bp, Artificial
  CRISPR gRNA sequence
caaaaaaaaaaaaaaaattc

SEQ ID NO: 444150 - DNA, 20 bp, Artificial
  CRISPR gRNA sequence
aaaaaaaaaaaaaaaattca

SEQ ID NO: 444151 - DNA, 20 bp, Artificial
  CRISPR gRNA sequence
aaaatctaaaacatttctga

SEQ ID NO: 444152 - DNA, 20 bp, Artificial
  CRISPR gRNA sequence
aaacatttctgatctcaagc

SEQ ID NO: 444153 - DNA, 20 bp, Artificial
  CRISPR gRNA sequence
ctgatctcaagcatttcaga

SEQ ID NO: 444154 - DNA, 20 bp, Artificial
  CRISPR gRNA sequence
tgatctcaagcatttcagat

SEQ ID NO: 444155 - DNA, 20 bp, Artificial
  CRISPR gRNA sequence
atctcaagcatttcagataa

SEQ ID NO: 444156 - DNA, 20 bp, Artificial
  CRISPR gRNA sequence
aagcatttcagataaggagt

SEQ ID NO: 444157 - DNA, 20 bp, Artificial
  CRISPR gRNA sequence
cagataaggagtcttcaacc

SEQ ID NO: 444158 - DNA, 20 bp, Artificial
  CRISPR gRNA sequence
agataaggagtcttcaacct

SEQ ID NO: 444159 - DNA, 20 bp, Artificial
  CRISPR gRNA sequence
caacctgtaattatggccat

SEQ ID NO: 444160 - DNA, 20 bp, Artificial
  CRISPR gRNA sequence
aacctgtaattatggccatt

SEQ ID NO: 444161 - DNA, 20 bp, Artificial
  CRISPR gRNA sequence
taattatggccatttgtgtg

SEQ ID NO: 444162 - DNA, 20 bp, Artificial
  CRISPR gRNA sequence
tggccatttgtgtggctgtt

SEQ ID NO: 444163 - DNA, 20 bp, Artificial
  CRISPR gRNA sequence
gtgtggctgttagttccgct

SEQ ID NO: 444164 - DNA, 20 bp, Artificial
  CRISPR gRNA sequence
tgtggctgttagttccgcta

SEQ ID NO: 444165 - DNA, 20 bp, Artificial
  CRISPR gRNA sequence
ttagttccgctattaataat

SEQ ID NO: 444166 - DNA, 20 bp, Artificial
  CRISPR gRNA sequence
gttccgctattaataatcag

SEQ ID NO: 444167 - DNA, 20 bp, Artificial
  CRISPR gRNA sequence
cgctattaataatcagaatg

SEQ ID NO: 444168 - DNA, 20 bp, Artificial
  CRISPR gRNA sequence
ttaataatcagaatgtaaca

SEQ ID NO: 444169 - DNA, 20 bp, Artificial
  CRISPR gRNA sequence
ataatcagaatgtaacaatg

SEQ ID NO: 444170 - DNA, 20 bp, Artificial
  CRISPR gRNA sequence
catcttacctttgtcaaaca

SEQ ID NO: 444171 - DNA, 20 bp, Artificial
  CRISPR gRNA sequence
acctttgtcaaacatttgaa

SEQ ID NO: 444172 - DNA, 20 bp, Artificial
  CRISPR gRNA sequence
cctttgtcaaacatttgaag

SEQ ID NO: 444173 - DNA, 20 bp, Artificial
  CRISPR gRNA sequence
tgtcaaacatttgaagtgtg

SEQ ID NO: 444174 - DNA, 20 bp, Artificial
  CRISPR gRNA sequence
gtcaaacatttgaagtgtgt

SEQ ID NO: 444175 - DNA, 20 bp, Artificial
  CRISPR gRNA sequence
tcaaacatttgaagtgtgtg

SEQ ID NO: 444176 - DNA, 20 bp, Artificial
  CRISPR gRNA sequence
gaagtgtgtgatacactctc

SEQ ID NO: 444177 - DNA, 20 bp, Artificial
  CRISPR gRNA sequence
aagtgtgtgatacactctca

SEQ ID NO: 444178 - DNA, 20 bp, Artificial
  CRISPR gRNA sequence
tcaacgtaggtatccaggca

SEQ ID NO: 444179 - DNA, 20 bp, Artificial
  CRISPR gRNA sequence
aacgtaggtatccaggcagg

SEQ ID NO: 444180 - DNA, 20 bp, Artificial
  CRISPR gRNA sequence
ggaagctgagggtgtatttc

SEQ ID NO: 444181 - DNA, 20 bp, Artificial
  CRISPR gRNA sequence
gaagctgagggtgtatttct

SEQ ID NO: 444182 - DNA, 20 bp, Artificial
  CRISPR gRNA sequence
agggtgtatttctctttctt

SEQ ID NO: 444183 - DNA, 20 bp, Artificial
  CRISPR gRNA sequence
ctctttcttaattgtctttc

SEQ ID NO: 444184 - DNA, 20 bp, Artificial
  CRISPR gRNA sequence
tctttcttaattgtctttcg

SEQ ID NO: 444185 - DNA, 20 bp, Artificial
  CRISPR gRNA sequence
tttcttaattgtctttcgca

SEQ ID NO: 444186 - DNA, 20 bp, Artificial
  CRISPR gRNA sequence
tcttaattgtctttcgcatt

SEQ ID NO: 444187 - DNA, 20 bp, Artificial
  CRISPR gRNA sequence
cttaattgtctttcgcattt

SEQ ID NO: 444188 - DNA, 20 bp, Artificial
  CRISPR gRNA sequence
ttaattgtctttcgcatttt

SEQ ID NO: 444189 - DNA, 20 bp, Artificial
  CRISPR gRNA sequence
aattgtctttcgcatttttt

SEQ ID NO: 444190 - DNA, 20 bp, Artificial
  CRISPR gRNA sequence
attgtctttcgcattttttt

SEQ ID NO: 444191 - DNA, 20 bp, Artificial
  CRISPR gRNA sequence
tctttcgcatttttttcttg

SEQ ID NO: 444192 - DNA, 20 bp, Artificial
  CRISPR gRNA sequence
tcgcatttttttcttgctgc

SEQ ID NO: 444193 - DNA, 20 bp, Artificial
  CRISPR gRNA sequence
cgcatttttttcttgctgcc

SEQ ID NO: 444194 - DNA, 20 bp, Artificial
  CRISPR gRNA sequence
gcatttttttcttgctgccc

SEQ ID NO: 444195 - DNA, 20 bp, Artificial
  CRISPR gRNA sequence
ttttcttgctgcccctttga

SEQ ID NO: 444196 - DNA, 20 bp, Artificial
  CRISPR gRNA sequence
tttcttgctgcccctttgat

SEQ ID NO: 444197 - DNA, 20 bp, Artificial
  CRISPR gRNA sequence
ttcttgctgcccctttgatt

SEQ ID NO: 444198 - DNA, 20 bp, Artificial
  CRISPR gRNA sequence
tcttgctgcccctttgattc

SEQ ID NO: 444199 - DNA, 20 bp, Artificial
  CRISPR gRNA sequence
cttgctgcccctttgattcc

SEQ ID NO: 444200 - DNA, 20 bp, Artificial
  CRISPR gRNA sequence
ttgctgcccctttgattccc

SEQ ID NO: 444201 - DNA, 20 bp, Artificial
  CRISPR gRNA sequence
gctgcccctttgattccctg

SEQ ID NO: 444202 - DNA, 20 bp, Artificial
  CRISPR gRNA sequence
ctgcccctttgattccctga

SEQ ID NO: 444203 - DNA, 20 bp, Artificial
  CRISPR gRNA sequence
cccctttgattccctgaaat

SEQ ID NO: 444204 - DNA, 20 bp, Artificial
  CRISPR gRNA sequence
tgattccctgaaataagctt

SEQ ID NO: 444205 - DNA, 20 bp, Artificial
  CRISPR gRNA sequence
gattccctgaaataagcttt

SEQ ID NO: 444206 - DNA, 20 bp, Artificial
  CRISPR gRNA sequence
attccctgaaataagctttc

SEQ ID NO: 444207 - DNA, 20 bp, Artificial
  CRISPR gRNA sequence
cctgaaataagctttctgct

SEQ ID NO: 444208 - DNA, 20 bp, Artificial
  CRISPR gRNA sequence
aaataagctttctgctctca

SEQ ID NO: 444209 - DNA, 20 bp, Artificial
  CRISPR gRNA sequence
tctgctctcagataattttc

SEQ ID NO: 444210 - DNA, 20 bp, Artificial
  CRISPR gRNA sequence
ctgctctcagataattttca

SEQ ID NO: 444211 - DNA, 20 bp, Artificial
  CRISPR gRNA sequence
tgctctcagataattttcat

SEQ ID NO: 444212 - DNA, 20 bp, Artificial
  CRISPR gRNA sequence
ctctcagataattttcatcc

SEQ ID NO: 444213 - DNA, 20 bp, Artificial
  CRISPR gRNA sequence
tcagataattttcatcctta

SEQ ID NO: 444214 - DNA, 20 bp, Artificial
  CRISPR gRNA sequence
agataattttcatccttatg

SEQ ID NO: 444215 - DNA, 20 bp, Artificial
  CRISPR gRNA sequence
tcatccttatgttgtttctg

SEQ ID NO: 444216 - DNA, 20 bp, Artificial
  CRISPR gRNA sequence
catccttatgttgtttctga

SEQ ID NO: 444217 - DNA, 20 bp, Artificial
  CRISPR gRNA sequence
atccttatgttgtttctgac

SEQ ID NO: 444218 - DNA, 20 bp, Artificial
  CRISPR gRNA sequence
atgttgtttctgacattagc

SEQ ID NO: 444219 - DNA, 20 bp, Artificial
  CRISPR gRNA sequence
tgttgtttctgacattagcc

SEQ ID NO: 444220 - DNA, 20 bp, Artificial
  CRISPR gRNA sequence
tttctgacattagccaaggt

SEQ ID NO: 444221 - DNA, 20 bp, Artificial
  CRISPR gRNA sequence
ctgacattagccaaggtcac

SEQ ID NO: 444222 - DNA, 20 bp, Artificial
  CRISPR gRNA sequence
tgacattagccaaggtcacc

SEQ ID NO: 444223 - DNA, 20 bp, Artificial
  CRISPR gRNA sequence
acattagccaaggtcacccc

SEQ ID NO: 444224 - DNA, 20 bp, Artificial
  CRISPR gRNA sequence
gccaaggtcacccctgcacc

SEQ ID NO: 444225 - DNA, 20 bp, Artificial
  CRISPR gRNA sequence
caccgactcggcagagagac

SEQ ID NO: 444226 - DNA, 20 bp, Artificial
  CRISPR gRNA sequence
ggcagagagacttcactgca

SEQ ID NO: 444227 - DNA, 20 bp, Artificial
  CRISPR gRNA sequence
cactgcagcctttccaagga

SEQ ID NO: 444228 - DNA, 20 bp, Artificial
  CRISPR gRNA sequence
actgcagcctttccaaggat

SEQ ID NO: 444229 - DNA, 20 bp, Artificial
  CRISPR gRNA sequence
cagcctttccaaggatgctt

SEQ ID NO: 444230 - DNA, 20 bp, Artificial
  CRISPR gRNA sequence
tccaaggatgcttaccacca

SEQ ID NO: 444231 - DNA, 20 bp, Artificial
  CRISPR gRNA sequence
ccaaggatgcttaccaccag

SEQ ID NO: 444232 - DNA, 20 bp, Artificial
  CRISPR gRNA sequence
caaggatgcttaccaccagg

SEQ ID NO: 444233 - DNA, 20 bp, Artificial
  CRISPR gRNA sequence
accaccaggggacatggccc

SEQ ID NO: 444234 - DNA, 20 bp, Artificial
  CRISPR gRNA sequence
ccaccaggggacatggccca

SEQ ID NO: 444235 - DNA, 20 bp, Artificial
  CRISPR gRNA sequence
tgcatggggcagaggaggga

SEQ ID NO: 444236 - DNA, 20 bp, Artificial
  CRISPR gRNA sequence
tagctggctctgaattcaga

SEQ ID NO: 444237 - DNA, 20 bp, Artificial
  CRISPR gRNA sequence
agctggctctgaattcagag

SEQ ID NO: 444238 - DNA, 20 bp, Artificial
  CRISPR gRNA sequence
gctggctctgaattcagagg

SEQ ID NO: 444239 - DNA, 20 bp, Artificial
  CRISPR gRNA sequence
gctctgaattcagaggattt

SEQ ID NO: 444240 - DNA, 20 bp, Artificial
  CRISPR gRNA sequence
tgaattcagaggattttgaa

SEQ ID NO: 444241 - DNA, 20 bp, Artificial
  CRISPR gRNA sequence
aattcagaggattttgaatg

SEQ ID NO: 444242 - DNA, 20 bp, Artificial
  CRISPR gRNA sequence
agaggattttgaatgtggga

SEQ ID NO: 444243 - DNA, 20 bp, Artificial
  CRISPR gRNA sequence
tgaatgtgggaaaaaaagat

SEQ ID NO: 444244 - DNA, 20 bp, Artificial
  CRISPR gRNA sequence
gaatgtgggaaaaaaagatg

SEQ ID NO: 444245 - DNA, 20 bp, Artificial
  CRISPR gRNA sequence
aatgtgggaaaaaaagatga

SEQ ID NO: 444246 - DNA, 20 bp, Artificial
  CRISPR gRNA sequence
cgtgcacctgaaatagtgtt

SEQ ID NO: 444247 - DNA, 20 bp, Artificial
  CRISPR gRNA sequence
aaatagtgtttgaaaagagg

SEQ ID NO: 444248 - DNA, 20 bp, Artificial
  CRISPR gRNA sequence
gaaaagagggaagtggtgga

SEQ ID NO: 444249 - DNA, 20 bp, Artificial
  CRISPR gRNA sequence
aaaagagggaagtggtggag

SEQ ID NO: 444250 - DNA, 20 bp, Artificial
  CRISPR gRNA sequence
tgctgggaaaaagatggtct

SEQ ID NO: 444251 - DNA, 20 bp, Artificial
  CRISPR gRNA sequence
ggaaaaagatggtctggctt

SEQ ID NO: 444252 - DNA, 20 bp, Artificial
  CRISPR gRNA sequence
gcttaggattattttactta

SEQ ID NO: 444253 - DNA, 20 bp, Artificial
  CRISPR gRNA sequence
aggattattttacttaaatt

SEQ ID NO: 444254 - DNA, 20 bp, Artificial
  CRISPR gRNA sequence
ggattattttacttaaattt

SEQ ID NO: 444255 - DNA, 20 bp, Artificial
  CRISPR gRNA sequence
ttttacttaaattttaactg

SEQ ID NO: 444256 - DNA, 20 bp, Artificial
  CRISPR gRNA sequence
tacttaaattttaactggaa

SEQ ID NO: 444257 - DNA, 20 bp, Artificial
  CRISPR gRNA sequence
acttaaattttaactggaaa

SEQ ID NO: 444258 - DNA, 20 bp, Artificial
  CRISPR gRNA sequence
cttaaattttaactggaaaa

SEQ ID NO: 444259 - DNA, 20 bp, Artificial
  CRISPR gRNA sequence
aaattttaactggaaaaaag

SEQ ID NO: 444260 - DNA, 20 bp, Artificial
  CRISPR gRNA sequence
aattttaactggaaaaaagt

SEQ ID NO: 444261 - DNA, 20 bp, Artificial
  CRISPR gRNA sequence
taactggaaaaaagttaata

SEQ ID NO: 444262 - DNA, 20 bp, Artificial
  CRISPR gRNA sequence
aactggaaaaaagttaataa

SEQ ID NO: 444263 - DNA, 20 bp, Artificial
  CRISPR gRNA sequence
actggaaaaaagttaataaa

SEQ ID NO: 444264 - DNA, 20 bp, Artificial
  CRISPR gRNA sequence
gaaaaaagttaataaacttt

SEQ ID NO: 444265 - DNA, 20 bp, Artificial
  CRISPR gRNA sequence
ataaactttatagtctttaa

SEQ ID NO: 444266 - DNA, 20 bp, Artificial
  CRISPR gRNA sequence
tatagtctttaattttactt

SEQ ID NO: 444267 - DNA, 20 bp, Artificial
  CRISPR gRNA sequence
atagtctttaattttactta

SEQ ID NO: 444268 - DNA, 20 bp, Artificial
  CRISPR gRNA sequence
tagtctttaattttacttaa

SEQ ID NO: 444269 - DNA, 20 bp, Artificial
  CRISPR gRNA sequence
taattttacttaaatattaa

SEQ ID NO: 444270 - DNA, 20 bp, Artificial
  CRISPR gRNA sequence
aattttacttaaatattaac

SEQ ID NO: 444271 - DNA, 20 bp, Artificial
  CRISPR gRNA sequence
attttacttaaatattaact

SEQ ID NO: 444272 - DNA, 20 bp, Artificial
  CRISPR gRNA sequence
tacttaaatattaactaaat

SEQ ID NO: 444273 - DNA, 20 bp, Artificial
  CRISPR gRNA sequence
acttaaatattaactaaatt

SEQ ID NO: 444274 - DNA, 20 bp, Artificial
  CRISPR gRNA sequence
cttaaatattaactaaattg

SEQ ID NO: 444275 - DNA, 20 bp, Artificial
  CRISPR gRNA sequence
aaatattaactaaattgaat

SEQ ID NO: 444276 - DNA, 20 bp, Artificial
  CRISPR gRNA sequence
aatattaactaaattgaatg

SEQ ID NO: 444277 - DNA, 20 bp, Artificial
  CRISPR gRNA sequence
actaaattgaatgaaatgct

SEQ ID NO: 444278 - DNA, 20 bp, Artificial
  CRISPR gRNA sequence
aattgaatgaaatgctcatt

SEQ ID NO: 444279 - DNA, 20 bp, Artificial
  CRISPR gRNA sequence
aatgaaatgctcattacttt

SEQ ID NO: 444280 - DNA, 20 bp, Artificial
  CRISPR gRNA sequence
attactttgtccacattttc

SEQ ID NO: 444281 - DNA, 20 bp, Artificial
  CRISPR gRNA sequence
ctttgtccacattttctgac

SEQ ID NO: 444282 - DNA, 20 bp, Artificial
  CRISPR gRNA sequence
tgtccacattttctgactga

SEQ ID NO: 444283 - DNA, 20 bp, Artificial
  CRISPR gRNA sequence
gtccacattttctgactgac

SEQ ID NO: 444284 - DNA, 20 bp, Artificial
  CRISPR gRNA sequence
tccacattttctgactgacc

SEQ ID NO: 444285 - DNA, 20 bp, Artificial
  CRISPR gRNA sequence
tctgactgaccctggactgg

SEQ ID NO: 444286 - DNA, 20 bp, Artificial
  CRISPR gRNA sequence
ctgactgaccctggactggt

SEQ ID NO: 444287 - DNA, 20 bp, Artificial
  CRISPR gRNA sequence
tgactgaccctggactggtg

SEQ ID NO: 444288 - DNA, 20 bp, Artificial
  CRISPR gRNA sequence
actgaccctggactggtgat

SEQ ID NO: 444289 - DNA, 20 bp, Artificial
  CRISPR gRNA sequence
accctggactggtgatgttt

SEQ ID NO: 444290 - DNA, 20 bp, Artificial
  CRISPR gRNA sequence
gactggtgatgtttggtcat

SEQ ID NO: 444291 - DNA, 20 bp, Artificial
  CRISPR gRNA sequence
gtgatgtttggtcatgaact

SEQ ID NO: 444292 - DNA, 20 bp, Artificial
  CRISPR gRNA sequence
ggtcatgaactggtgtcagt

SEQ ID NO: 444293 - DNA, 20 bp, Artificial
  CRISPR gRNA sequence
gtcatgaactggtgtcagtc

SEQ ID NO: 444294 - DNA, 20 bp, Artificial
  CRISPR gRNA sequence
gtgtcagtctgtgtttggga

SEQ ID NO: 444295 - DNA, 20 bp, Artificial
  CRISPR gRNA sequence
tgtttgggaactgacacatt

SEQ ID NO: 444296 - DNA, 20 bp, Artificial
  CRISPR gRNA sequence
gggaactgacacattggatt

SEQ ID NO: 444297 - DNA, 20 bp, Artificial
  CRISPR gRNA sequence
ggaactgacacattggatta

SEQ ID NO: 444298 - DNA, 20 bp, Artificial
  CRISPR gRNA sequence
acacattggattaggtgatt

SEQ ID NO: 444299 - DNA, 20 bp, Artificial
  CRISPR gRNA sequence
gattaggtgatttctaggat

SEQ ID NO: 444300 - DNA, 20 bp, Artificial
  CRISPR gRNA sequence
ggtgatttctaggatgcctt

SEQ ID NO: 444301 - DNA, 20 bp, Artificial
  CRISPR gRNA sequence
ctaggatgccttctagctag

SEQ ID NO: 444302 - DNA, 20 bp, Artificial
  CRISPR gRNA sequence
taggatgccttctagctaga

SEQ ID NO: 444303 - DNA, 20 bp, Artificial
  CRISPR gRNA sequence
ggatgccttctagctagaat

SEQ ID NO: 444304 - DNA, 20 bp, Artificial
  CRISPR gRNA sequence
ctagctagaataaagcccat

SEQ ID NO: 444305 - DNA, 20 bp, Artificial
  CRISPR gRNA sequence
tagctagaataaagcccatc

SEQ ID NO: 444306 - DNA, 20 bp, Artificial
  CRISPR gRNA sequence
gctagaataaagcccatcac

SEQ ID NO: 444307 - DNA, 20 bp, Artificial
  CRISPR gRNA sequence
gaataaagcccatcaccttc

SEQ ID NO: 444308 - DNA, 20 bp, Artificial
  CRISPR gRNA sequence
ccctggattccagccacaga

SEQ ID NO: 444309 - DNA, 20 bp, Artificial
  CRISPR gRNA sequence
cctggattccagccacagaa

SEQ ID NO: 444310 - DNA, 20 bp, Artificial
  CRISPR gRNA sequence
gattccagccacagaaagaa

SEQ ID NO: 444311 - DNA, 20 bp, Artificial
  CRISPR gRNA sequence
cagccacagaaagaatagtt

SEQ ID NO: 444312 - DNA, 20 bp, Artificial
  CRISPR gRNA sequence
aattcttcatgtaattcagc

SEQ ID NO: 444313 - DNA, 20 bp, Artificial
  CRISPR gRNA sequence
ttcatgtaattcagcaagga

SEQ ID NO: 444314 - DNA, 20 bp, Artificial
  CRISPR gRNA sequence
catgtaattcagcaaggacg

SEQ ID NO: 444315 - DNA, 20 bp, Artificial
  CRISPR gRNA sequence
atgtaattcagcaaggacgt

SEQ ID NO: 444316 - DNA, 20 bp, Artificial
  CRISPR gRNA sequence
agcaaggacgtactcagggt

SEQ ID NO: 444317 - DNA, 20 bp, Artificial
  CRISPR gRNA sequence
agggtgctccagaagagaac

SEQ ID NO: 444318 - DNA, 20 bp, Artificial
  CRISPR gRNA sequence
cagaagagaacactgggcat

SEQ ID NO: 444319 - DNA, 20 bp, Artificial
  CRISPR gRNA sequence
ggcataaagcagaagtcaag

SEQ ID NO: 444320 - DNA, 20 bp, Artificial
  CRISPR gRNA sequence
atcatgaaggttaattttaa

SEQ ID NO: 444321 - DNA, 20 bp, Artificial
  CRISPR gRNA sequence
attttaaggtatttcttgtc

SEQ ID NO: 444322 - DNA, 20 bp, Artificial
  CRISPR gRNA sequence
taaggtatttcttgtcagtg

SEQ ID NO: 444323 - DNA, 20 bp, Artificial
  CRISPR gRNA sequence
aaggtatttcttgtcagtgt

SEQ ID NO: 444324 - DNA, 20 bp, Artificial
  CRISPR gRNA sequence
aggtatttcttgtcagtgtc

SEQ ID NO: 444325 - DNA, 20 bp, Artificial
  CRISPR gRNA sequence
cttgtcagtgtcctggtctc

SEQ ID NO: 444326 - DNA, 20 bp, Artificial
  CRISPR gRNA sequence
ttgtcagtgtcctggtctct

SEQ ID NO: 444327 - DNA, 20 bp, Artificial
  CRISPR gRNA sequence
gtcagtgtcctggtctcttc

SEQ ID NO: 444328 - DNA, 20 bp, Artificial
  CRISPR gRNA sequence
tcagtgtcctggtctcttct

SEQ ID NO: 444329 - DNA, 20 bp, Artificial
  CRISPR gRNA sequence
gtctcttctaaactctctgg

SEQ ID NO: 444330 - DNA, 20 bp, Artificial
  CRISPR gRNA sequence
ttctaaactctctggagctc

SEQ ID NO: 444331 - DNA, 20 bp, Artificial
  CRISPR gRNA sequence
ctaaactctctggagctcca

SEQ ID NO: 444332 - DNA, 20 bp, Artificial
  CRISPR gRNA sequence
taaactctctggagctccat

SEQ ID NO: 444333 - DNA, 20 bp, Artificial
  CRISPR gRNA sequence
aactctctggagctccattt

SEQ ID NO: 444334 - DNA, 20 bp, Artificial
  CRISPR gRNA sequence
tctggagctccatttttttt

SEQ ID NO: 444335 - DNA, 20 bp, Artificial
  CRISPR gRNA sequence
tggagctccatttttttttt

SEQ ID NO: 444336 - DNA, 20 bp, Artificial
  CRISPR gRNA sequence
gagctccattttttttttct

SEQ ID NO: 444337 - DNA, 20 bp, Artificial
  CRISPR gRNA sequence
cattttttttttcttctgta

SEQ ID NO: 444338 - DNA, 20 bp, Artificial
  CRISPR gRNA sequence
tttttttcttctgtaaaatg

SEQ ID NO: 444339 - DNA, 20 bp, Artificial
  CRISPR gRNA sequence
ttttttcttctgtaaaatga

SEQ ID NO: 444340 - DNA, 20 bp, Artificial
  CRISPR gRNA sequence
tttttcttctgtaaaatgag

SEQ ID NO: 444341 - DNA, 20 bp, Artificial
  CRISPR gRNA sequence
ttttcttctgtaaaatgagg

SEQ ID NO: 444342 - DNA, 20 bp, Artificial
  CRISPR gRNA sequence
tttcttctgtaaaatgaggt

SEQ ID NO: 444343 - DNA, 20 bp, Artificial
  CRISPR gRNA sequence
ttcttctgtaaaatgaggtt

SEQ ID NO: 444344 - DNA, 20 bp, Artificial
  CRISPR gRNA sequence
tcttctgtaaaatgaggtta

SEQ ID NO: 444345 - DNA, 20 bp, Artificial
  CRISPR gRNA sequence
cttctgtaaaatgaggttaa

SEQ ID NO: 444346 - DNA, 20 bp, Artificial
  CRISPR gRNA sequence
ttctgtaaaatgaggttaat

SEQ ID NO: 444347 - DNA, 20 bp, Artificial
  CRISPR gRNA sequence
ctgtaaaatgaggttaatag

SEQ ID NO: 444348 - DNA, 20 bp, Artificial
  CRISPR gRNA sequence
tgtaaaatgaggttaatagg

SEQ ID NO: 444349 - DNA, 20 bp, Artificial
  CRISPR gRNA sequence
taaaatgaggttaataggtg

SEQ ID NO: 444350 - DNA, 20 bp, Artificial
  CRISPR gRNA sequence
ataggtgagtcccacctcat

SEQ ID NO: 444351 - DNA, 20 bp, Artificial
  CRISPR gRNA sequence
ataatgtcataaatctcata

SEQ ID NO: 444352 - DNA, 20 bp, Artificial
  CRISPR gRNA sequence
ataaatcacaccttatgggc

SEQ ID NO: 444353 - DNA, 20 bp, Artificial
  CRISPR gRNA sequence
atgggctttaaataagaaaa

SEQ ID NO: 444354 - DNA, 20 bp, Artificial
  CRISPR gRNA sequence
tgggctttaaataagaaaat

SEQ ID NO: 444355 - DNA, 20 bp, Artificial
  CRISPR gRNA sequence
taaataagaaaatgtctaaa

SEQ ID NO: 444356 - DNA, 20 bp, Artificial
  CRISPR gRNA sequence
aaataagaaaatgtctaaaa

SEQ ID NO: 444357 - DNA, 20 bp, Artificial
  CRISPR gRNA sequence
aataagaaaatgtctaaaac

SEQ ID NO: 444358 - DNA, 20 bp, Artificial
  CRISPR gRNA sequence
aaacgtttatcccaatgtct

SEQ ID NO: 444359 - DNA, 20 bp, Artificial
  CRISPR gRNA sequence
atcccaatgtctgaccacaa

SEQ ID NO: 444360 - DNA, 20 bp, Artificial
  CRISPR gRNA sequence
tcccaatgtctgaccacaat

SEQ ID NO: 444361 - DNA, 20 bp, Artificial
  CRISPR gRNA sequence
accacaatttgtacatgtta

SEQ ID NO: 444362 - DNA, 20 bp, Artificial
  CRISPR gRNA sequence
gtacatgttagctgttgtcg

SEQ ID NO: 444363 - DNA, 20 bp, Artificial
  CRISPR gRNA sequence
tacatgttagctgttgtcgt

SEQ ID NO: 444364 - DNA, 20 bp, Artificial
  CRISPR gRNA sequence
gctgttgtcgttaatattat

SEQ ID NO: 444365 - DNA, 20 bp, Artificial
  CRISPR gRNA sequence
ttgtcgttaatattataaga

SEQ ID NO: 444366 - DNA, 20 bp, Artificial
  CRISPR gRNA sequence
tcgttaatattataagatca

SEQ ID NO: 444367 - DNA, 20 bp, Artificial
  CRISPR gRNA sequence
atattataagatcaggaggc

SEQ ID NO: 444368 - DNA, 20 bp, Artificial
  CRISPR gRNA sequence
taagatcaggaggcacagtg

SEQ ID NO: 444369 - DNA, 20 bp, Artificial
  CRISPR gRNA sequence
tggttaaagtacttcagtga

SEQ ID NO: 444370 - DNA, 20 bp, Artificial
  CRISPR gRNA sequence
aagtacttcagtgacaggtg

SEQ ID NO: 444371 - DNA, 20 bp, Artificial
  CRISPR gRNA sequence
cagtgacaggtggaatgggt

SEQ ID NO: 444372 - DNA, 20 bp, Artificial
  CRISPR gRNA sequence
agtgacaggtggaatgggtt

SEQ ID NO: 444373 - DNA, 20 bp, Artificial
  CRISPR gRNA sequence
taatttcagctgttcttgat

SEQ ID NO: 444374 - DNA, 20 bp, Artificial
  CRISPR gRNA sequence
atttcagctgttcttgatag

SEQ ID NO: 444375 - DNA, 20 bp, Artificial
  CRISPR gRNA sequence
cagctgttcttgatagctct

SEQ ID NO: 444376 - DNA, 20 bp, Artificial
  CRISPR gRNA sequence
agctgttcttgatagctctg

SEQ ID NO: 444377 - DNA, 20 bp, Artificial
  CRISPR gRNA sequence
ttcttgatagctctgtgacc

SEQ ID NO: 444378 - DNA, 20 bp, Artificial
  CRISPR gRNA sequence
ttgatagctctgtgacctca

SEQ ID NO: 444379 - DNA, 20 bp, Artificial
  CRISPR gRNA sequence
gatagctctgtgacctcagt

SEQ ID NO: 444380 - DNA, 20 bp, Artificial
  CRISPR gRNA sequence
atagctctgtgacctcagtc

SEQ ID NO: 444381 - DNA, 20 bp, Artificial
  CRISPR gRNA sequence
tgtgacctcagtcaagttgc

SEQ ID NO: 444382 - DNA, 20 bp, Artificial
  CRISPR gRNA sequence
tgacctcagtcaagttgctc

SEQ ID NO: 444383 - DNA, 20 bp, Artificial
  CRISPR gRNA sequence
agtcaagttgctcaaattct

SEQ ID NO: 444384 - DNA, 20 bp, Artificial
  CRISPR gRNA sequence
ctcaaattctctgaagctca

SEQ ID NO: 444385 - DNA, 20 bp, Artificial
  CRISPR gRNA sequence
aaattctctgaagctcagtt

SEQ ID NO: 444386 - DNA, 20 bp, Artificial
  CRISPR gRNA sequence
tctgaagctcagtttgctca

SEQ ID NO: 444387 - DNA, 20 bp, Artificial
  CRISPR gRNA sequence
tgaagctcagtttgctcatc

SEQ ID NO: 444388 - DNA, 20 bp, Artificial
  CRISPR gRNA sequence
aagctcagtttgctcatctc

SEQ ID NO: 444389 - DNA, 20 bp, Artificial
  CRISPR gRNA sequence
agtttgctcatctctacaat

SEQ ID NO: 444390 - DNA, 20 bp, Artificial
  CRISPR gRNA sequence
gctcatctctacaatgagga

SEQ ID NO: 444391 - DNA, 20 bp, Artificial
  CRISPR gRNA sequence
ctcatctctacaatgaggat

SEQ ID NO: 444392 - DNA, 20 bp, Artificial
  CRISPR gRNA sequence
atctctacaatgaggataat

SEQ ID NO: 444393 - DNA, 20 bp, Artificial
  CRISPR gRNA sequence
tacaatgaggataattccag

SEQ ID NO: 444394 - DNA, 20 bp, Artificial
  CRISPR gRNA sequence
caatgaggataattccagtg

SEQ ID NO: 444395 - DNA, 20 bp, Artificial
  CRISPR gRNA sequence
cagtgcccatgtcatgaggt

SEQ ID NO: 444396 - DNA, 20 bp, Artificial
  CRISPR gRNA sequence
taatgtataaacatgataat

SEQ ID NO: 444397 - DNA, 20 bp, Artificial
  CRISPR gRNA sequence
agcatagtacctggcccata

SEQ ID NO: 444398 - DNA, 20 bp, Artificial
  CRISPR gRNA sequence
gcccataaaaagcactcaac

SEQ ID NO: 444399 - DNA, 20 bp, Artificial
  CRISPR gRNA sequence
aactgtttattattactata

SEQ ID NO: 444400 - DNA, 20 bp, Artificial
  CRISPR gRNA sequence
tttattattactatagttac

SEQ ID NO: 444401 - DNA, 20 bp, Artificial
  CRISPR gRNA sequence
attattactatagttactgg

SEQ ID NO: 444402 - DNA, 20 bp, Artificial
  CRISPR gRNA sequence
ttattactatagttactggt

SEQ ID NO: 444403 - DNA, 20 bp, Artificial
  CRISPR gRNA sequence
ttactatagttactggtttt

SEQ ID NO: 444404 - DNA, 20 bp, Artificial
  CRISPR gRNA sequence
ctatagttactggttttagc

SEQ ID NO: 444405 - DNA, 20 bp, Artificial
  CRISPR gRNA sequence
tagttactggttttagctct

SEQ ID NO: 444406 - DNA, 20 bp, Artificial
  CRISPR gRNA sequence
ctggttttagctctccaaag

SEQ ID NO: 444407 - DNA, 20 bp, Artificial
  CRISPR gRNA sequence
gttttagctctccaaagttt

SEQ ID NO: 444408 - DNA, 20 bp, Artificial
  CRISPR gRNA sequence
tagctctccaaagtttcagt

SEQ ID NO: 444409 - DNA, 20 bp, Artificial
  CRISPR gRNA sequence
agctctccaaagtttcagtc

SEQ ID NO: 444410 - DNA, 20 bp, Artificial
  CRISPR gRNA sequence
gctctccaaagtttcagtct

SEQ ID NO: 444411 - DNA, 20 bp, Artificial
  CRISPR gRNA sequence
tccaaagtttcagtctttgg

SEQ ID NO: 444412 - DNA, 20 bp, Artificial
  CRISPR gRNA sequence
caaagtttcagtctttggtt

SEQ ID NO: 444413 - DNA, 20 bp, Artificial
  CRISPR gRNA sequence
cagtctttggttagtcttta

SEQ ID NO: 444414 - DNA, 20 bp, Artificial
  CRISPR gRNA sequence
agtctttggttagtctttag

SEQ ID NO: 444415 - DNA, 20 bp, Artificial
  CRISPR gRNA sequence
tggttagtctttagtgattg

SEQ ID NO: 444416 - DNA, 20 bp, Artificial
  CRISPR gRNA sequence
ggttagtctttagtgattgg

SEQ ID NO: 444417 - DNA, 20 bp, Artificial
  CRISPR gRNA sequence
gttagtctttagtgattggt

SEQ ID NO: 444418 - DNA, 20 bp, Artificial
  CRISPR gRNA sequence
gtctttagtgattggtagcc

SEQ ID NO: 444419 - DNA, 20 bp, Artificial
  CRISPR gRNA sequence
tagtgattggtagccaacat

SEQ ID NO: 444420 - DNA, 20 bp, Artificial
  CRISPR gRNA sequence
agtgattggtagccaacatc

SEQ ID NO: 444421 - DNA, 20 bp, Artificial
  CRISPR gRNA sequence
gtgattggtagccaacatct

SEQ ID NO: 444422 - DNA, 20 bp, Artificial
  CRISPR gRNA sequence
gtagccaacatcttttatgc

SEQ ID NO: 444423 - DNA, 20 bp, Artificial
  CRISPR gRNA sequence
ttatgcaattagagaggaaa

SEQ ID NO: 444424 - DNA, 20 bp, Artificial
  CRISPR gRNA sequence
tatgcaattagagaggaaac

SEQ ID NO: 444425 - DNA, 20 bp, Artificial
  CRISPR gRNA sequence
atgcaattagagaggaaact

SEQ ID NO: 444426 - DNA, 20 bp, Artificial
  CRISPR gRNA sequence
tgcaattagagaggaaacta

SEQ ID NO: 444427 - DNA, 20 bp, Artificial
  CRISPR gRNA sequence
gagaggaaactaaatatggt

SEQ ID NO: 444428 - DNA, 20 bp, Artificial
  CRISPR gRNA sequence
aatatggtggggacagaaaa

SEQ ID NO: 444429 - DNA, 20 bp, Artificial
  CRISPR gRNA sequence
taccagatacttattgtatg

SEQ ID NO: 444430 - DNA, 20 bp, Artificial
  CRISPR gRNA sequence
attgtatgccattgttatat

SEQ ID NO: 444431 - DNA, 20 bp, Artificial
  CRISPR gRNA sequence
ttgtatgccattgttatatt

SEQ ID NO: 444432 - DNA, 20 bp, Artificial
  CRISPR gRNA sequence
tatgccattgttatatttta

SEQ ID NO: 444433 - DNA, 20 bp, Artificial
  CRISPR gRNA sequence
ttatattttaaagaatctta

SEQ ID NO: 444434 - DNA, 20 bp, Artificial
  CRISPR gRNA sequence
tattttaaagaatcttacaa

SEQ ID NO: 444435 - DNA, 20 bp, Artificial
  CRISPR gRNA sequence
taaagaatcttacaaccata

SEQ ID NO: 444436 - DNA, 20 bp, Artificial
  CRISPR gRNA sequence
aaagaatcttacaaccatag

SEQ ID NO: 444437 - DNA, 20 bp, Artificial
  CRISPR gRNA sequence
aagaatcttacaaccatagt

SEQ ID NO: 444438 - DNA, 20 bp, Artificial
  CRISPR gRNA sequence
acaaccatagtgctagaagg

SEQ ID NO: 444439 - DNA, 20 bp, Artificial
  CRISPR gRNA sequence
caaccatagtgctagaaggg

SEQ ID NO: 444440 - DNA, 20 bp, Artificial
  CRISPR gRNA sequence
gaagggacttcaagggtcat

SEQ ID NO: 444441 - DNA, 20 bp, Artificial
  CRISPR gRNA sequence
caagggtcatttagtctcac

SEQ ID NO: 444442 - DNA, 20 bp, Artificial
  CRISPR gRNA sequence
aagggtcatttagtctcact

SEQ ID NO: 444443 - DNA, 20 bp, Artificial
  CRISPR gRNA sequence
agtctcactttcccatcctg

SEQ ID NO: 444444 - DNA, 20 bp, Artificial
  CRISPR gRNA sequence
gtctcactttcccatcctgt

SEQ ID NO: 444445 - DNA, 20 bp, Artificial
  CRISPR gRNA sequence
actttcccatcctgtgcttc

SEQ ID NO: 444446 - DNA, 20 bp, Artificial
  CRISPR gRNA sequence
tcccatcctgtgcttcagta

SEQ ID NO: 444447 - DNA, 20 bp, Artificial
  CRISPR gRNA sequence
cccatcctgtgcttcagtac

SEQ ID NO: 444448 - DNA, 20 bp, Artificial
  CRISPR gRNA sequence
ccatcctgtgcttcagtact

SEQ ID NO: 444449 - DNA, 20 bp, Artificial
  CRISPR gRNA sequence
tgcttcagtacttttttttt

SEQ ID NO: 444450 - DNA, 20 bp, Artificial
  CRISPR gRNA sequence
cagtactttttttttttttt

SEQ ID NO: 444451 - DNA, 20 bp, Artificial
  CRISPR gRNA sequence
agtacttttttttttttttt

SEQ ID NO: 444452 - DNA, 20 bp, Artificial
  CRISPR gRNA sequence
ttttttttttttttaattga

SEQ ID NO: 444453 - DNA, 20 bp, Artificial
  CRISPR gRNA sequence
tttttttttttttaattgag

SEQ ID NO: 444454 - DNA, 20 bp, Artificial
  CRISPR gRNA sequence
ttttttttttttaattgaga

SEQ ID NO: 444455 - DNA, 20 bp, Artificial
  CRISPR gRNA sequence
tttttttttttaattgagac

SEQ ID NO: 444456 - DNA, 20 bp, Artificial
  CRISPR gRNA sequence
ttttttttttaattgagacg

SEQ ID NO: 444457 - DNA, 20 bp, Artificial
  CRISPR gRNA sequence
tttttttttaattgagacgg

SEQ ID NO: 444458 - DNA, 20 bp, Artificial
  CRISPR gRNA sequence
ttttttttaattgagacgga

SEQ ID NO: 444459 - DNA, 20 bp, Artificial
  CRISPR gRNA sequence
tttttttaattgagacggag

SEQ ID NO: 444460 - DNA, 20 bp, Artificial
  CRISPR gRNA sequence
ttttttaattgagacggagt

SEQ ID NO: 444461 - DNA, 20 bp, Artificial
  CRISPR gRNA sequence
tttttaattgagacggagtc

SEQ ID NO: 444462 - DNA, 20 bp, Artificial
  CRISPR gRNA sequence
ttttaattgagacggagtct

SEQ ID NO: 444463 - DNA, 20 bp, Artificial
  CRISPR gRNA sequence
tttaattgagacggagtctt

SEQ ID NO: 444464 - DNA, 20 bp, Artificial
  CRISPR gRNA sequence
ttaattgagacggagtcttg

SEQ ID NO: 444465 - DNA, 20 bp, Artificial
  CRISPR gRNA sequence
taattgagacggagtcttgc

SEQ ID NO: 444466 - DNA, 20 bp, Artificial
  CRISPR gRNA sequence
aattgagacggagtcttgct

SEQ ID NO: 444467 - DNA, 20 bp, Artificial
  CRISPR gRNA sequence
attgagacggagtcttgctc

SEQ ID NO: 444468 - DNA, 20 bp, Artificial
  CRISPR gRNA sequence
agacggagtcttgctctgtc

SEQ ID NO: 444469 - DNA, 20 bp, Artificial
  CRISPR gRNA sequence
gctctgtcacccagactaga

SEQ ID NO: 444470 - DNA, 20 bp, Artificial
  CRISPR gRNA sequence
ctctgtcacccagactagag

SEQ ID NO: 444471 - DNA, 20 bp, Artificial
  CRISPR gRNA sequence
tgtcacccagactagagtgc

SEQ ID NO: 444472 - DNA, 20 bp, Artificial
  CRISPR gRNA sequence
tcacccagactagagtgcag

SEQ ID NO: 444473 - DNA, 20 bp, Artificial
  CRISPR gRNA sequence
gagtgcagtggcgcaatctc

SEQ ID NO: 444474 - DNA, 20 bp, Artificial
  CRISPR gRNA sequence
ggctcactgcaagttccgcc

SEQ ID NO: 444475 - DNA, 20 bp, Artificial
  CRISPR gRNA sequence
actgcaagttccgcctcctg

SEQ ID NO: 444476 - DNA, 20 bp, Artificial
  CRISPR gRNA sequence
caagttccgcctcctgggtt

SEQ ID NO: 444477 - DNA, 20 bp, Artificial
  CRISPR gRNA sequence
cgcctcctgggttcacgcca

SEQ ID NO: 444478 - DNA, 20 bp, Artificial
  CRISPR gRNA sequence
ctgggttcacgccattctcc

SEQ ID NO: 444479 - DNA, 20 bp, Artificial
  CRISPR gRNA sequence
ggttcacgccattctcctgc

SEQ ID NO: 444480 - DNA, 20 bp, Artificial
  CRISPR gRNA sequence
acgccattctcctgcctcag

SEQ ID NO: 444481 - DNA, 20 bp, Artificial
  CRISPR gRNA sequence
tcctgcctcagcctcccaag

SEQ ID NO: 444482 - DNA, 20 bp, Artificial
  CRISPR gRNA sequence
ctgcctcagcctcccaagta

SEQ ID NO: 444483 - DNA, 20 bp, Artificial
  CRISPR gRNA sequence
cctcagcctcccaagtagct

SEQ ID NO: 444484 - DNA, 20 bp, Artificial
  CRISPR gRNA sequence
agcctcccaagtagctggga

SEQ ID NO: 444485 - DNA, 20 bp, Artificial
  CRISPR gRNA sequence
ccaagtagctgggactacag

SEQ ID NO: 444486 - DNA, 20 bp, Artificial
  CRISPR gRNA sequence
ggactacaggcgcccaccat

SEQ ID NO: 444487 - DNA, 20 bp, Artificial
  CRISPR gRNA sequence
caggcgcccaccatcaagcc

SEQ ID NO: 444488 - DNA, 20 bp, Artificial
  CRISPR gRNA sequence
atttttttcttttttgtatt

SEQ ID NO: 444489 - DNA, 20 bp, Artificial
  CRISPR gRNA sequence
ttttcttttttgtattttta

SEQ ID NO: 444490 - DNA, 20 bp, Artificial
  CRISPR gRNA sequence
tttcttttttgtatttttag

SEQ ID NO: 444491 - DNA, 20 bp, Artificial
  CRISPR gRNA sequence
ttcttttttgtatttttagt

SEQ ID NO: 444492 - DNA, 20 bp, Artificial
  CRISPR gRNA sequence
tcttttttgtatttttagta

SEQ ID NO: 444493 - DNA, 20 bp, Artificial
  CRISPR gRNA sequence
cttttttgtatttttagtag

SEQ ID NO: 444494 - DNA, 20 bp, Artificial
  CRISPR gRNA sequence
ttttttgtatttttagtaga

SEQ ID NO: 444495 - DNA, 20 bp, Artificial
  CRISPR gRNA sequence
ttttgtatttttagtagaga

SEQ ID NO: 444496 - DNA, 20 bp, Artificial
  CRISPR gRNA sequence
tttgtatttttagtagagac

SEQ ID NO: 444497 - DNA, 20 bp, Artificial
  CRISPR gRNA sequence
ttgtatttttagtagagaca

SEQ ID NO: 444498 - DNA, 20 bp, Artificial
  CRISPR gRNA sequence
tgtatttttagtagagacag

SEQ ID NO: 444499 - DNA, 20 bp, Artificial
  CRISPR gRNA sequence
gtatttttagtagagacaga

SEQ ID NO: 444500 - DNA, 20 bp, Artificial
  CRISPR gRNA sequence
tatttttagtagagacagag

SEQ ID NO: 444501 - DNA, 20 bp, Artificial
  CRISPR gRNA sequence
ttagtagagacagagtttca

SEQ ID NO: 444502 - DNA, 20 bp, Artificial
  CRISPR gRNA sequence
tagtagagacagagtttcac

SEQ ID NO: 444503 - DNA, 20 bp, Artificial
  CRISPR gRNA sequence
agtagagacagagtttcacc

SEQ ID NO: 444504 - DNA, 20 bp, Artificial
  CRISPR gRNA sequence
gtagagacagagtttcaccg

SEQ ID NO: 444505 - DNA, 20 bp, Artificial
  CRISPR gRNA sequence
caccgtgttagccaggatgg

SEQ ID NO: 444506 - DNA, 20 bp, Artificial
  CRISPR gRNA sequence
accgtgttagccaggatggt

SEQ ID NO: 444507 - DNA, 20 bp, Artificial
  CRISPR gRNA sequence
gccaggatggtctccatctc

SEQ ID NO: 444508 - DNA, 20 bp, Artificial
  CRISPR gRNA sequence
catctcctgaccttgtgatc

SEQ ID NO: 444509 - DNA, 20 bp, Artificial
  CRISPR gRNA sequence
ctgaccttgtgatcctcccg

SEQ ID NO: 444510 - DNA, 20 bp, Artificial
  CRISPR gRNA sequence
accttgtgatcctcccgcct

SEQ ID NO: 444511 - DNA, 20 bp, Artificial
  CRISPR gRNA sequence
gtgatcctcccgcctcggcc

SEQ ID NO: 444512 - DNA, 20 bp, Artificial
  CRISPR gRNA sequence
tgatcctcccgcctcggcct

SEQ ID NO: 444513 - DNA, 20 bp, Artificial
  CRISPR gRNA sequence
ccgcctcggcctcccaaagt

SEQ ID NO: 444514 - DNA, 20 bp, Artificial
  CRISPR gRNA sequence
ggcctcccaaagtgctggga

SEQ ID NO: 444515 - DNA, 20 bp, Artificial
  CRISPR gRNA sequence
ccaaagtgctgggattacac

SEQ ID NO: 444516 - DNA, 20 bp, Artificial
  CRISPR gRNA sequence
ggattacacgcgtgagccac

SEQ ID NO: 444517 - DNA, 20 bp, Artificial
  CRISPR gRNA sequence
cacgcgtgagccaccgcgcc

SEQ ID NO: 444518 - DNA, 20 bp, Artificial
  CRISPR gRNA sequence
tttactacatcaccactgaa

SEQ ID NO: 444519 - DNA, 20 bp, Artificial
  CRISPR gRNA sequence
ttactacatcaccactgaat

SEQ ID NO: 444520 - DNA, 20 bp, Artificial
  CRISPR gRNA sequence
tactacatcaccactgaatg

SEQ ID NO: 444521 - DNA, 20 bp, Artificial
  CRISPR gRNA sequence
actacatcaccactgaatgg

SEQ ID NO: 444522 - DNA, 20 bp, Artificial
  CRISPR gRNA sequence
ctacatcaccactgaatggg

SEQ ID NO: 444523 - DNA, 20 bp, Artificial
  CRISPR gRNA sequence
catcaccactgaatgggcat

SEQ ID NO: 444524 - DNA, 20 bp, Artificial
  CRISPR gRNA sequence
aatgggcatttgctgtagac

SEQ ID NO: 444525 - DNA, 20 bp, Artificial
  CRISPR gRNA sequence
gctgtagacggagttcactc

SEQ ID NO: 444526 - DNA, 20 bp, Artificial
  CRISPR gRNA sequence
ctgtagacggagttcactcc

SEQ ID NO: 444527 - DNA, 20 bp, Artificial
  CRISPR gRNA sequence
tagacggagttcactccctg

SEQ ID NO: 444528 - DNA, 20 bp, Artificial
  CRISPR gRNA sequence
actccctgtcgaggtggtgc

SEQ ID NO: 444529 - DNA, 20 bp, Artificial
  CRISPR gRNA sequence
cctgtcgaggtggtgcattt

SEQ ID NO: 444530 - DNA, 20 bp, Artificial
  CRISPR gRNA sequence
tcgaggtggtgcatttcctt

SEQ ID NO: 444531 - DNA, 20 bp, Artificial
  CRISPR gRNA sequence
ccttatacttgtctctacca

SEQ ID NO: 444532 - DNA, 20 bp, Artificial
  CRISPR gRNA sequence
cttatacttgtctctaccac

SEQ ID NO: 444533 - DNA, 20 bp, Artificial
  CRISPR gRNA sequence
atacttgtctctaccacaga

SEQ ID NO: 444534 - DNA, 20 bp, Artificial
  CRISPR gRNA sequence
tacttgtctctaccacagac

SEQ ID NO: 444535 - DNA, 20 bp, Artificial
  CRISPR gRNA sequence
gtctctaccacagacagaag

SEQ ID NO: 444536 - DNA, 20 bp, Artificial
  CRISPR gRNA sequence
tctctaccacagacagaagt

SEQ ID NO: 444537 - DNA, 20 bp, Artificial
  CRISPR gRNA sequence
taccacagacagaagtcttc

SEQ ID NO: 444538 - DNA, 20 bp, Artificial
  CRISPR gRNA sequence
ccacagacagaagtcttctt

SEQ ID NO: 444539 - DNA, 20 bp, Artificial
  CRISPR gRNA sequence
ctttcctttagtttttcttt

SEQ ID NO: 444540 - DNA, 20 bp, Artificial
  CRISPR gRNA sequence
tttcctttagtttttctttc

SEQ ID NO: 444541 - DNA, 20 bp, Artificial
  CRISPR gRNA sequence
tcctttagtttttctttcct

SEQ ID NO: 444542 - DNA, 20 bp, Artificial
  CRISPR gRNA sequence
cctttagtttttctttcctt

SEQ ID NO: 444543 - DNA, 20 bp, Artificial
  CRISPR gRNA sequence
ctttagtttttctttccttt

SEQ ID NO: 444544 - DNA, 20 bp, Artificial
  CRISPR gRNA sequence
tagtttttctttcctttttt

SEQ ID NO: 444545 - DNA, 20 bp, Artificial
  CRISPR gRNA sequence
agtttttctttccttttttt

SEQ ID NO: 444546 - DNA, 20 bp, Artificial
  CRISPR gRNA sequence
gtttttctttcctttttttt

SEQ ID NO: 444547 - DNA, 20 bp, Artificial
  CRISPR gRNA sequence
ttctttcctttttttttttt

SEQ ID NO: 444548 - DNA, 20 bp, Artificial
  CRISPR gRNA sequence
tctttccttttttttttttt

SEQ ID NO: 444549 - DNA, 20 bp, Artificial
  CRISPR gRNA sequence
ctttcctttttttttttttt

SEQ ID NO: 444550 - DNA, 20 bp, Artificial
  CRISPR gRNA sequence
tttccttttttttttttttt

SEQ ID NO: 444551 - DNA, 20 bp, Artificial
  CRISPR gRNA sequence
tcctttttttttttttttga

SEQ ID NO: 444552 - DNA, 20 bp, Artificial
  CRISPR gRNA sequence
cctttttttttttttttgag

SEQ ID NO: 444553 - DNA, 20 bp, Artificial
  CRISPR gRNA sequence
ctttttttttttttttgaga

SEQ ID NO: 444554 - DNA, 20 bp, Artificial
  CRISPR gRNA sequence
tttttttttttttgagacgg

SEQ ID NO: 444555 - DNA, 20 bp, Artificial
  CRISPR gRNA sequence
ttttttttttttgagacgga

SEQ ID NO: 444556 - DNA, 20 bp, Artificial
  CRISPR gRNA sequence
tttttttttttgagacggag

SEQ ID NO: 444557 - DNA, 20 bp, Artificial
  CRISPR gRNA sequence
ttttttttttgagacggagt

SEQ ID NO: 444558 - DNA, 20 bp, Artificial
  CRISPR gRNA sequence
tttttttttgagacggagtc

SEQ ID NO: 444559 - DNA, 20 bp, Artificial
  CRISPR gRNA sequence
ttttttttgagacggagtct

SEQ ID NO: 444560 - DNA, 20 bp, Artificial
  CRISPR gRNA sequence
tttttttgagacggagtctc

SEQ ID NO: 444561 - DNA, 20 bp, Artificial
  CRISPR gRNA sequence
ttttttgagacggagtctca

SEQ ID NO: 444562 - DNA, 20 bp, Artificial
  CRISPR gRNA sequence
tttttgagacggagtctcac

SEQ ID NO: 444563 - DNA, 20 bp, Artificial
  CRISPR gRNA sequence
ttttgagacggagtctcact

SEQ ID NO: 444564 - DNA, 20 bp, Artificial
  CRISPR gRNA sequence
tttgagacggagtctcactc

SEQ ID NO: 444565 - DNA, 20 bp, Artificial
  CRISPR gRNA sequence
ttgagacggagtctcactct

SEQ ID NO: 444566 - DNA, 20 bp, Artificial
  CRISPR gRNA sequence
tgagacggagtctcactctc

SEQ ID NO: 444567 - DNA, 20 bp, Artificial
  CRISPR gRNA sequence
gagacggagtctcactctct

SEQ ID NO: 444568 - DNA, 20 bp, Artificial
  CRISPR gRNA sequence
agacggagtctcactctctc

SEQ ID NO: 444569 - DNA, 20 bp, Artificial
  CRISPR gRNA sequence
actctctcacccaggctgga

SEQ ID NO: 444570 - DNA, 20 bp, Artificial
  CRISPR gRNA sequence
tctcacccaggctggagtgc

SEQ ID NO: 444571 - DNA, 20 bp, Artificial
  CRISPR gRNA sequence
tcacccaggctggagtgcaa

SEQ ID NO: 444572 - DNA, 20 bp, Artificial
  CRISPR gRNA sequence
acccaggctggagtgcaatg

SEQ ID NO: 444573 - DNA, 20 bp, Artificial
  CRISPR gRNA sequence
gagtgcaatgacacgatctt

SEQ ID NO: 444574 - DNA, 20 bp, Artificial
  CRISPR gRNA sequence
ggctcactgcaaactctgcc

SEQ ID NO: 444575 - DNA, 20 bp, Artificial
  CRISPR gRNA sequence
gctcactgcaaactctgcct

SEQ ID NO: 444576 - DNA, 20 bp, Artificial
  CRISPR gRNA sequence
actgcaaactctgcctccca

SEQ ID NO: 444577 - DNA, 20 bp, Artificial
  CRISPR gRNA sequence
caaactctgcctcccaggtt

SEQ ID NO: 444578 - DNA, 20 bp, Artificial
  CRISPR gRNA sequence
tgcctcccaggttcatgcca

SEQ ID NO: 444579 - DNA, 20 bp, Artificial
  CRISPR gRNA sequence
cctcccaggttcatgccatt

SEQ ID NO: 444580 - DNA, 20 bp, Artificial
  CRISPR gRNA sequence
ccaggttcatgccattctcc

SEQ ID NO: 444581 - DNA, 20 bp, Artificial
  CRISPR gRNA sequence
atgccattctcctgcctcag

SEQ ID NO: 444582 - DNA, 20 bp, Artificial
  CRISPR gRNA sequence
tcctgcctcagcctcccaag

SEQ ID NO: 444583 - DNA, 20 bp, Artificial
  CRISPR gRNA sequence
ctgcctcagcctcccaagta

SEQ ID NO: 444584 - DNA, 20 bp, Artificial
  CRISPR gRNA sequence
cctcagcctcccaagtagct

SEQ ID NO: 444585 - DNA, 20 bp, Artificial
  CRISPR gRNA sequence
agcctcccaagtagctggga

SEQ ID NO: 444586 - DNA, 20 bp, Artificial
  CRISPR gRNA sequence
ccaagtagctgggattacag

SEQ ID NO: 444587 - DNA, 20 bp, Artificial
  CRISPR gRNA sequence
ggattacagacgcgcgccac

SEQ ID NO: 444588 - DNA, 20 bp, Artificial
  CRISPR gRNA sequence
cagacgcgcgccaccacgcc

SEQ ID NO: 444589 - DNA, 20 bp, Artificial
  CRISPR gRNA sequence
atttttgtatttttattaga

SEQ ID NO: 444590 - DNA, 20 bp, Artificial
  CRISPR gRNA sequence
ttgtatttttattagagacg

SEQ ID NO: 444591 - DNA, 20 bp, Artificial
  CRISPR gRNA sequence
tgtatttttattagagacgg

SEQ ID NO: 444592 - DNA, 20 bp, Artificial
  CRISPR gRNA sequence
gtatttttattagagacggg

SEQ ID NO: 444593 - DNA, 20 bp, Artificial
  CRISPR gRNA sequence
tatttttattagagacgggg

SEQ ID NO: 444594 - DNA, 20 bp, Artificial
  CRISPR gRNA sequence
ttattagagacggggtttca

SEQ ID NO: 444595 - DNA, 20 bp, Artificial
  CRISPR gRNA sequence
tattagagacggggtttcac

SEQ ID NO: 444596 - DNA, 20 bp, Artificial
  CRISPR gRNA sequence
attagagacggggtttcacc

SEQ ID NO: 444597 - DNA, 20 bp, Artificial
  CRISPR gRNA sequence
ttagagacggggtttcacca

SEQ ID NO: 444598 - DNA, 20 bp, Artificial
  CRISPR gRNA sequence
gagacggggtttcaccatgg

SEQ ID NO: 444599 - DNA, 20 bp, Artificial
  CRISPR gRNA sequence
caccatggtggccatgctgg

SEQ ID NO: 444600 - DNA, 20 bp, Artificial
  CRISPR gRNA sequence
accatggtggccatgctggt

SEQ ID NO: 444601 - DNA, 20 bp, Artificial
  CRISPR gRNA sequence
gtctcgaactcctaacctca

SEQ ID NO: 444602 - DNA, 20 bp, Artificial
  CRISPR gRNA sequence
gaactcctaacctcaggtga

SEQ ID NO: 444603 - DNA, 20 bp, Artificial
  CRISPR gRNA sequence
ctaacctcaggtgatccctc

SEQ ID NO: 444604 - DNA, 20 bp, Artificial
  CRISPR gRNA sequence
acctcaggtgatccctctgc

SEQ ID NO: 444605 - DNA, 20 bp, Artificial
  CRISPR gRNA sequence
aggtgatccctctgcctcgg

SEQ ID NO: 444606 - DNA, 20 bp, Artificial
  CRISPR gRNA sequence
tgcctcggcctcccaaagcg

SEQ ID NO: 444607 - DNA, 20 bp, Artificial
  CRISPR gRNA sequence
cctcggcctcccaaagcgct

SEQ ID NO: 444608 - DNA, 20 bp, Artificial
  CRISPR gRNA sequence
ggcctcccaaagcgctggga

SEQ ID NO: 444609 - DNA, 20 bp, Artificial
  CRISPR gRNA sequence
ccaaagcgctgggattacag

SEQ ID NO: 444610 - DNA, 20 bp, Artificial
  CRISPR gRNA sequence
ggattacaggtgtaagccac

SEQ ID NO: 444611 - DNA, 20 bp, Artificial
  CRISPR gRNA sequence
caggtgtaagccaccacgcc

SEQ ID NO: 444612 - DNA, 20 bp, Artificial
  CRISPR gRNA sequence
ccctttagtttttgtttgtt

SEQ ID NO: 444613 - DNA, 20 bp, Artificial
  CRISPR gRNA sequence
cctttagtttttgtttgtta

SEQ ID NO: 444614 - DNA, 20 bp, Artificial
  CRISPR gRNA sequence
tagtttttgtttgttagttc

SEQ ID NO: 444615 - DNA, 20 bp, Artificial
  CRISPR gRNA sequence
agtttttgtttgttagttcc

SEQ ID NO: 444616 - DNA, 20 bp, Artificial
  CRISPR gRNA sequence
gtttttgtttgttagttcct

SEQ ID NO: 444617 - DNA, 20 bp, Artificial
  CRISPR gRNA sequence
ttgtttgttagttccttccc

SEQ ID NO: 444618 - DNA, 20 bp, Artificial
  CRISPR gRNA sequence
tgtttgttagttccttccct

SEQ ID NO: 444619 - DNA, 20 bp, Artificial
  CRISPR gRNA sequence
gtttgttagttccttccctc

SEQ ID NO: 444620 - DNA, 20 bp, Artificial
  CRISPR gRNA sequence
tttgttagttccttccctct

SEQ ID NO: 444621 - DNA, 20 bp, Artificial
  CRISPR gRNA sequence
gttagttccttccctctagg

SEQ ID NO: 444622 - DNA, 20 bp, Artificial
  CRISPR gRNA sequence
ttagttccttccctctaggg

SEQ ID NO: 444623 - DNA, 20 bp, Artificial
  CRISPR gRNA sequence
gttccttccctctagggcaa

SEQ ID NO: 444624 - DNA, 20 bp, Artificial
  CRISPR gRNA sequence
cttccctctagggcaacaaa

SEQ ID NO: 444625 - DNA, 20 bp, Artificial
  CRISPR gRNA sequence
ccctctagggcaacaaaaat

SEQ ID NO: 444626 - DNA, 20 bp, Artificial
  CRISPR gRNA sequence
cctctagggcaacaaaaatg

SEQ ID NO: 444627 - DNA, 20 bp, Artificial
  CRISPR gRNA sequence
tagggcaacaaaaatgggaa

SEQ ID NO: 444628 - DNA, 20 bp, Artificial
  CRISPR gRNA sequence
gggcaacaaaaatgggaata

SEQ ID NO: 444629 - DNA, 20 bp, Artificial
  CRISPR gRNA sequence
gaacctctgagcttctcaag

SEQ ID NO: 444630 - DNA, 20 bp, Artificial
  CRISPR gRNA sequence
tgagcttctcaagggcctga

SEQ ID NO: 444631 - DNA, 20 bp, Artificial
  CRISPR gRNA sequence
agcttctcaagggcctgact

SEQ ID NO: 444632 - DNA, 20 bp, Artificial
  CRISPR gRNA sequence
ctcaagggcctgactgagaa

SEQ ID NO: 444633 - DNA, 20 bp, Artificial
  CRISPR gRNA sequence
tcaagggcctgactgagaaa

SEQ ID NO: 444634 - DNA, 20 bp, Artificial
  CRISPR gRNA sequence
aagggcctgactgagaaaaa

SEQ ID NO: 444635 - DNA, 20 bp, Artificial
  CRISPR gRNA sequence
actgagaaaaaatattgaaa

SEQ ID NO: 444636 - DNA, 20 bp, Artificial
  CRISPR gRNA sequence
agaaaaaatattgaaacaac

SEQ ID NO: 444637 - DNA, 20 bp, Artificial
  CRISPR gRNA sequence
aaacaaccaaaaataggtca

SEQ ID NO: 444638 - DNA, 20 bp, Artificial
  CRISPR gRNA sequence
ctaaataggaaaataaaata

SEQ ID NO: 444639 - DNA, 20 bp, Artificial
  CRISPR gRNA sequence
aataggaaaataaaataaaa

SEQ ID NO: 444640 - DNA, 20 bp, Artificial
  CRISPR gRNA sequence
aaatgaatgaatatttaatg

SEQ ID NO: 444641 - DNA, 20 bp, Artificial
  CRISPR gRNA sequence
aatggtttgtctataatatg

SEQ ID NO: 444642 - DNA, 20 bp, Artificial
  CRISPR gRNA sequence
atggtttgtctataatatgt

SEQ ID NO: 444643 - DNA, 20 bp, Artificial
  CRISPR gRNA sequence
gtctataatatgtaacatta

SEQ ID NO: 444644 - DNA, 20 bp, Artificial
  CRISPR gRNA sequence
tctataatatgtaacattat

SEQ ID NO: 444645 - DNA, 20 bp, Artificial
  CRISPR gRNA sequence
taatatgtaacattatgtaa

SEQ ID NO: 444646 - DNA, 20 bp, Artificial
  CRISPR gRNA sequence
tgtaaattggctgctggcaa

SEQ ID NO: 444647 - DNA, 20 bp, Artificial
  CRISPR gRNA sequence
gctgctggcaaaccaactct

SEQ ID NO: 444648 - DNA, 20 bp, Artificial
  CRISPR gRNA sequence
ctggcaaaccaactctaaat

SEQ ID NO: 444649 - DNA, 20 bp, Artificial
  CRISPR gRNA sequence
gcaaaccaactctaaatgtg

SEQ ID NO: 444650 - DNA, 20 bp, Artificial
  CRISPR gRNA sequence
taaatgtgggatgtgggagc

SEQ ID NO: 444651 - DNA, 20 bp, Artificial
  CRISPR gRNA sequence
aatgtgggatgtgggagcat

SEQ ID NO: 444652 - DNA, 20 bp, Artificial
  CRISPR gRNA sequence
aatataaaaatggggctggg

SEQ ID NO: 444653 - DNA, 20 bp, Artificial
  CRISPR gRNA sequence
atataaaaatggggctgggc

SEQ ID NO: 444654 - DNA, 20 bp, Artificial
  CRISPR gRNA sequence
ggcacagtggctcacatgtg

SEQ ID NO: 444655 - DNA, 20 bp, Artificial
  CRISPR gRNA sequence
acatgtgtaatcccagcact

SEQ ID NO: 444656 - DNA, 20 bp, Artificial
  CRISPR gRNA sequence
tgggaggccaaggcaggcag

SEQ ID NO: 444657 - DNA, 20 bp, Artificial
  CRISPR gRNA sequence
gagctcaggagttcaagacc

SEQ ID NO: 444658 - DNA, 20 bp, Artificial
  CRISPR gRNA sequence
aggagttcaagaccagcctg

SEQ ID NO: 444659 - DNA, 20 bp, Artificial
  CRISPR gRNA sequence
aagaccagcctgggcaacat

SEQ ID NO: 444660 - DNA, 20 bp, Artificial
  CRISPR gRNA sequence
ggcaacatggcaaaacccca

SEQ ID NO: 444661 - DNA, 20 bp, Artificial
  CRISPR gRNA sequence
tactaagaatacaaaaaatt

SEQ ID NO: 444662 - DNA, 20 bp, Artificial
  CRISPR gRNA sequence
ctaagaatacaaaaaattag

SEQ ID NO: 444663 - DNA, 20 bp, Artificial
  CRISPR gRNA sequence
agaatacaaaaaattaggct

SEQ ID NO: 444664 - DNA, 20 bp, Artificial
  CRISPR gRNA sequence
ggctgagtgcagtggctcac

SEQ ID NO: 444665 - DNA, 20 bp, Artificial
  CRISPR gRNA sequence
agtgcagtggctcacacctg

SEQ ID NO: 444666 - DNA, 20 bp, Artificial
  CRISPR gRNA sequence
acacctgtaatcccagcact

SEQ ID NO: 444667 - DNA, 20 bp, Artificial
  CRISPR gRNA sequence
taatcccagcactttgggag

SEQ ID NO: 444668 - DNA, 20 bp, Artificial
  CRISPR gRNA sequence
tgggaggccaaggcagatgg

SEQ ID NO: 444669 - DNA, 20 bp, Artificial
  CRISPR gRNA sequence
gggaggccaaggcagatgga

SEQ ID NO: 444670 - DNA, 20 bp, Artificial
  CRISPR gRNA sequence
ggaggccaaggcagatggat

SEQ ID NO: 444671 - DNA, 20 bp, Artificial
  CRISPR gRNA sequence
aggtcaggagtttaagccag

SEQ ID NO: 444672 - DNA, 20 bp, Artificial
  CRISPR gRNA sequence
aagccagcctggccaagatg

SEQ ID NO: 444673 - DNA, 20 bp, Artificial
  CRISPR gRNA sequence
agccagcctggccaagatgg

SEQ ID NO: 444674 - DNA, 20 bp, Artificial
  CRISPR gRNA sequence
gccaagatggtgaaacccct

SEQ ID NO: 444675 - DNA, 20 bp, Artificial
  CRISPR gRNA sequence
tctctactaaaaatacaaaa

SEQ ID NO: 444676 - DNA, 20 bp, Artificial
  CRISPR gRNA sequence
tactaaaaatacaaaaatta

SEQ ID NO: 444677 - DNA, 20 bp, Artificial
  CRISPR gRNA sequence
ctaaaaatacaaaaattagc

SEQ ID NO: 444678 - DNA, 20 bp, Artificial
  CRISPR gRNA sequence
aaaatacaaaaattagctgg

SEQ ID NO: 444679 - DNA, 20 bp, Artificial
  CRISPR gRNA sequence
gctggtcatggtggtgcatg

SEQ ID NO: 444680 - DNA, 20 bp, Artificial
  CRISPR gRNA sequence
gtcatggtggtgcatgccta

SEQ ID NO: 444681 - DNA, 20 bp, Artificial
  CRISPR gRNA sequence
taattccagctactcaggag

SEQ ID NO: 444682 - DNA, 20 bp, Artificial
  CRISPR gRNA sequence
cagctactcaggaggctgag

SEQ ID NO: 444683 - DNA, 20 bp, Artificial
  CRISPR gRNA sequence
ctcaggaggctgaggcagga

SEQ ID NO: 444684 - DNA, 20 bp, Artificial
  CRISPR gRNA sequence
aggaggctgaggcaggagaa

SEQ ID NO: 444685 - DNA, 20 bp, Artificial
  CRISPR gRNA sequence
aggcaggagaattgtctgag

SEQ ID NO: 444686 - DNA, 20 bp, Artificial
  CRISPR gRNA sequence
tctgagcctgggaggagtga

SEQ ID NO: 444687 - DNA, 20 bp, Artificial
  CRISPR gRNA sequence
agcctgggaggagtgaaccg

SEQ ID NO: 444688 - DNA, 20 bp, Artificial
  CRISPR gRNA sequence
ggaggagtgaaccgagatct

SEQ ID NO: 444689 - DNA, 20 bp, Artificial
  CRISPR gRNA sequence
accactgtcctgaagcctgg

SEQ ID NO: 444690 - DNA, 20 bp, Artificial
  CRISPR gRNA sequence
tcctgaagcctggaaaacag

SEQ ID NO: 444691 - DNA, 20 bp, Artificial
  CRISPR gRNA sequence
aagcctggaaaacagagcga

SEQ ID NO: 444692 - DNA, 20 bp, Artificial
  CRISPR gRNA sequence
gaaaacagagcgagattcca

SEQ ID NO: 444693 - DNA, 20 bp, Artificial
  CRISPR gRNA sequence
catcccaaaaaaaaaaaaaa

SEQ ID NO: 444694 - DNA, 20 bp, Artificial
  CRISPR gRNA sequence
tagtcccagctacttggcag

SEQ ID NO: 444695 - DNA, 20 bp, Artificial
  CRISPR gRNA sequence
cttggcagggctgaggcagg

SEQ ID NO: 444696 - DNA, 20 bp, Artificial
  CRISPR gRNA sequence
ggcagggctgaggcaggaag

SEQ ID NO: 444697 - DNA, 20 bp, Artificial
  CRISPR gRNA sequence
gcagggctgaggcaggaaga

SEQ ID NO: 444698 - DNA, 20 bp, Artificial
  CRISPR gRNA sequence
aggcaggaagattgcttgaa

SEQ ID NO: 444699 - DNA, 20 bp, Artificial
  CRISPR gRNA sequence
cttgaactcaggaggttgag

SEQ ID NO: 444700 - DNA, 20 bp, Artificial
  CRISPR gRNA sequence
gaactcaggaggttgaggat

SEQ ID NO: 444701 - DNA, 20 bp, Artificial
  CRISPR gRNA sequence
aactcaggaggttgaggatt

SEQ ID NO: 444702 - DNA, 20 bp, Artificial
  CRISPR gRNA sequence
aggaggttgaggattcactg

SEQ ID NO: 444703 - DNA, 20 bp, Artificial
  CRISPR gRNA sequence
aggattcactgagccgagtt

SEQ ID NO: 444704 - DNA, 20 bp, Artificial
  CRISPR gRNA sequence
actgagccgagttggtgcca

SEQ ID NO: 444705 - DNA, 20 bp, Artificial
  CRISPR gRNA sequence
agccgagttggtgccactgt

SEQ ID NO: 444706 - DNA, 20 bp, Artificial
  CRISPR gRNA sequence
gtgccactgtactccaaacc

SEQ ID NO: 444707 - DNA, 20 bp, Artificial
  CRISPR gRNA sequence
tactccaaacctgggcaaca

SEQ ID NO: 444708 - DNA, 20 bp, Artificial
  CRISPR gRNA sequence
caaacctgggcaacagagcg

SEQ ID NO: 444709 - DNA, 20 bp, Artificial
  CRISPR gRNA sequence
ggcaacagagcgagaccctt

SEQ ID NO: 444710 - DNA, 20 bp, Artificial
  CRISPR gRNA sequence
tctcagaaaaaaaaaaaaaa

SEQ ID NO: 444711 - DNA, 20 bp, Artificial
  CRISPR gRNA sequence
ctcagaaaaaaaaaaaaaaa

SEQ ID NO: 444712 - DNA, 20 bp, Artificial
  CRISPR gRNA sequence
tcagaaaaaaaaaaaaaaaa

SEQ ID NO: 444713 - DNA, 20 bp, Artificial
  CRISPR gRNA sequence
agaaaaaaaaaaaaaaaaaa

SEQ ID NO: 444714 - DNA, 20 bp, Artificial
  CRISPR gRNA sequence
taaaagtaagagatccaagg

SEQ ID NO: 444715 - DNA, 20 bp, Artificial
  CRISPR gRNA sequence
aaaagtaagagatccaaggg

SEQ ID NO: 444716 - DNA, 20 bp, Artificial
  CRISPR gRNA sequence
aaagtaagagatccaagggc

SEQ ID NO: 444717 - DNA, 20 bp, Artificial
  CRISPR gRNA sequence
gaatttgaacacagaacaaa

SEQ ID NO: 444718 - DNA, 20 bp, Artificial
  CRISPR gRNA sequence
gaacacagaacaaatgcaac

SEQ ID NO: 444719 - DNA, 20 bp, Artificial
  CRISPR gRNA sequence
aacacagaacaaatgcaact

SEQ ID NO: 444720 - DNA, 20 bp, Artificial
  CRISPR gRNA sequence
gtcttctacctgaaggagta

SEQ ID NO: 444721 - DNA, 20 bp, Artificial
  CRISPR gRNA sequence
tcttctacctgaaggagtaa

SEQ ID NO: 444722 - DNA, 20 bp, Artificial
  CRISPR gRNA sequence
ctacctgaaggagtaaggac

SEQ ID NO: 444723 - DNA, 20 bp, Artificial
  CRISPR gRNA sequence
tacctgaaggagtaaggact

SEQ ID NO: 444724 - DNA, 20 bp, Artificial
  CRISPR gRNA sequence
cctgaaggagtaaggactgg

SEQ ID NO: 444725 - DNA, 20 bp, Artificial
  CRISPR gRNA sequence
aaggagtaaggactgggtca

SEQ ID NO: 444726 - DNA, 20 bp, Artificial
  CRISPR gRNA sequence
ggtcacaggtgagtcctcag

SEQ ID NO: 444727 - DNA, 20 bp, Artificial
  CRISPR gRNA sequence
agctctagagtagatctgct

SEQ ID NO: 444728 - DNA, 20 bp, Artificial
  CRISPR gRNA sequence
tagagtagatctgctttaaa

SEQ ID NO: 444729 - DNA, 20 bp, Artificial
  CRISPR gRNA sequence
gagtagatctgctttaaatc

SEQ ID NO: 444730 - DNA, 20 bp, Artificial
  CRISPR gRNA sequence
ctttaaatcctagctttccc

SEQ ID NO: 444731 - DNA, 20 bp, Artificial
  CRISPR gRNA sequence
taaatcctagctttcccaat

SEQ ID NO: 444732 - DNA, 20 bp, Artificial
  CRISPR gRNA sequence
aaatcctagctttcccaatt

SEQ ID NO: 444733 - DNA, 20 bp, Artificial
  CRISPR gRNA sequence
aatcctagctttcccaatta

SEQ ID NO: 444734 - DNA, 20 bp, Artificial
  CRISPR gRNA sequence
gctttcccaattaatagctg

SEQ ID NO: 444735 - DNA, 20 bp, Artificial
  CRISPR gRNA sequence
tcccaattaatagctgtgtg

SEQ ID NO: 444736 - DNA, 20 bp, Artificial
  CRISPR gRNA sequence
cccaattaatagctgtgtga

SEQ ID NO: 444737 - DNA, 20 bp, Artificial
  CRISPR gRNA sequence
ccaattaatagctgtgtgat

SEQ ID NO: 444738 - DNA, 20 bp, Artificial
  CRISPR gRNA sequence
atagctgtgtgatcttgggc

SEQ ID NO: 444739 - DNA, 20 bp, Artificial
  CRISPR gRNA sequence
tgtgatcttgggcaaagtgg

SEQ ID NO: 444740 - DNA, 20 bp, Artificial
  CRISPR gRNA sequence
gggcaaagtggctctctcag

SEQ ID NO: 444741 - DNA, 20 bp, Artificial
  CRISPR gRNA sequence
ggcaaagtggctctctcaga

SEQ ID NO: 444742 - DNA, 20 bp, Artificial
  CRISPR gRNA sequence
tctcagactcagtatcttca

SEQ ID NO: 444743 - DNA, 20 bp, Artificial
  CRISPR gRNA sequence
tcagactcagtatcttcatc

SEQ ID NO: 444744 - DNA, 20 bp, Artificial
  CRISPR gRNA sequence
agactcagtatcttcatctg

SEQ ID NO: 444745 - DNA, 20 bp, Artificial
  CRISPR gRNA sequence
agtatcttcatctgaaaaat

SEQ ID NO: 444746 - DNA, 20 bp, Artificial
  CRISPR gRNA sequence
catctgaaaaatggggaaaa

SEQ ID NO: 444747 - DNA, 20 bp, Artificial
  CRISPR gRNA sequence
atctgaaaaatggggaaaat

SEQ ID NO: 444748 - DNA, 20 bp, Artificial
  CRISPR gRNA sequence
aaaaatggggaaaatagtag

SEQ ID NO: 444749 - DNA, 20 bp, Artificial
  CRISPR gRNA sequence
cttattgtggttgaggatta

SEQ ID NO: 444750 - DNA, 20 bp, Artificial
  CRISPR gRNA sequence
attgtggttgaggattaaat

SEQ ID NO: 444751 - DNA, 20 bp, Artificial
  CRISPR gRNA sequence
ttgtggttgaggattaaatg

SEQ ID NO: 444752 - DNA, 20 bp, Artificial
  CRISPR gRNA sequence
tggttgaggattaaatgaga

SEQ ID NO: 444753 - DNA, 20 bp, Artificial
  CRISPR gRNA sequence
aggattaaatgagattgtat

SEQ ID NO: 444754 - DNA, 20 bp, Artificial
  CRISPR gRNA sequence
aatgagattgtatgtatatg

SEQ ID NO: 444755 - DNA, 20 bp, Artificial
  CRISPR gRNA sequence
tatgtatatggtgctaagca

SEQ ID NO: 444756 - DNA, 20 bp, Artificial
  CRISPR gRNA sequence
agcaccatgtctggcaccta

SEQ ID NO: 444757 - DNA, 20 bp, Artificial
  CRISPR gRNA sequence
gcacctaataagtaccaaat

SEQ ID NO: 444758 - DNA, 20 bp, Artificial
  CRISPR gRNA sequence
ataagtaccaaatagatggt

SEQ ID NO: 444759 - DNA, 20 bp, Artificial
  CRISPR gRNA sequence
ctaaatttatacactgttaa

SEQ ID NO: 444760 - DNA, 20 bp, Artificial
  CRISPR gRNA sequence
aatttatacactgttaaggc

SEQ ID NO: 444761 - DNA, 20 bp, Artificial
  CRISPR gRNA sequence
atacactgttaaggccatca

SEQ ID NO: 444762 - DNA, 20 bp, Artificial
  CRISPR gRNA sequence
tacactgttaaggccatcac

SEQ ID NO: 444763 - DNA, 20 bp, Artificial
  CRISPR gRNA sequence
ttaaggccatcacatctcac

SEQ ID NO: 444764 - DNA, 20 bp, Artificial
  CRISPR gRNA sequence
aggccatcacatctcacctc

SEQ ID NO: 444765 - DNA, 20 bp, Artificial
  CRISPR gRNA sequence
acctccgctgctacctgccc

SEQ ID NO: 444766 - DNA, 20 bp, Artificial
  CRISPR gRNA sequence
cgctgctacctgccccacca

SEQ ID NO: 444767 - DNA, 20 bp, Artificial
  CRISPR gRNA sequence
ctacctgccccaccaggcaa

SEQ ID NO: 444768 - DNA, 20 bp, Artificial
  CRISPR gRNA sequence
cctgccccaccaggcaaatc

SEQ ID NO: 444769 - DNA, 20 bp, Artificial
  CRISPR gRNA sequence
ccccaccaggcaaatcttgg

SEQ ID NO: 444770 - DNA, 20 bp, Artificial
  CRISPR gRNA sequence
ggtttctccagaaagaacat

SEQ ID NO: 444771 - DNA, 20 bp, Artificial
  CRISPR gRNA sequence
gtttctccagaaagaacatt

SEQ ID NO: 444772 - DNA, 20 bp, Artificial
  CRISPR gRNA sequence
ctccagaaagaacattgcca

SEQ ID NO: 444773 - DNA, 20 bp, Artificial
  CRISPR gRNA sequence
tccagaaagaacattgccac

SEQ ID NO: 444774 - DNA, 20 bp, Artificial
  CRISPR gRNA sequence
cagaaagaacattgccactc

SEQ ID NO: 444775 - DNA, 20 bp, Artificial
  CRISPR gRNA sequence
ccactcccttcaactgtccc

SEQ ID NO: 444776 - DNA, 20 bp, Artificial
  CRISPR gRNA sequence
ccttcaactgtcccatccat

SEQ ID NO: 444777 - DNA, 20 bp, Artificial
  CRISPR gRNA sequence
caactgtcccatccatcttg

SEQ ID NO: 444778 - DNA, 20 bp, Artificial
  CRISPR gRNA sequence
aactgtcccatccatcttgg

SEQ ID NO: 444779 - DNA, 20 bp, Artificial
  CRISPR gRNA sequence
tcccatccatcttggttggt

SEQ ID NO: 444780 - DNA, 20 bp, Artificial
  CRISPR gRNA sequence
ggttggtggccaaatctgtg

SEQ ID NO: 444781 - DNA, 20 bp, Artificial
  CRISPR gRNA sequence
gttggtggccaaatctgtgt

SEQ ID NO: 444782 - DNA, 20 bp, Artificial
  CRISPR gRNA sequence
gtggccaaatctgtgtgaaa

SEQ ID NO: 444783 - DNA, 20 bp, Artificial
  CRISPR gRNA sequence
tgtgaaaaaaagctgtaatg

SEQ ID NO: 444784 - DNA, 20 bp, Artificial
  CRISPR gRNA sequence
taatgacacaacagtgcttg

SEQ ID NO: 444785 - DNA, 20 bp, Artificial
  CRISPR gRNA sequence
gattttactgatcattttca

SEQ ID NO: 444786 - DNA, 20 bp, Artificial
  CRISPR gRNA sequence
attttactgatcattttcat

SEQ ID NO: 444787 - DNA, 20 bp, Artificial
  CRISPR gRNA sequence
tactgatcattttcatagca

SEQ ID NO: 444788 - DNA, 20 bp, Artificial
  CRISPR gRNA sequence
actgatcattttcatagcaa

SEQ ID NO: 444789 - DNA, 20 bp, Artificial
  CRISPR gRNA sequence
ctgatcattttcatagcaaa

SEQ ID NO: 444790 - DNA, 20 bp, Artificial
  CRISPR gRNA sequence
atcattttcatagcaaaatg

SEQ ID NO: 444791 - DNA, 20 bp, Artificial
  CRISPR gRNA sequence
tcatagcaaaatgaagtttt

SEQ ID NO: 444792 - DNA, 20 bp, Artificial
  CRISPR gRNA sequence
catagcaaaatgaagttttt

SEQ ID NO: 444793 - DNA, 20 bp, Artificial
  CRISPR gRNA sequence
atagcaaaatgaagttttta

SEQ ID NO: 444794 - DNA, 20 bp, Artificial
  CRISPR gRNA sequence
ttaaaaagttagttttacca

SEQ ID NO: 444795 - DNA, 20 bp, Artificial
  CRISPR gRNA sequence
taaaaagttagttttaccat

SEQ ID NO: 444796 - DNA, 20 bp, Artificial
  CRISPR gRNA sequence
aaaaagttagttttaccatt

SEQ ID NO: 444797 - DNA, 20 bp, Artificial
  CRISPR gRNA sequence
aaaagttagttttaccattt

SEQ ID NO: 444798 - DNA, 20 bp, Artificial
  CRISPR gRNA sequence
gttttaccatttttatcaag

SEQ ID NO: 444799 - DNA, 20 bp, Artificial
  CRISPR gRNA sequence
taccatttttatcaagaaaa

SEQ ID NO: 444800 - DNA, 20 bp, Artificial
  CRISPR gRNA sequence
accatttttatcaagaaaaa

SEQ ID NO: 444801 - DNA, 20 bp, Artificial
  CRISPR gRNA sequence
ccatttttatcaagaaaaat

SEQ ID NO: 444802 - DNA, 20 bp, Artificial
  CRISPR gRNA sequence
ttatcaagaaaaataattat

SEQ ID NO: 444803 - DNA, 20 bp, Artificial
  CRISPR gRNA sequence
tatcaagaaaaataattata

SEQ ID NO: 444804 - DNA, 20 bp, Artificial
  CRISPR gRNA sequence
atcaagaaaaataattataa

SEQ ID NO: 444805 - DNA, 20 bp, Artificial
  CRISPR gRNA sequence
tcaagaaaaataattataag

SEQ ID NO: 444806 - DNA, 20 bp, Artificial
  CRISPR gRNA sequence
taaggagtctgaaactggat

SEQ ID NO: 444807 - DNA, 20 bp, Artificial
  CRISPR gRNA sequence
aaactggatttacatttaaa

SEQ ID NO: 444808 - DNA, 20 bp, Artificial
  CRISPR gRNA sequence
gatttacatttaaaatctta

SEQ ID NO: 444809 - DNA, 20 bp, Artificial
  CRISPR gRNA sequence
acatttaaaatcttatgtgc

SEQ ID NO: 444810 - DNA, 20 bp, Artificial
  CRISPR gRNA sequence
catttaaaatcttatgtgca

SEQ ID NO: 444811 - DNA, 20 bp, Artificial
  CRISPR gRNA sequence
aaaatcttatgtgcacttaa

SEQ ID NO: 444812 - DNA, 20 bp, Artificial
  CRISPR gRNA sequence
aaatcttatgtgcacttaag

SEQ ID NO: 444813 - DNA, 20 bp, Artificial
  CRISPR gRNA sequence
atgtgcacttaagattcatg

SEQ ID NO: 444814 - DNA, 20 bp, Artificial
  CRISPR gRNA sequence
tgtgcacttaagattcatgt

SEQ ID NO: 444815 - DNA, 20 bp, Artificial
  CRISPR gRNA sequence
aagattcatgtttacttagc

SEQ ID NO: 444816 - DNA, 20 bp, Artificial
  CRISPR gRNA sequence
agattcatgtttacttagca

SEQ ID NO: 444817 - DNA, 20 bp, Artificial
  CRISPR gRNA sequence
atgtttacttagcagttgta

SEQ ID NO: 444818 - DNA, 20 bp, Artificial
  CRISPR gRNA sequence
acttagcagttgtactgatg

SEQ ID NO: 444819 - DNA, 20 bp, Artificial
  CRISPR gRNA sequence
cttagcagttgtactgatga

SEQ ID NO: 444820 - DNA, 20 bp, Artificial
  CRISPR gRNA sequence
agcagttgtactgatgaggg

SEQ ID NO: 444821 - DNA, 20 bp, Artificial
  CRISPR gRNA sequence
gcagttgtactgatgagggt

SEQ ID NO: 444822 - DNA, 20 bp, Artificial
  CRISPR gRNA sequence
tactgatgagggtctttttt

SEQ ID NO: 444823 - DNA, 20 bp, Artificial
  CRISPR gRNA sequence
atgagggtcttttttttatt

SEQ ID NO: 444824 - DNA, 20 bp, Artificial
  CRISPR gRNA sequence
ttttttatttttttgatatg

SEQ ID NO: 444825 - DNA, 20 bp, Artificial
  CRISPR gRNA sequence
tttttatttttttgatatgg

SEQ ID NO: 444826 - DNA, 20 bp, Artificial
  CRISPR gRNA sequence
ttttatttttttgatatgga

SEQ ID NO: 444827 - DNA, 20 bp, Artificial
  CRISPR gRNA sequence
tttatttttttgatatggag

SEQ ID NO: 444828 - DNA, 20 bp, Artificial
  CRISPR gRNA sequence
ttatttttttgatatggagt

SEQ ID NO: 444829 - DNA, 20 bp, Artificial
  CRISPR gRNA sequence
tatttttttgatatggagtc

SEQ ID NO: 444830 - DNA, 20 bp, Artificial
  CRISPR gRNA sequence
atttttttgatatggagtct

SEQ ID NO: 444831 - DNA, 20 bp, Artificial
  CRISPR gRNA sequence
tttttttgatatggagtctt

SEQ ID NO: 444832 - DNA, 20 bp, Artificial
  CRISPR gRNA sequence
ttttgatatggagtcttgct

SEQ ID NO: 444833 - DNA, 20 bp, Artificial
  CRISPR gRNA sequence
tttgatatggagtcttgctc

SEQ ID NO: 444834 - DNA, 20 bp, Artificial
  CRISPR gRNA sequence
ttgatatggagtcttgctct

SEQ ID NO: 444835 - DNA, 20 bp, Artificial
  CRISPR gRNA sequence
tgatatggagtcttgctctg

SEQ ID NO: 444836 - DNA, 20 bp, Artificial
  CRISPR gRNA sequence
gatatggagtcttgctctgt

SEQ ID NO: 444837 - DNA, 20 bp, Artificial
  CRISPR gRNA sequence
atatggagtcttgctctgtc

SEQ ID NO: 444838 - DNA, 20 bp, Artificial
  CRISPR gRNA sequence
gctctgtcaccaggctggag

SEQ ID NO: 444839 - DNA, 20 bp, Artificial
  CRISPR gRNA sequence
ctctgtcaccaggctggagt

SEQ ID NO: 444840 - DNA, 20 bp, Artificial
  CRISPR gRNA sequence
tgtcaccaggctggagtgca

SEQ ID NO: 444841 - DNA, 20 bp, Artificial
  CRISPR gRNA sequence
tcaccaggctggagtgcaat

SEQ ID NO: 444842 - DNA, 20 bp, Artificial
  CRISPR gRNA sequence
gagtgcaatggtgtgatctc

SEQ ID NO: 444843 - DNA, 20 bp, Artificial
  CRISPR gRNA sequence
ggctcactgcaacctccacc

SEQ ID NO: 444844 - DNA, 20 bp, Artificial
  CRISPR gRNA sequence
actgcaacctccacctcctg

SEQ ID NO: 444845 - DNA, 20 bp, Artificial
  CRISPR gRNA sequence
caacctccacctcctgggtt

SEQ ID NO: 444846 - DNA, 20 bp, Artificial
  CRISPR gRNA sequence
cacctcctgggttcaagcga

SEQ ID NO: 444847 - DNA, 20 bp, Artificial
  CRISPR gRNA sequence
ctgggttcaagcgattccac

SEQ ID NO: 444848 - DNA, 20 bp, Artificial
  CRISPR gRNA sequence
ggttcaagcgattccactgc

SEQ ID NO: 444849 - DNA, 20 bp, Artificial
  CRISPR gRNA sequence
aagcgattccactgcctcag

SEQ ID NO: 444850 - DNA, 20 bp, Artificial
  CRISPR gRNA sequence
cactgcctcagcctcctgag

SEQ ID NO: 444851 - DNA, 20 bp, Artificial
  CRISPR gRNA sequence
cctcagcctcctgagtagct

SEQ ID NO: 444852 - DNA, 20 bp, Artificial
  CRISPR gRNA sequence
agcctcctgagtagctggga

SEQ ID NO: 444853 - DNA, 20 bp, Artificial
  CRISPR gRNA sequence
ctgagtagctgggactacag

SEQ ID NO: 444854 - DNA, 20 bp, Artificial
  CRISPR gRNA sequence
agtagctgggactacaggcg

SEQ ID NO: 444855 - DNA, 20 bp, Artificial
  CRISPR gRNA sequence
ggactacaggcgtacaccac

SEQ ID NO: 444856 - DNA, 20 bp, Artificial
  CRISPR gRNA sequence
caggcgtacaccaccacgcc

SEQ ID NO: 444857 - DNA, 20 bp, Artificial
  CRISPR gRNA sequence
attttttgtattttagtaga

SEQ ID NO: 444858 - DNA, 20 bp, Artificial
  CRISPR gRNA sequence
tttgtattttagtagagatg

SEQ ID NO: 444859 - DNA, 20 bp, Artificial
  CRISPR gRNA sequence
ttgtattttagtagagatgg

SEQ ID NO: 444860 - DNA, 20 bp, Artificial
  CRISPR gRNA sequence
tgtattttagtagagatggg

SEQ ID NO: 444861 - DNA, 20 bp, Artificial
  CRISPR gRNA sequence
gtattttagtagagatgggg

SEQ ID NO: 444862 - DNA, 20 bp, Artificial
  CRISPR gRNA sequence
tattttagtagagatggggt

SEQ ID NO: 444863 - DNA, 20 bp, Artificial
  CRISPR gRNA sequence
tagtagagatggggtttcac

SEQ ID NO: 444864 - DNA, 20 bp, Artificial
  CRISPR gRNA sequence
agtagagatggggtttcacc

SEQ ID NO: 444865 - DNA, 20 bp, Artificial
  CRISPR gRNA sequence
gtagagatggggtttcacca

SEQ ID NO: 444866 - DNA, 20 bp, Artificial
  CRISPR gRNA sequence
caccatattggccaggatgg

SEQ ID NO: 444867 - DNA, 20 bp, Artificial
  CRISPR gRNA sequence
accatattggccaggatggt

SEQ ID NO: 444868 - DNA, 20 bp, Artificial
  CRISPR gRNA sequence
gccaggatggtctcgatctc

SEQ ID NO: 444869 - DNA, 20 bp, Artificial
  CRISPR gRNA sequence
gatctcctgacctcgtgatc

SEQ ID NO: 444870 - DNA, 20 bp, Artificial
  CRISPR gRNA sequence
ctgacctcgtgatctgcctg

SEQ ID NO: 444871 - DNA, 20 bp, Artificial
  CRISPR gRNA sequence
acctcgtgatctgcctgccc

SEQ ID NO: 444872 - DNA, 20 bp, Artificial
  CRISPR gRNA sequence
gtgatctgcctgccctcggc

SEQ ID NO: 444873 - DNA, 20 bp, Artificial
  CRISPR gRNA sequence
cctgccctcggcctcccaaa

SEQ ID NO: 444874 - DNA, 20 bp, Artificial
  CRISPR gRNA sequence
ccctcggcctcccaaagtgc

SEQ ID NO: 444875 - DNA, 20 bp, Artificial
  CRISPR gRNA sequence
ggcctcccaaagtgctggga

SEQ ID NO: 444876 - DNA, 20 bp, Artificial
  CRISPR gRNA sequence
ccaaagtgctgggattacag

SEQ ID NO: 444877 - DNA, 20 bp, Artificial
  CRISPR gRNA sequence
ggattacaggtgtgagccac

SEQ ID NO: 444878 - DNA, 20 bp, Artificial
  CRISPR gRNA sequence
caggtgtgagccactgcacc

SEQ ID NO: 444879 - DNA, 20 bp, Artificial
  CRISPR gRNA sequence
caccaggcctgtggttttta

SEQ ID NO: 444880 - DNA, 20 bp, Artificial
  CRISPR gRNA sequence
tggtttttatattttaaatt

SEQ ID NO: 444881 - DNA, 20 bp, Artificial
  CRISPR gRNA sequence
ttatattttaaatttttttc

SEQ ID NO: 444882 - DNA, 20 bp, Artificial
  CRISPR gRNA sequence
tatattttaaatttttttct

SEQ ID NO: 444883 - DNA, 20 bp, Artificial
  CRISPR gRNA sequence
atattttaaatttttttctg

SEQ ID NO: 444884 - DNA, 20 bp, Artificial
  CRISPR gRNA sequence
tattttaaatttttttctgg

SEQ ID NO: 444885 - DNA, 20 bp, Artificial
  CRISPR gRNA sequence
taaatttttttctggtaatt

SEQ ID NO: 444886 - DNA, 20 bp, Artificial
  CRISPR gRNA sequence
aaatttttttctggtaatta

SEQ ID NO: 444887 - DNA, 20 bp, Artificial
  CRISPR gRNA sequence
aatttttttctggtaattag

SEQ ID NO: 444888 - DNA, 20 bp, Artificial
  CRISPR gRNA sequence
ttttctggtaattagggcaa

SEQ ID NO: 444889 - DNA, 20 bp, Artificial
  CRISPR gRNA sequence
tttctggtaattagggcaaa

SEQ ID NO: 444890 - DNA, 20 bp, Artificial
  CRISPR gRNA sequence
ttctggtaattagggcaaaa

SEQ ID NO: 444891 - DNA, 20 bp, Artificial
  CRISPR gRNA sequence
tctggtaattagggcaaaag

SEQ ID NO: 444892 - DNA, 20 bp, Artificial
  CRISPR gRNA sequence
ctggtaattagggcaaaagt

SEQ ID NO: 444893 - DNA, 20 bp, Artificial
  CRISPR gRNA sequence
tggtaattagggcaaaagta

SEQ ID NO: 444894 - DNA, 20 bp, Artificial
  CRISPR gRNA sequence
gtaattagggcaaaagtaat

SEQ ID NO: 444895 - DNA, 20 bp, Artificial
  CRISPR gRNA sequence
gggcaaaagtaattggaaca

SEQ ID NO: 444896 - DNA, 20 bp, Artificial
  CRISPR gRNA sequence
gaacataatctttttttctt

SEQ ID NO: 444897 - DNA, 20 bp, Artificial
  CRISPR gRNA sequence
tttttcttcaataattttag

SEQ ID NO: 444898 - DNA, 20 bp, Artificial
  CRISPR gRNA sequence
ttttcttcaataattttagg

SEQ ID NO: 444899 - DNA, 20 bp, Artificial
  CRISPR gRNA sequence
tttcttcaataattttaggc

SEQ ID NO: 444900 - DNA, 20 bp, Artificial
  CRISPR gRNA sequence
ttcttcaataattttaggct

SEQ ID NO: 444901 - DNA, 20 bp, Artificial
  CRISPR gRNA sequence
tcttcaataattttaggctg

SEQ ID NO: 444902 - DNA, 20 bp, Artificial
  CRISPR gRNA sequence
cttcaataattttaggctga

SEQ ID NO: 444903 - DNA, 20 bp, Artificial
  CRISPR gRNA sequence
ttcaataattttaggctgag

SEQ ID NO: 444904 - DNA, 20 bp, Artificial
  CRISPR gRNA sequence
caataattttaggctgaggc

SEQ ID NO: 444905 - DNA, 20 bp, Artificial
  CRISPR gRNA sequence
aataattttaggctgaggct

SEQ ID NO: 444906 - DNA, 20 bp, Artificial
  CRISPR gRNA sequence
taggctgaggctatgccttt

SEQ ID NO: 444907 - DNA, 20 bp, Artificial
  CRISPR gRNA sequence
aggctgaggctatgccttta

SEQ ID NO: 444908 - DNA, 20 bp, Artificial
  CRISPR gRNA sequence
ggctgaggctatgcctttat

SEQ ID NO: 444909 - DNA, 20 bp, Artificial
  CRISPR gRNA sequence
aggctatgcctttataatat

SEQ ID NO: 444910 - DNA, 20 bp, Artificial
  CRISPR gRNA sequence
tgcctttataatatttaaac

SEQ ID NO: 444911 - DNA, 20 bp, Artificial
  CRISPR gRNA sequence
tataatatttaaactatagt

SEQ ID NO: 444912 - DNA, 20 bp, Artificial
  CRISPR gRNA sequence
ataatatttaaactatagtt

SEQ ID NO: 444913 - DNA, 20 bp, Artificial
  CRISPR gRNA sequence
taatatttaaactatagttt

SEQ ID NO: 444914 - DNA, 20 bp, Artificial
  CRISPR gRNA sequence
aaactatagtttgctaaacc

SEQ ID NO: 444915 - DNA, 20 bp, Artificial
  CRISPR gRNA sequence
aactatagtttgctaaacca

SEQ ID NO: 444916 - DNA, 20 bp, Artificial
  CRISPR gRNA sequence
tagtttgctaaaccagcatt

SEQ ID NO: 444917 - DNA, 20 bp, Artificial
  CRISPR gRNA sequence
gctaaaccagcatttagtca

SEQ ID NO: 444918 - DNA, 20 bp, Artificial
  CRISPR gRNA sequence
ctaaaccagcatttagtcaa

SEQ ID NO: 444919 - DNA, 20 bp, Artificial
  CRISPR gRNA sequence
aaccagcatttagtcaaacc

SEQ ID NO: 444920 - DNA, 20 bp, Artificial
  CRISPR gRNA sequence
agtcaaaccctttatacaca

SEQ ID NO: 444921 - DNA, 20 bp, Artificial
  CRISPR gRNA sequence
gtcaaaccctttatacacat

SEQ ID NO: 444922 - DNA, 20 bp, Artificial
  CRISPR gRNA sequence
tatacacattaaggcttcca

SEQ ID NO: 444923 - DNA, 20 bp, Artificial
  CRISPR gRNA sequence
atacacattaaggcttccag

SEQ ID NO: 444924 - DNA, 20 bp, Artificial
  CRISPR gRNA sequence
tacacattaaggcttccaga

SEQ ID NO: 444925 - DNA, 20 bp, Artificial
  CRISPR gRNA sequence
aggcttccagaaggtgacag

SEQ ID NO: 444926 - DNA, 20 bp, Artificial
  CRISPR gRNA sequence
ccagaaggtgacagtgacat

SEQ ID NO: 444927 - DNA, 20 bp, Artificial
  CRISPR gRNA sequence
cagaaggtgacagtgacatt

SEQ ID NO: 444928 - DNA, 20 bp, Artificial
  CRISPR gRNA sequence
aagaagtttcaacatctctg

SEQ ID NO: 444929 - DNA, 20 bp, Artificial
  CRISPR gRNA sequence
agaagtttcaacatctctga

SEQ ID NO: 444930 - DNA, 20 bp, Artificial
  CRISPR gRNA sequence
caacatctctgactcagcca

SEQ ID NO: 444931 - DNA, 20 bp, Artificial
  CRISPR gRNA sequence
aacatctctgactcagccat

SEQ ID NO: 444932 - DNA, 20 bp, Artificial
  CRISPR gRNA sequence
tgactcagccataaaaatga

SEQ ID NO: 444933 - DNA, 20 bp, Artificial
  CRISPR gRNA sequence
actcagccataaaaatgagt

SEQ ID NO: 444934 - DNA, 20 bp, Artificial
  CRISPR gRNA sequence
agccataaaaatgagtaagc

SEQ ID NO: 444935 - DNA, 20 bp, Artificial
  CRISPR gRNA sequence
agttttccaaaagctggcaa

SEQ ID NO: 444936 - DNA, 20 bp, Artificial
  CRISPR gRNA sequence
gttttccaaaagctggcaat

SEQ ID NO: 444937 - DNA, 20 bp, Artificial
  CRISPR gRNA sequence
tccaaaagctggcaatgtac

SEQ ID NO: 444938 - DNA, 20 bp, Artificial
  CRISPR gRNA sequence
ccaaaagctggcaatgtact

SEQ ID NO: 444939 - DNA, 20 bp, Artificial
  CRISPR gRNA sequence
caaaagctggcaatgtactt

SEQ ID NO: 444940 - DNA, 20 bp, Artificial
  CRISPR gRNA sequence
gcaatgtacttatttttaga

SEQ ID NO: 444941 - DNA, 20 bp, Artificial
  CRISPR gRNA sequence
atttttagaattcagtgttc

SEQ ID NO: 444942 - DNA, 20 bp, Artificial
  CRISPR gRNA sequence
tttttagaattcagtgttca

SEQ ID NO: 444943 - DNA, 20 bp, Artificial
  CRISPR gRNA sequence
ttagaattcagtgttcatga

SEQ ID NO: 444944 - DNA, 20 bp, Artificial
  CRISPR gRNA sequence
tagaattcagtgttcatgag

SEQ ID NO: 444945 - DNA, 20 bp, Artificial
  CRISPR gRNA sequence
agaattcagtgttcatgagg

SEQ ID NO: 444946 - DNA, 20 bp, Artificial
  CRISPR gRNA sequence
gaattcagtgttcatgaggt

SEQ ID NO: 444947 - DNA, 20 bp, Artificial
  CRISPR gRNA sequence
agtgttcatgaggtcagggc

SEQ ID NO: 444948 - DNA, 20 bp, Artificial
  CRISPR gRNA sequence
atgaggtcagggcctgtgcc

SEQ ID NO: 444949 - DNA, 20 bp, Artificial
  CRISPR gRNA sequence
tgcccctcttgtttcctgct

SEQ ID NO: 444950 - DNA, 20 bp, Artificial
  CRISPR gRNA sequence
ttgtttcctgctctgtcccc

SEQ ID NO: 444951 - DNA, 20 bp, Artificial
  CRISPR gRNA sequence
gtttcctgctctgtcccctg

SEQ ID NO: 444952 - DNA, 20 bp, Artificial
  CRISPR gRNA sequence
tttcctgctctgtcccctgt

SEQ ID NO: 444953 - DNA, 20 bp, Artificial
  CRISPR gRNA sequence
cctgctctgtcccctgtgcc

SEQ ID NO: 444954 - DNA, 20 bp, Artificial
  CRISPR gRNA sequence
ctgctctgtcccctgtgcct

SEQ ID NO: 444955 - DNA, 20 bp, Artificial
  CRISPR gRNA sequence
ctctgtcccctgtgcctaga

SEQ ID NO: 444956 - DNA, 20 bp, Artificial
  CRISPR gRNA sequence
tgtcccctgtgcctagagta

SEQ ID NO: 444957 - DNA, 20 bp, Artificial
  CRISPR gRNA sequence
tcccctgtgcctagagtaag

SEQ ID NO: 444958 - DNA, 20 bp, Artificial
  CRISPR gRNA sequence
tgcctagagtaagggcatag

SEQ ID NO: 444959 - DNA, 20 bp, Artificial
  CRISPR gRNA sequence
gagtaagggcatagtgcata

SEQ ID NO: 444960 - DNA, 20 bp, Artificial
  CRISPR gRNA sequence
atggaatggatcagcagatg

SEQ ID NO: 444961 - DNA, 20 bp, Artificial
  CRISPR gRNA sequence
ggcaacgtgaccctcttcat

SEQ ID NO: 444962 - DNA, 20 bp, Artificial
  CRISPR gRNA sequence
ttcataatgacagcactgag

SEQ ID NO: 444963 - DNA, 20 bp, Artificial
  CRISPR gRNA sequence
cataatgacagcactgaggt

SEQ ID NO: 444964 - DNA, 20 bp, Artificial
  CRISPR gRNA sequence
ataatgacagcactgaggta

SEQ ID NO: 444965 - DNA, 20 bp, Artificial
  CRISPR gRNA sequence
aggtaagggctggtgaaggc

SEQ ID NO: 444966 - DNA, 20 bp, Artificial
  CRISPR gRNA sequence
gtgaaggcagtataattaag

SEQ ID NO: 444967 - DNA, 20 bp, Artificial
  CRISPR gRNA sequence
agaatgtgcatttaaggcta

SEQ ID NO: 444968 - DNA, 20 bp, Artificial
  CRISPR gRNA sequence
aaggctatgcagacctaaat

SEQ ID NO: 444969 - DNA, 20 bp, Artificial
  CRISPR gRNA sequence
aggctatgcagacctaaatt

SEQ ID NO: 444970 - DNA, 20 bp, Artificial
  CRISPR gRNA sequence
tgcagacctaaattggaagg

SEQ ID NO: 444971 - DNA, 20 bp, Artificial
  CRISPR gRNA sequence
aattggaaggccattttgtc

SEQ ID NO: 444972 - DNA, 20 bp, Artificial
  CRISPR gRNA sequence
gaaggccattttgtcatttg

SEQ ID NO: 444973 - DNA, 20 bp, Artificial
  CRISPR gRNA sequence
tgtcatttgctaagtcatgt

SEQ ID NO: 444974 - DNA, 20 bp, Artificial
  CRISPR gRNA sequence
gtcatttgctaagtcatgtg

SEQ ID NO: 444975 - DNA, 20 bp, Artificial
  CRISPR gRNA sequence
tcatttgctaagtcatgtga

SEQ ID NO: 444976 - DNA, 20 bp, Artificial
  CRISPR gRNA sequence
gctaagtcatgtgaccttgg

SEQ ID NO: 444977 - DNA, 20 bp, Artificial
  CRISPR gRNA sequence
ctaagtcatgtgaccttggg

SEQ ID NO: 444978 - DNA, 20 bp, Artificial
  CRISPR gRNA sequence
agtcatgtgaccttgggtta

SEQ ID NO: 444979 - DNA, 20 bp, Artificial
  CRISPR gRNA sequence
gggttagtcacttcacttcc

SEQ ID NO: 444980 - DNA, 20 bp, Artificial
  CRISPR gRNA sequence
ggttagtcacttcacttccc

SEQ ID NO: 444981 - DNA, 20 bp, Artificial
  CRISPR gRNA sequence
gtcacttcacttccctaatt

SEQ ID NO: 444982 - DNA, 20 bp, Artificial
  CRISPR gRNA sequence
cacttccctaattttcagtt

SEQ ID NO: 444983 - DNA, 20 bp, Artificial
  CRISPR gRNA sequence
acttccctaattttcagttt

SEQ ID NO: 444984 - DNA, 20 bp, Artificial
  CRISPR gRNA sequence
ccctaattttcagtttcttc

SEQ ID NO: 444985 - DNA, 20 bp, Artificial
  CRISPR gRNA sequence
cctaattttcagtttcttca

SEQ ID NO: 444986 - DNA, 20 bp, Artificial
  CRISPR gRNA sequence
attttcagtttcttcatctg

SEQ ID NO: 444987 - DNA, 20 bp, Artificial
  CRISPR gRNA sequence
tcagtttcttcatctgtgca

SEQ ID NO: 444988 - DNA, 20 bp, Artificial
  CRISPR gRNA sequence
cagtttcttcatctgtgcaa

SEQ ID NO: 444989 - DNA, 20 bp, Artificial
  CRISPR gRNA sequence
agtttcttcatctgtgcaat

SEQ ID NO: 444990 - DNA, 20 bp, Artificial
  CRISPR gRNA sequence
cttcatctgtgcaatgggac

SEQ ID NO: 444991 - DNA, 20 bp, Artificial
  CRISPR gRNA sequence
ttcatctgtgcaatgggact

SEQ ID NO: 444992 - DNA, 20 bp, Artificial
  CRISPR gRNA sequence
catctgtgcaatgggactaa

SEQ ID NO: 444993 - DNA, 20 bp, Artificial
  CRISPR gRNA sequence
atctgtgcaatgggactaac

SEQ ID NO: 444994 - DNA, 20 bp, Artificial
  CRISPR gRNA sequence
tgcaatgggactaacagtct

SEQ ID NO: 444995 - DNA, 20 bp, Artificial
  CRISPR gRNA sequence
acagtctctactttagaagc

SEQ ID NO: 444996 - DNA, 20 bp, Artificial
  CRISPR gRNA sequence
tactttagaagcgtagttct

SEQ ID NO: 444997 - DNA, 20 bp, Artificial
  CRISPR gRNA sequence
ctttagaagcgtagttctaa

SEQ ID NO: 444998 - DNA, 20 bp, Artificial
  CRISPR gRNA sequence
tagaagcgtagttctaaagt

SEQ ID NO: 444999 - DNA, 20 bp, Artificial
  CRISPR gRNA sequence
agaagcgtagttctaaagta

SEQ ID NO: 445000 - DNA, 20 bp, Artificial
  CRISPR gRNA sequence
gaagcgtagttctaaagtaa

SEQ ID NO: 445001 - DNA, 20 bp, Artificial
  CRISPR gRNA sequence
taaagtaagtgcttctaagt

SEQ ID NO: 445002 - DNA, 20 bp, Artificial
  CRISPR gRNA sequence
aagtaagtgcttctaagtat

SEQ ID NO: 445003 - DNA, 20 bp, Artificial
  CRISPR gRNA sequence
ctaagtatctctaaaatgag

SEQ ID NO: 445004 - DNA, 20 bp, Artificial
  CRISPR gRNA sequence
taagtatctctaaaatgagc

SEQ ID NO: 445005 - DNA, 20 bp, Artificial
  CRISPR gRNA sequence
agtatctctaaaatgagctt

SEQ ID NO: 445006 - DNA, 20 bp, Artificial
  CRISPR gRNA sequence
taaaatgagcttcttcactg

SEQ ID NO: 445007 - DNA, 20 bp, Artificial
  CRISPR gRNA sequence
aaatgagcttcttcactgaa

SEQ ID NO: 445008 - DNA, 20 bp, Artificial
  CRISPR gRNA sequence
cttcactgaaagagtttatt

SEQ ID NO: 445009 - DNA, 20 bp, Artificial
  CRISPR gRNA sequence
ttcactgaaagagtttattt

SEQ ID NO: 445010 - DNA, 20 bp, Artificial
  CRISPR gRNA sequence
cactgaaagagtttatttag

SEQ ID NO: 445011 - DNA, 20 bp, Artificial
  CRISPR gRNA sequence
actgaaagagtttatttagc

SEQ ID NO: 445012 - DNA, 20 bp, Artificial
  CRISPR gRNA sequence
aaagagtttatttagcacaa

SEQ ID NO: 445013 - DNA, 20 bp, Artificial
  CRISPR gRNA sequence
atttagcacaaggcctggct

SEQ ID NO: 445014 - DNA, 20 bp, Artificial
  CRISPR gRNA sequence
tttagcacaaggcctggctc

SEQ ID NO: 445015 - DNA, 20 bp, Artificial
  CRISPR gRNA sequence
agcacaaggcctggctccta

SEQ ID NO: 445016 - DNA, 20 bp, Artificial
  CRISPR gRNA sequence
gcacaaggcctggctcctat

SEQ ID NO: 445017 - DNA, 20 bp, Artificial
  CRISPR gRNA sequence
gctcctattacattgtgacc

SEQ ID NO: 445018 - DNA, 20 bp, Artificial
  CRISPR gRNA sequence
ctattacattgtgaccacag

SEQ ID NO: 445019 - DNA, 20 bp, Artificial
  CRISPR gRNA sequence
ttacattgtgaccacagtga

SEQ ID NO: 445020 - DNA, 20 bp, Artificial
  CRISPR gRNA sequence
cattgtgaccacagtgatta

SEQ ID NO: 445021 - DNA, 20 bp, Artificial
  CRISPR gRNA sequence
tgaccacagtgattattttc

SEQ ID NO: 445022 - DNA, 20 bp, Artificial
  CRISPR gRNA sequence
ttttcatttgttggcaaccc

SEQ ID NO: 445023 - DNA, 20 bp, Artificial
  CRISPR gRNA sequence
tcatttgttggcaaccctgt

SEQ ID NO: 445024 - DNA, 20 bp, Artificial
  CRISPR gRNA sequence
catttgttggcaaccctgtc

SEQ ID NO: 445025 - DNA, 20 bp, Artificial
  CRISPR gRNA sequence
atttgttggcaaccctgtct

SEQ ID NO: 445026 - DNA, 20 bp, Artificial
  CRISPR gRNA sequence
gttggcaaccctgtctccct

SEQ ID NO: 445027 - DNA, 20 bp, Artificial
  CRISPR gRNA sequence
ttggcaaccctgtctccctt

SEQ ID NO: 445028 - DNA, 20 bp, Artificial
  CRISPR gRNA sequence
gcaaccctgtctcccttctc

SEQ ID NO: 445029 - DNA, 20 bp, Artificial
  CRISPR gRNA sequence
tctcccttctcatgagtaaa

SEQ ID NO: 445030 - DNA, 20 bp, Artificial
  CRISPR gRNA sequence
ccttctcatgagtaaatgca

SEQ ID NO: 445031 - DNA, 20 bp, Artificial
  CRISPR gRNA sequence
ctcatgagtaaatgcaaaac

SEQ ID NO: 445032 - DNA, 20 bp, Artificial
  CRISPR gRNA sequence
tcatgagtaaatgcaaaact

SEQ ID NO: 445033 - DNA, 20 bp, Artificial
  CRISPR gRNA sequence
atgagtaaatgcaaaactta

SEQ ID NO: 445034 - DNA, 20 bp, Artificial
  CRISPR gRNA sequence
atttaagaaaatggaggctg

SEQ ID NO: 445035 - DNA, 20 bp, Artificial
  CRISPR gRNA sequence
tttaagaaaatggaggctgg

SEQ ID NO: 445036 - DNA, 20 bp, Artificial
  CRISPR gRNA sequence
aagaaaatggaggctgggca

SEQ ID NO: 445037 - DNA, 20 bp, Artificial
  CRISPR gRNA sequence
agaaaatggaggctgggcac

SEQ ID NO: 445038 - DNA, 20 bp, Artificial
  CRISPR gRNA sequence
ggcacggcacggtggctcac

SEQ ID NO: 445039 - DNA, 20 bp, Artificial
  CRISPR gRNA sequence
acgcctgtaatcccagcact

SEQ ID NO: 445040 - DNA, 20 bp, Artificial
  CRISPR gRNA sequence
taatcccagcactttgggag

SEQ ID NO: 445041 - DNA, 20 bp, Artificial
  CRISPR gRNA sequence
tgggaggccgaggcgggtgg

SEQ ID NO: 445042 - DNA, 20 bp, Artificial
  CRISPR gRNA sequence
gggaggccgaggcgggtgga

SEQ ID NO: 445043 - DNA, 20 bp, Artificial
  CRISPR gRNA sequence
ggaggccgaggcgggtggat

SEQ ID NO: 445044 - DNA, 20 bp, Artificial
  CRISPR gRNA sequence
gaggtcaggagttcgagact

SEQ ID NO: 445045 - DNA, 20 bp, Artificial
  CRISPR gRNA sequence
aggtcaggagttcgagacta

SEQ ID NO: 445046 - DNA, 20 bp, Artificial
  CRISPR gRNA sequence
gagactagcctggccaacat

SEQ ID NO: 445047 - DNA, 20 bp, Artificial
  CRISPR gRNA sequence
gcctggccaacatggcgaaa

SEQ ID NO: 445048 - DNA, 20 bp, Artificial
  CRISPR gRNA sequence
gccaacatggcgaaaccccg

SEQ ID NO: 445049 - DNA, 20 bp, Artificial
  CRISPR gRNA sequence
tactaaaaatacaaaaatta

SEQ ID NO: 445050 - DNA, 20 bp, Artificial
  CRISPR gRNA sequence
ctaaaaatacaaaaattagc

SEQ ID NO: 445051 - DNA, 20 bp, Artificial
  CRISPR gRNA sequence
aaaatacaaaaattagctgt

SEQ ID NO: 445052 - DNA, 20 bp, Artificial
  CRISPR gRNA sequence
gctgtgtgtggtggtgtgcc

SEQ ID NO: 445053 - DNA, 20 bp, Artificial
  CRISPR gRNA sequence
tgtgtggtggtgtgcccctg

SEQ ID NO: 445054 - DNA, 20 bp, Artificial
  CRISPR gRNA sequence
tagtcccagctaccagggag

SEQ ID NO: 445055 - DNA, 20 bp, Artificial
  CRISPR gRNA sequence
ccagggaggctgaggcagga

SEQ ID NO: 445056 - DNA, 20 bp, Artificial
  CRISPR gRNA sequence
aggcaggagaatcgcttgaa

SEQ ID NO: 445057 - DNA, 20 bp, Artificial
  CRISPR gRNA sequence
gaactcaggagatggaggtt

SEQ ID NO: 445058 - DNA, 20 bp, Artificial
  CRISPR gRNA sequence
aactcaggagatggaggttg

SEQ ID NO: 445059 - DNA, 20 bp, Artificial
  CRISPR gRNA sequence
aggagatggaggttgcagtg

SEQ ID NO: 445060 - DNA, 20 bp, Artificial
  CRISPR gRNA sequence
cagtgagcagagatcatgct

SEQ ID NO: 445061 - DNA, 20 bp, Artificial
  CRISPR gRNA sequence
ctgcactccagcctgggtga

SEQ ID NO: 445062 - DNA, 20 bp, Artificial
  CRISPR gRNA sequence
cactccagcctgggtgatag

SEQ ID NO: 445063 - DNA, 20 bp, Artificial
  CRISPR gRNA sequence
cagcctgggtgatagagtga

SEQ ID NO: 445064 - DNA, 20 bp, Artificial
  CRISPR gRNA sequence
ggtgatagagtgagattctg

SEQ ID NO: 445065 - DNA, 20 bp, Artificial
  CRISPR gRNA sequence
tgtctcgcaaaaagaaaaaa

SEQ ID NO: 445066 - DNA, 20 bp, Artificial
  CRISPR gRNA sequence
tctcgcaaaaagaaaaaaaa

SEQ ID NO: 445067 - DNA, 20 bp, Artificial
  CRISPR gRNA sequence
gcaaaaagaaaaaaaagaaa

SEQ ID NO: 445068 - DNA, 20 bp, Artificial
  CRISPR gRNA sequence
cagtgagttgagattgtgcc

SEQ ID NO: 445069 - DNA, 20 bp, Artificial
  CRISPR gRNA sequence
agattgtgccactgcactcc

SEQ ID NO: 445070 - DNA, 20 bp, Artificial
  CRISPR gRNA sequence
tgccactgcactccagcctg

SEQ ID NO: 445071 - DNA, 20 bp, Artificial
  CRISPR gRNA sequence
cactccagcctgggcaacag

SEQ ID NO: 445072 - DNA, 20 bp, Artificial
  CRISPR gRNA sequence
cagcctgggcaacagagtga

SEQ ID NO: 445073 - DNA, 20 bp, Artificial
  CRISPR gRNA sequence
ggcaacagagtgagactgtc

SEQ ID NO: 445074 - DNA, 20 bp, Artificial
  CRISPR gRNA sequence
tctcaaaaaaacaaaaaaga

SEQ ID NO: 445075 - DNA, 20 bp, Artificial
  CRISPR gRNA sequence
aaaaaaacaaaaaagaagga

SEQ ID NO: 445076 - DNA, 20 bp, Artificial
  CRISPR gRNA sequence
ttgttgtcttttaaaatcta

SEQ ID NO: 445077 - DNA, 20 bp, Artificial
  CRISPR gRNA sequence
tgttgtcttttaaaatctaa

SEQ ID NO: 445078 - DNA, 20 bp, Artificial
  CRISPR gRNA sequence
gttgtcttttaaaatctaat

SEQ ID NO: 445079 - DNA, 20 bp, Artificial
  CRISPR gRNA sequence
ttgtcttttaaaatctaatt

SEQ ID NO: 445080 - DNA, 20 bp, Artificial
  CRISPR gRNA sequence
tcttttaaaatctaattaga

SEQ ID NO: 445081 - DNA, 20 bp, Artificial
  CRISPR gRNA sequence
ttaaaatctaattagaatat

SEQ ID NO: 445082 - DNA, 20 bp, Artificial
  CRISPR gRNA sequence
taaaatctaattagaatata

SEQ ID NO: 445083 - DNA, 20 bp, Artificial
  CRISPR gRNA sequence
aaaatctaattagaatataa

SEQ ID NO: 445084 - DNA, 20 bp, Artificial
  CRISPR gRNA sequence
aaatctaattagaatataat

SEQ ID NO: 445085 - DNA, 20 bp, Artificial
  CRISPR gRNA sequence
attagaatataatgcctgag

SEQ ID NO: 445086 - DNA, 20 bp, Artificial
  CRISPR gRNA sequence
gaatataatgcctgaggcca

SEQ ID NO: 445087 - DNA, 20 bp, Artificial
  CRISPR gRNA sequence
aggccaagcctggtcgttca

SEQ ID NO: 445088 - DNA, 20 bp, Artificial
  CRISPR gRNA sequence
gtcgttcacacctgtaatcc

SEQ ID NO: 445089 - DNA, 20 bp, Artificial
  CRISPR gRNA sequence
acacctgtaatcccagcatt

SEQ ID NO: 445090 - DNA, 20 bp, Artificial
  CRISPR gRNA sequence
taatcccagcattttgggag

SEQ ID NO: 445091 - DNA, 20 bp, Artificial
  CRISPR gRNA sequence
tgggaggctgaggtgggcag

SEQ ID NO: 445092 - DNA, 20 bp, Artificial
  CRISPR gRNA sequence
gggaggctgaggtgggcaga

SEQ ID NO: 445093 - DNA, 20 bp, Artificial
  CRISPR gRNA sequence
ggaggctgaggtgggcagat

SEQ ID NO: 445094 - DNA, 20 bp, Artificial
  CRISPR gRNA sequence
aggtgggcagatcacctgag

SEQ ID NO: 445095 - DNA, 20 bp, Artificial
  CRISPR gRNA sequence
aggtcaggagttcacaacca

SEQ ID NO: 445096 - DNA, 20 bp, Artificial
  CRISPR gRNA sequence
acaaccagcctggtcaacat

SEQ ID NO: 445097 - DNA, 20 bp, Artificial
  CRISPR gRNA sequence
gtcaacatggcctcgtctct

SEQ ID NO: 445098 - DNA, 20 bp, Artificial
  CRISPR gRNA sequence
gtctctactaaaaatacaaa

SEQ ID NO: 445099 - DNA, 20 bp, Artificial
  CRISPR gRNA sequence
tactaaaaatacaaaaatta

SEQ ID NO: 445100 - DNA, 20 bp, Artificial
  CRISPR gRNA sequence
ctaaaaatacaaaaattagc

SEQ ID NO: 445101 - DNA, 20 bp, Artificial
  CRISPR gRNA sequence
aaaatacaaaaattagctgg

SEQ ID NO: 445102 - DNA, 20 bp, Artificial
  CRISPR gRNA sequence
gctgggcgtggtggtgcatg

SEQ ID NO: 445103 - DNA, 20 bp, Artificial
  CRISPR gRNA sequence
ggcgtggtggtgcatgcatg

SEQ ID NO: 445104 - DNA, 20 bp, Artificial
  CRISPR gRNA sequence
cttgggaggatgagggatga

SEQ ID NO: 445105 - DNA, 20 bp, Artificial
  CRISPR gRNA sequence
gggaggatgagggatgagaa

SEQ ID NO: 445106 - DNA, 20 bp, Artificial
  CRISPR gRNA sequence
ggaggatgagggatgagaat

SEQ ID NO: 445107 - DNA, 20 bp, Artificial
  CRISPR gRNA sequence
cttgaaccagggaggccgag

SEQ ID NO: 445108 - DNA, 20 bp, Artificial
  CRISPR gRNA sequence
gaaccagggaggccgaggtt

SEQ ID NO: 445109 - DNA, 20 bp, Artificial
  CRISPR gRNA sequence
aaccagggaggccgaggttg

SEQ ID NO: 445110 - DNA, 20 bp, Artificial
  CRISPR gRNA sequence
cggtgagctgagattatgcc

SEQ ID NO: 445111 - DNA, 20 bp, Artificial
  CRISPR gRNA sequence
agattatgccactgcactcc

SEQ ID NO: 445112 - DNA, 20 bp, Artificial
  CRISPR gRNA sequence
tgccactgcactccagcctg

SEQ ID NO: 445113 - DNA, 20 bp, Artificial
  CRISPR gRNA sequence
cactccagcctgggtgacag

SEQ ID NO: 445114 - DNA, 20 bp, Artificial
  CRISPR gRNA sequence
cagcctgggtgacagagtga

SEQ ID NO: 445115 - DNA, 20 bp, Artificial
  CRISPR gRNA sequence
ggtgacagagtgaaattctg

SEQ ID NO: 445116 - DNA, 20 bp, Artificial
  CRISPR gRNA sequence
tgtgtctaaataaataaata

SEQ ID NO: 445117 - DNA, 20 bp, Artificial
  CRISPR gRNA sequence
tgtctaaataaataaataaa

SEQ ID NO: 445118 - DNA, 20 bp, Artificial
  CRISPR gRNA sequence
aataaataaataaataaata

SEQ ID NO: 445119 - DNA, 20 bp, Artificial
  CRISPR gRNA sequence
agtcttatcaatattgctag

SEQ ID NO: 445120 - DNA, 20 bp, Artificial
  CRISPR gRNA sequence
atcaatattgctagatgttt

SEQ ID NO: 445121 - DNA, 20 bp, Artificial
  CRISPR gRNA sequence
tcaatattgctagatgtttg

SEQ ID NO: 445122 - DNA, 20 bp, Artificial
  CRISPR gRNA sequence
ctagatgtttgtagaactca

SEQ ID NO: 445123 - DNA, 20 bp, Artificial
  CRISPR gRNA sequence
gatgtttgtagaactcatta

SEQ ID NO: 445124 - DNA, 20 bp, Artificial
  CRISPR gRNA sequence
gtagaactcattagggtcct

SEQ ID NO: 445125 - DNA, 20 bp, Artificial
  CRISPR gRNA sequence
tagaactcattagggtcctg

SEQ ID NO: 445126 - DNA, 20 bp, Artificial
  CRISPR gRNA sequence
attagggtcctgtgaaaaaa

SEQ ID NO: 445127 - DNA, 20 bp, Artificial
  CRISPR gRNA sequence
gggtcctgtgaaaaaaacaa

SEQ ID NO: 445128 - DNA, 20 bp, Artificial
  CRISPR gRNA sequence
tgaaaaaaacaaagcacata

SEQ ID NO: 445129 - DNA, 20 bp, Artificial
  CRISPR gRNA sequence
aatgtaggacttcctggcag

SEQ ID NO: 445130 - DNA, 20 bp, Artificial
  CRISPR gRNA sequence
atgtaggacttcctggcaga

SEQ ID NO: 445131 - DNA, 20 bp, Artificial
  CRISPR gRNA sequence
cctggcagaagtctctattt

SEQ ID NO: 445132 - DNA, 20 bp, Artificial
  CRISPR gRNA sequence
ctggcagaagtctctatttc

SEQ ID NO: 445133 - DNA, 20 bp, Artificial
  CRISPR gRNA sequence
gcagaagtctctatttcata

SEQ ID NO: 445134 - DNA, 20 bp, Artificial
  CRISPR gRNA sequence
tatttcataaaacagtacgg

SEQ ID NO: 445135 - DNA, 20 bp, Artificial
  CRISPR gRNA sequence
tttcataaaacagtacggtt

SEQ ID NO: 445136 - DNA, 20 bp, Artificial
  CRISPR gRNA sequence
cataaaacagtacggttcat

SEQ ID NO: 445137 - DNA, 20 bp, Artificial
  CRISPR gRNA sequence
ataaaacagtacggttcatt

SEQ ID NO: 445138 - DNA, 20 bp, Artificial
  CRISPR gRNA sequence
attatctagatgaaaaaatg

SEQ ID NO: 445139 - DNA, 20 bp, Artificial
  CRISPR gRNA sequence
tctagatgaaaaaatgtggc

SEQ ID NO: 445140 - DNA, 20 bp, Artificial
  CRISPR gRNA sequence
gatgaaaaaatgtggccatc

SEQ ID NO: 445141 - DNA, 20 bp, Artificial
  CRISPR gRNA sequence
aagttgattcctgggtgttc

SEQ ID NO: 445142 - DNA, 20 bp, Artificial
  CRISPR gRNA sequence
attcctgggtgttcagtaaa

SEQ ID NO: 445143 - DNA, 20 bp, Artificial
  CRISPR gRNA sequence
ctgggtgttcagtaaatttt

SEQ ID NO: 445144 - DNA, 20 bp, Artificial
  CRISPR gRNA sequence
ggtgttcagtaaattttgtc

SEQ ID NO: 445145 - DNA, 20 bp, Artificial
  CRISPR gRNA sequence
agtaaattttgtctgtctct

SEQ ID NO: 445146 - DNA, 20 bp, Artificial
  CRISPR gRNA sequence
tgtctgtctctccattaatt

SEQ ID NO: 445147 - DNA, 20 bp, Artificial
  CRISPR gRNA sequence
gtctgtctctccattaatta

SEQ ID NO: 445148 - DNA, 20 bp, Artificial
  CRISPR gRNA sequence
tctgtctctccattaattat

SEQ ID NO: 445149 - DNA, 20 bp, Artificial
  CRISPR gRNA sequence
tctctccattaattattgtg

SEQ ID NO: 445150 - DNA, 20 bp, Artificial
  CRISPR gRNA sequence
tccattaattattgtgacaa

SEQ ID NO: 445151 - DNA, 20 bp, Artificial
  CRISPR gRNA sequence
cattaattattgtgacaagt

SEQ ID NO: 445152 - DNA, 20 bp, Artificial
  CRISPR gRNA sequence
attattgtgacaagtacgga

SEQ ID NO: 445153 - DNA, 20 bp, Artificial
  CRISPR gRNA sequence
ttgtgacaagtacggagtag

SEQ ID NO: 445154 - DNA, 20 bp, Artificial
  CRISPR gRNA sequence
tgacaagtacggagtagaat

SEQ ID NO: 445155 - DNA, 20 bp, Artificial
  CRISPR gRNA sequence
atttcaaataggattatagg

SEQ ID NO: 445156 - DNA, 20 bp, Artificial
  CRISPR gRNA sequence
caaataggattataggcatc

SEQ ID NO: 445157 - DNA, 20 bp, Artificial
  CRISPR gRNA sequence
aaataggattataggcatca

SEQ ID NO: 445158 - DNA, 20 bp, Artificial
  CRISPR gRNA sequence
taggcatcattaagattttt

SEQ ID NO: 445159 - DNA, 20 bp, Artificial
  CRISPR gRNA sequence
agattttttaaaaacttaga

SEQ ID NO: 445160 - DNA, 20 bp, Artificial
  CRISPR gRNA sequence
tttaaaaacttagataaaag

SEQ ID NO: 445161 - DNA, 20 bp, Artificial
  CRISPR gRNA sequence
ttaaaaacttagataaaaga

SEQ ID NO: 445162 - DNA, 20 bp, Artificial
  CRISPR gRNA sequence
taaaaacttagataaaagaa

SEQ ID NO: 445163 - DNA, 20 bp, Artificial
  CRISPR gRNA sequence
aaaaacttagataaaagaaa

SEQ ID NO: 445164 - DNA, 20 bp, Artificial
  CRISPR gRNA sequence
aaaacttagataaaagaaaa

SEQ ID NO: 445165 - DNA, 20 bp, Artificial
  CRISPR gRNA sequence
agataaaagaaaacgttctt

SEQ ID NO: 445166 - DNA, 20 bp, Artificial
  CRISPR gRNA sequence
gataaaagaaaacgttctta

SEQ ID NO: 445167 - DNA, 20 bp, Artificial
  CRISPR gRNA sequence
ttaactatactattggctat

SEQ ID NO: 445168 - DNA, 20 bp, Artificial
  CRISPR gRNA sequence
aactatactattggctattt

SEQ ID NO: 445169 - DNA, 20 bp, Artificial
  CRISPR gRNA sequence
actatactattggctatttt

SEQ ID NO: 445170 - DNA, 20 bp, Artificial
  CRISPR gRNA sequence
tactattggctatttttcct

SEQ ID NO: 445171 - DNA, 20 bp, Artificial
  CRISPR gRNA sequence
ttggctatttttcctctctc

SEQ ID NO: 445172 - DNA, 20 bp, Artificial
  CRISPR gRNA sequence
gctatttttcctctctctct

SEQ ID NO: 445173 - DNA, 20 bp, Artificial
  CRISPR gRNA sequence
tttttcctctctctctctct

SEQ ID NO: 445174 - DNA, 20 bp, Artificial
  CRISPR gRNA sequence
ttcctctctctctctctctc

SEQ ID NO: 445175 - DNA, 20 bp, Artificial
  CRISPR gRNA sequence
tcctctctctctctctctct

SEQ ID NO: 445176 - DNA, 20 bp, Artificial
  CRISPR gRNA sequence
cctctctctctctctctctc

SEQ ID NO: 445177 - DNA, 20 bp, Artificial
  CRISPR gRNA sequence
ctctctctctctctctctct

SEQ ID NO: 445178 - DNA, 20 bp, Artificial
  CRISPR gRNA sequence
tctctctctctctctctctt

SEQ ID NO: 445179 - DNA, 20 bp, Artificial
  CRISPR gRNA sequence
tctctctctctctctctttt

SEQ ID NO: 445180 - DNA, 20 bp, Artificial
  CRISPR gRNA sequence
tctctctctctctcttttta

SEQ ID NO: 445181 - DNA, 20 bp, Artificial
  CRISPR gRNA sequence
tctctctctctctttttata

SEQ ID NO: 445182 - DNA, 20 bp, Artificial
  CRISPR gRNA sequence
tctctctctctttttatagc

SEQ ID NO: 445183 - DNA, 20 bp, Artificial
  CRISPR gRNA sequence
tctctctctttttatagcag

SEQ ID NO: 445184 - DNA, 20 bp, Artificial
  CRISPR gRNA sequence
tctctctttttatagcagag

SEQ ID NO: 445185 - DNA, 20 bp, Artificial
  CRISPR gRNA sequence
tctctttttatagcagagac

SEQ ID NO: 445186 - DNA, 20 bp, Artificial
  CRISPR gRNA sequence
tctttttatagcagagacac

SEQ ID NO: 445187 - DNA, 20 bp, Artificial
  CRISPR gRNA sequence
tttttatagcagagacacag

SEQ ID NO: 445188 - DNA, 20 bp, Artificial
  CRISPR gRNA sequence
tttatagcagagacacagac

SEQ ID NO: 445189 - DNA, 20 bp, Artificial
  CRISPR gRNA sequence
ttatagcagagacacagaca

SEQ ID NO: 445190 - DNA, 20 bp, Artificial
  CRISPR gRNA sequence
tatagcagagacacagacac

SEQ ID NO: 445191 - DNA, 20 bp, Artificial
  CRISPR gRNA sequence
atagcagagacacagacact

SEQ ID NO: 445192 - DNA, 20 bp, Artificial
  CRISPR gRNA sequence
tagcagagacacagacactg

SEQ ID NO: 445193 - DNA, 20 bp, Artificial
  CRISPR gRNA sequence
gggagcctccctgatataaa

SEQ ID NO: 445194 - DNA, 20 bp, Artificial
  CRISPR gRNA sequence
cctgatataaatctaacagt

SEQ ID NO: 445195 - DNA, 20 bp, Artificial
  CRISPR gRNA sequence
atataaatctaacagtaagt

SEQ ID NO: 445196 - DNA, 20 bp, Artificial
  CRISPR gRNA sequence
acagtaagtaactttttttg

SEQ ID NO: 445197 - DNA, 20 bp, Artificial
  CRISPR gRNA sequence
tttttgtgagctatgttgta

SEQ ID NO: 445198 - DNA, 20 bp, Artificial
  CRISPR gRNA sequence
ttttgtgagctatgttgtac

SEQ ID NO: 445199 - DNA, 20 bp, Artificial
  CRISPR gRNA sequence
tttgtgagctatgttgtact

SEQ ID NO: 445200 - DNA, 20 bp, Artificial
  CRISPR gRNA sequence
ttgtgagctatgttgtactc

SEQ ID NO: 445201 - DNA, 20 bp, Artificial
  CRISPR gRNA sequence
tgtgagctatgttgtactca

SEQ ID NO: 445202 - DNA, 20 bp, Artificial
  CRISPR gRNA sequence
gtgagctatgttgtactcaa

SEQ ID NO: 445203 - DNA, 20 bp, Artificial
  CRISPR gRNA sequence
tgagctatgttgtactcaac

SEQ ID NO: 445204 - DNA, 20 bp, Artificial
  CRISPR gRNA sequence
tgttgtactcaacttggagg

SEQ ID NO: 445205 - DNA, 20 bp, Artificial
  CRISPR gRNA sequence
tactcaacttggaggggaaa

SEQ ID NO: 445206 - DNA, 20 bp, Artificial
  CRISPR gRNA sequence
aacttggaggggaaatcatg

SEQ ID NO: 445207 - DNA, 20 bp, Artificial
  CRISPR gRNA sequence
ggaggggaaatcatggcttt

SEQ ID NO: 445208 - DNA, 20 bp, Artificial
  CRISPR gRNA sequence
gaggggaaatcatggcttta

SEQ ID NO: 445209 - DNA, 20 bp, Artificial
  CRISPR gRNA sequence
tagacttccttcatgcccac

SEQ ID NO: 445210 - DNA, 20 bp, Artificial
  CRISPR gRNA sequence
agacttccttcatgcccacc

SEQ ID NO: 445211 - DNA, 20 bp, Artificial
  CRISPR gRNA sequence
gacttccttcatgcccacct

SEQ ID NO: 445212 - DNA, 20 bp, Artificial
  CRISPR gRNA sequence
ccttcatgcccaccttgtcc

SEQ ID NO: 445213 - DNA, 20 bp, Artificial
  CRISPR gRNA sequence
cttcatgcccaccttgtcct

SEQ ID NO: 445214 - DNA, 20 bp, Artificial
  CRISPR gRNA sequence
catgcccaccttgtccttgg

SEQ ID NO: 445215 - DNA, 20 bp, Artificial
  CRISPR gRNA sequence
atgcccaccttgtccttggg

SEQ ID NO: 445216 - DNA, 20 bp, Artificial
  CRISPR gRNA sequence
gtccttggggtaaaaagcct

SEQ ID NO: 445217 - DNA, 20 bp, Artificial
  CRISPR gRNA sequence
tccttggggtaaaaagcctt

SEQ ID NO: 445218 - DNA, 20 bp, Artificial
  CRISPR gRNA sequence
ggggtaaaaagccttaagtt

SEQ ID NO: 445219 - DNA, 20 bp, Artificial
  CRISPR gRNA sequence
gggtaaaaagccttaagttc

SEQ ID NO: 445220 - DNA, 20 bp, Artificial
  CRISPR gRNA sequence
aagttcccttagcttcagat

SEQ ID NO: 445221 - DNA, 20 bp, Artificial
  CRISPR gRNA sequence
agttcccttagcttcagatt

SEQ ID NO: 445222 - DNA, 20 bp, Artificial
  CRISPR gRNA sequence
ccttagcttcagattcctgg

SEQ ID NO: 445223 - DNA, 20 bp, Artificial
  CRISPR gRNA sequence
agcttcagattcctgggctg

SEQ ID NO: 445224 - DNA, 20 bp, Artificial
  CRISPR gRNA sequence
gcttcagattcctgggctgt

SEQ ID NO: 445225 - DNA, 20 bp, Artificial
  CRISPR gRNA sequence
cagattcctgggctgtaaca

SEQ ID NO: 445226 - DNA, 20 bp, Artificial
  CRISPR gRNA sequence
agattcctgggctgtaacat

SEQ ID NO: 445227 - DNA, 20 bp, Artificial
  CRISPR gRNA sequence
ctgggctgtaacatgttgat

SEQ ID NO: 445228 - DNA, 20 bp, Artificial
  CRISPR gRNA sequence
ggctgtaacatgttgatgat

SEQ ID NO: 445229 - DNA, 20 bp, Artificial
  CRISPR gRNA sequence
taacatgttgatgatgacag

SEQ ID NO: 445230 - DNA, 20 bp, Artificial
  CRISPR gRNA sequence
atgatgacagttctaacctc

SEQ ID NO: 445231 - DNA, 20 bp, Artificial
  CRISPR gRNA sequence
taacctcataggcctgctgt

SEQ ID NO: 445232 - DNA, 20 bp, Artificial
  CRISPR gRNA sequence
acctcataggcctgctgtaa

SEQ ID NO: 445233 - DNA, 20 bp, Artificial
  CRISPR gRNA sequence
ataggcctgctgtaatgaag

SEQ ID NO: 445234 - DNA, 20 bp, Artificial
  CRISPR gRNA sequence
ctgtaatgaaggactgacat

SEQ ID NO: 445235 - DNA, 20 bp, Artificial
  CRISPR gRNA sequence
taatgaaggactgacatgat

SEQ ID NO: 445236 - DNA, 20 bp, Artificial
  CRISPR gRNA sequence
acatgatgtgtgtaaagtgc

SEQ ID NO: 445237 - DNA, 20 bp, Artificial
  CRISPR gRNA sequence
gcatatagtaagagcttgaa

SEQ ID NO: 445238 - DNA, 20 bp, Artificial
  CRISPR gRNA sequence
gaaaaccacaaagaagaaac

SEQ ID NO: 445239 - DNA, 20 bp, Artificial
  CRISPR gRNA sequence
aaaaccacaaagaagaaaca

SEQ ID NO: 445240 - DNA, 20 bp, Artificial
  CRISPR gRNA sequence
gcattttgtccctcttattc

SEQ ID NO: 445241 - DNA, 20 bp, Artificial
  CRISPR gRNA sequence
tgtccctcttattcttcaat

SEQ ID NO: 445242 - DNA, 20 bp, Artificial
  CRISPR gRNA sequence
gtccctcttattcttcaatt

SEQ ID NO: 445243 - DNA, 20 bp, Artificial
  CRISPR gRNA sequence
tccctcttattcttcaattt

SEQ ID NO: 445244 - DNA, 20 bp, Artificial
  CRISPR gRNA sequence
ttattcttcaatttcacaac

SEQ ID NO: 445245 - DNA, 20 bp, Artificial
  CRISPR gRNA sequence
attcttcaatttcacaactg

SEQ ID NO: 445246 - DNA, 20 bp, Artificial
  CRISPR gRNA sequence
ttcttcaatttcacaactgt

SEQ ID NO: 445247 - DNA, 20 bp, Artificial
  CRISPR gRNA sequence
ttcaatttcacaactgtcta

SEQ ID NO: 445248 - DNA, 20 bp, Artificial
  CRISPR gRNA sequence
caatttcacaactgtctacc

SEQ ID NO: 445249 - DNA, 20 bp, Artificial
  CRISPR gRNA sequence
aatttcacaactgtctaccc

SEQ ID NO: 445250 - DNA, 20 bp, Artificial
  CRISPR gRNA sequence
cacaactgtctaccctgtgg

SEQ ID NO: 445251 - DNA, 20 bp, Artificial
  CRISPR gRNA sequence
acaactgtctaccctgtgga

SEQ ID NO: 445252 - DNA, 20 bp, Artificial
  CRISPR gRNA sequence
tctaccctgtggaaggttca

SEQ ID NO: 445253 - DNA, 20 bp, Artificial
  CRISPR gRNA sequence
ccctgtggaaggttcaaaga

SEQ ID NO: 445254 - DNA, 20 bp, Artificial
  CRISPR gRNA sequence
tggaaggttcaaagattctt

SEQ ID NO: 445255 - DNA, 20 bp, Artificial
  CRISPR gRNA sequence
aaagattcttcatctcccta

SEQ ID NO: 445256 - DNA, 20 bp, Artificial
  CRISPR gRNA sequence
ttcatctccctagaatacca

SEQ ID NO: 445257 - DNA, 20 bp, Artificial
  CRISPR gRNA sequence
catctccctagaataccatt

SEQ ID NO: 445258 - DNA, 20 bp, Artificial
  CRISPR gRNA sequence
atctccctagaataccattc

SEQ ID NO: 445259 - DNA, 20 bp, Artificial
  CRISPR gRNA sequence
cctagaataccattcttctt

SEQ ID NO: 445260 - DNA, 20 bp, Artificial
  CRISPR gRNA sequence
gaataccattcttcttgctt

SEQ ID NO: 445261 - DNA, 20 bp, Artificial
  CRISPR gRNA sequence
ttcttgcttccattgcaatc

SEQ ID NO: 445262 - DNA, 20 bp, Artificial
  CRISPR gRNA sequence
cttgcttccattgcaatcct

SEQ ID NO: 445263 - DNA, 20 bp, Artificial
  CRISPR gRNA sequence
ttgcttccattgcaatccta

SEQ ID NO: 445264 - DNA, 20 bp, Artificial
  CRISPR gRNA sequence
gcttccattgcaatcctaat

SEQ ID NO: 445265 - DNA, 20 bp, Artificial
  CRISPR gRNA sequence
cttccattgcaatcctaatg

SEQ ID NO: 445266 - DNA, 20 bp, Artificial
  CRISPR gRNA sequence
ccattgcaatcctaatggga

SEQ ID NO: 445267 - DNA, 20 bp, Artificial
  CRISPR gRNA sequence
cattgcaatcctaatgggaa

SEQ ID NO: 445268 - DNA, 20 bp, Artificial
  CRISPR gRNA sequence
caatcctaatgggaaagagt

SEQ ID NO: 445269 - DNA, 20 bp, Artificial
  CRISPR gRNA sequence
atgggaaagagtatttaaat

SEQ ID NO: 445270 - DNA, 20 bp, Artificial
  CRISPR gRNA sequence
aaatttatctctttaaatat

SEQ ID NO: 445271 - DNA, 20 bp, Artificial
  CRISPR gRNA sequence
aatttatctctttaaatatg

SEQ ID NO: 445272 - DNA, 20 bp, Artificial
  CRISPR gRNA sequence
atctctttaaatatggcaag

SEQ ID NO: 445273 - DNA, 20 bp, Artificial
  CRISPR gRNA sequence
tctctttaaatatggcaaga

SEQ ID NO: 445274 - DNA, 20 bp, Artificial
  CRISPR gRNA sequence
tttaaatatggcaagacacc

SEQ ID NO: 445275 - DNA, 20 bp, Artificial
  CRISPR gRNA sequence
taaatatggcaagacaccag

SEQ ID NO: 445276 - DNA, 20 bp, Artificial
  CRISPR gRNA sequence
aaatatggcaagacaccagt

SEQ ID NO: 445277 - DNA, 20 bp, Artificial
  CRISPR gRNA sequence
aatatggcaagacaccagtc

SEQ ID NO: 445278 - DNA, 20 bp, Artificial
  CRISPR gRNA sequence
aaagtgaagaggtttttttt

SEQ ID NO: 445279 - DNA, 20 bp, Artificial
  CRISPR gRNA sequence
tttttttttttttttagaca

SEQ ID NO: 445280 - DNA, 20 bp, Artificial
  CRISPR gRNA sequence
ttttttttttttttagacag

SEQ ID NO: 445281 - DNA, 20 bp, Artificial
  CRISPR gRNA sequence
tttttttttttttagacaga

SEQ ID NO: 445282 - DNA, 20 bp, Artificial
  CRISPR gRNA sequence
ttttttttttttagacagaa

SEQ ID NO: 445283 - DNA, 20 bp, Artificial
  CRISPR gRNA sequence
tttttttttttagacagaat

SEQ ID NO: 445284 - DNA, 20 bp, Artificial
  CRISPR gRNA sequence
ttttttttttagacagaatt

SEQ ID NO: 445285 - DNA, 20 bp, Artificial
  CRISPR gRNA sequence
tttttttttagacagaattt

SEQ ID NO: 445286 - DNA, 20 bp, Artificial
  CRISPR gRNA sequence
ttttttttagacagaatttc

SEQ ID NO: 445287 - DNA, 20 bp, Artificial
  CRISPR gRNA sequence
tttttttagacagaatttcg

SEQ ID NO: 445288 - DNA, 20 bp, Artificial
  CRISPR gRNA sequence
ttttttagacagaatttcgc

SEQ ID NO: 445289 - DNA, 20 bp, Artificial
  CRISPR gRNA sequence
tttttagacagaatttcgct

SEQ ID NO: 445290 - DNA, 20 bp, Artificial
  CRISPR gRNA sequence
ttttagacagaatttcgctc

SEQ ID NO: 445291 - DNA, 20 bp, Artificial
  CRISPR gRNA sequence
tttagacagaatttcgctct

SEQ ID NO: 445292 - DNA, 20 bp, Artificial
  CRISPR gRNA sequence
ttagacagaatttcgctctt

SEQ ID NO: 445293 - DNA, 20 bp, Artificial
  CRISPR gRNA sequence
tagacagaatttcgctcttg

SEQ ID NO: 445294 - DNA, 20 bp, Artificial
  CRISPR gRNA sequence
agacagaatttcgctcttgt

SEQ ID NO: 445295 - DNA, 20 bp, Artificial
  CRISPR gRNA sequence
gacagaatttcgctcttgtt

SEQ ID NO: 445296 - DNA, 20 bp, Artificial
  CRISPR gRNA sequence
cgctcttgttgcccaggctg

SEQ ID NO: 445297 - DNA, 20 bp, Artificial
  CRISPR gRNA sequence
gctcttgttgcccaggctgg

SEQ ID NO: 445298 - DNA, 20 bp, Artificial
  CRISPR gRNA sequence
ttgttgcccaggctggagtg

SEQ ID NO: 445299 - DNA, 20 bp, Artificial
  CRISPR gRNA sequence
gttgcccaggctggagtgca

SEQ ID NO: 445300 - DNA, 20 bp, Artificial
  CRISPR gRNA sequence
ttgcccaggctggagtgcaa

SEQ ID NO: 445301 - DNA, 20 bp, Artificial
  CRISPR gRNA sequence
cccaggctggagtgcaaggg

SEQ ID NO: 445302 - DNA, 20 bp, Artificial
  CRISPR gRNA sequence
gagtgcaagggtgtgatcct

SEQ ID NO: 445303 - DNA, 20 bp, Artificial
  CRISPR gRNA sequence
gctcacctcaacctccgcct

SEQ ID NO: 445304 - DNA, 20 bp, Artificial
  CRISPR gRNA sequence
acctcaacctccgcctcccg

SEQ ID NO: 445305 - DNA, 20 bp, Artificial
  CRISPR gRNA sequence
aacctccgcctcccgggttc

SEQ ID NO: 445306 - DNA, 20 bp, Artificial
  CRISPR gRNA sequence
cgcctcccgggttcaagcga

SEQ ID NO: 445307 - DNA, 20 bp, Artificial
  CRISPR gRNA sequence
ccgggttcaagcgattctcc

SEQ ID NO: 445308 - DNA, 20 bp, Artificial
  CRISPR gRNA sequence
aagcgattctcctgcctcag

SEQ ID NO: 445309 - DNA, 20 bp, Artificial
  CRISPR gRNA sequence
tcctgcctcagccttccgag

SEQ ID NO: 445310 - DNA, 20 bp, Artificial
  CRISPR gRNA sequence
ctgcctcagccttccgagta

SEQ ID NO: 445311 - DNA, 20 bp, Artificial
  CRISPR gRNA sequence
cctcagccttccgagtagct

SEQ ID NO: 445312 - DNA, 20 bp, Artificial
  CRISPR gRNA sequence
agccttccgagtagctggga

SEQ ID NO: 445313 - DNA, 20 bp, Artificial
  CRISPR gRNA sequence
ccgagtagctgggattacag

SEQ ID NO: 445314 - DNA, 20 bp, Artificial
  CRISPR gRNA sequence
cgagtagctgggattacagg

SEQ ID NO: 445315 - DNA, 20 bp, Artificial
  CRISPR gRNA sequence
ggattacaggcatgagccac

SEQ ID NO: 445316 - DNA, 20 bp, Artificial
  CRISPR gRNA sequence
caggcatgagccaccacacc

SEQ ID NO: 445317 - DNA, 20 bp, Artificial
  CRISPR gRNA sequence
atttttttatttttagtaga

SEQ ID NO: 445318 - DNA, 20 bp, Artificial
  CRISPR gRNA sequence
ttttatttttagtagagacg

SEQ ID NO: 445319 - DNA, 20 bp, Artificial
  CRISPR gRNA sequence
tttatttttagtagagacgg

SEQ ID NO: 445320 - DNA, 20 bp, Artificial
  CRISPR gRNA sequence
ttatttttagtagagacgga

SEQ ID NO: 445321 - DNA, 20 bp, Artificial
  CRISPR gRNA sequence
tatttttagtagagacggag

SEQ ID NO: 445322 - DNA, 20 bp, Artificial
  CRISPR gRNA sequence
atttttagtagagacggagt

SEQ ID NO: 445323 - DNA, 20 bp, Artificial
  CRISPR gRNA sequence
tttttagtagagacggagtt

SEQ ID NO: 445324 - DNA, 20 bp, Artificial
  CRISPR gRNA sequence
ttagtagagacggagtttca

SEQ ID NO: 445325 - DNA, 20 bp, Artificial
  CRISPR gRNA sequence
tagtagagacggagtttcac

SEQ ID NO: 445326 - DNA, 20 bp, Artificial
  CRISPR gRNA sequence
agtagagacggagtttcacc

SEQ ID NO: 445327 - DNA, 20 bp, Artificial
  CRISPR gRNA sequence
gtagagacggagtttcacca

SEQ ID NO: 445328 - DNA, 20 bp, Artificial
  CRISPR gRNA sequence
caccacattggccaggctga

SEQ ID NO: 445329 - DNA, 20 bp, Artificial
  CRISPR gRNA sequence
accacattggccaggctgat

SEQ ID NO: 445330 - DNA, 20 bp, Artificial
  CRISPR gRNA sequence
gccaggctgatcttgaactc

SEQ ID NO: 445331 - DNA, 20 bp, Artificial
  CRISPR gRNA sequence
atcttgaactcctgacctca

SEQ ID NO: 445332 - DNA, 20 bp, Artificial
  CRISPR gRNA sequence
gaactcctgacctcaggtga

SEQ ID NO: 445333 - DNA, 20 bp, Artificial
  CRISPR gRNA sequence
aactcctgacctcaggtgat

SEQ ID NO: 445334 - DNA, 20 bp, Artificial
  CRISPR gRNA sequence
ctgacctcaggtgatccacc

SEQ ID NO: 445335 - DNA, 20 bp, Artificial
  CRISPR gRNA sequence
acctcaggtgatccacctgc

SEQ ID NO: 445336 - DNA, 20 bp, Artificial
  CRISPR gRNA sequence
aggtgatccacctgcctcgg

SEQ ID NO: 445337 - DNA, 20 bp, Artificial
  CRISPR gRNA sequence
cctcggcctcccaaagtgct

SEQ ID NO: 445338 - DNA, 20 bp, Artificial
  CRISPR gRNA sequence
ggcctcccaaagtgctgaga

SEQ ID NO: 445339 - DNA, 20 bp, Artificial
  CRISPR gRNA sequence
ccaaagtgctgagattgcag

SEQ ID NO: 445340 - DNA, 20 bp, Artificial
  CRISPR gRNA sequence
agattgcaggcgtgagccat

SEQ ID NO: 445341 - DNA, 20 bp, Artificial
  CRISPR gRNA sequence
caggcgtgagccatggcacc

SEQ ID NO: 445342 - DNA, 20 bp, Artificial
  CRISPR gRNA sequence
gcctaattttgtatttttag

SEQ ID NO: 445343 - DNA, 20 bp, Artificial
  CRISPR gRNA sequence
attttgtatttttagtagag

SEQ ID NO: 445344 - DNA, 20 bp, Artificial
  CRISPR gRNA sequence
tgtatttttagtagagacag

SEQ ID NO: 445345 - DNA, 20 bp, Artificial
  CRISPR gRNA sequence
gtatttttagtagagacagg

SEQ ID NO: 445346 - DNA, 20 bp, Artificial
  CRISPR gRNA sequence
tatttttagtagagacaggg

SEQ ID NO: 445347 - DNA, 20 bp, Artificial
  CRISPR gRNA sequence
ttagtagagacagggtttct

SEQ ID NO: 445348 - DNA, 20 bp, Artificial
  CRISPR gRNA sequence
tagtagagacagggtttctc

SEQ ID NO: 445349 - DNA, 20 bp, Artificial
  CRISPR gRNA sequence
agtagagacagggtttctcc

SEQ ID NO: 445350 - DNA, 20 bp, Artificial
  CRISPR gRNA sequence
gtagagacagggtttctcca

SEQ ID NO: 445351 - DNA, 20 bp, Artificial
  CRISPR gRNA sequence
ctccatgttggtcaggctgg

SEQ ID NO: 445352 - DNA, 20 bp, Artificial
  CRISPR gRNA sequence
tccatgttggtcaggctggt

SEQ ID NO: 445353 - DNA, 20 bp, Artificial
  CRISPR gRNA sequence
catgttggtcaggctggtct

SEQ ID NO: 445354 - DNA, 20 bp, Artificial
  CRISPR gRNA sequence
gtcaggctggtcttgaactc

SEQ ID NO: 445355 - DNA, 20 bp, Artificial
  CRISPR gRNA sequence
gtcttgaactcctgacctca

SEQ ID NO: 445356 - DNA, 20 bp, Artificial
  CRISPR gRNA sequence
gaactcctgacctcaggtga

SEQ ID NO: 445357 - DNA, 20 bp, Artificial
  CRISPR gRNA sequence
aactcctgacctcaggtgat

SEQ ID NO: 445358 - DNA, 20 bp, Artificial
  CRISPR gRNA sequence
ctgacctcaggtgatccgcc

SEQ ID NO: 445359 - DNA, 20 bp, Artificial
  CRISPR gRNA sequence
acctcaggtgatccgcccaa

SEQ ID NO: 445360 - DNA, 20 bp, Artificial
  CRISPR gRNA sequence
aggtgatccgcccaacttgg

SEQ ID NO: 445361 - DNA, 20 bp, Artificial
  CRISPR gRNA sequence
ggcctcccaaagtgctggga

SEQ ID NO: 445362 - DNA, 20 bp, Artificial
  CRISPR gRNA sequence
gcctcccaaagtgctgggat

SEQ ID NO: 445363 - DNA, 20 bp, Artificial
  CRISPR gRNA sequence
ccaaagtgctgggattacag

SEQ ID NO: 445364 - DNA, 20 bp, Artificial
  CRISPR gRNA sequence
ggattacaggcatgagccat

SEQ ID NO: 445365 - DNA, 20 bp, Artificial
  CRISPR gRNA sequence
caggcatgagccatggtgcc

SEQ ID NO: 445366 - DNA, 20 bp, Artificial
  CRISPR gRNA sequence
tatgtatttaactataaata

SEQ ID NO: 445367 - DNA, 20 bp, Artificial
  CRISPR gRNA sequence
atgtatttaactataaataa

SEQ ID NO: 445368 - DNA, 20 bp, Artificial
  CRISPR gRNA sequence
tgtatttaactataaataaa

SEQ ID NO: 445369 - DNA, 20 bp, Artificial
  CRISPR gRNA sequence
aactataaataaagccatac

SEQ ID NO: 445370 - DNA, 20 bp, Artificial
  CRISPR gRNA sequence
actataaataaagccatacc

SEQ ID NO: 445371 - DNA, 20 bp, Artificial
  CRISPR gRNA sequence
taaataaagccataccttaa

SEQ ID NO: 445372 - DNA, 20 bp, Artificial
  CRISPR gRNA sequence
aataaacctcaattttactg

SEQ ID NO: 445373 - DNA, 20 bp, Artificial
  CRISPR gRNA sequence
ataaacctcaattttactgt

SEQ ID NO: 445374 - DNA, 20 bp, Artificial
  CRISPR gRNA sequence
aattttactgtccctgctac

SEQ ID NO: 445375 - DNA, 20 bp, Artificial
  CRISPR gRNA sequence
tactgtccctgctaccttct

SEQ ID NO: 445376 - DNA, 20 bp, Artificial
  CRISPR gRNA sequence
actgtccctgctaccttctc

SEQ ID NO: 445377 - DNA, 20 bp, Artificial
  CRISPR gRNA sequence
ctgtccctgctaccttctca

SEQ ID NO: 445378 - DNA, 20 bp, Artificial
  CRISPR gRNA sequence
tccctgctaccttctcagaa

SEQ ID NO: 445379 - DNA, 20 bp, Artificial
  CRISPR gRNA sequence
ctaccttctcagaataaaag

SEQ ID NO: 445380 - DNA, 20 bp, Artificial
  CRISPR gRNA sequence
ccttctcagaataaaagaaa

SEQ ID NO: 445381 - DNA, 20 bp, Artificial
  CRISPR gRNA sequence
ctcagaataaaagaaaaact

SEQ ID NO: 445382 - DNA, 20 bp, Artificial
  CRISPR gRNA sequence
tcagaataaaagaaaaactg

SEQ ID NO: 445383 - DNA, 20 bp, Artificial
  CRISPR gRNA sequence
agaataaaagaaaaactggc

SEQ ID NO: 445384 - DNA, 20 bp, Artificial
  CRISPR gRNA sequence
gctgggcgcagtgactcacg

SEQ ID NO: 445385 - DNA, 20 bp, Artificial
  CRISPR gRNA sequence
ggcgcagtgactcacgtctg

SEQ ID NO: 445386 - DNA, 20 bp, Artificial
  CRISPR gRNA sequence
acgtctgtaatcccagcact

SEQ ID NO: 445387 - DNA, 20 bp, Artificial
  CRISPR gRNA sequence
taatcccagcactttgggag

SEQ ID NO: 445388 - DNA, 20 bp, Artificial
  CRISPR gRNA sequence
tgggaggctaagtagggtgg

SEQ ID NO: 445389 - DNA, 20 bp, Artificial
  CRISPR gRNA sequence
gggaggctaagtagggtgga

SEQ ID NO: 445390 - DNA, 20 bp, Artificial
  CRISPR gRNA sequence
ggaggctaagtagggtggat

SEQ ID NO: 445391 - DNA, 20 bp, Artificial
  CRISPR gRNA sequence
agtagggtggatcacctgtc

SEQ ID NO: 445392 - DNA, 20 bp, Artificial
  CRISPR gRNA sequence
tcaggggtttgagaccagcc

SEQ ID NO: 445393 - DNA, 20 bp, Artificial
  CRISPR gRNA sequence
gagaccagcctggtcaacat

SEQ ID NO: 445394 - DNA, 20 bp, Artificial
  CRISPR gRNA sequence
agaccagcctggtcaacatg

SEQ ID NO: 445395 - DNA, 20 bp, Artificial
  CRISPR gRNA sequence
gtcaacatggtgaaacccca

SEQ ID NO: 445396 - DNA, 20 bp, Artificial
  CRISPR gRNA sequence
tactaaaaatacaaaaaatt

SEQ ID NO: 445397 - DNA, 20 bp, Artificial
  CRISPR gRNA sequence
ctaaaaatacaaaaaattag

SEQ ID NO: 445398 - DNA, 20 bp, Artificial
  CRISPR gRNA sequence
aaaatacaaaaaattagcca

SEQ ID NO: 445399 - DNA, 20 bp, Artificial
  CRISPR gRNA sequence
gccaggtatggtggtgtgtg

SEQ ID NO: 445400 - DNA, 20 bp, Artificial
  CRISPR gRNA sequence
tgtagtctcagctactcagg

SEQ ID NO: 445401 - DNA, 20 bp, Artificial
  CRISPR gRNA sequence
agctactcaggaggctgaga

SEQ ID NO: 445402 - DNA, 20 bp, Artificial
  CRISPR gRNA sequence
ctcaggaggctgagacagga

SEQ ID NO: 445403 - DNA, 20 bp, Artificial
  CRISPR gRNA sequence
aggaggctgagacaggagaa

SEQ ID NO: 445404 - DNA, 20 bp, Artificial
  CRISPR gRNA sequence
agacaggagaatcgcttgaa

SEQ ID NO: 445405 - DNA, 20 bp, Artificial
  CRISPR gRNA sequence
gaatccaggaggtggaggtt

SEQ ID NO: 445406 - DNA, 20 bp, Artificial
  CRISPR gRNA sequence
aatccaggaggtggaggttg

SEQ ID NO: 445407 - DNA, 20 bp, Artificial
  CRISPR gRNA sequence
cagtgagctgaggtcgcgcc

SEQ ID NO: 445408 - DNA, 20 bp, Artificial
  CRISPR gRNA sequence
aggtcgcgccactgcacacc

SEQ ID NO: 445409 - DNA, 20 bp, Artificial
  CRISPR gRNA sequence
cacaccagcctgggcaacaa

SEQ ID NO: 445410 - DNA, 20 bp, Artificial
  CRISPR gRNA sequence
ggcaacaagagcgaaattcc

SEQ ID NO: 445411 - DNA, 20 bp, Artificial
  CRISPR gRNA sequence
cctcataaaagaaaaaccac

SEQ ID NO: 445412 - DNA, 20 bp, Artificial
  CRISPR gRNA sequence
ataaaagaaaaaccactaga

SEQ ID NO: 445413 - DNA, 20 bp, Artificial
  CRISPR gRNA sequence
gaaggcaagcttgcagcaat

SEQ ID NO: 445414 - DNA, 20 bp, Artificial
  CRISPR gRNA sequence
gcagcaatgacttaaaaatt

SEQ ID NO: 445415 - DNA, 20 bp, Artificial
  CRISPR gRNA sequence
cagcaatgacttaaaaattc

SEQ ID NO: 445416 - DNA, 20 bp, Artificial
  CRISPR gRNA sequence
aaaaattctttgaggaggcc

SEQ ID NO: 445417 - DNA, 20 bp, Artificial
  CRISPR gRNA sequence
aaaattctttgaggaggccg

SEQ ID NO: 445418 - DNA, 20 bp, Artificial
  CRISPR gRNA sequence
tttgaggaggccgggcacag

SEQ ID NO: 445419 - DNA, 20 bp, Artificial
  CRISPR gRNA sequence
tgaggaggccgggcacagtg

SEQ ID NO: 445420 - DNA, 20 bp, Artificial
  CRISPR gRNA sequence
gaggaggccgggcacagtgt

SEQ ID NO: 445421 - DNA, 20 bp, Artificial
  CRISPR gRNA sequence
aggaggccgggcacagtgtc

SEQ ID NO: 445422 - DNA, 20 bp, Artificial
  CRISPR gRNA sequence
atgcctgtaatcccagcact

SEQ ID NO: 445423 - DNA, 20 bp, Artificial
  CRISPR gRNA sequence
taatcccagcactttaggag

SEQ ID NO: 445424 - DNA, 20 bp, Artificial
  CRISPR gRNA sequence
taggaggccaaggtggaagg

SEQ ID NO: 445425 - DNA, 20 bp, Artificial
  CRISPR gRNA sequence
aggaggccaaggtggaagga

SEQ ID NO: 445426 - DNA, 20 bp, Artificial
  CRISPR gRNA sequence
ggaggccaaggtggaaggaa

SEQ ID NO: 445427 - DNA, 20 bp, Artificial
  CRISPR gRNA sequence
gagaccaggagtttgagact

SEQ ID NO: 445428 - DNA, 20 bp, Artificial
  CRISPR gRNA sequence
agaccaggagtttgagacta

SEQ ID NO: 445429 - DNA, 20 bp, Artificial
  CRISPR gRNA sequence
gagactagcctgggccacat

SEQ ID NO: 445430 - DNA, 20 bp, Artificial
  CRISPR gRNA sequence
agactagcctgggccacata

SEQ ID NO: 445431 - DNA, 20 bp, Artificial
  CRISPR gRNA sequence
gcctgggccacatagtgaca

SEQ ID NO: 445432 - DNA, 20 bp, Artificial
  CRISPR gRNA sequence
ggccacatagtgacaccctg

SEQ ID NO: 445433 - DNA, 20 bp, Artificial
  CRISPR gRNA sequence
tctctacaaaaaatattttt

SEQ ID NO: 445434 - DNA, 20 bp, Artificial
  CRISPR gRNA sequence
tacaaaaaatattttttaaa

SEQ ID NO: 445435 - DNA, 20 bp, Artificial
  CRISPR gRNA sequence
caaaaaatattttttaaaat

SEQ ID NO: 445436 - DNA, 20 bp, Artificial
  CRISPR gRNA sequence
tttaaaatttggccaggcat

SEQ ID NO: 445437 - DNA, 20 bp, Artificial
  CRISPR gRNA sequence
ttaaaatttggccaggcatg

SEQ ID NO: 445438 - DNA, 20 bp, Artificial
  CRISPR gRNA sequence
taaaatttggccaggcatgg

SEQ ID NO: 445439 - DNA, 20 bp, Artificial
  CRISPR gRNA sequence
aaaatttggccaggcatggt

SEQ ID NO: 445440 - DNA, 20 bp, Artificial
  CRISPR gRNA sequence
aaatttggccaggcatggtg

SEQ ID NO: 445441 - DNA, 20 bp, Artificial
  CRISPR gRNA sequence
ggccaggcatggtgctgcaa

SEQ ID NO: 445442 - DNA, 20 bp, Artificial
  CRISPR gRNA sequence
gccaggcatggtgctgcaaa

SEQ ID NO: 445443 - DNA, 20 bp, Artificial
  CRISPR gRNA sequence
caaacctgtagttccagcta

SEQ ID NO: 445444 - DNA, 20 bp, Artificial
  CRISPR gRNA sequence
tagttccagctacttgggag

SEQ ID NO: 445445 - DNA, 20 bp, Artificial
  CRISPR gRNA sequence
cagctacttgggaggctgag

SEQ ID NO: 445446 - DNA, 20 bp, Artificial
  CRISPR gRNA sequence
cttgggaggctgaggcagga

SEQ ID NO: 445447 - DNA, 20 bp, Artificial
  CRISPR gRNA sequence
gggaggctgaggcaggagga

SEQ ID NO: 445448 - DNA, 20 bp, Artificial
  CRISPR gRNA sequence
ggaggctgaggcaggaggat

SEQ ID NO: 445449 - DNA, 20 bp, Artificial
  CRISPR gRNA sequence
aggcaggaggatcacttgag

SEQ ID NO: 445450 - DNA, 20 bp, Artificial
  CRISPR gRNA sequence
gagcccagtaggttgaggct

SEQ ID NO: 445451 - DNA, 20 bp, Artificial
  CRISPR gRNA sequence
agcccagtaggttgaggctg

SEQ ID NO: 445452 - DNA, 20 bp, Artificial
  CRISPR gRNA sequence
aggctgcattgagctgtgat

SEQ ID NO: 445453 - DNA, 20 bp, Artificial
  CRISPR gRNA sequence
cattgagctgtgatcatgcc

SEQ ID NO: 445454 - DNA, 20 bp, Artificial
  CRISPR gRNA sequence
agctgtgatcatgcccctgc

SEQ ID NO: 445455 - DNA, 20 bp, Artificial
  CRISPR gRNA sequence
tgatcatgcccctgcactcc

SEQ ID NO: 445456 - DNA, 20 bp, Artificial
  CRISPR gRNA sequence
cactccatcctaggtgacag

SEQ ID NO: 445457 - DNA, 20 bp, Artificial
  CRISPR gRNA sequence
catcctaggtgacagggcaa

SEQ ID NO: 445458 - DNA, 20 bp, Artificial
  CRISPR gRNA sequence
ggtgacagggcaaggccttg

SEQ ID NO: 445459 - DNA, 20 bp, Artificial
  CRISPR gRNA sequence
gtctcaaaaaaaaaaaaaaa

SEQ ID NO: 445460 - DNA, 20 bp, Artificial
  CRISPR gRNA sequence
tctcaaaaaaaaaaaaaaaa

SEQ ID NO: 445461 - DNA, 20 bp, Artificial
  CRISPR gRNA sequence
aaaaaaaaaaaaaaaaaaaa

SEQ ID NO: 445462 - DNA, 20 bp, Artificial
  CRISPR gRNA sequence
cttgagggcatatccaggag

SEQ ID NO: 445463 - DNA, 20 bp, Artificial
  CRISPR gRNA sequence
gagggcatatccaggagccc

SEQ ID NO: 445464 - DNA, 20 bp, Artificial
  CRISPR gRNA sequence
agggcatatccaggagccca

SEQ ID NO: 445465 - DNA, 20 bp, Artificial
  CRISPR gRNA sequence
atttgactcagtttcttgct

SEQ ID NO: 445466 - DNA, 20 bp, Artificial
  CRISPR gRNA sequence
tttgactcagtttcttgctt

SEQ ID NO: 445467 - DNA, 20 bp, Artificial
  CRISPR gRNA sequence
gactcagtttcttgcttgtg

SEQ ID NO: 445468 - DNA, 20 bp, Artificial
  CRISPR gRNA sequence
actcagtttcttgcttgtgt

SEQ ID NO: 445469 - DNA, 20 bp, Artificial
  CRISPR gRNA sequence
agtttcttgcttgtgtattc

SEQ ID NO: 445470 - DNA, 20 bp, Artificial
  CRISPR gRNA sequence
cttgcttgtgtattcacaac

SEQ ID NO: 445471 - DNA, 20 bp, Artificial
  CRISPR gRNA sequence
ttgcttgtgtattcacaact

SEQ ID NO: 445472 - DNA, 20 bp, Artificial
  CRISPR gRNA sequence
gcttgtgtattcacaactga

SEQ ID NO: 445473 - DNA, 20 bp, Artificial
  CRISPR gRNA sequence
cttgtgtattcacaactgat

SEQ ID NO: 445474 - DNA, 20 bp, Artificial
  CRISPR gRNA sequence
gtgtattcacaactgatgct

SEQ ID NO: 445475 - DNA, 20 bp, Artificial
  CRISPR gRNA sequence
tgtattcacaactgatgctc

SEQ ID NO: 445476 - DNA, 20 bp, Artificial
  CRISPR gRNA sequence
acaactgatgctcagcatct

SEQ ID NO: 445477 - DNA, 20 bp, Artificial
  CRISPR gRNA sequence
atgctcagcatcttgtattt

SEQ ID NO: 445478 - DNA, 20 bp, Artificial
  CRISPR gRNA sequence
agcatcttgtatttgctcct

SEQ ID NO: 445479 - DNA, 20 bp, Artificial
  CRISPR gRNA sequence
gtatttgctccttctctctt

SEQ ID NO: 445480 - DNA, 20 bp, Artificial
  CRISPR gRNA sequence
tatttgctccttctctcttt

SEQ ID NO: 445481 - DNA, 20 bp, Artificial
  CRISPR gRNA sequence
gctccttctctctttgcaat

SEQ ID NO: 445482 - DNA, 20 bp, Artificial
  CRISPR gRNA sequence
ctccttctctctttgcaatc

SEQ ID NO: 445483 - DNA, 20 bp, Artificial
  CRISPR gRNA sequence
cttctctctttgcaatcaaa

SEQ ID NO: 445484 - DNA, 20 bp, Artificial
  CRISPR gRNA sequence
ctctctttgcaatcaaacag

SEQ ID NO: 445485 - DNA, 20 bp, Artificial
  CRISPR gRNA sequence
tctctttgcaatcaaacagt

SEQ ID NO: 445486 - DNA, 20 bp, Artificial
  CRISPR gRNA sequence
tctttgcaatcaaacagtgc

SEQ ID NO: 445487 - DNA, 20 bp, Artificial
  CRISPR gRNA sequence
tttgcaatcaaacagtgctt

SEQ ID NO: 445488 - DNA, 20 bp, Artificial
  CRISPR gRNA sequence
tgcaatcaaacagtgctttt

SEQ ID NO: 445489 - DNA, 20 bp, Artificial
  CRISPR gRNA sequence
gcaatcaaacagtgcttttt

SEQ ID NO: 445490 - DNA, 20 bp, Artificial
  CRISPR gRNA sequence
caatcaaacagtgcttttta

SEQ ID NO: 445491 - DNA, 20 bp, Artificial
  CRISPR gRNA sequence
tttaaggacctgtatgtgcc

SEQ ID NO: 445492 - DNA, 20 bp, Artificial
  CRISPR gRNA sequence
ttaaggacctgtatgtgccc

SEQ ID NO: 445493 - DNA, 20 bp, Artificial
  CRISPR gRNA sequence
taaggacctgtatgtgccca

SEQ ID NO: 445494 - DNA, 20 bp, Artificial
  CRISPR gRNA sequence
aaggacctgtatgtgcccac

SEQ ID NO: 445495 - DNA, 20 bp, Artificial
  CRISPR gRNA sequence
aggacctgtatgtgcccaca

SEQ ID NO: 445496 - DNA, 20 bp, Artificial
  CRISPR gRNA sequence
tatgtgcccacaatgcttaa

SEQ ID NO: 445497 - DNA, 20 bp, Artificial
  CRISPR gRNA sequence
aatgcacaatatcttgcata

SEQ ID NO: 445498 - DNA, 20 bp, Artificial
  CRISPR gRNA sequence
atgcacaatatcttgcatat

SEQ ID NO: 445499 - DNA, 20 bp, Artificial
  CRISPR gRNA sequence
gcatataggactcctgttat

SEQ ID NO: 445500 - DNA, 20 bp, Artificial
  CRISPR gRNA sequence
catataggactcctgttatt

SEQ ID NO: 445501 - DNA, 20 bp, Artificial
  CRISPR gRNA sequence
ctgttattgcaggagtaatg

SEQ ID NO: 445502 - DNA, 20 bp, Artificial
  CRISPR gRNA sequence
ttattgcaggagtaatgtgt

SEQ ID NO: 445503 - DNA, 20 bp, Artificial
  CRISPR gRNA sequence
ttgcaggagtaatgtgtatt

SEQ ID NO: 445504 - DNA, 20 bp, Artificial
  CRISPR gRNA sequence
caggagtaatgtgtattgaa

SEQ ID NO: 445505 - DNA, 20 bp, Artificial
  CRISPR gRNA sequence
aatcaatttgtaaatgtata

SEQ ID NO: 445506 - DNA, 20 bp, Artificial
  CRISPR gRNA sequence
gtaaatgtatattgaataaa

SEQ ID NO: 445507 - DNA, 20 bp, Artificial
  CRISPR gRNA sequence
taaatgtatattgaataaat

SEQ ID NO: 445508 - DNA, 20 bp, Artificial
  CRISPR gRNA sequence
aataaatggaagatttaact

SEQ ID NO: 445509 - DNA, 20 bp, Artificial
  CRISPR gRNA sequence
aacttccttaaattcattgt

SEQ ID NO: 445510 - DNA, 20 bp, Artificial
  CRISPR gRNA sequence
acttccttaaattcattgtt

SEQ ID NO: 445511 - DNA, 20 bp, Artificial
  CRISPR gRNA sequence
ccttaaattcattgttttaa

SEQ ID NO: 445512 - DNA, 20 bp, Artificial
  CRISPR gRNA sequence
cttaaattcattgttttaaa

SEQ ID NO: 445513 - DNA, 20 bp, Artificial
  CRISPR gRNA sequence
aaattcattgttttaaaaat

SEQ ID NO: 445514 - DNA, 20 bp, Artificial
  CRISPR gRNA sequence
aattcattgttttaaaaatg

SEQ ID NO: 445515 - DNA, 20 bp, Artificial
  CRISPR gRNA sequence
attgttttaaaaatgcttat

SEQ ID NO: 445516 - DNA, 20 bp, Artificial
  CRISPR gRNA sequence
ttttaaaaatgcttataatt

SEQ ID NO: 445517 - DNA, 20 bp, Artificial
  CRISPR gRNA sequence
taaaaatgcttataattata

SEQ ID NO: 445518 - DNA, 20 bp, Artificial
  CRISPR gRNA sequence
aaaaatgcttataattatat

SEQ ID NO: 445519 - DNA, 20 bp, Artificial
  CRISPR gRNA sequence
aaaatgcttataattatatg

SEQ ID NO: 445520 - DNA, 20 bp, Artificial
  CRISPR gRNA sequence
ataattatatgtgtgtgtgt

SEQ ID NO: 445521 - DNA, 20 bp, Artificial
  CRISPR gRNA sequence
taattatatgtgtgtgtgtg

SEQ ID NO: 445522 - DNA, 20 bp, Artificial
  CRISPR gRNA sequence
tatgtgtgtgtgtgtgtgtg

SEQ ID NO: 445523 - DNA, 20 bp, Artificial
  CRISPR gRNA sequence
tgtataaatggggtctcaat

SEQ ID NO: 445524 - DNA, 20 bp, Artificial
  CRISPR gRNA sequence
gtataaatggggtctcaata

SEQ ID NO: 445525 - DNA, 20 bp, Artificial
  CRISPR gRNA sequence
tataaatggggtctcaatat

SEQ ID NO: 445526 - DNA, 20 bp, Artificial
  CRISPR gRNA sequence
aatattattaggctggtccc

SEQ ID NO: 445527 - DNA, 20 bp, Artificial
  CRISPR gRNA sequence
ttaggctggtccctaactcc

SEQ ID NO: 445528 - DNA, 20 bp, Artificial
  CRISPR gRNA sequence
ggctggtccctaactcctgg

SEQ ID NO: 445529 - DNA, 20 bp, Artificial
  CRISPR gRNA sequence
gtccctaactcctggtctca

SEQ ID NO: 445530 - DNA, 20 bp, Artificial
  CRISPR gRNA sequence
actcctggtctcaagtgatc

SEQ ID NO: 445531 - DNA, 20 bp, Artificial
  CRISPR gRNA sequence
ctggtctcaagtgatcctcc

SEQ ID NO: 445532 - DNA, 20 bp, Artificial
  CRISPR gRNA sequence
gtctcaagtgatcctcccat

SEQ ID NO: 445533 - DNA, 20 bp, Artificial
  CRISPR gRNA sequence
aagtgatcctcccatctcag

SEQ ID NO: 445534 - DNA, 20 bp, Artificial
  CRISPR gRNA sequence
ccatctcagcttcccaaagt

SEQ ID NO: 445535 - DNA, 20 bp, Artificial
  CRISPR gRNA sequence
agcttcccaaagtgctggga

SEQ ID NO: 445536 - DNA, 20 bp, Artificial
  CRISPR gRNA sequence
cccaaagtgctgggattata

SEQ ID NO: 445537 - DNA, 20 bp, Artificial
  CRISPR gRNA sequence
ccaaagtgctgggattatag

SEQ ID NO: 445538 - DNA, 20 bp, Artificial
  CRISPR gRNA sequence
ggattataggtgtgagcctg

SEQ ID NO: 445539 - DNA, 20 bp, Artificial
  CRISPR gRNA sequence
taggtgtgagcctggcctat

SEQ ID NO: 445540 - DNA, 20 bp, Artificial
  CRISPR gRNA sequence
gcctataattattatttatt

SEQ ID NO: 445541 - DNA, 20 bp, Artificial
  CRISPR gRNA sequence
taattattatttatttatta

SEQ ID NO: 445542 - DNA, 20 bp, Artificial
  CRISPR gRNA sequence
ttatttatttattaatttat

SEQ ID NO: 445543 - DNA, 20 bp, Artificial
  CRISPR gRNA sequence
tttatttattaatttattat

SEQ ID NO: 445544 - DNA, 20 bp, Artificial
  CRISPR gRNA sequence
atttattaatttattattta

SEQ ID NO: 445545 - DNA, 20 bp, Artificial
  CRISPR gRNA sequence
tttattaatttattatttat

SEQ ID NO: 445546 - DNA, 20 bp, Artificial
  CRISPR gRNA sequence
attaatttattatttatttt

SEQ ID NO: 445547 - DNA, 20 bp, Artificial
  CRISPR gRNA sequence
ttaatttattatttattttt

SEQ ID NO: 445548 - DNA, 20 bp, Artificial
  CRISPR gRNA sequence
atttattatttatttttgag

SEQ ID NO: 445549 - DNA, 20 bp, Artificial
  CRISPR gRNA sequence
attatttatttttgagatgg

SEQ ID NO: 445550 - DNA, 20 bp, Artificial
  CRISPR gRNA sequence
ttatttatttttgagatgga

SEQ ID NO: 445551 - DNA, 20 bp, Artificial
  CRISPR gRNA sequence
tttatttttgagatggagtt

SEQ ID NO: 445552 - DNA, 20 bp, Artificial
  CRISPR gRNA sequence
atttttgagatggagttttg

SEQ ID NO: 445553 - DNA, 20 bp, Artificial
  CRISPR gRNA sequence
tttttgagatggagttttgc

SEQ ID NO: 445554 - DNA, 20 bp, Artificial
  CRISPR gRNA sequence
ttgagatggagttttgctct

SEQ ID NO: 445555 - DNA, 20 bp, Artificial
  CRISPR gRNA sequence
tgagatggagttttgctctt

SEQ ID NO: 445556 - DNA, 20 bp, Artificial
  CRISPR gRNA sequence
gagatggagttttgctcttg

SEQ ID NO: 445557 - DNA, 20 bp, Artificial
  CRISPR gRNA sequence
agatggagttttgctcttgt

SEQ ID NO: 445558 - DNA, 20 bp, Artificial
  CRISPR gRNA sequence
tgctcttgtcgcccaggctg

SEQ ID NO: 445559 - DNA, 20 bp, Artificial
  CRISPR gRNA sequence
gctcttgtcgcccaggctgg

SEQ ID NO: 445560 - DNA, 20 bp, Artificial
  CRISPR gRNA sequence
ctcttgtcgcccaggctgga

SEQ ID NO: 445561 - DNA, 20 bp, Artificial
  CRISPR gRNA sequence
ttgtcgcccaggctggagta

SEQ ID NO: 445562 - DNA, 20 bp, Artificial
  CRISPR gRNA sequence
gtcgcccaggctggagtaca

SEQ ID NO: 445563 - DNA, 20 bp, Artificial
  CRISPR gRNA sequence
tcgcccaggctggagtacaa

SEQ ID NO: 445564 - DNA, 20 bp, Artificial
  CRISPR gRNA sequence
gagtacaatggcacaacctt

SEQ ID NO: 445565 - DNA, 20 bp, Artificial
  CRISPR gRNA sequence
ggctcactgcaacctctgcc

SEQ ID NO: 445566 - DNA, 20 bp, Artificial
  CRISPR gRNA sequence
gctcactgcaacctctgcct

SEQ ID NO: 445567 - DNA, 20 bp, Artificial
  CRISPR gRNA sequence
actgcaacctctgcctcctg

SEQ ID NO: 445568 - DNA, 20 bp, Artificial
  CRISPR gRNA sequence
caacctctgcctcctgggtt

SEQ ID NO: 445569 - DNA, 20 bp, Artificial
  CRISPR gRNA sequence
tgcctcctgggttcaagcga

SEQ ID NO: 445570 - DNA, 20 bp, Artificial
  CRISPR gRNA sequence
cctcctgggttcaagcgatt

SEQ ID NO: 445571 - DNA, 20 bp, Artificial
  CRISPR gRNA sequence
ctgggttcaagcgattgtcc

SEQ ID NO: 445572 - DNA, 20 bp, Artificial
  CRISPR gRNA sequence
ggttcaagcgattgtcctgc

SEQ ID NO: 445573 - DNA, 20 bp, Artificial
  CRISPR gRNA sequence
aagcgattgtcctgcctcag

SEQ ID NO: 445574 - DNA, 20 bp, Artificial
  CRISPR gRNA sequence
tcctgcctcagcctcccaaa

SEQ ID NO: 445575 - DNA, 20 bp, Artificial
  CRISPR gRNA sequence
cctcagcctcccaaatagct

SEQ ID NO: 445576 - DNA, 20 bp, Artificial
  CRISPR gRNA sequence
agcctcccaaatagctggga

SEQ ID NO: 445577 - DNA, 20 bp, Artificial
  CRISPR gRNA sequence
ccaaatagctgggactatag

SEQ ID NO: 445578 - DNA, 20 bp, Artificial
  CRISPR gRNA sequence
ggactataggtgcccgccac

SEQ ID NO: 445579 - DNA, 20 bp, Artificial
  CRISPR gRNA sequence
taggtgcccgccaccacacc

SEQ ID NO: 445580 - DNA, 20 bp, Artificial
  CRISPR gRNA sequence
gctaatttttgtatttttag

SEQ ID NO: 445581 - DNA, 20 bp, Artificial
  CRISPR gRNA sequence
atttttgtatttttagtaga

SEQ ID NO: 445582 - DNA, 20 bp, Artificial
  CRISPR gRNA sequence
ttgtatttttagtagagatg

SEQ ID NO: 445583 - DNA, 20 bp, Artificial
  CRISPR gRNA sequence
tgtatttttagtagagatgg

SEQ ID NO: 445584 - DNA, 20 bp, Artificial
  CRISPR gRNA sequence
gtatttttagtagagatggg

SEQ ID NO: 445585 - DNA, 20 bp, Artificial
  CRISPR gRNA sequence
tatttttagtagagatgggg

SEQ ID NO: 445586 - DNA, 20 bp, Artificial
  CRISPR gRNA sequence
ttagtagagatggggtttca

SEQ ID NO: 445587 - DNA, 20 bp, Artificial
  CRISPR gRNA sequence
tagtagagatggggtttcac

SEQ ID NO: 445588 - DNA, 20 bp, Artificial
  CRISPR gRNA sequence
agtagagatggggtttcacc

SEQ ID NO: 445589 - DNA, 20 bp, Artificial
  CRISPR gRNA sequence
gtagagatggggtttcacca

SEQ ID NO: 445590 - DNA, 20 bp, Artificial
  CRISPR gRNA sequence
caccatgttggccaggctgg

SEQ ID NO: 445591 - DNA, 20 bp, Artificial
  CRISPR gRNA sequence
accatgttggccaggctggt

SEQ ID NO: 445592 - DNA, 20 bp, Artificial
  CRISPR gRNA sequence
gccaggctggtcttgaactc

SEQ ID NO: 445593 - DNA, 20 bp, Artificial
  CRISPR gRNA sequence
gtcttgaactcctgacctcg

SEQ ID NO: 445594 - DNA, 20 bp, Artificial
  CRISPR gRNA sequence
gaactcctgacctcgtgatc

SEQ ID NO: 445595 - DNA, 20 bp, Artificial
  CRISPR gRNA sequence
aactcctgacctcgtgatct

SEQ ID NO: 445596 - DNA, 20 bp, Artificial
  CRISPR gRNA sequence
ctgacctcgtgatctgcctg

SEQ ID NO: 445597 - DNA, 20 bp, Artificial
  CRISPR gRNA sequence
acctcgtgatctgcctgcct

SEQ ID NO: 445598 - DNA, 20 bp, Artificial
  CRISPR gRNA sequence
gtgatctgcctgccttggcc

SEQ ID NO: 445599 - DNA, 20 bp, Artificial
  CRISPR gRNA sequence
cctgccttggcctcccaaag

SEQ ID NO: 445600 - DNA, 20 bp, Artificial
  CRISPR gRNA sequence
ccttggcctcccaaagtgct

SEQ ID NO: 445601 - DNA, 20 bp, Artificial
  CRISPR gRNA sequence
ggcctcccaaagtgctggga

SEQ ID NO: 445602 - DNA, 20 bp, Artificial
  CRISPR gRNA sequence
gcctcccaaagtgctgggac

SEQ ID NO: 445603 - DNA, 20 bp, Artificial
  CRISPR gRNA sequence
ccaaagtgctgggactacag

SEQ ID NO: 445604 - DNA, 20 bp, Artificial
  CRISPR gRNA sequence
ggactacaggcgtgagccac

SEQ ID NO: 445605 - DNA, 20 bp, Artificial
  CRISPR gRNA sequence
caggcgtgagccaccgcacc

SEQ ID NO: 445606 - DNA, 20 bp, Artificial
  CRISPR gRNA sequence
gcctaatcattgtttttaaa

SEQ ID NO: 445607 - DNA, 20 bp, Artificial
  CRISPR gRNA sequence
atcattgtttttaaagagag

SEQ ID NO: 445608 - DNA, 20 bp, Artificial
  CRISPR gRNA sequence
tttttaaagagagaaaaaga

SEQ ID NO: 445609 - DNA, 20 bp, Artificial
  CRISPR gRNA sequence
ttaaagagagaaaaagagag

SEQ ID NO: 445610 - DNA, 20 bp, Artificial
  CRISPR gRNA sequence
taaagagagaaaaagagaga

SEQ ID NO: 445611 - DNA, 20 bp, Artificial
  CRISPR gRNA sequence
aaagagagaaaaagagagaa

SEQ ID NO: 445612 - DNA, 20 bp, Artificial
  CRISPR gRNA sequence
aagagagaaaaagagagaac

SEQ ID NO: 445613 - DNA, 20 bp, Artificial
  CRISPR gRNA sequence
aaattttagaaacaggattt

SEQ ID NO: 445614 - DNA, 20 bp, Artificial
  CRISPR gRNA sequence
tagaaacaggatttattttg

SEQ ID NO: 445615 - DNA, 20 bp, Artificial
  CRISPR gRNA sequence
agaaacaggatttattttgt

SEQ ID NO: 445616 - DNA, 20 bp, Artificial
  CRISPR gRNA sequence
gaaacaggatttattttgtg

SEQ ID NO: 445617 - DNA, 20 bp, Artificial
  CRISPR gRNA sequence
attttgtgtggctctcagtt

SEQ ID NO: 445618 - DNA, 20 bp, Artificial
  CRISPR gRNA sequence
ttttgtgtggctctcagtta

SEQ ID NO: 445619 - DNA, 20 bp, Artificial
  CRISPR gRNA sequence
tgtgtggctctcagttatca

SEQ ID NO: 445620 - DNA, 20 bp, Artificial
  CRISPR gRNA sequence
gtgtggctctcagttatcag

SEQ ID NO: 445621 - DNA, 20 bp, Artificial
  CRISPR gRNA sequence
tgtggctctcagttatcaga

SEQ ID NO: 445622 - DNA, 20 bp, Artificial
  CRISPR gRNA sequence
tcagttatcagaaaatcaag

SEQ ID NO: 445623 - DNA, 20 bp, Artificial
  CRISPR gRNA sequence
agttatcagaaaatcaagtt

SEQ ID NO: 445624 - DNA, 20 bp, Artificial
  CRISPR gRNA sequence
tcagaaaatcaagttaacta

SEQ ID NO: 445625 - DNA, 20 bp, Artificial
  CRISPR gRNA sequence
actagagcaatagcaataat

SEQ ID NO: 445626 - DNA, 20 bp, Artificial
  CRISPR gRNA sequence
gagcaatagcaataatagct

SEQ ID NO: 445627 - DNA, 20 bp, Artificial
  CRISPR gRNA sequence
cgattgattgaacatttatt

SEQ ID NO: 445628 - DNA, 20 bp, Artificial
  CRISPR gRNA sequence
attgaacatttattatgtac

SEQ ID NO: 445629 - DNA, 20 bp, Artificial
  CRISPR gRNA sequence
aacatttattatgtaccagg

SEQ ID NO: 445630 - DNA, 20 bp, Artificial
  CRISPR gRNA sequence
attatgtaccaggccctgta

SEQ ID NO: 445631 - DNA, 20 bp, Artificial
  CRISPR gRNA sequence
ttatgtaccaggccctgtac

SEQ ID NO: 445632 - DNA, 20 bp, Artificial
  CRISPR gRNA sequence
tgtaccaggccctgtactaa

SEQ ID NO: 445633 - DNA, 20 bp, Artificial
  CRISPR gRNA sequence
tactaagcattttatatttt

SEQ ID NO: 445634 - DNA, 20 bp, Artificial
  CRISPR gRNA sequence
agcattttatattttctctc

SEQ ID NO: 445635 - DNA, 20 bp, Artificial
  CRISPR gRNA sequence
tatattttctctcacttagt

SEQ ID NO: 445636 - DNA, 20 bp, Artificial
  CRISPR gRNA sequence
atattttctctcacttagtt

SEQ ID NO: 445637 - DNA, 20 bp, Artificial
  CRISPR gRNA sequence
tattttctctcacttagttt

SEQ ID NO: 445638 - DNA, 20 bp, Artificial
  CRISPR gRNA sequence
tctctcacttagttttcctg

SEQ ID NO: 445639 - DNA, 20 bp, Artificial
  CRISPR gRNA sequence
ctctcacttagttttcctga

SEQ ID NO: 445640 - DNA, 20 bp, Artificial
  CRISPR gRNA sequence
tctcacttagttttcctgat

SEQ ID NO: 445641 - DNA, 20 bp, Artificial
  CRISPR gRNA sequence
tcacttagttttcctgataa

SEQ ID NO: 445642 - DNA, 20 bp, Artificial
  CRISPR gRNA sequence
acttagttttcctgataact

SEQ ID NO: 445643 - DNA, 20 bp, Artificial
  CRISPR gRNA sequence
agttttcctgataactctac

SEQ ID NO: 445644 - DNA, 20 bp, Artificial
  CRISPR gRNA sequence
gttttcctgataactctaca

SEQ ID NO: 445645 - DNA, 20 bp, Artificial
  CRISPR gRNA sequence
tcctgataactctacaggat

SEQ ID NO: 445646 - DNA, 20 bp, Artificial
  CRISPR gRNA sequence
cctgataactctacaggatt

SEQ ID NO: 445647 - DNA, 20 bp, Artificial
  CRISPR gRNA sequence
ctgataactctacaggatta

SEQ ID NO: 445648 - DNA, 20 bp, Artificial
  CRISPR gRNA sequence
ataactctacaggattactc

SEQ ID NO: 445649 - DNA, 20 bp, Artificial
  CRISPR gRNA sequence
tacaggattactcagccctt

SEQ ID NO: 445650 - DNA, 20 bp, Artificial
  CRISPR gRNA sequence
caggattactcagcccttag

SEQ ID NO: 445651 - DNA, 20 bp, Artificial
  CRISPR gRNA sequence
ctcagcccttagtggcagag

SEQ ID NO: 445652 - DNA, 20 bp, Artificial
  CRISPR gRNA sequence
agcccttagtggcagagctg

SEQ ID NO: 445653 - DNA, 20 bp, Artificial
  CRISPR gRNA sequence
agtggcagagctgggaattt

SEQ ID NO: 445654 - DNA, 20 bp, Artificial
  CRISPR gRNA sequence
gtggcagagctgggaatttt

SEQ ID NO: 445655 - DNA, 20 bp, Artificial
  CRISPR gRNA sequence
ggaatttttttttttttttt

SEQ ID NO: 445656 - DNA, 20 bp, Artificial
  CRISPR gRNA sequence
tttttttttttttttttttg

SEQ ID NO: 445657 - DNA, 20 bp, Artificial
  CRISPR gRNA sequence
ttttttttttttttttttga

SEQ ID NO: 445658 - DNA, 20 bp, Artificial
  CRISPR gRNA sequence
tttttttttttttttttgag

SEQ ID NO: 445659 - DNA, 20 bp, Artificial
  CRISPR gRNA sequence
ttttttttttttttttgaga

SEQ ID NO: 445660 - DNA, 20 bp, Artificial
  CRISPR gRNA sequence
tttttttttttttttgagat

SEQ ID NO: 445661 - DNA, 20 bp, Artificial
  CRISPR gRNA sequence
ttttttttttttttgagatg

SEQ ID NO: 445662 - DNA, 20 bp, Artificial
  CRISPR gRNA sequence
tttttttttttttgagatgg

SEQ ID NO: 445663 - DNA, 20 bp, Artificial
  CRISPR gRNA sequence
ttttttttttttgagatgga

SEQ ID NO: 445664 - DNA, 20 bp, Artificial
  CRISPR gRNA sequence
tttttttttttgagatggag

SEQ ID NO: 445665 - DNA, 20 bp, Artificial
  CRISPR gRNA sequence
ttttttttttgagatggagt

SEQ ID NO: 445666 - DNA, 20 bp, Artificial
  CRISPR gRNA sequence
tttttttttgagatggagtc

SEQ ID NO: 445667 - DNA, 20 bp, Artificial
  CRISPR gRNA sequence
ttttttttgagatggagtct

SEQ ID NO: 445668 - DNA, 20 bp, Artificial
  CRISPR gRNA sequence
tttttttgagatggagtctc

SEQ ID NO: 445669 - DNA, 20 bp, Artificial
  CRISPR gRNA sequence
ttttttgagatggagtctcg

SEQ ID NO: 445670 - DNA, 20 bp, Artificial
  CRISPR gRNA sequence
tttttgagatggagtctcgc

SEQ ID NO: 445671 - DNA, 20 bp, Artificial
  CRISPR gRNA sequence
ttttgagatggagtctcgct

SEQ ID NO: 445672 - DNA, 20 bp, Artificial
  CRISPR gRNA sequence
tttgagatggagtctcgctc

SEQ ID NO: 445673 - DNA, 20 bp, Artificial
  CRISPR gRNA sequence
ttgagatggagtctcgctct

SEQ ID NO: 445674 - DNA, 20 bp, Artificial
  CRISPR gRNA sequence
tgagatggagtctcgctctg

SEQ ID NO: 445675 - DNA, 20 bp, Artificial
  CRISPR gRNA sequence
gagatggagtctcgctctgt

SEQ ID NO: 445676 - DNA, 20 bp, Artificial
  CRISPR gRNA sequence
agatggagtctcgctctgtt

SEQ ID NO: 445677 - DNA, 20 bp, Artificial
  CRISPR gRNA sequence
gctctgttgcccaggttggc

SEQ ID NO: 445678 - DNA, 20 bp, Artificial
  CRISPR gRNA sequence
tgttgcccaggttggcgtgc

SEQ ID NO: 445679 - DNA, 20 bp, Artificial
  CRISPR gRNA sequence
ttgcccaggttggcgtgcag

SEQ ID NO: 445680 - DNA, 20 bp, Artificial
  CRISPR gRNA sequence
cccaggttggcgtgcagtgg

SEQ ID NO: 445681 - DNA, 20 bp, Artificial
  CRISPR gRNA sequence
gcgtgcagtggcatgatctc

SEQ ID NO: 445682 - DNA, 20 bp, Artificial
  CRISPR gRNA sequence
aactcgagtactccagtctt

SEQ ID NO: 445683 - DNA, 20 bp, Artificial
  CRISPR gRNA sequence
gagtactccagtctttgcct

SEQ ID NO: 445684 - DNA, 20 bp, Artificial
  CRISPR gRNA sequence
cagtctttgcctcctgggtt

SEQ ID NO: 445685 - DNA, 20 bp, Artificial
  CRISPR gRNA sequence
tgcctcctgggtttaagtga

SEQ ID NO: 445686 - DNA, 20 bp, Artificial
  CRISPR gRNA sequence
gcctcctgggtttaagtgat

SEQ ID NO: 445687 - DNA, 20 bp, Artificial
  CRISPR gRNA sequence
cctcctgggtttaagtgatt

SEQ ID NO: 445688 - DNA, 20 bp, Artificial
  CRISPR gRNA sequence
ctgggtttaagtgattctcc

SEQ ID NO: 445689 - DNA, 20 bp, Artificial
  CRISPR gRNA sequence
ggtttaagtgattctcctgc

SEQ ID NO: 445690 - DNA, 20 bp, Artificial
  CRISPR gRNA sequence
aagtgattctcctgcctcag

SEQ ID NO: 445691 - DNA, 20 bp, Artificial
  CRISPR gRNA sequence
agtgattctcctgcctcagc

SEQ ID NO: 445692 - DNA, 20 bp, Artificial
  CRISPR gRNA sequence
tcctgcctcagcctccccac

SEQ ID NO: 445693 - DNA, 20 bp, Artificial
  CRISPR gRNA sequence
ctgcctcagcctccccacta

SEQ ID NO: 445694 - DNA, 20 bp, Artificial
  CRISPR gRNA sequence
cctcagcctccccactagct

SEQ ID NO: 445695 - DNA, 20 bp, Artificial
  CRISPR gRNA sequence
agcctccccactagctagga

SEQ ID NO: 445696 - DNA, 20 bp, Artificial
  CRISPR gRNA sequence
cccactagctaggattacag

SEQ ID NO: 445697 - DNA, 20 bp, Artificial
  CRISPR gRNA sequence
gctaggattacaggcatgtg

SEQ ID NO: 445698 - DNA, 20 bp, Artificial
  CRISPR gRNA sequence
ggattacaggcatgtgttac

SEQ ID NO: 445699 - DNA, 20 bp, Artificial
  CRISPR gRNA sequence
caggcatgtgttaccacgcc

SEQ ID NO: 445700 - DNA, 20 bp, Artificial
  CRISPR gRNA sequence
ccacgcctggctaagttttg

SEQ ID NO: 445701 - DNA, 20 bp, Artificial
  CRISPR gRNA sequence
gctaagttttgtatttttag

SEQ ID NO: 445702 - DNA, 20 bp, Artificial
  CRISPR gRNA sequence
agttttgtatttttagtaga

SEQ ID NO: 445703 - DNA, 20 bp, Artificial
  CRISPR gRNA sequence
tgtatttttagtagagacgg

SEQ ID NO: 445704 - DNA, 20 bp, Artificial
  CRISPR gRNA sequence
gtatttttagtagagacggg

SEQ ID NO: 445705 - DNA, 20 bp, Artificial
  CRISPR gRNA sequence
tatttttagtagagacgggg

SEQ ID NO: 445706 - DNA, 20 bp, Artificial
  CRISPR gRNA sequence
ttagtagagacggggtttca

SEQ ID NO: 445707 - DNA, 20 bp, Artificial
  CRISPR gRNA sequence
tagtagagacggggtttcac

SEQ ID NO: 445708 - DNA, 20 bp, Artificial
  CRISPR gRNA sequence
agtagagacggggtttcacc

SEQ ID NO: 445709 - DNA, 20 bp, Artificial
  CRISPR gRNA sequence
gtagagacggggtttcacca

SEQ ID NO: 445710 - DNA, 20 bp, Artificial
  CRISPR gRNA sequence
caccatgttgtccaggctgg

SEQ ID NO: 445711 - DNA, 20 bp, Artificial
  CRISPR gRNA sequence
accatgttgtccaggctggt

SEQ ID NO: 445712 - DNA, 20 bp, Artificial
  CRISPR gRNA sequence
tccaggctggtctcaaactc

SEQ ID NO: 445713 - DNA, 20 bp, Artificial
  CRISPR gRNA sequence
gtctcaaactcctgatgtca

SEQ ID NO: 445714 - DNA, 20 bp, Artificial
  CRISPR gRNA sequence
aaactcctgatgtcaggtga

SEQ ID NO: 445715 - DNA, 20 bp, Artificial
  CRISPR gRNA sequence
ctgatgtcaggtgatccgcc

SEQ ID NO: 445716 - DNA, 20 bp, Artificial
  CRISPR gRNA sequence
atgtcaggtgatccgcctgc

SEQ ID NO: 445717 - DNA, 20 bp, Artificial
  CRISPR gRNA sequence
cctaggcctcccaaagtgct

SEQ ID NO: 445718 - DNA, 20 bp, Artificial
  CRISPR gRNA sequence
ggcctcccaaagtgctggga

SEQ ID NO: 445719 - DNA, 20 bp, Artificial
  CRISPR gRNA sequence
ccaaagtgctgggattacag

SEQ ID NO: 445720 - DNA, 20 bp, Artificial
  CRISPR gRNA sequence
ggattacaggcattagccac

SEQ ID NO: 445721 - DNA, 20 bp, Artificial
  CRISPR gRNA sequence
caggcattagccaccgcgcc

SEQ ID NO: 445722 - DNA, 20 bp, Artificial
  CRISPR gRNA sequence
gccaccgcgcccggcctcag

SEQ ID NO: 445723 - DNA, 20 bp, Artificial
  CRISPR gRNA sequence
agagctgggatttgaatcca

SEQ ID NO: 445724 - DNA, 20 bp, Artificial
  CRISPR gRNA sequence
ggatttgaatccacgaccgt

SEQ ID NO: 445725 - DNA, 20 bp, Artificial
  CRISPR gRNA sequence
gaatccacgaccgtctggct

SEQ ID NO: 445726 - DNA, 20 bp, Artificial
  CRISPR gRNA sequence
aatccacgaccgtctggctg

SEQ ID NO: 445727 - DNA, 20 bp, Artificial
  CRISPR gRNA sequence
gctgtaaagtcttggctatt

SEQ ID NO: 445728 - DNA, 20 bp, Artificial
  CRISPR gRNA sequence
taaagtcttggctattgaat

SEQ ID NO: 445729 - DNA, 20 bp, Artificial
  CRISPR gRNA sequence
ggctattgaatcactgtctt

SEQ ID NO: 445730 - DNA, 20 bp, Artificial
  CRISPR gRNA sequence
gctattgaatcactgtcttt

SEQ ID NO: 445731 - DNA, 20 bp, Artificial
  CRISPR gRNA sequence
ttgaatcactgtctttttgt

SEQ ID NO: 445732 - DNA, 20 bp, Artificial
  CRISPR gRNA sequence
aatcactgtctttttgtgaa

SEQ ID NO: 445733 - DNA, 20 bp, Artificial
  CRISPR gRNA sequence
tctttttgtgaaaaatagac

SEQ ID NO: 445734 - DNA, 20 bp, Artificial
  CRISPR gRNA sequence
tttgtgaaaaatagacgttt

SEQ ID NO: 445735 - DNA, 20 bp, Artificial
  CRISPR gRNA sequence
ttgtgaaaaatagacgtttc

SEQ ID NO: 445736 - DNA, 20 bp, Artificial
  CRISPR gRNA sequence
tgtgaaaaatagacgtttca

SEQ ID NO: 445737 - DNA, 20 bp, Artificial
  CRISPR gRNA sequence
gtgaaaaatagacgtttcat

SEQ ID NO: 445738 - DNA, 20 bp, Artificial
  CRISPR gRNA sequence
tgaaaaatagacgtttcata

SEQ ID NO: 445739 - DNA, 20 bp, Artificial
  CRISPR gRNA sequence
catagcaagacactaaatgt

SEQ ID NO: 445740 - DNA, 20 bp, Artificial
  CRISPR gRNA sequence
atagcaagacactaaatgta

SEQ ID NO: 445741 - DNA, 20 bp, Artificial
  CRISPR gRNA sequence
aatgtaaactactctaaaac

SEQ ID NO: 445742 - DNA, 20 bp, Artificial
  CRISPR gRNA sequence
ctctaaaactctctggggaa

SEQ ID NO: 445743 - DNA, 20 bp, Artificial
  CRISPR gRNA sequence
taaaactctctggggaatct

SEQ ID NO: 445744 - DNA, 20 bp, Artificial
  CRISPR gRNA sequence
aaactctctggggaatctta

SEQ ID NO: 445745 - DNA, 20 bp, Artificial
  CRISPR gRNA sequence
tctggggaatcttaggggat

SEQ ID NO: 445746 - DNA, 20 bp, Artificial
  CRISPR gRNA sequence
tggggaatcttaggggatct

SEQ ID NO: 445747 - DNA, 20 bp, Artificial
  CRISPR gRNA sequence
gggaatcttaggggatcttg

SEQ ID NO: 445748 - DNA, 20 bp, Artificial
  CRISPR gRNA sequence
aggggatcttgaaccaacaa

SEQ ID NO: 445749 - DNA, 20 bp, Artificial
  CRISPR gRNA sequence
ggggatcttgaaccaacaag

SEQ ID NO: 445750 - DNA, 20 bp, Artificial
  CRISPR gRNA sequence
gaaccaacaagactccactc

SEQ ID NO: 445751 - DNA, 20 bp, Artificial
  CRISPR gRNA sequence
aaccaacaagactccactct

SEQ ID NO: 445752 - DNA, 20 bp, Artificial
  CRISPR gRNA sequence
cactctaaagccaatttttg

SEQ ID NO: 445753 - DNA, 20 bp, Artificial
  CRISPR gRNA sequence
taaagccaatttttgcaggg

SEQ ID NO: 445754 - DNA, 20 bp, Artificial
  CRISPR gRNA sequence
aagccaatttttgcaggggc

SEQ ID NO: 445755 - DNA, 20 bp, Artificial
  CRISPR gRNA sequence
ttgcaggggcagggaaaggg

SEQ ID NO: 445756 - DNA, 20 bp, Artificial
  CRISPR gRNA sequence
tgcaggggcagggaaagggt

SEQ ID NO: 445757 - DNA, 20 bp, Artificial
  CRISPR gRNA sequence
gcaggggcagggaaagggtc

SEQ ID NO: 445758 - DNA, 20 bp, Artificial
  CRISPR gRNA sequence
caggggcagggaaagggtct

SEQ ID NO: 445759 - DNA, 20 bp, Artificial
  CRISPR gRNA sequence
aagagctccttctctctttt

SEQ ID NO: 445760 - DNA, 20 bp, Artificial
  CRISPR gRNA sequence
agagctccttctctcttttt

SEQ ID NO: 445761 - DNA, 20 bp, Artificial
  CRISPR gRNA sequence
cttctctctttttttttttt

SEQ ID NO: 445762 - DNA, 20 bp, Artificial
  CRISPR gRNA sequence
ctctcttttttttttttttt

SEQ ID NO: 445763 - DNA, 20 bp, Artificial
  CRISPR gRNA sequence
tctctttttttttttttttt

SEQ ID NO: 445764 - DNA, 20 bp, Artificial
  CRISPR gRNA sequence
tctttttttttttttttttt

SEQ ID NO: 445765 - DNA, 20 bp, Artificial
  CRISPR gRNA sequence
ttttttttttttttttttta

SEQ ID NO: 445766 - DNA, 20 bp, Artificial
  CRISPR gRNA sequence
tttttttttttttttttaag

SEQ ID NO: 445767 - DNA, 20 bp, Artificial
  CRISPR gRNA sequence
ttttttttttttttttaaga

SEQ ID NO: 445768 - DNA, 20 bp, Artificial
  CRISPR gRNA sequence
tttttttttttttttaagag

SEQ ID NO: 445769 - DNA, 20 bp, Artificial
  CRISPR gRNA sequence
ttttttttttttttaagagc

SEQ ID NO: 445770 - DNA, 20 bp, Artificial
  CRISPR gRNA sequence
tttttttttttttaagagct

SEQ ID NO: 445771 - DNA, 20 bp, Artificial
  CRISPR gRNA sequence
ttttttttttttaagagctc

SEQ ID NO: 445772 - DNA, 20 bp, Artificial
  CRISPR gRNA sequence
tttttttttttaagagctcc

SEQ ID NO: 445773 - DNA, 20 bp, Artificial
  CRISPR gRNA sequence
ttttttttttaagagctcct

SEQ ID NO: 445774 - DNA, 20 bp, Artificial
  CRISPR gRNA sequence
tttttttttaagagctcctt

SEQ ID NO: 445775 - DNA, 20 bp, Artificial
  CRISPR gRNA sequence
ttttttttaagagctccttc

SEQ ID NO: 445776 - DNA, 20 bp, Artificial
  CRISPR gRNA sequence
tttttttaagagctccttct

SEQ ID NO: 445777 - DNA, 20 bp, Artificial
  CRISPR gRNA sequence
ttttttaagagctccttctc

SEQ ID NO: 445778 - DNA, 20 bp, Artificial
  CRISPR gRNA sequence
tttttaagagctccttctct

SEQ ID NO: 445779 - DNA, 20 bp, Artificial
  CRISPR gRNA sequence
ttttaagagctccttctcta

SEQ ID NO: 445780 - DNA, 20 bp, Artificial
  CRISPR gRNA sequence
tttaagagctccttctctac

SEQ ID NO: 445781 - DNA, 20 bp, Artificial
  CRISPR gRNA sequence
ttaagagctccttctctacc

SEQ ID NO: 445782 - DNA, 20 bp, Artificial
  CRISPR gRNA sequence
taagagctccttctctaccc

SEQ ID NO: 445783 - DNA, 20 bp, Artificial
  CRISPR gRNA sequence
aagagctccttctctaccca

SEQ ID NO: 445784 - DNA, 20 bp, Artificial
  CRISPR gRNA sequence
agagctccttctctacccac

SEQ ID NO: 445785 - DNA, 20 bp, Artificial
  CRISPR gRNA sequence
cttctctacccacaacacag

SEQ ID NO: 445786 - DNA, 20 bp, Artificial
  CRISPR gRNA sequence
ctctacccacaacacagaag

SEQ ID NO: 445787 - DNA, 20 bp, Artificial
  CRISPR gRNA sequence
tctacccacaacacagaagg

SEQ ID NO: 445788 - DNA, 20 bp, Artificial
  CRISPR gRNA sequence
tacccacaacacagaagggc

SEQ ID NO: 445789 - DNA, 20 bp, Artificial
  CRISPR gRNA sequence
cccacaacacagaagggcac

SEQ ID NO: 445790 - DNA, 20 bp, Artificial
  CRISPR gRNA sequence
tgtttccttgctaactccaa

SEQ ID NO: 445791 - DNA, 20 bp, Artificial
  CRISPR gRNA sequence
gtttccttgctaactccaaa

SEQ ID NO: 445792 - DNA, 20 bp, Artificial
  CRISPR gRNA sequence
tttccttgctaactccaaag

SEQ ID NO: 445793 - DNA, 20 bp, Artificial
  CRISPR gRNA sequence
ccttgctaactccaaaggtt

SEQ ID NO: 445794 - DNA, 20 bp, Artificial
  CRISPR gRNA sequence
cttgctaactccaaaggtta

SEQ ID NO: 445795 - DNA, 20 bp, Artificial
  CRISPR gRNA sequence
gctaactccaaaggttaagg

SEQ ID NO: 445796 - DNA, 20 bp, Artificial
  CRISPR gRNA sequence
ctaactccaaaggttaaggg

SEQ ID NO: 445797 - DNA, 20 bp, Artificial
  CRISPR gRNA sequence
actccaaaggttaagggaga

SEQ ID NO: 445798 - DNA, 20 bp, Artificial
  CRISPR gRNA sequence
caaaggttaagggagaccct

SEQ ID NO: 445799 - DNA, 20 bp, Artificial
  CRISPR gRNA sequence
agggagaccctttcttgggt

SEQ ID NO: 445800 - DNA, 20 bp, Artificial
  CRISPR gRNA sequence
tcttgggttggcttgagtgt

SEQ ID NO: 445801 - DNA, 20 bp, Artificial
  CRISPR gRNA sequence
cttgggttggcttgagtgtt

SEQ ID NO: 445802 - DNA, 20 bp, Artificial
  CRISPR gRNA sequence
ttgggttggcttgagtgttg

SEQ ID NO: 445803 - DNA, 20 bp, Artificial
  CRISPR gRNA sequence
gggttggcttgagtgttggc

SEQ ID NO: 445804 - DNA, 20 bp, Artificial
  CRISPR gRNA sequence
ggttggcttgagtgttggct

SEQ ID NO: 445805 - DNA, 20 bp, Artificial
  CRISPR gRNA sequence
gcttgagtgttggctacaag

SEQ ID NO: 445806 - DNA, 20 bp, Artificial
  CRISPR gRNA sequence
gagtgttggctacaaggtga

SEQ ID NO: 445807 - DNA, 20 bp, Artificial
  CRISPR gRNA sequence
agtgttggctacaaggtgac

SEQ ID NO: 445808 - DNA, 20 bp, Artificial
  CRISPR gRNA sequence
gctacaaggtgacagatcaa

SEQ ID NO: 445809 - DNA, 20 bp, Artificial
  CRISPR gRNA sequence
caaggtgacagatcaaaggt

SEQ ID NO: 445810 - DNA, 20 bp, Artificial
  CRISPR gRNA sequence
gaaggactcagccatcctgt

SEQ ID NO: 445811 - DNA, 20 bp, Artificial
  CRISPR gRNA sequence
aaggactcagccatcctgtg

SEQ ID NO: 445812 - DNA, 20 bp, Artificial
  CRISPR gRNA sequence
agccatcctgtgatgttgta

SEQ ID NO: 445813 - DNA, 20 bp, Artificial
  CRISPR gRNA sequence
tgatgttgtaaaagggatgg

SEQ ID NO: 445814 - DNA, 20 bp, Artificial
  CRISPR gRNA sequence
taaaagggatggtccaattc

SEQ ID NO: 445815 - DNA, 20 bp, Artificial
  CRISPR gRNA sequence
acaaatcttgaagctgatta

SEQ ID NO: 445816 - DNA, 20 bp, Artificial
  CRISPR gRNA sequence
gaagctgattacacaagcga

SEQ ID NO: 445817 - DNA, 20 bp, Artificial
  CRISPR gRNA sequence
aagctgattacacaagcgat

SEQ ID NO: 445818 - DNA, 20 bp, Artificial
  CRISPR gRNA sequence
attacacaagcgatttctag

SEQ ID NO: 445819 - DNA, 20 bp, Artificial
  CRISPR gRNA sequence
cacaagcgatttctagctgt

SEQ ID NO: 445820 - DNA, 20 bp, Artificial
  CRISPR gRNA sequence
ctagctgttttctgcttaaa

SEQ ID NO: 445821 - DNA, 20 bp, Artificial
  CRISPR gRNA sequence
tagctgttttctgcttaaat

SEQ ID NO: 445822 - DNA, 20 bp, Artificial
  CRISPR gRNA sequence
gctgttttctgcttaaatcc

SEQ ID NO: 445823 - DNA, 20 bp, Artificial
  CRISPR gRNA sequence
ttttctgcttaaatcctgtt

SEQ ID NO: 445824 - DNA, 20 bp, Artificial
  CRISPR gRNA sequence
tctgcttaaatcctgtttgt

SEQ ID NO: 445825 - DNA, 20 bp, Artificial
  CRISPR gRNA sequence
ctgcttaaatcctgtttgtg

SEQ ID NO: 445826 - DNA, 20 bp, Artificial
  CRISPR gRNA sequence
tgcttaaatcctgtttgtgt

SEQ ID NO: 445827 - DNA, 20 bp, Artificial
  CRISPR gRNA sequence
cttaaatcctgtttgtgttt

SEQ ID NO: 445828 - DNA, 20 bp, Artificial
  CRISPR gRNA sequence
aaatcctgtttgtgtttcca

SEQ ID NO: 445829 - DNA, 20 bp, Artificial
  CRISPR gRNA sequence
aatcctgtttgtgtttccat

SEQ ID NO: 445830 - DNA, 20 bp, Artificial
  CRISPR gRNA sequence
tttgtgtttccatagcaaat

SEQ ID NO: 445831 - DNA, 20 bp, Artificial
  CRISPR gRNA sequence
gtgtttccatagcaaatatc

SEQ ID NO: 445832 - DNA, 20 bp, Artificial
  CRISPR gRNA sequence
tgtttccatagcaaatatcc

SEQ ID NO: 445833 - DNA, 20 bp, Artificial
  CRISPR gRNA sequence
ccatagcaaatatccacatt

SEQ ID NO: 445834 - DNA, 20 bp, Artificial
  CRISPR gRNA sequence
catagcaaatatccacattg

SEQ ID NO: 445835 - DNA, 20 bp, Artificial
  CRISPR gRNA sequence
gccaatgagttacgggactc

SEQ ID NO: 445836 - DNA, 20 bp, Artificial
  CRISPR gRNA sequence
cgggactctagattggccaa

SEQ ID NO: 445837 - DNA, 20 bp, Artificial
  CRISPR gRNA sequence
tagattggccaatgacttac

SEQ ID NO: 445838 - DNA, 20 bp, Artificial
  CRISPR gRNA sequence
gattggccaatgacttacgg

SEQ ID NO: 445839 - DNA, 20 bp, Artificial
  CRISPR gRNA sequence
gccaatgacttacgggactc

SEQ ID NO: 445840 - DNA, 20 bp, Artificial
  CRISPR gRNA sequence
acgggactctggagcaacca

SEQ ID NO: 445841 - DNA, 20 bp, Artificial
  CRISPR gRNA sequence
cgggactctggagcaaccat

SEQ ID NO: 445842 - DNA, 20 bp, Artificial
  CRISPR gRNA sequence
tggagcaaccatcagaatag

SEQ ID NO: 445843 - DNA, 20 bp, Artificial
  CRISPR gRNA sequence
gagcaaccatcagaataggc

SEQ ID NO: 445844 - DNA, 20 bp, Artificial
  CRISPR gRNA sequence
catcggagcagggatctgtg

SEQ ID NO: 445845 - DNA, 20 bp, Artificial
  CRISPR gRNA sequence
tgctgggctggctctggctc

SEQ ID NO: 445846 - DNA, 20 bp, Artificial
  CRISPR gRNA sequence
ggctggctctggctcttatc

SEQ ID NO: 445847 - DNA, 20 bp, Artificial
  CRISPR gRNA sequence
gctctggctcttatcttcgg

SEQ ID NO: 445848 - DNA, 20 bp, Artificial
  CRISPR gRNA sequence
tggctcttatcttcggcgct

SEQ ID NO: 445849 - DNA, 20 bp, Artificial
  CRISPR gRNA sequence
gctcttatcttcggcgcttt

SEQ ID NO: 445850 - DNA, 20 bp, Artificial
  CRISPR gRNA sequence
ttatcttcggcgctttaatt

SEQ ID NO: 445851 - DNA, 20 bp, Artificial
  CRISPR gRNA sequence
atcttcggcgctttaatttt

SEQ ID NO: 445852 - DNA, 20 bp, Artificial
  CRISPR gRNA sequence
tcttcggcgctttaattttc

SEQ ID NO: 445853 - DNA, 20 bp, Artificial
  CRISPR gRNA sequence
cggcgctttaattttcaaat

SEQ ID NO: 445854 - DNA, 20 bp, Artificial
  CRISPR gRNA sequence
ggcgctttaattttcaaatg

SEQ ID NO: 445855 - DNA, 20 bp, Artificial
  CRISPR gRNA sequence
taattttcaaatgtaagtgt

SEQ ID NO: 445856 - DNA, 20 bp, Artificial
  CRISPR gRNA sequence
aattttcaaatgtaagtgtt

SEQ ID NO: 445857 - DNA, 20 bp, Artificial
  CRISPR gRNA sequence
attttcaaatgtaagtgttt

SEQ ID NO: 445858 - DNA, 20 bp, Artificial
  CRISPR gRNA sequence
tcaaatgtaagtgtttttgt

SEQ ID NO: 445859 - DNA, 20 bp, Artificial
  CRISPR gRNA sequence
caaatgtaagtgtttttgtt

SEQ ID NO: 445860 - DNA, 20 bp, Artificial
  CRISPR gRNA sequence
aaatgtaagtgtttttgttt

SEQ ID NO: 445861 - DNA, 20 bp, Artificial
  CRISPR gRNA sequence
ttgtttctctctccctctga

SEQ ID NO: 445862 - DNA, 20 bp, Artificial
  CRISPR gRNA sequence
tgtttctctctccctctgat

SEQ ID NO: 445863 - DNA, 20 bp, Artificial
  CRISPR gRNA sequence
gtttctctctccctctgata

SEQ ID NO: 445864 - DNA, 20 bp, Artificial
  CRISPR gRNA sequence
tttctctctccctctgataa

SEQ ID NO: 445865 - DNA, 20 bp, Artificial
  CRISPR gRNA sequence
ctctctccctctgataacaa

SEQ ID NO: 445866 - DNA, 20 bp, Artificial
  CRISPR gRNA sequence
tctctccctctgataacaaa

SEQ ID NO: 445867 - DNA, 20 bp, Artificial
  CRISPR gRNA sequence
tctccctctgataacaaatt

SEQ ID NO: 445868 - DNA, 20 bp, Artificial
  CRISPR gRNA sequence
tccctctgataacaaattct

SEQ ID NO: 445869 - DNA, 20 bp, Artificial
  CRISPR gRNA sequence
cctctgataacaaattcttc

SEQ ID NO: 445870 - DNA, 20 bp, Artificial
  CRISPR gRNA sequence
tgataacaaattcttcagtg

SEQ ID NO: 445871 - DNA, 20 bp, Artificial
  CRISPR gRNA sequence
ataacaaattcttcagtgag

SEQ ID NO: 445872 - DNA, 20 bp, Artificial
  CRISPR gRNA sequence
ttcagtgagaaccagtaaaa

SEQ ID NO: 445873 - DNA, 20 bp, Artificial
  CRISPR gRNA sequence
cagtgagaaccagtaaaaac

SEQ ID NO: 445874 - DNA, 20 bp, Artificial
  CRISPR gRNA sequence
agtgagaaccagtaaaaacc

SEQ ID NO: 445875 - DNA, 20 bp, Artificial
  CRISPR gRNA sequence
gatagaaatgcaaattcatg

SEQ ID NO: 445876 - DNA, 20 bp, Artificial
  CRISPR gRNA sequence
atgtttatacccaaagatga

SEQ ID NO: 445877 - DNA, 20 bp, Artificial
  CRISPR gRNA sequence
atacccaaagatgattagac

SEQ ID NO: 445878 - DNA, 20 bp, Artificial
  CRISPR gRNA sequence
tacccaaagatgattagact

SEQ ID NO: 445879 - DNA, 20 bp, Artificial
  CRISPR gRNA sequence
gactaaatacccttttgtcc

SEQ ID NO: 445880 - DNA, 20 bp, Artificial
  CRISPR gRNA sequence
aatacccttttgtccatcca

SEQ ID NO: 445881 - DNA, 20 bp, Artificial
  CRISPR gRNA sequence
ttgtccatccaaatcctaac

SEQ ID NO: 445882 - DNA, 20 bp, Artificial
  CRISPR gRNA sequence
tgtccatccaaatcctaaca

SEQ ID NO: 445883 - DNA, 20 bp, Artificial
  CRISPR gRNA sequence
gtccatccaaatcctaacaa

SEQ ID NO: 445884 - DNA, 20 bp, Artificial
  CRISPR gRNA sequence
tccatccaaatcctaacaat

SEQ ID NO: 445885 - DNA, 20 bp, Artificial
  CRISPR gRNA sequence
acaataatggctaattttta

SEQ ID NO: 445886 - DNA, 20 bp, Artificial
  CRISPR gRNA sequence
atttttatttaatatttatt

SEQ ID NO: 445887 - DNA, 20 bp, Artificial
  CRISPR gRNA sequence
ttatttaatatttattgtgt

SEQ ID NO: 445888 - DNA, 20 bp, Artificial
  CRISPR gRNA sequence
tatttaatatttattgtgtg

SEQ ID NO: 445889 - DNA, 20 bp, Artificial
  CRISPR gRNA sequence
atttaatatttattgtgtgt

SEQ ID NO: 445890 - DNA, 20 bp, Artificial
  CRISPR gRNA sequence
tttaatatttattgtgtgtc

SEQ ID NO: 445891 - DNA, 20 bp, Artificial
  CRISPR gRNA sequence
aatatttattgtgtgtcagg

SEQ ID NO: 445892 - DNA, 20 bp, Artificial
  CRISPR gRNA sequence
atatttattgtgtgtcaggc

SEQ ID NO: 445893 - DNA, 20 bp, Artificial
  CRISPR gRNA sequence
attgtgtgtcaggcagccac

SEQ ID NO: 445894 - DNA, 20 bp, Artificial
  CRISPR gRNA sequence
ttgtgtgtcaggcagccact

SEQ ID NO: 445895 - DNA, 20 bp, Artificial
  CRISPR gRNA sequence
tgtgtcaggcagccactgcg

SEQ ID NO: 445896 - DNA, 20 bp, Artificial
  CRISPR gRNA sequence
cgttaaatgttttacataca

SEQ ID NO: 445897 - DNA, 20 bp, Artificial
  CRISPR gRNA sequence
aatgttttacatacatttta

SEQ ID NO: 445898 - DNA, 20 bp, Artificial
  CRISPR gRNA sequence
tacatacattttatcatcat

SEQ ID NO: 445899 - DNA, 20 bp, Artificial
  CRISPR gRNA sequence
acatacattttatcatcatt

SEQ ID NO: 445900 - DNA, 20 bp, Artificial
  CRISPR gRNA sequence
catacattttatcatcatta

SEQ ID NO: 445901 - DNA, 20 bp, Artificial
  CRISPR gRNA sequence
tatcatcattactgtcttat

SEQ ID NO: 445902 - DNA, 20 bp, Artificial
  CRISPR gRNA sequence
atcatcattactgtcttatg

SEQ ID NO: 445903 - DNA, 20 bp, Artificial
  CRISPR gRNA sequence
tcatcattactgtcttatga

SEQ ID NO: 445904 - DNA, 20 bp, Artificial
  CRISPR gRNA sequence
ctgtcttatgagataaggaa

SEQ ID NO: 445905 - DNA, 20 bp, Artificial
  CRISPR gRNA sequence
tcttatgagataaggaatag

SEQ ID NO: 445906 - DNA, 20 bp, Artificial
  CRISPR gRNA sequence
atgagataaggaatagtacc

SEQ ID NO: 445907 - DNA, 20 bp, Artificial
  CRISPR gRNA sequence
tgagataaggaatagtacca

SEQ ID NO: 445908 - DNA, 20 bp, Artificial
  CRISPR gRNA sequence
tacagtgaagggaagtcaag

SEQ ID NO: 445909 - DNA, 20 bp, Artificial
  CRISPR gRNA sequence
acagtgaagggaagtcaagc

SEQ ID NO: 445910 - DNA, 20 bp, Artificial
  CRISPR gRNA sequence
cagtgaagggaagtcaagct

SEQ ID NO: 445911 - DNA, 20 bp, Artificial
  CRISPR gRNA sequence
agagtaagctgccttcccga

SEQ ID NO: 445912 - DNA, 20 bp, Artificial
  CRISPR gRNA sequence
gagtaagctgccttcccgag

SEQ ID NO: 445913 - DNA, 20 bp, Artificial
  CRISPR gRNA sequence
ccttcccgaggtttcaacat

SEQ ID NO: 445914 - DNA, 20 bp, Artificial
  CRISPR gRNA sequence
cccgaggtttcaacatcagt

SEQ ID NO: 445915 - DNA, 20 bp, Artificial
  CRISPR gRNA sequence
ccgaggtttcaacatcagta

SEQ ID NO: 445916 - DNA, 20 bp, Artificial
  CRISPR gRNA sequence
caacatcagtacctggcaga

SEQ ID NO: 445917 - DNA, 20 bp, Artificial
  CRISPR gRNA sequence
aacatcagtacctggcagaa

SEQ ID NO: 445918 - DNA, 20 bp, Artificial
  CRISPR gRNA sequence
gcagaaccggaaatcaaatc

SEQ ID NO: 445919 - DNA, 20 bp, Artificial
  CRISPR gRNA sequence
attccagtaaactaatttct

SEQ ID NO: 445920 - DNA, 20 bp, Artificial
  CRISPR gRNA sequence
cagtaaactaatttctttaa

SEQ ID NO: 445921 - DNA, 20 bp, Artificial
  CRISPR gRNA sequence
atttctttaattcatgaata

SEQ ID NO: 445922 - DNA, 20 bp, Artificial
  CRISPR gRNA sequence
ctttaattcatgaatatgtc

SEQ ID NO: 445923 - DNA, 20 bp, Artificial
  CRISPR gRNA sequence
tttaattcatgaatatgtct

SEQ ID NO: 445924 - DNA, 20 bp, Artificial
  CRISPR gRNA sequence
taattcatgaatatgtctag

SEQ ID NO: 445925 - DNA, 20 bp, Artificial
  CRISPR gRNA sequence
aattcatgaatatgtctagg

SEQ ID NO: 445926 - DNA, 20 bp, Artificial
  CRISPR gRNA sequence
attcatgaatatgtctaggt

SEQ ID NO: 445927 - DNA, 20 bp, Artificial
  CRISPR gRNA sequence
atgaatatgtctaggtttgt

SEQ ID NO: 445928 - DNA, 20 bp, Artificial
  CRISPR gRNA sequence
ggtttgttacgaaacacaac

SEQ ID NO: 445929 - DNA, 20 bp, Artificial
  CRISPR gRNA sequence
gttacgaaacacaacaacaa

SEQ ID NO: 445930 - DNA, 20 bp, Artificial
  CRISPR gRNA sequence
ttacgaaacacaacaacaaa

SEQ ID NO: 445931 - DNA, 20 bp, Artificial
  CRISPR gRNA sequence
cgaaacacaacaacaaaaaa

SEQ ID NO: 445932 - DNA, 20 bp, Artificial
  CRISPR gRNA sequence
ccttctgtgcacttttctgt

SEQ ID NO: 445933 - DNA, 20 bp, Artificial
  CRISPR gRNA sequence
cttctgtgcacttttctgtt

SEQ ID NO: 445934 - DNA, 20 bp, Artificial
  CRISPR gRNA sequence
ctgtgcacttttctgttatt

SEQ ID NO: 445935 - DNA, 20 bp, Artificial
  CRISPR gRNA sequence
tgtgcacttttctgttattg

SEQ ID NO: 445936 - DNA, 20 bp, Artificial
  CRISPR gRNA sequence
tgcacttttctgttattggt

SEQ ID NO: 445937 - DNA, 20 bp, Artificial
  CRISPR gRNA sequence
ttctgttattggtttctcag

SEQ ID NO: 445938 - DNA, 20 bp, Artificial
  CRISPR gRNA sequence
tctgttattggtttctcagg

SEQ ID NO: 445939 - DNA, 20 bp, Artificial
  CRISPR gRNA sequence
ctgttattggtttctcaggc

SEQ ID NO: 445940 - DNA, 20 bp, Artificial
  CRISPR gRNA sequence
tgttattggtttctcaggca

SEQ ID NO: 445941 - DNA, 20 bp, Artificial
  CRISPR gRNA sequence
ttattggtttctcaggcata

SEQ ID NO: 445942 - DNA, 20 bp, Artificial
  CRISPR gRNA sequence
ttggtttctcaggcatacct

SEQ ID NO: 445943 - DNA, 20 bp, Artificial
  CRISPR gRNA sequence
gtttctcaggcatacctctc

SEQ ID NO: 445944 - DNA, 20 bp, Artificial
  CRISPR gRNA sequence
ctcaggcatacctctctggc

SEQ ID NO: 445945 - DNA, 20 bp, Artificial
  CRISPR gRNA sequence
tcaggcatacctctctggca

SEQ ID NO: 445946 - DNA, 20 bp, Artificial
  CRISPR gRNA sequence
aggcatacctctctggcagt

SEQ ID NO: 445947 - DNA, 20 bp, Artificial
  CRISPR gRNA sequence
tctggcagtagactgcaagt

SEQ ID NO: 445948 - DNA, 20 bp, Artificial
  CRISPR gRNA sequence
tggcagtagactgcaagtcc

SEQ ID NO: 445949 - DNA, 20 bp, Artificial
  CRISPR gRNA sequence
gcagtagactgcaagtccct

SEQ ID NO: 445950 - DNA, 20 bp, Artificial
  CRISPR gRNA sequence
caagtccctttaacactggg

SEQ ID NO: 445951 - DNA, 20 bp, Artificial
  CRISPR gRNA sequence
taacactgggtcgtgactgg

SEQ ID NO: 445952 - DNA, 20 bp, Artificial
  CRISPR gRNA sequence
aacactgggtcgtgactggg

SEQ ID NO: 445953 - DNA, 20 bp, Artificial
  CRISPR gRNA sequence
acactgggtcgtgactgggg

SEQ ID NO: 445954 - DNA, 20 bp, Artificial
  CRISPR gRNA sequence
ggtcgtgactggggttagag

SEQ ID NO: 445955 - DNA, 20 bp, Artificial
  CRISPR gRNA sequence
gggttagagaatgttttcct

SEQ ID NO: 445956 - DNA, 20 bp, Artificial
  CRISPR gRNA sequence
gagaatgttttcctccatca

SEQ ID NO: 445957 - DNA, 20 bp, Artificial
  CRISPR gRNA sequence
tcctccatcatggtacttag

SEQ ID NO: 445958 - DNA, 20 bp, Artificial
  CRISPR gRNA sequence
cctccatcatggtacttagc

SEQ ID NO: 445959 - DNA, 20 bp, Artificial
  CRISPR gRNA sequence
ctccatcatggtacttagca

SEQ ID NO: 445960 - DNA, 20 bp, Artificial
  CRISPR gRNA sequence
catcatggtacttagcacat

SEQ ID NO: 445961 - DNA, 20 bp, Artificial
  CRISPR gRNA sequence
agcacatagctttttctaag

SEQ ID NO: 445962 - DNA, 20 bp, Artificial
  CRISPR gRNA sequence
gcacatagctttttctaagt

SEQ ID NO: 445963 - DNA, 20 bp, Artificial
  CRISPR gRNA sequence
tttctaagttacttatccct

SEQ ID NO: 445964 - DNA, 20 bp, Artificial
  CRISPR gRNA sequence
ttctaagttacttatccctt

SEQ ID NO: 445965 - DNA, 20 bp, Artificial
  CRISPR gRNA sequence
tctaagttacttatcccttt

SEQ ID NO: 445966 - DNA, 20 bp, Artificial
  CRISPR gRNA sequence
ctaagttacttatccctttt

SEQ ID NO: 445967 - DNA, 20 bp, Artificial
  CRISPR gRNA sequence
taagttacttatcccttttt

SEQ ID NO: 445968 - DNA, 20 bp, Artificial
  CRISPR gRNA sequence
agttacttatcccttttttt

SEQ ID NO: 445969 - DNA, 20 bp, Artificial
  CRISPR gRNA sequence
cttatccctttttttttttt

SEQ ID NO: 445970 - DNA, 20 bp, Artificial
  CRISPR gRNA sequence
atcccttttttttttttaaa

SEQ ID NO: 445971 - DNA, 20 bp, Artificial
  CRISPR gRNA sequence
tcccttttttttttttaaac

SEQ ID NO: 445972 - DNA, 20 bp, Artificial
  CRISPR gRNA sequence
ttttttttttaaactagcaa

SEQ ID NO: 445973 - DNA, 20 bp, Artificial
  CRISPR gRNA sequence
tttttttttaaactagcaaa

SEQ ID NO: 445974 - DNA, 20 bp, Artificial
  CRISPR gRNA sequence
ttttttttaaactagcaaac

SEQ ID NO: 445975 - DNA, 20 bp, Artificial
  CRISPR gRNA sequence
tttttttaaactagcaaaca

SEQ ID NO: 445976 - DNA, 20 bp, Artificial
  CRISPR gRNA sequence
ttttttaaactagcaaacaa

SEQ ID NO: 445977 - DNA, 20 bp, Artificial
  CRISPR gRNA sequence
tttttaaactagcaaacaaa

SEQ ID NO: 445978 - DNA, 20 bp, Artificial
  CRISPR gRNA sequence
ttttaaactagcaaacaaac

SEQ ID NO: 445979 - DNA, 20 bp, Artificial
  CRISPR gRNA sequence
tttaaactagcaaacaaaca

SEQ ID NO: 445980 - DNA, 20 bp, Artificial
  CRISPR gRNA sequence
ttaaactagcaaacaaacaa

SEQ ID NO: 445981 - DNA, 20 bp, Artificial
  CRISPR gRNA sequence
taaactagcaaacaaacaaa

SEQ ID NO: 445982 - DNA, 20 bp, Artificial
  CRISPR gRNA sequence
aaactagcaaacaaacaaaa

SEQ ID NO: 445983 - DNA, 20 bp, Artificial
  CRISPR gRNA sequence
aactagcaaacaaacaaaaa

SEQ ID NO: 445984 - DNA, 20 bp, Artificial
  CRISPR gRNA sequence
gcaaacaaacaaaaacaaaa

SEQ ID NO: 445985 - DNA, 20 bp, Artificial
  CRISPR gRNA sequence
acgcctgtaatcccagcact

SEQ ID NO: 445986 - DNA, 20 bp, Artificial
  CRISPR gRNA sequence
taatcccagcactttgggag

SEQ ID NO: 445987 - DNA, 20 bp, Artificial
  CRISPR gRNA sequence
tgggaggctgaggggggtgg

SEQ ID NO: 445988 - DNA, 20 bp, Artificial
  CRISPR gRNA sequence
gggaggctgaggggggtgga

SEQ ID NO: 445989 - DNA, 20 bp, Artificial
  CRISPR gRNA sequence
ggaggctgaggggggtggat

SEQ ID NO: 445990 - DNA, 20 bp, Artificial
  CRISPR gRNA sequence
aggggggtggatcatttgag

SEQ ID NO: 445991 - DNA, 20 bp, Artificial
  CRISPR gRNA sequence
gaggtcaggagttcgagacc

SEQ ID NO: 445992 - DNA, 20 bp, Artificial
  CRISPR gRNA sequence
aggtcaggagttcgagacca

SEQ ID NO: 445993 - DNA, 20 bp, Artificial
  CRISPR gRNA sequence
gagaccagcttggccaacat

SEQ ID NO: 445994 - DNA, 20 bp, Artificial
  CRISPR gRNA sequence
ggccaacatggtgagacccc

SEQ ID NO: 445995 - DNA, 20 bp, Artificial
  CRISPR gRNA sequence
gccaacatggtgagacccca

SEQ ID NO: 445996 - DNA, 20 bp, Artificial
  CRISPR gRNA sequence
tactaaaaatacaaaattag

SEQ ID NO: 445997 - DNA, 20 bp, Artificial
  CRISPR gRNA sequence
ctaaaaatacaaaattagcc

SEQ ID NO: 445998 - DNA, 20 bp, Artificial
  CRISPR gRNA sequence
aaaatacaaaattagccggg

SEQ ID NO: 445999 - DNA, 20 bp, Artificial
  CRISPR gRNA sequence
gccgggtgtggtggcgcatg

SEQ ID NO: 446000 - DNA, 20 bp, Artificial
  CRISPR gRNA sequence
taatcccagctactcaggag

SEQ ID NO: 446001 - DNA, 20 bp, Artificial
  CRISPR gRNA sequence
ctcaggaggctgaggcagag

SEQ ID NO: 446002 - DNA, 20 bp, Artificial
  CRISPR gRNA sequence
aggaggctgaggcagaggaa

SEQ ID NO: 446003 - DNA, 20 bp, Artificial
  CRISPR gRNA sequence
aggcagaggaatcactcaaa

SEQ ID NO: 446004 - DNA, 20 bp, Artificial
  CRISPR gRNA sequence
aaacctggtaggtggaggtt

SEQ ID NO: 446005 - DNA, 20 bp, Artificial
  CRISPR gRNA sequence
gtaggtggaggttacagtga

SEQ ID NO: 446006 - DNA, 20 bp, Artificial
  CRISPR gRNA sequence
cagtgagctcagatcatgcc

SEQ ID NO: 446007 - DNA, 20 bp, Artificial
  CRISPR gRNA sequence
agatcatgccactgcactcc

SEQ ID NO: 446008 - DNA, 20 bp, Artificial
  CRISPR gRNA sequence
cactccagcctgggtgacag

SEQ ID NO: 446009 - DNA, 20 bp, Artificial
  CRISPR gRNA sequence
cagcctgggtgacagagtga

SEQ ID NO: 446010 - DNA, 20 bp, Artificial
  CRISPR gRNA sequence
ggtgacagagtgagactgtc

SEQ ID NO: 446011 - DNA, 20 bp, Artificial
  CRISPR gRNA sequence
tcttaaaaaaaaaagtaata

SEQ ID NO: 446012 - DNA, 20 bp, Artificial
  CRISPR gRNA sequence
aaaaaaaaaagtaataaaat

SEQ ID NO: 446013 - DNA, 20 bp, Artificial
  CRISPR gRNA sequence
aaaaaaaaagtaataaaata

SEQ ID NO: 446014 - DNA, 20 bp, Artificial
  CRISPR gRNA sequence
atgcctgtattttcaacact

SEQ ID NO: 446015 - DNA, 20 bp, Artificial
  CRISPR gRNA sequence
tattttcaacactttcggaa

SEQ ID NO: 446016 - DNA, 20 bp, Artificial
  CRISPR gRNA sequence
tcaacactttcggaagctga

SEQ ID NO: 446017 - DNA, 20 bp, Artificial
  CRISPR gRNA sequence
caacactttcggaagctgag

SEQ ID NO: 446018 - DNA, 20 bp, Artificial
  CRISPR gRNA sequence
aacactttcggaagctgagg

SEQ ID NO: 446019 - DNA, 20 bp, Artificial
  CRISPR gRNA sequence
tcggaagctgaggtgagagg

SEQ ID NO: 446020 - DNA, 20 bp, Artificial
  CRISPR gRNA sequence
cggaagctgaggtgagagga

SEQ ID NO: 446021 - DNA, 20 bp, Artificial
  CRISPR gRNA sequence
ggaagctgaggtgagaggat

SEQ ID NO: 446022 - DNA, 20 bp, Artificial
  CRISPR gRNA sequence
aggtgagaggatcagttgag

SEQ ID NO: 446023 - DNA, 20 bp, Artificial
  CRISPR gRNA sequence
agcccaggagtttgagacca

SEQ ID NO: 446024 - DNA, 20 bp, Artificial
  CRISPR gRNA sequence
gagaccaagatcagcctggg

SEQ ID NO: 446025 - DNA, 20 bp, Artificial
  CRISPR gRNA sequence
agaccaagatcagcctgggc

SEQ ID NO: 446026 - DNA, 20 bp, Artificial
  CRISPR gRNA sequence
ggcagcaaagcaggatcctg

SEQ ID NO: 446027 - DNA, 20 bp, Artificial
  CRISPR gRNA sequence
cctctacaacgtaataataa

SEQ ID NO: 446028 - DNA, 20 bp, Artificial
  CRISPR gRNA sequence
tacaacgtaataataataat

SEQ ID NO: 446029 - DNA, 20 bp, Artificial
  CRISPR gRNA sequence
caacgtaataataataataa

SEQ ID NO: 446030 - DNA, 20 bp, Artificial
  CRISPR gRNA sequence
ggcatggtggcacacacctg

SEQ ID NO: 446031 - DNA, 20 bp, Artificial
  CRISPR gRNA sequence
tagtcccatctactcaggag

SEQ ID NO: 446032 - DNA, 20 bp, Artificial
  CRISPR gRNA sequence
ctcaggaggctgaggtggga

SEQ ID NO: 446033 - DNA, 20 bp, Artificial
  CRISPR gRNA sequence
aggaggctgaggtgggagga

SEQ ID NO: 446034 - DNA, 20 bp, Artificial
  CRISPR gRNA sequence
aggtgggaggatcacttgag

SEQ ID NO: 446035 - DNA, 20 bp, Artificial
  CRISPR gRNA sequence
gagctcaggaggctgcagtg

SEQ ID NO: 446036 - DNA, 20 bp, Artificial
  CRISPR gRNA sequence
agctcaggaggctgcagtga

SEQ ID NO: 446037 - DNA, 20 bp, Artificial
  CRISPR gRNA sequence
aggaggctgcagtgagcggt

SEQ ID NO: 446038 - DNA, 20 bp, Artificial
  CRISPR gRNA sequence
cagtgagcggtgattgcatc

SEQ ID NO: 446039 - DNA, 20 bp, Artificial
  CRISPR gRNA sequence
catcattgcactccaccctg

SEQ ID NO: 446040 - DNA, 20 bp, Artificial
  CRISPR gRNA sequence
cactccaccctgggcaacag

SEQ ID NO: 446041 - DNA, 20 bp, Artificial
  CRISPR gRNA sequence
caccctgggcaacagaataa

SEQ ID NO: 446042 - DNA, 20 bp, Artificial
  CRISPR gRNA sequence
ggcaacagaataagacagtc

SEQ ID NO: 446043 - DNA, 20 bp, Artificial
  CRISPR gRNA sequence
caaaaaaaaaaaaaaaaaga

SEQ ID NO: 446044 - DNA, 20 bp, Artificial
  CRISPR gRNA sequence
aagttgatgaattttgatgg

SEQ ID NO: 446045 - DNA, 20 bp, Artificial
  CRISPR gRNA sequence
atgaattttgatggagaatt

SEQ ID NO: 446046 - DNA, 20 bp, Artificial
  CRISPR gRNA sequence
tgatggagaattacagtagg

SEQ ID NO: 446047 - DNA, 20 bp, Artificial
  CRISPR gRNA sequence
gatggagaattacagtagga

SEQ ID NO: 446048 - DNA, 20 bp, Artificial
  CRISPR gRNA sequence
atggagaattacagtaggaa

SEQ ID NO: 446049 - DNA, 20 bp, Artificial
  CRISPR gRNA sequence
cagtaggaagccatcatcac

SEQ ID NO: 446050 - DNA, 20 bp, Artificial
  CRISPR gRNA sequence
aatacttccagtacccccaa

SEQ ID NO: 446051 - DNA, 20 bp, Artificial
  CRISPR gRNA sequence
ccagtacccccaaaacctcg

SEQ ID NO: 446052 - DNA, 20 bp, Artificial
  CRISPR gRNA sequence
cagtacccccaaaacctcgc

SEQ ID NO: 446053 - DNA, 20 bp, Artificial
  CRISPR gRNA sequence
gcacacttttgtttttttgg

SEQ ID NO: 446054 - DNA, 20 bp, Artificial
  CRISPR gRNA sequence
ttgtttttttggagatggac

SEQ ID NO: 446055 - DNA, 20 bp, Artificial
  CRISPR gRNA sequence
tgtttttttggagatggacg

SEQ ID NO: 446056 - DNA, 20 bp, Artificial
  CRISPR gRNA sequence
gtttttttggagatggacgc

SEQ ID NO: 446057 - DNA, 20 bp, Artificial
  CRISPR gRNA sequence
tttttttggagatggacgct

SEQ ID NO: 446058 - DNA, 20 bp, Artificial
  CRISPR gRNA sequence
ttttggagatggacgctgga

SEQ ID NO: 446059 - DNA, 20 bp, Artificial
  CRISPR gRNA sequence
tttggagatggacgctggag

SEQ ID NO: 446060 - DNA, 20 bp, Artificial
  CRISPR gRNA sequence
ttggagatggacgctggagt

SEQ ID NO: 446061 - DNA, 20 bp, Artificial
  CRISPR gRNA sequence
tggagatggacgctggagtg

SEQ ID NO: 446062 - DNA, 20 bp, Artificial
  CRISPR gRNA sequence
ggagatggacgctggagtgc

SEQ ID NO: 446063 - DNA, 20 bp, Artificial
  CRISPR gRNA sequence
gagatggacgctggagtgca

SEQ ID NO: 446064 - DNA, 20 bp, Artificial
  CRISPR gRNA sequence
gagtgcagtggcacgatctc

SEQ ID NO: 446065 - DNA, 20 bp, Artificial
  CRISPR gRNA sequence
agctcactgtaacctctgcc

SEQ ID NO: 446066 - DNA, 20 bp, Artificial
  CRISPR gRNA sequence
actgtaacctctgcctcccg

SEQ ID NO: 446067 - DNA, 20 bp, Artificial
  CRISPR gRNA sequence
taacctctgcctcccgggtt

SEQ ID NO: 446068 - DNA, 20 bp, Artificial
  CRISPR gRNA sequence
tgcctcccgggttcaagtgt

SEQ ID NO: 446069 - DNA, 20 bp, Artificial
  CRISPR gRNA sequence
cctcccgggttcaagtgttt

SEQ ID NO: 446070 - DNA, 20 bp, Artificial
  CRISPR gRNA sequence
ccgggttcaagtgtttctcc

SEQ ID NO: 446071 - DNA, 20 bp, Artificial
  CRISPR gRNA sequence
aagtgtttctcctgactcag

SEQ ID NO: 446072 - DNA, 20 bp, Artificial
  CRISPR gRNA sequence
ctcctgactcagcttccaga

SEQ ID NO: 446073 - DNA, 20 bp, Artificial
  CRISPR gRNA sequence
tcctgactcagcttccagag

SEQ ID NO: 446074 - DNA, 20 bp, Artificial
  CRISPR gRNA sequence
ctgactcagcttccagagta

SEQ ID NO: 446075 - DNA, 20 bp, Artificial
  CRISPR gRNA sequence
actcagcttccagagtagct

SEQ ID NO: 446076 - DNA, 20 bp, Artificial
  CRISPR gRNA sequence
agcttccagagtagctggga

SEQ ID NO: 446077 - DNA, 20 bp, Artificial
  CRISPR gRNA sequence
ccagagtagctgggactaca

SEQ ID NO: 446078 - DNA, 20 bp, Artificial
  CRISPR gRNA sequence
cagagtagctgggactacag

SEQ ID NO: 446079 - DNA, 20 bp, Artificial
  CRISPR gRNA sequence
ggactacaggcatgtaccac

SEQ ID NO: 446080 - DNA, 20 bp, Artificial
  CRISPR gRNA sequence
caggcatgtaccaccacgcc

SEQ ID NO: 446081 - DNA, 20 bp, Artificial
  CRISPR gRNA sequence
gctaatttttatatttttag

SEQ ID NO: 446082 - DNA, 20 bp, Artificial
  CRISPR gRNA sequence
atttttatatttttagtaga

SEQ ID NO: 446083 - DNA, 20 bp, Artificial
  CRISPR gRNA sequence
ttatatttttagtagagaca

SEQ ID NO: 446084 - DNA, 20 bp, Artificial
  CRISPR gRNA sequence
tatatttttagtagagacag

SEQ ID NO: 446085 - DNA, 20 bp, Artificial
  CRISPR gRNA sequence
atatttttagtagagacagg

SEQ ID NO: 446086 - DNA, 20 bp, Artificial
  CRISPR gRNA sequence
tatttttagtagagacaggg

SEQ ID NO: 446087 - DNA, 20 bp, Artificial
  CRISPR gRNA sequence
ttagtagagacagggtttca

SEQ ID NO: 446088 - DNA, 20 bp, Artificial
  CRISPR gRNA sequence
tagtagagacagggtttcac

SEQ ID NO: 446089 - DNA, 20 bp, Artificial
  CRISPR gRNA sequence
agtagagacagggtttcacc

SEQ ID NO: 446090 - DNA, 20 bp, Artificial
  CRISPR gRNA sequence
gtagagacagggtttcacca

SEQ ID NO: 446091 - DNA, 20 bp, Artificial
  CRISPR gRNA sequence
caccatgttgggcaagatgt

SEQ ID NO: 446092 - DNA, 20 bp, Artificial
  CRISPR gRNA sequence
accatgttgggcaagatgtt

SEQ ID NO: 446093 - DNA, 20 bp, Artificial
  CRISPR gRNA sequence
ggcaagatgttcttgatctc

SEQ ID NO: 446094 - DNA, 20 bp, Artificial
  CRISPR gRNA sequence
ttgatctcctgaccttgtga

SEQ ID NO: 446095 - DNA, 20 bp, Artificial
  CRISPR gRNA sequence
gatctcctgaccttgtgatc

SEQ ID NO: 446096 - DNA, 20 bp, Artificial
  CRISPR gRNA sequence
atctcctgaccttgtgatcc

SEQ ID NO: 446097 - DNA, 20 bp, Artificial
  CRISPR gRNA sequence
ctgaccttgtgatccgtcca

SEQ ID NO: 446098 - DNA, 20 bp, Artificial
  CRISPR gRNA sequence
accttgtgatccgtccacct

SEQ ID NO: 446099 - DNA, 20 bp, Artificial
  CRISPR gRNA sequence
gtgatccgtccacctcgacc

SEQ ID NO: 446100 - DNA, 20 bp, Artificial
  CRISPR gRNA sequence
tgatccgtccacctcgacct

SEQ ID NO: 446101 - DNA, 20 bp, Artificial
  CRISPR gRNA sequence
gacctcccaatgttttggga

SEQ ID NO: 446102 - DNA, 20 bp, Artificial
  CRISPR gRNA sequence
ccaatgttttgggattacag

SEQ ID NO: 446103 - DNA, 20 bp, Artificial
  CRISPR gRNA sequence
tgggattacaggcgtgagcc

SEQ ID NO: 446104 - DNA, 20 bp, Artificial
  CRISPR gRNA sequence
gggattacaggcgtgagcca

SEQ ID NO: 446105 - DNA, 20 bp, Artificial
  CRISPR gRNA sequence
ggattacaggcgtgagccac

SEQ ID NO: 446106 - DNA, 20 bp, Artificial
  CRISPR gRNA sequence
caggcgtgagccactgtgcc

SEQ ID NO: 446107 - DNA, 20 bp, Artificial
  CRISPR gRNA sequence
tgcctggccactcacacact

SEQ ID NO: 446108 - DNA, 20 bp, Artificial
  CRISPR gRNA sequence
gccactcacacacttttata

SEQ ID NO: 446109 - DNA, 20 bp, Artificial
  CRISPR gRNA sequence
acacacttttataattgtgt

SEQ ID NO: 446110 - DNA, 20 bp, Artificial
  CRISPR gRNA sequence
ttataattgtgtctatttta

SEQ ID NO: 446111 - DNA, 20 bp, Artificial
  CRISPR gRNA sequence
tataattgtgtctattttat

SEQ ID NO: 446112 - DNA, 20 bp, Artificial
  CRISPR gRNA sequence
ataattgtgtctattttatt

SEQ ID NO: 446113 - DNA, 20 bp, Artificial
  CRISPR gRNA sequence
taattgtgtctattttattt

SEQ ID NO: 446114 - DNA, 20 bp, Artificial
  CRISPR gRNA sequence
tgtctattttattttctttt

SEQ ID NO: 446115 - DNA, 20 bp, Artificial
  CRISPR gRNA sequence
ttttattttcttttagggca

SEQ ID NO: 446116 - DNA, 20 bp, Artificial
  CRISPR gRNA sequence
tattttcttttagggcagaa

SEQ ID NO: 446117 - DNA, 20 bp, Artificial
  CRISPR gRNA sequence
attttcttttagggcagaaa

SEQ ID NO: 446118 - DNA, 20 bp, Artificial
  CRISPR gRNA sequence
ttttcttttagggcagaaac

SEQ ID NO: 446119 - DNA, 20 bp, Artificial
  CRISPR gRNA sequence
tcttttagggcagaaaccaa

SEQ ID NO: 446120 - DNA, 20 bp, Artificial
  CRISPR gRNA sequence
cttttagggcagaaaccaag

SEQ ID NO: 446121 - DNA, 20 bp, Artificial
  CRISPR gRNA sequence
ttttagggcagaaaccaagt

SEQ ID NO: 446122 - DNA, 20 bp, Artificial
  CRISPR gRNA sequence
ttagggcagaaaccaagtcc

SEQ ID NO: 446123 - DNA, 20 bp, Artificial
  CRISPR gRNA sequence
tagggcagaaaccaagtcct

SEQ ID NO: 446124 - DNA, 20 bp, Artificial
  CRISPR gRNA sequence
agggcagaaaccaagtcctt

SEQ ID NO: 446125 - DNA, 20 bp, Artificial
  CRISPR gRNA sequence
gggcagaaaccaagtcctta

SEQ ID NO: 446126 - DNA, 20 bp, Artificial
  CRISPR gRNA sequence
atgccccagagcgtaatatg

SEQ ID NO: 446127 - DNA, 20 bp, Artificial
  CRISPR gRNA sequence
tgccccagagcgtaatatga

SEQ ID NO: 446128 - DNA, 20 bp, Artificial
  CRISPR gRNA sequence
tcttactaatacacaaacag

SEQ ID NO: 446129 - DNA, 20 bp, Artificial
  CRISPR gRNA sequence
cttactaatacacaaacagg

SEQ ID NO: 446130 - DNA, 20 bp, Artificial
  CRISPR gRNA sequence
ttactaatacacaaacaggg

SEQ ID NO: 446131 - DNA, 20 bp, Artificial
  CRISPR gRNA sequence
actaatacacaaacagggac

SEQ ID NO: 446132 - DNA, 20 bp, Artificial
  CRISPR gRNA sequence
ctaatacacaaacagggact

SEQ ID NO: 446133 - DNA, 20 bp, Artificial
  CRISPR gRNA sequence
atacacaaacagggactgtg

SEQ ID NO: 446134 - DNA, 20 bp, Artificial
  CRISPR gRNA sequence
tgtgtgtagagtgagcaatc

SEQ ID NO: 446135 - DNA, 20 bp, Artificial
  CRISPR gRNA sequence
agattagctcaagactaaag

SEQ ID NO: 446136 - DNA, 20 bp, Artificial
  CRISPR gRNA sequence
gctcaagactaaagggtgtt

SEQ ID NO: 446137 - DNA, 20 bp, Artificial
  CRISPR gRNA sequence
aagactaaagggtgttccta

SEQ ID NO: 446138 - DNA, 20 bp, Artificial
  CRISPR gRNA sequence
aagggtgttcctaagatata

SEQ ID NO: 446139 - DNA, 20 bp, Artificial
  CRISPR gRNA sequence
ctaagatatatgggacttct

SEQ ID NO: 446140 - DNA, 20 bp, Artificial
  CRISPR gRNA sequence
agatatatgggacttctagg

SEQ ID NO: 446141 - DNA, 20 bp, Artificial
  CRISPR gRNA sequence
ctagggctaaaactggaaca

SEQ ID NO: 446142 - DNA, 20 bp, Artificial
  CRISPR gRNA sequence
tagggctaaaactggaacag

SEQ ID NO: 446143 - DNA, 20 bp, Artificial
  CRISPR gRNA sequence
gggctaaaactggaacagtc

SEQ ID NO: 446144 - DNA, 20 bp, Artificial
  CRISPR gRNA sequence
aaactggaacagtccaagaa

SEQ ID NO: 446145 - DNA, 20 bp, Artificial
  CRISPR gRNA sequence
gaacagtccaagaaaaacat

SEQ ID NO: 446146 - DNA, 20 bp, Artificial
  CRISPR gRNA sequence
gtccccccactaactgtgga

SEQ ID NO: 446147 - DNA, 20 bp, Artificial
  CRISPR gRNA sequence
actgtggactgaagctgcca

SEQ ID NO: 446148 - DNA, 20 bp, Artificial
  CRISPR gRNA sequence
tggactgaagctgccaagtg

SEQ ID NO: 446149 - DNA, 20 bp, Artificial
  CRISPR gRNA sequence
aagctgccaagtgctttacg

SEQ ID NO: 446150 - DNA, 20 bp, Artificial
  CRISPR gRNA sequence
ccaagtgctttacgtgcatt

SEQ ID NO: 446151 - DNA, 20 bp, Artificial
  CRISPR gRNA sequence
tacgtgcattaaattctcgt

SEQ ID NO: 446152 - DNA, 20 bp, Artificial
  CRISPR gRNA sequence
acgtgcattaaattctcgta

SEQ ID NO: 446153 - DNA, 20 bp, Artificial
  CRISPR gRNA sequence
cgtgcattaaattctcgtaa

SEQ ID NO: 446154 - DNA, 20 bp, Artificial
  CRISPR gRNA sequence
aattctcgtaactaccctat

SEQ ID NO: 446155 - DNA, 20 bp, Artificial
  CRISPR gRNA sequence
tcgtaactaccctatgagat

SEQ ID NO: 446156 - DNA, 20 bp, Artificial
  CRISPR gRNA sequence
gtaactaccctatgagatag

SEQ ID NO: 446157 - DNA, 20 bp, Artificial
  CRISPR gRNA sequence
ccctatgagataggtactaa

SEQ ID NO: 446158 - DNA, 20 bp, Artificial
  CRISPR gRNA sequence
tgagataggtactaatatgt

SEQ ID NO: 446159 - DNA, 20 bp, Artificial
  CRISPR gRNA sequence
atatgtttctaatggagaat

SEQ ID NO: 446160 - DNA, 20 bp, Artificial
  CRISPR gRNA sequence
ctaatggagaatcagcatgc

SEQ ID NO: 446161 - DNA, 20 bp, Artificial
  CRISPR gRNA sequence
taatggagaatcagcatgct

SEQ ID NO: 446162 - DNA, 20 bp, Artificial
  CRISPR gRNA sequence
atggagaatcagcatgctaa

SEQ ID NO: 446163 - DNA, 20 bp, Artificial
  CRISPR gRNA sequence
aaaggttaggtcacttgcct

SEQ ID NO: 446164 - DNA, 20 bp, Artificial
  CRISPR gRNA sequence
ggtcacttgcctgcatttac

SEQ ID NO: 446165 - DNA, 20 bp, Artificial
  CRISPR gRNA sequence
gcctgcatttacacagttaa

SEQ ID NO: 446166 - DNA, 20 bp, Artificial
  CRISPR gRNA sequence
cctgcatttacacagttaat

SEQ ID NO: 446167 - DNA, 20 bp, Artificial
  CRISPR gRNA sequence
catttacacagttaattgat

SEQ ID NO: 446168 - DNA, 20 bp, Artificial
  CRISPR gRNA sequence
acacagttaattgatagata

SEQ ID NO: 446169 - DNA, 20 bp, Artificial
  CRISPR gRNA sequence
cacagttaattgatagatac

SEQ ID NO: 446170 - DNA, 20 bp, Artificial
  CRISPR gRNA sequence
attgatagatactggatttg

SEQ ID NO: 446171 - DNA, 20 bp, Artificial
  CRISPR gRNA sequence
atagatactggatttgaaac

SEQ ID NO: 446172 - DNA, 20 bp, Artificial
  CRISPR gRNA sequence
gatttgaaaccaggactgtc

SEQ ID NO: 446173 - DNA, 20 bp, Artificial
  CRISPR gRNA sequence
gaaaccaggactgtcctgct

SEQ ID NO: 446174 - DNA, 20 bp, Artificial
  CRISPR gRNA sequence
aaaccaggactgtcctgctc

SEQ ID NO: 446175 - DNA, 20 bp, Artificial
  CRISPR gRNA sequence
tcctgctcctcatctttatg

SEQ ID NO: 446176 - DNA, 20 bp, Artificial
  CRISPR gRNA sequence
ctcctcatctttatggtttc

SEQ ID NO: 446177 - DNA, 20 bp, Artificial
  CRISPR gRNA sequence
ctcatctttatggtttctgc

SEQ ID NO: 446178 - DNA, 20 bp, Artificial
  CRISPR gRNA sequence
atctttatggtttctgcgat

SEQ ID NO: 446179 - DNA, 20 bp, Artificial
  CRISPR gRNA sequence
tatggtttctgcgattatgg

SEQ ID NO: 446180 - DNA, 20 bp, Artificial
  CRISPR gRNA sequence
atggtttctgcgattatggt

SEQ ID NO: 446181 - DNA, 20 bp, Artificial
  CRISPR gRNA sequence
tggtttctgcgattatggtt

SEQ ID NO: 446182 - DNA, 20 bp, Artificial
  CRISPR gRNA sequence
ctgcgattatggttaaatgg

SEQ ID NO: 446183 - DNA, 20 bp, Artificial
  CRISPR gRNA sequence
tgcgattatggttaaatgga

SEQ ID NO: 446184 - DNA, 20 bp, Artificial
  CRISPR gRNA sequence
cgattatggttaaatggatt

SEQ ID NO: 446185 - DNA, 20 bp, Artificial
  CRISPR gRNA sequence
tggttaaatggattattcag

SEQ ID NO: 446186 - DNA, 20 bp, Artificial
  CRISPR gRNA sequence
aatggattattcagaaaaag

SEQ ID NO: 446187 - DNA, 20 bp, Artificial
  CRISPR gRNA sequence
ttcagaaaaagaaactaccc

SEQ ID NO: 446188 - DNA, 20 bp, Artificial
  CRISPR gRNA sequence
agaaaaagaaactaccccac

SEQ ID NO: 446189 - DNA, 20 bp, Artificial
  CRISPR gRNA sequence
ccccacccacacttacctgg

SEQ ID NO: 446190 - DNA, 20 bp, Artificial
  CRISPR gRNA sequence
acctgggtttattcagagat

SEQ ID NO: 446191 - DNA, 20 bp, Artificial
  CRISPR gRNA sequence
cctgggtttattcagagata

SEQ ID NO: 446192 - DNA, 20 bp, Artificial
  CRISPR gRNA sequence
ggtttattcagagatagcca

SEQ ID NO: 446193 - DNA, 20 bp, Artificial
  CRISPR gRNA sequence
attcagagatagccatggaa

SEQ ID NO: 446194 - DNA, 20 bp, Artificial
  CRISPR gRNA sequence
ttcagagatagccatggaat

SEQ ID NO: 446195 - DNA, 20 bp, Artificial
  CRISPR gRNA sequence
agagatagccatggaatttt

SEQ ID NO: 446196 - DNA, 20 bp, Artificial
  CRISPR gRNA sequence
ttgaattgatcacatgaata

SEQ ID NO: 446197 - DNA, 20 bp, Artificial
  CRISPR gRNA sequence
tgaattgatcacatgaatat

SEQ ID NO: 446198 - DNA, 20 bp, Artificial
  CRISPR gRNA sequence
gaattgatcacatgaatata

SEQ ID NO: 446199 - DNA, 20 bp, Artificial
  CRISPR gRNA sequence
aattgatcacatgaatatat

SEQ ID NO: 446200 - DNA, 20 bp, Artificial
  CRISPR gRNA sequence
atcacatgaatatatatata

SEQ ID NO: 446201 - DNA, 20 bp, Artificial
  CRISPR gRNA sequence
attattattgggacagagtc

SEQ ID NO: 446202 - DNA, 20 bp, Artificial
  CRISPR gRNA sequence
ttattattgggacagagtct

SEQ ID NO: 446203 - DNA, 20 bp, Artificial
  CRISPR gRNA sequence
ttattgggacagagtcttac

SEQ ID NO: 446204 - DNA, 20 bp, Artificial
  CRISPR gRNA sequence
ttgggacagagtcttactct

SEQ ID NO: 446205 - DNA, 20 bp, Artificial
  CRISPR gRNA sequence
ggacagagtcttactctgtc

SEQ ID NO: 446206 - DNA, 20 bp, Artificial
  CRISPR gRNA sequence
actctgtcacctgggagctg

SEQ ID NO: 446207 - DNA, 20 bp, Artificial
  CRISPR gRNA sequence
ctctgtcacctgggagctgg

SEQ ID NO: 446208 - DNA, 20 bp, Artificial
  CRISPR gRNA sequence
tgtcacctgggagctggact

SEQ ID NO: 446209 - DNA, 20 bp, Artificial
  CRISPR gRNA sequence
tcacctgggagctggactac

SEQ ID NO: 446210 - DNA, 20 bp, Artificial
  CRISPR gRNA sequence
ggagctggactacagtggtg

SEQ ID NO: 446211 - DNA, 20 bp, Artificial
  CRISPR gRNA sequence
gactacagtggtgtgatctt

SEQ ID NO: 446212 - DNA, 20 bp, Artificial
  CRISPR gRNA sequence
cagtggtgtgatcttggctc

SEQ ID NO: 446213 - DNA, 20 bp, Artificial
  CRISPR gRNA sequence
ggctcacttcaacctctgcc

SEQ ID NO: 446214 - DNA, 20 bp, Artificial
  CRISPR gRNA sequence
gctcacttcaacctctgcct

SEQ ID NO: 446215 - DNA, 20 bp, Artificial
  CRISPR gRNA sequence
acttcaacctctgcctcctg

SEQ ID NO: 446216 - DNA, 20 bp, Artificial
  CRISPR gRNA sequence
caacctctgcctcctgggtt

SEQ ID NO: 446217 - DNA, 20 bp, Artificial
  CRISPR gRNA sequence
aacctctgcctcctgggttc

SEQ ID NO: 446218 - DNA, 20 bp, Artificial
  CRISPR gRNA sequence
tgcctcctgggttcaagcaa

SEQ ID NO: 446219 - DNA, 20 bp, Artificial
  CRISPR gRNA sequence
cctcctgggttcaagcaatt

SEQ ID NO: 446220 - DNA, 20 bp, Artificial
  CRISPR gRNA sequence
ctgggttcaagcaattcttg

SEQ ID NO: 446221 - DNA, 20 bp, Artificial
  CRISPR gRNA sequence
ggttcaagcaattcttgtgc

SEQ ID NO: 446222 - DNA, 20 bp, Artificial
  CRISPR gRNA sequence
aagcaattcttgtgcctcag

SEQ ID NO: 446223 - DNA, 20 bp, Artificial
  CRISPR gRNA sequence
ttgtgcctcagcctcccaag

SEQ ID NO: 446224 - DNA, 20 bp, Artificial
  CRISPR gRNA sequence
gtgcctcagcctcccaagta

SEQ ID NO: 446225 - DNA, 20 bp, Artificial
  CRISPR gRNA sequence
tgcctcagcctcccaagtag

SEQ ID NO: 446226 - DNA, 20 bp, Artificial
  CRISPR gRNA sequence
agcctcccaagtagctgaga

SEQ ID NO: 446227 - DNA, 20 bp, Artificial
  CRISPR gRNA sequence
ccaagtagctgagattacag

SEQ ID NO: 446228 - DNA, 20 bp, Artificial
  CRISPR gRNA sequence
agattacaggcatatgccac

SEQ ID NO: 446229 - DNA, 20 bp, Artificial
  CRISPR gRNA sequence
caggcatatgccaccacacc

SEQ ID NO: 446230 - DNA, 20 bp, Artificial
  CRISPR gRNA sequence
gctagttttttttttttttt

SEQ ID NO: 446231 - DNA, 20 bp, Artificial
  CRISPR gRNA sequence
gttttttttttttttttttt

SEQ ID NO: 446232 - DNA, 20 bp, Artificial
  CRISPR gRNA sequence
tttttttttttttttttttt

SEQ ID NO: 446233 - DNA, 20 bp, Artificial
  CRISPR gRNA sequence
tttttttttttttttttttt

SEQ ID NO: 446234 - DNA, 20 bp, Artificial
  CRISPR gRNA sequence
tttttttttttttttttttt

SEQ ID NO: 446235 - DNA, 20 bp, Artificial
  CRISPR gRNA sequence
tttttttttttttttttttt

SEQ ID NO: 446236 - DNA, 20 bp, Artificial
  CRISPR gRNA sequence
tttttttttttttttttttt

SEQ ID NO: 446237 - DNA, 20 bp, Artificial
  CRISPR gRNA sequence
tttttttttttttttttttt

SEQ ID NO: 446238 - DNA, 20 bp, Artificial
  CRISPR gRNA sequence
tttttttttttttttttttt

SEQ ID NO: 446239 - DNA, 20 bp, Artificial
  CRISPR gRNA sequence
tttttttttttttttttttt

SEQ ID NO: 446240 - DNA, 20 bp, Artificial
  CRISPR gRNA sequence
tttttttttttttttttttt

SEQ ID NO: 446241 - DNA, 20 bp, Artificial
  CRISPR gRNA sequence
tttttttttttttttttttt

SEQ ID NO: 446242 - DNA, 20 bp, Artificial
  CRISPR gRNA sequence
tttttttttttttttttttt

SEQ ID NO: 446243 - DNA, 20 bp, Artificial
  CRISPR gRNA sequence
tttttttttttttttttttt

SEQ ID NO: 446244 - DNA, 20 bp, Artificial
  CRISPR gRNA sequence
tttttttttttttttttttt

SEQ ID NO: 446245 - DNA, 20 bp, Artificial
  CRISPR gRNA sequence
tttttttttttttttttttt

SEQ ID NO: 446246 - DNA, 20 bp, Artificial
  CRISPR gRNA sequence
tttttttttttttttttttt

SEQ ID NO: 446247 - DNA, 20 bp, Artificial
  CRISPR gRNA sequence
tttttttttttttttttttt

SEQ ID NO: 446248 - DNA, 20 bp, Artificial
  CRISPR gRNA sequence
tttttttttttttttttttt

SEQ ID NO: 446249 - DNA, 20 bp, Artificial
  CRISPR gRNA sequence
tttttttttttttttttttt

SEQ ID NO: 446250 - DNA, 20 bp, Artificial
  CRISPR gRNA sequence
tttttttttttttttttttg

SEQ ID NO: 446251 - DNA, 20 bp, Artificial
  CRISPR gRNA sequence
ttttttttttttttttttgg

SEQ ID NO: 446252 - DNA, 20 bp, Artificial
  CRISPR gRNA sequence
tttttttttttttttttggt

SEQ ID NO: 446253 - DNA, 20 bp, Artificial
  CRISPR gRNA sequence
ttttttttttttttttggta

SEQ ID NO: 446254 - DNA, 20 bp, Artificial
  CRISPR gRNA sequence
tttttttttttttttggtag

SEQ ID NO: 446255 - DNA, 20 bp, Artificial
  CRISPR gRNA sequence
ttttttttttttttggtaga

SEQ ID NO: 446256 - DNA, 20 bp, Artificial
  CRISPR gRNA sequence
tttttttttttttggtagag

SEQ ID NO: 446257 - DNA, 20 bp, Artificial
  CRISPR gRNA sequence
ttttttttttttggtagaga

SEQ ID NO: 446258 - DNA, 20 bp, Artificial
  CRISPR gRNA sequence
tttttttttttggtagagac

SEQ ID NO: 446259 - DNA, 20 bp, Artificial
  CRISPR gRNA sequence
ttttttttttggtagagaca

SEQ ID NO: 446260 - DNA, 20 bp, Artificial
  CRISPR gRNA sequence
tttttttttggtagagacag

SEQ ID NO: 446261 - DNA, 20 bp, Artificial
  CRISPR gRNA sequence
ttttttttggtagagacagg

SEQ ID NO: 446262 - DNA, 20 bp, Artificial
  CRISPR gRNA sequence
tttttttggtagagacaggg

SEQ ID NO: 446263 - DNA, 20 bp, Artificial
  CRISPR gRNA sequence
ttttttggtagagacagggt

SEQ ID NO: 446264 - DNA, 20 bp, Artificial
  CRISPR gRNA sequence
tttttggtagagacagggtt

SEQ ID NO: 446265 - DNA, 20 bp, Artificial
  CRISPR gRNA sequence
ttttggtagagacagggttt

SEQ ID NO: 446266 - DNA, 20 bp, Artificial
  CRISPR gRNA sequence
tttggtagagacagggtttt

SEQ ID NO: 446267 - DNA, 20 bp, Artificial
  CRISPR gRNA sequence
ttggtagagacagggttttg

SEQ ID NO: 446268 - DNA, 20 bp, Artificial
  CRISPR gRNA sequence
tggtagagacagggttttgc

SEQ ID NO: 446269 - DNA, 20 bp, Artificial
  CRISPR gRNA sequence
ggtagagacagggttttgcc

SEQ ID NO: 446270 - DNA, 20 bp, Artificial
  CRISPR gRNA sequence
gtagagacagggttttgcca

SEQ ID NO: 446271 - DNA, 20 bp, Artificial
  CRISPR gRNA sequence
tgccatgttgcccagaaaat

SEQ ID NO: 446272 - DNA, 20 bp, Artificial
  CRISPR gRNA sequence
gccatgttgcccagaaaatt

SEQ ID NO: 446273 - DNA, 20 bp, Artificial
  CRISPR gRNA sequence
ccatgttgcccagaaaattg

SEQ ID NO: 446274 - DNA, 20 bp, Artificial
  CRISPR gRNA sequence
cccagaaaattggtctcaat

SEQ ID NO: 446275 - DNA, 20 bp, Artificial
  CRISPR gRNA sequence
gtctcaatctcctgagctca

SEQ ID NO: 446276 - DNA, 20 bp, Artificial
  CRISPR gRNA sequence
aatctcctgagctcaggtga

SEQ ID NO: 446277 - DNA, 20 bp, Artificial
  CRISPR gRNA sequence
ctgagctcaggtgatcctcc

SEQ ID NO: 446278 - DNA, 20 bp, Artificial
  CRISPR gRNA sequence
agctcaggtgatcctcctac

SEQ ID NO: 446279 - DNA, 20 bp, Artificial
  CRISPR gRNA sequence
aggtgatcctcctacttcag

SEQ ID NO: 446280 - DNA, 20 bp, Artificial
  CRISPR gRNA sequence
ctacttcagcctcccaaagt

SEQ ID NO: 446281 - DNA, 20 bp, Artificial
  CRISPR gRNA sequence
cttcagcctcccaaagtgct

SEQ ID NO: 446282 - DNA, 20 bp, Artificial
  CRISPR gRNA sequence
cagcctcccaaagtgctggg

SEQ ID NO: 446283 - DNA, 20 bp, Artificial
  CRISPR gRNA sequence
agcctcccaaagtgctggga

SEQ ID NO: 446284 - DNA, 20 bp, Artificial
  CRISPR gRNA sequence
ccaaagtgctgggattacag

SEQ ID NO: 446285 - DNA, 20 bp, Artificial
  CRISPR gRNA sequence
ggattacaggcgtgatgaat

SEQ ID NO: 446286 - DNA, 20 bp, Artificial
  CRISPR gRNA sequence
caggcgtgatgaatatatac

SEQ ID NO: 446287 - DNA, 20 bp, Artificial
  CRISPR gRNA sequence
aaaaatagaggctgagcacg

SEQ ID NO: 446288 - DNA, 20 bp, Artificial
  CRISPR gRNA sequence
aaaatagaggctgagcacgg

SEQ ID NO: 446289 - DNA, 20 bp, Artificial
  CRISPR gRNA sequence
agcacggtggcttacgcctg

SEQ ID NO: 446290 - DNA, 20 bp, Artificial
  CRISPR gRNA sequence
acgcctgtaatcctagcact

SEQ ID NO: 446291 - DNA, 20 bp, Artificial
  CRISPR gRNA sequence
cgcctgtaatcctagcactt

SEQ ID NO: 446292 - DNA, 20 bp, Artificial
  CRISPR gRNA sequence
taatcctagcactttgggag

SEQ ID NO: 446293 - DNA, 20 bp, Artificial
  CRISPR gRNA sequence
gcactttgggaggccgaggt

SEQ ID NO: 446294 - DNA, 20 bp, Artificial
  CRISPR gRNA sequence
tgggaggccgaggtgagtgg

SEQ ID NO: 446295 - DNA, 20 bp, Artificial
  CRISPR gRNA sequence
gggaggccgaggtgagtgga

SEQ ID NO: 446296 - DNA, 20 bp, Artificial
  CRISPR gRNA sequence
ggaggccgaggtgagtggat

SEQ ID NO: 446297 - DNA, 20 bp, Artificial
  CRISPR gRNA sequence
aggctgggagtttgagacca

SEQ ID NO: 446298 - DNA, 20 bp, Artificial
  CRISPR gRNA sequence
ggagtttgagaccagcctga

SEQ ID NO: 446299 - DNA, 20 bp, Artificial
  CRISPR gRNA sequence
gagaccagcctgaccaacgt

SEQ ID NO: 446300 - DNA, 20 bp, Artificial
  CRISPR gRNA sequence
agaccagcctgaccaacgtg

SEQ ID NO: 446301 - DNA, 20 bp, Artificial
  CRISPR gRNA sequence
accaacgtggagaaacctca

SEQ ID NO: 446302 - DNA, 20 bp, Artificial
  CRISPR gRNA sequence
atctctactaaaaatacaaa

SEQ ID NO: 446303 - DNA, 20 bp, Artificial
  CRISPR gRNA sequence
tactaaaaatacaaaattag

SEQ ID NO: 446304 - DNA, 20 bp, Artificial
  CRISPR gRNA sequence
ctaaaaatacaaaattagcc

SEQ ID NO: 446305 - DNA, 20 bp, Artificial
  CRISPR gRNA sequence
aaaatacaaaattagccggg

SEQ ID NO: 446306 - DNA, 20 bp, Artificial
  CRISPR gRNA sequence
gccgggcatgggggcacatg

SEQ ID NO: 446307 - DNA, 20 bp, Artificial
  CRISPR gRNA sequence
taattccagctactcgggaa

SEQ ID NO: 446308 - DNA, 20 bp, Artificial
  CRISPR gRNA sequence
cagctactcgggaagctgag

SEQ ID NO: 446309 - DNA, 20 bp, Artificial
  CRISPR gRNA sequence
ctcgggaagctgaggtggga

SEQ ID NO: 446310 - DNA, 20 bp, Artificial
  CRISPR gRNA sequence
gggaagctgaggtgggagaa

SEQ ID NO: 446311 - DNA, 20 bp, Artificial
  CRISPR gRNA sequence
aggtgggagaatcacttgag

SEQ ID NO: 446312 - DNA, 20 bp, Artificial
  CRISPR gRNA sequence
gagcccaggaggcggaggtt

SEQ ID NO: 446313 - DNA, 20 bp, Artificial
  CRISPR gRNA sequence
agcccaggaggcggaggttg

SEQ ID NO: 446314 - DNA, 20 bp, Artificial
  CRISPR gRNA sequence
cagtgagctgagatcgtgcc

SEQ ID NO: 446315 - DNA, 20 bp, Artificial
  CRISPR gRNA sequence
agatcgtgccattgcactcc

SEQ ID NO: 446316 - DNA, 20 bp, Artificial
  CRISPR gRNA sequence
cactccagcctgggcaacaa

SEQ ID NO: 446317 - DNA, 20 bp, Artificial
  CRISPR gRNA sequence
cagcctgggcaacaagagtg

SEQ ID NO: 446318 - DNA, 20 bp, Artificial
  CRISPR gRNA sequence
ggcaacaagagtgaaactcc

SEQ ID NO: 446319 - DNA, 20 bp, Artificial
  CRISPR gRNA sequence
catctcaaaaaataaataaa

SEQ ID NO: 446320 - DNA, 20 bp, Artificial
  CRISPR gRNA sequence
aaaaaataaataaaataaaa

SEQ ID NO: 446321 - DNA, 20 bp, Artificial
  CRISPR gRNA sequence
gctatgttgctcaagctggt

SEQ ID NO: 446322 - DNA, 20 bp, Artificial
  CRISPR gRNA sequence
ctatgttgctcaagctggtc

SEQ ID NO: 446323 - DNA, 20 bp, Artificial
  CRISPR gRNA sequence
tgttgctcaagctggtctca

SEQ ID NO: 446324 - DNA, 20 bp, Artificial
  CRISPR gRNA sequence
ctcaagctggtctcaaactc

SEQ ID NO: 446325 - DNA, 20 bp, Artificial
  CRISPR gRNA sequence
aagctggtctcaaactcctg

SEQ ID NO: 446326 - DNA, 20 bp, Artificial
  CRISPR gRNA sequence
gtctcaaactcctgggctta

SEQ ID NO: 446327 - DNA, 20 bp, Artificial
  CRISPR gRNA sequence
aaactcctgggcttaaataa

SEQ ID NO: 446328 - DNA, 20 bp, Artificial
  CRISPR gRNA sequence
ctgggcttaaataatcctcc

SEQ ID NO: 446329 - DNA, 20 bp, Artificial
  CRISPR gRNA sequence
ggcttaaataatcctcccac

SEQ ID NO: 446330 - DNA, 20 bp, Artificial
  CRISPR gRNA sequence
aaataatcctcccacctcag

SEQ ID NO: 446331 - DNA, 20 bp, Artificial
  CRISPR gRNA sequence
aataatcctcccacctcagc

SEQ ID NO: 446332 - DNA, 20 bp, Artificial
  CRISPR gRNA sequence
ccacctcagcctcccaaaat

SEQ ID NO: 446333 - DNA, 20 bp, Artificial
  CRISPR gRNA sequence
agcctcccaaaatgttggga

SEQ ID NO: 446334 - DNA, 20 bp, Artificial
  CRISPR gRNA sequence
ccaaaatgttgggattatag

SEQ ID NO: 446335 - DNA, 20 bp, Artificial
  CRISPR gRNA sequence
ggattataggcatgagtcat

SEQ ID NO: 446336 - DNA, 20 bp, Artificial
  CRISPR gRNA sequence
taggcatgagtcattgcact

SEQ ID NO: 446337 - DNA, 20 bp, Artificial
  CRISPR gRNA sequence
cacttagcctcacttgagta

SEQ ID NO: 446338 - DNA, 20 bp, Artificial
  CRISPR gRNA sequence
agcctcacttgagtatttcc

SEQ ID NO: 446339 - DNA, 20 bp, Artificial
  CRISPR gRNA sequence
gcctcacttgagtatttcca

SEQ ID NO: 446340 - DNA, 20 bp, Artificial
  CRISPR gRNA sequence
acttgagtatttccaaaaca

SEQ ID NO: 446341 - DNA, 20 bp, Artificial
  CRISPR gRNA sequence
gagtatttccaaaacagact

SEQ ID NO: 446342 - DNA, 20 bp, Artificial
  CRISPR gRNA sequence
agtatttccaaaacagacta

SEQ ID NO: 446343 - DNA, 20 bp, Artificial
  CRISPR gRNA sequence
ccaaaacagactagggattg

SEQ ID NO: 446344 - DNA, 20 bp, Artificial
  CRISPR gRNA sequence
caaaacagactagggattgt

SEQ ID NO: 446345 - DNA, 20 bp, Artificial
  CRISPR gRNA sequence
gggattgttaaggagcactg

SEQ ID NO: 446346 - DNA, 20 bp, Artificial
  CRISPR gRNA sequence
ttaaggagcactgataacac

SEQ ID NO: 446347 - DNA, 20 bp, Artificial
  CRISPR gRNA sequence
aggagcactgataacactca

SEQ ID NO: 446348 - DNA, 20 bp, Artificial
  CRISPR gRNA sequence
ataacactcactactttttt

SEQ ID NO: 446349 - DNA, 20 bp, Artificial
  CRISPR gRNA sequence
actacttttttgacttctgc

SEQ ID NO: 446350 - DNA, 20 bp, Artificial
  CRISPR gRNA sequence
cttttttgacttctgccatg

SEQ ID NO: 446351 - DNA, 20 bp, Artificial
  CRISPR gRNA sequence
ttttgacttctgccatggct

SEQ ID NO: 446352 - DNA, 20 bp, Artificial
  CRISPR gRNA sequence
tttgacttctgccatggctc

SEQ ID NO: 446353 - DNA, 20 bp, Artificial
  CRISPR gRNA sequence
ttgacttctgccatggctca

SEQ ID NO: 446354 - DNA, 20 bp, Artificial
  CRISPR gRNA sequence
tgacttctgccatggctcaa

SEQ ID NO: 446355 - DNA, 20 bp, Artificial
  CRISPR gRNA sequence
gacttctgccatggctcaaa

SEQ ID NO: 446356 - DNA, 20 bp, Artificial
  CRISPR gRNA sequence
acttctgccatggctcaaag

SEQ ID NO: 446357 - DNA, 20 bp, Artificial
  CRISPR gRNA sequence
ctgccatggctcaaagtaaa

SEQ ID NO: 446358 - DNA, 20 bp, Artificial
  CRISPR gRNA sequence
tgccatggctcaaagtaaaa

SEQ ID NO: 446359 - DNA, 20 bp, Artificial
  CRISPR gRNA sequence
ccatggctcaaagtaaaact

SEQ ID NO: 446360 - DNA, 20 bp, Artificial
  CRISPR gRNA sequence
aaagtaaaactttgagcttt

SEQ ID NO: 446361 - DNA, 20 bp, Artificial
  CRISPR gRNA sequence
tgagctttactattatatat

SEQ ID NO: 446362 - DNA, 20 bp, Artificial
  CRISPR gRNA sequence
gagctttactattatatata

SEQ ID NO: 446363 - DNA, 20 bp, Artificial
  CRISPR gRNA sequence
agctttactattatatatat

SEQ ID NO: 446364 - DNA, 20 bp, Artificial
  CRISPR gRNA sequence
tactattatatatattagag

SEQ ID NO: 446365 - DNA, 20 bp, Artificial
  CRISPR gRNA sequence
actattatatatattagaga

SEQ ID NO: 446366 - DNA, 20 bp, Artificial
  CRISPR gRNA sequence
ctattatatatattagagac

SEQ ID NO: 446367 - DNA, 20 bp, Artificial
  CRISPR gRNA sequence
ttatatatattagagaccac

SEQ ID NO: 446368 - DNA, 20 bp, Artificial
  CRISPR gRNA sequence
tatatattagagaccacttt

SEQ ID NO: 446369 - DNA, 20 bp, Artificial
  CRISPR gRNA sequence
gagaccactttatatatata

SEQ ID NO: 446370 - DNA, 20 bp, Artificial
  CRISPR gRNA sequence
tatatatatatgtgtgtgtg

SEQ ID NO: 446371 - DNA, 20 bp, Artificial
  CRISPR gRNA sequence
atatatatatgtgtgtgtgt

SEQ ID NO: 446372 - DNA, 20 bp, Artificial
  CRISPR gRNA sequence
tatatatatgtgtgtgtgta

SEQ ID NO: 446373 - DNA, 20 bp, Artificial
  CRISPR gRNA sequence
atacatattagcacttattc

SEQ ID NO: 446374 - DNA, 20 bp, Artificial
  CRISPR gRNA sequence
tacatattagcacttattct

SEQ ID NO: 446375 - DNA, 20 bp, Artificial
  CRISPR gRNA sequence
gcacttattctagtttgtat

SEQ ID NO: 446376 - DNA, 20 bp, Artificial
  CRISPR gRNA sequence
attctagtttgtataaagag

SEQ ID NO: 446377 - DNA, 20 bp, Artificial
  CRISPR gRNA sequence
ttctagtttgtataaagagt

SEQ ID NO: 446378 - DNA, 20 bp, Artificial
  CRISPR gRNA sequence
tagtttgtataaagagtgat

SEQ ID NO: 446379 - DNA, 20 bp, Artificial
  CRISPR gRNA sequence
gtttgtataaagagtgatgg

SEQ ID NO: 446380 - DNA, 20 bp, Artificial
  CRISPR gRNA sequence
gtataaagagtgatgggatc

SEQ ID NO: 446381 - DNA, 20 bp, Artificial
  CRISPR gRNA sequence
tataaagagtgatgggatct

SEQ ID NO: 446382 - DNA, 20 bp, Artificial
  CRISPR gRNA sequence
gaggaaatctgatgctttgt

SEQ ID NO: 446383 - DNA, 20 bp, Artificial
  CRISPR gRNA sequence
atgctttgtacacacacata

SEQ ID NO: 446384 - DNA, 20 bp, Artificial
  CRISPR gRNA sequence
tgtacacacacatatatgcc

SEQ ID NO: 446385 - DNA, 20 bp, Artificial
  CRISPR gRNA sequence
gtacacacacatatatgcca

SEQ ID NO: 446386 - DNA, 20 bp, Artificial
  CRISPR gRNA sequence
tacacacacatatatgccac

SEQ ID NO: 446387 - DNA, 20 bp, Artificial
  CRISPR gRNA sequence
caaaaaaacatggctactga

SEQ ID NO: 446388 - DNA, 20 bp, Artificial
  CRISPR gRNA sequence
ctgagaagtacagataagaa

SEQ ID NO: 446389 - DNA, 20 bp, Artificial
  CRISPR gRNA sequence
agaagtacagataagaaagg

SEQ ID NO: 446390 - DNA, 20 bp, Artificial
  CRISPR gRNA sequence
tttcatttccaatcttttcc

SEQ ID NO: 446391 - DNA, 20 bp, Artificial
  CRISPR gRNA sequence
catttccaatcttttccctg

SEQ ID NO: 446392 - DNA, 20 bp, Artificial
  CRISPR gRNA sequence
atttccaatcttttccctgg

SEQ ID NO: 446393 - DNA, 20 bp, Artificial
  CRISPR gRNA sequence
ccaatcttttccctggaagt

SEQ ID NO: 446394 - DNA, 20 bp, Artificial
  CRISPR gRNA sequence
caatcttttccctggaagtt

SEQ ID NO: 446395 - DNA, 20 bp, Artificial
  CRISPR gRNA sequence
ttccctggaagttgctggag

SEQ ID NO: 446396 - DNA, 20 bp, Artificial
  CRISPR gRNA sequence
tccctggaagttgctggaga

SEQ ID NO: 446397 - DNA, 20 bp, Artificial
  CRISPR gRNA sequence
ccctggaagttgctggagaa

SEQ ID NO: 446398 - DNA, 20 bp, Artificial
  CRISPR gRNA sequence
cctggaagttgctggagaaa

SEQ ID NO: 446399 - DNA, 20 bp, Artificial
  CRISPR gRNA sequence
gaagttgctggagaaaatat

SEQ ID NO: 446400 - DNA, 20 bp, Artificial
  CRISPR gRNA sequence
ctggagaaaatattaaaatc

SEQ ID NO: 446401 - DNA, 20 bp, Artificial
  CRISPR gRNA sequence
gagaaaatattaaaatcaag

SEQ ID NO: 446402 - DNA, 20 bp, Artificial
  CRISPR gRNA sequence
aaatcaaggtgacagctttt

SEQ ID NO: 446403 - DNA, 20 bp, Artificial
  CRISPR gRNA sequence
tttaagtcatgacctcacaa

SEQ ID NO: 446404 - DNA, 20 bp, Artificial
  CRISPR gRNA sequence
ttaagtcatgacctcacaaa

SEQ ID NO: 446405 - DNA, 20 bp, Artificial
  CRISPR gRNA sequence
taagtcatgacctcacaaaa

SEQ ID NO: 446406 - DNA, 20 bp, Artificial
  CRISPR gRNA sequence
aagtcatgacctcacaaaaa

SEQ ID NO: 446407 - DNA, 20 bp, Artificial
  CRISPR gRNA sequence
agtcatgacctcacaaaaac

SEQ ID NO: 446408 - DNA, 20 bp, Artificial
  CRISPR gRNA sequence
acaaaaacaaactgacactc

SEQ ID NO: 446409 - DNA, 20 bp, Artificial
  CRISPR gRNA sequence
acactcaataatgccccaca

SEQ ID NO: 446410 - DNA, 20 bp, Artificial
  CRISPR gRNA sequence
aataatgccccacaatcttc

SEQ ID NO: 446411 - DNA, 20 bp, Artificial
  CRISPR gRNA sequence
ccatctttctagtgtactct

SEQ ID NO: 446412 - DNA, 20 bp, Artificial
  CRISPR gRNA sequence
catctttctagtgtactctc

SEQ ID NO: 446413 - DNA, 20 bp, Artificial
  CRISPR gRNA sequence
tctagtgtactctctgagat

SEQ ID NO: 446414 - DNA, 20 bp, Artificial
  CRISPR gRNA sequence
ctagtgtactctctgagatg

SEQ ID NO: 446415 - DNA, 20 bp, Artificial
  CRISPR gRNA sequence
tagtgtactctctgagatga

SEQ ID NO: 446416 - DNA, 20 bp, Artificial
  CRISPR gRNA sequence
gtgtactctctgagatgacc

SEQ ID NO: 446417 - DNA, 20 bp, Artificial
  CRISPR gRNA sequence
tctgagatgaccatccatac

SEQ ID NO: 446418 - DNA, 20 bp, Artificial
  CRISPR gRNA sequence
tgagatgaccatccatacct

SEQ ID NO: 446419 - DNA, 20 bp, Artificial
  CRISPR gRNA sequence
agatgaccatccatacctca

SEQ ID NO: 446420 - DNA, 20 bp, Artificial
  CRISPR gRNA sequence
actgctgctcaaaacttctt

SEQ ID NO: 446421 - DNA, 20 bp, Artificial
  CRISPR gRNA sequence
ctgctcaaaacttctttgcc

SEQ ID NO: 446422 - DNA, 20 bp, Artificial
  CRISPR gRNA sequence
ctcaaaacttctttgcccct

SEQ ID NO: 446423 - DNA, 20 bp, Artificial
  CRISPR gRNA sequence
aaaacttctttgcccctctc

SEQ ID NO: 446424 - DNA, 20 bp, Artificial
  CRISPR gRNA sequence
ctttgcccctctcctaactg

SEQ ID NO: 446425 - DNA, 20 bp, Artificial
  CRISPR gRNA sequence
tttgcccctctcctaactga

SEQ ID NO: 446426 - DNA, 20 bp, Artificial
  CRISPR gRNA sequence
tgcccctctcctaactgatg

SEQ ID NO: 446427 - DNA, 20 bp, Artificial
  CRISPR gRNA sequence
gcccctctcctaactgatga

SEQ ID NO: 446428 - DNA, 20 bp, Artificial
  CRISPR gRNA sequence
cccctctcctaactgatgaa

SEQ ID NO: 446429 - DNA, 20 bp, Artificial
  CRISPR gRNA sequence
tcctaactgatgaaatatga

SEQ ID NO: 446430 - DNA, 20 bp, Artificial
  CRISPR gRNA sequence
ctaactgatgaaatatgaaa

SEQ ID NO: 446431 - DNA, 20 bp, Artificial
  CRISPR gRNA sequence
actgatgaaatatgaaaggg

SEQ ID NO: 446432 - DNA, 20 bp, Artificial
  CRISPR gRNA sequence
atgaaatatgaaagggcttt

SEQ ID NO: 446433 - DNA, 20 bp, Artificial
  CRISPR gRNA sequence
tttaatctccattgcctagg

SEQ ID NO: 446434 - DNA, 20 bp, Artificial
  CRISPR gRNA sequence
ttaatctccattgcctaggc

SEQ ID NO: 446435 - DNA, 20 bp, Artificial
  CRISPR gRNA sequence
taatctccattgcctaggcc

SEQ ID NO: 446436 - DNA, 20 bp, Artificial
  CRISPR gRNA sequence
aatctccattgcctaggcca

SEQ ID NO: 446437 - DNA, 20 bp, Artificial
  CRISPR gRNA sequence
atctccattgcctaggccaa

SEQ ID NO: 446438 - DNA, 20 bp, Artificial
  CRISPR gRNA sequence
cattgcctaggccaagactt

SEQ ID NO: 446439 - DNA, 20 bp, Artificial
  CRISPR gRNA sequence
cctaggccaagacttcatcc

SEQ ID NO: 446440 - DNA, 20 bp, Artificial
  CRISPR gRNA sequence
ggccaagacttcatccttct

SEQ ID NO: 446441 - DNA, 20 bp, Artificial
  CRISPR gRNA sequence
catccttctttttatccctt

SEQ ID NO: 446442 - DNA, 20 bp, Artificial
  CRISPR gRNA sequence
atccttctttttatcccttt

SEQ ID NO: 446443 - DNA, 20 bp, Artificial
  CRISPR gRNA sequence
ctttttatccctttcttctg

SEQ ID NO: 446444 - DNA, 20 bp, Artificial
  CRISPR gRNA sequence
tttttatccctttcttctga

SEQ ID NO: 446445 - DNA, 20 bp, Artificial
  CRISPR gRNA sequence
tttatccctttcttctgagt

SEQ ID NO: 446446 - DNA, 20 bp, Artificial
  CRISPR gRNA sequence
ttatccctttcttctgagtc

SEQ ID NO: 446447 - DNA, 20 bp, Artificial
  CRISPR gRNA sequence
tatccctttcttctgagtca

SEQ ID NO: 446448 - DNA, 20 bp, Artificial
  CRISPR gRNA sequence
atccctttcttctgagtcat

SEQ ID NO: 446449 - DNA, 20 bp, Artificial
  CRISPR gRNA sequence
tccctttcttctgagtcatc

SEQ ID NO: 446450 - DNA, 20 bp, Artificial
  CRISPR gRNA sequence
tcttctgagtcatctctctc

SEQ ID NO: 446451 - DNA, 20 bp, Artificial
  CRISPR gRNA sequence
cttctgagtcatctctctcc

SEQ ID NO: 446452 - DNA, 20 bp, Artificial
  CRISPR gRNA sequence
ttctgagtcatctctctcct

SEQ ID NO: 446453 - DNA, 20 bp, Artificial
  CRISPR gRNA sequence
ctgagtcatctctctccttt

SEQ ID NO: 446454 - DNA, 20 bp, Artificial
  CRISPR gRNA sequence
tgagtcatctctctcctttt

SEQ ID NO: 446455 - DNA, 20 bp, Artificial
  CRISPR gRNA sequence
agtcatctctctccttttct

SEQ ID NO: 446456 - DNA, 20 bp, Artificial
  CRISPR gRNA sequence
tctccttttctgtttatgct

SEQ ID NO: 446457 - DNA, 20 bp, Artificial
  CRISPR gRNA sequence
tccttttctgtttatgctat

SEQ ID NO: 446458 - DNA, 20 bp, Artificial
  CRISPR gRNA sequence
cttttctgtttatgctattt

SEQ ID NO: 446459 - DNA, 20 bp, Artificial
  CRISPR gRNA sequence
ttctgtttatgctattttca

SEQ ID NO: 446460 - DNA, 20 bp, Artificial
  CRISPR gRNA sequence
tctgtttatgctattttcat

SEQ ID NO: 446461 - DNA, 20 bp, Artificial
  CRISPR gRNA sequence
ctgtttatgctattttcatt

SEQ ID NO: 446462 - DNA, 20 bp, Artificial
  CRISPR gRNA sequence
tgtttatgctattttcatta

SEQ ID NO: 446463 - DNA, 20 bp, Artificial
  CRISPR gRNA sequence
tttatgctattttcattagc

SEQ ID NO: 446464 - DNA, 20 bp, Artificial
  CRISPR gRNA sequence
atgctattttcattagcaga

SEQ ID NO: 446465 - DNA, 20 bp, Artificial
  CRISPR gRNA sequence
tgctattttcattagcagaa

SEQ ID NO: 446466 - DNA, 20 bp, Artificial
  CRISPR gRNA sequence
ttttcattagcagaatatat

SEQ ID NO: 446467 - DNA, 20 bp, Artificial
  CRISPR gRNA sequence
tcattagcagaatatatgtt

SEQ ID NO: 446468 - DNA, 20 bp, Artificial
  CRISPR gRNA sequence
cattagcagaatatatgttc

SEQ ID NO: 446469 - DNA, 20 bp, Artificial
  CRISPR gRNA sequence
attagcagaatatatgttct

SEQ ID NO: 446470 - DNA, 20 bp, Artificial
  CRISPR gRNA sequence
gcagaatatatgttctagtc

SEQ ID NO: 446471 - DNA, 20 bp, Artificial
  CRISPR gRNA sequence
tagtccatgcattcctctcc

SEQ ID NO: 446472 - DNA, 20 bp, Artificial
  CRISPR gRNA sequence
gtccatgcattcctctccag

SEQ ID NO: 446473 - DNA, 20 bp, Artificial
  CRISPR gRNA sequence
ctctccagctagtcccattt

SEQ ID NO: 446474 - DNA, 20 bp, Artificial
  CRISPR gRNA sequence
tccagctagtcccatttctc

SEQ ID NO: 446475 - DNA, 20 bp, Artificial
  CRISPR gRNA sequence
cagctagtcccatttctcaa

SEQ ID NO: 446476 - DNA, 20 bp, Artificial
  CRISPR gRNA sequence
gtcccatttctcaactcgtt

SEQ ID NO: 446477 - DNA, 20 bp, Artificial
  CRISPR gRNA sequence
ctcaactcgttctcacagcc

SEQ ID NO: 446478 - DNA, 20 bp, Artificial
  CRISPR gRNA sequence
tcaactcgttctcacagcca

SEQ ID NO: 446479 - DNA, 20 bp, Artificial
  CRISPR gRNA sequence
aactcgttctcacagccata

SEQ ID NO: 446480 - DNA, 20 bp, Artificial
  CRISPR gRNA sequence
gttctcacagccatattttt

SEQ ID NO: 446481 - DNA, 20 bp, Artificial
  CRISPR gRNA sequence
tcacagccatatttttcaaa

SEQ ID NO: 446482 - DNA, 20 bp, Artificial
  CRISPR gRNA sequence
acagccatatttttcaaagg

SEQ ID NO: 446483 - DNA, 20 bp, Artificial
  CRISPR gRNA sequence
ttcaaaggagttgtctctac

SEQ ID NO: 446484 - DNA, 20 bp, Artificial
  CRISPR gRNA sequence
tcaaaggagttgtctctact

SEQ ID NO: 446485 - DNA, 20 bp, Artificial
  CRISPR gRNA sequence
caaaggagttgtctctactt

SEQ ID NO: 446486 - DNA, 20 bp, Artificial
  CRISPR gRNA sequence
aaaggagttgtctctacttt

SEQ ID NO: 446487 - DNA, 20 bp, Artificial
  CRISPR gRNA sequence
tctctacttttcacccatct

SEQ ID NO: 446488 - DNA, 20 bp, Artificial
  CRISPR gRNA sequence
tacttttcacccatctacac

SEQ ID NO: 446489 - DNA, 20 bp, Artificial
  CRISPR gRNA sequence
cttttcacccatctacactc

SEQ ID NO: 446490 - DNA, 20 bp, Artificial
  CRISPR gRNA sequence
ttcacccatctacactcctt

SEQ ID NO: 446491 - DNA, 20 bp, Artificial
  CRISPR gRNA sequence
tcacccatctacactccttg

SEQ ID NO: 446492 - DNA, 20 bp, Artificial
  CRISPR gRNA sequence
cacccatctacactccttga

SEQ ID NO: 446493 - DNA, 20 bp, Artificial
  CRISPR gRNA sequence
acccatctacactccttgac

SEQ ID NO: 446494 - DNA, 20 bp, Artificial
  CRISPR gRNA sequence
cactccttgacccaccatca

SEQ ID NO: 446495 - DNA, 20 bp, Artificial
  CRISPR gRNA sequence
cttgacccaccatcatctag

SEQ ID NO: 446496 - DNA, 20 bp, Artificial
  CRISPR gRNA sequence
gacccaccatcatctagttt

SEQ ID NO: 446497 - DNA, 20 bp, Artificial
  CRISPR gRNA sequence
acccaccatcatctagtttc

SEQ ID NO: 446498 - DNA, 20 bp, Artificial
  CRISPR gRNA sequence
gtttctgctccaaagcacaa

SEQ ID NO: 446499 - DNA, 20 bp, Artificial
  CRISPR gRNA sequence
ctgctccaaagcacaacgga

SEQ ID NO: 446500 - DNA, 20 bp, Artificial
  CRISPR gRNA sequence
tgctccaaagcacaacggaa

SEQ ID NO: 446501 - DNA, 20 bp, Artificial
  CRISPR gRNA sequence
ctccaaagcacaacggaaat

SEQ ID NO: 446502 - DNA, 20 bp, Artificial
  CRISPR gRNA sequence
caaagcacaacggaaatggt

SEQ ID NO: 446503 - DNA, 20 bp, Artificial
  CRISPR gRNA sequence
accactgaccttcagttttc

SEQ ID NO: 446504 - DNA, 20 bp, Artificial
  CRISPR gRNA sequence
accttcagttttctaaatta

SEQ ID NO: 446505 - DNA, 20 bp, Artificial
  CRISPR gRNA sequence
cagttttctaaattaaatat

SEQ ID NO: 446506 - DNA, 20 bp, Artificial
  CRISPR gRNA sequence
agttttctaaattaaatatt

SEQ ID NO: 446507 - DNA, 20 bp, Artificial
  CRISPR gRNA sequence
tctaaattaaatattaacag

SEQ ID NO: 446508 - DNA, 20 bp, Artificial
  CRISPR gRNA sequence
ctaaattaaatattaacaga

SEQ ID NO: 446509 - DNA, 20 bp, Artificial
  CRISPR gRNA sequence
taaattaaatattaacagat

SEQ ID NO: 446510 - DNA, 20 bp, Artificial
  CRISPR gRNA sequence
aattaaatattaacagatac

SEQ ID NO: 446511 - DNA, 20 bp, Artificial
  CRISPR gRNA sequence
aatattaacagataccttta

SEQ ID NO: 446512 - DNA, 20 bp, Artificial
  CRISPR gRNA sequence
acagatacctttatcttttt

SEQ ID NO: 446513 - DNA, 20 bp, Artificial
  CRISPR gRNA sequence
tatctttttttttttttttg

SEQ ID NO: 446514 - DNA, 20 bp, Artificial
  CRISPR gRNA sequence
atctttttttttttttttga

SEQ ID NO: 446515 - DNA, 20 bp, Artificial
  CRISPR gRNA sequence
tctttttttttttttttgag

SEQ ID NO: 446516 - DNA, 20 bp, Artificial
  CRISPR gRNA sequence
tttttttttttttgagacag

SEQ ID NO: 446517 - DNA, 20 bp, Artificial
  CRISPR gRNA sequence
ttttttttttttgagacaga

SEQ ID NO: 446518 - DNA, 20 bp, Artificial
  CRISPR gRNA sequence
tttttttttttgagacagag

SEQ ID NO: 446519 - DNA, 20 bp, Artificial
  CRISPR gRNA sequence
ttttttttttgagacagagt

SEQ ID NO: 446520 - DNA, 20 bp, Artificial
  CRISPR gRNA sequence
tttttttttgagacagagtt

SEQ ID NO: 446521 - DNA, 20 bp, Artificial
  CRISPR gRNA sequence
ttttttttgagacagagttt

SEQ ID NO: 446522 - DNA, 20 bp, Artificial
  CRISPR gRNA sequence
tttttttgagacagagtttc

SEQ ID NO: 446523 - DNA, 20 bp, Artificial
  CRISPR gRNA sequence
ttttttgagacagagtttca

SEQ ID NO: 446524 - DNA, 20 bp, Artificial
  CRISPR gRNA sequence
tttttgagacagagtttcac

SEQ ID NO: 446525 - DNA, 20 bp, Artificial
  CRISPR gRNA sequence
ttttgagacagagtttcact

SEQ ID NO: 446526 - DNA, 20 bp, Artificial
  CRISPR gRNA sequence
tttgagacagagtttcactc

SEQ ID NO: 446527 - DNA, 20 bp, Artificial
  CRISPR gRNA sequence
ttgagacagagtttcactct

SEQ ID NO: 446528 - DNA, 20 bp, Artificial
  CRISPR gRNA sequence
tgagacagagtttcactctt

SEQ ID NO: 446529 - DNA, 20 bp, Artificial
  CRISPR gRNA sequence
gagacagagtttcactcttg

SEQ ID NO: 446530 - DNA, 20 bp, Artificial
  CRISPR gRNA sequence
agacagagtttcactcttgt

SEQ ID NO: 446531 - DNA, 20 bp, Artificial
  CRISPR gRNA sequence
cactcttgttgcttaggctg

SEQ ID NO: 446532 - DNA, 20 bp, Artificial
  CRISPR gRNA sequence
actcttgttgcttaggctgg

SEQ ID NO: 446533 - DNA, 20 bp, Artificial
  CRISPR gRNA sequence
ttgttgcttaggctggagtg

SEQ ID NO: 446534 - DNA, 20 bp, Artificial
  CRISPR gRNA sequence
gttgcttaggctggagtgca

SEQ ID NO: 446535 - DNA, 20 bp, Artificial
  CRISPR gRNA sequence
ttgcttaggctggagtgcaa

SEQ ID NO: 446536 - DNA, 20 bp, Artificial
  CRISPR gRNA sequence
cttaggctggagtgcaatgg

SEQ ID NO: 446537 - DNA, 20 bp, Artificial
  CRISPR gRNA sequence
aggctggagtgcaatggtgc

SEQ ID NO: 446538 - DNA, 20 bp, Artificial
  CRISPR gRNA sequence
ggctggagtgcaatggtgca

SEQ ID NO: 446539 - DNA, 20 bp, Artificial
  CRISPR gRNA sequence
gagtgcaatggtgcaatctt

SEQ ID NO: 446540 - DNA, 20 bp, Artificial
  CRISPR gRNA sequence
ggctcactgcaacctctgcc

SEQ ID NO: 446541 - DNA, 20 bp, Artificial
  CRISPR gRNA sequence
gctcactgcaacctctgcct

SEQ ID NO: 446542 - DNA, 20 bp, Artificial
  CRISPR gRNA sequence
actgcaacctctgcctcccc

SEQ ID NO: 446543 - DNA, 20 bp, Artificial
  CRISPR gRNA sequence
caacctctgcctccccgggt

SEQ ID NO: 446544 - DNA, 20 bp, Artificial
  CRISPR gRNA sequence
tgcctccccgggttcaagtg

SEQ ID NO: 446545 - DNA, 20 bp, Artificial
  CRISPR gRNA sequence
cctccccgggttcaagtgat

SEQ ID NO: 446546 - DNA, 20 bp, Artificial
  CRISPR gRNA sequence
cccgggttcaagtgattctc

SEQ ID NO: 446547 - DNA, 20 bp, Artificial
  CRISPR gRNA sequence
aagtgattctcccccctcag

SEQ ID NO: 446548 - DNA, 20 bp, Artificial
  CRISPR gRNA sequence
tcccccctcagcctcctgag

SEQ ID NO: 446549 - DNA, 20 bp, Artificial
  CRISPR gRNA sequence
ccccctcagcctcctgagta

SEQ ID NO: 446550 - DNA, 20 bp, Artificial
  CRISPR gRNA sequence
agcctcctgagtagctggga

SEQ ID NO: 446551 - DNA, 20 bp, Artificial
  CRISPR gRNA sequence
ctgagtagctgggatttcat

SEQ ID NO: 446552 - DNA, 20 bp, Artificial
  CRISPR gRNA sequence
agtagctgggatttcatgca

SEQ ID NO: 446553 - DNA, 20 bp, Artificial
  CRISPR gRNA sequence
ggatttcatgcatgtgccgc

SEQ ID NO: 446554 - DNA, 20 bp, Artificial
  CRISPR gRNA sequence
catgcatgtgccgccatgcc

SEQ ID NO: 446555 - DNA, 20 bp, Artificial
  CRISPR gRNA sequence
atgcatgtgccgccatgcct

SEQ ID NO: 446556 - DNA, 20 bp, Artificial
  CRISPR gRNA sequence
gctaattttgtatttttagt

SEQ ID NO: 446557 - DNA, 20 bp, Artificial
  CRISPR gRNA sequence
attttgtatttttagtagag

SEQ ID NO: 446558 - DNA, 20 bp, Artificial
  CRISPR gRNA sequence
tgtatttttagtagagacgg

SEQ ID NO: 446559 - DNA, 20 bp, Artificial
  CRISPR gRNA sequence
gtatttttagtagagacggg

SEQ ID NO: 446560 - DNA, 20 bp, Artificial
  CRISPR gRNA sequence
tatttttagtagagacgggg

SEQ ID NO: 446561 - DNA, 20 bp, Artificial
  CRISPR gRNA sequence
ttagtagagacgggggtttc

SEQ ID NO: 446562 - DNA, 20 bp, Artificial
  CRISPR gRNA sequence
tagtagagacgggggtttca

SEQ ID NO: 446563 - DNA, 20 bp, Artificial
  CRISPR gRNA sequence
agtagagacgggggtttcac

SEQ ID NO: 446564 - DNA, 20 bp, Artificial
  CRISPR gRNA sequence
gtagagacgggggtttcacc

SEQ ID NO: 446565 - DNA, 20 bp, Artificial
  CRISPR gRNA sequence
caccatgttggccaggctgg

SEQ ID NO: 446566 - DNA, 20 bp, Artificial
  CRISPR gRNA sequence
accatgttggccaggctggt

SEQ ID NO: 446567 - DNA, 20 bp, Artificial
  CRISPR gRNA sequence
gccaggctggtctcaaactc

SEQ ID NO: 446568 - DNA, 20 bp, Artificial
  CRISPR gRNA sequence
gtctcaaactcttgacctca

SEQ ID NO: 446569 - DNA, 20 bp, Artificial
  CRISPR gRNA sequence
aaactcttgacctcagatga

SEQ ID NO: 446570 - DNA, 20 bp, Artificial
  CRISPR gRNA sequence
ttgacctcagatgatctgcc

SEQ ID NO: 446571 - DNA, 20 bp, Artificial
  CRISPR gRNA sequence
gacctcagatgatctgcccg

SEQ ID NO: 446572 - DNA, 20 bp, Artificial
  CRISPR gRNA sequence
acctcagatgatctgcccgc

SEQ ID NO: 446573 - DNA, 20 bp, Artificial
  CRISPR gRNA sequence
agatgatctgcccgccttgg

SEQ ID NO: 446574 - DNA, 20 bp, Artificial
  CRISPR gRNA sequence
cccgccttggcctcccaaag

SEQ ID NO: 446575 - DNA, 20 bp, Artificial
  CRISPR gRNA sequence
ggcctcccaaagtgctggga

SEQ ID NO: 446576 - DNA, 20 bp, Artificial
  CRISPR gRNA sequence
gcctcccaaagtgctgggat

SEQ ID NO: 446577 - DNA, 20 bp, Artificial
  CRISPR gRNA sequence
ccaaagtgctgggattatag

SEQ ID NO: 446578 - DNA, 20 bp, Artificial
  CRISPR gRNA sequence
ggattataggcgtgagccac

SEQ ID NO: 446579 - DNA, 20 bp, Artificial
  CRISPR gRNA sequence
taggcgtgagccaccgttcc

SEQ ID NO: 446580 - DNA, 20 bp, Artificial
  CRISPR gRNA sequence
ccagcctgatacctttatct

SEQ ID NO: 446581 - DNA, 20 bp, Artificial
  CRISPR gRNA sequence
atacctttatctttattata

SEQ ID NO: 446582 - DNA, 20 bp, Artificial
  CRISPR gRNA sequence
tatctttattatagtcaacc

SEQ ID NO: 446583 - DNA, 20 bp, Artificial
  CRISPR gRNA sequence
atctttattatagtcaacct

SEQ ID NO: 446584 - DNA, 20 bp, Artificial
  CRISPR gRNA sequence
tctttattatagtcaacctt

SEQ ID NO: 446585 - DNA, 20 bp, Artificial
  CRISPR gRNA sequence
tattatagtcaaccttttaa

SEQ ID NO: 446586 - DNA, 20 bp, Artificial
  CRISPR gRNA sequence
attatagtcaaccttttaaa

SEQ ID NO: 446587 - DNA, 20 bp, Artificial
  CRISPR gRNA sequence
ttatagtcaaccttttaaat

SEQ ID NO: 446588 - DNA, 20 bp, Artificial
  CRISPR gRNA sequence
tagtcaaccttttaaattga

SEQ ID NO: 446589 - DNA, 20 bp, Artificial
  CRISPR gRNA sequence
ttaaattgatcactcattct

SEQ ID NO: 446590 - DNA, 20 bp, Artificial
  CRISPR gRNA sequence
taaattgatcactcattcta

SEQ ID NO: 446591 - DNA, 20 bp, Artificial
  CRISPR gRNA sequence
aaattgatcactcattctag

SEQ ID NO: 446592 - DNA, 20 bp, Artificial
  CRISPR gRNA sequence
aattgatcactcattctaga

SEQ ID NO: 446593 - DNA, 20 bp, Artificial
  CRISPR gRNA sequence
atcactcattctagaaagtc

SEQ ID NO: 446594 - DNA, 20 bp, Artificial
  CRISPR gRNA sequence
attctagaaagtcctccttc

SEQ ID NO: 446595 - DNA, 20 bp, Artificial
  CRISPR gRNA sequence
tagaaagtcctccttctctt

SEQ ID NO: 446596 - DNA, 20 bp, Artificial
  CRISPR gRNA sequence
gaaagtcctccttctcttgg

SEQ ID NO: 446597 - DNA, 20 bp, Artificial
  CRISPR gRNA sequence
cttctcttggcttctgaaat

SEQ ID NO: 446598 - DNA, 20 bp, Artificial
  CRISPR gRNA sequence
ctcttggcttctgaaatgac

SEQ ID NO: 446599 - DNA, 20 bp, Artificial
  CRISPR gRNA sequence
tcttggcttctgaaatgaca

SEQ ID NO: 446600 - DNA, 20 bp, Artificial
  CRISPR gRNA sequence
ttggcttctgaaatgacatt

SEQ ID NO: 446601 - DNA, 20 bp, Artificial
  CRISPR gRNA sequence
ggcttctgaaatgacattct

SEQ ID NO: 446602 - DNA, 20 bp, Artificial
  CRISPR gRNA sequence
gcttctgaaatgacattctt

SEQ ID NO: 446603 - DNA, 20 bp, Artificial
  CRISPR gRNA sequence
ctgaaatgacattcttctct

SEQ ID NO: 446604 - DNA, 20 bp, Artificial
  CRISPR gRNA sequence
tgaaatgacattcttctctt

SEQ ID NO: 446605 - DNA, 20 bp, Artificial
  CRISPR gRNA sequence
aaatgacattcttctctttg

SEQ ID NO: 446606 - DNA, 20 bp, Artificial
  CRISPR gRNA sequence
ttctctttgatccattgctt

SEQ ID NO: 446607 - DNA, 20 bp, Artificial
  CRISPR gRNA sequence
ctctttgatccattgctttt

SEQ ID NO: 446608 - DNA, 20 bp, Artificial
  CRISPR gRNA sequence
tctttgatccattgcttttc

SEQ ID NO: 446609 - DNA, 20 bp, Artificial
  CRISPR gRNA sequence
tttgatccattgcttttcag

SEQ ID NO: 446610 - DNA, 20 bp, Artificial
  CRISPR gRNA sequence
tgatccattgcttttcagat

SEQ ID NO: 446611 - DNA, 20 bp, Artificial
  CRISPR gRNA sequence
gatccattgcttttcagatc

SEQ ID NO: 446612 - DNA, 20 bp, Artificial
  CRISPR gRNA sequence
atccattgcttttcagatct

SEQ ID NO: 446613 - DNA, 20 bp, Artificial
  CRISPR gRNA sequence
cttttcagatcttcttctgc

SEQ ID NO: 446614 - DNA, 20 bp, Artificial
  CRISPR gRNA sequence
ttcagatcttcttctgcctg

SEQ ID NO: 446615 - DNA, 20 bp, Artificial
  CRISPR gRNA sequence
tcagatcttcttctgcctga

SEQ ID NO: 446616 - DNA, 20 bp, Artificial
  CRISPR gRNA sequence
cagatcttcttctgcctgat

SEQ ID NO: 446617 - DNA, 20 bp, Artificial
  CRISPR gRNA sequence
agatcttcttctgcctgatc

SEQ ID NO: 446618 - DNA, 20 bp, Artificial
  CRISPR gRNA sequence
cttctgcctgatccttagat

SEQ ID NO: 446619 - DNA, 20 bp, Artificial
  CRISPR gRNA sequence
ttctgcctgatccttagatg

SEQ ID NO: 446620 - DNA, 20 bp, Artificial
  CRISPR gRNA sequence
ctgcctgatccttagatgtt

SEQ ID NO: 446621 - DNA, 20 bp, Artificial
  CRISPR gRNA sequence
tgcctgatccttagatgttg

SEQ ID NO: 446622 - DNA, 20 bp, Artificial
  CRISPR gRNA sequence
cctgatccttagatgttgag

SEQ ID NO: 446623 - DNA, 20 bp, Artificial
  CRISPR gRNA sequence
atccttagatgttgagattc

SEQ ID NO: 446624 - DNA, 20 bp, Artificial
  CRISPR gRNA sequence
agatgttgagattccttagg

SEQ ID NO: 446625 - DNA, 20 bp, Artificial
  CRISPR gRNA sequence
gatgttgagattccttaggg

SEQ ID NO: 446626 - DNA, 20 bp, Artificial
  CRISPR gRNA sequence
agattccttagggctgggta

SEQ ID NO: 446627 - DNA, 20 bp, Artificial
  CRISPR gRNA sequence
cttagggctgggtatggtgg

SEQ ID NO: 446628 - DNA, 20 bp, Artificial
  CRISPR gRNA sequence
agggctgggtatggtggtgc

SEQ ID NO: 446629 - DNA, 20 bp, Artificial
  CRISPR gRNA sequence
gggctgggtatggtggtgca

SEQ ID NO: 446630 - DNA, 20 bp, Artificial
  CRISPR gRNA sequence
ggtatggtggtgcacgccta

SEQ ID NO: 446631 - DNA, 20 bp, Artificial
  CRISPR gRNA sequence
tcgtcccagctactcaggag

SEQ ID NO: 446632 - DNA, 20 bp, Artificial
  CRISPR gRNA sequence
ctcaggagaatgaagcagga

SEQ ID NO: 446633 - DNA, 20 bp, Artificial
  CRISPR gRNA sequence
aggagaatgaagcaggaaga

SEQ ID NO: 446634 - DNA, 20 bp, Artificial
  CRISPR gRNA sequence
gagcccaggagtttgaggct

SEQ ID NO: 446635 - DNA, 20 bp, Artificial
  CRISPR gRNA sequence
agcccaggagtttgaggcta

SEQ ID NO: 446636 - DNA, 20 bp, Artificial
  CRISPR gRNA sequence
gaggctatgaactatgatct

SEQ ID NO: 446637 - DNA, 20 bp, Artificial
  CRISPR gRNA sequence
aggctatgaactatgatctt

SEQ ID NO: 446638 - DNA, 20 bp, Artificial
  CRISPR gRNA sequence
tgaactatgatcttgctgct

SEQ ID NO: 446639 - DNA, 20 bp, Artificial
  CRISPR gRNA sequence
tgatcttgctgctgcattct

SEQ ID NO: 446640 - DNA, 20 bp, Artificial
  CRISPR gRNA sequence
gctgctgcattctagcctgg

SEQ ID NO: 446641 - DNA, 20 bp, Artificial
  CRISPR gRNA sequence
ctgctgcattctagcctggg

SEQ ID NO: 446642 - DNA, 20 bp, Artificial
  CRISPR gRNA sequence
ctgcattctagcctgggtga

SEQ ID NO: 446643 - DNA, 20 bp, Artificial
  CRISPR gRNA sequence
cattctagcctgggtgacac

SEQ ID NO: 446644 - DNA, 20 bp, Artificial
  CRISPR gRNA sequence
tagcctgggtgacacagcac

SEQ ID NO: 446645 - DNA, 20 bp, Artificial
  CRISPR gRNA sequence
gcctgggtgacacagcacag

SEQ ID NO: 446646 - DNA, 20 bp, Artificial
  CRISPR gRNA sequence
ggtgacacagcacagggaga

SEQ ID NO: 446647 - DNA, 20 bp, Artificial
  CRISPR gRNA sequence
tctcagagaaaaacaacaac

SEQ ID NO: 446648 - DNA, 20 bp, Artificial
  CRISPR gRNA sequence
agagaaaaacaacaacagaa

SEQ ID NO: 446649 - DNA, 20 bp, Artificial
  CRISPR gRNA sequence
ctgcagtcttcctccaacat

SEQ ID NO: 446650 - DNA, 20 bp, Artificial
  CRISPR gRNA sequence
cagtcttcctccaacataca

SEQ ID NO: 446651 - DNA, 20 bp, Artificial
  CRISPR gRNA sequence
cctccaacatacatctaaag

SEQ ID NO: 446652 - DNA, 20 bp, Artificial
  CRISPR gRNA sequence
ctccaacatacatctaaagt

SEQ ID NO: 446653 - DNA, 20 bp, Artificial
  CRISPR gRNA sequence
caacatacatctaaagtgtt

SEQ ID NO: 446654 - DNA, 20 bp, Artificial
  CRISPR gRNA sequence
aagtgttttcattattctgc

SEQ ID NO: 446655 - DNA, 20 bp, Artificial
  CRISPR gRNA sequence
tcattattctgcatctcttt

SEQ ID NO: 446656 - DNA, 20 bp, Artificial
  CRISPR gRNA sequence
cattattctgcatctctttt

SEQ ID NO: 446657 - DNA, 20 bp, Artificial
  CRISPR gRNA sequence
attattctgcatctcttttg

SEQ ID NO: 446658 - DNA, 20 bp, Artificial
  CRISPR gRNA sequence
ttctgcatctcttttggcca

SEQ ID NO: 446659 - DNA, 20 bp, Artificial
  CRISPR gRNA sequence
tgcatctcttttggccattc

SEQ ID NO: 446660 - DNA, 20 bp, Artificial
  CRISPR gRNA sequence
catctcttttggccattcct

SEQ ID NO: 446661 - DNA, 20 bp, Artificial
  CRISPR gRNA sequence
ttttggccattccttactcc

SEQ ID NO: 446662 - DNA, 20 bp, Artificial
  CRISPR gRNA sequence
ttggccattccttactccaa

SEQ ID NO: 446663 - DNA, 20 bp, Artificial
  CRISPR gRNA sequence
tggccattccttactccaag

SEQ ID NO: 446664 - DNA, 20 bp, Artificial
  CRISPR gRNA sequence
ggccattccttactccaaga

SEQ ID NO: 446665 - DNA, 20 bp, Artificial
  CRISPR gRNA sequence
gccattccttactccaagac

SEQ ID NO: 446666 - DNA, 20 bp, Artificial
  CRISPR gRNA sequence
cttactccaagacaccatta

SEQ ID NO: 446667 - DNA, 20 bp, Artificial
  CRISPR gRNA sequence
actccaagacaccattattt

SEQ ID NO: 446668 - DNA, 20 bp, Artificial
  CRISPR gRNA sequence
ctccaagacaccattatttc

SEQ ID NO: 446669 - DNA, 20 bp, Artificial
  CRISPR gRNA sequence
caagacaccattatttctac

SEQ ID NO: 446670 - DNA, 20 bp, Artificial
  CRISPR gRNA sequence
tttctacttaatttatcttc

SEQ ID NO: 446671 - DNA, 20 bp, Artificial
  CRISPR gRNA sequence
ctacttaatttatcttctca

SEQ ID NO: 446672 - DNA, 20 bp, Artificial
  CRISPR gRNA sequence
tacttaatttatcttctcat

SEQ ID NO: 446673 - DNA, 20 bp, Artificial
  CRISPR gRNA sequence
cttaatttatcttctcattt

SEQ ID NO: 446674 - DNA, 20 bp, Artificial
  CRISPR gRNA sequence
aatttatcttctcatttctt

SEQ ID NO: 446675 - DNA, 20 bp, Artificial
  CRISPR gRNA sequence
atttatcttctcatttcttt

SEQ ID NO: 446676 - DNA, 20 bp, Artificial
  CRISPR gRNA sequence
atcttctcatttctttattc

SEQ ID NO: 446677 - DNA, 20 bp, Artificial
  CRISPR gRNA sequence
tcttctcatttctttattcc

SEQ ID NO: 446678 - DNA, 20 bp, Artificial
  CRISPR gRNA sequence
ctcatttctttattcctcct

SEQ ID NO: 446679 - DNA, 20 bp, Artificial
  CRISPR gRNA sequence
tcatttctttattcctcctt

SEQ ID NO: 446680 - DNA, 20 bp, Artificial
  CRISPR gRNA sequence
atttctttattcctccttcg

SEQ ID NO: 446681 - DNA, 20 bp, Artificial
  CRISPR gRNA sequence
ctttattcctccttcgaatc

SEQ ID NO: 446682 - DNA, 20 bp, Artificial
  CRISPR gRNA sequence
tttattcctccttcgaatcc

SEQ ID NO: 446683 - DNA, 20 bp, Artificial
  CRISPR gRNA sequence
tattcctccttcgaatccaa

SEQ ID NO: 446684 - DNA, 20 bp, Artificial
  CRISPR gRNA sequence
attcctccttcgaatccaat

SEQ ID NO: 446685 - DNA, 20 bp, Artificial
  CRISPR gRNA sequence
ttcctccttcgaatccaata

SEQ ID NO: 446686 - DNA, 20 bp, Artificial
  CRISPR gRNA sequence
ctccttcgaatccaatatta

SEQ ID NO: 446687 - DNA, 20 bp, Artificial
  CRISPR gRNA sequence
cttcgaatccaatattaaaa

SEQ ID NO: 446688 - DNA, 20 bp, Artificial
  CRISPR gRNA sequence
cgaatccaatattaaaaccc

SEQ ID NO: 446689 - DNA, 20 bp, Artificial
  CRISPR gRNA sequence
gaatccaatattaaaaccca

SEQ ID NO: 446690 - DNA, 20 bp, Artificial
  CRISPR gRNA sequence
aaacccaaatcaatgtctga

SEQ ID NO: 446691 - DNA, 20 bp, Artificial
  CRISPR gRNA sequence
agcacaatggctcatgccta

SEQ ID NO: 446692 - DNA, 20 bp, Artificial
  CRISPR gRNA sequence
atgcctataatcctaacact

SEQ ID NO: 446693 - DNA, 20 bp, Artificial
  CRISPR gRNA sequence
taatcctaacacttcgggag

SEQ ID NO: 446694 - DNA, 20 bp, Artificial
  CRISPR gRNA sequence
acacttcgggaggccaagac

SEQ ID NO: 446695 - DNA, 20 bp, Artificial
  CRISPR gRNA sequence
cgggaggccaagacaggaga

SEQ ID NO: 446696 - DNA, 20 bp, Artificial
  CRISPR gRNA sequence
gggaggccaagacaggagag

SEQ ID NO: 446697 - DNA, 20 bp, Artificial
  CRISPR gRNA sequence
gaggccaggagtttgagact

SEQ ID NO: 446698 - DNA, 20 bp, Artificial
  CRISPR gRNA sequence
aggccaggagtttgagacta

SEQ ID NO: 446699 - DNA, 20 bp, Artificial
  CRISPR gRNA sequence
gagactagcctgggcaacat

SEQ ID NO: 446700 - DNA, 20 bp, Artificial
  CRISPR gRNA sequence
agactagcctgggcaacata

SEQ ID NO: 446701 - DNA, 20 bp, Artificial
  CRISPR gRNA sequence
gcctgggcaacatattgaga

SEQ ID NO: 446702 - DNA, 20 bp, Artificial
  CRISPR gRNA sequence
ggcaacatattgagattcac

SEQ ID NO: 446703 - DNA, 20 bp, Artificial
  CRISPR gRNA sequence
agattcacccaggctggagt

SEQ ID NO: 446704 - DNA, 20 bp, Artificial
  CRISPR gRNA sequence
acccaggctggagtgcagtg

SEQ ID NO: 446705 - DNA, 20 bp, Artificial
  CRISPR gRNA sequence
gagtgcagtggtgtgatcat

SEQ ID NO: 446706 - DNA, 20 bp, Artificial
  CRISPR gRNA sequence
actgcaacctctacctcccg

SEQ ID NO: 446707 - DNA, 20 bp, Artificial
  CRISPR gRNA sequence
caacctctacctcccgagtt

SEQ ID NO: 446708 - DNA, 20 bp, Artificial
  CRISPR gRNA sequence
tacctcccgagttcaagcaa

SEQ ID NO: 446709 - DNA, 20 bp, Artificial
  CRISPR gRNA sequence
cctcccgagttcaagcaact

SEQ ID NO: 446710 - DNA, 20 bp, Artificial
  CRISPR gRNA sequence
ccgagttcaagcaactctcc

SEQ ID NO: 446711 - DNA, 20 bp, Artificial
  CRISPR gRNA sequence
aagcaactctcctgcctcag

SEQ ID NO: 446712 - DNA, 20 bp, Artificial
  CRISPR gRNA sequence
tcctgcctcagcctccaagt

SEQ ID NO: 446713 - DNA, 20 bp, Artificial
  CRISPR gRNA sequence
ctgcctcagcctccaagtag

SEQ ID NO: 446714 - DNA, 20 bp, Artificial
  CRISPR gRNA sequence
cctcagcctccaagtagcta

SEQ ID NO: 446715 - DNA, 20 bp, Artificial
  CRISPR gRNA sequence
agcctccaagtagctaggac

SEQ ID NO: 446716 - DNA, 20 bp, Artificial
  CRISPR gRNA sequence
caagtagctaggaccacggg

SEQ ID NO: 446717 - DNA, 20 bp, Artificial
  CRISPR gRNA sequence
ggaccacgggcatgtgccag

SEQ ID NO: 446718 - DNA, 20 bp, Artificial
  CRISPR gRNA sequence
gctagtttttgtatttttag

SEQ ID NO: 446719 - DNA, 20 bp, Artificial
  CRISPR gRNA sequence
gtttttgtatttttagtaga

SEQ ID NO: 446720 - DNA, 20 bp, Artificial
  CRISPR gRNA sequence
ttgtatttttagtagagatg

SEQ ID NO: 446721 - DNA, 20 bp, Artificial
  CRISPR gRNA sequence
tgtatttttagtagagatga

SEQ ID NO: 446722 - DNA, 20 bp, Artificial
  CRISPR gRNA sequence
gtatttttagtagagatgag

SEQ ID NO: 446723 - DNA, 20 bp, Artificial
  CRISPR gRNA sequence
tatttttagtagagatgagg

SEQ ID NO: 446724 - DNA, 20 bp, Artificial
  CRISPR gRNA sequence
ttagtagagatgaggtttta

SEQ ID NO: 446725 - DNA, 20 bp, Artificial
  CRISPR gRNA sequence
tagtagagatgaggttttac

SEQ ID NO: 446726 - DNA, 20 bp, Artificial
  CRISPR gRNA sequence
agtagagatgaggttttacc

SEQ ID NO: 446727 - DNA, 20 bp, Artificial
  CRISPR gRNA sequence
gtagagatgaggttttacca

SEQ ID NO: 446728 - DNA, 20 bp, Artificial
  CRISPR gRNA sequence
taccatgttgcccaggctgg

SEQ ID NO: 446729 - DNA, 20 bp, Artificial
  CRISPR gRNA sequence
accatgttgcccaggctggt

SEQ ID NO: 446730 - DNA, 20 bp, Artificial
  CRISPR gRNA sequence
ccatgttgcccaggctggtc

SEQ ID NO: 446731 - DNA, 20 bp, Artificial
  CRISPR gRNA sequence
cccaggctggtctcgaactc

SEQ ID NO: 446732 - DNA, 20 bp, Artificial
  CRISPR gRNA sequence
gtctcgaactcccaagctca

SEQ ID NO: 446733 - DNA, 20 bp, Artificial
  CRISPR gRNA sequence
gaactcccaagctcaagaaa

SEQ ID NO: 446734 - DNA, 20 bp, Artificial
  CRISPR gRNA sequence
ccaagctcaagaaatccacc

SEQ ID NO: 446735 - DNA, 20 bp, Artificial
  CRISPR gRNA sequence
aagaaatccacctgccttgc

SEQ ID NO: 446736 - DNA, 20 bp, Artificial
  CRISPR gRNA sequence
ccttgcctcccaaagtgcta

SEQ ID NO: 446737 - DNA, 20 bp, Artificial
  CRISPR gRNA sequence
gcctcccaaagtgctaggat

SEQ ID NO: 446738 - DNA, 20 bp, Artificial
  CRISPR gRNA sequence
cctcccaaagtgctaggatt

SEQ ID NO: 446739 - DNA, 20 bp, Artificial
  CRISPR gRNA sequence
ccaaagtgctaggattacag

SEQ ID NO: 446740 - DNA, 20 bp, Artificial
  CRISPR gRNA sequence
ggattacaggcgtgagccac

SEQ ID NO: 446741 - DNA, 20 bp, Artificial
  CRISPR gRNA sequence
caggcgtgagccactgcatc

SEQ ID NO: 446742 - DNA, 20 bp, Artificial
  CRISPR gRNA sequence
catccagcccaaaaacatta

SEQ ID NO: 446743 - DNA, 20 bp, Artificial
  CRISPR gRNA sequence
aaaaaaattatccagctgtg

SEQ ID NO: 446744 - DNA, 20 bp, Artificial
  CRISPR gRNA sequence
tccagctgtggtagtgtgca

SEQ ID NO: 446745 - DNA, 20 bp, Artificial
  CRISPR gRNA sequence
tggtagtgtgcacctatagt

SEQ ID NO: 446746 - DNA, 20 bp, Artificial
  CRISPR gRNA sequence
tagttctagctactcagaag

SEQ ID NO: 446747 - DNA, 20 bp, Artificial
  CRISPR gRNA sequence
tagctactcagaagctgaga

SEQ ID NO: 446748 - DNA, 20 bp, Artificial
  CRISPR gRNA sequence
gctactcagaagctgagatg

SEQ ID NO: 446749 - DNA, 20 bp, Artificial
  CRISPR gRNA sequence
ctcagaagctgagatgggta

SEQ ID NO: 446750 - DNA, 20 bp, Artificial
  CRISPR gRNA sequence
agaagctgagatgggtagat

SEQ ID NO: 446751 - DNA, 20 bp, Artificial
  CRISPR gRNA sequence
agatgggtagatcccttgag

SEQ ID NO: 446752 - DNA, 20 bp, Artificial
  CRISPR gRNA sequence
gagcccaggagttcaaagtt

SEQ ID NO: 446753 - DNA, 20 bp, Artificial
  CRISPR gRNA sequence
agcccaggagttcaaagttg

SEQ ID NO: 446754 - DNA, 20 bp, Artificial
  CRISPR gRNA sequence
aaagttgcaatcagatatga

SEQ ID NO: 446755 - DNA, 20 bp, Artificial
  CRISPR gRNA sequence
caatcagatatgatcttact

SEQ ID NO: 446756 - DNA, 20 bp, Artificial
  CRISPR gRNA sequence
actactgcattccagcctgg

SEQ ID NO: 446757 - DNA, 20 bp, Artificial
  CRISPR gRNA sequence
ctactgcattccagcctggc

SEQ ID NO: 446758 - DNA, 20 bp, Artificial
  CRISPR gRNA sequence
ctgcattccagcctggccaa

SEQ ID NO: 446759 - DNA, 20 bp, Artificial
  CRISPR gRNA sequence
cattccagcctggccaacag

SEQ ID NO: 446760 - DNA, 20 bp, Artificial
  CRISPR gRNA sequence
cagcctggccaacagagcaa

SEQ ID NO: 446761 - DNA, 20 bp, Artificial
  CRISPR gRNA sequence
gccaacagagcaagaccctg

SEQ ID NO: 446762 - DNA, 20 bp, Artificial
  CRISPR gRNA sequence
tctcaaaaaaaaaaaaaaaa

SEQ ID NO: 446763 - DNA, 20 bp, Artificial
  CRISPR gRNA sequence
aaaaaaaaaaaaaaaaaaaa

SEQ ID NO: 446764 - DNA, 20 bp, Artificial
  CRISPR gRNA sequence
taagtttcaaatttttgaaa

SEQ ID NO: 446765 - DNA, 20 bp, Artificial
  CRISPR gRNA sequence
aagtttcaaatttttgaaac

SEQ ID NO: 446766 - DNA, 20 bp, Artificial
  CRISPR gRNA sequence
agtttcaaatttttgaaact

SEQ ID NO: 446767 - DNA, 20 bp, Artificial
  CRISPR gRNA sequence
caaatttttgaaactgcatc

SEQ ID NO: 446768 - DNA, 20 bp, Artificial
  CRISPR gRNA sequence
aaatttttgaaactgcatcc

SEQ ID NO: 446769 - DNA, 20 bp, Artificial
  CRISPR gRNA sequence
ttgaaactgcatccccagaa

SEQ ID NO: 446770 - DNA, 20 bp, Artificial
  CRISPR gRNA sequence
tgaaactgcatccccagaag

SEQ ID NO: 446771 - DNA, 20 bp, Artificial
  CRISPR gRNA sequence
gaaactgcatccccagaaga

SEQ ID NO: 446772 - DNA, 20 bp, Artificial
  CRISPR gRNA sequence
aaactgcatccccagaagac

SEQ ID NO: 446773 - DNA, 20 bp, Artificial
  CRISPR gRNA sequence
catccccagaagacaccttg

SEQ ID NO: 446774 - DNA, 20 bp, Artificial
  CRISPR gRNA sequence
gaaagaccttgatccagagg

SEQ ID NO: 446775 - DNA, 20 bp, Artificial
  CRISPR gRNA sequence
aaagaccttgatccagaggt

SEQ ID NO: 446776 - DNA, 20 bp, Artificial
  CRISPR gRNA sequence
gatccagaggtacccagtaa

SEQ ID NO: 446777 - DNA, 20 bp, Artificial
  CRISPR gRNA sequence
atccagaggtacccagtaag

SEQ ID NO: 446778 - DNA, 20 bp, Artificial
  CRISPR gRNA sequence
gattcctgacccacaacaca

SEQ ID NO: 446779 - DNA, 20 bp, Artificial
  CRISPR gRNA sequence
ctgacccacaacacagaaat

SEQ ID NO: 446780 - DNA, 20 bp, Artificial
  CRISPR gRNA sequence
acccacaacacagaaatgat

SEQ ID NO: 446781 - DNA, 20 bp, Artificial
  CRISPR gRNA sequence
ttttcagcgggtaaaagaaa

SEQ ID NO: 446782 - DNA, 20 bp, Artificial
  CRISPR gRNA sequence
tcagcgggtaaaagaaaccc

SEQ ID NO: 446783 - DNA, 20 bp, Artificial
  CRISPR gRNA sequence
cagcgggtaaaagaaaccca

SEQ ID NO: 446784 - DNA, 20 bp, Artificial
  CRISPR gRNA sequence
agcgggtaaaagaaacccaa

SEQ ID NO: 446785 - DNA, 20 bp, Artificial
  CRISPR gRNA sequence
tgcccttcaaggaaatctaa

SEQ ID NO: 446786 - DNA, 20 bp, Artificial
  CRISPR gRNA sequence
cccttcaaggaaatctaagg

SEQ ID NO: 446787 - DNA, 20 bp, Artificial
  CRISPR gRNA sequence
caaggaaatctaaggtttcc

SEQ ID NO: 446788 - DNA, 20 bp, Artificial
  CRISPR gRNA sequence
aaggaaatctaaggtttcct

SEQ ID NO: 446789 - DNA, 20 bp, Artificial
  CRISPR gRNA sequence
aggtttcctacaggtcttag

SEQ ID NO: 446790 - DNA, 20 bp, Artificial
  CRISPR gRNA sequence
cctacaggtcttagaataaa

SEQ ID NO: 446791 - DNA, 20 bp, Artificial
  CRISPR gRNA sequence
ctacaggtcttagaataaaa

SEQ ID NO: 446792 - DNA, 20 bp, Artificial
  CRISPR gRNA sequence
caggtcttagaataaaatcc

SEQ ID NO: 446793 - DNA, 20 bp, Artificial
  CRISPR gRNA sequence
agaataaaatccagactcct

SEQ ID NO: 446794 - DNA, 20 bp, Artificial
  CRISPR gRNA sequence
gaataaaatccagactcctg

SEQ ID NO: 446795 - DNA, 20 bp, Artificial
  CRISPR gRNA sequence
ctgattatggctggaaaggt

SEQ ID NO: 446796 - DNA, 20 bp, Artificial
  CRISPR gRNA sequence
attatggctggaaaggtctt

SEQ ID NO: 446797 - DNA, 20 bp, Artificial
  CRISPR gRNA sequence
tggctggaaaggtcttattg

SEQ ID NO: 446798 - DNA, 20 bp, Artificial
  CRISPR gRNA sequence
gaaaggtcttattggaccta

SEQ ID NO: 446799 - DNA, 20 bp, Artificial
  CRISPR gRNA sequence
attggacctagccccagcct

SEQ ID NO: 446800 - DNA, 20 bp, Artificial
  CRISPR gRNA sequence
ttggacctagccccagccta

SEQ ID NO: 446801 - DNA, 20 bp, Artificial
  CRISPR gRNA sequence
gacctagccccagcctacct

SEQ ID NO: 446802 - DNA, 20 bp, Artificial
  CRISPR gRNA sequence
gccccagcctacctttcaga

SEQ ID NO: 446803 - DNA, 20 bp, Artificial
  CRISPR gRNA sequence
cctttcagaccttatcttgg

SEQ ID NO: 446804 - DNA, 20 bp, Artificial
  CRISPR gRNA sequence
tcagaccttatcttgggccg

SEQ ID NO: 446805 - DNA, 20 bp, Artificial
  CRISPR gRNA sequence
cagaccttatcttgggccgc

SEQ ID NO: 446806 - DNA, 20 bp, Artificial
  CRISPR gRNA sequence
agaccttatcttgggccgct

SEQ ID NO: 446807 - DNA, 20 bp, Artificial
  CRISPR gRNA sequence
atcttgggccgctcccttaa

SEQ ID NO: 446808 - DNA, 20 bp, Artificial
  CRISPR gRNA sequence
tcttgggccgctcccttaat

SEQ ID NO: 446809 - DNA, 20 bp, Artificial
  CRISPR gRNA sequence
gggccgctcccttaatccag

SEQ ID NO: 446810 - DNA, 20 bp, Artificial
  CRISPR gRNA sequence
ggccgctcccttaatccagc

SEQ ID NO: 446811 - DNA, 20 bp, Artificial
  CRISPR gRNA sequence
ccttaatccagccacgtttt

SEQ ID NO: 446812 - DNA, 20 bp, Artificial
  CRISPR gRNA sequence
aatccagccacgttttcagt

SEQ ID NO: 446813 - DNA, 20 bp, Artificial
  CRISPR gRNA sequence
atccagccacgttttcagtt

SEQ ID NO: 446814 - DNA, 20 bp, Artificial
  CRISPR gRNA sequence
tcagtttcaggtactcagca

SEQ ID NO: 446815 - DNA, 20 bp, Artificial
  CRISPR gRNA sequence
cagtttcaggtactcagcaa

SEQ ID NO: 446816 - DNA, 20 bp, Artificial
  CRISPR gRNA sequence
agtttcaggtactcagcaag

SEQ ID NO: 446817 - DNA, 20 bp, Artificial
  CRISPR gRNA sequence
caggtactcagcaagatctt

SEQ ID NO: 446818 - DNA, 20 bp, Artificial
  CRISPR gRNA sequence
aggtactcagcaagatcttt

SEQ ID NO: 446819 - DNA, 20 bp, Artificial
  CRISPR gRNA sequence
agcaagatctttacaagggg

SEQ ID NO: 446820 - DNA, 20 bp, Artificial
  CRISPR gRNA sequence
tacaaggggctccctcatcc

SEQ ID NO: 446821 - DNA, 20 bp, Artificial
  CRISPR gRNA sequence
acaaggggctccctcatcct

SEQ ID NO: 446822 - DNA, 20 bp, Artificial
  CRISPR gRNA sequence
caaggggctccctcatcctg

SEQ ID NO: 446823 - DNA, 20 bp, Artificial
  CRISPR gRNA sequence
cctcatcctggaatgctcct

SEQ ID NO: 446824 - DNA, 20 bp, Artificial
  CRISPR gRNA sequence
atcctggaatgctccttctg

SEQ ID NO: 446825 - DNA, 20 bp, Artificial
  CRISPR gRNA sequence
gaatgctccttctggctctt

SEQ ID NO: 446826 - DNA, 20 bp, Artificial
  CRISPR gRNA sequence
cttctggctctttacttggc

SEQ ID NO: 446827 - DNA, 20 bp, Artificial
  CRISPR gRNA sequence
ctggctctttacttggctga

SEQ ID NO: 446828 - DNA, 20 bp, Artificial
  CRISPR gRNA sequence
tggctctttacttggctgac

SEQ ID NO: 446829 - DNA, 20 bp, Artificial
  CRISPR gRNA sequence
gctctttacttggctgactc

SEQ ID NO: 446830 - DNA, 20 bp, Artificial
  CRISPR gRNA sequence
tttacttggctgactcattt

SEQ ID NO: 446831 - DNA, 20 bp, Artificial
  CRISPR gRNA sequence
tacttggctgactcatttca

SEQ ID NO: 446832 - DNA, 20 bp, Artificial
  CRISPR gRNA sequence
acttggctgactcatttcag

SEQ ID NO: 446833 - DNA, 20 bp, Artificial
  CRISPR gRNA sequence
cttggctgactcatttcaga

SEQ ID NO: 446834 - DNA, 20 bp, Artificial
  CRISPR gRNA sequence
ggctgactcatttcagaaac

SEQ ID NO: 446835 - DNA, 20 bp, Artificial
  CRISPR gRNA sequence
gctgactcatttcagaaacg

SEQ ID NO: 446836 - DNA, 20 bp, Artificial
  CRISPR gRNA sequence
actcatttcagaaacgagct

SEQ ID NO: 446837 - DNA, 20 bp, Artificial
  CRISPR gRNA sequence
atttcagaaacgagcttaaa

SEQ ID NO: 446838 - DNA, 20 bp, Artificial
  CRISPR gRNA sequence
cagaaacgagcttaaagttc

SEQ ID NO: 446839 - DNA, 20 bp, Artificial
  CRISPR gRNA sequence
agaaacgagcttaaagttca

SEQ ID NO: 446840 - DNA, 20 bp, Artificial
  CRISPR gRNA sequence
aaagttcatctctgagggtc

SEQ ID NO: 446841 - DNA, 20 bp, Artificial
  CRISPR gRNA sequence
aagttcatctctgagggtcc

SEQ ID NO: 446842 - DNA, 20 bp, Artificial
  CRISPR gRNA sequence
atctctgagggtccttccct

SEQ ID NO: 446843 - DNA, 20 bp, Artificial
  CRISPR gRNA sequence
tgagggtccttccctgacca

SEQ ID NO: 446844 - DNA, 20 bp, Artificial
  CRISPR gRNA sequence
agggtccttccctgaccacc

SEQ ID NO: 446845 - DNA, 20 bp, Artificial
  CRISPR gRNA sequence
ccctgaccaccctctctatt

SEQ ID NO: 446846 - DNA, 20 bp, Artificial
  CRISPR gRNA sequence
cctgaccaccctctctatta

SEQ ID NO: 446847 - DNA, 20 bp, Artificial
  CRISPR gRNA sequence
accaccctctctattatctg

SEQ ID NO: 446848 - DNA, 20 bp, Artificial
  CRISPR gRNA sequence
tctattatctgtttcactat

SEQ ID NO: 446849 - DNA, 20 bp, Artificial
  CRISPR gRNA sequence
tattatctgtttcactatga

SEQ ID NO: 446850 - DNA, 20 bp, Artificial
  CRISPR gRNA sequence
ttatctgtttcactatgatg

SEQ ID NO: 446851 - DNA, 20 bp, Artificial
  CRISPR gRNA sequence
tctgtttcactatgatgttg

SEQ ID NO: 446852 - DNA, 20 bp, Artificial
  CRISPR gRNA sequence
tttcactatgatgttggttt

SEQ ID NO: 446853 - DNA, 20 bp, Artificial
  CRISPR gRNA sequence
cactatgatgttggtttcct

SEQ ID NO: 446854 - DNA, 20 bp, Artificial
  CRISPR gRNA sequence
actatgatgttggtttcctt

SEQ ID NO: 446855 - DNA, 20 bp, Artificial
  CRISPR gRNA sequence
tgatgttggtttcctttata

SEQ ID NO: 446856 - DNA, 20 bp, Artificial
  CRISPR gRNA sequence
gtttcctttataatacatca

SEQ ID NO: 446857 - DNA, 20 bp, Artificial
  CRISPR gRNA sequence
cctttataatacatcataat

SEQ ID NO: 446858 - DNA, 20 bp, Artificial
  CRISPR gRNA sequence
ctttataatacatcataatt

SEQ ID NO: 446859 - DNA, 20 bp, Artificial
  CRISPR gRNA sequence
tataatacatcataatttga

SEQ ID NO: 446860 - DNA, 20 bp, Artificial
  CRISPR gRNA sequence
ataatacatcataatttgaa

SEQ ID NO: 446861 - DNA, 20 bp, Artificial
  CRISPR gRNA sequence
taatacatcataatttgaaa

SEQ ID NO: 446862 - DNA, 20 bp, Artificial
  CRISPR gRNA sequence
gaaattattttgttttccta

SEQ ID NO: 446863 - DNA, 20 bp, Artificial
  CRISPR gRNA sequence
aaattattttgttttcctat

SEQ ID NO: 446864 - DNA, 20 bp, Artificial
  CRISPR gRNA sequence
ttttgttttcctatttacta

SEQ ID NO: 446865 - DNA, 20 bp, Artificial
  CRISPR gRNA sequence
tgttttcctatttactattt

SEQ ID NO: 446866 - DNA, 20 bp, Artificial
  CRISPR gRNA sequence
gttttcctatttactatttc

SEQ ID NO: 446867 - DNA, 20 bp, Artificial
  CRISPR gRNA sequence
ttttcctatttactatttcc

SEQ ID NO: 446868 - DNA, 20 bp, Artificial
  CRISPR gRNA sequence
tcctatttactatttccttt

SEQ ID NO: 446869 - DNA, 20 bp, Artificial
  CRISPR gRNA sequence
cctatttactatttcctttt

SEQ ID NO: 446870 - DNA, 20 bp, Artificial
  CRISPR gRNA sequence
ctatttactatttccttttt

SEQ ID NO: 446871 - DNA, 20 bp, Artificial
  CRISPR gRNA sequence
tttactatttcctttttgtt

SEQ ID NO: 446872 - DNA, 20 bp, Artificial
  CRISPR gRNA sequence
actatttcctttttgttgtt

SEQ ID NO: 446873 - DNA, 20 bp, Artificial
  CRISPR gRNA sequence
ctatttcctttttgttgttg

SEQ ID NO: 446874 - DNA, 20 bp, Artificial
  CRISPR gRNA sequence
tttcctttttgttgttgttt

SEQ ID NO: 446875 - DNA, 20 bp, Artificial
  CRISPR gRNA sequence
cctttttgttgttgtttttt

SEQ ID NO: 446876 - DNA, 20 bp, Artificial
  CRISPR gRNA sequence
ctttttgttgttgttttttt

SEQ ID NO: 446877 - DNA, 20 bp, Artificial
  CRISPR gRNA sequence
tttgttgttgtttttttttt

SEQ ID NO: 446878 - DNA, 20 bp, Artificial
  CRISPR gRNA sequence
ttgttgttgttttttttttt

SEQ ID NO: 446879 - DNA, 20 bp, Artificial
  CRISPR gRNA sequence
tgttgttgtttttttttttt

SEQ ID NO: 446880 - DNA, 20 bp, Artificial
  CRISPR gRNA sequence
gttgttgttttttttttttt

SEQ ID NO: 446881 - DNA, 20 bp, Artificial
  CRISPR gRNA sequence
ttgttgtttttttttttttg

SEQ ID NO: 446882 - DNA, 20 bp, Artificial
  CRISPR gRNA sequence
ttgtttttttttttttgaga

SEQ ID NO: 446883 - DNA, 20 bp, Artificial
  CRISPR gRNA sequence
tttttttttttttgagacgg

SEQ ID NO: 446884 - DNA, 20 bp, Artificial
  CRISPR gRNA sequence
ttttttttttgagacggagt

SEQ ID NO: 446885 - DNA, 20 bp, Artificial
  CRISPR gRNA sequence
tttttttttgagacggagtt

SEQ ID NO: 446886 - DNA, 20 bp, Artificial
  CRISPR gRNA sequence
ttttttttgagacggagttt

SEQ ID NO: 446887 - DNA, 20 bp, Artificial
  CRISPR gRNA sequence
tttttttgagacggagtttc

SEQ ID NO: 446888 - DNA, 20 bp, Artificial
  CRISPR gRNA sequence
ttttttgagacggagtttcg

SEQ ID NO: 446889 - DNA, 20 bp, Artificial
  CRISPR gRNA sequence
tttttgagacggagtttcgc

SEQ ID NO: 446890 - DNA, 20 bp, Artificial
  CRISPR gRNA sequence
ttttgagacggagtttcgct

SEQ ID NO: 446891 - DNA, 20 bp, Artificial
  CRISPR gRNA sequence
tttgagacggagtttcgctc

SEQ ID NO: 446892 - DNA, 20 bp, Artificial
  CRISPR gRNA sequence
ttgagacggagtttcgctct

SEQ ID NO: 446893 - DNA, 20 bp, Artificial
  CRISPR gRNA sequence
tgagacggagtttcgctctc

SEQ ID NO: 446894 - DNA, 20 bp, Artificial
  CRISPR gRNA sequence
gagacggagtttcgctctcg

SEQ ID NO: 446895 - DNA, 20 bp, Artificial
  CRISPR gRNA sequence
agacggagtttcgctctcgt

SEQ ID NO: 446896 - DNA, 20 bp, Artificial
  CRISPR gRNA sequence
cgctctcgttgcccaggctg

SEQ ID NO: 446897 - DNA, 20 bp, Artificial
  CRISPR gRNA sequence
gctctcgttgcccaggctgg

SEQ ID NO: 446898 - DNA, 20 bp, Artificial
  CRISPR gRNA sequence
tcgttgcccaggctggagtg

SEQ ID NO: 446899 - DNA, 20 bp, Artificial
  CRISPR gRNA sequence
gttgcccaggctggagtgca

SEQ ID NO: 446900 - DNA, 20 bp, Artificial
  CRISPR gRNA sequence
cccaggctggagtgcaatgg

SEQ ID NO: 446901 - DNA, 20 bp, Artificial
  CRISPR gRNA sequence
gagtgcaatggcgcaatctt

SEQ ID NO: 446902 - DNA, 20 bp, Artificial
  CRISPR gRNA sequence
ggctcaccgcaacctccgtc

SEQ ID NO: 446903 - DNA, 20 bp, Artificial
  CRISPR gRNA sequence
gctcaccgcaacctccgtct

SEQ ID NO: 446904 - DNA, 20 bp, Artificial
  CRISPR gRNA sequence
accgcaacctccgtctcccg

SEQ ID NO: 446905 - DNA, 20 bp, Artificial
  CRISPR gRNA sequence
cgtctcccgggttcatgtga

SEQ ID NO: 446906 - DNA, 20 bp, Artificial
  CRISPR gRNA sequence
ccgggttcatgtgattctcc

SEQ ID NO: 446907 - DNA, 20 bp, Artificial
  CRISPR gRNA sequence
atgtgattctcctgcctcag

SEQ ID NO: 446908 - DNA, 20 bp, Artificial
  CRISPR gRNA sequence
tcctgcctcagcctcccgag

SEQ ID NO: 446909 - DNA, 20 bp, Artificial
  CRISPR gRNA sequence
ctgcctcagcctcccgagta

SEQ ID NO: 446910 - DNA, 20 bp, Artificial
  CRISPR gRNA sequence
cctcagcctcccgagtagct

SEQ ID NO: 446911 - DNA, 20 bp, Artificial
  CRISPR gRNA sequence
agcctcccgagtagctggga

SEQ ID NO: 446912 - DNA, 20 bp, Artificial
  CRISPR gRNA sequence
ccgagtagctgggattacag

SEQ ID NO: 446913 - DNA, 20 bp, Artificial
  CRISPR gRNA sequence
ggattacaggcatgggccac

SEQ ID NO: 446914 - DNA, 20 bp, Artificial
  CRISPR gRNA sequence
caggcatgggccaccacatc

SEQ ID NO: 446915 - DNA, 20 bp, Artificial
  CRISPR gRNA sequence
attttgtatttttagtagag

SEQ ID NO: 446916 - DNA, 20 bp, Artificial
  CRISPR gRNA sequence
tgtatttttagtagagacgg

SEQ ID NO: 446917 - DNA, 20 bp, Artificial
  CRISPR gRNA sequence
gtatttttagtagagacggg

SEQ ID NO: 446918 - DNA, 20 bp, Artificial
  CRISPR gRNA sequence
tatttttagtagagacgggg

SEQ ID NO: 446919 - DNA, 20 bp, Artificial
  CRISPR gRNA sequence
ttagtagagacggggtttct

SEQ ID NO: 446920 - DNA, 20 bp, Artificial
  CRISPR gRNA sequence
tagtagagacggggtttctc

SEQ ID NO: 446921 - DNA, 20 bp, Artificial
  CRISPR gRNA sequence
agtagagacggggtttctcc

SEQ ID NO: 446922 - DNA, 20 bp, Artificial
  CRISPR gRNA sequence
gtagagacggggtttctcca

SEQ ID NO: 446923 - DNA, 20 bp, Artificial
  CRISPR gRNA sequence
ctccatgttggtcaggctgg

SEQ ID NO: 446924 - DNA, 20 bp, Artificial
  CRISPR gRNA sequence
tccatgttggtcaggctggt

SEQ ID NO: 446925 - DNA, 20 bp, Artificial
  CRISPR gRNA sequence
catgttggtcaggctggtct

SEQ ID NO: 446926 - DNA, 20 bp, Artificial
  CRISPR gRNA sequence
gtcaggctggtcttgggtct

SEQ ID NO: 446927 - DNA, 20 bp, Artificial
  CRISPR gRNA sequence
gtcttgggtctggggtactg

SEQ ID NO: 446928 - DNA, 20 bp, Artificial
  CRISPR gRNA sequence
gggtctggggtactgttttc

SEQ ID NO: 446929 - DNA, 20 bp, Artificial
  CRISPR gRNA sequence
ggtctggggtactgttttct

SEQ ID NO: 446930 - DNA, 20 bp, Artificial
  CRISPR gRNA sequence
gggtactgttttcttttatt

SEQ ID NO: 446931 - DNA, 20 bp, Artificial
  CRISPR gRNA sequence
ttttcttttatttctttggt

SEQ ID NO: 446932 - DNA, 20 bp, Artificial
  CRISPR gRNA sequence
tcttttatttctttggtctc

SEQ ID NO: 446933 - DNA, 20 bp, Artificial
  CRISPR gRNA sequence
cttttatttctttggtctcc

SEQ ID NO: 446934 - DNA, 20 bp, Artificial
  CRISPR gRNA sequence
ttttatttctttggtctccc

SEQ ID NO: 446935 - DNA, 20 bp, Artificial
  CRISPR gRNA sequence
ttatttctttggtctcccac

SEQ ID NO: 446936 - DNA, 20 bp, Artificial
  CRISPR gRNA sequence
tatttctttggtctcccaca

SEQ ID NO: 446937 - DNA, 20 bp, Artificial
  CRISPR gRNA sequence
atttctttggtctcccacag

SEQ ID NO: 446938 - DNA, 20 bp, Artificial
  CRISPR gRNA sequence
tttctttggtctcccacagg

SEQ ID NO: 446939 - DNA, 20 bp, Artificial
  CRISPR gRNA sequence
ctttggtctcccacaggaga

SEQ ID NO: 446940 - DNA, 20 bp, Artificial
  CRISPR gRNA sequence
tttggtctcccacaggagag

SEQ ID NO: 446941 - DNA, 20 bp, Artificial
  CRISPR gRNA sequence
tggtctcccacaggagagcg

SEQ ID NO: 446942 - DNA, 20 bp, Artificial
  CRISPR gRNA sequence
ggtctcccacaggagagcgt

SEQ ID NO: 446943 - DNA, 20 bp, Artificial
  CRISPR gRNA sequence
gtctcccacaggagagcgtg

SEQ ID NO: 446944 - DNA, 20 bp, Artificial
  CRISPR gRNA sequence
ccacaggagagcgtgagctt

SEQ ID NO: 446945 - DNA, 20 bp, Artificial
  CRISPR gRNA sequence
cgtgaaattagggctcacaa

SEQ ID NO: 446946 - DNA, 20 bp, Artificial
  CRISPR gRNA sequence
gtgaaattagggctcacaat

SEQ ID NO: 446947 - DNA, 20 bp, Artificial
  CRISPR gRNA sequence
gggctcacaattcactttta

SEQ ID NO: 446948 - DNA, 20 bp, Artificial
  CRISPR gRNA sequence
acaattcacttttatgttcc

SEQ ID NO: 446949 - DNA, 20 bp, Artificial
  CRISPR gRNA sequence
acttttatgttcctgtgttc

SEQ ID NO: 446950 - DNA, 20 bp, Artificial
  CRISPR gRNA sequence
ttatgttcctgtgttccttg

SEQ ID NO: 446951 - DNA, 20 bp, Artificial
  CRISPR gRNA sequence
tatgttcctgtgttccttgt

SEQ ID NO: 446952 - DNA, 20 bp, Artificial
  CRISPR gRNA sequence
atgttcctgtgttccttgtg

SEQ ID NO: 446953 - DNA, 20 bp, Artificial
  CRISPR gRNA sequence
tgttcctgtgttccttgtgc

SEQ ID NO: 446954 - DNA, 20 bp, Artificial
  CRISPR gRNA sequence
ctgtgttccttgtgccaggc

SEQ ID NO: 446955 - DNA, 20 bp, Artificial
  CRISPR gRNA sequence
tgttccttgtgccaggcaaa

SEQ ID NO: 446956 - DNA, 20 bp, Artificial
  CRISPR gRNA sequence
cttgtgccaggcaaactgcc

SEQ ID NO: 446957 - DNA, 20 bp, Artificial
  CRISPR gRNA sequence
gtgccaggcaaactgccaga

SEQ ID NO: 446958 - DNA, 20 bp, Artificial
  CRISPR gRNA sequence
tgccaggcaaactgccagac

SEQ ID NO: 446959 - DNA, 20 bp, Artificial
  CRISPR gRNA sequence
ccagacacatagtagaggtc

SEQ ID NO: 446960 - DNA, 20 bp, Artificial
  CRISPR gRNA sequence
ataatatttgttaaataaga

SEQ ID NO: 446961 - DNA, 20 bp, Artificial
  CRISPR gRNA sequence
gttaaataagaaaaatgcat

SEQ ID NO: 446962 - DNA, 20 bp, Artificial
  CRISPR gRNA sequence
ttaaataagaaaaatgcatc

SEQ ID NO: 446963 - DNA, 20 bp, Artificial
  CRISPR gRNA sequence
aataagaaaaatgcatcttt

SEQ ID NO: 446964 - DNA, 20 bp, Artificial
  CRISPR gRNA sequence
tattattattttctaacaca

SEQ ID NO: 446965 - DNA, 20 bp, Artificial
  CRISPR gRNA sequence
attattattttctaacacag

SEQ ID NO: 446966 - DNA, 20 bp, Artificial
  CRISPR gRNA sequence
ttattattttctaacacagt

SEQ ID NO: 446967 - DNA, 20 bp, Artificial
  CRISPR gRNA sequence
ttattttctaacacagtcca

SEQ ID NO: 446968 - DNA, 20 bp, Artificial
  CRISPR gRNA sequence
ttttctaacacagtccatat

SEQ ID NO: 446969 - DNA, 20 bp, Artificial
  CRISPR gRNA sequence
tctaacacagtccatataac

SEQ ID NO: 446970 - DNA, 20 bp, Artificial
  CRISPR gRNA sequence
ctaacacagtccatataact

SEQ ID NO: 446971 - DNA, 20 bp, Artificial
  CRISPR gRNA sequence
taacacagtccatataacta

SEQ ID NO: 446972 - DNA, 20 bp, Artificial
  CRISPR gRNA sequence
acacagtccatataactatc

SEQ ID NO: 446973 - DNA, 20 bp, Artificial
  CRISPR gRNA sequence
tctaaggcacacgttgagag

SEQ ID NO: 446974 - DNA, 20 bp, Artificial
  CRISPR gRNA sequence
aggcacacgttgagagtttc

SEQ ID NO: 446975 - DNA, 20 bp, Artificial
  CRISPR gRNA sequence
agagtttcatttaactcaat

SEQ ID NO: 446976 - DNA, 20 bp, Artificial
  CRISPR gRNA sequence
catttaactcaatctgagat

SEQ ID NO: 446977 - DNA, 20 bp, Artificial
  CRISPR gRNA sequence
atttaactcaatctgagatg

SEQ ID NO: 446978 - DNA, 20 bp, Artificial
  CRISPR gRNA sequence
aactcaatctgagatgagac

SEQ ID NO: 446979 - DNA, 20 bp, Artificial
  CRISPR gRNA sequence
actcaatctgagatgagacc

SEQ ID NO: 446980 - DNA, 20 bp, Artificial
  CRISPR gRNA sequence
aatctgagatgagaccagat

SEQ ID NO: 446981 - DNA, 20 bp, Artificial
  CRISPR gRNA sequence
agatgagaccagatttccct

SEQ ID NO: 446982 - DNA, 20 bp, Artificial
  CRISPR gRNA sequence
ccctaaactatgcgtgcttc

SEQ ID NO: 446983 - DNA, 20 bp, Artificial
  CRISPR gRNA sequence
cctaaactatgcgtgcttcc

SEQ ID NO: 446984 - DNA, 20 bp, Artificial
  CRISPR gRNA sequence
aactatgcgtgcttccagtg

SEQ ID NO: 446985 - DNA, 20 bp, Artificial
  CRISPR gRNA sequence
tgcgtgcttccagtgaacct

SEQ ID NO: 446986 - DNA, 20 bp, Artificial
  CRISPR gRNA sequence
ccagtgaacctatttgattt

SEQ ID NO: 446987 - DNA, 20 bp, Artificial
  CRISPR gRNA sequence
cagtgaacctatttgatttc

SEQ ID NO: 446988 - DNA, 20 bp, Artificial
  CRISPR gRNA sequence
tttgatttcttgtctcattt

SEQ ID NO: 446989 - DNA, 20 bp, Artificial
  CRISPR gRNA sequence
gatttcttgtctcatttatt

SEQ ID NO: 446990 - DNA, 20 bp, Artificial
  CRISPR gRNA sequence
atttcttgtctcatttattt

SEQ ID NO: 446991 - DNA, 20 bp, Artificial
  CRISPR gRNA sequence
cttgtctcatttattttatg

SEQ ID NO: 446992 - DNA, 20 bp, Artificial
  CRISPR gRNA sequence
ttgtctcatttattttatga

SEQ ID NO: 446993 - DNA, 20 bp, Artificial
  CRISPR gRNA sequence
gtctcatttattttatgaat

SEQ ID NO: 446994 - DNA, 20 bp, Artificial
  CRISPR gRNA sequence
tctcatttattttatgaatg

SEQ ID NO: 446995 - DNA, 20 bp, Artificial
  CRISPR gRNA sequence
atttattttatgaatgcatt

SEQ ID NO: 446996 - DNA, 20 bp, Artificial
  CRISPR gRNA sequence
attttatgaatgcattttta

SEQ ID NO: 446997 - DNA, 20 bp, Artificial
  CRISPR gRNA sequence
ttttatgaatgcatttttat

SEQ ID NO: 446998 - DNA, 20 bp, Artificial
  CRISPR gRNA sequence
tatgaatgcatttttattgg

SEQ ID NO: 446999 - DNA, 20 bp, Artificial
  CRISPR gRNA sequence
atgaatgcatttttattggc

SEQ ID NO: 447000 - DNA, 20 bp, Artificial
  CRISPR gRNA sequence
tgaatgcatttttattggct

SEQ ID NO: 447001 - DNA, 20 bp, Artificial
  CRISPR gRNA sequence
ttattggcttttgtttcccc

SEQ ID NO: 447002 - DNA, 20 bp, Artificial
  CRISPR gRNA sequence
tattggcttttgtttccccc

SEQ ID NO: 447003 - DNA, 20 bp, Artificial
  CRISPR gRNA sequence
attggcttttgtttccccct

SEQ ID NO: 447004 - DNA, 20 bp, Artificial
  CRISPR gRNA sequence
ttggcttttgtttccccctt

SEQ ID NO: 447005 - DNA, 20 bp, Artificial
  CRISPR gRNA sequence
gcttttgtttcccccttact

SEQ ID NO: 447006 - DNA, 20 bp, Artificial
  CRISPR gRNA sequence
ttgtttcccccttactaggg

SEQ ID NO: 447007 - DNA, 20 bp, Artificial
  CRISPR gRNA sequence
tgtttcccccttactagggt

SEQ ID NO: 447008 - DNA, 20 bp, Artificial
  CRISPR gRNA sequence
gtttcccccttactagggta

SEQ ID NO: 447009 - DNA, 20 bp, Artificial
  CRISPR gRNA sequence
tttcccccttactagggtat

SEQ ID NO: 447010 - DNA, 20 bp, Artificial
  CRISPR gRNA sequence
cccccttactagggtattct

SEQ ID NO: 447011 - DNA, 20 bp, Artificial
  CRISPR gRNA sequence
ccccttactagggtattctc

SEQ ID NO: 447012 - DNA, 20 bp, Artificial
  CRISPR gRNA sequence
actagggtattctcatagca

SEQ ID NO: 447013 - DNA, 20 bp, Artificial
  CRISPR gRNA sequence
ctagggtattctcatagcaa

SEQ ID NO: 447014 - DNA, 20 bp, Artificial
  CRISPR gRNA sequence
gggtattctcatagcaaaga

SEQ ID NO: 447015 - DNA, 20 bp, Artificial
  CRISPR gRNA sequence
tcatagcaaagagaagatac

SEQ ID NO: 447016 - DNA, 20 bp, Artificial
  CRISPR gRNA sequence
atagcaaagagaagatacag

SEQ ID NO: 447017 - DNA, 20 bp, Artificial
  CRISPR gRNA sequence
aaggtaagaataatggaatg

SEQ ID NO: 447018 - DNA, 20 bp, Artificial
  CRISPR gRNA sequence
aggtaagaataatggaatgg

SEQ ID NO: 447019 - DNA, 20 bp, Artificial
  CRISPR gRNA sequence
ggaaaaggtgagaatcttgg

SEQ ID NO: 447020 - DNA, 20 bp, Artificial
  CRISPR gRNA sequence
ggaagtccctactctaacat

SEQ ID NO: 447021 - DNA, 20 bp, Artificial
  CRISPR gRNA sequence
gaagtccctactctaacatg

SEQ ID NO: 447022 - DNA, 20 bp, Artificial
  CRISPR gRNA sequence
ctctaacatgtctgatcttt

SEQ ID NO: 447023 - DNA, 20 bp, Artificial
  CRISPR gRNA sequence
taacatgtctgatcttttct

SEQ ID NO: 447024 - DNA, 20 bp, Artificial
  CRISPR gRNA sequence
acatgtctgatcttttctct

SEQ ID NO: 447025 - DNA, 20 bp, Artificial
  CRISPR gRNA sequence
atcttttctctgagaaatcc

SEQ ID NO: 447026 - DNA, 20 bp, Artificial
  CRISPR gRNA sequence
ttctctgagaaatcctgtcc

SEQ ID NO: 447027 - DNA, 20 bp, Artificial
  CRISPR gRNA sequence
tctctgagaaatcctgtcct

SEQ ID NO: 447028 - DNA, 20 bp, Artificial
  CRISPR gRNA sequence
ctctgagaaatcctgtcctg

SEQ ID NO: 447029 - DNA, 20 bp, Artificial
  CRISPR gRNA sequence
tctgagaaatcctgtcctgg

SEQ ID NO: 447030 - DNA, 20 bp, Artificial
  CRISPR gRNA sequence
tgagaaatcctgtcctgggg

SEQ ID NO: 447031 - DNA, 20 bp, Artificial
  CRISPR gRNA sequence
agaaatcctgtcctggggct

SEQ ID NO: 447032 - DNA, 20 bp, Artificial
  CRISPR gRNA sequence
tcctggggctttgagatctg

SEQ ID NO: 447033 - DNA, 20 bp, Artificial
  CRISPR gRNA sequence
gggctttgagatctgagttt

SEQ ID NO: 447034 - DNA, 20 bp, Artificial
  CRISPR gRNA sequence
tgagatctgagtttatactt

SEQ ID NO: 447035 - DNA, 20 bp, Artificial
  CRISPR gRNA sequence
gagatctgagtttatacttc

SEQ ID NO: 447036 - DNA, 20 bp, Artificial
  CRISPR gRNA sequence
agatctgagtttatacttcc

SEQ ID NO: 447037 - DNA, 20 bp, Artificial
  CRISPR gRNA sequence
agtttatacttccttctttc

SEQ ID NO: 447038 - DNA, 20 bp, Artificial
  CRISPR gRNA sequence
atacttccttctttctctag

SEQ ID NO: 447039 - DNA, 20 bp, Artificial
  CRISPR gRNA sequence
tacttccttctttctctagg

SEQ ID NO: 447040 - DNA, 20 bp, Artificial
  CRISPR gRNA sequence
ccttctttctctaggtctag

SEQ ID NO: 447041 - DNA, 20 bp, Artificial
  CRISPR gRNA sequence
cttctttctctaggtctagt

SEQ ID NO: 447042 - DNA, 20 bp, Artificial
  CRISPR gRNA sequence
ctttctctaggtctagttat

SEQ ID NO: 447043 - DNA, 20 bp, Artificial
  CRISPR gRNA sequence
tttctctaggtctagttatg

SEQ ID NO: 447044 - DNA, 20 bp, Artificial
  CRISPR gRNA sequence
tctctaggtctagttatgaa

SEQ ID NO: 447045 - DNA, 20 bp, Artificial
  CRISPR gRNA sequence
ctctaggtctagttatgaag

SEQ ID NO: 447046 - DNA, 20 bp, Artificial
  CRISPR gRNA sequence
tctaggtctagttatgaagt

SEQ ID NO: 447047 - DNA, 20 bp, Artificial
  CRISPR gRNA sequence
taggtctagttatgaagtga

SEQ ID NO: 447048 - DNA, 20 bp, Artificial
  CRISPR gRNA sequence
ggtctagttatgaagtgaaa

SEQ ID NO: 447049 - DNA, 20 bp, Artificial
  CRISPR gRNA sequence
gttatgaagtgaaaatgtaa

SEQ ID NO: 447050 - DNA, 20 bp, Artificial
  CRISPR gRNA sequence
tgaagtgaaaatgtaacatg

SEQ ID NO: 447051 - DNA, 20 bp, Artificial
  CRISPR gRNA sequence
ctgtgtgtacttcctgacac

SEQ ID NO: 447052 - DNA, 20 bp, Artificial
  CRISPR gRNA sequence
tgtgtacttcctgacacctc

SEQ ID NO: 447053 - DNA, 20 bp, Artificial
  CRISPR gRNA sequence
cctgacacctctagcttctt

SEQ ID NO: 447054 - DNA, 20 bp, Artificial
  CRISPR gRNA sequence
ctgacacctctagcttcttt

SEQ ID NO: 447055 - DNA, 20 bp, Artificial
  CRISPR gRNA sequence
acacctctagcttctttagt

SEQ ID NO: 447056 - DNA, 20 bp, Artificial
  CRISPR gRNA sequence
tagcttctttagttctaaag

SEQ ID NO: 447057 - DNA, 20 bp, Artificial
  CRISPR gRNA sequence
gcttctttagttctaaagtt

SEQ ID NO: 447058 - DNA, 20 bp, Artificial
  CRISPR gRNA sequence
ctttagttctaaagttaagg

SEQ ID NO: 447059 - DNA, 20 bp, Artificial
  CRISPR gRNA sequence
tttagttctaaagttaaggt

SEQ ID NO: 447060 - DNA, 20 bp, Artificial
  CRISPR gRNA sequence
tagttctaaagttaaggtat

SEQ ID NO: 447061 - DNA, 20 bp, Artificial
  CRISPR gRNA sequence
agttctaaagttaaggtata

SEQ ID NO: 447062 - DNA, 20 bp, Artificial
  CRISPR gRNA sequence
gttctaaagttaaggtatag

SEQ ID NO: 447063 - DNA, 20 bp, Artificial
  CRISPR gRNA sequence
taaagttaaggtatagaatt

SEQ ID NO: 447064 - DNA, 20 bp, Artificial
  CRISPR gRNA sequence
aagttaaggtatagaattta

SEQ ID NO: 447065 - DNA, 20 bp, Artificial
  CRISPR gRNA sequence
aggtatagaatttatcaccc

SEQ ID NO: 447066 - DNA, 20 bp, Artificial
  CRISPR gRNA sequence
atcaccctaataatacaaca

SEQ ID NO: 447067 - DNA, 20 bp, Artificial
  CRISPR gRNA sequence
tcaccctaataatacaacat

SEQ ID NO: 447068 - DNA, 20 bp, Artificial
  CRISPR gRNA sequence
ataatacaacatgcttattc

SEQ ID NO: 447069 - DNA, 20 bp, Artificial
  CRISPR gRNA sequence
attcatctcgatattaatgg

SEQ ID NO: 447070 - DNA, 20 bp, Artificial
  CRISPR gRNA sequence
ttcatctcgatattaatggt

SEQ ID NO: 447071 - DNA, 20 bp, Artificial
  CRISPR gRNA sequence
atctcgatattaatggtttt

SEQ ID NO: 447072 - DNA, 20 bp, Artificial
  CRISPR gRNA sequence
gatattaatggtttttccac

SEQ ID NO: 447073 - DNA, 20 bp, Artificial
  CRISPR gRNA sequence
atggtttttccactgaactg

SEQ ID NO: 447074 - DNA, 20 bp, Artificial
  CRISPR gRNA sequence
ttccactgaactgaaacatc

SEQ ID NO: 447075 - DNA, 20 bp, Artificial
  CRISPR gRNA sequence
tccactgaactgaaacatca

SEQ ID NO: 447076 - DNA, 20 bp, Artificial
  CRISPR gRNA sequence
ccactgaactgaaacatcaa

SEQ ID NO: 447077 - DNA, 20 bp, Artificial
  CRISPR gRNA sequence
cactgaactgaaacatcaac

SEQ ID NO: 447078 - DNA, 20 bp, Artificial
  CRISPR gRNA sequence
aactgaaacatcaacggatt

SEQ ID NO: 447079 - DNA, 20 bp, Artificial
  CRISPR gRNA sequence
aaacatcaacggattgagct

SEQ ID NO: 447080 - DNA, 20 bp, Artificial
  CRISPR gRNA sequence
agctcctattatatccaggg

SEQ ID NO: 447081 - DNA, 20 bp, Artificial
  CRISPR gRNA sequence
ctattatatccagggtctgg

SEQ ID NO: 447082 - DNA, 20 bp, Artificial
  CRISPR gRNA sequence
ttatatccagggtctgggct

SEQ ID NO: 447083 - DNA, 20 bp, Artificial
  CRISPR gRNA sequence
tatccagggtctgggctgca

SEQ ID NO: 447084 - DNA, 20 bp, Artificial
  CRISPR gRNA sequence
ggctgcacttaggcgttaca

SEQ ID NO: 447085 - DNA, 20 bp, Artificial
  CRISPR gRNA sequence
cacttaggcgttacagaagt

SEQ ID NO: 447086 - DNA, 20 bp, Artificial
  CRISPR gRNA sequence
aggcgttacagaagtgagca

SEQ ID NO: 447087 - DNA, 20 bp, Artificial
  CRISPR gRNA sequence
ggcgttacagaagtgagcaa

SEQ ID NO: 447088 - DNA, 20 bp, Artificial
  CRISPR gRNA sequence
cagaagtgagcaagaaaccc

SEQ ID NO: 447089 - DNA, 20 bp, Artificial
  CRISPR gRNA sequence
ttctcagcatttctgtaaac

SEQ ID NO: 447090 - DNA, 20 bp, Artificial
  CRISPR gRNA sequence
tcagcatttctgtaaacagc

SEQ ID NO: 447091 - DNA, 20 bp, Artificial
  CRISPR gRNA sequence
agcatttctgtaaacagccc

SEQ ID NO: 447092 - DNA, 20 bp, Artificial
  CRISPR gRNA sequence
ctgtaaacagcccaggcatt

SEQ ID NO: 447093 - DNA, 20 bp, Artificial
  CRISPR gRNA sequence
tgtaaacagcccaggcattt

SEQ ID NO: 447094 - DNA, 20 bp, Artificial
  CRISPR gRNA sequence
taaacagcccaggcattttc

SEQ ID NO: 447095 - DNA, 20 bp, Artificial
  CRISPR gRNA sequence
tcaactttagtttcctatta

SEQ ID NO: 447096 - DNA, 20 bp, Artificial
  CRISPR gRNA sequence
caactttagtttcctattag

SEQ ID NO: 447097 - DNA, 20 bp, Artificial
  CRISPR gRNA sequence
aactttagtttcctattaga

SEQ ID NO: 447098 - DNA, 20 bp, Artificial
  CRISPR gRNA sequence
tagtttcctattagaatcac

SEQ ID NO: 447099 - DNA, 20 bp, Artificial
  CRISPR gRNA sequence
agtttcctattagaatcacc

SEQ ID NO: 447100 - DNA, 20 bp, Artificial
  CRISPR gRNA sequence
gtttcctattagaatcaccc

SEQ ID NO: 447101 - DNA, 20 bp, Artificial
  CRISPR gRNA sequence
cctattagaatcacccaggc

SEQ ID NO: 447102 - DNA, 20 bp, Artificial
  CRISPR gRNA sequence
ctattagaatcacccaggca

SEQ ID NO: 447103 - DNA, 20 bp, Artificial
  CRISPR gRNA sequence
ttagaatcacccaggcactg

SEQ ID NO: 447104 - DNA, 20 bp, Artificial
  CRISPR gRNA sequence
gaatcacccaggcactgaag

SEQ ID NO: 447105 - DNA, 20 bp, Artificial
  CRISPR gRNA sequence
aagtgtactaatgcagggcc

SEQ ID NO: 447106 - DNA, 20 bp, Artificial
  CRISPR gRNA sequence
atgcagggccaaccccagag

SEQ ID NO: 447107 - DNA, 20 bp, Artificial
  CRISPR gRNA sequence
aatcagaatctctggggatg

SEQ ID NO: 447108 - DNA, 20 bp, Artificial
  CRISPR gRNA sequence
tggggatgaagcctaagcat

SEQ ID NO: 447109 - DNA, 20 bp, Artificial
  CRISPR gRNA sequence
gggatgaagcctaagcatag

SEQ ID NO: 447110 - DNA, 20 bp, Artificial
  CRISPR gRNA sequence
agcatagaaattgttctaaa

SEQ ID NO: 447111 - DNA, 20 bp, Artificial
  CRISPR gRNA sequence
ttctaaaagctctccaggtg

SEQ ID NO: 447112 - DNA, 20 bp, Artificial
  CRISPR gRNA sequence
taaaagctctccaggtgatt

SEQ ID NO: 447113 - DNA, 20 bp, Artificial
  CRISPR gRNA sequence
aaagctctccaggtgattct

SEQ ID NO: 447114 - DNA, 20 bp, Artificial
  CRISPR gRNA sequence
tccaggtgattctagtgaac

SEQ ID NO: 447115 - DNA, 20 bp, Artificial
  CRISPR gRNA sequence
caggtgattctagtgaacag

SEQ ID NO: 447116 - DNA, 20 bp, Artificial
  CRISPR gRNA sequence
tagtgaacagtcagggctga

SEQ ID NO: 447117 - DNA, 20 bp, Artificial
  CRISPR gRNA sequence
gtgaacagtcagggctgaga

SEQ ID NO: 447118 - DNA, 20 bp, Artificial
  CRISPR gRNA sequence
agaactgctagtctgttata

SEQ ID NO: 447119 - DNA, 20 bp, Artificial
  CRISPR gRNA sequence
ctagtctgttatagactcct

SEQ ID NO: 447120 - DNA, 20 bp, Artificial
  CRISPR gRNA sequence
gtctgttatagactcctgtc

SEQ ID NO: 447121 - DNA, 20 bp, Artificial
  CRISPR gRNA sequence
ttatagactcctgtcttgac

SEQ ID NO: 447122 - DNA, 20 bp, Artificial
  CRISPR gRNA sequence
tagactcctgtcttgacctt

SEQ ID NO: 447123 - DNA, 20 bp, Artificial
  CRISPR gRNA sequence
ctgtcttgaccttcgttcct

SEQ ID NO: 447124 - DNA, 20 bp, Artificial
  CRISPR gRNA sequence
tcttgaccttcgttcctgat

SEQ ID NO: 447125 - DNA, 20 bp, Artificial
  CRISPR gRNA sequence
gaccttcgttcctgattata

SEQ ID NO: 447126 - DNA, 20 bp, Artificial
  CRISPR gRNA sequence
accttcgttcctgattatac

SEQ ID NO: 447127 - DNA, 20 bp, Artificial
  CRISPR gRNA sequence
cgttcctgattatacacacc

SEQ ID NO: 447128 - DNA, 20 bp, Artificial
  CRISPR gRNA sequence
gttcctgattatacacaccc

SEQ ID NO: 447129 - DNA, 20 bp, Artificial
  CRISPR gRNA sequence
ctgattatacacacccacac

SEQ ID NO: 447130 - DNA, 20 bp, Artificial
  CRISPR gRNA sequence
attatacacacccacacatc

SEQ ID NO: 447131 - DNA, 20 bp, Artificial
  CRISPR gRNA sequence
tacacacccacacatccatt

SEQ ID NO: 447132 - DNA, 20 bp, Artificial
  CRISPR gRNA sequence
caaataggtatggcttacat

SEQ ID NO: 447133 - DNA, 20 bp, Artificial
  CRISPR gRNA sequence
aaataggtatggcttacata

SEQ ID NO: 447134 - DNA, 20 bp, Artificial
  CRISPR gRNA sequence
acataacttactagatttta

SEQ ID NO: 447135 - DNA, 20 bp, Artificial
  CRISPR gRNA sequence
cataacttactagattttag

SEQ ID NO: 447136 - DNA, 20 bp, Artificial
  CRISPR gRNA sequence
actagattttagacttttag

SEQ ID NO: 447137 - DNA, 20 bp, Artificial
  CRISPR gRNA sequence
ctagattttagacttttagt

SEQ ID NO: 447138 - DNA, 20 bp, Artificial
  CRISPR gRNA sequence
gattttagacttttagtgat

SEQ ID NO: 447139 - DNA, 20 bp, Artificial
  CRISPR gRNA sequence
tagacttttagtgatgtttg

SEQ ID NO: 447140 - DNA, 20 bp, Artificial
  CRISPR gRNA sequence
agacttttagtgatgtttgg

SEQ ID NO: 447141 - DNA, 20 bp, Artificial
  CRISPR gRNA sequence
gacttttagtgatgtttggc

SEQ ID NO: 447142 - DNA, 20 bp, Artificial
  CRISPR gRNA sequence
ttagtgatgtttggcacatg

SEQ ID NO: 447143 - DNA, 20 bp, Artificial
  CRISPR gRNA sequence
tagtgatgtttggcacatga

SEQ ID NO: 447144 - DNA, 20 bp, Artificial
  CRISPR gRNA sequence
agtgatgtttggcacatgaa

SEQ ID NO: 447145 - DNA, 20 bp, Artificial
  CRISPR gRNA sequence
gtgatgtttggcacatgaat

SEQ ID NO: 447146 - DNA, 20 bp, Artificial
  CRISPR gRNA sequence
ggcacatgaatggaatacaa

SEQ ID NO: 447147 - DNA, 20 bp, Artificial
  CRISPR gRNA sequence
gcacatgaatggaatacaat

SEQ ID NO: 447148 - DNA, 20 bp, Artificial
  CRISPR gRNA sequence
ggattacaaaaatgattctg

SEQ ID NO: 447149 - DNA, 20 bp, Artificial
  CRISPR gRNA sequence
gattacaaaaatgattctgg

SEQ ID NO: 447150 - DNA, 20 bp, Artificial
  CRISPR gRNA sequence
caaaaatgattctgggctag

SEQ ID NO: 447151 - DNA, 20 bp, Artificial
  CRISPR gRNA sequence
tgggctaggtgctgtggctt

SEQ ID NO: 447152 - DNA, 20 bp, Artificial
  CRISPR gRNA sequence
ggctaggtgctgtggcttac

SEQ ID NO: 447153 - DNA, 20 bp, Artificial
  CRISPR gRNA sequence
ggtgctgtggcttacgccta

SEQ ID NO: 447154 - DNA, 20 bp, Artificial
  CRISPR gRNA sequence
tggcttacgcctataagccc

SEQ ID NO: 447155 - DNA, 20 bp, Artificial
  CRISPR gRNA sequence
acgcctataagcccagcact

SEQ ID NO: 447156 - DNA, 20 bp, Artificial
  CRISPR gRNA sequence
cgcctataagcccagcactt

SEQ ID NO: 447157 - DNA, 20 bp, Artificial
  CRISPR gRNA sequence
taagcccagcactttgggag

SEQ ID NO: 447158 - DNA, 20 bp, Artificial
  CRISPR gRNA sequence
tgggaggctgaggtgggagg

SEQ ID NO: 447159 - DNA, 20 bp, Artificial
  CRISPR gRNA sequence
gggaggctgaggtgggagga

SEQ ID NO: 447160 - DNA, 20 bp, Artificial
  CRISPR gRNA sequence
ggaggctgaggtgggaggat

SEQ ID NO: 447161 - DNA, 20 bp, Artificial
  CRISPR gRNA sequence
aggtgggaggatcacatgag

SEQ ID NO: 447162 - DNA, 20 bp, Artificial
  CRISPR gRNA sequence
aagaccagcctgggcaacat

SEQ ID NO: 447163 - DNA, 20 bp, Artificial
  CRISPR gRNA sequence
ggcaacatgatgagacctct

SEQ ID NO: 447164 - DNA, 20 bp, Artificial
  CRISPR gRNA sequence
ttctctacaaaaaaatggaa

SEQ ID NO: 447165 - DNA, 20 bp, Artificial
  CRISPR gRNA sequence
ctctacaaaaaaatggaaac

SEQ ID NO: 447166 - DNA, 20 bp, Artificial
  CRISPR gRNA sequence
tctacaaaaaaatggaaaca

SEQ ID NO: 447167 - DNA, 20 bp, Artificial
  CRISPR gRNA sequence
tacaaaaaaatggaaacatt

SEQ ID NO: 447168 - DNA, 20 bp, Artificial
  CRISPR gRNA sequence
caaaaaaatggaaacattag

SEQ ID NO: 447169 - DNA, 20 bp, Artificial
  CRISPR gRNA sequence
ggtggaaggattgctggagc

SEQ ID NO: 447170 - DNA, 20 bp, Artificial
  CRISPR gRNA sequence
ctggagcacaggagatgaag

SEQ ID NO: 447171 - DNA, 20 bp, Artificial
  CRISPR gRNA sequence
gagcacaggagatgaaggct

SEQ ID NO: 447172 - DNA, 20 bp, Artificial
  CRISPR gRNA sequence
caatgagccatgattgtgcc

SEQ ID NO: 447173 - DNA, 20 bp, Artificial
  CRISPR gRNA sequence
tgccactgcattcccacctg

SEQ ID NO: 447174 - DNA, 20 bp, Artificial
  CRISPR gRNA sequence
cattcccacctgggtgacag

SEQ ID NO: 447175 - DNA, 20 bp, Artificial
  CRISPR gRNA sequence
ccacctgggtgacagagaaa

SEQ ID NO: 447176 - DNA, 20 bp, Artificial
  CRISPR gRNA sequence
ggtgacagagaaagacccag

SEQ ID NO: 447177 - DNA, 20 bp, Artificial
  CRISPR gRNA sequence
tgtccattgaatgctatcta

SEQ ID NO: 447178 - DNA, 20 bp, Artificial
  CRISPR gRNA sequence
tccattgaatgctatctaaa

SEQ ID NO: 447179 - DNA, 20 bp, Artificial
  CRISPR gRNA sequence
aatgctatctaaagcattaa

SEQ ID NO: 447180 - DNA, 20 bp, Artificial
  CRISPR gRNA sequence
tctaaagcattaataatttt

SEQ ID NO: 447181 - DNA, 20 bp, Artificial
  CRISPR gRNA sequence
aagcattaataatttttttt

SEQ ID NO: 447182 - DNA, 20 bp, Artificial
  CRISPR gRNA sequence
ataatttttttttttttttt

SEQ ID NO: 447183 - DNA, 20 bp, Artificial
  CRISPR gRNA sequence
tttttttttttttttgagac

SEQ ID NO: 447184 - DNA, 20 bp, Artificial
  CRISPR gRNA sequence
ttttttttttttttgagacg

SEQ ID NO: 447185 - DNA, 20 bp, Artificial
  CRISPR gRNA sequence
tttttttttttttgagacgg

SEQ ID NO: 447186 - DNA, 20 bp, Artificial
  CRISPR gRNA sequence
ttttttttttttgagacgga

SEQ ID NO: 447187 - DNA, 20 bp, Artificial
  CRISPR gRNA sequence
tttttttttttgagacggag

SEQ ID NO: 447188 - DNA, 20 bp, Artificial
  CRISPR gRNA sequence
ttttttttttgagacggagt

SEQ ID NO: 447189 - DNA, 20 bp, Artificial
  CRISPR gRNA sequence
tttttttttgagacggagtc

SEQ ID NO: 447190 - DNA, 20 bp, Artificial
  CRISPR gRNA sequence
ttttttttgagacggagtct

SEQ ID NO: 447191 - DNA, 20 bp, Artificial
  CRISPR gRNA sequence
tttttttgagacggagtctg

SEQ ID NO: 447192 - DNA, 20 bp, Artificial
  CRISPR gRNA sequence
ttttttgagacggagtctgg

SEQ ID NO: 447193 - DNA, 20 bp, Artificial
  CRISPR gRNA sequence
tttttgagacggagtctggc

SEQ ID NO: 447194 - DNA, 20 bp, Artificial
  CRISPR gRNA sequence
ttttgagacggagtctggct

SEQ ID NO: 447195 - DNA, 20 bp, Artificial
  CRISPR gRNA sequence
tttgagacggagtctggctc

SEQ ID NO: 447196 - DNA, 20 bp, Artificial
  CRISPR gRNA sequence
ttgagacggagtctggctct

SEQ ID NO: 447197 - DNA, 20 bp, Artificial
  CRISPR gRNA sequence
tgagacggagtctggctctg

SEQ ID NO: 447198 - DNA, 20 bp, Artificial
  CRISPR gRNA sequence
gagacggagtctggctctgt

SEQ ID NO: 447199 - DNA, 20 bp, Artificial
  CRISPR gRNA sequence
agacggagtctggctctgtc

SEQ ID NO: 447200 - DNA, 20 bp, Artificial
  CRISPR gRNA sequence
gctctgtcacccaggctgga

SEQ ID NO: 447201 - DNA, 20 bp, Artificial
  CRISPR gRNA sequence
tgtcacccaggctggagtgc

SEQ ID NO: 447202 - DNA, 20 bp, Artificial
  CRISPR gRNA sequence
tcacccaggctggagtgcag

SEQ ID NO: 447203 - DNA, 20 bp, Artificial
  CRISPR gRNA sequence
gagtgcagtggcacaacctc

SEQ ID NO: 447204 - DNA, 20 bp, Artificial
  CRISPR gRNA sequence
ggctcactataacctctgct

SEQ ID NO: 447205 - DNA, 20 bp, Artificial
  CRISPR gRNA sequence
actataacctctgcttctcg

SEQ ID NO: 447206 - DNA, 20 bp, Artificial
  CRISPR gRNA sequence
taacctctgcttctcgggtt

SEQ ID NO: 447207 - DNA, 20 bp, Artificial
  CRISPR gRNA sequence
tgcttctcgggttcaagcga

SEQ ID NO: 447208 - DNA, 20 bp, Artificial
  CRISPR gRNA sequence
cttctcgggttcaagcgatt

SEQ ID NO: 447209 - DNA, 20 bp, Artificial
  CRISPR gRNA sequence
ctcgggttcaagcgattctc

SEQ ID NO: 447210 - DNA, 20 bp, Artificial
  CRISPR gRNA sequence
tcgggttcaagcgattctct

SEQ ID NO: 447211 - DNA, 20 bp, Artificial
  CRISPR gRNA sequence
gggttcaagcgattctctgc

SEQ ID NO: 447212 - DNA, 20 bp, Artificial
  CRISPR gRNA sequence
aagcgattctctgcattagc

SEQ ID NO: 447213 - DNA, 20 bp, Artificial
  CRISPR gRNA sequence
tctgcattagcctcccaagt

SEQ ID NO: 447214 - DNA, 20 bp, Artificial
  CRISPR gRNA sequence
tgcattagcctcccaagtag

SEQ ID NO: 447215 - DNA, 20 bp, Artificial
  CRISPR gRNA sequence
cattagcctcccaagtagct

SEQ ID NO: 447216 - DNA, 20 bp, Artificial
  CRISPR gRNA sequence
gcctcccaagtagctgggat

SEQ ID NO: 447217 - DNA, 20 bp, Artificial
  CRISPR gRNA sequence
ccaagtagctgggattacag

SEQ ID NO: 447218 - DNA, 20 bp, Artificial
  CRISPR gRNA sequence
ggattacaggtgcatgccac

SEQ ID NO: 447219 - DNA, 20 bp, Artificial
  CRISPR gRNA sequence
caggtgcatgccaccacgct

SEQ ID NO: 447220 - DNA, 20 bp, Artificial
  CRISPR gRNA sequence
gctaattttttgtatgttta

SEQ ID NO: 447221 - DNA, 20 bp, Artificial
  CRISPR gRNA sequence
attttttgtatgtttagtag

SEQ ID NO: 447222 - DNA, 20 bp, Artificial
  CRISPR gRNA sequence
tttgtatgtttagtagagac

SEQ ID NO: 447223 - DNA, 20 bp, Artificial
  CRISPR gRNA sequence
ttgtatgtttagtagagacg

SEQ ID NO: 447224 - DNA, 20 bp, Artificial
  CRISPR gRNA sequence
tgtatgtttagtagagacgg

SEQ ID NO: 447225 - DNA, 20 bp, Artificial
  CRISPR gRNA sequence
gtatgtttagtagagacggg

SEQ ID NO: 447226 - DNA, 20 bp, Artificial
  CRISPR gRNA sequence
tatgtttagtagagacgggg

SEQ ID NO: 447227 - DNA, 20 bp, Artificial
  CRISPR gRNA sequence
agtagagacggggtttcact

SEQ ID NO: 447228 - DNA, 20 bp, Artificial
  CRISPR gRNA sequence
gtagagacggggtttcacta

SEQ ID NO: 447229 - DNA, 20 bp, Artificial
  CRISPR gRNA sequence
cactatgttggccaggctgg

SEQ ID NO: 447230 - DNA, 20 bp, Artificial
  CRISPR gRNA sequence
actatgttggccaggctggt

SEQ ID NO: 447231 - DNA, 20 bp, Artificial
  CRISPR gRNA sequence
tgttggccaggctggtctcg

SEQ ID NO: 447232 - DNA, 20 bp, Artificial
  CRISPR gRNA sequence
gccaggctggtctcgaactc

SEQ ID NO: 447233 - DNA, 20 bp, Artificial
  CRISPR gRNA sequence
gtctcgaactcctgacctcg

SEQ ID NO: 447234 - DNA, 20 bp, Artificial
  CRISPR gRNA sequence
gaactcctgacctcgtgatc

SEQ ID NO: 447235 - DNA, 20 bp, Artificial
  CRISPR gRNA sequence
ctgacctcgtgatctgccag

SEQ ID NO: 447236 - DNA, 20 bp, Artificial
  CRISPR gRNA sequence
acctcgtgatctgccaggct

SEQ ID NO: 447237 - DNA, 20 bp, Artificial
  CRISPR gRNA sequence
gtgatctgccaggctcagcc

SEQ ID NO: 447238 - DNA, 20 bp, Artificial
  CRISPR gRNA sequence
ccaggctcagcctcccaaag

SEQ ID NO: 447239 - DNA, 20 bp, Artificial
  CRISPR gRNA sequence
agcctcccaaagtgctggga

SEQ ID NO: 447240 - DNA, 20 bp, Artificial
  CRISPR gRNA sequence
ccaaagtgctgggattacag

SEQ ID NO: 447241 - DNA, 20 bp, Artificial
  CRISPR gRNA sequence
ggattacaggcgtgagccac

SEQ ID NO: 447242 - DNA, 20 bp, Artificial
  CRISPR gRNA sequence
caggcgtgagccacggcgcc

SEQ ID NO: 447243 - DNA, 20 bp, Artificial
  CRISPR gRNA sequence
tttgaaaatctaaatgtgta

SEQ ID NO: 447244 - DNA, 20 bp, Artificial
  CRISPR gRNA sequence
ttgaaaatctaaatgtgtac

SEQ ID NO: 447245 - DNA, 20 bp, Artificial
  CRISPR gRNA sequence
tgaaaatctaaatgtgtaca

SEQ ID NO: 447246 - DNA, 20 bp, Artificial
  CRISPR gRNA sequence
gaaaatctaaatgtgtacat

SEQ ID NO: 447247 - DNA, 20 bp, Artificial
  CRISPR gRNA sequence
aaaatctaaatgtgtacata

SEQ ID NO: 447248 - DNA, 20 bp, Artificial
  CRISPR gRNA sequence
aatgtgtacataattgcaga

SEQ ID NO: 447249 - DNA, 20 bp, Artificial
  CRISPR gRNA sequence
cagacatcttgatacttcac

SEQ ID NO: 447250 - DNA, 20 bp, Artificial
  CRISPR gRNA sequence
gatacttcacctaaacttca

SEQ ID NO: 447251 - DNA, 20 bp, Artificial
  CRISPR gRNA sequence
atacttcacctaaacttcag

SEQ ID NO: 447252 - DNA, 20 bp, Artificial
  CRISPR gRNA sequence
cacctaaacttcagcctgca

SEQ ID NO: 447253 - DNA, 20 bp, Artificial
  CRISPR gRNA sequence
acctaaacttcagcctgcac

SEQ ID NO: 447254 - DNA, 20 bp, Artificial
  CRISPR gRNA sequence
aacttcagcctgcacctccg

SEQ ID NO: 447255 - DNA, 20 bp, Artificial
  CRISPR gRNA sequence
cagcctgcacctccgagaaa

SEQ ID NO: 447256 - DNA, 20 bp, Artificial
  CRISPR gRNA sequence
agcctgcacctccgagaaat

SEQ ID NO: 447257 - DNA, 20 bp, Artificial
  CRISPR gRNA sequence
cacctccgagaaataaaaat

SEQ ID NO: 447258 - DNA, 20 bp, Artificial
  CRISPR gRNA sequence
cgagaaataaaaatattctc

SEQ ID NO: 447259 - DNA, 20 bp, Artificial
  CRISPR gRNA sequence
tcttagctatcacaatgctg

SEQ ID NO: 447260 - DNA, 20 bp, Artificial
  CRISPR gRNA sequence
ttagctatcacaatgctgtt

SEQ ID NO: 447261 - DNA, 20 bp, Artificial
  CRISPR gRNA sequence
agctatcacaatgctgttgt

SEQ ID NO: 447262 - DNA, 20 bp, Artificial
  CRISPR gRNA sequence
gctatcacaatgctgttgtt

SEQ ID NO: 447263 - DNA, 20 bp, Artificial
  CRISPR gRNA sequence
tcacaatgctgttgttatac

SEQ ID NO: 447264 - DNA, 20 bp, Artificial
  CRISPR gRNA sequence
ttgttatacctaagaaaatt

SEQ ID NO: 447265 - DNA, 20 bp, Artificial
  CRISPR gRNA sequence
ttatacctaagaaaattaaa

SEQ ID NO: 447266 - DNA, 20 bp, Artificial
  CRISPR gRNA sequence
tacctaagaaaattaaaatt

SEQ ID NO: 447267 - DNA, 20 bp, Artificial
  CRISPR gRNA sequence
agaaaattaaaattaatgga

SEQ ID NO: 447268 - DNA, 20 bp, Artificial
  CRISPR gRNA sequence
aaattaatggacattttctc

SEQ ID NO: 447269 - DNA, 20 bp, Artificial
  CRISPR gRNA sequence
atggacattttctcaattgt

SEQ ID NO: 447270 - DNA, 20 bp, Artificial
  CRISPR gRNA sequence
tctcaattgtttccccatag

SEQ ID NO: 447271 - DNA, 20 bp, Artificial
  CRISPR gRNA sequence
ctcaattgtttccccatagt

SEQ ID NO: 447272 - DNA, 20 bp, Artificial
  CRISPR gRNA sequence
tcaattgtttccccatagta

SEQ ID NO: 447273 - DNA, 20 bp, Artificial
  CRISPR gRNA sequence
aattgtttccccatagtatt

SEQ ID NO: 447274 - DNA, 20 bp, Artificial
  CRISPR gRNA sequence
tttccccatagtattttatt

SEQ ID NO: 447275 - DNA, 20 bp, Artificial
  CRISPR gRNA sequence
ccccatagtattttattgct

SEQ ID NO: 447276 - DNA, 20 bp, Artificial
  CRISPR gRNA sequence
cccatagtattttattgcta

SEQ ID NO: 447277 - DNA, 20 bp, Artificial
  CRISPR gRNA sequence
tattgctatttcttggcttt

SEQ ID NO: 447278 - DNA, 20 bp, Artificial
  CRISPR gRNA sequence
attgctatttcttggctttt

SEQ ID NO: 447279 - DNA, 20 bp, Artificial
  CRISPR gRNA sequence
ttgctatttcttggcttttc

SEQ ID NO: 447280 - DNA, 20 bp, Artificial
  CRISPR gRNA sequence
ctatttcttggcttttccac

SEQ ID NO: 447281 - DNA, 20 bp, Artificial
  CRISPR gRNA sequence
tttcttggcttttccacttg

SEQ ID NO: 447282 - DNA, 20 bp, Artificial
  CRISPR gRNA sequence
cttggcttttccacttgttc

SEQ ID NO: 447283 - DNA, 20 bp, Artificial
  CRISPR gRNA sequence
ttggcttttccacttgttca

SEQ ID NO: 447284 - DNA, 20 bp, Artificial
  CRISPR gRNA sequence
ggcttttccacttgttcagc

SEQ ID NO: 447285 - DNA, 20 bp, Artificial
  CRISPR gRNA sequence
gcttttccacttgttcagca

SEQ ID NO: 447286 - DNA, 20 bp, Artificial
  CRISPR gRNA sequence
ttccacttgttcagcatctg

SEQ ID NO: 447287 - DNA, 20 bp, Artificial
  CRISPR gRNA sequence
tccacttgttcagcatctga

SEQ ID NO: 447288 - DNA, 20 bp, Artificial
  CRISPR gRNA sequence
ccacttgttcagcatctgat

SEQ ID NO: 447289 - DNA, 20 bp, Artificial
  CRISPR gRNA sequence
cacttgttcagcatctgatc

SEQ ID NO: 447290 - DNA, 20 bp, Artificial
  CRISPR gRNA sequence
gttcagcatctgatcaaaga

SEQ ID NO: 447291 - DNA, 20 bp, Artificial
  CRISPR gRNA sequence
ttcagcatctgatcaaagat

SEQ ID NO: 447292 - DNA, 20 bp, Artificial
  CRISPR gRNA sequence
agcatctgatcaaagatcat

SEQ ID NO: 447293 - DNA, 20 bp, Artificial
  CRISPR gRNA sequence
atcaaagatcatgcactata

SEQ ID NO: 447294 - DNA, 20 bp, Artificial
  CRISPR gRNA sequence
tatttagttgctgtctcttt

SEQ ID NO: 447295 - DNA, 20 bp, Artificial
  CRISPR gRNA sequence
agttgctgtctctttgggaa

SEQ ID NO: 447296 - DNA, 20 bp, Artificial
  CRISPR gRNA sequence
gttgctgtctctttgggaaa

SEQ ID NO: 447297 - DNA, 20 bp, Artificial
  CRISPR gRNA sequence
ctgtctctttgggaaagcct

SEQ ID NO: 447298 - DNA, 20 bp, Artificial
  CRISPR gRNA sequence
tctctttgggaaagcctatt

SEQ ID NO: 447299 - DNA, 20 bp, Artificial
  CRISPR gRNA sequence
tttgggaaagcctattctct

SEQ ID NO: 447300 - DNA, 20 bp, Artificial
  CRISPR gRNA sequence
tgggaaagcctattctctta

SEQ ID NO: 447301 - DNA, 20 bp, Artificial
  CRISPR gRNA sequence
gggaaagcctattctcttaa

SEQ ID NO: 447302 - DNA, 20 bp, Artificial
  CRISPR gRNA sequence
ggaaagcctattctcttaac

SEQ ID NO: 447303 - DNA, 20 bp, Artificial
  CRISPR gRNA sequence
ttctcttaactctattccgt

SEQ ID NO: 447304 - DNA, 20 bp, Artificial
  CRISPR gRNA sequence
tcttaactctattccgtgtt

SEQ ID NO: 447305 - DNA, 20 bp, Artificial
  CRISPR gRNA sequence
ttaactctattccgtgttac

SEQ ID NO: 447306 - DNA, 20 bp, Artificial
  CRISPR gRNA sequence
aactctattccgtgttacct

SEQ ID NO: 447307 - DNA, 20 bp, Artificial
  CRISPR gRNA sequence
actctattccgtgttacctg

SEQ ID NO: 447308 - DNA, 20 bp, Artificial
  CRISPR gRNA sequence
tattccgtgttacctgggaa

SEQ ID NO: 447309 - DNA, 20 bp, Artificial
  CRISPR gRNA sequence
ttccgtgttacctgggaaat

SEQ ID NO: 447310 - DNA, 20 bp, Artificial
  CRISPR gRNA sequence
cgtgttacctgggaaatgct

SEQ ID NO: 447311 - DNA, 20 bp, Artificial
  CRISPR gRNA sequence
cctgggaaatgcttaactca

SEQ ID NO: 447312 - DNA, 20 bp, Artificial
  CRISPR gRNA sequence
ggaaatgcttaactcaaccg

SEQ ID NO: 447313 - DNA, 20 bp, Artificial
  CRISPR gRNA sequence
aactcaaccgcaacacttta

SEQ ID NO: 447314 - DNA, 20 bp, Artificial
  CRISPR gRNA sequence
actcaaccgcaacactttat

SEQ ID NO: 447315 - DNA, 20 bp, Artificial
  CRISPR gRNA sequence
aaccgcaacactttatttcc

SEQ ID NO: 447316 - DNA, 20 bp, Artificial
  CRISPR gRNA sequence
tatttccacagcctcatctc

SEQ ID NO: 447317 - DNA, 20 bp, Artificial
  CRISPR gRNA sequence
atttccacagcctcatctct

SEQ ID NO: 447318 - DNA, 20 bp, Artificial
  CRISPR gRNA sequence
tttccacagcctcatctctt

SEQ ID NO: 447319 - DNA, 20 bp, Artificial
  CRISPR gRNA sequence
ccacagcctcatctctttgg

SEQ ID NO: 447320 - DNA, 20 bp, Artificial
  CRISPR gRNA sequence
cacagcctcatctctttggc

SEQ ID NO: 447321 - DNA, 20 bp, Artificial
  CRISPR gRNA sequence
atctctttggccaacctccc

SEQ ID NO: 447322 - DNA, 20 bp, Artificial
  CRISPR gRNA sequence
tttggccaacctccctccct

SEQ ID NO: 447323 - DNA, 20 bp, Artificial
  CRISPR gRNA sequence
tggccaacctccctccctca

SEQ ID NO: 447324 - DNA, 20 bp, Artificial
  CRISPR gRNA sequence
ggccaacctccctccctcag

SEQ ID NO: 447325 - DNA, 20 bp, Artificial
  CRISPR gRNA sequence
gccaacctccctccctcagg

SEQ ID NO: 447326 - DNA, 20 bp, Artificial
  CRISPR gRNA sequence
cctccctcaggattggcaaa

SEQ ID NO: 447327 - DNA, 20 bp, Artificial
  CRISPR gRNA sequence
cctcaggattggcaaatgca

SEQ ID NO: 447328 - DNA, 20 bp, Artificial
  CRISPR gRNA sequence
aggattggcaaatgcagtag

SEQ ID NO: 447329 - DNA, 20 bp, Artificial
  CRISPR gRNA sequence
gcaaatgcagtagcagaggg

SEQ ID NO: 447330 - DNA, 20 bp, Artificial
  CRISPR gRNA sequence
gctcagaagaaaacatctat

SEQ ID NO: 447331 - DNA, 20 bp, Artificial
  CRISPR gRNA sequence
agaagaaaacatctatacca

SEQ ID NO: 447332 - DNA, 20 bp, Artificial
  CRISPR gRNA sequence
taccattgaagagaacgtat

SEQ ID NO: 447333 - DNA, 20 bp, Artificial
  CRISPR gRNA sequence
aagagaacgtatatgaagtg

SEQ ID NO: 447334 - DNA, 20 bp, Artificial
  CRISPR gRNA sequence
ttgctatgtcagcagcaggc

SEQ ID NO: 447335 - DNA, 20 bp, Artificial
  CRISPR gRNA sequence
ctatgtcagcagcaggcagc

SEQ ID NO: 447336 - DNA, 20 bp, Artificial
  CRISPR gRNA sequence
tgtcagcagcaggcagcaac

SEQ ID NO: 447337 - DNA, 20 bp, Artificial
  CRISPR gRNA sequence
acaacctttgggttgtcgct

SEQ ID NO: 447338 - DNA, 20 bp, Artificial
  CRISPR gRNA sequence
tgggttgtcgctttgcaatg

SEQ ID NO: 447339 - DNA, 20 bp, Artificial
  CRISPR gRNA sequence
gggttgtcgctttgcaatgc

SEQ ID NO: 447340 - DNA, 20 bp, Artificial
  CRISPR gRNA sequence
ggttgtcgctttgcaatgcc

SEQ ID NO: 447341 - DNA, 20 bp, Artificial
  CRISPR gRNA sequence
tcgctttgcaatgccataga

SEQ ID NO: 447342 - DNA, 20 bp, Artificial
  CRISPR gRNA sequence
tgcaatgccatagatccaac

SEQ ID NO: 447343 - DNA, 20 bp, Artificial
  CRISPR gRNA sequence
gcaatgccatagatccaacc

SEQ ID NO: 447344 - DNA, 20 bp, Artificial
  CRISPR gRNA sequence
caatgccatagatccaacca

SEQ ID NO: 447345 - DNA, 20 bp, Artificial
  CRISPR gRNA sequence
atttttgagcttggtgtttt

SEQ ID NO: 447346 - DNA, 20 bp, Artificial
  CRISPR gRNA sequence
tttttgagcttggtgttttg

SEQ ID NO: 447347 - DNA, 20 bp, Artificial
  CRISPR gRNA sequence
ttgagcttggtgttttgtct

SEQ ID NO: 447348 - DNA, 20 bp, Artificial
  CRISPR gRNA sequence
tgagcttggtgttttgtctt

SEQ ID NO: 447349 - DNA, 20 bp, Artificial
  CRISPR gRNA sequence
gagcttggtgttttgtcttt

SEQ ID NO: 447350 - DNA, 20 bp, Artificial
  CRISPR gRNA sequence
agcttggtgttttgtctttt

SEQ ID NO: 447351 - DNA, 20 bp, Artificial
  CRISPR gRNA sequence
ggtgttttgtctttttcaga

SEQ ID NO: 447352 - DNA, 20 bp, Artificial
  CRISPR gRNA sequence
gtgttttgtctttttcagaa

SEQ ID NO: 447353 - DNA, 20 bp, Artificial
  CRISPR gRNA sequence
tgtctttttcagaaactatg

SEQ ID NO: 447354 - DNA, 20 bp, Artificial
  CRISPR gRNA sequence
gtctttttcagaaactatga

SEQ ID NO: 447355 - DNA, 20 bp, Artificial
  CRISPR gRNA sequence
tctttttcagaaactatgag

SEQ ID NO: 447356 - DNA, 20 bp, Artificial
  CRISPR gRNA sequence
tttcagaaactatgagctgt

SEQ ID NO: 447357 - DNA, 20 bp, Artificial
  CRISPR gRNA sequence
ttcagaaactatgagctgtg

SEQ ID NO: 447358 - DNA, 20 bp, Artificial
  CRISPR gRNA sequence
tcagaaactatgagctgtgt

SEQ ID NO: 447359 - DNA, 20 bp, Artificial
  CRISPR gRNA sequence
cagaaactatgagctgtgtc

SEQ ID NO: 447360 - DNA, 20 bp, Artificial
  CRISPR gRNA sequence
agaaactatgagctgtgtca

SEQ ID NO: 447361 - DNA, 20 bp, Artificial
  CRISPR gRNA sequence
tgagctgtgtcacctgactg

SEQ ID NO: 447362 - DNA, 20 bp, Artificial
  CRISPR gRNA sequence
tgtcacctgactggttttgg

SEQ ID NO: 447363 - DNA, 20 bp, Artificial
  CRISPR gRNA sequence
actggttttggaggttctgt

SEQ ID NO: 447364 - DNA, 20 bp, Artificial
  CRISPR gRNA sequence
gttttggaggttctgtccac

SEQ ID NO: 447365 - DNA, 20 bp, Artificial
  CRISPR gRNA sequence
tggaggttctgtccactgct

SEQ ID NO: 447366 - DNA, 20 bp, Artificial
  CRISPR gRNA sequence
ggaggttctgtccactgcta

SEQ ID NO: 447367 - DNA, 20 bp, Artificial
  CRISPR gRNA sequence
gaggttctgtccactgctat

SEQ ID NO: 447368 - DNA, 20 bp, Artificial
  CRISPR gRNA sequence
tgtccactgctatggagcag

SEQ ID NO: 447369 - DNA, 20 bp, Artificial
  CRISPR gRNA sequence
tccactgctatggagcagag

SEQ ID NO: 447370 - DNA, 20 bp, Artificial
  CRISPR gRNA sequence
ctatggagcagagttttccc

SEQ ID NO: 447371 - DNA, 20 bp, Artificial
  CRISPR gRNA sequence
tggagcagagttttcccatt

SEQ ID NO: 447372 - DNA, 20 bp, Artificial
  CRISPR gRNA sequence
tcccattttcagaagataat

SEQ ID NO: 447373 - DNA, 20 bp, Artificial
  CRISPR gRNA sequence
cccattttcagaagataatg

SEQ ID NO: 447374 - DNA, 20 bp, Artificial
  CRISPR gRNA sequence
ccattttcagaagataatga

SEQ ID NO: 447375 - DNA, 20 bp, Artificial
  CRISPR gRNA sequence
tcagaagataatgactcaca

SEQ ID NO: 447376 - DNA, 20 bp, Artificial
  CRISPR gRNA sequence
cagaagataatgactcacat

SEQ ID NO: 447377 - DNA, 20 bp, Artificial
  CRISPR gRNA sequence
agaagataatgactcacatg

SEQ ID NO: 447378 - DNA, 20 bp, Artificial
  CRISPR gRNA sequence
acatgggaattgaactggga

SEQ ID NO: 447379 - DNA, 20 bp, Artificial
  CRISPR gRNA sequence
aactgggacctgcactgaac

SEQ ID NO: 447380 - DNA, 20 bp, Artificial
  CRISPR gRNA sequence
ggacctgcactgaacttaaa

SEQ ID NO: 447381 - DNA, 20 bp, Artificial
  CRISPR gRNA sequence
cactgaacttaaacaggcat

SEQ ID NO: 447382 - DNA, 20 bp, Artificial
  CRISPR gRNA sequence
aacttaaacaggcatgtcat

SEQ ID NO: 447383 - DNA, 20 bp, Artificial
  CRISPR gRNA sequence
aaacaggcatgtcattgcct

SEQ ID NO: 447384 - DNA, 20 bp, Artificial
  CRISPR gRNA sequence
aacaggcatgtcattgcctc

SEQ ID NO: 447385 - DNA, 20 bp, Artificial
  CRISPR gRNA sequence
cctctgtatttaagccaaca

SEQ ID NO: 447386 - DNA, 20 bp, Artificial
  CRISPR gRNA sequence
tgtatttaagccaacagagt

SEQ ID NO: 447387 - DNA, 20 bp, Artificial
  CRISPR gRNA sequence
tatttaagccaacagagtta

SEQ ID NO: 447388 - DNA, 20 bp, Artificial
  CRISPR gRNA sequence
aagccaacagagttacccaa

SEQ ID NO: 447389 - DNA, 20 bp, Artificial
  CRISPR gRNA sequence
agccaacagagttacccaac

SEQ ID NO: 447390 - DNA, 20 bp, Artificial
  CRISPR gRNA sequence
cccaacccagagactgttaa

SEQ ID NO: 447391 - DNA, 20 bp, Artificial
  CRISPR gRNA sequence
ttaatcatggatgttagagc

SEQ ID NO: 447392 - DNA, 20 bp, Artificial
  CRISPR gRNA sequence
atcatggatgttagagctca

SEQ ID NO: 447393 - DNA, 20 bp, Artificial
  CRISPR gRNA sequence
gagctcaaacgggcttttat

SEQ ID NO: 447394 - DNA, 20 bp, Artificial
  CRISPR gRNA sequence
aaacgggcttttatatacac

SEQ ID NO: 447395 - DNA, 20 bp, Artificial
  CRISPR gRNA sequence
ttatatacactaggaattct

SEQ ID NO: 447396 - DNA, 20 bp, Artificial
  CRISPR gRNA sequence
tatatacactaggaattctt

SEQ ID NO: 447397 - DNA, 20 bp, Artificial
  CRISPR gRNA sequence
atatacactaggaattcttg

SEQ ID NO: 447398 - DNA, 20 bp, Artificial
  CRISPR gRNA sequence
tatacactaggaattcttga

SEQ ID NO: 447399 - DNA, 20 bp, Artificial
  CRISPR gRNA sequence
ggaattcttgacgtggggtc

SEQ ID NO: 447400 - DNA, 20 bp, Artificial
  CRISPR gRNA sequence
ttgacgtggggtctctggag

SEQ ID NO: 447401 - DNA, 20 bp, Artificial
  CRISPR gRNA sequence
gacgtggggtctctggagct

SEQ ID NO: 447402 - DNA, 20 bp, Artificial
  CRISPR gRNA sequence
acgtggggtctctggagctc

SEQ ID NO: 447403 - DNA, 20 bp, Artificial
  CRISPR gRNA sequence
tggagctccaggaaattcgg

SEQ ID NO: 447404 - DNA, 20 bp, Artificial
  CRISPR gRNA sequence
gagctccaggaaattcgggc

SEQ ID NO: 447405 - DNA, 20 bp, Artificial
  CRISPR gRNA sequence
caggaaattcgggcacatca

SEQ ID NO: 447406 - DNA, 20 bp, Artificial
  CRISPR gRNA sequence
gggcacatcatatgtccatg

SEQ ID NO: 447407 - DNA, 20 bp, Artificial
  CRISPR gRNA sequence
cagataaactagggaaaact

SEQ ID NO: 447408 - DNA, 20 bp, Artificial
  CRISPR gRNA sequence
agataaactagggaaaactg

SEQ ID NO: 447409 - DNA, 20 bp, Artificial
  CRISPR gRNA sequence
gggaaaactgggtgctgagg

SEQ ID NO: 447410 - DNA, 20 bp, Artificial
  CRISPR gRNA sequence
ggtgctgaggtgaaagcata

SEQ ID NO: 447411 - DNA, 20 bp, Artificial
  CRISPR gRNA sequence
aggtgaaagcataacttttt

SEQ ID NO: 447412 - DNA, 20 bp, Artificial
  CRISPR gRNA sequence
ttttggcacagaaagtctaa

SEQ ID NO: 447413 - DNA, 20 bp, Artificial
  CRISPR gRNA sequence
tttggcacagaaagtctaaa

SEQ ID NO: 447414 - DNA, 20 bp, Artificial
  CRISPR gRNA sequence
ttggcacagaaagtctaaag

SEQ ID NO: 447415 - DNA, 20 bp, Artificial
  CRISPR gRNA sequence
tggcacagaaagtctaaagg

SEQ ID NO: 447416 - DNA, 20 bp, Artificial
  CRISPR gRNA sequence
ggcacagaaagtctaaaggg

SEQ ID NO: 447417 - DNA, 20 bp, Artificial
  CRISPR gRNA sequence
gcacagaaagtctaaagggg

SEQ ID NO: 447418 - DNA, 20 bp, Artificial
  CRISPR gRNA sequence
aaggggccactgattttcaa

SEQ ID NO: 447419 - DNA, 20 bp, Artificial
  CRISPR gRNA sequence
attttcaaagagatctgtga

SEQ ID NO: 447420 - DNA, 20 bp, Artificial
  CRISPR gRNA sequence
tcaaagagatctgtgatccc

SEQ ID NO: 447421 - DNA, 20 bp, Artificial
  CRISPR gRNA sequence
caaagagatctgtgatccct

SEQ ID NO: 447422 - DNA, 20 bp, Artificial
  CRISPR gRNA sequence
aaagagatctgtgatccctt

SEQ ID NO: 447423 - DNA, 20 bp, Artificial
  CRISPR gRNA sequence
tgatccctttttgttttttg

SEQ ID NO: 447424 - DNA, 20 bp, Artificial
  CRISPR gRNA sequence
tttgttttttgtttttgaga

SEQ ID NO: 447425 - DNA, 20 bp, Artificial
  CRISPR gRNA sequence
ttgttttttgtttttgagat

SEQ ID NO: 447426 - DNA, 20 bp, Artificial
  CRISPR gRNA sequence
tgttttttgtttttgagatg

SEQ ID NO: 447427 - DNA, 20 bp, Artificial
  CRISPR gRNA sequence
gttttttgtttttgagatgg

SEQ ID NO: 447428 - DNA, 20 bp, Artificial
  CRISPR gRNA sequence
ttttttgtttttgagatgga

SEQ ID NO: 447429 - DNA, 20 bp, Artificial
  CRISPR gRNA sequence
tttgtttttgagatggagtc

SEQ ID NO: 447430 - DNA, 20 bp, Artificial
  CRISPR gRNA sequence
ttgtttttgagatggagtct

SEQ ID NO: 447431 - DNA, 20 bp, Artificial
  CRISPR gRNA sequence
tgtttttgagatggagtctt

SEQ ID NO: 447432 - DNA, 20 bp, Artificial
  CRISPR gRNA sequence
gtttttgagatggagtcttg

SEQ ID NO: 447433 - DNA, 20 bp, Artificial
  CRISPR gRNA sequence
tttttgagatggagtcttgc

SEQ ID NO: 447434 - DNA, 20 bp, Artificial
  CRISPR gRNA sequence
ttgagatggagtcttgctct

SEQ ID NO: 447435 - DNA, 20 bp, Artificial
  CRISPR gRNA sequence
tgagatggagtcttgctctg

SEQ ID NO: 447436 - DNA, 20 bp, Artificial
  CRISPR gRNA sequence
gagatggagtcttgctctgt

SEQ ID NO: 447437 - DNA, 20 bp, Artificial
  CRISPR gRNA sequence
agatggagtcttgctctgtt

SEQ ID NO: 447438 - DNA, 20 bp, Artificial
  CRISPR gRNA sequence
gctctgttgcccaggctgga

SEQ ID NO: 447439 - DNA, 20 bp, Artificial
  CRISPR gRNA sequence
ctctgttgcccaggctggag

SEQ ID NO: 447440 - DNA, 20 bp, Artificial
  CRISPR gRNA sequence
tgttgcccaggctggagtgc

SEQ ID NO: 447441 - DNA, 20 bp, Artificial
  CRISPR gRNA sequence
ttgcccaggctggagtgcaa

SEQ ID NO: 447442 - DNA, 20 bp, Artificial
  CRISPR gRNA sequence
cccaggctggagtgcaatgg

SEQ ID NO: 447443 - DNA, 20 bp, Artificial
  CRISPR gRNA sequence
gagtgcaatggcacaatctc

SEQ ID NO: 447444 - DNA, 20 bp, Artificial
  CRISPR gRNA sequence
ggctcactgcaagctccgcc

SEQ ID NO: 447445 - DNA, 20 bp, Artificial
  CRISPR gRNA sequence
actgcaagctccgcctcctg

SEQ ID NO: 447446 - DNA, 20 bp, Artificial
  CRISPR gRNA sequence
caagctccgcctcctgggtt

SEQ ID NO: 447447 - DNA, 20 bp, Artificial
  CRISPR gRNA sequence
cgcctcctgggttcaagcga

SEQ ID NO: 447448 - DNA, 20 bp, Artificial
  CRISPR gRNA sequence
ctgggttcaagcgattctcc

SEQ ID NO: 447449 - DNA, 20 bp, Artificial
  CRISPR gRNA sequence
ggttcaagcgattctcctgc

SEQ ID NO: 447450 - DNA, 20 bp, Artificial
  CRISPR gRNA sequence
aagcgattctcctgcctcag

SEQ ID NO: 447451 - DNA, 20 bp, Artificial
  CRISPR gRNA sequence
tcctgcctcagcctcctgag

SEQ ID NO: 447452 - DNA, 20 bp, Artificial
  CRISPR gRNA sequence
ctgcctcagcctcctgagtg

SEQ ID NO: 447453 - DNA, 20 bp, Artificial
  CRISPR gRNA sequence
cctcagcctcctgagtggct

SEQ ID NO: 447454 - DNA, 20 bp, Artificial
  CRISPR gRNA sequence
agcctcctgagtggctggga

SEQ ID NO: 447455 - DNA, 20 bp, Artificial
  CRISPR gRNA sequence
ctgagtggctgggattacag

SEQ ID NO: 447456 - DNA, 20 bp, Artificial
  CRISPR gRNA sequence
agtggctgggattacaggca

SEQ ID NO: 447457 - DNA, 20 bp, Artificial
  CRISPR gRNA sequence
ggattacaggcatgcaccac

SEQ ID NO: 447458 - DNA, 20 bp, Artificial
  CRISPR gRNA sequence
caggcatgcaccaccatgcc

SEQ ID NO: 447459 - DNA, 20 bp, Artificial
  CRISPR gRNA sequence
atttgttgtatttttagtag

SEQ ID NO: 447460 - DNA, 20 bp, Artificial
  CRISPR gRNA sequence
gttgtatttttagtagagac

SEQ ID NO: 447461 - DNA, 20 bp, Artificial
  CRISPR gRNA sequence
ttgtatttttagtagagaca

SEQ ID NO: 447462 - DNA, 20 bp, Artificial
  CRISPR gRNA sequence
tatttttagtagagacaggg

SEQ ID NO: 447463 - DNA, 20 bp, Artificial
  CRISPR gRNA sequence
ttagtagagacagggtttca

SEQ ID NO: 447464 - DNA, 20 bp, Artificial
  CRISPR gRNA sequence
tagtagagacagggtttcac

SEQ ID NO: 447465 - DNA, 20 bp, Artificial
  CRISPR gRNA sequence
agtagagacagggtttcacc

SEQ ID NO: 447466 - DNA, 20 bp, Artificial
  CRISPR gRNA sequence
gtagagacagggtttcacca

SEQ ID NO: 447467 - DNA, 20 bp, Artificial
  CRISPR gRNA sequence
caccatgttggccagtgtgg

SEQ ID NO: 447468 - DNA, 20 bp, Artificial
  CRISPR gRNA sequence
accatgttggccagtgtggt

SEQ ID NO: 447469 - DNA, 20 bp, Artificial
  CRISPR gRNA sequence
gccagtgtggtctcaaactc

SEQ ID NO: 447470 - DNA, 20 bp, Artificial
  CRISPR gRNA sequence
aaactcctgacctcatgatt

SEQ ID NO: 447471 - DNA, 20 bp, Artificial
  CRISPR gRNA sequence
ctgacctcatgatttgcctg

SEQ ID NO: 447472 - DNA, 20 bp, Artificial
  CRISPR gRNA sequence
acctcatgatttgcctgcct

SEQ ID NO: 447473 - DNA, 20 bp, Artificial
  CRISPR gRNA sequence
atgatttgcctgcctcggcc

SEQ ID NO: 447474 - DNA, 20 bp, Artificial
  CRISPR gRNA sequence
gcctgcctcggcctcccaaa

SEQ ID NO: 447475 - DNA, 20 bp, Artificial
  CRISPR gRNA sequence
cctgcctcggcctcccaaag

SEQ ID NO: 447476 - DNA, 20 bp, Artificial
  CRISPR gRNA sequence
cctcggcctcccaaagcact

SEQ ID NO: 447477 - DNA, 20 bp, Artificial
  CRISPR gRNA sequence
ggcctcccaaagcactggga

SEQ ID NO: 447478 - DNA, 20 bp, Artificial
  CRISPR gRNA sequence
ccaaagcactgggattacag

SEQ ID NO: 447479 - DNA, 20 bp, Artificial
  CRISPR gRNA sequence
ggattacaggcgtgagccac

SEQ ID NO: 447480 - DNA, 20 bp, Artificial
  CRISPR gRNA sequence
caggcgtgagccaccacatc

SEQ ID NO: 447481 - DNA, 20 bp, Artificial
  CRISPR gRNA sequence
aaaagattaagagatgactg

SEQ ID NO: 447482 - DNA, 20 bp, Artificial
  CRISPR gRNA sequence
aaagattaagagatgactgg

SEQ ID NO: 447483 - DNA, 20 bp, Artificial
  CRISPR gRNA sequence
agagatgactggaccaggtc

SEQ ID NO: 447484 - DNA, 20 bp, Artificial
  CRISPR gRNA sequence
gaccaggtctaccttgatct

SEQ ID NO: 447485 - DNA, 20 bp, Artificial
  CRISPR gRNA sequence
ccttgatcttgaagattccc

SEQ ID NO: 447486 - DNA, 20 bp, Artificial
  CRISPR gRNA sequence
gatcttgaagattcccttgg

SEQ ID NO: 447487 - DNA, 20 bp, Artificial
  CRISPR gRNA sequence
atcttgaagattcccttgga

SEQ ID NO: 447488 - DNA, 20 bp, Artificial
  CRISPR gRNA sequence
gaagattcccttggaatgtt

SEQ ID NO: 447489 - DNA, 20 bp, Artificial
  CRISPR gRNA sequence
aagattcccttggaatgttg

SEQ ID NO: 447490 - DNA, 20 bp, Artificial
  CRISPR gRNA sequence
ccttggaatgttgagattta

SEQ ID NO: 447491 - DNA, 20 bp, Artificial
  CRISPR gRNA sequence
ggaatgttgagatttaggct

SEQ ID NO: 447492 - DNA, 20 bp, Artificial
  CRISPR gRNA sequence
gaatgttgagatttaggctt

SEQ ID NO: 447493 - DNA, 20 bp, Artificial
  CRISPR gRNA sequence
agatttaggcttatttgagc

SEQ ID NO: 447494 - DNA, 20 bp, Artificial
  CRISPR gRNA sequence
aggcttatttgagcactgcc

SEQ ID NO: 447495 - DNA, 20 bp, Artificial
  CRISPR gRNA sequence
ggcttatttgagcactgcct

SEQ ID NO: 447496 - DNA, 20 bp, Artificial
  CRISPR gRNA sequence
atttgagcactgcctgccca

SEQ ID NO: 447497 - DNA, 20 bp, Artificial
  CRISPR gRNA sequence
tttgagcactgcctgcccaa

SEQ ID NO: 447498 - DNA, 20 bp, Artificial
  CRISPR gRNA sequence
gagcactgcctgcccaactg

SEQ ID NO: 447499 - DNA, 20 bp, Artificial
  CRISPR gRNA sequence
agcactgcctgcccaactgt

SEQ ID NO: 447500 - DNA, 20 bp, Artificial
  CRISPR gRNA sequence
cctgcccaactgtcagtgcc

SEQ ID NO: 447501 - DNA, 20 bp, Artificial
  CRISPR gRNA sequence
cccaactgtcagtgccagtg

SEQ ID NO: 447502 - DNA, 20 bp, Artificial
  CRISPR gRNA sequence
tcagtgccagtgcatagccc

SEQ ID NO: 447503 - DNA, 20 bp, Artificial
  CRISPR gRNA sequence
cttttgtctcccttatgaag

SEQ ID NO: 447504 - DNA, 20 bp, Artificial
  CRISPR gRNA sequence
ttttgtctcccttatgaaga

SEQ ID NO: 447505 - DNA, 20 bp, Artificial
  CRISPR gRNA sequence
ttgtctcccttatgaagact

SEQ ID NO: 447506 - DNA, 20 bp, Artificial
  CRISPR gRNA sequence
tgtctcccttatgaagactg

SEQ ID NO: 447507 - DNA, 20 bp, Artificial
  CRISPR gRNA sequence
gtctcccttatgaagactgc

SEQ ID NO: 447508 - DNA, 20 bp, Artificial
  CRISPR gRNA sequence
tctcccttatgaagactgcc

SEQ ID NO: 447509 - DNA, 20 bp, Artificial
  CRISPR gRNA sequence
ccttatgaagactgccctgc

SEQ ID NO: 447510 - DNA, 20 bp, Artificial
  CRISPR gRNA sequence
atgaagactgccctgcaggg

SEQ ID NO: 447511 - DNA, 20 bp, Artificial
  CRISPR gRNA sequence
tgaagactgccctgcagggc

SEQ ID NO: 447512 - DNA, 20 bp, Artificial
  CRISPR gRNA sequence
ccctgcagggctgagatgtg

SEQ ID NO: 447513 - DNA, 20 bp, Artificial
  CRISPR gRNA sequence
cagggctgagatgtggcagg

SEQ ID NO: 447514 - DNA, 20 bp, Artificial
  CRISPR gRNA sequence
agatgtggcaggagctccca

SEQ ID NO: 447515 - DNA, 20 bp, Artificial
  CRISPR gRNA sequence
ccagggaaaaacgaagtgca

SEQ ID NO: 447516 - DNA, 20 bp, Artificial
  CRISPR gRNA sequence
gattggtgtgtattggccaa

SEQ ID NO: 447517 - DNA, 20 bp, Artificial
  CRISPR gRNA sequence
attggtgtgtattggccaag

SEQ ID NO: 447518 - DNA, 20 bp, Artificial
  CRISPR gRNA sequence
gtgtgtattggccaagtttt

SEQ ID NO: 447519 - DNA, 20 bp, Artificial
  CRISPR gRNA sequence
gccaagttttgcttgttgtg

SEQ ID NO: 447520 - DNA, 20 bp, Artificial
  CRISPR gRNA sequence
tgcttgttgtgtgcttgaaa

SEQ ID NO: 447521 - DNA, 20 bp, Artificial
  CRISPR gRNA sequence
gcttgttgtgtgcttgaaag

SEQ ID NO: 447522 - DNA, 20 bp, Artificial
  CRISPR gRNA sequence
cttgttgtgtgcttgaaaga

SEQ ID NO: 447523 - DNA, 20 bp, Artificial
  CRISPR gRNA sequence
gttgtgtgcttgaaagaaaa

SEQ ID NO: 447524 - DNA, 20 bp, Artificial
  CRISPR gRNA sequence
ttgtgtgcttgaaagaaaat

SEQ ID NO: 447525 - DNA, 20 bp, Artificial
  CRISPR gRNA sequence
tgtgcttgaaagaaaatatc

SEQ ID NO: 447526 - DNA, 20 bp, Artificial
  CRISPR gRNA sequence
gaaagaaaatatctctgacc

SEQ ID NO: 447527 - DNA, 20 bp, Artificial
  CRISPR gRNA sequence
aaagaaaatatctctgacca

SEQ ID NO: 447528 - DNA, 20 bp, Artificial
  CRISPR gRNA sequence
tgaccaacttctgtattcgt

SEQ ID NO: 447529 - DNA, 20 bp, Artificial
  CRISPR gRNA sequence
accaacttctgtattcgtgg

SEQ ID NO: 447530 - DNA, 20 bp, Artificial
  CRISPR gRNA sequence
ctgtattcgtggaccaaact

SEQ ID NO: 447531 - DNA, 20 bp, Artificial
  CRISPR gRNA sequence
tgtattcgtggaccaaactg

SEQ ID NO: 447532 - DNA, 20 bp, Artificial
  CRISPR gRNA sequence
tattcgtggaccaaactgaa

SEQ ID NO: 447533 - DNA, 20 bp, Artificial
  CRISPR gRNA sequence
gtggaccaaactgaagctat

SEQ ID NO: 447534 - DNA, 20 bp, Artificial
  CRISPR gRNA sequence
aagctatatttttcacagaa

SEQ ID NO: 447535 - DNA, 20 bp, Artificial
  CRISPR gRNA sequence
tatttttcacagaagaagaa

SEQ ID NO: 447536 - DNA, 20 bp, Artificial
  CRISPR gRNA sequence
ttcacagaagaagaagcagt

SEQ ID NO: 447537 - DNA, 20 bp, Artificial
  CRISPR gRNA sequence
tcacagaagaagaagcagtg

SEQ ID NO: 447538 - DNA, 20 bp, Artificial
  CRISPR gRNA sequence
cacagaagaagaagcagtga

SEQ ID NO: 447539 - DNA, 20 bp, Artificial
  CRISPR gRNA sequence
acagaagaagaagcagtgac

SEQ ID NO: 447540 - DNA, 20 bp, Artificial
  CRISPR gRNA sequence
tgttgcctggtggaaagaag

SEQ ID NO: 447541 - DNA, 20 bp, Artificial
  CRISPR gRNA sequence
ttgcctggtggaaagaaggc

SEQ ID NO: 447542 - DNA, 20 bp, Artificial
  CRISPR gRNA sequence
cctggtggaaagaaggcaaa

SEQ ID NO: 447543 - DNA, 20 bp, Artificial
  CRISPR gRNA sequence
gtggaaagaaggcaaaggcc

SEQ ID NO: 447544 - DNA, 20 bp, Artificial
  CRISPR gRNA sequence
cagcaatctatattaccagc

SEQ ID NO: 447545 - DNA, 20 bp, Artificial
  CRISPR gRNA sequence
agcaatctatattaccagcg

SEQ ID NO: 447546 - DNA, 20 bp, Artificial
  CRISPR gRNA sequence
tattaccagcgctggatcct

SEQ ID NO: 447547 - DNA, 20 bp, Artificial
  CRISPR gRNA sequence
ccagcgctggatcctttgac

SEQ ID NO: 447548 - DNA, 20 bp, Artificial
  CRISPR gRNA sequence
gatcctttgacagagagtgg

SEQ ID NO: 447549 - DNA, 20 bp, Artificial
  CRISPR gRNA sequence
tgacagagagtggtccctaa

SEQ ID NO: 447550 - DNA, 20 bp, Artificial
  CRISPR gRNA sequence
gacagagagtggtccctaaa

SEQ ID NO: 447551 - DNA, 20 bp, Artificial
  CRISPR gRNA sequence
acagagagtggtccctaaac

SEQ ID NO: 447552 - DNA, 20 bp, Artificial
  CRISPR gRNA sequence
aacttaaatttcaagacggt

SEQ ID NO: 447553 - DNA, 20 bp, Artificial
  CRISPR gRNA sequence
aaatttcaagacggtatagg

SEQ ID NO: 447554 - DNA, 20 bp, Artificial
  CRISPR gRNA sequence
aatttcaagacggtataggc

SEQ ID NO: 447555 - DNA, 20 bp, Artificial
  CRISPR gRNA sequence
caagacggtataggcttgat

SEQ ID NO: 447556 - DNA, 20 bp, Artificial
  CRISPR gRNA sequence
aagacggtataggcttgatc

SEQ ID NO: 447557 - DNA, 20 bp, Artificial
  CRISPR gRNA sequence
gatctgtcttgcttattgtt

SEQ ID NO: 447558 - DNA, 20 bp, Artificial
  CRISPR gRNA sequence
atctgtcttgcttattgttg

SEQ ID NO: 447559 - DNA, 20 bp, Artificial
  CRISPR gRNA sequence
tcttgcttattgttgccccc

SEQ ID NO: 447560 - DNA, 20 bp, Artificial
  CRISPR gRNA sequence
gcttattgttgccccctgcg

SEQ ID NO: 447561 - DNA, 20 bp, Artificial
  CRISPR gRNA sequence
cttattgttgccccctgcgc

SEQ ID NO: 447562 - DNA, 20 bp, Artificial
  CRISPR gRNA sequence
attgttgccccctgcgccta

SEQ ID NO: 447563 - DNA, 20 bp, Artificial
  CRISPR gRNA sequence
ttgttgccccctgcgcctag

SEQ ID NO: 447564 - DNA, 20 bp, Artificial
  CRISPR gRNA sequence
ttgccccctgcgcctagcac

SEQ ID NO: 447565 - DNA, 20 bp, Artificial
  CRISPR gRNA sequence
ccccctgcgcctagcacaat

SEQ ID NO: 447566 - DNA, 20 bp, Artificial
  CRISPR gRNA sequence
cgcctagcacaattctgaca

SEQ ID NO: 447567 - DNA, 20 bp, Artificial
  CRISPR gRNA sequence
gcacaattctgacacacaat

SEQ ID NO: 447568 - DNA, 20 bp, Artificial
  CRISPR gRNA sequence
tgacacacaattggaactta

SEQ ID NO: 447569 - DNA, 20 bp, Artificial
  CRISPR gRNA sequence
acacacaattggaacttact

SEQ ID NO: 447570 - DNA, 20 bp, Artificial
  CRISPR gRNA sequence
gaacttactaaaaatttttt

SEQ ID NO: 447571 - DNA, 20 bp, Artificial
  CRISPR gRNA sequence
actaaaaatttttttttact

SEQ ID NO: 447572 - DNA, 20 bp, Artificial
  CRISPR gRNA sequence
ctaaaaatttttttttactg

SEQ ID NO: 447573 - DNA, 20 bp, Artificial
  CRISPR gRNA sequence
aaaatttttttttactgttt

SEQ ID NO: 447574 - DNA, 20 bp, Artificial
  CRISPR gRNA sequence
ttttttactgttttttgttt

SEQ ID NO: 447575 - DNA, 20 bp, Artificial
  CRISPR gRNA sequence
tttttactgttttttgtttg

SEQ ID NO: 447576 - DNA, 20 bp, Artificial
  CRISPR gRNA sequence
ttttactgttttttgtttgt

SEQ ID NO: 447577 - DNA, 20 bp, Artificial
  CRISPR gRNA sequence
tttactgttttttgtttgtt

SEQ ID NO: 447578 - DNA, 20 bp, Artificial
  CRISPR gRNA sequence
ttactgttttttgtttgttt

SEQ ID NO: 447579 - DNA, 20 bp, Artificial
  CRISPR gRNA sequence
tactgttttttgtttgtttg

SEQ ID NO: 447580 - DNA, 20 bp, Artificial
  CRISPR gRNA sequence
actgttttttgtttgtttgt

SEQ ID NO: 447581 - DNA, 20 bp, Artificial
  CRISPR gRNA sequence
ctgttttttgtttgtttgtt

SEQ ID NO: 447582 - DNA, 20 bp, Artificial
  CRISPR gRNA sequence
ttttttgtttgtttgtttgt

SEQ ID NO: 447583 - DNA, 20 bp, Artificial
  CRISPR gRNA sequence
tttgtttgtttgtttgtttt

SEQ ID NO: 447584 - DNA, 20 bp, Artificial
  CRISPR gRNA sequence
ttgtttgtttgtttgttttt

SEQ ID NO: 447585 - DNA, 20 bp, Artificial
  CRISPR gRNA sequence
tgtttgtttgtttgtttttt

SEQ ID NO: 447586 - DNA, 20 bp, Artificial
  CRISPR gRNA sequence
gtttgtttgtttgttttttg

SEQ ID NO: 447587 - DNA, 20 bp, Artificial
  CRISPR gRNA sequence
tttgtttgtttgttttttga

SEQ ID NO: 447588 - DNA, 20 bp, Artificial
  CRISPR gRNA sequence
gtttgtttgttttttgagat

SEQ ID NO: 447589 - DNA, 20 bp, Artificial
  CRISPR gRNA sequence
tttgtttgttttttgagata

SEQ ID NO: 447590 - DNA, 20 bp, Artificial
  CRISPR gRNA sequence
gtttgttttttgagatagaa

SEQ ID NO: 447591 - DNA, 20 bp, Artificial
  CRISPR gRNA sequence
tttgttttttgagatagaat

SEQ ID NO: 447592 - DNA, 20 bp, Artificial
  CRISPR gRNA sequence
gttttttgagatagaatctc

SEQ ID NO: 447593 - DNA, 20 bp, Artificial
  CRISPR gRNA sequence
ttttttgagatagaatctcg

SEQ ID NO: 447594 - DNA, 20 bp, Artificial
  CRISPR gRNA sequence
tttgagatagaatctcgctc

SEQ ID NO: 447595 - DNA, 20 bp, Artificial
  CRISPR gRNA sequence
ttgagatagaatctcgctct

SEQ ID NO: 447596 - DNA, 20 bp, Artificial
  CRISPR gRNA sequence
tgagatagaatctcgctctg

SEQ ID NO: 447597 - DNA, 20 bp, Artificial
  CRISPR gRNA sequence
gagatagaatctcgctctgt

SEQ ID NO: 447598 - DNA, 20 bp, Artificial
  CRISPR gRNA sequence
agatagaatctcgctctgtc

SEQ ID NO: 447599 - DNA, 20 bp, Artificial
  CRISPR gRNA sequence
gctctgtctgagttcattgt

SEQ ID NO: 447600 - DNA, 20 bp, Artificial
  CRISPR gRNA sequence
tgtctgagttcattgtagat

SEQ ID NO: 447601 - DNA, 20 bp, Artificial
  CRISPR gRNA sequence
tctgagttcattgtagattc

SEQ ID NO: 447602 - DNA, 20 bp, Artificial
  CRISPR gRNA sequence
agttcattgtagattctgga

SEQ ID NO: 447603 - DNA, 20 bp, Artificial
  CRISPR gRNA sequence
attgtagattctggatatta

SEQ ID NO: 447604 - DNA, 20 bp, Artificial
  CRISPR gRNA sequence
tagattctggatattagccc

SEQ ID NO: 447605 - DNA, 20 bp, Artificial
  CRISPR gRNA sequence
tggatattagccctttgtca

SEQ ID NO: 447606 - DNA, 20 bp, Artificial
  CRISPR gRNA sequence
gatattagccctttgtcaga

SEQ ID NO: 447607 - DNA, 20 bp, Artificial
  CRISPR gRNA sequence
gccctttgtcagatgagtag

SEQ ID NO: 447608 - DNA, 20 bp, Artificial
  CRISPR gRNA sequence
tgtcagatgagtaggttgcg

SEQ ID NO: 447609 - DNA, 20 bp, Artificial
  CRISPR gRNA sequence
gtcagatgagtaggttgcga

SEQ ID NO: 447610 - DNA, 20 bp, Artificial
  CRISPR gRNA sequence
tcagatgagtaggttgcgaa

SEQ ID NO: 447611 - DNA, 20 bp, Artificial
  CRISPR gRNA sequence
agaaaggagaaaaaaatcca

SEQ ID NO: 447612 - DNA, 20 bp, Artificial
  CRISPR gRNA sequence
aaggagaaaaaaatccacag

SEQ ID NO: 447613 - DNA, 20 bp, Artificial
  CRISPR gRNA sequence
aggagaaaaaaatccacagt

SEQ ID NO: 447614 - DNA, 20 bp, Artificial
  CRISPR gRNA sequence
ggagaaaaaaatccacagtg

SEQ ID NO: 447615 - DNA, 20 bp, Artificial
  CRISPR gRNA sequence
gagaaaaaaatccacagtgg

SEQ ID NO: 447616 - DNA, 20 bp, Artificial
  CRISPR gRNA sequence
aaaaaaatccacagtggggg

SEQ ID NO: 447617 - DNA, 20 bp, Artificial
  CRISPR gRNA sequence
aaaatccacagtgggggtgg

SEQ ID NO: 447618 - DNA, 20 bp, Artificial
  CRISPR gRNA sequence
atccacagtgggggtggcgg

SEQ ID NO: 447619 - DNA, 20 bp, Artificial
  CRISPR gRNA sequence
acttctaacaacccattctg

SEQ ID NO: 447620 - DNA, 20 bp, Artificial
  CRISPR gRNA sequence
aacccattctgtggttttca

SEQ ID NO: 447621 - DNA, 20 bp, Artificial
  CRISPR gRNA sequence
cccattctgtggttttcaaa

SEQ ID NO: 447622 - DNA, 20 bp, Artificial
  CRISPR gRNA sequence
tcaaagagcgaatataataa

SEQ ID NO: 447623 - DNA, 20 bp, Artificial
  CRISPR gRNA sequence
gaatataataacagctatga

SEQ ID NO: 447624 - DNA, 20 bp, Artificial
  CRISPR gRNA sequence
aataacagctatgaaagtgt

SEQ ID NO: 447625 - DNA, 20 bp, Artificial
  CRISPR gRNA sequence
agtgtgagcaatgacgaaac

SEQ ID NO: 447626 - DNA, 20 bp, Artificial
  CRISPR gRNA sequence
tgtgagcaatgacgaaactg

SEQ ID NO: 447627 - DNA, 20 bp, Artificial
  CRISPR gRNA sequence
tgagcaatgacgaaactgga

SEQ ID NO: 447628 - DNA, 20 bp, Artificial
  CRISPR gRNA sequence
caatgacgaaactggagaga

SEQ ID NO: 447629 - DNA, 20 bp, Artificial
  CRISPR gRNA sequence
aatgacgaaactggagagat

SEQ ID NO: 447630 - DNA, 20 bp, Artificial
  CRISPR gRNA sequence
atgacgaaactggagagata

SEQ ID NO: 447631 - DNA, 20 bp, Artificial
  CRISPR gRNA sequence
tggagagatagggttttaac

SEQ ID NO: 447632 - DNA, 20 bp, Artificial
  CRISPR gRNA sequence
atagggttttaacaagatgc

SEQ ID NO: 447633 - DNA, 20 bp, Artificial
  CRISPR gRNA sequence
tagggttttaacaagatgca

SEQ ID NO: 447634 - DNA, 20 bp, Artificial
  CRISPR gRNA sequence
acaagatgcaaggacaatct

SEQ ID NO: 447635 - DNA, 20 bp, Artificial
  CRISPR gRNA sequence
caagatgcaaggacaatctg

SEQ ID NO: 447636 - DNA, 20 bp, Artificial
  CRISPR gRNA sequence
gcaaggacaatctgaggact

SEQ ID NO: 447637 - DNA, 20 bp, Artificial
  CRISPR gRNA sequence
aaggacaatctgaggactga

SEQ ID NO: 447638 - DNA, 20 bp, Artificial
  CRISPR gRNA sequence
actgagagccatttcaacgt

SEQ ID NO: 447639 - DNA, 20 bp, Artificial
  CRISPR gRNA sequence
gccatttcaacgtgagcccc

SEQ ID NO: 447640 - DNA, 20 bp, Artificial
  CRISPR gRNA sequence
tcaacgtgagcccccagtct

SEQ ID NO: 447641 - DNA, 20 bp, Artificial
  CRISPR gRNA sequence
tgagcccccagtctgagaac

SEQ ID NO: 447642 - DNA, 20 bp, Artificial
  CRISPR gRNA sequence
cccccagtctgagaacaaga

SEQ ID NO: 447643 - DNA, 20 bp, Artificial
  CRISPR gRNA sequence
ccagtctgagaacaagaaag

SEQ ID NO: 447644 - DNA, 20 bp, Artificial
  CRISPR gRNA sequence
gaaagaagaacttctgtctc

SEQ ID NO: 447645 - DNA, 20 bp, Artificial
  CRISPR gRNA sequence
aaagaagaacttctgtctcg

SEQ ID NO: 447646 - DNA, 20 bp, Artificial
  CRISPR gRNA sequence
aacttctgtctcgaggtaaa

SEQ ID NO: 447647 - DNA, 20 bp, Artificial
  CRISPR gRNA sequence
acttctgtctcgaggtaaaa

SEQ ID NO: 447648 - DNA, 20 bp, Artificial
  CRISPR gRNA sequence
ctcgaggtaaaaaggcctgc

SEQ ID NO: 447649 - DNA, 20 bp, Artificial
  CRISPR gRNA sequence
tcgaggtaaaaaggcctgct

SEQ ID NO: 447650 - DNA, 20 bp, Artificial
  CRISPR gRNA sequence
cgaggtaaaaaggcctgctg

SEQ ID NO: 447651 - DNA, 20 bp, Artificial
  CRISPR gRNA sequence
aaaaaggcctgctggggacc

SEQ ID NO: 447652 - DNA, 20 bp, Artificial
  CRISPR gRNA sequence
aaaaggcctgctggggacct

SEQ ID NO: 447653 - DNA, 20 bp, Artificial
  CRISPR gRNA sequence
aaaggcctgctggggacctg

SEQ ID NO: 447654 - DNA, 20 bp, Artificial
  CRISPR gRNA sequence
cctgctggggacctggggtc

SEQ ID NO: 447655 - DNA, 20 bp, Artificial
  CRISPR gRNA sequence
ctgctggggacctggggtcc

SEQ ID NO: 447656 - DNA, 20 bp, Artificial
  CRISPR gRNA sequence
ggggacctggggtccaggtg

SEQ ID NO: 447657 - DNA, 20 bp, Artificial
  CRISPR gRNA sequence
gggacctggggtccaggtga

SEQ ID NO: 447658 - DNA, 20 bp, Artificial
  CRISPR gRNA sequence
ggacctggggtccaggtgaa

SEQ ID NO: 447659 - DNA, 20 bp, Artificial
  CRISPR gRNA sequence
ctggggtccaggtgaaggga

SEQ ID NO: 447660 - DNA, 20 bp, Artificial
  CRISPR gRNA sequence
tggggtccaggtgaagggat

SEQ ID NO: 447661 - DNA, 20 bp, Artificial
  CRISPR gRNA sequence
gtccaggtgaagggatggga

SEQ ID NO: 447662 - DNA, 20 bp, Artificial
  CRISPR gRNA sequence
tgaagggatgggatggttga

SEQ ID NO: 447663 - DNA, 20 bp, Artificial
  CRISPR gRNA sequence
ggatggttgacagaactgct

SEQ ID NO: 447664 - DNA, 20 bp, Artificial
  CRISPR gRNA sequence
gatggttgacagaactgctc

SEQ ID NO: 447665 - DNA, 20 bp, Artificial
  CRISPR gRNA sequence
gttgacagaactgctcaggt

SEQ ID NO: 447666 - DNA, 20 bp, Artificial
  CRISPR gRNA sequence
ttgacagaactgctcaggtg

SEQ ID NO: 447667 - DNA, 20 bp, Artificial
  CRISPR gRNA sequence
cagaactgctcaggtgagga

SEQ ID NO: 447668 - DNA, 20 bp, Artificial
  CRISPR gRNA sequence
agaactgctcaggtgaggac

SEQ ID NO: 447669 - DNA, 20 bp, Artificial
  CRISPR gRNA sequence
ggtgaggacaggcttctcat

SEQ ID NO: 447670 - DNA, 20 bp, Artificial
  CRISPR gRNA sequence
gtgaggacaggcttctcatg

SEQ ID NO: 447671 - DNA, 20 bp, Artificial
  CRISPR gRNA sequence
aggcttctcatgaggtccct

SEQ ID NO: 447672 - DNA, 20 bp, Artificial
  CRISPR gRNA sequence
tccctgagaaacttgccttt

SEQ ID NO: 447673 - DNA, 20 bp, Artificial
  CRISPR gRNA sequence
cctgagaaacttgccttttg

SEQ ID NO: 447674 - DNA, 20 bp, Artificial
  CRISPR gRNA sequence
ctgagaaacttgccttttgg

SEQ ID NO: 447675 - DNA, 20 bp, Artificial
  CRISPR gRNA sequence
tgagaaacttgccttttgga

SEQ ID NO: 447676 - DNA, 20 bp, Artificial
  CRISPR gRNA sequence
gggaaatgtcctctgccctc

SEQ ID NO: 447677 - DNA, 20 bp, Artificial
  CRISPR gRNA sequence
gaaatgtcctctgccctctg

SEQ ID NO: 447678 - DNA, 20 bp, Artificial
  CRISPR gRNA sequence
gtcctctgccctctggagcc

SEQ ID NO: 447679 - DNA, 20 bp, Artificial
  CRISPR gRNA sequence
tcctctgccctctggagcct

SEQ ID NO: 447680 - DNA, 20 bp, Artificial
  CRISPR gRNA sequence
cctctgccctctggagcctg

SEQ ID NO: 447681 - DNA, 20 bp, Artificial
  CRISPR gRNA sequence
tctgccctctggagcctggg

SEQ ID NO: 447682 - DNA, 20 bp, Artificial
  CRISPR gRNA sequence
gccctctggagcctggggag

SEQ ID NO: 447683 - DNA, 20 bp, Artificial
  CRISPR gRNA sequence
ccctctggagcctggggaga

SEQ ID NO: 447684 - DNA, 20 bp, Artificial
  CRISPR gRNA sequence
agaaggttatttctgcccgc

SEQ ID NO: 447685 - DNA, 20 bp, Artificial
  CRISPR gRNA sequence
gttatttctgcccgccagac

SEQ ID NO: 447686 - DNA, 20 bp, Artificial
  CRISPR gRNA sequence
gcatgctcgcttttcttcca

SEQ ID NO: 447687 - DNA, 20 bp, Artificial
  CRISPR gRNA sequence
catgctcgcttttcttccat

SEQ ID NO: 447688 - DNA, 20 bp, Artificial
  CRISPR gRNA sequence
gcttttcttccatgggcatt

SEQ ID NO: 447689 - DNA, 20 bp, Artificial
  CRISPR gRNA sequence
cttttcttccatgggcattc

SEQ ID NO: 447690 - DNA, 20 bp, Artificial
  CRISPR gRNA sequence
ccatgggcattcaggaatcc

SEQ ID NO: 447691 - DNA, 20 bp, Artificial
  CRISPR gRNA sequence
ccattctgacattcctcaaa

SEQ ID NO: 447692 - DNA, 20 bp, Artificial
  CRISPR gRNA sequence
attctgacattcctcaaatg

SEQ ID NO: 447693 - DNA, 20 bp, Artificial
  CRISPR gRNA sequence
ttctgacattcctcaaatgg

SEQ ID NO: 447694 - DNA, 20 bp, Artificial
  CRISPR gRNA sequence
ggaggaattcctcaaattac

SEQ ID NO: 447695 - DNA, 20 bp, Artificial
  CRISPR gRNA sequence
aggaattcctcaaattacca

SEQ ID NO: 447696 - DNA, 20 bp, Artificial
  CRISPR gRNA sequence
ggaattcctcaaattaccag

SEQ ID NO: 447697 - DNA, 20 bp, Artificial
  CRISPR gRNA sequence
ttcctcaaattaccagagga

SEQ ID NO: 447698 - DNA, 20 bp, Artificial
  CRISPR gRNA sequence
ttaccagaggaaagttacca

SEQ ID NO: 447699 - DNA, 20 bp, Artificial
  CRISPR gRNA sequence
agaggaaagttaccaaagtt

SEQ ID NO: 447700 - DNA, 20 bp, Artificial
  CRISPR gRNA sequence
ttaccaaagtttagatctgc

SEQ ID NO: 447701 - DNA, 20 bp, Artificial
  CRISPR gRNA sequence
accaaagtttagatctgctg

SEQ ID NO: 447702 - DNA, 20 bp, Artificial
  CRISPR gRNA sequence
tagatctgctggagctcttc

SEQ ID NO: 447703 - DNA, 20 bp, Artificial
  CRISPR gRNA sequence
agatctgctggagctcttca

SEQ ID NO: 447704 - DNA, 20 bp, Artificial
  CRISPR gRNA sequence
tgctggagctcttcaaggat

SEQ ID NO: 447705 - DNA, 20 bp, Artificial
  CRISPR gRNA sequence
agctcttcaaggattggcct

SEQ ID NO: 447706 - DNA, 20 bp, Artificial
  CRISPR gRNA sequence
ttcaaggattggcctgagac

SEQ ID NO: 447707 - DNA, 20 bp, Artificial
  CRISPR gRNA sequence
aggattggcctgagacaagc

SEQ ID NO: 447708 - DNA, 20 bp, Artificial
  CRISPR gRNA sequence
ggattggcctgagacaagcc

SEQ ID NO: 447709 - DNA, 20 bp, Artificial
  CRISPR gRNA sequence
attggcctgagacaagccgg

SEQ ID NO: 447710 - DNA, 20 bp, Artificial
  CRISPR gRNA sequence
ttggcctgagacaagccggg

SEQ ID NO: 447711 - DNA, 20 bp, Artificial
  CRISPR gRNA sequence
agacaagccgggaggtgcca

SEQ ID NO: 447712 - DNA, 20 bp, Artificial
  CRISPR gRNA sequence
gacaagccgggaggtgccac

SEQ ID NO: 447713 - DNA, 20 bp, Artificial
  CRISPR gRNA sequence
acaagccgggaggtgccacg

SEQ ID NO: 447714 - DNA, 20 bp, Artificial
  CRISPR gRNA sequence
ccgggaggtgccacggggct

SEQ ID NO: 447715 - DNA, 20 bp, Artificial
  CRISPR gRNA sequence
gggaggtgccacggggcttg

SEQ ID NO: 447716 - DNA, 20 bp, Artificial
  CRISPR gRNA sequence
ggtgccacggggcttggagc

SEQ ID NO: 447717 - DNA, 20 bp, Artificial
  CRISPR gRNA sequence
gggcttggagctggccctgt

SEQ ID NO: 447718 - DNA, 20 bp, Artificial
  CRISPR gRNA sequence
ggcttggagctggccctgtg

SEQ ID NO: 447719 - DNA, 20 bp, Artificial
  CRISPR gRNA sequence
ctggccctgtgaggcacctc

SEQ ID NO: 447720 - DNA, 20 bp, Artificial
  CRISPR gRNA sequence
tggccctgtgaggcacctcc

SEQ ID NO: 447721 - DNA, 20 bp, Artificial
  CRISPR gRNA sequence
ggccctgtgaggcacctccg

SEQ ID NO: 447722 - DNA, 20 bp, Artificial
  CRISPR gRNA sequence
gccctgtgaggcacctccgg

SEQ ID NO: 447723 - DNA, 20 bp, Artificial
  CRISPR gRNA sequence
ctgtgaggcacctccggggg

SEQ ID NO: 447724 - DNA, 20 bp, Artificial
  CRISPR gRNA sequence
tccgggggaagttcatgtcc

SEQ ID NO: 447725 - DNA, 20 bp, Artificial
  CRISPR gRNA sequence
ccgggggaagttcatgtcct

SEQ ID NO: 447726 - DNA, 20 bp, Artificial
  CRISPR gRNA sequence
ggggaagttcatgtcctagg

SEQ ID NO: 447727 - DNA, 20 bp, Artificial
  CRISPR gRNA sequence
gtcctaggtggttcacgtca

SEQ ID NO: 447728 - DNA, 20 bp, Artificial
  CRISPR gRNA sequence
ggttcacgtcatggacctct

SEQ ID NO: 447729 - DNA, 20 bp, Artificial
  CRISPR gRNA sequence
ttcacgtcatggacctcttg

SEQ ID NO: 447730 - DNA, 20 bp, Artificial
  CRISPR gRNA sequence
tcacgtcatggacctcttgg

SEQ ID NO: 447731 - DNA, 20 bp, Artificial
  CRISPR gRNA sequence
acctcttggaggtccgtgaa

SEQ ID NO: 447732 - DNA, 20 bp, Artificial
  CRISPR gRNA sequence
tccgtgaatagatttattca

SEQ ID NO: 447733 - DNA, 20 bp, Artificial
  CRISPR gRNA sequence
ccgtgaatagatttattcat

SEQ ID NO: 447734 - DNA, 20 bp, Artificial
  CRISPR gRNA sequence
tattcatgggatttgtgaat

SEQ ID NO: 447735 - DNA, 20 bp, Artificial
  CRISPR gRNA sequence
attcatgggatttgtgaatt

SEQ ID NO: 447736 - DNA, 20 bp, Artificial
  CRISPR gRNA sequence
ttcatgggatttgtgaattg

SEQ ID NO: 447737 - DNA, 20 bp, Artificial
  CRISPR gRNA sequence
tcatgggatttgtgaattgg

SEQ ID NO: 447738 - DNA, 20 bp, Artificial
  CRISPR gRNA sequence
catgggatttgtgaattggg

SEQ ID NO: 447739 - DNA, 20 bp, Artificial
  CRISPR gRNA sequence
tttcactaatctttaattga

SEQ ID NO: 447740 - DNA, 20 bp, Artificial
  CRISPR gRNA sequence
actaatctttaattgaaagt

SEQ ID NO: 447741 - DNA, 20 bp, Artificial
  CRISPR gRNA sequence
ttgaaagtcagcacttgctt

SEQ ID NO: 447742 - DNA, 20 bp, Artificial
  CRISPR gRNA sequence
acttgcttcagttatgaatg

SEQ ID NO: 447743 - DNA, 20 bp, Artificial
  CRISPR gRNA sequence
atgtagacaatgaaccacaa

SEQ ID NO: 447744 - DNA, 20 bp, Artificial
  CRISPR gRNA sequence
acaatagaatttgccatcaa

SEQ ID NO: 447745 - DNA, 20 bp, Artificial
  CRISPR gRNA sequence
aatattttcaaatctcatta

SEQ ID NO: 447746 - DNA, 20 bp, Artificial
  CRISPR gRNA sequence
aaatctcattacagttttta

SEQ ID NO: 447747 - DNA, 20 bp, Artificial
  CRISPR gRNA sequence
ctccaaatgtccttaacgct

SEQ ID NO: 447748 - DNA, 20 bp, Artificial
  CRISPR gRNA sequence
cttaacgctcagcactacta

SEQ ID NO: 447749 - DNA, 20 bp, Artificial
  CRISPR gRNA sequence
gcactactacagaattacaa

SEQ ID NO: 447750 - DNA, 20 bp, Artificial
  CRISPR gRNA sequence
tacagaattacaacagttat

SEQ ID NO: 447751 - DNA, 20 bp, Artificial
  CRISPR gRNA sequence
acagaattacaacagttatt

SEQ ID NO: 447752 - DNA, 20 bp, Artificial
  CRISPR gRNA sequence
ttaggctgatgtcaaatcta

SEQ ID NO: 447753 - DNA, 20 bp, Artificial
  CRISPR gRNA sequence
ggctgatgtcaaatctaaag

SEQ ID NO: 447754 - DNA, 20 bp, Artificial
  CRISPR gRNA sequence
taatttttaaatgttgttct

SEQ ID NO: 447755 - DNA, 20 bp, Artificial
  CRISPR gRNA sequence
tttttaaatgttgttctgag

SEQ ID NO: 447756 - DNA, 20 bp, Artificial
  CRISPR gRNA sequence
ttttaaatgttgttctgaga

SEQ ID NO: 447757 - DNA, 20 bp, Artificial
  CRISPR gRNA sequence
tttaaatgttgttctgagaa

SEQ ID NO: 447758 - DNA, 20 bp, Artificial
  CRISPR gRNA sequence
agggactccatatgccttcc

SEQ ID NO: 447759 - DNA, 20 bp, Artificial
  CRISPR gRNA sequence
tatgccttcccagaccacca

SEQ ID NO: 447760 - DNA, 20 bp, Artificial
  CRISPR gRNA sequence
tgccttcccagaccaccaaa

SEQ ID NO: 447761 - DNA, 20 bp, Artificial
  CRISPR gRNA sequence
gccttcccagaccaccaaag

SEQ ID NO: 447762 - DNA, 20 bp, Artificial
  CRISPR gRNA sequence
cagaccaccaaagaggtcca

SEQ ID NO: 447763 - DNA, 20 bp, Artificial
  CRISPR gRNA sequence
ggtccatggcgcctttatgt

SEQ ID NO: 447764 - DNA, 20 bp, Artificial
  CRISPR gRNA sequence
gtccatggcgcctttatgtc

SEQ ID NO: 447765 - DNA, 20 bp, Artificial
  CRISPR gRNA sequence
tttatgtcaggcacctgctt

SEQ ID NO: 447766 - DNA, 20 bp, Artificial
  CRISPR gRNA sequence
ggcacctgctttggtgtgtt

SEQ ID NO: 447767 - DNA, 20 bp, Artificial
  CRISPR gRNA sequence
acctgctttggtgtgttgag

SEQ ID NO: 447768 - DNA, 20 bp, Artificial
  CRISPR gRNA sequence
cctgctttggtgtgttgagc

SEQ ID NO: 447769 - DNA, 20 bp, Artificial
  CRISPR gRNA sequence
gctttggtgtgttgagcagg

SEQ ID NO: 447770 - DNA, 20 bp, Artificial
  CRISPR gRNA sequence
gtgtgttgagcaggaagcct

SEQ ID NO: 447771 - DNA, 20 bp, Artificial
  CRISPR gRNA sequence
gagcaggaagcctgagatct

SEQ ID NO: 447772 - DNA, 20 bp, Artificial
  CRISPR gRNA sequence
ggaagcctgagatctcagac

SEQ ID NO: 447773 - DNA, 20 bp, Artificial
  CRISPR gRNA sequence
aagcctgagatctcagacaa

SEQ ID NO: 447774 - DNA, 20 bp, Artificial
  CRISPR gRNA sequence
agatctcagacaagagcttc

SEQ ID NO: 447775 - DNA, 20 bp, Artificial
  CRISPR gRNA sequence
gatctcagacaagagcttca

SEQ ID NO: 447776 - DNA, 20 bp, Artificial
  CRISPR gRNA sequence
atctcagacaagagcttcaa

SEQ ID NO: 447777 - DNA, 20 bp, Artificial
  CRISPR gRNA sequence
caagagcttcaagggccccc

SEQ ID NO: 447778 - DNA, 20 bp, Artificial
  CRISPR gRNA sequence
ccaaacctctgtctactaac

SEQ ID NO: 447779 - DNA, 20 bp, Artificial
  CRISPR gRNA sequence
cctctgtctactaacaagtc

SEQ ID NO: 447780 - DNA, 20 bp, Artificial
  CRISPR gRNA sequence
aacaagtctggttctacttt

SEQ ID NO: 447781 - DNA, 20 bp, Artificial
  CRISPR gRNA sequence
acaagtctggttctacttta

SEQ ID NO: 447782 - DNA, 20 bp, Artificial
  CRISPR gRNA sequence
agtctggttctactttaagg

SEQ ID NO: 447783 - DNA, 20 bp, Artificial
  CRISPR gRNA sequence
tggttctactttaaggcagt

SEQ ID NO: 447784 - DNA, 20 bp, Artificial
  CRISPR gRNA sequence
ggttctactttaaggcagtt

SEQ ID NO: 447785 - DNA, 20 bp, Artificial
  CRISPR gRNA sequence
gttctactttaaggcagttg

SEQ ID NO: 447786 - DNA, 20 bp, Artificial
  CRISPR gRNA sequence
ctttaaggcagttggggttg

SEQ ID NO: 447787 - DNA, 20 bp, Artificial
  CRISPR gRNA sequence
ttaaggcagttggggttgtg

SEQ ID NO: 447788 - DNA, 20 bp, Artificial
  CRISPR gRNA sequence
tggggttgtggagattgaaa

SEQ ID NO: 447789 - DNA, 20 bp, Artificial
  CRISPR gRNA sequence
ggttgtggagattgaaaaag

SEQ ID NO: 447790 - DNA, 20 bp, Artificial
  CRISPR gRNA sequence
ttgaaaaagaagccccttca

SEQ ID NO: 447791 - DNA, 20 bp, Artificial
  CRISPR gRNA sequence
gccccttcacagctgcaaat

SEQ ID NO: 447792 - DNA, 20 bp, Artificial
  CRISPR gRNA sequence
agctgcaaatgagatctttc

SEQ ID NO: 447793 - DNA, 20 bp, Artificial
  CRISPR gRNA sequence
gctgcaaatgagatctttct

SEQ ID NO: 447794 - DNA, 20 bp, Artificial
  CRISPR gRNA sequence
atctttctgggcatcttttt

SEQ ID NO: 447795 - DNA, 20 bp, Artificial
  CRISPR gRNA sequence
gggcatctttttcagtgtcg

SEQ ID NO: 447796 - DNA, 20 bp, Artificial
  CRISPR gRNA sequence
ggcatctttttcagtgtcgt

SEQ ID NO: 447797 - DNA, 20 bp, Artificial
  CRISPR gRNA sequence
catctttttcagtgtcgtgg

SEQ ID NO: 447798 - DNA, 20 bp, Artificial
  CRISPR gRNA sequence
tgtcgtgggagatctgtata

SEQ ID NO: 447799 - DNA, 20 bp, Artificial
  CRISPR gRNA sequence
tcgtgggagatctgtataca

SEQ ID NO: 447800 - DNA, 20 bp, Artificial
  CRISPR gRNA sequence
cgtgggagatctgtatacag

SEQ ID NO: 447801 - DNA, 20 bp, Artificial
  CRISPR gRNA sequence
tctgtatacagaggtatttg

SEQ ID NO: 447802 - DNA, 20 bp, Artificial
  CRISPR gRNA sequence
tgtatacagaggtatttgtg

SEQ ID NO: 447803 - DNA, 20 bp, Artificial
  CRISPR gRNA sequence
acagaggtatttgtggagct

SEQ ID NO: 447804 - DNA, 20 bp, Artificial
  CRISPR gRNA sequence
agaggtatttgtggagctca

SEQ ID NO: 447805 - DNA, 20 bp, Artificial
  CRISPR gRNA sequence
ggagctcagagctgaccttc

SEQ ID NO: 447806 - DNA, 20 bp, Artificial
  CRISPR gRNA sequence
gctgaccttccagctcctct

SEQ ID NO: 447807 - DNA, 20 bp, Artificial
  CRISPR gRNA sequence
tgaccttccagctcctctga

SEQ ID NO: 447808 - DNA, 20 bp, Artificial
  CRISPR gRNA sequence
gaccttccagctcctctgag

SEQ ID NO: 447809 - DNA, 20 bp, Artificial
  CRISPR gRNA sequence
ttccagctcctctgagaggt

SEQ ID NO: 447810 - DNA, 20 bp, Artificial
  CRISPR gRNA sequence
ctcctctgagaggttagatc

SEQ ID NO: 447811 - DNA, 20 bp, Artificial
  CRISPR gRNA sequence
tcctctgagaggttagatcc

SEQ ID NO: 447812 - DNA, 20 bp, Artificial
  CRISPR gRNA sequence
gagaggttagatccgggctc

SEQ ID NO: 447813 - DNA, 20 bp, Artificial
  CRISPR gRNA sequence
aggttagatccgggctccgg

SEQ ID NO: 447814 - DNA, 20 bp, Artificial
  CRISPR gRNA sequence
ttagatccgggctccggtgg

SEQ ID NO: 447815 - DNA, 20 bp, Artificial
  CRISPR gRNA sequence
agatccgggctccggtggca

SEQ ID NO: 447816 - DNA, 20 bp, Artificial
  CRISPR gRNA sequence
gatccgggctccggtggcag

SEQ ID NO: 447817 - DNA, 20 bp, Artificial
  CRISPR gRNA sequence
ggctccggtggcagaggaaa

SEQ ID NO: 447818 - DNA, 20 bp, Artificial
  CRISPR gRNA sequence
ctccggtggcagaggaaatg

SEQ ID NO: 447819 - DNA, 20 bp, Artificial
  CRISPR gRNA sequence
cctcttgtccccaccctccc

SEQ ID NO: 447820 - DNA, 20 bp, Artificial
  CRISPR gRNA sequence
caccctccccagaaaacctc

SEQ ID NO: 447821 - DNA, 20 bp, Artificial
  CRISPR gRNA sequence
tccccagaaaacctctggca

SEQ ID NO: 447822 - DNA, 20 bp, Artificial
  CRISPR gRNA sequence
aaccgtcaccacattcctat

SEQ ID NO: 447823 - DNA, 20 bp, Artificial
  CRISPR gRNA sequence
accgtcaccacattcctatg

SEQ ID NO: 447824 - DNA, 20 bp, Artificial
  CRISPR gRNA sequence
gtcaccacattcctatgagg

SEQ ID NO: 447825 - DNA, 20 bp, Artificial
  CRISPR gRNA sequence
tatgaggtagttttaaacac

SEQ ID NO: 447826 - DNA, 20 bp, Artificial
  CRISPR gRNA sequence
tgaggtagttttaaacacaa

SEQ ID NO: 447827 - DNA, 20 bp, Artificial
  CRISPR gRNA sequence
gaggtagttttaaacacaag

SEQ ID NO: 447828 - DNA, 20 bp, Artificial
  CRISPR gRNA sequence
tttaaacacaagaggaatgt

SEQ ID NO: 447829 - DNA, 20 bp, Artificial
  CRISPR gRNA sequence
ttaaacacaagaggaatgtg

SEQ ID NO: 447830 - DNA, 20 bp, Artificial
  CRISPR gRNA sequence
cacaagaggaatgtgaggct

SEQ ID NO: 447831 - DNA, 20 bp, Artificial
  CRISPR gRNA sequence
agaggaatgtgaggctgagt

SEQ ID NO: 447832 - DNA, 20 bp, Artificial
  CRISPR gRNA sequence
gaggaatgtgaggctgagtg

SEQ ID NO: 447833 - DNA, 20 bp, Artificial
  CRISPR gRNA sequence
atgtgaggctgagtgaggtc

SEQ ID NO: 447834 - DNA, 20 bp, Artificial
  CRISPR gRNA sequence
agtgaggtccagcaatgtgc

SEQ ID NO: 447835 - DNA, 20 bp, Artificial
  CRISPR gRNA sequence
agcaatgtgctggtcacaca

SEQ ID NO: 447836 - DNA, 20 bp, Artificial
  CRISPR gRNA sequence
tgtgctggtcacacaaagct

SEQ ID NO: 447837 - DNA, 20 bp, Artificial
  CRISPR gRNA sequence
acaaagcttggatttgaacc

SEQ ID NO: 447838 - DNA, 20 bp, Artificial
  CRISPR gRNA sequence
caaagcttggatttgaaccc

SEQ ID NO: 447839 - DNA, 20 bp, Artificial
  CRISPR gRNA sequence
aagcttggatttgaacccag

SEQ ID NO: 447840 - DNA, 20 bp, Artificial
  CRISPR gRNA sequence
atttgaacccaggagtccac

SEQ ID NO: 447841 - DNA, 20 bp, Artificial
  CRISPR gRNA sequence
cccaggagtccacaagactc

SEQ ID NO: 447842 - DNA, 20 bp, Artificial
  CRISPR gRNA sequence
ccaggagtccacaagactcc

SEQ ID NO: 447843 - DNA, 20 bp, Artificial
  CRISPR gRNA sequence
agactccaggaccgcctccg

SEQ ID NO: 447844 - DNA, 20 bp, Artificial
  CRISPR gRNA sequence
gactccaggaccgcctccga

SEQ ID NO: 447845 - DNA, 20 bp, Artificial
  CRISPR gRNA sequence
caggaccgcctccgaaggtg

SEQ ID NO: 447846 - DNA, 20 bp, Artificial
  CRISPR gRNA sequence
aggaccgcctccgaaggtgc

SEQ ID NO: 447847 - DNA, 20 bp, Artificial
  CRISPR gRNA sequence
gaccgcctccgaaggtgcgg

SEQ ID NO: 447848 - DNA, 20 bp, Artificial
  CRISPR gRNA sequence
accgcctccgaaggtgcggg

SEQ ID NO: 447849 - DNA, 20 bp, Artificial
  CRISPR gRNA sequence
ccgcctccgaaggtgcggga

SEQ ID NO: 447850 - DNA, 20 bp, Artificial
  CRISPR gRNA sequence
cctccgaaggtgcgggaggg

SEQ ID NO: 447851 - DNA, 20 bp, Artificial
  CRISPR gRNA sequence
tccgaaggtgcgggagggaa

SEQ ID NO: 447852 - DNA, 20 bp, Artificial
  CRISPR gRNA sequence
aagagtttcccgccgtctgt

SEQ ID NO: 447853 - DNA, 20 bp, Artificial
  CRISPR gRNA sequence
ccgtctgtgagctgtcgcct

SEQ ID NO: 447854 - DNA, 20 bp, Artificial
  CRISPR gRNA sequence
gtctgtgagctgtcgcctga

SEQ ID NO: 447855 - DNA, 20 bp, Artificial
  CRISPR gRNA sequence
ctgtgagctgtcgcctgaga

SEQ ID NO: 447856 - DNA, 20 bp, Artificial
  CRISPR gRNA sequence
tgtgagctgtcgcctgagag

SEQ ID NO: 447857 - DNA, 20 bp, Artificial
  CRISPR gRNA sequence
tgtcgcctgagagaggcacc

SEQ ID NO: 447858 - DNA, 20 bp, Artificial
  CRISPR gRNA sequence
ctgagagaggcaccgagccc

SEQ ID NO: 447859 - DNA, 20 bp, Artificial
  CRISPR gRNA sequence
tgagagaggcaccgagccct

SEQ ID NO: 447860 - DNA, 20 bp, Artificial
  CRISPR gRNA sequence
gagagaggcaccgagccctg

SEQ ID NO: 447861 - DNA, 20 bp, Artificial
  CRISPR gRNA sequence
gcaccgagccctggggccac

SEQ ID NO: 447862 - DNA, 20 bp, Artificial
  CRISPR gRNA sequence
gagccctggggccaccagcg

SEQ ID NO: 447863 - DNA, 20 bp, Artificial
  CRISPR gRNA sequence
ctggggccaccagcgcagct

SEQ ID NO: 447864 - DNA, 20 bp, Artificial
  CRISPR gRNA sequence
tggggccaccagcgcagctc

SEQ ID NO: 447865 - DNA, 20 bp, Artificial
  CRISPR gRNA sequence
gggccaccagcgcagctcag

SEQ ID NO: 447866 - DNA, 20 bp, Artificial
  CRISPR gRNA sequence
ccagcgcagctcaggagccc

SEQ ID NO: 447867 - DNA, 20 bp, Artificial
  CRISPR gRNA sequence
cagcgcagctcaggagcccc

SEQ ID NO: 447868 - DNA, 20 bp, Artificial
  CRISPR gRNA sequence
agcgcagctcaggagccccg

SEQ ID NO: 447869 - DNA, 20 bp, Artificial
  CRISPR gRNA sequence
aggagccccggggaccatca

SEQ ID NO: 447870 - DNA, 20 bp, Artificial
  CRISPR gRNA sequence
ccccggggaccatcaaagat

SEQ ID NO: 447871 - DNA, 20 bp, Artificial
  CRISPR gRNA sequence
cccggggaccatcaaagatg

SEQ ID NO: 447872 - DNA, 20 bp, Artificial
  CRISPR gRNA sequence
agatgaggatgccaactcca

SEQ ID NO: 447873 - DNA, 20 bp, Artificial
  CRISPR gRNA sequence
gatgaggatgccaactccac

SEQ ID NO: 447874 - DNA, 20 bp, Artificial
  CRISPR gRNA sequence
accctcccccctgcccgcgc

SEQ ID NO: 447875 - DNA, 20 bp, Artificial
  CRISPR gRNA sequence
ccctcccccctgcccgcgct

SEQ ID NO: 447876 - DNA, 20 bp, Artificial
  CRISPR gRNA sequence
cctcccccctgcccgcgctg

SEQ ID NO: 447877 - DNA, 20 bp, Artificial
  CRISPR gRNA sequence
gctggggctcacaacgtttt

SEQ ID NO: 447878 - DNA, 20 bp, Artificial
  CRISPR gRNA sequence
tggggctcacaacgttttaa

SEQ ID NO: 447879 - DNA, 20 bp, Artificial
  CRISPR gRNA sequence
ggggctcacaacgttttaag

SEQ ID NO: 447880 - DNA, 20 bp, Artificial
  CRISPR gRNA sequence
gggctcacaacgttttaaga

SEQ ID NO: 447881 - DNA, 20 bp, Artificial
  CRISPR gRNA sequence
ggctcacaacgttttaagag

SEQ ID NO: 447882 - DNA, 20 bp, Artificial
  CRISPR gRNA sequence
ctcacaacgttttaagaggg

SEQ ID NO: 447883 - DNA, 20 bp, Artificial
  CRISPR gRNA sequence
taagaggggagacccgcccc

SEQ ID NO: 447884 - DNA, 20 bp, Artificial
  CRISPR gRNA sequence
ggagacccgcccctggcgtg

SEQ ID NO: 447885 - DNA, 20 bp, Artificial
  CRISPR gRNA sequence
gacccgcccctggcgtgtag

SEQ ID NO: 447886 - DNA, 20 bp, Artificial
  CRISPR gRNA sequence
acccgcccctggcgtgtagt

SEQ ID NO: 447887 - DNA, 20 bp, Artificial
  CRISPR gRNA sequence
cccctggcgtgtagtgggcc

SEQ ID NO: 447888 - DNA, 20 bp, Artificial
  CRISPR gRNA sequence
tagtgggcccggaaaattcc

SEQ ID NO: 447889 - DNA, 20 bp, Artificial
  CRISPR gRNA sequence
cacccgctctcccctctgtt

SEQ ID NO: 447890 - DNA, 20 bp, Artificial
  CRISPR gRNA sequence
acccgctctcccctctgttg

SEQ ID NO: 447891 - DNA, 20 bp, Artificial
  CRISPR gRNA sequence
cccgctctcccctctgttga

SEQ ID NO: 447892 - DNA, 20 bp, Artificial
  CRISPR gRNA sequence
ctctcccctctgttgagggc

SEQ ID NO: 447893 - DNA, 20 bp, Artificial
  CRISPR gRNA sequence
tctcccctctgttgagggcc

SEQ ID NO: 447894 - DNA, 20 bp, Artificial
  CRISPR gRNA sequence
ttgagggccaggtgccgctc

SEQ ID NO: 447895 - DNA, 20 bp, Artificial
  CRISPR gRNA sequence
tctagtacatgctgcgtccc

SEQ ID NO: 447896 - DNA, 20 bp, Artificial
  CRISPR gRNA sequence
ctagtacatgctgcgtcccc

SEQ ID NO: 447897 - DNA, 20 bp, Artificial
  CRISPR gRNA sequence
gctgcgtccccaggacccac

SEQ ID NO: 447898 - DNA, 20 bp, Artificial
  CRISPR gRNA sequence
ctgcgtccccaggacccacc

SEQ ID NO: 447899 - DNA, 20 bp, Artificial
  CRISPR gRNA sequence
caccccctcatctcccctcc

SEQ ID NO: 447900 - DNA, 20 bp, Artificial
  CRISPR gRNA sequence
cctcatctcccctcctagtt

SEQ ID NO: 447901 - DNA, 20 bp, Artificial
  CRISPR gRNA sequence
ctcctagtttagactttccc

SEQ ID NO: 447902 - DNA, 20 bp, Artificial
  CRISPR gRNA sequence
tagtttagactttccctggc

SEQ ID NO: 447903 - DNA, 20 bp, Artificial
  CRISPR gRNA sequence
tggctagcccccatgctcgc

SEQ ID NO: 447904 - DNA, 20 bp, Artificial
  CRISPR gRNA sequence
tagcccccatgctcgctgga

SEQ ID NO: 447905 - DNA, 20 bp, Artificial
  CRISPR gRNA sequence
catgctcgctggatggccca

SEQ ID NO: 447906 - DNA, 20 bp, Artificial
  CRISPR gRNA sequence
ctcgctggatggcccatggc

SEQ ID NO: 447907 - DNA, 20 bp, Artificial
  CRISPR gRNA sequence
cgctggatggcccatggctg

SEQ ID NO: 447908 - DNA, 20 bp, Artificial
  CRISPR gRNA sequence
ggcccatggctggagtgacg

SEQ ID NO: 447909 - DNA, 20 bp, Artificial
  CRISPR gRNA sequence
gcccatggctggagtgacgc

SEQ ID NO: 447910 - DNA, 20 bp, Artificial
  CRISPR gRNA sequence
tggagtgacgcgggccaacg

SEQ ID NO: 447911 - DNA, 20 bp, Artificial
  CRISPR gRNA sequence
ggagtgacgcgggccaacgc

SEQ ID NO: 447912 - DNA, 20 bp, Artificial
  CRISPR gRNA sequence
gagtgacgcgggccaacgcg

SEQ ID NO: 447913 - DNA, 20 bp, Artificial
  CRISPR gRNA sequence
tgacgcgggccaacgcgggg

SEQ ID NO: 447914 - DNA, 20 bp, Artificial
  CRISPR gRNA sequence
gacgcgggccaacgcggggc

SEQ ID NO: 447915 - DNA, 20 bp, Artificial
  CRISPR gRNA sequence
gcgggccaacgcggggcagg

SEQ ID NO: 447916 - DNA, 20 bp, Artificial
  CRISPR gRNA sequence
cgggccaacgcggggcaggt

SEQ ID NO: 447917 - DNA, 20 bp, Artificial
  CRISPR gRNA sequence
gggccaacgcggggcaggta

SEQ ID NO: 447918 - DNA, 20 bp, Artificial
  CRISPR gRNA sequence
ggccaacgcggggcaggtag

SEQ ID NO: 447919 - DNA, 20 bp, Artificial
  CRISPR gRNA sequence
gccaacgcggggcaggtagg

SEQ ID NO: 447920 - DNA, 20 bp, Artificial
  CRISPR gRNA sequence
ggggcaggtagggggtcact

SEQ ID NO: 447921 - DNA, 20 bp, Artificial
  CRISPR gRNA sequence
ggtagggggtcactcggctt

SEQ ID NO: 447922 - DNA, 20 bp, Artificial
  CRISPR gRNA sequence
ggtcactcggctttggctga

SEQ ID NO: 447923 - DNA, 20 bp, Artificial
  CRISPR gRNA sequence
gtcactcggctttggctgaa

SEQ ID NO: 447924 - DNA, 20 bp, Artificial
  CRISPR gRNA sequence
actcggctttggctgaaagg

SEQ ID NO: 447925 - DNA, 20 bp, Artificial
  CRISPR gRNA sequence
ggctgaaaggcagcgccctc

SEQ ID NO: 447926 - DNA, 20 bp, Artificial
  CRISPR gRNA sequence
tgaaaggcagcgccctctag

SEQ ID NO: 447927 - DNA, 20 bp, Artificial
  CRISPR gRNA sequence
aggcagcgccctctagcggc

SEQ ID NO: 447928 - DNA, 20 bp, Artificial
  CRISPR gRNA sequence
gcagcgccctctagcggcca

SEQ ID NO: 447929 - DNA, 20 bp, Artificial
  CRISPR gRNA sequence
tagcggccagagtgcgaaat

SEQ ID NO: 447930 - DNA, 20 bp, Artificial
  CRISPR gRNA sequence
gagtgcgaaatcagcgccgc

SEQ ID NO: 447931 - DNA, 20 bp, Artificial
  CRISPR gRNA sequence
ctgccccgcctgcatcacaa

SEQ ID NO: 447932 - DNA, 20 bp, Artificial
  CRISPR gRNA sequence
tgccccgcctgcatcacaac

SEQ ID NO: 447933 - DNA, 20 bp, Artificial
  CRISPR gRNA sequence
gccccgcctgcatcacaaca

SEQ ID NO: 447934 - DNA, 20 bp, Artificial
  CRISPR gRNA sequence
acaacagggtgctcccctcc

SEQ ID NO: 447935 - DNA, 20 bp, Artificial
  CRISPR gRNA sequence
caacagggtgctcccctccc

SEQ ID NO: 447936 - DNA, 20 bp, Artificial
  CRISPR gRNA sequence
gtgctcccctcccgggcacc

SEQ ID NO: 447937 - DNA, 20 bp, Artificial
  CRISPR gRNA sequence
tgctcccctcccgggcacca

SEQ ID NO: 447938 - DNA, 20 bp, Artificial
  CRISPR gRNA sequence
cgggcaccaaggtcacttcc

SEQ ID NO: 447939 - DNA, 20 bp, Artificial
  CRISPR gRNA sequence
ggcaccaaggtcacttccca

SEQ ID NO: 447940 - DNA, 20 bp, Artificial
  CRISPR gRNA sequence
cttcccagagcatccttgcc

SEQ ID NO: 447941 - DNA, 20 bp, Artificial
  CRISPR gRNA sequence
ccagtgacctcgctgccccc

SEQ ID NO: 447942 - DNA, 20 bp, Artificial
  CRISPR gRNA sequence
acctcgctgccccccagcgc

SEQ ID NO: 447943 - DNA, 20 bp, Artificial
  CRISPR gRNA sequence
cgctgccccccagcgctggt

SEQ ID NO: 447944 - DNA, 20 bp, Artificial
  CRISPR gRNA sequence
gctgccccccagcgctggtg

SEQ ID NO: 447945 - DNA, 20 bp, Artificial
  CRISPR gRNA sequence
ctgccccccagcgctggtga

SEQ ID NO: 447946 - DNA, 20 bp, Artificial
  CRISPR gRNA sequence
tgccccccagcgctggtgag

SEQ ID NO: 447947 - DNA, 20 bp, Artificial
  CRISPR gRNA sequence
cgctggtgaggggcccacaa

SEQ ID NO: 447948 - DNA, 20 bp, Artificial
  CRISPR gRNA sequence
ttacatgctcttcttcaact

SEQ ID NO: 447949 - DNA, 20 bp, Artificial
  CRISPR gRNA sequence
gctcttcttcaactcggccc

SEQ ID NO: 447950 - DNA, 20 bp, Artificial
  CRISPR gRNA sequence
ctcttcttcaactcggccct

SEQ ID NO: 447951 - DNA, 20 bp, Artificial
  CRISPR gRNA sequence
actcggccctaggcaccgcg

SEQ ID NO: 447952 - DNA, 20 bp, Artificial
  CRISPR gRNA sequence
gccctaggcaccgcgaagtc

SEQ ID NO: 447953 - DNA, 20 bp, Artificial
  CRISPR gRNA sequence
accgcgaagtctggccactc

SEQ ID NO: 447954 - DNA, 20 bp, Artificial
  CRISPR gRNA sequence
gcgaagtctggccactccag

SEQ ID NO: 447955 - DNA, 20 bp, Artificial
  CRISPR gRNA sequence
gaagtctggccactccagcg

SEQ ID NO: 447956 - DNA, 20 bp, Artificial
  CRISPR gRNA sequence
ggccactccagcggagtgac

SEQ ID NO: 447957 - DNA, 20 bp, Artificial
  CRISPR gRNA sequence
agcggagtgaccagctgcat

SEQ ID NO: 447958 - DNA, 20 bp, Artificial
  CRISPR gRNA sequence
ccgcctgtcctctctctcct

SEQ ID NO: 447959 - DNA, 20 bp, Artificial
  CRISPR gRNA sequence
cctgtcctctctctccttgg

SEQ ID NO: 447960 - DNA, 20 bp, Artificial
  CRISPR gRNA sequence
gtcctctctctccttggaag

SEQ ID NO: 447961 - DNA, 20 bp, Artificial
  CRISPR gRNA sequence
cccctcccatcccgctgcac

SEQ ID NO: 447962 - DNA, 20 bp, Artificial
  CRISPR gRNA sequence
atcccgctgcaccagtccct

SEQ ID NO: 447963 - DNA, 20 bp, Artificial
  CRISPR gRNA sequence
tcccgctgcaccagtccctt

SEQ ID NO: 447964 - DNA, 20 bp, Artificial
  CRISPR gRNA sequence
agtcccttaggaaacacgcc

SEQ ID NO: 447965 - DNA, 20 bp, Artificial
  CRISPR gRNA sequence
tcccttaggaaacacgccta

SEQ ID NO: 447966 - DNA, 20 bp, Artificial
  CRISPR gRNA sequence
cttaggaaacacgcctagag

SEQ ID NO: 447967 - DNA, 20 bp, Artificial
  CRISPR gRNA sequence
ttaggaaacacgcctagaga

SEQ ID NO: 447968 - DNA, 20 bp, Artificial
  CRISPR gRNA sequence
taggaaacacgcctagagaa

SEQ ID NO: 447969 - DNA, 20 bp, Artificial
  CRISPR gRNA sequence
acgaccttgtcaacattcca

SEQ ID NO: 447970 - DNA, 20 bp, Artificial
  CRISPR gRNA sequence
gtcaacattccacagctacc

SEQ ID NO: 447971 - DNA, 20 bp, Artificial
  CRISPR gRNA sequence
cattccacagctacctagtg

SEQ ID NO: 447972 - DNA, 20 bp, Artificial
  CRISPR gRNA sequence
ttccacagctacctagtgcg

SEQ ID NO: 447973 - DNA, 20 bp, Artificial
  CRISPR gRNA sequence
acagctacctagtgcggagc

SEQ ID NO: 447974 - DNA, 20 bp, Artificial
  CRISPR gRNA sequence
cagctacctagtgcggagcc

SEQ ID NO: 447975 - DNA, 20 bp, Artificial
  CRISPR gRNA sequence
acctagtgcggagccaggac

SEQ ID NO: 447976 - DNA, 20 bp, Artificial
  CRISPR gRNA sequence
tagtgcggagccaggactgg

SEQ ID NO: 447977 - DNA, 20 bp, Artificial
  CRISPR gRNA sequence
gcggagccaggactggaagc

SEQ ID NO: 447978 - DNA, 20 bp, Artificial
  CRISPR gRNA sequence
gactggaagccagatctcct

SEQ ID NO: 447979 - DNA, 20 bp, Artificial
  CRISPR gRNA sequence
aattcacccaccgtattctt

SEQ ID NO: 447980 - DNA, 20 bp, Artificial
  CRISPR gRNA sequence
ccaccgtattctttagtcac

SEQ ID NO: 447981 - DNA, 20 bp, Artificial
  CRISPR gRNA sequence
ttctttagtcaccagctccc

SEQ ID NO: 447982 - DNA, 20 bp, Artificial
  CRISPR gRNA sequence
ctttagtcaccagctcccga

SEQ ID NO: 447983 - DNA, 20 bp, Artificial
  CRISPR gRNA sequence
agagcccacaaacaactatg

SEQ ID NO: 447984 - DNA, 20 bp, Artificial
  CRISPR gRNA sequence
gagcccacaaacaactatga

SEQ ID NO: 447985 - DNA, 20 bp, Artificial
  CRISPR gRNA sequence
ctaacttcattgccatcttg

SEQ ID NO: 447986 - DNA, 20 bp, Artificial
  CRISPR gRNA sequence
gcctttccacatccctcatc

SEQ ID NO: 447987 - DNA, 20 bp, Artificial
  CRISPR gRNA sequence
cactttatgaccttattact

SEQ ID NO: 447988 - DNA, 20 bp, Artificial
  CRISPR gRNA sequence
tatgaccttattacttagta

SEQ ID NO: 447989 - DNA, 20 bp, Artificial
  CRISPR gRNA sequence
tacagtcgttcttgtgttaa

SEQ ID NO: 447990 - DNA, 20 bp, Artificial
  CRISPR gRNA sequence
tgttaacagctgttcgtgaa

SEQ ID NO: 447991 - DNA, 20 bp, Artificial
  CRISPR gRNA sequence
acagctgttcgtgaatggat

SEQ ID NO: 447992 - DNA, 20 bp, Artificial
  CRISPR gRNA sequence
gctgttcgtgaatggatgag

SEQ ID NO: 447993 - DNA, 20 bp, Artificial
  CRISPR gRNA sequence
gtgaatggatgagcggctgt

SEQ ID NO: 447994 - DNA, 20 bp, Artificial
  CRISPR gRNA sequence
tgaatggatgagcggctgtg

SEQ ID NO: 447995 - DNA, 20 bp, Artificial
  CRISPR gRNA sequence
aatggatgagcggctgtgag

SEQ ID NO: 447996 - DNA, 20 bp, Artificial
  CRISPR gRNA sequence
tggatgagcggctgtgagga

SEQ ID NO: 447997 - DNA, 20 bp, Artificial
  CRISPR gRNA sequence
ggatgagcggctgtgaggag

SEQ ID NO: 447998 - DNA, 20 bp, Artificial
  CRISPR gRNA sequence
gatgagcggctgtgaggaga

SEQ ID NO: 447999 - DNA, 20 bp, Artificial
  CRISPR gRNA sequence
cggctgtgaggagagggaca

SEQ ID NO: 448000 - DNA, 20 bp, Artificial
  CRISPR gRNA sequence
ggctgtgaggagagggacaa

SEQ ID NO: 448001 - DNA, 20 bp, Artificial
  CRISPR gRNA sequence
gctgtgaggagagggacaaa

SEQ ID NO: 448002 - DNA, 20 bp, Artificial
  CRISPR gRNA sequence
ctgtgaggagagggacaaag

SEQ ID NO: 448003 - DNA, 20 bp, Artificial
  CRISPR gRNA sequence
agagggacaaaggggactcc

SEQ ID NO: 448004 - DNA, 20 bp, Artificial
  CRISPR gRNA sequence
agggacaaaggggactccaa

SEQ ID NO: 448005 - DNA, 20 bp, Artificial
  CRISPR gRNA sequence
acaaaggggactccaagaga

SEQ ID NO: 448006 - DNA, 20 bp, Artificial
  CRISPR gRNA sequence
agagaaagactctcataact

SEQ ID NO: 448007 - DNA, 20 bp, Artificial
  CRISPR gRNA sequence
gagaaagactctcataactt

SEQ ID NO: 448008 - DNA, 20 bp, Artificial
  CRISPR gRNA sequence
aagactctcataacttgggt

SEQ ID NO: 448009 - DNA, 20 bp, Artificial
  CRISPR gRNA sequence
gactctcataacttgggtta

SEQ ID NO: 448010 - DNA, 20 bp, Artificial
  CRISPR gRNA sequence
tagagtcctgctccccaact

SEQ ID NO: 448011 - DNA, 20 bp, Artificial
  CRISPR gRNA sequence
agagtcctgctccccaactt

SEQ ID NO: 448012 - DNA, 20 bp, Artificial
  CRISPR gRNA sequence
agtcctgctccccaacttag

SEQ ID NO: 448013 - DNA, 20 bp, Artificial
  CRISPR gRNA sequence
aacttaggagctgtgatttt

SEQ ID NO: 448014 - DNA, 20 bp, Artificial
  CRISPR gRNA sequence
taggagctgtgattttaagc

SEQ ID NO: 448015 - DNA, 20 bp, Artificial
  CRISPR gRNA sequence
tgtgattttaagcaagtcac

SEQ ID NO: 448016 - DNA, 20 bp, Artificial
  CRISPR gRNA sequence
gcaagtcacaagtcccctcc

SEQ ID NO: 448017 - DNA, 20 bp, Artificial
  CRISPR gRNA sequence
ttcgtacaaataataaattt

SEQ ID NO: 448018 - DNA, 20 bp, Artificial
  CRISPR gRNA sequence
taaattttagaaaataataa

SEQ ID NO: 448019 - DNA, 20 bp, Artificial
  CRISPR gRNA sequence
tttagaaaataataatggct

SEQ ID NO: 448020 - DNA, 20 bp, Artificial
  CRISPR gRNA sequence
ataatggcttagtgttttat

SEQ ID NO: 448021 - DNA, 20 bp, Artificial
  CRISPR gRNA sequence
taatggcttagtgttttata

SEQ ID NO: 448022 - DNA, 20 bp, Artificial
  CRISPR gRNA sequence
tgttttataaggactaaaca

SEQ ID NO: 448023 - DNA, 20 bp, Artificial
  CRISPR gRNA sequence
aaggactaaacacagtcttg

SEQ ID NO: 448024 - DNA, 20 bp, Artificial
  CRISPR gRNA sequence
aggactaaacacagtcttgc

SEQ ID NO: 448025 - DNA, 20 bp, Artificial
  CRISPR gRNA sequence
actaaacacagtcttgcagg

SEQ ID NO: 448026 - DNA, 20 bp, Artificial
  CRISPR gRNA sequence
gtcttgcaggtagatgtgcc

SEQ ID NO: 448027 - DNA, 20 bp, Artificial
  CRISPR gRNA sequence
ctgtccattgattccaatat

SEQ ID NO: 448028 - DNA, 20 bp, Artificial
  CRISPR gRNA sequence
ccattgattccaatataaga

SEQ ID NO: 448029 - DNA, 20 bp, Artificial
  CRISPR gRNA sequence
agaaagcataaaactaatca

SEQ ID NO: 448030 - DNA, 20 bp, Artificial
  CRISPR gRNA sequence
aatcatagctatcatttatt

SEQ ID NO: 448031 - DNA, 20 bp, Artificial
  CRISPR gRNA sequence
attgagcccttactctctgc

SEQ ID NO: 448032 - DNA, 20 bp, Artificial
  CRISPR gRNA sequence
ttgagcccttactctctgcc

SEQ ID NO: 448033 - DNA, 20 bp, Artificial
  CRISPR gRNA sequence
tctctgccaggcactgtgct

SEQ ID NO: 448034 - DNA, 20 bp, Artificial
  CRISPR gRNA sequence
actgtgctaagtaatttaca

SEQ ID NO: 448035 - DNA, 20 bp, Artificial
  CRISPR gRNA sequence
ctgtgctaagtaatttacat

SEQ ID NO: 448036 - DNA, 20 bp, Artificial
  CRISPR gRNA sequence
tcatttgaccctcacaaccc

SEQ ID NO: 448037 - DNA, 20 bp, Artificial
  CRISPR gRNA sequence
catttgaccctcacaaccca

SEQ ID NO: 448038 - DNA, 20 bp, Artificial
  CRISPR gRNA sequence
ttgaccctcacaacccaagg

SEQ ID NO: 448039 - DNA, 20 bp, Artificial
  CRISPR gRNA sequence
gaccctcacaacccaaggaa

SEQ ID NO: 448040 - DNA, 20 bp, Artificial
  CRISPR gRNA sequence
aatattttgtcaccatttta

SEQ ID NO: 448041 - DNA, 20 bp, Artificial
  CRISPR gRNA sequence
atattttgtcaccattttat

SEQ ID NO: 448042 - DNA, 20 bp, Artificial
  CRISPR gRNA sequence
tcaccattttataggtcatt

SEQ ID NO: 448043 - DNA, 20 bp, Artificial
  CRISPR gRNA sequence
accattttataggtcattaa

SEQ ID NO: 448044 - DNA, 20 bp, Artificial
  CRISPR gRNA sequence
ttataggtcattaagagatt

SEQ ID NO: 448045 - DNA, 20 bp, Artificial
  CRISPR gRNA sequence
gaaacttgcccaatattaca

SEQ ID NO: 448046 - DNA, 20 bp, Artificial
  CRISPR gRNA sequence
cttgcccaatattacacaga

SEQ ID NO: 448047 - DNA, 20 bp, Artificial
  CRISPR gRNA sequence
ccaatattacacagatagtt

SEQ ID NO: 448048 - DNA, 20 bp, Artificial
  CRISPR gRNA sequence
acacagatagttaagtttca

SEQ ID NO: 448049 - DNA, 20 bp, Artificial
  CRISPR gRNA sequence
agatagttaagtttcaaagc

SEQ ID NO: 448050 - DNA, 20 bp, Artificial
  CRISPR gRNA sequence
aagccagatctgaaacatcc

SEQ ID NO: 448051 - DNA, 20 bp, Artificial
  CRISPR gRNA sequence
gaaacatcctggtctgactc

SEQ ID NO: 448052 - DNA, 20 bp, Artificial
  CRISPR gRNA sequence
aacatcctggtctgactcta

SEQ ID NO: 448053 - DNA, 20 bp, Artificial
  CRISPR gRNA sequence
aacgtccgcctctgctgtgt

SEQ ID NO: 448054 - DNA, 20 bp, Artificial
  CRISPR gRNA sequence
agtgatctctctgtgcccca

SEQ ID NO: 448055 - DNA, 20 bp, Artificial
  CRISPR gRNA sequence
ccatggtgtctgacacatta

SEQ ID NO: 448056 - DNA, 20 bp, Artificial
  CRISPR gRNA sequence
tgaaatatgtctatttatta

SEQ ID NO: 448057 - DNA, 20 bp, Artificial
  CRISPR gRNA sequence
gaaatatgtctatttattaa

SEQ ID NO: 448058 - DNA, 20 bp, Artificial
  CRISPR gRNA sequence
atgtctatttattaaaggct

SEQ ID NO: 448059 - DNA, 20 bp, Artificial
  CRISPR gRNA sequence
tatttattaaaggctgagca

SEQ ID NO: 448060 - DNA, 20 bp, Artificial
  CRISPR gRNA sequence
taaaggctgagcatagcgcc

SEQ ID NO: 448061 - DNA, 20 bp, Artificial
  CRISPR gRNA sequence
gctgagcatagcgcctggcc

SEQ ID NO: 448062 - DNA, 20 bp, Artificial
  CRISPR gRNA sequence
ctgagcatagcgcctggccc

SEQ ID NO: 448063 - DNA, 20 bp, Artificial
  CRISPR gRNA sequence
gagcatagcgcctggcccag

SEQ ID NO: 448064 - DNA, 20 bp, Artificial
  CRISPR gRNA sequence
agcgcctggcccaggagcct

SEQ ID NO: 448065 - DNA, 20 bp, Artificial
  CRISPR gRNA sequence
ggagcctaagaaacttgacc

SEQ ID NO: 448066 - DNA, 20 bp, Artificial
  CRISPR gRNA sequence
gaccgagtcatgcaactatt

SEQ ID NO: 448067 - DNA, 20 bp, Artificial
  CRISPR gRNA sequence
gtttttatttttgttttttc

SEQ ID NO: 448068 - DNA, 20 bp, Artificial
  CRISPR gRNA sequence
ttatttttgttttttcgaga

SEQ ID NO: 448069 - DNA, 20 bp, Artificial
  CRISPR gRNA sequence
cagaatcttgctctgtcgcc

SEQ ID NO: 448070 - DNA, 20 bp, Artificial
  CRISPR gRNA sequence
agaatcttgctctgtcgccc

SEQ ID NO: 448071 - DNA, 20 bp, Artificial
  CRISPR gRNA sequence
tcttgctctgtcgcccaggc

SEQ ID NO: 448072 - DNA, 20 bp, Artificial
  CRISPR gRNA sequence
ttgctctgtcgcccaggctg

SEQ ID NO: 448073 - DNA, 20 bp, Artificial
  CRISPR gRNA sequence
ctgtcgcccaggctggagtg

SEQ ID NO: 448074 - DNA, 20 bp, Artificial
  CRISPR gRNA sequence
tcgcccaggctggagtgcag

SEQ ID NO: 448075 - DNA, 20 bp, Artificial
  CRISPR gRNA sequence
ggagtgcagtagcgcgatct

SEQ ID NO: 448076 - DNA, 20 bp, Artificial
  CRISPR gRNA sequence
gcgcgatctcagctcactgc

SEQ ID NO: 448077 - DNA, 20 bp, Artificial
  CRISPR gRNA sequence
tcactgcaagctccgcctct

SEQ ID NO: 448078 - DNA, 20 bp, Artificial
  CRISPR gRNA sequence
cactgcaagctccgcctctc

SEQ ID NO: 448079 - DNA, 20 bp, Artificial
  CRISPR gRNA sequence
ctcacgccattctcctgcct

SEQ ID NO: 448080 - DNA, 20 bp, Artificial
  CRISPR gRNA sequence
ttctcctgcctcagcctccc

SEQ ID NO: 448081 - DNA, 20 bp, Artificial
  CRISPR gRNA sequence
tcctgcctcagcctcccgag

SEQ ID NO: 448082 - DNA, 20 bp, Artificial
  CRISPR gRNA sequence
gcctcagcctcccgagtagc

SEQ ID NO: 448083 - DNA, 20 bp, Artificial
  CRISPR gRNA sequence
cctcagcctcccgagtagct

SEQ ID NO: 448084 - DNA, 20 bp, Artificial
  CRISPR gRNA sequence
ctcccgagtagctgggacta

SEQ ID NO: 448085 - DNA, 20 bp, Artificial
  CRISPR gRNA sequence
tcccgagtagctgggactac

SEQ ID NO: 448086 - DNA, 20 bp, Artificial
  CRISPR gRNA sequence
caggcgcccgccaccacgcc

SEQ ID NO: 448087 - DNA, 20 bp, Artificial
  CRISPR gRNA sequence
ctaattttttgtattttttt

SEQ ID NO: 448088 - DNA, 20 bp, Artificial
  CRISPR gRNA sequence
attttttgtattttttttag

SEQ ID NO: 448089 - DNA, 20 bp, Artificial
  CRISPR gRNA sequence
tttttgtattttttttagta

SEQ ID NO: 448090 - DNA, 20 bp, Artificial
  CRISPR gRNA sequence
tgtattttttttagtagaga

SEQ ID NO: 448091 - DNA, 20 bp, Artificial
  CRISPR gRNA sequence
gtattttttttagtagagat

SEQ ID NO: 448092 - DNA, 20 bp, Artificial
  CRISPR gRNA sequence
tattttttttagtagagatg

SEQ ID NO: 448093 - DNA, 20 bp, Artificial
  CRISPR gRNA sequence
gagatggggtttcaccgtgt

SEQ ID NO: 448094 - DNA, 20 bp, Artificial
  CRISPR gRNA sequence
tggggtttcaccgtgttagc

SEQ ID NO: 448095 - DNA, 20 bp, Artificial
  CRISPR gRNA sequence
ggggtttcaccgtgttagcc

SEQ ID NO: 448096 - DNA, 20 bp, Artificial
  CRISPR gRNA sequence
tttcaccgtgttagccagga

SEQ ID NO: 448097 - DNA, 20 bp, Artificial
  CRISPR gRNA sequence
acctcgtgatctgcccacct

SEQ ID NO: 448098 - DNA, 20 bp, Artificial
  CRISPR gRNA sequence
ctgcccacctcggcctccca

SEQ ID NO: 448099 - DNA, 20 bp, Artificial
  CRISPR gRNA sequence
acctcggcctcccaaagtgc

SEQ ID NO: 448100 - DNA, 20 bp, Artificial
  CRISPR gRNA sequence
cctcggcctcccaaagtgct

SEQ ID NO: 448101 - DNA, 20 bp, Artificial
  CRISPR gRNA sequence
ctcccaaagtgctgggatta

SEQ ID NO: 448102 - DNA, 20 bp, Artificial
  CRISPR gRNA sequence
tcccaaagtgctgggattac

SEQ ID NO: 448103 - DNA, 20 bp, Artificial
  CRISPR gRNA sequence
agtgctgggattacaggcgt

SEQ ID NO: 448104 - DNA, 20 bp, Artificial
  CRISPR gRNA sequence
caggcgtgagacaccgcgcc

SEQ ID NO: 448105 - DNA, 20 bp, Artificial
  CRISPR gRNA sequence
ccgcgcccggcgccactatt

SEQ ID NO: 448106 - DNA, 20 bp, Artificial
  CRISPR gRNA sequence
ccggcgccactattaagttt

SEQ ID NO: 448107 - DNA, 20 bp, Artificial
  CRISPR gRNA sequence
cggcgccactattaagtttt

SEQ ID NO: 448108 - DNA, 20 bp, Artificial
  CRISPR gRNA sequence
ccactattaagttttaggac

SEQ ID NO: 448109 - DNA, 20 bp, Artificial
  CRISPR gRNA sequence
cactattaagttttaggacc

SEQ ID NO: 448110 - DNA, 20 bp, Artificial
  CRISPR gRNA sequence
ggatttgaacacaaacactc

SEQ ID NO: 448111 - DNA, 20 bp, Artificial
  CRISPR gRNA sequence
gaacacaaacactctggctc

SEQ ID NO: 448112 - DNA, 20 bp, Artificial
  CRISPR gRNA sequence
acacaaacactctggctcta

SEQ ID NO: 448113 - DNA, 20 bp, Artificial
  CRISPR gRNA sequence
acgctttttaaccataattc

SEQ ID NO: 448114 - DNA, 20 bp, Artificial
  CRISPR gRNA sequence
cgctttttaaccataattct

SEQ ID NO: 448115 - DNA, 20 bp, Artificial
  CRISPR gRNA sequence
cacttaatattccatgtttc

SEQ ID NO: 448116 - DNA, 20 bp, Artificial
  CRISPR gRNA sequence
cttaatattccatgtttcaa

SEQ ID NO: 448117 - DNA, 20 bp, Artificial
  CRISPR gRNA sequence
ttccatgtttcaagagtcac

SEQ ID NO: 448118 - DNA, 20 bp, Artificial
  CRISPR gRNA sequence
tccatgtttcaagagtcacc

SEQ ID NO: 448119 - DNA, 20 bp, Artificial
  CRISPR gRNA sequence
caagagtcaccaggacattc

SEQ ID NO: 448120 - DNA, 20 bp, Artificial
  CRISPR gRNA sequence
gtcaccaggacattctggtg

SEQ ID NO: 448121 - DNA, 20 bp, Artificial
  CRISPR gRNA sequence
ggacattctggtgtagcatg

SEQ ID NO: 448122 - DNA, 20 bp, Artificial
  CRISPR gRNA sequence
gacattctggtgtagcatga

SEQ ID NO: 448123 - DNA, 20 bp, Artificial
  CRISPR gRNA sequence
agcatgaaggtatgataaca

SEQ ID NO: 448124 - DNA, 20 bp, Artificial
  CRISPR gRNA sequence
gcatgaaggtatgataacac

SEQ ID NO: 448125 - DNA, 20 bp, Artificial
  CRISPR gRNA sequence
atgaaggtatgataacacag

SEQ ID NO: 448126 - DNA, 20 bp, Artificial
  CRISPR gRNA sequence
aaggtatgataacacaggag

SEQ ID NO: 448127 - DNA, 20 bp, Artificial
  CRISPR gRNA sequence
aggtatgataacacaggaga

SEQ ID NO: 448128 - DNA, 20 bp, Artificial
  CRISPR gRNA sequence
gataacacaggagaaggaac

SEQ ID NO: 448129 - DNA, 20 bp, Artificial
  CRISPR gRNA sequence
ataacacaggagaaggaaca

SEQ ID NO: 448130 - DNA, 20 bp, Artificial
  CRISPR gRNA sequence
aacacaggagaaggaacaag

SEQ ID NO: 448131 - DNA, 20 bp, Artificial
  CRISPR gRNA sequence
cacaggagaaggaacaagga

SEQ ID NO: 448132 - DNA, 20 bp, Artificial
  CRISPR gRNA sequence
acaggagaaggaacaaggag

SEQ ID NO: 448133 - DNA, 20 bp, Artificial
  CRISPR gRNA sequence
agaaggaacaaggagaggtc

SEQ ID NO: 448134 - DNA, 20 bp, Artificial
  CRISPR gRNA sequence
gaaggaacaaggagaggtca

SEQ ID NO: 448135 - DNA, 20 bp, Artificial
  CRISPR gRNA sequence
gaacaaggagaggtcaaggc

SEQ ID NO: 448136 - DNA, 20 bp, Artificial
  CRISPR gRNA sequence
aacaaggagaggtcaaggct

SEQ ID NO: 448137 - DNA, 20 bp, Artificial
  CRISPR gRNA sequence
aggagaggtcaaggctagga

SEQ ID NO: 448138 - DNA, 20 bp, Artificial
  CRISPR gRNA sequence
ggagaggtcaaggctaggaa

SEQ ID NO: 448139 - DNA, 20 bp, Artificial
  CRISPR gRNA sequence
tcaaggctaggaaaggacat

SEQ ID NO: 448140 - DNA, 20 bp, Artificial
  CRISPR gRNA sequence
caaggctaggaaaggacatt

SEQ ID NO: 448141 - DNA, 20 bp, Artificial
  CRISPR gRNA sequence
aaggctaggaaaggacattg

SEQ ID NO: 448142 - DNA, 20 bp, Artificial
  CRISPR gRNA sequence
ggacattggggccataccat

SEQ ID NO: 448143 - DNA, 20 bp, Artificial
  CRISPR gRNA sequence
gccataccatgagctgctgc

SEQ ID NO: 448144 - DNA, 20 bp, Artificial
  CRISPR gRNA sequence
ccataccatgagctgctgct

SEQ ID NO: 448145 - DNA, 20 bp, Artificial
  CRISPR gRNA sequence
ctgctgctgggatgttttat

SEQ ID NO: 448146 - DNA, 20 bp, Artificial
  CRISPR gRNA sequence
tgctgctgggatgttttatt

SEQ ID NO: 448147 - DNA, 20 bp, Artificial
  CRISPR gRNA sequence
ttaggattgtgacaaatgta

SEQ ID NO: 448148 - DNA, 20 bp, Artificial
  CRISPR gRNA sequence
attgtgacaaatgtatagat

SEQ ID NO: 448149 - DNA, 20 bp, Artificial
  CRISPR gRNA sequence
gacaaatgtatagataagta

SEQ ID NO: 448150 - DNA, 20 bp, Artificial
  CRISPR gRNA sequence
aaatgtatagataagtacag

SEQ ID NO: 448151 - DNA, 20 bp, Artificial
  CRISPR gRNA sequence
atttaacaatcgtctctact

SEQ ID NO: 448152 - DNA, 20 bp, Artificial
  CRISPR gRNA sequence
ttttcttttatgttccttaa

SEQ ID NO: 448153 - DNA, 20 bp, Artificial
  CRISPR gRNA sequence
tgttccttaatagtactgta

SEQ ID NO: 448154 - DNA, 20 bp, Artificial
  CRISPR gRNA sequence
actgtatagtttgtatccta

SEQ ID NO: 448155 - DNA, 20 bp, Artificial
  CRISPR gRNA sequence
ctgtatagtttgtatcctat

SEQ ID NO: 448156 - DNA, 20 bp, Artificial
  CRISPR gRNA sequence
tgtatcctataggtcctatt

SEQ ID NO: 448157 - DNA, 20 bp, Artificial
  CRISPR gRNA sequence
ggaatgttgttacatttttc

SEQ ID NO: 448158 - DNA, 20 bp, Artificial
  CRISPR gRNA sequence
acatttttctggacatttga

SEQ ID NO: 448159 - DNA, 20 bp, Artificial
  CRISPR gRNA sequence
catttttctggacatttgat

SEQ ID NO: 448160 - DNA, 20 bp, Artificial
  CRISPR gRNA sequence
tggacatttgatgggttttt

SEQ ID NO: 448161 - DNA, 20 bp, Artificial
  CRISPR gRNA sequence
tttttggttgctataatgaa

SEQ ID NO: 448162 - DNA, 20 bp, Artificial
  CRISPR gRNA sequence
ttctgactaataattatatc

SEQ ID NO: 448163 - DNA, 20 bp, Artificial
  CRISPR gRNA sequence
tctgactaataattatatcc

SEQ ID NO: 448164 - DNA, 20 bp, Artificial
  CRISPR gRNA sequence
ttttaatcttatgtattaat

SEQ ID NO: 448165 - DNA, 20 bp, Artificial
  CRISPR gRNA sequence
tgtatgtatatacactaatt

SEQ ID NO: 448166 - DNA, 20 bp, Artificial
  CRISPR gRNA sequence
ttacataacattctattctg

SEQ ID NO: 448167 - DNA, 20 bp, Artificial
  CRISPR gRNA sequence
atttattcaaccattctcac

SEQ ID NO: 448168 - DNA, 20 bp, Artificial
  CRISPR gRNA sequence
tattcaaccattctcaccag

SEQ ID NO: 448169 - DNA, 20 bp, Artificial
  CRISPR gRNA sequence
attcaaccattctcaccagt

SEQ ID NO: 448170 - DNA, 20 bp, Artificial
  CRISPR gRNA sequence
tcacctgtttccttttttta

SEQ ID NO: 448171 - DNA, 20 bp, Artificial
  CRISPR gRNA sequence
cacctgtttcctttttttat

SEQ ID NO: 448172 - DNA, 20 bp, Artificial
  CRISPR gRNA sequence
acctgtttcctttttttatg

SEQ ID NO: 448173 - DNA, 20 bp, Artificial
  CRISPR gRNA sequence
cctgtttcctttttttatgg

SEQ ID NO: 448174 - DNA, 20 bp, Artificial
  CRISPR gRNA sequence
gtttcctttttttatggggg

SEQ ID NO: 448175 - DNA, 20 bp, Artificial
  CRISPR gRNA sequence
tttcctttttttatgggggc

SEQ ID NO: 448176 - DNA, 20 bp, Artificial
  CRISPR gRNA sequence
cctttttttatgggggcagg

SEQ ID NO: 448177 - DNA, 20 bp, Artificial
  CRISPR gRNA sequence
ctttttttatgggggcagga

SEQ ID NO: 448178 - DNA, 20 bp, Artificial
  CRISPR gRNA sequence
atgggggcaggaaggcgaca

SEQ ID NO: 448179 - DNA, 20 bp, Artificial
  CRISPR gRNA sequence
caaagttttgctctgttgcc

SEQ ID NO: 448180 - DNA, 20 bp, Artificial
  CRISPR gRNA sequence
aaagttttgctctgttgccc

SEQ ID NO: 448181 - DNA, 20 bp, Artificial
  CRISPR gRNA sequence
ttttgctctgttgcccaggc

SEQ ID NO: 448182 - DNA, 20 bp, Artificial
  CRISPR gRNA sequence
ttgctctgttgcccaggctg

SEQ ID NO: 448183 - DNA, 20 bp, Artificial
  CRISPR gRNA sequence
ctgttgcccaggctggagtg

SEQ ID NO: 448184 - DNA, 20 bp, Artificial
  CRISPR gRNA sequence
ttgcccaggctggagtgcag

SEQ ID NO: 448185 - DNA, 20 bp, Artificial
  CRISPR gRNA sequence
ggagtgcagtggcgtgatct

SEQ ID NO: 448186 - DNA, 20 bp, Artificial
  CRISPR gRNA sequence
tcactgcaatctctgcctcc

SEQ ID NO: 448187 - DNA, 20 bp, Artificial
  CRISPR gRNA sequence
cactgcaatctctgcctccc

SEQ ID NO: 448188 - DNA, 20 bp, Artificial
  CRISPR gRNA sequence
aatctctgcctcccaggttc

SEQ ID NO: 448189 - DNA, 20 bp, Artificial
  CRISPR gRNA sequence
ttcaagcaattatcctgcct

SEQ ID NO: 448190 - DNA, 20 bp, Artificial
  CRISPR gRNA sequence
ttatcctgcctcagcctcct

SEQ ID NO: 448191 - DNA, 20 bp, Artificial
  CRISPR gRNA sequence
tcctgcctcagcctcctgag

SEQ ID NO: 448192 - DNA, 20 bp, Artificial
  CRISPR gRNA sequence
cctgcctcagcctcctgagt

SEQ ID NO: 448193 - DNA, 20 bp, Artificial
  CRISPR gRNA sequence
gcctcagcctcctgagtagg

SEQ ID NO: 448194 - DNA, 20 bp, Artificial
  CRISPR gRNA sequence
cctcagcctcctgagtaggt

SEQ ID NO: 448195 - DNA, 20 bp, Artificial
  CRISPR gRNA sequence
ctcctgagtaggtgggatca

SEQ ID NO: 448196 - DNA, 20 bp, Artificial
  CRISPR gRNA sequence
tcctgagtaggtgggatcac

SEQ ID NO: 448197 - DNA, 20 bp, Artificial
  CRISPR gRNA sequence
caggcacctgctacaacacc

SEQ ID NO: 448198 - DNA, 20 bp, Artificial
  CRISPR gRNA sequence
ccagctaatttttgcatttt

SEQ ID NO: 448199 - DNA, 20 bp, Artificial
  CRISPR gRNA sequence
gctaatttttgcatttttag

SEQ ID NO: 448200 - DNA, 20 bp, Artificial
  CRISPR gRNA sequence
taatttttgcatttttagta

SEQ ID NO: 448201 - DNA, 20 bp, Artificial
  CRISPR gRNA sequence
ttttgcatttttagtagagc

SEQ ID NO: 448202 - DNA, 20 bp, Artificial
  CRISPR gRNA sequence
tttgcatttttagtagagcc

SEQ ID NO: 448203 - DNA, 20 bp, Artificial
  CRISPR gRNA sequence
ttgcatttttagtagagcca

SEQ ID NO: 448204 - DNA, 20 bp, Artificial
  CRISPR gRNA sequence
agagccagggtttcaccatg

SEQ ID NO: 448205 - DNA, 20 bp, Artificial
  CRISPR gRNA sequence
gagccagggtttcaccatgt

SEQ ID NO: 448206 - DNA, 20 bp, Artificial
  CRISPR gRNA sequence
cagggtttcaccatgtgggc

SEQ ID NO: 448207 - DNA, 20 bp, Artificial
  CRISPR gRNA sequence
agggtttcaccatgtgggcc

SEQ ID NO: 448208 - DNA, 20 bp, Artificial
  CRISPR gRNA sequence
tttcaccatgtgggccaggc

SEQ ID NO: 448209 - DNA, 20 bp, Artificial
  CRISPR gRNA sequence
tggtctcgaactcctgacct

SEQ ID NO: 448210 - DNA, 20 bp, Artificial
  CRISPR gRNA sequence
ggtctcgaactcctgacctc

SEQ ID NO: 448211 - DNA, 20 bp, Artificial
  CRISPR gRNA sequence
ggtgatccgcacgcctccca

SEQ ID NO: 448212 - DNA, 20 bp, Artificial
  CRISPR gRNA sequence
ccgcacgcctcccaaagtgc

SEQ ID NO: 448213 - DNA, 20 bp, Artificial
  CRISPR gRNA sequence
cgcacgcctcccaaagtgct

SEQ ID NO: 448214 - DNA, 20 bp, Artificial
  CRISPR gRNA sequence
ctcccaaagtgctgggatta

SEQ ID NO: 448215 - DNA, 20 bp, Artificial
  CRISPR gRNA sequence
tcccaaagtgctgggattac

SEQ ID NO: 448216 - DNA, 20 bp, Artificial
  CRISPR gRNA sequence
agtgctgggattacaggtgt

SEQ ID NO: 448217 - DNA, 20 bp, Artificial
  CRISPR gRNA sequence
caggtgtgagccaccacacc

SEQ ID NO: 448218 - DNA, 20 bp, Artificial
  CRISPR gRNA sequence
ttcacctgtttctatttttt

SEQ ID NO: 448219 - DNA, 20 bp, Artificial
  CRISPR gRNA sequence
tggtattataaaaaatgctg

SEQ ID NO: 448220 - DNA, 20 bp, Artificial
  CRISPR gRNA sequence
atatccttgtacatctatac

SEQ ID NO: 448221 - DNA, 20 bp, Artificial
  CRISPR gRNA sequence
actcatgcttttatttctgt

SEQ ID NO: 448222 - DNA, 20 bp, Artificial
  CRISPR gRNA sequence
gcttttatttctgtaagcta

SEQ ID NO: 448223 - DNA, 20 bp, Artificial
  CRISPR gRNA sequence
atttctgtaagctatagcca

SEQ ID NO: 448224 - DNA, 20 bp, Artificial
  CRISPR gRNA sequence
tttctgtaagctatagccaa

SEQ ID NO: 448225 - DNA, 20 bp, Artificial
  CRISPR gRNA sequence
ttctgtaagctatagccaaa

SEQ ID NO: 448226 - DNA, 20 bp, Artificial
  CRISPR gRNA sequence
gtaagctatagccaaaggga

SEQ ID NO: 448227 - DNA, 20 bp, Artificial
  CRISPR gRNA sequence
taagctatagccaaagggac

SEQ ID NO: 448228 - DNA, 20 bp, Artificial
  CRISPR gRNA sequence
aagctatagccaaagggaca

SEQ ID NO: 448229 - DNA, 20 bp, Artificial
  CRISPR gRNA sequence
ttgaaatgttaatatataat

SEQ ID NO: 448230 - DNA, 20 bp, Artificial
  CRISPR gRNA sequence
atataatgagtattccccca

SEQ ID NO: 448231 - DNA, 20 bp, Artificial
  CRISPR gRNA sequence
caaagctccgtaacaatgta

SEQ ID NO: 448232 - DNA, 20 bp, Artificial
  CRISPR gRNA sequence
taacaatgtatagttctacc

SEQ ID NO: 448233 - DNA, 20 bp, Artificial
  CRISPR gRNA sequence
acaatgtatagttctaccta

SEQ ID NO: 448234 - DNA, 20 bp, Artificial
  CRISPR gRNA sequence
ttaaatttttgttcacttaa

SEQ ID NO: 448235 - DNA, 20 bp, Artificial
  CRISPR gRNA sequence
taaatttttgttcacttaac

SEQ ID NO: 448236 - DNA, 20 bp, Artificial
  CRISPR gRNA sequence
atttttgttcacttaacagg

SEQ ID NO: 448237 - DNA, 20 bp, Artificial
  CRISPR gRNA sequence
tcttttgtgaactgcctatt

SEQ ID NO: 448238 - DNA, 20 bp, Artificial
  CRISPR gRNA sequence
gtttctaataattctcaatt

SEQ ID NO: 448239 - DNA, 20 bp, Artificial
  CRISPR gRNA sequence
taattctcaattaagtttct

SEQ ID NO: 448240 - DNA, 20 bp, Artificial
  CRISPR gRNA sequence
aattctcaattaagtttctt

SEQ ID NO: 448241 - DNA, 20 bp, Artificial
  CRISPR gRNA sequence
attaagtttcttgggttttc

SEQ ID NO: 448242 - DNA, 20 bp, Artificial
  CRISPR gRNA sequence
ttcttgggttttctagatgt

SEQ ID NO: 448243 - DNA, 20 bp, Artificial
  CRISPR gRNA sequence
taagttatatcacatataaa

SEQ ID NO: 448244 - DNA, 20 bp, Artificial
  CRISPR gRNA sequence
aatagtaataaatttgcctt

SEQ ID NO: 448245 - DNA, 20 bp, Artificial
  CRISPR gRNA sequence
attttcttgtctaaatataa

SEQ ID NO: 448246 - DNA, 20 bp, Artificial
  CRISPR gRNA sequence
aatataatggcaaacacttt

SEQ ID NO: 448247 - DNA, 20 bp, Artificial
  CRISPR gRNA sequence
ttcagaacaatgtgaaataa

SEQ ID NO: 448248 - DNA, 20 bp, Artificial
  CRISPR gRNA sequence
atgtgaaataacagaaataa

SEQ ID NO: 448249 - DNA, 20 bp, Artificial
  CRISPR gRNA sequence
tgtgaaataacagaaataat

SEQ ID NO: 448250 - DNA, 20 bp, Artificial
  CRISPR gRNA sequence
gaaataacagaaataatagg

SEQ ID NO: 448251 - DNA, 20 bp, Artificial
  CRISPR gRNA sequence
tgccttgctcctaatattaa

SEQ ID NO: 448252 - DNA, 20 bp, Artificial
  CRISPR gRNA sequence
atgatgctgcaattttatct

SEQ ID NO: 448253 - DNA, 20 bp, Artificial
  CRISPR gRNA sequence
catttctccattatattgaa

SEQ ID NO: 448254 - DNA, 20 bp, Artificial
  CRISPR gRNA sequence
tcatccattaccattttact

SEQ ID NO: 448255 - DNA, 20 bp, Artificial
  CRISPR gRNA sequence
catccattaccattttactt

SEQ ID NO: 448256 - DNA, 20 bp, Artificial
  CRISPR gRNA sequence
taccattttacttaggattt

SEQ ID NO: 448257 - DNA, 20 bp, Artificial
  CRISPR gRNA sequence
cattttacttaggattttag

SEQ ID NO: 448258 - DNA, 20 bp, Artificial
  CRISPR gRNA sequence
attttacttaggattttagt

SEQ ID NO: 448259 - DNA, 20 bp, Artificial
  CRISPR gRNA sequence
attttagtgggaattaatgt

SEQ ID NO: 448260 - DNA, 20 bp, Artificial
  CRISPR gRNA sequence
gaattaatgtaagatgttat

SEQ ID NO: 448261 - DNA, 20 bp, Artificial
  CRISPR gRNA sequence
ttaatgtaagatgttatcag

SEQ ID NO: 448262 - DNA, 20 bp, Artificial
  CRISPR gRNA sequence
taatgtaagatgttatcaga

SEQ ID NO: 448263 - DNA, 20 bp, Artificial
  CRISPR gRNA sequence
tattgactttcttttttatc

SEQ ID NO: 448264 - DNA, 20 bp, Artificial
  CRISPR gRNA sequence
tgactttcttttttatccag

SEQ ID NO: 448265 - DNA, 20 bp, Artificial
  CRISPR gRNA sequence
tccagtagtatgttaattaa

SEQ ID NO: 448266 - DNA, 20 bp, Artificial
  CRISPR gRNA sequence
ttcctaatattaaatcatcc

SEQ ID NO: 448267 - DNA, 20 bp, Artificial
  CRISPR gRNA sequence
aaaccttattccatttgtca

SEQ ID NO: 448268 - DNA, 20 bp, Artificial
  CRISPR gRNA sequence
tttttaatatcttgtatgat

SEQ ID NO: 448269 - DNA, 20 bp, Artificial
  CRISPR gRNA sequence
gtgtgtgtaatttttgattt

SEQ ID NO: 448270 - DNA, 20 bp, Artificial
  CRISPR gRNA sequence
tttttgattttggttttctt

SEQ ID NO: 448271 - DNA, 20 bp, Artificial
  CRISPR gRNA sequence
tgattttggttttcttgaga

SEQ ID NO: 448272 - DNA, 20 bp, Artificial
  CRISPR gRNA sequence
gattttggttttcttgagac

SEQ ID NO: 448273 - DNA, 20 bp, Artificial
  CRISPR gRNA sequence
attttggttttcttgagaca

SEQ ID NO: 448274 - DNA, 20 bp, Artificial
  CRISPR gRNA sequence
gacagggtctcactgtcaac

SEQ ID NO: 448275 - DNA, 20 bp, Artificial
  CRISPR gRNA sequence
acagggtctcactgtcaacc

SEQ ID NO: 448276 - DNA, 20 bp, Artificial
  CRISPR gRNA sequence
ggtctcactgtcaaccaggc

SEQ ID NO: 448277 - DNA, 20 bp, Artificial
  CRISPR gRNA sequence
tctcactgtcaaccaggcca

SEQ ID NO: 448278 - DNA, 20 bp, Artificial
  CRISPR gRNA sequence
ctgtcaaccaggccagagtg

SEQ ID NO: 448279 - DNA, 20 bp, Artificial
  CRISPR gRNA sequence
aaccaggccagagtgcagtg

SEQ ID NO: 448280 - DNA, 20 bp, Artificial
  CRISPR gRNA sequence
tcactacatccgtgaactcc

SEQ ID NO: 448281 - DNA, 20 bp, Artificial
  CRISPR gRNA sequence
cactacatccgtgaactccc

SEQ ID NO: 448282 - DNA, 20 bp, Artificial
  CRISPR gRNA sequence
ctcccgggctcctcccacct

SEQ ID NO: 448283 - DNA, 20 bp, Artificial
  CRISPR gRNA sequence
tcctcccacctaagtctctt

SEQ ID NO: 448284 - DNA, 20 bp, Artificial
  CRISPR gRNA sequence
tcccacctaagtctcttgag

SEQ ID NO: 448285 - DNA, 20 bp, Artificial
  CRISPR gRNA sequence
acctaagtctcttgagtagc

SEQ ID NO: 448286 - DNA, 20 bp, Artificial
  CRISPR gRNA sequence
cctaagtctcttgagtagct

SEQ ID NO: 448287 - DNA, 20 bp, Artificial
  CRISPR gRNA sequence
ctcttgagtagctgggactt

SEQ ID NO: 448288 - DNA, 20 bp, Artificial
  CRISPR gRNA sequence
tcttgagtagctgggacttc

SEQ ID NO: 448289 - DNA, 20 bp, Artificial
  CRISPR gRNA sequence
caggtacgcaccaccacacg

SEQ ID NO: 448290 - DNA, 20 bp, Artificial
  CRISPR gRNA sequence
taatttttgtattttttgta

SEQ ID NO: 448291 - DNA, 20 bp, Artificial
  CRISPR gRNA sequence
ttgtattttttgtaaagaca

SEQ ID NO: 448292 - DNA, 20 bp, Artificial
  CRISPR gRNA sequence
catggtctcactttgctgcc

SEQ ID NO: 448293 - DNA, 20 bp, Artificial
  CRISPR gRNA sequence
atggtctcactttgctgccc

SEQ ID NO: 448294 - DNA, 20 bp, Artificial
  CRISPR gRNA sequence
tctcactttgctgcccaggc

SEQ ID NO: 448295 - DNA, 20 bp, Artificial
  CRISPR gRNA sequence
ccaggctggtctcaaactcc

SEQ ID NO: 448296 - DNA, 20 bp, Artificial
  CRISPR gRNA sequence
caggctggtctcaaactcct

SEQ ID NO: 448297 - DNA, 20 bp, Artificial
  CRISPR gRNA sequence
ggtctcaaactcctgggctc

SEQ ID NO: 448298 - DNA, 20 bp, Artificial
  CRISPR gRNA sequence
ctcaagtgatcctcccacct

SEQ ID NO: 448299 - DNA, 20 bp, Artificial
  CRISPR gRNA sequence
cctcccacctcggcctccca

SEQ ID NO: 448300 - DNA, 20 bp, Artificial
  CRISPR gRNA sequence
ctcccacctcggcctcccaa

SEQ ID NO: 448301 - DNA, 20 bp, Artificial
  CRISPR gRNA sequence
acctcggcctcccaaaggct

SEQ ID NO: 448302 - DNA, 20 bp, Artificial
  CRISPR gRNA sequence
cctcggcctcccaaaggctt

SEQ ID NO: 448303 - DNA, 20 bp, Artificial
  CRISPR gRNA sequence
ctcccaaaggcttgggatta

SEQ ID NO: 448304 - DNA, 20 bp, Artificial
  CRISPR gRNA sequence
tcccaaaggcttgggattac

SEQ ID NO: 448305 - DNA, 20 bp, Artificial
  CRISPR gRNA sequence
aggcttgggattacaggcgt

SEQ ID NO: 448306 - DNA, 20 bp, Artificial
  CRISPR gRNA sequence
caggcgtgagccaccgcaac

SEQ ID NO: 448307 - DNA, 20 bp, Artificial
  CRISPR gRNA sequence
aggcgtgagccaccgcaact

SEQ ID NO: 448308 - DNA, 20 bp, Artificial
  CRISPR gRNA sequence
ttaaatataatattataaaa

SEQ ID NO: 448309 - DNA, 20 bp, Artificial
  CRISPR gRNA sequence
taatattataaaacagaata

SEQ ID NO: 448310 - DNA, 20 bp, Artificial
  CRISPR gRNA sequence
tattataaaacagaatacag

SEQ ID NO: 448311 - DNA, 20 bp, Artificial
  CRISPR gRNA sequence
agaatacagcagcacatgaa

SEQ ID NO: 448312 - DNA, 20 bp, Artificial
  CRISPR gRNA sequence
acatgaaaagaataacatac

SEQ ID NO: 448313 - DNA, 20 bp, Artificial
  CRISPR gRNA sequence
catgaaaagaataacatact

SEQ ID NO: 448314 - DNA, 20 bp, Artificial
  CRISPR gRNA sequence
aaaagaataacatactaggc

SEQ ID NO: 448315 - DNA, 20 bp, Artificial
  CRISPR gRNA sequence
aaagaataacatactaggcc

SEQ ID NO: 448316 - DNA, 20 bp, Artificial
  CRISPR gRNA sequence
ataacatactaggccgggcg

SEQ ID NO: 448317 - DNA, 20 bp, Artificial
  CRISPR gRNA sequence
acatactaggccgggcgtgg

SEQ ID NO: 448318 - DNA, 20 bp, Artificial
  CRISPR gRNA sequence
gtggttcacgcctgtaatcc

SEQ ID NO: 448319 - DNA, 20 bp, Artificial
  CRISPR gRNA sequence
cgcctgtaatcccagcactt

SEQ ID NO: 448320 - DNA, 20 bp, Artificial
  CRISPR gRNA sequence
gcctgtaatcccagcacttt

SEQ ID NO: 448321 - DNA, 20 bp, Artificial
  CRISPR gRNA sequence
ctgtaatcccagcactttgg

SEQ ID NO: 448322 - DNA, 20 bp, Artificial
  CRISPR gRNA sequence
tgtaatcccagcactttggg

SEQ ID NO: 448323 - DNA, 20 bp, Artificial
  CRISPR gRNA sequence
tcccagcactttgggaggcc

SEQ ID NO: 448324 - DNA, 20 bp, Artificial
  CRISPR gRNA sequence
cccagcactttgggaggcca

SEQ ID NO: 448325 - DNA, 20 bp, Artificial
  CRISPR gRNA sequence
agcactttgggaggccaagg

SEQ ID NO: 448326 - DNA, 20 bp, Artificial
  CRISPR gRNA sequence
gcactttgggaggccaaggt

SEQ ID NO: 448327 - DNA, 20 bp, Artificial
  CRISPR gRNA sequence
ctttgggaggccaaggtggg

SEQ ID NO: 448328 - DNA, 20 bp, Artificial
  CRISPR gRNA sequence
ggccaaggtgggtggatcac

SEQ ID NO: 448329 - DNA, 20 bp, Artificial
  CRISPR gRNA sequence
gccaaggtgggtggatcaca

SEQ ID NO: 448330 - DNA, 20 bp, Artificial
  CRISPR gRNA sequence
aggtgggtggatcacaaggt

SEQ ID NO: 448331 - DNA, 20 bp, Artificial
  CRISPR gRNA sequence
ggtgggtggatcacaaggtt

SEQ ID NO: 448332 - DNA, 20 bp, Artificial
  CRISPR gRNA sequence
tgggtggatcacaaggttag

SEQ ID NO: 448333 - DNA, 20 bp, Artificial
  CRISPR gRNA sequence
gatcacaaggttaggagttc

SEQ ID NO: 448334 - DNA, 20 bp, Artificial
  CRISPR gRNA sequence
ttaggagttcaagatcaccc

SEQ ID NO: 448335 - DNA, 20 bp, Artificial
  CRISPR gRNA sequence
agttcaagatcaccctggcc

SEQ ID NO: 448336 - DNA, 20 bp, Artificial
  CRISPR gRNA sequence
caagatcaccctggccaaga

SEQ ID NO: 448337 - DNA, 20 bp, Artificial
  CRISPR gRNA sequence
tctactaaaaatacaaaaat

SEQ ID NO: 448338 - DNA, 20 bp, Artificial
  CRISPR gRNA sequence
taaaaatacaaaaattagcc

SEQ ID NO: 448339 - DNA, 20 bp, Artificial
  CRISPR gRNA sequence
atacaaaaattagccgagcg

SEQ ID NO: 448340 - DNA, 20 bp, Artificial
  CRISPR gRNA sequence
caaaaattagccgagcgcag

SEQ ID NO: 448341 - DNA, 20 bp, Artificial
  CRISPR gRNA sequence
aaattagccgagcgcagtgg

SEQ ID NO: 448342 - DNA, 20 bp, Artificial
  CRISPR gRNA sequence
aattagccgagcgcagtggc

SEQ ID NO: 448343 - DNA, 20 bp, Artificial
  CRISPR gRNA sequence
gtggcaggcgcctgtaatcc

SEQ ID NO: 448344 - DNA, 20 bp, Artificial
  CRISPR gRNA sequence
cgcctgtaatcccagatact

SEQ ID NO: 448345 - DNA, 20 bp, Artificial
  CRISPR gRNA sequence
ctgtaatcccagatactcgg

SEQ ID NO: 448346 - DNA, 20 bp, Artificial
  CRISPR gRNA sequence
tgtaatcccagatactcggc

SEQ ID NO: 448347 - DNA, 20 bp, Artificial
  CRISPR gRNA sequence
tcggcaggcgcctgtaatcc

SEQ ID NO: 448348 - DNA, 20 bp, Artificial
  CRISPR gRNA sequence
cgcctgtaatcccagatact

SEQ ID NO: 448349 - DNA, 20 bp, Artificial
  CRISPR gRNA sequence
ctgtaatcccagatactcgg

SEQ ID NO: 448350 - DNA, 20 bp, Artificial
  CRISPR gRNA sequence
tgtaatcccagatactcggc

SEQ ID NO: 448351 - DNA, 20 bp, Artificial
  CRISPR gRNA sequence
tcccagatactcggcaggct

SEQ ID NO: 448352 - DNA, 20 bp, Artificial
  CRISPR gRNA sequence
cccagatactcggcaggctg

SEQ ID NO: 448353 - DNA, 20 bp, Artificial
  CRISPR gRNA sequence
agatactcggcaggctgagg

SEQ ID NO: 448354 - DNA, 20 bp, Artificial
  CRISPR gRNA sequence
gatactcggcaggctgaggc

SEQ ID NO: 448355 - DNA, 20 bp, Artificial
  CRISPR gRNA sequence
tactcggcaggctgaggcag

SEQ ID NO: 448356 - DNA, 20 bp, Artificial
  CRISPR gRNA sequence
gcaggagaatcgcttgaacc

SEQ ID NO: 448357 - DNA, 20 bp, Artificial
  CRISPR gRNA sequence
caggagaatcgcttgaaccc

SEQ ID NO: 448358 - DNA, 20 bp, Artificial
  CRISPR gRNA sequence
ggagaatcgcttgaacccag

SEQ ID NO: 448359 - DNA, 20 bp, Artificial
  CRISPR gRNA sequence
gagaatcgcttgaacccagg

SEQ ID NO: 448360 - DNA, 20 bp, Artificial
  CRISPR gRNA sequence
aatcgcttgaacccaggagg

SEQ ID NO: 448361 - DNA, 20 bp, Artificial
  CRISPR gRNA sequence
cgcttgaacccaggaggtgg

SEQ ID NO: 448362 - DNA, 20 bp, Artificial
  CRISPR gRNA sequence
aacccaggaggtggaagttg

SEQ ID NO: 448363 - DNA, 20 bp, Artificial
  CRISPR gRNA sequence
caggaggtggaagttgcagt

SEQ ID NO: 448364 - DNA, 20 bp, Artificial
  CRISPR gRNA sequence
ggtggaagttgcagtaagcc

SEQ ID NO: 448365 - DNA, 20 bp, Artificial
  CRISPR gRNA sequence
aagatcgtgccactgcactc

SEQ ID NO: 448366 - DNA, 20 bp, Artificial
  CRISPR gRNA sequence
cgtgccactgcactccagcc

SEQ ID NO: 448367 - DNA, 20 bp, Artificial
  CRISPR gRNA sequence
gtgccactgcactccagcct

SEQ ID NO: 448368 - DNA, 20 bp, Artificial
  CRISPR gRNA sequence
ctgcactccagcctgggcga

SEQ ID NO: 448369 - DNA, 20 bp, Artificial
  CRISPR gRNA sequence
gcactccagcctgggcgaca

SEQ ID NO: 448370 - DNA, 20 bp, Artificial
  CRISPR gRNA sequence
tccagcctgggcgacagagt

SEQ ID NO: 448371 - DNA, 20 bp, Artificial
  CRISPR gRNA sequence
agagtgagactctgtctcaa

SEQ ID NO: 448372 - DNA, 20 bp, Artificial
  CRISPR gRNA sequence
aacaacatactatgaccaaa

SEQ ID NO: 448373 - DNA, 20 bp, Artificial
  CRISPR gRNA sequence
atactatgaccaaatggctt

SEQ ID NO: 448374 - DNA, 20 bp, Artificial
  CRISPR gRNA sequence
tcagtttttgtttgtttgtc

SEQ ID NO: 448375 - DNA, 20 bp, Artificial
  CRISPR gRNA sequence
cagtttttgtttgtttgtct

SEQ ID NO: 448376 - DNA, 20 bp, Artificial
  CRISPR gRNA sequence
tttgtttgtctgggactgca

SEQ ID NO: 448377 - DNA, 20 bp, Artificial
  CRISPR gRNA sequence
ctgcaaagatgtatcaattt

SEQ ID NO: 448378 - DNA, 20 bp, Artificial
  CRISPR gRNA sequence
tgcaaagatgtatcaatttt

SEQ ID NO: 448379 - DNA, 20 bp, Artificial
  CRISPR gRNA sequence
ttttaggaaatctattaatg

SEQ ID NO: 448380 - DNA, 20 bp, Artificial
  CRISPR gRNA sequence
cgccatcttaatatatctta

SEQ ID NO: 448381 - DNA, 20 bp, Artificial
  CRISPR gRNA sequence
aaagaaaaataatatcattt

SEQ ID NO: 448382 - DNA, 20 bp, Artificial
  CRISPR gRNA sequence
atcattttagttgatattta

SEQ ID NO: 448383 - DNA, 20 bp, Artificial
  CRISPR gRNA sequence
tcattttagttgatatttaa

SEQ ID NO: 448384 - DNA, 20 bp, Artificial
  CRISPR gRNA sequence
ttttaaaactcttaataaaa

SEQ ID NO: 448385 - DNA, 20 bp, Artificial
  CRISPR gRNA sequence
taaaatacatctcattctca

SEQ ID NO: 448386 - DNA, 20 bp, Artificial
  CRISPR gRNA sequence
aagctactataatacttaat

SEQ ID NO: 448387 - DNA, 20 bp, Artificial
  CRISPR gRNA sequence
agctactataatacttaata

SEQ ID NO: 448388 - DNA, 20 bp, Artificial
  CRISPR gRNA sequence
tacttaataaggaaacattt

SEQ ID NO: 448389 - DNA, 20 bp, Artificial
  CRISPR gRNA sequence
taagcatcccccattaaact

SEQ ID NO: 448390 - DNA, 20 bp, Artificial
  CRISPR gRNA sequence
cccccattaaacttagaaaa

SEQ ID NO: 448391 - DNA, 20 bp, Artificial
  CRISPR gRNA sequence
cattaaacttagaaaaaaga

SEQ ID NO: 448392 - DNA, 20 bp, Artificial
  CRISPR gRNA sequence
ttaaacttagaaaaaagaca

SEQ ID NO: 448393 - DNA, 20 bp, Artificial
  CRISPR gRNA sequence
attattatttaatatttttc

SEQ ID NO: 448394 - DNA, 20 bp, Artificial
  CRISPR gRNA sequence
tattatttaatatttttctg

SEQ ID NO: 448395 - DNA, 20 bp, Artificial
  CRISPR gRNA sequence
gagatattaaccaacacaat

SEQ ID NO: 448396 - DNA, 20 bp, Artificial
  CRISPR gRNA sequence
atattaaccaacacaattag

SEQ ID NO: 448397 - DNA, 20 bp, Artificial
  CRISPR gRNA sequence
taaccaacacaattagaaga

SEQ ID NO: 448398 - DNA, 20 bp, Artificial
  CRISPR gRNA sequence
cacaattagaagaaagaaat

SEQ ID NO: 448399 - DNA, 20 bp, Artificial
  CRISPR gRNA sequence
caattagaagaaagaaatca

SEQ ID NO: 448400 - DNA, 20 bp, Artificial
  CRISPR gRNA sequence
aagaaatcagagatataaaa

SEQ ID NO: 448401 - DNA, 20 bp, Artificial
  CRISPR gRNA sequence
atcagagatataaaatagaa

SEQ ID NO: 448402 - DNA, 20 bp, Artificial
  CRISPR gRNA sequence
tcagagatataaaatagaaa

SEQ ID NO: 448403 - DNA, 20 bp, Artificial
  CRISPR gRNA sequence
gagatataaaatagaaaagg

SEQ ID NO: 448404 - DNA, 20 bp, Artificial
  CRISPR gRNA sequence
acataatatgattgcataac

SEQ ID NO: 448405 - DNA, 20 bp, Artificial
  CRISPR gRNA sequence
attgcataactggaaaatcc

SEQ ID NO: 448406 - DNA, 20 bp, Artificial
  CRISPR gRNA sequence
tgcataactggaaaatccaa

SEQ ID NO: 448407 - DNA, 20 bp, Artificial
  CRISPR gRNA sequence
gagaatcaactgaaaaatga

SEQ ID NO: 448408 - DNA, 20 bp, Artificial
  CRISPR gRNA sequence
aactgaaaaatgatagaatt

SEQ ID NO: 448409 - DNA, 20 bp, Artificial
  CRISPR gRNA sequence
actgaaaaatgatagaatta

SEQ ID NO: 448410 - DNA, 20 bp, Artificial
  CRISPR gRNA sequence
ctgaaaaatgatagaattaa

SEQ ID NO: 448411 - DNA, 20 bp, Artificial
  CRISPR gRNA sequence
gaaaaatgatagaattaagg

SEQ ID NO: 448412 - DNA, 20 bp, Artificial
  CRISPR gRNA sequence
aaaaatgatagaattaaggg

SEQ ID NO: 448413 - DNA, 20 bp, Artificial
  CRISPR gRNA sequence
aaaatgatagaattaaggga

SEQ ID NO: 448414 - DNA, 20 bp, Artificial
  CRISPR gRNA sequence
aaatgatagaattaagggag

SEQ ID NO: 448415 - DNA, 20 bp, Artificial
  CRISPR gRNA sequence
atgatagaattaagggaggg

SEQ ID NO: 448416 - DNA, 20 bp, Artificial
  CRISPR gRNA sequence
tagaattaagggaggggagc

SEQ ID NO: 448417 - DNA, 20 bp, Artificial
  CRISPR gRNA sequence
agaattaagggaggggagct

SEQ ID NO: 448418 - DNA, 20 bp, Artificial
  CRISPR gRNA sequence
ctgggtatgaaattaatatc

SEQ ID NO: 448419 - DNA, 20 bp, Artificial
  CRISPR gRNA sequence
ttaatatctagtaaaacaaa

SEQ ID NO: 448420 - DNA, 20 bp, Artificial
  CRISPR gRNA sequence
gaacaataatgaaaaattaa

SEQ ID NO: 448421 - DNA, 20 bp, Artificial
  CRISPR gRNA sequence
aagatataatgaatgatata

SEQ ID NO: 448422 - DNA, 20 bp, Artificial
  CRISPR gRNA sequence
gatataatgaatgatataaa

SEQ ID NO: 448423 - DNA, 20 bp, Artificial
  CRISPR gRNA sequence
tataaagagactgaaaaaat

SEQ ID NO: 448424 - DNA, 20 bp, Artificial
  CRISPR gRNA sequence
agactgaaaaaataagttaa

SEQ ID NO: 448425 - DNA, 20 bp, Artificial
  CRISPR gRNA sequence
aataagttaaaagatacaac

SEQ ID NO: 448426 - DNA, 20 bp, Artificial
  CRISPR gRNA sequence
aagttaaaagatacaacgag

SEQ ID NO: 448427 - DNA, 20 bp, Artificial
  CRISPR gRNA sequence
gatacaacgagtggaaacaa

SEQ ID NO: 448428 - DNA, 20 bp, Artificial
  CRISPR gRNA sequence
cgagtggaaacaacagatgc

SEQ ID NO: 448429 - DNA, 20 bp, Artificial
  CRISPR gRNA sequence
agtggaaacaacagatgctg

SEQ ID NO: 448430 - DNA, 20 bp, Artificial
  CRISPR gRNA sequence
ggaaacaacagatgctggag

SEQ ID NO: 448431 - DNA, 20 bp, Artificial
  CRISPR gRNA sequence
aacagatgctggagaagatg

SEQ ID NO: 448432 - DNA, 20 bp, Artificial
  CRISPR gRNA sequence
cagatgctggagaagatgtg

SEQ ID NO: 448433 - DNA, 20 bp, Artificial
  CRISPR gRNA sequence
ctggagaagatgtggagaaa

SEQ ID NO: 448434 - DNA, 20 bp, Artificial
  CRISPR gRNA sequence
tggagaagatgtggagaaat

SEQ ID NO: 448435 - DNA, 20 bp, Artificial
  CRISPR gRNA sequence
gaatgcttttacactgttga

SEQ ID NO: 448436 - DNA, 20 bp, Artificial
  CRISPR gRNA sequence
aatgcttttacactgttgat

SEQ ID NO: 448437 - DNA, 20 bp, Artificial
  CRISPR gRNA sequence
tgcttttacactgttgatgg

SEQ ID NO: 448438 - DNA, 20 bp, Artificial
  CRISPR gRNA sequence
ctgttgatgggagtgtaaat

SEQ ID NO: 448439 - DNA, 20 bp, Artificial
  CRISPR gRNA sequence
gtaaattagttcaaccactg

SEQ ID NO: 448440 - DNA, 20 bp, Artificial
  CRISPR gRNA sequence
aattagttcaaccactgtgg

SEQ ID NO: 448441 - DNA, 20 bp, Artificial
  CRISPR gRNA sequence
agttcaaccactgtggaaga

SEQ ID NO: 448442 - DNA, 20 bp, Artificial
  CRISPR gRNA sequence
aaccactgtggaagacagtg

SEQ ID NO: 448443 - DNA, 20 bp, Artificial
  CRISPR gRNA sequence
accactgtggaagacagtgt

SEQ ID NO: 448444 - DNA, 20 bp, Artificial
  CRISPR gRNA sequence
ccactgtggaagacagtgtg

SEQ ID NO: 448445 - DNA, 20 bp, Artificial
  CRISPR gRNA sequence
agacagtgtggggattcctc

SEQ ID NO: 448446 - DNA, 20 bp, Artificial
  CRISPR gRNA sequence
gacagtgtggggattcctca

SEQ ID NO: 448447 - DNA, 20 bp, Artificial
  CRISPR gRNA sequence
gtggggattcctcaaggatc

SEQ ID NO: 448448 - DNA, 20 bp, Artificial
  CRISPR gRNA sequence
attcctcaaggatctagaac

SEQ ID NO: 448449 - DNA, 20 bp, Artificial
  CRISPR gRNA sequence
actagaaataccatttgacc

SEQ ID NO: 448450 - DNA, 20 bp, Artificial
  CRISPR gRNA sequence
tgacccagcaatctcattac

SEQ ID NO: 448451 - DNA, 20 bp, Artificial
  CRISPR gRNA sequence
gacccagcaatctcattact

SEQ ID NO: 448452 - DNA, 20 bp, Artificial
  CRISPR gRNA sequence
cattactgggcatataccca

SEQ ID NO: 448453 - DNA, 20 bp, Artificial
  CRISPR gRNA sequence
attactgggcatatacccaa

SEQ ID NO: 448454 - DNA, 20 bp, Artificial
  CRISPR gRNA sequence
ttataaatcattctacgata

SEQ ID NO: 448455 - DNA, 20 bp, Artificial
  CRISPR gRNA sequence
attctacgataaagatgcac

SEQ ID NO: 448456 - DNA, 20 bp, Artificial
  CRISPR gRNA sequence
atgcacaagtatgtttattg

SEQ ID NO: 448457 - DNA, 20 bp, Artificial
  CRISPR gRNA sequence
tattgtggtactattcacaa

SEQ ID NO: 448458 - DNA, 20 bp, Artificial
  CRISPR gRNA sequence
tggtactattcacaatagca

SEQ ID NO: 448459 - DNA, 20 bp, Artificial
  CRISPR gRNA sequence
ctattcacaatagcaaagcc

SEQ ID NO: 448460 - DNA, 20 bp, Artificial
  CRISPR gRNA sequence
tattcacaatagcaaagcct

SEQ ID NO: 448461 - DNA, 20 bp, Artificial
  CRISPR gRNA sequence
acccaaatgtccatcaatga

SEQ ID NO: 448462 - DNA, 20 bp, Artificial
  CRISPR gRNA sequence
aatgtccatcaatgatagac

SEQ ID NO: 448463 - DNA, 20 bp, Artificial
  CRISPR gRNA sequence
catcaatgatagactggatt

SEQ ID NO: 448464 - DNA, 20 bp, Artificial
  CRISPR gRNA sequence
tagactggattaagaaaatg

SEQ ID NO: 448465 - DNA, 20 bp, Artificial
  CRISPR gRNA sequence
aatgtggcacatatacacca

SEQ ID NO: 448466 - DNA, 20 bp, Artificial
  CRISPR gRNA sequence
atacaccatggaatactatg

SEQ ID NO: 448467 - DNA, 20 bp, Artificial
  CRISPR gRNA sequence
aatactatgcagccataaaa

SEQ ID NO: 448468 - DNA, 20 bp, Artificial
  CRISPR gRNA sequence
atactatgcagccataaaaa

SEQ ID NO: 448469 - DNA, 20 bp, Artificial
  CRISPR gRNA sequence
atgcagccataaaaaaggat

SEQ ID NO: 448470 - DNA, 20 bp, Artificial
  CRISPR gRNA sequence
ggatgagttcatgtcctttg

SEQ ID NO: 448471 - DNA, 20 bp, Artificial
  CRISPR gRNA sequence
gatgagttcatgtcctttgc

SEQ ID NO: 448472 - DNA, 20 bp, Artificial
  CRISPR gRNA sequence
atgagttcatgtcctttgca

SEQ ID NO: 448473 - DNA, 20 bp, Artificial
  CRISPR gRNA sequence
tcatgtcctttgcagggaca

SEQ ID NO: 448474 - DNA, 20 bp, Artificial
  CRISPR gRNA sequence
cctttgcagggacatagatg

SEQ ID NO: 448475 - DNA, 20 bp, Artificial
  CRISPR gRNA sequence
tgcagggacatagatgaagc

SEQ ID NO: 448476 - DNA, 20 bp, Artificial
  CRISPR gRNA sequence
aagctggaaaccatcattct

SEQ ID NO: 448477 - DNA, 20 bp, Artificial
  CRISPR gRNA sequence
cattctaagcaaactgtcac

SEQ ID NO: 448478 - DNA, 20 bp, Artificial
  CRISPR gRNA sequence
attctaagcaaactgtcaca

SEQ ID NO: 448479 - DNA, 20 bp, Artificial
  CRISPR gRNA sequence
taagcaaactgtcacaagga

SEQ ID NO: 448480 - DNA, 20 bp, Artificial
  CRISPR gRNA sequence
aagcaaactgtcacaaggac

SEQ ID NO: 448481 - DNA, 20 bp, Artificial
  CRISPR gRNA sequence
cactgcatgttctcgctcat

SEQ ID NO: 448482 - DNA, 20 bp, Artificial
  CRISPR gRNA sequence
tgcatgttctcgctcataag

SEQ ID NO: 448483 - DNA, 20 bp, Artificial
  CRISPR gRNA sequence
gcatgttctcgctcataagt

SEQ ID NO: 448484 - DNA, 20 bp, Artificial
  CRISPR gRNA sequence
atgttctcgctcataagtag

SEQ ID NO: 448485 - DNA, 20 bp, Artificial
  CRISPR gRNA sequence
ataagtaggagttgaacaat

SEQ ID NO: 448486 - DNA, 20 bp, Artificial
  CRISPR gRNA sequence
acaatgagaacacatgaacc

SEQ ID NO: 448487 - DNA, 20 bp, Artificial
  CRISPR gRNA sequence
caatgagaacacatgaaccc

SEQ ID NO: 448488 - DNA, 20 bp, Artificial
  CRISPR gRNA sequence
aatgagaacacatgaaccca

SEQ ID NO: 448489 - DNA, 20 bp, Artificial
  CRISPR gRNA sequence
gagaacacatgaacccaggg

SEQ ID NO: 448490 - DNA, 20 bp, Artificial
  CRISPR gRNA sequence
agaacacatgaacccagggt

SEQ ID NO: 448491 - DNA, 20 bp, Artificial
  CRISPR gRNA sequence
gaacacatgaacccagggtg

SEQ ID NO: 448492 - DNA, 20 bp, Artificial
  CRISPR gRNA sequence
cacacaccgatgacgttcca

SEQ ID NO: 448493 - DNA, 20 bp, Artificial
  CRISPR gRNA sequence
acacaccgatgacgttccac

SEQ ID NO: 448494 - DNA, 20 bp, Artificial
  CRISPR gRNA sequence
caccgatgacgttccacggg

SEQ ID NO: 448495 - DNA, 20 bp, Artificial
  CRISPR gRNA sequence
accgatgacgttccacgggt

SEQ ID NO: 448496 - DNA, 20 bp, Artificial
  CRISPR gRNA sequence
ccgatgacgttccacgggtg

SEQ ID NO: 448497 - DNA, 20 bp, Artificial
  CRISPR gRNA sequence
cgatgacgttccacgggtgg

SEQ ID NO: 448498 - DNA, 20 bp, Artificial
  CRISPR gRNA sequence
acgttccacgggtgggggcc

SEQ ID NO: 448499 - DNA, 20 bp, Artificial
  CRISPR gRNA sequence
cgttccacgggtgggggccc

SEQ ID NO: 448500 - DNA, 20 bp, Artificial
  CRISPR gRNA sequence
gttccacgggtgggggcccg

SEQ ID NO: 448501 - DNA, 20 bp, Artificial
  CRISPR gRNA sequence
ttccacgggtgggggcccgg

SEQ ID NO: 448502 - DNA, 20 bp, Artificial
  CRISPR gRNA sequence
ccacgggtgggggcccgggg

SEQ ID NO: 448503 - DNA, 20 bp, Artificial
  CRISPR gRNA sequence
cacgggtgggggcccggggg

SEQ ID NO: 448504 - DNA, 20 bp, Artificial
  CRISPR gRNA sequence
acgggtgggggcccggggga

SEQ ID NO: 448505 - DNA, 20 bp, Artificial
  CRISPR gRNA sequence
gtgggggcccgggggaggga

SEQ ID NO: 448506 - DNA, 20 bp, Artificial
  CRISPR gRNA sequence
gcccgggggagggatagcat

SEQ ID NO: 448507 - DNA, 20 bp, Artificial
  CRISPR gRNA sequence
cccgggggagggatagcatt

SEQ ID NO: 448508 - DNA, 20 bp, Artificial
  CRISPR gRNA sequence
cgggggagggatagcattag

SEQ ID NO: 448509 - DNA, 20 bp, Artificial
  CRISPR gRNA sequence
aaatacctaatgtaaatgac

SEQ ID NO: 448510 - DNA, 20 bp, Artificial
  CRISPR gRNA sequence
taatgtaaatgacaagttga

SEQ ID NO: 448511 - DNA, 20 bp, Artificial
  CRISPR gRNA sequence
aatgtaaatgacaagttgat

SEQ ID NO: 448512 - DNA, 20 bp, Artificial
  CRISPR gRNA sequence
aaatgacaagttgatgggtg

SEQ ID NO: 448513 - DNA, 20 bp, Artificial
  CRISPR gRNA sequence
cacattgtgcacatgtaccc

SEQ ID NO: 448514 - DNA, 20 bp, Artificial
  CRISPR gRNA sequence
cacatgtaccctagaactta

SEQ ID NO: 448515 - DNA, 20 bp, Artificial
  CRISPR gRNA sequence
acttaaagtatattaaaaaa

SEQ ID NO: 448516 - DNA, 20 bp, Artificial
  CRISPR gRNA sequence
atattaaaaaaaagatataa

SEQ ID NO: 448517 - DNA, 20 bp, Artificial
  CRISPR gRNA sequence
tattaaaaaaaagatataat

SEQ ID NO: 448518 - DNA, 20 bp, Artificial
  CRISPR gRNA sequence
aaaaaagatataatgggtaa

SEQ ID NO: 448519 - DNA, 20 bp, Artificial
  CRISPR gRNA sequence
gtaaaagatgacattttcaa

SEQ ID NO: 448520 - DNA, 20 bp, Artificial
  CRISPR gRNA sequence
tgaaaaaatatgaattactc

SEQ ID NO: 448521 - DNA, 20 bp, Artificial
  CRISPR gRNA sequence
aattactcaagaaacaaact

SEQ ID NO: 448522 - DNA, 20 bp, Artificial
  CRISPR gRNA sequence
ctcaagaaacaaacttagct

SEQ ID NO: 448523 - DNA, 20 bp, Artificial
  CRISPR gRNA sequence
aaacaaacttagctaagaaa

SEQ ID NO: 448524 - DNA, 20 bp, Artificial
  CRISPR gRNA sequence
aacttagctaagaaatggac

SEQ ID NO: 448525 - DNA, 20 bp, Artificial
  CRISPR gRNA sequence
acttagctaagaaatggacg

SEQ ID NO: 448526 - DNA, 20 bp, Artificial
  CRISPR gRNA sequence
aaatggacgaggactttatg

SEQ ID NO: 448527 - DNA, 20 bp, Artificial
  CRISPR gRNA sequence
gaaaacttctatacatacct

SEQ ID NO: 448528 - DNA, 20 bp, Artificial
  CRISPR gRNA sequence
aaaaatgaatatcacattct

SEQ ID NO: 448529 - DNA, 20 bp, Artificial
  CRISPR gRNA sequence
atatcacattctcggatcaa

SEQ ID NO: 448530 - DNA, 20 bp, Artificial
  CRISPR gRNA sequence
aatcaatgtcacaacaaatt

SEQ ID NO: 448531 - DNA, 20 bp, Artificial
  CRISPR gRNA sequence
caacaaattcagttctccct

SEQ ID NO: 448532 - DNA, 20 bp, Artificial
  CRISPR gRNA sequence
tcccaattttaaaataccaa

SEQ ID NO: 448533 - DNA, 20 bp, Artificial
  CRISPR gRNA sequence
cccaattttaaaataccaat

SEQ ID NO: 448534 - DNA, 20 bp, Artificial
  CRISPR gRNA sequence
ccaataggactttttcttga

SEQ ID NO: 448535 - DNA, 20 bp, Artificial
  CRISPR gRNA sequence
ctttttcttgatggtacaca

SEQ ID NO: 448536 - DNA, 20 bp, Artificial
  CRISPR gRNA sequence
tttcttgatggtacacacag

SEQ ID NO: 448537 - DNA, 20 bp, Artificial
  CRISPR gRNA sequence
ttcttgatggtacacacagt

SEQ ID NO: 448538 - DNA, 20 bp, Artificial
  CRISPR gRNA sequence
ttgatggtacacacagtagg

SEQ ID NO: 448539 - DNA, 20 bp, Artificial
  CRISPR gRNA sequence
tgatggtacacacagtagga

SEQ ID NO: 448540 - DNA, 20 bp, Artificial
  CRISPR gRNA sequence
gatggtacacacagtaggaa

SEQ ID NO: 448541 - DNA, 20 bp, Artificial
  CRISPR gRNA sequence
gtacacacagtaggaagggc

SEQ ID NO: 448542 - DNA, 20 bp, Artificial
  CRISPR gRNA sequence
cacagtaggaagggcaagac

SEQ ID NO: 448543 - DNA, 20 bp, Artificial
  CRISPR gRNA sequence
taggaagggcaagactagac

SEQ ID NO: 448544 - DNA, 20 bp, Artificial
  CRISPR gRNA sequence
gacaagctgattataaaaat

SEQ ID NO: 448545 - DNA, 20 bp, Artificial
  CRISPR gRNA sequence
aaatcagaaaaataaattta

SEQ ID NO: 448546 - DNA, 20 bp, Artificial
  CRISPR gRNA sequence
gaatgtaattaccacttcaa

SEQ ID NO: 448547 - DNA, 20 bp, Artificial
  CRISPR gRNA sequence
ttttaaaacacatacacaca

SEQ ID NO: 448548 - DNA, 20 bp, Artificial
  CRISPR gRNA sequence
ttaaaacacatacacacata

SEQ ID NO: 448549 - DNA, 20 bp, Artificial
  CRISPR gRNA sequence
aaaacacatacacacataga

SEQ ID NO: 448550 - DNA, 20 bp, Artificial
  CRISPR gRNA sequence
aaacacatacacacatagag

SEQ ID NO: 448551 - DNA, 20 bp, Artificial
  CRISPR gRNA sequence
ctatatcatgaacatccctc

SEQ ID NO: 448552 - DNA, 20 bp, Artificial
  CRISPR gRNA sequence
tatatcatgaacatccctcc

SEQ ID NO: 448553 - DNA, 20 bp, Artificial
  CRISPR gRNA sequence
tccctccaggcccatattta

SEQ ID NO: 448554 - DNA, 20 bp, Artificial
  CRISPR gRNA sequence
ctccaggcccatatttatag

SEQ ID NO: 448555 - DNA, 20 bp, Artificial
  CRISPR gRNA sequence
atatataatattttgtcaca

SEQ ID NO: 448556 - DNA, 20 bp, Artificial
  CRISPR gRNA sequence
tttccctattgatgaaattc

SEQ ID NO: 448557 - DNA, 20 bp, Artificial
  CRISPR gRNA sequence
ttcaagtgtttgtttttctt

SEQ ID NO: 448558 - DNA, 20 bp, Artificial
  CRISPR gRNA sequence
tcagtttgtttattttgaaa

SEQ ID NO: 448559 - DNA, 20 bp, Artificial
  CRISPR gRNA sequence
cagtttgtttattttgaaac

SEQ ID NO: 448560 - DNA, 20 bp, Artificial
  CRISPR gRNA sequence
gtttgtttattttgaaacag

SEQ ID NO: 448561 - DNA, 20 bp, Artificial
  CRISPR gRNA sequence
gaaacaggagtaatttttct

SEQ ID NO: 448562 - DNA, 20 bp, Artificial
  CRISPR gRNA sequence
caggagtaatttttcttagc

SEQ ID NO: 448563 - DNA, 20 bp, Artificial
  CRISPR gRNA sequence
aggagtaatttttcttagcc

SEQ ID NO: 448564 - DNA, 20 bp, Artificial
  CRISPR gRNA sequence
taatttttcttagccaggat

SEQ ID NO: 448565 - DNA, 20 bp, Artificial
  CRISPR gRNA sequence
tttttcttagccaggattag

SEQ ID NO: 448566 - DNA, 20 bp, Artificial
  CRISPR gRNA sequence
ttagaagatgtaactataaa

SEQ ID NO: 448567 - DNA, 20 bp, Artificial
  CRISPR gRNA sequence
taaaacaataaaaatattga

SEQ ID NO: 448568 - DNA, 20 bp, Artificial
  CRISPR gRNA sequence
aaaatattgaaagaaaatta

SEQ ID NO: 448569 - DNA, 20 bp, Artificial
  CRISPR gRNA sequence
aagaaaattatagcctcaat

SEQ ID NO: 448570 - DNA, 20 bp, Artificial
  CRISPR gRNA sequence
gaaaattatagcctcaattg

SEQ ID NO: 448571 - DNA, 20 bp, Artificial
  CRISPR gRNA sequence
aaaattatagcctcaattgg

SEQ ID NO: 448572 - DNA, 20 bp, Artificial
  CRISPR gRNA sequence
aaattatagcctcaattgga

SEQ ID NO: 448573 - DNA, 20 bp, Artificial
  CRISPR gRNA sequence
ggaaactttcctaaacaatg

SEQ ID NO: 448574 - DNA, 20 bp, Artificial
  CRISPR gRNA sequence
gaaactttcctaaacaatgc

SEQ ID NO: 448575 - DNA, 20 bp, Artificial
  CRISPR gRNA sequence
cctaaacaatgcaggaaacc

SEQ ID NO: 448576 - DNA, 20 bp, Artificial
  CRISPR gRNA sequence
caggaaacccagacaactta

SEQ ID NO: 448577 - DNA, 20 bp, Artificial
  CRISPR gRNA sequence
aggaaacccagacaacttaa

SEQ ID NO: 448578 - DNA, 20 bp, Artificial
  CRISPR gRNA sequence
acccagacaacttaaaggaa

SEQ ID NO: 448579 - DNA, 20 bp, Artificial
  CRISPR gRNA sequence
agacaacttaaaggaaaaga

SEQ ID NO: 448580 - DNA, 20 bp, Artificial
  CRISPR gRNA sequence
aaactttccttgtgaaaaaa

SEQ ID NO: 448581 - DNA, 20 bp, Artificial
  CRISPR gRNA sequence
aaaaaaaagcctcataaaaa

SEQ ID NO: 448582 - DNA, 20 bp, Artificial
  CRISPR gRNA sequence
aaagcctcataaaaaaagtg

SEQ ID NO: 448583 - DNA, 20 bp, Artificial
  CRISPR gRNA sequence
agcctcataaaaaaagtgaa

SEQ ID NO: 448584 - DNA, 20 bp, Artificial
  CRISPR gRNA sequence
tgaagagacaaacaacaaat

SEQ ID NO: 448585 - DNA, 20 bp, Artificial
  CRISPR gRNA sequence
gaagagacaaacaacaaatt

SEQ ID NO: 448586 - DNA, 20 bp, Artificial
  CRISPR gRNA sequence
agagacaaacaacaaattgg

SEQ ID NO: 448587 - DNA, 20 bp, Artificial
  CRISPR gRNA sequence
acaaacaacaaattgggaga

SEQ ID NO: 448588 - DNA, 20 bp, Artificial
  CRISPR gRNA sequence
aaagtatttgcctaaaaaaa

SEQ ID NO: 448589 - DNA, 20 bp, Artificial
  CRISPR gRNA sequence
gtatttgcctaaaaaaatgg

SEQ ID NO: 448590 - DNA, 20 bp, Artificial
  CRISPR gRNA sequence
ttgcctaaaaaaatggcaga

SEQ ID NO: 448591 - DNA, 20 bp, Artificial
  CRISPR gRNA sequence
tgcctaaaaaaatggcagat

SEQ ID NO: 448592 - DNA, 20 bp, Artificial
  CRISPR gRNA sequence
atgggttaatatctctaata

SEQ ID NO: 448593 - DNA, 20 bp, Artificial
  CRISPR gRNA sequence
gggttaatatctctaatacg

SEQ ID NO: 448594 - DNA, 20 bp, Artificial
  CRISPR gRNA sequence
taatatctctaatacggaga

SEQ ID NO: 448595 - DNA, 20 bp, Artificial
  CRISPR gRNA sequence
aatacggagaaagtgcctaa

SEQ ID NO: 448596 - DNA, 20 bp, Artificial
  CRISPR gRNA sequence
ggagaaagtgcctaaaagtt

SEQ ID NO: 448597 - DNA, 20 bp, Artificial
  CRISPR gRNA sequence
cctaaaagttaagaaatgtg

SEQ ID NO: 448598 - DNA, 20 bp, Artificial
  CRISPR gRNA sequence
gaatatgaacacacaattca

SEQ ID NO: 448599 - DNA, 20 bp, Artificial
  CRISPR gRNA sequence
tgaacacacaattcacagac

SEQ ID NO: 448600 - DNA, 20 bp, Artificial
  CRISPR gRNA sequence
gaacacacaattcacagaca

SEQ ID NO: 448601 - DNA, 20 bp, Artificial
  CRISPR gRNA sequence
aacacacaattcacagacaa

SEQ ID NO: 448602 - DNA, 20 bp, Artificial
  CRISPR gRNA sequence
agggaatactaatgaccaat

SEQ ID NO: 448603 - DNA, 20 bp, Artificial
  CRISPR gRNA sequence
atgaccaataagcatatgaa

SEQ ID NO: 448604 - DNA, 20 bp, Artificial
  CRISPR gRNA sequence
atcctcaacttcactaatca

SEQ ID NO: 448605 - DNA, 20 bp, Artificial
  CRISPR gRNA sequence
aatcatggaaatgcaacata

SEQ ID NO: 448606 - DNA, 20 bp, Artificial
  CRISPR gRNA sequence
catggaaatgcaacataaag

SEQ ID NO: 448607 - DNA, 20 bp, Artificial
  CRISPR gRNA sequence
atggaaatgcaacataaagc

SEQ ID NO: 448608 - DNA, 20 bp, Artificial
  CRISPR gRNA sequence
aggtctaatttttcatccat

SEQ ID NO: 448609 - DNA, 20 bp, Artificial
  CRISPR gRNA sequence
taatttttcatccatcagat

SEQ ID NO: 448610 - DNA, 20 bp, Artificial
  CRISPR gRNA sequence
tcagattggcaaaaatgtta

SEQ ID NO: 448611 - DNA, 20 bp, Artificial
  CRISPR gRNA sequence
ttggcaaaaatgttaaagta

SEQ ID NO: 448612 - DNA, 20 bp, Artificial
  CRISPR gRNA sequence
gttaaagtacagataatacc

SEQ ID NO: 448613 - DNA, 20 bp, Artificial
  CRISPR gRNA sequence
taaagtacagataataccca

SEQ ID NO: 448614 - DNA, 20 bp, Artificial
  CRISPR gRNA sequence
gtacagataatacccagagc

SEQ ID NO: 448615 - DNA, 20 bp, Artificial
  CRISPR gRNA sequence
agataatacccagagctagc

SEQ ID NO: 448616 - DNA, 20 bp, Artificial
  CRISPR gRNA sequence
gataatacccagagctagca

SEQ ID NO: 448617 - DNA, 20 bp, Artificial
  CRISPR gRNA sequence
ataatacccagagctagcaa

SEQ ID NO: 448618 - DNA, 20 bp, Artificial
  CRISPR gRNA sequence
cccagagctagcaagggcac

SEQ ID NO: 448619 - DNA, 20 bp, Artificial
  CRISPR gRNA sequence
ccagagctagcaagggcacg

SEQ ID NO: 448620 - DNA, 20 bp, Artificial
  CRISPR gRNA sequence
acgaggaaatgtacactatc

SEQ ID NO: 448621 - DNA, 20 bp, Artificial
  CRISPR gRNA sequence
tgtacactatcaagcattct

SEQ ID NO: 448622 - DNA, 20 bp, Artificial
  CRISPR gRNA sequence
ggtgaacatctgattatcaa

SEQ ID NO: 448623 - DNA, 20 bp, Artificial
  CRISPR gRNA sequence
ctgattatcaacagcctttt

SEQ ID NO: 448624 - DNA, 20 bp, Artificial
  CRISPR gRNA sequence
gattatcaacagcctttttg

SEQ ID NO: 448625 - DNA, 20 bp, Artificial
  CRISPR gRNA sequence
ttatcaacagcctttttgga

SEQ ID NO: 448626 - DNA, 20 bp, Artificial
  CRISPR gRNA sequence
tttggagagcaatctgatta

SEQ ID NO: 448627 - DNA, 20 bp, Artificial
  CRISPR gRNA sequence
ggagagcaatctgattatag

SEQ ID NO: 448628 - DNA, 20 bp, Artificial
  CRISPR gRNA sequence
atctgattatagtagaaaaa

SEQ ID NO: 448629 - DNA, 20 bp, Artificial
  CRISPR gRNA sequence
aatcatcatattctttgacg

SEQ ID NO: 448630 - DNA, 20 bp, Artificial
  CRISPR gRNA sequence
taacttaaaaaaatatatat

SEQ ID NO: 448631 - DNA, 20 bp, Artificial
  CRISPR gRNA sequence
aaaaaatatatatgagaaaa

SEQ ID NO: 448632 - DNA, 20 bp, Artificial
  CRISPR gRNA sequence
atatatgagaaaatagcctt

SEQ ID NO: 448633 - DNA, 20 bp, Artificial
  CRISPR gRNA sequence
tccctatgcccctccctccc

SEQ ID NO: 448634 - DNA, 20 bp, Artificial
  CRISPR gRNA sequence
gcccctccctccccggctcc

SEQ ID NO: 448635 - DNA, 20 bp, Artificial
  CRISPR gRNA sequence
ggctcccagtgtatctcact

SEQ ID NO: 448636 - DNA, 20 bp, Artificial
  CRISPR gRNA sequence
tggtttaccgcctcacttcc

SEQ ID NO: 448637 - DNA, 20 bp, Artificial
  CRISPR gRNA sequence
ttaccgcctcacttcccagc

SEQ ID NO: 448638 - DNA, 20 bp, Artificial
  CRISPR gRNA sequence
cgcctcacttcccagccagc

SEQ ID NO: 448639 - DNA, 20 bp, Artificial
  CRISPR gRNA sequence
ccagctggactctcatgccc

SEQ ID NO: 448640 - DNA, 20 bp, Artificial
  CRISPR gRNA sequence
cctctacctccatcatactc

SEQ ID NO: 448641 - DNA, 20 bp, Artificial
  CRISPR gRNA sequence
catcatactctagccaatca

SEQ ID NO: 448642 - DNA, 20 bp, Artificial
  CRISPR gRNA sequence
atactctagccaatcaaagc

SEQ ID NO: 448643 - DNA, 20 bp, Artificial
  CRISPR gRNA sequence
actctagccaatcaaagcta

SEQ ID NO: 448644 - DNA, 20 bp, Artificial
  CRISPR gRNA sequence
agccaatcaaagctagagcc

SEQ ID NO: 448645 - DNA, 20 bp, Artificial
  CRISPR gRNA sequence
gccaatcaaagctagagcct

SEQ ID NO: 448646 - DNA, 20 bp, Artificial
  CRISPR gRNA sequence
atcaaagctagagcctggga

SEQ ID NO: 448647 - DNA, 20 bp, Artificial
  CRISPR gRNA sequence
tcaaagctagagcctgggat

SEQ ID NO: 448648 - DNA, 20 bp, Artificial
  CRISPR gRNA sequence
caaagctagagcctgggatg

SEQ ID NO: 448649 - DNA, 20 bp, Artificial
  CRISPR gRNA sequence
tagagcctgggatggggaaa

SEQ ID NO: 448650 - DNA, 20 bp, Artificial
  CRISPR gRNA sequence
ctgggatggggaaatggtct

SEQ ID NO: 448651 - DNA, 20 bp, Artificial
  CRISPR gRNA sequence
gggaaatggtcttggaaccc

SEQ ID NO: 448652 - DNA, 20 bp, Artificial
  CRISPR gRNA sequence
aaatggtcttggaaccctgg

SEQ ID NO: 448653 - DNA, 20 bp, Artificial
  CRISPR gRNA sequence
aatggtcttggaaccctgga

SEQ ID NO: 448654 - DNA, 20 bp, Artificial
  CRISPR gRNA sequence
gaaccctggaaggctttgtc

SEQ ID NO: 448655 - DNA, 20 bp, Artificial
  CRISPR gRNA sequence
ccctggaaggctttgtctag

SEQ ID NO: 448656 - DNA, 20 bp, Artificial
  CRISPR gRNA sequence
cctggaaggctttgtctagt

SEQ ID NO: 448657 - DNA, 20 bp, Artificial
  CRISPR gRNA sequence
agtgggtccccctgtgcttt

SEQ ID NO: 448658 - DNA, 20 bp, Artificial
  CRISPR gRNA sequence
gtgggtccccctgtgctttt

SEQ ID NO: 448659 - DNA, 20 bp, Artificial
  CRISPR gRNA sequence
gggtccccctgtgcttttag

SEQ ID NO: 448660 - DNA, 20 bp, Artificial
  CRISPR gRNA sequence
cctgtgcttttaggagactg

SEQ ID NO: 448661 - DNA, 20 bp, Artificial
  CRISPR gRNA sequence
gcttttaggagactgaagcc

SEQ ID NO: 448662 - DNA, 20 bp, Artificial
  CRISPR gRNA sequence
cttttaggagactgaagcca

SEQ ID NO: 448663 - DNA, 20 bp, Artificial
  CRISPR gRNA sequence
gagactgaagccaaggatac

SEQ ID NO: 448664 - DNA, 20 bp, Artificial
  CRISPR gRNA sequence
actgaagccaaggataccag

SEQ ID NO: 448665 - DNA, 20 bp, Artificial
  CRISPR gRNA sequence
tgaagccaaggataccagca

SEQ ID NO: 448666 - DNA, 20 bp, Artificial
  CRISPR gRNA sequence
gcagagccaacatttgcttc

SEQ ID NO: 448667 - DNA, 20 bp, Artificial
  CRISPR gRNA sequence
caacatttgcttcaagttcc

SEQ ID NO: 448668 - DNA, 20 bp, Artificial
  CRISPR gRNA sequence
aacatttgcttcaagttcct

SEQ ID NO: 448669 - DNA, 20 bp, Artificial
  CRISPR gRNA sequence
caagttcctgggcctgctga

SEQ ID NO: 448670 - DNA, 20 bp, Artificial
  CRISPR gRNA sequence
ctgggcctgctgacagcgtg

SEQ ID NO: 448671 - DNA, 20 bp, Artificial
  CRISPR gRNA sequence
tgggcctgctgacagcgtgc

SEQ ID NO: 448672 - DNA, 20 bp, Artificial
  CRISPR gRNA sequence
gacagcgtgcaggatgctgt

SEQ ID NO: 448673 - DNA, 20 bp, Artificial
  CRISPR gRNA sequence
tgcaggatgctgttggaacc

SEQ ID NO: 448674 - DNA, 20 bp, Artificial
  CRISPR gRNA sequence
aggatgctgttggaacccgg

SEQ ID NO: 448675 - DNA, 20 bp, Artificial
  CRISPR gRNA sequence
gatgctgttggaacccggca

SEQ ID NO: 448676 - DNA, 20 bp, Artificial
  CRISPR gRNA sequence
atgctgttggaacccggcag

SEQ ID NO: 448677 - DNA, 20 bp, Artificial
  CRISPR gRNA sequence
cggcagaggctgctgtgccc

SEQ ID NO: 448678 - DNA, 20 bp, Artificial
  CRISPR gRNA sequence
ctgtgccctggccatcctgc

SEQ ID NO: 448679 - DNA, 20 bp, Artificial
  CRISPR gRNA sequence
ggccatcctgctggcaattg

SEQ ID NO: 448680 - DNA, 20 bp, Artificial
  CRISPR gRNA sequence
tgctggcaattgtggacatc

SEQ ID NO: 448681 - DNA, 20 bp, Artificial
  CRISPR gRNA sequence
gcaattgtggacatccagtc

SEQ ID NO: 448682 - DNA, 20 bp, Artificial
  CRISPR gRNA sequence
attgtggacatccagtctgg

SEQ ID NO: 448683 - DNA, 20 bp, Artificial
  CRISPR gRNA sequence
tggacatccagtctggtggt

SEQ ID NO: 448684 - DNA, 20 bp, Artificial
  CRISPR gRNA sequence
ggacatccagtctggtggtg

SEQ ID NO: 448685 - DNA, 20 bp, Artificial
  CRISPR gRNA sequence
atccagtctggtggtgagga

SEQ ID NO: 448686 - DNA, 20 bp, Artificial
  CRISPR gRNA sequence
ctggtggtgaggatagaccc

SEQ ID NO: 448687 - DNA, 20 bp, Artificial
  CRISPR gRNA sequence
ggtggtgaggatagacccta

SEQ ID NO: 448688 - DNA, 20 bp, Artificial
  CRISPR gRNA sequence
ggtgaggatagaccctagag

SEQ ID NO: 448689 - DNA, 20 bp, Artificial
  CRISPR gRNA sequence
tgaggatagaccctagagca

SEQ ID NO: 448690 - DNA, 20 bp, Artificial
  CRISPR gRNA sequence
gatagaccctagagcagaga

SEQ ID NO: 448691 - DNA, 20 bp, Artificial
  CRISPR gRNA sequence
ccctagagcagagacggcca

SEQ ID NO: 448692 - DNA, 20 bp, Artificial
  CRISPR gRNA sequence
cctagagcagagacggccat

SEQ ID NO: 448693 - DNA, 20 bp, Artificial
  CRISPR gRNA sequence
ctagagcagagacggccatg

SEQ ID NO: 448694 - DNA, 20 bp, Artificial
  CRISPR gRNA sequence
agagcagagacggccatggg

SEQ ID NO: 448695 - DNA, 20 bp, Artificial
  CRISPR gRNA sequence
gagcagagacggccatgggg

SEQ ID NO: 448696 - DNA, 20 bp, Artificial
  CRISPR gRNA sequence
gacggccatggggaggatcc

SEQ ID NO: 448697 - DNA, 20 bp, Artificial
  CRISPR gRNA sequence
acggccatggggaggatcct

SEQ ID NO: 448698 - DNA, 20 bp, Artificial
  CRISPR gRNA sequence
tggggaggatcctgggcttg

SEQ ID NO: 448699 - DNA, 20 bp, Artificial
  CRISPR gRNA sequence
ggggaggatcctgggcttgt

SEQ ID NO: 448700 - DNA, 20 bp, Artificial
  CRISPR gRNA sequence
gaggatcctgggcttgtggg

SEQ ID NO: 448701 - DNA, 20 bp, Artificial
  CRISPR gRNA sequence
aggatcctgggcttgtggga

SEQ ID NO: 448702 - DNA, 20 bp, Artificial
  CRISPR gRNA sequence
ggatcctgggcttgtgggaa

SEQ ID NO: 448703 - DNA, 20 bp, Artificial
  CRISPR gRNA sequence
cctgggcttgtgggaagggc

SEQ ID NO: 448704 - DNA, 20 bp, Artificial
  CRISPR gRNA sequence
ctggatcccgtgattttctc

SEQ ID NO: 448705 - DNA, 20 bp, Artificial
  CRISPR gRNA sequence
gatcccgtgattttctctag

SEQ ID NO: 448706 - DNA, 20 bp, Artificial
  CRISPR gRNA sequence
atcccgtgattttctctagt

SEQ ID NO: 448707 - DNA, 20 bp, Artificial
  CRISPR gRNA sequence
tcccgtgattttctctagtg

SEQ ID NO: 448708 - DNA, 20 bp, Artificial
  CRISPR gRNA sequence
ttttctctagtggggaaaca

SEQ ID NO: 448709 - DNA, 20 bp, Artificial
  CRISPR gRNA sequence
tttctctagtggggaaacaa

SEQ ID NO: 448710 - DNA, 20 bp, Artificial
  CRISPR gRNA sequence
tttttttttttttttttttt

SEQ ID NO: 448711 - DNA, 20 bp, Artificial
  CRISPR gRNA sequence
tttttttttttttttttttg

SEQ ID NO: 448712 - DNA, 20 bp, Artificial
  CRISPR gRNA sequence
ttttttttttttttttttga

SEQ ID NO: 448713 - DNA, 20 bp, Artificial
  CRISPR gRNA sequence
ttttttttttttttttgagg

SEQ ID NO: 448714 - DNA, 20 bp, Artificial
  CRISPR gRNA sequence
gggagtctcgctctgtcacc

SEQ ID NO: 448715 - DNA, 20 bp, Artificial
  CRISPR gRNA sequence
ggagtctcgctctgtcaccc

SEQ ID NO: 448716 - DNA, 20 bp, Artificial
  CRISPR gRNA sequence
tctcgctctgtcacccaggc

SEQ ID NO: 448717 - DNA, 20 bp, Artificial
  CRISPR gRNA sequence
tcgctctgtcacccaggctg

SEQ ID NO: 448718 - DNA, 20 bp, Artificial
  CRISPR gRNA sequence
ctgtcacccaggctggagtg

SEQ ID NO: 448719 - DNA, 20 bp, Artificial
  CRISPR gRNA sequence
tcacccaggctggagtgcag

SEQ ID NO: 448720 - DNA, 20 bp, Artificial
  CRISPR gRNA sequence
ggagtgcagtggcgcgatct

SEQ ID NO: 448721 - DNA, 20 bp, Artificial
  CRISPR gRNA sequence
aacctccgcctcccatgttc

SEQ ID NO: 448722 - DNA, 20 bp, Artificial
  CRISPR gRNA sequence
ccatgttcaagcaattctgc

SEQ ID NO: 448723 - DNA, 20 bp, Artificial
  CRISPR gRNA sequence
ttcaagcaattctgctggct

SEQ ID NO: 448724 - DNA, 20 bp, Artificial
  CRISPR gRNA sequence
ttctgctggctcagcttccc

SEQ ID NO: 448725 - DNA, 20 bp, Artificial
  CRISPR gRNA sequence
tgctggctcagcttcccgag

SEQ ID NO: 448726 - DNA, 20 bp, Artificial
  CRISPR gRNA sequence
ggctcagcttcccgagtagc

SEQ ID NO: 448727 - DNA, 20 bp, Artificial
  CRISPR gRNA sequence
gctcagcttcccgagtagct

SEQ ID NO: 448728 - DNA, 20 bp, Artificial
  CRISPR gRNA sequence
ttcccgagtagctgggacta

SEQ ID NO: 448729 - DNA, 20 bp, Artificial
  CRISPR gRNA sequence
tcccgagtagctgggactac

SEQ ID NO: 448730 - DNA, 20 bp, Artificial
  CRISPR gRNA sequence
caggcttatgccgccaccgc

SEQ ID NO: 448731 - DNA, 20 bp, Artificial
  CRISPR gRNA sequence
ccggctaatttttgtatttt

SEQ ID NO: 448732 - DNA, 20 bp, Artificial
  CRISPR gRNA sequence
gctaatttttgtatttttag

SEQ ID NO: 448733 - DNA, 20 bp, Artificial
  CRISPR gRNA sequence
taatttttgtatttttagta

SEQ ID NO: 448734 - DNA, 20 bp, Artificial
  CRISPR gRNA sequence
ttttgtatttttagtagaga

SEQ ID NO: 448735 - DNA, 20 bp, Artificial
  CRISPR gRNA sequence
tttgtatttttagtagagac

SEQ ID NO: 448736 - DNA, 20 bp, Artificial
  CRISPR gRNA sequence
ttgtatttttagtagagacg

SEQ ID NO: 448737 - DNA, 20 bp, Artificial
  CRISPR gRNA sequence
gagacggggtttcaccatat

SEQ ID NO: 448738 - DNA, 20 bp, Artificial
  CRISPR gRNA sequence
cggggtttcaccatattggt

SEQ ID NO: 448739 - DNA, 20 bp, Artificial
  CRISPR gRNA sequence
ggggtttcaccatattggtc

SEQ ID NO: 448740 - DNA, 20 bp, Artificial
  CRISPR gRNA sequence
tttcaccatattggtcaggc

SEQ ID NO: 448741 - DNA, 20 bp, Artificial
  CRISPR gRNA sequence
cctcgaactctgcctgacct

SEQ ID NO: 448742 - DNA, 20 bp, Artificial
  CRISPR gRNA sequence
ctcgaactctgcctgacctc

SEQ ID NO: 448743 - DNA, 20 bp, Artificial
  CRISPR gRNA sequence
gcctgacctcaggtgatcct

SEQ ID NO: 448744 - DNA, 20 bp, Artificial
  CRISPR gRNA sequence
cctgacctcaggtgatcctc

SEQ ID NO: 448745 - DNA, 20 bp, Artificial
  CRISPR gRNA sequence
tcaggtgatcctcaggcgcc

SEQ ID NO: 448746 - DNA, 20 bp, Artificial
  CRISPR gRNA sequence
gactcactctccttgacatt

SEQ ID NO: 448747 - DNA, 20 bp, Artificial
  CRISPR gRNA sequence
actcactctccttgacatta

SEQ ID NO: 448748 - DNA, 20 bp, Artificial
  CRISPR gRNA sequence
actctccttgacattaagga

SEQ ID NO: 448749 - DNA, 20 bp, Artificial
  CRISPR gRNA sequence
ctctccttgacattaaggaa

SEQ ID NO: 448750 - DNA, 20 bp, Artificial
  CRISPR gRNA sequence
tctccttgacattaaggaaa

SEQ ID NO: 448751 - DNA, 20 bp, Artificial
  CRISPR gRNA sequence
ttgacattaaggaaagggta

SEQ ID NO: 448752 - DNA, 20 bp, Artificial
  CRISPR gRNA sequence
attgtctttttctttttcat

SEQ ID NO: 448753 - DNA, 20 bp, Artificial
  CRISPR gRNA sequence
tgatactattgcctctctat

SEQ ID NO: 448754 - DNA, 20 bp, Artificial
  CRISPR gRNA sequence
tgtctctgctatatgtttca

SEQ ID NO: 448755 - DNA, 20 bp, Artificial
  CRISPR gRNA sequence
tctctgctatatgtttcaaa

SEQ ID NO: 448756 - DNA, 20 bp, Artificial
  CRISPR gRNA sequence
gctatatgtttcaaagagcc

SEQ ID NO: 448757 - DNA, 20 bp, Artificial
  CRISPR gRNA sequence
ggcaatctgcgcctcaacct

SEQ ID NO: 448758 - DNA, 20 bp, Artificial
  CRISPR gRNA sequence
gcctcaacctaagattcctt

SEQ ID NO: 448759 - DNA, 20 bp, Artificial
  CRISPR gRNA sequence
cctcaacctaagattccttt

SEQ ID NO: 448760 - DNA, 20 bp, Artificial
  CRISPR gRNA sequence
tactataaatttatgaaatc

SEQ ID NO: 448761 - DNA, 20 bp, Artificial
  CRISPR gRNA sequence
actataaatttatgaaatcc

SEQ ID NO: 448762 - DNA, 20 bp, Artificial
  CRISPR gRNA sequence
aatttatgaaatccaggttt

SEQ ID NO: 448763 - DNA, 20 bp, Artificial
  CRISPR gRNA sequence
tgaaatccaggtttgagatc

SEQ ID NO: 448764 - DNA, 20 bp, Artificial
  CRISPR gRNA sequence
actgcaatcttcattaactt

SEQ ID NO: 448765 - DNA, 20 bp, Artificial
  CRISPR gRNA sequence
gcaatcttcattaacttcag

SEQ ID NO: 448766 - DNA, 20 bp, Artificial
  CRISPR gRNA sequence
tcttcattaacttcagcagc

SEQ ID NO: 448767 - DNA, 20 bp, Artificial
  CRISPR gRNA sequence
caatttgtgtatttataaaa

SEQ ID NO: 448768 - DNA, 20 bp, Artificial
  CRISPR gRNA sequence
aatttgtgtatttataaaat

SEQ ID NO: 448769 - DNA, 20 bp, Artificial
  CRISPR gRNA sequence
ttgtgtatttataaaatggg

SEQ ID NO: 448770 - DNA, 20 bp, Artificial
  CRISPR gRNA sequence
gtgtatttataaaatgggaa

SEQ ID NO: 448771 - DNA, 20 bp, Artificial
  CRISPR gRNA sequence
agagtaatacctgccctcta

SEQ ID NO: 448772 - DNA, 20 bp, Artificial
  CRISPR gRNA sequence
ctgccctctatggctatact

SEQ ID NO: 448773 - DNA, 20 bp, Artificial
  CRISPR gRNA sequence
tgccctctatggctatactg

SEQ ID NO: 448774 - DNA, 20 bp, Artificial
  CRISPR gRNA sequence
tatactgaggatttgatata

SEQ ID NO: 448775 - DNA, 20 bp, Artificial
  CRISPR gRNA sequence
tgaggatttgatatacagaa

SEQ ID NO: 448776 - DNA, 20 bp, Artificial
  CRISPR gRNA sequence
tatacagaaaagcactctaa

SEQ ID NO: 448777 - DNA, 20 bp, Artificial
  CRISPR gRNA sequence
tacagaaaagcactctaaca

SEQ ID NO: 448778 - DNA, 20 bp, Artificial
  CRISPR gRNA sequence
gcactctaacagagacccta

SEQ ID NO: 448779 - DNA, 20 bp, Artificial
  CRISPR gRNA sequence
ctctaacagagaccctatag

SEQ ID NO: 448780 - DNA, 20 bp, Artificial
  CRISPR gRNA sequence
cagagaccctatagaagttc

SEQ ID NO: 448781 - DNA, 20 bp, Artificial
  CRISPR gRNA sequence
gaccctatagaagttccagc

SEQ ID NO: 448782 - DNA, 20 bp, Artificial
  CRISPR gRNA sequence
ctatagaagttccagctgga

SEQ ID NO: 448783 - DNA, 20 bp, Artificial
  CRISPR gRNA sequence
tagaagttccagctggaaag

SEQ ID NO: 448784 - DNA, 20 bp, Artificial
  CRISPR gRNA sequence
aaataaaatataaaccattt

SEQ ID NO: 448785 - DNA, 20 bp, Artificial
  CRISPR gRNA sequence
ataaaatataaaccattttg

SEQ ID NO: 448786 - DNA, 20 bp, Artificial
  CRISPR gRNA sequence
accattttggagtgaatcaa

SEQ ID NO: 448787 - DNA, 20 bp, Artificial
  CRISPR gRNA sequence
ttttggagtgaatcaatggc

SEQ ID NO: 448788 - DNA, 20 bp, Artificial
  CRISPR gRNA sequence
tttggagtgaatcaatggct

SEQ ID NO: 448789 - DNA, 20 bp, Artificial
  CRISPR gRNA sequence
tgaatcaatggctgggattg

SEQ ID NO: 448790 - DNA, 20 bp, Artificial
  CRISPR gRNA sequence
gaatcaatggctgggattgc

SEQ ID NO: 448791 - DNA, 20 bp, Artificial
  CRISPR gRNA sequence
ctgggattgcaggtctccct

SEQ ID NO: 448792 - DNA, 20 bp, Artificial
  CRISPR gRNA sequence
ttgcaggtctccctcagata

SEQ ID NO: 448793 - DNA, 20 bp, Artificial
  CRISPR gRNA sequence
tgcaggtctccctcagatat

SEQ ID NO: 448794 - DNA, 20 bp, Artificial
  CRISPR gRNA sequence
tctccctcagatatgggtct

SEQ ID NO: 448795 - DNA, 20 bp, Artificial
  CRISPR gRNA sequence
ccctcagatatgggtcttgg

SEQ ID NO: 448796 - DNA, 20 bp, Artificial
  CRISPR gRNA sequence
acccatatctcttactcttg

SEQ ID NO: 448797 - DNA, 20 bp, Artificial
  CRISPR gRNA sequence
cccatatctcttactcttgt

SEQ ID NO: 448798 - DNA, 20 bp, Artificial
  CRISPR gRNA sequence
catatctcttactcttgtag

SEQ ID NO: 448799 - DNA, 20 bp, Artificial
  CRISPR gRNA sequence
ctcttactcttgtaggagaa

SEQ ID NO: 448800 - DNA, 20 bp, Artificial
  CRISPR gRNA sequence
ggagaatggcattcaatatg

SEQ ID NO: 448801 - DNA, 20 bp, Artificial
  CRISPR gRNA sequence
gagaatggcattcaatatgc

SEQ ID NO: 448802 - DNA, 20 bp, Artificial
  CRISPR gRNA sequence
agaatggcattcaatatgca

SEQ ID NO: 448803 - DNA, 20 bp, Artificial
  CRISPR gRNA sequence
gaatggcattcaatatgcag

SEQ ID NO: 448804 - DNA, 20 bp, Artificial
  CRISPR gRNA sequence
aatggcattcaatatgcagg

SEQ ID NO: 448805 - DNA, 20 bp, Artificial
  CRISPR gRNA sequence
ggcattcaatatgcaggggg

SEQ ID NO: 448806 - DNA, 20 bp, Artificial
  CRISPR gRNA sequence
tgcctcttcaccgttttcat

SEQ ID NO: 448807 - DNA, 20 bp, Artificial
  CRISPR gRNA sequence
cctcttcaccgttttcatga

SEQ ID NO: 448808 - DNA, 20 bp, Artificial
  CRISPR gRNA sequence
cgttttcatgagagtgaatt

SEQ ID NO: 448809 - DNA, 20 bp, Artificial
  CRISPR gRNA sequence
tttagtttactatgtatacc

SEQ ID NO: 448810 - DNA, 20 bp, Artificial
  CRISPR gRNA sequence
ttagtttactatgtatacca

SEQ ID NO: 448811 - DNA, 20 bp, Artificial
  CRISPR gRNA sequence
tagtttactatgtataccaa

SEQ ID NO: 448812 - DNA, 20 bp, Artificial
  CRISPR gRNA sequence
agtttactatgtataccaag

SEQ ID NO: 448813 - DNA, 20 bp, Artificial
  CRISPR gRNA sequence
tttactatgtataccaaggg

SEQ ID NO: 448814 - DNA, 20 bp, Artificial
  CRISPR gRNA sequence
tataccaaggggagtcttaa

SEQ ID NO: 448815 - DNA, 20 bp, Artificial
  CRISPR gRNA sequence
ataccaaggggagtcttaaa

SEQ ID NO: 448816 - DNA, 20 bp, Artificial
  CRISPR gRNA sequence
aaggggagtcttaaaaggaa

SEQ ID NO: 448817 - DNA, 20 bp, Artificial
  CRISPR gRNA sequence
ggagtcttaaaaggaaaagc

SEQ ID NO: 448818 - DNA, 20 bp, Artificial
  CRISPR gRNA sequence
ttaaaaggaaaagcaagtca

SEQ ID NO: 448819 - DNA, 20 bp, Artificial
  CRISPR gRNA sequence
aaaggaaaagcaagtcatag

SEQ ID NO: 448820 - DNA, 20 bp, Artificial
  CRISPR gRNA sequence
aaagcaagtcatagcggatc

SEQ ID NO: 448821 - DNA, 20 bp, Artificial
  CRISPR gRNA sequence
tcatagcggatcaagctgcc

SEQ ID NO: 448822 - DNA, 20 bp, Artificial
  CRISPR gRNA sequence
catagcggatcaagctgcca

SEQ ID NO: 448823 - DNA, 20 bp, Artificial
  CRISPR gRNA sequence
atagcggatcaagctgccaa

SEQ ID NO: 448824 - DNA, 20 bp, Artificial
  CRISPR gRNA sequence
agcggatcaagctgccaagg

SEQ ID NO: 448825 - DNA, 20 bp, Artificial
  CRISPR gRNA sequence
ggatcaagctgccaagggag

SEQ ID NO: 448826 - DNA, 20 bp, Artificial
  CRISPR gRNA sequence
gatcaagctgccaagggagt

SEQ ID NO: 448827 - DNA, 20 bp, Artificial
  CRISPR gRNA sequence
atcaagctgccaagggagtg

SEQ ID NO: 448828 - DNA, 20 bp, Artificial
  CRISPR gRNA sequence
tcaagctgccaagggagtgg

SEQ ID NO: 448829 - DNA, 20 bp, Artificial
  CRISPR gRNA sequence
aagctgccaagggagtgggg

SEQ ID NO: 448830 - DNA, 20 bp, Artificial
  CRISPR gRNA sequence
agctgccaagggagtggggg

SEQ ID NO: 448831 - DNA, 20 bp, Artificial
  CRISPR gRNA sequence
gctgccaagggagtggggga

SEQ ID NO: 448832 - DNA, 20 bp, Artificial
  CRISPR gRNA sequence
ctgccaagggagtgggggag

SEQ ID NO: 448833 - DNA, 20 bp, Artificial
  CRISPR gRNA sequence
tgccaagggagtgggggagg

SEQ ID NO: 448834 - DNA, 20 bp, Artificial
  CRISPR gRNA sequence
aagggagtgggggagggggc

SEQ ID NO: 448835 - DNA, 20 bp, Artificial
  CRISPR gRNA sequence
ggagtgggggagggggctgg

SEQ ID NO: 448836 - DNA, 20 bp, Artificial
  CRISPR gRNA sequence
ggggagggggctggcagcct

SEQ ID NO: 448837 - DNA, 20 bp, Artificial
  CRISPR gRNA sequence
ctggcagcctcagcatctgc

SEQ ID NO: 448838 - DNA, 20 bp, Artificial
  CRISPR gRNA sequence
agcctcagcatctgccggat

SEQ ID NO: 448839 - DNA, 20 bp, Artificial
  CRISPR gRNA sequence
gcatctgccggatgagtttt

SEQ ID NO: 448840 - DNA, 20 bp, Artificial
  CRISPR gRNA sequence
tctgccggatgagttttcag

SEQ ID NO: 448841 - DNA, 20 bp, Artificial
  CRISPR gRNA sequence
tgccggatgagttttcagca

SEQ ID NO: 448842 - DNA, 20 bp, Artificial
  CRISPR gRNA sequence
ccggatgagttttcagcaga

SEQ ID NO: 448843 - DNA, 20 bp, Artificial
  CRISPR gRNA sequence
atgagttttcagcagagagc

SEQ ID NO: 448844 - DNA, 20 bp, Artificial
  CRISPR gRNA sequence
gcagagagctggatttaacc

SEQ ID NO: 448845 - DNA, 20 bp, Artificial
  CRISPR gRNA sequence
cagagagctggatttaaccg

SEQ ID NO: 448846 - DNA, 20 bp, Artificial
  CRISPR gRNA sequence
gagctggatttaaccgaggt

SEQ ID NO: 448847 - DNA, 20 bp, Artificial
  CRISPR gRNA sequence
agctggatttaaccgaggtt

SEQ ID NO: 448848 - DNA, 20 bp, Artificial
  CRISPR gRNA sequence
gctggatttaaccgaggttg

SEQ ID NO: 448849 - DNA, 20 bp, Artificial
  CRISPR gRNA sequence
aaccgaggttggggttttgc

SEQ ID NO: 448850 - DNA, 20 bp, Artificial
  CRISPR gRNA sequence
accgaggttggggttttgcg

SEQ ID NO: 448851 - DNA, 20 bp, Artificial
  CRISPR gRNA sequence
ggttttgcgaggatccatca

SEQ ID NO: 448852 - DNA, 20 bp, Artificial
  CRISPR gRNA sequence
tttgcgaggatccatcacag

SEQ ID NO: 448853 - DNA, 20 bp, Artificial
  CRISPR gRNA sequence
ttgcgaggatccatcacagt

SEQ ID NO: 448854 - DNA, 20 bp, Artificial
  CRISPR gRNA sequence
gcgaggatccatcacagtag

SEQ ID NO: 448855 - DNA, 20 bp, Artificial
  CRISPR gRNA sequence
gatccatcacagtaggagta

SEQ ID NO: 448856 - DNA, 20 bp, Artificial
  CRISPR gRNA sequence
atcacagtaggagtaaagct

SEQ ID NO: 448857 - DNA, 20 bp, Artificial
  CRISPR gRNA sequence
tcacagtaggagtaaagcta

SEQ ID NO: 448858 - DNA, 20 bp, Artificial
  CRISPR gRNA sequence
cacagtaggagtaaagctaa

SEQ ID NO: 448859 - DNA, 20 bp, Artificial
  CRISPR gRNA sequence
cagtaggagtaaagctaagg

SEQ ID NO: 448860 - DNA, 20 bp, Artificial
  CRISPR gRNA sequence
ggagtaaagctaagggagct

SEQ ID NO: 448861 - DNA, 20 bp, Artificial
  CRISPR gRNA sequence
gagtaaagctaagggagctg

SEQ ID NO: 448862 - DNA, 20 bp, Artificial
  CRISPR gRNA sequence
agtaaagctaagggagctga

SEQ ID NO: 448863 - DNA, 20 bp, Artificial
  CRISPR gRNA sequence
aaagctaagggagctgaggg

SEQ ID NO: 448864 - DNA, 20 bp, Artificial
  CRISPR gRNA sequence
agggagctgagggtggatat

SEQ ID NO: 448865 - DNA, 20 bp, Artificial
  CRISPR gRNA sequence
gggagctgagggtggatata

SEQ ID NO: 448866 - DNA, 20 bp, Artificial
  CRISPR gRNA sequence
ggagctgagggtggatataa

SEQ ID NO: 448867 - DNA, 20 bp, Artificial
  CRISPR gRNA sequence
agctgagggtggatataagg

SEQ ID NO: 448868 - DNA, 20 bp, Artificial
  CRISPR gRNA sequence
ctgagggtggatataaggga

SEQ ID NO: 448869 - DNA, 20 bp, Artificial
  CRISPR gRNA sequence
taagggagagattataataa

SEQ ID NO: 448870 - DNA, 20 bp, Artificial
  CRISPR gRNA sequence
ggactacaaaatataaacta

SEQ ID NO: 448871 - DNA, 20 bp, Artificial
  CRISPR gRNA sequence
ctacaaaatataaactacag

SEQ ID NO: 448872 - DNA, 20 bp, Artificial
  CRISPR gRNA sequence
tacaaaatataaactacaga

SEQ ID NO: 448873 - DNA, 20 bp, Artificial
  CRISPR gRNA sequence
aaaatataaactacagaagg

SEQ ID NO: 448874 - DNA, 20 bp, Artificial
  CRISPR gRNA sequence
ataaactacagaaggaagtg

SEQ ID NO: 448875 - DNA, 20 bp, Artificial
  CRISPR gRNA sequence
tacagaaggaagtgaagttt

SEQ ID NO: 448876 - DNA, 20 bp, Artificial
  CRISPR gRNA sequence
acagaaggaagtgaagtttg

SEQ ID NO: 448877 - DNA, 20 bp, Artificial
  CRISPR gRNA sequence
agaaggaagtgaagtttgag

SEQ ID NO: 448878 - DNA, 20 bp, Artificial
  CRISPR gRNA sequence
aaggaagtgaagtttgagga

SEQ ID NO: 448879 - DNA, 20 bp, Artificial
  CRISPR gRNA sequence
aagtgaagtttgaggagagt

SEQ ID NO: 448880 - DNA, 20 bp, Artificial
  CRISPR gRNA sequence
agtgaagtttgaggagagtg

SEQ ID NO: 448881 - DNA, 20 bp, Artificial
  CRISPR gRNA sequence
gtgaagtttgaggagagtga

SEQ ID NO: 448882 - DNA, 20 bp, Artificial
  CRISPR gRNA sequence
tgaagtttgaggagagtgag

SEQ ID NO: 448883 - DNA, 20 bp, Artificial
  CRISPR gRNA sequence
agtttgaggagagtgagggg

SEQ ID NO: 448884 - DNA, 20 bp, Artificial
  CRISPR gRNA sequence
ggagagtgaggggcagtaca

SEQ ID NO: 448885 - DNA, 20 bp, Artificial
  CRISPR gRNA sequence
agtgaggggcagtacaaagt

SEQ ID NO: 448886 - DNA, 20 bp, Artificial
  CRISPR gRNA sequence
gaggggcagtacaaagttgg

SEQ ID NO: 448887 - DNA, 20 bp, Artificial
  CRISPR gRNA sequence
aggggcagtacaaagttggc

SEQ ID NO: 448888 - DNA, 20 bp, Artificial
  CRISPR gRNA sequence
ggggcagtacaaagttggca

SEQ ID NO: 448889 - DNA, 20 bp, Artificial
  CRISPR gRNA sequence
gggccaatgcattgcaaaat

SEQ ID NO: 448890 - DNA, 20 bp, Artificial
  CRISPR gRNA sequence
ggccaatgcattgcaaaatt

SEQ ID NO: 448891 - DNA, 20 bp, Artificial
  CRISPR gRNA sequence
aatgcattgcaaaattaggt

SEQ ID NO: 448892 - DNA, 20 bp, Artificial
  CRISPR gRNA sequence
tgcattgcaaaattaggtca

SEQ ID NO: 448893 - DNA, 20 bp, Artificial
  CRISPR gRNA sequence
ttaggtcagagacacccatc

SEQ ID NO: 448894 - DNA, 20 bp, Artificial
  CRISPR gRNA sequence
cccatcgagccaaaacatcc

SEQ ID NO: 448895 - DNA, 20 bp, Artificial
  CRISPR gRNA sequence
ccatcgagccaaaacatcct

SEQ ID NO: 448896 - DNA, 20 bp, Artificial
  CRISPR gRNA sequence
attttctccacttctgtatc

SEQ ID NO: 448897 - DNA, 20 bp, Artificial
  CRISPR gRNA sequence
ttttctccacttctgtatcc

SEQ ID NO: 448898 - DNA, 20 bp, Artificial
  CRISPR gRNA sequence
ccacttctgtatccaggtta

SEQ ID NO: 448899 - DNA, 20 bp, Artificial
  CRISPR gRNA sequence
tccaggttacagattactta

SEQ ID NO: 448900 - DNA, 20 bp, Artificial
  CRISPR gRNA sequence
ccaggttacagattacttac

SEQ ID NO: 448901 - DNA, 20 bp, Artificial
  CRISPR gRNA sequence
caggttacagattacttaca

SEQ ID NO: 448902 - DNA, 20 bp, Artificial
  CRISPR gRNA sequence
gattacttacagggaaaatc

SEQ ID NO: 448903 - DNA, 20 bp, Artificial
  CRISPR gRNA sequence
tacttacagggaaaatcaag

SEQ ID NO: 448904 - DNA, 20 bp, Artificial
  CRISPR gRNA sequence
acttacagggaaaatcaagt

SEQ ID NO: 448905 - DNA, 20 bp, Artificial
  CRISPR gRNA sequence
tacagggaaaatcaagtggg

SEQ ID NO: 448906 - DNA, 20 bp, Artificial
  CRISPR gRNA sequence
ggaaaatcaagtgggcagac

SEQ ID NO: 448907 - DNA, 20 bp, Artificial
  CRISPR gRNA sequence
agtgggcagactggcaccat

SEQ ID NO: 448908 - DNA, 20 bp, Artificial
  CRISPR gRNA sequence
tgggcagactggcaccatca

SEQ ID NO: 448909 - DNA, 20 bp, Artificial
  CRISPR gRNA sequence
gactggcaccatcagagtca

SEQ ID NO: 448910 - DNA, 20 bp, Artificial
  CRISPR gRNA sequence
accatcagagtcatggtctt

SEQ ID NO: 448911 - DNA, 20 bp, Artificial
  CRISPR gRNA sequence
tcatggtctttggatatcaa

SEQ ID NO: 448912 - DNA, 20 bp, Artificial
  CRISPR gRNA sequence
atcaatggtccctcaataat

SEQ ID NO: 448913 - DNA, 20 bp, Artificial
  CRISPR gRNA sequence
caataattagtctgtttctc

SEQ ID NO: 448914 - DNA, 20 bp, Artificial
  CRISPR gRNA sequence
attctcactccatttccaca

SEQ ID NO: 448915 - DNA, 20 bp, Artificial
  CRISPR gRNA sequence
ctcactccatttccacacag

SEQ ID NO: 448916 - DNA, 20 bp, Artificial
  CRISPR gRNA sequence
tggctgtttttaatcatctc

SEQ ID NO: 448917 - DNA, 20 bp, Artificial
  CRISPR gRNA sequence
aatcatctctggtatttctg

SEQ ID NO: 448918 - DNA, 20 bp, Artificial
  CRISPR gRNA sequence
ctctctcatcctatatttct

SEQ ID NO: 448919 - DNA, 20 bp, Artificial
  CRISPR gRNA sequence
aaaacttttactcatccttc

SEQ ID NO: 448920 - DNA, 20 bp, Artificial
  CRISPR gRNA sequence
cttttactcatccttcaagt

SEQ ID NO: 448921 - DNA, 20 bp, Artificial
  CRISPR gRNA sequence
ctcatccttcaagtcagctc

SEQ ID NO: 448922 - DNA, 20 bp, Artificial
  CRISPR gRNA sequence
ccagcactaacttcactgtg

SEQ ID NO: 448923 - DNA, 20 bp, Artificial
  CRISPR gRNA sequence
gtgaagtttccctgatgctt

SEQ ID NO: 448924 - DNA, 20 bp, Artificial
  CRISPR gRNA sequence
tttccctgatgcttcagact

SEQ ID NO: 448925 - DNA, 20 bp, Artificial
  CRISPR gRNA sequence
ttccctgatgcttcagactc

SEQ ID NO: 448926 - DNA, 20 bp, Artificial
  CRISPR gRNA sequence
cttcagactcaggaatctct

SEQ ID NO: 448927 - DNA, 20 bp, Artificial
  CRISPR gRNA sequence
ttcctcaattataataactg

SEQ ID NO: 448928 - DNA, 20 bp, Artificial
  CRISPR gRNA sequence
ttgctaatttgtttttacat

SEQ ID NO: 448929 - DNA, 20 bp, Artificial
  CRISPR gRNA sequence
tgctaatttgtttttacatt

SEQ ID NO: 448930 - DNA, 20 bp, Artificial
  CRISPR gRNA sequence
tacattaggctttaaactct

SEQ ID NO: 448931 - DNA, 20 bp, Artificial
  CRISPR gRNA sequence
cattaggctttaaactctga

SEQ ID NO: 448932 - DNA, 20 bp, Artificial
  CRISPR gRNA sequence
taggctttaaactctgagag

SEQ ID NO: 448933 - DNA, 20 bp, Artificial
  CRISPR gRNA sequence
ctttaaactctgagagtggc

SEQ ID NO: 448934 - DNA, 20 bp, Artificial
  CRISPR gRNA sequence
tttaaactctgagagtggcc

SEQ ID NO: 448935 - DNA, 20 bp, Artificial
  CRISPR gRNA sequence
actctgagagtggccaggca

SEQ ID NO: 448936 - DNA, 20 bp, Artificial
  CRISPR gRNA sequence
ctgagagtggccaggcacag

SEQ ID NO: 448937 - DNA, 20 bp, Artificial
  CRISPR gRNA sequence
gtggttcatgcctgtaatcc

SEQ ID NO: 448938 - DNA, 20 bp, Artificial
  CRISPR gRNA sequence
gttcatgcctgtaatcccag

SEQ ID NO: 448939 - DNA, 20 bp, Artificial
  CRISPR gRNA sequence
tgcctgtaatcccagcagtt

SEQ ID NO: 448940 - DNA, 20 bp, Artificial
  CRISPR gRNA sequence
gcctgtaatcccagcagttt

SEQ ID NO: 448941 - DNA, 20 bp, Artificial
  CRISPR gRNA sequence
ctgtaatcccagcagtttgg

SEQ ID NO: 448942 - DNA, 20 bp, Artificial
  CRISPR gRNA sequence
tgtaatcccagcagtttggg

SEQ ID NO: 448943 - DNA, 20 bp, Artificial
  CRISPR gRNA sequence
aatcccagcagtttgggagg

SEQ ID NO: 448944 - DNA, 20 bp, Artificial
  CRISPR gRNA sequence
tcccagcagtttgggaggca

SEQ ID NO: 448945 - DNA, 20 bp, Artificial
  CRISPR gRNA sequence
cccagcagtttgggaggcag

SEQ ID NO: 448946 - DNA, 20 bp, Artificial
  CRISPR gRNA sequence
agcagtttgggaggcagagg

SEQ ID NO: 448947 - DNA, 20 bp, Artificial
  CRISPR gRNA sequence
gcagtttgggaggcagaggc

SEQ ID NO: 448948 - DNA, 20 bp, Artificial
  CRISPR gRNA sequence
agtttgggaggcagaggcag

SEQ ID NO: 448949 - DNA, 20 bp, Artificial
  CRISPR gRNA sequence
gtttgggaggcagaggcagg

SEQ ID NO: 448950 - DNA, 20 bp, Artificial
  CRISPR gRNA sequence
tttgggaggcagaggcagga

SEQ ID NO: 448951 - DNA, 20 bp, Artificial
  CRISPR gRNA sequence
caggagggttgcttgatgcc

SEQ ID NO: 448952 - DNA, 20 bp, Artificial
  CRISPR gRNA sequence
ggagggttgcttgatgccta

SEQ ID NO: 448953 - DNA, 20 bp, Artificial
  CRISPR gRNA sequence
ttgcttgatgcctagagttc

SEQ ID NO: 448954 - DNA, 20 bp, Artificial
  CRISPR gRNA sequence
tgatgcctagagttcaagac

SEQ ID NO: 448955 - DNA, 20 bp, Artificial
  CRISPR gRNA sequence
cctagagttcaagactagcc

SEQ ID NO: 448956 - DNA, 20 bp, Artificial
  CRISPR gRNA sequence
caagactagcctggacaaca

SEQ ID NO: 448957 - DNA, 20 bp, Artificial
  CRISPR gRNA sequence
actagcctggacaacatagt

SEQ ID NO: 448958 - DNA, 20 bp, Artificial
  CRISPR gRNA sequence
gtctctacaaaataaaaaat

SEQ ID NO: 448959 - DNA, 20 bp, Artificial
  CRISPR gRNA sequence
ctacaaaataaaaaattagc

SEQ ID NO: 448960 - DNA, 20 bp, Artificial
  CRISPR gRNA sequence
tacaaaataaaaaattagcc

SEQ ID NO: 448961 - DNA, 20 bp, Artificial
  CRISPR gRNA sequence
aataaaaaattagccaggca

SEQ ID NO: 448962 - DNA, 20 bp, Artificial
  CRISPR gRNA sequence
aaaaaattagccaggcatag

SEQ ID NO: 448963 - DNA, 20 bp, Artificial
  CRISPR gRNA sequence
ggcatagtggtgcatacctg

SEQ ID NO: 448964 - DNA, 20 bp, Artificial
  CRISPR gRNA sequence
gtggtgcatacctgtagtgt

SEQ ID NO: 448965 - DNA, 20 bp, Artificial
  CRISPR gRNA sequence
tacctgtagtgttagctatt

SEQ ID NO: 448966 - DNA, 20 bp, Artificial
  CRISPR gRNA sequence
ctgtagtgttagctattcgg

SEQ ID NO: 448967 - DNA, 20 bp, Artificial
  CRISPR gRNA sequence
tgtagtgttagctattcgga

SEQ ID NO: 448968 - DNA, 20 bp, Artificial
  CRISPR gRNA sequence
agtgttagctattcggaagg

SEQ ID NO: 448969 - DNA, 20 bp, Artificial
  CRISPR gRNA sequence
gttagctattcggaaggcgg

SEQ ID NO: 448970 - DNA, 20 bp, Artificial
  CRISPR gRNA sequence
agctattcggaaggcggaag

SEQ ID NO: 448971 - DNA, 20 bp, Artificial
  CRISPR gRNA sequence
gctattcggaaggcggaagc

SEQ ID NO: 448972 - DNA, 20 bp, Artificial
  CRISPR gRNA sequence
tattcggaaggcggaagcag

SEQ ID NO: 448973 - DNA, 20 bp, Artificial
  CRISPR gRNA sequence
attcggaaggcggaagcagg

SEQ ID NO: 448974 - DNA, 20 bp, Artificial
  CRISPR gRNA sequence
cggaagcaggaggattgctt

SEQ ID NO: 448975 - DNA, 20 bp, Artificial
  CRISPR gRNA sequence
gcaggaggattgcttgagcc

SEQ ID NO: 448976 - DNA, 20 bp, Artificial
  CRISPR gRNA sequence
caggaggattgcttgagccc

SEQ ID NO: 448977 - DNA, 20 bp, Artificial
  CRISPR gRNA sequence
ggaggattgcttgagcccag

SEQ ID NO: 448978 - DNA, 20 bp, Artificial
  CRISPR gRNA sequence
tgcttgagcccaggagttca

SEQ ID NO: 448979 - DNA, 20 bp, Artificial
  CRISPR gRNA sequence
gcttgagcccaggagttcaa

SEQ ID NO: 448980 - DNA, 20 bp, Artificial
  CRISPR gRNA sequence
agcccaggagttcaaaggtg

SEQ ID NO: 448981 - DNA, 20 bp, Artificial
  CRISPR gRNA sequence
caggagttcaaaggtgcagt

SEQ ID NO: 448982 - DNA, 20 bp, Artificial
  CRISPR gRNA sequence
acgattgtgccactgccctc

SEQ ID NO: 448983 - DNA, 20 bp, Artificial
  CRISPR gRNA sequence
tgtgccactgccctccagcc

SEQ ID NO: 448984 - DNA, 20 bp, Artificial
  CRISPR gRNA sequence
gtgccactgccctccagcct

SEQ ID NO: 448985 - DNA, 20 bp, Artificial
  CRISPR gRNA sequence
gccctccagcctgggtgaca

SEQ ID NO: 448986 - DNA, 20 bp, Artificial
  CRISPR gRNA sequence
tccagcctgggtgacacagc

SEQ ID NO: 448987 - DNA, 20 bp, Artificial
  CRISPR gRNA sequence
ttttttaaattaaaaatccc

SEQ ID NO: 448988 - DNA, 20 bp, Artificial
  CRISPR gRNA sequence
aaaaatccccggtcatctaa

SEQ ID NO: 448989 - DNA, 20 bp, Artificial
  CRISPR gRNA sequence
atccccggtcatctaatggt

SEQ ID NO: 448990 - DNA, 20 bp, Artificial
  CRISPR gRNA sequence
tccccggtcatctaatggtt

SEQ ID NO: 448991 - DNA, 20 bp, Artificial
  CRISPR gRNA sequence
ccccggtcatctaatggtta

SEQ ID NO: 448992 - DNA, 20 bp, Artificial
  CRISPR gRNA sequence
cccggtcatctaatggttag

SEQ ID NO: 448993 - DNA, 20 bp, Artificial
  CRISPR gRNA sequence
ctaatggttaggggaaaaaa

SEQ ID NO: 448994 - DNA, 20 bp, Artificial
  CRISPR gRNA sequence
aggggaaaaaaaagttctga

SEQ ID NO: 448995 - DNA, 20 bp, Artificial
  CRISPR gRNA sequence
ggaaaaaaaagttctgacag

SEQ ID NO: 448996 - DNA, 20 bp, Artificial
  CRISPR gRNA sequence
gaaaaaaaagttctgacagt

SEQ ID NO: 448997 - DNA, 20 bp, Artificial
  CRISPR gRNA sequence
aaaaaaaagttctgacagta

SEQ ID NO: 448998 - DNA, 20 bp, Artificial
  CRISPR gRNA sequence
tgacagtagggctcacgtcc

SEQ ID NO: 448999 - DNA, 20 bp, Artificial
  CRISPR gRNA sequence
ggctcacgtcctagtcctca

SEQ ID NO: 449000 - DNA, 20 bp, Artificial
  CRISPR gRNA sequence
cgtcctagtcctcatagccc

SEQ ID NO: 449001 - DNA, 20 bp, Artificial
  CRISPR gRNA sequence
cctagtcctcatagccccag

SEQ ID NO: 449002 - DNA, 20 bp, Artificial
  CRISPR gRNA sequence
ctagtcctcatagccccagc

SEQ ID NO: 449003 - DNA, 20 bp, Artificial
  CRISPR gRNA sequence
tagtcctcatagccccagca

SEQ ID NO: 449004 - DNA, 20 bp, Artificial
  CRISPR gRNA sequence
ctcatagccccagcagggct

SEQ ID NO: 449005 - DNA, 20 bp, Artificial
  CRISPR gRNA sequence
atagccccagcagggcttgg

SEQ ID NO: 449006 - DNA, 20 bp, Artificial
  CRISPR gRNA sequence
agccccagcagggcttggca

SEQ ID NO: 449007 - DNA, 20 bp, Artificial
  CRISPR gRNA sequence
aatacctaaacgtatttgtt

SEQ ID NO: 449008 - DNA, 20 bp, Artificial
  CRISPR gRNA sequence
acctaaacgtatttgttaag

SEQ ID NO: 449009 - DNA, 20 bp, Artificial
  CRISPR gRNA sequence
ctaaacgtatttgttaagtg

SEQ ID NO: 449010 - DNA, 20 bp, Artificial
  CRISPR gRNA sequence
taaacgtatttgttaagtgg

SEQ ID NO: 449011 - DNA, 20 bp, Artificial
  CRISPR gRNA sequence
caaataaacctatgaattaa

SEQ ID NO: 449012 - DNA, 20 bp, Artificial
  CRISPR gRNA sequence
tatgaattaatggatgcttt

SEQ ID NO: 449013 - DNA, 20 bp, Artificial
  CRISPR gRNA sequence
gatgctttgagcatattatt

SEQ ID NO: 449014 - DNA, 20 bp, Artificial
  CRISPR gRNA sequence
gtcccttaattttcattttc

SEQ ID NO: 449015 - DNA, 20 bp, Artificial
  CRISPR gRNA sequence
agatgaataaactactgccc

SEQ ID NO: 449016 - DNA, 20 bp, Artificial
  CRISPR gRNA sequence
gatgaataaactactgccca

SEQ ID NO: 449017 - DNA, 20 bp, Artificial
  CRISPR gRNA sequence
tgaataaactactgcccaag

SEQ ID NO: 449018 - DNA, 20 bp, Artificial
  CRISPR gRNA sequence
taaactactgcccaaggagt

SEQ ID NO: 449019 - DNA, 20 bp, Artificial
  CRISPR gRNA sequence
aaactactgcccaaggagtt

SEQ ID NO: 449020 - DNA, 20 bp, Artificial
  CRISPR gRNA sequence
ggagttaggtaacttgctta

SEQ ID NO: 449021 - DNA, 20 bp, Artificial
  CRISPR gRNA sequence
gtaacttgcttacagtcaca

SEQ ID NO: 449022 - DNA, 20 bp, Artificial
  CRISPR gRNA sequence
tacagtcacacagccatcga

SEQ ID NO: 449023 - DNA, 20 bp, Artificial
  CRISPR gRNA sequence
cagtcacacagccatcgata

SEQ ID NO: 449024 - DNA, 20 bp, Artificial
  CRISPR gRNA sequence
cacacagccatcgatagagc

SEQ ID NO: 449025 - DNA, 20 bp, Artificial
  CRISPR gRNA sequence
aatttgtatttcctgtctgc

SEQ ID NO: 449026 - DNA, 20 bp, Artificial
  CRISPR gRNA sequence
ctgtctgccagcactactgc

SEQ ID NO: 449027 - DNA, 20 bp, Artificial
  CRISPR gRNA sequence
tgtctgccagcactactgcc

SEQ ID NO: 449028 - DNA, 20 bp, Artificial
  CRISPR gRNA sequence
actactgccaggttctgctt

SEQ ID NO: 449029 - DNA, 20 bp, Artificial
  CRISPR gRNA sequence
tctgcttcagtccttccttg

SEQ ID NO: 449030 - DNA, 20 bp, Artificial
  CRISPR gRNA sequence
agtccttccttgaagacttc

SEQ ID NO: 449031 - DNA, 20 bp, Artificial
  CRISPR gRNA sequence
ccttgaagacttctagtgat

SEQ ID NO: 449032 - DNA, 20 bp, Artificial
  CRISPR gRNA sequence
cttgaagacttctagtgata

SEQ ID NO: 449033 - DNA, 20 bp, Artificial
  CRISPR gRNA sequence
tgaagacttctagtgataag

SEQ ID NO: 449034 - DNA, 20 bp, Artificial
  CRISPR gRNA sequence
agacttctagtgataaggag

SEQ ID NO: 449035 - DNA, 20 bp, Artificial
  CRISPR gRNA sequence
ctagtgataaggagcagtta

SEQ ID NO: 449036 - DNA, 20 bp, Artificial
  CRISPR gRNA sequence
agcagttacggtgaaattca

SEQ ID NO: 449037 - DNA, 20 bp, Artificial
  CRISPR gRNA sequence
acagaatgctacctgacctc

SEQ ID NO: 449038 - DNA, 20 bp, Artificial
  CRISPR gRNA sequence
cagaatgctacctgacctct

SEQ ID NO: 449039 - DNA, 20 bp, Artificial
  CRISPR gRNA sequence
taattcttccctttccattc

SEQ ID NO: 449040 - DNA, 20 bp, Artificial
  CRISPR gRNA sequence
aattcttccctttccattcc

SEQ ID NO: 449041 - DNA, 20 bp, Artificial
  CRISPR gRNA sequence
ccaggatgcattaacatcac

SEQ ID NO: 449042 - DNA, 20 bp, Artificial
  CRISPR gRNA sequence
atgcattaacatcaccagct

SEQ ID NO: 449043 - DNA, 20 bp, Artificial
  CRISPR gRNA sequence
acatcaccagctcagcttcc

SEQ ID NO: 449044 - DNA, 20 bp, Artificial
  CRISPR gRNA sequence
catcaccagctcagcttccc

SEQ ID NO: 449045 - DNA, 20 bp, Artificial
  CRISPR gRNA sequence
caccagctcagcttcccagg

SEQ ID NO: 449046 - DNA, 20 bp, Artificial
  CRISPR gRNA sequence
accagctcagcttcccagga

SEQ ID NO: 449047 - DNA, 20 bp, Artificial
  CRISPR gRNA sequence
taaacttaatctgtactgta

SEQ ID NO: 449048 - DNA, 20 bp, Artificial
  CRISPR gRNA sequence
taatctgtactgtatggcat

SEQ ID NO: 449049 - DNA, 20 bp, Artificial
  CRISPR gRNA sequence
ctgtactgtatggcataaga

SEQ ID NO: 449050 - DNA, 20 bp, Artificial
  CRISPR gRNA sequence
tactgtatggcataagaaag

SEQ ID NO: 449051 - DNA, 20 bp, Artificial
  CRISPR gRNA sequence
ctgtatggcataagaaagaa

SEQ ID NO: 449052 - DNA, 20 bp, Artificial
  CRISPR gRNA sequence
tgtatggcataagaaagaag

SEQ ID NO: 449053 - DNA, 20 bp, Artificial
  CRISPR gRNA sequence
ggcataagaaagaagaggct

SEQ ID NO: 449054 - DNA, 20 bp, Artificial
  CRISPR gRNA sequence
gcataagaaagaagaggctg

SEQ ID NO: 449055 - DNA, 20 bp, Artificial
  CRISPR gRNA sequence
cataagaaagaagaggctga

SEQ ID NO: 449056 - DNA, 20 bp, Artificial
  CRISPR gRNA sequence
ataagaaagaagaggctgag

SEQ ID NO: 449057 - DNA, 20 bp, Artificial
  CRISPR gRNA sequence
agaagaggctgaggggtttg

SEQ ID NO: 449058 - DNA, 20 bp, Artificial
  CRISPR gRNA sequence
ggtttgtagtgtttttgtgc

SEQ ID NO: 449059 - DNA, 20 bp, Artificial
  CRISPR gRNA sequence
gtttgtagtgtttttgtgca

SEQ ID NO: 449060 - DNA, 20 bp, Artificial
  CRISPR gRNA sequence
gtagtgtttttgtgcaagga

SEQ ID NO: 449061 - DNA, 20 bp, Artificial
  CRISPR gRNA sequence
tagtgtttttgtgcaaggac

SEQ ID NO: 449062 - DNA, 20 bp, Artificial
  CRISPR gRNA sequence
tttttgtgcaaggacaggtc

SEQ ID NO: 449063 - DNA, 20 bp, Artificial
  CRISPR gRNA sequence
tttgtgcaaggacaggtctg

SEQ ID NO: 449064 - DNA, 20 bp, Artificial
  CRISPR gRNA sequence
ggtctggagactgttctcct

SEQ ID NO: 449065 - DNA, 20 bp, Artificial
  CRISPR gRNA sequence
ggagactgttctcctgagac

SEQ ID NO: 449066 - DNA, 20 bp, Artificial
  CRISPR gRNA sequence
ctcctgagaccagtttaaaa

SEQ ID NO: 449067 - DNA, 20 bp, Artificial
  CRISPR gRNA sequence
gagaccagtttaaaacagct

SEQ ID NO: 449068 - DNA, 20 bp, Artificial
  CRISPR gRNA sequence
ttaaaacagctgagacttaa

SEQ ID NO: 449069 - DNA, 20 bp, Artificial
  CRISPR gRNA sequence
taaaacagctgagacttaaa

SEQ ID NO: 449070 - DNA, 20 bp, Artificial
  CRISPR gRNA sequence
aaaacagctgagacttaaaa

SEQ ID NO: 449071 - DNA, 20 bp, Artificial
  CRISPR gRNA sequence
ctgagacttaaaagggatcc

SEQ ID NO: 449072 - DNA, 20 bp, Artificial
  CRISPR gRNA sequence
tgagacttaaaagggatcct

SEQ ID NO: 449073 - DNA, 20 bp, Artificial
  CRISPR gRNA sequence
acttaaaagggatcctggga

SEQ ID NO: 449074 - DNA, 20 bp, Artificial
  CRISPR gRNA sequence
aaaagggatcctgggataga

SEQ ID NO: 449075 - DNA, 20 bp, Artificial
  CRISPR gRNA sequence
gatcctgggatagatggtgt

SEQ ID NO: 449076 - DNA, 20 bp, Artificial
  CRISPR gRNA sequence
gtgttggtgaaatatcatct

SEQ ID NO: 449077 - DNA, 20 bp, Artificial
  CRISPR gRNA sequence
tctcagttgatgttcaccat

SEQ ID NO: 449078 - DNA, 20 bp, Artificial
  CRISPR gRNA sequence
gttgatgttcaccataagcc

SEQ ID NO: 449079 - DNA, 20 bp, Artificial
  CRISPR gRNA sequence
agccaagtcacaccgttgca

SEQ ID NO: 449080 - DNA, 20 bp, Artificial
  CRISPR gRNA sequence
caagtcacaccgttgcacag

SEQ ID NO: 449081 - DNA, 20 bp, Artificial
  CRISPR gRNA sequence
aagtcacaccgttgcacagt

SEQ ID NO: 449082 - DNA, 20 bp, Artificial
  CRISPR gRNA sequence
cgttgcacagtgggacctac

SEQ ID NO: 449083 - DNA, 20 bp, Artificial
  CRISPR gRNA sequence
gggacctaccagtgttgtgc

SEQ ID NO: 449084 - DNA, 20 bp, Artificial
  CRISPR gRNA sequence
acctaccagtgttgtgccag

SEQ ID NO: 449085 - DNA, 20 bp, Artificial
  CRISPR gRNA sequence
accagtgttgtgccagaagc

SEQ ID NO: 449086 - DNA, 20 bp, Artificial
  CRISPR gRNA sequence
agtgttgtgccagaagccag

SEQ ID NO: 449087 - DNA, 20 bp, Artificial
  CRISPR gRNA sequence
ttgtgccagaagccagaagt

SEQ ID NO: 449088 - DNA, 20 bp, Artificial
  CRISPR gRNA sequence
tgtgccagaagccagaagtc

SEQ ID NO: 449089 - DNA, 20 bp, Artificial
  CRISPR gRNA sequence
agaagtcaggtatccgcctt

SEQ ID NO: 449090 - DNA, 20 bp, Artificial
  CRISPR gRNA sequence
gaagtcaggtatccgccttc

SEQ ID NO: 449091 - DNA, 20 bp, Artificial
  CRISPR gRNA sequence
aagtcaggtatccgccttca

SEQ ID NO: 449092 - DNA, 20 bp, Artificial
  CRISPR gRNA sequence
ttttttctccattctattca

SEQ ID NO: 449093 - DNA, 20 bp, Artificial
  CRISPR gRNA sequence
tttttctccattctattcac

SEQ ID NO: 449094 - DNA, 20 bp, Artificial
  CRISPR gRNA sequence
tctccattctattcacaggt

SEQ ID NO: 449095 - DNA, 20 bp, Artificial
  CRISPR gRNA sequence
tcaaatactcctaatgccac

SEQ ID NO: 449096 - DNA, 20 bp, Artificial
  CRISPR gRNA sequence
caaatactcctaatgccacc

SEQ ID NO: 449097 - DNA, 20 bp, Artificial
  CRISPR gRNA sequence
atactcctaatgccaccagg

SEQ ID NO: 449098 - DNA, 20 bp, Artificial
  CRISPR gRNA sequence
tactcctaatgccaccaggt

SEQ ID NO: 449099 - DNA, 20 bp, Artificial
  CRISPR gRNA sequence
cctaatgccaccaggtggga

SEQ ID NO: 449100 - DNA, 20 bp, Artificial
  CRISPR gRNA sequence
atgccaccaggtgggacagt

SEQ ID NO: 449101 - DNA, 20 bp, Artificial
  CRISPR gRNA sequence
ccaccaggtgggacagtgag

SEQ ID NO: 449102 - DNA, 20 bp, Artificial
  CRISPR gRNA sequence
caccaggtgggacagtgagc

SEQ ID NO: 449103 - DNA, 20 bp, Artificial
  CRISPR gRNA sequence
accaggtgggacagtgagca

SEQ ID NO: 449104 - DNA, 20 bp, Artificial
  CRISPR gRNA sequence
gggacagtgagcagggttga

SEQ ID NO: 449105 - DNA, 20 bp, Artificial
  CRISPR gRNA sequence
acagtgagcagggttgacag

SEQ ID NO: 449106 - DNA, 20 bp, Artificial
  CRISPR gRNA sequence
agtgagcagggttgacagtg

SEQ ID NO: 449107 - DNA, 20 bp, Artificial
  CRISPR gRNA sequence
gttgacagtggagatgtaac

SEQ ID NO: 449108 - DNA, 20 bp, Artificial
  CRISPR gRNA sequence
acagtggagatgtaaccaga

SEQ ID NO: 449109 - DNA, 20 bp, Artificial
  CRISPR gRNA sequence
ggagatgtaaccagatagtt

SEQ ID NO: 449110 - DNA, 20 bp, Artificial
  CRISPR gRNA sequence
gagatgtaaccagatagttc

SEQ ID NO: 449111 - DNA, 20 bp, Artificial
  CRISPR gRNA sequence
taaccagatagttcaggtcc

SEQ ID NO: 449112 - DNA, 20 bp, Artificial
  CRISPR gRNA sequence
cagatagttcaggtcctgga

SEQ ID NO: 449113 - DNA, 20 bp, Artificial
  CRISPR gRNA sequence
agatagttcaggtcctggaa

SEQ ID NO: 449114 - DNA, 20 bp, Artificial
  CRISPR gRNA sequence
tagttcaggtcctggaaagg

SEQ ID NO: 449115 - DNA, 20 bp, Artificial
  CRISPR gRNA sequence
tccttttccaacatccccat

SEQ ID NO: 449116 - DNA, 20 bp, Artificial
  CRISPR gRNA sequence
ttttccaacatccccattgg

SEQ ID NO: 449117 - DNA, 20 bp, Artificial
  CRISPR gRNA sequence
gcagatgctgcctttcttca

SEQ ID NO: 449118 - DNA, 20 bp, Artificial
  CRISPR gRNA sequence
tctcattttgtctttaattt

SEQ ID NO: 449119 - DNA, 20 bp, Artificial
  CRISPR gRNA sequence
ttaattttagaactcttact

SEQ ID NO: 449120 - DNA, 20 bp, Artificial
  CRISPR gRNA sequence
taattttagaactcttactt

SEQ ID NO: 449121 - DNA, 20 bp, Artificial
  CRISPR gRNA sequence
aattttagaactcttacttg

SEQ ID NO: 449122 - DNA, 20 bp, Artificial
  CRISPR gRNA sequence
tttagaactcttacttgggg

SEQ ID NO: 449123 - DNA, 20 bp, Artificial
  CRISPR gRNA sequence
ggccattgcatttttactga

SEQ ID NO: 449124 - DNA, 20 bp, Artificial
  CRISPR gRNA sequence
gccattgcatttttactgac

SEQ ID NO: 449125 - DNA, 20 bp, Artificial
  CRISPR gRNA sequence
ccattgcatttttactgaca

SEQ ID NO: 449126 - DNA, 20 bp, Artificial
  CRISPR gRNA sequence
attgcatttttactgacagg

SEQ ID NO: 449127 - DNA, 20 bp, Artificial
  CRISPR gRNA sequence
catttttactgacagggaga

SEQ ID NO: 449128 - DNA, 20 bp, Artificial
  CRISPR gRNA sequence
ctgacagggagatggtgaca

SEQ ID NO: 449129 - DNA, 20 bp, Artificial
  CRISPR gRNA sequence
tgacagggagatggtgacac

SEQ ID NO: 449130 - DNA, 20 bp, Artificial
  CRISPR gRNA sequence
gacagggagatggtgacaca

SEQ ID NO: 449131 - DNA, 20 bp, Artificial
  CRISPR gRNA sequence
acagggagatggtgacacag

SEQ ID NO: 449132 - DNA, 20 bp, Artificial
  CRISPR gRNA sequence
agatggtgacacaggggttg

SEQ ID NO: 449133 - DNA, 20 bp, Artificial
  CRISPR gRNA sequence
atggtgacacaggggttgaa

SEQ ID NO: 449134 - DNA, 20 bp, Artificial
  CRISPR gRNA sequence
aggggttgaagagacttgtc

SEQ ID NO: 449135 - DNA, 20 bp, Artificial
  CRISPR gRNA sequence
acttgtccagtgctactcac

SEQ ID NO: 449136 - DNA, 20 bp, Artificial
  CRISPR gRNA sequence
ccagtgctactcactggtga

SEQ ID NO: 449137 - DNA, 20 bp, Artificial
  CRISPR gRNA sequence
ctcactggtgaaagtaaaaa

SEQ ID NO: 449138 - DNA, 20 bp, Artificial
  CRISPR gRNA sequence
ctggtgaaagtaaaaacaga

SEQ ID NO: 449139 - DNA, 20 bp, Artificial
  CRISPR gRNA sequence
aagtaaaaacagatagaaat

SEQ ID NO: 449140 - DNA, 20 bp, Artificial
  CRISPR gRNA sequence
agtaaaaacagatagaaatt

SEQ ID NO: 449141 - DNA, 20 bp, Artificial
  CRISPR gRNA sequence
cagatagaaattaggcttcc

SEQ ID NO: 449142 - DNA, 20 bp, Artificial
  CRISPR gRNA sequence
tagaaattaggcttcctggc

SEQ ID NO: 449143 - DNA, 20 bp, Artificial
  CRISPR gRNA sequence
agaaattaggcttcctggcc

SEQ ID NO: 449144 - DNA, 20 bp, Artificial
  CRISPR gRNA sequence
ttaggcttcctggccaggca

SEQ ID NO: 449145 - DNA, 20 bp, Artificial
  CRISPR gRNA sequence
ggcttcctggccaggcatgg

SEQ ID NO: 449146 - DNA, 20 bp, Artificial
  CRISPR gRNA sequence
gtggctcatgcctgtaatcc

SEQ ID NO: 449147 - DNA, 20 bp, Artificial
  CRISPR gRNA sequence
tgcctgtaatcccagcattt

SEQ ID NO: 449148 - DNA, 20 bp, Artificial
  CRISPR gRNA sequence
gcctgtaatcccagcatttt

SEQ ID NO: 449149 - DNA, 20 bp, Artificial
  CRISPR gRNA sequence
ctgtaatcccagcattttgg

SEQ ID NO: 449150 - DNA, 20 bp, Artificial
  CRISPR gRNA sequence
tgtaatcccagcattttggg

SEQ ID NO: 449151 - DNA, 20 bp, Artificial
  CRISPR gRNA sequence
tcccagcattttgggaggct

SEQ ID NO: 449152 - DNA, 20 bp, Artificial
  CRISPR gRNA sequence
cccagcattttgggaggctg

SEQ ID NO: 449153 - DNA, 20 bp, Artificial
  CRISPR gRNA sequence
agcattttgggaggctgagg

SEQ ID NO: 449154 - DNA, 20 bp, Artificial
  CRISPR gRNA sequence
gcattttgggaggctgaggt

SEQ ID NO: 449155 - DNA, 20 bp, Artificial
  CRISPR gRNA sequence
ttttgggaggctgaggtagg

SEQ ID NO: 449156 - DNA, 20 bp, Artificial
  CRISPR gRNA sequence
ctgaggtaggcagatcaccc

SEQ ID NO: 449157 - DNA, 20 bp, Artificial
  CRISPR gRNA sequence
tgaggtaggcagatcacccg

SEQ ID NO: 449158 - DNA, 20 bp, Artificial
  CRISPR gRNA sequence
gtaggcagatcacccgaggt

SEQ ID NO: 449159 - DNA, 20 bp, Artificial
  CRISPR gRNA sequence
taggcagatcacccgaggtc

SEQ ID NO: 449160 - DNA, 20 bp, Artificial
  CRISPR gRNA sequence
ggcagatcacccgaggtcag

SEQ ID NO: 449161 - DNA, 20 bp, Artificial
  CRISPR gRNA sequence
tcacccgaggtcaggagtta

SEQ ID NO: 449162 - DNA, 20 bp, Artificial
  CRISPR gRNA sequence
cgaggtcaggagttaaagat

SEQ ID NO: 449163 - DNA, 20 bp, Artificial
  CRISPR gRNA sequence
tcaggagttaaagatcagcc

SEQ ID NO: 449164 - DNA, 20 bp, Artificial
  CRISPR gRNA sequence
aaagatcagcctagccaaca

SEQ ID NO: 449165 - DNA, 20 bp, Artificial
  CRISPR gRNA sequence
agatcagcctagccaacatg

SEQ ID NO: 449166 - DNA, 20 bp, Artificial
  CRISPR gRNA sequence
ctctactaaaaatacaaaat

SEQ ID NO: 449167 - DNA, 20 bp, Artificial
  CRISPR gRNA sequence
actaaaaatacaaaattagc

SEQ ID NO: 449168 - DNA, 20 bp, Artificial
  CRISPR gRNA sequence
ctaaaaatacaaaattagcc

SEQ ID NO: 449169 - DNA, 20 bp, Artificial
  CRISPR gRNA sequence
aatacaaaattagccgggtg

SEQ ID NO: 449170 - DNA, 20 bp, Artificial
  CRISPR gRNA sequence
acaaaattagccgggtgtgg

SEQ ID NO: 449171 - DNA, 20 bp, Artificial
  CRISPR gRNA sequence
gtggcgcatgcctgtaatcc

SEQ ID NO: 449172 - DNA, 20 bp, Artificial
  CRISPR gRNA sequence
tgcctgtaatcccagctact

SEQ ID NO: 449173 - DNA, 20 bp, Artificial
  CRISPR gRNA sequence
gcctgtaatcccagctactc

SEQ ID NO: 449174 - DNA, 20 bp, Artificial
  CRISPR gRNA sequence
ctgtaatcccagctactcag

SEQ ID NO: 449175 - DNA, 20 bp, Artificial
  CRISPR gRNA sequence
tgtaatcccagctactcagg

SEQ ID NO: 449176 - DNA, 20 bp, Artificial
  CRISPR gRNA sequence
tcccagctactcaggaggct

SEQ ID NO: 449177 - DNA, 20 bp, Artificial
  CRISPR gRNA sequence
cccagctactcaggaggcta

SEQ ID NO: 449178 - DNA, 20 bp, Artificial
  CRISPR gRNA sequence
gctactcaggaggctaaggc

SEQ ID NO: 449179 - DNA, 20 bp, Artificial
  CRISPR gRNA sequence
tactcaggaggctaaggcaa

SEQ ID NO: 449180 - DNA, 20 bp, Artificial
  CRISPR gRNA sequence
gcaagagaatcgcttgaacc

SEQ ID NO: 449181 - DNA, 20 bp, Artificial
  CRISPR gRNA sequence
caagagaatcgcttgaacct

SEQ ID NO: 449182 - DNA, 20 bp, Artificial
  CRISPR gRNA sequence
agagaatcgcttgaacctgg

SEQ ID NO: 449183 - DNA, 20 bp, Artificial
  CRISPR gRNA sequence
gagaatcgcttgaacctggg

SEQ ID NO: 449184 - DNA, 20 bp, Artificial
  CRISPR gRNA sequence
aatcgcttgaacctgggagg

SEQ ID NO: 449185 - DNA, 20 bp, Artificial
  CRISPR gRNA sequence
tcgcttgaacctgggaggcg

SEQ ID NO: 449186 - DNA, 20 bp, Artificial
  CRISPR gRNA sequence
cgcttgaacctgggaggcgg

SEQ ID NO: 449187 - DNA, 20 bp, Artificial
  CRISPR gRNA sequence
aacctgggaggcggaggttg

SEQ ID NO: 449188 - DNA, 20 bp, Artificial
  CRISPR gRNA sequence
tgggaggcggaggttgcagt

SEQ ID NO: 449189 - DNA, 20 bp, Artificial
  CRISPR gRNA sequence
ggcggaggttgcagtgagcc

SEQ ID NO: 449190 - DNA, 20 bp, Artificial
  CRISPR gRNA sequence
tgtgccattgcactctatct

SEQ ID NO: 449191 - DNA, 20 bp, Artificial
  CRISPR gRNA sequence
gtgccattgcactctatctt

SEQ ID NO: 449192 - DNA, 20 bp, Artificial
  CRISPR gRNA sequence
tgcactctatcttgggcaac

SEQ ID NO: 449193 - DNA, 20 bp, Artificial
  CRISPR gRNA sequence
cactctatcttgggcaacta

SEQ ID NO: 449194 - DNA, 20 bp, Artificial
  CRISPR gRNA sequence
gtctcaaaaaaataaaaaac

SEQ ID NO: 449195 - DNA, 20 bp, Artificial
  CRISPR gRNA sequence
aaaaaaataaaaaacaagaa

SEQ ID NO: 449196 - DNA, 20 bp, Artificial
  CRISPR gRNA sequence
aataaaaaacaagaaaagaa

SEQ ID NO: 449197 - DNA, 20 bp, Artificial
  CRISPR gRNA sequence
aaaaacaagaaaagaaaaga

SEQ ID NO: 449198 - DNA, 20 bp, Artificial
  CRISPR gRNA sequence
agaaaagaaaagaaagaaat

SEQ ID NO: 449199 - DNA, 20 bp, Artificial
  CRISPR gRNA sequence
gaaaagaaaagaaagaaatt

SEQ ID NO: 449200 - DNA, 20 bp, Artificial
  CRISPR gRNA sequence
aggcctcctgattcccaatt

SEQ ID NO: 449201 - DNA, 20 bp, Artificial
  CRISPR gRNA sequence
ttcccaattcagaactctcc

SEQ ID NO: 449202 - DNA, 20 bp, Artificial
  CRISPR gRNA sequence
tcagaactctcccagaaatg

SEQ ID NO: 449203 - DNA, 20 bp, Artificial
  CRISPR gRNA sequence
tgtggctatatttctaaatt

SEQ ID NO: 449204 - DNA, 20 bp, Artificial
  CRISPR gRNA sequence
gtggctatatttctaaattc

SEQ ID NO: 449205 - DNA, 20 bp, Artificial
  CRISPR gRNA sequence
gctatatttctaaattcagg

SEQ ID NO: 449206 - DNA, 20 bp, Artificial
  CRISPR gRNA sequence
tctaaattcaggcagacaac

SEQ ID NO: 449207 - DNA, 20 bp, Artificial
  CRISPR gRNA sequence
attcaggcagacaacgagat

SEQ ID NO: 449208 - DNA, 20 bp, Artificial
  CRISPR gRNA sequence
ttcaggcagacaacgagatt

SEQ ID NO: 449209 - DNA, 20 bp, Artificial
  CRISPR gRNA sequence
cagacaacgagattaggttt

SEQ ID NO: 449210 - DNA, 20 bp, Artificial
  CRISPR gRNA sequence
agattaggtttgagataata

SEQ ID NO: 449211 - DNA, 20 bp, Artificial
  CRISPR gRNA sequence
gattaggtttgagataatat

SEQ ID NO: 449212 - DNA, 20 bp, Artificial
  CRISPR gRNA sequence
ataatatgggtgtctgtctt

SEQ ID NO: 449213 - DNA, 20 bp, Artificial
  CRISPR gRNA sequence
taatatgggtgtctgtctta

SEQ ID NO: 449214 - DNA, 20 bp, Artificial
  CRISPR gRNA sequence
atatgggtgtctgtcttaag

SEQ ID NO: 449215 - DNA, 20 bp, Artificial
  CRISPR gRNA sequence
tgtctgtcttaaggagcatt

SEQ ID NO: 449216 - DNA, 20 bp, Artificial
  CRISPR gRNA sequence
tgtcttaaggagcatttagt

SEQ ID NO: 449217 - DNA, 20 bp, Artificial
  CRISPR gRNA sequence
tcttaaggagcatttagttg

SEQ ID NO: 449218 - DNA, 20 bp, Artificial
  CRISPR gRNA sequence
cttaaggagcatttagttgg

SEQ ID NO: 449219 - DNA, 20 bp, Artificial
  CRISPR gRNA sequence
gagcatttagttggaggaaa

SEQ ID NO: 449220 - DNA, 20 bp, Artificial
  CRISPR gRNA sequence
aggaaacagaaaccaattca

SEQ ID NO: 449221 - DNA, 20 bp, Artificial
  CRISPR gRNA sequence
gaaaccaattcaaagtacca

SEQ ID NO: 449222 - DNA, 20 bp, Artificial
  CRISPR gRNA sequence
attcaaagtaccatagatta

SEQ ID NO: 449223 - DNA, 20 bp, Artificial
  CRISPR gRNA sequence
ttcaaagtaccatagattaa

SEQ ID NO: 449224 - DNA, 20 bp, Artificial
  CRISPR gRNA sequence
caaagtaccatagattaaag

SEQ ID NO: 449225 - DNA, 20 bp, Artificial
  CRISPR gRNA sequence
aaagtaccatagattaaagg

SEQ ID NO: 449226 - DNA, 20 bp, Artificial
  CRISPR gRNA sequence
taaaggaggaaaaaataaaa

SEQ ID NO: 449227 - DNA, 20 bp, Artificial
  CRISPR gRNA sequence
gaggaaaaaataaaaaagta

SEQ ID NO: 449228 - DNA, 20 bp, Artificial
  CRISPR gRNA sequence
aaaaaataaaaaagtacagc

SEQ ID NO: 449229 - DNA, 20 bp, Artificial
  CRISPR gRNA sequence
aaagtacagctggccctcat

SEQ ID NO: 449230 - DNA, 20 bp, Artificial
  CRISPR gRNA sequence
cagctggccctcatgagttc

SEQ ID NO: 449231 - DNA, 20 bp, Artificial
  CRISPR gRNA sequence
ccctcatgagttctagctcc

SEQ ID NO: 449232 - DNA, 20 bp, Artificial
  CRISPR gRNA sequence
tgagttctagctcctggaat

SEQ ID NO: 449233 - DNA, 20 bp, Artificial
  CRISPR gRNA sequence
tagctcctggaatcagaaac

SEQ ID NO: 449234 - DNA, 20 bp, Artificial
  CRISPR gRNA sequence
tcctggaatcagaaactaga

SEQ ID NO: 449235 - DNA, 20 bp, Artificial
  CRISPR gRNA sequence
cctggaatcagaaactagaa

SEQ ID NO: 449236 - DNA, 20 bp, Artificial
  CRISPR gRNA sequence
ctggaatcagaaactagaaa

SEQ ID NO: 449237 - DNA, 20 bp, Artificial
  CRISPR gRNA sequence
tggaatcagaaactagaaag

SEQ ID NO: 449238 - DNA, 20 bp, Artificial
  CRISPR gRNA sequence
atcagaaactagaaagggga

SEQ ID NO: 449239 - DNA, 20 bp, Artificial
  CRISPR gRNA sequence
tcagaaactagaaaggggac

SEQ ID NO: 449240 - DNA, 20 bp, Artificial
  CRISPR gRNA sequence
aaaggggacaggacgcaaaa

SEQ ID NO: 449241 - DNA, 20 bp, Artificial
  CRISPR gRNA sequence
cagttaccgtttcaaactgt

SEQ ID NO: 449242 - DNA, 20 bp, Artificial
  CRISPR gRNA sequence
agttaccgtttcaaactgtg

SEQ ID NO: 449243 - DNA, 20 bp, Artificial
  CRISPR gRNA sequence
taccgtttcaaactgtgagg

SEQ ID NO: 449244 - DNA, 20 bp, Artificial
  CRISPR gRNA sequence
gtttcaaactgtgaggcagc

SEQ ID NO: 449245 - DNA, 20 bp, Artificial
  CRISPR gRNA sequence
tttcaaactgtgaggcagca

SEQ ID NO: 449246 - DNA, 20 bp, Artificial
  CRISPR gRNA sequence
ctgtgaggcagcaaggcctc

SEQ ID NO: 449247 - DNA, 20 bp, Artificial
  CRISPR gRNA sequence
cccctgctccattactactt

SEQ ID NO: 449248 - DNA, 20 bp, Artificial
  CRISPR gRNA sequence
actttggcatatcctaaata

SEQ ID NO: 449249 - DNA, 20 bp, Artificial
  CRISPR gRNA sequence
tatcctaaatatggccactc

SEQ ID NO: 449250 - DNA, 20 bp, Artificial
  CRISPR gRNA sequence
aaatatggccactccagccc

SEQ ID NO: 449251 - DNA, 20 bp, Artificial
  CRISPR gRNA sequence
gccactccagccccagcttt

SEQ ID NO: 449252 - DNA, 20 bp, Artificial
  CRISPR gRNA sequence
actccagccccagctttaag

SEQ ID NO: 449253 - DNA, 20 bp, Artificial
  CRISPR gRNA sequence
cagctttaagtggcttcctt

SEQ ID NO: 449254 - DNA, 20 bp, Artificial
  CRISPR gRNA sequence
ttaagtcaaattgtgcccaa

SEQ ID NO: 449255 - DNA, 20 bp, Artificial
  CRISPR gRNA sequence
gtcaaattgtgcccaacaga

SEQ ID NO: 449256 - DNA, 20 bp, Artificial
  CRISPR gRNA sequence
tctctgtgtaactatattcc

SEQ ID NO: 449257 - DNA, 20 bp, Artificial
  CRISPR gRNA sequence
gtaactatattcctagacaa

SEQ ID NO: 449258 - DNA, 20 bp, Artificial
  CRISPR gRNA sequence
aactatattcctagacaata

SEQ ID NO: 449259 - DNA, 20 bp, Artificial
  CRISPR gRNA sequence
atattcctagacaatagagc

SEQ ID NO: 449260 - DNA, 20 bp, Artificial
  CRISPR gRNA sequence
agcaagccttcaaaattctg

SEQ ID NO: 449261 - DNA, 20 bp, Artificial
  CRISPR gRNA sequence
gcaagccttcaaaattctgt

SEQ ID NO: 449262 - DNA, 20 bp, Artificial
  CRISPR gRNA sequence
tgggaaaaaaaaaatttacc

SEQ ID NO: 449263 - DNA, 20 bp, Artificial
  CRISPR gRNA sequence
tttacctagaattatatatt

SEQ ID NO: 449264 - DNA, 20 bp, Artificial
  CRISPR gRNA sequence
ccaaactataaaccaaatgt

SEQ ID NO: 449265 - DNA, 20 bp, Artificial
  CRISPR gRNA sequence
caaactataaaccaaatgta

SEQ ID NO: 449266 - DNA, 20 bp, Artificial
  CRISPR gRNA sequence
ctataaaccaaatgtaagga

SEQ ID NO: 449267 - DNA, 20 bp, Artificial
  CRISPR gRNA sequence
ccaaatgtaaggaaagaaaa

SEQ ID NO: 449268 - DNA, 20 bp, Artificial
  CRISPR gRNA sequence
aagaaaaaagacactatcat

SEQ ID NO: 449269 - DNA, 20 bp, Artificial
  CRISPR gRNA sequence
ccttccatgtgatcttttca

SEQ ID NO: 449270 - DNA, 20 bp, Artificial
  CRISPR gRNA sequence
tccatgtgatcttttcaaag

SEQ ID NO: 449271 - DNA, 20 bp, Artificial
  CRISPR gRNA sequence
gatcttttcaaagaagctac

SEQ ID NO: 449272 - DNA, 20 bp, Artificial
  CRISPR gRNA sequence
tcttttcaaagaagctacca

SEQ ID NO: 449273 - DNA, 20 bp, Artificial
  CRISPR gRNA sequence
cttttcaaagaagctaccag

SEQ ID NO: 449274 - DNA, 20 bp, Artificial
  CRISPR gRNA sequence
agctaccagaggatgtgctt

SEQ ID NO: 449275 - DNA, 20 bp, Artificial
  CRISPR gRNA sequence
aggatgtgcttcagtaaaac

SEQ ID NO: 449276 - DNA, 20 bp, Artificial
  CRISPR gRNA sequence
tgtgcttcagtaaaacaaga

SEQ ID NO: 449277 - DNA, 20 bp, Artificial
  CRISPR gRNA sequence
aacaagaaagtgaatccata

SEQ ID NO: 449278 - DNA, 20 bp, Artificial
  CRISPR gRNA sequence
acaagaaagtgaatccataa

SEQ ID NO: 449279 - DNA, 20 bp, Artificial
  CRISPR gRNA sequence
caagaaagtgaatccataaa

SEQ ID NO: 449280 - DNA, 20 bp, Artificial
  CRISPR gRNA sequence
aagaaagtgaatccataaag

SEQ ID NO: 449281 - DNA, 20 bp, Artificial
  CRISPR gRNA sequence
aaaggggataaaatgacata

SEQ ID NO: 449282 - DNA, 20 bp, Artificial
  CRISPR gRNA sequence
aaggggataaaatgacatac

SEQ ID NO: 449283 - DNA, 20 bp, Artificial
  CRISPR gRNA sequence
taaaatgacatacaggaaac

SEQ ID NO: 449284 - DNA, 20 bp, Artificial
  CRISPR gRNA sequence
aaaatgacatacaggaaaca

SEQ ID NO: 449285 - DNA, 20 bp, Artificial
  CRISPR gRNA sequence
aatgacatacaggaaacaag

SEQ ID NO: 449286 - DNA, 20 bp, Artificial
  CRISPR gRNA sequence
caggaaacaaggagtctaac

SEQ ID NO: 449287 - DNA, 20 bp, Artificial
  CRISPR gRNA sequence
aggaaacaaggagtctaaca

SEQ ID NO: 449288 - DNA, 20 bp, Artificial
  CRISPR gRNA sequence
aaacaaggagtctaacaagg

SEQ ID NO: 449289 - DNA, 20 bp, Artificial
  CRISPR gRNA sequence
ggagtctaacaaggaagttc

SEQ ID NO: 449290 - DNA, 20 bp, Artificial
  CRISPR gRNA sequence
gagtctaacaaggaagttct

SEQ ID NO: 449291 - DNA, 20 bp, Artificial
  CRISPR gRNA sequence
ctaacaaggaagttctaggc

SEQ ID NO: 449292 - DNA, 20 bp, Artificial
  CRISPR gRNA sequence
aggaagttctaggctggaca

SEQ ID NO: 449293 - DNA, 20 bp, Artificial
  CRISPR gRNA sequence
aagttctaggctggacacag

SEQ ID NO: 449294 - DNA, 20 bp, Artificial
  CRISPR gRNA sequence
ctggacacagtggctcatgc

SEQ ID NO: 449295 - DNA, 20 bp, Artificial
  CRISPR gRNA sequence
gtggctcatgccagcacttt

SEQ ID NO: 449296 - DNA, 20 bp, Artificial
  CRISPR gRNA sequence
ggctcatgccagcacttttg

SEQ ID NO: 449297 - DNA, 20 bp, Artificial
  CRISPR gRNA sequence
gctcatgccagcacttttgg

SEQ ID NO: 449298 - DNA, 20 bp, Artificial
  CRISPR gRNA sequence
tgccagcacttttggaggcc

SEQ ID NO: 449299 - DNA, 20 bp, Artificial
  CRISPR gRNA sequence
gccagcacttttggaggcca

SEQ ID NO: 449300 - DNA, 20 bp, Artificial
  CRISPR gRNA sequence
agcacttttggaggccaagg

SEQ ID NO: 449301 - DNA, 20 bp, Artificial
  CRISPR gRNA sequence
gcacttttggaggccaaggt

SEQ ID NO: 449302 - DNA, 20 bp, Artificial
  CRISPR gRNA sequence
acttttggaggccaaggtgg

SEQ ID NO: 449303 - DNA, 20 bp, Artificial
  CRISPR gRNA sequence
cttttggaggccaaggtggg

SEQ ID NO: 449304 - DNA, 20 bp, Artificial
  CRISPR gRNA sequence
ccaaggtgggaggatcactt

SEQ ID NO: 449305 - DNA, 20 bp, Artificial
  CRISPR gRNA sequence
gtgggaggatcacttgagcc

SEQ ID NO: 449306 - DNA, 20 bp, Artificial
  CRISPR gRNA sequence
tgggaggatcacttgagccc

SEQ ID NO: 449307 - DNA, 20 bp, Artificial
  CRISPR gRNA sequence
ggaggatcacttgagcccag

SEQ ID NO: 449308 - DNA, 20 bp, Artificial
  CRISPR gRNA sequence
gatcacttgagcccaggagt

SEQ ID NO: 449309 - DNA, 20 bp, Artificial
  CRISPR gRNA sequence
tcacttgagcccaggagtta

SEQ ID NO: 449310 - DNA, 20 bp, Artificial
  CRISPR gRNA sequence
tgagcccaggagttagagat

SEQ ID NO: 449311 - DNA, 20 bp, Artificial
  CRISPR gRNA sequence
ccaggagttagagataagcc

SEQ ID NO: 449312 - DNA, 20 bp, Artificial
  CRISPR gRNA sequence
caggagttagagataagcct

SEQ ID NO: 449313 - DNA, 20 bp, Artificial
  CRISPR gRNA sequence
agagataagcctgggcaaca

SEQ ID NO: 449314 - DNA, 20 bp, Artificial
  CRISPR gRNA sequence
gagataagcctgggcaacac

SEQ ID NO: 449315 - DNA, 20 bp, Artificial
  CRISPR gRNA sequence
agataagcctgggcaacaca

SEQ ID NO: 449316 - DNA, 20 bp, Artificial
  CRISPR gRNA sequence
ataagcctgggcaacacagg

SEQ ID NO: 449317 - DNA, 20 bp, Artificial
  CRISPR gRNA sequence
acacagggagacaccatctc

SEQ ID NO: 449318 - DNA, 20 bp, Artificial
  CRISPR gRNA sequence
cagggagacaccatctctag

SEQ ID NO: 449319 - DNA, 20 bp, Artificial
  CRISPR gRNA sequence
agacaccatctctagtggaa

SEQ ID NO: 449320 - DNA, 20 bp, Artificial
  CRISPR gRNA sequence
ctagtggaaaagaaaaaaaa

SEQ ID NO: 449321 - DNA, 20 bp, Artificial
  CRISPR gRNA sequence
tagtggaaaagaaaaaaaaa

SEQ ID NO: 449322 - DNA, 20 bp, Artificial
  CRISPR gRNA sequence
agaaaaaaaaaaggaaattc

SEQ ID NO: 449323 - DNA, 20 bp, Artificial
  CRISPR gRNA sequence
aggaaattcaagaattaaaa

SEQ ID NO: 449324 - DNA, 20 bp, Artificial
  CRISPR gRNA sequence
ggaaattcaagaattaaaaa

SEQ ID NO: 449325 - DNA, 20 bp, Artificial
  CRISPR gRNA sequence
gaaattcaagaattaaaaaa

SEQ ID NO: 449326 - DNA, 20 bp, Artificial
  CRISPR gRNA sequence
attcaagaattaaaaaaggg

SEQ ID NO: 449327 - DNA, 20 bp, Artificial
  CRISPR gRNA sequence
aagaattaaaaaagggcagt

SEQ ID NO: 449328 - DNA, 20 bp, Artificial
  CRISPR gRNA sequence
ttaaaaaagggcagttagtc

SEQ ID NO: 449329 - DNA, 20 bp, Artificial
  CRISPR gRNA sequence
aaaaagggcagttagtccag

SEQ ID NO: 449330 - DNA, 20 bp, Artificial
  CRISPR gRNA sequence
aaagggcagttagtccagaa

SEQ ID NO: 449331 - DNA, 20 bp, Artificial
  CRISPR gRNA sequence
agggcagttagtccagaaga

SEQ ID NO: 449332 - DNA, 20 bp, Artificial
  CRISPR gRNA sequence
cagttagtccagaagagagc

SEQ ID NO: 449333 - DNA, 20 bp, Artificial
  CRISPR gRNA sequence
gttagtccagaagagagcaa

SEQ ID NO: 449334 - DNA, 20 bp, Artificial
  CRISPR gRNA sequence
gtccagaagagagcaagaga

SEQ ID NO: 449335 - DNA, 20 bp, Artificial
  CRISPR gRNA sequence
gagcaagagaaagacgactc

SEQ ID NO: 449336 - DNA, 20 bp, Artificial
  CRISPR gRNA sequence
caagagaaagacgactctgg

SEQ ID NO: 449337 - DNA, 20 bp, Artificial
  CRISPR gRNA sequence
aagagaaagacgactctgga

SEQ ID NO: 449338 - DNA, 20 bp, Artificial
  CRISPR gRNA sequence
agagaaagacgactctggaa

SEQ ID NO: 449339 - DNA, 20 bp, Artificial
  CRISPR gRNA sequence
agaaagacgactctggaagg

SEQ ID NO: 449340 - DNA, 20 bp, Artificial
  CRISPR gRNA sequence
gactctggaagggagatctc

SEQ ID NO: 449341 - DNA, 20 bp, Artificial
  CRISPR gRNA sequence
actctggaagggagatctct

SEQ ID NO: 449342 - DNA, 20 bp, Artificial
  CRISPR gRNA sequence
tctggaagggagatctctag

SEQ ID NO: 449343 - DNA, 20 bp, Artificial
  CRISPR gRNA sequence
ctggaagggagatctctagg

SEQ ID NO: 449344 - DNA, 20 bp, Artificial
  CRISPR gRNA sequence
agatctctaggaggtaaaaa

SEQ ID NO: 449345 - DNA, 20 bp, Artificial
  CRISPR gRNA sequence
atcgacatatcatctttcta

SEQ ID NO: 449346 - DNA, 20 bp, Artificial
  CRISPR gRNA sequence
tcgacatatcatctttctaa

SEQ ID NO: 449347 - DNA, 20 bp, Artificial
  CRISPR gRNA sequence
atctttctaaaggcccatta

SEQ ID NO: 449348 - DNA, 20 bp, Artificial
  CRISPR gRNA sequence
cccattaaagacccaataaa

SEQ ID NO: 449349 - DNA, 20 bp, Artificial
  CRISPR gRNA sequence
aagacccaataaaaagatta

SEQ ID NO: 449350 - DNA, 20 bp, Artificial
  CRISPR gRNA sequence
caataaaaagattaaagaaa

SEQ ID NO: 449351 - DNA, 20 bp, Artificial
  CRISPR gRNA sequence
aaagattaaagaaatggata

SEQ ID NO: 449352 - DNA, 20 bp, Artificial
  CRISPR gRNA sequence
atggatatggaaaactctgc

SEQ ID NO: 449353 - DNA, 20 bp, Artificial
  CRISPR gRNA sequence
tgccagtaaaaaaataaaat

SEQ ID NO: 449354 - DNA, 20 bp, Artificial
  CRISPR gRNA sequence
gccagtaaaaaaataaaatc

SEQ ID NO: 449355 - DNA, 20 bp, Artificial
  CRISPR gRNA sequence
aaaaaaataaaatcaggctc

SEQ ID NO: 449356 - DNA, 20 bp, Artificial
  CRISPR gRNA sequence
gaaaaaactaaattttacaa

SEQ ID NO: 449357 - DNA, 20 bp, Artificial
  CRISPR gRNA sequence
taaattttacaaaagaaaca

SEQ ID NO: 449358 - DNA, 20 bp, Artificial
  CRISPR gRNA sequence
tgattttgcaaaaaataaca

SEQ ID NO: 449359 - DNA, 20 bp, Artificial
  CRISPR gRNA sequence
actaatttaaataaaatttg

SEQ ID NO: 449360 - DNA, 20 bp, Artificial
  CRISPR gRNA sequence
atttgtggtacaattatttt

SEQ ID NO: 449361 - DNA, 20 bp, Artificial
  CRISPR gRNA sequence
tgtggtacaattatttttag

SEQ ID NO: 449362 - DNA, 20 bp, Artificial
  CRISPR gRNA sequence
caattatttttagaagaatg

SEQ ID NO: 449363 - DNA, 20 bp, Artificial
  CRISPR gRNA sequence
attatttttagaagaatgca

SEQ ID NO: 449364 - DNA, 20 bp, Artificial
  CRISPR gRNA sequence
atttttagaagaatgcagag

SEQ ID NO: 449365 - DNA, 20 bp, Artificial
  CRISPR gRNA sequence
tttttagaagaatgcagaga

SEQ ID NO: 449366 - DNA, 20 bp, Artificial
  CRISPR gRNA sequence
aagaatgcagagaaggaaaa

SEQ ID NO: 449367 - DNA, 20 bp, Artificial
  CRISPR gRNA sequence
agaatgcagagaaggaaaat

SEQ ID NO: 449368 - DNA, 20 bp, Artificial
  CRISPR gRNA sequence
cagagaaggaaaatgggtga

SEQ ID NO: 449369 - DNA, 20 bp, Artificial
  CRISPR gRNA sequence
aatcctcatctactatattc

SEQ ID NO: 449370 - DNA, 20 bp, Artificial
  CRISPR gRNA sequence
tagcacatcttcatctactg

SEQ ID NO: 449371 - DNA, 20 bp, Artificial
  CRISPR gRNA sequence
cacatcttcatctactgtag

SEQ ID NO: 449372 - DNA, 20 bp, Artificial
  CRISPR gRNA sequence
tcttcatctactgtagcaga

SEQ ID NO: 449373 - DNA, 20 bp, Artificial
  CRISPR gRNA sequence
ctactgtagcagaaagccaa

SEQ ID NO: 449374 - DNA, 20 bp, Artificial
  CRISPR gRNA sequence
aaatgtctaaattttatcac

SEQ ID NO: 449375 - DNA, 20 bp, Artificial
  CRISPR gRNA sequence
aatgtctaaattttatcact

SEQ ID NO: 449376 - DNA, 20 bp, Artificial
  CRISPR gRNA sequence
gtctaaattttatcactagg

SEQ ID NO: 449377 - DNA, 20 bp, Artificial
  CRISPR gRNA sequence
taaattttatcactaggaag

SEQ ID NO: 449378 - DNA, 20 bp, Artificial
  CRISPR gRNA sequence
tcactaggaagcagcaatat

SEQ ID NO: 449379 - DNA, 20 bp, Artificial
  CRISPR gRNA sequence
agcaatatgagcatattatt

SEQ ID NO: 449380 - DNA, 20 bp, Artificial
  CRISPR gRNA sequence
gcaatatgagcatattattt

SEQ ID NO: 449381 - DNA, 20 bp, Artificial
  CRISPR gRNA sequence
atattatttaggaatataat

SEQ ID NO: 449382 - DNA, 20 bp, Artificial
  CRISPR gRNA sequence
gaatataataagacatctcg

SEQ ID NO: 449383 - DNA, 20 bp, Artificial
  CRISPR gRNA sequence
atataataagacatctcgaa

SEQ ID NO: 449384 - DNA, 20 bp, Artificial
  CRISPR gRNA sequence
aagacatctcgaagagttga

SEQ ID NO: 449385 - DNA, 20 bp, Artificial
  CRISPR gRNA sequence
acatctcgaagagttgacag

SEQ ID NO: 449386 - DNA, 20 bp, Artificial
  CRISPR gRNA sequence
agagttgacagtggttgtct

SEQ ID NO: 449387 - DNA, 20 bp, Artificial
  CRISPR gRNA sequence
cagtggttgtctcagacaat

SEQ ID NO: 449388 - DNA, 20 bp, Artificial
  CRISPR gRNA sequence
gttgtctcagacaataagcc

SEQ ID NO: 449389 - DNA, 20 bp, Artificial
  CRISPR gRNA sequence
ttgtctcagacaataagcct

SEQ ID NO: 449390 - DNA, 20 bp, Artificial
  CRISPR gRNA sequence
gtctcagacaataagcctag

SEQ ID NO: 449391 - DNA, 20 bp, Artificial
  CRISPR gRNA sequence
tctcagacaataagcctagg

SEQ ID NO: 449392 - DNA, 20 bp, Artificial
  CRISPR gRNA sequence
caataagcctaggaggacaa

SEQ ID NO: 449393 - DNA, 20 bp, Artificial
  CRISPR gRNA sequence
aataagcctaggaggacaaa

SEQ ID NO: 449394 - DNA, 20 bp, Artificial
  CRISPR gRNA sequence
ataagcctaggaggacaaaa

SEQ ID NO: 449395 - DNA, 20 bp, Artificial
  CRISPR gRNA sequence
ttctttttctttgatttttt

SEQ ID NO: 449396 - DNA, 20 bp, Artificial
  CRISPR gRNA sequence
ttttctttgattttttgaga

SEQ ID NO: 449397 - DNA, 20 bp, Artificial
  CRISPR gRNA sequence
tgagacagactctcactctg

SEQ ID NO: 449398 - DNA, 20 bp, Artificial
  CRISPR gRNA sequence
cagactctcactctgtggtc

SEQ ID NO: 449399 - DNA, 20 bp, Artificial
  CRISPR gRNA sequence
agactctcactctgtggtcc

SEQ ID NO: 449400 - DNA, 20 bp, Artificial
  CRISPR gRNA sequence
tctcactctgtggtccgggc

SEQ ID NO: 449401 - DNA, 20 bp, Artificial
  CRISPR gRNA sequence
tcactctgtggtccgggctg

SEQ ID NO: 449402 - DNA, 20 bp, Artificial
  CRISPR gRNA sequence
actctgtggtccgggctgga

SEQ ID NO: 449403 - DNA, 20 bp, Artificial
  CRISPR gRNA sequence
ctgtggtccgggctggagag

SEQ ID NO: 449404 - DNA, 20 bp, Artificial
  CRISPR gRNA sequence
tggtccgggctggagagcag

SEQ ID NO: 449405 - DNA, 20 bp, Artificial
  CRISPR gRNA sequence
tcactgcaacctccacctcc

SEQ ID NO: 449406 - DNA, 20 bp, Artificial
  CRISPR gRNA sequence
cactgcaacctccacctcca

SEQ ID NO: 449407 - DNA, 20 bp, Artificial
  CRISPR gRNA sequence
aacctccacctccaaggttc

SEQ ID NO: 449408 - DNA, 20 bp, Artificial
  CRISPR gRNA sequence
ttcaagtgattctcctgcct

SEQ ID NO: 449409 - DNA, 20 bp, Artificial
  CRISPR gRNA sequence
tcctgcctcagccgcccaaa

SEQ ID NO: 449410 - DNA, 20 bp, Artificial
  CRISPR gRNA sequence
gcctcagccgcccaaatagc

SEQ ID NO: 449411 - DNA, 20 bp, Artificial
  CRISPR gRNA sequence
cctcagccgcccaaatagct

SEQ ID NO: 449412 - DNA, 20 bp, Artificial
  CRISPR gRNA sequence
cgcccaaatagctgggacta

SEQ ID NO: 449413 - DNA, 20 bp, Artificial
  CRISPR gRNA sequence
gcccaaatagctgggactac

SEQ ID NO: 449414 - DNA, 20 bp, Artificial
  CRISPR gRNA sequence
actaattttttttgtatttt

SEQ ID NO: 449415 - DNA, 20 bp, Artificial
  CRISPR gRNA sequence
ttttttttgtatttttagtt

SEQ ID NO: 449416 - DNA, 20 bp, Artificial
  CRISPR gRNA sequence
ttttgtatttttagttgaga

SEQ ID NO: 449417 - DNA, 20 bp, Artificial
  CRISPR gRNA sequence
tttgtatttttagttgagac

SEQ ID NO: 449418 - DNA, 20 bp, Artificial
  CRISPR gRNA sequence
ttgtatttttagttgagacg

SEQ ID NO: 449419 - DNA, 20 bp, Artificial
  CRISPR gRNA sequence
gagacggggttttgccatga

SEQ ID NO: 449420 - DNA, 20 bp, Artificial
  CRISPR gRNA sequence
cggggttttgccatgacggc

SEQ ID NO: 449421 - DNA, 20 bp, Artificial
  CRISPR gRNA sequence
ggggttttgccatgacggcc

SEQ ID NO: 449422 - DNA, 20 bp, Artificial
  CRISPR gRNA sequence
ttttgccatgacggccaggc

SEQ ID NO: 449423 - DNA, 20 bp, Artificial
  CRISPR gRNA sequence
tggtctcaaactcctgacct

SEQ ID NO: 449424 - DNA, 20 bp, Artificial
  CRISPR gRNA sequence
ggtctcaaactcctgacctc

SEQ ID NO: 449425 - DNA, 20 bp, Artificial
  CRISPR gRNA sequence
ctcaggtgatctatccgcct

SEQ ID NO: 449426 - DNA, 20 bp, Artificial
  CRISPR gRNA sequence
gtgatctatccgcctcagcc

SEQ ID NO: 449427 - DNA, 20 bp, Artificial
  CRISPR gRNA sequence
tatccgcctcagcctagcca

SEQ ID NO: 449428 - DNA, 20 bp, Artificial
  CRISPR gRNA sequence
cctcagcctagccaaagtgc

SEQ ID NO: 449429 - DNA, 20 bp, Artificial
  CRISPR gRNA sequence
ctcagcctagccaaagtgct

SEQ ID NO: 449430 - DNA, 20 bp, Artificial
  CRISPR gRNA sequence
tagccaaagtgctgggatta

SEQ ID NO: 449431 - DNA, 20 bp, Artificial
  CRISPR gRNA sequence
agccaaagtgctgggattac

SEQ ID NO: 449432 - DNA, 20 bp, Artificial
  CRISPR gRNA sequence
agtgctgggattacaggtgt

SEQ ID NO: 449433 - DNA, 20 bp, Artificial
  CRISPR gRNA sequence
caggtgtgagccaccgtgcc

SEQ ID NO: 449434 - DNA, 20 bp, Artificial
  CRISPR gRNA sequence
cctggcctatcttacttttt

SEQ ID NO: 449435 - DNA, 20 bp, Artificial
  CRISPR gRNA sequence
tcttactttttaagaaaaac

SEQ ID NO: 449436 - DNA, 20 bp, Artificial
  CRISPR gRNA sequence
accctccccccatgaaaaac

SEQ ID NO: 449437 - DNA, 20 bp, Artificial
  CRISPR gRNA sequence
ccccccatgaaaaactggcc

SEQ ID NO: 449438 - DNA, 20 bp, Artificial
  CRISPR gRNA sequence
ccccatgaaaaactggccca

SEQ ID NO: 449439 - DNA, 20 bp, Artificial
  CRISPR gRNA sequence
atgtttctaatcacctccta

SEQ ID NO: 449440 - DNA, 20 bp, Artificial
  CRISPR gRNA sequence
taatcacctcctatggttcc

SEQ ID NO: 449441 - DNA, 20 bp, Artificial
  CRISPR gRNA sequence
attcaaattttcaacttgtt

SEQ ID NO: 449442 - DNA, 20 bp, Artificial
  CRISPR gRNA sequence
tgactttgttccttgcttcc

SEQ ID NO: 449443 - DNA, 20 bp, Artificial
  CRISPR gRNA sequence
tggtgtcttcctgtctgacc

SEQ ID NO: 449444 - DNA, 20 bp, Artificial
  CRISPR gRNA sequence
cttcctgtctgacctagcta

SEQ ID NO: 449445 - DNA, 20 bp, Artificial
  CRISPR gRNA sequence
tctgacctagctatagcatt

SEQ ID NO: 449446 - DNA, 20 bp, Artificial
  CRISPR gRNA sequence
cttcatcaaactgtcatctc

SEQ ID NO: 449447 - DNA, 20 bp, Artificial
  CRISPR gRNA sequence
catcaaactgtcatctccag

SEQ ID NO: 449448 - DNA, 20 bp, Artificial
  CRISPR gRNA sequence
cttctgtgactgtactcccc

SEQ ID NO: 449449 - DNA, 20 bp, Artificial
  CRISPR gRNA sequence
ccctggctgttctacccacc

SEQ ID NO: 449450 - DNA, 20 bp, Artificial
  CRISPR gRNA sequence
tcctcccacctctcaaacat

SEQ ID NO: 449451 - DNA, 20 bp, Artificial
  CRISPR gRNA sequence
ctcaaacatgagtattcccc

SEQ ID NO: 449452 - DNA, 20 bp, Artificial
  CRISPR gRNA sequence
ttctctttactctctctccc

SEQ ID NO: 449453 - DNA, 20 bp, Artificial
  CRISPR gRNA sequence
catctacccacgatttaaac

SEQ ID NO: 449454 - DNA, 20 bp, Artificial
  CRISPR gRNA sequence
agcatctccctgcaactgac

SEQ ID NO: 449455 - DNA, 20 bp, Artificial
  CRISPR gRNA sequence
gaccagcaaatcaacttctc

SEQ ID NO: 449456 - DNA, 20 bp, Artificial
  CRISPR gRNA sequence
ccagcttgaacacctttcct

SEQ ID NO: 449457 - DNA, 20 bp, Artificial
  CRISPR gRNA sequence
taaactaaaaactgtactcc

SEQ ID NO: 449458 - DNA, 20 bp, Artificial
  CRISPR gRNA sequence
aaaactgtactcctagctcc

SEQ ID NO: 449459 - DNA, 20 bp, Artificial
  CRISPR gRNA sequence
tcccaccatttcctcaaact

SEQ ID NO: 449460 - DNA, 20 bp, Artificial
  CRISPR gRNA sequence
tttcctcaaactcagtatca

SEQ ID NO: 449461 - DNA, 20 bp, Artificial
  CRISPR gRNA sequence
agtatcaaagctatcctcct

SEQ ID NO: 449462 - DNA, 20 bp, Artificial
  CRISPR gRNA sequence
gaccctatttctgttcatga

SEQ ID NO: 449463 - DNA, 20 bp, Artificial
  CRISPR gRNA sequence
ccctatttctgttcatgacg

SEQ ID NO: 449464 - DNA, 20 bp, Artificial
  CRISPR gRNA sequence
gttcatgacggagtcaactt

SEQ ID NO: 449465 - DNA, 20 bp, Artificial
  CRISPR gRNA sequence
ttttttcttaacccccaatt

SEQ ID NO: 449466 - DNA, 20 bp, Artificial
  CRISPR gRNA sequence
ttttcttaacccccaattca

SEQ ID NO: 449467 - DNA, 20 bp, Artificial
  CRISPR gRNA sequence
ttcttaacccccaattcaga

SEQ ID NO: 449468 - DNA, 20 bp, Artificial
  CRISPR gRNA sequence
ccccaattcagagagttact

SEQ ID NO: 449469 - DNA, 20 bp, Artificial
  CRISPR gRNA sequence
agtactgctgttcttccgca

SEQ ID NO: 449470 - DNA, 20 bp, Artificial
  CRISPR gRNA sequence
actgctgttcttccgcacag

SEQ ID NO: 449471 - DNA, 20 bp, Artificial
  CRISPR gRNA sequence
ttcttccgcacagcagtact

SEQ ID NO: 449472 - DNA, 20 bp, Artificial
  CRISPR gRNA sequence
ttccgcacagcagtacttag

SEQ ID NO: 449473 - DNA, 20 bp, Artificial
  CRISPR gRNA sequence
tccgcacagcagtacttagt

SEQ ID NO: 449474 - DNA, 20 bp, Artificial
  CRISPR gRNA sequence
ccgcacagcagtacttagtg

SEQ ID NO: 449475 - DNA, 20 bp, Artificial
  CRISPR gRNA sequence
cacagcagtacttagtgggg

SEQ ID NO: 449476 - DNA, 20 bp, Artificial
  CRISPR gRNA sequence
cagtacttagtggggaagaa

SEQ ID NO: 449477 - DNA, 20 bp, Artificial
  CRISPR gRNA sequence
tacttagtggggaagaatag

SEQ ID NO: 449478 - DNA, 20 bp, Artificial
  CRISPR gRNA sequence
ttgttattcctttccttcca

SEQ ID NO: 449479 - DNA, 20 bp, Artificial
  CRISPR gRNA sequence
tgttattcctttccttccaa

SEQ ID NO: 449480 - DNA, 20 bp, Artificial
  CRISPR gRNA sequence
ttccttccaaaggtgttttt

SEQ ID NO: 449481 - DNA, 20 bp, Artificial
  CRISPR gRNA sequence
tccttccaaaggtgtttttc

SEQ ID NO: 449482 - DNA, 20 bp, Artificial
  CRISPR gRNA sequence
tcacacttaacatattccta

SEQ ID NO: 449483 - DNA, 20 bp, Artificial
  CRISPR gRNA sequence
tattcctatagtctcctaac

SEQ ID NO: 449484 - DNA, 20 bp, Artificial
  CRISPR gRNA sequence
cctatagtctcctaactagt

SEQ ID NO: 449485 - DNA, 20 bp, Artificial
  CRISPR gRNA sequence
tcctaactagtgagtccctt

SEQ ID NO: 449486 - DNA, 20 bp, Artificial
  CRISPR gRNA sequence
actagtgagtcccttgagtt

SEQ ID NO: 449487 - DNA, 20 bp, Artificial
  CRISPR gRNA sequence
tgagttcagcaactgtgccc

SEQ ID NO: 449488 - DNA, 20 bp, Artificial
  CRISPR gRNA sequence
tgtatctcccacacctacca

SEQ ID NO: 449489 - DNA, 20 bp, Artificial
  CRISPR gRNA sequence
gtatctcccacacctaccac

SEQ ID NO: 449490 - DNA, 20 bp, Artificial
  CRISPR gRNA sequence
tatctcccacacctaccaca

SEQ ID NO: 449491 - DNA, 20 bp, Artificial
  CRISPR gRNA sequence
cccacacctaccacagggcc

SEQ ID NO: 449492 - DNA, 20 bp, Artificial
  CRISPR gRNA sequence
ctaccacagggcctagcact

SEQ ID NO: 449493 - DNA, 20 bp, Artificial
  CRISPR gRNA sequence
agcactgagctgttgcctaa

SEQ ID NO: 449494 - DNA, 20 bp, Artificial
  CRISPR gRNA sequence
tgagctgttgcctaatggtc

SEQ ID NO: 449495 - DNA, 20 bp, Artificial
  CRISPR gRNA sequence
tccattctacatactaccac

SEQ ID NO: 449496 - DNA, 20 bp, Artificial
  CRISPR gRNA sequence
tgtacatgccacatcactca

SEQ ID NO: 449497 - DNA, 20 bp, Artificial
  CRISPR gRNA sequence
cacatcactcaaagttttaa

SEQ ID NO: 449498 - DNA, 20 bp, Artificial
  CRISPR gRNA sequence
taatggcttctcactgtcta

SEQ ID NO: 449499 - DNA, 20 bp, Artificial
  CRISPR gRNA sequence
ttctcactgtctatggaata

SEQ ID NO: 449500 - DNA, 20 bp, Artificial
  CRISPR gRNA sequence
gaataaagtctaaattacat

SEQ ID NO: 449501 - DNA, 20 bp, Artificial
  CRISPR gRNA sequence
aagtctaaattacattagcc

SEQ ID NO: 449502 - DNA, 20 bp, Artificial
  CRISPR gRNA sequence
aaattacattagcctggcac

SEQ ID NO: 449503 - DNA, 20 bp, Artificial
  CRISPR gRNA sequence
attacattagcctggcacta

SEQ ID NO: 449504 - DNA, 20 bp, Artificial
  CRISPR gRNA sequence
gcctggcactagagactcta

SEQ ID NO: 449505 - DNA, 20 bp, Artificial
  CRISPR gRNA sequence
tttatgtgaatacattgctt

SEQ ID NO: 449506 - DNA, 20 bp, Artificial
  CRISPR gRNA sequence
ttgcttcagttaaactgcac

SEQ ID NO: 449507 - DNA, 20 bp, Artificial
  CRISPR gRNA sequence
cttcagttaaactgcactag

SEQ ID NO: 449508 - DNA, 20 bp, Artificial
  CRISPR gRNA sequence
caaatatgtattgtgcatcc

SEQ ID NO: 449509 - DNA, 20 bp, Artificial
  CRISPR gRNA sequence
aaatatgtattgtgcatccc

SEQ ID NO: 449510 - DNA, 20 bp, Artificial
  CRISPR gRNA sequence
tgtattgtgcatcccaggcc

SEQ ID NO: 449511 - DNA, 20 bp, Artificial
  CRISPR gRNA sequence
ccaggcccagcgctatgcct

SEQ ID NO: 449512 - DNA, 20 bp, Artificial
  CRISPR gRNA sequence
aggcccagcgctatgccttg

SEQ ID NO: 449513 - DNA, 20 bp, Artificial
  CRISPR gRNA sequence
cagcgctatgccttggagaa

SEQ ID NO: 449514 - DNA, 20 bp, Artificial
  CRISPR gRNA sequence
tatgccttggagaacagaat

SEQ ID NO: 449515 - DNA, 20 bp, Artificial
  CRISPR gRNA sequence
atgccttggagaacagaatg

SEQ ID NO: 449516 - DNA, 20 bp, Artificial
  CRISPR gRNA sequence
gaacagaatgaggtataaca

SEQ ID NO: 449517 - DNA, 20 bp, Artificial
  CRISPR gRNA sequence
gttctcctaatatattgttt

SEQ ID NO: 449518 - DNA, 20 bp, Artificial
  CRISPR gRNA sequence
aatatattgttttagttgtg

SEQ ID NO: 449519 - DNA, 20 bp, Artificial
  CRISPR gRNA sequence
tagttgtgaagattctccct

SEQ ID NO: 449520 - DNA, 20 bp, Artificial
  CRISPR gRNA sequence
agttgtgaagattctcccta

SEQ ID NO: 449521 - DNA, 20 bp, Artificial
  CRISPR gRNA sequence
tgtgaagattctccctaagg

SEQ ID NO: 449522 - DNA, 20 bp, Artificial
  CRISPR gRNA sequence
gaatgcttttctcatcttct

SEQ ID NO: 449523 - DNA, 20 bp, Artificial
  CRISPR gRNA sequence
ctcatcttctcagcatattt

SEQ ID NO: 449524 - DNA, 20 bp, Artificial
  CRISPR gRNA sequence
ttctcagcatatttaagtat

SEQ ID NO: 449525 - DNA, 20 bp, Artificial
  CRISPR gRNA sequence
ctcagcatatttaagtatta

SEQ ID NO: 449526 - DNA, 20 bp, Artificial
  CRISPR gRNA sequence
gcatatttaagtattagagt

SEQ ID NO: 449527 - DNA, 20 bp, Artificial
  CRISPR gRNA sequence
agtattagagtcagcacatc

SEQ ID NO: 449528 - DNA, 20 bp, Artificial
  CRISPR gRNA sequence
ttagagtcagcacatctaga

SEQ ID NO: 449529 - DNA, 20 bp, Artificial
  CRISPR gRNA sequence
gcacatctagatggttcccc

SEQ ID NO: 449530 - DNA, 20 bp, Artificial
  CRISPR gRNA sequence
tctagatggttccccaagtg

SEQ ID NO: 449531 - DNA, 20 bp, Artificial
  CRISPR gRNA sequence
ggttccccaagtgtggaaat

SEQ ID NO: 449532 - DNA, 20 bp, Artificial
  CRISPR gRNA sequence
gttccccaagtgtggaaatt

SEQ ID NO: 449533 - DNA, 20 bp, Artificial
  CRISPR gRNA sequence
tgtggaaattaggtgcattt

SEQ ID NO: 449534 - DNA, 20 bp, Artificial
  CRISPR gRNA sequence
ggaaattaggtgcattttgg

SEQ ID NO: 449535 - DNA, 20 bp, Artificial
  CRISPR gRNA sequence
gaaattaggtgcattttgga

SEQ ID NO: 449536 - DNA, 20 bp, Artificial
  CRISPR gRNA sequence
tgcattttggaaggtaaaac

SEQ ID NO: 449537 - DNA, 20 bp, Artificial
  CRISPR gRNA sequence
tttggaaggtaaaactagtt

SEQ ID NO: 449538 - DNA, 20 bp, Artificial
  CRISPR gRNA sequence
ggaaggtaaaactagttaag

SEQ ID NO: 449539 - DNA, 20 bp, Artificial
  CRISPR gRNA sequence
aaggtaaaactagttaagaa

SEQ ID NO: 449540 - DNA, 20 bp, Artificial
  CRISPR gRNA sequence
taaaactagttaagaagaga

SEQ ID NO: 449541 - DNA, 20 bp, Artificial
  CRISPR gRNA sequence
aaaactagttaagaagagac

SEQ ID NO: 449542 - DNA, 20 bp, Artificial
  CRISPR gRNA sequence
agacaggtaataaacaatgt

SEQ ID NO: 449543 - DNA, 20 bp, Artificial
  CRISPR gRNA sequence
gacaggtaataaacaatgtc

SEQ ID NO: 449544 - DNA, 20 bp, Artificial
  CRISPR gRNA sequence
acaggtaataaacaatgtca

SEQ ID NO: 449545 - DNA, 20 bp, Artificial
  CRISPR gRNA sequence
ggtaataaacaatgtcaggg

SEQ ID NO: 449546 - DNA, 20 bp, Artificial
  CRISPR gRNA sequence
gtaataaacaatgtcagggt

SEQ ID NO: 449547 - DNA, 20 bp, Artificial
  CRISPR gRNA sequence
ataaacaatgtcagggtggg

SEQ ID NO: 449548 - DNA, 20 bp, Artificial
  CRISPR gRNA sequence
aacaatgtcagggtgggtgg

SEQ ID NO: 449549 - DNA, 20 bp, Artificial
  CRISPR gRNA sequence
gtggctcacgcctgtaatcc

SEQ ID NO: 449550 - DNA, 20 bp, Artificial
  CRISPR gRNA sequence
cgcctgtaatcccagcactt

SEQ ID NO: 449551 - DNA, 20 bp, Artificial
  CRISPR gRNA sequence
gcctgtaatcccagcacttc

SEQ ID NO: 449552 - DNA, 20 bp, Artificial
  CRISPR gRNA sequence
ctgtaatcccagcacttcag

SEQ ID NO: 449553 - DNA, 20 bp, Artificial
  CRISPR gRNA sequence
tgtaatcccagcacttcagg

SEQ ID NO: 449554 - DNA, 20 bp, Artificial
  CRISPR gRNA sequence
tcccagcacttcaggaggct

SEQ ID NO: 449555 - DNA, 20 bp, Artificial
  CRISPR gRNA sequence
cccagcacttcaggaggctg

SEQ ID NO: 449556 - DNA, 20 bp, Artificial
  CRISPR gRNA sequence
gcacttcaggaggctgaggc

SEQ ID NO: 449557 - DNA, 20 bp, Artificial
  CRISPR gRNA sequence
cttcaggaggctgaggctgg

SEQ ID NO: 449558 - DNA, 20 bp, Artificial
  CRISPR gRNA sequence
ctgaggctggcagatcattt

SEQ ID NO: 449559 - DNA, 20 bp, Artificial
  CRISPR gRNA sequence
gctggcagatcatttgagat

SEQ ID NO: 449560 - DNA, 20 bp, Artificial
  CRISPR gRNA sequence
ctggcagatcatttgagatc

SEQ ID NO: 449561 - DNA, 20 bp, Artificial
  CRISPR gRNA sequence
ggcagatcatttgagatcag

SEQ ID NO: 449562 - DNA, 20 bp, Artificial
  CRISPR gRNA sequence
tcatttgagatcaggagttc

SEQ ID NO: 449563 - DNA, 20 bp, Artificial
  CRISPR gRNA sequence
tgagatcaggagttcgagac

SEQ ID NO: 449564 - DNA, 20 bp, Artificial
  CRISPR gRNA sequence
tcaggagttcgagacaagcc

SEQ ID NO: 449565 - DNA, 20 bp, Artificial
  CRISPR gRNA sequence
cgagacaagcctggccaaca

SEQ ID NO: 449566 - DNA, 20 bp, Artificial
  CRISPR gRNA sequence
tctactaaaaatacaaaaaa

SEQ ID NO: 449567 - DNA, 20 bp, Artificial
  CRISPR gRNA sequence
taaaaatacaaaaaatagcc

SEQ ID NO: 449568 - DNA, 20 bp, Artificial
  CRISPR gRNA sequence
atacaaaaaatagccgagtg

SEQ ID NO: 449569 - DNA, 20 bp, Artificial
  CRISPR gRNA sequence
caaaaaatagccgagtgtgg

SEQ ID NO: 449570 - DNA, 20 bp, Artificial
  CRISPR gRNA sequence
gtagcacgcacctgtaatcc

SEQ ID NO: 449571 - DNA, 20 bp, Artificial
  CRISPR gRNA sequence
cacctgtaatcccagctact

SEQ ID NO: 449572 - DNA, 20 bp, Artificial
  CRISPR gRNA sequence
acctgtaatcccagctactt

SEQ ID NO: 449573 - DNA, 20 bp, Artificial
  CRISPR gRNA sequence
ctgtaatcccagctacttgg

SEQ ID NO: 449574 - DNA, 20 bp, Artificial
  CRISPR gRNA sequence
tgtaatcccagctacttggg

SEQ ID NO: 449575 - DNA, 20 bp, Artificial
  CRISPR gRNA sequence
tcccagctacttgggaggct

SEQ ID NO: 449576 - DNA, 20 bp, Artificial
  CRISPR gRNA sequence
cccagctacttgggaggctg

SEQ ID NO: 449577 - DNA, 20 bp, Artificial
  CRISPR gRNA sequence
agctacttgggaggctgagg

SEQ ID NO: 449578 - DNA, 20 bp, Artificial
  CRISPR gRNA sequence
gctacttgggaggctgaggc

SEQ ID NO: 449579 - DNA, 20 bp, Artificial
  CRISPR gRNA sequence
tacttgggaggctgaggcag

SEQ ID NO: 449580 - DNA, 20 bp, Artificial
  CRISPR gRNA sequence
gcaggagaatcacttgaacc

SEQ ID NO: 449581 - DNA, 20 bp, Artificial
  CRISPR gRNA sequence
caggagaatcacttgaaccc

SEQ ID NO: 449582 - DNA, 20 bp, Artificial
  CRISPR gRNA sequence
gagaatcacttgaacccggg

SEQ ID NO: 449583 - DNA, 20 bp, Artificial
  CRISPR gRNA sequence
aatcacttgaacccgggaag

SEQ ID NO: 449584 - DNA, 20 bp, Artificial
  CRISPR gRNA sequence
tcacttgaacccgggaagca

SEQ ID NO: 449585 - DNA, 20 bp, Artificial
  CRISPR gRNA sequence
cacttgaacccgggaagcag

SEQ ID NO: 449586 - DNA, 20 bp, Artificial
  CRISPR gRNA sequence
aacccgggaagcagaggttg

SEQ ID NO: 449587 - DNA, 20 bp, Artificial
  CRISPR gRNA sequence
cgggaagcagaggttgcagt

SEQ ID NO: 449588 - DNA, 20 bp, Artificial
  CRISPR gRNA sequence
agcagaggttgcagtgagcc

SEQ ID NO: 449589 - DNA, 20 bp, Artificial
  CRISPR gRNA sequence
gagattgcgccactgcactc

SEQ ID NO: 449590 - DNA, 20 bp, Artificial
  CRISPR gRNA sequence
tgcgccactgcactcgagcc

SEQ ID NO: 449591 - DNA, 20 bp, Artificial
  CRISPR gRNA sequence
gcgccactgcactcgagcct

SEQ ID NO: 449592 - DNA, 20 bp, Artificial
  CRISPR gRNA sequence
ctgcactcgagcctgggcga

SEQ ID NO: 449593 - DNA, 20 bp, Artificial
  CRISPR gRNA sequence
gcactcgagcctgggcgaca

SEQ ID NO: 449594 - DNA, 20 bp, Artificial
  CRISPR gRNA sequence
tcgagcctgggcgacagagc

SEQ ID NO: 449595 - DNA, 20 bp, Artificial
  CRISPR gRNA sequence
gccagactctgtctcaaaaa

SEQ ID NO: 449596 - DNA, 20 bp, Artificial
  CRISPR gRNA sequence
aacaatgtctgccatttact

SEQ ID NO: 449597 - DNA, 20 bp, Artificial
  CRISPR gRNA sequence
catttactgagtgcttactg

SEQ ID NO: 449598 - DNA, 20 bp, Artificial
  CRISPR gRNA sequence
atttactgagtgcttactgt

SEQ ID NO: 449599 - DNA, 20 bp, Artificial
  CRISPR gRNA sequence
actgagtgcttactgtgggc

SEQ ID NO: 449600 - DNA, 20 bp, Artificial
  CRISPR gRNA sequence
ctgagtgcttactgtgggcc

SEQ ID NO: 449601 - DNA, 20 bp, Artificial
  CRISPR gRNA sequence
tgtgggccaggcattgtgct

SEQ ID NO: 449602 - DNA, 20 bp, Artificial
  CRISPR gRNA sequence
attatattatttaatctcca

SEQ ID NO: 449603 - DNA, 20 bp, Artificial
  CRISPR gRNA sequence
tttaatctccatggtctttt

SEQ ID NO: 449604 - DNA, 20 bp, Artificial
  CRISPR gRNA sequence
ctattgtcctgtgataactc

SEQ ID NO: 449605 - DNA, 20 bp, Artificial
  CRISPR gRNA sequence
cctgtgataactcaagcttg

SEQ ID NO: 449606 - DNA, 20 bp, Artificial
  CRISPR gRNA sequence
gataatttatgttcatccaa

SEQ ID NO: 449607 - DNA, 20 bp, Artificial
  CRISPR gRNA sequence
gttcatccaacagtaaatga

SEQ ID NO: 449608 - DNA, 20 bp, Artificial
  CRISPR gRNA sequence
gtaaatgatggataaaaatc

SEQ ID NO: 449609 - DNA, 20 bp, Artificial
  CRISPR gRNA sequence
gatggataaaaatccagatc

SEQ ID NO: 449610 - DNA, 20 bp, Artificial
  CRISPR gRNA sequence
ataaaaatccagatctagtc

SEQ ID NO: 449611 - DNA, 20 bp, Artificial
  CRISPR gRNA sequence
taaaaatccagatctagtcc

SEQ ID NO: 449612 - DNA, 20 bp, Artificial
  CRISPR gRNA sequence
atccagatctagtccaggtg

SEQ ID NO: 449613 - DNA, 20 bp, Artificial
  CRISPR gRNA sequence
gtgtctcatgcctgtaaccc

SEQ ID NO: 449614 - DNA, 20 bp, Artificial
  CRISPR gRNA sequence
atgcctgtaaccccagcact

SEQ ID NO: 449615 - DNA, 20 bp, Artificial
  CRISPR gRNA sequence
tgcctgtaaccccagcactt

SEQ ID NO: 449616 - DNA, 20 bp, Artificial
  CRISPR gRNA sequence
gcctgtaaccccagcactta

SEQ ID NO: 449617 - DNA, 20 bp, Artificial
  CRISPR gRNA sequence
ctgtaaccccagcacttagg

SEQ ID NO: 449618 - DNA, 20 bp, Artificial
  CRISPR gRNA sequence
tgtaaccccagcacttaggg

SEQ ID NO: 449619 - DNA, 20 bp, Artificial
  CRISPR gRNA sequence
ccccagcacttagggaggcc

SEQ ID NO: 449620 - DNA, 20 bp, Artificial
  CRISPR gRNA sequence
cccagcacttagggaggcca

SEQ ID NO: 449621 - DNA, 20 bp, Artificial
  CRISPR gRNA sequence
agcacttagggaggccaagg

SEQ ID NO: 449622 - DNA, 20 bp, Artificial
  CRISPR gRNA sequence
gcacttagggaggccaaggc

SEQ ID NO: 449623 - DNA, 20 bp, Artificial
  CRISPR gRNA sequence
gcaggtgcatcacttgaacc

SEQ ID NO: 449624 - DNA, 20 bp, Artificial
  CRISPR gRNA sequence
caggtgcatcacttgaaccc

SEQ ID NO: 449625 - DNA, 20 bp, Artificial
  CRISPR gRNA sequence
ggtgcatcacttgaacccag

SEQ ID NO: 449626 - DNA, 20 bp, Artificial
  CRISPR gRNA sequence
tcacttgaacccaggagttc

SEQ ID NO: 449627 - DNA, 20 bp, Artificial
  CRISPR gRNA sequence
tgaacccaggagttcgagac

SEQ ID NO: 449628 - DNA, 20 bp, Artificial
  CRISPR gRNA sequence
ccaggagttcgagaccagcc

SEQ ID NO: 449629 - DNA, 20 bp, Artificial
  CRISPR gRNA sequence
caggagttcgagaccagcct

SEQ ID NO: 449630 - DNA, 20 bp, Artificial
  CRISPR gRNA sequence
cgagaccagcctgggcaaca

SEQ ID NO: 449631 - DNA, 20 bp, Artificial
  CRISPR gRNA sequence
tctacaaaaaatacaaaaat

SEQ ID NO: 449632 - DNA, 20 bp, Artificial
  CRISPR gRNA sequence
caaaaaatacaaaaattggc

SEQ ID NO: 449633 - DNA, 20 bp, Artificial
  CRISPR gRNA sequence
aaaaaatacaaaaattggct

SEQ ID NO: 449634 - DNA, 20 bp, Artificial
  CRISPR gRNA sequence
atacaaaaattggctgggcg

SEQ ID NO: 449635 - DNA, 20 bp, Artificial
  CRISPR gRNA sequence
caaaaattggctgggcgtgg

SEQ ID NO: 449636 - DNA, 20 bp, Artificial
  CRISPR gRNA sequence
ggcgtggtggcacatgcctg

SEQ ID NO: 449637 - DNA, 20 bp, Artificial
  CRISPR gRNA sequence
gtggcacatgcctgtagtcc

SEQ ID NO: 449638 - DNA, 20 bp, Artificial
  CRISPR gRNA sequence
atgcctgtagtcccagctac

SEQ ID NO: 449639 - DNA, 20 bp, Artificial
  CRISPR gRNA sequence
tgcctgtagtcccagctact

SEQ ID NO: 449640 - DNA, 20 bp, Artificial
  CRISPR gRNA sequence
gcctgtagtcccagctacta

SEQ ID NO: 449641 - DNA, 20 bp, Artificial
  CRISPR gRNA sequence
tgtagtcccagctactaggg

SEQ ID NO: 449642 - DNA, 20 bp, Artificial
  CRISPR gRNA sequence
tcccagctactagggaagct

SEQ ID NO: 449643 - DNA, 20 bp, Artificial
  CRISPR gRNA sequence
cccagctactagggaagctg

SEQ ID NO: 449644 - DNA, 20 bp, Artificial
  CRISPR gRNA sequence
agctactagggaagctgagg

SEQ ID NO: 449645 - DNA, 20 bp, Artificial
  CRISPR gRNA sequence
gctactagggaagctgaggt

SEQ ID NO: 449646 - DNA, 20 bp, Artificial
  CRISPR gRNA sequence
tactagggaagctgaggtgg

SEQ ID NO: 449647 - DNA, 20 bp, Artificial
  CRISPR gRNA sequence
actagggaagctgaggtggg

SEQ ID NO: 449648 - DNA, 20 bp, Artificial
  CRISPR gRNA sequence
gctgaggtgggaggatcgat

SEQ ID NO: 449649 - DNA, 20 bp, Artificial
  CRISPR gRNA sequence
ctgaggtgggaggatcgatt

SEQ ID NO: 449650 - DNA, 20 bp, Artificial
  CRISPR gRNA sequence
gtgggaggatcgattgggct

SEQ ID NO: 449651 - DNA, 20 bp, Artificial
  CRISPR gRNA sequence
tgggaggatcgattgggctc

SEQ ID NO: 449652 - DNA, 20 bp, Artificial
  CRISPR gRNA sequence
gggaggatcgattgggctcg

SEQ ID NO: 449653 - DNA, 20 bp, Artificial
  CRISPR gRNA sequence
atcgattgggctcggggcat

SEQ ID NO: 449654 - DNA, 20 bp, Artificial
  CRISPR gRNA sequence
tcgattgggctcggggcatg

SEQ ID NO: 449655 - DNA, 20 bp, Artificial
  CRISPR gRNA sequence
gggctcggggcatgaggctg

SEQ ID NO: 449656 - DNA, 20 bp, Artificial
  CRISPR gRNA sequence
atgatcatgccactgtactc

SEQ ID NO: 449657 - DNA, 20 bp, Artificial
  CRISPR gRNA sequence
catgccactgtactctagcc

SEQ ID NO: 449658 - DNA, 20 bp, Artificial
  CRISPR gRNA sequence
ctgtactctagcctggatga

SEQ ID NO: 449659 - DNA, 20 bp, Artificial
  CRISPR gRNA sequence
gtactctagcctggatgaca

SEQ ID NO: 449660 - DNA, 20 bp, Artificial
  CRISPR gRNA sequence
tctagcctggatgacagagc

SEQ ID NO: 449661 - DNA, 20 bp, Artificial
  CRISPR gRNA sequence
acaaacaaacaaaaaaaacc

SEQ ID NO: 449662 - DNA, 20 bp, Artificial
  CRISPR gRNA sequence
aaaacccagatctattccaa

SEQ ID NO: 449663 - DNA, 20 bp, Artificial
  CRISPR gRNA sequence
aaacccagatctattccaaa

SEQ ID NO: 449664 - DNA, 20 bp, Artificial
  CRISPR gRNA sequence
aacccagatctattccaaaa

SEQ ID NO: 449665 - DNA, 20 bp, Artificial
  CRISPR gRNA sequence
cagatctattccaaaagggc

SEQ ID NO: 449666 - DNA, 20 bp, Artificial
  CRISPR gRNA sequence
ggcaagattttaacttatgc

SEQ ID NO: 449667 - DNA, 20 bp, Artificial
  CRISPR gRNA sequence
ctagattgcttgaaccactc

SEQ ID NO: 449668 - DNA, 20 bp, Artificial
  CRISPR gRNA sequence
gcttgaaccactctagaaaa

SEQ ID NO: 449669 - DNA, 20 bp, Artificial
  CRISPR gRNA sequence
cttgaaccactctagaaaat

SEQ ID NO: 449670 - DNA, 20 bp, Artificial
  CRISPR gRNA sequence
ttgaaccactctagaaaatg

SEQ ID NO: 449671 - DNA, 20 bp, Artificial
  CRISPR gRNA sequence
ctctagaaaatggggctatt

SEQ ID NO: 449672 - DNA, 20 bp, Artificial
  CRISPR gRNA sequence
tctagaaaatggggctattt

SEQ ID NO: 449673 - DNA, 20 bp, Artificial
  CRISPR gRNA sequence
ctagaaaatggggctatttg

SEQ ID NO: 449674 - DNA, 20 bp, Artificial
  CRISPR gRNA sequence
ggggctatttggggataccc

SEQ ID NO: 449675 - DNA, 20 bp, Artificial
  CRISPR gRNA sequence
atttggggatacccaagtcc

SEQ ID NO: 449676 - DNA, 20 bp, Artificial
  CRISPR gRNA sequence
tttggggatacccaagtcca

SEQ ID NO: 449677 - DNA, 20 bp, Artificial
  CRISPR gRNA sequence
tacccaagtccaaggcgact

SEQ ID NO: 449678 - DNA, 20 bp, Artificial
  CRISPR gRNA sequence
ccaaggcgactaagctgttt

SEQ ID NO: 449679 - DNA, 20 bp, Artificial
  CRISPR gRNA sequence
agctgtttcagctatctctg

SEQ ID NO: 449680 - DNA, 20 bp, Artificial
  CRISPR gRNA sequence
ctatctctgtggcaaaactt

SEQ ID NO: 449681 - DNA, 20 bp, Artificial
  CRISPR gRNA sequence
caaaactttagaattacttt

SEQ ID NO: 449682 - DNA, 20 bp, Artificial
  CRISPR gRNA sequence
ttaagatctatctgcatccc

SEQ ID NO: 449683 - DNA, 20 bp, Artificial
  CRISPR gRNA sequence
catccctagtgtctgacaca

SEQ ID NO: 449684 - DNA, 20 bp, Artificial
  CRISPR gRNA sequence
atccctagtgtctgacacac

SEQ ID NO: 449685 - DNA, 20 bp, Artificial
  CRISPR gRNA sequence
ccctagtgtctgacacacag

SEQ ID NO: 449686 - DNA, 20 bp, Artificial
  CRISPR gRNA sequence
ggagattctatacttattta

SEQ ID NO: 449687 - DNA, 20 bp, Artificial
  CRISPR gRNA sequence
atacttatttatggctgcct

SEQ ID NO: 449688 - DNA, 20 bp, Artificial
  CRISPR gRNA sequence
caatgttaaaaatacttatt

SEQ ID NO: 449689 - DNA, 20 bp, Artificial
  CRISPR gRNA sequence
aatgttaaaaatacttattt

SEQ ID NO: 449690 - DNA, 20 bp, Artificial
  CRISPR gRNA sequence
cttatttgggcaacgaatta

SEQ ID NO: 449691 - DNA, 20 bp, Artificial
  CRISPR gRNA sequence
tatttgggcaacgaattaca

SEQ ID NO: 449692 - DNA, 20 bp, Artificial
  CRISPR gRNA sequence
atttgggcaacgaattacag

SEQ ID NO: 449693 - DNA, 20 bp, Artificial
  CRISPR gRNA sequence
tttgggcaacgaattacaga

SEQ ID NO: 449694 - DNA, 20 bp, Artificial
  CRISPR gRNA sequence
tgggcaacgaattacagagg

SEQ ID NO: 449695 - DNA, 20 bp, Artificial
  CRISPR gRNA sequence
gggcaacgaattacagaggg

SEQ ID NO: 449696 - DNA, 20 bp, Artificial
  CRISPR gRNA sequence
attacagagggaggaatcct

SEQ ID NO: 449697 - DNA, 20 bp, Artificial
  CRISPR gRNA sequence
tacagagggaggaatccttg

SEQ ID NO: 449698 - DNA, 20 bp, Artificial
  CRISPR gRNA sequence
ggaatccttggagatcataa

SEQ ID NO: 449699 - DNA, 20 bp, Artificial
  CRISPR gRNA sequence
aatccttggagatcataaaa

SEQ ID NO: 449700 - DNA, 20 bp, Artificial
  CRISPR gRNA sequence
gatcataaaagagatgttat

SEQ ID NO: 449701 - DNA, 20 bp, Artificial
  CRISPR gRNA sequence
gatgttatgagatgatgcaa

SEQ ID NO: 449702 - DNA, 20 bp, Artificial
  CRISPR gRNA sequence
atgttatgagatgatgcaaa

SEQ ID NO: 449703 - DNA, 20 bp, Artificial
  CRISPR gRNA sequence
gttatgagatgatgcaaaag

SEQ ID NO: 449704 - DNA, 20 bp, Artificial
  CRISPR gRNA sequence
tccatgattctcttttgaac

SEQ ID NO: 449705 - DNA, 20 bp, Artificial
  CRISPR gRNA sequence
catgattctcttttgaacca

SEQ ID NO: 449706 - DNA, 20 bp, Artificial
  CRISPR gRNA sequence
attctcttttgaaccagaga

SEQ ID NO: 449707 - DNA, 20 bp, Artificial
  CRISPR gRNA sequence
ttctcttttgaaccagagac

SEQ ID NO: 449708 - DNA, 20 bp, Artificial
  CRISPR gRNA sequence
tctcttttgaaccagagaca

SEQ ID NO: 449709 - DNA, 20 bp, Artificial
  CRISPR gRNA sequence
accagagacagggaactaca

SEQ ID NO: 449710 - DNA, 20 bp, Artificial
  CRISPR gRNA sequence
gacagggaactacacagtga

SEQ ID NO: 449711 - DNA, 20 bp, Artificial
  CRISPR gRNA sequence
acagggaactacacagtgac

SEQ ID NO: 449712 - DNA, 20 bp, Artificial
  CRISPR gRNA sequence
acagtgacgggattgaaaca

SEQ ID NO: 449713 - DNA, 20 bp, Artificial
  CRISPR gRNA sequence
tgaaacaaagacaacacctt

SEQ ID NO: 449714 - DNA, 20 bp, Artificial
  CRISPR gRNA sequence
caaagacaacaccttgagtt

SEQ ID NO: 449715 - DNA, 20 bp, Artificial
  CRISPR gRNA sequence
ccttgagttcagccataatg

SEQ ID NO: 449716 - DNA, 20 bp, Artificial
  CRISPR gRNA sequence
cttgagttcagccataatga

SEQ ID NO: 449717 - DNA, 20 bp, Artificial
  CRISPR gRNA sequence
agccataatgaaggcactct

SEQ ID NO: 449718 - DNA, 20 bp, Artificial
  CRISPR gRNA sequence
taatgaaggcactctcagtt

SEQ ID NO: 449719 - DNA, 20 bp, Artificial
  CRISPR gRNA sequence
aatgaaggcactctcagttc

SEQ ID NO: 449720 - DNA, 20 bp, Artificial
  CRISPR gRNA sequence
tctcagttcaggcttcctac

SEQ ID NO: 449721 - DNA, 20 bp, Artificial
  CRISPR gRNA sequence
gttcaggcttcctacaagaa

SEQ ID NO: 449722 - DNA, 20 bp, Artificial
  CRISPR gRNA sequence
ttcaggcttcctacaagaaa

SEQ ID NO: 449723 - DNA, 20 bp, Artificial
  CRISPR gRNA sequence
gcttcctacaagaaaaggtc

SEQ ID NO: 449724 - DNA, 20 bp, Artificial
  CRISPR gRNA sequence
cttcctacaagaaaaggtct

SEQ ID NO: 449725 - DNA, 20 bp, Artificial
  CRISPR gRNA sequence
agaaaaggtctgggtaatgc

SEQ ID NO: 449726 - DNA, 20 bp, Artificial
  CRISPR gRNA sequence
gtctgggtaatgctggtcac

SEQ ID NO: 449727 - DNA, 20 bp, Artificial
  CRISPR gRNA sequence
aatgctggtcaccagccttg

SEQ ID NO: 449728 - DNA, 20 bp, Artificial
  CRISPR gRNA sequence
caccagccttgtggcccttc

SEQ ID NO: 449729 - DNA, 20 bp, Artificial
  CRISPR gRNA sequence
accagccttgtggcccttca

SEQ ID NO: 449730 - DNA, 20 bp, Artificial
  CRISPR gRNA sequence
gcccttcaaggtatgtccaa

SEQ ID NO: 449731 - DNA, 20 bp, Artificial
  CRISPR gRNA sequence
ccttcaaggtatgtccaaaa

SEQ ID NO: 449732 - DNA, 20 bp, Artificial
  CRISPR gRNA sequence
ggtatgtccaaaagagccgt

SEQ ID NO: 449733 - DNA, 20 bp, Artificial
  CRISPR gRNA sequence
aaaagagccgtaagcacccc

SEQ ID NO: 449734 - DNA, 20 bp, Artificial
  CRISPR gRNA sequence
ccgtaagcaccccaagcaat

SEQ ID NO: 449735 - DNA, 20 bp, Artificial
  CRISPR gRNA sequence
cgtaagcaccccaagcaatg

SEQ ID NO: 449736 - DNA, 20 bp, Artificial
  CRISPR gRNA sequence
gtaagcaccccaagcaatga

SEQ ID NO: 449737 - DNA, 20 bp, Artificial
  CRISPR gRNA sequence
ctattatatttctgccacct

SEQ ID NO: 449738 - DNA, 20 bp, Artificial
  CRISPR gRNA sequence
ctgccaccttggttattctc

SEQ ID NO: 449739 - DNA, 20 bp, Artificial
  CRISPR gRNA sequence
tgccaccttggttattctcc

SEQ ID NO: 449740 - DNA, 20 bp, Artificial
  CRISPR gRNA sequence
ccaccttggttattctccag

SEQ ID NO: 449741 - DNA, 20 bp, Artificial
  CRISPR gRNA sequence
caccttggttattctccagg

SEQ ID NO: 449742 - DNA, 20 bp, Artificial
  CRISPR gRNA sequence
ccttggttattctccaggag

SEQ ID NO: 449743 - DNA, 20 bp, Artificial
  CRISPR gRNA sequence
tggttattctccaggaggag

SEQ ID NO: 449744 - DNA, 20 bp, Artificial
  CRISPR gRNA sequence
ggttattctccaggaggaga

SEQ ID NO: 449745 - DNA, 20 bp, Artificial
  CRISPR gRNA sequence
attctccaggaggagaaggt

SEQ ID NO: 449746 - DNA, 20 bp, Artificial
  CRISPR gRNA sequence
tccaggaggagaaggttgga

SEQ ID NO: 449747 - DNA, 20 bp, Artificial
  CRISPR gRNA sequence
ccaggaggagaaggttggaa

SEQ ID NO: 449748 - DNA, 20 bp, Artificial
  CRISPR gRNA sequence
agaaggttggaaaggatgtc

SEQ ID NO: 449749 - DNA, 20 bp, Artificial
  CRISPR gRNA sequence
gaaggttggaaaggatgtcc

SEQ ID NO: 449750 - DNA, 20 bp, Artificial
  CRISPR gRNA sequence
aaggttggaaaggatgtcca

SEQ ID NO: 449751 - DNA, 20 bp, Artificial
  CRISPR gRNA sequence
aggttggaaaggatgtccag

SEQ ID NO: 449752 - DNA, 20 bp, Artificial
  CRISPR gRNA sequence
ggttggaaaggatgtccagg

SEQ ID NO: 449753 - DNA, 20 bp, Artificial
  CRISPR gRNA sequence
ttggaaaggatgtccagggg

SEQ ID NO: 449754 - DNA, 20 bp, Artificial
  CRISPR gRNA sequence
ggaaaggatgtccaggggga

SEQ ID NO: 449755 - DNA, 20 bp, Artificial
  CRISPR gRNA sequence
gggagagaaaaatgttactc

SEQ ID NO: 449756 - DNA, 20 bp, Artificial
  CRISPR gRNA sequence
gaaaaatgttactcaagccc

SEQ ID NO: 449757 - DNA, 20 bp, Artificial
  CRISPR gRNA sequence
actcaagccctggctatcca

SEQ ID NO: 449758 - DNA, 20 bp, Artificial
  CRISPR gRNA sequence
ctcaagccctggctatccac

SEQ ID NO: 449759 - DNA, 20 bp, Artificial
  CRISPR gRNA sequence
agccctggctatccacagga

SEQ ID NO: 449760 - DNA, 20 bp, Artificial
  CRISPR gRNA sequence
atccacaggaaagttcaaac

SEQ ID NO: 449761 - DNA, 20 bp, Artificial
  CRISPR gRNA sequence
aaaccagtttcactgatcca

SEQ ID NO: 449762 - DNA, 20 bp, Artificial
  CRISPR gRNA sequence
aaccagtttcactgatccaa

SEQ ID NO: 449763 - DNA, 20 bp, Artificial
  CRISPR gRNA sequence
ttcactgatccaaaggcact

SEQ ID NO: 449764 - DNA, 20 bp, Artificial
  CRISPR gRNA sequence
tcactgatccaaaggcacta

SEQ ID NO: 449765 - DNA, 20 bp, Artificial
  CRISPR gRNA sequence
actgatccaaaggcactaag

SEQ ID NO: 449766 - DNA, 20 bp, Artificial
  CRISPR gRNA sequence
ctgatccaaaggcactaagg

SEQ ID NO: 449767 - DNA, 20 bp, Artificial
  CRISPR gRNA sequence
atccaaaggcactaaggagg

SEQ ID NO: 449768 - DNA, 20 bp, Artificial
  CRISPR gRNA sequence
aaaggcactaaggaggaaga

SEQ ID NO: 449769 - DNA, 20 bp, Artificial
  CRISPR gRNA sequence
aaggaggaagacagataaat

SEQ ID NO: 449770 - DNA, 20 bp, Artificial
  CRISPR gRNA sequence
agataaatcagacttttcaa

SEQ ID NO: 449771 - DNA, 20 bp, Artificial
  CRISPR gRNA sequence
gataaatcagacttttcaat

SEQ ID NO: 449772 - DNA, 20 bp, Artificial
  CRISPR gRNA sequence
aaatcagacttttcaatggg

SEQ ID NO: 449773 - DNA, 20 bp, Artificial
  CRISPR gRNA sequence
aatcagacttttcaatgggt

SEQ ID NO: 449774 - DNA, 20 bp, Artificial
  CRISPR gRNA sequence
tcagacttttcaatgggtag

SEQ ID NO: 449775 - DNA, 20 bp, Artificial
  CRISPR gRNA sequence
cagacttttcaatgggtagg

SEQ ID NO: 449776 - DNA, 20 bp, Artificial
  CRISPR gRNA sequence
cttttcaatgggtaggaggt

SEQ ID NO: 449777 - DNA, 20 bp, Artificial
  CRISPR gRNA sequence
gggtaggaggtaagactcat

SEQ ID NO: 449778 - DNA, 20 bp, Artificial
  CRISPR gRNA sequence
ggtaggaggtaagactcatt

SEQ ID NO: 449779 - DNA, 20 bp, Artificial
  CRISPR gRNA sequence
ggtaagactcattaggaatg

SEQ ID NO: 449780 - DNA, 20 bp, Artificial
  CRISPR gRNA sequence
gtaagactcattaggaatga

SEQ ID NO: 449781 - DNA, 20 bp, Artificial
  CRISPR gRNA sequence
cattaggaatgaaggcctgt

SEQ ID NO: 449782 - DNA, 20 bp, Artificial
  CRISPR gRNA sequence
ttaggaatgaaggcctgtga

SEQ ID NO: 449783 - DNA, 20 bp, Artificial
  CRISPR gRNA sequence
aggaatgaaggcctgtgaga

SEQ ID NO: 449784 - DNA, 20 bp, Artificial
  CRISPR gRNA sequence
ggaatgaaggcctgtgagag

SEQ ID NO: 449785 - DNA, 20 bp, Artificial
  CRISPR gRNA sequence
tgaaggcctgtgagagaggc

SEQ ID NO: 449786 - DNA, 20 bp, Artificial
  CRISPR gRNA sequence
ggcctgtgagagaggcaagt

SEQ ID NO: 449787 - DNA, 20 bp, Artificial
  CRISPR gRNA sequence
acctctactcactgcatgaa

SEQ ID NO: 449788 - DNA, 20 bp, Artificial
  CRISPR gRNA sequence
ctctactcactgcatgaaca

SEQ ID NO: 449789 - DNA, 20 bp, Artificial
  CRISPR gRNA sequence
tctactcactgcatgaacag

SEQ ID NO: 449790 - DNA, 20 bp, Artificial
  CRISPR gRNA sequence
ctactcactgcatgaacaga

SEQ ID NO: 449791 - DNA, 20 bp, Artificial
  CRISPR gRNA sequence
ctgcatgaacagagggctac

SEQ ID NO: 449792 - DNA, 20 bp, Artificial
  CRISPR gRNA sequence
gaacagagggctacaagttg

SEQ ID NO: 449793 - DNA, 20 bp, Artificial
  CRISPR gRNA sequence
agggctacaagttgaagcaa

SEQ ID NO: 449794 - DNA, 20 bp, Artificial
  CRISPR gRNA sequence
aagttgaagcaacagatttt

SEQ ID NO: 449795 - DNA, 20 bp, Artificial
  CRISPR gRNA sequence
agcaacagattttcagctat

SEQ ID NO: 449796 - DNA, 20 bp, Artificial
  CRISPR gRNA sequence
caacagattttcagctatta

SEQ ID NO: 449797 - DNA, 20 bp, Artificial
  CRISPR gRNA sequence
aacagattttcagctattag

SEQ ID NO: 449798 - DNA, 20 bp, Artificial
  CRISPR gRNA sequence
agattttcagctattagagg

SEQ ID NO: 449799 - DNA, 20 bp, Artificial
  CRISPR gRNA sequence
ttcagctattagaggaagaa

SEQ ID NO: 449800 - DNA, 20 bp, Artificial
  CRISPR gRNA sequence
tcagctattagaggaagaaa

SEQ ID NO: 449801 - DNA, 20 bp, Artificial
  CRISPR gRNA sequence
ctattagaggaagaaaaggc

SEQ ID NO: 449802 - DNA, 20 bp, Artificial
  CRISPR gRNA sequence
attagaggaagaaaaggcaa

SEQ ID NO: 449803 - DNA, 20 bp, Artificial
  CRISPR gRNA sequence
gaggaagaaaaggcaagaga

SEQ ID NO: 449804 - DNA, 20 bp, Artificial
  CRISPR gRNA sequence
gaaaaggcaagagacagact

SEQ ID NO: 449805 - DNA, 20 bp, Artificial
  CRISPR gRNA sequence
ggcaagagacagacttggtt

SEQ ID NO: 449806 - DNA, 20 bp, Artificial
  CRISPR gRNA sequence
caagagacagacttggtttg

SEQ ID NO: 449807 - DNA, 20 bp, Artificial
  CRISPR gRNA sequence
agacagacttggtttggaga

SEQ ID NO: 449808 - DNA, 20 bp, Artificial
  CRISPR gRNA sequence
gacagacttggtttggagat

SEQ ID NO: 449809 - DNA, 20 bp, Artificial
  CRISPR gRNA sequence
gagatgggttttgaacaatg

SEQ ID NO: 449810 - DNA, 20 bp, Artificial
  CRISPR gRNA sequence
ttttgaacaatgcggctcct

SEQ ID NO: 449811 - DNA, 20 bp, Artificial
  CRISPR gRNA sequence
aacaatgcggctcctcagca

SEQ ID NO: 449812 - DNA, 20 bp, Artificial
  CRISPR gRNA sequence
acaatgcggctcctcagcaa

SEQ ID NO: 449813 - DNA, 20 bp, Artificial
  CRISPR gRNA sequence
ggctcctcagcaaaggctga

SEQ ID NO: 449814 - DNA, 20 bp, Artificial
  CRISPR gRNA sequence
cctcagcaaaggctgatggc

SEQ ID NO: 449815 - DNA, 20 bp, Artificial
  CRISPR gRNA sequence
caaaggctgatggccagatt

SEQ ID NO: 449816 - DNA, 20 bp, Artificial
  CRISPR gRNA sequence
ttgagtatattaaacacatg

SEQ ID NO: 449817 - DNA, 20 bp, Artificial
  CRISPR gRNA sequence
tatattaaacacatgtagct

SEQ ID NO: 449818 - DNA, 20 bp, Artificial
  CRISPR gRNA sequence
ctgaaaaccatttaccaata

SEQ ID NO: 449819 - DNA, 20 bp, Artificial
  CRISPR gRNA sequence
aaccatttaccaatatagat

SEQ ID NO: 449820 - DNA, 20 bp, Artificial
  CRISPR gRNA sequence
tagattagcgttttccctat

SEQ ID NO: 449821 - DNA, 20 bp, Artificial
  CRISPR gRNA sequence
tttccctattagataacaaa

SEQ ID NO: 449822 - DNA, 20 bp, Artificial
  CRISPR gRNA sequence
tcataacgtttttgcataac

SEQ ID NO: 449823 - DNA, 20 bp, Artificial
  CRISPR gRNA sequence
tgcataacaagcaactgatt

SEQ ID NO: 449824 - DNA, 20 bp, Artificial
  CRISPR gRNA sequence
gcataacaagcaactgattc

SEQ ID NO: 449825 - DNA, 20 bp, Artificial
  CRISPR gRNA sequence
aactgattcaggtttttgcc

SEQ ID NO: 449826 - DNA, 20 bp, Artificial
  CRISPR gRNA sequence
ttcaggtttttgcctggcct

SEQ ID NO: 449827 - DNA, 20 bp, Artificial
  CRISPR gRNA sequence
attcttaactccattttatt

SEQ ID NO: 449828 - DNA, 20 bp, Artificial
  CRISPR gRNA sequence
ttcttaactccattttattt

SEQ ID NO: 449829 - DNA, 20 bp, Artificial
  CRISPR gRNA sequence
ataactaccactgttttgaa

SEQ ID NO: 449830 - DNA, 20 bp, Artificial
  CRISPR gRNA sequence
accactgttttgaatggcat

SEQ ID NO: 449831 - DNA, 20 bp, Artificial
  CRISPR gRNA sequence
tttgaatggcatcagaatgt

SEQ ID NO: 449832 - DNA, 20 bp, Artificial
  CRISPR gRNA sequence
tgtaagctctatatatatgt

SEQ ID NO: 449833 - DNA, 20 bp, Artificial
  CRISPR gRNA sequence
gtaagctctatatatatgta

SEQ ID NO: 449834 - DNA, 20 bp, Artificial
  CRISPR gRNA sequence
gtcttctttaccccaacgaa

SEQ ID NO: 449835 - DNA, 20 bp, Artificial
  CRISPR gRNA sequence
aacgaaaagtcccacacata

SEQ ID NO: 449836 - DNA, 20 bp, Artificial
  CRISPR gRNA sequence
gaaaagtcccacacatatgg

SEQ ID NO: 449837 - DNA, 20 bp, Artificial
  CRISPR gRNA sequence
aaaagtcccacacatatggc

SEQ ID NO: 449838 - DNA, 20 bp, Artificial
  CRISPR gRNA sequence
aaaaaacctgtatgatgaat

SEQ ID NO: 449839 - DNA, 20 bp, Artificial
  CRISPR gRNA sequence
taaccttatacaacccttgc

SEQ ID NO: 449840 - DNA, 20 bp, Artificial
  CRISPR gRNA sequence
ccttgcaagcaaacatcccc

SEQ ID NO: 449841 - DNA, 20 bp, Artificial
  CRISPR gRNA sequence
aacatcccctggttactcat

SEQ ID NO: 449842 - DNA, 20 bp, Artificial
  CRISPR gRNA sequence
acatcccctggttactcatc

SEQ ID NO: 449843 - DNA, 20 bp, Artificial
  CRISPR gRNA sequence
cctggttactcatcaggaaa

SEQ ID NO: 449844 - DNA, 20 bp, Artificial
  CRISPR gRNA sequence
actcatcaggaaacagacac

SEQ ID NO: 449845 - DNA, 20 bp, Artificial
  CRISPR gRNA sequence
ctcatcaggaaacagacaca

SEQ ID NO: 449846 - DNA, 20 bp, Artificial
  CRISPR gRNA sequence
atcaggaaacagacacaagg

SEQ ID NO: 449847 - DNA, 20 bp, Artificial
  CRISPR gRNA sequence
acagacacaaggaagttaaa

SEQ ID NO: 449848 - DNA, 20 bp, Artificial
  CRISPR gRNA sequence
cagacacaaggaagttaaat

SEQ ID NO: 449849 - DNA, 20 bp, Artificial
  CRISPR gRNA sequence
agacacaaggaagttaaata

SEQ ID NO: 449850 - DNA, 20 bp, Artificial
  CRISPR gRNA sequence
caaggaagttaaatagggcc

SEQ ID NO: 449851 - DNA, 20 bp, Artificial
  CRISPR gRNA sequence
aagttaaatagggcctggtg

SEQ ID NO: 449852 - DNA, 20 bp, Artificial
  CRISPR gRNA sequence
ttaaatagggcctggtgcgg

SEQ ID NO: 449853 - DNA, 20 bp, Artificial
  CRISPR gRNA sequence
gtggctcacgcctgtaatcc

SEQ ID NO: 449854 - DNA, 20 bp, Artificial
  CRISPR gRNA sequence
cgcctgtaatcccagcactt

SEQ ID NO: 449855 - DNA, 20 bp, Artificial
  CRISPR gRNA sequence
gcctgtaatcccagcacttt

SEQ ID NO: 449856 - DNA, 20 bp, Artificial
  CRISPR gRNA sequence
ctgtaatcccagcactttgg

SEQ ID NO: 449857 - DNA, 20 bp, Artificial
  CRISPR gRNA sequence
tgtaatcccagcactttggg

SEQ ID NO: 449858 - DNA, 20 bp, Artificial
  CRISPR gRNA sequence
tcccagcactttgggaggcc

SEQ ID NO: 449859 - DNA, 20 bp, Artificial
  CRISPR gRNA sequence
cccagcactttgggaggcca

SEQ ID NO: 449860 - DNA, 20 bp, Artificial
  CRISPR gRNA sequence
agcactttgggaggccaagg

SEQ ID NO: 449861 - DNA, 20 bp, Artificial
  CRISPR gRNA sequence
gcactttgggaggccaaggc

SEQ ID NO: 449862 - DNA, 20 bp, Artificial
  CRISPR gRNA sequence
ctttgggaggccaaggcagg

SEQ ID NO: 449863 - DNA, 20 bp, Artificial
  CRISPR gRNA sequence
ccaaggcaggcagatccttt

SEQ ID NO: 449864 - DNA, 20 bp, Artificial
  CRISPR gRNA sequence
gcaggcagatcctttgagcc

SEQ ID NO: 449865 - DNA, 20 bp, Artificial
  CRISPR gRNA sequence
caggcagatcctttgagcct

SEQ ID NO: 449866 - DNA, 20 bp, Artificial
  CRISPR gRNA sequence
ggcagatcctttgagcctag

SEQ ID NO: 449867 - DNA, 20 bp, Artificial
  CRISPR gRNA sequence
tcctttgagcctaggagttt

SEQ ID NO: 449868 - DNA, 20 bp, Artificial
  CRISPR gRNA sequence
cctttgagcctaggagtttg

SEQ ID NO: 449869 - DNA, 20 bp, Artificial
  CRISPR gRNA sequence
tgagcctaggagtttgaggc

SEQ ID NO: 449870 - DNA, 20 bp, Artificial
  CRISPR gRNA sequence
ctaggagtttgaggccagtc

SEQ ID NO: 449871 - DNA, 20 bp, Artificial
  CRISPR gRNA sequence
taggagtttgaggccagtct

SEQ ID NO: 449872 - DNA, 20 bp, Artificial
  CRISPR gRNA sequence
tgaggccagtctgggcaaca

SEQ ID NO: 449873 - DNA, 20 bp, Artificial
  CRISPR gRNA sequence
tggggttttgccatgttgcc

SEQ ID NO: 449874 - DNA, 20 bp, Artificial
  CRISPR gRNA sequence
ttttgccatgttgcccagac

SEQ ID NO: 449875 - DNA, 20 bp, Artificial
  CRISPR gRNA sequence
ccagactggcctcaaactcc

SEQ ID NO: 449876 - DNA, 20 bp, Artificial
  CRISPR gRNA sequence
cagactggcctcaaactcct

SEQ ID NO: 449877 - DNA, 20 bp, Artificial
  CRISPR gRNA sequence
gcctcaaactcctaggctca

SEQ ID NO: 449878 - DNA, 20 bp, Artificial
  CRISPR gRNA sequence
cctcaaactcctaggctcaa

SEQ ID NO: 449879 - DNA, 20 bp, Artificial
  CRISPR gRNA sequence
ctcaaaggatctgcctgcct

SEQ ID NO: 449880 - DNA, 20 bp, Artificial
  CRISPR gRNA sequence
ctgcctgccttggcctccca

SEQ ID NO: 449881 - DNA, 20 bp, Artificial
  CRISPR gRNA sequence
gccttggcctcccaaagtgc

SEQ ID NO: 449882 - DNA, 20 bp, Artificial
  CRISPR gRNA sequence
ccttggcctcccaaagtgct

SEQ ID NO: 449883 - DNA, 20 bp, Artificial
  CRISPR gRNA sequence
ctcccaaagtgctgggatta

SEQ ID NO: 449884 - DNA, 20 bp, Artificial
  CRISPR gRNA sequence
tcccaaagtgctgggattac

SEQ ID NO: 449885 - DNA, 20 bp, Artificial
  CRISPR gRNA sequence
agtgctgggattacaggcgt

SEQ ID NO: 449886 - DNA, 20 bp, Artificial
  CRISPR gRNA sequence
acaggcgtgagccaccgcac

SEQ ID NO: 449887 - DNA, 20 bp, Artificial
  CRISPR gRNA sequence
caggcgtgagccaccgcacc

SEQ ID NO: 449888 - DNA, 20 bp, Artificial
  CRISPR gRNA sequence
ccttgtgtctgtttcctgat

SEQ ID NO: 449889 - DNA, 20 bp, Artificial
  CRISPR gRNA sequence
tctgtttcctgatgagtaac

SEQ ID NO: 449890 - DNA, 20 bp, Artificial
  CRISPR gRNA sequence
ctgtttcctgatgagtaacc

SEQ ID NO: 449891 - DNA, 20 bp, Artificial
  CRISPR gRNA sequence
tgtttcctgatgagtaacca

SEQ ID NO: 449892 - DNA, 20 bp, Artificial
  CRISPR gRNA sequence
gtttcctgatgagtaaccag

SEQ ID NO: 449893 - DNA, 20 bp, Artificial
  CRISPR gRNA sequence
accaggggatgtttgcttgc

SEQ ID NO: 449894 - DNA, 20 bp, Artificial
  CRISPR gRNA sequence
ccaggggatgtttgcttgca

SEQ ID NO: 449895 - DNA, 20 bp, Artificial
  CRISPR gRNA sequence
caggggatgtttgcttgcaa

SEQ ID NO: 449896 - DNA, 20 bp, Artificial
  CRISPR gRNA sequence
tttgcttgcaagggttgtat

SEQ ID NO: 449897 - DNA, 20 bp, Artificial
  CRISPR gRNA sequence
ttgcttgcaagggttgtata

SEQ ID NO: 449898 - DNA, 20 bp, Artificial
  CRISPR gRNA sequence
ttgcaagggttgtataaggt

SEQ ID NO: 449899 - DNA, 20 bp, Artificial
  CRISPR gRNA sequence
ggttagaatcatcatgtgta

SEQ ID NO: 449900 - DNA, 20 bp, Artificial
  CRISPR gRNA sequence
aaagcatctgattcatcata

SEQ ID NO: 449901 - DNA, 20 bp, Artificial
  CRISPR gRNA sequence
aagcatctgattcatcatac

SEQ ID NO: 449902 - DNA, 20 bp, Artificial
  CRISPR gRNA sequence
ggttttttaacaaatttatt

SEQ ID NO: 449903 - DNA, 20 bp, Artificial
  CRISPR gRNA sequence
ttttttaacaaatttattaa

SEQ ID NO: 449904 - DNA, 20 bp, Artificial
  CRISPR gRNA sequence
ttaagagcctgccatatgtg

SEQ ID NO: 449905 - DNA, 20 bp, Artificial
  CRISPR gRNA sequence
taagagcctgccatatgtgt

SEQ ID NO: 449906 - DNA, 20 bp, Artificial
  CRISPR gRNA sequence
atatgtgtgggacttttcgt

SEQ ID NO: 449907 - DNA, 20 bp, Artificial
  CRISPR gRNA sequence
tatgtgtgggacttttcgtt

SEQ ID NO: 449908 - DNA, 20 bp, Artificial
  CRISPR gRNA sequence
atgtgtgggacttttcgttg

SEQ ID NO: 449909 - DNA, 20 bp, Artificial
  CRISPR gRNA sequence
tgggacttttcgttggggta

SEQ ID NO: 449910 - DNA, 20 bp, Artificial
  CRISPR gRNA sequence
gacttttcgttggggtaaag

SEQ ID NO: 449911 - DNA, 20 bp, Artificial
  CRISPR gRNA sequence
tcgttggggtaaagaagaca

SEQ ID NO: 449912 - DNA, 20 bp, Artificial
  CRISPR gRNA sequence
acaaagtccttacatatata

SEQ ID NO: 449913 - DNA, 20 bp, Artificial
  CRISPR gRNA sequence
aaagtccttacatatatata

SEQ ID NO: 449914 - DNA, 20 bp, Artificial
  CRISPR gRNA sequence
cattctgatgccattcaaaa

SEQ ID NO: 449915 - DNA, 20 bp, Artificial
  CRISPR gRNA sequence
tctgatgccattcaaaacag

SEQ ID NO: 449916 - DNA, 20 bp, Artificial
  CRISPR gRNA sequence
gatgccattcaaaacagtgg

SEQ ID NO: 449917 - DNA, 20 bp, Artificial
  CRISPR gRNA sequence
acagtggtagttattgattt

SEQ ID NO: 449918 - DNA, 20 bp, Artificial
  CRISPR gRNA sequence
cagtggtagttattgatttg

SEQ ID NO: 449919 - DNA, 20 bp, Artificial
  CRISPR gRNA sequence
tgaggaatgcctaaataaaa

SEQ ID NO: 449920 - DNA, 20 bp, Artificial
  CRISPR gRNA sequence
aggaatgcctaaataaaatg

SEQ ID NO: 449921 - DNA, 20 bp, Artificial
  CRISPR gRNA sequence
tgcctaaataaaatggagtt

SEQ ID NO: 449922 - DNA, 20 bp, Artificial
  CRISPR gRNA sequence
aaaatggagttaagaatgcc

SEQ ID NO: 449923 - DNA, 20 bp, Artificial
  CRISPR gRNA sequence
aaatggagttaagaatgcca

SEQ ID NO: 449924 - DNA, 20 bp, Artificial
  CRISPR gRNA sequence
ggagttaagaatgccaaggc

SEQ ID NO: 449925 - DNA, 20 bp, Artificial
  CRISPR gRNA sequence
gagttaagaatgccaaggcc

SEQ ID NO: 449926 - DNA, 20 bp, Artificial
  CRISPR gRNA sequence
ggccaggcaaaaacctgaat

SEQ ID NO: 449927 - DNA, 20 bp, Artificial
  CRISPR gRNA sequence
aaaacgttatgacaaattat

SEQ ID NO: 449928 - DNA, 20 bp, Artificial
  CRISPR gRNA sequence
acgttatgacaaattattgg

SEQ ID NO: 449929 - DNA, 20 bp, Artificial
  CRISPR gRNA sequence
tttcactttttgttatctaa

SEQ ID NO: 449930 - DNA, 20 bp, Artificial
  CRISPR gRNA sequence
ttcactttttgttatctaat

SEQ ID NO: 449931 - DNA, 20 bp, Artificial
  CRISPR gRNA sequence
tcactttttgttatctaata

SEQ ID NO: 449932 - DNA, 20 bp, Artificial
  CRISPR gRNA sequence
gggaaaacgctaatctatat

SEQ ID NO: 449933 - DNA, 20 bp, Artificial
  CRISPR gRNA sequence
cgctaatctatattggtaaa

SEQ ID NO: 449934 - DNA, 20 bp, Artificial
  CRISPR gRNA sequence
ctatattggtaaatggtttt

SEQ ID NO: 449935 - DNA, 20 bp, Artificial
  CRISPR gRNA sequence
atattggtaaatggttttca

SEQ ID NO: 449936 - DNA, 20 bp, Artificial
  CRISPR gRNA sequence
tattggtaaatggttttcag

SEQ ID NO: 449937 - DNA, 20 bp, Artificial
  CRISPR gRNA sequence
taaatggttttcagaggact

SEQ ID NO: 449938 - DNA, 20 bp, Artificial
  CRISPR gRNA sequence
tgtgtttaatatactcaatc

SEQ ID NO: 449939 - DNA, 20 bp, Artificial
  CRISPR gRNA sequence
aatatactcaatctggccat

SEQ ID NO: 449940 - DNA, 20 bp, Artificial
  CRISPR gRNA sequence
tctggccatcagcctttgct

SEQ ID NO: 449941 - DNA, 20 bp, Artificial
  CRISPR gRNA sequence
ctggccatcagcctttgctg

SEQ ID NO: 449942 - DNA, 20 bp, Artificial
  CRISPR gRNA sequence
ggccatcagcctttgctgag

SEQ ID NO: 449943 - DNA, 20 bp, Artificial
  CRISPR gRNA sequence
tcaaaacccatctccaaacc

SEQ ID NO: 449944 - DNA, 20 bp, Artificial
  CRISPR gRNA sequence
cttgccttttcttcctctaa

SEQ ID NO: 449945 - DNA, 20 bp, Artificial
  CRISPR gRNA sequence
aaatctgttgcttcaacttg

SEQ ID NO: 449946 - DNA, 20 bp, Artificial
  CRISPR gRNA sequence
cttgtagccctctgttcatg

SEQ ID NO: 449947 - DNA, 20 bp, Artificial
  CRISPR gRNA sequence
tagccctctgttcatgcagt

SEQ ID NO: 449948 - DNA, 20 bp, Artificial
  CRISPR gRNA sequence
ccctctgttcatgcagtgag

SEQ ID NO: 449949 - DNA, 20 bp, Artificial
  CRISPR gRNA sequence
ctctgttcatgcagtgagta

SEQ ID NO: 449950 - DNA, 20 bp, Artificial
  CRISPR gRNA sequence
tctgttcatgcagtgagtag

SEQ ID NO: 449951 - DNA, 20 bp, Artificial
  CRISPR gRNA sequence
gttcatgcagtgagtagagg

SEQ ID NO: 449952 - DNA, 20 bp, Artificial
  CRISPR gRNA sequence
gtactaacttgcctctctca

SEQ ID NO: 449953 - DNA, 20 bp, Artificial
  CRISPR gRNA sequence
tactaacttgcctctctcac

SEQ ID NO: 449954 - DNA, 20 bp, Artificial
  CRISPR gRNA sequence
cacaggccttcattcctaat

SEQ ID NO: 449955 - DNA, 20 bp, Artificial
  CRISPR gRNA sequence
cttacctcctacccattgaa

SEQ ID NO: 449956 - DNA, 20 bp, Artificial
  CRISPR gRNA sequence
gatttatctgtcttcctcct

SEQ ID NO: 449957 - DNA, 20 bp, Artificial
  CRISPR gRNA sequence
gtcttcctccttagtgcctt

SEQ ID NO: 449958 - DNA, 20 bp, Artificial
  CRISPR gRNA sequence
cctccttagtgcctttggat

SEQ ID NO: 449959 - DNA, 20 bp, Artificial
  CRISPR gRNA sequence
tgcctttggatcagtgaaac

SEQ ID NO: 449960 - DNA, 20 bp, Artificial
  CRISPR gRNA sequence
aactggtttgaactttcctg

SEQ ID NO: 449961 - DNA, 20 bp, Artificial
  CRISPR gRNA sequence
ggtttgaactttcctgtgga

SEQ ID NO: 449962 - DNA, 20 bp, Artificial
  CRISPR gRNA sequence
tgaactttcctgtggatagc

SEQ ID NO: 449963 - DNA, 20 bp, Artificial
  CRISPR gRNA sequence
gaactttcctgtggatagcc

SEQ ID NO: 449964 - DNA, 20 bp, Artificial
  CRISPR gRNA sequence
aactttcctgtggatagcca

SEQ ID NO: 449965 - DNA, 20 bp, Artificial
  CRISPR gRNA sequence
cctgtggatagccagggctt

SEQ ID NO: 449966 - DNA, 20 bp, Artificial
  CRISPR gRNA sequence
gtaacatttttctctccccc

SEQ ID NO: 449967 - DNA, 20 bp, Artificial
  CRISPR gRNA sequence
cctttccaaccttctcctcc

SEQ ID NO: 449968 - DNA, 20 bp, Artificial
  CRISPR gRNA sequence
tttccaaccttctcctcctg

SEQ ID NO: 449969 - DNA, 20 bp, Artificial
  CRISPR gRNA sequence
tctcctcctggagaataacc

SEQ ID NO: 449970 - DNA, 20 bp, Artificial
  CRISPR gRNA sequence
ctcctcctggagaataacca

SEQ ID NO: 449971 - DNA, 20 bp, Artificial
  CRISPR gRNA sequence
ctcctggagaataaccaagg

SEQ ID NO: 449972 - DNA, 20 bp, Artificial
  CRISPR gRNA sequence
ctggagaataaccaaggtgg

SEQ ID NO: 449973 - DNA, 20 bp, Artificial
  CRISPR gRNA sequence
ccaaggtggcagaaatataa

SEQ ID NO: 449974 - DNA, 20 bp, Artificial
  CRISPR gRNA sequence
ataatagcaccctcattgct

SEQ ID NO: 449975 - DNA, 20 bp, Artificial
  CRISPR gRNA sequence
taatagcaccctcattgctt

SEQ ID NO: 449976 - DNA, 20 bp, Artificial
  CRISPR gRNA sequence
aatagcaccctcattgcttg

SEQ ID NO: 449977 - DNA, 20 bp, Artificial
  CRISPR gRNA sequence
ctcattgcttggggtgctta

SEQ ID NO: 449978 - DNA, 20 bp, Artificial
  CRISPR gRNA sequence
tggggtgcttacggctcttt

SEQ ID NO: 449979 - DNA, 20 bp, Artificial
  CRISPR gRNA sequence
gctcttttggacataccttg

SEQ ID NO: 449980 - DNA, 20 bp, Artificial
  CRISPR gRNA sequence
ctcttttggacataccttga

SEQ ID NO: 449981 - DNA, 20 bp, Artificial
  CRISPR gRNA sequence
tcttttggacataccttgaa

SEQ ID NO: 449982 - DNA, 20 bp, Artificial
  CRISPR gRNA sequence
gacataccttgaagggccac

SEQ ID NO: 449983 - DNA, 20 bp, Artificial
  CRISPR gRNA sequence
acataccttgaagggccaca

SEQ ID NO: 449984 - DNA, 20 bp, Artificial
  CRISPR gRNA sequence
accttgaagggccacaaggc

SEQ ID NO: 449985 - DNA, 20 bp, Artificial
  CRISPR gRNA sequence
agggccacaaggctggtgac

SEQ ID NO: 449986 - DNA, 20 bp, Artificial
  CRISPR gRNA sequence
ggctggtgaccagcattacc

SEQ ID NO: 449987 - DNA, 20 bp, Artificial
  CRISPR gRNA sequence
attacccagaccttttcttg

SEQ ID NO: 449988 - DNA, 20 bp, Artificial
  CRISPR gRNA sequence
ttacccagaccttttcttgt

SEQ ID NO: 449989 - DNA, 20 bp, Artificial
  CRISPR gRNA sequence
cccagaccttttcttgtagg

SEQ ID NO: 449990 - DNA, 20 bp, Artificial
  CRISPR gRNA sequence
tcttgtaggaagcctgaact

SEQ ID NO: 449991 - DNA, 20 bp, Artificial
  CRISPR gRNA sequence
ttgtaggaagcctgaactga

SEQ ID NO: 449992 - DNA, 20 bp, Artificial
  CRISPR gRNA sequence
aactgagagtgccttcatta

SEQ ID NO: 449993 - DNA, 20 bp, Artificial
  CRISPR gRNA sequence
ccttcattatggctgaactc

SEQ ID NO: 449994 - DNA, 20 bp, Artificial
  CRISPR gRNA sequence
cttcattatggctgaactca

SEQ ID NO: 449995 - DNA, 20 bp, Artificial
  CRISPR gRNA sequence
gtttcaatcccgtcactgtg

SEQ ID NO: 449996 - DNA, 20 bp, Artificial
  CRISPR gRNA sequence
actgtgtagttccctgtctc

SEQ ID NO: 449997 - DNA, 20 bp, Artificial
  CRISPR gRNA sequence
gttccctgtctctggttcaa

SEQ ID NO: 449998 - DNA, 20 bp, Artificial
  CRISPR gRNA sequence
tccctgtctctggttcaaaa

SEQ ID NO: 449999 - DNA, 20 bp, Artificial
  CRISPR gRNA sequence
tctggttcaaaagagaatca

SEQ ID NO: 450000 - DNA, 20 bp, Artificial
  CRISPR gRNA sequence
ttcaaaagagaatcatggat

SEQ ID NO: 450001 - DNA, 20 bp, Artificial
  CRISPR gRNA sequence
tcaaaagagaatcatggatc

SEQ ID NO: 450002 - DNA, 20 bp, Artificial
  CRISPR gRNA sequence
caaaagagaatcatggatca

SEQ ID NO: 450003 - DNA, 20 bp, Artificial
  CRISPR gRNA sequence
aaaagagaatcatggatcag

SEQ ID NO: 450004 - DNA, 20 bp, Artificial
  CRISPR gRNA sequence
aagagaatcatggatcaggg

SEQ ID NO: 450005 - DNA, 20 bp, Artificial
  CRISPR gRNA sequence
agagaatcatggatcagggg

SEQ ID NO: 450006 - DNA, 20 bp, Artificial
  CRISPR gRNA sequence
gagaatcatggatcagggga

SEQ ID NO: 450007 - DNA, 20 bp, Artificial
  CRISPR gRNA sequence
catggatcaggggagggttt

SEQ ID NO: 450008 - DNA, 20 bp, Artificial
  CRISPR gRNA sequence
gggagggtttcagaaatcat

SEQ ID NO: 450009 - DNA, 20 bp, Artificial
  CRISPR gRNA sequence
acatctcttttatgatctcc

SEQ ID NO: 450010 - DNA, 20 bp, Artificial
  CRISPR gRNA sequence
catctcttttatgatctcca

SEQ ID NO: 450011 - DNA, 20 bp, Artificial
  CRISPR gRNA sequence
ctgtaattcgttgcccaaat

SEQ ID NO: 450012 - DNA, 20 bp, Artificial
  CRISPR gRNA sequence
aataagtatttttaacattg

SEQ ID NO: 450013 - DNA, 20 bp, Artificial
  CRISPR gRNA sequence
ataagtatttttaacattgt

SEQ ID NO: 450014 - DNA, 20 bp, Artificial
  CRISPR gRNA sequence
gtgggtaatgatgatgtact

SEQ ID NO: 450015 - DNA, 20 bp, Artificial
  CRISPR gRNA sequence
tgggtaatgatgatgtactt

SEQ ID NO: 450016 - DNA, 20 bp, Artificial
  CRISPR gRNA sequence
gtaatgatgatgtacttagg

SEQ ID NO: 450017 - DNA, 20 bp, Artificial
  CRISPR gRNA sequence
gtacttaggcagccataaat

SEQ ID NO: 450018 - DNA, 20 bp, Artificial
  CRISPR gRNA sequence
taggcagccataaataagta

SEQ ID NO: 450019 - DNA, 20 bp, Artificial
  CRISPR gRNA sequence
gtatagaatctcctgtgtgt

SEQ ID NO: 450020 - DNA, 20 bp, Artificial
  CRISPR gRNA sequence
atctcctgtgtgtcagacac

SEQ ID NO: 450021 - DNA, 20 bp, Artificial
  CRISPR gRNA sequence
tctcctgtgtgtcagacact

SEQ ID NO: 450022 - DNA, 20 bp, Artificial
  CRISPR gRNA sequence
ctcctgtgtgtcagacacta

SEQ ID NO: 450023 - DNA, 20 bp, Artificial
  CRISPR gRNA sequence
tgtgtcagacactagggatg

SEQ ID NO: 450024 - DNA, 20 bp, Artificial
  CRISPR gRNA sequence
tcagacactagggatgcaga

SEQ ID NO: 450025 - DNA, 20 bp, Artificial
  CRISPR gRNA sequence
agggatgcagatagatctta

SEQ ID NO: 450026 - DNA, 20 bp, Artificial
  CRISPR gRNA sequence
tagatcttaaagtaattcta

SEQ ID NO: 450027 - DNA, 20 bp, Artificial
  CRISPR gRNA sequence
gtaattctaaagttttgcca

SEQ ID NO: 450028 - DNA, 20 bp, Artificial
  CRISPR gRNA sequence
aattctaaagttttgccaca

SEQ ID NO: 450029 - DNA, 20 bp, Artificial
  CRISPR gRNA sequence
ctaaagttttgccacagaga

SEQ ID NO: 450030 - DNA, 20 bp, Artificial
  CRISPR gRNA sequence
tgccacagagatagctgaaa

SEQ ID NO: 450031 - DNA, 20 bp, Artificial
  CRISPR gRNA sequence
cagagatagctgaaacagct

SEQ ID NO: 450032 - DNA, 20 bp, Artificial
  CRISPR gRNA sequence
ctgaaacagcttagtcgcct

SEQ ID NO: 450033 - DNA, 20 bp, Artificial
  CRISPR gRNA sequence
cagcttagtcgccttggact

SEQ ID NO: 450034 - DNA, 20 bp, Artificial
  CRISPR gRNA sequence
agcttagtcgccttggactt

SEQ ID NO: 450035 - DNA, 20 bp, Artificial
  CRISPR gRNA sequence
tggacttgggtatccccaaa

SEQ ID NO: 450036 - DNA, 20 bp, Artificial
  CRISPR gRNA sequence
ccccaaatagccccattttc

SEQ ID NO: 450037 - DNA, 20 bp, Artificial
  CRISPR gRNA sequence
ccaaatagccccattttcta

SEQ ID NO: 450038 - DNA, 20 bp, Artificial
  CRISPR gRNA sequence
aatagccccattttctagag

SEQ ID NO: 450039 - DNA, 20 bp, Artificial
  CRISPR gRNA sequence
cccattttctagagtggttc

SEQ ID NO: 450040 - DNA, 20 bp, Artificial
  CRISPR gRNA sequence
ctagagtggttcaagcaatc

SEQ ID NO: 450041 - DNA, 20 bp, Artificial
  CRISPR gRNA sequence
tggttcaagcaatctagcat

SEQ ID NO: 450042 - DNA, 20 bp, Artificial
  CRISPR gRNA sequence
aagttaaaatcttgcccttt

SEQ ID NO: 450043 - DNA, 20 bp, Artificial
  CRISPR gRNA sequence
aaaatcttgcccttttggaa

SEQ ID NO: 450044 - DNA, 20 bp, Artificial
  CRISPR gRNA sequence
ttgcccttttggaatagatc

SEQ ID NO: 450045 - DNA, 20 bp, Artificial
  CRISPR gRNA sequence
tgcccttttggaatagatct

SEQ ID NO: 450046 - DNA, 20 bp, Artificial
  CRISPR gRNA sequence
tgttttgtttttgttttttt

SEQ ID NO: 450047 - DNA, 20 bp, Artificial
  CRISPR gRNA sequence
ttgtttttgtttttttgaga

SEQ ID NO: 450048 - DNA, 20 bp, Artificial
  CRISPR gRNA sequence
tgtttttgtttttttgagac

SEQ ID NO: 450049 - DNA, 20 bp, Artificial
  CRISPR gRNA sequence
gtttttgtttttttgagaca

SEQ ID NO: 450050 - DNA, 20 bp, Artificial
  CRISPR gRNA sequence
cagggtcttgctctgtcatc

SEQ ID NO: 450051 - DNA, 20 bp, Artificial
  CRISPR gRNA sequence
agggtcttgctctgtcatcc

SEQ ID NO: 450052 - DNA, 20 bp, Artificial
  CRISPR gRNA sequence
tcttgctctgtcatccaggc

SEQ ID NO: 450053 - DNA, 20 bp, Artificial
  CRISPR gRNA sequence
ttgctctgtcatccaggcta

SEQ ID NO: 450054 - DNA, 20 bp, Artificial
  CRISPR gRNA sequence
ctgtcatccaggctagagta

SEQ ID NO: 450055 - DNA, 20 bp, Artificial
  CRISPR gRNA sequence
tcatccaggctagagtacag

SEQ ID NO: 450056 - DNA, 20 bp, Artificial
  CRISPR gRNA sequence
agagtacagtggcatgatca

SEQ ID NO: 450057 - DNA, 20 bp, Artificial
  CRISPR gRNA sequence
gagtacagtggcatgatcat

SEQ ID NO: 450058 - DNA, 20 bp, Artificial
  CRISPR gRNA sequence
ggcatgatcatgggtcactg

SEQ ID NO: 450059 - DNA, 20 bp, Artificial
  CRISPR gRNA sequence
tcactgcagcctcatgcccc

SEQ ID NO: 450060 - DNA, 20 bp, Artificial
  CRISPR gRNA sequence
cccaatcgatcctcccacct

SEQ ID NO: 450061 - DNA, 20 bp, Artificial
  CRISPR gRNA sequence
tcctcccacctcagcttccc

SEQ ID NO: 450062 - DNA, 20 bp, Artificial
  CRISPR gRNA sequence
tcccacctcagcttccctag

SEQ ID NO: 450063 - DNA, 20 bp, Artificial
  CRISPR gRNA sequence
acctcagcttccctagtagc

SEQ ID NO: 450064 - DNA, 20 bp, Artificial
  CRISPR gRNA sequence
cctcagcttccctagtagct

SEQ ID NO: 450065 - DNA, 20 bp, Artificial
  CRISPR gRNA sequence
ttccctagtagctgggacta

SEQ ID NO: 450066 - DNA, 20 bp, Artificial
  CRISPR gRNA sequence
tccctagtagctgggactac

SEQ ID NO: 450067 - DNA, 20 bp, Artificial
  CRISPR gRNA sequence
caggcatgtgccaccacgcc

SEQ ID NO: 450068 - DNA, 20 bp, Artificial
  CRISPR gRNA sequence
gccaatttttgtattttttg

SEQ ID NO: 450069 - DNA, 20 bp, Artificial
  CRISPR gRNA sequence
caatttttgtattttttgta

SEQ ID NO: 450070 - DNA, 20 bp, Artificial
  CRISPR gRNA sequence
ttttgtattttttgtagaga

SEQ ID NO: 450071 - DNA, 20 bp, Artificial
  CRISPR gRNA sequence
tttgtattttttgtagagac

SEQ ID NO: 450072 - DNA, 20 bp, Artificial
  CRISPR gRNA sequence
caggttttcactgtgttgcc

SEQ ID NO: 450073 - DNA, 20 bp, Artificial
  CRISPR gRNA sequence
aggttttcactgtgttgccc

SEQ ID NO: 450074 - DNA, 20 bp, Artificial
  CRISPR gRNA sequence
tttcactgtgttgcccaggc

SEQ ID NO: 450075 - DNA, 20 bp, Artificial
  CRISPR gRNA sequence
ccaggctggtctcgaactcc

SEQ ID NO: 450076 - DNA, 20 bp, Artificial
  CRISPR gRNA sequence
caggctggtctcgaactcct

SEQ ID NO: 450077 - DNA, 20 bp, Artificial
  CRISPR gRNA sequence
ggtctcgaactcctgggttc

SEQ ID NO: 450078 - DNA, 20 bp, Artificial
  CRISPR gRNA sequence
ttcaagtgatgcacctgcct

SEQ ID NO: 450079 - DNA, 20 bp, Artificial
  CRISPR gRNA sequence
gcacctgccttggcctccct

SEQ ID NO: 450080 - DNA, 20 bp, Artificial
  CRISPR gRNA sequence
gccttggcctccctaagtgc

SEQ ID NO: 450081 - DNA, 20 bp, Artificial
  CRISPR gRNA sequence
ccttggcctccctaagtgct

SEQ ID NO: 450082 - DNA, 20 bp, Artificial
  CRISPR gRNA sequence
cttggcctccctaagtgctg

SEQ ID NO: 450083 - DNA, 20 bp, Artificial
  CRISPR gRNA sequence
ctccctaagtgctggggtta

SEQ ID NO: 450084 - DNA, 20 bp, Artificial
  CRISPR gRNA sequence
tccctaagtgctggggttac

SEQ ID NO: 450085 - DNA, 20 bp, Artificial
  CRISPR gRNA sequence
agtgctggggttacaggcat

SEQ ID NO: 450086 - DNA, 20 bp, Artificial
  CRISPR gRNA sequence
caggcatgagacactgcacc

SEQ ID NO: 450087 - DNA, 20 bp, Artificial
  CRISPR gRNA sequence
atgagacactgcacctggac

SEQ ID NO: 450088 - DNA, 20 bp, Artificial
  CRISPR gRNA sequence
cactgcacctggactagatc

SEQ ID NO: 450089 - DNA, 20 bp, Artificial
  CRISPR gRNA sequence
ttttatccatcatttactgt

SEQ ID NO: 450090 - DNA, 20 bp, Artificial
  CRISPR gRNA sequence
gatgaacataaattatcttc

SEQ ID NO: 450091 - DNA, 20 bp, Artificial
  CRISPR gRNA sequence
cataaattatcttcaagctt

SEQ ID NO: 450092 - DNA, 20 bp, Artificial
  CRISPR gRNA sequence
tcttcaagcttgagttatca

SEQ ID NO: 450093 - DNA, 20 bp, Artificial
  CRISPR gRNA sequence
cttcaagcttgagttatcac

SEQ ID NO: 450094 - DNA, 20 bp, Artificial
  CRISPR gRNA sequence
cttgagttatcacaggacaa

SEQ ID NO: 450095 - DNA, 20 bp, Artificial
  CRISPR gRNA sequence
atcacaggacaatagctcaa

SEQ ID NO: 450096 - DNA, 20 bp, Artificial
  CRISPR gRNA sequence
gacaatagctcaaaagacca

SEQ ID NO: 450097 - DNA, 20 bp, Artificial
  CRISPR gRNA sequence
caatagctcaaaagaccatg

SEQ ID NO: 450098 - DNA, 20 bp, Artificial
  CRISPR gRNA sequence
ttaaataatataatatcact

SEQ ID NO: 450099 - DNA, 20 bp, Artificial
  CRISPR gRNA sequence
atatcacttagcacaatgcc

SEQ ID NO: 450100 - DNA, 20 bp, Artificial
  CRISPR gRNA sequence
ttagcacaatgcctggccca

SEQ ID NO: 450101 - DNA, 20 bp, Artificial
  CRISPR gRNA sequence
cacaatgcctggcccacagt

SEQ ID NO: 450102 - DNA, 20 bp, Artificial
  CRISPR gRNA sequence
cctggcccacagtaagcact

SEQ ID NO: 450103 - DNA, 20 bp, Artificial
  CRISPR gRNA sequence
cacagtaagcactcagtaaa

SEQ ID NO: 450104 - DNA, 20 bp, Artificial
  CRISPR gRNA sequence
agtaagcactcagtaaatgg

SEQ ID NO: 450105 - DNA, 20 bp, Artificial
  CRISPR gRNA sequence
attttattatttcttttttt

SEQ ID NO: 450106 - DNA, 20 bp, Artificial
  CRISPR gRNA sequence
tattatttctttttttgaga

SEQ ID NO: 450107 - DNA, 20 bp, Artificial
  CRISPR gRNA sequence
ttatttctttttttgagaca

SEQ ID NO: 450108 - DNA, 20 bp, Artificial
  CRISPR gRNA sequence
tctttttttgagacagagtc

SEQ ID NO: 450109 - DNA, 20 bp, Artificial
  CRISPR gRNA sequence
cagagtctggctctgtcgcc

SEQ ID NO: 450110 - DNA, 20 bp, Artificial
  CRISPR gRNA sequence
agagtctggctctgtcgccc

SEQ ID NO: 450111 - DNA, 20 bp, Artificial
  CRISPR gRNA sequence
tggctctgtcgcccaggctc

SEQ ID NO: 450112 - DNA, 20 bp, Artificial
  CRISPR gRNA sequence
ctgtcgcccaggctcgagtg

SEQ ID NO: 450113 - DNA, 20 bp, Artificial
  CRISPR gRNA sequence
tcgcccaggctcgagtgcag

SEQ ID NO: 450114 - DNA, 20 bp, Artificial
  CRISPR gRNA sequence
cgagtgcagtggcgcaatct

SEQ ID NO: 450115 - DNA, 20 bp, Artificial
  CRISPR gRNA sequence
tcactgcaacctctgcttcc

SEQ ID NO: 450116 - DNA, 20 bp, Artificial
  CRISPR gRNA sequence
cactgcaacctctgcttccc

SEQ ID NO: 450117 - DNA, 20 bp, Artificial
  CRISPR gRNA sequence
aacctctgcttcccgggttc

SEQ ID NO: 450118 - DNA, 20 bp, Artificial
  CRISPR gRNA sequence
ttcaagtgattctcctgcct

SEQ ID NO: 450119 - DNA, 20 bp, Artificial
  CRISPR gRNA sequence
ttctcctgcctcagcctccc

SEQ ID NO: 450120 - DNA, 20 bp, Artificial
  CRISPR gRNA sequence
tcctgcctcagcctcccaag

SEQ ID NO: 450121 - DNA, 20 bp, Artificial
  CRISPR gRNA sequence
gcctcagcctcccaagtagc

SEQ ID NO: 450122 - DNA, 20 bp, Artificial
  CRISPR gRNA sequence
cctcagcctcccaagtagct

SEQ ID NO: 450123 - DNA, 20 bp, Artificial
  CRISPR gRNA sequence
ctcccaagtagctgggatta

SEQ ID NO: 450124 - DNA, 20 bp, Artificial
  CRISPR gRNA sequence
tcccaagtagctgggattac

SEQ ID NO: 450125 - DNA, 20 bp, Artificial
  CRISPR gRNA sequence
caggtgcgtgctaccacact

SEQ ID NO: 450126 - DNA, 20 bp, Artificial
  CRISPR gRNA sequence
tcggctattttttgtatttt

SEQ ID NO: 450127 - DNA, 20 bp, Artificial
  CRISPR gRNA sequence
gctattttttgtatttttag

SEQ ID NO: 450128 - DNA, 20 bp, Artificial
  CRISPR gRNA sequence
tattttttgtatttttagta

SEQ ID NO: 450129 - DNA, 20 bp, Artificial
  CRISPR gRNA sequence
ttttgtatttttagtagaga

SEQ ID NO: 450130 - DNA, 20 bp, Artificial
  CRISPR gRNA sequence
tttgtatttttagtagagac

SEQ ID NO: 450131 - DNA, 20 bp, Artificial
  CRISPR gRNA sequence
ttgtatttttagtagagaca

SEQ ID NO: 450132 - DNA, 20 bp, Artificial
  CRISPR gRNA sequence
gagacagggtttcaccatgt

SEQ ID NO: 450133 - DNA, 20 bp, Artificial
  CRISPR gRNA sequence
cagggtttcaccatgttggc

SEQ ID NO: 450134 - DNA, 20 bp, Artificial
  CRISPR gRNA sequence
agggtttcaccatgttggcc

SEQ ID NO: 450135 - DNA, 20 bp, Artificial
  CRISPR gRNA sequence
cctgatctcaaatgatctgc

SEQ ID NO: 450136 - DNA, 20 bp, Artificial
  CRISPR gRNA sequence
ctcaaatgatctgccagcct

SEQ ID NO: 450137 - DNA, 20 bp, Artificial
  CRISPR gRNA sequence
ctgccagcctcagcctcctg

SEQ ID NO: 450138 - DNA, 20 bp, Artificial
  CRISPR gRNA sequence
gcctcagcctcctgaagtgc

SEQ ID NO: 450139 - DNA, 20 bp, Artificial
  CRISPR gRNA sequence
cctcagcctcctgaagtgct

SEQ ID NO: 450140 - DNA, 20 bp, Artificial
  CRISPR gRNA sequence
ctcctgaagtgctgggatta

SEQ ID NO: 450141 - DNA, 20 bp, Artificial
  CRISPR gRNA sequence
tcctgaagtgctgggattac

SEQ ID NO: 450142 - DNA, 20 bp, Artificial
  CRISPR gRNA sequence
agtgctgggattacaggcgt

SEQ ID NO: 450143 - DNA, 20 bp, Artificial
  CRISPR gRNA sequence
attacctgtctcttcttaac

SEQ ID NO: 450144 - DNA, 20 bp, Artificial
  CRISPR gRNA sequence
atgcacctaatttccacact

SEQ ID NO: 450145 - DNA, 20 bp, Artificial
  CRISPR gRNA sequence
tgcacctaatttccacactt

SEQ ID NO: 450146 - DNA, 20 bp, Artificial
  CRISPR gRNA sequence
gcacctaatttccacacttg

SEQ ID NO: 450147 - DNA, 20 bp, Artificial
  CRISPR gRNA sequence
tccacacttggggaaccatc

SEQ ID NO: 450148 - DNA, 20 bp, Artificial
  CRISPR gRNA sequence
ctctaatacttaaatatgct

SEQ ID NO: 450149 - DNA, 20 bp, Artificial
  CRISPR gRNA sequence
taatacttaaatatgctgag

SEQ ID NO: 450150 - DNA, 20 bp, Artificial
  CRISPR gRNA sequence
cttaaatatgctgagaagat

SEQ ID NO: 450151 - DNA, 20 bp, Artificial
  CRISPR gRNA sequence
atatgctgagaagatgagaa

SEQ ID NO: 450152 - DNA, 20 bp, Artificial
  CRISPR gRNA sequence
atgagaaaagcattcttcct

SEQ ID NO: 450153 - DNA, 20 bp, Artificial
  CRISPR gRNA sequence
tgagaaaagcattcttcctt

SEQ ID NO: 450154 - DNA, 20 bp, Artificial
  CRISPR gRNA sequence
gagaaaagcattcttcctta

SEQ ID NO: 450155 - DNA, 20 bp, Artificial
  CRISPR gRNA sequence
gaaaagcattcttccttagg

SEQ ID NO: 450156 - DNA, 20 bp, Artificial
  CRISPR gRNA sequence
tcacaactaaaacaatatat

SEQ ID NO: 450157 - DNA, 20 bp, Artificial
  CRISPR gRNA sequence
cacaactaaaacaatatatt

SEQ ID NO: 450158 - DNA, 20 bp, Artificial
  CRISPR gRNA sequence
caactaaaacaatatattag

SEQ ID NO: 450159 - DNA, 20 bp, Artificial
  CRISPR gRNA sequence
aaaacaatatattaggagaa

SEQ ID NO: 450160 - DNA, 20 bp, Artificial
  CRISPR gRNA sequence
aaacaatatattaggagaac

SEQ ID NO: 450161 - DNA, 20 bp, Artificial
  CRISPR gRNA sequence
tatattaggagaacaggatt

SEQ ID NO: 450162 - DNA, 20 bp, Artificial
  CRISPR gRNA sequence
atattaggagaacaggattt

SEQ ID NO: 450163 - DNA, 20 bp, Artificial
  CRISPR gRNA sequence
gagaacaggatttaggttat

SEQ ID NO: 450164 - DNA, 20 bp, Artificial
  CRISPR gRNA sequence
agaacaggatttaggttata

SEQ ID NO: 450165 - DNA, 20 bp, Artificial
  CRISPR gRNA sequence
aacaggatttaggttataag

SEQ ID NO: 450166 - DNA, 20 bp, Artificial
  CRISPR gRNA sequence
ggatttaggttataaggagc

SEQ ID NO: 450167 - DNA, 20 bp, Artificial
  CRISPR gRNA sequence
gatttaggttataaggagca

SEQ ID NO: 450168 - DNA, 20 bp, Artificial
  CRISPR gRNA sequence
tatacctcattctgttctcc

SEQ ID NO: 450169 - DNA, 20 bp, Artificial
  CRISPR gRNA sequence
atacctcattctgttctcca

SEQ ID NO: 450170 - DNA, 20 bp, Artificial
  CRISPR gRNA sequence
tcattctgttctccaaggca

SEQ ID NO: 450171 - DNA, 20 bp, Artificial
  CRISPR gRNA sequence
tgttctccaaggcatagcgc

SEQ ID NO: 450172 - DNA, 20 bp, Artificial
  CRISPR gRNA sequence
gttctccaaggcatagcgct

SEQ ID NO: 450173 - DNA, 20 bp, Artificial
  CRISPR gRNA sequence
ccaaggcatagcgctgggcc

SEQ ID NO: 450174 - DNA, 20 bp, Artificial
  CRISPR gRNA sequence
caaggcatagcgctgggcct

SEQ ID NO: 450175 - DNA, 20 bp, Artificial
  CRISPR gRNA sequence
gatgcacaatacatatttgt

SEQ ID NO: 450176 - DNA, 20 bp, Artificial
  CRISPR gRNA sequence
catatttgttagatgaatga

SEQ ID NO: 450177 - DNA, 20 bp, Artificial
  CRISPR gRNA sequence
tatttgttagatgaatgaaa

SEQ ID NO: 450178 - DNA, 20 bp, Artificial
  CRISPR gRNA sequence
atttgttagatgaatgaaag

SEQ ID NO: 450179 - DNA, 20 bp, Artificial
  CRISPR gRNA sequence
ttgttagatgaatgaaagag

SEQ ID NO: 450180 - DNA, 20 bp, Artificial
  CRISPR gRNA sequence
aatgaaagaggagtatccac

SEQ ID NO: 450181 - DNA, 20 bp, Artificial
  CRISPR gRNA sequence
aagaggagtatccactagtg

SEQ ID NO: 450182 - DNA, 20 bp, Artificial
  CRISPR gRNA sequence
ccactagtgcagtttaactg

SEQ ID NO: 450183 - DNA, 20 bp, Artificial
  CRISPR gRNA sequence
aagcaatgtattcacataaa

SEQ ID NO: 450184 - DNA, 20 bp, Artificial
  CRISPR gRNA sequence
ataaatagaatgaaatgcta

SEQ ID NO: 450185 - DNA, 20 bp, Artificial
  CRISPR gRNA sequence
aaatagaatgaaatgctata

SEQ ID NO: 450186 - DNA, 20 bp, Artificial
  CRISPR gRNA sequence
atgaaatgctatagagtctc

SEQ ID NO: 450187 - DNA, 20 bp, Artificial
  CRISPR gRNA sequence
tgctatagagtctctagtgc

SEQ ID NO: 450188 - DNA, 20 bp, Artificial
  CRISPR gRNA sequence
gctatagagtctctagtgcc

SEQ ID NO: 450189 - DNA, 20 bp, Artificial
  CRISPR gRNA sequence
agtgccaggctaatgtaatt

SEQ ID NO: 450190 - DNA, 20 bp, Artificial
  CRISPR gRNA sequence
gtaatttagactttattcca

SEQ ID NO: 450191 - DNA, 20 bp, Artificial
  CRISPR gRNA sequence
tttagactttattccataga

SEQ ID NO: 450192 - DNA, 20 bp, Artificial
  CRISPR gRNA sequence
gactttattccatagacagt

SEQ ID NO: 450193 - DNA, 20 bp, Artificial
  CRISPR gRNA sequence
tttattccatagacagtgag

SEQ ID NO: 450194 - DNA, 20 bp, Artificial
  CRISPR gRNA sequence
tgagaagccattaaaacttt

SEQ ID NO: 450195 - DNA, 20 bp, Artificial
  CRISPR gRNA sequence
cattaaaactttgagtgatg

SEQ ID NO: 450196 - DNA, 20 bp, Artificial
  CRISPR gRNA sequence
gtgatgtggcatgtacaaat

SEQ ID NO: 450197 - DNA, 20 bp, Artificial
  CRISPR gRNA sequence
gcatgtacaaattagcattt

SEQ ID NO: 450198 - DNA, 20 bp, Artificial
  CRISPR gRNA sequence
gtacaaattagcattttgga

SEQ ID NO: 450199 - DNA, 20 bp, Artificial
  CRISPR gRNA sequence
aattagcattttggaaagac

SEQ ID NO: 450200 - DNA, 20 bp, Artificial
  CRISPR gRNA sequence
agcattttggaaagacaagc

SEQ ID NO: 450201 - DNA, 20 bp, Artificial
  CRISPR gRNA sequence
attttggaaagacaagctgg

SEQ ID NO: 450202 - DNA, 20 bp, Artificial
  CRISPR gRNA sequence
ttggaaagacaagctggtgg

SEQ ID NO: 450203 - DNA, 20 bp, Artificial
  CRISPR gRNA sequence
gacaagctggtggtagtatg

SEQ ID NO: 450204 - DNA, 20 bp, Artificial
  CRISPR gRNA sequence
gctggtggtagtatgtagaa

SEQ ID NO: 450205 - DNA, 20 bp, Artificial
  CRISPR gRNA sequence
tggtagtatgtagaatggat

SEQ ID NO: 450206 - DNA, 20 bp, Artificial
  CRISPR gRNA sequence
gtagtatgtagaatggattg

SEQ ID NO: 450207 - DNA, 20 bp, Artificial
  CRISPR gRNA sequence
tagtatgtagaatggattgg

SEQ ID NO: 450208 - DNA, 20 bp, Artificial
  CRISPR gRNA sequence
tatgtagaatggattggagg

SEQ ID NO: 450209 - DNA, 20 bp, Artificial
  CRISPR gRNA sequence
gaatggattggaggcagaaa

SEQ ID NO: 450210 - DNA, 20 bp, Artificial
  CRISPR gRNA sequence
ttggaggcagaaacagtatt

SEQ ID NO: 450211 - DNA, 20 bp, Artificial
  CRISPR gRNA sequence
ggaggcagaaacagtattta

SEQ ID NO: 450212 - DNA, 20 bp, Artificial
  CRISPR gRNA sequence
gaaacagtatttagagttgc

SEQ ID NO: 450213 - DNA, 20 bp, Artificial
  CRISPR gRNA sequence
atttagagttgctggaccat

SEQ ID NO: 450214 - DNA, 20 bp, Artificial
  CRISPR gRNA sequence
tttagagttgctggaccatt

SEQ ID NO: 450215 - DNA, 20 bp, Artificial
  CRISPR gRNA sequence
gttgctggaccattaggcaa

SEQ ID NO: 450216 - DNA, 20 bp, Artificial
  CRISPR gRNA sequence
tggaccattaggcaacagct

SEQ ID NO: 450217 - DNA, 20 bp, Artificial
  CRISPR gRNA sequence
attaggcaacagctcagtgc

SEQ ID NO: 450218 - DNA, 20 bp, Artificial
  CRISPR gRNA sequence
ttaggcaacagctcagtgct

SEQ ID NO: 450219 - DNA, 20 bp, Artificial
  CRISPR gRNA sequence
cagctcagtgctaggccctg

SEQ ID NO: 450220 - DNA, 20 bp, Artificial
  CRISPR gRNA sequence
ctcagtgctaggccctgtgg

SEQ ID NO: 450221 - DNA, 20 bp, Artificial
  CRISPR gRNA sequence
tcagtgctaggccctgtggt

SEQ ID NO: 450222 - DNA, 20 bp, Artificial
  CRISPR gRNA sequence
gctaggccctgtggtaggtg

SEQ ID NO: 450223 - DNA, 20 bp, Artificial
  CRISPR gRNA sequence
ctaggccctgtggtaggtgt

SEQ ID NO: 450224 - DNA, 20 bp, Artificial
  CRISPR gRNA sequence
aggccctgtggtaggtgtgg

SEQ ID NO: 450225 - DNA, 20 bp, Artificial
  CRISPR gRNA sequence
tggtaggtgtgggagataca

SEQ ID NO: 450226 - DNA, 20 bp, Artificial
  CRISPR gRNA sequence
ggtaggtgtgggagatacaa

SEQ ID NO: 450227 - DNA, 20 bp, Artificial
  CRISPR gRNA sequence
gtgggagatacaaaggtgac

SEQ ID NO: 450228 - DNA, 20 bp, Artificial
  CRISPR gRNA sequence
tgggagatacaaaggtgact

SEQ ID NO: 450229 - DNA, 20 bp, Artificial
  CRISPR gRNA sequence
gggagatacaaaggtgacta

SEQ ID NO: 450230 - DNA, 20 bp, Artificial
  CRISPR gRNA sequence
atacaaaggtgactagggca

SEQ ID NO: 450231 - DNA, 20 bp, Artificial
  CRISPR gRNA sequence
agggcacagttgctgaactc

SEQ ID NO: 450232 - DNA, 20 bp, Artificial
  CRISPR gRNA sequence
gggcacagttgctgaactca

SEQ ID NO: 450233 - DNA, 20 bp, Artificial
  CRISPR gRNA sequence
ggcacagttgctgaactcaa

SEQ ID NO: 450234 - DNA, 20 bp, Artificial
  CRISPR gRNA sequence
gctgaactcaagggactcac

SEQ ID NO: 450235 - DNA, 20 bp, Artificial
  CRISPR gRNA sequence
aactcaagggactcactagt

SEQ ID NO: 450236 - DNA, 20 bp, Artificial
  CRISPR gRNA sequence
actcaagggactcactagtt

SEQ ID NO: 450237 - DNA, 20 bp, Artificial
  CRISPR gRNA sequence
tcaagggactcactagttag

SEQ ID NO: 450238 - DNA, 20 bp, Artificial
  CRISPR gRNA sequence
actcactagttaggagacta

SEQ ID NO: 450239 - DNA, 20 bp, Artificial
  CRISPR gRNA sequence
ctcactagttaggagactat

SEQ ID NO: 450240 - DNA, 20 bp, Artificial
  CRISPR gRNA sequence
ggagactataggaatatgtt

SEQ ID NO: 450241 - DNA, 20 bp, Artificial
  CRISPR gRNA sequence
tataggaatatgttaagtgt

SEQ ID NO: 450242 - DNA, 20 bp, Artificial
  CRISPR gRNA sequence
ataggaatatgttaagtgtg

SEQ ID NO: 450243 - DNA, 20 bp, Artificial
  CRISPR gRNA sequence
atgttaagtgtgaggtgatg

SEQ ID NO: 450244 - DNA, 20 bp, Artificial
  CRISPR gRNA sequence
gaagacctgaaaaacacctt

SEQ ID NO: 450245 - DNA, 20 bp, Artificial
  CRISPR gRNA sequence
gacctgaaaaacacctttgg

SEQ ID NO: 450246 - DNA, 20 bp, Artificial
  CRISPR gRNA sequence
acctgaaaaacacctttgga

SEQ ID NO: 450247 - DNA, 20 bp, Artificial
  CRISPR gRNA sequence
gaaaaacacctttggaagga

SEQ ID NO: 450248 - DNA, 20 bp, Artificial
  CRISPR gRNA sequence
aaaaacacctttggaaggaa

SEQ ID NO: 450249 - DNA, 20 bp, Artificial
  CRISPR gRNA sequence
ttggaaggaaaggaataaca

SEQ ID NO: 450250 - DNA, 20 bp, Artificial
  CRISPR gRNA sequence
tactgctattcttccccact

SEQ ID NO: 450251 - DNA, 20 bp, Artificial
  CRISPR gRNA sequence
ccccactaagtactgctgtg

SEQ ID NO: 450252 - DNA, 20 bp, Artificial
  CRISPR gRNA sequence
cactaagtactgctgtgcgg

SEQ ID NO: 450253 - DNA, 20 bp, Artificial
  CRISPR gRNA sequence
agtactgctgtgcggaagaa

SEQ ID NO: 450254 - DNA, 20 bp, Artificial
  CRISPR gRNA sequence
actgctgtgcggaagaacag

SEQ ID NO: 450255 - DNA, 20 bp, Artificial
  CRISPR gRNA sequence
tgcggaagaacagcagtact

SEQ ID NO: 450256 - DNA, 20 bp, Artificial
  CRISPR gRNA sequence
tacttagtaactctctgaat

SEQ ID NO: 450257 - DNA, 20 bp, Artificial
  CRISPR gRNA sequence
acttagtaactctctgaatt

SEQ ID NO: 450258 - DNA, 20 bp, Artificial
  CRISPR gRNA sequence
cttagtaactctctgaattg

SEQ ID NO: 450259 - DNA, 20 bp, Artificial
  CRISPR gRNA sequence
ttagtaactctctgaattgg

SEQ ID NO: 450260 - DNA, 20 bp, Artificial
  CRISPR gRNA sequence
aactctctgaattgggggtt

SEQ ID NO: 450261 - DNA, 20 bp, Artificial
  CRISPR gRNA sequence
tgaattgggggttaagaaaa

SEQ ID NO: 450262 - DNA, 20 bp, Artificial
  CRISPR gRNA sequence
gaattgggggttaagaaaaa

SEQ ID NO: 450263 - DNA, 20 bp, Artificial
  CRISPR gRNA sequence
attgggggttaagaaaaaag

SEQ ID NO: 450264 - DNA, 20 bp, Artificial
  CRISPR gRNA sequence
ttgggggttaagaaaaaagg

SEQ ID NO: 450265 - DNA, 20 bp, Artificial
  CRISPR gRNA sequence
taagaaaaaaggaggaacca

SEQ ID NO: 450266 - DNA, 20 bp, Artificial
  CRISPR gRNA sequence
aaagttgactccgtcatgaa

SEQ ID NO: 450267 - DNA, 20 bp, Artificial
  CRISPR gRNA sequence
gactccgtcatgaacagaaa

SEQ ID NO: 450268 - DNA, 20 bp, Artificial
  CRISPR gRNA sequence
actccgtcatgaacagaaat

SEQ ID NO: 450269 - DNA, 20 bp, Artificial
  CRISPR gRNA sequence
ctccgtcatgaacagaaata

SEQ ID NO: 450270 - DNA, 20 bp, Artificial
  CRISPR gRNA sequence
catgaacagaaatagggtct

SEQ ID NO: 450271 - DNA, 20 bp, Artificial
  CRISPR gRNA sequence
atgaacagaaatagggtctc

SEQ ID NO: 450272 - DNA, 20 bp, Artificial
  CRISPR gRNA sequence
gaacagaaatagggtctcag

SEQ ID NO: 450273 - DNA, 20 bp, Artificial
  CRISPR gRNA sequence
aacagaaatagggtctcagg

SEQ ID NO: 450274 - DNA, 20 bp, Artificial
  CRISPR gRNA sequence
gaaatagggtctcaggagga

SEQ ID NO: 450275 - DNA, 20 bp, Artificial
  CRISPR gRNA sequence
aggaggatagctttgatact

SEQ ID NO: 450276 - DNA, 20 bp, Artificial
  CRISPR gRNA sequence
atagctttgatactgagttt

SEQ ID NO: 450277 - DNA, 20 bp, Artificial
  CRISPR gRNA sequence
tagctttgatactgagtttg

SEQ ID NO: 450278 - DNA, 20 bp, Artificial
  CRISPR gRNA sequence
tgatactgagtttgaggaaa

SEQ ID NO: 450279 - DNA, 20 bp, Artificial
  CRISPR gRNA sequence
tactgagtttgaggaaatgg

SEQ ID NO: 450280 - DNA, 20 bp, Artificial
  CRISPR gRNA sequence
actgagtttgaggaaatggt

SEQ ID NO: 450281 - DNA, 20 bp, Artificial
  CRISPR gRNA sequence
tgaggaaatggtgggacatc

SEQ ID NO: 450282 - DNA, 20 bp, Artificial
  CRISPR gRNA sequence
gaggaaatggtgggacatcc

SEQ ID NO: 450283 - DNA, 20 bp, Artificial
  CRISPR gRNA sequence
ggaaatggtgggacatccag

SEQ ID NO: 450284 - DNA, 20 bp, Artificial
  CRISPR gRNA sequence
atggtgggacatccaggagc

SEQ ID NO: 450285 - DNA, 20 bp, Artificial
  CRISPR gRNA sequence
tggtgggacatccaggagct

SEQ ID NO: 450286 - DNA, 20 bp, Artificial
  CRISPR gRNA sequence
gtgggacatccaggagctag

SEQ ID NO: 450287 - DNA, 20 bp, Artificial
  CRISPR gRNA sequence
acatccaggagctaggagta

SEQ ID NO: 450288 - DNA, 20 bp, Artificial
  CRISPR gRNA sequence
ggagctaggagtacagtttt

SEQ ID NO: 450289 - DNA, 20 bp, Artificial
  CRISPR gRNA sequence
ttaaacgtttaattaaaact

SEQ ID NO: 450290 - DNA, 20 bp, Artificial
  CRISPR gRNA sequence
taaacgtttaattaaaactt

SEQ ID NO: 450291 - DNA, 20 bp, Artificial
  CRISPR gRNA sequence
cgtttaattaaaacttagga

SEQ ID NO: 450292 - DNA, 20 bp, Artificial
  CRISPR gRNA sequence
gtttaattaaaacttaggaa

SEQ ID NO: 450293 - DNA, 20 bp, Artificial
  CRISPR gRNA sequence
aaaacttaggaaaggtgttc

SEQ ID NO: 450294 - DNA, 20 bp, Artificial
  CRISPR gRNA sequence
cttaggaaaggtgttcaagc

SEQ ID NO: 450295 - DNA, 20 bp, Artificial
  CRISPR gRNA sequence
taggaaaggtgttcaagctg

SEQ ID NO: 450296 - DNA, 20 bp, Artificial
  CRISPR gRNA sequence
gaaaggtgttcaagctggag

SEQ ID NO: 450297 - DNA, 20 bp, Artificial
  CRISPR gRNA sequence
agctggagaagttgatttgc

SEQ ID NO: 450298 - DNA, 20 bp, Artificial
  CRISPR gRNA sequence
ggagaagttgatttgctggt

SEQ ID NO: 450299 - DNA, 20 bp, Artificial
  CRISPR gRNA sequence
gttgatttgctggtcagttg

SEQ ID NO: 450300 - DNA, 20 bp, Artificial
  CRISPR gRNA sequence
ttgatttgctggtcagttgc

SEQ ID NO: 450301 - DNA, 20 bp, Artificial
  CRISPR gRNA sequence
tgatttgctggtcagttgca

SEQ ID NO: 450302 - DNA, 20 bp, Artificial
  CRISPR gRNA sequence
atttgctggtcagttgcagg

SEQ ID NO: 450303 - DNA, 20 bp, Artificial
  CRISPR gRNA sequence
ggtcagttgcagggagatgc

SEQ ID NO: 450304 - DNA, 20 bp, Artificial
  CRISPR gRNA sequence
ggagatgctggtttaaatcg

SEQ ID NO: 450305 - DNA, 20 bp, Artificial
  CRISPR gRNA sequence
gagatgctggtttaaatcgt

SEQ ID NO: 450306 - DNA, 20 bp, Artificial
  CRISPR gRNA sequence
atgctggtttaaatcgtggg

SEQ ID NO: 450307 - DNA, 20 bp, Artificial
  CRISPR gRNA sequence
ggtttaaatcgtgggtagat

SEQ ID NO: 450308 - DNA, 20 bp, Artificial
  CRISPR gRNA sequence
aatcgtgggtagatgagaac

SEQ ID NO: 450309 - DNA, 20 bp, Artificial
  CRISPR gRNA sequence
atcgtgggtagatgagaact

SEQ ID NO: 450310 - DNA, 20 bp, Artificial
  CRISPR gRNA sequence
tcgtgggtagatgagaacta

SEQ ID NO: 450311 - DNA, 20 bp, Artificial
  CRISPR gRNA sequence
gtgggtagatgagaactagg

SEQ ID NO: 450312 - DNA, 20 bp, Artificial
  CRISPR gRNA sequence
gggtagatgagaactaggga

SEQ ID NO: 450313 - DNA, 20 bp, Artificial
  CRISPR gRNA sequence
gtagatgagaactagggaga

SEQ ID NO: 450314 - DNA, 20 bp, Artificial
  CRISPR gRNA sequence
agatgagaactagggagaga

SEQ ID NO: 450315 - DNA, 20 bp, Artificial
  CRISPR gRNA sequence
agaactagggagagagagta

SEQ ID NO: 450316 - DNA, 20 bp, Artificial
  CRISPR gRNA sequence
aactagggagagagagtaaa

SEQ ID NO: 450317 - DNA, 20 bp, Artificial
  CRISPR gRNA sequence
gggagagagagtaaagagaa

SEQ ID NO: 450318 - DNA, 20 bp, Artificial
  CRISPR gRNA sequence
ggagagagagtaaagagaaa

SEQ ID NO: 450319 - DNA, 20 bp, Artificial
  CRISPR gRNA sequence
agagtaaagagaaaaggttg

SEQ ID NO: 450320 - DNA, 20 bp, Artificial
  CRISPR gRNA sequence
gagtaaagagaaaaggttga

SEQ ID NO: 450321 - DNA, 20 bp, Artificial
  CRISPR gRNA sequence
agtaaagagaaaaggttgaa

SEQ ID NO: 450322 - DNA, 20 bp, Artificial
  CRISPR gRNA sequence
gtaaagagaaaaggttgaag

SEQ ID NO: 450323 - DNA, 20 bp, Artificial
  CRISPR gRNA sequence
agagaaaaggttgaaggggt

SEQ ID NO: 450324 - DNA, 20 bp, Artificial
  CRISPR gRNA sequence
gaaaaggttgaaggggtgag

SEQ ID NO: 450325 - DNA, 20 bp, Artificial
  CRISPR gRNA sequence
aggttgaaggggtgagaagt

SEQ ID NO: 450326 - DNA, 20 bp, Artificial
  CRISPR gRNA sequence
aaggggtgagaagtgagtct

SEQ ID NO: 450327 - DNA, 20 bp, Artificial
  CRISPR gRNA sequence
aggggtgagaagtgagtctt

SEQ ID NO: 450328 - DNA, 20 bp, Artificial
  CRISPR gRNA sequence
ggggtgagaagtgagtcttg

SEQ ID NO: 450329 - DNA, 20 bp, Artificial
  CRISPR gRNA sequence
cttggggaatactcatgttt

SEQ ID NO: 450330 - DNA, 20 bp, Artificial
  CRISPR gRNA sequence
tggggaatactcatgtttga

SEQ ID NO: 450331 - DNA, 20 bp, Artificial
  CRISPR gRNA sequence
ggggaatactcatgtttgag

SEQ ID NO: 450332 - DNA, 20 bp, Artificial
  CRISPR gRNA sequence
gaatactcatgtttgagagg

SEQ ID NO: 450333 - DNA, 20 bp, Artificial
  CRISPR gRNA sequence
aatactcatgtttgagaggt

SEQ ID NO: 450334 - DNA, 20 bp, Artificial
  CRISPR gRNA sequence
tactcatgtttgagaggtgg

SEQ ID NO: 450335 - DNA, 20 bp, Artificial
  CRISPR gRNA sequence
actcatgtttgagaggtggg

SEQ ID NO: 450336 - DNA, 20 bp, Artificial
  CRISPR gRNA sequence
tcatgtttgagaggtgggag

SEQ ID NO: 450337 - DNA, 20 bp, Artificial
  CRISPR gRNA sequence
catgtttgagaggtgggagg

SEQ ID NO: 450338 - DNA, 20 bp, Artificial
  CRISPR gRNA sequence
tgagaggtgggaggaggaaa

SEQ ID NO: 450339 - DNA, 20 bp, Artificial
  CRISPR gRNA sequence
agaggtgggaggaggaaata

SEQ ID NO: 450340 - DNA, 20 bp, Artificial
  CRISPR gRNA sequence
ggtgggaggaggaaatagag

SEQ ID NO: 450341 - DNA, 20 bp, Artificial
  CRISPR gRNA sequence
ggaggaaatagagaagacaa

SEQ ID NO: 450342 - DNA, 20 bp, Artificial
  CRISPR gRNA sequence
aaatagagaagacaaaagaa

SEQ ID NO: 450343 - DNA, 20 bp, Artificial
  CRISPR gRNA sequence
agagaagacaaaagaacagc

SEQ ID NO: 450344 - DNA, 20 bp, Artificial
  CRISPR gRNA sequence
gagaagacaaaagaacagcc

SEQ ID NO: 450345 - DNA, 20 bp, Artificial
  CRISPR gRNA sequence
aagacaaaagaacagccagg

SEQ ID NO: 450346 - DNA, 20 bp, Artificial
  CRISPR gRNA sequence
agacaaaagaacagccaggt

SEQ ID NO: 450347 - DNA, 20 bp, Artificial
  CRISPR gRNA sequence
caaaagaacagccaggtggg

SEQ ID NO: 450348 - DNA, 20 bp, Artificial
  CRISPR gRNA sequence
gaacagccaggtgggtagaa

SEQ ID NO: 450349 - DNA, 20 bp, Artificial
  CRISPR gRNA sequence
agccaggtgggtagaacagc

SEQ ID NO: 450350 - DNA, 20 bp, Artificial
  CRISPR gRNA sequence
gccaggtgggtagaacagcc

SEQ ID NO: 450351 - DNA, 20 bp, Artificial
  CRISPR gRNA sequence
ccaggtgggtagaacagcca

SEQ ID NO: 450352 - DNA, 20 bp, Artificial
  CRISPR gRNA sequence
caggtgggtagaacagccag

SEQ ID NO: 450353 - DNA, 20 bp, Artificial
  CRISPR gRNA sequence
ggtgggtagaacagccaggg

SEQ ID NO: 450354 - DNA, 20 bp, Artificial
  CRISPR gRNA sequence
gtagaacagccaggggagta

SEQ ID NO: 450355 - DNA, 20 bp, Artificial
  CRISPR gRNA sequence
cagccaggggagtacagtca

SEQ ID NO: 450356 - DNA, 20 bp, Artificial
  CRISPR gRNA sequence
ccaggggagtacagtcacag

SEQ ID NO: 450357 - DNA, 20 bp, Artificial
  CRISPR gRNA sequence
agtacagtcacagaagccac

SEQ ID NO: 450358 - DNA, 20 bp, Artificial
  CRISPR gRNA sequence
tacagtcacagaagccactg

SEQ ID NO: 450359 - DNA, 20 bp, Artificial
  CRISPR gRNA sequence
acagaagccactggagatga

SEQ ID NO: 450360 - DNA, 20 bp, Artificial
  CRISPR gRNA sequence
ctggagatgacagtttgatg

SEQ ID NO: 450361 - DNA, 20 bp, Artificial
  CRISPR gRNA sequence
tggagatgacagtttgatga

SEQ ID NO: 450362 - DNA, 20 bp, Artificial
  CRISPR gRNA sequence
gagatgacagtttgatgaag

SEQ ID NO: 450363 - DNA, 20 bp, Artificial
  CRISPR gRNA sequence
agatgacagtttgatgaagg

SEQ ID NO: 450364 - DNA, 20 bp, Artificial
  CRISPR gRNA sequence
gatgacagtttgatgaagga

SEQ ID NO: 450365 - DNA, 20 bp, Artificial
  CRISPR gRNA sequence
cagtttgatgaaggagggaa

SEQ ID NO: 450366 - DNA, 20 bp, Artificial
  CRISPR gRNA sequence
ttgatgaaggagggaatagt

SEQ ID NO: 450367 - DNA, 20 bp, Artificial
  CRISPR gRNA sequence
atgaaggagggaatagtcag

SEQ ID NO: 450368 - DNA, 20 bp, Artificial
  CRISPR gRNA sequence
gtcagaagtgctgaatgcta

SEQ ID NO: 450369 - DNA, 20 bp, Artificial
  CRISPR gRNA sequence
gaagtgctgaatgctatagc

SEQ ID NO: 450370 - DNA, 20 bp, Artificial
  CRISPR gRNA sequence
aagtgctgaatgctatagct

SEQ ID NO: 450371 - DNA, 20 bp, Artificial
  CRISPR gRNA sequence
gctgaatgctatagctaggt

SEQ ID NO: 450372 - DNA, 20 bp, Artificial
  CRISPR gRNA sequence
aatgctatagctaggtcaga

SEQ ID NO: 450373 - DNA, 20 bp, Artificial
  CRISPR gRNA sequence
atgctatagctaggtcagac

SEQ ID NO: 450374 - DNA, 20 bp, Artificial
  CRISPR gRNA sequence
ctatagctaggtcagacagg

SEQ ID NO: 450375 - DNA, 20 bp, Artificial
  CRISPR gRNA sequence
taggtcagacaggaagacac

SEQ ID NO: 450376 - DNA, 20 bp, Artificial
  CRISPR gRNA sequence
aggtcagacaggaagacacc

SEQ ID NO: 450377 - DNA, 20 bp, Artificial
  CRISPR gRNA sequence
tcagacaggaagacaccagg

SEQ ID NO: 450378 - DNA, 20 bp, Artificial
  CRISPR gRNA sequence
acaggaagacaccaggaagc

SEQ ID NO: 450379 - DNA, 20 bp, Artificial
  CRISPR gRNA sequence
caggaagacaccaggaagca

SEQ ID NO: 450380 - DNA, 20 bp, Artificial
  CRISPR gRNA sequence
acaccaggaagcaaggaaca

SEQ ID NO: 450381 - DNA, 20 bp, Artificial
  CRISPR gRNA sequence
caggaagcaaggaacaaagt

SEQ ID NO: 450382 - DNA, 20 bp, Artificial
  CRISPR gRNA sequence
caaagtcagtcaaactaaac

SEQ ID NO: 450383 - DNA, 20 bp, Artificial
  CRISPR gRNA sequence
agttgaaaatttgaattaac

SEQ ID NO: 450384 - DNA, 20 bp, Artificial
  CRISPR gRNA sequence
gttgaaaatttgaattaact

SEQ ID NO: 450385 - DNA, 20 bp, Artificial
  CRISPR gRNA sequence
tttgaattaactaggaacca

SEQ ID NO: 450386 - DNA, 20 bp, Artificial
  CRISPR gRNA sequence
ttgaattaactaggaaccat

SEQ ID NO: 450387 - DNA, 20 bp, Artificial
  CRISPR gRNA sequence
gaattaactaggaaccatag

SEQ ID NO: 450388 - DNA, 20 bp, Artificial
  CRISPR gRNA sequence
aattaactaggaaccatagg

SEQ ID NO: 450389 - DNA, 20 bp, Artificial
  CRISPR gRNA sequence
taggaaccataggaggtgat

SEQ ID NO: 450390 - DNA, 20 bp, Artificial
  CRISPR gRNA sequence
tgattagaaacatttgttca

SEQ ID NO: 450391 - DNA, 20 bp, Artificial
  CRISPR gRNA sequence
gattagaaacatttgttcaa

SEQ ID NO: 450392 - DNA, 20 bp, Artificial
  CRISPR gRNA sequence
aaacatttgttcaaaggctc

SEQ ID NO: 450393 - DNA, 20 bp, Artificial
  CRISPR gRNA sequence
aacatttgttcaaaggctct

SEQ ID NO: 450394 - DNA, 20 bp, Artificial
  CRISPR gRNA sequence
tttgttcaaaggctctgggc

SEQ ID NO: 450395 - DNA, 20 bp, Artificial
  CRISPR gRNA sequence
ggctctgggccagtttttca

SEQ ID NO: 450396 - DNA, 20 bp, Artificial
  CRISPR gRNA sequence
gctctgggccagtttttcat

SEQ ID NO: 450397 - DNA, 20 bp, Artificial
  CRISPR gRNA sequence
ctctgggccagtttttcatg

SEQ ID NO: 450398 - DNA, 20 bp, Artificial
  CRISPR gRNA sequence
tctgggccagtttttcatgg

SEQ ID NO: 450399 - DNA, 20 bp, Artificial
  CRISPR gRNA sequence
ctgggccagtttttcatggg

SEQ ID NO: 450400 - DNA, 20 bp, Artificial
  CRISPR gRNA sequence
gggccagtttttcatggggg

SEQ ID NO: 450401 - DNA, 20 bp, Artificial
  CRISPR gRNA sequence
ggccagtttttcatgggggg

SEQ ID NO: 450402 - DNA, 20 bp, Artificial
  CRISPR gRNA sequence
gccagtttttcatgggggga

SEQ ID NO: 450403 - DNA, 20 bp, Artificial
  CRISPR gRNA sequence
agtttttcatggggggaggg

SEQ ID NO: 450404 - DNA, 20 bp, Artificial
  CRISPR gRNA sequence
tttcatggggggagggtggt

SEQ ID NO: 450405 - DNA, 20 bp, Artificial
  CRISPR gRNA sequence
catggggggagggtggtgag

SEQ ID NO: 450406 - DNA, 20 bp, Artificial
  CRISPR gRNA sequence
atggggggagggtggtgagt

SEQ ID NO: 450407 - DNA, 20 bp, Artificial
  CRISPR gRNA sequence
ttatacttgtttttcttaaa

SEQ ID NO: 450408 - DNA, 20 bp, Artificial
  CRISPR gRNA sequence
acttgtttttcttaaaaagt

SEQ ID NO: 450409 - DNA, 20 bp, Artificial
  CRISPR gRNA sequence
gtttttcttaaaaagtaaga

SEQ ID NO: 450410 - DNA, 20 bp, Artificial
  CRISPR gRNA sequence
tttttcttaaaaagtaagat

SEQ ID NO: 450411 - DNA, 20 bp, Artificial
  CRISPR gRNA sequence
tcttaaaaagtaagataggc

SEQ ID NO: 450412 - DNA, 20 bp, Artificial
  CRISPR gRNA sequence
cttaaaaagtaagataggcc

SEQ ID NO: 450413 - DNA, 20 bp, Artificial
  CRISPR gRNA sequence
aaagtaagataggccaggca

SEQ ID NO: 450414 - DNA, 20 bp, Artificial
  CRISPR gRNA sequence
gtaagataggccaggcacgg

SEQ ID NO: 450415 - DNA, 20 bp, Artificial
  CRISPR gRNA sequence
gtggctcacacctgtaatcc

SEQ ID NO: 450416 - DNA, 20 bp, Artificial
  CRISPR gRNA sequence
cacctgtaatcccagcactt

SEQ ID NO: 450417 - DNA, 20 bp, Artificial
  CRISPR gRNA sequence
tgtaatcccagcactttggc

SEQ ID NO: 450418 - DNA, 20 bp, Artificial
  CRISPR gRNA sequence
gtaatcccagcactttggct

SEQ ID NO: 450419 - DNA, 20 bp, Artificial
  CRISPR gRNA sequence
cccagcactttggctaggct

SEQ ID NO: 450420 - DNA, 20 bp, Artificial
  CRISPR gRNA sequence
ccagcactttggctaggctg

SEQ ID NO: 450421 - DNA, 20 bp, Artificial
  CRISPR gRNA sequence
gcactttggctaggctgagg

SEQ ID NO: 450422 - DNA, 20 bp, Artificial
  CRISPR gRNA sequence
tttggctaggctgaggcgga

SEQ ID NO: 450423 - DNA, 20 bp, Artificial
  CRISPR gRNA sequence
ctgaggcggatagatcacct

SEQ ID NO: 450424 - DNA, 20 bp, Artificial
  CRISPR gRNA sequence
tgaggcggatagatcacctg

SEQ ID NO: 450425 - DNA, 20 bp, Artificial
  CRISPR gRNA sequence
gcggatagatcacctgaggt

SEQ ID NO: 450426 - DNA, 20 bp, Artificial
  CRISPR gRNA sequence
cggatagatcacctgaggtc

SEQ ID NO: 450427 - DNA, 20 bp, Artificial
  CRISPR gRNA sequence
gatagatcacctgaggtcag

SEQ ID NO: 450428 - DNA, 20 bp, Artificial
  CRISPR gRNA sequence
tcacctgaggtcaggagttt

SEQ ID NO: 450429 - DNA, 20 bp, Artificial
  CRISPR gRNA sequence
tgaggtcaggagtttgagac

SEQ ID NO: 450430 - DNA, 20 bp, Artificial
  CRISPR gRNA sequence
tcaggagtttgagaccagcc

SEQ ID NO: 450431 - DNA, 20 bp, Artificial
  CRISPR gRNA sequence
tgagaccagcctggccgtca

SEQ ID NO: 450432 - DNA, 20 bp, Artificial
  CRISPR gRNA sequence
actaaaaatacaaaaaaaat

SEQ ID NO: 450433 - DNA, 20 bp, Artificial
  CRISPR gRNA sequence
aaaatacaaaaaaaattagt

SEQ ID NO: 450434 - DNA, 20 bp, Artificial
  CRISPR gRNA sequence
tacaaaaaaaattagttgga

SEQ ID NO: 450435 - DNA, 20 bp, Artificial
  CRISPR gRNA sequence
acaaaaaaaattagttggat

SEQ ID NO: 450436 - DNA, 20 bp, Artificial
  CRISPR gRNA sequence
aaaaaaattagttggatggg

SEQ ID NO: 450437 - DNA, 20 bp, Artificial
  CRISPR gRNA sequence
aaaattagttggatgggtgg

SEQ ID NO: 450438 - DNA, 20 bp, Artificial
  CRISPR gRNA sequence
tgggtggtggcgtgtgcctg

SEQ ID NO: 450439 - DNA, 20 bp, Artificial
  CRISPR gRNA sequence
gtggcgtgtgcctgtagtcc

SEQ ID NO: 450440 - DNA, 20 bp, Artificial
  CRISPR gRNA sequence
tgcctgtagtcccagctatt

SEQ ID NO: 450441 - DNA, 20 bp, Artificial
  CRISPR gRNA sequence
gcctgtagtcccagctattt

SEQ ID NO: 450442 - DNA, 20 bp, Artificial
  CRISPR gRNA sequence
tgtagtcccagctatttggg

SEQ ID NO: 450443 - DNA, 20 bp, Artificial
  CRISPR gRNA sequence
tcccagctatttgggcggct

SEQ ID NO: 450444 - DNA, 20 bp, Artificial
  CRISPR gRNA sequence
cccagctatttgggcggctg

SEQ ID NO: 450445 - DNA, 20 bp, Artificial
  CRISPR gRNA sequence
agctatttgggcggctgagg

SEQ ID NO: 450446 - DNA, 20 bp, Artificial
  CRISPR gRNA sequence
gctatttgggcggctgaggc

SEQ ID NO: 450447 - DNA, 20 bp, Artificial
  CRISPR gRNA sequence
tatttgggcggctgaggcag

SEQ ID NO: 450448 - DNA, 20 bp, Artificial
  CRISPR gRNA sequence
caggagaatcacttgaacct

SEQ ID NO: 450449 - DNA, 20 bp, Artificial
  CRISPR gRNA sequence
ggagaatcacttgaaccttg

SEQ ID NO: 450450 - DNA, 20 bp, Artificial
  CRISPR gRNA sequence
gagaatcacttgaaccttgg

SEQ ID NO: 450451 - DNA, 20 bp, Artificial
  CRISPR gRNA sequence
aatcacttgaaccttggagg

SEQ ID NO: 450452 - DNA, 20 bp, Artificial
  CRISPR gRNA sequence
tcacttgaaccttggaggtg

SEQ ID NO: 450453 - DNA, 20 bp, Artificial
  CRISPR gRNA sequence
cacttgaaccttggaggtgg

SEQ ID NO: 450454 - DNA, 20 bp, Artificial
  CRISPR gRNA sequence
aaccttggaggtggaggttg

SEQ ID NO: 450455 - DNA, 20 bp, Artificial
  CRISPR gRNA sequence
ttggaggtggaggttgcagt

SEQ ID NO: 450456 - DNA, 20 bp, Artificial
  CRISPR gRNA sequence
gaggtggaggttgcagtgag

SEQ ID NO: 450457 - DNA, 20 bp, Artificial
  CRISPR gRNA sequence
ggtggaggttgcagtgagca

SEQ ID NO: 450458 - DNA, 20 bp, Artificial
  CRISPR gRNA sequence
gagatcacgccactgctctc

SEQ ID NO: 450459 - DNA, 20 bp, Artificial
  CRISPR gRNA sequence
cacgccactgctctccagcc

SEQ ID NO: 450460 - DNA, 20 bp, Artificial
  CRISPR gRNA sequence
ctgctctccagcccggacca

SEQ ID NO: 450461 - DNA, 20 bp, Artificial
  CRISPR gRNA sequence
gctctccagcccggaccaca

SEQ ID NO: 450462 - DNA, 20 bp, Artificial
  CRISPR gRNA sequence
tccagcccggaccacagagt

SEQ ID NO: 450463 - DNA, 20 bp, Artificial
  CRISPR gRNA sequence
cagcccggaccacagagtga

SEQ ID NO: 450464 - DNA, 20 bp, Artificial
  CRISPR gRNA sequence
gagtctgtctcaaaaaatca

SEQ ID NO: 450465 - DNA, 20 bp, Artificial
  CRISPR gRNA sequence
gtctcaaaaaatcaaagaaa

SEQ ID NO: 450466 - DNA, 20 bp, Artificial
  CRISPR gRNA sequence
tcaaagaaaaagaaaaaaaa

SEQ ID NO: 450467 - DNA, 20 bp, Artificial
  CRISPR gRNA sequence
agaaaaagaaaaaaaaaagt

SEQ ID NO: 450468 - DNA, 20 bp, Artificial
  CRISPR gRNA sequence
aaagaaaaaaaaaagtaaga

SEQ ID NO: 450469 - DNA, 20 bp, Artificial
  CRISPR gRNA sequence
aaaaaaagtaagatagttgt

SEQ ID NO: 450470 - DNA, 20 bp, Artificial
  CRISPR gRNA sequence
gtaagatagttgtaagttca

SEQ ID NO: 450471 - DNA, 20 bp, Artificial
  CRISPR gRNA sequence
aagatagttgtaagttcatg

SEQ ID NO: 450472 - DNA, 20 bp, Artificial
  CRISPR gRNA sequence
atagttgtaagttcatggag

SEQ ID NO: 450473 - DNA, 20 bp, Artificial
  CRISPR gRNA sequence
ttgtaagttcatggagaagt

SEQ ID NO: 450474 - DNA, 20 bp, Artificial
  CRISPR gRNA sequence
aagttcatggagaagtaaga

SEQ ID NO: 450475 - DNA, 20 bp, Artificial
  CRISPR gRNA sequence
gagaagtaagatagttgtaa

SEQ ID NO: 450476 - DNA, 20 bp, Artificial
  CRISPR gRNA sequence
aagatagttgtaaaagttca

SEQ ID NO: 450477 - DNA, 20 bp, Artificial
  CRISPR gRNA sequence
gatagttgtaaaagttcata

SEQ ID NO: 450478 - DNA, 20 bp, Artificial
  CRISPR gRNA sequence
taaaagttcatagagaataa

SEQ ID NO: 450479 - DNA, 20 bp, Artificial
  CRISPR gRNA sequence
aagttcatagagaataatag

SEQ ID NO: 450480 - DNA, 20 bp, Artificial
  CRISPR gRNA sequence
gcagtgcccttttgtcctcc

SEQ ID NO: 450481 - DNA, 20 bp, Artificial
  CRISPR gRNA sequence
cagtgcccttttgtcctcct

SEQ ID NO: 450482 - DNA, 20 bp, Artificial
  CRISPR gRNA sequence
tcctcctaggcttattgtct

SEQ ID NO: 450483 - DNA, 20 bp, Artificial
  CRISPR gRNA sequence
acaaccactgtcaactcttc

SEQ ID NO: 450484 - DNA, 20 bp, Artificial
  CRISPR gRNA sequence
atgctcatattgctgcttcc

SEQ ID NO: 450485 - DNA, 20 bp, Artificial
  CRISPR gRNA sequence
tgcttcctagtgataaaatt

SEQ ID NO: 450486 - DNA, 20 bp, Artificial
  CRISPR gRNA sequence
aaaatttagacattttctat

SEQ ID NO: 450487 - DNA, 20 bp, Artificial
  CRISPR gRNA sequence
tttctattggctttctgcta

SEQ ID NO: 450488 - DNA, 20 bp, Artificial
  CRISPR gRNA sequence
ctattggctttctgctacag

SEQ ID NO: 450489 - DNA, 20 bp, Artificial
  CRISPR gRNA sequence
gctttctgctacagtagatg

SEQ ID NO: 450490 - DNA, 20 bp, Artificial
  CRISPR gRNA sequence
tacagtagatgaagatgtgc

SEQ ID NO: 450491 - DNA, 20 bp, Artificial
  CRISPR gRNA sequence
gatgaagatgtgctagaata

SEQ ID NO: 450492 - DNA, 20 bp, Artificial
  CRISPR gRNA sequence
gaagatgtgctagaatatag

SEQ ID NO: 450493 - DNA, 20 bp, Artificial
  CRISPR gRNA sequence
tgtgctagaatatagtagat

SEQ ID NO: 450494 - DNA, 20 bp, Artificial
  CRISPR gRNA sequence
gtgctagaatatagtagatg

SEQ ID NO: 450495 - DNA, 20 bp, Artificial
  CRISPR gRNA sequence
accacaaattttatttaaat

SEQ ID NO: 450496 - DNA, 20 bp, Artificial
  CRISPR gRNA sequence
ttagtcatgtttacataatt

SEQ ID NO: 450497 - DNA, 20 bp, Artificial
  CRISPR gRNA sequence
gtgttattttttgcaaaatc

SEQ ID NO: 450498 - DNA, 20 bp, Artificial
  CRISPR gRNA sequence
tatgtttcttttgtaaaatt

SEQ ID NO: 450499 - DNA, 20 bp, Artificial
  CRISPR gRNA sequence
ttgtaaaatttagttttttc

SEQ ID NO: 450500 - DNA, 20 bp, Artificial
  CRISPR gRNA sequence
gtaaaatttagttttttcta

SEQ ID NO: 450501 - DNA, 20 bp, Artificial
  CRISPR gRNA sequence
gcctgattttatttttttac

SEQ ID NO: 450502 - DNA, 20 bp, Artificial
  CRISPR gRNA sequence
tgattttatttttttactgg

SEQ ID NO: 450503 - DNA, 20 bp, Artificial
  CRISPR gRNA sequence
attttatttttttactggca

SEQ ID NO: 450504 - DNA, 20 bp, Artificial
  CRISPR gRNA sequence
catttctttaatctttttat

SEQ ID NO: 450505 - DNA, 20 bp, Artificial
  CRISPR gRNA sequence
atttctttaatctttttatt

SEQ ID NO: 450506 - DNA, 20 bp, Artificial
  CRISPR gRNA sequence
tctttttattgggtctttaa

SEQ ID NO: 450507 - DNA, 20 bp, Artificial
  CRISPR gRNA sequence
ctttttattgggtctttaat

SEQ ID NO: 450508 - DNA, 20 bp, Artificial
  CRISPR gRNA sequence
ttgggtctttaatgggcctt

SEQ ID NO: 450509 - DNA, 20 bp, Artificial
  CRISPR gRNA sequence
gtctttaatgggcctttaga

SEQ ID NO: 450510 - DNA, 20 bp, Artificial
  CRISPR gRNA sequence
tcgattccatttttacctcc

SEQ ID NO: 450511 - DNA, 20 bp, Artificial
  CRISPR gRNA sequence
gattccatttttacctccta

SEQ ID NO: 450512 - DNA, 20 bp, Artificial
  CRISPR gRNA sequence
cctcctagagatctcccttc

SEQ ID NO: 450513 - DNA, 20 bp, Artificial
  CRISPR gRNA sequence
tcctagagatctcccttcca

SEQ ID NO: 450514 - DNA, 20 bp, Artificial
  CRISPR gRNA sequence
gtctttctcttgctctcttc

SEQ ID NO: 450515 - DNA, 20 bp, Artificial
  CRISPR gRNA sequence
cttttttttttcttttccac

SEQ ID NO: 450516 - DNA, 20 bp, Artificial
  CRISPR gRNA sequence
tttttttttcttttccacta

SEQ ID NO: 450517 - DNA, 20 bp, Artificial
  CRISPR gRNA sequence
tttttcttttccactagaga

SEQ ID NO: 450518 - DNA, 20 bp, Artificial
  CRISPR gRNA sequence
tggtgtctccctgtgttgcc

SEQ ID NO: 450519 - DNA, 20 bp, Artificial
  CRISPR gRNA sequence
ggtgtctccctgtgttgccc

SEQ ID NO: 450520 - DNA, 20 bp, Artificial
  CRISPR gRNA sequence
ccaggcttatctctaactcc

SEQ ID NO: 450521 - DNA, 20 bp, Artificial
  CRISPR gRNA sequence
caggcttatctctaactcct

SEQ ID NO: 450522 - DNA, 20 bp, Artificial
  CRISPR gRNA sequence
tatctctaactcctgggctc

SEQ ID NO: 450523 - DNA, 20 bp, Artificial
  CRISPR gRNA sequence
ctcaagtgatcctcccacct

SEQ ID NO: 450524 - DNA, 20 bp, Artificial
  CRISPR gRNA sequence
cctcccaccttggcctccaa

SEQ ID NO: 450525 - DNA, 20 bp, Artificial
  CRISPR gRNA sequence
accttggcctccaaaagtgc

SEQ ID NO: 450526 - DNA, 20 bp, Artificial
  CRISPR gRNA sequence
gcctccaaaagtgctggcat

SEQ ID NO: 450527 - DNA, 20 bp, Artificial
  CRISPR gRNA sequence
ctggcatgagccactgtgtc

SEQ ID NO: 450528 - DNA, 20 bp, Artificial
  CRISPR gRNA sequence
atgagccactgtgtccagcc

SEQ ID NO: 450529 - DNA, 20 bp, Artificial
  CRISPR gRNA sequence
ccagcctagaacttccttgt

SEQ ID NO: 450530 - DNA, 20 bp, Artificial
  CRISPR gRNA sequence
atgtcattttatccccttta

SEQ ID NO: 450531 - DNA, 20 bp, Artificial
  CRISPR gRNA sequence
ttcactttcttgttttactg

SEQ ID NO: 450532 - DNA, 20 bp, Artificial
  CRISPR gRNA sequence
ttttactgaagcacatcctc

SEQ ID NO: 450533 - DNA, 20 bp, Artificial
  CRISPR gRNA sequence
tactgaagcacatcctctgg

SEQ ID NO: 450534 - DNA, 20 bp, Artificial
  CRISPR gRNA sequence
cctctggtagcttctttgaa

SEQ ID NO: 450535 - DNA, 20 bp, Artificial
  CRISPR gRNA sequence
gcttctttgaaaagatcaca

SEQ ID NO: 450536 - DNA, 20 bp, Artificial
  CRISPR gRNA sequence
tctttgaaaagatcacatgg

SEQ ID NO: 450537 - DNA, 20 bp, Artificial
  CRISPR gRNA sequence
ctttgaaaagatcacatgga

SEQ ID NO: 450538 - DNA, 20 bp, Artificial
  CRISPR gRNA sequence
catggaaggcaaattttttt

SEQ ID NO: 450539 - DNA, 20 bp, Artificial
  CRISPR gRNA sequence
tgagtcattgcatctcatga

SEQ ID NO: 450540 - DNA, 20 bp, Artificial
  CRISPR gRNA sequence
cttttttctttccttacatt

SEQ ID NO: 450541 - DNA, 20 bp, Artificial
  CRISPR gRNA sequence
ctttccttacatttggttta

SEQ ID NO: 450542 - DNA, 20 bp, Artificial
  CRISPR gRNA sequence
cttacatttggtttatagtt

SEQ ID NO: 450543 - DNA, 20 bp, Artificial
  CRISPR gRNA sequence
tttggctgaatatataattc

SEQ ID NO: 450544 - DNA, 20 bp, Artificial
  CRISPR gRNA sequence
ttggctgaatatataattct

SEQ ID NO: 450545 - DNA, 20 bp, Artificial
  CRISPR gRNA sequence
ggtaaattttttttttccca

SEQ ID NO: 450546 - DNA, 20 bp, Artificial
  CRISPR gRNA sequence
ttttttcccacagaattttg

SEQ ID NO: 450547 - DNA, 20 bp, Artificial
  CRISPR gRNA sequence
tttttcccacagaattttga

SEQ ID NO: 450548 - DNA, 20 bp, Artificial
  CRISPR gRNA sequence
tgaaggcttgctctattgtc

SEQ ID NO: 450549 - DNA, 20 bp, Artificial
  CRISPR gRNA sequence
gaaggcttgctctattgtct

SEQ ID NO: 450550 - DNA, 20 bp, Artificial
  CRISPR gRNA sequence
tgctctattgtctaggaata

SEQ ID NO: 450551 - DNA, 20 bp, Artificial
  CRISPR gRNA sequence
tgtctaggaatatagttaca

SEQ ID NO: 450552 - DNA, 20 bp, Artificial
  CRISPR gRNA sequence
tctaggaatatagttacaca

SEQ ID NO: 450553 - DNA, 20 bp, Artificial
  CRISPR gRNA sequence
taggaatatagttacacaga

SEQ ID NO: 450554 - DNA, 20 bp, Artificial
  CRISPR gRNA sequence
cacagagagacactttctgt

SEQ ID NO: 450555 - DNA, 20 bp, Artificial
  CRISPR gRNA sequence
acagagagacactttctgtt

SEQ ID NO: 450556 - DNA, 20 bp, Artificial
  CRISPR gRNA sequence
tgttgggcacaatttgactt

SEQ ID NO: 450557 - DNA, 20 bp, Artificial
  CRISPR gRNA sequence
gttgggcacaatttgactta

SEQ ID NO: 450558 - DNA, 20 bp, Artificial
  CRISPR gRNA sequence
gggcacaatttgacttaagg

SEQ ID NO: 450559 - DNA, 20 bp, Artificial
  CRISPR gRNA sequence
tgacttaaggaagccactta

SEQ ID NO: 450560 - DNA, 20 bp, Artificial
  CRISPR gRNA sequence
ttaaggaagccacttaaagc

SEQ ID NO: 450561 - DNA, 20 bp, Artificial
  CRISPR gRNA sequence
taaggaagccacttaaagct

SEQ ID NO: 450562 - DNA, 20 bp, Artificial
  CRISPR gRNA sequence
aaggaagccacttaaagctg

SEQ ID NO: 450563 - DNA, 20 bp, Artificial
  CRISPR gRNA sequence
aagccacttaaagctggggc

SEQ ID NO: 450564 - DNA, 20 bp, Artificial
  CRISPR gRNA sequence
gccacttaaagctggggctg

SEQ ID NO: 450565 - DNA, 20 bp, Artificial
  CRISPR gRNA sequence
acttaaagctggggctggag

SEQ ID NO: 450566 - DNA, 20 bp, Artificial
  CRISPR gRNA sequence
ggggctggagtggccatatt

SEQ ID NO: 450567 - DNA, 20 bp, Artificial
  CRISPR gRNA sequence
gggctggagtggccatattt

SEQ ID NO: 450568 - DNA, 20 bp, Artificial
  CRISPR gRNA sequence
gccatatttaggatatgcca

SEQ ID NO: 450569 - DNA, 20 bp, Artificial
  CRISPR gRNA sequence
atatttaggatatgccaaag

SEQ ID NO: 450570 - DNA, 20 bp, Artificial
  CRISPR gRNA sequence
aggatatgccaaagtagtaa

SEQ ID NO: 450571 - DNA, 20 bp, Artificial
  CRISPR gRNA sequence
gatatgccaaagtagtaatg

SEQ ID NO: 450572 - DNA, 20 bp, Artificial
  CRISPR gRNA sequence
atgccaaagtagtaatggag

SEQ ID NO: 450573 - DNA, 20 bp, Artificial
  CRISPR gRNA sequence
tgccaaagtagtaatggagc

SEQ ID NO: 450574 - DNA, 20 bp, Artificial
  CRISPR gRNA sequence
gccaaagtagtaatggagca

SEQ ID NO: 450575 - DNA, 20 bp, Artificial
  CRISPR gRNA sequence
ccaaagtagtaatggagcag

SEQ ID NO: 450576 - DNA, 20 bp, Artificial
  CRISPR gRNA sequence
caaagtagtaatggagcagg

SEQ ID NO: 450577 - DNA, 20 bp, Artificial
  CRISPR gRNA sequence
aagtagtaatggagcagggg

SEQ ID NO: 450578 - DNA, 20 bp, Artificial
  CRISPR gRNA sequence
tggagcagggggagcatgca

SEQ ID NO: 450579 - DNA, 20 bp, Artificial
  CRISPR gRNA sequence
gagcagggggagcatgcata

SEQ ID NO: 450580 - DNA, 20 bp, Artificial
  CRISPR gRNA sequence
ggggagcatgcatagagtga

SEQ ID NO: 450581 - DNA, 20 bp, Artificial
  CRISPR gRNA sequence
agcatgcatagagtgaaaga

SEQ ID NO: 450582 - DNA, 20 bp, Artificial
  CRISPR gRNA sequence
catagagtgaaagacagatg

SEQ ID NO: 450583 - DNA, 20 bp, Artificial
  CRISPR gRNA sequence
agagtgaaagacagatgcag

SEQ ID NO: 450584 - DNA, 20 bp, Artificial
  CRISPR gRNA sequence
tgaaagacagatgcagaagc

SEQ ID NO: 450585 - DNA, 20 bp, Artificial
  CRISPR gRNA sequence
aaagacagatgcagaagcca

SEQ ID NO: 450586 - DNA, 20 bp, Artificial
  CRISPR gRNA sequence
aagacagatgcagaagccag

SEQ ID NO: 450587 - DNA, 20 bp, Artificial
  CRISPR gRNA sequence
ccagaggccttgctgcctca

SEQ ID NO: 450588 - DNA, 20 bp, Artificial
  CRISPR gRNA sequence
tgctgcctcacagtttgaaa

SEQ ID NO: 450589 - DNA, 20 bp, Artificial
  CRISPR gRNA sequence
tttgcgtcctgtcccctttc

SEQ ID NO: 450590 - DNA, 20 bp, Artificial
  CRISPR gRNA sequence
ccctttctagtttctgattc

SEQ ID NO: 450591 - DNA, 20 bp, Artificial
  CRISPR gRNA sequence
cctttctagtttctgattcc

SEQ ID NO: 450592 - DNA, 20 bp, Artificial
  CRISPR gRNA sequence
tttctagtttctgattccag

SEQ ID NO: 450593 - DNA, 20 bp, Artificial
  CRISPR gRNA sequence
tagtttctgattccaggagc

SEQ ID NO: 450594 - DNA, 20 bp, Artificial
  CRISPR gRNA sequence
ttccaggagctagaactcat

SEQ ID NO: 450595 - DNA, 20 bp, Artificial
  CRISPR gRNA sequence
tccaggagctagaactcatg

SEQ ID NO: 450596 - DNA, 20 bp, Artificial
  CRISPR gRNA sequence
ccaggagctagaactcatga

SEQ ID NO: 450597 - DNA, 20 bp, Artificial
  CRISPR gRNA sequence
gagctagaactcatgagggc

SEQ ID NO: 450598 - DNA, 20 bp, Artificial
  CRISPR gRNA sequence
ttttttcctcctttaatcta

SEQ ID NO: 450599 - DNA, 20 bp, Artificial
  CRISPR gRNA sequence
taatctatggtactttgaat

SEQ ID NO: 450600 - DNA, 20 bp, Artificial
  CRISPR gRNA sequence
cctccaactaaatgctcctt

SEQ ID NO: 450601 - DNA, 20 bp, Artificial
  CRISPR gRNA sequence
caactaaatgctccttaaga

SEQ ID NO: 450602 - DNA, 20 bp, Artificial
  CRISPR gRNA sequence
tctcgttgtctgcctgaatt

SEQ ID NO: 450603 - DNA, 20 bp, Artificial
  CRISPR gRNA sequence
tctgcctgaatttagaaata

SEQ ID NO: 450604 - DNA, 20 bp, Artificial
  CRISPR gRNA sequence
tagaaatatagccacatttc

SEQ ID NO: 450605 - DNA, 20 bp, Artificial
  CRISPR gRNA sequence
agaaatatagccacatttct

SEQ ID NO: 450606 - DNA, 20 bp, Artificial
  CRISPR gRNA sequence
aaatatagccacatttctgg

SEQ ID NO: 450607 - DNA, 20 bp, Artificial
  CRISPR gRNA sequence
atatagccacatttctggga

SEQ ID NO: 450608 - DNA, 20 bp, Artificial
  CRISPR gRNA sequence
tttctgggagagttctgaat

SEQ ID NO: 450609 - DNA, 20 bp, Artificial
  CRISPR gRNA sequence
ttctgggagagttctgaatt

SEQ ID NO: 450610 - DNA, 20 bp, Artificial
  CRISPR gRNA sequence
gagagttctgaattgggaat

SEQ ID NO: 450611 - DNA, 20 bp, Artificial
  CRISPR gRNA sequence
agagttctgaattgggaatc

SEQ ID NO: 450612 - DNA, 20 bp, Artificial
  CRISPR gRNA sequence
agttctgaattgggaatcag

SEQ ID NO: 450613 - DNA, 20 bp, Artificial
  CRISPR gRNA sequence
gttctgaattgggaatcagg

SEQ ID NO: 450614 - DNA, 20 bp, Artificial
  CRISPR gRNA sequence
ttcttgttttttattttttt

SEQ ID NO: 450615 - DNA, 20 bp, Artificial
  CRISPR gRNA sequence
ttttttatttttttgagaca

SEQ ID NO: 450616 - DNA, 20 bp, Artificial
  CRISPR gRNA sequence
tttgagacacagtttcgctc

SEQ ID NO: 450617 - DNA, 20 bp, Artificial
  CRISPR gRNA sequence
cagtttcgctctagttgccc

SEQ ID NO: 450618 - DNA, 20 bp, Artificial
  CRISPR gRNA sequence
ttcgctctagttgcccaaga

SEQ ID NO: 450619 - DNA, 20 bp, Artificial
  CRISPR gRNA sequence
cgctctagttgcccaagata

SEQ ID NO: 450620 - DNA, 20 bp, Artificial
  CRISPR gRNA sequence
ttgcccaagatagagtgcaa

SEQ ID NO: 450621 - DNA, 20 bp, Artificial
  CRISPR gRNA sequence
agagtgcaatggcacaatct

SEQ ID NO: 450622 - DNA, 20 bp, Artificial
  CRISPR gRNA sequence
tcactgcaacctccgcctcc

SEQ ID NO: 450623 - DNA, 20 bp, Artificial
  CRISPR gRNA sequence
cactgcaacctccgcctccc

SEQ ID NO: 450624 - DNA, 20 bp, Artificial
  CRISPR gRNA sequence
aacctccgcctcccaggttc

SEQ ID NO: 450625 - DNA, 20 bp, Artificial
  CRISPR gRNA sequence
ttcaagcgattctcttgcct

SEQ ID NO: 450626 - DNA, 20 bp, Artificial
  CRISPR gRNA sequence
ttctcttgccttagcctcct

SEQ ID NO: 450627 - DNA, 20 bp, Artificial
  CRISPR gRNA sequence
tcttgccttagcctcctgag

SEQ ID NO: 450628 - DNA, 20 bp, Artificial
  CRISPR gRNA sequence
gccttagcctcctgagtagc

SEQ ID NO: 450629 - DNA, 20 bp, Artificial
  CRISPR gRNA sequence
ccttagcctcctgagtagct

SEQ ID NO: 450630 - DNA, 20 bp, Artificial
  CRISPR gRNA sequence
ctcctgagtagctgggatta

SEQ ID NO: 450631 - DNA, 20 bp, Artificial
  CRISPR gRNA sequence
tcctgagtagctgggattac

SEQ ID NO: 450632 - DNA, 20 bp, Artificial
  CRISPR gRNA sequence
caggcatgcgccaccacacc

SEQ ID NO: 450633 - DNA, 20 bp, Artificial
  CRISPR gRNA sequence
cccggctaattttgtatttt

SEQ ID NO: 450634 - DNA, 20 bp, Artificial
  CRISPR gRNA sequence
ggctaattttgtatttttag

SEQ ID NO: 450635 - DNA, 20 bp, Artificial
  CRISPR gRNA sequence
ctaattttgtatttttagta

SEQ ID NO: 450636 - DNA, 20 bp, Artificial
  CRISPR gRNA sequence
ttttgtatttttagtagaga

SEQ ID NO: 450637 - DNA, 20 bp, Artificial
  CRISPR gRNA sequence
tttgtatttttagtagagac

SEQ ID NO: 450638 - DNA, 20 bp, Artificial
  CRISPR gRNA sequence
ttgtatttttagtagagaca

SEQ ID NO: 450639 - DNA, 20 bp, Artificial
  CRISPR gRNA sequence
gagacagggtttctccatgt

SEQ ID NO: 450640 - DNA, 20 bp, Artificial
  CRISPR gRNA sequence
cagggtttctccatgttggc

SEQ ID NO: 450641 - DNA, 20 bp, Artificial
  CRISPR gRNA sequence
agggtttctccatgttggct

SEQ ID NO: 450642 - DNA, 20 bp, Artificial
  CRISPR gRNA sequence
tgatctttaactcctgacct

SEQ ID NO: 450643 - DNA, 20 bp, Artificial
  CRISPR gRNA sequence
gatctttaactcctgacctc

SEQ ID NO: 450644 - DNA, 20 bp, Artificial
  CRISPR gRNA sequence
ctcgggtgatctgcctacct

SEQ ID NO: 450645 - DNA, 20 bp, Artificial
  CRISPR gRNA sequence
acctcagcctcccaaaatgc

SEQ ID NO: 450646 - DNA, 20 bp, Artificial
  CRISPR gRNA sequence
cctcagcctcccaaaatgct

SEQ ID NO: 450647 - DNA, 20 bp, Artificial
  CRISPR gRNA sequence
ctcccaaaatgctgggatta

SEQ ID NO: 450648 - DNA, 20 bp, Artificial
  CRISPR gRNA sequence
tcccaaaatgctgggattac

SEQ ID NO: 450649 - DNA, 20 bp, Artificial
  CRISPR gRNA sequence
aatgctgggattacaggcat

SEQ ID NO: 450650 - DNA, 20 bp, Artificial
  CRISPR gRNA sequence
caggcatgagccaccatgcc

SEQ ID NO: 450651 - DNA, 20 bp, Artificial
  CRISPR gRNA sequence
catgagccaccatgcctggc

SEQ ID NO: 450652 - DNA, 20 bp, Artificial
  CRISPR gRNA sequence
atgagccaccatgcctggcc

SEQ ID NO: 450653 - DNA, 20 bp, Artificial
  CRISPR gRNA sequence
agccaccatgcctggccagg

SEQ ID NO: 450654 - DNA, 20 bp, Artificial
  CRISPR gRNA sequence
ctatctgtttttactttcac

SEQ ID NO: 450655 - DNA, 20 bp, Artificial
  CRISPR gRNA sequence
ctgtttttactttcaccagt

SEQ ID NO: 450656 - DNA, 20 bp, Artificial
  CRISPR gRNA sequence
tttttactttcaccagtgag

SEQ ID NO: 450657 - DNA, 20 bp, Artificial
  CRISPR gRNA sequence
ctttcaccagtgagtagcac

SEQ ID NO: 450658 - DNA, 20 bp, Artificial
  CRISPR gRNA sequence
accagtgagtagcactggac

SEQ ID NO: 450659 - DNA, 20 bp, Artificial
  CRISPR gRNA sequence
ctgtgtcaccatctccctgt

SEQ ID NO: 450660 - DNA, 20 bp, Artificial
  CRISPR gRNA sequence
ccctgtcagtaaaaatgcaa

SEQ ID NO: 450661 - DNA, 20 bp, Artificial
  CRISPR gRNA sequence
aaaaatgcaatggccacccc

SEQ ID NO: 450662 - DNA, 20 bp, Artificial
  CRISPR gRNA sequence
atgcaatggccaccccaagt

SEQ ID NO: 450663 - DNA, 20 bp, Artificial
  CRISPR gRNA sequence
gcaatggccaccccaagtaa

SEQ ID NO: 450664 - DNA, 20 bp, Artificial
  CRISPR gRNA sequence
aagtaagagttctaaaatta

SEQ ID NO: 450665 - DNA, 20 bp, Artificial
  CRISPR gRNA sequence
tctaaaattaaagacaaaat

SEQ ID NO: 450666 - DNA, 20 bp, Artificial
  CRISPR gRNA sequence
atgtttgtgtgtgcgctttg

SEQ ID NO: 450667 - DNA, 20 bp, Artificial
  CRISPR gRNA sequence
ttgtgtgtgcgctttgaaga

SEQ ID NO: 450668 - DNA, 20 bp, Artificial
  CRISPR gRNA sequence
tgtgtgtgcgctttgaagaa

SEQ ID NO: 450669 - DNA, 20 bp, Artificial
  CRISPR gRNA sequence
gtgtgcgctttgaagaaagg

SEQ ID NO: 450670 - DNA, 20 bp, Artificial
  CRISPR gRNA sequence
agaaaggcagcatctgccaa

SEQ ID NO: 450671 - DNA, 20 bp, Artificial
  CRISPR gRNA sequence
gaaaggcagcatctgccaat

SEQ ID NO: 450672 - DNA, 20 bp, Artificial
  CRISPR gRNA sequence
aaaggcagcatctgccaatg

SEQ ID NO: 450673 - DNA, 20 bp, Artificial
  CRISPR gRNA sequence
gcatctgccaatggggatgt

SEQ ID NO: 450674 - DNA, 20 bp, Artificial
  CRISPR gRNA sequence
tgccaatggggatgttggaa

SEQ ID NO: 450675 - DNA, 20 bp, Artificial
  CRISPR gRNA sequence
gccaatggggatgttggaaa

SEQ ID NO: 450676 - DNA, 20 bp, Artificial
  CRISPR gRNA sequence
ggggatgttggaaaaggatt

SEQ ID NO: 450677 - DNA, 20 bp, Artificial
  CRISPR gRNA sequence
gggatgttggaaaaggattg

SEQ ID NO: 450678 - DNA, 20 bp, Artificial
  CRISPR gRNA sequence
atgttggaaaaggattgagg

SEQ ID NO: 450679 - DNA, 20 bp, Artificial
  CRISPR gRNA sequence
ttggaaaaggattgaggaag

SEQ ID NO: 450680 - DNA, 20 bp, Artificial
  CRISPR gRNA sequence
tggaaaaggattgaggaaga

SEQ ID NO: 450681 - DNA, 20 bp, Artificial
  CRISPR gRNA sequence
gaagaaggaaactgcctttc

SEQ ID NO: 450682 - DNA, 20 bp, Artificial
  CRISPR gRNA sequence
aagaaggaaactgcctttcc

SEQ ID NO: 450683 - DNA, 20 bp, Artificial
  CRISPR gRNA sequence
tttccaggacctgaactatc

SEQ ID NO: 450684 - DNA, 20 bp, Artificial
  CRISPR gRNA sequence
accctgctcactgtcccacc

SEQ ID NO: 450685 - DNA, 20 bp, Artificial
  CRISPR gRNA sequence
ctgctcactgtcccacctgg

SEQ ID NO: 450686 - DNA, 20 bp, Artificial
  CRISPR gRNA sequence
actgtcccacctggtggcat

SEQ ID NO: 450687 - DNA, 20 bp, Artificial
  CRISPR gRNA sequence
ctgtcccacctggtggcatt

SEQ ID NO: 450688 - DNA, 20 bp, Artificial
  CRISPR gRNA sequence
gtcccacctggtggcattag

SEQ ID NO: 450689 - DNA, 20 bp, Artificial
  CRISPR gRNA sequence
tggtggcattaggagtattt

SEQ ID NO: 450690 - DNA, 20 bp, Artificial
  CRISPR gRNA sequence
tttgagcactcacctgtgaa

SEQ ID NO: 450691 - DNA, 20 bp, Artificial
  CRISPR gRNA sequence
gcactcacctgtgaatagaa

SEQ ID NO: 450692 - DNA, 20 bp, Artificial
  CRISPR gRNA sequence
actcacctgtgaatagaatg

SEQ ID NO: 450693 - DNA, 20 bp, Artificial
  CRISPR gRNA sequence
tgaatagaatggagaaaaaa

SEQ ID NO: 450694 - DNA, 20 bp, Artificial
  CRISPR gRNA sequence
atggagaaaaaatggccctg

SEQ ID NO: 450695 - DNA, 20 bp, Artificial
  CRISPR gRNA sequence
tggagaaaaaatggccctga

SEQ ID NO: 450696 - DNA, 20 bp, Artificial
  CRISPR gRNA sequence
agaaaaaatggccctgaagg

SEQ ID NO: 450697 - DNA, 20 bp, Artificial
  CRISPR gRNA sequence
gaaggcggatacctgacttc

SEQ ID NO: 450698 - DNA, 20 bp, Artificial
  CRISPR gRNA sequence
gatacctgacttctggcttc

SEQ ID NO: 450699 - DNA, 20 bp, Artificial
  CRISPR gRNA sequence
tctggcttctggcacaacac

SEQ ID NO: 450700 - DNA, 20 bp, Artificial
  CRISPR gRNA sequence
ggcttctggcacaacactgg

SEQ ID NO: 450701 - DNA, 20 bp, Artificial
  CRISPR gRNA sequence
gcttctggcacaacactggt

SEQ ID NO: 450702 - DNA, 20 bp, Artificial
  CRISPR gRNA sequence
tggtaggtcccactgtgcaa

SEQ ID NO: 450703 - DNA, 20 bp, Artificial
  CRISPR gRNA sequence
cactgtgcaacggtgtgact

SEQ ID NO: 450704 - DNA, 20 bp, Artificial
  CRISPR gRNA sequence
caacggtgtgacttggctta

SEQ ID NO: 450705 - DNA, 20 bp, Artificial
  CRISPR gRNA sequence
gcttatggtgaacatcaact

SEQ ID NO: 450706 - DNA, 20 bp, Artificial
  CRISPR gRNA sequence
ttcaccaacaccatctatcc

SEQ ID NO: 450707 - DNA, 20 bp, Artificial
  CRISPR gRNA sequence
tcaccaacaccatctatccc

SEQ ID NO: 450708 - DNA, 20 bp, Artificial
  CRISPR gRNA sequence
tctatcccaggatccctttt

SEQ ID NO: 450709 - DNA, 20 bp, Artificial
  CRISPR gRNA sequence
ccaggatcccttttaagtct

SEQ ID NO: 450710 - DNA, 20 bp, Artificial
  CRISPR gRNA sequence
aagtctcagctgttttaaac

SEQ ID NO: 450711 - DNA, 20 bp, Artificial
  CRISPR gRNA sequence
cagctgttttaaactggtct

SEQ ID NO: 450712 - DNA, 20 bp, Artificial
  CRISPR gRNA sequence
agctgttttaaactggtctc

SEQ ID NO: 450713 - DNA, 20 bp, Artificial
  CRISPR gRNA sequence
ctgttttaaactggtctcag

SEQ ID NO: 450714 - DNA, 20 bp, Artificial
  CRISPR gRNA sequence
ttaaactggtctcaggagaa

SEQ ID NO: 450715 - DNA, 20 bp, Artificial
  CRISPR gRNA sequence
ggtctcaggagaacagtctc

SEQ ID NO: 450716 - DNA, 20 bp, Artificial
  CRISPR gRNA sequence
caaaaacactacaaacccct

SEQ ID NO: 450717 - DNA, 20 bp, Artificial
  CRISPR gRNA sequence
ctcttctttcttatgccata

SEQ ID NO: 450718 - DNA, 20 bp, Artificial
  CRISPR gRNA sequence
ctttcttatgccatacagta

SEQ ID NO: 450719 - DNA, 20 bp, Artificial
  CRISPR gRNA sequence
tatgccatacagtacagatt

SEQ ID NO: 450720 - DNA, 20 bp, Artificial
  CRISPR gRNA sequence
catacagtacagattaagtt

SEQ ID NO: 450721 - DNA, 20 bp, Artificial
  CRISPR gRNA sequence
agtttagtcgcgttccttcc

SEQ ID NO: 450722 - DNA, 20 bp, Artificial
  CRISPR gRNA sequence
gtttagtcgcgttccttcct

SEQ ID NO: 450723 - DNA, 20 bp, Artificial
  CRISPR gRNA sequence
tagtcgcgttccttcctggg

SEQ ID NO: 450724 - DNA, 20 bp, Artificial
  CRISPR gRNA sequence
gcgttccttcctgggaagct

SEQ ID NO: 450725 - DNA, 20 bp, Artificial
  CRISPR gRNA sequence
tccttcctgggaagctgagc

SEQ ID NO: 450726 - DNA, 20 bp, Artificial
  CRISPR gRNA sequence
ctggtgatgttaatgcatcc

SEQ ID NO: 450727 - DNA, 20 bp, Artificial
  CRISPR gRNA sequence
gatgttaatgcatcctggaa

SEQ ID NO: 450728 - DNA, 20 bp, Artificial
  CRISPR gRNA sequence
ttaatgcatcctggaatgga

SEQ ID NO: 450729 - DNA, 20 bp, Artificial
  CRISPR gRNA sequence
taatgcatcctggaatggaa

SEQ ID NO: 450730 - DNA, 20 bp, Artificial
  CRISPR gRNA sequence
aatgcatcctggaatggaaa

SEQ ID NO: 450731 - DNA, 20 bp, Artificial
  CRISPR gRNA sequence
gcatcctggaatggaaaggg

SEQ ID NO: 450732 - DNA, 20 bp, Artificial
  CRISPR gRNA sequence
atggaaagggaagaattacc

SEQ ID NO: 450733 - DNA, 20 bp, Artificial
  CRISPR gRNA sequence
ggaaagggaagaattaccca

SEQ ID NO: 450734 - DNA, 20 bp, Artificial
  CRISPR gRNA sequence
gaaagggaagaattacccag

SEQ ID NO: 450735 - DNA, 20 bp, Artificial
  CRISPR gRNA sequence
gggaagaattacccagaggt

SEQ ID NO: 450736 - DNA, 20 bp, Artificial
  CRISPR gRNA sequence
ggaagaattacccagaggtc

SEQ ID NO: 450737 - DNA, 20 bp, Artificial
  CRISPR gRNA sequence
agaattacccagaggtcagg

SEQ ID NO: 450738 - DNA, 20 bp, Artificial
  CRISPR gRNA sequence
ccgtaactgctccttatcac

SEQ ID NO: 450739 - DNA, 20 bp, Artificial
  CRISPR gRNA sequence
taactgctccttatcactag

SEQ ID NO: 450740 - DNA, 20 bp, Artificial
  CRISPR gRNA sequence
ccttatcactagaagtcttc

SEQ ID NO: 450741 - DNA, 20 bp, Artificial
  CRISPR gRNA sequence
cttatcactagaagtcttca

SEQ ID NO: 450742 - DNA, 20 bp, Artificial
  CRISPR gRNA sequence
atcactagaagtcttcaagg

SEQ ID NO: 450743 - DNA, 20 bp, Artificial
  CRISPR gRNA sequence
tcactagaagtcttcaagga

SEQ ID NO: 450744 - DNA, 20 bp, Artificial
  CRISPR gRNA sequence
aagtcttcaaggaaggactg

SEQ ID NO: 450745 - DNA, 20 bp, Artificial
  CRISPR gRNA sequence
tcttcaaggaaggactgaag

SEQ ID NO: 450746 - DNA, 20 bp, Artificial
  CRISPR gRNA sequence
ggaaggactgaagcagaacc

SEQ ID NO: 450747 - DNA, 20 bp, Artificial
  CRISPR gRNA sequence
aggactgaagcagaacctgg

SEQ ID NO: 450748 - DNA, 20 bp, Artificial
  CRISPR gRNA sequence
actgaagcagaacctggcag

SEQ ID NO: 450749 - DNA, 20 bp, Artificial
  CRISPR gRNA sequence
gcagaacctggcagtagtgc

SEQ ID NO: 450750 - DNA, 20 bp, Artificial
  CRISPR gRNA sequence
gaacctggcagtagtgctgg

SEQ ID NO: 450751 - DNA, 20 bp, Artificial
  CRISPR gRNA sequence
ctggcagtagtgctggcaga

SEQ ID NO: 450752 - DNA, 20 bp, Artificial
  CRISPR gRNA sequence
tggcagtagtgctggcagac

SEQ ID NO: 450753 - DNA, 20 bp, Artificial
  CRISPR gRNA sequence
cagacaggaaatacaaattc

SEQ ID NO: 450754 - DNA, 20 bp, Artificial
  CRISPR gRNA sequence
acaaattccagctctatcga

SEQ ID NO: 450755 - DNA, 20 bp, Artificial
  CRISPR gRNA sequence
atcgatggctgtgtgactgt

SEQ ID NO: 450756 - DNA, 20 bp, Artificial
  CRISPR gRNA sequence
atggctgtgtgactgtaagc

SEQ ID NO: 450757 - DNA, 20 bp, Artificial
  CRISPR gRNA sequence
aagcaagttacctaactcct

SEQ ID NO: 450758 - DNA, 20 bp, Artificial
  CRISPR gRNA sequence
agcaagttacctaactcctt

SEQ ID NO: 450759 - DNA, 20 bp, Artificial
  CRISPR gRNA sequence
aagttacctaactccttggg

SEQ ID NO: 450760 - DNA, 20 bp, Artificial
  CRISPR gRNA sequence
ttacctaactccttgggcag

SEQ ID NO: 450761 - DNA, 20 bp, Artificial
  CRISPR gRNA sequence
tgggcagtagtttattcatc

SEQ ID NO: 450762 - DNA, 20 bp, Artificial
  CRISPR gRNA sequence
tcatctggaaaatgaaaatt

SEQ ID NO: 450763 - DNA, 20 bp, Artificial
  CRISPR gRNA sequence
catctggaaaatgaaaatta

SEQ ID NO: 450764 - DNA, 20 bp, Artificial
  CRISPR gRNA sequence
atctggaaaatgaaaattaa

SEQ ID NO: 450765 - DNA, 20 bp, Artificial
  CRISPR gRNA sequence
gggactaaataatatgctca

SEQ ID NO: 450766 - DNA, 20 bp, Artificial
  CRISPR gRNA sequence
tcaaagcatccattaattca

SEQ ID NO: 450767 - DNA, 20 bp, Artificial
  CRISPR gRNA sequence
caaagcatccattaattcat

SEQ ID NO: 450768 - DNA, 20 bp, Artificial
  CRISPR gRNA sequence
ctccacttaacaaatacgtt

SEQ ID NO: 450769 - DNA, 20 bp, Artificial
  CRISPR gRNA sequence
tccacttaacaaatacgttt

SEQ ID NO: 450770 - DNA, 20 bp, Artificial
  CRISPR gRNA sequence
gtttaggtattcactctgcc

SEQ ID NO: 450771 - DNA, 20 bp, Artificial
  CRISPR gRNA sequence
ttcactctgccaagccctgc

SEQ ID NO: 450772 - DNA, 20 bp, Artificial
  CRISPR gRNA sequence
tcactctgccaagccctgct

SEQ ID NO: 450773 - DNA, 20 bp, Artificial
  CRISPR gRNA sequence
cactctgccaagccctgctg

SEQ ID NO: 450774 - DNA, 20 bp, Artificial
  CRISPR gRNA sequence
ccaagccctgctggggctat

SEQ ID NO: 450775 - DNA, 20 bp, Artificial
  CRISPR gRNA sequence
caagccctgctggggctatg

SEQ ID NO: 450776 - DNA, 20 bp, Artificial
  CRISPR gRNA sequence
cctgctggggctatgaggac

SEQ ID NO: 450777 - DNA, 20 bp, Artificial
  CRISPR gRNA sequence
ctgctggggctatgaggact

SEQ ID NO: 450778 - DNA, 20 bp, Artificial
  CRISPR gRNA sequence
ggctatgaggactaggacgt

SEQ ID NO: 450779 - DNA, 20 bp, Artificial
  CRISPR gRNA sequence
taggacgtgagccctactgt

SEQ ID NO: 450780 - DNA, 20 bp, Artificial
  CRISPR gRNA sequence
cttttttttcccctaaccat

SEQ ID NO: 450781 - DNA, 20 bp, Artificial
  CRISPR gRNA sequence
tcccctaaccattagatgac

SEQ ID NO: 450782 - DNA, 20 bp, Artificial
  CRISPR gRNA sequence
cccctaaccattagatgacc

SEQ ID NO: 450783 - DNA, 20 bp, Artificial
  CRISPR gRNA sequence
ccctaaccattagatgaccg

SEQ ID NO: 450784 - DNA, 20 bp, Artificial
  CRISPR gRNA sequence
aaaaaatttttttttaaaac

SEQ ID NO: 450785 - DNA, 20 bp, Artificial
  CRISPR gRNA sequence
aaaaatttttttttaaaaca

SEQ ID NO: 450786 - DNA, 20 bp, Artificial
  CRISPR gRNA sequence
caaggtcttgctgtgtcacc

SEQ ID NO: 450787 - DNA, 20 bp, Artificial
  CRISPR gRNA sequence
aaggtcttgctgtgtcaccc

SEQ ID NO: 450788 - DNA, 20 bp, Artificial
  CRISPR gRNA sequence
tcttgctgtgtcacccaggc

SEQ ID NO: 450789 - DNA, 20 bp, Artificial
  CRISPR gRNA sequence
ttgctgtgtcacccaggctg

SEQ ID NO: 450790 - DNA, 20 bp, Artificial
  CRISPR gRNA sequence
tgctgtgtcacccaggctgg

SEQ ID NO: 450791 - DNA, 20 bp, Artificial
  CRISPR gRNA sequence
gctgtgtcacccaggctgga

SEQ ID NO: 450792 - DNA, 20 bp, Artificial
  CRISPR gRNA sequence
gtgtcacccaggctggaggg

SEQ ID NO: 450793 - DNA, 20 bp, Artificial
  CRISPR gRNA sequence
tcacccaggctggagggcag

SEQ ID NO: 450794 - DNA, 20 bp, Artificial
  CRISPR gRNA sequence
tcactgcacctttgaactcc

SEQ ID NO: 450795 - DNA, 20 bp, Artificial
  CRISPR gRNA sequence
cactgcacctttgaactcct

SEQ ID NO: 450796 - DNA, 20 bp, Artificial
  CRISPR gRNA sequence
acctttgaactcctgggctc

SEQ ID NO: 450797 - DNA, 20 bp, Artificial
  CRISPR gRNA sequence
tcctgcttccgccttccgaa

SEQ ID NO: 450798 - DNA, 20 bp, Artificial
  CRISPR gRNA sequence
cttccgaatagctaacacta

SEQ ID NO: 450799 - DNA, 20 bp, Artificial
  CRISPR gRNA sequence
ttccgaatagctaacactac

SEQ ID NO: 450800 - DNA, 20 bp, Artificial
  CRISPR gRNA sequence
caggtatgcaccactatgcc

SEQ ID NO: 450801 - DNA, 20 bp, Artificial
  CRISPR gRNA sequence
ctggctaattttttattttg

SEQ ID NO: 450802 - DNA, 20 bp, Artificial
  CRISPR gRNA sequence
ggctaattttttattttgta

SEQ ID NO: 450803 - DNA, 20 bp, Artificial
  CRISPR gRNA sequence
aattttttattttgtagaga

SEQ ID NO: 450804 - DNA, 20 bp, Artificial
  CRISPR gRNA sequence
cagattctcactatgttgtc

SEQ ID NO: 450805 - DNA, 20 bp, Artificial
  CRISPR gRNA sequence
agattctcactatgttgtcc

SEQ ID NO: 450806 - DNA, 20 bp, Artificial
  CRISPR gRNA sequence
tctcactatgttgtccaggc

SEQ ID NO: 450807 - DNA, 20 bp, Artificial
  CRISPR gRNA sequence
tccaggctagtcttgaactc

SEQ ID NO: 450808 - DNA, 20 bp, Artificial
  CRISPR gRNA sequence
ccaggctagtcttgaactct

SEQ ID NO: 450809 - DNA, 20 bp, Artificial
  CRISPR gRNA sequence
agtcttgaactctaggcatc

SEQ ID NO: 450810 - DNA, 20 bp, Artificial
  CRISPR gRNA sequence
gcctctgcctcccaaactgc

SEQ ID NO: 450811 - DNA, 20 bp, Artificial
  CRISPR gRNA sequence
cctctgcctcccaaactgct

SEQ ID NO: 450812 - DNA, 20 bp, Artificial
  CRISPR gRNA sequence
ctcccaaactgctgggatta

SEQ ID NO: 450813 - DNA, 20 bp, Artificial
  CRISPR gRNA sequence
tcccaaactgctgggattac

SEQ ID NO: 450814 - DNA, 20 bp, Artificial
  CRISPR gRNA sequence
caggcatgaaccactgtgcc

SEQ ID NO: 450815 - DNA, 20 bp, Artificial
  CRISPR gRNA sequence
ccactgtgcctggccactct

SEQ ID NO: 450816 - DNA, 20 bp, Artificial
  CRISPR gRNA sequence
actgtgcctggccactctca

SEQ ID NO: 450817 - DNA, 20 bp, Artificial
  CRISPR gRNA sequence
ctggccactctcagagttta

SEQ ID NO: 450818 - DNA, 20 bp, Artificial
  CRISPR gRNA sequence
agcctaatgtaaaaacaaat

SEQ ID NO: 450819 - DNA, 20 bp, Artificial
  CRISPR gRNA sequence
tgtaaaaacaaattagcaaa

SEQ ID NO: 450820 - DNA, 20 bp, Artificial
  CRISPR gRNA sequence
aaagttacaatttaattcca

SEQ ID NO: 450821 - DNA, 20 bp, Artificial
  CRISPR gRNA sequence
attccacagttattataatt

SEQ ID NO: 450822 - DNA, 20 bp, Artificial
  CRISPR gRNA sequence
ttccacagttattataattg

SEQ ID NO: 450823 - DNA, 20 bp, Artificial
  CRISPR gRNA sequence
ttattataattgaggaatct

SEQ ID NO: 450824 - DNA, 20 bp, Artificial
  CRISPR gRNA sequence
attataattgaggaatctta

SEQ ID NO: 450825 - DNA, 20 bp, Artificial
  CRISPR gRNA sequence
gaggaatcttagagattcct

SEQ ID NO: 450826 - DNA, 20 bp, Artificial
  CRISPR gRNA sequence
cttagagattcctgagtctg

SEQ ID NO: 450827 - DNA, 20 bp, Artificial
  CRISPR gRNA sequence
gattcctgagtctgaagcat

SEQ ID NO: 450828 - DNA, 20 bp, Artificial
  CRISPR gRNA sequence
attcctgagtctgaagcatc

SEQ ID NO: 450829 - DNA, 20 bp, Artificial
  CRISPR gRNA sequence
ttcctgagtctgaagcatca

SEQ ID NO: 450830 - DNA, 20 bp, Artificial
  CRISPR gRNA sequence
gaagcatcagggaaacttca

SEQ ID NO: 450831 - DNA, 20 bp, Artificial
  CRISPR gRNA sequence
atcagggaaacttcacagtg

SEQ ID NO: 450832 - DNA, 20 bp, Artificial
  CRISPR gRNA sequence
gggaaacttcacagtgaagt

SEQ ID NO: 450833 - DNA, 20 bp, Artificial
  CRISPR gRNA sequence
cttcacagtgaagttagtgc

SEQ ID NO: 450834 - DNA, 20 bp, Artificial
  CRISPR gRNA sequence
tcacagtgaagttagtgctg

SEQ ID NO: 450835 - DNA, 20 bp, Artificial
  CRISPR gRNA sequence
ttagtgctggagctgacttg

SEQ ID NO: 450836 - DNA, 20 bp, Artificial
  CRISPR gRNA sequence
tagtgctggagctgacttga

SEQ ID NO: 450837 - DNA, 20 bp, Artificial
  CRISPR gRNA sequence
ctggagctgacttgaaggat

SEQ ID NO: 450838 - DNA, 20 bp, Artificial
  CRISPR gRNA sequence
ctgacttgaaggatgagtaa

SEQ ID NO: 450839 - DNA, 20 bp, Artificial
  CRISPR gRNA sequence
ggatgagtaaaagtttttct

SEQ ID NO: 450840 - DNA, 20 bp, Artificial
  CRISPR gRNA sequence
aaaagtttttctaagaaata

SEQ ID NO: 450841 - DNA, 20 bp, Artificial
  CRISPR gRNA sequence
aaagtttttctaagaaatat

SEQ ID NO: 450842 - DNA, 20 bp, Artificial
  CRISPR gRNA sequence
ttttctaagaaatataggat

SEQ ID NO: 450843 - DNA, 20 bp, Artificial
  CRISPR gRNA sequence
ttctaagaaatataggatga

SEQ ID NO: 450844 - DNA, 20 bp, Artificial
  CRISPR gRNA sequence
ctaagaaatataggatgaga

SEQ ID NO: 450845 - DNA, 20 bp, Artificial
  CRISPR gRNA sequence
atataggatgagagagacca

SEQ ID NO: 450846 - DNA, 20 bp, Artificial
  CRISPR gRNA sequence
gagagagaccacagaaatac

SEQ ID NO: 450847 - DNA, 20 bp, Artificial
  CRISPR gRNA sequence
gagagaccacagaaatacca

SEQ ID NO: 450848 - DNA, 20 bp, Artificial
  CRISPR gRNA sequence
ataccagagatgattaaaaa

SEQ ID NO: 450849 - DNA, 20 bp, Artificial
  CRISPR gRNA sequence
gattaaaaacagccactgtg

SEQ ID NO: 450850 - DNA, 20 bp, Artificial
  CRISPR gRNA sequence
aaacagccactgtgtggaaa

SEQ ID NO: 450851 - DNA, 20 bp, Artificial
  CRISPR gRNA sequence
acagccactgtgtggaaatg

SEQ ID NO: 450852 - DNA, 20 bp, Artificial
  CRISPR gRNA sequence
ccactgtgtggaaatggagt

SEQ ID NO: 450853 - DNA, 20 bp, Artificial
  CRISPR gRNA sequence
gtgtggaaatggagtgagaa

SEQ ID NO: 450854 - DNA, 20 bp, Artificial
  CRISPR gRNA sequence
gaaatggagtgagaatggac

SEQ ID NO: 450855 - DNA, 20 bp, Artificial
  CRISPR gRNA sequence
aatggagtgagaatggactg

SEQ ID NO: 450856 - DNA, 20 bp, Artificial
  CRISPR gRNA sequence
gtgagaatggactggagaaa

SEQ ID NO: 450857 - DNA, 20 bp, Artificial
  CRISPR gRNA sequence
ggagaaacagactaattatt

SEQ ID NO: 450858 - DNA, 20 bp, Artificial
  CRISPR gRNA sequence
gagaaacagactaattattg

SEQ ID NO: 450859 - DNA, 20 bp, Artificial
  CRISPR gRNA sequence
agaaacagactaattattga

SEQ ID NO: 450860 - DNA, 20 bp, Artificial
  CRISPR gRNA sequence
tgagggaccattgatatcca

SEQ ID NO: 450861 - DNA, 20 bp, Artificial
  CRISPR gRNA sequence
tccaaagaccatgactctga

SEQ ID NO: 450862 - DNA, 20 bp, Artificial
  CRISPR gRNA sequence
gaccatgactctgatggtgc

SEQ ID NO: 450863 - DNA, 20 bp, Artificial
  CRISPR gRNA sequence
gcccacttgattttccctgt

SEQ ID NO: 450864 - DNA, 20 bp, Artificial
  CRISPR gRNA sequence
cctgtaagtaatctgtaacc

SEQ ID NO: 450865 - DNA, 20 bp, Artificial
  CRISPR gRNA sequence
agtaatctgtaacctggata

SEQ ID NO: 450866 - DNA, 20 bp, Artificial
  CRISPR gRNA sequence
aatctgtaacctggatacag

SEQ ID NO: 450867 - DNA, 20 bp, Artificial
  CRISPR gRNA sequence
ctgtaacctggatacagaag

SEQ ID NO: 450868 - DNA, 20 bp, Artificial
  CRISPR gRNA sequence
gtaacctggatacagaagtg

SEQ ID NO: 450869 - DNA, 20 bp, Artificial
  CRISPR gRNA sequence
ggatacagaagtggagaaaa

SEQ ID NO: 450870 - DNA, 20 bp, Artificial
  CRISPR gRNA sequence
acagaagtggagaaaatagt

SEQ ID NO: 450871 - DNA, 20 bp, Artificial
  CRISPR gRNA sequence
cagaagtggagaaaatagtt

SEQ ID NO: 450872 - DNA, 20 bp, Artificial
  CRISPR gRNA sequence
agaaaatagttgggttaacc

SEQ ID NO: 450873 - DNA, 20 bp, Artificial
  CRISPR gRNA sequence
gaaaatagttgggttaaccc

SEQ ID NO: 450874 - DNA, 20 bp, Artificial
  CRISPR gRNA sequence
tgggttaacccaggatgttt

SEQ ID NO: 450875 - DNA, 20 bp, Artificial
  CRISPR gRNA sequence
cccaggatgttttggctcga

SEQ ID NO: 450876 - DNA, 20 bp, Artificial
  CRISPR gRNA sequence
ccaggatgttttggctcgat

SEQ ID NO: 450877 - DNA, 20 bp, Artificial
  CRISPR gRNA sequence
gacctaattttgcaatgcat

SEQ ID NO: 450878 - DNA, 20 bp, Artificial
  CRISPR gRNA sequence
tcaaacttcacttccttctg

SEQ ID NO: 450879 - DNA, 20 bp, Artificial
  CRISPR gRNA sequence
cttctgtagtttatattttg

SEQ ID NO: 450880 - DNA, 20 bp, Artificial
  CRISPR gRNA sequence
ctctcccttatatccaccct

SEQ ID NO: 450881 - DNA, 20 bp, Artificial
  CRISPR gRNA sequence
atatccaccctcagctccct

SEQ ID NO: 450882 - DNA, 20 bp, Artificial
  CRISPR gRNA sequence
tagctttactcctactgtga

SEQ ID NO: 450883 - DNA, 20 bp, Artificial
  CRISPR gRNA sequence
tcctcgcaaaaccccaacct

SEQ ID NO: 450884 - DNA, 20 bp, Artificial
  CRISPR gRNA sequence
accccaacctcggttaaatc

SEQ ID NO: 450885 - DNA, 20 bp, Artificial
  CRISPR gRNA sequence
ctctctgctgaaaactcatc

SEQ ID NO: 450886 - DNA, 20 bp, Artificial
  CRISPR gRNA sequence
tctgctgaaaactcatccgg

SEQ ID NO: 450887 - DNA, 20 bp, Artificial
  CRISPR gRNA sequence
aaactcatccggcagatgct

SEQ ID NO: 450888 - DNA, 20 bp, Artificial
  CRISPR gRNA sequence
aactcatccggcagatgctg

SEQ ID NO: 450889 - DNA, 20 bp, Artificial
  CRISPR gRNA sequence
ccggcagatgctgaggctgc

SEQ ID NO: 450890 - DNA, 20 bp, Artificial
  CRISPR gRNA sequence
agccccctcccccactccct

SEQ ID NO: 450891 - DNA, 20 bp, Artificial
  CRISPR gRNA sequence
cccctcccccactcccttgg

SEQ ID NO: 450892 - DNA, 20 bp, Artificial
  CRISPR gRNA sequence
tatgacttgcttttcctttt

SEQ ID NO: 450893 - DNA, 20 bp, Artificial
  CRISPR gRNA sequence
tttccttttaagactcccct

SEQ ID NO: 450894 - DNA, 20 bp, Artificial
  CRISPR gRNA sequence
aagactccccttggtataca

SEQ ID NO: 450895 - DNA, 20 bp, Artificial
  CRISPR gRNA sequence
taaattcactctcatgaaaa

SEQ ID NO: 450896 - DNA, 20 bp, Artificial
  CRISPR gRNA sequence
tcactctcatgaaaacggtg

SEQ ID NO: 450897 - DNA, 20 bp, Artificial
  CRISPR gRNA sequence
actctcatgaaaacggtgaa

SEQ ID NO: 450898 - DNA, 20 bp, Artificial
  CRISPR gRNA sequence
ctctcatgaaaacggtgaag

SEQ ID NO: 450899 - DNA, 20 bp, Artificial
  CRISPR gRNA sequence
tcatgaaaacggtgaagagg

SEQ ID NO: 450900 - DNA, 20 bp, Artificial
  CRISPR gRNA sequence
atgaaaacggtgaagaggca

SEQ ID NO: 450901 - DNA, 20 bp, Artificial
  CRISPR gRNA sequence
aaacggtgaagaggcagaga

SEQ ID NO: 450902 - DNA, 20 bp, Artificial
  CRISPR gRNA sequence
acggtgaagaggcagagatg

SEQ ID NO: 450903 - DNA, 20 bp, Artificial
  CRISPR gRNA sequence
cggtgaagaggcagagatgg

SEQ ID NO: 450904 - DNA, 20 bp, Artificial
  CRISPR gRNA sequence
attgaatgccattctcctac

SEQ ID NO: 450905 - DNA, 20 bp, Artificial
  CRISPR gRNA sequence
tgaatgccattctcctacaa

SEQ ID NO: 450906 - DNA, 20 bp, Artificial
  CRISPR gRNA sequence
tgccattctcctacaagagt

SEQ ID NO: 450907 - DNA, 20 bp, Artificial
  CRISPR gRNA sequence
ccattctcctacaagagtaa

SEQ ID NO: 450908 - DNA, 20 bp, Artificial
  CRISPR gRNA sequence
tcctacaagagtaagagata

SEQ ID NO: 450909 - DNA, 20 bp, Artificial
  CRISPR gRNA sequence
cctacaagagtaagagatat

SEQ ID NO: 450910 - DNA, 20 bp, Artificial
  CRISPR gRNA sequence
gtaagagatatgggtcttcc

SEQ ID NO: 450911 - DNA, 20 bp, Artificial
  CRISPR gRNA sequence
gtcttccaagacccatatct

SEQ ID NO: 450912 - DNA, 20 bp, Artificial
  CRISPR gRNA sequence
tcttccaagacccatatctg

SEQ ID NO: 450913 - DNA, 20 bp, Artificial
  CRISPR gRNA sequence
cttccaagacccatatctga

SEQ ID NO: 450914 - DNA, 20 bp, Artificial
  CRISPR gRNA sequence
tccaagacccatatctgagg

SEQ ID NO: 450915 - DNA, 20 bp, Artificial
  CRISPR gRNA sequence
ctgagggagacctgcaatcc

SEQ ID NO: 450916 - DNA, 20 bp, Artificial
  CRISPR gRNA sequence
gccattgattcactccaaaa

SEQ ID NO: 450917 - DNA, 20 bp, Artificial
  CRISPR gRNA sequence
tatattttatttctactttc

SEQ ID NO: 450918 - DNA, 20 bp, Artificial
  CRISPR gRNA sequence
ttttatttctactttccagc

SEQ ID NO: 450919 - DNA, 20 bp, Artificial
  CRISPR gRNA sequence
ctttccagctggaacttcta

SEQ ID NO: 450920 - DNA, 20 bp, Artificial
  CRISPR gRNA sequence
tttccagctggaacttctat

SEQ ID NO: 450921 - DNA, 20 bp, Artificial
  CRISPR gRNA sequence
ttccagctggaacttctata

SEQ ID NO: 450922 - DNA, 20 bp, Artificial
  CRISPR gRNA sequence
aacttctatagggtctctgt

SEQ ID NO: 450923 - DNA, 20 bp, Artificial
  CRISPR gRNA sequence
cttctatagggtctctgtta

SEQ ID NO: 450924 - DNA, 20 bp, Artificial
  CRISPR gRNA sequence
ttttctgtatatcaaatcct

SEQ ID NO: 450925 - DNA, 20 bp, Artificial
  CRISPR gRNA sequence
tgtatatcaaatcctcagta

SEQ ID NO: 450926 - DNA, 20 bp, Artificial
  CRISPR gRNA sequence
tcaaatcctcagtatagcca

SEQ ID NO: 450927 - DNA, 20 bp, Artificial
  CRISPR gRNA sequence
aaatcctcagtatagccata

SEQ ID NO: 450928 - DNA, 20 bp, Artificial
  CRISPR gRNA sequence
aatcctcagtatagccatag

SEQ ID NO: 450929 - DNA, 20 bp, Artificial
  CRISPR gRNA sequence
atcctcagtatagccataga

SEQ ID NO: 450930 - DNA, 20 bp, Artificial
  CRISPR gRNA sequence
ctcagtatagccatagaggg

SEQ ID NO: 450931 - DNA, 20 bp, Artificial
  CRISPR gRNA sequence
tcagtatagccatagagggc

SEQ ID NO: 450932 - DNA, 20 bp, Artificial
  CRISPR gRNA sequence
attttataaatacacaaatt

SEQ ID NO: 450933 - DNA, 20 bp, Artificial
  CRISPR gRNA sequence
ttttataaatacacaaattg

SEQ ID NO: 450934 - DNA, 20 bp, Artificial
  CRISPR gRNA sequence
taaatacacaaattgaggca

SEQ ID NO: 450935 - DNA, 20 bp, Artificial
  CRISPR gRNA sequence
aatacacaaattgaggcaca

SEQ ID NO: 450936 - DNA, 20 bp, Artificial
  CRISPR gRNA sequence
acacaaattgaggcacagag

SEQ ID NO: 450937 - DNA, 20 bp, Artificial
  CRISPR gRNA sequence
gaggcacagagtggttaaac

SEQ ID NO: 450938 - DNA, 20 bp, Artificial
  CRISPR gRNA sequence
agtggttaaactagctgctg

SEQ ID NO: 450939 - DNA, 20 bp, Artificial
  CRISPR gRNA sequence
actagctgctgaagttaatg

SEQ ID NO: 450940 - DNA, 20 bp, Artificial
  CRISPR gRNA sequence
gctgaagttaatgaagattg

SEQ ID NO: 450941 - DNA, 20 bp, Artificial
  CRISPR gRNA sequence
ttaatgaagattgcagtatc

SEQ ID NO: 450942 - DNA, 20 bp, Artificial
  CRISPR gRNA sequence
cagtatctggatctcaaacc

SEQ ID NO: 450943 - DNA, 20 bp, Artificial
  CRISPR gRNA sequence
acctggatttcataaattta

SEQ ID NO: 450944 - DNA, 20 bp, Artificial
  CRISPR gRNA sequence
ttcataaatttatagtatat

SEQ ID NO: 450945 - DNA, 20 bp, Artificial
  CRISPR gRNA sequence
cataaatttatagtatataa

SEQ ID NO: 450946 - DNA, 20 bp, Artificial
  CRISPR gRNA sequence
ttatagtatataagagccta

SEQ ID NO: 450947 - DNA, 20 bp, Artificial
  CRISPR gRNA sequence
tatagtatataagagcctaa

SEQ ID NO: 450948 - DNA, 20 bp, Artificial
  CRISPR gRNA sequence
ataagagcctaaaggaatct

SEQ ID NO: 450949 - DNA, 20 bp, Artificial
  CRISPR gRNA sequence
taagagcctaaaggaatctt

SEQ ID NO: 450950 - DNA, 20 bp, Artificial
  CRISPR gRNA sequence
gcctaaaggaatcttaggtt

SEQ ID NO: 450951 - DNA, 20 bp, Artificial
  CRISPR gRNA sequence
cctaaaggaatcttaggttg

SEQ ID NO: 450952 - DNA, 20 bp, Artificial
  CRISPR gRNA sequence
aggaatcttaggttgaggcg

SEQ ID NO: 450953 - DNA, 20 bp, Artificial
  CRISPR gRNA sequence
taggttgaggcgcagattgc

SEQ ID NO: 450954 - DNA, 20 bp, Artificial
  CRISPR gRNA sequence
aggttgaggcgcagattgcc

SEQ ID NO: 450955 - DNA, 20 bp, Artificial
  CRISPR gRNA sequence
gccaggctctttgaaacata

SEQ ID NO: 450956 - DNA, 20 bp, Artificial
  CRISPR gRNA sequence
aggctctttgaaacatatag

SEQ ID NO: 450957 - DNA, 20 bp, Artificial
  CRISPR gRNA sequence
gctctttgaaacatatagca

SEQ ID NO: 450958 - DNA, 20 bp, Artificial
  CRISPR gRNA sequence
tttgaaacatatagcagaga

SEQ ID NO: 450959 - DNA, 20 bp, Artificial
  CRISPR gRNA sequence
tgaaacatatagcagagaca

SEQ ID NO: 450960 - DNA, 20 bp, Artificial
  CRISPR gRNA sequence
agcagagacagagtgtctga

SEQ ID NO: 450961 - DNA, 20 bp, Artificial
  CRISPR gRNA sequence
cagagacagagtgtctgata

SEQ ID NO: 450962 - DNA, 20 bp, Artificial
  CRISPR gRNA sequence
gagacagagtgtctgataga

SEQ ID NO: 450963 - DNA, 20 bp, Artificial
  CRISPR gRNA sequence
agacagagtgtctgatagag

SEQ ID NO: 450964 - DNA, 20 bp, Artificial
  CRISPR gRNA sequence
agtgtctgatagagaggcaa

SEQ ID NO: 450965 - DNA, 20 bp, Artificial
  CRISPR gRNA sequence
tgatagagaggcaatagtat

SEQ ID NO: 450966 - DNA, 20 bp, Artificial
  CRISPR gRNA sequence
tagtatcagttctaatgaaa

SEQ ID NO: 450967 - DNA, 20 bp, Artificial
  CRISPR gRNA sequence
cagttctaatgaaaaagaaa

SEQ ID NO: 450968 - DNA, 20 bp, Artificial
  CRISPR gRNA sequence
tttaccctttccttaatgtc

SEQ ID NO: 450969 - DNA, 20 bp, Artificial
  CRISPR gRNA sequence
ttaccctttccttaatgtca

SEQ ID NO: 450970 - DNA, 20 bp, Artificial
  CRISPR gRNA sequence
accctttccttaatgtcaag

SEQ ID NO: 450971 - DNA, 20 bp, Artificial
  CRISPR gRNA sequence
cctttccttaatgtcaagga

SEQ ID NO: 450972 - DNA, 20 bp, Artificial
  CRISPR gRNA sequence
tccttaatgtcaaggagagt

SEQ ID NO: 450973 - DNA, 20 bp, Artificial
  CRISPR gRNA sequence
taatgtcaaggagagtgagt

SEQ ID NO: 450974 - DNA, 20 bp, Artificial
  CRISPR gRNA sequence
gtcaaggagagtgagtcagc

SEQ ID NO: 450975 - DNA, 20 bp, Artificial
  CRISPR gRNA sequence
tcaaggagagtgagtcagcc

SEQ ID NO: 450976 - DNA, 20 bp, Artificial
  CRISPR gRNA sequence
agtgagtcagccgggcgcct

SEQ ID NO: 450977 - DNA, 20 bp, Artificial
  CRISPR gRNA sequence
gtgagtcagccgggcgcctg

SEQ ID NO: 450978 - DNA, 20 bp, Artificial
  CRISPR gRNA sequence
cgggcgcctgaggatcacct

SEQ ID NO: 450979 - DNA, 20 bp, Artificial
  CRISPR gRNA sequence
gggcgcctgaggatcacctg

SEQ ID NO: 450980 - DNA, 20 bp, Artificial
  CRISPR gRNA sequence
gcctgaggatcacctgaggt

SEQ ID NO: 450981 - DNA, 20 bp, Artificial
  CRISPR gRNA sequence
cctgaggatcacctgaggtc

SEQ ID NO: 450982 - DNA, 20 bp, Artificial
  CRISPR gRNA sequence
gaggatcacctgaggtcagg

SEQ ID NO: 450983 - DNA, 20 bp, Artificial
  CRISPR gRNA sequence
ggatcacctgaggtcaggca

SEQ ID NO: 450984 - DNA, 20 bp, Artificial
  CRISPR gRNA sequence
cctgaggtcaggcagagttc

SEQ ID NO: 450985 - DNA, 20 bp, Artificial
  CRISPR gRNA sequence
ctgaggtcaggcagagttcg

SEQ ID NO: 450986 - DNA, 20 bp, Artificial
  CRISPR gRNA sequence
ggtcaggcagagttcgaggc

SEQ ID NO: 450987 - DNA, 20 bp, Artificial
  CRISPR gRNA sequence
cgaggccagcctgaccaata

SEQ ID NO: 450988 - DNA, 20 bp, Artificial
  CRISPR gRNA sequence
tctactaaaaatacaaaaat

SEQ ID NO: 450989 - DNA, 20 bp, Artificial
  CRISPR gRNA sequence
ctaaaaatacaaaaattagc

SEQ ID NO: 450990 - DNA, 20 bp, Artificial
  CRISPR gRNA sequence
aaaatacaaaaattagccgg

SEQ ID NO: 450991 - DNA, 20 bp, Artificial
  CRISPR gRNA sequence
atacaaaaattagccggcgg

SEQ ID NO: 450992 - DNA, 20 bp, Artificial
  CRISPR gRNA sequence
caaaaattagccggcggtgg

SEQ ID NO: 450993 - DNA, 20 bp, Artificial
  CRISPR gRNA sequence
ttagccggcggtggcggcat

SEQ ID NO: 450994 - DNA, 20 bp, Artificial
  CRISPR gRNA sequence
gcggtggcggcataagcctg

SEQ ID NO: 450995 - DNA, 20 bp, Artificial
  CRISPR gRNA sequence
gcggcataagcctgtagtcc

SEQ ID NO: 450996 - DNA, 20 bp, Artificial
  CRISPR gRNA sequence
agcctgtagtcccagctact

SEQ ID NO: 450997 - DNA, 20 bp, Artificial
  CRISPR gRNA sequence
gcctgtagtcccagctactc

SEQ ID NO: 450998 - DNA, 20 bp, Artificial
  CRISPR gRNA sequence
tgtagtcccagctactcggg

SEQ ID NO: 450999 - DNA, 20 bp, Artificial
  CRISPR gRNA sequence
tcccagctactcgggaagct

SEQ ID NO: 451000 - DNA, 20 bp, Artificial
  CRISPR gRNA sequence
agctactcgggaagctgagc

SEQ ID NO: 451001 - DNA, 20 bp, Artificial
  CRISPR gRNA sequence
tactcgggaagctgagccag

SEQ ID NO: 451002 - DNA, 20 bp, Artificial
  CRISPR gRNA sequence
ccagcagaattgcttgaaca

SEQ ID NO: 451003 - DNA, 20 bp, Artificial
  CRISPR gRNA sequence
cagcagaattgcttgaacat

SEQ ID NO: 451004 - DNA, 20 bp, Artificial
  CRISPR gRNA sequence
gcagaattgcttgaacatgg

SEQ ID NO: 451005 - DNA, 20 bp, Artificial
  CRISPR gRNA sequence
cagaattgcttgaacatggg

SEQ ID NO: 451006 - DNA, 20 bp, Artificial
  CRISPR gRNA sequence
aattgcttgaacatgggagg

SEQ ID NO: 451007 - DNA, 20 bp, Artificial
  CRISPR gRNA sequence
ttgcttgaacatgggaggcg

SEQ ID NO: 451008 - DNA, 20 bp, Artificial
  CRISPR gRNA sequence
tgcttgaacatgggaggcgg

SEQ ID NO: 451009 - DNA, 20 bp, Artificial
  CRISPR gRNA sequence
aacatgggaggcggaggttg

SEQ ID NO: 451010 - DNA, 20 bp, Artificial
  CRISPR gRNA sequence
tgggaggcggaggttgcagt

SEQ ID NO: 451011 - DNA, 20 bp, Artificial
  CRISPR gRNA sequence
ggcggaggttgcagtgagcc

SEQ ID NO: 451012 - DNA, 20 bp, Artificial
  CRISPR gRNA sequence
gagatcgcgccactgcactc

SEQ ID NO: 451013 - DNA, 20 bp, Artificial
  CRISPR gRNA sequence
cgcgccactgcactccagcc

SEQ ID NO: 451014 - DNA, 20 bp, Artificial
  CRISPR gRNA sequence
gcgccactgcactccagcct

SEQ ID NO: 451015 - DNA, 20 bp, Artificial
  CRISPR gRNA sequence
ctgcactccagcctgggtga

SEQ ID NO: 451016 - DNA, 20 bp, Artificial
  CRISPR gRNA sequence
gcactccagcctgggtgaca

SEQ ID NO: 451017 - DNA, 20 bp, Artificial
  CRISPR gRNA sequence
tccagcctgggtgacagagc

SEQ ID NO: 451018 - DNA, 20 bp, Artificial
  CRISPR gRNA sequence
aaaaaaaaaaaaaaaaaaaa

SEQ ID NO: 451019 - DNA, 20 bp, Artificial
  CRISPR gRNA sequence
aaaaaaaaaaaaaaaaaaaa

SEQ ID NO: 451020 - DNA, 20 bp, Artificial
  CRISPR gRNA sequence
agagtcctttgtttccccac

SEQ ID NO: 451021 - DNA, 20 bp, Artificial
  CRISPR gRNA sequence
agtcctttgtttccccacta

SEQ ID NO: 451022 - DNA, 20 bp, Artificial
  CRISPR gRNA sequence
ttccccactagagaaaatca

SEQ ID NO: 451023 - DNA, 20 bp, Artificial
  CRISPR gRNA sequence
tccccactagagaaaatcac

SEQ ID NO: 451024 - DNA, 20 bp, Artificial
  CRISPR gRNA sequence
ctagagaaaatcacgggatc

SEQ ID NO: 451025 - DNA, 20 bp, Artificial
  CRISPR gRNA sequence
cgggatccagcccttcccac

SEQ ID NO: 451026 - DNA, 20 bp, Artificial
  CRISPR gRNA sequence
tccagcccttcccacaagcc

SEQ ID NO: 451027 - DNA, 20 bp, Artificial
  CRISPR gRNA sequence
ccagcccttcccacaagccc

SEQ ID NO: 451028 - DNA, 20 bp, Artificial
  CRISPR gRNA sequence
caagcccaggatcctcccca

SEQ ID NO: 451029 - DNA, 20 bp, Artificial
  CRISPR gRNA sequence
ccccatggccgtctctgctc

SEQ ID NO: 451030 - DNA, 20 bp, Artificial
  CRISPR gRNA sequence
cccatggccgtctctgctct

SEQ ID NO: 451031 - DNA, 20 bp, Artificial
  CRISPR gRNA sequence
ccatggccgtctctgctcta

SEQ ID NO: 451032 - DNA, 20 bp, Artificial
  CRISPR gRNA sequence
ctagggtctatcctcaccac

SEQ ID NO: 451033 - DNA, 20 bp, Artificial
  CRISPR gRNA sequence
gtctatcctcaccaccagac

SEQ ID NO: 451034 - DNA, 20 bp, Artificial
  CRISPR gRNA sequence
gactggatgtccacaattgc

SEQ ID NO: 451035 - DNA, 20 bp, Artificial
  CRISPR gRNA sequence
tggatgtccacaattgccag

SEQ ID NO: 451036 - DNA, 20 bp, Artificial
  CRISPR gRNA sequence
ggatgtccacaattgccagc

SEQ ID NO: 451037 - DNA, 20 bp, Artificial
  CRISPR gRNA sequence
gtccacaattgccagcagga

SEQ ID NO: 451038 - DNA, 20 bp, Artificial
  CRISPR gRNA sequence
acaattgccagcaggatggc

SEQ ID NO: 451039 - DNA, 20 bp, Artificial
  CRISPR gRNA sequence
caattgccagcaggatggcc

SEQ ID NO: 451040 - DNA, 20 bp, Artificial
  CRISPR gRNA sequence
aattgccagcaggatggcca

SEQ ID NO: 451041 - DNA, 20 bp, Artificial
  CRISPR gRNA sequence
ccagcaggatggccagggca

SEQ ID NO: 451042 - DNA, 20 bp, Artificial
  CRISPR gRNA sequence
gcaggatggccagggcacag

SEQ ID NO: 451043 - DNA, 20 bp, Artificial
  CRISPR gRNA sequence
cagggcacagcagcctctgc

SEQ ID NO: 451044 - DNA, 20 bp, Artificial
  CRISPR gRNA sequence
agggcacagcagcctctgcc

SEQ ID NO: 451045 - DNA, 20 bp, Artificial
  CRISPR gRNA sequence
cagcctctgccgggttccaa

SEQ ID NO: 451046 - DNA, 20 bp, Artificial
  CRISPR gRNA sequence
aacagcatcctgcacgctgt

SEQ ID NO: 451047 - DNA, 20 bp, Artificial
  CRISPR gRNA sequence
agcatcctgcacgctgtcag

SEQ ID NO: 451048 - DNA, 20 bp, Artificial
  CRISPR gRNA sequence
gcatcctgcacgctgtcagc

SEQ ID NO: 451049 - DNA, 20 bp, Artificial
  CRISPR gRNA sequence
ctgcacgctgtcagcaggcc

SEQ ID NO: 451050 - DNA, 20 bp, Artificial
  CRISPR gRNA sequence
tgcacgctgtcagcaggccc

SEQ ID NO: 451051 - DNA, 20 bp, Artificial
  CRISPR gRNA sequence
tcagcaggcccaggaacttg

SEQ ID NO: 451052 - DNA, 20 bp, Artificial
  CRISPR gRNA sequence
caggaacttgaagcaaatgt

SEQ ID NO: 451053 - DNA, 20 bp, Artificial
  CRISPR gRNA sequence
gaagcaaatgttggctctgc

SEQ ID NO: 451054 - DNA, 20 bp, Artificial
  CRISPR gRNA sequence
gttggctctgctggtatcct

SEQ ID NO: 451055 - DNA, 20 bp, Artificial
  CRISPR gRNA sequence
tctgctggtatccttggctt

SEQ ID NO: 451056 - DNA, 20 bp, Artificial
  CRISPR gRNA sequence
ccttggcttcagtctcctaa

SEQ ID NO: 451057 - DNA, 20 bp, Artificial
  CRISPR gRNA sequence
gcttcagtctcctaaaagca

SEQ ID NO: 451058 - DNA, 20 bp, Artificial
  CRISPR gRNA sequence
cttcagtctcctaaaagcac

SEQ ID NO: 451059 - DNA, 20 bp, Artificial
  CRISPR gRNA sequence
ttcagtctcctaaaagcaca

SEQ ID NO: 451060 - DNA, 20 bp, Artificial
  CRISPR gRNA sequence
tcagtctcctaaaagcacag

SEQ ID NO: 451061 - DNA, 20 bp, Artificial
  CRISPR gRNA sequence
cagtctcctaaaagcacagg

SEQ ID NO: 451062 - DNA, 20 bp, Artificial
  CRISPR gRNA sequence
aaaagcacagggggacccac

SEQ ID NO: 451063 - DNA, 20 bp, Artificial
  CRISPR gRNA sequence
acagggggacccactagaca

SEQ ID NO: 451064 - DNA, 20 bp, Artificial
  CRISPR gRNA sequence
acccactagacaaagccttc

SEQ ID NO: 451065 - DNA, 20 bp, Artificial
  CRISPR gRNA sequence
cccactagacaaagccttcc

SEQ ID NO: 451066 - DNA, 20 bp, Artificial
  CRISPR gRNA sequence
ccactagacaaagccttcca

SEQ ID NO: 451067 - DNA, 20 bp, Artificial
  CRISPR gRNA sequence
acaaagccttccagggttcc

SEQ ID NO: 451068 - DNA, 20 bp, Artificial
  CRISPR gRNA sequence
ccaagaccatttccccatcc

SEQ ID NO: 451069 - DNA, 20 bp, Artificial
  CRISPR gRNA sequence
caagaccatttccccatccc

SEQ ID NO: 451070 - DNA, 20 bp, Artificial
  CRISPR gRNA sequence
catttccccatcccaggctc

SEQ ID NO: 451071 - DNA, 20 bp, Artificial
  CRISPR gRNA sequence
tcccaggctctagctttgat

SEQ ID NO: 451072 - DNA, 20 bp, Artificial
  CRISPR gRNA sequence
aggctctagctttgattggc

SEQ ID NO: 451073 - DNA, 20 bp, Artificial
  CRISPR gRNA sequence
gctctagctttgattggcta

SEQ ID NO: 451074 - DNA, 20 bp, Artificial
  CRISPR gRNA sequence
tttgattggctagagtatga

SEQ ID NO: 451075 - DNA, 20 bp, Artificial
  CRISPR gRNA sequence
tgattggctagagtatgatg

SEQ ID NO: 451076 - DNA, 20 bp, Artificial
  CRISPR gRNA sequence
gattggctagagtatgatgg

SEQ ID NO: 451077 - DNA, 20 bp, Artificial
  CRISPR gRNA sequence
tggctagagtatgatggagg

SEQ ID NO: 451078 - DNA, 20 bp, Artificial
  CRISPR gRNA sequence
gctagagtatgatggaggta

SEQ ID NO: 451079 - DNA, 20 bp, Artificial
  CRISPR gRNA sequence
ctagagtatgatggaggtag

SEQ ID NO: 451080 - DNA, 20 bp, Artificial
  CRISPR gRNA sequence
agagtatgatggaggtagag

SEQ ID NO: 451081 - DNA, 20 bp, Artificial
  CRISPR gRNA sequence
gagtatgatggaggtagagg

SEQ ID NO: 451082 - DNA, 20 bp, Artificial
  CRISPR gRNA sequence
agtatgatggaggtagagga

SEQ ID NO: 451083 - DNA, 20 bp, Artificial
  CRISPR gRNA sequence
gatggaggtagaggagggct

SEQ ID NO: 451084 - DNA, 20 bp, Artificial
  CRISPR gRNA sequence
atggaggtagaggagggctt

SEQ ID NO: 451085 - DNA, 20 bp, Artificial
  CRISPR gRNA sequence
gtagaggagggcttgggcat

SEQ ID NO: 451086 - DNA, 20 bp, Artificial
  CRISPR gRNA sequence
agaggagggcttgggcatga

SEQ ID NO: 451087 - DNA, 20 bp, Artificial
  CRISPR gRNA sequence
agggcttgggcatgagagtc

SEQ ID NO: 451088 - DNA, 20 bp, Artificial
  CRISPR gRNA sequence
cttgggcatgagagtccagc

SEQ ID NO: 451089 - DNA, 20 bp, Artificial
  CRISPR gRNA sequence
ggcatgagagtccagctggc

SEQ ID NO: 451090 - DNA, 20 bp, Artificial
  CRISPR gRNA sequence
gcatgagagtccagctggct

SEQ ID NO: 451091 - DNA, 20 bp, Artificial
  CRISPR gRNA sequence
tgagagtccagctggctggg

SEQ ID NO: 451092 - DNA, 20 bp, Artificial
  CRISPR gRNA sequence
agtccagctggctgggaagt

SEQ ID NO: 451093 - DNA, 20 bp, Artificial
  CRISPR gRNA sequence
gtccagctggctgggaagtg

SEQ ID NO: 451094 - DNA, 20 bp, Artificial
  CRISPR gRNA sequence
cagctggctgggaagtgagg

SEQ ID NO: 451095 - DNA, 20 bp, Artificial
  CRISPR gRNA sequence
gggaagtgaggcggtaaacc

SEQ ID NO: 451096 - DNA, 20 bp, Artificial
  CRISPR gRNA sequence
agtgaggcggtaaaccaagt

SEQ ID NO: 451097 - DNA, 20 bp, Artificial
  CRISPR gRNA sequence
gtaaaccaagtgagatacac

SEQ ID NO: 451098 - DNA, 20 bp, Artificial
  CRISPR gRNA sequence
taaaccaagtgagatacact

SEQ ID NO: 451099 - DNA, 20 bp, Artificial
  CRISPR gRNA sequence
aaccaagtgagatacactgg

SEQ ID NO: 451100 - DNA, 20 bp, Artificial
  CRISPR gRNA sequence
aagtgagatacactgggagc

SEQ ID NO: 451101 - DNA, 20 bp, Artificial
  CRISPR gRNA sequence
agtgagatacactgggagcc

SEQ ID NO: 451102 - DNA, 20 bp, Artificial
  CRISPR gRNA sequence
gtgagatacactgggagccg

SEQ ID NO: 451103 - DNA, 20 bp, Artificial
  CRISPR gRNA sequence
gagatacactgggagccggg

SEQ ID NO: 451104 - DNA, 20 bp, Artificial
  CRISPR gRNA sequence
agatacactgggagccgggg

SEQ ID NO: 451105 - DNA, 20 bp, Artificial
  CRISPR gRNA sequence
gatacactgggagccgggga

SEQ ID NO: 451106 - DNA, 20 bp, Artificial
  CRISPR gRNA sequence
tacactgggagccggggagg

SEQ ID NO: 451107 - DNA, 20 bp, Artificial
  CRISPR gRNA sequence
acactgggagccggggaggg

SEQ ID NO: 451108 - DNA, 20 bp, Artificial
  CRISPR gRNA sequence
cactgggagccggggaggga

SEQ ID NO: 451109 - DNA, 20 bp, Artificial
  CRISPR gRNA sequence
actgggagccggggagggag

SEQ ID NO: 451110 - DNA, 20 bp, Artificial
  CRISPR gRNA sequence
gagccggggagggaggggca

SEQ ID NO: 451111 - DNA, 20 bp, Artificial
  CRISPR gRNA sequence
agccggggagggaggggcat

SEQ ID NO: 451112 - DNA, 20 bp, Artificial
  CRISPR gRNA sequence
gccggggagggaggggcata

SEQ ID NO: 451113 - DNA, 20 bp, Artificial
  CRISPR gRNA sequence
cggggagggaggggcatagg

SEQ ID NO: 451114 - DNA, 20 bp, Artificial
  CRISPR gRNA sequence
aggggcatagggagacacta

SEQ ID NO: 451115 - DNA, 20 bp, Artificial
  CRISPR gRNA sequence
ggggcatagggagacactaa

SEQ ID NO: 451116 - DNA, 20 bp, Artificial
  CRISPR gRNA sequence
tttctcatatatattttttt

SEQ ID NO: 451117 - DNA, 20 bp, Artificial
  CRISPR gRNA sequence
tatatttttttaagttaaat

SEQ ID NO: 451118 - DNA, 20 bp, Artificial
  CRISPR gRNA sequence
taaattggattgctgcgtca

SEQ ID NO: 451119 - DNA, 20 bp, Artificial
  CRISPR gRNA sequence
aactttttttctactataat

SEQ ID NO: 451120 - DNA, 20 bp, Artificial
  CRISPR gRNA sequence
taatcagattgctctccaaa

SEQ ID NO: 451121 - DNA, 20 bp, Artificial
  CRISPR gRNA sequence
aatcagattgctctccaaaa

SEQ ID NO: 451122 - DNA, 20 bp, Artificial
  CRISPR gRNA sequence
ccaaaaaggctgttgataat

SEQ ID NO: 451123 - DNA, 20 bp, Artificial
  CRISPR gRNA sequence
ttgataatcagatgttcacc

SEQ ID NO: 451124 - DNA, 20 bp, Artificial
  CRISPR gRNA sequence
tgttcaccaagaatgcttga

SEQ ID NO: 451125 - DNA, 20 bp, Artificial
  CRISPR gRNA sequence
acatttcctcgtgcccttgc

SEQ ID NO: 451126 - DNA, 20 bp, Artificial
  CRISPR gRNA sequence
cctcgtgcccttgctagctc

SEQ ID NO: 451127 - DNA, 20 bp, Artificial
  CRISPR gRNA sequence
ctcgtgcccttgctagctct

SEQ ID NO: 451128 - DNA, 20 bp, Artificial
  CRISPR gRNA sequence
taacatttttgccaatctga

SEQ ID NO: 451129 - DNA, 20 bp, Artificial
  CRISPR gRNA sequence
caatctgatggatgaaaaat

SEQ ID NO: 451130 - DNA, 20 bp, Artificial
  CRISPR gRNA sequence
ttatgttgcatttccatgat

SEQ ID NO: 451131 - DNA, 20 bp, Artificial
  CRISPR gRNA sequence
ttgcatttccatgattagtg

SEQ ID NO: 451132 - DNA, 20 bp, Artificial
  CRISPR gRNA sequence
tttccatgattagtgaagtt

SEQ ID NO: 451133 - DNA, 20 bp, Artificial
  CRISPR gRNA sequence
ttccatgattagtgaagttg

SEQ ID NO: 451134 - DNA, 20 bp, Artificial
  CRISPR gRNA sequence
ggatcttttcatatgcttat

SEQ ID NO: 451135 - DNA, 20 bp, Artificial
  CRISPR gRNA sequence
ttcatatgcttattggtcat

SEQ ID NO: 451136 - DNA, 20 bp, Artificial
  CRISPR gRNA sequence
tcttcacatttcttaacttt

SEQ ID NO: 451137 - DNA, 20 bp, Artificial
  CRISPR gRNA sequence
cttcacatttcttaactttt

SEQ ID NO: 451138 - DNA, 20 bp, Artificial
  CRISPR gRNA sequence
tttaggcactttctccgtat

SEQ ID NO: 451139 - DNA, 20 bp, Artificial
  CRISPR gRNA sequence
taggcactttctccgtatta

SEQ ID NO: 451140 - DNA, 20 bp, Artificial
  CRISPR gRNA sequence
taacccatctgccatttttt

SEQ ID NO: 451141 - DNA, 20 bp, Artificial
  CRISPR gRNA sequence
aacccatctgccattttttt

SEQ ID NO: 451142 - DNA, 20 bp, Artificial
  CRISPR gRNA sequence
tgtctcttcactttttttat

SEQ ID NO: 451143 - DNA, 20 bp, Artificial
  CRISPR gRNA sequence
gtctcttcactttttttatg

SEQ ID NO: 451144 - DNA, 20 bp, Artificial
  CRISPR gRNA sequence
ttatgaggcttttttttcac

SEQ ID NO: 451145 - DNA, 20 bp, Artificial
  CRISPR gRNA sequence
tatgaggcttttttttcaca

SEQ ID NO: 451146 - DNA, 20 bp, Artificial
  CRISPR gRNA sequence
aggcttttttttcacaagga

SEQ ID NO: 451147 - DNA, 20 bp, Artificial
  CRISPR gRNA sequence
acatatctatcttttccttt

SEQ ID NO: 451148 - DNA, 20 bp, Artificial
  CRISPR gRNA sequence
atcttttcctttaagttgtc

SEQ ID NO: 451149 - DNA, 20 bp, Artificial
  CRISPR gRNA sequence
tcttttcctttaagttgtct

SEQ ID NO: 451150 - DNA, 20 bp, Artificial
  CRISPR gRNA sequence
tctgggtttcctgcattgtt

SEQ ID NO: 451151 - DNA, 20 bp, Artificial
  CRISPR gRNA sequence
ctgggtttcctgcattgttt

SEQ ID NO: 451152 - DNA, 20 bp, Artificial
  CRISPR gRNA sequence
gtttcctgcattgtttagga

SEQ ID NO: 451153 - DNA, 20 bp, Artificial
  CRISPR gRNA sequence
aggaaagtttccctccaatt

SEQ ID NO: 451154 - DNA, 20 bp, Artificial
  CRISPR gRNA sequence
ggaaagtttccctccaattg

SEQ ID NO: 451155 - DNA, 20 bp, Artificial
  CRISPR gRNA sequence
ttttattgttttacttttta

SEQ ID NO: 451156 - DNA, 20 bp, Artificial
  CRISPR gRNA sequence
atagttacatcttctaatcc

SEQ ID NO: 451157 - DNA, 20 bp, Artificial
  CRISPR gRNA sequence
tacatcttctaatcctggct

SEQ ID NO: 451158 - DNA, 20 bp, Artificial
  CRISPR gRNA sequence
gtttcaaaataaacaaactg

SEQ ID NO: 451159 - DNA, 20 bp, Artificial
  CRISPR gRNA sequence
aaacacttgaatttcatcaa

SEQ ID NO: 451160 - DNA, 20 bp, Artificial
  CRISPR gRNA sequence
aacacttgaatttcatcaat

SEQ ID NO: 451161 - DNA, 20 bp, Artificial
  CRISPR gRNA sequence
acacttgaatttcatcaata

SEQ ID NO: 451162 - DNA, 20 bp, Artificial
  CRISPR gRNA sequence
aatttcatcaatagggaaaa

SEQ ID NO: 451163 - DNA, 20 bp, Artificial
  CRISPR gRNA sequence
aatagggaaaatggtttaat

SEQ ID NO: 451164 - DNA, 20 bp, Artificial
  CRISPR gRNA sequence
aaaatattatatattattaa

SEQ ID NO: 451165 - DNA, 20 bp, Artificial
  CRISPR gRNA sequence
ttatatattattaaaagaat

SEQ ID NO: 451166 - DNA, 20 bp, Artificial
  CRISPR gRNA sequence
atgagatacttctataaata

SEQ ID NO: 451167 - DNA, 20 bp, Artificial
  CRISPR gRNA sequence
tgagatacttctataaatat

SEQ ID NO: 451168 - DNA, 20 bp, Artificial
  CRISPR gRNA sequence
tacttctataaatatgggcc

SEQ ID NO: 451169 - DNA, 20 bp, Artificial
  CRISPR gRNA sequence
cttctataaatatgggcctg

SEQ ID NO: 451170 - DNA, 20 bp, Artificial
  CRISPR gRNA sequence
ttctataaatatgggcctgg

SEQ ID NO: 451171 - DNA, 20 bp, Artificial
  CRISPR gRNA sequence
tctataaatatgggcctgga

SEQ ID NO: 451172 - DNA, 20 bp, Artificial
  CRISPR gRNA sequence
ctggagggatgttcatgata

SEQ ID NO: 451173 - DNA, 20 bp, Artificial
  CRISPR gRNA sequence
ggatgttcatgatatagcat

SEQ ID NO: 451174 - DNA, 20 bp, Artificial
  CRISPR gRNA sequence
gatgttcatgatatagcatt

SEQ ID NO: 451175 - DNA, 20 bp, Artificial
  CRISPR gRNA sequence
tgatatagcattaggtcaaa

SEQ ID NO: 451176 - DNA, 20 bp, Artificial
  CRISPR gRNA sequence
gatatagcattaggtcaaaa

SEQ ID NO: 451177 - DNA, 20 bp, Artificial
  CRISPR gRNA sequence
atatagcattaggtcaaaaa

SEQ ID NO: 451178 - DNA, 20 bp, Artificial
  CRISPR gRNA sequence
tgtgttttaaaaatatattt

SEQ ID NO: 451179 - DNA, 20 bp, Artificial
  CRISPR gRNA sequence
gtgttttaaaaatatattta

SEQ ID NO: 451180 - DNA, 20 bp, Artificial
  CRISPR gRNA sequence
aaaatatatttaaggttttg

SEQ ID NO: 451181 - DNA, 20 bp, Artificial
  CRISPR gRNA sequence
tttgtagtttataacttttg

SEQ ID NO: 451182 - DNA, 20 bp, Artificial
  CRISPR gRNA sequence
gtagtttataacttttgaag

SEQ ID NO: 451183 - DNA, 20 bp, Artificial
  CRISPR gRNA sequence
tgaagtggtaattacattca

SEQ ID NO: 451184 - DNA, 20 bp, Artificial
  CRISPR gRNA sequence
tcacagcatttaaaattcaa

SEQ ID NO: 451185 - DNA, 20 bp, Artificial
  CRISPR gRNA sequence
cacagcatttaaaattcaaa

SEQ ID NO: 451186 - DNA, 20 bp, Artificial
  CRISPR gRNA sequence
acagcatttaaaattcaaaa

SEQ ID NO: 451187 - DNA, 20 bp, Artificial
  CRISPR gRNA sequence
cagcatttaaaattcaaaag

SEQ ID NO: 451188 - DNA, 20 bp, Artificial
  CRISPR gRNA sequence
aaaattcaaaaggggaaaac

SEQ ID NO: 451189 - DNA, 20 bp, Artificial
  CRISPR gRNA sequence
atttttctgatttttataat

SEQ ID NO: 451190 - DNA, 20 bp, Artificial
  CRISPR gRNA sequence
atttttataatcagcttgtc

SEQ ID NO: 451191 - DNA, 20 bp, Artificial
  CRISPR gRNA sequence
ttcctactgtgtgtaccatc

SEQ ID NO: 451192 - DNA, 20 bp, Artificial
  CRISPR gRNA sequence
ctgtgtgtaccatcaagaaa

SEQ ID NO: 451193 - DNA, 20 bp, Artificial
  CRISPR gRNA sequence
ccatcaagaaaaagtcctat

SEQ ID NO: 451194 - DNA, 20 bp, Artificial
  CRISPR gRNA sequence
tcctattggtattttaaaat

SEQ ID NO: 451195 - DNA, 20 bp, Artificial
  CRISPR gRNA sequence
cctattggtattttaaaatt

SEQ ID NO: 451196 - DNA, 20 bp, Artificial
  CRISPR gRNA sequence
gttcaatttatattttaact

SEQ ID NO: 451197 - DNA, 20 bp, Artificial
  CRISPR gRNA sequence
ttcaatttatattttaactt

SEQ ID NO: 451198 - DNA, 20 bp, Artificial
  CRISPR gRNA sequence
tcaatttatattttaactta

SEQ ID NO: 451199 - DNA, 20 bp, Artificial
  CRISPR gRNA sequence
aatttatattttaacttagg

SEQ ID NO: 451200 - DNA, 20 bp, Artificial
  CRISPR gRNA sequence
gacattgattcttttgatcc

SEQ ID NO: 451201 - DNA, 20 bp, Artificial
  CRISPR gRNA sequence
tttttcaaatatgtgtgtct

SEQ ID NO: 451202 - DNA, 20 bp, Artificial
  CRISPR gRNA sequence
ttttcaaatatgtgtgtctc

SEQ ID NO: 451203 - DNA, 20 bp, Artificial
  CRISPR gRNA sequence
atgtgtgtctcaggtatgta

SEQ ID NO: 451204 - DNA, 20 bp, Artificial
  CRISPR gRNA sequence
tgtgtctcaggtatgtatag

SEQ ID NO: 451205 - DNA, 20 bp, Artificial
  CRISPR gRNA sequence
gtatagaagttttcttcata

SEQ ID NO: 451206 - DNA, 20 bp, Artificial
  CRISPR gRNA sequence
taaagtcctcgtccatttct

SEQ ID NO: 451207 - DNA, 20 bp, Artificial
  CRISPR gRNA sequence
tcctcgtccatttcttagct

SEQ ID NO: 451208 - DNA, 20 bp, Artificial
  CRISPR gRNA sequence
cttagctaagtttgtttctt

SEQ ID NO: 451209 - DNA, 20 bp, Artificial
  CRISPR gRNA sequence
tcttttttttaatatacttt

SEQ ID NO: 451210 - DNA, 20 bp, Artificial
  CRISPR gRNA sequence
ttttaatatactttaagttc

SEQ ID NO: 451211 - DNA, 20 bp, Artificial
  CRISPR gRNA sequence
tttaatatactttaagttct

SEQ ID NO: 451212 - DNA, 20 bp, Artificial
  CRISPR gRNA sequence
ttaatatactttaagttcta

SEQ ID NO: 451213 - DNA, 20 bp, Artificial
  CRISPR gRNA sequence
gggtacatgtgcacaatgtg

SEQ ID NO: 451214 - DNA, 20 bp, Artificial
  CRISPR gRNA sequence
ggtacatgtgcacaatgtgc

SEQ ID NO: 451215 - DNA, 20 bp, Artificial
  CRISPR gRNA sequence
caatgtgcaggtttgttaca

SEQ ID NO: 451216 - DNA, 20 bp, Artificial
  CRISPR gRNA sequence
tagttgtacatgtttcatgt

SEQ ID NO: 451217 - DNA, 20 bp, Artificial
  CRISPR gRNA sequence
catcaacttgtcatttacat

SEQ ID NO: 451218 - DNA, 20 bp, Artificial
  CRISPR gRNA sequence
atcaacttgtcatttacatt

SEQ ID NO: 451219 - DNA, 20 bp, Artificial
  CRISPR gRNA sequence
tcctaatgctatccctcccc

SEQ ID NO: 451220 - DNA, 20 bp, Artificial
  CRISPR gRNA sequence
cctaatgctatccctccccc

SEQ ID NO: 451221 - DNA, 20 bp, Artificial
  CRISPR gRNA sequence
ctcccccgggcccccacccg

SEQ ID NO: 451222 - DNA, 20 bp, Artificial
  CRISPR gRNA sequence
ccccacccgtggaacgtcat

SEQ ID NO: 451223 - DNA, 20 bp, Artificial
  CRISPR gRNA sequence
gtgtgtgatgttccccaccc

SEQ ID NO: 451224 - DNA, 20 bp, Artificial
  CRISPR gRNA sequence
tgtgtgatgttccccaccct

SEQ ID NO: 451225 - DNA, 20 bp, Artificial
  CRISPR gRNA sequence
attgttcaactcctacttat

SEQ ID NO: 451226 - DNA, 20 bp, Artificial
  CRISPR gRNA sequence
ttcaactcctacttatgagc

SEQ ID NO: 451227 - DNA, 20 bp, Artificial
  CRISPR gRNA sequence
tacttatgagcgagaacatg

SEQ ID NO: 451228 - DNA, 20 bp, Artificial
  CRISPR gRNA sequence
gagcgagaacatgcagtgtt

SEQ ID NO: 451229 - DNA, 20 bp, Artificial
  CRISPR gRNA sequence
ttggtttcctgtccttgtga

SEQ ID NO: 451230 - DNA, 20 bp, Artificial
  CRISPR gRNA sequence
tgtccttgtgacagtttgct

SEQ ID NO: 451231 - DNA, 20 bp, Artificial
  CRISPR gRNA sequence
tgacagtttgcttagaatga

SEQ ID NO: 451232 - DNA, 20 bp, Artificial
  CRISPR gRNA sequence
ttgcttagaatgatggtttc

SEQ ID NO: 451233 - DNA, 20 bp, Artificial
  CRISPR gRNA sequence
gcttcatctatgtccctgca

SEQ ID NO: 451234 - DNA, 20 bp, Artificial
  CRISPR gRNA sequence
cttcatctatgtccctgcaa

SEQ ID NO: 451235 - DNA, 20 bp, Artificial
  CRISPR gRNA sequence
catgaactcatcctttttta

SEQ ID NO: 451236 - DNA, 20 bp, Artificial
  CRISPR gRNA sequence
catccttttttatggctgca

SEQ ID NO: 451237 - DNA, 20 bp, Artificial
  CRISPR gRNA sequence
tatggctgcatagtattcca

SEQ ID NO: 451238 - DNA, 20 bp, Artificial
  CRISPR gRNA sequence
tgtgccacattttcttaatc

SEQ ID NO: 451239 - DNA, 20 bp, Artificial
  CRISPR gRNA sequence
ttaatccagtctatcattga

SEQ ID NO: 451240 - DNA, 20 bp, Artificial
  CRISPR gRNA sequence
gtctatcattgatggacatt

SEQ ID NO: 451241 - DNA, 20 bp, Artificial
  CRISPR gRNA sequence
tctatcattgatggacattt

SEQ ID NO: 451242 - DNA, 20 bp, Artificial
  CRISPR gRNA sequence
tcattgatggacatttgggt

SEQ ID NO: 451243 - DNA, 20 bp, Artificial
  CRISPR gRNA sequence
tggacatttgggttggttcc

SEQ ID NO: 451244 - DNA, 20 bp, Artificial
  CRISPR gRNA sequence
ggacatttgggttggttccc

SEQ ID NO: 451245 - DNA, 20 bp, Artificial
  CRISPR gRNA sequence
ccaggctttgctattgtgaa

SEQ ID NO: 451246 - DNA, 20 bp, Artificial
  CRISPR gRNA sequence
atacttgtgcatctttatcg

SEQ ID NO: 451247 - DNA, 20 bp, Artificial
  CRISPR gRNA sequence
tagaatgatttataatcctt

SEQ ID NO: 451248 - DNA, 20 bp, Artificial
  CRISPR gRNA sequence
agaatgatttataatccttt

SEQ ID NO: 451249 - DNA, 20 bp, Artificial
  CRISPR gRNA sequence
taatcctttgggtatatgcc

SEQ ID NO: 451250 - DNA, 20 bp, Artificial
  CRISPR gRNA sequence
ttgggtatatgcccagtaat

SEQ ID NO: 451251 - DNA, 20 bp, Artificial
  CRISPR gRNA sequence
atgcccagtaatgagattgc

SEQ ID NO: 451252 - DNA, 20 bp, Artificial
  CRISPR gRNA sequence
tgcccagtaatgagattgct

SEQ ID NO: 451253 - DNA, 20 bp, Artificial
  CRISPR gRNA sequence
aatgagattgctgggtcaaa

SEQ ID NO: 451254 - DNA, 20 bp, Artificial
  CRISPR gRNA sequence
gctgggtcaaatggtatttc

SEQ ID NO: 451255 - DNA, 20 bp, Artificial
  CRISPR gRNA sequence
tcaaatggtatttctagttc

SEQ ID NO: 451256 - DNA, 20 bp, Artificial
  CRISPR gRNA sequence
atttctagttctagatcctt

SEQ ID NO: 451257 - DNA, 20 bp, Artificial
  CRISPR gRNA sequence
tttctagttctagatccttg

SEQ ID NO: 451258 - DNA, 20 bp, Artificial
  CRISPR gRNA sequence
aatccccacactgtcttcca

SEQ ID NO: 451259 - DNA, 20 bp, Artificial
  CRISPR gRNA sequence
ccccacactgtcttccacag

SEQ ID NO: 451260 - DNA, 20 bp, Artificial
  CRISPR gRNA sequence
ctaatttacactcccatcaa

SEQ ID NO: 451261 - DNA, 20 bp, Artificial
  CRISPR gRNA sequence
cactcccatcaacagtgtaa

SEQ ID NO: 451262 - DNA, 20 bp, Artificial
  CRISPR gRNA sequence
ctatttctccacatcttctc

SEQ ID NO: 451263 - DNA, 20 bp, Artificial
  CRISPR gRNA sequence
tatcttttaacttatttttt

SEQ ID NO: 451264 - DNA, 20 bp, Artificial
  CRISPR gRNA sequence
tcattattgttcatatatga

SEQ ID NO: 451265 - DNA, 20 bp, Artificial
  CRISPR gRNA sequence
cattattgttcatatatgaa

SEQ ID NO: 451266 - DNA, 20 bp, Artificial
  CRISPR gRNA sequence
tgaaaggctatttgttttac

SEQ ID NO: 451267 - DNA, 20 bp, Artificial
  CRISPR gRNA sequence
ctagatattaatttcatacc

SEQ ID NO: 451268 - DNA, 20 bp, Artificial
  CRISPR gRNA sequence
cccttaattctatcattttt

SEQ ID NO: 451269 - DNA, 20 bp, Artificial
  CRISPR gRNA sequence
catttttcagttgattctct

SEQ ID NO: 451270 - DNA, 20 bp, Artificial
  CRISPR gRNA sequence
gttgattctcttggattttc

SEQ ID NO: 451271 - DNA, 20 bp, Artificial
  CRISPR gRNA sequence
tttctttcttctaattgtgt

SEQ ID NO: 451272 - DNA, 20 bp, Artificial
  CRISPR gRNA sequence
attgtgttggttaatatctc

SEQ ID NO: 451273 - DNA, 20 bp, Artificial
  CRISPR gRNA sequence
agaaaaatattaaataataa

SEQ ID NO: 451274 - DNA, 20 bp, Artificial
  CRISPR gRNA sequence
tgaatctctgtcttttttct

SEQ ID NO: 451275 - DNA, 20 bp, Artificial
  CRISPR gRNA sequence
tgtcttttttctaagtttaa

SEQ ID NO: 451276 - DNA, 20 bp, Artificial
  CRISPR gRNA sequence
gtcttttttctaagtttaat

SEQ ID NO: 451277 - DNA, 20 bp, Artificial
  CRISPR gRNA sequence
tcttttttctaagtttaatg

SEQ ID NO: 451278 - DNA, 20 bp, Artificial
  CRISPR gRNA sequence
cttttttctaagtttaatgg

SEQ ID NO: 451279 - DNA, 20 bp, Artificial
  CRISPR gRNA sequence
tgcttaaatgtttccttatt

SEQ ID NO: 451280 - DNA, 20 bp, Artificial
  CRISPR gRNA sequence
tgtttccttattaagtatta

SEQ ID NO: 451281 - DNA, 20 bp, Artificial
  CRISPR gRNA sequence
ttccttattaagtattatag

SEQ ID NO: 451282 - DNA, 20 bp, Artificial
  CRISPR gRNA sequence
ttaagtattatagtagcttt

SEQ ID NO: 451283 - DNA, 20 bp, Artificial
  CRISPR gRNA sequence
attatagtagctttgagaat

SEQ ID NO: 451284 - DNA, 20 bp, Artificial
  CRISPR gRNA sequence
gagatgtattttattatgtt

SEQ ID NO: 451285 - DNA, 20 bp, Artificial
  CRISPR gRNA sequence
agatgtattttattatgtta

SEQ ID NO: 451286 - DNA, 20 bp, Artificial
  CRISPR gRNA sequence
acatttatttctattttatt

SEQ ID NO: 451287 - DNA, 20 bp, Artificial
  CRISPR gRNA sequence
atttatttctattttattaa

SEQ ID NO: 451288 - DNA, 20 bp, Artificial
  CRISPR gRNA sequence
attaagagttttaaaatgtc

SEQ ID NO: 451289 - DNA, 20 bp, Artificial
  CRISPR gRNA sequence
ttaagagttttaaaatgtca

SEQ ID NO: 451290 - DNA, 20 bp, Artificial
  CRISPR gRNA sequence
gagttttaaaatgtcaagga

SEQ ID NO: 451291 - DNA, 20 bp, Artificial
  CRISPR gRNA sequence
aaatgatattatttttcttt

SEQ ID NO: 451292 - DNA, 20 bp, Artificial
  CRISPR gRNA sequence
atttttctttaagatatatt

SEQ ID NO: 451293 - DNA, 20 bp, Artificial
  CRISPR gRNA sequence
ttctttaagatatattaaga

SEQ ID NO: 451294 - DNA, 20 bp, Artificial
  CRISPR gRNA sequence
aagatggcgatctacattaa

SEQ ID NO: 451295 - DNA, 20 bp, Artificial
  CRISPR gRNA sequence
ctaaaattgatacatctttg

SEQ ID NO: 451296 - DNA, 20 bp, Artificial
  CRISPR gRNA sequence
ttgatacatctttgcagtcc

SEQ ID NO: 451297 - DNA, 20 bp, Artificial
  CRISPR gRNA sequence
agacaaacaaacaaaaactg

SEQ ID NO: 451298 - DNA, 20 bp, Artificial
  CRISPR gRNA sequence
aaacaaaaactgaagccatt

SEQ ID NO: 451299 - DNA, 20 bp, Artificial
  CRISPR gRNA sequence
aaactgaagccatttggtca

SEQ ID NO: 451300 - DNA, 20 bp, Artificial
  CRISPR gRNA sequence
gtatgttgttattttctttt

SEQ ID NO: 451301 - DNA, 20 bp, Artificial
  CRISPR gRNA sequence
gttgttattttcttttgaga

SEQ ID NO: 451302 - DNA, 20 bp, Artificial
  CRISPR gRNA sequence
tgttattttcttttgagaca

SEQ ID NO: 451303 - DNA, 20 bp, Artificial
  CRISPR gRNA sequence
cagagtctcactctgtcgcc

SEQ ID NO: 451304 - DNA, 20 bp, Artificial
  CRISPR gRNA sequence
agagtctcactctgtcgccc

SEQ ID NO: 451305 - DNA, 20 bp, Artificial
  CRISPR gRNA sequence
tctcactctgtcgcccaggc

SEQ ID NO: 451306 - DNA, 20 bp, Artificial
  CRISPR gRNA sequence
tcactctgtcgcccaggctg

SEQ ID NO: 451307 - DNA, 20 bp, Artificial
  CRISPR gRNA sequence
ctgtcgcccaggctggagtg

SEQ ID NO: 451308 - DNA, 20 bp, Artificial
  CRISPR gRNA sequence
tcgcccaggctggagtgcag

SEQ ID NO: 451309 - DNA, 20 bp, Artificial
  CRISPR gRNA sequence
ggagtgcagtggcacgatct

SEQ ID NO: 451310 - DNA, 20 bp, Artificial
  CRISPR gRNA sequence
ttactgcaacttccacctcc

SEQ ID NO: 451311 - DNA, 20 bp, Artificial
  CRISPR gRNA sequence
tactgcaacttccacctcct

SEQ ID NO: 451312 - DNA, 20 bp, Artificial
  CRISPR gRNA sequence
aacttccacctcctgggttc

SEQ ID NO: 451313 - DNA, 20 bp, Artificial
  CRISPR gRNA sequence
ttcaagcgattctcctgcct

SEQ ID NO: 451314 - DNA, 20 bp, Artificial
  CRISPR gRNA sequence
ttctcctgcctcagcctgcc

SEQ ID NO: 451315 - DNA, 20 bp, Artificial
  CRISPR gRNA sequence
gcctcagcctgccgagtatc

SEQ ID NO: 451316 - DNA, 20 bp, Artificial
  CRISPR gRNA sequence
cctcagcctgccgagtatct

SEQ ID NO: 451317 - DNA, 20 bp, Artificial
  CRISPR gRNA sequence
ctgccgagtatctgggatta

SEQ ID NO: 451318 - DNA, 20 bp, Artificial
  CRISPR gRNA sequence
tgccgagtatctgggattac

SEQ ID NO: 451319 - DNA, 20 bp, Artificial
  CRISPR gRNA sequence
tgggattacaggcgcctgcc

SEQ ID NO: 451320 - DNA, 20 bp, Artificial
  CRISPR gRNA sequence
acaggcgcctgccgagtatc

SEQ ID NO: 451321 - DNA, 20 bp, Artificial
  CRISPR gRNA sequence
caggcgcctgccgagtatct

SEQ ID NO: 451322 - DNA, 20 bp, Artificial
  CRISPR gRNA sequence
ctgccgagtatctgggatta

SEQ ID NO: 451323 - DNA, 20 bp, Artificial
  CRISPR gRNA sequence
tgccgagtatctgggattac

SEQ ID NO: 451324 - DNA, 20 bp, Artificial
  CRISPR gRNA sequence
caggcgcctgccactgcgct

SEQ ID NO: 451325 - DNA, 20 bp, Artificial
  CRISPR gRNA sequence
tcggctaatttttgtatttt

SEQ ID NO: 451326 - DNA, 20 bp, Artificial
  CRISPR gRNA sequence
gctaatttttgtatttttag

SEQ ID NO: 451327 - DNA, 20 bp, Artificial
  CRISPR gRNA sequence
taatttttgtatttttagta

SEQ ID NO: 451328 - DNA, 20 bp, Artificial
  CRISPR gRNA sequence
ttttgtatttttagtagaga

SEQ ID NO: 451329 - DNA, 20 bp, Artificial
  CRISPR gRNA sequence
tttgtatttttagtagagac

SEQ ID NO: 451330 - DNA, 20 bp, Artificial
  CRISPR gRNA sequence
ttgtatttttagtagagacg

SEQ ID NO: 451331 - DNA, 20 bp, Artificial
  CRISPR gRNA sequence
gagacggggtttcaccatct

SEQ ID NO: 451332 - DNA, 20 bp, Artificial
  CRISPR gRNA sequence
cggggtttcaccatcttggc

SEQ ID NO: 451333 - DNA, 20 bp, Artificial
  CRISPR gRNA sequence
ggggtttcaccatcttggcc

SEQ ID NO: 451334 - DNA, 20 bp, Artificial
  CRISPR gRNA sequence
gggtttcaccatcttggcca

SEQ ID NO: 451335 - DNA, 20 bp, Artificial
  CRISPR gRNA sequence
accttgtgatccacccacct

SEQ ID NO: 451336 - DNA, 20 bp, Artificial
  CRISPR gRNA sequence
ccacccaccttggcctccca

SEQ ID NO: 451337 - DNA, 20 bp, Artificial
  CRISPR gRNA sequence
accttggcctcccaaagtgc

SEQ ID NO: 451338 - DNA, 20 bp, Artificial
  CRISPR gRNA sequence
ccttggcctcccaaagtgct

SEQ ID NO: 451339 - DNA, 20 bp, Artificial
  CRISPR gRNA sequence
ctcccaaagtgctgggatta

SEQ ID NO: 451340 - DNA, 20 bp, Artificial
  CRISPR gRNA sequence
tcccaaagtgctgggattac

SEQ ID NO: 451341 - DNA, 20 bp, Artificial
  CRISPR gRNA sequence
caggcgtgaaccaccacgcc

SEQ ID NO: 451342 - DNA, 20 bp, Artificial
  CRISPR gRNA sequence
gtgaaccaccacgcccggcc

SEQ ID NO: 451343 - DNA, 20 bp, Artificial
  CRISPR gRNA sequence
tttaaatttttaaaaattga

SEQ ID NO: 451344 - DNA, 20 bp, Artificial
  CRISPR gRNA sequence
ttaaatttttaaaaattgaa

SEQ ID NO: 451345 - DNA, 20 bp, Artificial
  CRISPR gRNA sequence
tttttaaaaattgaaaggcc

SEQ ID NO: 451346 - DNA, 20 bp, Artificial
  CRISPR gRNA sequence
aaaattgaaaggcccagttg

SEQ ID NO: 451347 - DNA, 20 bp, Artificial
  CRISPR gRNA sequence
attgaaaggcccagttgcgg

SEQ ID NO: 451348 - DNA, 20 bp, Artificial
  CRISPR gRNA sequence
tggctcacgcctgtaatccc

SEQ ID NO: 451349 - DNA, 20 bp, Artificial
  CRISPR gRNA sequence
cgcctgtaatcccaagcctt

SEQ ID NO: 451350 - DNA, 20 bp, Artificial
  CRISPR gRNA sequence
gcctgtaatcccaagccttt

SEQ ID NO: 451351 - DNA, 20 bp, Artificial
  CRISPR gRNA sequence
ctgtaatcccaagcctttgg

SEQ ID NO: 451352 - DNA, 20 bp, Artificial
  CRISPR gRNA sequence
tgtaatcccaagcctttggg

SEQ ID NO: 451353 - DNA, 20 bp, Artificial
  CRISPR gRNA sequence
tcccaagcctttgggaggcc

SEQ ID NO: 451354 - DNA, 20 bp, Artificial
  CRISPR gRNA sequence
cccaagcctttgggaggccg

SEQ ID NO: 451355 - DNA, 20 bp, Artificial
  CRISPR gRNA sequence
aagcctttgggaggccgagg

SEQ ID NO: 451356 - DNA, 20 bp, Artificial
  CRISPR gRNA sequence
agcctttgggaggccgaggt

SEQ ID NO: 451357 - DNA, 20 bp, Artificial
  CRISPR gRNA sequence
cctttgggaggccgaggtgg

SEQ ID NO: 451358 - DNA, 20 bp, Artificial
  CRISPR gRNA sequence
ctttgggaggccgaggtggg

SEQ ID NO: 451359 - DNA, 20 bp, Artificial
  CRISPR gRNA sequence
ccgaggtgggaggatcactt

SEQ ID NO: 451360 - DNA, 20 bp, Artificial
  CRISPR gRNA sequence
gtgggaggatcacttgagcc

SEQ ID NO: 451361 - DNA, 20 bp, Artificial
  CRISPR gRNA sequence
tgggaggatcacttgagccc

SEQ ID NO: 451362 - DNA, 20 bp, Artificial
  CRISPR gRNA sequence
ggaggatcacttgagcccag

SEQ ID NO: 451363 - DNA, 20 bp, Artificial
  CRISPR gRNA sequence
tcacttgagcccaggagttt

SEQ ID NO: 451364 - DNA, 20 bp, Artificial
  CRISPR gRNA sequence
tgagcccaggagtttgagac

SEQ ID NO: 451365 - DNA, 20 bp, Artificial
  CRISPR gRNA sequence
ccaggagtttgagaccagcc

SEQ ID NO: 451366 - DNA, 20 bp, Artificial
  CRISPR gRNA sequence
caggagtttgagaccagcct

SEQ ID NO: 451367 - DNA, 20 bp, Artificial
  CRISPR gRNA sequence
gagtttgagaccagcctggg

SEQ ID NO: 451368 - DNA, 20 bp, Artificial
  CRISPR gRNA sequence
tgagaccagcctgggcagca

SEQ ID NO: 451369 - DNA, 20 bp, Artificial
  CRISPR gRNA sequence
accagcctgggcagcaaagt

SEQ ID NO: 451370 - DNA, 20 bp, Artificial
  CRISPR gRNA sequence
tttacaaaaaatacaaaaat

SEQ ID NO: 451371 - DNA, 20 bp, Artificial
  CRISPR gRNA sequence
atacaaaaattagccacgtg

SEQ ID NO: 451372 - DNA, 20 bp, Artificial
  CRISPR gRNA sequence
caaaaattagccacgtgtgg

SEQ ID NO: 451373 - DNA, 20 bp, Artificial
  CRISPR gRNA sequence
cgtgtggtggtgcgtacctg

SEQ ID NO: 451374 - DNA, 20 bp, Artificial
  CRISPR gRNA sequence
gtggtgcgtacctgaagtcc

SEQ ID NO: 451375 - DNA, 20 bp, Artificial
  CRISPR gRNA sequence
acctgaagtcccagctactc

SEQ ID NO: 451376 - DNA, 20 bp, Artificial
  CRISPR gRNA sequence
ctgaagtcccagctactcaa

SEQ ID NO: 451377 - DNA, 20 bp, Artificial
  CRISPR gRNA sequence
tcccagctactcaagagact

SEQ ID NO: 451378 - DNA, 20 bp, Artificial
  CRISPR gRNA sequence
cccagctactcaagagactt

SEQ ID NO: 451379 - DNA, 20 bp, Artificial
  CRISPR gRNA sequence
agctactcaagagacttagg

SEQ ID NO: 451380 - DNA, 20 bp, Artificial
  CRISPR gRNA sequence
gctactcaagagacttaggt

SEQ ID NO: 451381 - DNA, 20 bp, Artificial
  CRISPR gRNA sequence
tactcaagagacttaggtgg

SEQ ID NO: 451382 - DNA, 20 bp, Artificial
  CRISPR gRNA sequence
actcaagagacttaggtggg

SEQ ID NO: 451383 - DNA, 20 bp, Artificial
  CRISPR gRNA sequence
tcaagagacttaggtgggag

SEQ ID NO: 451384 - DNA, 20 bp, Artificial
  CRISPR gRNA sequence
agacttaggtgggaggagcc

SEQ ID NO: 451385 - DNA, 20 bp, Artificial
  CRISPR gRNA sequence
gacttaggtgggaggagccc

SEQ ID NO: 451386 - DNA, 20 bp, Artificial
  CRISPR gRNA sequence
cttaggtgggaggagcccgg

SEQ ID NO: 451387 - DNA, 20 bp, Artificial
  CRISPR gRNA sequence
gggaggagcccgggagttca

SEQ ID NO: 451388 - DNA, 20 bp, Artificial
  CRISPR gRNA sequence
agcccgggagttcacggatg

SEQ ID NO: 451389 - DNA, 20 bp, Artificial
  CRISPR gRNA sequence
cgggagttcacggatgtagt

SEQ ID NO: 451390 - DNA, 20 bp, Artificial
  CRISPR gRNA sequence
gggagttcacggatgtagtg

SEQ ID NO: 451391 - DNA, 20 bp, Artificial
  CRISPR gRNA sequence
gtatgatcttcactgcactc

SEQ ID NO: 451392 - DNA, 20 bp, Artificial
  CRISPR gRNA sequence
atcttcactgcactctggcc

SEQ ID NO: 451393 - DNA, 20 bp, Artificial
  CRISPR gRNA sequence
ctgcactctggcctggttga

SEQ ID NO: 451394 - DNA, 20 bp, Artificial
  CRISPR gRNA sequence
actctggcctggttgacagt

SEQ ID NO: 451395 - DNA, 20 bp, Artificial
  CRISPR gRNA sequence
tgacagtgagaccctgtctc

SEQ ID NO: 451396 - DNA, 20 bp, Artificial
  CRISPR gRNA sequence
cacaaattaaccaatcatac

SEQ ID NO: 451397 - DNA, 20 bp, Artificial
  CRISPR gRNA sequence
atataatacaccatgacaaa

SEQ ID NO: 451398 - DNA, 20 bp, Artificial
  CRISPR gRNA sequence
tacaccatgacaaatggaat

SEQ ID NO: 451399 - DNA, 20 bp, Artificial
  CRISPR gRNA sequence
acaccatgacaaatggaata

SEQ ID NO: 451400 - DNA, 20 bp, Artificial
  CRISPR gRNA sequence
atggaataaggtttcatttt

SEQ ID NO: 451401 - DNA, 20 bp, Artificial
  CRISPR gRNA sequence
gtttcatttttagaaattct

SEQ ID NO: 451402 - DNA, 20 bp, Artificial
  CRISPR gRNA sequence
attcttggatgatttaatat

SEQ ID NO: 451403 - DNA, 20 bp, Artificial
  CRISPR gRNA sequence
ttcttggatgatttaatatt

SEQ ID NO: 451404 - DNA, 20 bp, Artificial
  CRISPR gRNA sequence
tctattaattaacatactac

SEQ ID NO: 451405 - DNA, 20 bp, Artificial
  CRISPR gRNA sequence
taacatactactggataaaa

SEQ ID NO: 451406 - DNA, 20 bp, Artificial
  CRISPR gRNA sequence
atactactggataaaaaaga

SEQ ID NO: 451407 - DNA, 20 bp, Artificial
  CRISPR gRNA sequence
ttaattcccactaaaatcct

SEQ ID NO: 451408 - DNA, 20 bp, Artificial
  CRISPR gRNA sequence
cactaaaatcctaagtaaaa

SEQ ID NO: 451409 - DNA, 20 bp, Artificial
  CRISPR gRNA sequence
aatcctaagtaaaatggtaa

SEQ ID NO: 451410 - DNA, 20 bp, Artificial
  CRISPR gRNA sequence
atgaatactattcaatataa

SEQ ID NO: 451411 - DNA, 20 bp, Artificial
  CRISPR gRNA sequence
gaatactattcaatataatg

SEQ ID NO: 451412 - DNA, 20 bp, Artificial
  CRISPR gRNA sequence
taatggagaaatgtatatct

SEQ ID NO: 451413 - DNA, 20 bp, Artificial
  CRISPR gRNA sequence
gtatatctcagataaaattg

SEQ ID NO: 451414 - DNA, 20 bp, Artificial
  CRISPR gRNA sequence
aattgcagcatcatatttaa

SEQ ID NO: 451415 - DNA, 20 bp, Artificial
  CRISPR gRNA sequence
tcatatttaatggtaaaata

SEQ ID NO: 451416 - DNA, 20 bp, Artificial
  CRISPR gRNA sequence
catatttaatggtaaaatat

SEQ ID NO: 451417 - DNA, 20 bp, Artificial
  CRISPR gRNA sequence
gggataatttctattaatat

SEQ ID NO: 451418 - DNA, 20 bp, Artificial
  CRISPR gRNA sequence
ggataatttctattaatatt

SEQ ID NO: 451419 - DNA, 20 bp, Artificial
  CRISPR gRNA sequence
ataatttctattaatattag

SEQ ID NO: 451420 - DNA, 20 bp, Artificial
  CRISPR gRNA sequence
tttctattaatattaggagc

SEQ ID NO: 451421 - DNA, 20 bp, Artificial
  CRISPR gRNA sequence
ttctattaatattaggagca

SEQ ID NO: 451422 - DNA, 20 bp, Artificial
  CRISPR gRNA sequence
tattaatattaggagcaagg

SEQ ID NO: 451423 - DNA, 20 bp, Artificial
  CRISPR gRNA sequence
ttaatattaggagcaaggca

SEQ ID NO: 451424 - DNA, 20 bp, Artificial
  CRISPR gRNA sequence
gttatttcacattgttctga

SEQ ID NO: 451425 - DNA, 20 bp, Artificial
  CRISPR gRNA sequence
aaagtgtttgccattatatt

SEQ ID NO: 451426 - DNA, 20 bp, Artificial
  CRISPR gRNA sequence
gtttgccattatatttagac

SEQ ID NO: 451427 - DNA, 20 bp, Artificial
  CRISPR gRNA sequence
tatatttagacaagaaaata

SEQ ID NO: 451428 - DNA, 20 bp, Artificial
  CRISPR gRNA sequence
ttagacaagaaaataaagca

SEQ ID NO: 451429 - DNA, 20 bp, Artificial
  CRISPR gRNA sequence
tagacaagaaaataaagcaa

SEQ ID NO: 451430 - DNA, 20 bp, Artificial
  CRISPR gRNA sequence
agacaagaaaataaagcaaa

SEQ ID NO: 451431 - DNA, 20 bp, Artificial
  CRISPR gRNA sequence
aaagcaaagggtataaatat

SEQ ID NO: 451432 - DNA, 20 bp, Artificial
  CRISPR gRNA sequence
gtataaatattggaaatctt

SEQ ID NO: 451433 - DNA, 20 bp, Artificial
  CRISPR gRNA sequence
tataaatattggaaatctta

SEQ ID NO: 451434 - DNA, 20 bp, Artificial
  CRISPR gRNA sequence
tatgtgatataacttacatc

SEQ ID NO: 451435 - DNA, 20 bp, Artificial
  CRISPR gRNA sequence
aacttacatctagaaaaccc

SEQ ID NO: 451436 - DNA, 20 bp, Artificial
  CRISPR gRNA sequence
aaaacccaagaaacttaatt

SEQ ID NO: 451437 - DNA, 20 bp, Artificial
  CRISPR gRNA sequence
gaaacttaattgagaattat

SEQ ID NO: 451438 - DNA, 20 bp, Artificial
  CRISPR gRNA sequence
agaattattagaaacaataa

SEQ ID NO: 451439 - DNA, 20 bp, Artificial
  CRISPR gRNA sequence
aattattagaaacaataaaa

SEQ ID NO: 451440 - DNA, 20 bp, Artificial
  CRISPR gRNA sequence
acaataaaagagtatctgaa

SEQ ID NO: 451441 - DNA, 20 bp, Artificial
  CRISPR gRNA sequence
caataaaagagtatctgaat

SEQ ID NO: 451442 - DNA, 20 bp, Artificial
  CRISPR gRNA sequence
taaaagagtatctgaatagg

SEQ ID NO: 451443 - DNA, 20 bp, Artificial
  CRISPR gRNA sequence
tctgaataggcagttcacaa

SEQ ID NO: 451444 - DNA, 20 bp, Artificial
  CRISPR gRNA sequence
aaaagacgaaatgcaataaa

SEQ ID NO: 451445 - DNA, 20 bp, Artificial
  CRISPR gRNA sequence
aaatgcaataaaaagttttt

SEQ ID NO: 451446 - DNA, 20 bp, Artificial
  CRISPR gRNA sequence
aaaaagtttttcagttttac

SEQ ID NO: 451447 - DNA, 20 bp, Artificial
  CRISPR gRNA sequence
ttttcagttttacaagtatt

SEQ ID NO: 451448 - DNA, 20 bp, Artificial
  CRISPR gRNA sequence
tttcagttttacaagtattc

SEQ ID NO: 451449 - DNA, 20 bp, Artificial
  CRISPR gRNA sequence
ttcagttttacaagtattca

SEQ ID NO: 451450 - DNA, 20 bp, Artificial
  CRISPR gRNA sequence
agttttacaagtattcaggg

SEQ ID NO: 451451 - DNA, 20 bp, Artificial
  CRISPR gRNA sequence
ggaagtacaaattaaaaatt

SEQ ID NO: 451452 - DNA, 20 bp, Artificial
  CRISPR gRNA sequence
aagtacaaattaaaaattca

SEQ ID NO: 451453 - DNA, 20 bp, Artificial
  CRISPR gRNA sequence
caaattaaaaattcagagtt

SEQ ID NO: 451454 - DNA, 20 bp, Artificial
  CRISPR gRNA sequence
aaattcagagttcagaattt

SEQ ID NO: 451455 - DNA, 20 bp, Artificial
  CRISPR gRNA sequence
tttcagaattaccacctgtt

SEQ ID NO: 451456 - DNA, 20 bp, Artificial
  CRISPR gRNA sequence
ttaagtgaacaaaaatttaa

SEQ ID NO: 451457 - DNA, 20 bp, Artificial
  CRISPR gRNA sequence
ttaaaagataaatcaaattt

SEQ ID NO: 451458 - DNA, 20 bp, Artificial
  CRISPR gRNA sequence
aagataaatcaaattttggt

SEQ ID NO: 451459 - DNA, 20 bp, Artificial
  CRISPR gRNA sequence
agataaatcaaattttggta

SEQ ID NO: 451460 - DNA, 20 bp, Artificial
  CRISPR gRNA sequence
gataaatcaaattttggtaa

SEQ ID NO: 451461 - DNA, 20 bp, Artificial
  CRISPR gRNA sequence
aatcaaattttggtaagggt

SEQ ID NO: 451462 - DNA, 20 bp, Artificial
  CRISPR gRNA sequence
caaattttggtaagggtaag

SEQ ID NO: 451463 - DNA, 20 bp, Artificial
  CRISPR gRNA sequence
atatgtgcaatcattcactc

SEQ ID NO: 451464 - DNA, 20 bp, Artificial
  CRISPR gRNA sequence
tatgtgcaatcattcactct

SEQ ID NO: 451465 - DNA, 20 bp, Artificial
  CRISPR gRNA sequence
gtgcaatcattcactctagg

SEQ ID NO: 451466 - DNA, 20 bp, Artificial
  CRISPR gRNA sequence
ggtagaactatacattgtta

SEQ ID NO: 451467 - DNA, 20 bp, Artificial
  CRISPR gRNA sequence
tagaactatacattgttacg

SEQ ID NO: 451468 - DNA, 20 bp, Artificial
  CRISPR gRNA sequence
tatacattgttacggagctt

SEQ ID NO: 451469 - DNA, 20 bp, Artificial
  CRISPR gRNA sequence
atacattgttacggagcttt

SEQ ID NO: 451470 - DNA, 20 bp, Artificial
  CRISPR gRNA sequence
tacattgttacggagctttg

SEQ ID NO: 451471 - DNA, 20 bp, Artificial
  CRISPR gRNA sequence
acattgttacggagctttgg

SEQ ID NO: 451472 - DNA, 20 bp, Artificial
  CRISPR gRNA sequence
atgcacataccctgtccctt

SEQ ID NO: 451473 - DNA, 20 bp, Artificial
  CRISPR gRNA sequence
ataccctgtccctttggcta

SEQ ID NO: 451474 - DNA, 20 bp, Artificial
  CRISPR gRNA sequence
gtccctttggctatagctta

SEQ ID NO: 451475 - DNA, 20 bp, Artificial
  CRISPR gRNA sequence
gctatagcttacagaaataa

SEQ ID NO: 451476 - DNA, 20 bp, Artificial
  CRISPR gRNA sequence
gcttacagaaataaaagcat

SEQ ID NO: 451477 - DNA, 20 bp, Artificial
  CRISPR gRNA sequence
aaataaaagcatgagtgtgc

SEQ ID NO: 451478 - DNA, 20 bp, Artificial
  CRISPR gRNA sequence
aaagcatgagtgtgctagta

SEQ ID NO: 451479 - DNA, 20 bp, Artificial
  CRISPR gRNA sequence
gtgtgctagtatagatgtac

SEQ ID NO: 451480 - DNA, 20 bp, Artificial
  CRISPR gRNA sequence
tgtgctagtatagatgtaca

SEQ ID NO: 451481 - DNA, 20 bp, Artificial
  CRISPR gRNA sequence
atgtacaaggatattcactg

SEQ ID NO: 451482 - DNA, 20 bp, Artificial
  CRISPR gRNA sequence
tttttataataccaaaaaaa

SEQ ID NO: 451483 - DNA, 20 bp, Artificial
  CRISPR gRNA sequence
taataccaaaaaaatagaaa

SEQ ID NO: 451484 - DNA, 20 bp, Artificial
  CRISPR gRNA sequence
aataccaaaaaaatagaaac

SEQ ID NO: 451485 - DNA, 20 bp, Artificial
  CRISPR gRNA sequence
caaaaaaatagaaacaggtg

SEQ ID NO: 451486 - DNA, 20 bp, Artificial
  CRISPR gRNA sequence
aaaaaaatagaaacaggtga

SEQ ID NO: 451487 - DNA, 20 bp, Artificial
  CRISPR gRNA sequence
aaatagaaacaggtgaaggc

SEQ ID NO: 451488 - DNA, 20 bp, Artificial
  CRISPR gRNA sequence
aatagaaacaggtgaaggcc

SEQ ID NO: 451489 - DNA, 20 bp, Artificial
  CRISPR gRNA sequence
aaacaggtgaaggccaggtg

SEQ ID NO: 451490 - DNA, 20 bp, Artificial
  CRISPR gRNA sequence
caggtgaaggccaggtgtgg

SEQ ID NO: 451491 - DNA, 20 bp, Artificial
  CRISPR gRNA sequence
gtggctcacacctgtaatcc

SEQ ID NO: 451492 - DNA, 20 bp, Artificial
  CRISPR gRNA sequence
cacctgtaatcccagcactt

SEQ ID NO: 451493 - DNA, 20 bp, Artificial
  CRISPR gRNA sequence
acctgtaatcccagcacttt

SEQ ID NO: 451494 - DNA, 20 bp, Artificial
  CRISPR gRNA sequence
ctgtaatcccagcactttgg

SEQ ID NO: 451495 - DNA, 20 bp, Artificial
  CRISPR gRNA sequence
tgtaatcccagcactttggg

SEQ ID NO: 451496 - DNA, 20 bp, Artificial
  CRISPR gRNA sequence
ccagcactttgggaggcgtg

SEQ ID NO: 451497 - DNA, 20 bp, Artificial
  CRISPR gRNA sequence
gggaggcgtgcggatcacct

SEQ ID NO: 451498 - DNA, 20 bp, Artificial
  CRISPR gRNA sequence
ggaggcgtgcggatcacctg

SEQ ID NO: 451499 - DNA, 20 bp, Artificial
  CRISPR gRNA sequence
gcgtgcggatcacctgaggt

SEQ ID NO: 451500 - DNA, 20 bp, Artificial
  CRISPR gRNA sequence
cgtgcggatcacctgaggtc

SEQ ID NO: 451501 - DNA, 20 bp, Artificial
  CRISPR gRNA sequence
tgcggatcacctgaggtcag

SEQ ID NO: 451502 - DNA, 20 bp, Artificial
  CRISPR gRNA sequence
tcacctgaggtcaggagttc

SEQ ID NO: 451503 - DNA, 20 bp, Artificial
  CRISPR gRNA sequence
tgaggtcaggagttcgagac

SEQ ID NO: 451504 - DNA, 20 bp, Artificial
  CRISPR gRNA sequence
tcaggagttcgagaccagcc

SEQ ID NO: 451505 - DNA, 20 bp, Artificial
  CRISPR gRNA sequence
cgagaccagcctggcccaca

SEQ ID NO: 451506 - DNA, 20 bp, Artificial
  CRISPR gRNA sequence
tggcccacatggtgaaaccc

SEQ ID NO: 451507 - DNA, 20 bp, Artificial
  CRISPR gRNA sequence
tctactaaaaatgcaaaaat

SEQ ID NO: 451508 - DNA, 20 bp, Artificial
  CRISPR gRNA sequence
ctaaaaatgcaaaaattagc

SEQ ID NO: 451509 - DNA, 20 bp, Artificial
  CRISPR gRNA sequence
taaaaatgcaaaaattagct

SEQ ID NO: 451510 - DNA, 20 bp, Artificial
  CRISPR gRNA sequence
caaaaattagctgggtgttg

SEQ ID NO: 451511 - DNA, 20 bp, Artificial
  CRISPR gRNA sequence
aaattagctgggtgttgtag

SEQ ID NO: 451512 - DNA, 20 bp, Artificial
  CRISPR gRNA sequence
aattagctgggtgttgtagc

SEQ ID NO: 451513 - DNA, 20 bp, Artificial
  CRISPR gRNA sequence
tgcctgtgatcccacctact

SEQ ID NO: 451514 - DNA, 20 bp, Artificial
  CRISPR gRNA sequence
gcctgtgatcccacctactc

SEQ ID NO: 451515 - DNA, 20 bp, Artificial
  CRISPR gRNA sequence
ctgtgatcccacctactcag

SEQ ID NO: 451516 - DNA, 20 bp, Artificial
  CRISPR gRNA sequence
tgtgatcccacctactcagg

SEQ ID NO: 451517 - DNA, 20 bp, Artificial
  CRISPR gRNA sequence
tcccacctactcaggaggct

SEQ ID NO: 451518 - DNA, 20 bp, Artificial
  CRISPR gRNA sequence
cccacctactcaggaggctg

SEQ ID NO: 451519 - DNA, 20 bp, Artificial
  CRISPR gRNA sequence
acctactcaggaggctgagg

SEQ ID NO: 451520 - DNA, 20 bp, Artificial
  CRISPR gRNA sequence
cctactcaggaggctgaggc

SEQ ID NO: 451521 - DNA, 20 bp, Artificial
  CRISPR gRNA sequence
gcaggataattgcttgaacc

SEQ ID NO: 451522 - DNA, 20 bp, Artificial
  CRISPR gRNA sequence
caggataattgcttgaacct

SEQ ID NO: 451523 - DNA, 20 bp, Artificial
  CRISPR gRNA sequence
ggataattgcttgaacctgg

SEQ ID NO: 451524 - DNA, 20 bp, Artificial
  CRISPR gRNA sequence
gataattgcttgaacctggg

SEQ ID NO: 451525 - DNA, 20 bp, Artificial
  CRISPR gRNA sequence
aattgcttgaacctgggagg

SEQ ID NO: 451526 - DNA, 20 bp, Artificial
  CRISPR gRNA sequence
ttgcttgaacctgggaggca

SEQ ID NO: 451527 - DNA, 20 bp, Artificial
  CRISPR gRNA sequence
aacctgggaggcagagattg

SEQ ID NO: 451528 - DNA, 20 bp, Artificial
  CRISPR gRNA sequence
tgggaggcagagattgcagt

SEQ ID NO: 451529 - DNA, 20 bp, Artificial
  CRISPR gRNA sequence
ggcagagattgcagtgagcc

SEQ ID NO: 451530 - DNA, 20 bp, Artificial
  CRISPR gRNA sequence
aagatcacgccactgcactc

SEQ ID NO: 451531 - DNA, 20 bp, Artificial
  CRISPR gRNA sequence
cacgccactgcactccagcc

SEQ ID NO: 451532 - DNA, 20 bp, Artificial
  CRISPR gRNA sequence
acgccactgcactccagcct

SEQ ID NO: 451533 - DNA, 20 bp, Artificial
  CRISPR gRNA sequence
ctgcactccagcctgggcaa

SEQ ID NO: 451534 - DNA, 20 bp, Artificial
  CRISPR gRNA sequence
gcactccagcctgggcaaca

SEQ ID NO: 451535 - DNA, 20 bp, Artificial
  CRISPR gRNA sequence
ccttcctgcccccataaaaa

SEQ ID NO: 451536 - DNA, 20 bp, Artificial
  CRISPR gRNA sequence
cttcctgcccccataaaaaa

SEQ ID NO: 451537 - DNA, 20 bp, Artificial
  CRISPR gRNA sequence
gcccccataaaaaaaggaaa

SEQ ID NO: 451538 - DNA, 20 bp, Artificial
  CRISPR gRNA sequence
cccccataaaaaaaggaaac

SEQ ID NO: 451539 - DNA, 20 bp, Artificial
  CRISPR gRNA sequence
ataaaaaaaggaaacaggtg

SEQ ID NO: 451540 - DNA, 20 bp, Artificial
  CRISPR gRNA sequence
ggaaacaggtgaagacccac

SEQ ID NO: 451541 - DNA, 20 bp, Artificial
  CRISPR gRNA sequence
acaggtgaagacccactggt

SEQ ID NO: 451542 - DNA, 20 bp, Artificial
  CRISPR gRNA sequence
tgaagacccactggtgagaa

SEQ ID NO: 451543 - DNA, 20 bp, Artificial
  CRISPR gRNA sequence
aatggttgaataaattattg

SEQ ID NO: 451544 - DNA, 20 bp, Artificial
  CRISPR gRNA sequence
aataaattattgcagatcca

SEQ ID NO: 451545 - DNA, 20 bp, Artificial
  CRISPR gRNA sequence
attattgcagatccacagaa

SEQ ID NO: 451546 - DNA, 20 bp, Artificial
  CRISPR gRNA sequence
aatagaatgttatgtaatta

SEQ ID NO: 451547 - DNA, 20 bp, Artificial
  CRISPR gRNA sequence
tataaaacaataaactaaat

SEQ ID NO: 451548 - DNA, 20 bp, Artificial
  CRISPR gRNA sequence
gtatatacatacaatttaat

SEQ ID NO: 451549 - DNA, 20 bp, Artificial
  CRISPR gRNA sequence
tatatacatacaatttaata

SEQ ID NO: 451550 - DNA, 20 bp, Artificial
  CRISPR gRNA sequence
taaggtacttattaatacat

SEQ ID NO: 451551 - DNA, 20 bp, Artificial
  CRISPR gRNA sequence
cataagattaaaaattttcc

SEQ ID NO: 451552 - DNA, 20 bp, Artificial
  CRISPR gRNA sequence
attttcctggatataattat

SEQ ID NO: 451553 - DNA, 20 bp, Artificial
  CRISPR gRNA sequence
tcctggatataattattagt

SEQ ID NO: 451554 - DNA, 20 bp, Artificial
  CRISPR gRNA sequence
taattattagtcagaaaata

SEQ ID NO: 451555 - DNA, 20 bp, Artificial
  CRISPR gRNA sequence
ttattagtcagaaaatatgg

SEQ ID NO: 451556 - DNA, 20 bp, Artificial
  CRISPR gRNA sequence
ttagtcagaaaatatggtag

SEQ ID NO: 451557 - DNA, 20 bp, Artificial
  CRISPR gRNA sequence
tagtcagaaaatatggtaga

SEQ ID NO: 451558 - DNA, 20 bp, Artificial
  CRISPR gRNA sequence
agaaaatatggtagaaggaa

SEQ ID NO: 451559 - DNA, 20 bp, Artificial
  CRISPR gRNA sequence
aggaaaagttccattcatta

SEQ ID NO: 451560 - DNA, 20 bp, Artificial
  CRISPR gRNA sequence
caaaaaacccatcaaatgtc

SEQ ID NO: 451561 - DNA, 20 bp, Artificial
  CRISPR gRNA sequence
aaatgtaacaacattccgaa

SEQ ID NO: 451562 - DNA, 20 bp, Artificial
  CRISPR gRNA sequence
aatgtaacaacattccgaat

SEQ ID NO: 451563 - DNA, 20 bp, Artificial
  CRISPR gRNA sequence
aacattccgaataggaccta

SEQ ID NO: 451564 - DNA, 20 bp, Artificial
  CRISPR gRNA sequence
acattccgaataggacctat

SEQ ID NO: 451565 - DNA, 20 bp, Artificial
  CRISPR gRNA sequence
cctataggatacaaactata

SEQ ID NO: 451566 - DNA, 20 bp, Artificial
  CRISPR gRNA sequence
acaaactatacagtactatt

SEQ ID NO: 451567 - DNA, 20 bp, Artificial
  CRISPR gRNA sequence
caaactatacagtactatta

SEQ ID NO: 451568 - DNA, 20 bp, Artificial
  CRISPR gRNA sequence
agtactattaaggaacataa

SEQ ID NO: 451569 - DNA, 20 bp, Artificial
  CRISPR gRNA sequence
aggaacataaaagaaaatct

SEQ ID NO: 451570 - DNA, 20 bp, Artificial
  CRISPR gRNA sequence
aacataaaagaaaatctaag

SEQ ID NO: 451571 - DNA, 20 bp, Artificial
  CRISPR gRNA sequence
cataaaagaaaatctaagta

SEQ ID NO: 451572 - DNA, 20 bp, Artificial
  CRISPR gRNA sequence
acaatcctaataaaacatcc

SEQ ID NO: 451573 - DNA, 20 bp, Artificial
  CRISPR gRNA sequence
atcctaataaaacatcccag

SEQ ID NO: 451574 - DNA, 20 bp, Artificial
  CRISPR gRNA sequence
ctaataaaacatcccagcag

SEQ ID NO: 451575 - DNA, 20 bp, Artificial
  CRISPR gRNA sequence
aacatcccagcagcagctca

SEQ ID NO: 451576 - DNA, 20 bp, Artificial
  CRISPR gRNA sequence
cccagcagcagctcatggta

SEQ ID NO: 451577 - DNA, 20 bp, Artificial
  CRISPR gRNA sequence
atggccccaatgtcctttcc

SEQ ID NO: 451578 - DNA, 20 bp, Artificial
  CRISPR gRNA sequence
atcataccttcatgctacac

SEQ ID NO: 451579 - DNA, 20 bp, Artificial
  CRISPR gRNA sequence
catgctacaccagaatgtcc

SEQ ID NO: 451580 - DNA, 20 bp, Artificial
  CRISPR gRNA sequence
tcctggtgactcttgaaaca

SEQ ID NO: 451581 - DNA, 20 bp, Artificial
  CRISPR gRNA sequence
ctcttgaaacatggaatatt

SEQ ID NO: 451582 - DNA, 20 bp, Artificial
  CRISPR gRNA sequence
acatggaatattaagtgaca

SEQ ID NO: 451583 - DNA, 20 bp, Artificial
  CRISPR gRNA sequence
atggaatattaagtgacaaa

SEQ ID NO: 451584 - DNA, 20 bp, Artificial
  CRISPR gRNA sequence
tggaatattaagtgacaaag

SEQ ID NO: 451585 - DNA, 20 bp, Artificial
  CRISPR gRNA sequence
atgacaaatcattttattca

SEQ ID NO: 451586 - DNA, 20 bp, Artificial
  CRISPR gRNA sequence
gacaaatcattttattcaaa

SEQ ID NO: 451587 - DNA, 20 bp, Artificial
  CRISPR gRNA sequence
acaaatcattttattcaaag

SEQ ID NO: 451588 - DNA, 20 bp, Artificial
  CRISPR gRNA sequence
aatcattttattcaaagagg

SEQ ID NO: 451589 - DNA, 20 bp, Artificial
  CRISPR gRNA sequence
tttattcaaagaggaagaca

SEQ ID NO: 451590 - DNA, 20 bp, Artificial
  CRISPR gRNA sequence
attcaaagaggaagacaaag

SEQ ID NO: 451591 - DNA, 20 bp, Artificial
  CRISPR gRNA sequence
ttcaaagaggaagacaaaga

SEQ ID NO: 451592 - DNA, 20 bp, Artificial
  CRISPR gRNA sequence
aaggattgcaattattcatt

SEQ ID NO: 451593 - DNA, 20 bp, Artificial
  CRISPR gRNA sequence
ttgcaattattcattcagcc

SEQ ID NO: 451594 - DNA, 20 bp, Artificial
  CRISPR gRNA sequence
attcattcagcccagaatta

SEQ ID NO: 451595 - DNA, 20 bp, Artificial
  CRISPR gRNA sequence
agcccagaattatggttaaa

SEQ ID NO: 451596 - DNA, 20 bp, Artificial
  CRISPR gRNA sequence
agaattatggttaaaaagcg

SEQ ID NO: 451597 - DNA, 20 bp, Artificial
  CRISPR gRNA sequence
tggttaaaaagcgtagactc

SEQ ID NO: 451598 - DNA, 20 bp, Artificial
  CRISPR gRNA sequence
gttaaaaagcgtagactcta

SEQ ID NO: 451599 - DNA, 20 bp, Artificial
  CRISPR gRNA sequence
aaaagcgtagactctagagc

SEQ ID NO: 451600 - DNA, 20 bp, Artificial
  CRISPR gRNA sequence
aagcgtagactctagagcca

SEQ ID NO: 451601 - DNA, 20 bp, Artificial
  CRISPR gRNA sequence
gagtgtttgtgttcaaatcc

SEQ ID NO: 451602 - DNA, 20 bp, Artificial
  CRISPR gRNA sequence
atcctggtcctaaaacttaa

SEQ ID NO: 451603 - DNA, 20 bp, Artificial
  CRISPR gRNA sequence
ctggtcctaaaacttaatag

SEQ ID NO: 451604 - DNA, 20 bp, Artificial
  CRISPR gRNA sequence
ctaaaacttaatagtggcgc

SEQ ID NO: 451605 - DNA, 20 bp, Artificial
  CRISPR gRNA sequence
taaaacttaatagtggcgcc

SEQ ID NO: 451606 - DNA, 20 bp, Artificial
  CRISPR gRNA sequence
cttaatagtggcgccgggcg

SEQ ID NO: 451607 - DNA, 20 bp, Artificial
  CRISPR gRNA sequence
gtgtctcacgcctgtaatcc

SEQ ID NO: 451608 - DNA, 20 bp, Artificial
  CRISPR gRNA sequence
cgcctgtaatcccagcactt

SEQ ID NO: 451609 - DNA, 20 bp, Artificial
  CRISPR gRNA sequence
gcctgtaatcccagcacttt

SEQ ID NO: 451610 - DNA, 20 bp, Artificial
  CRISPR gRNA sequence
ctgtaatcccagcactttgg

SEQ ID NO: 451611 - DNA, 20 bp, Artificial
  CRISPR gRNA sequence
tgtaatcccagcactttggg

SEQ ID NO: 451612 - DNA, 20 bp, Artificial
  CRISPR gRNA sequence
tcccagcactttgggaggcc

SEQ ID NO: 451613 - DNA, 20 bp, Artificial
  CRISPR gRNA sequence
cccagcactttgggaggccg

SEQ ID NO: 451614 - DNA, 20 bp, Artificial
  CRISPR gRNA sequence
agcactttgggaggccgagg

SEQ ID NO: 451615 - DNA, 20 bp, Artificial
  CRISPR gRNA sequence
gcactttgggaggccgaggt

SEQ ID NO: 451616 - DNA, 20 bp, Artificial
  CRISPR gRNA sequence
ctttgggaggccgaggtggg

SEQ ID NO: 451617 - DNA, 20 bp, Artificial
  CRISPR gRNA sequence
ggccgaggtgggcagatcac

SEQ ID NO: 451618 - DNA, 20 bp, Artificial
  CRISPR gRNA sequence
gccgaggtgggcagatcacg

SEQ ID NO: 451619 - DNA, 20 bp, Artificial
  CRISPR gRNA sequence
aggtgggcagatcacgaggt

SEQ ID NO: 451620 - DNA, 20 bp, Artificial
  CRISPR gRNA sequence
ggtgggcagatcacgaggtc

SEQ ID NO: 451621 - DNA, 20 bp, Artificial
  CRISPR gRNA sequence
tgggcagatcacgaggtcag

SEQ ID NO: 451622 - DNA, 20 bp, Artificial
  CRISPR gRNA sequence
gatcacgaggtcaggagatc

SEQ ID NO: 451623 - DNA, 20 bp, Artificial
  CRISPR gRNA sequence
tcaggagatcgagaccatcc

SEQ ID NO: 451624 - DNA, 20 bp, Artificial
  CRISPR gRNA sequence
cgagaccatcctggctaaca

SEQ ID NO: 451625 - DNA, 20 bp, Artificial
  CRISPR gRNA sequence
ctaaaaaaaatacaaaaaat

SEQ ID NO: 451626 - DNA, 20 bp, Artificial
  CRISPR gRNA sequence
aaaaaatacaaaaaattagc

SEQ ID NO: 451627 - DNA, 20 bp, Artificial
  CRISPR gRNA sequence
aaaaatacaaaaaattagcc

SEQ ID NO: 451628 - DNA, 20 bp, Artificial
  CRISPR gRNA sequence
tacaaaaaattagccgggcg

SEQ ID NO: 451629 - DNA, 20 bp, Artificial
  CRISPR gRNA sequence
aaaaaattagccgggcgtgg

SEQ ID NO: 451630 - DNA, 20 bp, Artificial
  CRISPR gRNA sequence
aaattagccgggcgtggtgg

SEQ ID NO: 451631 - DNA, 20 bp, Artificial
  CRISPR gRNA sequence
aattagccgggcgtggtggc

SEQ ID NO: 451632 - DNA, 20 bp, Artificial
  CRISPR gRNA sequence
ggcgtggtggcgggcgcctg

SEQ ID NO: 451633 - DNA, 20 bp, Artificial
  CRISPR gRNA sequence
gtggcgggcgcctgtagtcc

SEQ ID NO: 451634 - DNA, 20 bp, Artificial
  CRISPR gRNA sequence
cgcctgtagtcccagctact

SEQ ID NO: 451635 - DNA, 20 bp, Artificial
  CRISPR gRNA sequence
gcctgtagtcccagctactc

SEQ ID NO: 451636 - DNA, 20 bp, Artificial
  CRISPR gRNA sequence
ctgtagtcccagctactcgg

SEQ ID NO: 451637 - DNA, 20 bp, Artificial
  CRISPR gRNA sequence
tgtagtcccagctactcggg

SEQ ID NO: 451638 - DNA, 20 bp, Artificial
  CRISPR gRNA sequence
tcccagctactcgggaggct

SEQ ID NO: 451639 - DNA, 20 bp, Artificial
  CRISPR gRNA sequence
cccagctactcgggaggctg

SEQ ID NO: 451640 - DNA, 20 bp, Artificial
  CRISPR gRNA sequence
agctactcgggaggctgagg

SEQ ID NO: 451641 - DNA, 20 bp, Artificial
  CRISPR gRNA sequence
gctactcgggaggctgaggc

SEQ ID NO: 451642 - DNA, 20 bp, Artificial
  CRISPR gRNA sequence
tactcgggaggctgaggcag

SEQ ID NO: 451643 - DNA, 20 bp, Artificial
  CRISPR gRNA sequence
gggaggctgaggcaggagaa

SEQ ID NO: 451644 - DNA, 20 bp, Artificial
  CRISPR gRNA sequence
ctgaggcaggagaatggcgt

SEQ ID NO: 451645 - DNA, 20 bp, Artificial
  CRISPR gRNA sequence
caggagaatggcgtgagccc

SEQ ID NO: 451646 - DNA, 20 bp, Artificial
  CRISPR gRNA sequence
ggagaatggcgtgagcccga

SEQ ID NO: 451647 - DNA, 20 bp, Artificial
  CRISPR gRNA sequence
gagaatggcgtgagcccgag

SEQ ID NO: 451648 - DNA, 20 bp, Artificial
  CRISPR gRNA sequence
aatggcgtgagcccgagagg

SEQ ID NO: 451649 - DNA, 20 bp, Artificial
  CRISPR gRNA sequence
tggcgtgagcccgagaggcg

SEQ ID NO: 451650 - DNA, 20 bp, Artificial
  CRISPR gRNA sequence
agcccgagaggcggagcttg

SEQ ID NO: 451651 - DNA, 20 bp, Artificial
  CRISPR gRNA sequence
cgagaggcggagcttgcagt

SEQ ID NO: 451652 - DNA, 20 bp, Artificial
  CRISPR gRNA sequence
ggcggagcttgcagtgagct

SEQ ID NO: 451653 - DNA, 20 bp, Artificial
  CRISPR gRNA sequence
gagatcgcgctactgcactc

SEQ ID NO: 451654 - DNA, 20 bp, Artificial
  CRISPR gRNA sequence
cgcgctactgcactccagcc

SEQ ID NO: 451655 - DNA, 20 bp, Artificial
  CRISPR gRNA sequence
gcgctactgcactccagcct

SEQ ID NO: 451656 - DNA, 20 bp, Artificial
  CRISPR gRNA sequence
ctgcactccagcctgggcga

SEQ ID NO: 451657 - DNA, 20 bp, Artificial
  CRISPR gRNA sequence
gcactccagcctgggcgaca

SEQ ID NO: 451658 - DNA, 20 bp, Artificial
  CRISPR gRNA sequence
tccagcctgggcgacagagc

SEQ ID NO: 451659 - DNA, 20 bp, Artificial
  CRISPR gRNA sequence
taaaaacaaaaaaaacttaa

SEQ ID NO: 451660 - DNA, 20 bp, Artificial
  CRISPR gRNA sequence
aacttaatagttgcatgact

SEQ ID NO: 451661 - DNA, 20 bp, Artificial
  CRISPR gRNA sequence
aatagttgcatgactcggtc

SEQ ID NO: 451662 - DNA, 20 bp, Artificial
  CRISPR gRNA sequence
catgactcggtcaagtttct

SEQ ID NO: 451663 - DNA, 20 bp, Artificial
  CRISPR gRNA sequence
atgactcggtcaagtttctt

SEQ ID NO: 451664 - DNA, 20 bp, Artificial
  CRISPR gRNA sequence
ggtcaagtttcttaggctcc

SEQ ID NO: 451665 - DNA, 20 bp, Artificial
  CRISPR gRNA sequence
gtcaagtttcttaggctcct

SEQ ID NO: 451666 - DNA, 20 bp, Artificial
  CRISPR gRNA sequence
agtttcttaggctcctgggc

SEQ ID NO: 451667 - DNA, 20 bp, Artificial
  CRISPR gRNA sequence
gtttcttaggctcctgggcc

SEQ ID NO: 451668 - DNA, 20 bp, Artificial
  CRISPR gRNA sequence
cctgggccaggcgctatgct

SEQ ID NO: 451669 - DNA, 20 bp, Artificial
  CRISPR gRNA sequence
tatgctcagcctttaataaa

SEQ ID NO: 451670 - DNA, 20 bp, Artificial
  CRISPR gRNA sequence
tttaataaatagacatattt

SEQ ID NO: 451671 - DNA, 20 bp, Artificial
  CRISPR gRNA sequence
atagacatatttcagaaaca

SEQ ID NO: 451672 - DNA, 20 bp, Artificial
  CRISPR gRNA sequence
agacatatttcagaaacacg

SEQ ID NO: 451673 - DNA, 20 bp, Artificial
  CRISPR gRNA sequence
acggagcatctataatgtgt

SEQ ID NO: 451674 - DNA, 20 bp, Artificial
  CRISPR gRNA sequence
ctataatgtgtcagacacca

SEQ ID NO: 451675 - DNA, 20 bp, Artificial
  CRISPR gRNA sequence
tataatgtgtcagacaccat

SEQ ID NO: 451676 - DNA, 20 bp, Artificial
  CRISPR gRNA sequence
ataatgtgtcagacaccatg

SEQ ID NO: 451677 - DNA, 20 bp, Artificial
  CRISPR gRNA sequence
gtgtcagacaccatggggca

SEQ ID NO: 451678 - DNA, 20 bp, Artificial
  CRISPR gRNA sequence
gtcagacaccatggggcaca

SEQ ID NO: 451679 - DNA, 20 bp, Artificial
  CRISPR gRNA sequence
cagacaccatggggcacaga

SEQ ID NO: 451680 - DNA, 20 bp, Artificial
  CRISPR gRNA sequence
gcacagagagatcactaaca

SEQ ID NO: 451681 - DNA, 20 bp, Artificial
  CRISPR gRNA sequence
cagagagatcactaacacag

SEQ ID NO: 451682 - DNA, 20 bp, Artificial
  CRISPR gRNA sequence
gagagatcactaacacagca

SEQ ID NO: 451683 - DNA, 20 bp, Artificial
  CRISPR gRNA sequence
agagatcactaacacagcag

SEQ ID NO: 451684 - DNA, 20 bp, Artificial
  CRISPR gRNA sequence
gatcactaacacagcagagg

SEQ ID NO: 451685 - DNA, 20 bp, Artificial
  CRISPR gRNA sequence
cacagcagaggcggacgttt

SEQ ID NO: 451686 - DNA, 20 bp, Artificial
  CRISPR gRNA sequence
agcagaggcggacgttttag

SEQ ID NO: 451687 - DNA, 20 bp, Artificial
  CRISPR gRNA sequence
cggacgttttagtggttaaa

SEQ ID NO: 451688 - DNA, 20 bp, Artificial
  CRISPR gRNA sequence
tttagtggttaaatggtctc

SEQ ID NO: 451689 - DNA, 20 bp, Artificial
  CRISPR gRNA sequence
tagtggttaaatggtctcta

SEQ ID NO: 451690 - DNA, 20 bp, Artificial
  CRISPR gRNA sequence
ggttaaatggtctctagagt

SEQ ID NO: 451691 - DNA, 20 bp, Artificial
  CRISPR gRNA sequence
aatggtctctagagtcagac

SEQ ID NO: 451692 - DNA, 20 bp, Artificial
  CRISPR gRNA sequence
atggtctctagagtcagacc

SEQ ID NO: 451693 - DNA, 20 bp, Artificial
  CRISPR gRNA sequence
agagtcagaccaggatgttt

SEQ ID NO: 451694 - DNA, 20 bp, Artificial
  CRISPR gRNA sequence
agaccaggatgtttcagatc

SEQ ID NO: 451695 - DNA, 20 bp, Artificial
  CRISPR gRNA sequence
cttaactatctgtgtaatat

SEQ ID NO: 451696 - DNA, 20 bp, Artificial
  CRISPR gRNA sequence
ttaactatctgtgtaatatt

SEQ ID NO: 451697 - DNA, 20 bp, Artificial
  CRISPR gRNA sequence
ctatctgtgtaatattgggc

SEQ ID NO: 451698 - DNA, 20 bp, Artificial
  CRISPR gRNA sequence
tctcttaatgacctataaaa

SEQ ID NO: 451699 - DNA, 20 bp, Artificial
  CRISPR gRNA sequence
tgacaaaatattctcttcct

SEQ ID NO: 451700 - DNA, 20 bp, Artificial
  CRISPR gRNA sequence
gacaaaatattctcttcctt

SEQ ID NO: 451701 - DNA, 20 bp, Artificial
  CRISPR gRNA sequence
tattctcttccttgggttgt

SEQ ID NO: 451702 - DNA, 20 bp, Artificial
  CRISPR gRNA sequence
attctcttccttgggttgtg

SEQ ID NO: 451703 - DNA, 20 bp, Artificial
  CRISPR gRNA sequence
ttctcttccttgggttgtga

SEQ ID NO: 451704 - DNA, 20 bp, Artificial
  CRISPR gRNA sequence
ttgggttgtgagggtcaaat

SEQ ID NO: 451705 - DNA, 20 bp, Artificial
  CRISPR gRNA sequence
tgggttgtgagggtcaaatg

SEQ ID NO: 451706 - DNA, 20 bp, Artificial
  CRISPR gRNA sequence
ggtcacctatgtaaattact

SEQ ID NO: 451707 - DNA, 20 bp, Artificial
  CRISPR gRNA sequence
cctatgtaaattacttagca

SEQ ID NO: 451708 - DNA, 20 bp, Artificial
  CRISPR gRNA sequence
aaattacttagcacagtgcc

SEQ ID NO: 451709 - DNA, 20 bp, Artificial
  CRISPR gRNA sequence
ttacttagcacagtgcctgg

SEQ ID NO: 451710 - DNA, 20 bp, Artificial
  CRISPR gRNA sequence
acttagcacagtgcctggca

SEQ ID NO: 451711 - DNA, 20 bp, Artificial
  CRISPR gRNA sequence
ttagcacagtgcctggcaga

SEQ ID NO: 451712 - DNA, 20 bp, Artificial
  CRISPR gRNA sequence
cacagtgcctggcagagagt

SEQ ID NO: 451713 - DNA, 20 bp, Artificial
  CRISPR gRNA sequence
acagtgcctggcagagagta

SEQ ID NO: 451714 - DNA, 20 bp, Artificial
  CRISPR gRNA sequence
cagtgcctggcagagagtaa

SEQ ID NO: 451715 - DNA, 20 bp, Artificial
  CRISPR gRNA sequence
agtaagggctcaataaatga

SEQ ID NO: 451716 - DNA, 20 bp, Artificial
  CRISPR gRNA sequence
caataaatgatagctatgat

SEQ ID NO: 451717 - DNA, 20 bp, Artificial
  CRISPR gRNA sequence
agttttatgctttcttatat

SEQ ID NO: 451718 - DNA, 20 bp, Artificial
  CRISPR gRNA sequence
ctttcttatattggaatcaa

SEQ ID NO: 451719 - DNA, 20 bp, Artificial
  CRISPR gRNA sequence
cttatattggaatcaatgga

SEQ ID NO: 451720 - DNA, 20 bp, Artificial
  CRISPR gRNA sequence
ggaatcaatggacagtgttc

SEQ ID NO: 451721 - DNA, 20 bp, Artificial
  CRISPR gRNA sequence
gaatcaatggacagtgttcc

SEQ ID NO: 451722 - DNA, 20 bp, Artificial
  CRISPR gRNA sequence
ttccaggcacatctacctgc

SEQ ID NO: 451723 - DNA, 20 bp, Artificial
  CRISPR gRNA sequence
tctacctgcaagactgtgtt

SEQ ID NO: 451724 - DNA, 20 bp, Artificial
  CRISPR gRNA sequence
tttagtccttataaaacact

SEQ ID NO: 451725 - DNA, 20 bp, Artificial
  CRISPR gRNA sequence
taaaatttattatttgtacg

SEQ ID NO: 451726 - DNA, 20 bp, Artificial
  CRISPR gRNA sequence
tattatttgtacgaagcata

SEQ ID NO: 451727 - DNA, 20 bp, Artificial
  CRISPR gRNA sequence
ttatttgtacgaagcatata

SEQ ID NO: 451728 - DNA, 20 bp, Artificial
  CRISPR gRNA sequence
tatttgtacgaagcatatag

SEQ ID NO: 451729 - DNA, 20 bp, Artificial
  CRISPR gRNA sequence
gtacgaagcatatagaggct

SEQ ID NO: 451730 - DNA, 20 bp, Artificial
  CRISPR gRNA sequence
acgaagcatatagaggcttg

SEQ ID NO: 451731 - DNA, 20 bp, Artificial
  CRISPR gRNA sequence
cgaagcatatagaggcttgg

SEQ ID NO: 451732 - DNA, 20 bp, Artificial
  CRISPR gRNA sequence
gaagcatatagaggcttgga

SEQ ID NO: 451733 - DNA, 20 bp, Artificial
  CRISPR gRNA sequence
aagcatatagaggcttggag

SEQ ID NO: 451734 - DNA, 20 bp, Artificial
  CRISPR gRNA sequence
ttgtgacttgcttaaaatca

SEQ ID NO: 451735 - DNA, 20 bp, Artificial
  CRISPR gRNA sequence
tgcttaaaatcacagctcct

SEQ ID NO: 451736 - DNA, 20 bp, Artificial
  CRISPR gRNA sequence
taaaatcacagctcctaagt

SEQ ID NO: 451737 - DNA, 20 bp, Artificial
  CRISPR gRNA sequence
aaaatcacagctcctaagtt

SEQ ID NO: 451738 - DNA, 20 bp, Artificial
  CRISPR gRNA sequence
aaatcacagctcctaagttg

SEQ ID NO: 451739 - DNA, 20 bp, Artificial
  CRISPR gRNA sequence
atcacagctcctaagttggg

SEQ ID NO: 451740 - DNA, 20 bp, Artificial
  CRISPR gRNA sequence
acagctcctaagttggggag

SEQ ID NO: 451741 - DNA, 20 bp, Artificial
  CRISPR gRNA sequence
cagctcctaagttggggagc

SEQ ID NO: 451742 - DNA, 20 bp, Artificial
  CRISPR gRNA sequence
ggggagcaggactctaaccc

SEQ ID NO: 451743 - DNA, 20 bp, Artificial
  CRISPR gRNA sequence
aggactctaacccaagttat

SEQ ID NO: 451744 - DNA, 20 bp, Artificial
  CRISPR gRNA sequence
gactctaacccaagttatga

SEQ ID NO: 451745 - DNA, 20 bp, Artificial
  CRISPR gRNA sequence
agttatgagagtctttctct

SEQ ID NO: 451746 - DNA, 20 bp, Artificial
  CRISPR gRNA sequence
ttatgagagtctttctcttg

SEQ ID NO: 451747 - DNA, 20 bp, Artificial
  CRISPR gRNA sequence
cccctttgtccctctcctca

SEQ ID NO: 451748 - DNA, 20 bp, Artificial
  CRISPR gRNA sequence
gccgctcatccattcacgaa

SEQ ID NO: 451749 - DNA, 20 bp, Artificial
  CRISPR gRNA sequence
tcacgaacagctgttaacac

SEQ ID NO: 451750 - DNA, 20 bp, Artificial
  CRISPR gRNA sequence
aacacaagaacgactgtact

SEQ ID NO: 451751 - DNA, 20 bp, Artificial
  CRISPR gRNA sequence
gaacgactgtactaagtaat

SEQ ID NO: 451752 - DNA, 20 bp, Artificial
  CRISPR gRNA sequence
aacgactgtactaagtaata

SEQ ID NO: 451753 - DNA, 20 bp, Artificial
  CRISPR gRNA sequence
tactaagtaataaggtcata

SEQ ID NO: 451754 - DNA, 20 bp, Artificial
  CRISPR gRNA sequence
taataaggtcataaagtgtc

SEQ ID NO: 451755 - DNA, 20 bp, Artificial
  CRISPR gRNA sequence
aataaggtcataaagtgtca

SEQ ID NO: 451756 - DNA, 20 bp, Artificial
  CRISPR gRNA sequence
ataaggtcataaagtgtcaa

SEQ ID NO: 451757 - DNA, 20 bp, Artificial
  CRISPR gRNA sequence
taaggtcataaagtgtcaag

SEQ ID NO: 451758 - DNA, 20 bp, Artificial
  CRISPR gRNA sequence
ggtcataaagtgtcaagggg

SEQ ID NO: 451759 - DNA, 20 bp, Artificial
  CRISPR gRNA sequence
taaagtgtcaaggggcagca

SEQ ID NO: 451760 - DNA, 20 bp, Artificial
  CRISPR gRNA sequence
aaagtgtcaaggggcagcac

SEQ ID NO: 451761 - DNA, 20 bp, Artificial
  CRISPR gRNA sequence
agtgtcaaggggcagcacag

SEQ ID NO: 451762 - DNA, 20 bp, Artificial
  CRISPR gRNA sequence
gggcagcacaggagaaattc

SEQ ID NO: 451763 - DNA, 20 bp, Artificial
  CRISPR gRNA sequence
gcacaggagaaattctggat

SEQ ID NO: 451764 - DNA, 20 bp, Artificial
  CRISPR gRNA sequence
cacaggagaaattctggatg

SEQ ID NO: 451765 - DNA, 20 bp, Artificial
  CRISPR gRNA sequence
acaggagaaattctggatga

SEQ ID NO: 451766 - DNA, 20 bp, Artificial
  CRISPR gRNA sequence
gaaattctggatgagggatg

SEQ ID NO: 451767 - DNA, 20 bp, Artificial
  CRISPR gRNA sequence
ttctggatgagggatgtgga

SEQ ID NO: 451768 - DNA, 20 bp, Artificial
  CRISPR gRNA sequence
tctggatgagggatgtggaa

SEQ ID NO: 451769 - DNA, 20 bp, Artificial
  CRISPR gRNA sequence
gagggatgtggaaaggctgc

SEQ ID NO: 451770 - DNA, 20 bp, Artificial
  CRISPR gRNA sequence
gatgtggaaaggctgcaaga

SEQ ID NO: 451771 - DNA, 20 bp, Artificial
  CRISPR gRNA sequence
aaggctgcaagatggcaatg

SEQ ID NO: 451772 - DNA, 20 bp, Artificial
  CRISPR gRNA sequence
ctgcaagatggcaatgaagt

SEQ ID NO: 451773 - DNA, 20 bp, Artificial
  CRISPR gRNA sequence
tgcaagatggcaatgaagtt

SEQ ID NO: 451774 - DNA, 20 bp, Artificial
  CRISPR gRNA sequence
gcaatgaagttaggccttca

SEQ ID NO: 451775 - DNA, 20 bp, Artificial
  CRISPR gRNA sequence
taggccttcatagttgtttg

SEQ ID NO: 451776 - DNA, 20 bp, Artificial
  CRISPR gRNA sequence
aggccttcatagttgtttgt

SEQ ID NO: 451777 - DNA, 20 bp, Artificial
  CRISPR gRNA sequence
catagttgtttgtgggctct

SEQ ID NO: 451778 - DNA, 20 bp, Artificial
  CRISPR gRNA sequence
atagttgtttgtgggctctc

SEQ ID NO: 451779 - DNA, 20 bp, Artificial
  CRISPR gRNA sequence
agttgtttgtgggctctcgg

SEQ ID NO: 451780 - DNA, 20 bp, Artificial
  CRISPR gRNA sequence
gtttgtgggctctcgggagc

SEQ ID NO: 451781 - DNA, 20 bp, Artificial
  CRISPR gRNA sequence
ctctcgggagctggtgacta

SEQ ID NO: 451782 - DNA, 20 bp, Artificial
  CRISPR gRNA sequence
gagctggtgactaaagaata

SEQ ID NO: 451783 - DNA, 20 bp, Artificial
  CRISPR gRNA sequence
ctggtgactaaagaatacgg

SEQ ID NO: 451784 - DNA, 20 bp, Artificial
  CRISPR gRNA sequence
tggtgactaaagaatacggt

SEQ ID NO: 451785 - DNA, 20 bp, Artificial
  CRISPR gRNA sequence
aagaatacggtgggtgaatt

SEQ ID NO: 451786 - DNA, 20 bp, Artificial
  CRISPR gRNA sequence
agaatacggtgggtgaatta

SEQ ID NO: 451787 - DNA, 20 bp, Artificial
  CRISPR gRNA sequence
atacggtgggtgaattaagg

SEQ ID NO: 451788 - DNA, 20 bp, Artificial
  CRISPR gRNA sequence
tacggtgggtgaattaaggt

SEQ ID NO: 451789 - DNA, 20 bp, Artificial
  CRISPR gRNA sequence
acggtgggtgaattaaggtg

SEQ ID NO: 451790 - DNA, 20 bp, Artificial
  CRISPR gRNA sequence
gggtgaattaaggtggggaa

SEQ ID NO: 451791 - DNA, 20 bp, Artificial
  CRISPR gRNA sequence
ggtgaattaaggtggggaat

SEQ ID NO: 451792 - DNA, 20 bp, Artificial
  CRISPR gRNA sequence
attaaggtggggaatgggct

SEQ ID NO: 451793 - DNA, 20 bp, Artificial
  CRISPR gRNA sequence
ttaaggtggggaatgggctg

SEQ ID NO: 451794 - DNA, 20 bp, Artificial
  CRISPR gRNA sequence
aaggtggggaatgggctgag

SEQ ID NO: 451795 - DNA, 20 bp, Artificial
  CRISPR gRNA sequence
gggaatgggctgaggagatc

SEQ ID NO: 451796 - DNA, 20 bp, Artificial
  CRISPR gRNA sequence
ggctgaggagatctggcttc

SEQ ID NO: 451797 - DNA, 20 bp, Artificial
  CRISPR gRNA sequence
ggagatctggcttccagtcc

SEQ ID NO: 451798 - DNA, 20 bp, Artificial
  CRISPR gRNA sequence
ttccagtcctggctccgcac

SEQ ID NO: 451799 - DNA, 20 bp, Artificial
  CRISPR gRNA sequence
tccagtcctggctccgcact

SEQ ID NO: 451800 - DNA, 20 bp, Artificial
  CRISPR gRNA sequence
agtcctggctccgcactagg

SEQ ID NO: 451801 - DNA, 20 bp, Artificial
  CRISPR gRNA sequence
ggctccgcactaggtagctg

SEQ ID NO: 451802 - DNA, 20 bp, Artificial
  CRISPR gRNA sequence
ggtagctgtggaatgttgac

SEQ ID NO: 451803 - DNA, 20 bp, Artificial
  CRISPR gRNA sequence
gtagctgtggaatgttgaca

SEQ ID NO: 451804 - DNA, 20 bp, Artificial
  CRISPR gRNA sequence
acaaggtcgtgtcccttctc

SEQ ID NO: 451805 - DNA, 20 bp, Artificial
  CRISPR gRNA sequence
caaggtcgtgtcccttctct

SEQ ID NO: 451806 - DNA, 20 bp, Artificial
  CRISPR gRNA sequence
cttctctaggcgtgtttcct

SEQ ID NO: 451807 - DNA, 20 bp, Artificial
  CRISPR gRNA sequence
ttctctaggcgtgtttccta

SEQ ID NO: 451808 - DNA, 20 bp, Artificial
  CRISPR gRNA sequence
tctctaggcgtgtttcctaa

SEQ ID NO: 451809 - DNA, 20 bp, Artificial
  CRISPR gRNA sequence
aggcgtgtttcctaagggac

SEQ ID NO: 451810 - DNA, 20 bp, Artificial
  CRISPR gRNA sequence
tgtttcctaagggactggtg

SEQ ID NO: 451811 - DNA, 20 bp, Artificial
  CRISPR gRNA sequence
ttcctaagggactggtgcag

SEQ ID NO: 451812 - DNA, 20 bp, Artificial
  CRISPR gRNA sequence
tcctaagggactggtgcagc

SEQ ID NO: 451813 - DNA, 20 bp, Artificial
  CRISPR gRNA sequence
aagggactggtgcagcggga

SEQ ID NO: 451814 - DNA, 20 bp, Artificial
  CRISPR gRNA sequence
agggactggtgcagcgggat

SEQ ID NO: 451815 - DNA, 20 bp, Artificial
  CRISPR gRNA sequence
ggactggtgcagcgggatgg

SEQ ID NO: 451816 - DNA, 20 bp, Artificial
  CRISPR gRNA sequence
gactggtgcagcgggatggg

SEQ ID NO: 451817 - DNA, 20 bp, Artificial
  CRISPR gRNA sequence
actggtgcagcgggatggga

SEQ ID NO: 451818 - DNA, 20 bp, Artificial
  CRISPR gRNA sequence
ctggtgcagcgggatgggag

SEQ ID NO: 451819 - DNA, 20 bp, Artificial
  CRISPR gRNA sequence
gcagcgggatgggaggggcg

SEQ ID NO: 451820 - DNA, 20 bp, Artificial
  CRISPR gRNA sequence
cagcgggatgggaggggcgc

SEQ ID NO: 451821 - DNA, 20 bp, Artificial
  CRISPR gRNA sequence
agcgggatgggaggggcgca

SEQ ID NO: 451822 - DNA, 20 bp, Artificial
  CRISPR gRNA sequence
gggatgggaggggcgcaggg

SEQ ID NO: 451823 - DNA, 20 bp, Artificial
  CRISPR gRNA sequence
ggatgggaggggcgcagggt

SEQ ID NO: 451824 - DNA, 20 bp, Artificial
  CRISPR gRNA sequence
gatgggaggggcgcagggta

SEQ ID NO: 451825 - DNA, 20 bp, Artificial
  CRISPR gRNA sequence
gcagggtagggaccgcttcc

SEQ ID NO: 451826 - DNA, 20 bp, Artificial
  CRISPR gRNA sequence
cagggtagggaccgcttcca

SEQ ID NO: 451827 - DNA, 20 bp, Artificial
  CRISPR gRNA sequence
gggtagggaccgcttccaag

SEQ ID NO: 451828 - DNA, 20 bp, Artificial
  CRISPR gRNA sequence
gtagggaccgcttccaagga

SEQ ID NO: 451829 - DNA, 20 bp, Artificial
  CRISPR gRNA sequence
agggaccgcttccaaggaga

SEQ ID NO: 451830 - DNA, 20 bp, Artificial
  CRISPR gRNA sequence
ggaccgcttccaaggagaga

SEQ ID NO: 451831 - DNA, 20 bp, Artificial
  CRISPR gRNA sequence
gaccgcttccaaggagagag

SEQ ID NO: 451832 - DNA, 20 bp, Artificial
  CRISPR gRNA sequence
gcttccaaggagagagagga

SEQ ID NO: 451833 - DNA, 20 bp, Artificial
  CRISPR gRNA sequence
cttccaaggagagagaggac

SEQ ID NO: 451834 - DNA, 20 bp, Artificial
  CRISPR gRNA sequence
ccaaggagagagaggacagg

SEQ ID NO: 451835 - DNA, 20 bp, Artificial
  CRISPR gRNA sequence
caaggagagagaggacaggc

SEQ ID NO: 451836 - DNA, 20 bp, Artificial
  CRISPR gRNA sequence
aggagagagaggacaggcgg

SEQ ID NO: 451837 - DNA, 20 bp, Artificial
  CRISPR gRNA sequence
ggagagagaggacaggcggg

SEQ ID NO: 451838 - DNA, 20 bp, Artificial
  CRISPR gRNA sequence
gagagagaggacaggcggga

SEQ ID NO: 451839 - DNA, 20 bp, Artificial
  CRISPR gRNA sequence
agagagaggacaggcgggag

SEQ ID NO: 451840 - DNA, 20 bp, Artificial
  CRISPR gRNA sequence
acaggcgggaggggctgatg

SEQ ID NO: 451841 - DNA, 20 bp, Artificial
  CRISPR gRNA sequence
gcgggaggggctgatgcagc

SEQ ID NO: 451842 - DNA, 20 bp, Artificial
  CRISPR gRNA sequence
gatgcagctggtcactccgc

SEQ ID NO: 451843 - DNA, 20 bp, Artificial
  CRISPR gRNA sequence
tgcagctggtcactccgctg

SEQ ID NO: 451844 - DNA, 20 bp, Artificial
  CRISPR gRNA sequence
agctggtcactccgctggag

SEQ ID NO: 451845 - DNA, 20 bp, Artificial
  CRISPR gRNA sequence
ggtcactccgctggagtggc

SEQ ID NO: 451846 - DNA, 20 bp, Artificial
  CRISPR gRNA sequence
gctggagtggccagacttcg

SEQ ID NO: 451847 - DNA, 20 bp, Artificial
  CRISPR gRNA sequence
tggccagacttcgcggtgcc

SEQ ID NO: 451848 - DNA, 20 bp, Artificial
  CRISPR gRNA sequence
ggccagacttcgcggtgcct

SEQ ID NO: 451849 - DNA, 20 bp, Artificial
  CRISPR gRNA sequence
gccagacttcgcggtgccta

SEQ ID NO: 451850 - DNA, 20 bp, Artificial
  CRISPR gRNA sequence
acttcgcggtgcctagggcc

SEQ ID NO: 451851 - DNA, 20 bp, Artificial
  CRISPR gRNA sequence
cggtgcctagggccgagttg

SEQ ID NO: 451852 - DNA, 20 bp, Artificial
  CRISPR gRNA sequence
tgcctagggccgagttgaag

SEQ ID NO: 451853 - DNA, 20 bp, Artificial
  CRISPR gRNA sequence
cctagggccgagttgaagaa

SEQ ID NO: 451854 - DNA, 20 bp, Artificial
  CRISPR gRNA sequence
cgagttgaagaagagcatgt

SEQ ID NO: 451855 - DNA, 20 bp, Artificial
  CRISPR gRNA sequence
aagagcatgtaagtctgttg

SEQ ID NO: 451856 - DNA, 20 bp, Artificial
  CRISPR gRNA sequence
agagcatgtaagtctgttgt

SEQ ID NO: 451857 - DNA, 20 bp, Artificial
  CRISPR gRNA sequence
gtctgttgtgggcccctcac

SEQ ID NO: 451858 - DNA, 20 bp, Artificial
  CRISPR gRNA sequence
tgtgggcccctcaccagcgc

SEQ ID NO: 451859 - DNA, 20 bp, Artificial
  CRISPR gRNA sequence
gtgggcccctcaccagcgct

SEQ ID NO: 451860 - DNA, 20 bp, Artificial
  CRISPR gRNA sequence
tgggcccctcaccagcgctg

SEQ ID NO: 451861 - DNA, 20 bp, Artificial
  CRISPR gRNA sequence
gggcccctcaccagcgctgg

SEQ ID NO: 451862 - DNA, 20 bp, Artificial
  CRISPR gRNA sequence
ggcccctcaccagcgctggg

SEQ ID NO: 451863 - DNA, 20 bp, Artificial
  CRISPR gRNA sequence
ccctcaccagcgctgggggg

SEQ ID NO: 451864 - DNA, 20 bp, Artificial
  CRISPR gRNA sequence
caccagcgctggggggcagc

SEQ ID NO: 451865 - DNA, 20 bp, Artificial
  CRISPR gRNA sequence
accagcgctggggggcagcg

SEQ ID NO: 451866 - DNA, 20 bp, Artificial
  CRISPR gRNA sequence
ctggggggcagcgaggtcac

SEQ ID NO: 451867 - DNA, 20 bp, Artificial
  CRISPR gRNA sequence
tggggggcagcgaggtcact

SEQ ID NO: 451868 - DNA, 20 bp, Artificial
  CRISPR gRNA sequence
gggcagcgaggtcactgggc

SEQ ID NO: 451869 - DNA, 20 bp, Artificial
  CRISPR gRNA sequence
ggcagcgaggtcactgggca

SEQ ID NO: 451870 - DNA, 20 bp, Artificial
  CRISPR gRNA sequence
gtcactgggcaaggatgctc

SEQ ID NO: 451871 - DNA, 20 bp, Artificial
  CRISPR gRNA sequence
tcactgggcaaggatgctct

SEQ ID NO: 451872 - DNA, 20 bp, Artificial
  CRISPR gRNA sequence
ctgggcaaggatgctctggg

SEQ ID NO: 451873 - DNA, 20 bp, Artificial
  CRISPR gRNA sequence
gatgctctgggaagtgacct

SEQ ID NO: 451874 - DNA, 20 bp, Artificial
  CRISPR gRNA sequence
tgggaagtgaccttggtgcc

SEQ ID NO: 451875 - DNA, 20 bp, Artificial
  CRISPR gRNA sequence
gggaagtgaccttggtgccc

SEQ ID NO: 451876 - DNA, 20 bp, Artificial
  CRISPR gRNA sequence
gaagtgaccttggtgcccgg

SEQ ID NO: 451877 - DNA, 20 bp, Artificial
  CRISPR gRNA sequence
aagtgaccttggtgcccggg

SEQ ID NO: 451878 - DNA, 20 bp, Artificial
  CRISPR gRNA sequence
agtgaccttggtgcccggga

SEQ ID NO: 451879 - DNA, 20 bp, Artificial
  CRISPR gRNA sequence
gtgaccttggtgcccgggag

SEQ ID NO: 451880 - DNA, 20 bp, Artificial
  CRISPR gRNA sequence
gaccttggtgcccgggaggg

SEQ ID NO: 451881 - DNA, 20 bp, Artificial
  CRISPR gRNA sequence
gggagcaccctgttgtgatg

SEQ ID NO: 451882 - DNA, 20 bp, Artificial
  CRISPR gRNA sequence
ggagcaccctgttgtgatgc

SEQ ID NO: 451883 - DNA, 20 bp, Artificial
  CRISPR gRNA sequence
gcaccctgttgtgatgcagg

SEQ ID NO: 451884 - DNA, 20 bp, Artificial
  CRISPR gRNA sequence
caccctgttgtgatgcaggc

SEQ ID NO: 451885 - DNA, 20 bp, Artificial
  CRISPR gRNA sequence
accctgttgtgatgcaggcg

SEQ ID NO: 451886 - DNA, 20 bp, Artificial
  CRISPR gRNA sequence
ctgttgtgatgcaggcgggg

SEQ ID NO: 451887 - DNA, 20 bp, Artificial
  CRISPR gRNA sequence
gtgatgcaggcggggcagcg

SEQ ID NO: 451888 - DNA, 20 bp, Artificial
  CRISPR gRNA sequence
gatgcaggcggggcagcgcg

SEQ ID NO: 451889 - DNA, 20 bp, Artificial
  CRISPR gRNA sequence
caggcggggcagcgcggagc

SEQ ID NO: 451890 - DNA, 20 bp, Artificial
  CRISPR gRNA sequence
gcggggcagcgcggagccgg

SEQ ID NO: 451891 - DNA, 20 bp, Artificial
  CRISPR gRNA sequence
gcggcgctgatttcgcactc

SEQ ID NO: 451892 - DNA, 20 bp, Artificial
  CRISPR gRNA sequence
tgatttcgcactctggccgc

SEQ ID NO: 451893 - DNA, 20 bp, Artificial
  CRISPR gRNA sequence
atttcgcactctggccgcta

SEQ ID NO: 451894 - DNA, 20 bp, Artificial
  CRISPR gRNA sequence
tttcgcactctggccgctag

SEQ ID NO: 451895 - DNA, 20 bp, Artificial
  CRISPR gRNA sequence
ttcgcactctggccgctaga

SEQ ID NO: 451896 - DNA, 20 bp, Artificial
  CRISPR gRNA sequence
cgctagagggcgctgccttt

SEQ ID NO: 451897 - DNA, 20 bp, Artificial
  CRISPR gRNA sequence
agggcgctgcctttcagcca

SEQ ID NO: 451898 - DNA, 20 bp, Artificial
  CRISPR gRNA sequence
gctgcctttcagccaaagcc

SEQ ID NO: 451899 - DNA, 20 bp, Artificial
  CRISPR gRNA sequence
accccctacctgccccgcgt

SEQ ID NO: 451900 - DNA, 20 bp, Artificial
  CRISPR gRNA sequence
cgcgttggcccgcgtcactc

SEQ ID NO: 451901 - DNA, 20 bp, Artificial
  CRISPR gRNA sequence
ggcccgcgtcactccagcca

SEQ ID NO: 451902 - DNA, 20 bp, Artificial
  CRISPR gRNA sequence
gcccgcgtcactccagccat

SEQ ID NO: 451903 - DNA, 20 bp, Artificial
  CRISPR gRNA sequence
cactccagccatgggccatc

SEQ ID NO: 451904 - DNA, 20 bp, Artificial
  CRISPR gRNA sequence
ccagccatgggccatccagc

SEQ ID NO: 451905 - DNA, 20 bp, Artificial
  CRISPR gRNA sequence
catgggccatccagcgagca

SEQ ID NO: 451906 - DNA, 20 bp, Artificial
  CRISPR gRNA sequence
atgggccatccagcgagcat

SEQ ID NO: 451907 - DNA, 20 bp, Artificial
  CRISPR gRNA sequence
tgggccatccagcgagcatg

SEQ ID NO: 451908 - DNA, 20 bp, Artificial
  CRISPR gRNA sequence
gggccatccagcgagcatgg

SEQ ID NO: 451909 - DNA, 20 bp, Artificial
  CRISPR gRNA sequence
catccagcgagcatgggggc

SEQ ID NO: 451910 - DNA, 20 bp, Artificial
  CRISPR gRNA sequence
cagcgagcatgggggctagc

SEQ ID NO: 451911 - DNA, 20 bp, Artificial
  CRISPR gRNA sequence
agcgagcatgggggctagcc

SEQ ID NO: 451912 - DNA, 20 bp, Artificial
  CRISPR gRNA sequence
gcgagcatgggggctagcca

SEQ ID NO: 451913 - DNA, 20 bp, Artificial
  CRISPR gRNA sequence
gcatgggggctagccaggga

SEQ ID NO: 451914 - DNA, 20 bp, Artificial
  CRISPR gRNA sequence
tagccagggaaagtctaaac

SEQ ID NO: 451915 - DNA, 20 bp, Artificial
  CRISPR gRNA sequence
agccagggaaagtctaaact

SEQ ID NO: 451916 - DNA, 20 bp, Artificial
  CRISPR gRNA sequence
ccagggaaagtctaaactag

SEQ ID NO: 451917 - DNA, 20 bp, Artificial
  CRISPR gRNA sequence
cagggaaagtctaaactagg

SEQ ID NO: 451918 - DNA, 20 bp, Artificial
  CRISPR gRNA sequence
agggaaagtctaaactagga

SEQ ID NO: 451919 - DNA, 20 bp, Artificial
  CRISPR gRNA sequence
gggaaagtctaaactaggag

SEQ ID NO: 451920 - DNA, 20 bp, Artificial
  CRISPR gRNA sequence
gaaagtctaaactaggaggg

SEQ ID NO: 451921 - DNA, 20 bp, Artificial
  CRISPR gRNA sequence
tctaaactaggaggggagat

SEQ ID NO: 451922 - DNA, 20 bp, Artificial
  CRISPR gRNA sequence
ctaaactaggaggggagatg

SEQ ID NO: 451923 - DNA, 20 bp, Artificial
  CRISPR gRNA sequence
taaactaggaggggagatga

SEQ ID NO: 451924 - DNA, 20 bp, Artificial
  CRISPR gRNA sequence
aaactaggaggggagatgag

SEQ ID NO: 451925 - DNA, 20 bp, Artificial
  CRISPR gRNA sequence
aactaggaggggagatgagg

SEQ ID NO: 451926 - DNA, 20 bp, Artificial
  CRISPR gRNA sequence
aggggagatgagggggtgca

SEQ ID NO: 451927 - DNA, 20 bp, Artificial
  CRISPR gRNA sequence
gagatgagggggtgcaaagt

SEQ ID NO: 451928 - DNA, 20 bp, Artificial
  CRISPR gRNA sequence
agatgagggggtgcaaagtt

SEQ ID NO: 451929 - DNA, 20 bp, Artificial
  CRISPR gRNA sequence
agggggtgcaaagttgggcc

SEQ ID NO: 451930 - DNA, 20 bp, Artificial
  CRISPR gRNA sequence
gggtgcaaagttgggcctgg

SEQ ID NO: 451931 - DNA, 20 bp, Artificial
  CRISPR gRNA sequence
ggtgcaaagttgggcctggt

SEQ ID NO: 451932 - DNA, 20 bp, Artificial
  CRISPR gRNA sequence
aagttgggcctggtgggtcc

SEQ ID NO: 451933 - DNA, 20 bp, Artificial
  CRISPR gRNA sequence
agttgggcctggtgggtcct

SEQ ID NO: 451934 - DNA, 20 bp, Artificial
  CRISPR gRNA sequence
gttgggcctggtgggtcctg

SEQ ID NO: 451935 - DNA, 20 bp, Artificial
  CRISPR gRNA sequence
cctggtgggtcctggggacg

SEQ ID NO: 451936 - DNA, 20 bp, Artificial
  CRISPR gRNA sequence
cctggggacgcagcatgtac

SEQ ID NO: 451937 - DNA, 20 bp, Artificial
  CRISPR gRNA sequence
tggggacgcagcatgtacta

SEQ ID NO: 451938 - DNA, 20 bp, Artificial
  CRISPR gRNA sequence
ggacgcagcatgtactagag

SEQ ID NO: 451939 - DNA, 20 bp, Artificial
  CRISPR gRNA sequence
gcatgtactagagcggcacc

SEQ ID NO: 451940 - DNA, 20 bp, Artificial
  CRISPR gRNA sequence
gagcggcacctggccctcaa

SEQ ID NO: 451941 - DNA, 20 bp, Artificial
  CRISPR gRNA sequence
gcggcacctggccctcaaca

SEQ ID NO: 451942 - DNA, 20 bp, Artificial
  CRISPR gRNA sequence
cggcacctggccctcaacag

SEQ ID NO: 451943 - DNA, 20 bp, Artificial
  CRISPR gRNA sequence
ggcacctggccctcaacaga

SEQ ID NO: 451944 - DNA, 20 bp, Artificial
  CRISPR gRNA sequence
gcacctggccctcaacagag

SEQ ID NO: 451945 - DNA, 20 bp, Artificial
  CRISPR gRNA sequence
acctggccctcaacagaggg

SEQ ID NO: 451946 - DNA, 20 bp, Artificial
  CRISPR gRNA sequence
ctggccctcaacagagggga

SEQ ID NO: 451947 - DNA, 20 bp, Artificial
  CRISPR gRNA sequence
gccctcaacagaggggagag

SEQ ID NO: 451948 - DNA, 20 bp, Artificial
  CRISPR gRNA sequence
ccctcaacagaggggagagc

SEQ ID NO: 451949 - DNA, 20 bp, Artificial
  CRISPR gRNA sequence
tcaacagaggggagagcggg

SEQ ID NO: 451950 - DNA, 20 bp, Artificial
  CRISPR gRNA sequence
aggggagagcgggtggtcgt

SEQ ID NO: 451951 - DNA, 20 bp, Artificial
  CRISPR gRNA sequence
ggagagcgggtggtcgtgag

SEQ ID NO: 451952 - DNA, 20 bp, Artificial
  CRISPR gRNA sequence
gcgggtggtcgtgagaagtc

SEQ ID NO: 451953 - DNA, 20 bp, Artificial
  CRISPR gRNA sequence
cgggtggtcgtgagaagtct

SEQ ID NO: 451954 - DNA, 20 bp, Artificial
  CRISPR gRNA sequence
tgagaagtctgggaattttc

SEQ ID NO: 451955 - DNA, 20 bp, Artificial
  CRISPR gRNA sequence
gagaagtctgggaattttcc

SEQ ID NO: 451956 - DNA, 20 bp, Artificial
  CRISPR gRNA sequence
tttccgggcccactacacgc

SEQ ID NO: 451957 - DNA, 20 bp, Artificial
  CRISPR gRNA sequence
ttccgggcccactacacgcc

SEQ ID NO: 451958 - DNA, 20 bp, Artificial
  CRISPR gRNA sequence
tccgggcccactacacgcca

SEQ ID NO: 451959 - DNA, 20 bp, Artificial
  CRISPR gRNA sequence
ccgggcccactacacgccag

SEQ ID NO: 451960 - DNA, 20 bp, Artificial
  CRISPR gRNA sequence
ggcccactacacgccagggg

SEQ ID NO: 451961 - DNA, 20 bp, Artificial
  CRISPR gRNA sequence
gcccactacacgccaggggc

SEQ ID NO: 451962 - DNA, 20 bp, Artificial
  CRISPR gRNA sequence
ctcccctcttaaaacgttgt

SEQ ID NO: 451963 - DNA, 20 bp, Artificial
  CRISPR gRNA sequence
tcttaaaacgttgtgagccc

SEQ ID NO: 451964 - DNA, 20 bp, Artificial
  CRISPR gRNA sequence
aaacgttgtgagccccagcg

SEQ ID NO: 451965 - DNA, 20 bp, Artificial
  CRISPR gRNA sequence
aacgttgtgagccccagcgc

SEQ ID NO: 451966 - DNA, 20 bp, Artificial
  CRISPR gRNA sequence
gttgtgagccccagcgcggg

SEQ ID NO: 451967 - DNA, 20 bp, Artificial
  CRISPR gRNA sequence
ttgtgagccccagcgcgggc

SEQ ID NO: 451968 - DNA, 20 bp, Artificial
  CRISPR gRNA sequence
tgtgagccccagcgcgggca

SEQ ID NO: 451969 - DNA, 20 bp, Artificial
  CRISPR gRNA sequence
gtgagccccagcgcgggcag

SEQ ID NO: 451970 - DNA, 20 bp, Artificial
  CRISPR gRNA sequence
tgagccccagcgcgggcagg

SEQ ID NO: 451971 - DNA, 20 bp, Artificial
  CRISPR gRNA sequence
gagccccagcgcgggcaggg

SEQ ID NO: 451972 - DNA, 20 bp, Artificial
  CRISPR gRNA sequence
gccccagcgcgggcaggggg

SEQ ID NO: 451973 - DNA, 20 bp, Artificial
  CRISPR gRNA sequence
ccccagcgcgggcagggggg

SEQ ID NO: 451974 - DNA, 20 bp, Artificial
  CRISPR gRNA sequence
cccagcgcgggcagggggga

SEQ ID NO: 451975 - DNA, 20 bp, Artificial
  CRISPR gRNA sequence
ggcaggggggagggtgcccg

SEQ ID NO: 451976 - DNA, 20 bp, Artificial
  CRISPR gRNA sequence
caggggggagggtgcccgtg

SEQ ID NO: 451977 - DNA, 20 bp, Artificial
  CRISPR gRNA sequence
ggggagggtgcccgtggagt

SEQ ID NO: 451978 - DNA, 20 bp, Artificial
  CRISPR gRNA sequence
gttggcatcctcatctttga

SEQ ID NO: 451979 - DNA, 20 bp, Artificial
  CRISPR gRNA sequence
tcctcatctttgatggtccc

SEQ ID NO: 451980 - DNA, 20 bp, Artificial
  CRISPR gRNA sequence
cctcatctttgatggtcccc

SEQ ID NO: 451981 - DNA, 20 bp, Artificial
  CRISPR gRNA sequence
ctcatctttgatggtccccg

SEQ ID NO: 451982 - DNA, 20 bp, Artificial
  CRISPR gRNA sequence
tgatggtccccggggctcct

SEQ ID NO: 451983 - DNA, 20 bp, Artificial
  CRISPR gRNA sequence
ccggggctcctgagctgcgc

SEQ ID NO: 451984 - DNA, 20 bp, Artificial
  CRISPR gRNA sequence
gggctcctgagctgcgctgg

SEQ ID NO: 451985 - DNA, 20 bp, Artificial
  CRISPR gRNA sequence
ctgagctgcgctggtggccc

SEQ ID NO: 451986 - DNA, 20 bp, Artificial
  CRISPR gRNA sequence
tgagctgcgctggtggcccc

SEQ ID NO: 451987 - DNA, 20 bp, Artificial
  CRISPR gRNA sequence
gagctgcgctggtggcccca

SEQ ID NO: 451988 - DNA, 20 bp, Artificial
  CRISPR gRNA sequence
gcgctggtggccccagggct

SEQ ID NO: 451989 - DNA, 20 bp, Artificial
  CRISPR gRNA sequence
ccagggctcggtgcctctct

SEQ ID NO: 451990 - DNA, 20 bp, Artificial
  CRISPR gRNA sequence
cagggctcggtgcctctctc

SEQ ID NO: 451991 - DNA, 20 bp, Artificial
  CRISPR gRNA sequence
tcggtgcctctctcaggcga

SEQ ID NO: 451992 - DNA, 20 bp, Artificial
  CRISPR gRNA sequence
ctctctcaggcgacagctca

SEQ ID NO: 451993 - DNA, 20 bp, Artificial
  CRISPR gRNA sequence
ctcaggcgacagctcacaga

SEQ ID NO: 451994 - DNA, 20 bp, Artificial
  CRISPR gRNA sequence
aggcgacagctcacagacgg

SEQ ID NO: 451995 - DNA, 20 bp, Artificial
  CRISPR gRNA sequence
ggcgacagctcacagacggc

SEQ ID NO: 451996 - DNA, 20 bp, Artificial
  CRISPR gRNA sequence
actcttccctcccgcacctt

SEQ ID NO: 451997 - DNA, 20 bp, Artificial
  CRISPR gRNA sequence
tcttccctcccgcaccttcg

SEQ ID NO: 451998 - DNA, 20 bp, Artificial
  CRISPR gRNA sequence
cttccctcccgcaccttcgg

SEQ ID NO: 451999 - DNA, 20 bp, Artificial
  CRISPR gRNA sequence
ccctcccgcaccttcggagg

SEQ ID NO: 452000 - DNA, 20 bp, Artificial
  CRISPR gRNA sequence
cgcaccttcggaggcggtcc

SEQ ID NO: 452001 - DNA, 20 bp, Artificial
  CRISPR gRNA sequence
caccttcggaggcggtcctg

SEQ ID NO: 452002 - DNA, 20 bp, Artificial
  CRISPR gRNA sequence
gaggcggtcctggagtcttg

SEQ ID NO: 452003 - DNA, 20 bp, Artificial
  CRISPR gRNA sequence
cctggagtcttgtggactcc

SEQ ID NO: 452004 - DNA, 20 bp, Artificial
  CRISPR gRNA sequence
ctggagtcttgtggactcct

SEQ ID NO: 452005 - DNA, 20 bp, Artificial
  CRISPR gRNA sequence
ggactcctgggttcaaatcc

SEQ ID NO: 452006 - DNA, 20 bp, Artificial
  CRISPR gRNA sequence
aaatccaagctttgtgtgac

SEQ ID NO: 452007 - DNA, 20 bp, Artificial
  CRISPR gRNA sequence
ttgtgtgaccagcacattgc

SEQ ID NO: 452008 - DNA, 20 bp, Artificial
  CRISPR gRNA sequence
gcacattgctggacctcact

SEQ ID NO: 452009 - DNA, 20 bp, Artificial
  CRISPR gRNA sequence
ttgtgtttaaaactacctca

SEQ ID NO: 452010 - DNA, 20 bp, Artificial
  CRISPR gRNA sequence
tgtgtttaaaactacctcat

SEQ ID NO: 452011 - DNA, 20 bp, Artificial
  CRISPR gRNA sequence
aaaactacctcataggaatg

SEQ ID NO: 452012 - DNA, 20 bp, Artificial
  CRISPR gRNA sequence
acctcataggaatgtggtga

SEQ ID NO: 452013 - DNA, 20 bp, Artificial
  CRISPR gRNA sequence
cataggaatgtggtgacggt

SEQ ID NO: 452014 - DNA, 20 bp, Artificial
  CRISPR gRNA sequence
tgacggttagatgacacata

SEQ ID NO: 452015 - DNA, 20 bp, Artificial
  CRISPR gRNA sequence
gatgacacataaagctttgc

SEQ ID NO: 452016 - DNA, 20 bp, Artificial
  CRISPR gRNA sequence
tgacacataaagctttgcca

SEQ ID NO: 452017 - DNA, 20 bp, Artificial
  CRISPR gRNA sequence
gacacataaagctttgccag

SEQ ID NO: 452018 - DNA, 20 bp, Artificial
  CRISPR gRNA sequence
aagctttgccagaggttttc

SEQ ID NO: 452019 - DNA, 20 bp, Artificial
  CRISPR gRNA sequence
agctttgccagaggttttct

SEQ ID NO: 452020 - DNA, 20 bp, Artificial
  CRISPR gRNA sequence
gctttgccagaggttttctg

SEQ ID NO: 452021 - DNA, 20 bp, Artificial
  CRISPR gRNA sequence
tttgccagaggttttctggg

SEQ ID NO: 452022 - DNA, 20 bp, Artificial
  CRISPR gRNA sequence
ttgccagaggttttctgggg

SEQ ID NO: 452023 - DNA, 20 bp, Artificial
  CRISPR gRNA sequence
tgccagaggttttctgggga

SEQ ID NO: 452024 - DNA, 20 bp, Artificial
  CRISPR gRNA sequence
cagaggttttctggggaggg

SEQ ID NO: 452025 - DNA, 20 bp, Artificial
  CRISPR gRNA sequence
agaggttttctggggagggt

SEQ ID NO: 452026 - DNA, 20 bp, Artificial
  CRISPR gRNA sequence
gaggttttctggggagggtg

SEQ ID NO: 452027 - DNA, 20 bp, Artificial
  CRISPR gRNA sequence
tttctggggagggtggggac

SEQ ID NO: 452028 - DNA, 20 bp, Artificial
  CRISPR gRNA sequence
tctggggagggtggggacaa

SEQ ID NO: 452029 - DNA, 20 bp, Artificial
  CRISPR gRNA sequence
ctggggagggtggggacaag

SEQ ID NO: 452030 - DNA, 20 bp, Artificial
  CRISPR gRNA sequence
tggggagggtggggacaaga

SEQ ID NO: 452031 - DNA, 20 bp, Artificial
  CRISPR gRNA sequence
gagggtggggacaagagggc

SEQ ID NO: 452032 - DNA, 20 bp, Artificial
  CRISPR gRNA sequence
agggtggggacaagagggca

SEQ ID NO: 452033 - DNA, 20 bp, Artificial
  CRISPR gRNA sequence
gtggggacaagagggcaagg

SEQ ID NO: 452034 - DNA, 20 bp, Artificial
  CRISPR gRNA sequence
ggggacaagagggcaaggaa

SEQ ID NO: 452035 - DNA, 20 bp, Artificial
  CRISPR gRNA sequence
gtctccatttcctctgccac

SEQ ID NO: 452036 - DNA, 20 bp, Artificial
  CRISPR gRNA sequence
ctccatttcctctgccaccg

SEQ ID NO: 452037 - DNA, 20 bp, Artificial
  CRISPR gRNA sequence
tttcctctgccaccggagcc

SEQ ID NO: 452038 - DNA, 20 bp, Artificial
  CRISPR gRNA sequence
ggagcccggatctaacctct

SEQ ID NO: 452039 - DNA, 20 bp, Artificial
  CRISPR gRNA sequence
agcccggatctaacctctca

SEQ ID NO: 452040 - DNA, 20 bp, Artificial
  CRISPR gRNA sequence
gcccggatctaacctctcag

SEQ ID NO: 452041 - DNA, 20 bp, Artificial
  CRISPR gRNA sequence
ccggatctaacctctcagag

SEQ ID NO: 452042 - DNA, 20 bp, Artificial
  CRISPR gRNA sequence
atctaacctctcagaggagc

SEQ ID NO: 452043 - DNA, 20 bp, Artificial
  CRISPR gRNA sequence
taacctctcagaggagctgg

SEQ ID NO: 452044 - DNA, 20 bp, Artificial
  CRISPR gRNA sequence
aacctctcagaggagctgga

SEQ ID NO: 452045 - DNA, 20 bp, Artificial
  CRISPR gRNA sequence
tctcagaggagctggaaggt

SEQ ID NO: 452046 - DNA, 20 bp, Artificial
  CRISPR gRNA sequence
ggagctggaaggtcagctct

SEQ ID NO: 452047 - DNA, 20 bp, Artificial
  CRISPR gRNA sequence
tccacaaatacctctgtata

SEQ ID NO: 452048 - DNA, 20 bp, Artificial
  CRISPR gRNA sequence
gatctcccacgacactgaaa

SEQ ID NO: 452049 - DNA, 20 bp, Artificial
  CRISPR gRNA sequence
acgacactgaaaaagatgcc

SEQ ID NO: 452050 - DNA, 20 bp, Artificial
  CRISPR gRNA sequence
cactgaaaaagatgcccaga

SEQ ID NO: 452051 - DNA, 20 bp, Artificial
  CRISPR gRNA sequence
gcccagaaagatctcatttg

SEQ ID NO: 452052 - DNA, 20 bp, Artificial
  CRISPR gRNA sequence
agatctcatttgcagctgtg

SEQ ID NO: 452053 - DNA, 20 bp, Artificial
  CRISPR gRNA sequence
gatctcatttgcagctgtga

SEQ ID NO: 452054 - DNA, 20 bp, Artificial
  CRISPR gRNA sequence
atctcatttgcagctgtgaa

SEQ ID NO: 452055 - DNA, 20 bp, Artificial
  CRISPR gRNA sequence
tctcatttgcagctgtgaag

SEQ ID NO: 452056 - DNA, 20 bp, Artificial
  CRISPR gRNA sequence
ccacaaccccaactgcctta

SEQ ID NO: 452057 - DNA, 20 bp, Artificial
  CRISPR gRNA sequence
caaccccaactgccttaaag

SEQ ID NO: 452058 - DNA, 20 bp, Artificial
  CRISPR gRNA sequence
caactgccttaaagtagaac

SEQ ID NO: 452059 - DNA, 20 bp, Artificial
  CRISPR gRNA sequence
taaagtagaaccagacttgt

SEQ ID NO: 452060 - DNA, 20 bp, Artificial
  CRISPR gRNA sequence
agtagaaccagacttgttag

SEQ ID NO: 452061 - DNA, 20 bp, Artificial
  CRISPR gRNA sequence
gaaccagacttgttagtaga

SEQ ID NO: 452062 - DNA, 20 bp, Artificial
  CRISPR gRNA sequence
accagacttgttagtagaca

SEQ ID NO: 452063 - DNA, 20 bp, Artificial
  CRISPR gRNA sequence
ccagacttgttagtagacag

SEQ ID NO: 452064 - DNA, 20 bp, Artificial
  CRISPR gRNA sequence
cttgttagtagacagaggtt

SEQ ID NO: 452065 - DNA, 20 bp, Artificial
  CRISPR gRNA sequence
ttgttagtagacagaggttt

SEQ ID NO: 452066 - DNA, 20 bp, Artificial
  CRISPR gRNA sequence
tagtagacagaggtttgggc

SEQ ID NO: 452067 - DNA, 20 bp, Artificial
  CRISPR gRNA sequence
agtagacagaggtttgggct

SEQ ID NO: 452068 - DNA, 20 bp, Artificial
  CRISPR gRNA sequence
gtagacagaggtttgggctg

SEQ ID NO: 452069 - DNA, 20 bp, Artificial
  CRISPR gRNA sequence
tagacagaggtttgggctgg

SEQ ID NO: 452070 - DNA, 20 bp, Artificial
  CRISPR gRNA sequence
agacagaggtttgggctggg

SEQ ID NO: 452071 - DNA, 20 bp, Artificial
  CRISPR gRNA sequence
tttgggctggggggcccttg

SEQ ID NO: 452072 - DNA, 20 bp, Artificial
  CRISPR gRNA sequence
ggcccttgaagctcttgtct

SEQ ID NO: 452073 - DNA, 20 bp, Artificial
  CRISPR gRNA sequence
gaagctcttgtctgagatct

SEQ ID NO: 452074 - DNA, 20 bp, Artificial
  CRISPR gRNA sequence
aagctcttgtctgagatctc

SEQ ID NO: 452075 - DNA, 20 bp, Artificial
  CRISPR gRNA sequence
gcttcctgctcaacacacca

SEQ ID NO: 452076 - DNA, 20 bp, Artificial
  CRISPR gRNA sequence
tcctgctcaacacaccaaag

SEQ ID NO: 452077 - DNA, 20 bp, Artificial
  CRISPR gRNA sequence
cctgctcaacacaccaaagc

SEQ ID NO: 452078 - DNA, 20 bp, Artificial
  CRISPR gRNA sequence
caaagcaggtgcctgacata

SEQ ID NO: 452079 - DNA, 20 bp, Artificial
  CRISPR gRNA sequence
aaagcaggtgcctgacataa

SEQ ID NO: 452080 - DNA, 20 bp, Artificial
  CRISPR gRNA sequence
tgcctgacataaaggcgcca

SEQ ID NO: 452081 - DNA, 20 bp, Artificial
  CRISPR gRNA sequence
aaaggcgccatggacctctt

SEQ ID NO: 452082 - DNA, 20 bp, Artificial
  CRISPR gRNA sequence
ggcgccatggacctctttgg

SEQ ID NO: 452083 - DNA, 20 bp, Artificial
  CRISPR gRNA sequence
catggacctctttggtggtc

SEQ ID NO: 452084 - DNA, 20 bp, Artificial
  CRISPR gRNA sequence
atggacctctttggtggtct

SEQ ID NO: 452085 - DNA, 20 bp, Artificial
  CRISPR gRNA sequence
gacctctttggtggtctggg

SEQ ID NO: 452086 - DNA, 20 bp, Artificial
  CRISPR gRNA sequence
acctctttggtggtctggga

SEQ ID NO: 452087 - DNA, 20 bp, Artificial
  CRISPR gRNA sequence
tggtggtctgggaaggcata

SEQ ID NO: 452088 - DNA, 20 bp, Artificial
  CRISPR gRNA sequence
gtggtctgggaaggcatatg

SEQ ID NO: 452089 - DNA, 20 bp, Artificial
  CRISPR gRNA sequence
aggcatatggagtcccttct

SEQ ID NO: 452090 - DNA, 20 bp, Artificial
  CRISPR gRNA sequence
aacaacatttaaaaattaat

SEQ ID NO: 452091 - DNA, 20 bp, Artificial
  CRISPR gRNA sequence
ttaaaaattaataagataca

SEQ ID NO: 452092 - DNA, 20 bp, Artificial
  CRISPR gRNA sequence
taaaaattaataagatacat

SEQ ID NO: 452093 - DNA, 20 bp, Artificial
  CRISPR gRNA sequence
ataagatacatgggataata

SEQ ID NO: 452094 - DNA, 20 bp, Artificial
  CRISPR gRNA sequence
taagatacatgggataataa

SEQ ID NO: 452095 - DNA, 20 bp, Artificial
  CRISPR gRNA sequence
aagatacatgggataataaa

SEQ ID NO: 452096 - DNA, 20 bp, Artificial
  CRISPR gRNA sequence
taaagggaacaaattatgac

SEQ ID NO: 452097 - DNA, 20 bp, Artificial
  CRISPR gRNA sequence
gggaacaaattatgacaaga

SEQ ID NO: 452098 - DNA, 20 bp, Artificial
  CRISPR gRNA sequence
caagacagttgtcaaaacat

SEQ ID NO: 452099 - DNA, 20 bp, Artificial
  CRISPR gRNA sequence
gacagttgtcaaaacattag

SEQ ID NO: 452100 - DNA, 20 bp, Artificial
  CRISPR gRNA sequence
caaaacattagaagaatgtg

SEQ ID NO: 452101 - DNA, 20 bp, Artificial
  CRISPR gRNA sequence
aacattagaagaatgtgtgg

SEQ ID NO: 452102 - DNA, 20 bp, Artificial
  CRISPR gRNA sequence
cattagaagaatgtgtggta

SEQ ID NO: 452103 - DNA, 20 bp, Artificial
  CRISPR gRNA sequence
tagaagaatgtgtggtagag

SEQ ID NO: 452104 - DNA, 20 bp, Artificial
  CRISPR gRNA sequence
gagcagtacacatgcttctt

SEQ ID NO: 452105 - DNA, 20 bp, Artificial
  CRISPR gRNA sequence
tgcttctttagatttgacat

SEQ ID NO: 452106 - DNA, 20 bp, Artificial
  CRISPR gRNA sequence
taataactgttgtaattctg

SEQ ID NO: 452107 - DNA, 20 bp, Artificial
  CRISPR gRNA sequence
taactgttgtaattctgtag

SEQ ID NO: 452108 - DNA, 20 bp, Artificial
  CRISPR gRNA sequence
tgtaattctgtagtagtgct

SEQ ID NO: 452109 - DNA, 20 bp, Artificial
  CRISPR gRNA sequence
ctgtagtagtgctgagcgtt

SEQ ID NO: 452110 - DNA, 20 bp, Artificial
  CRISPR gRNA sequence
tgtagtagtgctgagcgtta

SEQ ID NO: 452111 - DNA, 20 bp, Artificial
  CRISPR gRNA sequence
tgctgagcgttaaggacatt

SEQ ID NO: 452112 - DNA, 20 bp, Artificial
  CRISPR gRNA sequence
ctgagcgttaaggacatttg

SEQ ID NO: 452113 - DNA, 20 bp, Artificial
  CRISPR gRNA sequence
aaatctataaaaactgtaat

SEQ ID NO: 452114 - DNA, 20 bp, Artificial
  CRISPR gRNA sequence
atatttgtgttttctattga

SEQ ID NO: 452115 - DNA, 20 bp, Artificial
  CRISPR gRNA sequence
attgatggcaaattctattg

SEQ ID NO: 452116 - DNA, 20 bp, Artificial
  CRISPR gRNA sequence
attgtctacattcataactg

SEQ ID NO: 452117 - DNA, 20 bp, Artificial
  CRISPR gRNA sequence
tctacattcataactgaagc

SEQ ID NO: 452118 - DNA, 20 bp, Artificial
  CRISPR gRNA sequence
caagtgctgactttcaatta

SEQ ID NO: 452119 - DNA, 20 bp, Artificial
  CRISPR gRNA sequence
gctgactttcaattaaagat

SEQ ID NO: 452120 - DNA, 20 bp, Artificial
  CRISPR gRNA sequence
attaaagattagtgaaaata

SEQ ID NO: 452121 - DNA, 20 bp, Artificial
  CRISPR gRNA sequence
cccatgaataaatctattca

SEQ ID NO: 452122 - DNA, 20 bp, Artificial
  CRISPR gRNA sequence
aaatctattcacggacctcc

SEQ ID NO: 452123 - DNA, 20 bp, Artificial
  CRISPR gRNA sequence
atctattcacggacctccaa

SEQ ID NO: 452124 - DNA, 20 bp, Artificial
  CRISPR gRNA sequence
tctattcacggacctccaag

SEQ ID NO: 452125 - DNA, 20 bp, Artificial
  CRISPR gRNA sequence
ggtccatgacgtgaaccacc

SEQ ID NO: 452126 - DNA, 20 bp, Artificial
  CRISPR gRNA sequence
gtccatgacgtgaaccacct

SEQ ID NO: 452127 - DNA, 20 bp, Artificial
  CRISPR gRNA sequence
cctaggacatgaacttcccc

SEQ ID NO: 452128 - DNA, 20 bp, Artificial
  CRISPR gRNA sequence
taggacatgaacttcccccg

SEQ ID NO: 452129 - DNA, 20 bp, Artificial
  CRISPR gRNA sequence
aggacatgaacttcccccgg

SEQ ID NO: 452130 - DNA, 20 bp, Artificial
  CRISPR gRNA sequence
cttcccccggaggtgcctca

SEQ ID NO: 452131 - DNA, 20 bp, Artificial
  CRISPR gRNA sequence
ttcccccggaggtgcctcac

SEQ ID NO: 452132 - DNA, 20 bp, Artificial
  CRISPR gRNA sequence
tcccccggaggtgcctcaca

SEQ ID NO: 452133 - DNA, 20 bp, Artificial
  CRISPR gRNA sequence
ccggaggtgcctcacagggc

SEQ ID NO: 452134 - DNA, 20 bp, Artificial
  CRISPR gRNA sequence
tgcctcacagggccagctcc

SEQ ID NO: 452135 - DNA, 20 bp, Artificial
  CRISPR gRNA sequence
agggccagctccaagccccg

SEQ ID NO: 452136 - DNA, 20 bp, Artificial
  CRISPR gRNA sequence
ccaagccccgtggcacctcc

SEQ ID NO: 452137 - DNA, 20 bp, Artificial
  CRISPR gRNA sequence
tggcacctcccggcttgtct

SEQ ID NO: 452138 - DNA, 20 bp, Artificial
  CRISPR gRNA sequence
ggcacctcccggcttgtctc

SEQ ID NO: 452139 - DNA, 20 bp, Artificial
  CRISPR gRNA sequence
ttgtctcaggccaatccttg

SEQ ID NO: 452140 - DNA, 20 bp, Artificial
  CRISPR gRNA sequence
gtctcaggccaatccttgaa

SEQ ID NO: 452141 - DNA, 20 bp, Artificial
  CRISPR gRNA sequence
ggccaatccttgaagagctc

SEQ ID NO: 452142 - DNA, 20 bp, Artificial
  CRISPR gRNA sequence
caatccttgaagagctccag

SEQ ID NO: 452143 - DNA, 20 bp, Artificial
  CRISPR gRNA sequence
gctccagcagatctaaactt

SEQ ID NO: 452144 - DNA, 20 bp, Artificial
  CRISPR gRNA sequence
aaactttggtaactttcctc

SEQ ID NO: 452145 - DNA, 20 bp, Artificial
  CRISPR gRNA sequence
taactttcctctggtaattt

SEQ ID NO: 452146 - DNA, 20 bp, Artificial
  CRISPR gRNA sequence
aactttcctctggtaatttg

SEQ ID NO: 452147 - DNA, 20 bp, Artificial
  CRISPR gRNA sequence
tttgaggaattcctccattt

SEQ ID NO: 452148 - DNA, 20 bp, Artificial
  CRISPR gRNA sequence
ttgaggaattcctccatttg

SEQ ID NO: 452149 - DNA, 20 bp, Artificial
  CRISPR gRNA sequence
ttcctccatttgaggaatgt

SEQ ID NO: 452150 - DNA, 20 bp, Artificial
  CRISPR gRNA sequence
ccatttgaggaatgtcagaa

SEQ ID NO: 452151 - DNA, 20 bp, Artificial
  CRISPR gRNA sequence
catttgaggaatgtcagaat

SEQ ID NO: 452152 - DNA, 20 bp, Artificial
  CRISPR gRNA sequence
atttgaggaatgtcagaatg

SEQ ID NO: 452153 - DNA, 20 bp, Artificial
  CRISPR gRNA sequence
gaggaatgtcagaatggggc

SEQ ID NO: 452154 - DNA, 20 bp, Artificial
  CRISPR gRNA sequence
aggaatgtcagaatggggcc

SEQ ID NO: 452155 - DNA, 20 bp, Artificial
  CRISPR gRNA sequence
ccaggattcctgaatgccca

SEQ ID NO: 452156 - DNA, 20 bp, Artificial
  CRISPR gRNA sequence
ggattcctgaatgcccatgg

SEQ ID NO: 452157 - DNA, 20 bp, Artificial
  CRISPR gRNA sequence
cctgaatgcccatggaagaa

SEQ ID NO: 452158 - DNA, 20 bp, Artificial
  CRISPR gRNA sequence
aatgcccatggaagaaaagc

SEQ ID NO: 452159 - DNA, 20 bp, Artificial
  CRISPR gRNA sequence
tggaagaaaagcgagcatgc

SEQ ID NO: 452160 - DNA, 20 bp, Artificial
  CRISPR gRNA sequence
gaaaagcgagcatgctggtc

SEQ ID NO: 452161 - DNA, 20 bp, Artificial
  CRISPR gRNA sequence
aagcgagcatgctggtctgg

SEQ ID NO: 452162 - DNA, 20 bp, Artificial
  CRISPR gRNA sequence
agcgagcatgctggtctggc

SEQ ID NO: 452163 - DNA, 20 bp, Artificial
  CRISPR gRNA sequence
gagcatgctggtctggcggg

SEQ ID NO: 452164 - DNA, 20 bp, Artificial
  CRISPR gRNA sequence
ggcagaaataaccttctccc

SEQ ID NO: 452165 - DNA, 20 bp, Artificial
  CRISPR gRNA sequence
gcagaaataaccttctcccc

SEQ ID NO: 452166 - DNA, 20 bp, Artificial
  CRISPR gRNA sequence
ataaccttctccccaggctc

SEQ ID NO: 452167 - DNA, 20 bp, Artificial
  CRISPR gRNA sequence
aaccttctccccaggctcca

SEQ ID NO: 452168 - DNA, 20 bp, Artificial
  CRISPR gRNA sequence
accttctccccaggctccag

SEQ ID NO: 452169 - DNA, 20 bp, Artificial
  CRISPR gRNA sequence
ccttctccccaggctccaga

SEQ ID NO: 452170 - DNA, 20 bp, Artificial
  CRISPR gRNA sequence
tctccccaggctccagaggg

SEQ ID NO: 452171 - DNA, 20 bp, Artificial
  CRISPR gRNA sequence
tccccaggctccagagggca

SEQ ID NO: 452172 - DNA, 20 bp, Artificial
  CRISPR gRNA sequence
ccccaggctccagagggcag

SEQ ID NO: 452173 - DNA, 20 bp, Artificial
  CRISPR gRNA sequence
cagaggacatttccctccaa

SEQ ID NO: 452174 - DNA, 20 bp, Artificial
  CRISPR gRNA sequence
agaggacatttccctccaaa

SEQ ID NO: 452175 - DNA, 20 bp, Artificial
  CRISPR gRNA sequence
gacatttccctccaaaaggc

SEQ ID NO: 452176 - DNA, 20 bp, Artificial
  CRISPR gRNA sequence
cctccaaaaggcaagtttct

SEQ ID NO: 452177 - DNA, 20 bp, Artificial
  CRISPR gRNA sequence
ctccaaaaggcaagtttctc

SEQ ID NO: 452178 - DNA, 20 bp, Artificial
  CRISPR gRNA sequence
tccaaaaggcaagtttctca

SEQ ID NO: 452179 - DNA, 20 bp, Artificial
  CRISPR gRNA sequence
aagtttctcagggacctcat

SEQ ID NO: 452180 - DNA, 20 bp, Artificial
  CRISPR gRNA sequence
tttctcagggacctcatgag

SEQ ID NO: 452181 - DNA, 20 bp, Artificial
  CRISPR gRNA sequence
tgagaagcctgtcctcacct

SEQ ID NO: 452182 - DNA, 20 bp, Artificial
  CRISPR gRNA sequence
gaagcctgtcctcacctgag

SEQ ID NO: 452183 - DNA, 20 bp, Artificial
  CRISPR gRNA sequence
aaccatcccatcccttcacc

SEQ ID NO: 452184 - DNA, 20 bp, Artificial
  CRISPR gRNA sequence
ccatcccttcacctggaccc

SEQ ID NO: 452185 - DNA, 20 bp, Artificial
  CRISPR gRNA sequence
catcccttcacctggacccc

SEQ ID NO: 452186 - DNA, 20 bp, Artificial
  CRISPR gRNA sequence
tcacctggaccccaggtccc

SEQ ID NO: 452187 - DNA, 20 bp, Artificial
  CRISPR gRNA sequence
cctggaccccaggtccccag

SEQ ID NO: 452188 - DNA, 20 bp, Artificial
  CRISPR gRNA sequence
ctggaccccaggtccccagc

SEQ ID NO: 452189 - DNA, 20 bp, Artificial
  CRISPR gRNA sequence
ccagcaggcctttttacctc

SEQ ID NO: 452190 - DNA, 20 bp, Artificial
  CRISPR gRNA sequence
caggcctttttacctcgaga

SEQ ID NO: 452191 - DNA, 20 bp, Artificial
  CRISPR gRNA sequence
gcctttttacctcgagacag

SEQ ID NO: 452192 - DNA, 20 bp, Artificial
  CRISPR gRNA sequence
aagttcttctttcttgttct

SEQ ID NO: 452193 - DNA, 20 bp, Artificial
  CRISPR gRNA sequence
cttctttcttgttctcagac

SEQ ID NO: 452194 - DNA, 20 bp, Artificial
  CRISPR gRNA sequence
ttctttcttgttctcagact

SEQ ID NO: 452195 - DNA, 20 bp, Artificial
  CRISPR gRNA sequence
tctttcttgttctcagactg

SEQ ID NO: 452196 - DNA, 20 bp, Artificial
  CRISPR gRNA sequence
ctttcttgttctcagactgg

SEQ ID NO: 452197 - DNA, 20 bp, Artificial
  CRISPR gRNA sequence
actgggggctcacgttgaaa

SEQ ID NO: 452198 - DNA, 20 bp, Artificial
  CRISPR gRNA sequence
gctcacgttgaaatggctct

SEQ ID NO: 452199 - DNA, 20 bp, Artificial
  CRISPR gRNA sequence
ttgaaatggctctcagtcct

SEQ ID NO: 452200 - DNA, 20 bp, Artificial
  CRISPR gRNA sequence
ttgttaaaaccctatctctc

SEQ ID NO: 452201 - DNA, 20 bp, Artificial
  CRISPR gRNA sequence
cgtcattgctcacactttca

SEQ ID NO: 452202 - DNA, 20 bp, Artificial
  CRISPR gRNA sequence
tattcgctctttgaaaacca

SEQ ID NO: 452203 - DNA, 20 bp, Artificial
  CRISPR gRNA sequence
gctctttgaaaaccacagaa

SEQ ID NO: 452204 - DNA, 20 bp, Artificial
  CRISPR gRNA sequence
ctctttgaaaaccacagaat

SEQ ID NO: 452205 - DNA, 20 bp, Artificial
  CRISPR gRNA sequence
aaaaccacagaatgggttgt

SEQ ID NO: 452206 - DNA, 20 bp, Artificial
  CRISPR gRNA sequence
accacagaatgggttgttag

SEQ ID NO: 452207 - DNA, 20 bp, Artificial
  CRISPR gRNA sequence
gaatgggttgttagaagtca

SEQ ID NO: 452208 - DNA, 20 bp, Artificial
  CRISPR gRNA sequence
atcttccgccacccccactg

SEQ ID NO: 452209 - DNA, 20 bp, Artificial
  CRISPR gRNA sequence
aggagaaaaaaatccacagt

SEQ ID NO: 452210 - DNA, 20 bp, Artificial
  CRISPR gRNA sequence
cattctgtggttttcaaaga

SEQ ID NO: 452211 - DNA, 20 bp, Artificial
  CRISPR gRNA sequence
caatgacgaaactggagaga

SEQ ID NO: 452212 - DNA, 20 bp, Artificial
  CRISPR gRNA sequence
aaaaaggcctgctggggacc

SEQ ID NO: 452213 - DNA, 20 bp, Artificial
  CRISPR gRNA sequence
gggacctggggtccaggtga

SEQ ID NO: 452214 - DNA, 20 bp, Artificial
  CRISPR gRNA sequence
ctggggtccaggtgaaggga

SEQ ID NO: 452215 - DNA, 20 bp, Artificial
  CRISPR gRNA sequence
cttttcttccatgggcattc

SEQ ID NO: 452216 - DNA, 20 bp, Artificial
  CRISPR gRNA sequence
ttctgacattcctcaaatgg

SEQ ID NO: 452217 - DNA, 20 bp, Artificial
  CRISPR gRNA sequence
tagatctgctggagctcttc

SEQ ID NO: 452218 - DNA, 20 bp, Artificial
  CRISPR gRNA sequence
catggacctcttggaggtcc

SEQ ID NO: 452219 - DNA, 20 bp, Artificial
  CRISPR gRNA sequence
tccgtgaatagatttattca

SEQ ID NO: 452220 - DNA, 20 bp, Artificial
  CRISPR gRNA sequence
tagatttattcatgggattt

SEQ ID NO: 452221 - DNA, 20 bp, Artificial
  CRISPR gRNA sequence
agtcagcacttgcttcagtt

SEQ ID NO: 452222 - DNA, 20 bp, Artificial
  CRISPR gRNA sequence
atgtagacaatgaaccacaa

SEQ ID NO: 452223 - DNA, 20 bp, Artificial
  CRISPR gRNA sequence
cttaacgctcagcactacta

SEQ ID NO: 452224 - DNA, 20 bp, Artificial
  CRISPR gRNA sequence
tggttctactttaaggcagt

SEQ ID NO: 452225 - DNA, 20 bp, Artificial
  CRISPR gRNA sequence
gaggtagttttaaacacaag

SEQ ID NO: 452226 - DNA, 20 bp, Artificial
  CRISPR gRNA sequence
aacacaagaggaatgtgagg

SEQ ID NO: 452227 - DNA, 20 bp, Artificial
  CRISPR gRNA sequence
atgtgctggtcacacaaagc

SEQ ID NO: 452228 - DNA, 20 bp, Artificial
  CRISPR gRNA sequence
caaagcttggatttgaaccc

SEQ ID NO: 452229 - DNA, 20 bp, Artificial
  CRISPR gRNA sequence
cctccgaaggtgcgggaggg

SEQ ID NO: 452230 - DNA, 20 bp, Artificial
  CRISPR gRNA sequence
ccccggggaccatcaaagat

SEQ ID NO: 452231 - DNA, 20 bp, Artificial
  CRISPR gRNA sequence
ctggctagcccccatgctcg

SEQ ID NO: 452232 - DNA, 20 bp, Artificial
  CRISPR gRNA sequence
ctcgctggatggcccatggc

SEQ ID NO: 452233 - DNA, 20 bp, Artificial
  CRISPR gRNA sequence
gggccaacgcggggcaggta

SEQ ID NO: 452234 - DNA, 20 bp, Artificial
  CRISPR gRNA sequence
aggcagcgccctctagcggc

SEQ ID NO: 452235 - DNA, 20 bp, Artificial
  CRISPR gRNA sequence
ctgccccgcctgcatcacaa

SEQ ID NO: 452236 - DNA, 20 bp, Artificial
  CRISPR gRNA sequence
gcgaagtctggccactccag

SEQ ID NO: 452237 - DNA, 20 bp, Artificial
  CRISPR gRNA sequence
gcctttccacatccctcatc

SEQ ID NO: 452238 - DNA, 20 bp, Artificial
  CRISPR gRNA sequence
tcttgtgttaacagctgttc

SEQ ID NO: 452239 - DNA, 20 bp, Artificial
  CRISPR gRNA sequence
gtgttaacagctgttcgtga

SEQ ID NO: 452240 - DNA, 20 bp, Artificial
  CRISPR gRNA sequence
aagagaaagactctcataac

SEQ ID NO: 452241 - DNA, 20 bp, Artificial
  CRISPR gRNA sequence
aagactctcataacttgggt

SEQ ID NO: 452242 - DNA, 20 bp, Artificial
  CRISPR gRNA sequence
gaccctcacaacccaaggaa

SEQ ID NO: 452243 - DNA, 20 bp, Artificial
  CRISPR gRNA sequence
caggagcctaagaaacttga

SEQ ID NO: 452244 - DNA, 20 bp, Artificial
  CRISPR gRNA sequence
ttatttttgttttttcgaga

SEQ ID NO: 452245 - DNA, 20 bp, Artificial
  CRISPR gRNA sequence
tcttgctctgtcgcccaggc

SEQ ID NO: 452246 - DNA, 20 bp, Artificial
  CRISPR gRNA sequence
cattctcctgcctcagcctc

SEQ ID NO: 452247 - DNA, 20 bp, Artificial
  CRISPR gRNA sequence
tgtattttttttagtagaga

SEQ ID NO: 452248 - DNA, 20 bp, Artificial
  CRISPR gRNA sequence
tggggtttcaccgtgttagc

SEQ ID NO: 452249 - DNA, 20 bp, Artificial
  CRISPR gRNA sequence
acctcggcctcccaaagtgc

SEQ ID NO: 452250 - DNA, 20 bp, Artificial
  CRISPR gRNA sequence
ccactattaagttttaggac

SEQ ID NO: 452251 - DNA, 20 bp, Artificial
  CRISPR gRNA sequence
gaacacaaacactctggctc

SEQ ID NO: 452252 - DNA, 20 bp, Artificial
  CRISPR gRNA sequence
tttttaaccataattctggg

SEQ ID NO: 452253 - DNA, 20 bp, Artificial
  CRISPR gRNA sequence
taaccataattctgggctga

SEQ ID NO: 452254 - DNA, 20 bp, Artificial
  CRISPR gRNA sequence
atccttctttgtcttcctct

SEQ ID NO: 452255 - DNA, 20 bp, Artificial
  CRISPR gRNA sequence
cacttaatattccatgtttc

SEQ ID NO: 452256 - DNA, 20 bp, Artificial
  CRISPR gRNA sequence
gccataccatgagctgctgc

SEQ ID NO: 452257 - DNA, 20 bp, Artificial
  CRISPR gRNA sequence
ctgctgctgggatgttttat

SEQ ID NO: 452258 - DNA, 20 bp, Artificial
  CRISPR gRNA sequence
aaatgtatagataagtacag

SEQ ID NO: 452259 - DNA, 20 bp, Artificial
  CRISPR gRNA sequence
tgtatcctataggtcctatt

SEQ ID NO: 452260 - DNA, 20 bp, Artificial
  CRISPR gRNA sequence
tacatttttctggacatttg

SEQ ID NO: 452261 - DNA, 20 bp, Artificial
  CRISPR gRNA sequence
tgggttttttggttgctata

SEQ ID NO: 452262 - DNA, 20 bp, Artificial
  CRISPR gRNA sequence
attacataacattctattct

SEQ ID NO: 452263 - DNA, 20 bp, Artificial
  CRISPR gRNA sequence
ttattcaaccattctcacca

SEQ ID NO: 452264 - DNA, 20 bp, Artificial
  CRISPR gRNA sequence
ttttgctctgttgcccaggc

SEQ ID NO: 452265 - DNA, 20 bp, Artificial
  CRISPR gRNA sequence
aattatcctgcctcagcctc

SEQ ID NO: 452266 - DNA, 20 bp, Artificial
  CRISPR gRNA sequence
gcctcagcctcctgagtagg

SEQ ID NO: 452267 - DNA, 20 bp, Artificial
  CRISPR gRNA sequence
ttttgcatttttagtagagc

SEQ ID NO: 452268 - DNA, 20 bp, Artificial
  CRISPR gRNA sequence
ccgcacgcctcccaaagtgc

SEQ ID NO: 452269 - DNA, 20 bp, Artificial
  CRISPR gRNA sequence
gtattataaaaaatgctgca

SEQ ID NO: 452270 - DNA, 20 bp, Artificial
  CRISPR gRNA sequence
gtaagctatagccaaaggga

SEQ ID NO: 452271 - DNA, 20 bp, Artificial
  CRISPR gRNA sequence
atttgaaatgttaatatata

SEQ ID NO: 452272 - DNA, 20 bp, Artificial
  CRISPR gRNA sequence
taacaatgtatagttctacc

SEQ ID NO: 452273 - DNA, 20 bp, Artificial
  CRISPR gRNA sequence
aatgtatagttctacctaga

SEQ ID NO: 452274 - DNA, 20 bp, Artificial
  CRISPR gRNA sequence
taattctgaaattctgaact

SEQ ID NO: 452275 - DNA, 20 bp, Artificial
  CRISPR gRNA sequence
aatttttaatttgtacttcc

SEQ ID NO: 452276 - DNA, 20 bp, Artificial
  CRISPR gRNA sequence
ataattctcaattaagtttc

SEQ ID NO: 452277 - DNA, 20 bp, Artificial
  CRISPR gRNA sequence
atatacatttctccattata

SEQ ID NO: 452278 - DNA, 20 bp, Artificial
  CRISPR gRNA sequence
tcatccattaccattttact

SEQ ID NO: 452279 - DNA, 20 bp, Artificial
  CRISPR gRNA sequence
attttacttaggattttagt

SEQ ID NO: 452280 - DNA, 20 bp, Artificial
  CRISPR gRNA sequence
ttcctaatattaaatcatcc

SEQ ID NO: 452281 - DNA, 20 bp, Artificial
  CRISPR gRNA sequence
tgattttggttttcttgaga

SEQ ID NO: 452282 - DNA, 20 bp, Artificial
  CRISPR gRNA sequence
ggtctcactgtcaaccaggc

SEQ ID NO: 452283 - DNA, 20 bp, Artificial
  CRISPR gRNA sequence
gctcctcccacctaagtctc

SEQ ID NO: 452284 - DNA, 20 bp, Artificial
  CRISPR gRNA sequence
acctcggcctcccaaaggct

SEQ ID NO: 452285 - DNA, 20 bp, Artificial
  CRISPR gRNA sequence
ttaaatataatattataaaa

SEQ ID NO: 452286 - DNA, 20 bp, Artificial
  CRISPR gRNA sequence
agaatacagcagcacatgaa

SEQ ID NO: 452287 - DNA, 20 bp, Artificial
  CRISPR gRNA sequence
cagcactttgggaggccaag

SEQ ID NO: 452288 - DNA, 20 bp, Artificial
  CRISPR gRNA sequence
actttgggaggccaaggtgg

SEQ ID NO: 452289 - DNA, 20 bp, Artificial
  CRISPR gRNA sequence
ggtgggtggatcacaaggtt

SEQ ID NO: 452290 - DNA, 20 bp, Artificial
  CRISPR gRNA sequence
tactcggcaggctgaggcag

SEQ ID NO: 452291 - DNA, 20 bp, Artificial
  CRISPR gRNA sequence
ctgcactccagcctgggcga

SEQ ID NO: 452292 - DNA, 20 bp, Artificial
  CRISPR gRNA sequence
tgcataactggaaaatccaa

SEQ ID NO: 452293 - DNA, 20 bp, Artificial
  CRISPR gRNA sequence
gagaatcaactgaaaaatga

SEQ ID NO: 452294 - DNA, 20 bp, Artificial
  CRISPR gRNA sequence
atagaattaagggaggggag

SEQ ID NO: 452295 - DNA, 20 bp, Artificial
  CRISPR gRNA sequence
atgaaaaattaaaagatata

SEQ ID NO: 452296 - DNA, 20 bp, Artificial
  CRISPR gRNA sequence
aaaataagttaaaagataca

SEQ ID NO: 452297 - DNA, 20 bp, Artificial
  CRISPR gRNA sequence
tggagaagatgtggagaaat

SEQ ID NO: 452298 - DNA, 20 bp, Artificial
  CRISPR gRNA sequence
aatgcttttacactgttgat

SEQ ID NO: 452299 - DNA, 20 bp, Artificial
  CRISPR gRNA sequence
accactgtggaagacagtgt

SEQ ID NO: 452300 - DNA, 20 bp, Artificial
  CRISPR gRNA sequence
agacagtgtggggattcctc

SEQ ID NO: 452301 - DNA, 20 bp, Artificial
  CRISPR gRNA sequence
cattactgggcatataccca

SEQ ID NO: 452302 - DNA, 20 bp, Artificial
  CRISPR gRNA sequence
aaatgtccatcaatgataga

SEQ ID NO: 452303 - DNA, 20 bp, Artificial
  CRISPR gRNA sequence
aatgtggcacatatacacca

SEQ ID NO: 452304 - DNA, 20 bp, Artificial
  CRISPR gRNA sequence
aatactatgcagccataaaa

SEQ ID NO: 452305 - DNA, 20 bp, Artificial
  CRISPR gRNA sequence
ctatgcagccataaaaaagg

SEQ ID NO: 452306 - DNA, 20 bp, Artificial
  CRISPR gRNA sequence
gcatgttctcgctcataagt

SEQ ID NO: 452307 - DNA, 20 bp, Artificial
  CRISPR gRNA sequence
acaatgagaacacatgaacc

SEQ ID NO: 452308 - DNA, 20 bp, Artificial
  CRISPR gRNA sequence
tcacacaccgatgacgttcc

SEQ ID NO: 452309 - DNA, 20 bp, Artificial
  CRISPR gRNA sequence
cacgggtgggggcccggggg

SEQ ID NO: 452310 - DNA, 20 bp, Artificial
  CRISPR gRNA sequence
ctaatgtaaatgacaagttg

SEQ ID NO: 452311 - DNA, 20 bp, Artificial
  CRISPR gRNA sequence
tatattaaaaaaaagatata

SEQ ID NO: 452312 - DNA, 20 bp, Artificial
  CRISPR gRNA sequence
attttcaatagtgaaaaaat

SEQ ID NO: 452313 - DNA, 20 bp, Artificial
  CRISPR gRNA sequence
gagacacacatatttgaaaa

SEQ ID NO: 452314 - DNA, 20 bp, Artificial
  CRISPR gRNA sequence
gaaaaatgaatatcacattc

SEQ ID NO: 452315 - DNA, 20 bp, Artificial
  CRISPR gRNA sequence
atatcacattctcggatcaa

SEQ ID NO: 452316 - DNA, 20 bp, Artificial
  CRISPR gRNA sequence
aaaattcttgttttcccctt

SEQ ID NO: 452317 - DNA, 20 bp, Artificial
  CRISPR gRNA sequence
ccttttgaattttaaatgct

SEQ ID NO: 452318 - DNA, 20 bp, Artificial
  CRISPR gRNA sequence
aaaacacatacacacataga

SEQ ID NO: 452319 - DNA, 20 bp, Artificial
  CRISPR gRNA sequence
cagtttgtttattttgaaac

SEQ ID NO: 452320 - DNA, 20 bp, Artificial
  CRISPR gRNA sequence
caggagtaatttttcttagc

SEQ ID NO: 452321 - DNA, 20 bp, Artificial
  CRISPR gRNA sequence
tttgcctaaaaaaatggcag

SEQ ID NO: 452322 - DNA, 20 bp, Artificial
  CRISPR gRNA sequence
cctaaaagttaagaaatgtg

SEQ ID NO: 452323 - DNA, 20 bp, Artificial
  CRISPR gRNA sequence
aacacacaattcacagacaa

SEQ ID NO: 452324 - DNA, 20 bp, Artificial
  CRISPR gRNA sequence
agccaatcaaagctagagcc

SEQ ID NO: 452325 - DNA, 20 bp, Artificial
  CRISPR gRNA sequence
accctggaaggctttgtcta

SEQ ID NO: 452326 - DNA, 20 bp, Artificial
  CRISPR gRNA sequence
gcttttaggagactgaagcc

SEQ ID NO: 452327 - DNA, 20 bp, Artificial
  CRISPR gRNA sequence
ctgggcctgctgacagcgtg

SEQ ID NO: 452328 - DNA, 20 bp, Artificial
  CRISPR gRNA sequence
tggacatccagtctggtggt

SEQ ID NO: 452329 - DNA, 20 bp, Artificial
  CRISPR gRNA sequence
agagcagagacggccatggg

SEQ ID NO: 452330 - DNA, 20 bp, Artificial
  CRISPR gRNA sequence
tcctgggcttgtgggaaggg

SEQ ID NO: 452331 - DNA, 20 bp, Artificial
  CRISPR gRNA sequence
ttttttttttttttttttga

SEQ ID NO: 452332 - DNA, 20 bp, Artificial
  CRISPR gRNA sequence
tctcgctctgtcacccaggc

SEQ ID NO: 452333 - DNA, 20 bp, Artificial
  CRISPR gRNA sequence
aattctgctggctcagcttc

SEQ ID NO: 452334 - DNA, 20 bp, Artificial
  CRISPR gRNA sequence
ttttgtatttttagtagaga

SEQ ID NO: 452335 - DNA, 20 bp, Artificial
  CRISPR gRNA sequence
actctccttgacattaagga

SEQ ID NO: 452336 - DNA, 20 bp, Artificial
  CRISPR gRNA sequence
ttgacattaaggaaagggta

SEQ ID NO: 452337 - DNA, 20 bp, Artificial
  CRISPR gRNA sequence
ttgtgtatttataaaatggg

SEQ ID NO: 452338 - DNA, 20 bp, Artificial
  CRISPR gRNA sequence
ctgccctctatggctatact

SEQ ID NO: 452339 - DNA, 20 bp, Artificial
  CRISPR gRNA sequence
aaataaaatataaaccattt

SEQ ID NO: 452340 - DNA, 20 bp, Artificial
  CRISPR gRNA sequence
aaaatataaaccattttgga

SEQ ID NO: 452341 - DNA, 20 bp, Artificial
  CRISPR gRNA sequence
ttttggagtgaatcaatggc

SEQ ID NO: 452342 - DNA, 20 bp, Artificial
  CRISPR gRNA sequence
attgcaggtctccctcagat

SEQ ID NO: 452343 - DNA, 20 bp, Artificial
  CRISPR gRNA sequence
catatctcttactcttgtag

SEQ ID NO: 452344 - DNA, 20 bp, Artificial
  CRISPR gRNA sequence
tgcctcttcaccgttttcat

SEQ ID NO: 452345 - DNA, 20 bp, Artificial
  CRISPR gRNA sequence
tcttcaccgttttcatgaga

SEQ ID NO: 452346 - DNA, 20 bp, Artificial
  CRISPR gRNA sequence
agtttactatgtataccaag

SEQ ID NO: 452347 - DNA, 20 bp, Artificial
  CRISPR gRNA sequence
aaaaggaaaagcaagtcata

SEQ ID NO: 452348 - DNA, 20 bp, Artificial
  CRISPR gRNA sequence
atagcggatcaagctgccaa

SEQ ID NO: 452349 - DNA, 20 bp, Artificial
  CRISPR gRNA sequence
gctggcagcctcagcatctg

SEQ ID NO: 452350 - DNA, 20 bp, Artificial
  CRISPR gRNA sequence
gcagcctcagcatctgccgg

SEQ ID NO: 452351 - DNA, 20 bp, Artificial
  CRISPR gRNA sequence
gatgagttttcagcagagag

SEQ ID NO: 452352 - DNA, 20 bp, Artificial
  CRISPR gRNA sequence
gagctggatttaaccgaggt

SEQ ID NO: 452353 - DNA, 20 bp, Artificial
  CRISPR gRNA sequence
aaccgaggttggggttttgc

SEQ ID NO: 452354 - DNA, 20 bp, Artificial
  CRISPR gRNA sequence
ttgcgaggatccatcacagt

SEQ ID NO: 452355 - DNA, 20 bp, Artificial
  CRISPR gRNA sequence
ggagtaaagctaagggagct

SEQ ID NO: 452356 - DNA, 20 bp, Artificial
  CRISPR gRNA sequence
taaagctaagggagctgagg

SEQ ID NO: 452357 - DNA, 20 bp, Artificial
  CRISPR gRNA sequence
agaaggaagtgaagtttgag

SEQ ID NO: 452358 - DNA, 20 bp, Artificial
  CRISPR gRNA sequence
acccatcgagccaaaacatc

SEQ ID NO: 452359 - DNA, 20 bp, Artificial
  CRISPR gRNA sequence
agtgggcagactggcaccat

SEQ ID NO: 452360 - DNA, 20 bp, Artificial
  CRISPR gRNA sequence
caccatcagagtcatggtct

SEQ ID NO: 452361 - DNA, 20 bp, Artificial
  CRISPR gRNA sequence
ttccctgatgcttcagactc

SEQ ID NO: 452362 - DNA, 20 bp, Artificial
  CRISPR gRNA sequence
ttcctcaattataataactg

SEQ ID NO: 452363 - DNA, 20 bp, Artificial
  CRISPR gRNA sequence
tacattaggctttaaactct

SEQ ID NO: 452364 - DNA, 20 bp, Artificial
  CRISPR gRNA sequence
agtttgggaggcagaggcag

SEQ ID NO: 452365 - DNA, 20 bp, Artificial
  CRISPR gRNA sequence
caggagggttgcttgatgcc

SEQ ID NO: 452366 - DNA, 20 bp, Artificial
  CRISPR gRNA sequence
actagcctggacaacatagt

SEQ ID NO: 452367 - DNA, 20 bp, Artificial
  CRISPR gRNA sequence
tattcggaaggcggaagcag

SEQ ID NO: 452368 - DNA, 20 bp, Artificial
  CRISPR gRNA sequence
caggaggattgcttgagccc

SEQ ID NO: 452369 - DNA, 20 bp, Artificial
  CRISPR gRNA sequence
cccaggagttcaaaggtgca

SEQ ID NO: 452370 - DNA, 20 bp, Artificial
  CRISPR gRNA sequence
ttgtgccactgccctccagc

SEQ ID NO: 452371 - DNA, 20 bp, Artificial
  CRISPR gRNA sequence
atagccccagcagggcttgg

SEQ ID NO: 452372 - DNA, 20 bp, Artificial
  CRISPR gRNA sequence
ccccagcagggcttggcaga

SEQ ID NO: 452373 - DNA, 20 bp, Artificial
  CRISPR gRNA sequence
gtggaggaacaaataaacct

SEQ ID NO: 452374 - DNA, 20 bp, Artificial
  CRISPR gRNA sequence
acaaataaacctatgaatta

SEQ ID NO: 452375 - DNA, 20 bp, Artificial
  CRISPR gRNA sequence
ccttaattttcattttccag

SEQ ID NO: 452376 - DNA, 20 bp, Artificial
  CRISPR gRNA sequence
gatgaataaactactgccca

SEQ ID NO: 452377 - DNA, 20 bp, Artificial
  CRISPR gRNA sequence
cacacagccatcgatagagc

SEQ ID NO: 452378 - DNA, 20 bp, Artificial
  CRISPR gRNA sequence
agcagttacggtgaaattca

SEQ ID NO: 452379 - DNA, 20 bp, Artificial
  CRISPR gRNA sequence
cacagaatgctacctgacct

SEQ ID NO: 452380 - DNA, 20 bp, Artificial
  CRISPR gRNA sequence
taattcttccctttccattc

SEQ ID NO: 452381 - DNA, 20 bp, Artificial
  CRISPR gRNA sequence
gcataagaaagaagaggctg

SEQ ID NO: 452382 - DNA, 20 bp, Artificial
  CRISPR gRNA sequence
taaaacagctgagacttaaa

SEQ ID NO: 452383 - DNA, 20 bp, Artificial
  CRISPR gRNA sequence
ctgagacttaaaagggatcc

SEQ ID NO: 452384 - DNA, 20 bp, Artificial
  CRISPR gRNA sequence
tttctccattctattcacag

SEQ ID NO: 452385 - DNA, 20 bp, Artificial
  CRISPR gRNA sequence
ccaccaggtgggacagtgag

SEQ ID NO: 452386 - DNA, 20 bp, Artificial
  CRISPR gRNA sequence
ttaattttagaactcttact

SEQ ID NO: 452387 - DNA, 20 bp, Artificial
  CRISPR gRNA sequence
tgacagggagatggtgacac

SEQ ID NO: 452388 - DNA, 20 bp, Artificial
  CRISPR gRNA sequence
taggcagatcacccgaggtc

SEQ ID NO: 452389 - DNA, 20 bp, Artificial
  CRISPR gRNA sequence
tactaaaaatacaaaattag

SEQ ID NO: 452390 - DNA, 20 bp, Artificial
  CRISPR gRNA sequence
tactcaggaggctaaggcaa

SEQ ID NO: 452391 - DNA, 20 bp, Artificial
  CRISPR gRNA sequence
gagattaggtttgagataat

SEQ ID NO: 452392 - DNA, 20 bp, Artificial
  CRISPR gRNA sequence
aaaaagtacagctggccctc

SEQ ID NO: 452393 - DNA, 20 bp, Artificial
  CRISPR gRNA sequence
ccctcatgagttctagctcc

SEQ ID NO: 452394 - DNA, 20 bp, Artificial
  CRISPR gRNA sequence
tgggaaaaaaaaaatttacc

SEQ ID NO: 452395 - DNA, 20 bp, Artificial
  CRISPR gRNA sequence
tcttttcaaagaagctacca

SEQ ID NO: 452396 - DNA, 20 bp, Artificial
  CRISPR gRNA sequence
tgcttcagtaaaacaagaaa

SEQ ID NO: 452397 - DNA, 20 bp, Artificial
  CRISPR gRNA sequence
caagaaagtgaatccataaa

SEQ ID NO: 452398 - DNA, 20 bp, Artificial
  CRISPR gRNA sequence
aaaatgacatacaggaaaca

SEQ ID NO: 452399 - DNA, 20 bp, Artificial
  CRISPR gRNA sequence
acttttggaggccaaggtgg

SEQ ID NO: 452400 - DNA, 20 bp, Artificial
  CRISPR gRNA sequence
tgggaggatcacttgagccc

SEQ ID NO: 452401 - DNA, 20 bp, Artificial
  CRISPR gRNA sequence
agaaaaaaaaaaggaaattc

SEQ ID NO: 452402 - DNA, 20 bp, Artificial
  CRISPR gRNA sequence
agatctctaggaggtaaaaa

SEQ ID NO: 452403 - DNA, 20 bp, Artificial
  CRISPR gRNA sequence
ccaataaaaagattaaagaa

SEQ ID NO: 452404 - DNA, 20 bp, Artificial
  CRISPR gRNA sequence
tgattttgcaaaaaataaca

SEQ ID NO: 452405 - DNA, 20 bp, Artificial
  CRISPR gRNA sequence
tgtggtacaattatttttag

SEQ ID NO: 452406 - DNA, 20 bp, Artificial
  CRISPR gRNA sequence
gaagaatgcagagaaggaaa

SEQ ID NO: 452407 - DNA, 20 bp, Artificial
  CRISPR gRNA sequence
gcaatatgagcatattattt

SEQ ID NO: 452408 - DNA, 20 bp, Artificial
  CRISPR gRNA sequence
gaatataataagacatctcg

SEQ ID NO: 452409 - DNA, 20 bp, Artificial
  CRISPR gRNA sequence
ttttgtatttttagttgaga

SEQ ID NO: 452410 - DNA, 20 bp, Artificial
  CRISPR gRNA sequence
cctcagcctagccaaagtgc

SEQ ID NO: 452411 - DNA, 20 bp, Artificial
  CRISPR gRNA sequence
cctcctcccacctctcaaac

SEQ ID NO: 452412 - DNA, 20 bp, Artificial
  CRISPR gRNA sequence
aaaaactgtactcctagctc

SEQ ID NO: 452413 - DNA, 20 bp, Artificial
  CRISPR gRNA sequence
gaccctatttctgttcatga

SEQ ID NO: 452414 - DNA, 20 bp, Artificial
  CRISPR gRNA sequence
ttttcttaacccccaattca

SEQ ID NO: 452415 - DNA, 20 bp, Artificial
  CRISPR gRNA sequence
cacagcagtacttagtgggg

SEQ ID NO: 452416 - DNA, 20 bp, Artificial
  CRISPR gRNA sequence
ttcctatagtctcctaacta

SEQ ID NO: 452417 - DNA, 20 bp, Artificial
  CRISPR gRNA sequence
tctcctaactagtgagtccc

SEQ ID NO: 452418 - DNA, 20 bp, Artificial
  CRISPR gRNA sequence
taatggcttctcactgtcta

SEQ ID NO: 452419 - DNA, 20 bp, Artificial
  CRISPR gRNA sequence
tagcatttcattctatttat

SEQ ID NO: 452420 - DNA, 20 bp, Artificial
  CRISPR gRNA sequence
gcttcagttaaactgcacta

SEQ ID NO: 452421 - DNA, 20 bp, Artificial
  CRISPR gRNA sequence
cagcgctatgccttggagaa

SEQ ID NO: 452422 - DNA, 20 bp, Artificial
  CRISPR gRNA sequence
tgtgaagattctccctaagg

SEQ ID NO: 452423 - DNA, 20 bp, Artificial
  CRISPR gRNA sequence
ttctcagcatatttaagtat

SEQ ID NO: 452424 - DNA, 20 bp, Artificial
  CRISPR gRNA sequence
agacaggtaataaacaatgt

SEQ ID NO: 452425 - DNA, 20 bp, Artificial
  CRISPR gRNA sequence
aggtaataaacaatgtcagg

SEQ ID NO: 452426 - DNA, 20 bp, Artificial
  CRISPR gRNA sequence
ctggcagatcatttgagatc

SEQ ID NO: 452427 - DNA, 20 bp, Artificial
  CRISPR gRNA sequence
actaaaaatacaaaaaatag

SEQ ID NO: 452428 - DNA, 20 bp, Artificial
  CRISPR gRNA sequence
tacttgggaggctgaggcag

SEQ ID NO: 452429 - DNA, 20 bp, Artificial
  CRISPR gRNA sequence
aaaacaatgtctgccattta

SEQ ID NO: 452430 - DNA, 20 bp, Artificial
  CRISPR gRNA sequence
tgttcatccaacagtaaatg

SEQ ID NO: 452431 - DNA, 20 bp, Artificial
  CRISPR gRNA sequence
caggtgcatcacttgaaccc

SEQ ID NO: 452432 - DNA, 20 bp, Artificial
  CRISPR gRNA sequence
tactagggaagctgaggtgg

SEQ ID NO: 452433 - DNA, 20 bp, Artificial
  CRISPR gRNA sequence
tcatgccactgtactctagc

SEQ ID NO: 452434 - DNA, 20 bp, Artificial
  CRISPR gRNA sequence
tctagaaaatggggctattt

SEQ ID NO: 452435 - DNA, 20 bp, Artificial
  CRISPR gRNA sequence
ctatctctgtggcaaaactt

SEQ ID NO: 452436 - DNA, 20 bp, Artificial
  CRISPR gRNA sequence
taaaaatacttatttgggca

SEQ ID NO: 452437 - DNA, 20 bp, Artificial
  CRISPR gRNA sequence
gggcaacgaattacagaggg

SEQ ID NO: 452438 - DNA, 20 bp, Artificial
  CRISPR gRNA sequence
gacagggaactacacagtga

SEQ ID NO: 452439 - DNA, 20 bp, Artificial
  CRISPR gRNA sequence
attgaaacaaagacaacacc

SEQ ID NO: 452440 - DNA, 20 bp, Artificial
  CRISPR gRNA sequence
ggcttcctacaagaaaaggt

SEQ ID NO: 452441 - DNA, 20 bp, Artificial
  CRISPR gRNA sequence
ccgtaagcaccccaagcaat

SEQ ID NO: 452442 - DNA, 20 bp, Artificial
  CRISPR gRNA sequence
tccaggaggagaaggttgga

SEQ ID NO: 452443 - DNA, 20 bp, Artificial
  CRISPR gRNA sequence
cagataaatcagacttttca

SEQ ID NO: 452444 - DNA, 20 bp, Artificial
  CRISPR gRNA sequence
ggtaggaggtaagactcatt

SEQ ID NO: 452445 - DNA, 20 bp, Artificial
  CRISPR gRNA sequence
gagacagacttggtttggag

SEQ ID NO: 452446 - DNA, 20 bp, Artificial
  CRISPR gRNA sequence
agcaaaggctgatggccaga

SEQ ID NO: 452447 - DNA, 20 bp, Artificial
  CRISPR gRNA sequence
agtatattaaacacatgtag

SEQ ID NO: 452448 - DNA, 20 bp, Artificial
  CRISPR gRNA sequence
aatcaataactaccactgtt

SEQ ID NO: 452449 - DNA, 20 bp, Artificial
  CRISPR gRNA sequence
accactgttttgaatggcat

SEQ ID NO: 452450 - DNA, 20 bp, Artificial
  CRISPR gRNA sequence
tttgttaaaaaacctgtatg

SEQ ID NO: 452451 - DNA, 20 bp, Artificial
  CRISPR gRNA sequence
caggcagatcctttgagcct

SEQ ID NO: 452452 - DNA, 20 bp, Artificial
  CRISPR gRNA sequence
gcctcaaactcctaggctca

SEQ ID NO: 452453 - DNA, 20 bp, Artificial
  CRISPR gRNA sequence
gccttggcctcccaaagtgc

SEQ ID NO: 452454 - DNA, 20 bp, Artificial
  CRISPR gRNA sequence
ttccttgtgtctgtttcctg

SEQ ID NO: 452455 - DNA, 20 bp, Artificial
  CRISPR gRNA sequence
tgtttcctgatgagtaacca

SEQ ID NO: 452456 - DNA, 20 bp, Artificial
  CRISPR gRNA sequence
accaggggatgtttgcttgc

SEQ ID NO: 452457 - DNA, 20 bp, Artificial
  CRISPR gRNA sequence
ttgcaagggttgtataaggt

SEQ ID NO: 452458 - DNA, 20 bp, Artificial
  CRISPR gRNA sequence
atatgtgtgggacttttcgt

SEQ ID NO: 452459 - DNA, 20 bp, Artificial
  CRISPR gRNA sequence
cagtggtagttattgatttg

SEQ ID NO: 452460 - DNA, 20 bp, Artificial
  CRISPR gRNA sequence
tgaggaatgcctaaataaaa

SEQ ID NO: 452461 - DNA, 20 bp, Artificial
  CRISPR gRNA sequence
tgcctaaataaaatggagtt

SEQ ID NO: 452462 - DNA, 20 bp, Artificial
  CRISPR gRNA sequence
tgccaaggccaggcaaaaac

SEQ ID NO: 452463 - DNA, 20 bp, Artificial
  CRISPR gRNA sequence
tgtagccctctgttcatgca

SEQ ID NO: 452464 - DNA, 20 bp, Artificial
  CRISPR gRNA sequence
ctcacaggccttcattccta

SEQ ID NO: 452465 - DNA, 20 bp, Artificial
  CRISPR gRNA sequence
tgtcttcctccttagtgcct

SEQ ID NO: 452466 - DNA, 20 bp, Artificial
  CRISPR gRNA sequence
aaactggtttgaactttcct

SEQ ID NO: 452467 - DNA, 20 bp, Artificial
  CRISPR gRNA sequence
ttcctgtggatagccagggc

SEQ ID NO: 452468 - DNA, 20 bp, Artificial
  CRISPR gRNA sequence
tttccaaccttctcctcctg

SEQ ID NO: 452469 - DNA, 20 bp, Artificial
  CRISPR gRNA sequence
ataatagcaccctcattgct

SEQ ID NO: 452470 - DNA, 20 bp, Artificial
  CRISPR gRNA sequence
tcttgtaggaagcctgaact

SEQ ID NO: 452471 - DNA, 20 bp, Artificial
  CRISPR gRNA sequence
tccctgtctctggttcaaaa

SEQ ID NO: 452472 - DNA, 20 bp, Artificial
  CRISPR gRNA sequence
ctctggttcaaaagagaatc

SEQ ID NO: 452473 - DNA, 20 bp, Artificial
  CRISPR gRNA sequence
aagagaatcatggatcaggg

SEQ ID NO: 452474 - DNA, 20 bp, Artificial
  CRISPR gRNA sequence
acatctcttttatgatctcc

SEQ ID NO: 452475 - DNA, 20 bp, Artificial
  CRISPR gRNA sequence
aaataagtatttttaacatt

SEQ ID NO: 452476 - DNA, 20 bp, Artificial
  CRISPR gRNA sequence
taggcagccataaataagta

SEQ ID NO: 452477 - DNA, 20 bp, Artificial
  CRISPR gRNA sequence
tctcctgtgtgtcagacact

SEQ ID NO: 452478 - DNA, 20 bp, Artificial
  CRISPR gRNA sequence
acagcttagtcgccttggac

SEQ ID NO: 452479 - DNA, 20 bp, Artificial
  CRISPR gRNA sequence
ccccaaatagccccattttc

SEQ ID NO: 452480 - DNA, 20 bp, Artificial
  CRISPR gRNA sequence
aagttaaaatcttgcccttt

SEQ ID NO: 452481 - DNA, 20 bp, Artificial
  CRISPR gRNA sequence
cttgcccttttggaatagat

SEQ ID NO: 452482 - DNA, 20 bp, Artificial
  CRISPR gRNA sequence
ttgtttttgtttttttgaga

SEQ ID NO: 452483 - DNA, 20 bp, Artificial
  CRISPR gRNA sequence
tcttgctctgtcatccaggc

SEQ ID NO: 452484 - DNA, 20 bp, Artificial
  CRISPR gRNA sequence
tagagtacagtggcatgatc

SEQ ID NO: 452485 - DNA, 20 bp, Artificial
  CRISPR gRNA sequence
cccaggctggtctcgaactc

SEQ ID NO: 452486 - DNA, 20 bp, Artificial
  CRISPR gRNA sequence
gccttggcctccctaagtgc

SEQ ID NO: 452487 - DNA, 20 bp, Artificial
  CRISPR gRNA sequence
acactgcacctggactagat

SEQ ID NO: 452488 - DNA, 20 bp, Artificial
  CRISPR gRNA sequence
tttttatccatcatttactg

SEQ ID NO: 452489 - DNA, 20 bp, Artificial
  CRISPR gRNA sequence
aacataaattatcttcaagc

SEQ ID NO: 452490 - DNA, 20 bp, Artificial
  CRISPR gRNA sequence
tattatttctttttttgaga

SEQ ID NO: 452491 - DNA, 20 bp, Artificial
  CRISPR gRNA sequence
tctggctctgtcgcccaggc

SEQ ID NO: 452492 - DNA, 20 bp, Artificial
  CRISPR gRNA sequence
ctcactgcaacctctgcttc

SEQ ID NO: 452493 - DNA, 20 bp, Artificial
  CRISPR gRNA sequence
gcctcagcctcccaagtagc

SEQ ID NO: 452494 - DNA, 20 bp, Artificial
  CRISPR gRNA sequence
ttttgtatttttagtagaga

SEQ ID NO: 452495 - DNA, 20 bp, Artificial
  CRISPR gRNA sequence
gcctcagcctcctgaagtgc

SEQ ID NO: 452496 - DNA, 20 bp, Artificial
  CRISPR gRNA sequence
gaaaagcattcttccttagg

SEQ ID NO: 452497 - DNA, 20 bp, Artificial
  CRISPR gRNA sequence
aaaacaatatattaggagaa

SEQ ID NO: 452498 - DNA, 20 bp, Artificial
  CRISPR gRNA sequence
ccaaggcatagcgctgggcc

SEQ ID NO: 452499 - DNA, 20 bp, Artificial
  CRISPR gRNA sequence
gcacaatacatatttgttag

SEQ ID NO: 452500 - DNA, 20 bp, Artificial
  CRISPR gRNA sequence
atttgttagatgaatgaaag

SEQ ID NO: 452501 - DNA, 20 bp, Artificial
  CRISPR gRNA sequence
aagcaatgtattcacataaa

SEQ ID NO: 452502 - DNA, 20 bp, Artificial
  CRISPR gRNA sequence
ataaatagaatgaaatgcta

SEQ ID NO: 452503 - DNA, 20 bp, Artificial
  CRISPR gRNA sequence
agtgagaagccattaaaact

SEQ ID NO: 452504 - DNA, 20 bp, Artificial
  CRISPR gRNA sequence
gacaagctggtggtagtatg

SEQ ID NO: 452505 - DNA, 20 bp, Artificial
  CRISPR gRNA sequence
agctggtggtagtatgtaga

SEQ ID NO: 452506 - DNA, 20 bp, Artificial
  CRISPR gRNA sequence
ttggaggcagaaacagtatt

SEQ ID NO: 452507 - DNA, 20 bp, Artificial
  CRISPR gRNA sequence
ctcactagttaggagactat

SEQ ID NO: 452508 - DNA, 20 bp, Artificial
  CRISPR gRNA sequence
aaaaacacctttggaaggaa

SEQ ID NO: 452509 - DNA, 20 bp, Artificial
  CRISPR gRNA sequence
cagcagtacttagtaactct

SEQ ID NO: 452510 - DNA, 20 bp, Artificial
  CRISPR gRNA sequence
acttagtaactctctgaatt

SEQ ID NO: 452511 - DNA, 20 bp, Artificial
  CRISPR gRNA sequence
gactccgtcatgaacagaaa

SEQ ID NO: 452512 - DNA, 20 bp, Artificial
  CRISPR gRNA sequence
gaacagaaatagggtctcag

SEQ ID NO: 452513 - DNA, 20 bp, Artificial
  CRISPR gRNA sequence
tcaggaggatagctttgata

SEQ ID NO: 452514 - DNA, 20 bp, Artificial
  CRISPR gRNA sequence
tggtgggacatccaggagct

SEQ ID NO: 452515 - DNA, 20 bp, Artificial
  CRISPR gRNA sequence
gggagatgctggtttaaatc

SEQ ID NO: 452516 - DNA, 20 bp, Artificial
  CRISPR gRNA sequence
gtagatgagaactagggaga

SEQ ID NO: 452517 - DNA, 20 bp, Artificial
  CRISPR gRNA sequence
gagtaaagagaaaaggttga

SEQ ID NO: 452518 - DNA, 20 bp, Artificial
  CRISPR gRNA sequence
aaaggttgaaggggtgagaa

SEQ ID NO: 452519 - DNA, 20 bp, Artificial
  CRISPR gRNA sequence
ggggtgagaagtgagtcttg

SEQ ID NO: 452520 - DNA, 20 bp, Artificial
  CRISPR gRNA sequence
gaagacaaaagaacagccag

SEQ ID NO: 452521 - DNA, 20 bp, Artificial
  CRISPR gRNA sequence
caggtgggtagaacagccag

SEQ ID NO: 452522 - DNA, 20 bp, Artificial
  CRISPR gRNA sequence
gatgacagtttgatgaagga

SEQ ID NO: 452523 - DNA, 20 bp, Artificial
  CRISPR gRNA sequence
ggagggaatagtcagaagtg

SEQ ID NO: 452524 - DNA, 20 bp, Artificial
  CRISPR gRNA sequence
aaactaaacaagttgaaaat

SEQ ID NO: 452525 - DNA, 20 bp, Artificial
  CRISPR gRNA sequence
gggccagtttttcatggggg

SEQ ID NO: 452526 - DNA, 20 bp, Artificial
  CRISPR gRNA sequence
tttttcatggggggagggtg

SEQ ID NO: 452527 - DNA, 20 bp, Artificial
  CRISPR gRNA sequence
tcatggggggagggtggtga

SEQ ID NO: 452528 - DNA, 20 bp, Artificial
  CRISPR gRNA sequence
agcactttggctaggctgag

SEQ ID NO: 452529 - DNA, 20 bp, Artificial
  CRISPR gRNA sequence
cggatagatcacctgaggtc

SEQ ID NO: 452530 - DNA, 20 bp, Artificial
  CRISPR gRNA sequence
aaaaatacaaaaaaaattag

SEQ ID NO: 452531 - DNA, 20 bp, Artificial
  CRISPR gRNA sequence
atacaaaaaaaattagttgg

SEQ ID NO: 452532 - DNA, 20 bp, Artificial
  CRISPR gRNA sequence
tatttgggcggctgaggcag

SEQ ID NO: 452533 - DNA, 20 bp, Artificial
  CRISPR gRNA sequence
ctgctctccagcccggacca

SEQ ID NO: 452534 - DNA, 20 bp, Artificial
  CRISPR gRNA sequence
tccagcccggaccacagagt

SEQ ID NO: 452535 - DNA, 20 bp, Artificial
  CRISPR gRNA sequence
gatagttgtaaaagttcata

SEQ ID NO: 452536 - DNA, 20 bp, Artificial
  CRISPR gRNA sequence
tacagtagatgaagatgtgc

SEQ ID NO: 452537 - DNA, 20 bp, Artificial
  CRISPR gRNA sequence
tgtgctagaatatagtagat

SEQ ID NO: 452538 - DNA, 20 bp, Artificial
  CRISPR gRNA sequence
attagtcatgtttacataat

SEQ ID NO: 452539 - DNA, 20 bp, Artificial
  CRISPR gRNA sequence
tgattttatttttttactgg

SEQ ID NO: 452540 - DNA, 20 bp, Artificial
  CRISPR gRNA sequence
ccatttctttaatcttttta

SEQ ID NO: 452541 - DNA, 20 bp, Artificial
  CRISPR gRNA sequence
cctcctagagatctcccttc

SEQ ID NO: 452542 - DNA, 20 bp, Artificial
  CRISPR gRNA sequence
taactgcccttttttaattc

SEQ ID NO: 452543 - DNA, 20 bp, Artificial
  CRISPR gRNA sequence
tatgtcattttatccccttt

SEQ ID NO: 452544 - DNA, 20 bp, Artificial
  CRISPR gRNA sequence
cacatggaaggcaaattttt

SEQ ID NO: 452545 - DNA, 20 bp, Artificial
  CRISPR gRNA sequence
acatttggtttatagtttgg

SEQ ID NO: 452546 - DNA, 20 bp, Artificial
  CRISPR gRNA sequence
ggtaaattttttttttccca

SEQ ID NO: 452547 - DNA, 20 bp, Artificial
  CRISPR gRNA sequence
gaaggcttgctctattgtct

SEQ ID NO: 452548 - DNA, 20 bp, Artificial
  CRISPR gRNA sequence
aagccacttaaagctggggc

SEQ ID NO: 452549 - DNA, 20 bp, Artificial
  CRISPR gRNA sequence
ggggctggagtggccatatt

SEQ ID NO: 452550 - DNA, 20 bp, Artificial
  CRISPR gRNA sequence
tggagcagggggagcatgca

SEQ ID NO: 452551 - DNA, 20 bp, Artificial
  CRISPR gRNA sequence
ctcctttaatctatggtact

SEQ ID NO: 452552 - DNA, 20 bp, Artificial
  CRISPR gRNA sequence
aacctaatctcgttgtctgc

SEQ ID NO: 452553 - DNA, 20 bp, Artificial
  CRISPR gRNA sequence
aaatatagccacatttctgg

SEQ ID NO: 452554 - DNA, 20 bp, Artificial
  CRISPR gRNA sequence
gccacatttctgggagagtt

SEQ ID NO: 452555 - DNA, 20 bp, Artificial
  CRISPR gRNA sequence
ttctgggagagttctgaatt

SEQ ID NO: 452556 - DNA, 20 bp, Artificial
  CRISPR gRNA sequence
ttcgctctagttgcccaaga

SEQ ID NO: 452557 - DNA, 20 bp, Artificial
  CRISPR gRNA sequence
gattctcttgccttagcctc

SEQ ID NO: 452558 - DNA, 20 bp, Artificial
  CRISPR gRNA sequence
gccttagcctcctgagtagc

SEQ ID NO: 452559 - DNA, 20 bp, Artificial
  CRISPR gRNA sequence
ttttgtatttttagtagaga

SEQ ID NO: 452560 - DNA, 20 bp, Artificial
  CRISPR gRNA sequence
ctgatctttaactcctgacc

SEQ ID NO: 452561 - DNA, 20 bp, Artificial
  CRISPR gRNA sequence
acctcagcctcccaaaatgc

SEQ ID NO: 452562 - DNA, 20 bp, Artificial
  CRISPR gRNA sequence
atctgtttttactttcacca

SEQ ID NO: 452563 - DNA, 20 bp, Artificial
  CRISPR gRNA sequence
atgcaatggccaccccaagt

SEQ ID NO: 452564 - DNA, 20 bp, Artificial
  CRISPR gRNA sequence
gaaaggcagcatctgccaat

SEQ ID NO: 452565 - DNA, 20 bp, Artificial
  CRISPR gRNA sequence
tgccaatggggatgttggaa

SEQ ID NO: 452566 - DNA, 20 bp, Artificial
  CRISPR gRNA sequence
ctgtcccacctggtggcatt

SEQ ID NO: 452567 - DNA, 20 bp, Artificial
  CRISPR gRNA sequence
gagtatttgagcactcacct

SEQ ID NO: 452568 - DNA, 20 bp, Artificial
  CRISPR gRNA sequence
tttgagcactcacctgtgaa

SEQ ID NO: 452569 - DNA, 20 bp, Artificial
  CRISPR gRNA sequence
gagaaaaaatggccctgaag

SEQ ID NO: 452570 - DNA, 20 bp, Artificial
  CRISPR gRNA sequence
ttcaccaacaccatctatcc

SEQ ID NO: 452571 - DNA, 20 bp, Artificial
  CRISPR gRNA sequence
ctggtgatgttaatgcatcc

SEQ ID NO: 452572 - DNA, 20 bp, Artificial
  CRISPR gRNA sequence
gcatcctggaatggaaaggg

SEQ ID NO: 452573 - DNA, 20 bp, Artificial
  CRISPR gRNA sequence
cagaggtcaggtagcattct

SEQ ID NO: 452574 - DNA, 20 bp, Artificial
  CRISPR gRNA sequence
cccctaaccattagatgacc

SEQ ID NO: 452575 - DNA, 20 bp, Artificial
  CRISPR gRNA sequence
aatcctcctgcttccgcctt

SEQ ID NO: 452576 - DNA, 20 bp, Artificial
  CRISPR gRNA sequence
gcctctgcctcccaaactgc

SEQ ID NO: 452577 - DNA, 20 bp, Artificial
  CRISPR gRNA sequence
ccactgtgcctggccactct

SEQ ID NO: 452578 - DNA, 20 bp, Artificial
  CRISPR gRNA sequence
ttccacagttattataattg

SEQ ID NO: 452579 - DNA, 20 bp, Artificial
  CRISPR gRNA sequence
ttgaggaatcttagagattc

SEQ ID NO: 452580 - DNA, 20 bp, Artificial
  CRISPR gRNA sequence
ttagtgctggagctgacttg

SEQ ID NO: 452581 - DNA, 20 bp, Artificial
  CRISPR gRNA sequence
tgctggagctgacttgaagg

SEQ ID NO: 452582 - DNA, 20 bp, Artificial
  CRISPR gRNA sequence
aaaagtttttctaagaaata

SEQ ID NO: 452583 - DNA, 20 bp, Artificial
  CRISPR gRNA sequence
aaacagccactgtgtggaaa

SEQ ID NO: 452584 - DNA, 20 bp, Artificial
  CRISPR gRNA sequence
ccactgtgtggaaatggagt

SEQ ID NO: 452585 - DNA, 20 bp, Artificial
  CRISPR gRNA sequence
ccctgtaagtaatctgtaac

SEQ ID NO: 452586 - DNA, 20 bp, Artificial
  CRISPR gRNA sequence
tacagaagtggagaaaatag

SEQ ID NO: 452587 - DNA, 20 bp, Artificial
  CRISPR gRNA sequence
agaaaatagttgggttaacc

SEQ ID NO: 452588 - DNA, 20 bp, Artificial
  CRISPR gRNA sequence
acccaggatgttttggctcg

SEQ ID NO: 452589 - DNA, 20 bp, Artificial
  CRISPR gRNA sequence
ttagctttactcctactgtg

SEQ ID NO: 452590 - DNA, 20 bp, Artificial
  CRISPR gRNA sequence
tggaggctgccccctgcata

SEQ ID NO: 452591 - DNA, 20 bp, Artificial
  CRISPR gRNA sequence
attgaatgccattctcctac

SEQ ID NO: 452592 - DNA, 20 bp, Artificial
  CRISPR gRNA sequence
ctcctacaagagtaagagat

SEQ ID NO: 452593 - DNA, 20 bp, Artificial
  CRISPR gRNA sequence
ctttccagctggaacttcta

SEQ ID NO: 452594 - DNA, 20 bp, Artificial
  CRISPR gRNA sequence
aacttctatagggtctctgt

SEQ ID NO: 452595 - DNA, 20 bp, Artificial
  CRISPR gRNA sequence
taaatacacaaattgaggca

SEQ ID NO: 452596 - DNA, 20 bp, Artificial
  CRISPR gRNA sequence
gttaatgaagattgcagtat

SEQ ID NO: 452597 - DNA, 20 bp, Artificial
  CRISPR gRNA sequence
gcagtatctggatctcaaac

SEQ ID NO: 452598 - DNA, 20 bp, Artificial
  CRISPR gRNA sequence
tatagtatataagagcctaa

SEQ ID NO: 452599 - DNA, 20 bp, Artificial
  CRISPR gRNA sequence
tttgaaacatatagcagaga

SEQ ID NO: 452600 - DNA, 20 bp, Artificial
  CRISPR gRNA sequence
accctttccttaatgtcaag

SEQ ID NO: 452601 - DNA, 20 bp, Artificial
  CRISPR gRNA sequence
tttccttaatgtcaaggaga

SEQ ID NO: 452602 - DNA, 20 bp, Artificial
  CRISPR gRNA sequence
agtgagtcagccgggcgcct

SEQ ID NO: 452603 - DNA, 20 bp, Artificial
  CRISPR gRNA sequence
gaggatcacctgaggtcagg

SEQ ID NO: 452604 - DNA, 20 bp, Artificial
  CRISPR gRNA sequence
tactcgggaagctgagccag

SEQ ID NO: 452605 - DNA, 20 bp, Artificial
  CRISPR gRNA sequence
tcgcgccactgcactccagc

SEQ ID NO: 452606 - DNA, 20 bp, Artificial
  CRISPR gRNA sequence
aaaaaaaaaaaaaaaaaaaa

SEQ ID NO: 452607 - DNA, 20 bp, Artificial
  CRISPR gRNA sequence
ttccccactagagaaaatca

SEQ ID NO: 452608 - DNA, 20 bp, Artificial
  CRISPR gRNA sequence
tccagcccttcccacaagcc

SEQ ID NO: 452609 - DNA, 20 bp, Artificial
  CRISPR gRNA sequence
ccccatggccgtctctgctc

SEQ ID NO: 452610 - DNA, 20 bp, Artificial
  CRISPR gRNA sequence
ggtctatcctcaccaccaga

SEQ ID NO: 452611 - DNA, 20 bp, Artificial
  CRISPR gRNA sequence
tggatgtccacaattgccag

SEQ ID NO: 452612 - DNA, 20 bp, Artificial
  CRISPR gRNA sequence
ccagggcacagcagcctctg

SEQ ID NO: 452613 - DNA, 20 bp, Artificial
  CRISPR gRNA sequence
acccactagacaaagccttc

SEQ ID NO: 452614 - DNA, 20 bp, Artificial
  CRISPR gRNA sequence
aggctctagctttgattggc

SEQ ID NO: 452615 - DNA, 20 bp, Artificial
  CRISPR gRNA sequence
gtagaggagggcttgggcat

SEQ ID NO: 452616 - DNA, 20 bp, Artificial
  CRISPR gRNA sequence
atatatttttttaagttaaa

SEQ ID NO: 452617 - DNA, 20 bp, Artificial
  CRISPR gRNA sequence
taaattggattgctgcgtca

SEQ ID NO: 452618 - DNA, 20 bp, Artificial
  CRISPR gRNA sequence
ttgataatcagatgttcacc

SEQ ID NO: 452619 - DNA, 20 bp, Artificial
  CRISPR gRNA sequence
tcctcgtgcccttgctagct

SEQ ID NO: 452620 - DNA, 20 bp, Artificial
  CRISPR gRNA sequence
ttaacatttttgccaatctg

SEQ ID NO: 452621 - DNA, 20 bp, Artificial
  CRISPR gRNA sequence
tttccatgattagtgaagtt

SEQ ID NO: 452622 - DNA, 20 bp, Artificial
  CRISPR gRNA sequence
tcattagtattcccttgtct

SEQ ID NO: 452623 - DNA, 20 bp, Artificial
  CRISPR gRNA sequence
tatcttttcctttaagttgt

SEQ ID NO: 452624 - DNA, 20 bp, Artificial
  CRISPR gRNA sequence
aactgaagaaaaacaaacac

SEQ ID NO: 452625 - DNA, 20 bp, Artificial
  CRISPR gRNA sequence
aaaatattatatattattaa

SEQ ID NO: 452626 - DNA, 20 bp, Artificial
  CRISPR gRNA sequence
ttctataaatatgggcctgg

SEQ ID NO: 452627 - DNA, 20 bp, Artificial
  CRISPR gRNA sequence
aaaattcaaaaggggaaaac

SEQ ID NO: 452628 - DNA, 20 bp, Artificial
  CRISPR gRNA sequence
tcctattggtattttaaaat

SEQ ID NO: 452629 - DNA, 20 bp, Artificial
  CRISPR gRNA sequence
atattttaacttagggagaa

SEQ ID NO: 452630 - DNA, 20 bp, Artificial
  CRISPR gRNA sequence
gacattgattcttttgatcc

SEQ ID NO: 452631 - DNA, 20 bp, Artificial
  CRISPR gRNA sequence
ttcttagctaagtttgtttc

SEQ ID NO: 452632 - DNA, 20 bp, Artificial
  CRISPR gRNA sequence
ttttaatatactttaagttc

SEQ ID NO: 452633 - DNA, 20 bp, Artificial
  CRISPR gRNA sequence
ggtgtgtgatgttccccacc

SEQ ID NO: 452634 - DNA, 20 bp, Artificial
  CRISPR gRNA sequence
tgtccttgtgacagtttgct

SEQ ID NO: 452635 - DNA, 20 bp, Artificial
  CRISPR gRNA sequence
agtctatcattgatggacat

SEQ ID NO: 452636 - DNA, 20 bp, Artificial
  CRISPR gRNA sequence
ggttcccaggctttgctatt

SEQ ID NO: 452637 - DNA, 20 bp, Artificial
  CRISPR gRNA sequence
atacttgtgcatctttatcg

SEQ ID NO: 452638 - DNA, 20 bp, Artificial
  CRISPR gRNA sequence
gtagaatgatttataatcct

SEQ ID NO: 452639 - DNA, 20 bp, Artificial
  CRISPR gRNA sequence
tatgcccagtaatgagattg

SEQ ID NO: 452640 - DNA, 20 bp, Artificial
  CRISPR gRNA sequence
tttctagttctagatccttg

SEQ ID NO: 452641 - DNA, 20 bp, Artificial
  CRISPR gRNA sequence
tcatttttcagttgattctc

SEQ ID NO: 452642 - DNA, 20 bp, Artificial
  CRISPR gRNA sequence
attaaataataatggtaata

SEQ ID NO: 452643 - DNA, 20 bp, Artificial
  CRISPR gRNA sequence
tcttttttctaagtttaatg

SEQ ID NO: 452644 - DNA, 20 bp, Artificial
  CRISPR gRNA sequence
ttaagtattatagtagcttt

SEQ ID NO: 452645 - DNA, 20 bp, Artificial
  CRISPR gRNA sequence
agatgtattttattatgtta

SEQ ID NO: 452646 - DNA, 20 bp, Artificial
  CRISPR gRNA sequence
acatttatttctattttatt

SEQ ID NO: 452647 - DNA, 20 bp, Artificial
  CRISPR gRNA sequence
attaagagttttaaaatgtc

SEQ ID NO: 452648 - DNA, 20 bp, Artificial
  CRISPR gRNA sequence
agagttttaaaatgtcaagg

SEQ ID NO: 452649 - DNA, 20 bp, Artificial
  CRISPR gRNA sequence
ttaaaatgtcaaggatggat

SEQ ID NO: 452650 - DNA, 20 bp, Artificial
  CRISPR gRNA sequence
gttgttattttcttttgaga

SEQ ID NO: 452651 - DNA, 20 bp, Artificial
  CRISPR gRNA sequence
tctcactctgtcgcccaggc

SEQ ID NO: 452652 - DNA, 20 bp, Artificial
  CRISPR gRNA sequence
cttactgcaacttccacctc

SEQ ID NO: 452653 - DNA, 20 bp, Artificial
  CRISPR gRNA sequence
gattctcctgcctcagcctg

SEQ ID NO: 452654 - DNA, 20 bp, Artificial
  CRISPR gRNA sequence
gcctcagcctgccgagtatc

SEQ ID NO: 452655 - DNA, 20 bp, Artificial
  CRISPR gRNA sequence
tctgggattacaggcgcctg

SEQ ID NO: 452656 - DNA, 20 bp, Artificial
  CRISPR gRNA sequence
acaggcgcctgccgagtatc

SEQ ID NO: 452657 - DNA, 20 bp, Artificial
  CRISPR gRNA sequence
ttttgtatttttagtagaga

SEQ ID NO: 452658 - DNA, 20 bp, Artificial
  CRISPR gRNA sequence
cggggtttcaccatcttggc

SEQ ID NO: 452659 - DNA, 20 bp, Artificial
  CRISPR gRNA sequence
accttggcctcccaaagtgc

SEQ ID NO: 452660 - DNA, 20 bp, Artificial
  CRISPR gRNA sequence
cctttgggaggccgaggtgg

SEQ ID NO: 452661 - DNA, 20 bp, Artificial
  CRISPR gRNA sequence
tgggaggatcacttgagccc

SEQ ID NO: 452662 - DNA, 20 bp, Artificial
  CRISPR gRNA sequence
gacttaggtgggaggagccc

SEQ ID NO: 452663 - DNA, 20 bp, Artificial
  CRISPR gRNA sequence
tgggaggagcccgggagttc

SEQ ID NO: 452664 - DNA, 20 bp, Artificial
  CRISPR gRNA sequence
atataatacaccatgacaaa

SEQ ID NO: 452665 - DNA, 20 bp, Artificial
  CRISPR gRNA sequence
ggtttcatttttagaaattc

SEQ ID NO: 452666 - DNA, 20 bp, Artificial
  CRISPR gRNA sequence
atctattaattaacatacta

SEQ ID NO: 452667 - DNA, 20 bp, Artificial
  CRISPR gRNA sequence
aaatcctaagtaaaatggta

SEQ ID NO: 452668 - DNA, 20 bp, Artificial
  CRISPR gRNA sequence
cctaagtaaaatggtaatgg

SEQ ID NO: 452669 - DNA, 20 bp, Artificial
  CRISPR gRNA sequence
tcatatttaatggtaaaata

SEQ ID NO: 452670 - DNA, 20 bp, Artificial
  CRISPR gRNA sequence
ttagacaagaaaataaagca

SEQ ID NO: 452671 - DNA, 20 bp, Artificial
  CRISPR gRNA sequence
aaaacccaagaaacttaatt

SEQ ID NO: 452672 - DNA, 20 bp, Artificial
  CRISPR gRNA sequence
agaattattagaaacaataa

SEQ ID NO: 452673 - DNA, 20 bp, Artificial
  CRISPR gRNA sequence
tagaaacaataaaagagtat

SEQ ID NO: 452674 - DNA, 20 bp, Artificial
  CRISPR gRNA sequence
ggaagtacaaattaaaaatt

SEQ ID NO: 452675 - DNA, 20 bp, Artificial
  CRISPR gRNA sequence
caaattaaaaattcagagtt

SEQ ID NO: 452676 - DNA, 20 bp, Artificial
  CRISPR gRNA sequence
aaattcagagttcagaattt

SEQ ID NO: 452677 - DNA, 20 bp, Artificial
  CRISPR gRNA sequence
aagataaatcaaattttggt

SEQ ID NO: 452678 - DNA, 20 bp, Artificial
  CRISPR gRNA sequence
acattgttacggagctttgg

SEQ ID NO: 452679 - DNA, 20 bp, Artificial
  CRISPR gRNA sequence
tagcttacagaaataaaagc

SEQ ID NO: 452680 - DNA, 20 bp, Artificial
  CRISPR gRNA sequence
gtgtgctagtatagatgtac

SEQ ID NO: 452681 - DNA, 20 bp, Artificial
  CRISPR gRNA sequence
cccagcactttgggaggcgt

SEQ ID NO: 452682 - DNA, 20 bp, Artificial
  CRISPR gRNA sequence
cgtgcggatcacctgaggtc

SEQ ID NO: 452683 - DNA, 20 bp, Artificial
  CRISPR gRNA sequence
actaaaaatgcaaaaattag

SEQ ID NO: 452684 - DNA, 20 bp, Artificial
  CRISPR gRNA sequence
acctactcaggaggctgagg

SEQ ID NO: 452685 - DNA, 20 bp, Artificial
  CRISPR gRNA sequence
acaggtgaagacccactggt

SEQ ID NO: 452686 - DNA, 20 bp, Artificial
  CRISPR gRNA sequence
agacccactggtgagaatgg

SEQ ID NO: 452687 - DNA, 20 bp, Artificial
  CRISPR gRNA sequence
aataaattattgcagatcca

SEQ ID NO: 452688 - DNA, 20 bp, Artificial
  CRISPR gRNA sequence
attattgcagatccacagaa

SEQ ID NO: 452689 - DNA, 20 bp, Artificial
  CRISPR gRNA sequence
acataagattaaaaattttc

SEQ ID NO: 452690 - DNA, 20 bp, Artificial
  CRISPR gRNA sequence
cagaaaaatgtaacaacatt

SEQ ID NO: 452691 - DNA, 20 bp, Artificial
  CRISPR gRNA sequence
aacattccgaataggaccta

SEQ ID NO: 452692 - DNA, 20 bp, Artificial
  CRISPR gRNA sequence
atcataccttcatgctacac

SEQ ID NO: 452693 - DNA, 20 bp, Artificial
  CRISPR gRNA sequence
tcctggtgactcttgaaaca

SEQ ID NO: 452694 - DNA, 20 bp, Artificial
  CRISPR gRNA sequence
atggaatattaagtgacaaa

SEQ ID NO: 452695 - DNA, 20 bp, Artificial
  CRISPR gRNA sequence
ttaagtgacaaagaggataa

SEQ ID NO: 452696 - DNA, 20 bp, Artificial
  CRISPR gRNA sequence
attcaaagaggaagacaaag

SEQ ID NO: 452697 - DNA, 20 bp, Artificial
  CRISPR gRNA sequence
ttgcaattattcattcagcc

SEQ ID NO: 452698 - DNA, 20 bp, Artificial
  CRISPR gRNA sequence
aaaagcgtagactctagagc

SEQ ID NO: 452699 - DNA, 20 bp, Artificial
  CRISPR gRNA sequence
tactcgggaggctgaggcag

SEQ ID NO: 452700 - DNA, 20 bp, Artificial
  CRISPR gRNA sequence
tttagtggttaaatggtctc

SEQ ID NO: 452701 - DNA, 20 bp, Artificial
  CRISPR gRNA sequence
aatggtctctagagtcagac

SEQ ID NO: 452702 - DNA, 20 bp, Artificial
  CRISPR gRNA sequence
gtgacaaaatattctcttcc

SEQ ID NO: 452703 - DNA, 20 bp, Artificial
  CRISPR gRNA sequence
tattctcttccttgggttgt

SEQ ID NO: 452704 - DNA, 20 bp, Artificial
  CRISPR gRNA sequence
acttagcacagtgcctggca

SEQ ID NO: 452705 - DNA, 20 bp, Artificial
  CRISPR gRNA sequence
agttttatgctttcttatat

SEQ ID NO: 452706 - DNA, 20 bp, Artificial
  CRISPR gRNA sequence
aggactctaacccaagttat

SEQ ID NO: 452707 - DNA, 20 bp, Artificial
  CRISPR gRNA sequence
agttatgagagtctttctct

SEQ ID NO: 452708 - DNA, 20 bp, Artificial
  CRISPR gRNA sequence
ggggcagcacaggagaaatt

SEQ ID NO: 452709 - DNA, 20 bp, Artificial
  CRISPR gRNA sequence
cacaggagaaattctggatg

SEQ ID NO: 452710 - DNA, 20 bp, Artificial
  CRISPR gRNA sequence
ctctcgggagctggtgacta

SEQ ID NO: 452711 - DNA, 20 bp, Artificial
  CRISPR gRNA sequence
gctggtgactaaagaatacg

SEQ ID NO: 452712 - DNA, 20 bp, Artificial
  CRISPR gRNA sequence
gtgactaaagaatacggtgg

SEQ ID NO: 452713 - DNA, 20 bp, Artificial
  CRISPR gRNA sequence
acggtgggtgaattaaggtg

SEQ ID NO: 452714 - DNA, 20 bp, Artificial
  CRISPR gRNA sequence
ggctccgcactaggtagctg

SEQ ID NO: 452715 - DNA, 20 bp, Artificial
  CRISPR gRNA sequence
ttcctaagggactggtgcag

SEQ ID NO: 452716 - DNA, 20 bp, Artificial
  CRISPR gRNA sequence
gcagcgggatgggaggggcg

SEQ ID NO: 452717 - DNA, 20 bp, Artificial
  CRISPR gRNA sequence
gatgcagctggtcactccgc

SEQ ID NO: 452718 - DNA, 20 bp, Artificial
  CRISPR gRNA sequence
agacttcgcggtgcctaggg

SEQ ID NO: 452719 - DNA, 20 bp, Artificial
  CRISPR gRNA sequence
gggcagcgaggtcactgggc

SEQ ID NO: 452720 - DNA, 20 bp, Artificial
  CRISPR gRNA sequence
gcgctgcctttcagccaaag

SEQ ID NO: 452721 - DNA, 20 bp, Artificial
  CRISPR gRNA sequence
taaactaggaggggagatga

SEQ ID NO: 452722 - DNA, 20 bp, Artificial
  CRISPR gRNA sequence
ggggtgcaaagttgggcctg

SEQ ID NO: 452723 - DNA, 20 bp, Artificial
  CRISPR gRNA sequence
ggccctcaacagaggggaga

SEQ ID NO: 452724 - DNA, 20 bp, Artificial
  CRISPR gRNA sequence
cgggtggtcgtgagaagtct

SEQ ID NO: 452725 - DNA, 20 bp, Artificial
  CRISPR gRNA sequence
gggcccactacacgccaggg

SEQ ID NO: 452726 - DNA, 20 bp, Artificial
  CRISPR gRNA sequence
gccccagcgcgggcaggggg

SEQ ID NO: 452727 - DNA, 20 bp, Artificial
  CRISPR gRNA sequence
ggcaggggggagggtgcccg

SEQ ID NO: 452728 - DNA, 20 bp, Artificial
  CRISPR gRNA sequence
cgcaccttcggaggcggtcc

SEQ ID NO: 452729 - DNA, 20 bp, Artificial
  CRISPR gRNA sequence
tcctggagtcttgtggactc

SEQ ID NO: 452730 - DNA, 20 bp, Artificial
  CRISPR gRNA sequence
tgtgtttaaaactacctcat

SEQ ID NO: 452731 - DNA, 20 bp, Artificial
  CRISPR gRNA sequence
tttgccagaggttttctggg

SEQ ID NO: 452732 - DNA, 20 bp, Artificial
  CRISPR gRNA sequence
gtggggacaagagggcaagg

SEQ ID NO: 452733 - DNA, 20 bp, Artificial
  CRISPR gRNA sequence
atttcctctgccaccggagc

SEQ ID NO: 452734 - DNA, 20 bp, Artificial
  CRISPR gRNA sequence
tggtggtctgggaaggcata

SEQ ID NO: 452735 - DNA, 20 bp, Artificial
  CRISPR gRNA sequence
ttaaaaattaataagataca

SEQ ID NO: 452736 - DNA, 20 bp, Artificial
  CRISPR gRNA sequence
gacagttgtcaaaacattag

SEQ ID NO: 452737 - DNA, 20 bp, Artificial
  CRISPR gRNA sequence
ccccccaattcacaaatccc

SEQ ID NO: 452738 - DNA, 20 bp, Artificial
  CRISPR gRNA sequence
aactttcctctggtaatttg

SEQ ID NO: 452739 - DNA, 20 bp, Artificial
  CRISPR gRNA sequence
ttgaggaattcctccatttg

SEQ ID NO: 452740 - DNA, 20 bp, Artificial
  CRISPR gRNA sequence
ttcctccatttgaggaatgt

SEQ ID NO: 452741 - DNA, 20 bp, Artificial
  CRISPR gRNA sequence
gaggaatgtcagaatggggc

SEQ ID NO: 452742 - DNA, 20 bp, Artificial
  CRISPR gRNA sequence
tcagaatggggccaggattc

SEQ ID NO: 452743 - DNA, 20 bp, Artificial
  CRISPR gRNA sequence
tattcgctctttgaaaacca

SEQ ID NO: 452744 - DNA, 20 bp, Artificial
  CRISPR gRNA sequence
cgctctttgaaaaccacaga

SEQ ID NO: 452745 - DNA, 20 bp, Artificial
  CRISPR gRNA sequence
gatcttccgccacccccact

SEQ ID NO: 452746 - DNA, 20 bp, Artificial
  CRISPR gRNA sequence
tgacttctaacaacccattc

SEQ ID NO: 452747 - DNA, 20 bp, Artificial
  CRISPR gRNA sequence
caatgacgaaactggagaga

SEQ ID NO: 452748 - DNA, 20 bp, Artificial
  CRISPR gRNA sequence
acagaactgctcaggtgagg

SEQ ID NO: 452749 - DNA, 20 bp, Artificial
  CRISPR gRNA sequence
tctgcccgccagaccagcat

SEQ ID NO: 452750 - DNA, 20 bp, Artificial
  CRISPR gRNA sequence
aattaccagaggaaagttac

SEQ ID NO: 452751 - DNA, 20 bp, Artificial
  CRISPR gRNA sequence
ttagatctgctggagctctt

SEQ ID NO: 452752 - DNA, 20 bp, Artificial
  CRISPR gRNA sequence
agacaagccgggaggtgcca

SEQ ID NO: 452753 - DNA, 20 bp, Artificial
  CRISPR gRNA sequence
ggacctcttggaggtccgtg

SEQ ID NO: 452754 - DNA, 20 bp, Artificial
  CRISPR gRNA sequence
gtccgtgaatagatttattc

SEQ ID NO: 452755 - DNA, 20 bp, Artificial
  CRISPR gRNA sequence
atctttaattgaaagtcagc

SEQ ID NO: 452756 - DNA, 20 bp, Artificial
  CRISPR gRNA sequence
caaatattttcaaatctcat

SEQ ID NO: 452757 - DNA, 20 bp, Artificial
  CRISPR gRNA sequence
tcaaatctcattacagtttt

SEQ ID NO: 452758 - DNA, 20 bp, Artificial
  CRISPR gRNA sequence
tgctctaccacacattcttc

SEQ ID NO: 452759 - DNA, 20 bp, Artificial
  CRISPR gRNA sequence
atggcgcctttatgtcaggc

SEQ ID NO: 452760 - DNA, 20 bp, Artificial
  CRISPR gRNA sequence
ggaagcctgagatctcagac

SEQ ID NO: 452761 - DNA, 20 bp, Artificial
  CRISPR gRNA sequence
ctttaaggcagttggggttg

SEQ ID NO: 452762 - DNA, 20 bp, Artificial
  CRISPR gRNA sequence
cctccccagaaaacctctgg

SEQ ID NO: 452763 - DNA, 20 bp, Artificial
  CRISPR gRNA sequence
ccgtcaccacattcctatga

SEQ ID NO: 452764 - DNA, 20 bp, Artificial
  CRISPR gRNA sequence
ccagcaatgtgctggtcaca

SEQ ID NO: 452765 - DNA, 20 bp, Artificial
  CRISPR gRNA sequence
aatgtgctggtcacacaaag

SEQ ID NO: 452766 - DNA, 20 bp, Artificial
  CRISPR gRNA sequence
cctccgaaggtgcgggaggg

SEQ ID NO: 452767 - DNA, 20 bp, Artificial
  CRISPR gRNA sequence
cctgcccgcgctggggctca

SEQ ID NO: 452768 - DNA, 20 bp, Artificial
  CRISPR gRNA sequence
tgcaccccctcatctcccct

SEQ ID NO: 452769 - DNA, 20 bp, Artificial
  CRISPR gRNA sequence
gcggggcaggtagggggtca

SEQ ID NO: 452770 - DNA, 20 bp, Artificial
  CRISPR gRNA sequence
cctgctccccaacttaggag

SEQ ID NO: 452771 - DNA, 20 bp, Artificial
  CRISPR gRNA sequence
caagtcccctccaagcctct

SEQ ID NO: 452772 - DNA, 20 bp, Artificial
  CRISPR gRNA sequence
aataaattttagaaaataat

SEQ ID NO: 452773 - DNA, 20 bp, Artificial
  CRISPR gRNA sequence
tttagaaaataataatggct

SEQ ID NO: 452774 - DNA, 20 bp, Artificial
  CRISPR gRNA sequence
gatgtgcctggaacactgtc

SEQ ID NO: 452775 - DNA, 20 bp, Artificial
  CRISPR gRNA sequence
tcaccattttataggtcatt

SEQ ID NO: 452776 - DNA, 20 bp, Artificial
  CRISPR gRNA sequence
gcccaatattacacagatag

SEQ ID NO: 452777 - DNA, 20 bp, Artificial
  CRISPR gRNA sequence
tctgacacattatagatgct

SEQ ID NO: 452778 - DNA, 20 bp, Artificial
  CRISPR gRNA sequence
ttgaccgagtcatgcaacta

SEQ ID NO: 452779 - DNA, 20 bp, Artificial
  CRISPR gRNA sequence
tcatgcaactattaagtttt

SEQ ID NO: 452780 - DNA, 20 bp, Artificial
  CRISPR gRNA sequence
taagttttttttgtttttat

SEQ ID NO: 452781 - DNA, 20 bp, Artificial
  CRISPR gRNA sequence
tgtattttttttagtagaga

SEQ ID NO: 452782 - DNA, 20 bp, Artificial
  CRISPR gRNA sequence
cacctcggcctcccaaagtg

SEQ ID NO: 452783 - DNA, 20 bp, Artificial
  CRISPR gRNA sequence
caccgcgcccggcgccacta

SEQ ID NO: 452784 - DNA, 20 bp, Artificial
  CRISPR gRNA sequence
gccactattaagttttagga

SEQ ID NO: 452785 - DNA, 20 bp, Artificial
  CRISPR gRNA sequence
aaacactctggctctagagt

SEQ ID NO: 452786 - DNA, 20 bp, Artificial
  CRISPR gRNA sequence
tttgtcttcctctttgaata

SEQ ID NO: 452787 - DNA, 20 bp, Artificial
  CRISPR gRNA sequence
cctctttgtcacttaatatt

SEQ ID NO: 452788 - DNA, 20 bp, Artificial
  CRISPR gRNA sequence
cataccatgagctgctgctg

SEQ ID NO: 452789 - DNA, 20 bp, Artificial
  CRISPR gRNA sequence
gctgctgctgggatgtttta

SEQ ID NO: 452790 - DNA, 20 bp, Artificial
  CRISPR gRNA sequence
gaatttaacaatcgtctcta

SEQ ID NO: 452791 - DNA, 20 bp, Artificial
  CRISPR gRNA sequence
tatgttccttaatagtactg

SEQ ID NO: 452792 - DNA, 20 bp, Artificial
  CRISPR gRNA sequence
tacatttttctggacatttg

SEQ ID NO: 452793 - DNA, 20 bp, Artificial
  CRISPR gRNA sequence
attgtatgtatatacactaa

SEQ ID NO: 452794 - DNA, 20 bp, Artificial
  CRISPR gRNA sequence
gtatatacactaatttagtt

SEQ ID NO: 452795 - DNA, 20 bp, Artificial
  CRISPR gRNA sequence
attctcaccagtgggtcttc

SEQ ID NO: 452796 - DNA, 20 bp, Artificial
  CRISPR gRNA sequence
ttatgggggcaggaaggcga

SEQ ID NO: 452797 - DNA, 20 bp, Artificial
  CRISPR gRNA sequence
ttttgcatttttagtagagc

SEQ ID NO: 452798 - DNA, 20 bp, Artificial
  CRISPR gRNA sequence
tccgcacgcctcccaaagtg

SEQ ID NO: 452799 - DNA, 20 bp, Artificial
  CRISPR gRNA sequence
agccaccacacctggccttc

SEQ ID NO: 452800 - DNA, 20 bp, Artificial
  CRISPR gRNA sequence
gtacatctatactagcacac

SEQ ID NO: 452801 - DNA, 20 bp, Artificial
  CRISPR gRNA sequence
tgtatagttctacctagagt

SEQ ID NO: 452802 - DNA, 20 bp, Artificial
  CRISPR gRNA sequence
ttcttcttacccttaccaaa

SEQ ID NO: 452803 - DNA, 20 bp, Artificial
  CRISPR gRNA sequence
tgcctattcagatactcttt

SEQ ID NO: 452804 - DNA, 20 bp, Artificial
  CRISPR gRNA sequence
ttgtttctaataattctcaa

SEQ ID NO: 452805 - DNA, 20 bp, Artificial
  CRISPR gRNA sequence
ataattctcaattaagtttc

SEQ ID NO: 452806 - DNA, 20 bp, Artificial
  CRISPR gRNA sequence
taaatagtaataaatttgcc

SEQ ID NO: 452807 - DNA, 20 bp, Artificial
  CRISPR gRNA sequence
agatttccaatatttatacc

SEQ ID NO: 452808 - DNA, 20 bp, Artificial
  CRISPR gRNA sequence
ttcatccattaccattttac

SEQ ID NO: 452809 - DNA, 20 bp, Artificial
  CRISPR gRNA sequence
tatccagtagtatgttaatt

SEQ ID NO: 452810 - DNA, 20 bp, Artificial
  CRISPR gRNA sequence
tattatatttttaatatctt

SEQ ID NO: 452811 - DNA, 20 bp, Artificial
  CRISPR gRNA sequence
aatttgtgtgtgtgtgtaat

SEQ ID NO: 452812 - DNA, 20 bp, Artificial
  CRISPR gRNA sequence
gtgtgtgtgtaatttttgat

SEQ ID NO: 452813 - DNA, 20 bp, Artificial
  CRISPR gRNA sequence
tcctcccacctcggcctccc

SEQ ID NO: 452814 - DNA, 20 bp, Artificial
  CRISPR gRNA sequence
cacctcggcctcccaaaggc

SEQ ID NO: 452815 - DNA, 20 bp, Artificial
  CRISPR gRNA sequence
tcggcaggctgaggcaggag

SEQ ID NO: 452816 - DNA, 20 bp, Artificial
  CRISPR gRNA sequence
ataacaacatactatgacca

SEQ ID NO: 452817 - DNA, 20 bp, Artificial
  CRISPR gRNA sequence
acatactatgaccaaatggc

SEQ ID NO: 452818 - DNA, 20 bp, Artificial
  CRISPR gRNA sequence
tatgaccaaatggcttcagt

SEQ ID NO: 452819 - DNA, 20 bp, Artificial
  CRISPR gRNA sequence
accaaatggcttcagttttt

SEQ ID NO: 452820 - DNA, 20 bp, Artificial
  CRISPR gRNA sequence
cattaaacttagaaaaaaga

SEQ ID NO: 452821 - DNA, 20 bp, Artificial
  CRISPR gRNA sequence
attatcattatgtacacata

SEQ ID NO: 452822 - DNA, 20 bp, Artificial
  CRISPR gRNA sequence
gagaagatgtggagaaatag

SEQ ID NO: 452823 - DNA, 20 bp, Artificial
  CRISPR gRNA sequence
aaccactgtggaagacagtg

SEQ ID NO: 452824 - DNA, 20 bp, Artificial
  CRISPR gRNA sequence
tcattactgggcatataccc

SEQ ID NO: 452825 - DNA, 20 bp, Artificial
  CRISPR gRNA sequence
tctacgataaagatgcacaa

SEQ ID NO: 452826 - DNA, 20 bp, Artificial
  CRISPR gRNA sequence
caaatgtccatcaatgatag

SEQ ID NO: 452827 - DNA, 20 bp, Artificial
  CRISPR gRNA sequence
aggaagggcaagactagaca

SEQ ID NO: 452828 - DNA, 20 bp, Artificial
  CRISPR gRNA sequence
aaataaatttatagaaaaat

SEQ ID NO: 452829 - DNA, 20 bp, Artificial
  CRISPR gRNA sequence
taaaacacatacacacatag

SEQ ID NO: 452830 - DNA, 20 bp, Artificial
  CRISPR gRNA sequence
taatatataatattttgtca

SEQ ID NO: 452831 - DNA, 20 bp, Artificial
  CRISPR gRNA sequence
tttccctattgatgaaattc

SEQ ID NO: 452832 - DNA, 20 bp, Artificial
  CRISPR gRNA sequence
cctattgatgaaattcaagt

SEQ ID NO: 452833 - DNA, 20 bp, Artificial
  CRISPR gRNA sequence
aattcaagtgtttgtttttc

SEQ ID NO: 452834 - DNA, 20 bp, Artificial
  CRISPR gRNA sequence
caagtgtttgtttttcttca

SEQ ID NO: 452835 - DNA, 20 bp, Artificial
  CRISPR gRNA sequence
acaggagtaatttttcttag

SEQ ID NO: 452836 - DNA, 20 bp, Artificial
  CRISPR gRNA sequence
gcaggtctaatttttcatcc

SEQ ID NO: 452837 - DNA, 20 bp, Artificial
  CRISPR gRNA sequence
atcaagcattcttggtgaac

SEQ ID NO: 452838 - DNA, 20 bp, Artificial
  CRISPR gRNA sequence
aacagcctttttggagagca

SEQ ID NO: 452839 - DNA, 20 bp, Artificial
  CRISPR gRNA sequence
caatctgattatagtagaaa

SEQ ID NO: 452840 - DNA, 20 bp, Artificial
  CRISPR gRNA sequence
ccggctcccagtgtatctca

SEQ ID NO: 452841 - DNA, 20 bp, Artificial
  CRISPR gRNA sequence
gaaatggtcttggaaccctg

SEQ ID NO: 452842 - DNA, 20 bp, Artificial
  CRISPR gRNA sequence
gctttgtctagtgggtcccc

SEQ ID NO: 452843 - DNA, 20 bp, Artificial
  CRISPR gRNA sequence
aggataccagcagagccaac

SEQ ID NO: 452844 - DNA, 20 bp, Artificial
  CRISPR gRNA sequence
agacggccatggggaggatc

SEQ ID NO: 452845 - DNA, 20 bp, Artificial
  CRISPR gRNA sequence
cttgtgggaagggctggatc

SEQ ID NO: 452846 - DNA, 20 bp, Artificial
  CRISPR gRNA sequence
tgttcaagcaattctgctgg

SEQ ID NO: 452847 - DNA, 20 bp, Artificial
  CRISPR gRNA sequence
cttcccgagtagctgggact

SEQ ID NO: 452848 - DNA, 20 bp, Artificial
  CRISPR gRNA sequence
ttttgtatttttagtagaga

SEQ ID NO: 452849 - DNA, 20 bp, Artificial
  CRISPR gRNA sequence
tcagacactctgtctctgct

SEQ ID NO: 452850 - DNA, 20 bp, Artificial
  CRISPR gRNA sequence
ctggcaatctgcgcctcaac

SEQ ID NO: 452851 - DNA, 20 bp, Artificial
  CRISPR gRNA sequence
atactataaatttatgaaat

SEQ ID NO: 452852 - DNA, 20 bp, Artificial
  CRISPR gRNA sequence
aatcttcattaacttcagca

SEQ ID NO: 452853 - DNA, 20 bp, Artificial
  CRISPR gRNA sequence
cctgccctctatggctatac

SEQ ID NO: 452854 - DNA, 20 bp, Artificial
  CRISPR gRNA sequence
attttggagtgaatcaatgg

SEQ ID NO: 452855 - DNA, 20 bp, Artificial
  CRISPR gRNA sequence
agcctccatctctgcctctt

SEQ ID NO: 452856 - DNA, 20 bp, Artificial
  CRISPR gRNA sequence
accgttttcatgagagtgaa

SEQ ID NO: 452857 - DNA, 20 bp, Artificial
  CRISPR gRNA sequence
gcagcctcagcatctgccgg

SEQ ID NO: 452858 - DNA, 20 bp, Artificial
  CRISPR gRNA sequence
ggatgagttttcagcagaga

SEQ ID NO: 452859 - DNA, 20 bp, Artificial
  CRISPR gRNA sequence
gagctggatttaaccgaggt

SEQ ID NO: 452860 - DNA, 20 bp, Artificial
  CRISPR gRNA sequence
agctgagggtggatataagg

SEQ ID NO: 452861 - DNA, 20 bp, Artificial
  CRISPR gRNA sequence
atataaactacagaaggaag

SEQ ID NO: 452862 - DNA, 20 bp, Artificial
  CRISPR gRNA sequence
ctccacttctgtatccaggt

SEQ ID NO: 452863 - DNA, 20 bp, Artificial
  CRISPR gRNA sequence
caatggtccctcaataatta

SEQ ID NO: 452864 - DNA, 20 bp, Artificial
  CRISPR gRNA sequence
tcactccatttccacacagt

SEQ ID NO: 452865 - DNA, 20 bp, Artificial
  CRISPR gRNA sequence
ctccagcactaacttcactg

SEQ ID NO: 452866 - DNA, 20 bp, Artificial
  CRISPR gRNA sequence
acttcactgtgaagtttccc

SEQ ID NO: 452867 - DNA, 20 bp, Artificial
  CRISPR gRNA sequence
tgcttcagactcaggaatct

SEQ ID NO: 452868 - DNA, 20 bp, Artificial
  CRISPR gRNA sequence
taaattgtaactttttgcta

SEQ ID NO: 452869 - DNA, 20 bp, Artificial
  CRISPR gRNA sequence
tttgctaatttgtttttaca

SEQ ID NO: 452870 - DNA, 20 bp, Artificial
  CRISPR gRNA sequence
tggttcatgcctgtaatccc

SEQ ID NO: 452871 - DNA, 20 bp, Artificial
  CRISPR gRNA sequence
ttgggaggcagaggcaggag

SEQ ID NO: 452872 - DNA, 20 bp, Artificial
  CRISPR gRNA sequence
ctattcggaaggcggaagca

SEQ ID NO: 452873 - DNA, 20 bp, Artificial
  CRISPR gRNA sequence
tcggaaggcggaagcaggag

SEQ ID NO: 452874 - DNA, 20 bp, Artificial
  CRISPR gRNA sequence
gagttcaaaggtgcagtgag

SEQ ID NO: 452875 - DNA, 20 bp, Artificial
  CRISPR gRNA sequence
gcctgggtgacacagcaaga

SEQ ID NO: 452876 - DNA, 20 bp, Artificial
  CRISPR gRNA sequence
cctagtcctcatagccccag

SEQ ID NO: 452877 - DNA, 20 bp, Artificial
  CRISPR gRNA sequence
aaataaacctatgaattaat

SEQ ID NO: 452878 - DNA, 20 bp, Artificial
  CRISPR gRNA sequence
actgcccaaggagttaggta

SEQ ID NO: 452879 - DNA, 20 bp, Artificial
  CRISPR gRNA sequence
ctgccagcactactgccagg

SEQ ID NO: 452880 - DNA, 20 bp, Artificial
  CRISPR gRNA sequence
ggatgcattaacatcaccag

SEQ ID NO: 452881 - DNA, 20 bp, Artificial
  CRISPR gRNA sequence
gcataagaaagaagaggctg

SEQ ID NO: 452882 - DNA, 20 bp, Artificial
  CRISPR gRNA sequence
agaagaggctgaggggtttg

SEQ ID NO: 452883 - DNA, 20 bp, Artificial
  CRISPR gRNA sequence
ctggagactgttctcctgag

SEQ ID NO: 452884 - DNA, 20 bp, Artificial
  CRISPR gRNA sequence
gatagttcaggtcctggaaa

SEQ ID NO: 452885 - DNA, 20 bp, Artificial
  CRISPR gRNA sequence
aaagtaaaaacagatagaaa

SEQ ID NO: 452886 - DNA, 20 bp, Artificial
  CRISPR gRNA sequence
tcaggaggctaaggcaagag

SEQ ID NO: 452887 - DNA, 20 bp, Artificial
  CRISPR gRNA sequence
gaggcggaggttgcagtgag

SEQ ID NO: 452888 - DNA, 20 bp, Artificial
  CRISPR gRNA sequence
gaaaagaaagaaattaggcc

SEQ ID NO: 452889 - DNA, 20 bp, Artificial
  CRISPR gRNA sequence
tttctaaattcaggcagaca

SEQ ID NO: 452890 - DNA, 20 bp, Artificial
  CRISPR gRNA sequence
aattcaggcagacaacgaga

SEQ ID NO: 452891 - DNA, 20 bp, Artificial
  CRISPR gRNA sequence
cagaaaccaattcaaagtac

SEQ ID NO: 452892 - DNA, 20 bp, Artificial
  CRISPR gRNA sequence
gggacaggacgcaaaacagt

SEQ ID NO: 452893 - DNA, 20 bp, Artificial
  CRISPR gRNA sequence
aactgtgaggcagcaaggcc

SEQ ID NO: 452894 - DNA, 20 bp, Artificial
  CRISPR gRNA sequence
ctaaatatggccactccagc

SEQ ID NO: 452895 - DNA, 20 bp, Artificial
  CRISPR gRNA sequence
ccactccagccccagcttta

SEQ ID NO: 452896 - DNA, 20 bp, Artificial
  CRISPR gRNA sequence
ttcaaagaagctaccagagg

SEQ ID NO: 452897 - DNA, 20 bp, Artificial
  CRISPR gRNA sequence
ggcccattaaagacccaata

SEQ ID NO: 452898 - DNA, 20 bp, Artificial
  CRISPR gRNA sequence
caaaagaaacatagcgcaca

SEQ ID NO: 452899 - DNA, 20 bp, Artificial
  CRISPR gRNA sequence
ttacttttttttttcttttt

SEQ ID NO: 452900 - DNA, 20 bp, Artificial
  CRISPR gRNA sequence
aacctccacctccaaggttc

SEQ ID NO: 452901 - DNA, 20 bp, Artificial
  CRISPR gRNA sequence
ttttgtatttttagttgaga

SEQ ID NO: 452902 - DNA, 20 bp, Artificial
  CRISPR gRNA sequence
gcctcagcctagccaaagtg

SEQ ID NO: 452903 - DNA, 20 bp, Artificial
  CRISPR gRNA sequence
ctggcccagagcctttgaac

SEQ ID NO: 452904 - DNA, 20 bp, Artificial
  CRISPR gRNA sequence
ctagttaattcaaattttca

SEQ ID NO: 452905 - DNA, 20 bp, Artificial
  CRISPR gRNA sequence
taattcaaattttcaacttg

SEQ ID NO: 452906 - DNA, 20 bp, Artificial
  CRISPR gRNA sequence
ttagtttgactgactttgtt

SEQ ID NO: 452907 - DNA, 20 bp, Artificial
  CRISPR gRNA sequence
ttcatcaaactgtcatctcc

SEQ ID NO: 452908 - DNA, 20 bp, Artificial
  CRISPR gRNA sequence
tctccctagttctcatctac

SEQ ID NO: 452909 - DNA, 20 bp, Artificial
  CRISPR gRNA sequence
ctgaccagcaaatcaacttc

SEQ ID NO: 452910 - DNA, 20 bp, Artificial
  CRISPR gRNA sequence
ctccagcttgaacacctttc

SEQ ID NO: 452911 - DNA, 20 bp, Artificial
  CRISPR gRNA sequence
acctttcctaagttttaatt

SEQ ID NO: 452912 - DNA, 20 bp, Artificial
  CRISPR gRNA sequence
tgttattcctttccttccaa

SEQ ID NO: 452913 - DNA, 20 bp, Artificial
  CRISPR gRNA sequence
aatggtccagcaactctaaa

SEQ ID NO: 452914 - DNA, 20 bp, Artificial
  CRISPR gRNA sequence
aatccattctacatactacc

SEQ ID NO: 452915 - DNA, 20 bp, Artificial
  CRISPR gRNA sequence
tttgtacatgccacatcact

SEQ ID NO: 452916 - DNA, 20 bp, Artificial
  CRISPR gRNA sequence
gccacatcactcaaagtttt

SEQ ID NO: 452917 - DNA, 20 bp, Artificial
  CRISPR gRNA sequence
tcattctatttatgtgaata

SEQ ID NO: 452918 - DNA, 20 bp, Artificial
  CRISPR gRNA sequence
taaatcctgttctcctaata

SEQ ID NO: 452919 - DNA, 20 bp, Artificial
  CRISPR gRNA sequence
ctaatatattgttttagttg

SEQ ID NO: 452920 - DNA, 20 bp, Artificial
  CRISPR gRNA sequence
tgaagattctccctaaggaa

SEQ ID NO: 452921 - DNA, 20 bp, Artificial
  CRISPR gRNA sequence
gaagcagaggttgcagtgag

SEQ ID NO: 452922 - DNA, 20 bp, Artificial
  CRISPR gRNA sequence
aacaatgtctgccatttact

SEQ ID NO: 452923 - DNA, 20 bp, Artificial
  CRISPR gRNA sequence
agctattgtcctgtgataac

SEQ ID NO: 452924 - DNA, 20 bp, Artificial
  CRISPR gRNA sequence
tagggaagctgaggtgggag

SEQ ID NO: 452925 - DNA, 20 bp, Artificial
  CRISPR gRNA sequence
cccagatctattccaaaagg

SEQ ID NO: 452926 - DNA, 20 bp, Artificial
  CRISPR gRNA sequence
agggcaagattttaacttat

SEQ ID NO: 452927 - DNA, 20 bp, Artificial
  CRISPR gRNA sequence
caagattttaacttatgcta

SEQ ID NO: 452928 - DNA, 20 bp, Artificial
  CRISPR gRNA sequence
acccaagtccaaggcgacta

SEQ ID NO: 452929 - DNA, 20 bp, Artificial
  CRISPR gRNA sequence
atccctagtgtctgacacac

SEQ ID NO: 452930 - DNA, 20 bp, Artificial
  CRISPR gRNA sequence
gatgatgcaaaaggagatac

SEQ ID NO: 452931 - DNA, 20 bp, Artificial
  CRISPR gRNA sequence
ttctgaaaccctcccctgat

SEQ ID NO: 452932 - DNA, 20 bp, Artificial
  CRISPR gRNA sequence
agacagggaactacacagtg

SEQ ID NO: 452933 - DNA, 20 bp, Artificial
  CRISPR gRNA sequence
ataatgaaggcactctcagt

SEQ ID NO: 452934 - DNA, 20 bp, Artificial
  CRISPR gRNA sequence
ctatccacaggaaagttcaa

SEQ ID NO: 452935 - DNA, 20 bp, Artificial
  CRISPR gRNA sequence
agagggctacaagttgaagc

SEQ ID NO: 452936 - DNA, 20 bp, Artificial
  CRISPR gRNA sequence
aagaaaaggcaagagacaga

SEQ ID NO: 452937 - DNA, 20 bp, Artificial
  CRISPR gRNA sequence
gagacagacttggtttggag

SEQ ID NO: 452938 - DNA, 20 bp, Artificial
  CRISPR gRNA sequence
ctcctcagcaaaggctgatg

SEQ ID NO: 452939 - DNA, 20 bp, Artificial
  CRISPR gRNA sequence
ctctgaaaaccatttaccaa

SEQ ID NO: 452940 - DNA, 20 bp, Artificial
  CRISPR gRNA sequence
aaccatttaccaatatagat

SEQ ID NO: 452941 - DNA, 20 bp, Artificial
  CRISPR gRNA sequence
aaacttccaataatttgtca

SEQ ID NO: 452942 - DNA, 20 bp, Artificial
  CRISPR gRNA sequence
aacgtttttgcataacaagc

SEQ ID NO: 452943 - DNA, 20 bp, Artificial
  CRISPR gRNA sequence
ttgcataacaagcaactgat

SEQ ID NO: 452944 - DNA, 20 bp, Artificial
  CRISPR gRNA sequence
ttcctcaaatcaataactac

SEQ ID NO: 452945 - DNA, 20 bp, Artificial
  CRISPR gRNA sequence
aaaaacctgtatgatgaatc

SEQ ID NO: 452946 - DNA, 20 bp, Artificial
  CRISPR gRNA sequence
tgaatcagatgctttacaca

SEQ ID NO: 452947 - DNA, 20 bp, Artificial
  CRISPR gRNA sequence
caggcagatcctttgagcct

SEQ ID NO: 452948 - DNA, 20 bp, Artificial
  CRISPR gRNA sequence
tgccttggcctcccaaagtg

SEQ ID NO: 452949 - DNA, 20 bp, Artificial
  CRISPR gRNA sequence
gccctatttaacttccttgt

SEQ ID NO: 452950 - DNA, 20 bp, Artificial
  CRISPR gRNA sequence
tttcctgatgagtaaccagg

SEQ ID NO: 452951 - DNA, 20 bp, Artificial
  CRISPR gRNA sequence
ctgatgagtaaccaggggat

SEQ ID NO: 452952 - DNA, 20 bp, Artificial
  CRISPR gRNA sequence
agaatcatcatgtgtaaagc

SEQ ID NO: 452953 - DNA, 20 bp, Artificial
  CRISPR gRNA sequence
taaagcatctgattcatcat

SEQ ID NO: 452954 - DNA, 20 bp, Artificial
  CRISPR gRNA sequence
acaaagtccttacatatata

SEQ ID NO: 452955 - DNA, 20 bp, Artificial
  CRISPR gRNA sequence
ccattcaaaacagtggtagt

SEQ ID NO: 452956 - DNA, 20 bp, Artificial
  CRISPR gRNA sequence
gccaggcaaaaacctgaatc

SEQ ID NO: 452957 - DNA, 20 bp, Artificial
  CRISPR gRNA sequence
aaacgttatgacaaattatt

SEQ ID NO: 452958 - DNA, 20 bp, Artificial
  CRISPR gRNA sequence
aacgctaatctatattggta

SEQ ID NO: 452959 - DNA, 20 bp, Artificial
  CRISPR gRNA sequence
ttttcagaggactcagctac

SEQ ID NO: 452960 - DNA, 20 bp, Artificial
  CRISPR gRNA sequence
tcctctaatagctgaaaatc

SEQ ID NO: 452961 - DNA, 20 bp, Artificial
  CRISPR gRNA sequence
tacctcctacccattgaaaa

SEQ ID NO: 452962 - DNA, 20 bp, Artificial
  CRISPR gRNA sequence
agtgcctttggatcagtgaa

SEQ ID NO: 452963 - DNA, 20 bp, Artificial
  CRISPR gRNA sequence
tgaactttcctgtggatagc

SEQ ID NO: 452964 - DNA, 20 bp, Artificial
  CRISPR gRNA sequence
cagaaatataatagcaccct

SEQ ID NO: 452965 - DNA, 20 bp, Artificial
  CRISPR gRNA sequence
aatagcaccctcattgcttg

SEQ ID NO: 452966 - DNA, 20 bp, Artificial
  CRISPR gRNA sequence
ggctgaactcaaggtgttgt

SEQ ID NO: 452967 - DNA, 20 bp, Artificial
  CRISPR gRNA sequence
aagagaatcatggatcaggg

SEQ ID NO: 452968 - DNA, 20 bp, Artificial
  CRISPR gRNA sequence
aacatctcttttatgatctc

SEQ ID NO: 452969 - DNA, 20 bp, Artificial
  CRISPR gRNA sequence
gatagatcttaaagtaattc

SEQ ID NO: 452970 - DNA, 20 bp, Artificial
  CRISPR gRNA sequence
tttgccacagagatagctga

SEQ ID NO: 452971 - DNA, 20 bp, Artificial
  CRISPR gRNA sequence
cttgcccttttggaatagat

SEQ ID NO: 452972 - DNA, 20 bp, Artificial
  CRISPR gRNA sequence
ttggaatagatctgggtttt

SEQ ID NO: 452973 - DNA, 20 bp, Artificial
  CRISPR gRNA sequence
aatagatctgggtttttttt

SEQ ID NO: 452974 - DNA, 20 bp, Artificial
  CRISPR gRNA sequence
gatctgggttttttttgttt

SEQ ID NO: 452975 - DNA, 20 bp, Artificial
  CRISPR gRNA sequence
tgggttttttttgtttgttt

SEQ ID NO: 452976 - DNA, 20 bp, Artificial
  CRISPR gRNA sequence
tttttttgtttgtttgtttg

SEQ ID NO: 452977 - DNA, 20 bp, Artificial
  CRISPR gRNA sequence
tgtttgtttgtttgttttgt

SEQ ID NO: 452978 - DNA, 20 bp, Artificial
  CRISPR gRNA sequence
agcccaatcgatcctcccac

SEQ ID NO: 452979 - DNA, 20 bp, Artificial
  CRISPR gRNA sequence
tttttgtattttttgtagag

SEQ ID NO: 452980 - DNA, 20 bp, Artificial
  CRISPR gRNA sequence
gacactgcacctggactaga

SEQ ID NO: 452981 - DNA, 20 bp, Artificial
  CRISPR gRNA sequence
tggatgaacataaattatct

SEQ ID NO: 452982 - DNA, 20 bp, Artificial
  CRISPR gRNA sequence
gacaatagctcaaaagacca

SEQ ID NO: 452983 - DNA, 20 bp, Artificial
  CRISPR gRNA sequence
agcactcagtaaatggcaga

SEQ ID NO: 452984 - DNA, 20 bp, Artificial
  CRISPR gRNA sequence
caatctcggctcactgcaac

SEQ ID NO: 452985 - DNA, 20 bp, Artificial
  CRISPR gRNA sequence
aacctctgcttcccgggttc

SEQ ID NO: 452986 - DNA, 20 bp, Artificial
  CRISPR gRNA sequence
tgcctcagcctcccaagtag

SEQ ID NO: 452987 - DNA, 20 bp, Artificial
  CRISPR gRNA sequence
ttttgtatttttagtagaga

SEQ ID NO: 452988 - DNA, 20 bp, Artificial
  CRISPR gRNA sequence
acagggtttcaccatgttgg

SEQ ID NO: 452989 - DNA, 20 bp, Artificial
  CRISPR gRNA sequence
agcctcagcctcctgaagtg

SEQ ID NO: 452990 - DNA, 20 bp, Artificial
  CRISPR gRNA sequence
tgagccaccacccaccctga

SEQ ID NO: 452991 - DNA, 20 bp, Artificial
  CRISPR gRNA sequence
ttattacctgtctcttctta

SEQ ID NO: 452992 - DNA, 20 bp, Artificial
  CRISPR gRNA sequence
taaaacaatatattaggaga

SEQ ID NO: 452993 - DNA, 20 bp, Artificial
  CRISPR gRNA sequence
gaaagaggagtatccactag

SEQ ID NO: 452994 - DNA, 20 bp, Artificial
  CRISPR gRNA sequence
aagctggtggtagtatgtag

SEQ ID NO: 452995 - DNA, 20 bp, Artificial
  CRISPR gRNA sequence
cagaaatagggtctcaggag

SEQ ID NO: 452996 - DNA, 20 bp, Artificial
  CRISPR gRNA sequence
tcaggaggatagctttgata

SEQ ID NO: 452997 - DNA, 20 bp, Artificial
  CRISPR gRNA sequence
ggacatccaggagctaggag

SEQ ID NO: 452998 - DNA, 20 bp, Artificial
  CRISPR gRNA sequence
caggagctaggagtacagtt

SEQ ID NO: 452999 - DNA, 20 bp, Artificial
  CRISPR gRNA sequence
aggagtacagtttttagttt

SEQ ID NO: 453000 - DNA, 20 bp, Artificial
  CRISPR gRNA sequence
aaaggtgttcaagctggaga

SEQ ID NO: 453001 - DNA, 20 bp, Artificial
  CRISPR gRNA sequence
ctggtcagttgcagggagat

SEQ ID NO: 453002 - DNA, 20 bp, Artificial
  CRISPR gRNA sequence
aagtgagtcttggggaatac

SEQ ID NO: 453003 - DNA, 20 bp, Artificial
  CRISPR gRNA sequence
tcacagaagccactggagat

SEQ ID NO: 453004 - DNA, 20 bp, Artificial
  CRISPR gRNA sequence
aattaactaggaaccatagg

SEQ ID NO: 453005 - DNA, 20 bp, Artificial
  CRISPR gRNA sequence
catttgttcaaaggctctgg

SEQ ID NO: 453006 - DNA, 20 bp, Artificial
  CRISPR gRNA sequence
gtggtgagtgggtaatttat

SEQ ID NO: 453007 - DNA, 20 bp, Artificial
  CRISPR gRNA sequence
cggatagatcacctgaggtc

SEQ ID NO: 453008 - DNA, 20 bp, Artificial
  CRISPR gRNA sequence
agcagtgcccttttgtcctc

SEQ ID NO: 453009 - DNA, 20 bp, Artificial
  CRISPR gRNA sequence
cctaaataatatgctcatat

SEQ ID NO: 453010 - DNA, 20 bp, Artificial
  CRISPR gRNA sequence
ataaaatttagacattttct

SEQ ID NO: 453011 - DNA, 20 bp, Artificial
  CRISPR gRNA sequence
atgtgctagaatatagtaga

SEQ ID NO: 453012 - DNA, 20 bp, Artificial
  CRISPR gRNA sequence
acaaattttatttaaattag

SEQ ID NO: 453013 - DNA, 20 bp, Artificial
  CRISPR gRNA sequence
aattagtcatgtttacataa

SEQ ID NO: 453014 - DNA, 20 bp, Artificial
  CRISPR gRNA sequence
ttgcaaaatcaagttgtgcg

SEQ ID NO: 453015 - DNA, 20 bp, Artificial
  CRISPR gRNA sequence
gctatgtttcttttgtaaaa

SEQ ID NO: 453016 - DNA, 20 bp, Artificial
  CRISPR gRNA sequence
aaaatttagttttttctaga

SEQ ID NO: 453017 - DNA, 20 bp, Artificial
  CRISPR gRNA sequence
tgattttatttttttactgg

SEQ ID NO: 453018 - DNA, 20 bp, Artificial
  CRISPR gRNA sequence
gggcctttagaaagatgata

SEQ ID NO: 453019 - DNA, 20 bp, Artificial
  CRISPR gRNA sequence
atggtgtctccctgtgttgc

SEQ ID NO: 453020 - DNA, 20 bp, Artificial
  CRISPR gRNA sequence
tagaacttccttgttagact

SEQ ID NO: 453021 - DNA, 20 bp, Artificial
  CRISPR gRNA sequence
gtatgtcattttatcccctt

SEQ ID NO: 453022 - DNA, 20 bp, Artificial
  CRISPR gRNA sequence
tcccctttatggattcactt

SEQ ID NO: 453023 - DNA, 20 bp, Artificial
  CRISPR gRNA sequence
tttactgaagcacatcctct

SEQ ID NO: 453024 - DNA, 20 bp, Artificial
  CRISPR gRNA sequence
gtcttttttctttccttaca

SEQ ID NO: 453025 - DNA, 20 bp, Artificial
  CRISPR gRNA sequence
ttctttccttacatttggtt

SEQ ID NO: 453026 - DNA, 20 bp, Artificial
  CRISPR gRNA sequence
tttttttcccacagaatttt

SEQ ID NO: 453027 - DNA, 20 bp, Artificial
  CRISPR gRNA sequence
agccagaggccttgctgcct

SEQ ID NO: 453028 - DNA, 20 bp, Artificial
  CRISPR gRNA sequence
gcctcacagtttgaaacggt

SEQ ID NO: 453029 - DNA, 20 bp, Artificial
  CRISPR gRNA sequence
gttttgcgtcctgtcccctt

SEQ ID NO: 453030 - DNA, 20 bp, Artificial
  CRISPR gRNA sequence
cgtcctgtcccctttctagt

SEQ ID NO: 453031 - DNA, 20 bp, Artificial
  CRISPR gRNA sequence
tttaatctatggtactttga

SEQ ID NO: 453032 - DNA, 20 bp, Artificial
  CRISPR gRNA sequence
ctatggtactttgaattggt

SEQ ID NO: 453033 - DNA, 20 bp, Artificial
  CRISPR gRNA sequence
ctaatttctttcttttcttt

SEQ ID NO: 453034 - DNA, 20 bp, Artificial
  CRISPR gRNA sequence
tgttttttatttttttgaga

SEQ ID NO: 453035 - DNA, 20 bp, Artificial
  CRISPR gRNA sequence
aacctccgcctcccaggttc

SEQ ID NO: 453036 - DNA, 20 bp, Artificial
  CRISPR gRNA sequence
tgccttagcctcctgagtag

SEQ ID NO: 453037 - DNA, 20 bp, Artificial
  CRISPR gRNA sequence
ttttgtatttttagtagaga

SEQ ID NO: 453038 - DNA, 20 bp, Artificial
  CRISPR gRNA sequence
tacctcagcctcccaaaatg

SEQ ID NO: 453039 - DNA, 20 bp, Artificial
  CRISPR gRNA sequence
ggccaggaagcctaatttct

SEQ ID NO: 453040 - DNA, 20 bp, Artificial
  CRISPR gRNA sequence
gttctaaaattaaagacaaa

SEQ ID NO: 453041 - DNA, 20 bp, Artificial
  CRISPR gRNA sequence
aaattaaagacaaaatgaga

SEQ ID NO: 453042 - DNA, 20 bp, Artificial
  CRISPR gRNA sequence
aaatgagattatgtttgtgt

SEQ ID NO: 453043 - DNA, 20 bp, Artificial
  CRISPR gRNA sequence
ctgccaatggggatgttgga

SEQ ID NO: 453044 - DNA, 20 bp, Artificial
  CRISPR gRNA sequence
ctgaaggcggatacctgact

SEQ ID NO: 453045 - DNA, 20 bp, Artificial
  CRISPR gRNA sequence
cccactgtgcaacggtgtga

SEQ ID NO: 453046 - DNA, 20 bp, Artificial
  CRISPR gRNA sequence
caggatcccttttaagtctc

SEQ ID NO: 453047 - DNA, 20 bp, Artificial
  CRISPR gRNA sequence
ttctttcttatgccatacag

SEQ ID NO: 453048 - DNA, 20 bp, Artificial
  CRISPR gRNA sequence
cttatgccatacagtacaga

SEQ ID NO: 453049 - DNA, 20 bp, Artificial
  CRISPR gRNA sequence
agttacctaactccttgggc

SEQ ID NO: 453050 - DNA, 20 bp, Artificial
  CRISPR gRNA sequence
ctcaaagcatccattaattc

SEQ ID NO: 453051 - DNA, 20 bp, Artificial
  CRISPR gRNA sequence
tttgttcctccacttaacaa

SEQ ID NO: 453052 - DNA, 20 bp, Artificial
  CRISPR gRNA sequence
tcccctaaccattagatgac

SEQ ID NO: 453053 - DNA, 20 bp, Artificial
  CRISPR gRNA sequence
ctcctgggctcaagcaatcc

SEQ ID NO: 453054 - DNA, 20 bp, Artificial
  CRISPR gRNA sequence
ctaattttttattttgtaga

SEQ ID NO: 453055 - DNA, 20 bp, Artificial
  CRISPR gRNA sequence
tgcctctgcctcccaaactg

SEQ ID NO: 453056 - DNA, 20 bp, Artificial
  CRISPR gRNA sequence
ccactgtgcctggccactct

SEQ ID NO: 453057 - DNA, 20 bp, Artificial
  CRISPR gRNA sequence
ttattataattgaggaatct

SEQ ID NO: 453058 - DNA, 20 bp, Artificial
  CRISPR gRNA sequence
agctgacttgaaggatgagt

SEQ ID NO: 453059 - DNA, 20 bp, Artificial
  CRISPR gRNA sequence
agagaccacagaaataccag

SEQ ID NO: 453060 - DNA, 20 bp, Artificial
  CRISPR gRNA sequence
ctgatggtgccagtctgccc

SEQ ID NO: 453061 - DNA, 20 bp, Artificial
  CRISPR gRNA sequence
aaaatagttgggttaaccca

SEQ ID NO: 453062 - DNA, 20 bp, Artificial
  CRISPR gRNA sequence
cctcaaacttcacttccttc

SEQ ID NO: 453063 - DNA, 20 bp, Artificial
  CRISPR gRNA sequence
ttatatccaccctcagctcc

SEQ ID NO: 453064 - DNA, 20 bp, Artificial
  CRISPR gRNA sequence
gccccctcccccactccctt

SEQ ID NO: 453065 - DNA, 20 bp, Artificial
  CRISPR gRNA sequence
tggcagcttgatccgctatg

SEQ ID NO: 453066 - DNA, 20 bp, Artificial
  CRISPR gRNA sequence
gggagacctgcaatcccagc

SEQ ID NO: 453067 - DNA, 20 bp, Artificial
  CRISPR gRNA sequence
cagccattgattcactccaa

SEQ ID NO: 453068 - DNA, 20 bp, Artificial
  CRISPR gRNA sequence
cttctatagggtctctgtta

SEQ ID NO: 453069 - DNA, 20 bp, Artificial
  CRISPR gRNA sequence
aaactagctgctgaagttaa

SEQ ID NO: 453070 - DNA, 20 bp, Artificial
  CRISPR gRNA sequence
tgcagtatctggatctcaaa

SEQ ID NO: 453071 - DNA, 20 bp, Artificial
  CRISPR gRNA sequence
aaaggaatcttaggttgagg

SEQ ID NO: 453072 - DNA, 20 bp, Artificial
  CRISPR gRNA sequence
tcgggaagctgagccagcag

SEQ ID NO: 453073 - DNA, 20 bp, Artificial
  CRISPR gRNA sequence
aaaaaaaaaaaaaaagagtc

SEQ ID NO: 453074 - DNA, 20 bp, Artificial
  CRISPR gRNA sequence
atgttggctctgctggtatc

SEQ ID NO: 453075 - DNA, 20 bp, Artificial
  CRISPR gRNA sequence
accatttccccatcccaggc

SEQ ID NO: 453076 - DNA, 20 bp, Artificial
  CRISPR gRNA sequence
ttccccatcccaggctctag

SEQ ID NO: 453077 - DNA, 20 bp, Artificial
  CRISPR gRNA sequence
agagtatgatggaggtagag

SEQ ID NO: 453078 - DNA, 20 bp, Artificial
  CRISPR gRNA sequence
tatatatttttttaagttaa

SEQ ID NO: 453079 - DNA, 20 bp, Artificial
  CRISPR gRNA sequence
gattgctgcgtcaaagaata

SEQ ID NO: 453080 - DNA, 20 bp, Artificial
  CRISPR gRNA sequence
aaaactttttttctactata

SEQ ID NO: 453081 - DNA, 20 bp, Artificial
  CRISPR gRNA sequence
gataatcagatgttcaccaa

SEQ ID NO: 453082 - DNA, 20 bp, Artificial
  CRISPR gRNA sequence
tctgatggatgaaaaattag

SEQ ID NO: 453083 - DNA, 20 bp, Artificial
  CRISPR gRNA sequence
acctgctttatgttgcattt

SEQ ID NO: 453084 - DNA, 20 bp, Artificial
  CRISPR gRNA sequence
gtgaagttgaggatcttttc

SEQ ID NO: 453085 - DNA, 20 bp, Artificial
  CRISPR gRNA sequence
gcaaatactttctcccaatt

SEQ ID NO: 453086 - DNA, 20 bp, Artificial
  CRISPR gRNA sequence
ttgtctcttcacttttttta

SEQ ID NO: 453087 - DNA, 20 bp, Artificial
  CRISPR gRNA sequence
tgaggcttttttttcacaag

SEQ ID NO: 453088 - DNA, 20 bp, Artificial
  CRISPR gRNA sequence
tatcttttcctttaagttgt

SEQ ID NO: 453089 - DNA, 20 bp, Artificial
  CRISPR gRNA sequence
taagttgtctgggtttcctg

SEQ ID NO: 453090 - DNA, 20 bp, Artificial
  CRISPR gRNA sequence
gggtttcctgcattgtttag

SEQ ID NO: 453091 - DNA, 20 bp, Artificial
  CRISPR gRNA sequence
taattttctttcaatatttt

SEQ ID NO: 453092 - DNA, 20 bp, Artificial
  CRISPR gRNA sequence
tcctggctaagaaaaattac

SEQ ID NO: 453093 - DNA, 20 bp, Artificial
  CRISPR gRNA sequence
tgaatttcatcaatagggaa

SEQ ID NO: 453094 - DNA, 20 bp, Artificial
  CRISPR gRNA sequence
tcaatagggaaaatggttta

SEQ ID NO: 453095 - DNA, 20 bp, Artificial
  CRISPR gRNA sequence
aaaatcctctctatgtgtgt

SEQ ID NO: 453096 - DNA, 20 bp, Artificial
  CRISPR gRNA sequence
atgtgttttaaaaatatatt

SEQ ID NO: 453097 - DNA, 20 bp, Artificial
  CRISPR gRNA sequence
taaaaatatatttaaggttt

SEQ ID NO: 453098 - DNA, 20 bp, Artificial
  CRISPR gRNA sequence
atttttctataaatttattt

SEQ ID NO: 453099 - DNA, 20 bp, Artificial
  CRISPR gRNA sequence
ttatttttctgatttttata

SEQ ID NO: 453100 - DNA, 20 bp, Artificial
  CRISPR gRNA sequence
gagaactgaatttgttgtga

SEQ ID NO: 453101 - DNA, 20 bp, Artificial
  CRISPR gRNA sequence
tgtgtgtctcaggtatgtat

SEQ ID NO: 453102 - DNA, 20 bp, Artificial
  CRISPR gRNA sequence
agtcctcgtccatttcttag

SEQ ID NO: 453103 - DNA, 20 bp, Artificial
  CRISPR gRNA sequence
ctcgtccatttcttagctaa

SEQ ID NO: 453104 - DNA, 20 bp, Artificial
  CRISPR gRNA sequence
agggtacatgtgcacaatgt

SEQ ID NO: 453105 - DNA, 20 bp, Artificial
  CRISPR gRNA sequence
caggtttgttacatagttgt

SEQ ID NO: 453106 - DNA, 20 bp, Artificial
  CRISPR gRNA sequence
catagttgtacatgtttcat

SEQ ID NO: 453107 - DNA, 20 bp, Artificial
  CRISPR gRNA sequence
tacttatgagcgagaacatg

SEQ ID NO: 453108 - DNA, 20 bp, Artificial
  CRISPR gRNA sequence
atgagcgagaacatgcagtg

SEQ ID NO: 453109 - DNA, 20 bp, Artificial
  CRISPR gRNA sequence
gtttggtttcctgtccttgt

SEQ ID NO: 453110 - DNA, 20 bp, Artificial
  CRISPR gRNA sequence
ggtttcctgtccttgtgaca

SEQ ID NO: 453111 - DNA, 20 bp, Artificial
  CRISPR gRNA sequence
tgtgacagtttgcttagaat

SEQ ID NO: 453112 - DNA, 20 bp, Artificial
  CRISPR gRNA sequence
gtttgcttagaatgatggtt

SEQ ID NO: 453113 - DNA, 20 bp, Artificial
  CRISPR gRNA sequence
atggacatttgggttggttc

SEQ ID NO: 453114 - DNA, 20 bp, Artificial
  CRISPR gRNA sequence
acttgtgcatctttatcgta

SEQ ID NO: 453115 - DNA, 20 bp, Artificial
  CRISPR gRNA sequence
ctttgggtatatgcccagta

SEQ ID NO: 453116 - DNA, 20 bp, Artificial
  CRISPR gRNA sequence
tccacatcttctccagcatc

SEQ ID NO: 453117 - DNA, 20 bp, Artificial
  CRISPR gRNA sequence
ttgttcatatatgaaaggct

SEQ ID NO: 453118 - DNA, 20 bp, Artificial
  CRISPR gRNA sequence
ccttaattctatcatttttc

SEQ ID NO: 453119 - DNA, 20 bp, Artificial
  CRISPR gRNA sequence
atcatttttcagttgattct

SEQ ID NO: 453120 - DNA, 20 bp, Artificial
  CRISPR gRNA sequence
cttccttttctattttatat

SEQ ID NO: 453121 - DNA, 20 bp, Artificial
  CRISPR gRNA sequence
aatgaatctctgtctttttt

SEQ ID NO: 453122 - DNA, 20 bp, Artificial
  CRISPR gRNA sequence
ttttttctaagtttaatggg

SEQ ID NO: 453123 - DNA, 20 bp, Artificial
  CRISPR gRNA sequence
aagtttaatgggggatgctt

SEQ ID NO: 453124 - DNA, 20 bp, Artificial
  CRISPR gRNA sequence
gtttccttattaagtattat

SEQ ID NO: 453125 - DNA, 20 bp, Artificial
  CRISPR gRNA sequence
acatttatttctattttatt

SEQ ID NO: 453126 - DNA, 20 bp, Artificial
  CRISPR gRNA sequence
aaaatgtcaaggatggatgt

SEQ ID NO: 453127 - DNA, 20 bp, Artificial
  CRISPR gRNA sequence
ttaagatggcgatctacatt

SEQ ID NO: 453128 - DNA, 20 bp, Artificial
  CRISPR gRNA sequence
ctggagtgcagtggcacgat

SEQ ID NO: 453129 - DNA, 20 bp, Artificial
  CRISPR gRNA sequence
aacttccacctcctgggttc

SEQ ID NO: 453130 - DNA, 20 bp, Artificial
  CRISPR gRNA sequence
tgcctcagcctgccgagtat

SEQ ID NO: 453131 - DNA, 20 bp, Artificial
  CRISPR gRNA sequence
tacaggcgcctgccgagtat

SEQ ID NO: 453132 - DNA, 20 bp, Artificial
  CRISPR gRNA sequence
ttttgtatttttagtagaga

SEQ ID NO: 453133 - DNA, 20 bp, Artificial
  CRISPR gRNA sequence
caccttggcctcccaaagtg

SEQ ID NO: 453134 - DNA, 20 bp, Artificial
  CRISPR gRNA sequence
tcttttcatgtgctgctgta

SEQ ID NO: 453135 - DNA, 20 bp, Artificial
  CRISPR gRNA sequence
tgggaggatcacttgagccc

SEQ ID NO: 453136 - DNA, 20 bp, Artificial
  CRISPR gRNA sequence
atacaccatgacaaatggaa

SEQ ID NO: 453137 - DNA, 20 bp, Artificial
  CRISPR gRNA sequence
tttcatttttagaaattctt

SEQ ID NO: 453138 - DNA, 20 bp, Artificial
  CRISPR gRNA sequence
taatattaggagcaaggcag

SEQ ID NO: 453139 - DNA, 20 bp, Artificial
  CRISPR gRNA sequence
gttatttcacattgttctga

SEQ ID NO: 453140 - DNA, 20 bp, Artificial
  CRISPR gRNA sequence
acaaaagacgaaatgcaata

SEQ ID NO: 453141 - DNA, 20 bp, Artificial
  CRISPR gRNA sequence
cgaaatgcaataaaaagttt

SEQ ID NO: 453142 - DNA, 20 bp, Artificial
  CRISPR gRNA sequence
ggtagaactatacattgtta

SEQ ID NO: 453143 - DNA, 20 bp, Artificial
  CRISPR gRNA sequence
acataccctgtccctttggc

SEQ ID NO: 453144 - DNA, 20 bp, Artificial
  CRISPR gRNA sequence
tcaggaggctgaggcaggat

SEQ ID NO: 453145 - DNA, 20 bp, Artificial
  CRISPR gRNA sequence
aattgcttgaacctgggagg

SEQ ID NO: 453146 - DNA, 20 bp, Artificial
  CRISPR gRNA sequence
agaatagaatgttatgtaat

SEQ ID NO: 453147 - DNA, 20 bp, Artificial
  CRISPR gRNA sequence
aataaggtacttattaatac

SEQ ID NO: 453148 - DNA, 20 bp, Artificial
  CRISPR gRNA sequence
ataaaagaaaatctaagtag

SEQ ID NO: 453149 - DNA, 20 bp, Artificial
  CRISPR gRNA sequence
tattcaaagaggaagacaaa

SEQ ID NO: 453150 - DNA, 20 bp, Artificial
  CRISPR gRNA sequence
aagcgtagactctagagcca

SEQ ID NO: 453151 - DNA, 20 bp, Artificial
  CRISPR gRNA sequence
aatggcgtgagcccgagagg

SEQ ID NO: 453152 - DNA, 20 bp, Artificial
  CRISPR gRNA sequence
actccagcctgggcgacaga

SEQ ID NO: 453153 - DNA, 20 bp, Artificial
  CRISPR gRNA sequence
ttaatagttgcatgactcgg

SEQ ID NO: 453154 - DNA, 20 bp, Artificial
  CRISPR gRNA sequence
atcactaacacagcagaggc

SEQ ID NO: 453155 - DNA, 20 bp, Artificial
  CRISPR gRNA sequence
tggtctctagagtcagacca

SEQ ID NO: 453156 - DNA, 20 bp, Artificial
  CRISPR gRNA sequence
tcagaccaggatgtttcaga

SEQ ID NO: 453157 - DNA, 20 bp, Artificial
  CRISPR gRNA sequence
aactatctgtgtaatattgg

SEQ ID NO: 453158 - DNA, 20 bp, Artificial
  CRISPR gRNA sequence
aagggctcaataaatgatag

SEQ ID NO: 453159 - DNA, 20 bp, Artificial
  CRISPR gRNA sequence
ctcaataaatgatagctatg

SEQ ID NO: 453160 - DNA, 20 bp, Artificial
  CRISPR gRNA sequence
aatgatagctatgattagtt

SEQ ID NO: 453161 - DNA, 20 bp, Artificial
  CRISPR gRNA sequence
aggcacatctacctgcaaga

SEQ ID NO: 453162 - DNA, 20 bp, Artificial
  CRISPR gRNA sequence
attatttgtacgaagcatat

SEQ ID NO: 453163 - DNA, 20 bp, Artificial
  CRISPR gRNA sequence
aggcttggaggggacttgtg

SEQ ID NO: 453164 - DNA, 20 bp, Artificial
  CRISPR gRNA sequence
caatgaagttaggccttcat

SEQ ID NO: 453165 - DNA, 20 bp, Artificial
  CRISPR gRNA sequence
tggggaatgggctgaggaga

SEQ ID NO: 453166 - DNA, 20 bp, Artificial
  CRISPR gRNA sequence
aggtcgtgtcccttctctag

SEQ ID NO: 453167 - DNA, 20 bp, Artificial
  CRISPR gRNA sequence
tgggaggggcgcagggtagg

SEQ ID NO: 453168 - DNA, 20 bp, Artificial
  CRISPR gRNA sequence
gggcagcgcggagccggcgg

SEQ ID NO: 453169 - DNA, 20 bp, Artificial
  CRISPR gRNA sequence
gtggactcctgggttcaaat

SEQ ID NO: 453170 - DNA, 20 bp, Artificial
  CRISPR gRNA sequence
cactcagcctcacattcctc

SEQ ID NO: 453171 - DNA, 20 bp, Artificial
  CRISPR gRNA sequence
ggtgacggttagatgacaca

SEQ ID NO: 453172 - DNA, 20 bp, Artificial
  CRISPR gRNA sequence
atgacacataaagctttgcc

SEQ ID NO: 453173 - DNA, 20 bp, Artificial
  CRISPR gRNA sequence
gatctcatttgcagctgtga

SEQ ID NO: 453174 - DNA, 20 bp, Artificial
  CRISPR gRNA sequence
aaccagacttgttagtagac

SEQ ID NO: 453175 - DNA, 20 bp, Artificial
  CRISPR gRNA sequence
tgaagctcttgtctgagatc

SEQ ID NO: 453176 - DNA, 20 bp, Artificial
  CRISPR gRNA sequence
aatgtgtggtagagcagtac

SEQ ID NO: 453177 - DNA, 20 bp, Artificial
  CRISPR gRNA sequence
tagagcagtacacatgcttc

SEQ ID NO: 453178 - DNA, 20 bp, Artificial
  CRISPR gRNA sequence
agaaatctataaaaactgta

SEQ ID NO: 453179 - DNA, 20 bp, Artificial
  CRISPR gRNA sequence
gtaatgagatttgaaaatat

SEQ ID NO: 453180 - DNA, 20 bp, Artificial
  CRISPR gRNA sequence
agcaagtgctgactttcaat

SEQ ID NO: 453181 - DNA, 20 bp, Artificial
  CRISPR gRNA sequence
ctccaagccccgtggcacct

SEQ ID NO: 453182 - DNA, 20 bp, Artificial
  CRISPR gRNA sequence
tgaggaatgtcagaatgggg

SEQ ID NO: 453183 - DNA, 20 bp, Artificial
  CRISPR gRNA sequence
aggacatttccctccaaaag

SEQ ID NO: 453184 - DNA, 20 bp, Artificial
  CRISPR gRNA sequence
cgttgaaatggctctcagtc

SEQ ID NO: 453185 - DNA, 20 bp, Artificial
  CRISPR gRNA sequence
tcttgttaaaaccctatctc

SEQ ID NO: 453186 - DNA, 20 bp, Artificial
  CRISPR gRNA sequence
agatcttccgccacccccac

SEQ ID NO: 453187 - DNA, 20 bp, Artificial
  CRISPR gRNA sequence
gtgagcccccagtctgagaa

SEQ ID NO: 453188 - DNA, 20 bp, Artificial
  CRISPR gRNA sequence
caggcttctcatgaggtccc

SEQ ID NO: 453189 - DNA, 20 bp, Artificial
  CRISPR gRNA sequence
aatgtagacaatgaaccaca

SEQ ID NO: 453190 - DNA, 20 bp, Artificial
  CRISPR gRNA sequence
cacaatagaatttgccatca

SEQ ID NO: 453191 - DNA, 20 bp, Artificial
  CRISPR gRNA sequence
ccttaacgctcagcactact

SEQ ID NO: 453192 - DNA, 20 bp, Artificial
  CRISPR gRNA sequence
ccctcttgtccccaccctcc

SEQ ID NO: 453193 - DNA, 20 bp, Artificial
  CRISPR gRNA sequence
agcctttccacatccctcat

SEQ ID NO: 453194 - DNA, 20 bp, Artificial
  CRISPR gRNA sequence
gagggacaaaggggactcca

SEQ ID NO: 453195 - DNA, 20 bp, Artificial
  CRISPR gRNA sequence
cttcgtacaaataataaatt

SEQ ID NO: 453196 - DNA, 20 bp, Artificial
  CRISPR gRNA sequence
actgtccattgattccaata

SEQ ID NO: 453197 - DNA, 20 bp, Artificial
  CRISPR gRNA sequence
tgaccctcacaacccaagga

SEQ ID NO: 453198 - DNA, 20 bp, Artificial
  CRISPR gRNA sequence
tttataggtcattaagagat

SEQ ID NO: 453199 - DNA, 20 bp, Artificial
  CRISPR gRNA sequence
tagcgcctggcccaggagcc

SEQ ID NO: 453200 - DNA, 20 bp, Artificial
  CRISPR gRNA sequence
tttatttttgttttttcgag

SEQ ID NO: 453201 - DNA, 20 bp, Artificial
  CRISPR gRNA sequence
caaatgtatagataagtaca

SEQ ID NO: 453202 - DNA, 20 bp, Artificial
  CRISPR gRNA sequence
tttcagaacaatgtgaaata

SEQ ID NO: 453203 - DNA, 20 bp, Artificial
  CRISPR gRNA sequence
ctgccttgctcctaatatta

SEQ ID NO: 453204 - DNA, 20 bp, Artificial
  CRISPR gRNA sequence
tttcctaatattaaatcatc

SEQ ID NO: 453205 - DNA, 20 bp, Artificial
  CRISPR gRNA sequence
tttaaatataatattataaa

SEQ ID NO: 453206 - DNA, 20 bp, Artificial
  CRISPR gRNA sequence
cagaatacagcagcacatga

SEQ ID NO: 453207 - DNA, 20 bp, Artificial
  CRISPR gRNA sequence
atactcggcaggctgaggca

SEQ ID NO: 453208 - DNA, 20 bp, Artificial
  CRISPR gRNA sequence
cagagtgagactctgtctca

SEQ ID NO: 453209 - DNA, 20 bp, Artificial
  CRISPR gRNA sequence
tcgccatcttaatatatctt

SEQ ID NO: 453210 - DNA, 20 bp, Artificial
  CRISPR gRNA sequence
attttaaaactcttaataaa

SEQ ID NO: 453211 - DNA, 20 bp, Artificial
  CRISPR gRNA sequence
ttaagcatcccccattaaac

SEQ ID NO: 453212 - DNA, 20 bp, Artificial
  CRISPR gRNA sequence
gatattaaccaacacaatta

SEQ ID NO: 453213 - DNA, 20 bp, Artificial
  CRISPR gRNA sequence
ttaaccaacacaattagaag

SEQ ID NO: 453214 - DNA, 20 bp, Artificial
  CRISPR gRNA sequence
aaagaaatcagagatataaa

SEQ ID NO: 453215 - DNA, 20 bp, Artificial
  CRISPR gRNA sequence
ttgcataactggaaaatcca

SEQ ID NO: 453216 - DNA, 20 bp, Artificial
  CRISPR gRNA sequence
agagaatcaactgaaaaatg

SEQ ID NO: 453217 - DNA, 20 bp, Artificial
  CRISPR gRNA sequence
acagatgctggagaagatgt

SEQ ID NO: 453218 - DNA, 20 bp, Artificial
  CRISPR gRNA sequence
gattcctcaaggatctagaa

SEQ ID NO: 453219 - DNA, 20 bp, Artificial
  CRISPR gRNA sequence
ccatcaatgatagactggat

SEQ ID NO: 453220 - DNA, 20 bp, Artificial
  CRISPR gRNA sequence
ccgggggagggatagcatta

SEQ ID NO: 453221 - DNA, 20 bp, Artificial
  CRISPR gRNA sequence
gtgaaaaaatatgaattact

SEQ ID NO: 453222 - DNA, 20 bp, Artificial
  CRISPR gRNA sequence
actcaagaaacaaacttagc

SEQ ID NO: 453223 - DNA, 20 bp, Artificial
  CRISPR gRNA sequence
gaaatggacgaggactttat

SEQ ID NO: 453224 - DNA, 20 bp, Artificial
  CRISPR gRNA sequence
aatatcacattctcggatca

SEQ ID NO: 453225 - DNA, 20 bp, Artificial
  CRISPR gRNA sequence
agacaagctgattataaaaa

SEQ ID NO: 453226 - DNA, 20 bp, Artificial
  CRISPR gRNA sequence
aaaatcagaaaaataaattt

SEQ ID NO: 453227 - DNA, 20 bp, Artificial
  CRISPR gRNA sequence
gtaaaacaataaaaatattg

SEQ ID NO: 453228 - DNA, 20 bp, Artificial
  CRISPR gRNA sequence
aagagacaaacaacaaattg

SEQ ID NO: 453229 - DNA, 20 bp, Artificial
  CRISPR gRNA sequence
tgggttaatatctctaatac

SEQ ID NO: 453230 - DNA, 20 bp, Artificial
  CRISPR gRNA sequence
cggagaaagtgcctaaaagt

SEQ ID NO: 453231 - DNA, 20 bp, Artificial
  CRISPR gRNA sequence
gcctaaaagttaagaaatgt

SEQ ID NO: 453232 - DNA, 20 bp, Artificial
  CRISPR gRNA sequence
tggagagcaatctgattata

SEQ ID NO: 453233 - DNA, 20 bp, Artificial
  CRISPR gRNA sequence
ttaacttaaaaaaatatata

SEQ ID NO: 453234 - DNA, 20 bp, Artificial
  CRISPR gRNA sequence
cttgacattaaggaaagggt

SEQ ID NO: 453235 - DNA, 20 bp, Artificial
  CRISPR gRNA sequence
ctatactgaggatttgatat

SEQ ID NO: 453236 - DNA, 20 bp, Artificial
  CRISPR gRNA sequence
atagaagttccagctggaaa

SEQ ID NO: 453237 - DNA, 20 bp, Artificial
  CRISPR gRNA sequence
ccatatctcttactcttgta

SEQ ID NO: 453238 - DNA, 20 bp, Artificial
  CRISPR gRNA sequence
tctctctcatcctatatttc

SEQ ID NO: 453239 - DNA, 20 bp, Artificial
  CRISPR gRNA sequence
gactagcctggacaacatag

SEQ ID NO: 453240 - DNA, 20 bp, Artificial
  CRISPR gRNA sequence
gagcagttacggtgaaattc

SEQ ID NO: 453241 - DNA, 20 bp, Artificial
  CRISPR gRNA sequence
ttaatctgtactgtatggca

SEQ ID NO: 453242 - DNA, 20 bp, Artificial
  CRISPR gRNA sequence
actggtgaaagtaaaaacag

SEQ ID NO: 453243 - DNA, 20 bp, Artificial
  CRISPR gRNA sequence
aagatcagcctagccaacat

SEQ ID NO: 453244 - DNA, 20 bp, Artificial
  CRISPR gRNA sequence
ctactcaggaggctaaggca

SEQ ID NO: 453245 - DNA, 20 bp, Artificial
  CRISPR gRNA sequence
tgtctcaaaaaaataaaaaa

SEQ ID NO: 453246 - DNA, 20 bp, Artificial
  CRISPR gRNA sequence
caaaaaaataaaaaacaaga

SEQ ID NO: 453247 - DNA, 20 bp, Artificial
  CRISPR gRNA sequence
aaataaaaaacaagaaaaga

SEQ ID NO: 453248 - DNA, 20 bp, Artificial
  CRISPR gRNA sequence
aaaaaacaagaaaagaaaag

SEQ ID NO: 453249 - DNA, 20 bp, Artificial
  CRISPR gRNA sequence
attcccaattcagaactctc

SEQ ID NO: 453250 - DNA, 20 bp, Artificial
  CRISPR gRNA sequence
ggagcatttagttggaggaa

SEQ ID NO: 453251 - DNA, 20 bp, Artificial
  CRISPR gRNA sequence
atgagttctagctcctggaa

SEQ ID NO: 453252 - DNA, 20 bp, Artificial
  CRISPR gRNA sequence
ctagctcctggaatcagaaa

SEQ ID NO: 453253 - DNA, 20 bp, Artificial
  CRISPR gRNA sequence
cttaagtcaaattgtgccca

SEQ ID NO: 453254 - DNA, 20 bp, Artificial
  CRISPR gRNA sequence
gtgggaaaaaaaaaatttac

SEQ ID NO: 453255 - DNA, 20 bp, Artificial
  CRISPR gRNA sequence
actataaaccaaatgtaagg

SEQ ID NO: 453256 - DNA, 20 bp, Artificial
  CRISPR gRNA sequence
gaggatgtgcttcagtaaaa

SEQ ID NO: 453257 - DNA, 20 bp, Artificial
  CRISPR gRNA sequence
gagacaccatctctagtgga

SEQ ID NO: 453258 - DNA, 20 bp, Artificial
  CRISPR gRNA sequence
aagaaaaaaaaaaggaaatt

SEQ ID NO: 453259 - DNA, 20 bp, Artificial
  CRISPR gRNA sequence
agttagtccagaagagagca

SEQ ID NO: 453260 - DNA, 20 bp, Artificial
  CRISPR gRNA sequence
aaagacccaataaaaagatt

SEQ ID NO: 453261 - DNA, 20 bp, Artificial
  CRISPR gRNA sequence
taaaaaaataaaatcaggct

SEQ ID NO: 453262 - DNA, 20 bp, Artificial
  CRISPR gRNA sequence
agaaaaaactaaattttaca

SEQ ID NO: 453263 - DNA, 20 bp, Artificial
  CRISPR gRNA sequence
ttgattttgcaaaaaataac

SEQ ID NO: 453264 - DNA, 20 bp, Artificial
  CRISPR gRNA sequence
ttgtggtacaattattttta

SEQ ID NO: 453265 - DNA, 20 bp, Artificial
  CRISPR gRNA sequence
gcacatcttcatctactgta

SEQ ID NO: 453266 - DNA, 20 bp, Artificial
  CRISPR gRNA sequence
tctactgtagcagaaagcca

SEQ ID NO: 453267 - DNA, 20 bp, Artificial
  CRISPR gRNA sequence
gcctggcctatcttactttt

SEQ ID NO: 453268 - DNA, 20 bp, Artificial
  CRISPR gRNA sequence
gcacagcagtacttagtggg

SEQ ID NO: 453269 - DNA, 20 bp, Artificial
  CRISPR gRNA sequence
ccagcgctatgccttggaga

SEQ ID NO: 453270 - DNA, 20 bp, Artificial
  CRISPR gRNA sequence
ttgtgaagattctccctaag

SEQ ID NO: 453271 - DNA, 20 bp, Artificial
  CRISPR gRNA sequence
ctacttgggaggctgaggca

SEQ ID NO: 453272 - DNA, 20 bp, Artificial
  CRISPR gRNA sequence
agccagactctgtctcaaaa

SEQ ID NO: 453273 - DNA, 20 bp, Artificial
  CRISPR gRNA sequence
gctagattgcttgaaccact

SEQ ID NO: 453274 - DNA, 20 bp, Artificial
  CRISPR gRNA sequence
gctatctctgtggcaaaact

SEQ ID NO: 453275 - DNA, 20 bp, Artificial
  CRISPR gRNA sequence
ctctcagttcaggcttccta

SEQ ID NO: 453276 - DNA, 20 bp, Artificial
  CRISPR gRNA sequence
tggaaaggatgtccaggggg

SEQ ID NO: 453277 - DNA, 20 bp, Artificial
  CRISPR gRNA sequence
cagattttcagctattagag

SEQ ID NO: 453278 - DNA, 20 bp, Artificial
  CRISPR gRNA sequence
taccactgttttgaatggca

SEQ ID NO: 453279 - DNA, 20 bp, Artificial
  CRISPR gRNA sequence
cttgcaagggttgtataagg

SEQ ID NO: 453280 - DNA, 20 bp, Artificial
  CRISPR gRNA sequence
atgcctaaataaaatggagt

SEQ ID NO: 453281 - DNA, 20 bp, Artificial
  CRISPR gRNA sequence
ctttccaaccttctcctcct

SEQ ID NO: 453282 - DNA, 20 bp, Artificial
  CRISPR gRNA sequence
cctggagaataaccaaggtg

SEQ ID NO: 453283 - DNA, 20 bp, Artificial
  CRISPR gRNA sequence
ttccctgtctctggttcaaa

SEQ ID NO: 453284 - DNA, 20 bp, Artificial
  CRISPR gRNA sequence
tcatggatcaggggagggtt

SEQ ID NO: 453285 - DNA, 20 bp, Artificial
  CRISPR gRNA sequence
ttaggcagccataaataagt

SEQ ID NO: 453286 - DNA, 20 bp, Artificial
  CRISPR gRNA sequence
acttaaatatgctgagaaga

SEQ ID NO: 453287 - DNA, 20 bp, Artificial
  CRISPR gRNA sequence
agaaaagcattcttccttag

SEQ ID NO: 453288 - DNA, 20 bp, Artificial
  CRISPR gRNA sequence
gaagcaatgtattcacataa

SEQ ID NO: 453289 - DNA, 20 bp, Artificial
  CRISPR gRNA sequence
agacaagctggtggtagtat

SEQ ID NO: 453290 - DNA, 20 bp, Artificial
  CRISPR gRNA sequence
gtatgtagaatggattggag

SEQ ID NO: 453291 - DNA, 20 bp, Artificial
  CRISPR gRNA sequence
taactctctgaattgggggt

SEQ ID NO: 453292 - DNA, 20 bp, Artificial
  CRISPR gRNA sequence
caaagttgactccgtcatga

SEQ ID NO: 453293 - DNA, 20 bp, Artificial
  CRISPR gRNA sequence
gaactagggagagagagtaa

SEQ ID NO: 453294 - DNA, 20 bp, Artificial
  CRISPR gRNA sequence
ctaggaaccataggaggtga

SEQ ID NO: 453295 - DNA, 20 bp, Artificial
  CRISPR gRNA sequence
ctatttgggcggctgaggca

SEQ ID NO: 453296 - DNA, 20 bp, Artificial
  CRISPR gRNA sequence
agagtctgtctcaaaaaatc

SEQ ID NO: 453297 - DNA, 20 bp, Artificial
  CRISPR gRNA sequence
tgtctcaaaaaatcaaagaa

SEQ ID NO: 453298 - DNA, 20 bp, Artificial
  CRISPR gRNA sequence
agatagttgtaaaagttcat

SEQ ID NO: 453299 - DNA, 20 bp, Artificial
  CRISPR gRNA sequence
ctacagtagatgaagatgtg

SEQ ID NO: 453300 - DNA, 20 bp, Artificial
  CRISPR gRNA sequence
attgggtctttaatgggcct

SEQ ID NO: 453301 - DNA, 20 bp, Artificial
  CRISPR gRNA sequence
aggtaaattttttttttccc

SEQ ID NO: 453302 - DNA, 20 bp, Artificial
  CRISPR gRNA sequence
atctcgttgtctgcctgaat

SEQ ID NO: 453303 - DNA, 20 bp, Artificial
  CRISPR gRNA sequence
tatgtttgtgtgtgcgcttt

SEQ ID NO: 453304 - DNA, 20 bp, Artificial
  CRISPR gRNA sequence
atttgagcactcacctgtga

SEQ ID NO: 453305 - DNA, 20 bp, Artificial
  CRISPR gRNA sequence
cactcacctgtgaatagaat

SEQ ID NO: 453306 - DNA, 20 bp, Artificial
  CRISPR gRNA sequence
tgcatcctggaatggaaagg

SEQ ID NO: 453307 - DNA, 20 bp, Artificial
  CRISPR gRNA sequence
aggatgagtaaaagtttttc

SEQ ID NO: 453308 - DNA, 20 bp, Artificial
  CRISPR gRNA sequence
aatataggatgagagagacc

SEQ ID NO: 453309 - DNA, 20 bp, Artificial
  CRISPR gRNA sequence
gccactgtgtggaaatggag

SEQ ID NO: 453310 - DNA, 20 bp, Artificial
  CRISPR gRNA sequence
aaatggagtgagaatggact

SEQ ID NO: 453311 - DNA, 20 bp, Artificial
  CRISPR gRNA sequence
tgtaacctggatacagaagt

SEQ ID NO: 453312 - DNA, 20 bp, Artificial
  CRISPR gRNA sequence
atagtatcagttctaatgaa

SEQ ID NO: 453313 - DNA, 20 bp, Artificial
  CRISPR gRNA sequence
ctactcgggaagctgagcca

SEQ ID NO: 453314 - DNA, 20 bp, Artificial
  CRISPR gRNA sequence
gagtcctttgtttccccact

SEQ ID NO: 453315 - DNA, 20 bp, Artificial
  CRISPR gRNA sequence
ttaaattggattgctgcgtc

SEQ ID NO: 453316 - DNA, 20 bp, Artificial
  CRISPR gRNA sequence
gttgataatcagatgttcac

SEQ ID NO: 453317 - DNA, 20 bp, Artificial
  CRISPR gRNA sequence
ttacatcttctaatcctggc

SEQ ID NO: 453318 - DNA, 20 bp, Artificial
  CRISPR gRNA sequence
tgtttcaaaataaacaaact

SEQ ID NO: 453319 - DNA, 20 bp, Artificial
  CRISPR gRNA sequence
caaaatattatatattatta

SEQ ID NO: 453320 - DNA, 20 bp, Artificial
  CRISPR gRNA sequence
taaaattcaaaaggggaaaa

SEQ ID NO: 453321 - DNA, 20 bp, Artificial
  CRISPR gRNA sequence
cttcctactgtgtgtaccat

SEQ ID NO: 453322 - DNA, 20 bp, Artificial
  CRISPR gRNA sequence
tgacattgattcttttgatc

SEQ ID NO: 453323 - DNA, 20 bp, Artificial
  CRISPR gRNA sequence
ctgtccttgtgacagtttgc

SEQ ID NO: 453324 - DNA, 20 bp, Artificial
  CRISPR gRNA sequence
catacttgtgcatctttatc

SEQ ID NO: 453325 - DNA, 20 bp, Artificial
  CRISPR gRNA sequence
aattgtgttggttaatatct

SEQ ID NO: 453326 - DNA, 20 bp, Artificial
  CRISPR gRNA sequence
attaagtattatagtagctt

SEQ ID NO: 453327 - DNA, 20 bp, Artificial
  CRISPR gRNA sequence
ttgacagtgagaccctgtct

SEQ ID NO: 453328 - DNA, 20 bp, Artificial
  CRISPR gRNA sequence
aatggaataaggtttcattt

SEQ ID NO: 453329 - DNA, 20 bp, Artificial
  CRISPR gRNA sequence
ttaacatactactggataaa

SEQ ID NO: 453330 - DNA, 20 bp, Artificial
  CRISPR gRNA sequence
tgaatactattcaatataat

SEQ ID NO: 453331 - DNA, 20 bp, Artificial
  CRISPR gRNA sequence
tgtttgccattatatttaga

SEQ ID NO: 453332 - DNA, 20 bp, Artificial
  CRISPR gRNA sequence
atatgtgatataacttacat

SEQ ID NO: 453333 - DNA, 20 bp, Artificial
  CRISPR gRNA sequence
taacttacatctagaaaacc

SEQ ID NO: 453334 - DNA, 20 bp, Artificial
  CRISPR gRNA sequence
gaaaacccaagaaacttaat

SEQ ID NO: 453335 - DNA, 20 bp, Artificial
  CRISPR gRNA sequence
agaaacttaattgagaatta

SEQ ID NO: 453336 - DNA, 20 bp, Artificial
  CRISPR gRNA sequence
acaaattaaaaattcagagt

SEQ ID NO: 453337 - DNA, 20 bp, Artificial
  CRISPR gRNA sequence
aaaattcagagttcagaatt

SEQ ID NO: 453338 - DNA, 20 bp, Artificial
  CRISPR gRNA sequence
tcaaattttggtaagggtaa

SEQ ID NO: 453339 - DNA, 20 bp, Artificial
  CRISPR gRNA sequence
tgtccctttggctatagctt

SEQ ID NO: 453340 - DNA, 20 bp, Artificial
  CRISPR gRNA sequence
ttttttataataccaaaaaa

SEQ ID NO: 453341 - DNA, 20 bp, Artificial
  CRISPR gRNA sequence
aacaggtgaagacccactgg

SEQ ID NO: 453342 - DNA, 20 bp, Artificial
  CRISPR gRNA sequence
gaataaattattgcagatcc

SEQ ID NO: 453343 - DNA, 20 bp, Artificial
  CRISPR gRNA sequence
aattattgcagatccacaga

SEQ ID NO: 453344 - DNA, 20 bp, Artificial
  CRISPR gRNA sequence
ttcctggatataattattag

SEQ ID NO: 453345 - DNA, 20 bp, Artificial
  CRISPR gRNA sequence
ccaaaaaacccatcaaatgt

SEQ ID NO: 453346 - DNA, 20 bp, Artificial
  CRISPR gRNA sequence
cagtactattaaggaacata

SEQ ID NO: 453347 - DNA, 20 bp, Artificial
  CRISPR gRNA sequence
tatcataccttcatgctaca

SEQ ID NO: 453348 - DNA, 20 bp, Artificial
  CRISPR gRNA sequence
attgcaattattcattcagc

SEQ ID NO: 453349 - DNA, 20 bp, Artificial
  CRISPR gRNA sequence
ctactcgggaggctgaggca

SEQ ID NO: 453350 - DNA, 20 bp, Artificial
  CRISPR gRNA sequence
ctttaataaatagacatatt

SEQ ID NO: 453351 - DNA, 20 bp, Artificial
  CRISPR gRNA sequence
aagtgtcaaggggcagcaca

SEQ ID NO: 453352 - DNA, 20 bp, Artificial
  CRISPR gRNA sequence
gctctcgggagctggtgact

SEQ ID NO: 453353 - DNA, 20 bp, Artificial
  CRISPR gRNA sequence
cacgacactgaaaaagatgc

SEQ ID NO: 453354 - DNA, 20 bp, Artificial
  CRISPR gRNA sequence
agacagttgtcaaaacatta

SEQ ID NO: 453355 - DNA, 20 bp, Artificial
  CRISPR gRNA sequence
gctgagcgttaaggacattt

SEQ ID NO: 453356 - DNA, 20 bp, Artificial
  CRISPR gRNA sequence
attcctccatttgaggaatg

SEQ ID NO: 453357 - DNA, 20 bp, Artificial
  CRISPR gRNA sequence
aggattcctgaatgcccatg

SEQ ID NO: 453358 - DNA, 20 bp, Artificial
  CRISPR gRNA sequence
cgagcatgctggtctggcgg

SEQ ID NO: 453359 - DNA, 20 bp, Artificial
  CRISPR gRNA sequence
atattcgctctttgaaaacc

SEQ ID NO: 453360 - DNA, 20 bp, Artificial
  CRISPR gRNA sequence
aatagaatttgccatcaata

SEQ ID NO: 453361 - DNA, 20 bp, Artificial
  CRISPR gRNA sequence
tcttgtccccaccctcccca

SEQ ID NO: 453362 - DNA, 20 bp, Artificial
  CRISPR gRNA sequence
gattccaatataagaaagca

SEQ ID NO: 453363 - DNA, 20 bp, Artificial
  CRISPR gRNA sequence
tctagagaccatttaaccac

SEQ ID NO: 453364 - DNA, 20 bp, Artificial
  CRISPR gRNA sequence
tgtacttccctgaatacttg

SEQ ID NO: 453365 - DNA, 20 bp, Artificial
  CRISPR gRNA sequence
cctgaatacttgtaaaactg

SEQ ID NO: 453366 - DNA, 20 bp, Artificial
  CRISPR gRNA sequence
aaaatttaaatataatatta

SEQ ID NO: 453367 - DNA, 20 bp, Artificial
  CRISPR gRNA sequence
tgatatttaaaggcaattaa

SEQ ID NO: 453368 - DNA, 20 bp, Artificial
  CRISPR gRNA sequence
cacatccatccttgacattt

SEQ ID NO: 453369 - DNA, 20 bp, Artificial
  CRISPR gRNA sequence
ggtatgaaattaatatctag

SEQ ID NO: 453370 - DNA, 20 bp, Artificial
  CRISPR gRNA sequence
atggacgaggactttatgaa

SEQ ID NO: 453371 - DNA, 20 bp, Artificial
  CRISPR gRNA sequence
acttcaaaagttataaacta

SEQ ID NO: 453372 - DNA, 20 bp, Artificial
  CRISPR gRNA sequence
caaaaccttaaatatatttt

SEQ ID NO: 453373 - DNA, 20 bp, Artificial
  CRISPR gRNA sequence
gaagatgtaactataaaaag

SEQ ID NO: 453374 - DNA, 20 bp, Artificial
  CRISPR gRNA sequence
gtcagagacacccatcgagc

SEQ ID NO: 453375 - DNA, 20 bp, Artificial
  CRISPR gRNA sequence
tctcatcctatatttcttag

SEQ ID NO: 453376 - DNA, 20 bp, Artificial
  CRISPR gRNA sequence
ctgttctcctgagaccagtt

SEQ ID NO: 453377 - DNA, 20 bp, Artificial
  CRISPR gRNA sequence
tgctactcactggtgaaagt

SEQ ID NO: 453378 - DNA, 20 bp, Artificial
  CRISPR gRNA sequence
aactgtgtctcaaaaaaata

SEQ ID NO: 453379 - DNA, 20 bp, Artificial
  CRISPR gRNA sequence
actagaaaggggacaggacg

SEQ ID NO: 453380 - DNA, 20 bp, Artificial
  CRISPR gRNA sequence
taccagaggatgtgcttcag

SEQ ID NO: 453381 - DNA, 20 bp, Artificial
  CRISPR gRNA sequence
agattaaagaaatggatatg

SEQ ID NO: 453382 - DNA, 20 bp, Artificial
  CRISPR gRNA sequence
aaataaaatcaggctctaga

SEQ ID NO: 453383 - DNA, 20 bp, Artificial
  CRISPR gRNA sequence
ggcctatcttactttttaag

SEQ ID NO: 453384 - DNA, 20 bp, Artificial
  CRISPR gRNA sequence
ctcaccaccctccccccatg

SEQ ID NO: 453385 - DNA, 20 bp, Artificial
  CRISPR gRNA sequence
tttaattaaacgtttaaact

SEQ ID NO: 453386 - DNA, 20 bp, Artificial
  CRISPR gRNA sequence
attaggtgcattttggaagg

SEQ ID NO: 453387 - DNA, 20 bp, Artificial
  CRISPR gRNA sequence
agaaataataaaataaaata

SEQ ID NO: 453388 - DNA, 20 bp, Artificial
  CRISPR gRNA sequence
accagcctgggcaacacagt

SEQ ID NO: 453389 - DNA, 20 bp, Artificial
  CRISPR gRNA sequence
agagcaagaccctgtctcaa

SEQ ID NO: 453390 - DNA, 20 bp, Artificial
  CRISPR gRNA sequence
agaccctgtctcaaaaaaac

SEQ ID NO: 453391 - DNA, 20 bp, Artificial
  CRISPR gRNA sequence
ctgtctcaaaaaaacaaaaa

SEQ ID NO: 453392 - DNA, 20 bp, Artificial
  CRISPR gRNA sequence
aaaacaaacaaacaaacaaa

SEQ ID NO: 453393 - DNA, 20 bp, Artificial
  CRISPR gRNA sequence
tgtttcagctatctctgtgg

SEQ ID NO: 453394 - DNA, 20 bp, Artificial
  CRISPR gRNA sequence
cacatgtagctgagtcctct

SEQ ID NO: 453395 - DNA, 20 bp, Artificial
  CRISPR gRNA sequence
ggctcttaataaatttgtta

SEQ ID NO: 453396 - DNA, 20 bp, Artificial
  CRISPR gRNA sequence
ggccagtctgggcaacatgg

SEQ ID NO: 453397 - DNA, 20 bp, Artificial
  CRISPR gRNA sequence
gcttacattctgatgccatt

SEQ ID NO: 453398 - DNA, 20 bp, Artificial
  CRISPR gRNA sequence
taagaatgccaaggccaggc

SEQ ID NO: 453399 - DNA, 20 bp, Artificial
  CRISPR gRNA sequence
gaatcagttgcttgttatgc

SEQ ID NO: 453400 - DNA, 20 bp, Artificial
  CRISPR gRNA sequence
actttttgttatctaatagg

SEQ ID NO: 453401 - DNA, 20 bp, Artificial
  CRISPR gRNA sequence
tgctgaggagccgcattgtt

SEQ ID NO: 453402 - DNA, 20 bp, Artificial
  CRISPR gRNA sequence
ttagggagaatcttcacaac

SEQ ID NO: 453403 - DNA, 20 bp, Artificial
  CRISPR gRNA sequence
catagacagtgagaagccat

SEQ ID NO: 453404 - DNA, 20 bp, Artificial
  CRISPR gRNA sequence
tgtgaggtgatgaagacctg

SEQ ID NO: 453405 - DNA, 20 bp, Artificial
  CRISPR gRNA sequence
ttttagtttaaacgtttaat

SEQ ID NO: 453406 - DNA, 20 bp, Artificial
  CRISPR gRNA sequence
gaccagcctggccgtcatgg

SEQ ID NO: 453407 - DNA, 20 bp, Artificial
  CRISPR gRNA sequence
ctccagacctgtccttgcac

SEQ ID NO: 453408 - DNA, 20 bp, Artificial
  CRISPR gRNA sequence
taatttaaaaaatttttttt

SEQ ID NO: 453409 - DNA, 20 bp, Artificial
  CRISPR gRNA sequence
cagagtttaaagcctaatgt

SEQ ID NO: 453410 - DNA, 20 bp, Artificial
  CRISPR gRNA sequence
cagaaataccagagatgatt

SEQ ID NO: 453411 - DNA, 20 bp, Artificial
  CRISPR gRNA sequence
cctactgtgatggatcctcg

SEQ ID NO: 453412 - DNA, 20 bp, Artificial
  CRISPR gRNA sequence
gttaaatccagctctctgct

SEQ ID NO: 453413 - DNA, 20 bp, Artificial
  CRISPR gRNA sequence
taaactaaattcactctcat

SEQ ID NO: 453414 - DNA, 20 bp, Artificial
  CRISPR gRNA sequence
gcgtcaaagaatatgatgat

SEQ ID NO: 453415 - DNA, 20 bp, Artificial
  CRISPR gRNA sequence
tcaaaataaacaaactgaag

SEQ ID NO: 453416 - DNA, 20 bp, Artificial
  CRISPR gRNA sequence
gcatttaaaattcaaaaggg

SEQ ID NO: 453417 - DNA, 20 bp, Artificial
  CRISPR gRNA sequence
gcagtcccagacaaacaaac

SEQ ID NO: 453418 - DNA, 20 bp, Artificial
  CRISPR gRNA sequence
acagtgagaccctgtctcaa

SEQ ID NO: 453419 - DNA, 20 bp, Artificial
  CRISPR gRNA sequence
tgtgatataacttacatcta

SEQ ID NO: 453420 - DNA, 20 bp, Artificial
  CRISPR gRNA sequence
ctccagcctgggcaacagag

SEQ ID NO: 453421 - DNA, 20 bp, Artificial
  CRISPR gRNA sequence
ttatgtaattatagtttgta

SEQ ID NO: 453422 - DNA, 20 bp, Artificial
  CRISPR gRNA sequence
tccattcattatagcaacca

SEQ ID NO: 453423 - DNA, 20 bp, Artificial
  CRISPR gRNA sequence
tacatttgtcacaatcctaa

SEQ ID NO: 453424 - DNA, 20 bp, Artificial
  CRISPR gRNA sequence
ttgtgttcaaatcctggtcc

SEQ ID NO: 453425 - DNA, 20 bp, Artificial
  CRISPR gRNA sequence
agagcaagattctgtctcga

SEQ ID NO: 453426 - DNA, 20 bp, Artificial
  CRISPR gRNA sequence
tgtctcgaaaaaacaaaaat

SEQ ID NO: 453427 - DNA, 20 bp, Artificial
  CRISPR gRNA sequence
aaaacaaaaataaaaacaaa

SEQ ID NO: 453428 - DNA, 20 bp, Artificial
  CRISPR gRNA sequence
aagactgtgtttagtcctta

SEQ ID NO: 453429 - DNA, 20 bp, Artificial
  CRISPR gRNA sequence
caggggcgggtctcccctct

SEQ ID NO: 453430 - DNA, 20 bp, Artificial
  CRISPR gRNA sequence
cctcacattcctcttgtgtt

SEQ ID NO: 453431 - DNA, 20 bp, Artificial
  CRISPR gRNA sequence
aattatgacaagacagttgt

SEQ ID NO: 453432 - DNA, 20 bp, Artificial
  CRISPR gRNA sequence
ggacatttggagaaatctat

SEQ ID NO: 453433 - DNA, 20 bp, Artificial
  CRISPR gRNA sequence
agattgtccttgcatcttgt

SEQ ID NO: 453434 - DNA, 20 bp, Artificial
  CRISPR gRNA sequence
tgttattatattcgctcttt

SEQ ID NO: 453435 - DNA, 20 bp, Artificial
  CRISPR gRNA sequence
tgacttctaacaacccattc

SEQ ID NO: 453436 - DNA, 20 bp, Artificial
  CRISPR gRNA sequence
ctaacaacccattctgtggt

SEQ ID NO: 453437 - DNA, 20 bp, Artificial
  CRISPR gRNA sequence
taacaacccattctgtggtt

SEQ ID NO: 453438 - DNA, 20 bp, Artificial
  CRISPR gRNA sequence
acaacccattctgtggtttt

SEQ ID NO: 453439 - DNA, 20 bp, Artificial
  CRISPR gRNA sequence
tgtggttttcaaagagcgaa

SEQ ID NO: 453440 - DNA, 20 bp, Artificial
  CRISPR gRNA sequence
tggttttcaaagagcgaata

SEQ ID NO: 453441 - DNA, 20 bp, Artificial
  CRISPR gRNA sequence
tcaaagagcgaatataataa

SEQ ID NO: 453442 - DNA, 20 bp, Artificial
  CRISPR gRNA sequence
caaagagcgaatataataac

SEQ ID NO: 453443 - DNA, 20 bp, Artificial
  CRISPR gRNA sequence
aaagagcgaatataataaca

SEQ ID NO: 453444 - DNA, 20 bp, Artificial
  CRISPR gRNA sequence
tgaaagtgtgagcaatgacg

SEQ ID NO: 453445 - DNA, 20 bp, Artificial
  CRISPR gRNA sequence
gagagatagggttttaacaa

SEQ ID NO: 453446 - DNA, 20 bp, Artificial
  CRISPR gRNA sequence
taacaagatgcaaggacaat

SEQ ID NO: 453447 - DNA, 20 bp, Artificial
  CRISPR gRNA sequence
aacaagatgcaaggacaatc

SEQ ID NO: 453448 - DNA, 20 bp, Artificial
  CRISPR gRNA sequence
acaagatgcaaggacaatct

SEQ ID NO: 453449 - DNA, 20 bp, Artificial
  CRISPR gRNA sequence
aggactgagagccatttcaa

SEQ ID NO: 453450 - DNA, 20 bp, Artificial
  CRISPR gRNA sequence
agagccatttcaacgtgagc

SEQ ID NO: 453451 - DNA, 20 bp, Artificial
  CRISPR gRNA sequence
caacgtgagcccccagtctg

SEQ ID NO: 453452 - DNA, 20 bp, Artificial
  CRISPR gRNA sequence
aacgtgagcccccagtctga

SEQ ID NO: 453453 - DNA, 20 bp, Artificial
  CRISPR gRNA sequence
agaacaagaaagaagaactt

SEQ ID NO: 453454 - DNA, 20 bp, Artificial
  CRISPR gRNA sequence
ctgtctcgaggtaaaaaggc

SEQ ID NO: 453455 - DNA, 20 bp, Artificial
  CRISPR gRNA sequence
tgtctcgaggtaaaaaggcc

SEQ ID NO: 453456 - DNA, 20 bp, Artificial
  CRISPR gRNA sequence
tctcgaggtaaaaaggcctg

SEQ ID NO: 453457 - DNA, 20 bp, Artificial
  CRISPR gRNA sequence
gaggtaaaaaggcctgctgg

SEQ ID NO: 453458 - DNA, 20 bp, Artificial
  CRISPR gRNA sequence
ctggggacctggggtccagg

SEQ ID NO: 453459 - DNA, 20 bp, Artificial
  CRISPR gRNA sequence
gggacctggggtccaggtga

SEQ ID NO: 453460 - DNA, 20 bp, Artificial
  CRISPR gRNA sequence
gggtccaggtgaagggatgg

SEQ ID NO: 453461 - DNA, 20 bp, Artificial
  CRISPR gRNA sequence
acagaactgctcaggtgagg

SEQ ID NO: 453462 - DNA, 20 bp, Artificial
  CRISPR gRNA sequence
ctcaggtgaggacaggcttc

SEQ ID NO: 453463 - DNA, 20 bp, Artificial
  CRISPR gRNA sequence
aggtgaggacaggcttctca

SEQ ID NO: 453464 - DNA, 20 bp, Artificial
  CRISPR gRNA sequence
ctcatgaggtccctgagaaa

SEQ ID NO: 453465 - DNA, 20 bp, Artificial
  CRISPR gRNA sequence
tcatgaggtccctgagaaac

SEQ ID NO: 453466 - DNA, 20 bp, Artificial
  CRISPR gRNA sequence
atgaggtccctgagaaactt

SEQ ID NO: 453467 - DNA, 20 bp, Artificial
  CRISPR gRNA sequence
agaaacttgccttttggagg

SEQ ID NO: 453468 - DNA, 20 bp, Artificial
  CRISPR gRNA sequence
gccttttggagggaaatgtc

SEQ ID NO: 453469 - DNA, 20 bp, Artificial
  CRISPR gRNA sequence
ccttttggagggaaatgtcc

SEQ ID NO: 453470 - DNA, 20 bp, Artificial
  CRISPR gRNA sequence
ttggagggaaatgtcctctg

SEQ ID NO: 453471 - DNA, 20 bp, Artificial
  CRISPR gRNA sequence
tggagggaaatgtcctctgc

SEQ ID NO: 453472 - DNA, 20 bp, Artificial
  CRISPR gRNA sequence
ggagggaaatgtcctctgcc

SEQ ID NO: 453473 - DNA, 20 bp, Artificial
  CRISPR gRNA sequence
gagggaaatgtcctctgccc

SEQ ID NO: 453474 - DNA, 20 bp, Artificial
  CRISPR gRNA sequence
tgccctctggagcctgggga

SEQ ID NO: 453475 - DNA, 20 bp, Artificial
  CRISPR gRNA sequence
ccctctggagcctggggaga

SEQ ID NO: 453476 - DNA, 20 bp, Artificial
  CRISPR gRNA sequence
tggagcctggggagaaggtt

SEQ ID NO: 453477 - DNA, 20 bp, Artificial
  CRISPR gRNA sequence
gagcctggggagaaggttat

SEQ ID NO: 453478 - DNA, 20 bp, Artificial
  CRISPR gRNA sequence
gggagaaggttatttctgcc

SEQ ID NO: 453479 - DNA, 20 bp, Artificial
  CRISPR gRNA sequence
tttctgcccgccagaccagc

SEQ ID NO: 453480 - DNA, 20 bp, Artificial
  CRISPR gRNA sequence
ctgcccgccagaccagcatg

SEQ ID NO: 453481 - DNA, 20 bp, Artificial
  CRISPR gRNA sequence
tgcccgccagaccagcatgc

SEQ ID NO: 453482 - DNA, 20 bp, Artificial
  CRISPR gRNA sequence
cccgccagaccagcatgctc

SEQ ID NO: 453483 - DNA, 20 bp, Artificial
  CRISPR gRNA sequence
gcttttcttccatgggcatt

SEQ ID NO: 453484 - DNA, 20 bp, Artificial
  CRISPR gRNA sequence
ttcttccatgggcattcagg

SEQ ID NO: 453485 - DNA, 20 bp, Artificial
  CRISPR gRNA sequence
tcttccatgggcattcagga

SEQ ID NO: 453486 - DNA, 20 bp, Artificial
  CRISPR gRNA sequence
cttccatgggcattcaggaa

SEQ ID NO: 453487 - DNA, 20 bp, Artificial
  CRISPR gRNA sequence
ttccatgggcattcaggaat

SEQ ID NO: 453488 - DNA, 20 bp, Artificial
  CRISPR gRNA sequence
ccatgggcattcaggaatcc

SEQ ID NO: 453489 - DNA, 20 bp, Artificial
  CRISPR gRNA sequence
catgggcattcaggaatcct

SEQ ID NO: 453490 - DNA, 20 bp, Artificial
  CRISPR gRNA sequence
aggaatcctggccccattct

SEQ ID NO: 453491 - DNA, 20 bp, Artificial
  CRISPR gRNA sequence
gccccattctgacattcctc

SEQ ID NO: 453492 - DNA, 20 bp, Artificial
  CRISPR gRNA sequence
tgacattcctcaaatggagg

SEQ ID NO: 453493 - DNA, 20 bp, Artificial
  CRISPR gRNA sequence
acattcctcaaatggaggaa

SEQ ID NO: 453494 - DNA, 20 bp, Artificial
  CRISPR gRNA sequence
ctcaaatggaggaattcctc

SEQ ID NO: 453495 - DNA, 20 bp, Artificial
  CRISPR gRNA sequence
aaatggaggaattcctcaaa

SEQ ID NO: 453496 - DNA, 20 bp, Artificial
  CRISPR gRNA sequence
ctcaaattaccagaggaaag

SEQ ID NO: 453497 - DNA, 20 bp, Artificial
  CRISPR gRNA sequence
aaattaccagaggaaagtta

SEQ ID NO: 453498 - DNA, 20 bp, Artificial
  CRISPR gRNA sequence
ccagaggaaagttaccaaag

SEQ ID NO: 453499 - DNA, 20 bp, Artificial
  CRISPR gRNA sequence
ccaaagtttagatctgctgg

SEQ ID NO: 453500 - DNA, 20 bp, Artificial
  CRISPR gRNA sequence
agatctgctggagctcttca

SEQ ID NO: 453501 - DNA, 20 bp, Artificial
  CRISPR gRNA sequence
gatctgctggagctcttcaa

SEQ ID NO: 453502 - DNA, 20 bp, Artificial
  CRISPR gRNA sequence
ctggagctcttcaaggattg

SEQ ID NO: 453503 - DNA, 20 bp, Artificial
  CRISPR gRNA sequence
gagctcttcaaggattggcc

SEQ ID NO: 453504 - DNA, 20 bp, Artificial
  CRISPR gRNA sequence
ttcaaggattggcctgagac

SEQ ID NO: 453505 - DNA, 20 bp, Artificial
  CRISPR gRNA sequence
caaggattggcctgagacaa

SEQ ID NO: 453506 - DNA, 20 bp, Artificial
  CRISPR gRNA sequence
aaggattggcctgagacaag

SEQ ID NO: 453507 - DNA, 20 bp, Artificial
  CRISPR gRNA sequence
gcctgagacaagccgggagg

SEQ ID NO: 453508 - DNA, 20 bp, Artificial
  CRISPR gRNA sequence
agacaagccgggaggtgcca

SEQ ID NO: 453509 - DNA, 20 bp, Artificial
  CRISPR gRNA sequence
ggagctggccctgtgaggca

SEQ ID NO: 453510 - DNA, 20 bp, Artificial
  CRISPR gRNA sequence
gagctggccctgtgaggcac

SEQ ID NO: 453511 - DNA, 20 bp, Artificial
  CRISPR gRNA sequence
gccctgtgaggcacctccgg

SEQ ID NO: 453512 - DNA, 20 bp, Artificial
  CRISPR gRNA sequence
tgaggcacctccgggggaag

SEQ ID NO: 453513 - DNA, 20 bp, Artificial
  CRISPR gRNA sequence
cgggggaagttcatgtccta

SEQ ID NO: 453514 - DNA, 20 bp, Artificial
  CRISPR gRNA sequence
atgtcctaggtggttcacgt

SEQ ID NO: 453515 - DNA, 20 bp, Artificial
  CRISPR gRNA sequence
ggtggttcacgtcatggacc

SEQ ID NO: 453516 - DNA, 20 bp, Artificial
  CRISPR gRNA sequence
acgtcatggacctcttggag

SEQ ID NO: 453517 - DNA, 20 bp, Artificial
  CRISPR gRNA sequence
ttggaggtccgtgaatagat

SEQ ID NO: 453518 - DNA, 20 bp, Artificial
  CRISPR gRNA sequence
ggaggtccgtgaatagattt

SEQ ID NO: 453519 - DNA, 20 bp, Artificial
  CRISPR gRNA sequence
gaggtccgtgaatagattta

SEQ ID NO: 453520 - DNA, 20 bp, Artificial
  CRISPR gRNA sequence
attcatgggatttgtgaatt

SEQ ID NO: 453521 - DNA, 20 bp, Artificial
  CRISPR gRNA sequence
ttcatgggatttgtgaattg

SEQ ID NO: 453522 - DNA, 20 bp, Artificial
  CRISPR gRNA sequence
atgggatttgtgaattgggg

SEQ ID NO: 453523 - DNA, 20 bp, Artificial
  CRISPR gRNA sequence
gtgaattggggggaaaaata

SEQ ID NO: 453524 - DNA, 20 bp, Artificial
  CRISPR gRNA sequence
tgaattggggggaaaaatac

SEQ ID NO: 453525 - DNA, 20 bp, Artificial
  CRISPR gRNA sequence
gggggaaaaatacatcttta

SEQ ID NO: 453526 - DNA, 20 bp, Artificial
  CRISPR gRNA sequence
tattttcactaatctttaat

SEQ ID NO: 453527 - DNA, 20 bp, Artificial
  CRISPR gRNA sequence
attttcactaatctttaatt

SEQ ID NO: 453528 - DNA, 20 bp, Artificial
  CRISPR gRNA sequence
ttttcactaatctttaattg

SEQ ID NO: 453529 - DNA, 20 bp, Artificial
  CRISPR gRNA sequence
tcactaatctttaattgaaa

SEQ ID NO: 453530 - DNA, 20 bp, Artificial
  CRISPR gRNA sequence
cactaatctttaattgaaag

SEQ ID NO: 453531 - DNA, 20 bp, Artificial
  CRISPR gRNA sequence
actaatctttaattgaaagt

SEQ ID NO: 453532 - DNA, 20 bp, Artificial
  CRISPR gRNA sequence
atctttaattgaaagtcagc

SEQ ID NO: 453533 - DNA, 20 bp, Artificial
  CRISPR gRNA sequence
taattgaaagtcagcacttg

SEQ ID NO: 453534 - DNA, 20 bp, Artificial
  CRISPR gRNA sequence
aattgaaagtcagcacttgc

SEQ ID NO: 453535 - DNA, 20 bp, Artificial
  CRISPR gRNA sequence
attgaaagtcagcacttgct

SEQ ID NO: 453536 - DNA, 20 bp, Artificial
  CRISPR gRNA sequence
aaagtcagcacttgcttcag

SEQ ID NO: 453537 - DNA, 20 bp, Artificial
  CRISPR gRNA sequence
gcttcagttatgaatgtaga

SEQ ID NO: 453538 - DNA, 20 bp, Artificial
  CRISPR gRNA sequence
cttcagttatgaatgtagac

SEQ ID NO: 453539 - DNA, 20 bp, Artificial
  CRISPR gRNA sequence
cagttatgaatgtagacaat

SEQ ID NO: 453540 - DNA, 20 bp, Artificial
  CRISPR gRNA sequence
agttatgaatgtagacaatg

SEQ ID NO: 453541 - DNA, 20 bp, Artificial
  CRISPR gRNA sequence
tgaatgtagacaatgaacca

SEQ ID NO: 453542 - DNA, 20 bp, Artificial
  CRISPR gRNA sequence
gccatcaatagaaaacacaa

SEQ ID NO: 453543 - DNA, 20 bp, Artificial
  CRISPR gRNA sequence
ccatcaatagaaaacacaaa

SEQ ID NO: 453544 - DNA, 20 bp, Artificial
  CRISPR gRNA sequence
tcaaatctcattacagtttt

SEQ ID NO: 453545 - DNA, 20 bp, Artificial
  CRISPR gRNA sequence
caaatctcattacagttttt

SEQ ID NO: 453546 - DNA, 20 bp, Artificial
  CRISPR gRNA sequence
aaatctcattacagttttta

SEQ ID NO: 453547 - DNA, 20 bp, Artificial
  CRISPR gRNA sequence
attacagtttttatagattt

SEQ ID NO: 453548 - DNA, 20 bp, Artificial
  CRISPR gRNA sequence
cagtttttatagatttctcc

SEQ ID NO: 453549 - DNA, 20 bp, Artificial
  CRISPR gRNA sequence
ttatagatttctccaaatgt

SEQ ID NO: 453550 - DNA, 20 bp, Artificial
  CRISPR gRNA sequence
tatagatttctccaaatgtc

SEQ ID NO: 453551 - DNA, 20 bp, Artificial
  CRISPR gRNA sequence
atagatttctccaaatgtcc

SEQ ID NO: 453552 - DNA, 20 bp, Artificial
  CRISPR gRNA sequence
tagatttctccaaatgtcct

SEQ ID NO: 453553 - DNA, 20 bp, Artificial
  CRISPR gRNA sequence
ctccaaatgtccttaacgct

SEQ ID NO: 453554 - DNA, 20 bp, Artificial
  CRISPR gRNA sequence
tccaaatgtccttaacgctc

SEQ ID NO: 453555 - DNA, 20 bp, Artificial
  CRISPR gRNA sequence
caaatgtccttaacgctcag

SEQ ID NO: 453556 - DNA, 20 bp, Artificial
  CRISPR gRNA sequence
aacgctcagcactactacag

SEQ ID NO: 453557 - DNA, 20 bp, Artificial
  CRISPR gRNA sequence
acgctcagcactactacaga

SEQ ID NO: 453558 - DNA, 20 bp, Artificial
  CRISPR gRNA sequence
agcactactacagaattaca

SEQ ID NO: 453559 - DNA, 20 bp, Artificial
  CRISPR gRNA sequence
ctacagaattacaacagtta

SEQ ID NO: 453560 - DNA, 20 bp, Artificial
  CRISPR gRNA sequence
cagaattacaacagttatta

SEQ ID NO: 453561 - DNA, 20 bp, Artificial
  CRISPR gRNA sequence
caacagttattaggctgatg

SEQ ID NO: 453562 - DNA, 20 bp, Artificial
  CRISPR gRNA sequence
ttaggctgatgtcaaatcta

SEQ ID NO: 453563 - DNA, 20 bp, Artificial
  CRISPR gRNA sequence
ggctgatgtcaaatctaaag

SEQ ID NO: 453564 - DNA, 20 bp, Artificial
  CRISPR gRNA sequence
atgtcaaatctaaagaagca

SEQ ID NO: 453565 - DNA, 20 bp, Artificial
  CRISPR gRNA sequence
aagaagcatgtgtactgctc

SEQ ID NO: 453566 - DNA, 20 bp, Artificial
  CRISPR gRNA sequence
ctctaccacacattcttcta

SEQ ID NO: 453567 - DNA, 20 bp, Artificial
  CRISPR gRNA sequence
taccacacattcttctaatg

SEQ ID NO: 453568 - DNA, 20 bp, Artificial
  CRISPR gRNA sequence
ccacacattcttctaatgtt

SEQ ID NO: 453569 - DNA, 20 bp, Artificial
  CRISPR gRNA sequence
ttctaatgttttgacaactg

SEQ ID NO: 453570 - DNA, 20 bp, Artificial
  CRISPR gRNA sequence
ctaatgttttgacaactgtc

SEQ ID NO: 453571 - DNA, 20 bp, Artificial
  CRISPR gRNA sequence
taatgttttgacaactgtct

SEQ ID NO: 453572 - DNA, 20 bp, Artificial
  CRISPR gRNA sequence
atgttttgacaactgtcttg

SEQ ID NO: 453573 - DNA, 20 bp, Artificial
  CRISPR gRNA sequence
tgacaactgtcttgtcataa

SEQ ID NO: 453574 - DNA, 20 bp, Artificial
  CRISPR gRNA sequence
gacaactgtcttgtcataat

SEQ ID NO: 453575 - DNA, 20 bp, Artificial
  CRISPR gRNA sequence
acaactgtcttgtcataatt

SEQ ID NO: 453576 - DNA, 20 bp, Artificial
  CRISPR gRNA sequence
tcttgtcataatttgttccc

SEQ ID NO: 453577 - DNA, 20 bp, Artificial
  CRISPR gRNA sequence
gtcataatttgttcccttta

SEQ ID NO: 453578 - DNA, 20 bp, Artificial
  CRISPR gRNA sequence
tcataatttgttccctttat

SEQ ID NO: 453579 - DNA, 20 bp, Artificial
  CRISPR gRNA sequence
gttccctttattatcccatg

SEQ ID NO: 453580 - DNA, 20 bp, Artificial
  CRISPR gRNA sequence
ttccctttattatcccatgt

SEQ ID NO: 453581 - DNA, 20 bp, Artificial
  CRISPR gRNA sequence
cctttattatcccatgtatc

SEQ ID NO: 453582 - DNA, 20 bp, Artificial
  CRISPR gRNA sequence
tattatcccatgtatcttat

SEQ ID NO: 453583 - DNA, 20 bp, Artificial
  CRISPR gRNA sequence
attatcccatgtatcttatt

SEQ ID NO: 453584 - DNA, 20 bp, Artificial
  CRISPR gRNA sequence
ttatcccatgtatcttatta

SEQ ID NO: 453585 - DNA, 20 bp, Artificial
  CRISPR gRNA sequence
tcccatgtatcttattaatt

SEQ ID NO: 453586 - DNA, 20 bp, Artificial
  CRISPR gRNA sequence
attaatttttaaatgttgtt

SEQ ID NO: 453587 - DNA, 20 bp, Artificial
  CRISPR gRNA sequence
ttaatttttaaatgttgttc

SEQ ID NO: 453588 - DNA, 20 bp, Artificial
  CRISPR gRNA sequence
atttttaaatgttgttctga

SEQ ID NO: 453589 - DNA, 20 bp, Artificial
  CRISPR gRNA sequence
ttaaatgttgttctgagaag

SEQ ID NO: 453590 - DNA, 20 bp, Artificial
  CRISPR gRNA sequence
taaatgttgttctgagaagg

SEQ ID NO: 453591 - DNA, 20 bp, Artificial
  CRISPR gRNA sequence
aaatgttgttctgagaaggg

SEQ ID NO: 453592 - DNA, 20 bp, Artificial
  CRISPR gRNA sequence
aatgttgttctgagaaggga

SEQ ID NO: 453593 - DNA, 20 bp, Artificial
  CRISPR gRNA sequence
ttctgagaagggactccata

SEQ ID NO: 453594 - DNA, 20 bp, Artificial
  CRISPR gRNA sequence
tgagaagggactccatatgc

SEQ ID NO: 453595 - DNA, 20 bp, Artificial
  CRISPR gRNA sequence
agaagggactccatatgcct

SEQ ID NO: 453596 - DNA, 20 bp, Artificial
  CRISPR gRNA sequence
catatgccttcccagaccac

SEQ ID NO: 453597 - DNA, 20 bp, Artificial
  CRISPR gRNA sequence
cccagaccaccaaagaggtc

SEQ ID NO: 453598 - DNA, 20 bp, Artificial
  CRISPR gRNA sequence
ccagaccaccaaagaggtcc

SEQ ID NO: 453599 - DNA, 20 bp, Artificial
  CRISPR gRNA sequence
tatgtcaggcacctgctttg

SEQ ID NO: 453600 - DNA, 20 bp, Artificial
  CRISPR gRNA sequence
atgtcaggcacctgctttgg

SEQ ID NO: 453601 - DNA, 20 bp, Artificial
  CRISPR gRNA sequence
tgtcaggcacctgctttggt

SEQ ID NO: 453602 - DNA, 20 bp, Artificial
  CRISPR gRNA sequence
ctttggtgtgttgagcagga

SEQ ID NO: 453603 - DNA, 20 bp, Artificial
  CRISPR gRNA sequence
tggtgtgttgagcaggaagc

SEQ ID NO: 453604 - DNA, 20 bp, Artificial
  CRISPR gRNA sequence
ggtgtgttgagcaggaagcc

SEQ ID NO: 453605 - DNA, 20 bp, Artificial
  CRISPR gRNA sequence
gtgtgttgagcaggaagcct

SEQ ID NO: 453606 - DNA, 20 bp, Artificial
  CRISPR gRNA sequence
agcaggaagcctgagatctc

SEQ ID NO: 453607 - DNA, 20 bp, Artificial
  CRISPR gRNA sequence
agatctcagacaagagcttc

SEQ ID NO: 453608 - DNA, 20 bp, Artificial
  CRISPR gRNA sequence
agacaagagcttcaagggcc

SEQ ID NO: 453609 - DNA, 20 bp, Artificial
  CRISPR gRNA sequence
caagggccccccagcccaaa

SEQ ID NO: 453610 - DNA, 20 bp, Artificial
  CRISPR gRNA sequence
aagggccccccagcccaaac

SEQ ID NO: 453611 - DNA, 20 bp, Artificial
  CRISPR gRNA sequence
tgtctactaacaagtctggt

SEQ ID NO: 453612 - DNA, 20 bp, Artificial
  CRISPR gRNA sequence
tctactaacaagtctggttc

SEQ ID NO: 453613 - DNA, 20 bp, Artificial
  CRISPR gRNA sequence
ctaacaagtctggttctact

SEQ ID NO: 453614 - DNA, 20 bp, Artificial
  CRISPR gRNA sequence
acaagtctggttctacttta

SEQ ID NO: 453615 - DNA, 20 bp, Artificial
  CRISPR gRNA sequence
gttctactttaaggcagttg

SEQ ID NO: 453616 - DNA, 20 bp, Artificial
  CRISPR gRNA sequence
tactttaaggcagttggggt

SEQ ID NO: 453617 - DNA, 20 bp, Artificial
  CRISPR gRNA sequence
ctttaaggcagttggggttg

SEQ ID NO: 453618 - DNA, 20 bp, Artificial
  CRISPR gRNA sequence
taaggcagttggggttgtgg

SEQ ID NO: 453619 - DNA, 20 bp, Artificial
  CRISPR gRNA sequence
aaggcagttggggttgtgga

SEQ ID NO: 453620 - DNA, 20 bp, Artificial
  CRISPR gRNA sequence
aggcagttggggttgtggag

SEQ ID NO: 453621 - DNA, 20 bp, Artificial
  CRISPR gRNA sequence
gggttgtggagattgaaaaa

SEQ ID NO: 453622 - DNA, 20 bp, Artificial
  CRISPR gRNA sequence
tggagattgaaaaagaagcc

SEQ ID NO: 453623 - DNA, 20 bp, Artificial
  CRISPR gRNA sequence
aaaaagaagccccttcacag

SEQ ID NO: 453624 - DNA, 20 bp, Artificial
  CRISPR gRNA sequence
cacagctgcaaatgagatct

SEQ ID NO: 453625 - DNA, 20 bp, Artificial
  CRISPR gRNA sequence
acagctgcaaatgagatctt

SEQ ID NO: 453626 - DNA, 20 bp, Artificial
  CRISPR gRNA sequence
caaatgagatctttctgggc

SEQ ID NO: 453627 - DNA, 20 bp, Artificial
  CRISPR gRNA sequence
tctgggcatctttttcagtg

SEQ ID NO: 453628 - DNA, 20 bp, Artificial
  CRISPR gRNA sequence
ctgggcatctttttcagtgt

SEQ ID NO: 453629 - DNA, 20 bp, Artificial
  CRISPR gRNA sequence
tgggcatctttttcagtgtc

SEQ ID NO: 453630 - DNA, 20 bp, Artificial
  CRISPR gRNA sequence
ggcatctttttcagtgtcgt

SEQ ID NO: 453631 - DNA, 20 bp, Artificial
  CRISPR gRNA sequence
tttcagtgtcgtgggagatc

SEQ ID NO: 453632 - DNA, 20 bp, Artificial
  CRISPR gRNA sequence
ttcagtgtcgtgggagatct

SEQ ID NO: 453633 - DNA, 20 bp, Artificial
  CRISPR gRNA sequence
tcagtgtcgtgggagatctg

SEQ ID NO: 453634 - DNA, 20 bp, Artificial
  CRISPR gRNA sequence
cagtgtcgtgggagatctgt

SEQ ID NO: 453635 - DNA, 20 bp, Artificial
  CRISPR gRNA sequence
agtgtcgtgggagatctgta

SEQ ID NO: 453636 - DNA, 20 bp, Artificial
  CRISPR gRNA sequence
tatacagaggtatttgtgga

SEQ ID NO: 453637 - DNA, 20 bp, Artificial
  CRISPR gRNA sequence
gtggagctcagagctgacct

SEQ ID NO: 453638 - DNA, 20 bp, Artificial
  CRISPR gRNA sequence
tggagctcagagctgacctt

SEQ ID NO: 453639 - DNA, 20 bp, Artificial
  CRISPR gRNA sequence
agagctgaccttccagctcc

SEQ ID NO: 453640 - DNA, 20 bp, Artificial
  CRISPR gRNA sequence
accttccagctcctctgaga

SEQ ID NO: 453641 - DNA, 20 bp, Artificial
  CRISPR gRNA sequence
ccagctcctctgagaggtta

SEQ ID NO: 453642 - DNA, 20 bp, Artificial
  CRISPR gRNA sequence
cagctcctctgagaggttag

SEQ ID NO: 453643 - DNA, 20 bp, Artificial
  CRISPR gRNA sequence
ctctgagaggttagatccgg

SEQ ID NO: 453644 - DNA, 20 bp, Artificial
  CRISPR gRNA sequence
tgagaggttagatccgggct

SEQ ID NO: 453645 - DNA, 20 bp, Artificial
  CRISPR gRNA sequence
agaggttagatccgggctcc

SEQ ID NO: 453646 - DNA, 20 bp, Artificial
  CRISPR gRNA sequence
gatccgggctccggtggcag

SEQ ID NO: 453647 - DNA, 20 bp, Artificial
  CRISPR gRNA sequence
cggtggcagaggaaatggag

SEQ ID NO: 453648 - DNA, 20 bp, Artificial
  CRISPR gRNA sequence
ttccttgccctcttgtcccc

SEQ ID NO: 453649 - DNA, 20 bp, Artificial
  CRISPR gRNA sequence
ccttgccctcttgtccccac

SEQ ID NO: 453650 - DNA, 20 bp, Artificial
  CRISPR gRNA sequence
cttgccctcttgtccccacc

SEQ ID NO: 453651 - DNA, 20 bp, Artificial
  CRISPR gRNA sequence
gccctcttgtccccaccctc

SEQ ID NO: 453652 - DNA, 20 bp, Artificial
  CRISPR gRNA sequence
ccctcttgtccccaccctcc

SEQ ID NO: 453653 - DNA, 20 bp, Artificial
  CRISPR gRNA sequence
ttgtccccaccctccccaga

SEQ ID NO: 453654 - DNA, 20 bp, Artificial
  CRISPR gRNA sequence
gtccccaccctccccagaaa

SEQ ID NO: 453655 - DNA, 20 bp, Artificial
  CRISPR gRNA sequence
tccccaccctccccagaaaa

SEQ ID NO: 453656 - DNA, 20 bp, Artificial
  CRISPR gRNA sequence
cccagaaaacctctggcaaa

SEQ ID NO: 453657 - DNA, 20 bp, Artificial
  CRISPR gRNA sequence
tggcaaagctttatgtgtca

SEQ ID NO: 453658 - DNA, 20 bp, Artificial
  CRISPR gRNA sequence
gcaaagctttatgtgtcatc

SEQ ID NO: 453659 - DNA, 20 bp, Artificial
  CRISPR gRNA sequence
tatgtgtcatctaaccgtca

SEQ ID NO: 453660 - DNA, 20 bp, Artificial
  CRISPR gRNA sequence
atgtgtcatctaaccgtcac

SEQ ID NO: 453661 - DNA, 20 bp, Artificial
  CRISPR gRNA sequence
tgtgtcatctaaccgtcacc

SEQ ID NO: 453662 - DNA, 20 bp, Artificial
  CRISPR gRNA sequence
accgtcaccacattcctatg

SEQ ID NO: 453663 - DNA, 20 bp, Artificial
  CRISPR gRNA sequence
ctatgaggtagttttaaaca

SEQ ID NO: 453664 - DNA, 20 bp, Artificial
  CRISPR gRNA sequence
tgaggtagttttaaacacaa

SEQ ID NO: 453665 - DNA, 20 bp, Artificial
  CRISPR gRNA sequence
taaacacaagaggaatgtga

SEQ ID NO: 453666 - DNA, 20 bp, Artificial
  CRISPR gRNA sequence
aaacacaagaggaatgtgag

SEQ ID NO: 453667 - DNA, 20 bp, Artificial
  CRISPR gRNA sequence
aacacaagaggaatgtgagg

SEQ ID NO: 453668 - DNA, 20 bp, Artificial
  CRISPR gRNA sequence
agtgaggtccagcaatgtgc

SEQ ID NO: 453669 - DNA, 20 bp, Artificial
  CRISPR gRNA sequence
gtcacacaaagcttggattt

SEQ ID NO: 453670 - DNA, 20 bp, Artificial
  CRISPR gRNA sequence
ggatttgaacccaggagtcc

SEQ ID NO: 453671 - DNA, 20 bp, Artificial
  CRISPR gRNA sequence
gatttgaacccaggagtcca

SEQ ID NO: 453672 - DNA, 20 bp, Artificial
  CRISPR gRNA sequence
gaacccaggagtccacaaga

SEQ ID NO: 453673 - DNA, 20 bp, Artificial
  CRISPR gRNA sequence
aacccaggagtccacaagac

SEQ ID NO: 453674 - DNA, 20 bp, Artificial
  CRISPR gRNA sequence
caggaccgcctccgaaggtg

SEQ ID NO: 453675 - DNA, 20 bp, Artificial
  CRISPR gRNA sequence
cgaaggtgcgggagggaaga

SEQ ID NO: 453676 - DNA, 20 bp, Artificial
  CRISPR gRNA sequence
cccgccgtctgtgagctgtc

SEQ ID NO: 453677 - DNA, 20 bp, Artificial
  CRISPR gRNA sequence
ccgccgtctgtgagctgtcg

SEQ ID NO: 453678 - DNA, 20 bp, Artificial
  CRISPR gRNA sequence
tgagctgtcgcctgagagag

SEQ ID NO: 453679 - DNA, 20 bp, Artificial
  CRISPR gRNA sequence
tcgcctgagagaggcaccga

SEQ ID NO: 453680 - DNA, 20 bp, Artificial
  CRISPR gRNA sequence
agagaggcaccgagccctgg

SEQ ID NO: 453681 - DNA, 20 bp, Artificial
  CRISPR gRNA sequence
gggccaccagcgcagctcag

SEQ ID NO: 453682 - DNA, 20 bp, Artificial
  CRISPR gRNA sequence
aggagccccggggaccatca

SEQ ID NO: 453683 - DNA, 20 bp, Artificial
  CRISPR gRNA sequence
cacgggcaccctcccccctg

SEQ ID NO: 453684 - DNA, 20 bp, Artificial
  CRISPR gRNA sequence
ccccctgcccgcgctggggc

SEQ ID NO: 453685 - DNA, 20 bp, Artificial
  CRISPR gRNA sequence
cccgcgctggggctcacaac

SEQ ID NO: 453686 - DNA, 20 bp, Artificial
  CRISPR gRNA sequence
gggctcacaacgttttaaga

SEQ ID NO: 453687 - DNA, 20 bp, Artificial
  CRISPR gRNA sequence
acaacgttttaagaggggag

SEQ ID NO: 453688 - DNA, 20 bp, Artificial
  CRISPR gRNA sequence
taagaggggagacccgcccc

SEQ ID NO: 453689 - DNA, 20 bp, Artificial
  CRISPR gRNA sequence
aagaggggagacccgcccct

SEQ ID NO: 453690 - DNA, 20 bp, Artificial
  CRISPR gRNA sequence
agaggggagacccgcccctg

SEQ ID NO: 453691 - DNA, 20 bp, Artificial
  CRISPR gRNA sequence
gcgtgtagtgggcccggaaa

SEQ ID NO: 453692 - DNA, 20 bp, Artificial
  CRISPR gRNA sequence
ccagacttctcacgaccacc

SEQ ID NO: 453693 - DNA, 20 bp, Artificial
  CRISPR gRNA sequence
ctcacgaccacccgctctcc

SEQ ID NO: 453694 - DNA, 20 bp, Artificial
  CRISPR gRNA sequence
tcacgaccacccgctctccc

SEQ ID NO: 453695 - DNA, 20 bp, Artificial
  CRISPR gRNA sequence
acgaccacccgctctcccct

SEQ ID NO: 453696 - DNA, 20 bp, Artificial
  CRISPR gRNA sequence
tcccctctgttgagggccag

SEQ ID NO: 453697 - DNA, 20 bp, Artificial
  CRISPR gRNA sequence
ccctctgttgagggccaggt

SEQ ID NO: 453698 - DNA, 20 bp, Artificial
  CRISPR gRNA sequence
tgttgagggccaggtgccgc

SEQ ID NO: 453699 - DNA, 20 bp, Artificial
  CRISPR gRNA sequence
ttgagggccaggtgccgctc

SEQ ID NO: 453700 - DNA, 20 bp, Artificial
  CRISPR gRNA sequence
agggccaggtgccgctctag

SEQ ID NO: 453701 - DNA, 20 bp, Artificial
  CRISPR gRNA sequence
tagtacatgctgcgtcccca

SEQ ID NO: 453702 - DNA, 20 bp, Artificial
  CRISPR gRNA sequence
gtacatgctgcgtccccagg

SEQ ID NO: 453703 - DNA, 20 bp, Artificial
  CRISPR gRNA sequence
cgtccccaggacccaccagg

SEQ ID NO: 453704 - DNA, 20 bp, Artificial
  CRISPR gRNA sequence
tgcaccccctcatctcccct

SEQ ID NO: 453705 - DNA, 20 bp, Artificial
  CRISPR gRNA sequence
gcaccccctcatctcccctc

SEQ ID NO: 453706 - DNA, 20 bp, Artificial
  CRISPR gRNA sequence
caccccctcatctcccctcc

SEQ ID NO: 453707 - DNA, 20 bp, Artificial
  CRISPR gRNA sequence
atctcccctcctagtttaga

SEQ ID NO: 453708 - DNA, 20 bp, Artificial
  CRISPR gRNA sequence
ccctcctagtttagactttc

SEQ ID NO: 453709 - DNA, 20 bp, Artificial
  CRISPR gRNA sequence
ctagtttagactttccctgg

SEQ ID NO: 453710 - DNA, 20 bp, Artificial
  CRISPR gRNA sequence
gtttagactttccctggcta

SEQ ID NO: 453711 - DNA, 20 bp, Artificial
  CRISPR gRNA sequence
agactttccctggctagccc

SEQ ID NO: 453712 - DNA, 20 bp, Artificial
  CRISPR gRNA sequence
gactttccctggctagcccc

SEQ ID NO: 453713 - DNA, 20 bp, Artificial
  CRISPR gRNA sequence
tccctggctagcccccatgc

SEQ ID NO: 453714 - DNA, 20 bp, Artificial
  CRISPR gRNA sequence
ccctggctagcccccatgct

SEQ ID NO: 453715 - DNA, 20 bp, Artificial
  CRISPR gRNA sequence
cctggctagcccccatgctc

SEQ ID NO: 453716 - DNA, 20 bp, Artificial
  CRISPR gRNA sequence
gctagcccccatgctcgctg

SEQ ID NO: 453717 - DNA, 20 bp, Artificial
  CRISPR gRNA sequence
gcccccatgctcgctggatg

SEQ ID NO: 453718 - DNA, 20 bp, Artificial
  CRISPR gRNA sequence
gctggatggcccatggctgg

SEQ ID NO: 453719 - DNA, 20 bp, Artificial
  CRISPR gRNA sequence
gatggcccatggctggagtg

SEQ ID NO: 453720 - DNA, 20 bp, Artificial
  CRISPR gRNA sequence
gagtgacgcgggccaacgcg

SEQ ID NO: 453721 - DNA, 20 bp, Artificial
  CRISPR gRNA sequence
ggctttggctgaaaggcagc

SEQ ID NO: 453722 - DNA, 20 bp, Artificial
  CRISPR gRNA sequence
tggctgaaaggcagcgccct

SEQ ID NO: 453723 - DNA, 20 bp, Artificial
  CRISPR gRNA sequence
ggctgaaaggcagcgccctc

SEQ ID NO: 453724 - DNA, 20 bp, Artificial
  CRISPR gRNA sequence
gctgaaaggcagcgccctct

SEQ ID NO: 453725 - DNA, 20 bp, Artificial
  CRISPR gRNA sequence
aaaggcagcgccctctagcg

SEQ ID NO: 453726 - DNA, 20 bp, Artificial
  CRISPR gRNA sequence
tagcggccagagtgcgaaat

SEQ ID NO: 453727 - DNA, 20 bp, Artificial
  CRISPR gRNA sequence
gcggccagagtgcgaaatca

SEQ ID NO: 453728 - DNA, 20 bp, Artificial
  CRISPR gRNA sequence
cgcgctgccccgcctgcatc

SEQ ID NO: 453729 - DNA, 20 bp, Artificial
  CRISPR gRNA sequence
ccccgcctgcatcacaacag

SEQ ID NO: 453730 - DNA, 20 bp, Artificial
  CRISPR gRNA sequence
catcacaacagggtgctccc

SEQ ID NO: 453731 - DNA, 20 bp, Artificial
  CRISPR gRNA sequence
ccctcccgggcaccaaggtc

SEQ ID NO: 453732 - DNA, 20 bp, Artificial
  CRISPR gRNA sequence
ccgggcaccaaggtcacttc

SEQ ID NO: 453733 - DNA, 20 bp, Artificial
  CRISPR gRNA sequence
cccagagcatccttgcccag

SEQ ID NO: 453734 - DNA, 20 bp, Artificial
  CRISPR gRNA sequence
ccagagcatccttgcccagt

SEQ ID NO: 453735 - DNA, 20 bp, Artificial
  CRISPR gRNA sequence
gcccagtgacctcgctgccc

SEQ ID NO: 453736 - DNA, 20 bp, Artificial
  CRISPR gRNA sequence
cccagtgacctcgctgcccc

SEQ ID NO: 453737 - DNA, 20 bp, Artificial
  CRISPR gRNA sequence
gctgccccccagcgctggtg

SEQ ID NO: 453738 - DNA, 20 bp, Artificial
  CRISPR gRNA sequence
ccccccagcgctggtgaggg

SEQ ID NO: 453739 - DNA, 20 bp, Artificial
  CRISPR gRNA sequence
gtgaggggcccacaacagac

SEQ ID NO: 453740 - DNA, 20 bp, Artificial
  CRISPR gRNA sequence
acatgctcttcttcaactcg

SEQ ID NO: 453741 - DNA, 20 bp, Artificial
  CRISPR gRNA sequence
catgctcttcttcaactcgg

SEQ ID NO: 453742 - DNA, 20 bp, Artificial
  CRISPR gRNA sequence
ttcttcaactcggccctagg

SEQ ID NO: 453743 - DNA, 20 bp, Artificial
  CRISPR gRNA sequence
cttcaactcggccctaggca

SEQ ID NO: 453744 - DNA, 20 bp, Artificial
  CRISPR gRNA sequence
ttcaactcggccctaggcac

SEQ ID NO: 453745 - DNA, 20 bp, Artificial
  CRISPR gRNA sequence
caactcggccctaggcaccg

SEQ ID NO: 453746 - DNA, 20 bp, Artificial
  CRISPR gRNA sequence
aactcggccctaggcaccgc

SEQ ID NO: 453747 - DNA, 20 bp, Artificial
  CRISPR gRNA sequence
ggccctaggcaccgcgaagt

SEQ ID NO: 453748 - DNA, 20 bp, Artificial
  CRISPR gRNA sequence
ggcaccgcgaagtctggcca

SEQ ID NO: 453749 - DNA, 20 bp, Artificial
  CRISPR gRNA sequence
gccactccagcggagtgacc

SEQ ID NO: 453750 - DNA, 20 bp, Artificial
  CRISPR gRNA sequence
cagcggagtgaccagctgca

SEQ ID NO: 453751 - DNA, 20 bp, Artificial
  CRISPR gRNA sequence
catcagcccctcccgcctgt

SEQ ID NO: 453752 - DNA, 20 bp, Artificial
  CRISPR gRNA sequence
ccgcctgtcctctctctcct

SEQ ID NO: 453753 - DNA, 20 bp, Artificial
  CRISPR gRNA sequence
tcctctctctccttggaagc

SEQ ID NO: 453754 - DNA, 20 bp, Artificial
  CRISPR gRNA sequence
tctctccttggaagcggtcc

SEQ ID NO: 453755 - DNA, 20 bp, Artificial
  CRISPR gRNA sequence
tctccttggaagcggtccct

SEQ ID NO: 453756 - DNA, 20 bp, Artificial
  CRISPR gRNA sequence
tccttggaagcggtccctac

SEQ ID NO: 453757 - DNA, 20 bp, Artificial
  CRISPR gRNA sequence
cttggaagcggtccctaccc

SEQ ID NO: 453758 - DNA, 20 bp, Artificial
  CRISPR gRNA sequence
ggaagcggtccctaccctgc

SEQ ID NO: 453759 - DNA, 20 bp, Artificial
  CRISPR gRNA sequence
gaagcggtccctaccctgcg

SEQ ID NO: 453760 - DNA, 20 bp, Artificial
  CRISPR gRNA sequence
ccctgcgcccctcccatccc

SEQ ID NO: 453761 - DNA, 20 bp, Artificial
  CRISPR gRNA sequence
cgcccctcccatcccgctgc

SEQ ID NO: 453762 - DNA, 20 bp, Artificial
  CRISPR gRNA sequence
ccatcccgctgcaccagtcc

SEQ ID NO: 453763 - DNA, 20 bp, Artificial
  CRISPR gRNA sequence
caccagtcccttaggaaaca

SEQ ID NO: 453764 - DNA, 20 bp, Artificial
  CRISPR gRNA sequence
aggaaacacgcctagagaag

SEQ ID NO: 453765 - DNA, 20 bp, Artificial
  CRISPR gRNA sequence
ggaaacacgcctagagaagg

SEQ ID NO: 453766 - DNA, 20 bp, Artificial
  CRISPR gRNA sequence
gagaagggacacgaccttgt

SEQ ID NO: 453767 - DNA, 20 bp, Artificial
  CRISPR gRNA sequence
gtcaacattccacagctacc

SEQ ID NO: 453768 - DNA, 20 bp, Artificial
  CRISPR gRNA sequence
tcaacattccacagctacct

SEQ ID NO: 453769 - DNA, 20 bp, Artificial
  CRISPR gRNA sequence
cacagctacctagtgcggag

SEQ ID NO: 453770 - DNA, 20 bp, Artificial
  CRISPR gRNA sequence
cctagtgcggagccaggact

SEQ ID NO: 453771 - DNA, 20 bp, Artificial
  CRISPR gRNA sequence
gtgcggagccaggactggaa

SEQ ID NO: 453772 - DNA, 20 bp, Artificial
  CRISPR gRNA sequence
gaagccagatctcctcagcc

SEQ ID NO: 453773 - DNA, 20 bp, Artificial
  CRISPR gRNA sequence
ctcagcccattccccacctt

SEQ ID NO: 453774 - DNA, 20 bp, Artificial
  CRISPR gRNA sequence
agcccattccccaccttaat

SEQ ID NO: 453775 - DNA, 20 bp, Artificial
  CRISPR gRNA sequence
cccaccttaattcacccacc

SEQ ID NO: 453776 - DNA, 20 bp, Artificial
  CRISPR gRNA sequence
aattcacccaccgtattctt

SEQ ID NO: 453777 - DNA, 20 bp, Artificial
  CRISPR gRNA sequence
attcacccaccgtattcttt

SEQ ID NO: 453778 - DNA, 20 bp, Artificial
  CRISPR gRNA sequence
acccaccgtattctttagtc

SEQ ID NO: 453779 - DNA, 20 bp, Artificial
  CRISPR gRNA sequence
tttagtcaccagctcccgag

SEQ ID NO: 453780 - DNA, 20 bp, Artificial
  CRISPR gRNA sequence
tagtcaccagctcccgagag

SEQ ID NO: 453781 - DNA, 20 bp, Artificial
  CRISPR gRNA sequence
agtcaccagctcccgagagc

SEQ ID NO: 453782 - DNA, 20 bp, Artificial
  CRISPR gRNA sequence
gtcaccagctcccgagagcc

SEQ ID NO: 453783 - DNA, 20 bp, Artificial
  CRISPR gRNA sequence
ccgagagcccacaaacaact

SEQ ID NO: 453784 - DNA, 20 bp, Artificial
  CRISPR gRNA sequence
tgaaggcctaacttcattgc

SEQ ID NO: 453785 - DNA, 20 bp, Artificial
  CRISPR gRNA sequence
acttcattgccatcttgcag

SEQ ID NO: 453786 - DNA, 20 bp, Artificial
  CRISPR gRNA sequence
cattgccatcttgcagcctt

SEQ ID NO: 453787 - DNA, 20 bp, Artificial
  CRISPR gRNA sequence
attgccatcttgcagccttt

SEQ ID NO: 453788 - DNA, 20 bp, Artificial
  CRISPR gRNA sequence
ccatcttgcagcctttccac

SEQ ID NO: 453789 - DNA, 20 bp, Artificial
  CRISPR gRNA sequence
gcagcctttccacatccctc

SEQ ID NO: 453790 - DNA, 20 bp, Artificial
  CRISPR gRNA sequence
cagcctttccacatccctca

SEQ ID NO: 453791 - DNA, 20 bp, Artificial
  CRISPR gRNA sequence
tccacatccctcatccagaa

SEQ ID NO: 453792 - DNA, 20 bp, Artificial
  CRISPR gRNA sequence
ccacatccctcatccagaat

SEQ ID NO: 453793 - DNA, 20 bp, Artificial
  CRISPR gRNA sequence
cacatccctcatccagaatt

SEQ ID NO: 453794 - DNA, 20 bp, Artificial
  CRISPR gRNA sequence
atccagaatttctcctgtgc

SEQ ID NO: 453795 - DNA, 20 bp, Artificial
  CRISPR gRNA sequence
ctcctgtgctgccccttgac

SEQ ID NO: 453796 - DNA, 20 bp, Artificial
  CRISPR gRNA sequence
tcctgtgctgccccttgaca

SEQ ID NO: 453797 - DNA, 20 bp, Artificial
  CRISPR gRNA sequence
ctgtgctgccccttgacact

SEQ ID NO: 453798 - DNA, 20 bp, Artificial
  CRISPR gRNA sequence
tgctgccccttgacacttta

SEQ ID NO: 453799 - DNA, 20 bp, Artificial
  CRISPR gRNA sequence
ccccttgacactttatgacc

SEQ ID NO: 453800 - DNA, 20 bp, Artificial
  CRISPR gRNA sequence
gacactttatgaccttatta

SEQ ID NO: 453801 - DNA, 20 bp, Artificial
  CRISPR gRNA sequence
acactttatgaccttattac

SEQ ID NO: 453802 - DNA, 20 bp, Artificial
  CRISPR gRNA sequence
tatgaccttattacttagta

SEQ ID NO: 453803 - DNA, 20 bp, Artificial
  CRISPR gRNA sequence
atgaccttattacttagtac

SEQ ID NO: 453804 - DNA, 20 bp, Artificial
  CRISPR gRNA sequence
tgaccttattacttagtaca

SEQ ID NO: 453805 - DNA, 20 bp, Artificial
  CRISPR gRNA sequence
attacttagtacagtcgttc

SEQ ID NO: 453806 - DNA, 20 bp, Artificial
  CRISPR gRNA sequence
ttacttagtacagtcgttct

SEQ ID NO: 453807 - DNA, 20 bp, Artificial
  CRISPR gRNA sequence
cttagtacagtcgttcttgt

SEQ ID NO: 453808 - DNA, 20 bp, Artificial
  CRISPR gRNA sequence
agtacagtcgttcttgtgtt

SEQ ID NO: 453809 - DNA, 20 bp, Artificial
  CRISPR gRNA sequence
gtacagtcgttcttgtgtta

SEQ ID NO: 453810 - DNA, 20 bp, Artificial
  CRISPR gRNA sequence
ttgtgttaacagctgttcgt

SEQ ID NO: 453811 - DNA, 20 bp, Artificial
  CRISPR gRNA sequence
gtgttaacagctgttcgtga

SEQ ID NO: 453812 - DNA, 20 bp, Artificial
  CRISPR gRNA sequence
tgttaacagctgttcgtgaa

SEQ ID NO: 453813 - DNA, 20 bp, Artificial
  CRISPR gRNA sequence
acagctgttcgtgaatggat

SEQ ID NO: 453814 - DNA, 20 bp, Artificial
  CRISPR gRNA sequence
ttcgtgaatggatgagcggc

SEQ ID NO: 453815 - DNA, 20 bp, Artificial
  CRISPR gRNA sequence
gtgaatggatgagcggctgt

SEQ ID NO: 453816 - DNA, 20 bp, Artificial
  CRISPR gRNA sequence
tgaggagagggacaaagggg

SEQ ID NO: 453817 - DNA, 20 bp, Artificial
  CRISPR gRNA sequence
caagagaaagactctcataa

SEQ ID NO: 453818 - DNA, 20 bp, Artificial
  CRISPR gRNA sequence
tcataacttgggttagagtc

SEQ ID NO: 453819 - DNA, 20 bp, Artificial
  CRISPR gRNA sequence
ataacttgggttagagtcct

SEQ ID NO: 453820 - DNA, 20 bp, Artificial
  CRISPR gRNA sequence
gggttagagtcctgctcccc

SEQ ID NO: 453821 - DNA, 20 bp, Artificial
  CRISPR gRNA sequence
ggttagagtcctgctcccca

SEQ ID NO: 453822 - DNA, 20 bp, Artificial
  CRISPR gRNA sequence
gagtcctgctccccaactta

SEQ ID NO: 453823 - DNA, 20 bp, Artificial
  CRISPR gRNA sequence
ctccccaacttaggagctgt

SEQ ID NO: 453824 - DNA, 20 bp, Artificial
  CRISPR gRNA sequence
cccaacttaggagctgtgat

SEQ ID NO: 453825 - DNA, 20 bp, Artificial
  CRISPR gRNA sequence
aggagctgtgattttaagca

SEQ ID NO: 453826 - DNA, 20 bp, Artificial
  CRISPR gRNA sequence
ggagctgtgattttaagcaa

SEQ ID NO: 453827 - DNA, 20 bp, Artificial
  CRISPR gRNA sequence
tgattttaagcaagtcacaa

SEQ ID NO: 453828 - DNA, 20 bp, Artificial
  CRISPR gRNA sequence
taagcaagtcacaagtcccc

SEQ ID NO: 453829 - DNA, 20 bp, Artificial
  CRISPR gRNA sequence
aagcaagtcacaagtcccct

SEQ ID NO: 453830 - DNA, 20 bp, Artificial
  CRISPR gRNA sequence
agcaagtcacaagtcccctc

SEQ ID NO: 453831 - DNA, 20 bp, Artificial
  CRISPR gRNA sequence
caagcctctatatgcttcgt

SEQ ID NO: 453832 - DNA, 20 bp, Artificial
  CRISPR gRNA sequence
tatatgcttcgtacaaataa

SEQ ID NO: 453833 - DNA, 20 bp, Artificial
  CRISPR gRNA sequence
tatgcttcgtacaaataata

SEQ ID NO: 453834 - DNA, 20 bp, Artificial
  CRISPR gRNA sequence
cgtacaaataataaatttta

SEQ ID NO: 453835 - DNA, 20 bp, Artificial
  CRISPR gRNA sequence
gtacaaataataaattttag

SEQ ID NO: 453836 - DNA, 20 bp, Artificial
  CRISPR gRNA sequence
tagaaaataataatggctta

SEQ ID NO: 453837 - DNA, 20 bp, Artificial
  CRISPR gRNA sequence
agaaaataataatggcttag

SEQ ID NO: 453838 - DNA, 20 bp, Artificial
  CRISPR gRNA sequence
gaaaataataatggcttagt

SEQ ID NO: 453839 - DNA, 20 bp, Artificial
  CRISPR gRNA sequence
agtgttttataaggactaaa

SEQ ID NO: 453840 - DNA, 20 bp, Artificial
  CRISPR gRNA sequence
gtgttttataaggactaaac

SEQ ID NO: 453841 - DNA, 20 bp, Artificial
  CRISPR gRNA sequence
tataaggactaaacacagtc

SEQ ID NO: 453842 - DNA, 20 bp, Artificial
  CRISPR gRNA sequence
ataaggactaaacacagtct

SEQ ID NO: 453843 - DNA, 20 bp, Artificial
  CRISPR gRNA sequence
taaggactaaacacagtctt

SEQ ID NO: 453844 - DNA, 20 bp, Artificial
  CRISPR gRNA sequence
aacacagtcttgcaggtaga

SEQ ID NO: 453845 - DNA, 20 bp, Artificial
  CRISPR gRNA sequence
gcaggtagatgtgcctggaa

SEQ ID NO: 453846 - DNA, 20 bp, Artificial
  CRISPR gRNA sequence
caggtagatgtgcctggaac

SEQ ID NO: 453847 - DNA, 20 bp, Artificial
  CRISPR gRNA sequence
gaacactgtccattgattcc

SEQ ID NO: 453848 - DNA, 20 bp, Artificial
  CRISPR gRNA sequence
tccattgattccaatataag

SEQ ID NO: 453849 - DNA, 20 bp, Artificial
  CRISPR gRNA sequence
attccaatataagaaagcat

SEQ ID NO: 453850 - DNA, 20 bp, Artificial
  CRISPR gRNA sequence
caatataagaaagcataaaa

SEQ ID NO: 453851 - DNA, 20 bp, Artificial
  CRISPR gRNA sequence
atcatagctatcatttattg

SEQ ID NO: 453852 - DNA, 20 bp, Artificial
  CRISPR gRNA sequence
tcatttattgagcccttact

SEQ ID NO: 453853 - DNA, 20 bp, Artificial
  CRISPR gRNA sequence
attgagcccttactctctgc

SEQ ID NO: 453854 - DNA, 20 bp, Artificial
  CRISPR gRNA sequence
ttgagcccttactctctgcc

SEQ ID NO: 453855 - DNA, 20 bp, Artificial
  CRISPR gRNA sequence
agcccttactctctgccagg

SEQ ID NO: 453856 - DNA, 20 bp, Artificial
  CRISPR gRNA sequence
actctctgccaggcactgtg

SEQ ID NO: 453857 - DNA, 20 bp, Artificial
  CRISPR gRNA sequence
ctctctgccaggcactgtgc

SEQ ID NO: 453858 - DNA, 20 bp, Artificial
  CRISPR gRNA sequence
tctgccaggcactgtgctaa

SEQ ID NO: 453859 - DNA, 20 bp, Artificial
  CRISPR gRNA sequence
tgccaggcactgtgctaagt

SEQ ID NO: 453860 - DNA, 20 bp, Artificial
  CRISPR gRNA sequence
ccaggcactgtgctaagtaa

SEQ ID NO: 453861 - DNA, 20 bp, Artificial
  CRISPR gRNA sequence
tgctaagtaatttacatagg

SEQ ID NO: 453862 - DNA, 20 bp, Artificial
  CRISPR gRNA sequence
agtaatttacataggtgacc

SEQ ID NO: 453863 - DNA, 20 bp, Artificial
  CRISPR gRNA sequence
acataggtgacctcatttga

SEQ ID NO: 453864 - DNA, 20 bp, Artificial
  CRISPR gRNA sequence
cataggtgacctcatttgac

SEQ ID NO: 453865 - DNA, 20 bp, Artificial
  CRISPR gRNA sequence
atttgaccctcacaacccaa

SEQ ID NO: 453866 - DNA, 20 bp, Artificial
  CRISPR gRNA sequence
gaccctcacaacccaaggaa

SEQ ID NO: 453867 - DNA, 20 bp, Artificial
  CRISPR gRNA sequence
accctcacaacccaaggaag

SEQ ID NO: 453868 - DNA, 20 bp, Artificial
  CRISPR gRNA sequence
acaacccaaggaagagaata

SEQ ID NO: 453869 - DNA, 20 bp, Artificial
  CRISPR gRNA sequence
tgtcaccattttataggtca

SEQ ID NO: 453870 - DNA, 20 bp, Artificial
  CRISPR gRNA sequence
gtcaccattttataggtcat

SEQ ID NO: 453871 - DNA, 20 bp, Artificial
  CRISPR gRNA sequence
tcaccattttataggtcatt

SEQ ID NO: 453872 - DNA, 20 bp, Artificial
  CRISPR gRNA sequence
tataggtcattaagagatta

SEQ ID NO: 453873 - DNA, 20 bp, Artificial
  CRISPR gRNA sequence
ataggtcattaagagattaa

SEQ ID NO: 453874 - DNA, 20 bp, Artificial
  CRISPR gRNA sequence
taggtcattaagagattaag

SEQ ID NO: 453875 - DNA, 20 bp, Artificial
  CRISPR gRNA sequence
agagattaagaaacttgccc

SEQ ID NO: 453876 - DNA, 20 bp, Artificial
  CRISPR gRNA sequence
agaaacttgcccaatattac

SEQ ID NO: 453877 - DNA, 20 bp, Artificial
  CRISPR gRNA sequence
gcccaatattacacagatag

SEQ ID NO: 453878 - DNA, 20 bp, Artificial
  CRISPR gRNA sequence
cccaatattacacagatagt

SEQ ID NO: 453879 - DNA, 20 bp, Artificial
  CRISPR gRNA sequence
cacagatagttaagtttcaa

SEQ ID NO: 453880 - DNA, 20 bp, Artificial
  CRISPR gRNA sequence
agtttcaaagccagatctga

SEQ ID NO: 453881 - DNA, 20 bp, Artificial
  CRISPR gRNA sequence
caaagccagatctgaaacat

SEQ ID NO: 453882 - DNA, 20 bp, Artificial
  CRISPR gRNA sequence
aaagccagatctgaaacatc

SEQ ID NO: 453883 - DNA, 20 bp, Artificial
  CRISPR gRNA sequence
aaacatcctggtctgactct

SEQ ID NO: 453884 - DNA, 20 bp, Artificial
  CRISPR gRNA sequence
gtctgactctagagaccatt

SEQ ID NO: 453885 - DNA, 20 bp, Artificial
  CRISPR gRNA sequence
actctagagaccatttaacc

SEQ ID NO: 453886 - DNA, 20 bp, Artificial
  CRISPR gRNA sequence
tagagaccatttaaccacta

SEQ ID NO: 453887 - DNA, 20 bp, Artificial
  CRISPR gRNA sequence
gagaccatttaaccactaaa

SEQ ID NO: 453888 - DNA, 20 bp, Artificial
  CRISPR gRNA sequence
aaccactaaaacgtccgcct

SEQ ID NO: 453889 - DNA, 20 bp, Artificial
  CRISPR gRNA sequence
accactaaaacgtccgcctc

SEQ ID NO: 453890 - DNA, 20 bp, Artificial
  CRISPR gRNA sequence
aaacgtccgcctctgctgtg

SEQ ID NO: 453891 - DNA, 20 bp, Artificial
  CRISPR gRNA sequence
tgctgtgttagtgatctctc

SEQ ID NO: 453892 - DNA, 20 bp, Artificial
  CRISPR gRNA sequence
ctgtgttagtgatctctctg

SEQ ID NO: 453893 - DNA, 20 bp, Artificial
  CRISPR gRNA sequence
tgttagtgatctctctgtgc

SEQ ID NO: 453894 - DNA, 20 bp, Artificial
  CRISPR gRNA sequence
gtgatctctctgtgccccat

SEQ ID NO: 453895 - DNA, 20 bp, Artificial
  CRISPR gRNA sequence
tctgtgccccatggtgtctg

SEQ ID NO: 453896 - DNA, 20 bp, Artificial
  CRISPR gRNA sequence
tgtgccccatggtgtctgac

SEQ ID NO: 453897 - DNA, 20 bp, Artificial
  CRISPR gRNA sequence
tgccccatggtgtctgacac

SEQ ID NO: 453898 - DNA, 20 bp, Artificial
  CRISPR gRNA sequence
acacattatagatgctccgt

SEQ ID NO: 453899 - DNA, 20 bp, Artificial
  CRISPR gRNA sequence
tagatgctccgtgtttctga

SEQ ID NO: 453900 - DNA, 20 bp, Artificial
  CRISPR gRNA sequence
cgtgtttctgaaatatgtct

SEQ ID NO: 453901 - DNA, 20 bp, Artificial
  CRISPR gRNA sequence
ctgaaatatgtctatttatt

SEQ ID NO: 453902 - DNA, 20 bp, Artificial
  CRISPR gRNA sequence
tgaaatatgtctatttatta

SEQ ID NO: 453903 - DNA, 20 bp, Artificial
  CRISPR gRNA sequence
aaatatgtctatttattaaa

SEQ ID NO: 453904 - DNA, 20 bp, Artificial
  CRISPR gRNA sequence
tttattaaaggctgagcata

SEQ ID NO: 453905 - DNA, 20 bp, Artificial
  CRISPR gRNA sequence
attaaaggctgagcatagcg

SEQ ID NO: 453906 - DNA, 20 bp, Artificial
  CRISPR gRNA sequence
ttaaaggctgagcatagcgc

SEQ ID NO: 453907 - DNA, 20 bp, Artificial
  CRISPR gRNA sequence
aaggctgagcatagcgcctg

SEQ ID NO: 453908 - DNA, 20 bp, Artificial
  CRISPR gRNA sequence
agcatagcgcctggcccagg

SEQ ID NO: 453909 - DNA, 20 bp, Artificial
  CRISPR gRNA sequence
gcccaggagcctaagaaact

SEQ ID NO: 453910 - DNA, 20 bp, Artificial
  CRISPR gRNA sequence
agaaacttgaccgagtcatg

SEQ ID NO: 453911 - DNA, 20 bp, Artificial
  CRISPR gRNA sequence
gaccgagtcatgcaactatt

SEQ ID NO: 453912 - DNA, 20 bp, Artificial
  CRISPR gRNA sequence
accgagtcatgcaactatta

SEQ ID NO: 453913 - DNA, 20 bp, Artificial
  CRISPR gRNA sequence
ttaagttttttttgttttta

SEQ ID NO: 453914 - DNA, 20 bp, Artificial
  CRISPR gRNA sequence
agttttttttgtttttattt

SEQ ID NO: 453915 - DNA, 20 bp, Artificial
  CRISPR gRNA sequence
tttttgtttttatttttgtt

SEQ ID NO: 453916 - DNA, 20 bp, Artificial
  CRISPR gRNA sequence
ttttgtttttatttttgttt

SEQ ID NO: 453917 - DNA, 20 bp, Artificial
  CRISPR gRNA sequence
tttgtttttatttttgtttt

SEQ ID NO: 453918 - DNA, 20 bp, Artificial
  CRISPR gRNA sequence
ttgtttttatttttgttttt

SEQ ID NO: 453919 - DNA, 20 bp, Artificial
  CRISPR gRNA sequence
tgtttttatttttgtttttt

SEQ ID NO: 453920 - DNA, 20 bp, Artificial
  CRISPR gRNA sequence
gtttttatttttgttttttc

SEQ ID NO: 453921 - DNA, 20 bp, Artificial
  CRISPR gRNA sequence
tttttatttttgttttttcg

SEQ ID NO: 453922 - DNA, 20 bp, Artificial
  CRISPR gRNA sequence
ttatttttgttttttcgaga

SEQ ID NO: 453923 - DNA, 20 bp, Artificial
  CRISPR gRNA sequence
tatttttgttttttcgagac

SEQ ID NO: 453924 - DNA, 20 bp, Artificial
  CRISPR gRNA sequence
atttttgttttttcgagaca

SEQ ID NO: 453925 - DNA, 20 bp, Artificial
  CRISPR gRNA sequence
tttttgttttttcgagacag

SEQ ID NO: 453926 - DNA, 20 bp, Artificial
  CRISPR gRNA sequence
ttgttttttcgagacagaat

SEQ ID NO: 453927 - DNA, 20 bp, Artificial
  CRISPR gRNA sequence
tgttttttcgagacagaatc

SEQ ID NO: 453928 - DNA, 20 bp, Artificial
  CRISPR gRNA sequence
gttttttcgagacagaatct

SEQ ID NO: 453929 - DNA, 20 bp, Artificial
  CRISPR gRNA sequence
ttttttcgagacagaatctt

SEQ ID NO: 453930 - DNA, 20 bp, Artificial
  CRISPR gRNA sequence
tttcgagacagaatcttgct

SEQ ID NO: 453931 - DNA, 20 bp, Artificial
  CRISPR gRNA sequence
ttcgagacagaatcttgctc

SEQ ID NO: 453932 - DNA, 20 bp, Artificial
  CRISPR gRNA sequence
tcgagacagaatcttgctct

SEQ ID NO: 453933 - DNA, 20 bp, Artificial
  CRISPR gRNA sequence
cgagacagaatcttgctctg

SEQ ID NO: 453934 - DNA, 20 bp, Artificial
  CRISPR gRNA sequence
gagacagaatcttgctctgt

SEQ ID NO: 453935 - DNA, 20 bp, Artificial
  CRISPR gRNA sequence
gctctgtcgcccaggctgga

SEQ ID NO: 453936 - DNA, 20 bp, Artificial
  CRISPR gRNA sequence
ctctgtcgcccaggctggag

SEQ ID NO: 453937 - DNA, 20 bp, Artificial
  CRISPR gRNA sequence
tgtcgcccaggctggagtgc

SEQ ID NO: 453938 - DNA, 20 bp, Artificial
  CRISPR gRNA sequence
tcgcccaggctggagtgcag

SEQ ID NO: 453939 - DNA, 20 bp, Artificial
  CRISPR gRNA sequence
gagtgcagtagcgcgatctc

SEQ ID NO: 453940 - DNA, 20 bp, Artificial
  CRISPR gRNA sequence
agctcactgcaagctccgcc

SEQ ID NO: 453941 - DNA, 20 bp, Artificial
  CRISPR gRNA sequence
actgcaagctccgcctctcg

SEQ ID NO: 453942 - DNA, 20 bp, Artificial
  CRISPR gRNA sequence
caagctccgcctctcgggct

SEQ ID NO: 453943 - DNA, 20 bp, Artificial
  CRISPR gRNA sequence
cgcctctcgggctcacgcca

SEQ ID NO: 453944 - DNA, 20 bp, Artificial
  CRISPR gRNA sequence
tcgggctcacgccattctcc

SEQ ID NO: 453945 - DNA, 20 bp, Artificial
  CRISPR gRNA sequence
gggctcacgccattctcctg

SEQ ID NO: 453946 - DNA, 20 bp, Artificial
  CRISPR gRNA sequence
acgccattctcctgcctcag

SEQ ID NO: 453947 - DNA, 20 bp, Artificial
  CRISPR gRNA sequence
tcctgcctcagcctcccgag

SEQ ID NO: 453948 - DNA, 20 bp, Artificial
  CRISPR gRNA sequence
ctgcctcagcctcccgagta

SEQ ID NO: 453949 - DNA, 20 bp, Artificial
  CRISPR gRNA sequence
cctcagcctcccgagtagct

SEQ ID NO: 453950 - DNA, 20 bp, Artificial
  CRISPR gRNA sequence
agcctcccgagtagctggga

SEQ ID NO: 453951 - DNA, 20 bp, Artificial
  CRISPR gRNA sequence
ccgagtagctgggactacag

SEQ ID NO: 453952 - DNA, 20 bp, Artificial
  CRISPR gRNA sequence
ggactacaggcgcccgccac

SEQ ID NO: 453953 - DNA, 20 bp, Artificial
  CRISPR gRNA sequence
caggcgcccgccaccacgcc

SEQ ID NO: 453954 - DNA, 20 bp, Artificial
  CRISPR gRNA sequence
attttttgtattttttttag

SEQ ID NO: 453955 - DNA, 20 bp, Artificial
  CRISPR gRNA sequence
tttgtattttttttagtaga

SEQ ID NO: 453956 - DNA, 20 bp, Artificial
  CRISPR gRNA sequence
ttgtattttttttagtagag

SEQ ID NO: 453957 - DNA, 20 bp, Artificial
  CRISPR gRNA sequence
tgtattttttttagtagaga

SEQ ID NO: 453958 - DNA, 20 bp, Artificial
  CRISPR gRNA sequence
gtattttttttagtagagat

SEQ ID NO: 453959 - DNA, 20 bp, Artificial
  CRISPR gRNA sequence
tattttttttagtagagatg

SEQ ID NO: 453960 - DNA, 20 bp, Artificial
  CRISPR gRNA sequence
tttttagtagagatggggtt

SEQ ID NO: 453961 - DNA, 20 bp, Artificial
  CRISPR gRNA sequence
ttttagtagagatggggttt

SEQ ID NO: 453962 - DNA, 20 bp, Artificial
  CRISPR gRNA sequence
tttagtagagatggggtttc

SEQ ID NO: 453963 - DNA, 20 bp, Artificial
  CRISPR gRNA sequence
ttagtagagatggggtttca

SEQ ID NO: 453964 - DNA, 20 bp, Artificial
  CRISPR gRNA sequence
tagtagagatggggtttcac

SEQ ID NO: 453965 - DNA, 20 bp, Artificial
  CRISPR gRNA sequence
agtagagatggggtttcacc

SEQ ID NO: 453966 - DNA, 20 bp, Artificial
  CRISPR gRNA sequence
gtagagatggggtttcaccg

SEQ ID NO: 453967 - DNA, 20 bp, Artificial
  CRISPR gRNA sequence
caccgtgttagccaggatgg

SEQ ID NO: 453968 - DNA, 20 bp, Artificial
  CRISPR gRNA sequence
accgtgttagccaggatggt

SEQ ID NO: 453969 - DNA, 20 bp, Artificial
  CRISPR gRNA sequence
gccaggatggtctcgatctc

SEQ ID NO: 453970 - DNA, 20 bp, Artificial
  CRISPR gRNA sequence
gatctcctgacctcgtgatc

SEQ ID NO: 453971 - DNA, 20 bp, Artificial
  CRISPR gRNA sequence
ctgacctcgtgatctgccca

SEQ ID NO: 453972 - DNA, 20 bp, Artificial
  CRISPR gRNA sequence
acctcgtgatctgcccacct

SEQ ID NO: 453973 - DNA, 20 bp, Artificial
  CRISPR gRNA sequence
gtgatctgcccacctcggcc

SEQ ID NO: 453974 - DNA, 20 bp, Artificial
  CRISPR gRNA sequence
cccacctcggcctcccaaag

SEQ ID NO: 453975 - DNA, 20 bp, Artificial
  CRISPR gRNA sequence
ggcctcccaaagtgctggga

SEQ ID NO: 453976 - DNA, 20 bp, Artificial
  CRISPR gRNA sequence
ccaaagtgctgggattacag

SEQ ID NO: 453977 - DNA, 20 bp, Artificial
  CRISPR gRNA sequence
ggattacaggcgtgagacac

SEQ ID NO: 453978 - DNA, 20 bp, Artificial
  CRISPR gRNA sequence
caggcgtgagacaccgcgcc

SEQ ID NO: 453979 - DNA, 20 bp, Artificial
  CRISPR gRNA sequence
ttaagttttaggaccaggat

SEQ ID NO: 453980 - DNA, 20 bp, Artificial
  CRISPR gRNA sequence
agttttaggaccaggatttg

SEQ ID NO: 453981 - DNA, 20 bp, Artificial
  CRISPR gRNA sequence
taggaccaggatttgaacac

SEQ ID NO: 453982 - DNA, 20 bp, Artificial
  CRISPR gRNA sequence
aggaccaggatttgaacaca

SEQ ID NO: 453983 - DNA, 20 bp, Artificial
  CRISPR gRNA sequence
ggaccaggatttgaacacaa

SEQ ID NO: 453984 - DNA, 20 bp, Artificial
  CRISPR gRNA sequence
gaacacaaacactctggctc

SEQ ID NO: 453985 - DNA, 20 bp, Artificial
  CRISPR gRNA sequence
aacacaaacactctggctct

SEQ ID NO: 453986 - DNA, 20 bp, Artificial
  CRISPR gRNA sequence
tggctctagagtctacgctt

SEQ ID NO: 453987 - DNA, 20 bp, Artificial
  CRISPR gRNA sequence
gctctagagtctacgctttt

SEQ ID NO: 453988 - DNA, 20 bp, Artificial
  CRISPR gRNA sequence
tagagtctacgctttttaac

SEQ ID NO: 453989 - DNA, 20 bp, Artificial
  CRISPR gRNA sequence
gagtctacgctttttaacca

SEQ ID NO: 453990 - DNA, 20 bp, Artificial
  CRISPR gRNA sequence
cgctttttaaccataattct

SEQ ID NO: 453991 - DNA, 20 bp, Artificial
  CRISPR gRNA sequence
tttaaccataattctgggct

SEQ ID NO: 453992 - DNA, 20 bp, Artificial
  CRISPR gRNA sequence
ttaaccataattctgggctg

SEQ ID NO: 453993 - DNA, 20 bp, Artificial
  CRISPR gRNA sequence
taaccataattctgggctga

SEQ ID NO: 453994 - DNA, 20 bp, Artificial
  CRISPR gRNA sequence
aaccataattctgggctgaa

SEQ ID NO: 453995 - DNA, 20 bp, Artificial
  CRISPR gRNA sequence
accataattctgggctgaat

SEQ ID NO: 453996 - DNA, 20 bp, Artificial
  CRISPR gRNA sequence
tgggctgaatgaataattgc

SEQ ID NO: 453997 - DNA, 20 bp, Artificial
  CRISPR gRNA sequence
ggctgaatgaataattgcaa

SEQ ID NO: 453998 - DNA, 20 bp, Artificial
  CRISPR gRNA sequence
aatgaataattgcaatcctt

SEQ ID NO: 453999 - DNA, 20 bp, Artificial
  CRISPR gRNA sequence
caatccttctttgtcttcct

SEQ ID NO: 454000 - DNA, 20 bp, Artificial
  CRISPR gRNA sequence
ctttgtcttcctctttgaat

SEQ ID NO: 454001 - DNA, 20 bp, Artificial
  CRISPR gRNA sequence
tttgtcttcctctttgaata

SEQ ID NO: 454002 - DNA, 20 bp, Artificial
  CRISPR gRNA sequence
tgtcttcctctttgaataaa

SEQ ID NO: 454003 - DNA, 20 bp, Artificial
  CRISPR gRNA sequence
gtcttcctctttgaataaaa

SEQ ID NO: 454004 - DNA, 20 bp, Artificial
  CRISPR gRNA sequence
tcttcctctttgaataaaat

SEQ ID NO: 454005 - DNA, 20 bp, Artificial
  CRISPR gRNA sequence
cctctttgaataaaatgatt

SEQ ID NO: 454006 - DNA, 20 bp, Artificial
  CRISPR gRNA sequence
ctctttgaataaaatgattt

SEQ ID NO: 454007 - DNA, 20 bp, Artificial
  CRISPR gRNA sequence
tttgaataaaatgatttgtc

SEQ ID NO: 454008 - DNA, 20 bp, Artificial
  CRISPR gRNA sequence
tgaataaaatgatttgtcat

SEQ ID NO: 454009 - DNA, 20 bp, Artificial
  CRISPR gRNA sequence
gaataaaatgatttgtcatt

SEQ ID NO: 454010 - DNA, 20 bp, Artificial
  CRISPR gRNA sequence
aataaaatgatttgtcattt

SEQ ID NO: 454011 - DNA, 20 bp, Artificial
  CRISPR gRNA sequence
gtcattttattcatttatcc

SEQ ID NO: 454012 - DNA, 20 bp, Artificial
  CRISPR gRNA sequence
tcattttattcatttatcct

SEQ ID NO: 454013 - DNA, 20 bp, Artificial
  CRISPR gRNA sequence
tattcatttatcctctttgt

SEQ ID NO: 454014 - DNA, 20 bp, Artificial
  CRISPR gRNA sequence
attcatttatcctctttgtc

SEQ ID NO: 454015 - DNA, 20 bp, Artificial
  CRISPR gRNA sequence
ttcatttatcctctttgtca

SEQ ID NO: 454016 - DNA, 20 bp, Artificial
  CRISPR gRNA sequence
atttatcctctttgtcactt

SEQ ID NO: 454017 - DNA, 20 bp, Artificial
  CRISPR gRNA sequence
atcctctttgtcacttaata

SEQ ID NO: 454018 - DNA, 20 bp, Artificial
  CRISPR gRNA sequence
tcctctttgtcacttaatat

SEQ ID NO: 454019 - DNA, 20 bp, Artificial
  CRISPR gRNA sequence
tttgtcacttaatattccat

SEQ ID NO: 454020 - DNA, 20 bp, Artificial
  CRISPR gRNA sequence
tgtcacttaatattccatgt

SEQ ID NO: 454021 - DNA, 20 bp, Artificial
  CRISPR gRNA sequence
gtcacttaatattccatgtt

SEQ ID NO: 454022 - DNA, 20 bp, Artificial
  CRISPR gRNA sequence
tcacttaatattccatgttt

SEQ ID NO: 454023 - DNA, 20 bp, Artificial
  CRISPR gRNA sequence
aatattccatgtttcaagag

SEQ ID NO: 454024 - DNA, 20 bp, Artificial
  CRISPR gRNA sequence
atattccatgtttcaagagt

SEQ ID NO: 454025 - DNA, 20 bp, Artificial
  CRISPR gRNA sequence
catgtttcaagagtcaccag

SEQ ID NO: 454026 - DNA, 20 bp, Artificial
  CRISPR gRNA sequence
caagagtcaccaggacattc

SEQ ID NO: 454027 - DNA, 20 bp, Artificial
  CRISPR gRNA sequence
aagagtcaccaggacattct

SEQ ID NO: 454028 - DNA, 20 bp, Artificial
  CRISPR gRNA sequence
tggtgtagcatgaaggtatg

SEQ ID NO: 454029 - DNA, 20 bp, Artificial
  CRISPR gRNA sequence
gtgtagcatgaaggtatgat

SEQ ID NO: 454030 - DNA, 20 bp, Artificial
  CRISPR gRNA sequence
ggaaaggacattggggccat

SEQ ID NO: 454031 - DNA, 20 bp, Artificial
  CRISPR gRNA sequence
gggccataccatgagctgct

SEQ ID NO: 454032 - DNA, 20 bp, Artificial
  CRISPR gRNA sequence
ctgctgggatgttttattag

SEQ ID NO: 454033 - DNA, 20 bp, Artificial
  CRISPR gRNA sequence
ctgggatgttttattaggat

SEQ ID NO: 454034 - DNA, 20 bp, Artificial
  CRISPR gRNA sequence
ggatgttttattaggattgt

SEQ ID NO: 454035 - DNA, 20 bp, Artificial
  CRISPR gRNA sequence
tattaggattgtgacaaatg

SEQ ID NO: 454036 - DNA, 20 bp, Artificial
  CRISPR gRNA sequence
attaggattgtgacaaatgt

SEQ ID NO: 454037 - DNA, 20 bp, Artificial
  CRISPR gRNA sequence
ttaggattgtgacaaatgta

SEQ ID NO: 454038 - DNA, 20 bp, Artificial
  CRISPR gRNA sequence
ggattgtgacaaatgtatag

SEQ ID NO: 454039 - DNA, 20 bp, Artificial
  CRISPR gRNA sequence
tgacaaatgtatagataagt

SEQ ID NO: 454040 - DNA, 20 bp, Artificial
  CRISPR gRNA sequence
aacaatcgtctctacttaga

SEQ ID NO: 454041 - DNA, 20 bp, Artificial
  CRISPR gRNA sequence
acaatcgtctctacttagat

SEQ ID NO: 454042 - DNA, 20 bp, Artificial
  CRISPR gRNA sequence
tacttagattttcttttatg

SEQ ID NO: 454043 - DNA, 20 bp, Artificial
  CRISPR gRNA sequence
cttagattttcttttatgtt

SEQ ID NO: 454044 - DNA, 20 bp, Artificial
  CRISPR gRNA sequence
agattttcttttatgttcct

SEQ ID NO: 454045 - DNA, 20 bp, Artificial
  CRISPR gRNA sequence
gattttcttttatgttcctt

SEQ ID NO: 454046 - DNA, 20 bp, Artificial
  CRISPR gRNA sequence
tcttttatgttccttaatag

SEQ ID NO: 454047 - DNA, 20 bp, Artificial
  CRISPR gRNA sequence
cttttatgttccttaatagt

SEQ ID NO: 454048 - DNA, 20 bp, Artificial
  CRISPR gRNA sequence
ttttatgttccttaatagta

SEQ ID NO: 454049 - DNA, 20 bp, Artificial
  CRISPR gRNA sequence
ttatgttccttaatagtact

SEQ ID NO: 454050 - DNA, 20 bp, Artificial
  CRISPR gRNA sequence
tatgttccttaatagtactg

SEQ ID NO: 454051 - DNA, 20 bp, Artificial
  CRISPR gRNA sequence
atgttccttaatagtactgt

SEQ ID NO: 454052 - DNA, 20 bp, Artificial
  CRISPR gRNA sequence
tgttccttaatagtactgta

SEQ ID NO: 454053 - DNA, 20 bp, Artificial
  CRISPR gRNA sequence
cttaatagtactgtatagtt

SEQ ID NO: 454054 - DNA, 20 bp, Artificial
  CRISPR gRNA sequence
aatagtactgtatagtttgt

SEQ ID NO: 454055 - DNA, 20 bp, Artificial
  CRISPR gRNA sequence
atagtactgtatagtttgta

SEQ ID NO: 454056 - DNA, 20 bp, Artificial
  CRISPR gRNA sequence
tatagtttgtatcctatagg

SEQ ID NO: 454057 - DNA, 20 bp, Artificial
  CRISPR gRNA sequence
gtatcctataggtcctattc

SEQ ID NO: 454058 - DNA, 20 bp, Artificial
  CRISPR gRNA sequence
tatcctataggtcctattcg

SEQ ID NO: 454059 - DNA, 20 bp, Artificial
  CRISPR gRNA sequence
taggtcctattcggaatgtt

SEQ ID NO: 454060 - DNA, 20 bp, Artificial
  CRISPR gRNA sequence
ttcggaatgttgttacattt

SEQ ID NO: 454061 - DNA, 20 bp, Artificial
  CRISPR gRNA sequence
ggaatgttgttacatttttc

SEQ ID NO: 454062 - DNA, 20 bp, Artificial
  CRISPR gRNA sequence
ttacatttttctggacattt

SEQ ID NO: 454063 - DNA, 20 bp, Artificial
  CRISPR gRNA sequence
catttttctggacatttgat

SEQ ID NO: 454064 - DNA, 20 bp, Artificial
  CRISPR gRNA sequence
ttctggacatttgatgggtt

SEQ ID NO: 454065 - DNA, 20 bp, Artificial
  CRISPR gRNA sequence
tctggacatttgatgggttt

SEQ ID NO: 454066 - DNA, 20 bp, Artificial
  CRISPR gRNA sequence
ctggacatttgatgggtttt

SEQ ID NO: 454067 - DNA, 20 bp, Artificial
  CRISPR gRNA sequence
tggacatttgatgggttttt

SEQ ID NO: 454068 - DNA, 20 bp, Artificial
  CRISPR gRNA sequence
gacatttgatgggttttttg

SEQ ID NO: 454069 - DNA, 20 bp, Artificial
  CRISPR gRNA sequence
gatgggttttttggttgcta

SEQ ID NO: 454070 - DNA, 20 bp, Artificial
  CRISPR gRNA sequence
atgggttttttggttgctat

SEQ ID NO: 454071 - DNA, 20 bp, Artificial
  CRISPR gRNA sequence
tttggttgctataatgaatg

SEQ ID NO: 454072 - DNA, 20 bp, Artificial
  CRISPR gRNA sequence
ttggttgctataatgaatgg

SEQ ID NO: 454073 - DNA, 20 bp, Artificial
  CRISPR gRNA sequence
tggttgctataatgaatgga

SEQ ID NO: 454074 - DNA, 20 bp, Artificial
  CRISPR gRNA sequence
ggttgctataatgaatggaa

SEQ ID NO: 454075 - DNA, 20 bp, Artificial
  CRISPR gRNA sequence
gttgctataatgaatggaac

SEQ ID NO: 454076 - DNA, 20 bp, Artificial
  CRISPR gRNA sequence
ctataatgaatggaactttt

SEQ ID NO: 454077 - DNA, 20 bp, Artificial
  CRISPR gRNA sequence
taatgaatggaacttttcct

SEQ ID NO: 454078 - DNA, 20 bp, Artificial
  CRISPR gRNA sequence
ttccttctaccatattttct

SEQ ID NO: 454079 - DNA, 20 bp, Artificial
  CRISPR gRNA sequence
tccttctaccatattttctg

SEQ ID NO: 454080 - DNA, 20 bp, Artificial
  CRISPR gRNA sequence
ccttctaccatattttctga

SEQ ID NO: 454081 - DNA, 20 bp, Artificial
  CRISPR gRNA sequence
cttctaccatattttctgac

SEQ ID NO: 454082 - DNA, 20 bp, Artificial
  CRISPR gRNA sequence
ctaccatattttctgactaa

SEQ ID NO: 454083 - DNA, 20 bp, Artificial
  CRISPR gRNA sequence
taccatattttctgactaat

SEQ ID NO: 454084 - DNA, 20 bp, Artificial
  CRISPR gRNA sequence
ccatattttctgactaataa

SEQ ID NO: 454085 - DNA, 20 bp, Artificial
  CRISPR gRNA sequence
tctgactaataattatatcc

SEQ ID NO: 454086 - DNA, 20 bp, Artificial
  CRISPR gRNA sequence
ctgactaataattatatcca

SEQ ID NO: 454087 - DNA, 20 bp, Artificial
  CRISPR gRNA sequence
tgactaataattatatccag

SEQ ID NO: 454088 - DNA, 20 bp, Artificial
  CRISPR gRNA sequence
actaataattatatccagga

SEQ ID NO: 454089 - DNA, 20 bp, Artificial
  CRISPR gRNA sequence
ataattatatccaggaaaat

SEQ ID NO: 454090 - DNA, 20 bp, Artificial
  CRISPR gRNA sequence
tatccaggaaaatttttaat

SEQ ID NO: 454091 - DNA, 20 bp, Artificial
  CRISPR gRNA sequence
ttaatcttatgtattaataa

SEQ ID NO: 454092 - DNA, 20 bp, Artificial
  CRISPR gRNA sequence
taatcttatgtattaataag

SEQ ID NO: 454093 - DNA, 20 bp, Artificial
  CRISPR gRNA sequence
aatcttatgtattaataagt

SEQ ID NO: 454094 - DNA, 20 bp, Artificial
  CRISPR gRNA sequence
atcttatgtattaataagta

SEQ ID NO: 454095 - DNA, 20 bp, Artificial
  CRISPR gRNA sequence
atgtattaataagtacctta

SEQ ID NO: 454096 - DNA, 20 bp, Artificial
  CRISPR gRNA sequence
tgtattaataagtaccttat

SEQ ID NO: 454097 - DNA, 20 bp, Artificial
  CRISPR gRNA sequence
ataagtaccttattaaattg

SEQ ID NO: 454098 - DNA, 20 bp, Artificial
  CRISPR gRNA sequence
attaaattgtatgtatatac

SEQ ID NO: 454099 - DNA, 20 bp, Artificial
  CRISPR gRNA sequence
ttaaattgtatgtatataca

SEQ ID NO: 454100 - DNA, 20 bp, Artificial
  CRISPR gRNA sequence
aattgtatgtatatacacta

SEQ ID NO: 454101 - DNA, 20 bp, Artificial
  CRISPR gRNA sequence
tatgtatatacactaattta

SEQ ID NO: 454102 - DNA, 20 bp, Artificial
  CRISPR gRNA sequence
atttagtttattgttttata

SEQ ID NO: 454103 - DNA, 20 bp, Artificial
  CRISPR gRNA sequence
agtttattgttttatacaaa

SEQ ID NO: 454104 - DNA, 20 bp, Artificial
  CRISPR gRNA sequence
gtttattgttttatacaaac

SEQ ID NO: 454105 - DNA, 20 bp, Artificial
  CRISPR gRNA sequence
attgttttatacaaactata

SEQ ID NO: 454106 - DNA, 20 bp, Artificial
  CRISPR gRNA sequence
ttgttttatacaaactataa

SEQ ID NO: 454107 - DNA, 20 bp, Artificial
  CRISPR gRNA sequence
ttttatacaaactataatta

SEQ ID NO: 454108 - DNA, 20 bp, Artificial
  CRISPR gRNA sequence
tatacaaactataattacat

SEQ ID NO: 454109 - DNA, 20 bp, Artificial
  CRISPR gRNA sequence
atacaaactataattacata

SEQ ID NO: 454110 - DNA, 20 bp, Artificial
  CRISPR gRNA sequence
tacaaactataattacataa

SEQ ID NO: 454111 - DNA, 20 bp, Artificial
  CRISPR gRNA sequence
taattacataacattctatt

SEQ ID NO: 454112 - DNA, 20 bp, Artificial
  CRISPR gRNA sequence
cataacattctattctgtgg

SEQ ID NO: 454113 - DNA, 20 bp, Artificial
  CRISPR gRNA sequence
tattctgtggatctgcaata

SEQ ID NO: 454114 - DNA, 20 bp, Artificial
  CRISPR gRNA sequence
ttctgtggatctgcaataat

SEQ ID NO: 454115 - DNA, 20 bp, Artificial
  CRISPR gRNA sequence
tgtggatctgcaataattta

SEQ ID NO: 454116 - DNA, 20 bp, Artificial
  CRISPR gRNA sequence
tggatctgcaataatttatt

SEQ ID NO: 454117 - DNA, 20 bp, Artificial
  CRISPR gRNA sequence
caataatttattcaaccatt

SEQ ID NO: 454118 - DNA, 20 bp, Artificial
  CRISPR gRNA sequence
attcaaccattctcaccagt

SEQ ID NO: 454119 - DNA, 20 bp, Artificial
  CRISPR gRNA sequence
ttcaaccattctcaccagtg

SEQ ID NO: 454120 - DNA, 20 bp, Artificial
  CRISPR gRNA sequence
aaccattctcaccagtgggt

SEQ ID NO: 454121 - DNA, 20 bp, Artificial
  CRISPR gRNA sequence
tcaccagtgggtcttcacct

SEQ ID NO: 454122 - DNA, 20 bp, Artificial
  CRISPR gRNA sequence
accagtgggtcttcacctgt

SEQ ID NO: 454123 - DNA, 20 bp, Artificial
  CRISPR gRNA sequence
cacctgtttcctttttttat

SEQ ID NO: 454124 - DNA, 20 bp, Artificial
  CRISPR gRNA sequence
acctgtttcctttttttatg

SEQ ID NO: 454125 - DNA, 20 bp, Artificial
  CRISPR gRNA sequence
tttcctttttttatgggggc

SEQ ID NO: 454126 - DNA, 20 bp, Artificial
  CRISPR gRNA sequence
cctttttttatgggggcagg

SEQ ID NO: 454127 - DNA, 20 bp, Artificial
  CRISPR gRNA sequence
ctttttttatgggggcagga

SEQ ID NO: 454128 - DNA, 20 bp, Artificial
  CRISPR gRNA sequence
tttttatgggggcaggaagg

SEQ ID NO: 454129 - DNA, 20 bp, Artificial
  CRISPR gRNA sequence
ttttatgggggcaggaaggc

SEQ ID NO: 454130 - DNA, 20 bp, Artificial
  CRISPR gRNA sequence
tttatgggggcaggaaggcg

SEQ ID NO: 454131 - DNA, 20 bp, Artificial
  CRISPR gRNA sequence
ttatgggggcaggaaggcga

SEQ ID NO: 454132 - DNA, 20 bp, Artificial
  CRISPR gRNA sequence
tatgggggcaggaaggcgac

SEQ ID NO: 454133 - DNA, 20 bp, Artificial
  CRISPR gRNA sequence
atgggggcaggaaggcgaca

SEQ ID NO: 454134 - DNA, 20 bp, Artificial
  CRISPR gRNA sequence
tgggggcaggaaggcgacaa

SEQ ID NO: 454135 - DNA, 20 bp, Artificial
  CRISPR gRNA sequence
tgctctgttgcccaggctgg

SEQ ID NO: 454136 - DNA, 20 bp, Artificial
  CRISPR gRNA sequence
gctctgttgcccaggctgga

SEQ ID NO: 454137 - DNA, 20 bp, Artificial
  CRISPR gRNA sequence
ctctgttgcccaggctggag

SEQ ID NO: 454138 - DNA, 20 bp, Artificial
  CRISPR gRNA sequence
tgttgcccaggctggagtgc

SEQ ID NO: 454139 - DNA, 20 bp, Artificial
  CRISPR gRNA sequence
ttgcccaggctggagtgcag

SEQ ID NO: 454140 - DNA, 20 bp, Artificial
  CRISPR gRNA sequence
cccaggctggagtgcagtgg

SEQ ID NO: 454141 - DNA, 20 bp, Artificial
  CRISPR gRNA sequence
gagtgcagtggcgtgatctt

SEQ ID NO: 454142 - DNA, 20 bp, Artificial
  CRISPR gRNA sequence
ggctcactgcaatctctgcc

SEQ ID NO: 454143 - DNA, 20 bp, Artificial
  CRISPR gRNA sequence
gctcactgcaatctctgcct

SEQ ID NO: 454144 - DNA, 20 bp, Artificial
  CRISPR gRNA sequence
actgcaatctctgcctccca

SEQ ID NO: 454145 - DNA, 20 bp, Artificial
  CRISPR gRNA sequence
caatctctgcctcccaggtt

SEQ ID NO: 454146 - DNA, 20 bp, Artificial
  CRISPR gRNA sequence
tgcctcccaggttcaagcaa

SEQ ID NO: 454147 - DNA, 20 bp, Artificial
  CRISPR gRNA sequence
cctcccaggttcaagcaatt

SEQ ID NO: 454148 - DNA, 20 bp, Artificial
  CRISPR gRNA sequence
ccaggttcaagcaattatcc

SEQ ID NO: 454149 - DNA, 20 bp, Artificial
  CRISPR gRNA sequence
aagcaattatcctgcctcag

SEQ ID NO: 454150 - DNA, 20 bp, Artificial
  CRISPR gRNA sequence
tcctgcctcagcctcctgag

SEQ ID NO: 454151 - DNA, 20 bp, Artificial
  CRISPR gRNA sequence
cctcagcctcctgagtaggt

SEQ ID NO: 454152 - DNA, 20 bp, Artificial
  CRISPR gRNA sequence
agcctcctgagtaggtggga

SEQ ID NO: 454153 - DNA, 20 bp, Artificial
  CRISPR gRNA sequence
ctgagtaggtgggatcacag

SEQ ID NO: 454154 - DNA, 20 bp, Artificial
  CRISPR gRNA sequence
agtaggtgggatcacaggca

SEQ ID NO: 454155 - DNA, 20 bp, Artificial
  CRISPR gRNA sequence
ctacaacacccagctaattt

SEQ ID NO: 454156 - DNA, 20 bp, Artificial
  CRISPR gRNA sequence
caacacccagctaatttttg

SEQ ID NO: 454157 - DNA, 20 bp, Artificial
  CRISPR gRNA sequence
atttttgcatttttagtaga

SEQ ID NO: 454158 - DNA, 20 bp, Artificial
  CRISPR gRNA sequence
ttgcatttttagtagagcca

SEQ ID NO: 454159 - DNA, 20 bp, Artificial
  CRISPR gRNA sequence
tgcatttttagtagagccag

SEQ ID NO: 454160 - DNA, 20 bp, Artificial
  CRISPR gRNA sequence
gcatttttagtagagccagg

SEQ ID NO: 454161 - DNA, 20 bp, Artificial
  CRISPR gRNA sequence
catttttagtagagccaggg

SEQ ID NO: 454162 - DNA, 20 bp, Artificial
  CRISPR gRNA sequence
ttagtagagccagggtttca

SEQ ID NO: 454163 - DNA, 20 bp, Artificial
  CRISPR gRNA sequence
tagtagagccagggtttcac

SEQ ID NO: 454164 - DNA, 20 bp, Artificial
  CRISPR gRNA sequence
agtagagccagggtttcacc

SEQ ID NO: 454165 - DNA, 20 bp, Artificial
  CRISPR gRNA sequence
gtagagccagggtttcacca

SEQ ID NO: 454166 - DNA, 20 bp, Artificial
  CRISPR gRNA sequence
caccatgtgggccaggctgg

SEQ ID NO: 454167 - DNA, 20 bp, Artificial
  CRISPR gRNA sequence
accatgtgggccaggctggt

SEQ ID NO: 454168 - DNA, 20 bp, Artificial
  CRISPR gRNA sequence
gtctcgaactcctgacctca

SEQ ID NO: 454169 - DNA, 20 bp, Artificial
  CRISPR gRNA sequence
gaactcctgacctcaggtga

SEQ ID NO: 454170 - DNA, 20 bp, Artificial
  CRISPR gRNA sequence
ctgacctcaggtgatccgca

SEQ ID NO: 454171 - DNA, 20 bp, Artificial
  CRISPR gRNA sequence
acctcaggtgatccgcacgc

SEQ ID NO: 454172 - DNA, 20 bp, Artificial
  CRISPR gRNA sequence
aggtgatccgcacgcctccc

SEQ ID NO: 454173 - DNA, 20 bp, Artificial
  CRISPR gRNA sequence
ccaaagtgctgggattacag

SEQ ID NO: 454174 - DNA, 20 bp, Artificial
  CRISPR gRNA sequence
ggattacaggtgtgagccac

SEQ ID NO: 454175 - DNA, 20 bp, Artificial
  CRISPR gRNA sequence
caggtgtgagccaccacacc

SEQ ID NO: 454176 - DNA, 20 bp, Artificial
  CRISPR gRNA sequence
gccttcacctgtttctattt

SEQ ID NO: 454177 - DNA, 20 bp, Artificial
  CRISPR gRNA sequence
cacctgtttctatttttttg

SEQ ID NO: 454178 - DNA, 20 bp, Artificial
  CRISPR gRNA sequence
acctgtttctatttttttgg

SEQ ID NO: 454179 - DNA, 20 bp, Artificial
  CRISPR gRNA sequence
tttctatttttttggtatta

SEQ ID NO: 454180 - DNA, 20 bp, Artificial
  CRISPR gRNA sequence
ctatttttttggtattataa

SEQ ID NO: 454181 - DNA, 20 bp, Artificial
  CRISPR gRNA sequence
tatttttttggtattataaa

SEQ ID NO: 454182 - DNA, 20 bp, Artificial
  CRISPR gRNA sequence
tttttttggtattataaaaa

SEQ ID NO: 454183 - DNA, 20 bp, Artificial
  CRISPR gRNA sequence
ttttggtattataaaaaatg

SEQ ID NO: 454184 - DNA, 20 bp, Artificial
  CRISPR gRNA sequence
tttggtattataaaaaatgc

SEQ ID NO: 454185 - DNA, 20 bp, Artificial
  CRISPR gRNA sequence
ttggtattataaaaaatgct

SEQ ID NO: 454186 - DNA, 20 bp, Artificial
  CRISPR gRNA sequence
tggtattataaaaaatgctg

SEQ ID NO: 454187 - DNA, 20 bp, Artificial
  CRISPR gRNA sequence
ggtattataaaaaatgctgc

SEQ ID NO: 454188 - DNA, 20 bp, Artificial
  CRISPR gRNA sequence
gtattataaaaaatgctgca

SEQ ID NO: 454189 - DNA, 20 bp, Artificial
  CRISPR gRNA sequence
taaaaaatgctgcagtgaat

SEQ ID NO: 454190 - DNA, 20 bp, Artificial
  CRISPR gRNA sequence
cagtgaatatccttgtacat

SEQ ID NO: 454191 - DNA, 20 bp, Artificial
  CRISPR gRNA sequence
gtacatctatactagcacac

SEQ ID NO: 454192 - DNA, 20 bp, Artificial
  CRISPR gRNA sequence
tacatctatactagcacact

SEQ ID NO: 454193 - DNA, 20 bp, Artificial
  CRISPR gRNA sequence
tactagcacactcatgcttt

SEQ ID NO: 454194 - DNA, 20 bp, Artificial
  CRISPR gRNA sequence
gcacactcatgcttttattt

SEQ ID NO: 454195 - DNA, 20 bp, Artificial
  CRISPR gRNA sequence
atgcttttatttctgtaagc

SEQ ID NO: 454196 - DNA, 20 bp, Artificial
  CRISPR gRNA sequence
ttatttctgtaagctatagc

SEQ ID NO: 454197 - DNA, 20 bp, Artificial
  CRISPR gRNA sequence
tatttctgtaagctatagcc

SEQ ID NO: 454198 - DNA, 20 bp, Artificial
  CRISPR gRNA sequence
atttctgtaagctatagcca

SEQ ID NO: 454199 - DNA, 20 bp, Artificial
  CRISPR gRNA sequence
tttctgtaagctatagccaa

SEQ ID NO: 454200 - DNA, 20 bp, Artificial
  CRISPR gRNA sequence
ctgtaagctatagccaaagg

SEQ ID NO: 454201 - DNA, 20 bp, Artificial
  CRISPR gRNA sequence
tgtaagctatagccaaaggg

SEQ ID NO: 454202 - DNA, 20 bp, Artificial
  CRISPR gRNA sequence
taagctatagccaaagggac

SEQ ID NO: 454203 - DNA, 20 bp, Artificial
  CRISPR gRNA sequence
tagccaaagggacagggtat

SEQ ID NO: 454204 - DNA, 20 bp, Artificial
  CRISPR gRNA sequence
gaaatgttaatatataatga

SEQ ID NO: 454205 - DNA, 20 bp, Artificial
  CRISPR gRNA sequence
aaatgttaatatataatgag

SEQ ID NO: 454206 - DNA, 20 bp, Artificial
  CRISPR gRNA sequence
atatataatgagtattcccc

SEQ ID NO: 454207 - DNA, 20 bp, Artificial
  CRISPR gRNA sequence
ccccaaagctccgtaacaat

SEQ ID NO: 454208 - DNA, 20 bp, Artificial
  CRISPR gRNA sequence
cgtaacaatgtatagttcta

SEQ ID NO: 454209 - DNA, 20 bp, Artificial
  CRISPR gRNA sequence
tacctagagtgaatgattgc

SEQ ID NO: 454210 - DNA, 20 bp, Artificial
  CRISPR gRNA sequence
cctagagtgaatgattgcac

SEQ ID NO: 454211 - DNA, 20 bp, Artificial
  CRISPR gRNA sequence
gagtgaatgattgcacatat

SEQ ID NO: 454212 - DNA, 20 bp, Artificial
  CRISPR gRNA sequence
cacatatttcttcttaccct

SEQ ID NO: 454213 - DNA, 20 bp, Artificial
  CRISPR gRNA sequence
cttcttacccttaccaaaat

SEQ ID NO: 454214 - DNA, 20 bp, Artificial
  CRISPR gRNA sequence
ttcttacccttaccaaaatt

SEQ ID NO: 454215 - DNA, 20 bp, Artificial
  CRISPR gRNA sequence
cttacccttaccaaaatttg

SEQ ID NO: 454216 - DNA, 20 bp, Artificial
  CRISPR gRNA sequence
ttacccttaccaaaatttga

SEQ ID NO: 454217 - DNA, 20 bp, Artificial
  CRISPR gRNA sequence
acccttaccaaaatttgatt

SEQ ID NO: 454218 - DNA, 20 bp, Artificial
  CRISPR gRNA sequence
cccttaccaaaatttgattt

SEQ ID NO: 454219 - DNA, 20 bp, Artificial
  CRISPR gRNA sequence
accaaaatttgatttatctt

SEQ ID NO: 454220 - DNA, 20 bp, Artificial
  CRISPR gRNA sequence
ccaaaatttgatttatcttt

SEQ ID NO: 454221 - DNA, 20 bp, Artificial
  CRISPR gRNA sequence
gatttatcttttaaattttt

SEQ ID NO: 454222 - DNA, 20 bp, Artificial
  CRISPR gRNA sequence
atttatcttttaaatttttg

SEQ ID NO: 454223 - DNA, 20 bp, Artificial
  CRISPR gRNA sequence
atcttttaaatttttgttca

SEQ ID NO: 454224 - DNA, 20 bp, Artificial
  CRISPR gRNA sequence
tcttttaaatttttgttcac

SEQ ID NO: 454225 - DNA, 20 bp, Artificial
  CRISPR gRNA sequence
ttaaatttttgttcacttaa

SEQ ID NO: 454226 - DNA, 20 bp, Artificial
  CRISPR gRNA sequence
taaatttttgttcacttaac

SEQ ID NO: 454227 - DNA, 20 bp, Artificial
  CRISPR gRNA sequence
aaatttttgttcacttaaca

SEQ ID NO: 454228 - DNA, 20 bp, Artificial
  CRISPR gRNA sequence
aatttttgttcacttaacag

SEQ ID NO: 454229 - DNA, 20 bp, Artificial
  CRISPR gRNA sequence
ttgttcacttaacaggtggt

SEQ ID NO: 454230 - DNA, 20 bp, Artificial
  CRISPR gRNA sequence
tgttcacttaacaggtggta

SEQ ID NO: 454231 - DNA, 20 bp, Artificial
  CRISPR gRNA sequence
gttcacttaacaggtggtaa

SEQ ID NO: 454232 - DNA, 20 bp, Artificial
  CRISPR gRNA sequence
ttcacttaacaggtggtaat

SEQ ID NO: 454233 - DNA, 20 bp, Artificial
  CRISPR gRNA sequence
acttaacaggtggtaattct

SEQ ID NO: 454234 - DNA, 20 bp, Artificial
  CRISPR gRNA sequence
aacaggtggtaattctgaaa

SEQ ID NO: 454235 - DNA, 20 bp, Artificial
  CRISPR gRNA sequence
acaggtggtaattctgaaat

SEQ ID NO: 454236 - DNA, 20 bp, Artificial
  CRISPR gRNA sequence
tgaaattctgaactctgaat

SEQ ID NO: 454237 - DNA, 20 bp, Artificial
  CRISPR gRNA sequence
aaattctgaactctgaattt

SEQ ID NO: 454238 - DNA, 20 bp, Artificial
  CRISPR gRNA sequence
tgaactctgaatttttaatt

SEQ ID NO: 454239 - DNA, 20 bp, Artificial
  CRISPR gRNA sequence
aactctgaatttttaatttg

SEQ ID NO: 454240 - DNA, 20 bp, Artificial
  CRISPR gRNA sequence
tgaatttttaatttgtactt

SEQ ID NO: 454241 - DNA, 20 bp, Artificial
  CRISPR gRNA sequence
aatttttaatttgtacttcc

SEQ ID NO: 454242 - DNA, 20 bp, Artificial
  CRISPR gRNA sequence
ttaatttgtacttccctgaa

SEQ ID NO: 454243 - DNA, 20 bp, Artificial
  CRISPR gRNA sequence
taatttgtacttccctgaat

SEQ ID NO: 454244 - DNA, 20 bp, Artificial
  CRISPR gRNA sequence
aatttgtacttccctgaata

SEQ ID NO: 454245 - DNA, 20 bp, Artificial
  CRISPR gRNA sequence
atttgtacttccctgaatac

SEQ ID NO: 454246 - DNA, 20 bp, Artificial
  CRISPR gRNA sequence
gtacttccctgaatacttgt

SEQ ID NO: 454247 - DNA, 20 bp, Artificial
  CRISPR gRNA sequence
tacttccctgaatacttgta

SEQ ID NO: 454248 - DNA, 20 bp, Artificial
  CRISPR gRNA sequence
ccctgaatacttgtaaaact

SEQ ID NO: 454249 - DNA, 20 bp, Artificial
  CRISPR gRNA sequence
cctgaatacttgtaaaactg

SEQ ID NO: 454250 - DNA, 20 bp, Artificial
  CRISPR gRNA sequence
aatacttgtaaaactgaaaa

SEQ ID NO: 454251 - DNA, 20 bp, Artificial
  CRISPR gRNA sequence
gtaaaactgaaaaacttttt

SEQ ID NO: 454252 - DNA, 20 bp, Artificial
  CRISPR gRNA sequence
taaaactgaaaaacttttta

SEQ ID NO: 454253 - DNA, 20 bp, Artificial
  CRISPR gRNA sequence
aaaaactttttattgcattt

SEQ ID NO: 454254 - DNA, 20 bp, Artificial
  CRISPR gRNA sequence
tttattgcatttcgtctttt

SEQ ID NO: 454255 - DNA, 20 bp, Artificial
  CRISPR gRNA sequence
ttattgcatttcgtcttttg

SEQ ID NO: 454256 - DNA, 20 bp, Artificial
  CRISPR gRNA sequence
tattgcatttcgtcttttgt

SEQ ID NO: 454257 - DNA, 20 bp, Artificial
  CRISPR gRNA sequence
attgcatttcgtcttttgtg

SEQ ID NO: 454258 - DNA, 20 bp, Artificial
  CRISPR gRNA sequence
ttgcatttcgtcttttgtga

SEQ ID NO: 454259 - DNA, 20 bp, Artificial
  CRISPR gRNA sequence
catttcgtcttttgtgaact

SEQ ID NO: 454260 - DNA, 20 bp, Artificial
  CRISPR gRNA sequence
cgtcttttgtgaactgccta

SEQ ID NO: 454261 - DNA, 20 bp, Artificial
  CRISPR gRNA sequence
gtcttttgtgaactgcctat

SEQ ID NO: 454262 - DNA, 20 bp, Artificial
  CRISPR gRNA sequence
ttgtgaactgcctattcaga

SEQ ID NO: 454263 - DNA, 20 bp, Artificial
  CRISPR gRNA sequence
tgtgaactgcctattcagat

SEQ ID NO: 454264 - DNA, 20 bp, Artificial
  CRISPR gRNA sequence
gtgaactgcctattcagata

SEQ ID NO: 454265 - DNA, 20 bp, Artificial
  CRISPR gRNA sequence
tgaactgcctattcagatac

SEQ ID NO: 454266 - DNA, 20 bp, Artificial
  CRISPR gRNA sequence
cctattcagatactctttta

SEQ ID NO: 454267 - DNA, 20 bp, Artificial
  CRISPR gRNA sequence
ttcagatactcttttattgt

SEQ ID NO: 454268 - DNA, 20 bp, Artificial
  CRISPR gRNA sequence
agatactcttttattgtttc

SEQ ID NO: 454269 - DNA, 20 bp, Artificial
  CRISPR gRNA sequence
ttttattgtttctaataatt

SEQ ID NO: 454270 - DNA, 20 bp, Artificial
  CRISPR gRNA sequence
ttattgtttctaataattct

SEQ ID NO: 454271 - DNA, 20 bp, Artificial
  CRISPR gRNA sequence
tattgtttctaataattctc

SEQ ID NO: 454272 - DNA, 20 bp, Artificial
  CRISPR gRNA sequence
attgtttctaataattctca

SEQ ID NO: 454273 - DNA, 20 bp, Artificial
  CRISPR gRNA sequence
ttgtttctaataattctcaa

SEQ ID NO: 454274 - DNA, 20 bp, Artificial
  CRISPR gRNA sequence
tttctaataattctcaatta

SEQ ID NO: 454275 - DNA, 20 bp, Artificial
  CRISPR gRNA sequence
ctaataattctcaattaagt

SEQ ID NO: 454276 - DNA, 20 bp, Artificial
  CRISPR gRNA sequence
taataattctcaattaagtt

SEQ ID NO: 454277 - DNA, 20 bp, Artificial
  CRISPR gRNA sequence
ataattctcaattaagtttc

SEQ ID NO: 454278 - DNA, 20 bp, Artificial
  CRISPR gRNA sequence
tcaattaagtttcttgggtt

SEQ ID NO: 454279 - DNA, 20 bp, Artificial
  CRISPR gRNA sequence
aattaagtttcttgggtttt

SEQ ID NO: 454280 - DNA, 20 bp, Artificial
  CRISPR gRNA sequence
agtttcttgggttttctaga

SEQ ID NO: 454281 - DNA, 20 bp, Artificial
  CRISPR gRNA sequence
cttgggttttctagatgtaa

SEQ ID NO: 454282 - DNA, 20 bp, Artificial
  CRISPR gRNA sequence
ttgggttttctagatgtaag

SEQ ID NO: 454283 - DNA, 20 bp, Artificial
  CRISPR gRNA sequence
gggttttctagatgtaagtt

SEQ ID NO: 454284 - DNA, 20 bp, Artificial
  CRISPR gRNA sequence
ggttttctagatgtaagtta

SEQ ID NO: 454285 - DNA, 20 bp, Artificial
  CRISPR gRNA sequence
tctagatgtaagttatatca

SEQ ID NO: 454286 - DNA, 20 bp, Artificial
  CRISPR gRNA sequence
ctagatgtaagttatatcac

SEQ ID NO: 454287 - DNA, 20 bp, Artificial
  CRISPR gRNA sequence
tagatgtaagttatatcaca

SEQ ID NO: 454288 - DNA, 20 bp, Artificial
  CRISPR gRNA sequence
gatgtaagttatatcacata

SEQ ID NO: 454289 - DNA, 20 bp, Artificial
  CRISPR gRNA sequence
tatcacatataaatagtaat

SEQ ID NO: 454290 - DNA, 20 bp, Artificial
  CRISPR gRNA sequence
gccttaagatttccaatatt

SEQ ID NO: 454291 - DNA, 20 bp, Artificial
  CRISPR gRNA sequence
ccttaagatttccaatattt

SEQ ID NO: 454292 - DNA, 20 bp, Artificial
  CRISPR gRNA sequence
aagatttccaatatttatac

SEQ ID NO: 454293 - DNA, 20 bp, Artificial
  CRISPR gRNA sequence
agatttccaatatttatacc

SEQ ID NO: 454294 - DNA, 20 bp, Artificial
  CRISPR gRNA sequence
ccaatatttataccctttgc

SEQ ID NO: 454295 - DNA, 20 bp, Artificial
  CRISPR gRNA sequence
caatatttataccctttgct

SEQ ID NO: 454296 - DNA, 20 bp, Artificial
  CRISPR gRNA sequence
ataccctttgctttattttc

SEQ ID NO: 454297 - DNA, 20 bp, Artificial
  CRISPR gRNA sequence
taccctttgctttattttct

SEQ ID NO: 454298 - DNA, 20 bp, Artificial
  CRISPR gRNA sequence
tgctttattttcttgtctaa

SEQ ID NO: 454299 - DNA, 20 bp, Artificial
  CRISPR gRNA sequence
gctttattttcttgtctaaa

SEQ ID NO: 454300 - DNA, 20 bp, Artificial
  CRISPR gRNA sequence
ctttattttcttgtctaaat

SEQ ID NO: 454301 - DNA, 20 bp, Artificial
  CRISPR gRNA sequence
tattttcttgtctaaatata

SEQ ID NO: 454302 - DNA, 20 bp, Artificial
  CRISPR gRNA sequence
attttcttgtctaaatataa

SEQ ID NO: 454303 - DNA, 20 bp, Artificial
  CRISPR gRNA sequence
ttttcttgtctaaatataat

SEQ ID NO: 454304 - DNA, 20 bp, Artificial
  CRISPR gRNA sequence
tcttgtctaaatataatggc

SEQ ID NO: 454305 - DNA, 20 bp, Artificial
  CRISPR gRNA sequence
cttgtctaaatataatggca

SEQ ID NO: 454306 - DNA, 20 bp, Artificial
  CRISPR gRNA sequence
ttgtctaaatataatggcaa

SEQ ID NO: 454307 - DNA, 20 bp, Artificial
  CRISPR gRNA sequence
gtctaaatataatggcaaac

SEQ ID NO: 454308 - DNA, 20 bp, Artificial
  CRISPR gRNA sequence
tctaaatataatggcaaaca

SEQ ID NO: 454309 - DNA, 20 bp, Artificial
  CRISPR gRNA sequence
aatataatggcaaacacttt

SEQ ID NO: 454310 - DNA, 20 bp, Artificial
  CRISPR gRNA sequence
tcagaacaatgtgaaataac

SEQ ID NO: 454311 - DNA, 20 bp, Artificial
  CRISPR gRNA sequence
cagaacaatgtgaaataaca

SEQ ID NO: 454312 - DNA, 20 bp, Artificial
  CRISPR gRNA sequence
agaacaatgtgaaataacag

SEQ ID NO: 454313 - DNA, 20 bp, Artificial
  CRISPR gRNA sequence
tgccttgctcctaatattaa

SEQ ID NO: 454314 - DNA, 20 bp, Artificial
  CRISPR gRNA sequence
ccttgctcctaatattaata

SEQ ID NO: 454315 - DNA, 20 bp, Artificial
  CRISPR gRNA sequence
gctcctaatattaatagaaa

SEQ ID NO: 454316 - DNA, 20 bp, Artificial
  CRISPR gRNA sequence
ctcctaatattaatagaaat

SEQ ID NO: 454317 - DNA, 20 bp, Artificial
  CRISPR gRNA sequence
ctaatattaatagaaattat

SEQ ID NO: 454318 - DNA, 20 bp, Artificial
  CRISPR gRNA sequence
atattaatagaaattatccc

SEQ ID NO: 454319 - DNA, 20 bp, Artificial
  CRISPR gRNA sequence
atagaaattatcccatattt

SEQ ID NO: 454320 - DNA, 20 bp, Artificial
  CRISPR gRNA sequence
tcccatattttaccattaaa

SEQ ID NO: 454321 - DNA, 20 bp, Artificial
  CRISPR gRNA sequence
taccattaaatatgatgctg

SEQ ID NO: 454322 - DNA, 20 bp, Artificial
  CRISPR gRNA sequence
accattaaatatgatgctgc

SEQ ID NO: 454323 - DNA, 20 bp, Artificial
  CRISPR gRNA sequence
ccattaaatatgatgctgca

SEQ ID NO: 454324 - DNA, 20 bp, Artificial
  CRISPR gRNA sequence
aatatgatgctgcaatttta

SEQ ID NO: 454325 - DNA, 20 bp, Artificial
  CRISPR gRNA sequence
caattttatctgagatatac

SEQ ID NO: 454326 - DNA, 20 bp, Artificial
  CRISPR gRNA sequence
tatctgagatatacatttct

SEQ ID NO: 454327 - DNA, 20 bp, Artificial
  CRISPR gRNA sequence
atctgagatatacatttctc

SEQ ID NO: 454328 - DNA, 20 bp, Artificial
  CRISPR gRNA sequence
tctgagatatacatttctcc

SEQ ID NO: 454329 - DNA, 20 bp, Artificial
  CRISPR gRNA sequence
agatatacatttctccatta

SEQ ID NO: 454330 - DNA, 20 bp, Artificial
  CRISPR gRNA sequence
ctccattatattgaatagta

SEQ ID NO: 454331 - DNA, 20 bp, Artificial
  CRISPR gRNA sequence
tccattatattgaatagtat

SEQ ID NO: 454332 - DNA, 20 bp, Artificial
  CRISPR gRNA sequence
cattatattgaatagtattc

SEQ ID NO: 454333 - DNA, 20 bp, Artificial
  CRISPR gRNA sequence
tattgaatagtattcatcca

SEQ ID NO: 454334 - DNA, 20 bp, Artificial
  CRISPR gRNA sequence
aatagtattcatccattacc

SEQ ID NO: 454335 - DNA, 20 bp, Artificial
  CRISPR gRNA sequence
atccattaccattttactta

SEQ ID NO: 454336 - DNA, 20 bp, Artificial
  CRISPR gRNA sequence
ccattttacttaggatttta

SEQ ID NO: 454337 - DNA, 20 bp, Artificial
  CRISPR gRNA sequence
tacttaggattttagtggga

SEQ ID NO: 454338 - DNA, 20 bp, Artificial
  CRISPR gRNA sequence
acttaggattttagtgggaa

SEQ ID NO: 454339 - DNA, 20 bp, Artificial
  CRISPR gRNA sequence
cttaggattttagtgggaat

SEQ ID NO: 454340 - DNA, 20 bp, Artificial
  CRISPR gRNA sequence
aggattttagtgggaattaa

SEQ ID NO: 454341 - DNA, 20 bp, Artificial
  CRISPR gRNA sequence
ggattttagtgggaattaat

SEQ ID NO: 454342 - DNA, 20 bp, Artificial
  CRISPR gRNA sequence
tagtgggaattaatgtaaga

SEQ ID NO: 454343 - DNA, 20 bp, Artificial
  CRISPR gRNA sequence
agtgggaattaatgtaagat

SEQ ID NO: 454344 - DNA, 20 bp, Artificial
  CRISPR gRNA sequence
gtgggaattaatgtaagatg

SEQ ID NO: 454345 - DNA, 20 bp, Artificial
  CRISPR gRNA sequence
atgtaagatgttatcagaag

SEQ ID NO: 454346 - DNA, 20 bp, Artificial
  CRISPR gRNA sequence
tcagaaggtaatattgactt

SEQ ID NO: 454347 - DNA, 20 bp, Artificial
  CRISPR gRNA sequence
actttcttttttatccagta

SEQ ID NO: 454348 - DNA, 20 bp, Artificial
  CRISPR gRNA sequence
tcttttttatccagtagtat

SEQ ID NO: 454349 - DNA, 20 bp, Artificial
  CRISPR gRNA sequence
cttttttatccagtagtatg

SEQ ID NO: 454350 - DNA, 20 bp, Artificial
  CRISPR gRNA sequence
ttttttatccagtagtatgt

SEQ ID NO: 454351 - DNA, 20 bp, Artificial
  CRISPR gRNA sequence
ttttatccagtagtatgtta

SEQ ID NO: 454352 - DNA, 20 bp, Artificial
  CRISPR gRNA sequence
tttatccagtagtatgttaa

SEQ ID NO: 454353 - DNA, 20 bp, Artificial
  CRISPR gRNA sequence
ttatccagtagtatgttaat

SEQ ID NO: 454354 - DNA, 20 bp, Artificial
  CRISPR gRNA sequence
tatccagtagtatgttaatt

SEQ ID NO: 454355 - DNA, 20 bp, Artificial
  CRISPR gRNA sequence
atccagtagtatgttaatta

SEQ ID NO: 454356 - DNA, 20 bp, Artificial
  CRISPR gRNA sequence
tccagtagtatgttaattaa

SEQ ID NO: 454357 - DNA, 20 bp, Artificial
  CRISPR gRNA sequence
attaatagatttcctaatat

SEQ ID NO: 454358 - DNA, 20 bp, Artificial
  CRISPR gRNA sequence
atagatttcctaatattaaa

SEQ ID NO: 454359 - DNA, 20 bp, Artificial
  CRISPR gRNA sequence
cctaatattaaatcatccaa

SEQ ID NO: 454360 - DNA, 20 bp, Artificial
  CRISPR gRNA sequence
ctaatattaaatcatccaag

SEQ ID NO: 454361 - DNA, 20 bp, Artificial
  CRISPR gRNA sequence
atattaaatcatccaagaat

SEQ ID NO: 454362 - DNA, 20 bp, Artificial
  CRISPR gRNA sequence
aatcatccaagaatttctaa

SEQ ID NO: 454363 - DNA, 20 bp, Artificial
  CRISPR gRNA sequence
ctaaaaatgaaaccttattc

SEQ ID NO: 454364 - DNA, 20 bp, Artificial
  CRISPR gRNA sequence
taaaaatgaaaccttattcc

SEQ ID NO: 454365 - DNA, 20 bp, Artificial
  CRISPR gRNA sequence
aaaatgaaaccttattccat

SEQ ID NO: 454366 - DNA, 20 bp, Artificial
  CRISPR gRNA sequence
attccatttgtcatggtgta

SEQ ID NO: 454367 - DNA, 20 bp, Artificial
  CRISPR gRNA sequence
ttccatttgtcatggtgtat

SEQ ID NO: 454368 - DNA, 20 bp, Artificial
  CRISPR gRNA sequence
catttgtcatggtgtattat

SEQ ID NO: 454369 - DNA, 20 bp, Artificial
  CRISPR gRNA sequence
gtcatggtgtattatatttt

SEQ ID NO: 454370 - DNA, 20 bp, Artificial
  CRISPR gRNA sequence
tcatggtgtattatattttt

SEQ ID NO: 454371 - DNA, 20 bp, Artificial
  CRISPR gRNA sequence
tatttttaatatcttgtatg

SEQ ID NO: 454372 - DNA, 20 bp, Artificial
  CRISPR gRNA sequence
ttaatatcttgtatgattgg

SEQ ID NO: 454373 - DNA, 20 bp, Artificial
  CRISPR gRNA sequence
taatatcttgtatgattggt

SEQ ID NO: 454374 - DNA, 20 bp, Artificial
  CRISPR gRNA sequence
aatatcttgtatgattggtt

SEQ ID NO: 454375 - DNA, 20 bp, Artificial
  CRISPR gRNA sequence
atatcttgtatgattggtta

SEQ ID NO: 454376 - DNA, 20 bp, Artificial
  CRISPR gRNA sequence
gtatgattggttaatttgtg

SEQ ID NO: 454377 - DNA, 20 bp, Artificial
  CRISPR gRNA sequence
tatgattggttaatttgtgt

SEQ ID NO: 454378 - DNA, 20 bp, Artificial
  CRISPR gRNA sequence
gttaatttgtgtgtgtgtgt

SEQ ID NO: 454379 - DNA, 20 bp, Artificial
  CRISPR gRNA sequence
atttgtgtgtgtgtgtaatt

SEQ ID NO: 454380 - DNA, 20 bp, Artificial
  CRISPR gRNA sequence
gtgtgtgtgtgtaatttttg

SEQ ID NO: 454381 - DNA, 20 bp, Artificial
  CRISPR gRNA sequence
tgtgtgtgtgtaatttttga

SEQ ID NO: 454382 - DNA, 20 bp, Artificial
  CRISPR gRNA sequence
ttgattttggttttcttgag

SEQ ID NO: 454383 - DNA, 20 bp, Artificial
  CRISPR gRNA sequence
tgattttggttttcttgaga

SEQ ID NO: 454384 - DNA, 20 bp, Artificial
  CRISPR gRNA sequence
gattttggttttcttgagac

SEQ ID NO: 454385 - DNA, 20 bp, Artificial
  CRISPR gRNA sequence
attttggttttcttgagaca

SEQ ID NO: 454386 - DNA, 20 bp, Artificial
  CRISPR gRNA sequence
tggttttcttgagacagggt

SEQ ID NO: 454387 - DNA, 20 bp, Artificial
  CRISPR gRNA sequence
ggttttcttgagacagggtc

SEQ ID NO: 454388 - DNA, 20 bp, Artificial
  CRISPR gRNA sequence
gttttcttgagacagggtct

SEQ ID NO: 454389 - DNA, 20 bp, Artificial
  CRISPR gRNA sequence
tcttgagacagggtctcact

SEQ ID NO: 454390 - DNA, 20 bp, Artificial
  CRISPR gRNA sequence
cttgagacagggtctcactg

SEQ ID NO: 454391 - DNA, 20 bp, Artificial
  CRISPR gRNA sequence
ttgagacagggtctcactgt

SEQ ID NO: 454392 - DNA, 20 bp, Artificial
  CRISPR gRNA sequence
gagacagggtctcactgtca

SEQ ID NO: 454393 - DNA, 20 bp, Artificial
  CRISPR gRNA sequence
agacagggtctcactgtcaa

SEQ ID NO: 454394 - DNA, 20 bp, Artificial
  CRISPR gRNA sequence
actgtcaaccaggccagagt

SEQ ID NO: 454395 - DNA, 20 bp, Artificial
  CRISPR gRNA sequence
tcaaccaggccagagtgcag

SEQ ID NO: 454396 - DNA, 20 bp, Artificial
  CRISPR gRNA sequence
actacatccgtgaactcccg

SEQ ID NO: 454397 - DNA, 20 bp, Artificial
  CRISPR gRNA sequence
catccgtgaactcccgggct

SEQ ID NO: 454398 - DNA, 20 bp, Artificial
  CRISPR gRNA sequence
ccgggctcctcccacctaag

SEQ ID NO: 454399 - DNA, 20 bp, Artificial
  CRISPR gRNA sequence
ctcccacctaagtctcttga

SEQ ID NO: 454400 - DNA, 20 bp, Artificial
  CRISPR gRNA sequence
ccacctaagtctcttgagta

SEQ ID NO: 454401 - DNA, 20 bp, Artificial
  CRISPR gRNA sequence
agtctcttgagtagctggga

SEQ ID NO: 454402 - DNA, 20 bp, Artificial
  CRISPR gRNA sequence
ttgagtagctgggacttcag

SEQ ID NO: 454403 - DNA, 20 bp, Artificial
  CRISPR gRNA sequence
gagtagctgggacttcaggt

SEQ ID NO: 454404 - DNA, 20 bp, Artificial
  CRISPR gRNA sequence
agtagctgggacttcaggta

SEQ ID NO: 454405 - DNA, 20 bp, Artificial
  CRISPR gRNA sequence
ggacttcaggtacgcaccac

SEQ ID NO: 454406 - DNA, 20 bp, Artificial
  CRISPR gRNA sequence
caggtacgcaccaccacacg

SEQ ID NO: 454407 - DNA, 20 bp, Artificial
  CRISPR gRNA sequence
aggtacgcaccaccacacgt

SEQ ID NO: 454408 - DNA, 20 bp, Artificial
  CRISPR gRNA sequence
atttttgtattttttgtaaa

SEQ ID NO: 454409 - DNA, 20 bp, Artificial
  CRISPR gRNA sequence
ttgtattttttgtaaagaca

SEQ ID NO: 454410 - DNA, 20 bp, Artificial
  CRISPR gRNA sequence
tgtattttttgtaaagacat

SEQ ID NO: 454411 - DNA, 20 bp, Artificial
  CRISPR gRNA sequence
gtattttttgtaaagacatg

SEQ ID NO: 454412 - DNA, 20 bp, Artificial
  CRISPR gRNA sequence
tattttttgtaaagacatgg

SEQ ID NO: 454413 - DNA, 20 bp, Artificial
  CRISPR gRNA sequence
tttgtaaagacatggtctca

SEQ ID NO: 454414 - DNA, 20 bp, Artificial
  CRISPR gRNA sequence
ttgtaaagacatggtctcac

SEQ ID NO: 454415 - DNA, 20 bp, Artificial
  CRISPR gRNA sequence
tgtaaagacatggtctcact

SEQ ID NO: 454416 - DNA, 20 bp, Artificial
  CRISPR gRNA sequence
gtaaagacatggtctcactt

SEQ ID NO: 454417 - DNA, 20 bp, Artificial
  CRISPR gRNA sequence
taaagacatggtctcacttt

SEQ ID NO: 454418 - DNA, 20 bp, Artificial
  CRISPR gRNA sequence
actttgctgcccaggctggt

SEQ ID NO: 454419 - DNA, 20 bp, Artificial
  CRISPR gRNA sequence
tgctgcccaggctggtctca

SEQ ID NO: 454420 - DNA, 20 bp, Artificial
  CRISPR gRNA sequence
gctgcccaggctggtctcaa

SEQ ID NO: 454421 - DNA, 20 bp, Artificial
  CRISPR gRNA sequence
ctgcccaggctggtctcaaa

SEQ ID NO: 454422 - DNA, 20 bp, Artificial
  CRISPR gRNA sequence
cccaggctggtctcaaactc

SEQ ID NO: 454423 - DNA, 20 bp, Artificial
  CRISPR gRNA sequence
gtctcaaactcctgggctca

SEQ ID NO: 454424 - DNA, 20 bp, Artificial
  CRISPR gRNA sequence
aaactcctgggctcaagtga

SEQ ID NO: 454425 - DNA, 20 bp, Artificial
  CRISPR gRNA sequence
ctgggctcaagtgatcctcc

SEQ ID NO: 454426 - DNA, 20 bp, Artificial
  CRISPR gRNA sequence
ggctcaagtgatcctcccac

SEQ ID NO: 454427 - DNA, 20 bp, Artificial
  CRISPR gRNA sequence
aagtgatcctcccacctcgg

SEQ ID NO: 454428 - DNA, 20 bp, Artificial
  CRISPR gRNA sequence
ccacctcggcctcccaaagg

SEQ ID NO: 454429 - DNA, 20 bp, Artificial
  CRISPR gRNA sequence
ggcctcccaaaggcttggga

SEQ ID NO: 454430 - DNA, 20 bp, Artificial
  CRISPR gRNA sequence
ccaaaggcttgggattacag

SEQ ID NO: 454431 - DNA, 20 bp, Artificial
  CRISPR gRNA sequence
gggattacaggcgtgagcca

SEQ ID NO: 454432 - DNA, 20 bp, Artificial
  CRISPR gRNA sequence
ggattacaggcgtgagccac

SEQ ID NO: 454433 - DNA, 20 bp, Artificial
  CRISPR gRNA sequence
caggcgtgagccaccgcaac

SEQ ID NO: 454434 - DNA, 20 bp, Artificial
  CRISPR gRNA sequence
ggcctttcaatttttaaaaa

SEQ ID NO: 454435 - DNA, 20 bp, Artificial
  CRISPR gRNA sequence
tcaatttttaaaaatttaaa

SEQ ID NO: 454436 - DNA, 20 bp, Artificial
  CRISPR gRNA sequence
caatttttaaaaatttaaat

SEQ ID NO: 454437 - DNA, 20 bp, Artificial
  CRISPR gRNA sequence
aatttttaaaaatttaaata

SEQ ID NO: 454438 - DNA, 20 bp, Artificial
  CRISPR gRNA sequence
ttaaaaatttaaatataata

SEQ ID NO: 454439 - DNA, 20 bp, Artificial
  CRISPR gRNA sequence
taaaaatttaaatataatat

SEQ ID NO: 454440 - DNA, 20 bp, Artificial
  CRISPR gRNA sequence
aaaaatttaaatataatatt

SEQ ID NO: 454441 - DNA, 20 bp, Artificial
  CRISPR gRNA sequence
aaaatttaaatataatatta

SEQ ID NO: 454442 - DNA, 20 bp, Artificial
  CRISPR gRNA sequence
aaatataatattataaaaca

SEQ ID NO: 454443 - DNA, 20 bp, Artificial
  CRISPR gRNA sequence
aatataatattataaaacag

SEQ ID NO: 454444 - DNA, 20 bp, Artificial
  CRISPR gRNA sequence
taaaacagaatacagcagca

SEQ ID NO: 454445 - DNA, 20 bp, Artificial
  CRISPR gRNA sequence
ggccgggcgtggtggttcac

SEQ ID NO: 454446 - DNA, 20 bp, Artificial
  CRISPR gRNA sequence
acgcctgtaatcccagcact

SEQ ID NO: 454447 - DNA, 20 bp, Artificial
  CRISPR gRNA sequence
taatcccagcactttgggag

SEQ ID NO: 454448 - DNA, 20 bp, Artificial
  CRISPR gRNA sequence
tgggaggccaaggtgggtgg

SEQ ID NO: 454449 - DNA, 20 bp, Artificial
  CRISPR gRNA sequence
gggaggccaaggtgggtgga

SEQ ID NO: 454450 - DNA, 20 bp, Artificial
  CRISPR gRNA sequence
ggaggccaaggtgggtggat

SEQ ID NO: 454451 - DNA, 20 bp, Artificial
  CRISPR gRNA sequence
ggagttcaagatcaccctgg

SEQ ID NO: 454452 - DNA, 20 bp, Artificial
  CRISPR gRNA sequence
aagatcaccctggccaagat

SEQ ID NO: 454453 - DNA, 20 bp, Artificial
  CRISPR gRNA sequence
gccaagatggtgaaaccccg

SEQ ID NO: 454454 - DNA, 20 bp, Artificial
  CRISPR gRNA sequence
tactaaaaatacaaaaatta

SEQ ID NO: 454455 - DNA, 20 bp, Artificial
  CRISPR gRNA sequence
ctaaaaatacaaaaattagc

SEQ ID NO: 454456 - DNA, 20 bp, Artificial
  CRISPR gRNA sequence
aaaatacaaaaattagccga

SEQ ID NO: 454457 - DNA, 20 bp, Artificial
  CRISPR gRNA sequence
gccgagcgcagtggcaggcg

SEQ ID NO: 454458 - DNA, 20 bp, Artificial
  CRISPR gRNA sequence
taatcccagatactcggcag

SEQ ID NO: 454459 - DNA, 20 bp, Artificial
  CRISPR gRNA sequence
ggcaggcgcctgtaatccca

SEQ ID NO: 454460 - DNA, 20 bp, Artificial
  CRISPR gRNA sequence
taatcccagatactcggcag

SEQ ID NO: 454461 - DNA, 20 bp, Artificial
  CRISPR gRNA sequence
ggcaggctgaggcaggagaa

SEQ ID NO: 454462 - DNA, 20 bp, Artificial
  CRISPR gRNA sequence
aggcaggagaatcgcttgaa

SEQ ID NO: 454463 - DNA, 20 bp, Artificial
  CRISPR gRNA sequence
gaacccaggaggtggaagtt

SEQ ID NO: 454464 - DNA, 20 bp, Artificial
  CRISPR gRNA sequence
aacccaggaggtggaagttg

SEQ ID NO: 454465 - DNA, 20 bp, Artificial
  CRISPR gRNA sequence
cagtaagccaagatcgtgcc

SEQ ID NO: 454466 - DNA, 20 bp, Artificial
  CRISPR gRNA sequence
cactccagcctgggcgacag

SEQ ID NO: 454467 - DNA, 20 bp, Artificial
  CRISPR gRNA sequence
cagcctgggcgacagagtga

SEQ ID NO: 454468 - DNA, 20 bp, Artificial
  CRISPR gRNA sequence
ggcgacagagtgagactctg

SEQ ID NO: 454469 - DNA, 20 bp, Artificial
  CRISPR gRNA sequence
tgtctcaaaagaaaataaca

SEQ ID NO: 454470 - DNA, 20 bp, Artificial
  CRISPR gRNA sequence
tctcaaaagaaaataacaac

SEQ ID NO: 454471 - DNA, 20 bp, Artificial
  CRISPR gRNA sequence
aaaagaaaataacaacatac

SEQ ID NO: 454472 - DNA, 20 bp, Artificial
  CRISPR gRNA sequence
tgaccaaatggcttcagttt

SEQ ID NO: 454473 - DNA, 20 bp, Artificial
  CRISPR gRNA sequence
cagtttttgtttgtttgtct

SEQ ID NO: 454474 - DNA, 20 bp, Artificial
  CRISPR gRNA sequence
agtttttgtttgtttgtctg

SEQ ID NO: 454475 - DNA, 20 bp, Artificial
  CRISPR gRNA sequence
ttgtttgtttgtctgggact

SEQ ID NO: 454476 - DNA, 20 bp, Artificial
  CRISPR gRNA sequence
tgtttgtttgtctgggactg

SEQ ID NO: 454477 - DNA, 20 bp, Artificial
  CRISPR gRNA sequence
gtttgtttgtctgggactgc

SEQ ID NO: 454478 - DNA, 20 bp, Artificial
  CRISPR gRNA sequence
tttgtttgtctgggactgca

SEQ ID NO: 454479 - DNA, 20 bp, Artificial
  CRISPR gRNA sequence
gtttgtctgggactgcaaag

SEQ ID NO: 454480 - DNA, 20 bp, Artificial
  CRISPR gRNA sequence
tttgtctgggactgcaaaga

SEQ ID NO: 454481 - DNA, 20 bp, Artificial
  CRISPR gRNA sequence
gtctgggactgcaaagatgt

SEQ ID NO: 454482 - DNA, 20 bp, Artificial
  CRISPR gRNA sequence
tctgggactgcaaagatgta

SEQ ID NO: 454483 - DNA, 20 bp, Artificial
  CRISPR gRNA sequence
ggactgcaaagatgtatcaa

SEQ ID NO: 454484 - DNA, 20 bp, Artificial
  CRISPR gRNA sequence
caaagatgtatcaattttag

SEQ ID NO: 454485 - DNA, 20 bp, Artificial
  CRISPR gRNA sequence
taggaaatctattaatgtag

SEQ ID NO: 454486 - DNA, 20 bp, Artificial
  CRISPR gRNA sequence
aggaaatctattaatgtaga

SEQ ID NO: 454487 - DNA, 20 bp, Artificial
  CRISPR gRNA sequence
ggaaatctattaatgtagat

SEQ ID NO: 454488 - DNA, 20 bp, Artificial
  CRISPR gRNA sequence
ttaatgtagatcgccatctt

SEQ ID NO: 454489 - DNA, 20 bp, Artificial
  CRISPR gRNA sequence
atgtagatcgccatcttaat

SEQ ID NO: 454490 - DNA, 20 bp, Artificial
  CRISPR gRNA sequence
aatatatcttaaagaaaaat

SEQ ID NO: 454491 - DNA, 20 bp, Artificial
  CRISPR gRNA sequence
atatatcttaaagaaaaata

SEQ ID NO: 454492 - DNA, 20 bp, Artificial
  CRISPR gRNA sequence
aaagaaaaataatatcattt

SEQ ID NO: 454493 - DNA, 20 bp, Artificial
  CRISPR gRNA sequence
aagaaaaataatatcatttt

SEQ ID NO: 454494 - DNA, 20 bp, Artificial
  CRISPR gRNA sequence
tagttgatatttaaaggcaa

SEQ ID NO: 454495 - DNA, 20 bp, Artificial
  CRISPR gRNA sequence
agttgatatttaaaggcaat

SEQ ID NO: 454496 - DNA, 20 bp, Artificial
  CRISPR gRNA sequence
gttgatatttaaaggcaatt

SEQ ID NO: 454497 - DNA, 20 bp, Artificial
  CRISPR gRNA sequence
atatttaaaggcaattaata

SEQ ID NO: 454498 - DNA, 20 bp, Artificial
  CRISPR gRNA sequence
aaaggcaattaataaaacat

SEQ ID NO: 454499 - DNA, 20 bp, Artificial
  CRISPR gRNA sequence
aaggcaattaataaaacatt

SEQ ID NO: 454500 - DNA, 20 bp, Artificial
  CRISPR gRNA sequence
ataaaacattcacatccatc

SEQ ID NO: 454501 - DNA, 20 bp, Artificial
  CRISPR gRNA sequence
acatccatccttgacatttt

SEQ ID NO: 454502 - DNA, 20 bp, Artificial
  CRISPR gRNA sequence
gacattttaaaactcttaat

SEQ ID NO: 454503 - DNA, 20 bp, Artificial
  CRISPR gRNA sequence
acattttaaaactcttaata

SEQ ID NO: 454504 - DNA, 20 bp, Artificial
  CRISPR gRNA sequence
taaaactcttaataaaatag

SEQ ID NO: 454505 - DNA, 20 bp, Artificial
  CRISPR gRNA sequence
aaaactcttaataaaataga

SEQ ID NO: 454506 - DNA, 20 bp, Artificial
  CRISPR gRNA sequence
aaactcttaataaaatagaa

SEQ ID NO: 454507 - DNA, 20 bp, Artificial
  CRISPR gRNA sequence
ttaataaaatagaaataaat

SEQ ID NO: 454508 - DNA, 20 bp, Artificial
  CRISPR gRNA sequence
aataaaatagaaataaatgt

SEQ ID NO: 454509 - DNA, 20 bp, Artificial
  CRISPR gRNA sequence
ataaaatagaaataaatgta

SEQ ID NO: 454510 - DNA, 20 bp, Artificial
  CRISPR gRNA sequence
cttaacataataaaatacat

SEQ ID NO: 454511 - DNA, 20 bp, Artificial
  CRISPR gRNA sequence
aacataataaaatacatctc

SEQ ID NO: 454512 - DNA, 20 bp, Artificial
  CRISPR gRNA sequence
acataataaaatacatctca

SEQ ID NO: 454513 - DNA, 20 bp, Artificial
  CRISPR gRNA sequence
attctcaaagctactataat

SEQ ID NO: 454514 - DNA, 20 bp, Artificial
  CRISPR gRNA sequence
tcaaagctactataatactt

SEQ ID NO: 454515 - DNA, 20 bp, Artificial
  CRISPR gRNA sequence
aaagctactataatacttaa

SEQ ID NO: 454516 - DNA, 20 bp, Artificial
  CRISPR gRNA sequence
ctataatacttaataaggaa

SEQ ID NO: 454517 - DNA, 20 bp, Artificial
  CRISPR gRNA sequence
taatacttaataaggaaaca

SEQ ID NO: 454518 - DNA, 20 bp, Artificial
  CRISPR gRNA sequence
aataaggaaacatttaagca

SEQ ID NO: 454519 - DNA, 20 bp, Artificial
  CRISPR gRNA sequence
ataaggaaacatttaagcat

SEQ ID NO: 454520 - DNA, 20 bp, Artificial
  CRISPR gRNA sequence
aagcatcccccattaaactt

SEQ ID NO: 454521 - DNA, 20 bp, Artificial
  CRISPR gRNA sequence
agcatcccccattaaactta

SEQ ID NO: 454522 - DNA, 20 bp, Artificial
  CRISPR gRNA sequence
aacttagaaaaaagacagag

SEQ ID NO: 454523 - DNA, 20 bp, Artificial
  CRISPR gRNA sequence
agaaaaaagacagagattca

SEQ ID NO: 454524 - DNA, 20 bp, Artificial
  CRISPR gRNA sequence
gaaaaaagacagagattcat

SEQ ID NO: 454525 - DNA, 20 bp, Artificial
  CRISPR gRNA sequence
attattaccattattattta

SEQ ID NO: 454526 - DNA, 20 bp, Artificial
  CRISPR gRNA sequence
ttaccattattatttaatat

SEQ ID NO: 454527 - DNA, 20 bp, Artificial
  CRISPR gRNA sequence
ccattattatttaatatttt

SEQ ID NO: 454528 - DNA, 20 bp, Artificial
  CRISPR gRNA sequence
ttatttaatatttttctgga

SEQ ID NO: 454529 - DNA, 20 bp, Artificial
  CRISPR gRNA sequence
tttaatatttttctggagat

SEQ ID NO: 454530 - DNA, 20 bp, Artificial
  CRISPR gRNA sequence
aatatttttctggagatatt

SEQ ID NO: 454531 - DNA, 20 bp, Artificial
  CRISPR gRNA sequence
atatttttctggagatatta

SEQ ID NO: 454532 - DNA, 20 bp, Artificial
  CRISPR gRNA sequence
ttctggagatattaaccaac

SEQ ID NO: 454533 - DNA, 20 bp, Artificial
  CRISPR gRNA sequence
tctggagatattaaccaaca

SEQ ID NO: 454534 - DNA, 20 bp, Artificial
  CRISPR gRNA sequence
ctggagatattaaccaacac

SEQ ID NO: 454535 - DNA, 20 bp, Artificial
  CRISPR gRNA sequence
tggagatattaaccaacaca

SEQ ID NO: 454536 - DNA, 20 bp, Artificial
  CRISPR gRNA sequence
gagatattaaccaacacaat

SEQ ID NO: 454537 - DNA, 20 bp, Artificial
  CRISPR gRNA sequence
accaacacaattagaagaaa

SEQ ID NO: 454538 - DNA, 20 bp, Artificial
  CRISPR gRNA sequence
gaagaaagaaatcagagata

SEQ ID NO: 454539 - DNA, 20 bp, Artificial
  CRISPR gRNA sequence
tcattatgtacacataatat

SEQ ID NO: 454540 - DNA, 20 bp, Artificial
  CRISPR gRNA sequence
tgtacacataatatgattgc

SEQ ID NO: 454541 - DNA, 20 bp, Artificial
  CRISPR gRNA sequence
cataactggaaaatccaaga

SEQ ID NO: 454542 - DNA, 20 bp, Artificial
  CRISPR gRNA sequence
gaaaatccaagagaatcaac

SEQ ID NO: 454543 - DNA, 20 bp, Artificial
  CRISPR gRNA sequence
aaaaatgatagaattaaggg

SEQ ID NO: 454544 - DNA, 20 bp, Artificial
  CRISPR gRNA sequence
agggaggggagctgggtatg

SEQ ID NO: 454545 - DNA, 20 bp, Artificial
  CRISPR gRNA sequence
ggtatgaaattaatatctag

SEQ ID NO: 454546 - DNA, 20 bp, Artificial
  CRISPR gRNA sequence
atatctagtaaaacaaatag

SEQ ID NO: 454547 - DNA, 20 bp, Artificial
  CRISPR gRNA sequence
gtaaaacaaatagcctttca

SEQ ID NO: 454548 - DNA, 20 bp, Artificial
  CRISPR gRNA sequence
tcatatatgaacaataatga

SEQ ID NO: 454549 - DNA, 20 bp, Artificial
  CRISPR gRNA sequence
catatatgaacaataatgaa

SEQ ID NO: 454550 - DNA, 20 bp, Artificial
  CRISPR gRNA sequence
atatatgaacaataatgaaa

SEQ ID NO: 454551 - DNA, 20 bp, Artificial
  CRISPR gRNA sequence
aaagatataatgaatgatat

SEQ ID NO: 454552 - DNA, 20 bp, Artificial
  CRISPR gRNA sequence
aaaaaataagttaaaagata

SEQ ID NO: 454553 - DNA, 20 bp, Artificial
  CRISPR gRNA sequence
aaagatacaacgagtggaaa

SEQ ID NO: 454554 - DNA, 20 bp, Artificial
  CRISPR gRNA sequence
gagaagatgtggagaaatag

SEQ ID NO: 454555 - DNA, 20 bp, Artificial
  CRISPR gRNA sequence
ttacactgttgatgggagtg

SEQ ID NO: 454556 - DNA, 20 bp, Artificial
  CRISPR gRNA sequence
tacactgttgatgggagtgt

SEQ ID NO: 454557 - DNA, 20 bp, Artificial
  CRISPR gRNA sequence
acactgttgatgggagtgta

SEQ ID NO: 454558 - DNA, 20 bp, Artificial
  CRISPR gRNA sequence
cactgttgatgggagtgtaa

SEQ ID NO: 454559 - DNA, 20 bp, Artificial
  CRISPR gRNA sequence
ttgatgggagtgtaaattag

SEQ ID NO: 454560 - DNA, 20 bp, Artificial
  CRISPR gRNA sequence
atgggagtgtaaattagttc

SEQ ID NO: 454561 - DNA, 20 bp, Artificial
  CRISPR gRNA sequence
gttcaaccactgtggaagac

SEQ ID NO: 454562 - DNA, 20 bp, Artificial
  CRISPR gRNA sequence
aaccactgtggaagacagtg

SEQ ID NO: 454563 - DNA, 20 bp, Artificial
  CRISPR gRNA sequence
tggaagacagtgtggggatt

SEQ ID NO: 454564 - DNA, 20 bp, Artificial
  CRISPR gRNA sequence
ctcaaggatctagaactaga

SEQ ID NO: 454565 - DNA, 20 bp, Artificial
  CRISPR gRNA sequence
aaggatctagaactagaaat

SEQ ID NO: 454566 - DNA, 20 bp, Artificial
  CRISPR gRNA sequence
gaactagaaataccatttga

SEQ ID NO: 454567 - DNA, 20 bp, Artificial
  CRISPR gRNA sequence
gaaataccatttgacccagc

SEQ ID NO: 454568 - DNA, 20 bp, Artificial
  CRISPR gRNA sequence
gacccagcaatctcattact

SEQ ID NO: 454569 - DNA, 20 bp, Artificial
  CRISPR gRNA sequence
acccagcaatctcattactg

SEQ ID NO: 454570 - DNA, 20 bp, Artificial
  CRISPR gRNA sequence
attactgggcatatacccaa

SEQ ID NO: 454571 - DNA, 20 bp, Artificial
  CRISPR gRNA sequence
ctgggcatatacccaaagga

SEQ ID NO: 454572 - DNA, 20 bp, Artificial
  CRISPR gRNA sequence
ggcatatacccaaaggatta

SEQ ID NO: 454573 - DNA, 20 bp, Artificial
  CRISPR gRNA sequence
taaatcattctacgataaag

SEQ ID NO: 454574 - DNA, 20 bp, Artificial
  CRISPR gRNA sequence
tacgataaagatgcacaagt

SEQ ID NO: 454575 - DNA, 20 bp, Artificial
  CRISPR gRNA sequence
cgataaagatgcacaagtat

SEQ ID NO: 454576 - DNA, 20 bp, Artificial
  CRISPR gRNA sequence
attgtggtactattcacaat

SEQ ID NO: 454577 - DNA, 20 bp, Artificial
  CRISPR gRNA sequence
ttgtggtactattcacaata

SEQ ID NO: 454578 - DNA, 20 bp, Artificial
  CRISPR gRNA sequence
tggtactattcacaatagca

SEQ ID NO: 454579 - DNA, 20 bp, Artificial
  CRISPR gRNA sequence
ttcacaatagcaaagcctgg

SEQ ID NO: 454580 - DNA, 20 bp, Artificial
  CRISPR gRNA sequence
acaatagcaaagcctgggaa

SEQ ID NO: 454581 - DNA, 20 bp, Artificial
  CRISPR gRNA sequence
ggaaccaacccaaatgtcca

SEQ ID NO: 454582 - DNA, 20 bp, Artificial
  CRISPR gRNA sequence
gattaagaaaatgtggcaca

SEQ ID NO: 454583 - DNA, 20 bp, Artificial
  CRISPR gRNA sequence
agaaaatgtggcacatatac

SEQ ID NO: 454584 - DNA, 20 bp, Artificial
  CRISPR gRNA sequence
tgcagccataaaaaaggatg

SEQ ID NO: 454585 - DNA, 20 bp, Artificial
  CRISPR gRNA sequence
atgtcctttgcagggacata

SEQ ID NO: 454586 - DNA, 20 bp, Artificial
  CRISPR gRNA sequence
tgcagggacatagatgaagc

SEQ ID NO: 454587 - DNA, 20 bp, Artificial
  CRISPR gRNA sequence
gcagggacatagatgaagct

SEQ ID NO: 454588 - DNA, 20 bp, Artificial
  CRISPR gRNA sequence
cagggacatagatgaagctg

SEQ ID NO: 454589 - DNA, 20 bp, Artificial
  CRISPR gRNA sequence
gaaaccatcattctaagcaa

SEQ ID NO: 454590 - DNA, 20 bp, Artificial
  CRISPR gRNA sequence
taagcaaactgtcacaagga

SEQ ID NO: 454591 - DNA, 20 bp, Artificial
  CRISPR gRNA sequence
agcaaactgtcacaaggaca

SEQ ID NO: 454592 - DNA, 20 bp, Artificial
  CRISPR gRNA sequence
tcacaaggacaggaaaccaa

SEQ ID NO: 454593 - DNA, 20 bp, Artificial
  CRISPR gRNA sequence
catgttctcgctcataagta

SEQ ID NO: 454594 - DNA, 20 bp, Artificial
  CRISPR gRNA sequence
tcgctcataagtaggagttg

SEQ ID NO: 454595 - DNA, 20 bp, Artificial
  CRISPR gRNA sequence
gctcataagtaggagttgaa

SEQ ID NO: 454596 - DNA, 20 bp, Artificial
  CRISPR gRNA sequence
ataagtaggagttgaacaat

SEQ ID NO: 454597 - DNA, 20 bp, Artificial
  CRISPR gRNA sequence
aacaatgagaacacatgaac

SEQ ID NO: 454598 - DNA, 20 bp, Artificial
  CRISPR gRNA sequence
cacgggtgggggcccggggg

SEQ ID NO: 454599 - DNA, 20 bp, Artificial
  CRISPR gRNA sequence
ggagaaatacctaatgtaaa

SEQ ID NO: 454600 - DNA, 20 bp, Artificial
  CRISPR gRNA sequence
atgtaaatgacaagttgatg

SEQ ID NO: 454601 - DNA, 20 bp, Artificial
  CRISPR gRNA sequence
atgggtgcagcaaaccaaca

SEQ ID NO: 454602 - DNA, 20 bp, Artificial
  CRISPR gRNA sequence
tgtaacaaacctgcacattg

SEQ ID NO: 454603 - DNA, 20 bp, Artificial
  CRISPR gRNA sequence
cacattgtgcacatgtaccc

SEQ ID NO: 454604 - DNA, 20 bp, Artificial
  CRISPR gRNA sequence
tgcacatgtaccctagaact

SEQ ID NO: 454605 - DNA, 20 bp, Artificial
  CRISPR gRNA sequence
gaacttaaagtatattaaaa

SEQ ID NO: 454606 - DNA, 20 bp, Artificial
  CRISPR gRNA sequence
aaagtatattaaaaaaaaga

SEQ ID NO: 454607 - DNA, 20 bp, Artificial
  CRISPR gRNA sequence
aagtatattaaaaaaaagat

SEQ ID NO: 454608 - DNA, 20 bp, Artificial
  CRISPR gRNA sequence
aaaaaaagatataatgggta

SEQ ID NO: 454609 - DNA, 20 bp, Artificial
  CRISPR gRNA sequence
tcaatagtgaaaaaatatga

SEQ ID NO: 454610 - DNA, 20 bp, Artificial
  CRISPR gRNA sequence
caatagtgaaaaaatatgaa

SEQ ID NO: 454611 - DNA, 20 bp, Artificial
  CRISPR gRNA sequence
aatagtgaaaaaatatgaat

SEQ ID NO: 454612 - DNA, 20 bp, Artificial
  CRISPR gRNA sequence
ctcaagaaacaaacttagct

SEQ ID NO: 454613 - DNA, 20 bp, Artificial
  CRISPR gRNA sequence
aagaaacaaacttagctaag

SEQ ID NO: 454614 - DNA, 20 bp, Artificial
  CRISPR gRNA sequence
agctaagaaatggacgagga

SEQ ID NO: 454615 - DNA, 20 bp, Artificial
  CRISPR gRNA sequence
gctaagaaatggacgaggac

SEQ ID NO: 454616 - DNA, 20 bp, Artificial
  CRISPR gRNA sequence
agaaatggacgaggacttta

SEQ ID NO: 454617 - DNA, 20 bp, Artificial
  CRISPR gRNA sequence
tatgaagaaaacttctatac

SEQ ID NO: 454618 - DNA, 20 bp, Artificial
  CRISPR gRNA sequence
atgaagaaaacttctataca

SEQ ID NO: 454619 - DNA, 20 bp, Artificial
  CRISPR gRNA sequence
tgaagaaaacttctatacat

SEQ ID NO: 454620 - DNA, 20 bp, Artificial
  CRISPR gRNA sequence
ctatacatacctgagacaca

SEQ ID NO: 454621 - DNA, 20 bp, Artificial
  CRISPR gRNA sequence
tatacatacctgagacacac

SEQ ID NO: 454622 - DNA, 20 bp, Artificial
  CRISPR gRNA sequence
tacatacctgagacacacat

SEQ ID NO: 454623 - DNA, 20 bp, Artificial
  CRISPR gRNA sequence
agacacacatatttgaaaaa

SEQ ID NO: 454624 - DNA, 20 bp, Artificial
  CRISPR gRNA sequence
gaaaaatgaatatcacattc

SEQ ID NO: 454625 - DNA, 20 bp, Artificial
  CRISPR gRNA sequence
aaaaatgaatatcacattct

SEQ ID NO: 454626 - DNA, 20 bp, Artificial
  CRISPR gRNA sequence
tcggatcaaaagaatcaatg

SEQ ID NO: 454627 - DNA, 20 bp, Artificial
  CRISPR gRNA sequence
ggatcaaaagaatcaatgtc

SEQ ID NO: 454628 - DNA, 20 bp, Artificial
  CRISPR gRNA sequence
agttctccctaagttaaaat

SEQ ID NO: 454629 - DNA, 20 bp, Artificial
  CRISPR gRNA sequence
tccctaagttaaaatataaa

SEQ ID NO: 454630 - DNA, 20 bp, Artificial
  CRISPR gRNA sequence
cctaagttaaaatataaatt

SEQ ID NO: 454631 - DNA, 20 bp, Artificial
  CRISPR gRNA sequence
agttaaaatataaattgaac

SEQ ID NO: 454632 - DNA, 20 bp, Artificial
  CRISPR gRNA sequence
aaatataaattgaacatatc

SEQ ID NO: 454633 - DNA, 20 bp, Artificial
  CRISPR gRNA sequence
aacatatcccaattttaaaa

SEQ ID NO: 454634 - DNA, 20 bp, Artificial
  CRISPR gRNA sequence
taaaataccaataggacttt

SEQ ID NO: 454635 - DNA, 20 bp, Artificial
  CRISPR gRNA sequence
aaaataccaataggactttt

SEQ ID NO: 454636 - DNA, 20 bp, Artificial
  CRISPR gRNA sequence
aaataccaataggacttttt

SEQ ID NO: 454637 - DNA, 20 bp, Artificial
  CRISPR gRNA sequence
tttcttgatggtacacacag

SEQ ID NO: 454638 - DNA, 20 bp, Artificial
  CRISPR gRNA sequence
ttcttgatggtacacacagt

SEQ ID NO: 454639 - DNA, 20 bp, Artificial
  CRISPR gRNA sequence
tcttgatggtacacacagta

SEQ ID NO: 454640 - DNA, 20 bp, Artificial
  CRISPR gRNA sequence
cttgatggtacacacagtag

SEQ ID NO: 454641 - DNA, 20 bp, Artificial
  CRISPR gRNA sequence
ttgatggtacacacagtagg

SEQ ID NO: 454642 - DNA, 20 bp, Artificial
  CRISPR gRNA sequence
gatggtacacacagtaggaa

SEQ ID NO: 454643 - DNA, 20 bp, Artificial
  CRISPR gRNA sequence
atggtacacacagtaggaag

SEQ ID NO: 454644 - DNA, 20 bp, Artificial
  CRISPR gRNA sequence
gacaagctgattataaaaat

SEQ ID NO: 454645 - DNA, 20 bp, Artificial
  CRISPR gRNA sequence
attataaaaatcagaaaaat

SEQ ID NO: 454646 - DNA, 20 bp, Artificial
  CRISPR gRNA sequence
taaaaatcagaaaaataaat

SEQ ID NO: 454647 - DNA, 20 bp, Artificial
  CRISPR gRNA sequence
atagaaaaattcttgttttc

SEQ ID NO: 454648 - DNA, 20 bp, Artificial
  CRISPR gRNA sequence
tagaaaaattcttgttttcc

SEQ ID NO: 454649 - DNA, 20 bp, Artificial
  CRISPR gRNA sequence
ttgttttccccttttgaatt

SEQ ID NO: 454650 - DNA, 20 bp, Artificial
  CRISPR gRNA sequence
gttttccccttttgaatttt

SEQ ID NO: 454651 - DNA, 20 bp, Artificial
  CRISPR gRNA sequence
ttttccccttttgaatttta

SEQ ID NO: 454652 - DNA, 20 bp, Artificial
  CRISPR gRNA sequence
tccccttttgaattttaaat

SEQ ID NO: 454653 - DNA, 20 bp, Artificial
  CRISPR gRNA sequence
ccccttttgaattttaaatg

SEQ ID NO: 454654 - DNA, 20 bp, Artificial
  CRISPR gRNA sequence
cccttttgaattttaaatgc

SEQ ID NO: 454655 - DNA, 20 bp, Artificial
  CRISPR gRNA sequence
ttgaattttaaatgctgtga

SEQ ID NO: 454656 - DNA, 20 bp, Artificial
  CRISPR gRNA sequence
tgaattttaaatgctgtgaa

SEQ ID NO: 454657 - DNA, 20 bp, Artificial
  CRISPR gRNA sequence
gaattttaaatgctgtgaat

SEQ ID NO: 454658 - DNA, 20 bp, Artificial
  CRISPR gRNA sequence
aattttaaatgctgtgaatg

SEQ ID NO: 454659 - DNA, 20 bp, Artificial
  CRISPR gRNA sequence
taaatgctgtgaatgtaatt

SEQ ID NO: 454660 - DNA, 20 bp, Artificial
  CRISPR gRNA sequence
aaatgctgtgaatgtaatta

SEQ ID NO: 454661 - DNA, 20 bp, Artificial
  CRISPR gRNA sequence
aatgctgtgaatgtaattac

SEQ ID NO: 454662 - DNA, 20 bp, Artificial
  CRISPR gRNA sequence
tgaatgtaattaccacttca

SEQ ID NO: 454663 - DNA, 20 bp, Artificial
  CRISPR gRNA sequence
ccacttcaaaagttataaac

SEQ ID NO: 454664 - DNA, 20 bp, Artificial
  CRISPR gRNA sequence
caaaagttataaactacaaa

SEQ ID NO: 454665 - DNA, 20 bp, Artificial
  CRISPR gRNA sequence
aaaagttataaactacaaaa

SEQ ID NO: 454666 - DNA, 20 bp, Artificial
  CRISPR gRNA sequence
taaactacaaaaccttaaat

SEQ ID NO: 454667 - DNA, 20 bp, Artificial
  CRISPR gRNA sequence
caaaaccttaaatatatttt

SEQ ID NO: 454668 - DNA, 20 bp, Artificial
  CRISPR gRNA sequence
aaatatatttttaaaacaca

SEQ ID NO: 454669 - DNA, 20 bp, Artificial
  CRISPR gRNA sequence
aatatatttttaaaacacat

SEQ ID NO: 454670 - DNA, 20 bp, Artificial
  CRISPR gRNA sequence
ttaaaacacatacacacata

SEQ ID NO: 454671 - DNA, 20 bp, Artificial
  CRISPR gRNA sequence
taaaacacatacacacatag

SEQ ID NO: 454672 - DNA, 20 bp, Artificial
  CRISPR gRNA sequence
aaaacacatacacacataga

SEQ ID NO: 454673 - DNA, 20 bp, Artificial
  CRISPR gRNA sequence
aaacacatacacacatagag

SEQ ID NO: 454674 - DNA, 20 bp, Artificial
  CRISPR gRNA sequence
tttaaaataaaaatgtattt

SEQ ID NO: 454675 - DNA, 20 bp, Artificial
  CRISPR gRNA sequence
ttaaaataaaaatgtattta

SEQ ID NO: 454676 - DNA, 20 bp, Artificial
  CRISPR gRNA sequence
taaaataaaaatgtatttat

SEQ ID NO: 454677 - DNA, 20 bp, Artificial
  CRISPR gRNA sequence
aaaataaaaatgtatttatt

SEQ ID NO: 454678 - DNA, 20 bp, Artificial
  CRISPR gRNA sequence
aaataaaaatgtatttattt

SEQ ID NO: 454679 - DNA, 20 bp, Artificial
  CRISPR gRNA sequence
attttatatacataattgca

SEQ ID NO: 454680 - DNA, 20 bp, Artificial
  CRISPR gRNA sequence
ttttatatacataattgcaa

SEQ ID NO: 454681 - DNA, 20 bp, Artificial
  CRISPR gRNA sequence
tatatacataattgcaattt

SEQ ID NO: 454682 - DNA, 20 bp, Artificial
  CRISPR gRNA sequence
atatacataattgcaatttg

SEQ ID NO: 454683 - DNA, 20 bp, Artificial
  CRISPR gRNA sequence
tatacataattgcaatttgc

SEQ ID NO: 454684 - DNA, 20 bp, Artificial
  CRISPR gRNA sequence
caatttgccctttttgacct

SEQ ID NO: 454685 - DNA, 20 bp, Artificial
  CRISPR gRNA sequence
gccctttttgacctaatgct

SEQ ID NO: 454686 - DNA, 20 bp, Artificial
  CRISPR gRNA sequence
ccctttttgacctaatgcta

SEQ ID NO: 454687 - DNA, 20 bp, Artificial
  CRISPR gRNA sequence
tttgacctaatgctatatca

SEQ ID NO: 454688 - DNA, 20 bp, Artificial
  CRISPR gRNA sequence
ttgacctaatgctatatcat

SEQ ID NO: 454689 - DNA, 20 bp, Artificial
  CRISPR gRNA sequence
tgacctaatgctatatcatg

SEQ ID NO: 454690 - DNA, 20 bp, Artificial
  CRISPR gRNA sequence
gacctaatgctatatcatga

SEQ ID NO: 454691 - DNA, 20 bp, Artificial
  CRISPR gRNA sequence
acctaatgctatatcatgaa

SEQ ID NO: 454692 - DNA, 20 bp, Artificial
  CRISPR gRNA sequence
atgctatatcatgaacatcc

SEQ ID NO: 454693 - DNA, 20 bp, Artificial
  CRISPR gRNA sequence
tatcatgaacatccctccag

SEQ ID NO: 454694 - DNA, 20 bp, Artificial
  CRISPR gRNA sequence
caggcccatatttatagaag

SEQ ID NO: 454695 - DNA, 20 bp, Artificial
  CRISPR gRNA sequence
atagaagtatctcattcttt

SEQ ID NO: 454696 - DNA, 20 bp, Artificial
  CRISPR gRNA sequence
tagaagtatctcattctttt

SEQ ID NO: 454697 - DNA, 20 bp, Artificial
  CRISPR gRNA sequence
attcttttaataatatataa

SEQ ID NO: 454698 - DNA, 20 bp, Artificial
  CRISPR gRNA sequence
ttttaataatatataatatt

SEQ ID NO: 454699 - DNA, 20 bp, Artificial
  CRISPR gRNA sequence
ttaataatatataatatttt

SEQ ID NO: 454700 - DNA, 20 bp, Artificial
  CRISPR gRNA sequence
taataatatataatattttg

SEQ ID NO: 454701 - DNA, 20 bp, Artificial
  CRISPR gRNA sequence
aataatatataatattttgt

SEQ ID NO: 454702 - DNA, 20 bp, Artificial
  CRISPR gRNA sequence
ataatatataatattttgtc

SEQ ID NO: 454703 - DNA, 20 bp, Artificial
  CRISPR gRNA sequence
tgtcacatagattaattgaa

SEQ ID NO: 454704 - DNA, 20 bp, Artificial
  CRISPR gRNA sequence
gtcacatagattaattgaaa

SEQ ID NO: 454705 - DNA, 20 bp, Artificial
  CRISPR gRNA sequence
tcacatagattaattgaaac

SEQ ID NO: 454706 - DNA, 20 bp, Artificial
  CRISPR gRNA sequence
attgaaacttattaaaccat

SEQ ID NO: 454707 - DNA, 20 bp, Artificial
  CRISPR gRNA sequence
aaacttattaaaccattttc

SEQ ID NO: 454708 - DNA, 20 bp, Artificial
  CRISPR gRNA sequence
attaaaccattttccctatt

SEQ ID NO: 454709 - DNA, 20 bp, Artificial
  CRISPR gRNA sequence
ttaaaccattttccctattg

SEQ ID NO: 454710 - DNA, 20 bp, Artificial
  CRISPR gRNA sequence
aaccattttccctattgatg

SEQ ID NO: 454711 - DNA, 20 bp, Artificial
  CRISPR gRNA sequence
tccctattgatgaaattcaa

SEQ ID NO: 454712 - DNA, 20 bp, Artificial
  CRISPR gRNA sequence
ccctattgatgaaattcaag

SEQ ID NO: 454713 - DNA, 20 bp, Artificial
  CRISPR gRNA sequence
cctattgatgaaattcaagt

SEQ ID NO: 454714 - DNA, 20 bp, Artificial
  CRISPR gRNA sequence
ttgatgaaattcaagtgttt

SEQ ID NO: 454715 - DNA, 20 bp, Artificial
  CRISPR gRNA sequence
atgaaattcaagtgtttgtt

SEQ ID NO: 454716 - DNA, 20 bp, Artificial
  CRISPR gRNA sequence
aagtgtttgtttttcttcag

SEQ ID NO: 454717 - DNA, 20 bp, Artificial
  CRISPR gRNA sequence
gtttttcttcagtttgttta

SEQ ID NO: 454718 - DNA, 20 bp, Artificial
  CRISPR gRNA sequence
tttttcttcagtttgtttat

SEQ ID NO: 454719 - DNA, 20 bp, Artificial
  CRISPR gRNA sequence
ttcttcagtttgtttatttt

SEQ ID NO: 454720 - DNA, 20 bp, Artificial
  CRISPR gRNA sequence
tcttcagtttgtttattttg

SEQ ID NO: 454721 - DNA, 20 bp, Artificial
  CRISPR gRNA sequence
cttcagtttgtttattttga

SEQ ID NO: 454722 - DNA, 20 bp, Artificial
  CRISPR gRNA sequence
ttcagtttgtttattttgaa

SEQ ID NO: 454723 - DNA, 20 bp, Artificial
  CRISPR gRNA sequence
cagtttgtttattttgaaac

SEQ ID NO: 454724 - DNA, 20 bp, Artificial
  CRISPR gRNA sequence
agtttgtttattttgaaaca

SEQ ID NO: 454725 - DNA, 20 bp, Artificial
  CRISPR gRNA sequence
gtttattttgaaacaggagt

SEQ ID NO: 454726 - DNA, 20 bp, Artificial
  CRISPR gRNA sequence
tttattttgaaacaggagta

SEQ ID NO: 454727 - DNA, 20 bp, Artificial
  CRISPR gRNA sequence
attttgaaacaggagtaatt

SEQ ID NO: 454728 - DNA, 20 bp, Artificial
  CRISPR gRNA sequence
ttttgaaacaggagtaattt

SEQ ID NO: 454729 - DNA, 20 bp, Artificial
  CRISPR gRNA sequence
tgaaacaggagtaatttttc

SEQ ID NO: 454730 - DNA, 20 bp, Artificial
  CRISPR gRNA sequence
gaaacaggagtaatttttct

SEQ ID NO: 454731 - DNA, 20 bp, Artificial
  CRISPR gRNA sequence
aaacaggagtaatttttctt

SEQ ID NO: 454732 - DNA, 20 bp, Artificial
  CRISPR gRNA sequence
ttcttagccaggattagaag

SEQ ID NO: 454733 - DNA, 20 bp, Artificial
  CRISPR gRNA sequence
tcttagccaggattagaaga

SEQ ID NO: 454734 - DNA, 20 bp, Artificial
  CRISPR gRNA sequence
cttagccaggattagaagat

SEQ ID NO: 454735 - DNA, 20 bp, Artificial
  CRISPR gRNA sequence
ttagccaggattagaagatg

SEQ ID NO: 454736 - DNA, 20 bp, Artificial
  CRISPR gRNA sequence
agccaggattagaagatgta

SEQ ID NO: 454737 - DNA, 20 bp, Artificial
  CRISPR gRNA sequence
gccaggattagaagatgtaa

SEQ ID NO: 454738 - DNA, 20 bp, Artificial
  CRISPR gRNA sequence
gaagatgtaactataaaaag

SEQ ID NO: 454739 - DNA, 20 bp, Artificial
  CRISPR gRNA sequence
taaaaagtaaaacaataaaa

SEQ ID NO: 454740 - DNA, 20 bp, Artificial
  CRISPR gRNA sequence
aaagaaaattatagcctcaa

SEQ ID NO: 454741 - DNA, 20 bp, Artificial
  CRISPR gRNA sequence
tagcctcaattggagggaaa

SEQ ID NO: 454742 - DNA, 20 bp, Artificial
  CRISPR gRNA sequence
aattggagggaaactttcct

SEQ ID NO: 454743 - DNA, 20 bp, Artificial
  CRISPR gRNA sequence
gagggaaactttcctaaaca

SEQ ID NO: 454744 - DNA, 20 bp, Artificial
  CRISPR gRNA sequence
tcctaaacaatgcaggaaac

SEQ ID NO: 454745 - DNA, 20 bp, Artificial
  CRISPR gRNA sequence
cctaaacaatgcaggaaacc

SEQ ID NO: 454746 - DNA, 20 bp, Artificial
  CRISPR gRNA sequence
ctaaacaatgcaggaaaccc

SEQ ID NO: 454747 - DNA, 20 bp, Artificial
  CRISPR gRNA sequence
aacaatgcaggaaacccaga

SEQ ID NO: 454748 - DNA, 20 bp, Artificial
  CRISPR gRNA sequence
aaaggaaaagatagatatgt

SEQ ID NO: 454749 - DNA, 20 bp, Artificial
  CRISPR gRNA sequence
aaggaaaagatagatatgtt

SEQ ID NO: 454750 - DNA, 20 bp, Artificial
  CRISPR gRNA sequence
tatttaattacatacaatgt

SEQ ID NO: 454751 - DNA, 20 bp, Artificial
  CRISPR gRNA sequence
aattacatacaatgtaaact

SEQ ID NO: 454752 - DNA, 20 bp, Artificial
  CRISPR gRNA sequence
attacatacaatgtaaactt

SEQ ID NO: 454753 - DNA, 20 bp, Artificial
  CRISPR gRNA sequence
catacaatgtaaactttcct

SEQ ID NO: 454754 - DNA, 20 bp, Artificial
  CRISPR gRNA sequence
tccttgtgaaaaaaaagcct

SEQ ID NO: 454755 - DNA, 20 bp, Artificial
  CRISPR gRNA sequence
ccttgtgaaaaaaaagcctc

SEQ ID NO: 454756 - DNA, 20 bp, Artificial
  CRISPR gRNA sequence
cttgtgaaaaaaaagcctca

SEQ ID NO: 454757 - DNA, 20 bp, Artificial
  CRISPR gRNA sequence
gtgaaaaaaaagcctcataa

SEQ ID NO: 454758 - DNA, 20 bp, Artificial
  CRISPR gRNA sequence
tgaaaaaaaagcctcataaa

SEQ ID NO: 454759 - DNA, 20 bp, Artificial
  CRISPR gRNA sequence
ataaaaaaagtgaagagaca

SEQ ID NO: 454760 - DNA, 20 bp, Artificial
  CRISPR gRNA sequence
ggagaaagtatttgcctaaa

SEQ ID NO: 454761 - DNA, 20 bp, Artificial
  CRISPR gRNA sequence
gcctaaaaaaatggcagatg

SEQ ID NO: 454762 - DNA, 20 bp, Artificial
  CRISPR gRNA sequence
cctaaaaaaatggcagatgg

SEQ ID NO: 454763 - DNA, 20 bp, Artificial
  CRISPR gRNA sequence
aaaaaatggcagatgggtta

SEQ ID NO: 454764 - DNA, 20 bp, Artificial
  CRISPR gRNA sequence
atatctctaatacggagaaa

SEQ ID NO: 454765 - DNA, 20 bp, Artificial
  CRISPR gRNA sequence
taatacggagaaagtgccta

SEQ ID NO: 454766 - DNA, 20 bp, Artificial
  CRISPR gRNA sequence
atacggagaaagtgcctaaa

SEQ ID NO: 454767 - DNA, 20 bp, Artificial
  CRISPR gRNA sequence
aaagttaagaaatgtgaaga

SEQ ID NO: 454768 - DNA, 20 bp, Artificial
  CRISPR gRNA sequence
agaaatgtgaagaatatgaa

SEQ ID NO: 454769 - DNA, 20 bp, Artificial
  CRISPR gRNA sequence
acagacaagggaatactaat

SEQ ID NO: 454770 - DNA, 20 bp, Artificial
  CRISPR gRNA sequence
atgaccaataagcatatgaa

SEQ ID NO: 454771 - DNA, 20 bp, Artificial
  CRISPR gRNA sequence
aacttcactaatcatggaaa

SEQ ID NO: 454772 - DNA, 20 bp, Artificial
  CRISPR gRNA sequence
cactaatcatggaaatgcaa

SEQ ID NO: 454773 - DNA, 20 bp, Artificial
  CRISPR gRNA sequence
actaatcatggaaatgcaac

SEQ ID NO: 454774 - DNA, 20 bp, Artificial
  CRISPR gRNA sequence
atcatggaaatgcaacataa

SEQ ID NO: 454775 - DNA, 20 bp, Artificial
  CRISPR gRNA sequence
atttttcatccatcagattg

SEQ ID NO: 454776 - DNA, 20 bp, Artificial
  CRISPR gRNA sequence
ttcatccatcagattggcaa

SEQ ID NO: 454777 - DNA, 20 bp, Artificial
  CRISPR gRNA sequence
tcatccatcagattggcaaa

SEQ ID NO: 454778 - DNA, 20 bp, Artificial
  CRISPR gRNA sequence
catccatcagattggcaaaa

SEQ ID NO: 454779 - DNA, 20 bp, Artificial
  CRISPR gRNA sequence
atccatcagattggcaaaaa

SEQ ID NO: 454780 - DNA, 20 bp, Artificial
  CRISPR gRNA sequence
gcaaaaatgttaaagtacag

SEQ ID NO: 454781 - DNA, 20 bp, Artificial
  CRISPR gRNA sequence
aagtacagataatacccaga

SEQ ID NO: 454782 - DNA, 20 bp, Artificial
  CRISPR gRNA sequence
gcaagggcacgaggaaatgt

SEQ ID NO: 454783 - DNA, 20 bp, Artificial
  CRISPR gRNA sequence
tcaagcattcttggtgaaca

SEQ ID NO: 454784 - DNA, 20 bp, Artificial
  CRISPR gRNA sequence
ttggtgaacatctgattatc

SEQ ID NO: 454785 - DNA, 20 bp, Artificial
  CRISPR gRNA sequence
ggtgaacatctgattatcaa

SEQ ID NO: 454786 - DNA, 20 bp, Artificial
  CRISPR gRNA sequence
gtgaacatctgattatcaac

SEQ ID NO: 454787 - DNA, 20 bp, Artificial
  CRISPR gRNA sequence
attatcaacagcctttttgg

SEQ ID NO: 454788 - DNA, 20 bp, Artificial
  CRISPR gRNA sequence
tcaacagcctttttggagag

SEQ ID NO: 454789 - DNA, 20 bp, Artificial
  CRISPR gRNA sequence
tttggagagcaatctgatta

SEQ ID NO: 454790 - DNA, 20 bp, Artificial
  CRISPR gRNA sequence
ttggagagcaatctgattat

SEQ ID NO: 454791 - DNA, 20 bp, Artificial
  CRISPR gRNA sequence
tggagagcaatctgattata

SEQ ID NO: 454792 - DNA, 20 bp, Artificial
  CRISPR gRNA sequence
ggagagcaatctgattatag

SEQ ID NO: 454793 - DNA, 20 bp, Artificial
  CRISPR gRNA sequence
gagagcaatctgattatagt

SEQ ID NO: 454794 - DNA, 20 bp, Artificial
  CRISPR gRNA sequence
attatagtagaaaaaaagtt

SEQ ID NO: 454795 - DNA, 20 bp, Artificial
  CRISPR gRNA sequence
tagtagaaaaaaagttttaa

SEQ ID NO: 454796 - DNA, 20 bp, Artificial
  CRISPR gRNA sequence
taatcatcatattctttgac

SEQ ID NO: 454797 - DNA, 20 bp, Artificial
  CRISPR gRNA sequence
aatcatcatattctttgacg

SEQ ID NO: 454798 - DNA, 20 bp, Artificial
  CRISPR gRNA sequence
atcatcatattctttgacgc

SEQ ID NO: 454799 - DNA, 20 bp, Artificial
  CRISPR gRNA sequence
tttgacgcagcaatccaatt

SEQ ID NO: 454800 - DNA, 20 bp, Artificial
  CRISPR gRNA sequence
tgacgcagcaatccaattta

SEQ ID NO: 454801 - DNA, 20 bp, Artificial
  CRISPR gRNA sequence
gacgcagcaatccaatttaa

SEQ ID NO: 454802 - DNA, 20 bp, Artificial
  CRISPR gRNA sequence
acgcagcaatccaatttaac

SEQ ID NO: 454803 - DNA, 20 bp, Artificial
  CRISPR gRNA sequence
aacttaaaaaaatatatatg

SEQ ID NO: 454804 - DNA, 20 bp, Artificial
  CRISPR gRNA sequence
acttaaaaaaatatatatga

SEQ ID NO: 454805 - DNA, 20 bp, Artificial
  CRISPR gRNA sequence
aaaaaaatatatatgagaaa

SEQ ID NO: 454806 - DNA, 20 bp, Artificial
  CRISPR gRNA sequence
aaaaaatatatatgagaaaa

SEQ ID NO: 454807 - DNA, 20 bp, Artificial
  CRISPR gRNA sequence
tagtgtctccctatgcccct

SEQ ID NO: 454808 - DNA, 20 bp, Artificial
  CRISPR gRNA sequence
agtgtctccctatgcccctc

SEQ ID NO: 454809 - DNA, 20 bp, Artificial
  CRISPR gRNA sequence
gtgtctccctatgcccctcc

SEQ ID NO: 454810 - DNA, 20 bp, Artificial
  CRISPR gRNA sequence
cctatgcccctccctccccg

SEQ ID NO: 454811 - DNA, 20 bp, Artificial
  CRISPR gRNA sequence
tgcccctccctccccggctc

SEQ ID NO: 454812 - DNA, 20 bp, Artificial
  CRISPR gRNA sequence
cctccccggctcccagtgta

SEQ ID NO: 454813 - DNA, 20 bp, Artificial
  CRISPR gRNA sequence
cccggctcccagtgtatctc

SEQ ID NO: 454814 - DNA, 20 bp, Artificial
  CRISPR gRNA sequence
ccagtgtatctcacttggtt

SEQ ID NO: 454815 - DNA, 20 bp, Artificial
  CRISPR gRNA sequence
acttggtttaccgcctcact

SEQ ID NO: 454816 - DNA, 20 bp, Artificial
  CRISPR gRNA sequence
ggtttaccgcctcacttccc

SEQ ID NO: 454817 - DNA, 20 bp, Artificial
  CRISPR gRNA sequence
gtttaccgcctcacttccca

SEQ ID NO: 454818 - DNA, 20 bp, Artificial
  CRISPR gRNA sequence
accgcctcacttcccagcca

SEQ ID NO: 454819 - DNA, 20 bp, Artificial
  CRISPR gRNA sequence
ccgcctcacttcccagccag

SEQ ID NO: 454820 - DNA, 20 bp, Artificial
  CRISPR gRNA sequence
acttcccagccagctggact

SEQ ID NO: 454821 - DNA, 20 bp, Artificial
  CRISPR gRNA sequence
cccagccagctggactctca

SEQ ID NO: 454822 - DNA, 20 bp, Artificial
  CRISPR gRNA sequence
ccagccagctggactctcat

SEQ ID NO: 454823 - DNA, 20 bp, Artificial
  CRISPR gRNA sequence
gactctcatgcccaagccct

SEQ ID NO: 454824 - DNA, 20 bp, Artificial
  CRISPR gRNA sequence
tcatgcccaagccctcctct

SEQ ID NO: 454825 - DNA, 20 bp, Artificial
  CRISPR gRNA sequence
atgcccaagccctcctctac

SEQ ID NO: 454826 - DNA, 20 bp, Artificial
  CRISPR gRNA sequence
ctctacctccatcatactct

SEQ ID NO: 454827 - DNA, 20 bp, Artificial
  CRISPR gRNA sequence
tacctccatcatactctagc

SEQ ID NO: 454828 - DNA, 20 bp, Artificial
  CRISPR gRNA sequence
cctccatcatactctagcca

SEQ ID NO: 454829 - DNA, 20 bp, Artificial
  CRISPR gRNA sequence
catcatactctagccaatca

SEQ ID NO: 454830 - DNA, 20 bp, Artificial
  CRISPR gRNA sequence
tagccaatcaaagctagagc

SEQ ID NO: 454831 - DNA, 20 bp, Artificial
  CRISPR gRNA sequence
gccaatcaaagctagagcct

SEQ ID NO: 454832 - DNA, 20 bp, Artificial
  CRISPR gRNA sequence
gagcctgggatggggaaatg

SEQ ID NO: 454833 - DNA, 20 bp, Artificial
  CRISPR gRNA sequence
ggatggggaaatggtcttgg

SEQ ID NO: 454834 - DNA, 20 bp, Artificial
  CRISPR gRNA sequence
ggaaccctggaaggctttgt

SEQ ID NO: 454835 - DNA, 20 bp, Artificial
  CRISPR gRNA sequence
gaaccctggaaggctttgtc

SEQ ID NO: 454836 - DNA, 20 bp, Artificial
  CRISPR gRNA sequence
gaaggctttgtctagtgggt

SEQ ID NO: 454837 - DNA, 20 bp, Artificial
  CRISPR gRNA sequence
tgtctagtgggtccccctgt

SEQ ID NO: 454838 - DNA, 20 bp, Artificial
  CRISPR gRNA sequence
gtctagtgggtccccctgtg

SEQ ID NO: 454839 - DNA, 20 bp, Artificial
  CRISPR gRNA sequence
tctagtgggtccccctgtgc

SEQ ID NO: 454840 - DNA, 20 bp, Artificial
  CRISPR gRNA sequence
gtgggtccccctgtgctttt

SEQ ID NO: 454841 - DNA, 20 bp, Artificial
  CRISPR gRNA sequence
tgcttttaggagactgaagc

SEQ ID NO: 454842 - DNA, 20 bp, Artificial
  CRISPR gRNA sequence
ttaggagactgaagccaagg

SEQ ID NO: 454843 - DNA, 20 bp, Artificial
  CRISPR gRNA sequence
taggagactgaagccaagga

SEQ ID NO: 454844 - DNA, 20 bp, Artificial
  CRISPR gRNA sequence
aggagactgaagccaaggat

SEQ ID NO: 454845 - DNA, 20 bp, Artificial
  CRISPR gRNA sequence
ggagactgaagccaaggata

SEQ ID NO: 454846 - DNA, 20 bp, Artificial
  CRISPR gRNA sequence
aagccaaggataccagcaga

SEQ ID NO: 454847 - DNA, 20 bp, Artificial
  CRISPR gRNA sequence
gcttcaagttcctgggcctg

SEQ ID NO: 454848 - DNA, 20 bp, Artificial
  CRISPR gRNA sequence
cttcaagttcctgggcctgc

SEQ ID NO: 454849 - DNA, 20 bp, Artificial
  CRISPR gRNA sequence
caagttcctgggcctgctga

SEQ ID NO: 454850 - DNA, 20 bp, Artificial
  CRISPR gRNA sequence
aagttcctgggcctgctgac

SEQ ID NO: 454851 - DNA, 20 bp, Artificial
  CRISPR gRNA sequence
ctgggcctgctgacagcgtg

SEQ ID NO: 454852 - DNA, 20 bp, Artificial
  CRISPR gRNA sequence
ggcctgctgacagcgtgcag

SEQ ID NO: 454853 - DNA, 20 bp, Artificial
  CRISPR gRNA sequence
ctgacagcgtgcaggatgct

SEQ ID NO: 454854 - DNA, 20 bp, Artificial
  CRISPR gRNA sequence
acagcgtgcaggatgctgtt

SEQ ID NO: 454855 - DNA, 20 bp, Artificial
  CRISPR gRNA sequence
ttggaacccggcagaggctg

SEQ ID NO: 454856 - DNA, 20 bp, Artificial
  CRISPR gRNA sequence
gaacccggcagaggctgctg

SEQ ID NO: 454857 - DNA, 20 bp, Artificial
  CRISPR gRNA sequence
ctgtgccctggccatcctgc

SEQ ID NO: 454858 - DNA, 20 bp, Artificial
  CRISPR gRNA sequence
tgccctggccatcctgctgg

SEQ ID NO: 454859 - DNA, 20 bp, Artificial
  CRISPR gRNA sequence
gccatcctgctggcaattgt

SEQ ID NO: 454860 - DNA, 20 bp, Artificial
  CRISPR gRNA sequence
ctggcaattgtggacatcca

SEQ ID NO: 454861 - DNA, 20 bp, Artificial
  CRISPR gRNA sequence
gcaattgtggacatccagtc

SEQ ID NO: 454862 - DNA, 20 bp, Artificial
  CRISPR gRNA sequence
tggacatccagtctggtggt

SEQ ID NO: 454863 - DNA, 20 bp, Artificial
  CRISPR gRNA sequence
gtggtgaggatagaccctag

SEQ ID NO: 454864 - DNA, 20 bp, Artificial
  CRISPR gRNA sequence
gagcagagacggccatgggg

SEQ ID NO: 454865 - DNA, 20 bp, Artificial
  CRISPR gRNA sequence
ggcttgtgggaagggctgga

SEQ ID NO: 454866 - DNA, 20 bp, Artificial
  CRISPR gRNA sequence
gtgggaagggctggatcccg

SEQ ID NO: 454867 - DNA, 20 bp, Artificial
  CRISPR gRNA sequence
tgggaagggctggatcccgt

SEQ ID NO: 454868 - DNA, 20 bp, Artificial
  CRISPR gRNA sequence
gatcccgtgattttctctag

SEQ ID NO: 454869 - DNA, 20 bp, Artificial
  CRISPR gRNA sequence
tctctagtggggaaacaaag

SEQ ID NO: 454870 - DNA, 20 bp, Artificial
  CRISPR gRNA sequence
ctctagtggggaaacaaagg

SEQ ID NO: 454871 - DNA, 20 bp, Artificial
  CRISPR gRNA sequence
tctagtggggaaacaaagga

SEQ ID NO: 454872 - DNA, 20 bp, Artificial
  CRISPR gRNA sequence
tagtggggaaacaaaggact

SEQ ID NO: 454873 - DNA, 20 bp, Artificial
  CRISPR gRNA sequence
gtggggaaacaaaggactct

SEQ ID NO: 454874 - DNA, 20 bp, Artificial
  CRISPR gRNA sequence
tttttttttttttttttttt

SEQ ID NO: 454875 - DNA, 20 bp, Artificial
  CRISPR gRNA sequence
tttttttttttttttttttt

SEQ ID NO: 454876 - DNA, 20 bp, Artificial
  CRISPR gRNA sequence
tttttttttttttttttttg

SEQ ID NO: 454877 - DNA, 20 bp, Artificial
  CRISPR gRNA sequence
ttttttttttttttttttga

SEQ ID NO: 454878 - DNA, 20 bp, Artificial
  CRISPR gRNA sequence
tttttttttttttttttgag

SEQ ID NO: 454879 - DNA, 20 bp, Artificial
  CRISPR gRNA sequence
ttttttttttttttttgagg

SEQ ID NO: 454880 - DNA, 20 bp, Artificial
  CRISPR gRNA sequence
tttttttttttttttgaggg

SEQ ID NO: 454881 - DNA, 20 bp, Artificial
  CRISPR gRNA sequence
ttttttttttttttgaggga

SEQ ID NO: 454882 - DNA, 20 bp, Artificial
  CRISPR gRNA sequence
tttttttttttttgagggag

SEQ ID NO: 454883 - DNA, 20 bp, Artificial
  CRISPR gRNA sequence
ttttttttttttgagggagt

SEQ ID NO: 454884 - DNA, 20 bp, Artificial
  CRISPR gRNA sequence
tttttttttttgagggagtc

SEQ ID NO: 454885 - DNA, 20 bp, Artificial
  CRISPR gRNA sequence
ttttttttttgagggagtct

SEQ ID NO: 454886 - DNA, 20 bp, Artificial
  CRISPR gRNA sequence
tttttttttgagggagtctc

SEQ ID NO: 454887 - DNA, 20 bp, Artificial
  CRISPR gRNA sequence
ttttttttgagggagtctcg

SEQ ID NO: 454888 - DNA, 20 bp, Artificial
  CRISPR gRNA sequence
tttttttgagggagtctcgc

SEQ ID NO: 454889 - DNA, 20 bp, Artificial
  CRISPR gRNA sequence
ttttttgagggagtctcgct

SEQ ID NO: 454890 - DNA, 20 bp, Artificial
  CRISPR gRNA sequence
tttttgagggagtctcgctc

SEQ ID NO: 454891 - DNA, 20 bp, Artificial
  CRISPR gRNA sequence
ttttgagggagtctcgctct

SEQ ID NO: 454892 - DNA, 20 bp, Artificial
  CRISPR gRNA sequence
tttgagggagtctcgctctg

SEQ ID NO: 454893 - DNA, 20 bp, Artificial
  CRISPR gRNA sequence
ttgagggagtctcgctctgt

SEQ ID NO: 454894 - DNA, 20 bp, Artificial
  CRISPR gRNA sequence
tgagggagtctcgctctgtc

SEQ ID NO: 454895 - DNA, 20 bp, Artificial
  CRISPR gRNA sequence
gagggagtctcgctctgtca

SEQ ID NO: 454896 - DNA, 20 bp, Artificial
  CRISPR gRNA sequence
agggagtctcgctctgtcac

SEQ ID NO: 454897 - DNA, 20 bp, Artificial
  CRISPR gRNA sequence
gctctgtcacccaggctgga

SEQ ID NO: 454898 - DNA, 20 bp, Artificial
  CRISPR gRNA sequence
tgtcacccaggctggagtgc

SEQ ID NO: 454899 - DNA, 20 bp, Artificial
  CRISPR gRNA sequence
tcacccaggctggagtgcag

SEQ ID NO: 454900 - DNA, 20 bp, Artificial
  CRISPR gRNA sequence
gagtgcagtggcgcgatctc

SEQ ID NO: 454901 - DNA, 20 bp, Artificial
  CRISPR gRNA sequence
ggctcactgcaacctccgcc

SEQ ID NO: 454902 - DNA, 20 bp, Artificial
  CRISPR gRNA sequence
actgcaacctccgcctccca

SEQ ID NO: 454903 - DNA, 20 bp, Artificial
  CRISPR gRNA sequence
caacctccgcctcccatgtt

SEQ ID NO: 454904 - DNA, 20 bp, Artificial
  CRISPR gRNA sequence
cgcctcccatgttcaagcaa

SEQ ID NO: 454905 - DNA, 20 bp, Artificial
  CRISPR gRNA sequence
ccatgttcaagcaattctgc

SEQ ID NO: 454906 - DNA, 20 bp, Artificial
  CRISPR gRNA sequence
aagcaattctgctggctcag

SEQ ID NO: 454907 - DNA, 20 bp, Artificial
  CRISPR gRNA sequence
tgctggctcagcttcccgag

SEQ ID NO: 454908 - DNA, 20 bp, Artificial
  CRISPR gRNA sequence
ctggctcagcttcccgagta

SEQ ID NO: 454909 - DNA, 20 bp, Artificial
  CRISPR gRNA sequence
gctcagcttcccgagtagct

SEQ ID NO: 454910 - DNA, 20 bp, Artificial
  CRISPR gRNA sequence
agcttcccgagtagctggga

SEQ ID NO: 454911 - DNA, 20 bp, Artificial
  CRISPR gRNA sequence
cccgagtagctgggactaca

SEQ ID NO: 454912 - DNA, 20 bp, Artificial
  CRISPR gRNA sequence
ccgagtagctgggactacag

SEQ ID NO: 454913 - DNA, 20 bp, Artificial
  CRISPR gRNA sequence
ggactacaggcttatgccgc

SEQ ID NO: 454914 - DNA, 20 bp, Artificial
  CRISPR gRNA sequence
caggcttatgccgccaccgc

SEQ ID NO: 454915 - DNA, 20 bp, Artificial
  CRISPR gRNA sequence
atgccgccaccgccggctaa

SEQ ID NO: 454916 - DNA, 20 bp, Artificial
  CRISPR gRNA sequence
tgccgccaccgccggctaat

SEQ ID NO: 454917 - DNA, 20 bp, Artificial
  CRISPR gRNA sequence
atttttgtatttttagtaga

SEQ ID NO: 454918 - DNA, 20 bp, Artificial
  CRISPR gRNA sequence
ttgtatttttagtagagacg

SEQ ID NO: 454919 - DNA, 20 bp, Artificial
  CRISPR gRNA sequence
tgtatttttagtagagacgg

SEQ ID NO: 454920 - DNA, 20 bp, Artificial
  CRISPR gRNA sequence
gtatttttagtagagacggg

SEQ ID NO: 454921 - DNA, 20 bp, Artificial
  CRISPR gRNA sequence
tatttttagtagagacgggg

SEQ ID NO: 454922 - DNA, 20 bp, Artificial
  CRISPR gRNA sequence
ttagtagagacggggtttca

SEQ ID NO: 454923 - DNA, 20 bp, Artificial
  CRISPR gRNA sequence
tagtagagacggggtttcac

SEQ ID NO: 454924 - DNA, 20 bp, Artificial
  CRISPR gRNA sequence
agtagagacggggtttcacc

SEQ ID NO: 454925 - DNA, 20 bp, Artificial
  CRISPR gRNA sequence
gtagagacggggtttcacca

SEQ ID NO: 454926 - DNA, 20 bp, Artificial
  CRISPR gRNA sequence
caccatattggtcaggctgg

SEQ ID NO: 454927 - DNA, 20 bp, Artificial
  CRISPR gRNA sequence
accatattggtcaggctggc

SEQ ID NO: 454928 - DNA, 20 bp, Artificial
  CRISPR gRNA sequence
gtcaggctggcctcgaactc

SEQ ID NO: 454929 - DNA, 20 bp, Artificial
  CRISPR gRNA sequence
gcctcgaactctgcctgacc

SEQ ID NO: 454930 - DNA, 20 bp, Artificial
  CRISPR gRNA sequence
gaactctgcctgacctcagg

SEQ ID NO: 454931 - DNA, 20 bp, Artificial
  CRISPR gRNA sequence
tgcctgacctcaggtgatcc

SEQ ID NO: 454932 - DNA, 20 bp, Artificial
  CRISPR gRNA sequence
cctgacctcaggtgatcctc

SEQ ID NO: 454933 - DNA, 20 bp, Artificial
  CRISPR gRNA sequence
acctcaggtgatcctcaggc

SEQ ID NO: 454934 - DNA, 20 bp, Artificial
  CRISPR gRNA sequence
aggtgatcctcaggcgcccg

SEQ ID NO: 454935 - DNA, 20 bp, Artificial
  CRISPR gRNA sequence
aggcgcccggctgactcact

SEQ ID NO: 454936 - DNA, 20 bp, Artificial
  CRISPR gRNA sequence
actcactctccttgacatta

SEQ ID NO: 454937 - DNA, 20 bp, Artificial
  CRISPR gRNA sequence
actctccttgacattaagga

SEQ ID NO: 454938 - DNA, 20 bp, Artificial
  CRISPR gRNA sequence
tccttgacattaaggaaagg

SEQ ID NO: 454939 - DNA, 20 bp, Artificial
  CRISPR gRNA sequence
cttgacattaaggaaagggt

SEQ ID NO: 454940 - DNA, 20 bp, Artificial
  CRISPR gRNA sequence
gacattaaggaaagggtaaa

SEQ ID NO: 454941 - DNA, 20 bp, Artificial
  CRISPR gRNA sequence
acattaaggaaagggtaaag

SEQ ID NO: 454942 - DNA, 20 bp, Artificial
  CRISPR gRNA sequence
aggaaagggtaaagaatata

SEQ ID NO: 454943 - DNA, 20 bp, Artificial
  CRISPR gRNA sequence
tctttttctttttcattaga

SEQ ID NO: 454944 - DNA, 20 bp, Artificial
  CRISPR gRNA sequence
tttctttttcattagaactg

SEQ ID NO: 454945 - DNA, 20 bp, Artificial
  CRISPR gRNA sequence
ttctttttcattagaactga

SEQ ID NO: 454946 - DNA, 20 bp, Artificial
  CRISPR gRNA sequence
tctttttcattagaactgat

SEQ ID NO: 454947 - DNA, 20 bp, Artificial
  CRISPR gRNA sequence
ctttttcattagaactgata

SEQ ID NO: 454948 - DNA, 20 bp, Artificial
  CRISPR gRNA sequence
tttttcattagaactgatac

SEQ ID NO: 454949 - DNA, 20 bp, Artificial
  CRISPR gRNA sequence
tttcattagaactgatacta

SEQ ID NO: 454950 - DNA, 20 bp, Artificial
  CRISPR gRNA sequence
ttcattagaactgatactat

SEQ ID NO: 454951 - DNA, 20 bp, Artificial
  CRISPR gRNA sequence
tcattagaactgatactatt

SEQ ID NO: 454952 - DNA, 20 bp, Artificial
  CRISPR gRNA sequence
cattagaactgatactattg

SEQ ID NO: 454953 - DNA, 20 bp, Artificial
  CRISPR gRNA sequence
attagaactgatactattgc

SEQ ID NO: 454954 - DNA, 20 bp, Artificial
  CRISPR gRNA sequence
gaactgatactattgcctct

SEQ ID NO: 454955 - DNA, 20 bp, Artificial
  CRISPR gRNA sequence
atactattgcctctctatca

SEQ ID NO: 454956 - DNA, 20 bp, Artificial
  CRISPR gRNA sequence
ttgcctctctatcagacact

SEQ ID NO: 454957 - DNA, 20 bp, Artificial
  CRISPR gRNA sequence
cctctctatcagacactctg

SEQ ID NO: 454958 - DNA, 20 bp, Artificial
  CRISPR gRNA sequence
tctatcagacactctgtctc

SEQ ID NO: 454959 - DNA, 20 bp, Artificial
  CRISPR gRNA sequence
tatcagacactctgtctctg

SEQ ID NO: 454960 - DNA, 20 bp, Artificial
  CRISPR gRNA sequence
tcagacactctgtctctgct

SEQ ID NO: 454961 - DNA, 20 bp, Artificial
  CRISPR gRNA sequence
tgtctctgctatatgtttca

SEQ ID NO: 454962 - DNA, 20 bp, Artificial
  CRISPR gRNA sequence
tctctgctatatgtttcaaa

SEQ ID NO: 454963 - DNA, 20 bp, Artificial
  CRISPR gRNA sequence
tgctatatgtttcaaagagc

SEQ ID NO: 454964 - DNA, 20 bp, Artificial
  CRISPR gRNA sequence
ctatatgtttcaaagagcct

SEQ ID NO: 454965 - DNA, 20 bp, Artificial
  CRISPR gRNA sequence
tatgtttcaaagagcctggc

SEQ ID NO: 454966 - DNA, 20 bp, Artificial
  CRISPR gRNA sequence
caaagagcctggcaatctgc

SEQ ID NO: 454967 - DNA, 20 bp, Artificial
  CRISPR gRNA sequence
aaagagcctggcaatctgcg

SEQ ID NO: 454968 - DNA, 20 bp, Artificial
  CRISPR gRNA sequence
gcaatctgcgcctcaaccta

SEQ ID NO: 454969 - DNA, 20 bp, Artificial
  CRISPR gRNA sequence
cgcctcaacctaagattcct

SEQ ID NO: 454970 - DNA, 20 bp, Artificial
  CRISPR gRNA sequence
aacctaagattcctttaggc

SEQ ID NO: 454971 - DNA, 20 bp, Artificial
  CRISPR gRNA sequence
agattcctttaggctcttat

SEQ ID NO: 454972 - DNA, 20 bp, Artificial
  CRISPR gRNA sequence
ctttaggctcttatatacta

SEQ ID NO: 454973 - DNA, 20 bp, Artificial
  CRISPR gRNA sequence
taggctcttatatactataa

SEQ ID NO: 454974 - DNA, 20 bp, Artificial
  CRISPR gRNA sequence
aggctcttatatactataaa

SEQ ID NO: 454975 - DNA, 20 bp, Artificial
  CRISPR gRNA sequence
ggctcttatatactataaat

SEQ ID NO: 454976 - DNA, 20 bp, Artificial
  CRISPR gRNA sequence
ttatatactataaatttatg

SEQ ID NO: 454977 - DNA, 20 bp, Artificial
  CRISPR gRNA sequence
atatactataaatttatgaa

SEQ ID NO: 454978 - DNA, 20 bp, Artificial
  CRISPR gRNA sequence
tatactataaatttatgaaa

SEQ ID NO: 454979 - DNA, 20 bp, Artificial
  CRISPR gRNA sequence
taaatttatgaaatccaggt

SEQ ID NO: 454980 - DNA, 20 bp, Artificial
  CRISPR gRNA sequence
atgaaatccaggtttgagat

SEQ ID NO: 454981 - DNA, 20 bp, Artificial
  CRISPR gRNA sequence
tgaaatccaggtttgagatc

SEQ ID NO: 454982 - DNA, 20 bp, Artificial
  CRISPR gRNA sequence
gagatccagatactgcaatc

SEQ ID NO: 454983 - DNA, 20 bp, Artificial
  CRISPR gRNA sequence
agatccagatactgcaatct

SEQ ID NO: 454984 - DNA, 20 bp, Artificial
  CRISPR gRNA sequence
caatcttcattaacttcagc

SEQ ID NO: 454985 - DNA, 20 bp, Artificial
  CRISPR gRNA sequence
cattaacttcagcagctagt

SEQ ID NO: 454986 - DNA, 20 bp, Artificial
  CRISPR gRNA sequence
attaacttcagcagctagtt

SEQ ID NO: 454987 - DNA, 20 bp, Artificial
  CRISPR gRNA sequence
acttcagcagctagtttaac

SEQ ID NO: 454988 - DNA, 20 bp, Artificial
  CRISPR gRNA sequence
cagcagctagtttaaccact

SEQ ID NO: 454989 - DNA, 20 bp, Artificial
  CRISPR gRNA sequence
agcagctagtttaaccactc

SEQ ID NO: 454990 - DNA, 20 bp, Artificial
  CRISPR gRNA sequence
gtttaaccactctgtgcctc

SEQ ID NO: 454991 - DNA, 20 bp, Artificial
  CRISPR gRNA sequence
aaccactctgtgcctcaatt

SEQ ID NO: 454992 - DNA, 20 bp, Artificial
  CRISPR gRNA sequence
accactctgtgcctcaattt

SEQ ID NO: 454993 - DNA, 20 bp, Artificial
  CRISPR gRNA sequence
tgtgcctcaatttgtgtatt

SEQ ID NO: 454994 - DNA, 20 bp, Artificial
  CRISPR gRNA sequence
tgcctcaatttgtgtattta

SEQ ID NO: 454995 - DNA, 20 bp, Artificial
  CRISPR gRNA sequence
aatttgtgtatttataaaat

SEQ ID NO: 454996 - DNA, 20 bp, Artificial
  CRISPR gRNA sequence
gtgtatttataaaatgggaa

SEQ ID NO: 454997 - DNA, 20 bp, Artificial
  CRISPR gRNA sequence
tgtatttataaaatgggaag

SEQ ID NO: 454998 - DNA, 20 bp, Artificial
  CRISPR gRNA sequence
ataaaatgggaagagtaata

SEQ ID NO: 454999 - DNA, 20 bp, Artificial
  CRISPR gRNA sequence
taaaatgggaagagtaatac

SEQ ID NO: 455000 - DNA, 20 bp, Artificial
  CRISPR gRNA sequence
ccctctatggctatactgag

SEQ ID NO: 455001 - DNA, 20 bp, Artificial
  CRISPR gRNA sequence
tatggctatactgaggattt

SEQ ID NO: 455002 - DNA, 20 bp, Artificial
  CRISPR gRNA sequence
tggctatactgaggatttga

SEQ ID NO: 455003 - DNA, 20 bp, Artificial
  CRISPR gRNA sequence
tactgaggatttgatataca

SEQ ID NO: 455004 - DNA, 20 bp, Artificial
  CRISPR gRNA sequence
aggatttgatatacagaaaa

SEQ ID NO: 455005 - DNA, 20 bp, Artificial
  CRISPR gRNA sequence
gatatacagaaaagcactct

SEQ ID NO: 455006 - DNA, 20 bp, Artificial
  CRISPR gRNA sequence
atatacagaaaagcactcta

SEQ ID NO: 455007 - DNA, 20 bp, Artificial
  CRISPR gRNA sequence
taacagagaccctatagaag

SEQ ID NO: 455008 - DNA, 20 bp, Artificial
  CRISPR gRNA sequence
acagagaccctatagaagtt

SEQ ID NO: 455009 - DNA, 20 bp, Artificial
  CRISPR gRNA sequence
tagaagttccagctggaaag

SEQ ID NO: 455010 - DNA, 20 bp, Artificial
  CRISPR gRNA sequence
cagctggaaagtagaaataa

SEQ ID NO: 455011 - DNA, 20 bp, Artificial
  CRISPR gRNA sequence
gaaagtagaaataaaatata

SEQ ID NO: 455012 - DNA, 20 bp, Artificial
  CRISPR gRNA sequence
tggagtgaatcaatggctgg

SEQ ID NO: 455013 - DNA, 20 bp, Artificial
  CRISPR gRNA sequence
ggagtgaatcaatggctggg

SEQ ID NO: 455014 - DNA, 20 bp, Artificial
  CRISPR gRNA sequence
gagtgaatcaatggctggga

SEQ ID NO: 455015 - DNA, 20 bp, Artificial
  CRISPR gRNA sequence
ggattgcaggtctccctcag

SEQ ID NO: 455016 - DNA, 20 bp, Artificial
  CRISPR gRNA sequence
caggtctccctcagatatgg

SEQ ID NO: 455017 - DNA, 20 bp, Artificial
  CRISPR gRNA sequence
cctcagatatgggtcttgga

SEQ ID NO: 455018 - DNA, 20 bp, Artificial
  CRISPR gRNA sequence
agatatgggtcttggaagac

SEQ ID NO: 455019 - DNA, 20 bp, Artificial
  CRISPR gRNA sequence
ggaagacccatatctcttac

SEQ ID NO: 455020 - DNA, 20 bp, Artificial
  CRISPR gRNA sequence
gaagacccatatctcttact

SEQ ID NO: 455021 - DNA, 20 bp, Artificial
  CRISPR gRNA sequence
ttactcttgtaggagaatgg

SEQ ID NO: 455022 - DNA, 20 bp, Artificial
  CRISPR gRNA sequence
actcttgtaggagaatggca

SEQ ID NO: 455023 - DNA, 20 bp, Artificial
  CRISPR gRNA sequence
ctcttgtaggagaatggcat

SEQ ID NO: 455024 - DNA, 20 bp, Artificial
  CRISPR gRNA sequence
ttgtaggagaatggcattca

SEQ ID NO: 455025 - DNA, 20 bp, Artificial
  CRISPR gRNA sequence
gtaggagaatggcattcaat

SEQ ID NO: 455026 - DNA, 20 bp, Artificial
  CRISPR gRNA sequence
taggagaatggcattcaata

SEQ ID NO: 455027 - DNA, 20 bp, Artificial
  CRISPR gRNA sequence
aatatgcagggggcagcctc

SEQ ID NO: 455028 - DNA, 20 bp, Artificial
  CRISPR gRNA sequence
catctctgcctcttcaccgt

SEQ ID NO: 455029 - DNA, 20 bp, Artificial
  CRISPR gRNA sequence
tgcctcttcaccgttttcat

SEQ ID NO: 455030 - DNA, 20 bp, Artificial
  CRISPR gRNA sequence
cctcttcaccgttttcatga

SEQ ID NO: 455031 - DNA, 20 bp, Artificial
  CRISPR gRNA sequence
ttcaccgttttcatgagagt

SEQ ID NO: 455032 - DNA, 20 bp, Artificial
  CRISPR gRNA sequence
caccgttttcatgagagtga

SEQ ID NO: 455033 - DNA, 20 bp, Artificial
  CRISPR gRNA sequence
accgttttcatgagagtgaa

SEQ ID NO: 455034 - DNA, 20 bp, Artificial
  CRISPR gRNA sequence
tcatgagagtgaatttagtt

SEQ ID NO: 455035 - DNA, 20 bp, Artificial
  CRISPR gRNA sequence
catgagagtgaatttagttt

SEQ ID NO: 455036 - DNA, 20 bp, Artificial
  CRISPR gRNA sequence
atgagagtgaatttagttta

SEQ ID NO: 455037 - DNA, 20 bp, Artificial
  CRISPR gRNA sequence
agtttactatgtataccaag

SEQ ID NO: 455038 - DNA, 20 bp, Artificial
  CRISPR gRNA sequence
gtttactatgtataccaagg

SEQ ID NO: 455039 - DNA, 20 bp, Artificial
  CRISPR gRNA sequence
actatgtataccaaggggag

SEQ ID NO: 455040 - DNA, 20 bp, Artificial
  CRISPR gRNA sequence
ctatgtataccaaggggagt

SEQ ID NO: 455041 - DNA, 20 bp, Artificial
  CRISPR gRNA sequence
tgtataccaaggggagtctt

SEQ ID NO: 455042 - DNA, 20 bp, Artificial
  CRISPR gRNA sequence
aaaaggaaaagcaagtcata

SEQ ID NO: 455043 - DNA, 20 bp, Artificial
  CRISPR gRNA sequence
aaaggaaaagcaagtcatag

SEQ ID NO: 455044 - DNA, 20 bp, Artificial
  CRISPR gRNA sequence
ccaagggagtgggggagggg

SEQ ID NO: 455045 - DNA, 20 bp, Artificial
  CRISPR gRNA sequence
gcagcctcagcatctgccgg

SEQ ID NO: 455046 - DNA, 20 bp, Artificial
  CRISPR gRNA sequence
agcatctgccggatgagttt

SEQ ID NO: 455047 - DNA, 20 bp, Artificial
  CRISPR gRNA sequence
ccggatgagttttcagcaga

SEQ ID NO: 455048 - DNA, 20 bp, Artificial
  CRISPR gRNA sequence
tcagcagagagctggattta

SEQ ID NO: 455049 - DNA, 20 bp, Artificial
  CRISPR gRNA sequence
cagcagagagctggatttaa

SEQ ID NO: 455050 - DNA, 20 bp, Artificial
  CRISPR gRNA sequence
agcagagagctggatttaac

SEQ ID NO: 455051 - DNA, 20 bp, Artificial
  CRISPR gRNA sequence
gatttaaccgaggttggggt

SEQ ID NO: 455052 - DNA, 20 bp, Artificial
  CRISPR gRNA sequence
aaccgaggttggggttttgc

SEQ ID NO: 455053 - DNA, 20 bp, Artificial
  CRISPR gRNA sequence
accgaggttggggttttgcg

SEQ ID NO: 455054 - DNA, 20 bp, Artificial
  CRISPR gRNA sequence
gggttttgcgaggatccatc

SEQ ID NO: 455055 - DNA, 20 bp, Artificial
  CRISPR gRNA sequence
tgcgaggatccatcacagta

SEQ ID NO: 455056 - DNA, 20 bp, Artificial
  CRISPR gRNA sequence
gcgaggatccatcacagtag

SEQ ID NO: 455057 - DNA, 20 bp, Artificial
  CRISPR gRNA sequence
cgaggatccatcacagtagg

SEQ ID NO: 455058 - DNA, 20 bp, Artificial
  CRISPR gRNA sequence
agggagctgagggtggatat

SEQ ID NO: 455059 - DNA, 20 bp, Artificial
  CRISPR gRNA sequence
agggtggatataagggagag

SEQ ID NO: 455060 - DNA, 20 bp, Artificial
  CRISPR gRNA sequence
taataatggactacaaaata

SEQ ID NO: 455061 - DNA, 20 bp, Artificial
  CRISPR gRNA sequence
caaaatataaactacagaag

SEQ ID NO: 455062 - DNA, 20 bp, Artificial
  CRISPR gRNA sequence
cagaaggaagtgaagtttga

SEQ ID NO: 455063 - DNA, 20 bp, Artificial
  CRISPR gRNA sequence
gaggagagtgaggggcagta

SEQ ID NO: 455064 - DNA, 20 bp, Artificial
  CRISPR gRNA sequence
aggagagtgaggggcagtac

SEQ ID NO: 455065 - DNA, 20 bp, Artificial
  CRISPR gRNA sequence
gcagggccaatgcattgcaa

SEQ ID NO: 455066 - DNA, 20 bp, Artificial
  CRISPR gRNA sequence
caaaattaggtcagagacac

SEQ ID NO: 455067 - DNA, 20 bp, Artificial
  CRISPR gRNA sequence
ggtcagagacacccatcgag

SEQ ID NO: 455068 - DNA, 20 bp, Artificial
  CRISPR gRNA sequence
ggttaacccaactattttct

SEQ ID NO: 455069 - DNA, 20 bp, Artificial
  CRISPR gRNA sequence
acccaactattttctccact

SEQ ID NO: 455070 - DNA, 20 bp, Artificial
  CRISPR gRNA sequence
ttttctccacttctgtatcc

SEQ ID NO: 455071 - DNA, 20 bp, Artificial
  CRISPR gRNA sequence
tctccacttctgtatccagg

SEQ ID NO: 455072 - DNA, 20 bp, Artificial
  CRISPR gRNA sequence
ctccacttctgtatccaggt

SEQ ID NO: 455073 - DNA, 20 bp, Artificial
  CRISPR gRNA sequence
tccacttctgtatccaggtt

SEQ ID NO: 455074 - DNA, 20 bp, Artificial
  CRISPR gRNA sequence
cacttctgtatccaggttac

SEQ ID NO: 455075 - DNA, 20 bp, Artificial
  CRISPR gRNA sequence
ctgtatccaggttacagatt

SEQ ID NO: 455076 - DNA, 20 bp, Artificial
  CRISPR gRNA sequence
tgtatccaggttacagatta

SEQ ID NO: 455077 - DNA, 20 bp, Artificial
  CRISPR gRNA sequence
tatccaggttacagattact

SEQ ID NO: 455078 - DNA, 20 bp, Artificial
  CRISPR gRNA sequence
cagattacttacagggaaaa

SEQ ID NO: 455079 - DNA, 20 bp, Artificial
  CRISPR gRNA sequence
cttacagggaaaatcaagtg

SEQ ID NO: 455080 - DNA, 20 bp, Artificial
  CRISPR gRNA sequence
acagggaaaatcaagtgggc

SEQ ID NO: 455081 - DNA, 20 bp, Artificial
  CRISPR gRNA sequence
cagggaaaatcaagtgggca

SEQ ID NO: 455082 - DNA, 20 bp, Artificial
  CRISPR gRNA sequence
gcaccatcagagtcatggtc

SEQ ID NO: 455083 - DNA, 20 bp, Artificial
  CRISPR gRNA sequence
tggatatcaatggtccctca

SEQ ID NO: 455084 - DNA, 20 bp, Artificial
  CRISPR gRNA sequence
ggatatcaatggtccctcaa

SEQ ID NO: 455085 - DNA, 20 bp, Artificial
  CRISPR gRNA sequence
gatatcaatggtccctcaat

SEQ ID NO: 455086 - DNA, 20 bp, Artificial
  CRISPR gRNA sequence
aataattagtctgtttctcc

SEQ ID NO: 455087 - DNA, 20 bp, Artificial
  CRISPR gRNA sequence
gtctgtttctccagtccatt

SEQ ID NO: 455088 - DNA, 20 bp, Artificial
  CRISPR gRNA sequence
tttctccagtccattctcac

SEQ ID NO: 455089 - DNA, 20 bp, Artificial
  CRISPR gRNA sequence
ctccagtccattctcactcc

SEQ ID NO: 455090 - DNA, 20 bp, Artificial
  CRISPR gRNA sequence
tccagtccattctcactcca

SEQ ID NO: 455091 - DNA, 20 bp, Artificial
  CRISPR gRNA sequence
cagtccattctcactccatt

SEQ ID NO: 455092 - DNA, 20 bp, Artificial
  CRISPR gRNA sequence
tcactccatttccacacagt

SEQ ID NO: 455093 - DNA, 20 bp, Artificial
  CRISPR gRNA sequence
actccatttccacacagtgg

SEQ ID NO: 455094 - DNA, 20 bp, Artificial
  CRISPR gRNA sequence
catttccacacagtggctgt

SEQ ID NO: 455095 - DNA, 20 bp, Artificial
  CRISPR gRNA sequence
ccacacagtggctgttttta

SEQ ID NO: 455096 - DNA, 20 bp, Artificial
  CRISPR gRNA sequence
cacacagtggctgtttttaa

SEQ ID NO: 455097 - DNA, 20 bp, Artificial
  CRISPR gRNA sequence
tttttaatcatctctggtat

SEQ ID NO: 455098 - DNA, 20 bp, Artificial
  CRISPR gRNA sequence
ttaatcatctctggtatttc

SEQ ID NO: 455099 - DNA, 20 bp, Artificial
  CRISPR gRNA sequence
taatcatctctggtatttct

SEQ ID NO: 455100 - DNA, 20 bp, Artificial
  CRISPR gRNA sequence
aatcatctctggtatttctg

SEQ ID NO: 455101 - DNA, 20 bp, Artificial
  CRISPR gRNA sequence
atcatctctggtatttctgt

SEQ ID NO: 455102 - DNA, 20 bp, Artificial
  CRISPR gRNA sequence
tggtatttctgtggtctctc

SEQ ID NO: 455103 - DNA, 20 bp, Artificial
  CRISPR gRNA sequence
gtatttctgtggtctctctc

SEQ ID NO: 455104 - DNA, 20 bp, Artificial
  CRISPR gRNA sequence
ctgtggtctctctcatccta

SEQ ID NO: 455105 - DNA, 20 bp, Artificial
  CRISPR gRNA sequence
tgtggtctctctcatcctat

SEQ ID NO: 455106 - DNA, 20 bp, Artificial
  CRISPR gRNA sequence
tggtctctctcatcctatat

SEQ ID NO: 455107 - DNA, 20 bp, Artificial
  CRISPR gRNA sequence
tctcatcctatatttcttag

SEQ ID NO: 455108 - DNA, 20 bp, Artificial
  CRISPR gRNA sequence
tcatcctatatttcttagaa

SEQ ID NO: 455109 - DNA, 20 bp, Artificial
  CRISPR gRNA sequence
atcctatatttcttagaaaa

SEQ ID NO: 455110 - DNA, 20 bp, Artificial
  CRISPR gRNA sequence
tatttcttagaaaaactttt

SEQ ID NO: 455111 - DNA, 20 bp, Artificial
  CRISPR gRNA sequence
cttagaaaaacttttactca

SEQ ID NO: 455112 - DNA, 20 bp, Artificial
  CRISPR gRNA sequence
ttagaaaaacttttactcat

SEQ ID NO: 455113 - DNA, 20 bp, Artificial
  CRISPR gRNA sequence
agaaaaacttttactcatcc

SEQ ID NO: 455114 - DNA, 20 bp, Artificial
  CRISPR gRNA sequence
gaaaaacttttactcatcct

SEQ ID NO: 455115 - DNA, 20 bp, Artificial
  CRISPR gRNA sequence
ttactcatccttcaagtcag

SEQ ID NO: 455116 - DNA, 20 bp, Artificial
  CRISPR gRNA sequence
tactcatccttcaagtcagc

SEQ ID NO: 455117 - DNA, 20 bp, Artificial
  CRISPR gRNA sequence
actcatccttcaagtcagct

SEQ ID NO: 455118 - DNA, 20 bp, Artificial
  CRISPR gRNA sequence
ctcatccttcaagtcagctc

SEQ ID NO: 455119 - DNA, 20 bp, Artificial
  CRISPR gRNA sequence
atccttcaagtcagctccag

SEQ ID NO: 455120 - DNA, 20 bp, Artificial
  CRISPR gRNA sequence
caagtcagctccagcactaa

SEQ ID NO: 455121 - DNA, 20 bp, Artificial
  CRISPR gRNA sequence
aagtcagctccagcactaac

SEQ ID NO: 455122 - DNA, 20 bp, Artificial
  CRISPR gRNA sequence
cagcactaacttcactgtga

SEQ ID NO: 455123 - DNA, 20 bp, Artificial
  CRISPR gRNA sequence
acttcactgtgaagtttccc

SEQ ID NO: 455124 - DNA, 20 bp, Artificial
  CRISPR gRNA sequence
cactgtgaagtttccctgat

SEQ ID NO: 455125 - DNA, 20 bp, Artificial
  CRISPR gRNA sequence
actgtgaagtttccctgatg

SEQ ID NO: 455126 - DNA, 20 bp, Artificial
  CRISPR gRNA sequence
tgaagtttccctgatgcttc

SEQ ID NO: 455127 - DNA, 20 bp, Artificial
  CRISPR gRNA sequence
ccctgatgcttcagactcag

SEQ ID NO: 455128 - DNA, 20 bp, Artificial
  CRISPR gRNA sequence
cctgatgcttcagactcagg

SEQ ID NO: 455129 - DNA, 20 bp, Artificial
  CRISPR gRNA sequence
atgcttcagactcaggaatc

SEQ ID NO: 455130 - DNA, 20 bp, Artificial
  CRISPR gRNA sequence
cagactcaggaatctctaag

SEQ ID NO: 455131 - DNA, 20 bp, Artificial
  CRISPR gRNA sequence
agactcaggaatctctaaga

SEQ ID NO: 455132 - DNA, 20 bp, Artificial
  CRISPR gRNA sequence
aggaatctctaagattcctc

SEQ ID NO: 455133 - DNA, 20 bp, Artificial
  CRISPR gRNA sequence
taagattcctcaattataat

SEQ ID NO: 455134 - DNA, 20 bp, Artificial
  CRISPR gRNA sequence
agattcctcaattataataa

SEQ ID NO: 455135 - DNA, 20 bp, Artificial
  CRISPR gRNA sequence
ctcaattataataactgtgg

SEQ ID NO: 455136 - DNA, 20 bp, Artificial
  CRISPR gRNA sequence
aattataataactgtggaat

SEQ ID NO: 455137 - DNA, 20 bp, Artificial
  CRISPR gRNA sequence
taataactgtggaattaaat

SEQ ID NO: 455138 - DNA, 20 bp, Artificial
  CRISPR gRNA sequence
tggaattaaattgtaacttt

SEQ ID NO: 455139 - DNA, 20 bp, Artificial
  CRISPR gRNA sequence
aattgtaactttttgctaat

SEQ ID NO: 455140 - DNA, 20 bp, Artificial
  CRISPR gRNA sequence
taactttttgctaatttgtt

SEQ ID NO: 455141 - DNA, 20 bp, Artificial
  CRISPR gRNA sequence
tttgctaatttgtttttaca

SEQ ID NO: 455142 - DNA, 20 bp, Artificial
  CRISPR gRNA sequence
ttgctaatttgtttttacat

SEQ ID NO: 455143 - DNA, 20 bp, Artificial
  CRISPR gRNA sequence
tgctaatttgtttttacatt

SEQ ID NO: 455144 - DNA, 20 bp, Artificial
  CRISPR gRNA sequence
gctaatttgtttttacatta

SEQ ID NO: 455145 - DNA, 20 bp, Artificial
  CRISPR gRNA sequence
ctaatttgtttttacattag

SEQ ID NO: 455146 - DNA, 20 bp, Artificial
  CRISPR gRNA sequence
atttgtttttacattaggct

SEQ ID NO: 455147 - DNA, 20 bp, Artificial
  CRISPR gRNA sequence
gtttttacattaggctttaa

SEQ ID NO: 455148 - DNA, 20 bp, Artificial
  CRISPR gRNA sequence
tttttacattaggctttaaa

SEQ ID NO: 455149 - DNA, 20 bp, Artificial
  CRISPR gRNA sequence
ttacattaggctttaaactc

SEQ ID NO: 455150 - DNA, 20 bp, Artificial
  CRISPR gRNA sequence
tacattaggctttaaactct

SEQ ID NO: 455151 - DNA, 20 bp, Artificial
  CRISPR gRNA sequence
acattaggctttaaactctg

SEQ ID NO: 455152 - DNA, 20 bp, Artificial
  CRISPR gRNA sequence
cattaggctttaaactctga

SEQ ID NO: 455153 - DNA, 20 bp, Artificial
  CRISPR gRNA sequence
ggctttaaactctgagagtg

SEQ ID NO: 455154 - DNA, 20 bp, Artificial
  CRISPR gRNA sequence
taaactctgagagtggccag

SEQ ID NO: 455155 - DNA, 20 bp, Artificial
  CRISPR gRNA sequence
aaactctgagagtggccagg

SEQ ID NO: 455156 - DNA, 20 bp, Artificial
  CRISPR gRNA sequence
aactctgagagtggccaggc

SEQ ID NO: 455157 - DNA, 20 bp, Artificial
  CRISPR gRNA sequence
tgagagtggccaggcacagt

SEQ ID NO: 455158 - DNA, 20 bp, Artificial
  CRISPR gRNA sequence
agagtggccaggcacagtgg

SEQ ID NO: 455159 - DNA, 20 bp, Artificial
  CRISPR gRNA sequence
atgcctgtaatcccagcagt

SEQ ID NO: 455160 - DNA, 20 bp, Artificial
  CRISPR gRNA sequence
taatcccagcagtttgggag

SEQ ID NO: 455161 - DNA, 20 bp, Artificial
  CRISPR gRNA sequence
gggaggcagaggcaggaggg

SEQ ID NO: 455162 - DNA, 20 bp, Artificial
  CRISPR gRNA sequence
ggaggcagaggcaggagggt

SEQ ID NO: 455163 - DNA, 20 bp, Artificial
  CRISPR gRNA sequence
cttgatgcctagagttcaag

SEQ ID NO: 455164 - DNA, 20 bp, Artificial
  CRISPR gRNA sequence
gatgcctagagttcaagact

SEQ ID NO: 455165 - DNA, 20 bp, Artificial
  CRISPR gRNA sequence
atgcctagagttcaagacta

SEQ ID NO: 455166 - DNA, 20 bp, Artificial
  CRISPR gRNA sequence
gagttcaagactagcctgga

SEQ ID NO: 455167 - DNA, 20 bp, Artificial
  CRISPR gRNA sequence
aagactagcctggacaacat

SEQ ID NO: 455168 - DNA, 20 bp, Artificial
  CRISPR gRNA sequence
gcctggacaacatagtgaga

SEQ ID NO: 455169 - DNA, 20 bp, Artificial
  CRISPR gRNA sequence
gacaacatagtgagaatctg

SEQ ID NO: 455170 - DNA, 20 bp, Artificial
  CRISPR gRNA sequence
tctctacaaaataaaaaatt

SEQ ID NO: 455171 - DNA, 20 bp, Artificial
  CRISPR gRNA sequence
tacaaaataaaaaattagcc

SEQ ID NO: 455172 - DNA, 20 bp, Artificial
  CRISPR gRNA sequence
caaaataaaaaattagccag

SEQ ID NO: 455173 - DNA, 20 bp, Artificial
  CRISPR gRNA sequence
gccaggcatagtggtgcata

SEQ ID NO: 455174 - DNA, 20 bp, Artificial
  CRISPR gRNA sequence
tagtgttagctattcggaag

SEQ ID NO: 455175 - DNA, 20 bp, Artificial
  CRISPR gRNA sequence
gctattcggaaggcggaagc

SEQ ID NO: 455176 - DNA, 20 bp, Artificial
  CRISPR gRNA sequence
ttcggaaggcggaagcagga

SEQ ID NO: 455177 - DNA, 20 bp, Artificial
  CRISPR gRNA sequence
ggaaggcggaagcaggagga

SEQ ID NO: 455178 - DNA, 20 bp, Artificial
  CRISPR gRNA sequence
cttgagcccaggagttcaaa

SEQ ID NO: 455179 - DNA, 20 bp, Artificial
  CRISPR gRNA sequence
gagcccaggagttcaaaggt

SEQ ID NO: 455180 - DNA, 20 bp, Artificial
  CRISPR gRNA sequence
agcccaggagttcaaaggtg

SEQ ID NO: 455181 - DNA, 20 bp, Artificial
  CRISPR gRNA sequence
aaaggtgcagtgagttacga

SEQ ID NO: 455182 - DNA, 20 bp, Artificial
  CRISPR gRNA sequence
cgattgtgccactgccctcc

SEQ ID NO: 455183 - DNA, 20 bp, Artificial
  CRISPR gRNA sequence
tgccactgccctccagcctg

SEQ ID NO: 455184 - DNA, 20 bp, Artificial
  CRISPR gRNA sequence
ccctccagcctgggtgacac

SEQ ID NO: 455185 - DNA, 20 bp, Artificial
  CRISPR gRNA sequence
cagcctgggtgacacagcaa

SEQ ID NO: 455186 - DNA, 20 bp, Artificial
  CRISPR gRNA sequence
ggtgacacagcaagaccttg

SEQ ID NO: 455187 - DNA, 20 bp, Artificial
  CRISPR gRNA sequence
gttttaaaaaaaaatttttt

SEQ ID NO: 455188 - DNA, 20 bp, Artificial
  CRISPR gRNA sequence
ttttaaaaaaaaatttttta

SEQ ID NO: 455189 - DNA, 20 bp, Artificial
  CRISPR gRNA sequence
taaaaaaaaattttttaaat

SEQ ID NO: 455190 - DNA, 20 bp, Artificial
  CRISPR gRNA sequence
aaaaaaaaattttttaaatt

SEQ ID NO: 455191 - DNA, 20 bp, Artificial
  CRISPR gRNA sequence
aaaaaaaattttttaaatta

SEQ ID NO: 455192 - DNA, 20 bp, Artificial
  CRISPR gRNA sequence
tttaaattaaaaatccccgg

SEQ ID NO: 455193 - DNA, 20 bp, Artificial
  CRISPR gRNA sequence
ttaaattaaaaatccccggt

SEQ ID NO: 455194 - DNA, 20 bp, Artificial
  CRISPR gRNA sequence
taaattaaaaatccccggtc

SEQ ID NO: 455195 - DNA, 20 bp, Artificial
  CRISPR gRNA sequence
aaattaaaaatccccggtca

SEQ ID NO: 455196 - DNA, 20 bp, Artificial
  CRISPR gRNA sequence
aattaaaaatccccggtcat

SEQ ID NO: 455197 - DNA, 20 bp, Artificial
  CRISPR gRNA sequence
aaaatccccggtcatctaat

SEQ ID NO: 455198 - DNA, 20 bp, Artificial
  CRISPR gRNA sequence
atggttaggggaaaaaaaag

SEQ ID NO: 455199 - DNA, 20 bp, Artificial
  CRISPR gRNA sequence
ggggaaaaaaaagttctgac

SEQ ID NO: 455200 - DNA, 20 bp, Artificial
  CRISPR gRNA sequence
tgacagtagggctcacgtcc

SEQ ID NO: 455201 - DNA, 20 bp, Artificial
  CRISPR gRNA sequence
acagtagggctcacgtccta

SEQ ID NO: 455202 - DNA, 20 bp, Artificial
  CRISPR gRNA sequence
acgtcctagtcctcatagcc

SEQ ID NO: 455203 - DNA, 20 bp, Artificial
  CRISPR gRNA sequence
gtcctcatagccccagcagg

SEQ ID NO: 455204 - DNA, 20 bp, Artificial
  CRISPR gRNA sequence
atagccccagcagggcttgg

SEQ ID NO: 455205 - DNA, 20 bp, Artificial
  CRISPR gRNA sequence
ggcagagtgaatacctaaac

SEQ ID NO: 455206 - DNA, 20 bp, Artificial
  CRISPR gRNA sequence
gcagagtgaatacctaaacg

SEQ ID NO: 455207 - DNA, 20 bp, Artificial
  CRISPR gRNA sequence
aacgtatttgttaagtggag

SEQ ID NO: 455208 - DNA, 20 bp, Artificial
  CRISPR gRNA sequence
gttaagtggaggaacaaata

SEQ ID NO: 455209 - DNA, 20 bp, Artificial
  CRISPR gRNA sequence
ttaagtggaggaacaaataa

SEQ ID NO: 455210 - DNA, 20 bp, Artificial
  CRISPR gRNA sequence
agtggaggaacaaataaacc

SEQ ID NO: 455211 - DNA, 20 bp, Artificial
  CRISPR gRNA sequence
tgaattaatggatgctttga

SEQ ID NO: 455212 - DNA, 20 bp, Artificial
  CRISPR gRNA sequence
atggatgctttgagcatatt

SEQ ID NO: 455213 - DNA, 20 bp, Artificial
  CRISPR gRNA sequence
tgagcatattatttagtccc

SEQ ID NO: 455214 - DNA, 20 bp, Artificial
  CRISPR gRNA sequence
gagcatattatttagtccct

SEQ ID NO: 455215 - DNA, 20 bp, Artificial
  CRISPR gRNA sequence
agcatattatttagtccctt

SEQ ID NO: 455216 - DNA, 20 bp, Artificial
  CRISPR gRNA sequence
tttagtcccttaattttcat

SEQ ID NO: 455217 - DNA, 20 bp, Artificial
  CRISPR gRNA sequence
agtcccttaattttcatttt

SEQ ID NO: 455218 - DNA, 20 bp, Artificial
  CRISPR gRNA sequence
gtcccttaattttcattttc

SEQ ID NO: 455219 - DNA, 20 bp, Artificial
  CRISPR gRNA sequence
aattttcattttccagatga

SEQ ID NO: 455220 - DNA, 20 bp, Artificial
  CRISPR gRNA sequence
attttcattttccagatgaa

SEQ ID NO: 455221 - DNA, 20 bp, Artificial
  CRISPR gRNA sequence
tcattttccagatgaataaa

SEQ ID NO: 455222 - DNA, 20 bp, Artificial
  CRISPR gRNA sequence
cattttccagatgaataaac

SEQ ID NO: 455223 - DNA, 20 bp, Artificial
  CRISPR gRNA sequence
attttccagatgaataaact

SEQ ID NO: 455224 - DNA, 20 bp, Artificial
  CRISPR gRNA sequence
tccagatgaataaactactg

SEQ ID NO: 455225 - DNA, 20 bp, Artificial
  CRISPR gRNA sequence
ccagatgaataaactactgc

SEQ ID NO: 455226 - DNA, 20 bp, Artificial
  CRISPR gRNA sequence
cagatgaataaactactgcc

SEQ ID NO: 455227 - DNA, 20 bp, Artificial
  CRISPR gRNA sequence
ctgcccaaggagttaggtaa

SEQ ID NO: 455228 - DNA, 20 bp, Artificial
  CRISPR gRNA sequence
cccaaggagttaggtaactt

SEQ ID NO: 455229 - DNA, 20 bp, Artificial
  CRISPR gRNA sequence
ggtaacttgcttacagtcac

SEQ ID NO: 455230 - DNA, 20 bp, Artificial
  CRISPR gRNA sequence
gcttacagtcacacagccat

SEQ ID NO: 455231 - DNA, 20 bp, Artificial
  CRISPR gRNA sequence
cttacagtcacacagccatc

SEQ ID NO: 455232 - DNA, 20 bp, Artificial
  CRISPR gRNA sequence
acagtcacacagccatcgat

SEQ ID NO: 455233 - DNA, 20 bp, Artificial
  CRISPR gRNA sequence
cagtcacacagccatcgata

SEQ ID NO: 455234 - DNA, 20 bp, Artificial
  CRISPR gRNA sequence
gaatttgtatttcctgtctg

SEQ ID NO: 455235 - DNA, 20 bp, Artificial
  CRISPR gRNA sequence
gtatttcctgtctgccagca

SEQ ID NO: 455236 - DNA, 20 bp, Artificial
  CRISPR gRNA sequence
tatttcctgtctgccagcac

SEQ ID NO: 455237 - DNA, 20 bp, Artificial
  CRISPR gRNA sequence
cctgtctgccagcactactg

SEQ ID NO: 455238 - DNA, 20 bp, Artificial
  CRISPR gRNA sequence
ctgtctgccagcactactgc

SEQ ID NO: 455239 - DNA, 20 bp, Artificial
  CRISPR gRNA sequence
tctgccagcactactgccag

SEQ ID NO: 455240 - DNA, 20 bp, Artificial
  CRISPR gRNA sequence
ccagcactactgccaggttc

SEQ ID NO: 455241 - DNA, 20 bp, Artificial
  CRISPR gRNA sequence
ctgccaggttctgcttcagt

SEQ ID NO: 455242 - DNA, 20 bp, Artificial
  CRISPR gRNA sequence
ccaggttctgcttcagtcct

SEQ ID NO: 455243 - DNA, 20 bp, Artificial
  CRISPR gRNA sequence
tgcttcagtccttccttgaa

SEQ ID NO: 455244 - DNA, 20 bp, Artificial
  CRISPR gRNA sequence
cttcagtccttccttgaaga

SEQ ID NO: 455245 - DNA, 20 bp, Artificial
  CRISPR gRNA sequence
cagtccttccttgaagactt

SEQ ID NO: 455246 - DNA, 20 bp, Artificial
  CRISPR gRNA sequence
agtccttccttgaagacttc

SEQ ID NO: 455247 - DNA, 20 bp, Artificial
  CRISPR gRNA sequence
ccttgaagacttctagtgat

SEQ ID NO: 455248 - DNA, 20 bp, Artificial
  CRISPR gRNA sequence
cttgaagacttctagtgata

SEQ ID NO: 455249 - DNA, 20 bp, Artificial
  CRISPR gRNA sequence
gaagacttctagtgataagg

SEQ ID NO: 455250 - DNA, 20 bp, Artificial
  CRISPR gRNA sequence
aagacttctagtgataagga

SEQ ID NO: 455251 - DNA, 20 bp, Artificial
  CRISPR gRNA sequence
ctagtgataaggagcagtta

SEQ ID NO: 455252 - DNA, 20 bp, Artificial
  CRISPR gRNA sequence
tagtgataaggagcagttac

SEQ ID NO: 455253 - DNA, 20 bp, Artificial
  CRISPR gRNA sequence
gtgataaggagcagttacgg

SEQ ID NO: 455254 - DNA, 20 bp, Artificial
  CRISPR gRNA sequence
cggtgaaattcacagaatgc

SEQ ID NO: 455255 - DNA, 20 bp, Artificial
  CRISPR gRNA sequence
acagaatgctacctgacctc

SEQ ID NO: 455256 - DNA, 20 bp, Artificial
  CRISPR gRNA sequence
cctgacctctgggtaattct

SEQ ID NO: 455257 - DNA, 20 bp, Artificial
  CRISPR gRNA sequence
acctctgggtaattcttccc

SEQ ID NO: 455258 - DNA, 20 bp, Artificial
  CRISPR gRNA sequence
tgggtaattcttccctttcc

SEQ ID NO: 455259 - DNA, 20 bp, Artificial
  CRISPR gRNA sequence
ggtaattcttccctttccat

SEQ ID NO: 455260 - DNA, 20 bp, Artificial
  CRISPR gRNA sequence
ttccctttccattccaggat

SEQ ID NO: 455261 - DNA, 20 bp, Artificial
  CRISPR gRNA sequence
ccctttccattccaggatgc

SEQ ID NO: 455262 - DNA, 20 bp, Artificial
  CRISPR gRNA sequence
cctttccattccaggatgca

SEQ ID NO: 455263 - DNA, 20 bp, Artificial
  CRISPR gRNA sequence
tccattccaggatgcattaa

SEQ ID NO: 455264 - DNA, 20 bp, Artificial
  CRISPR gRNA sequence
ccattccaggatgcattaac

SEQ ID NO: 455265 - DNA, 20 bp, Artificial
  CRISPR gRNA sequence
cattccaggatgcattaaca

SEQ ID NO: 455266 - DNA, 20 bp, Artificial
  CRISPR gRNA sequence
caggatgcattaacatcacc

SEQ ID NO: 455267 - DNA, 20 bp, Artificial
  CRISPR gRNA sequence
acatcaccagctcagcttcc

SEQ ID NO: 455268 - DNA, 20 bp, Artificial
  CRISPR gRNA sequence
agcttcccaggaaggaacgc

SEQ ID NO: 455269 - DNA, 20 bp, Artificial
  CRISPR gRNA sequence
cccaggaaggaacgcgacta

SEQ ID NO: 455270 - DNA, 20 bp, Artificial
  CRISPR gRNA sequence
ccaggaaggaacgcgactaa

SEQ ID NO: 455271 - DNA, 20 bp, Artificial
  CRISPR gRNA sequence
aacttaatctgtactgtatg

SEQ ID NO: 455272 - DNA, 20 bp, Artificial
  CRISPR gRNA sequence
aatctgtactgtatggcata

SEQ ID NO: 455273 - DNA, 20 bp, Artificial
  CRISPR gRNA sequence
atctgtactgtatggcataa

SEQ ID NO: 455274 - DNA, 20 bp, Artificial
  CRISPR gRNA sequence
tactgtatggcataagaaag

SEQ ID NO: 455275 - DNA, 20 bp, Artificial
  CRISPR gRNA sequence
tatggcataagaaagaagag

SEQ ID NO: 455276 - DNA, 20 bp, Artificial
  CRISPR gRNA sequence
aggggtttgtagtgtttttg

SEQ ID NO: 455277 - DNA, 20 bp, Artificial
  CRISPR gRNA sequence
gtagtgtttttgtgcaagga

SEQ ID NO: 455278 - DNA, 20 bp, Artificial
  CRISPR gRNA sequence
tagtgtttttgtgcaaggac

SEQ ID NO: 455279 - DNA, 20 bp, Artificial
  CRISPR gRNA sequence
ttgtgcaaggacaggtctgg

SEQ ID NO: 455280 - DNA, 20 bp, Artificial
  CRISPR gRNA sequence
tgtgcaaggacaggtctgga

SEQ ID NO: 455281 - DNA, 20 bp, Artificial
  CRISPR gRNA sequence
gtgcaaggacaggtctggag

SEQ ID NO: 455282 - DNA, 20 bp, Artificial
  CRISPR gRNA sequence
tgcaaggacaggtctggaga

SEQ ID NO: 455283 - DNA, 20 bp, Artificial
  CRISPR gRNA sequence
gagactgttctcctgagacc

SEQ ID NO: 455284 - DNA, 20 bp, Artificial
  CRISPR gRNA sequence
ttctcctgagaccagtttaa

SEQ ID NO: 455285 - DNA, 20 bp, Artificial
  CRISPR gRNA sequence
tcctgagaccagtttaaaac

SEQ ID NO: 455286 - DNA, 20 bp, Artificial
  CRISPR gRNA sequence
ctgagaccagtttaaaacag

SEQ ID NO: 455287 - DNA, 20 bp, Artificial
  CRISPR gRNA sequence
agaccagtttaaaacagctg

SEQ ID NO: 455288 - DNA, 20 bp, Artificial
  CRISPR gRNA sequence
aaaacagctgagacttaaaa

SEQ ID NO: 455289 - DNA, 20 bp, Artificial
  CRISPR gRNA sequence
aaacagctgagacttaaaag

SEQ ID NO: 455290 - DNA, 20 bp, Artificial
  CRISPR gRNA sequence
agacttaaaagggatcctgg

SEQ ID NO: 455291 - DNA, 20 bp, Artificial
  CRISPR gRNA sequence
aaaagggatcctgggataga

SEQ ID NO: 455292 - DNA, 20 bp, Artificial
  CRISPR gRNA sequence
aaagggatcctgggatagat

SEQ ID NO: 455293 - DNA, 20 bp, Artificial
  CRISPR gRNA sequence
ggatagatggtgttggtgaa

SEQ ID NO: 455294 - DNA, 20 bp, Artificial
  CRISPR gRNA sequence
gtgaaatatcatctcagttg

SEQ ID NO: 455295 - DNA, 20 bp, Artificial
  CRISPR gRNA sequence
agttgatgttcaccataagc

SEQ ID NO: 455296 - DNA, 20 bp, Artificial
  CRISPR gRNA sequence
atgttcaccataagccaagt

SEQ ID NO: 455297 - DNA, 20 bp, Artificial
  CRISPR gRNA sequence
accataagccaagtcacacc

SEQ ID NO: 455298 - DNA, 20 bp, Artificial
  CRISPR gRNA sequence
cacagtgggacctaccagtg

SEQ ID NO: 455299 - DNA, 20 bp, Artificial
  CRISPR gRNA sequence
ccagtgttgtgccagaagcc

SEQ ID NO: 455300 - DNA, 20 bp, Artificial
  CRISPR gRNA sequence
tgccagaagccagaagtcag

SEQ ID NO: 455301 - DNA, 20 bp, Artificial
  CRISPR gRNA sequence
cagggccattttttctccat

SEQ ID NO: 455302 - DNA, 20 bp, Artificial
  CRISPR gRNA sequence
agggccattttttctccatt

SEQ ID NO: 455303 - DNA, 20 bp, Artificial
  CRISPR gRNA sequence
tttctccattctattcacag

SEQ ID NO: 455304 - DNA, 20 bp, Artificial
  CRISPR gRNA sequence
ttctccattctattcacagg

SEQ ID NO: 455305 - DNA, 20 bp, Artificial
  CRISPR gRNA sequence
tctccattctattcacaggt

SEQ ID NO: 455306 - DNA, 20 bp, Artificial
  CRISPR gRNA sequence
ctccattctattcacaggtg

SEQ ID NO: 455307 - DNA, 20 bp, Artificial
  CRISPR gRNA sequence
tccattctattcacaggtga

SEQ ID NO: 455308 - DNA, 20 bp, Artificial
  CRISPR gRNA sequence
cattctattcacaggtgagt

SEQ ID NO: 455309 - DNA, 20 bp, Artificial
  CRISPR gRNA sequence
tattcacaggtgagtgctca

SEQ ID NO: 455310 - DNA, 20 bp, Artificial
  CRISPR gRNA sequence
ttcacaggtgagtgctcaaa

SEQ ID NO: 455311 - DNA, 20 bp, Artificial
  CRISPR gRNA sequence
acaggtgagtgctcaaatac

SEQ ID NO: 455312 - DNA, 20 bp, Artificial
  CRISPR gRNA sequence
aaatactcctaatgccacca

SEQ ID NO: 455313 - DNA, 20 bp, Artificial
  CRISPR gRNA sequence
ctaatgccaccaggtgggac

SEQ ID NO: 455314 - DNA, 20 bp, Artificial
  CRISPR gRNA sequence
atgccaccaggtgggacagt

SEQ ID NO: 455315 - DNA, 20 bp, Artificial
  CRISPR gRNA sequence
acagtggagatgtaaccaga

SEQ ID NO: 455316 - DNA, 20 bp, Artificial
  CRISPR gRNA sequence
aggtcctggaaaggcagttt

SEQ ID NO: 455317 - DNA, 20 bp, Artificial
  CRISPR gRNA sequence
gaaaggcagtttccttcttc

SEQ ID NO: 455318 - DNA, 20 bp, Artificial
  CRISPR gRNA sequence
ccttcttcctcaatcctttt

SEQ ID NO: 455319 - DNA, 20 bp, Artificial
  CRISPR gRNA sequence
cttcttcctcaatccttttc

SEQ ID NO: 455320 - DNA, 20 bp, Artificial
  CRISPR gRNA sequence
cttcctcaatccttttccaa

SEQ ID NO: 455321 - DNA, 20 bp, Artificial
  CRISPR gRNA sequence
ttcctcaatccttttccaac

SEQ ID NO: 455322 - DNA, 20 bp, Artificial
  CRISPR gRNA sequence
cctcaatccttttccaacat

SEQ ID NO: 455323 - DNA, 20 bp, Artificial
  CRISPR gRNA sequence
ctcaatccttttccaacatc

SEQ ID NO: 455324 - DNA, 20 bp, Artificial
  CRISPR gRNA sequence
aatccttttccaacatcccc

SEQ ID NO: 455325 - DNA, 20 bp, Artificial
  CRISPR gRNA sequence
ttccaacatccccattggca

SEQ ID NO: 455326 - DNA, 20 bp, Artificial
  CRISPR gRNA sequence
tccaacatccccattggcag

SEQ ID NO: 455327 - DNA, 20 bp, Artificial
  CRISPR gRNA sequence
ccaacatccccattggcaga

SEQ ID NO: 455328 - DNA, 20 bp, Artificial
  CRISPR gRNA sequence
caacatccccattggcagat

SEQ ID NO: 455329 - DNA, 20 bp, Artificial
  CRISPR gRNA sequence
gcagatgctgcctttcttca

SEQ ID NO: 455330 - DNA, 20 bp, Artificial
  CRISPR gRNA sequence
cctttcttcaaagcgcacac

SEQ ID NO: 455331 - DNA, 20 bp, Artificial
  CRISPR gRNA sequence
tcttcaaagcgcacacacaa

SEQ ID NO: 455332 - DNA, 20 bp, Artificial
  CRISPR gRNA sequence
cttcaaagcgcacacacaaa

SEQ ID NO: 455333 - DNA, 20 bp, Artificial
  CRISPR gRNA sequence
ttcaaagcgcacacacaaac

SEQ ID NO: 455334 - DNA, 20 bp, Artificial
  CRISPR gRNA sequence
caaagcgcacacacaaacat

SEQ ID NO: 455335 - DNA, 20 bp, Artificial
  CRISPR gRNA sequence
aaagcgcacacacaaacata

SEQ ID NO: 455336 - DNA, 20 bp, Artificial
  CRISPR gRNA sequence
attttgtctttaattttaga

SEQ ID NO: 455337 - DNA, 20 bp, Artificial
  CRISPR gRNA sequence
tgtctttaattttagaactc

SEQ ID NO: 455338 - DNA, 20 bp, Artificial
  CRISPR gRNA sequence
gtctttaattttagaactct

SEQ ID NO: 455339 - DNA, 20 bp, Artificial
  CRISPR gRNA sequence
tctttaattttagaactctt

SEQ ID NO: 455340 - DNA, 20 bp, Artificial
  CRISPR gRNA sequence
taattttagaactcttactt

SEQ ID NO: 455341 - DNA, 20 bp, Artificial
  CRISPR gRNA sequence
aattttagaactcttacttg

SEQ ID NO: 455342 - DNA, 20 bp, Artificial
  CRISPR gRNA sequence
attttagaactcttacttgg

SEQ ID NO: 455343 - DNA, 20 bp, Artificial
  CRISPR gRNA sequence
tagaactcttacttggggtg

SEQ ID NO: 455344 - DNA, 20 bp, Artificial
  CRISPR gRNA sequence
agaactcttacttggggtgg

SEQ ID NO: 455345 - DNA, 20 bp, Artificial
  CRISPR gRNA sequence
gaactcttacttggggtggc

SEQ ID NO: 455346 - DNA, 20 bp, Artificial
  CRISPR gRNA sequence
ttacttggggtggccattgc

SEQ ID NO: 455347 - DNA, 20 bp, Artificial
  CRISPR gRNA sequence
acttggggtggccattgcat

SEQ ID NO: 455348 - DNA, 20 bp, Artificial
  CRISPR gRNA sequence
cttggggtggccattgcatt

SEQ ID NO: 455349 - DNA, 20 bp, Artificial
  CRISPR gRNA sequence
ggggtggccattgcattttt

SEQ ID NO: 455350 - DNA, 20 bp, Artificial
  CRISPR gRNA sequence
gggtggccattgcattttta

SEQ ID NO: 455351 - DNA, 20 bp, Artificial
  CRISPR gRNA sequence
catttttactgacagggaga

SEQ ID NO: 455352 - DNA, 20 bp, Artificial
  CRISPR gRNA sequence
ttactgacagggagatggtg

SEQ ID NO: 455353 - DNA, 20 bp, Artificial
  CRISPR gRNA sequence
tactgacagggagatggtga

SEQ ID NO: 455354 - DNA, 20 bp, Artificial
  CRISPR gRNA sequence
actgacagggagatggtgac

SEQ ID NO: 455355 - DNA, 20 bp, Artificial
  CRISPR gRNA sequence
ctgacagggagatggtgaca

SEQ ID NO: 455356 - DNA, 20 bp, Artificial
  CRISPR gRNA sequence
acagggagatggtgacacag

SEQ ID NO: 455357 - DNA, 20 bp, Artificial
  CRISPR gRNA sequence
aagagacttgtccagtgcta

SEQ ID NO: 455358 - DNA, 20 bp, Artificial
  CRISPR gRNA sequence
gtccagtgctactcactggt

SEQ ID NO: 455359 - DNA, 20 bp, Artificial
  CRISPR gRNA sequence
tccagtgctactcactggtg

SEQ ID NO: 455360 - DNA, 20 bp, Artificial
  CRISPR gRNA sequence
ctcactggtgaaagtaaaaa

SEQ ID NO: 455361 - DNA, 20 bp, Artificial
  CRISPR gRNA sequence
actggtgaaagtaaaaacag

SEQ ID NO: 455362 - DNA, 20 bp, Artificial
  CRISPR gRNA sequence
gtgaaagtaaaaacagatag

SEQ ID NO: 455363 - DNA, 20 bp, Artificial
  CRISPR gRNA sequence
ggcttcctggccaggcatgg

SEQ ID NO: 455364 - DNA, 20 bp, Artificial
  CRISPR gRNA sequence
cctggccaggcatggtggct

SEQ ID NO: 455365 - DNA, 20 bp, Artificial
  CRISPR gRNA sequence
ctggccaggcatggtggctc

SEQ ID NO: 455366 - DNA, 20 bp, Artificial
  CRISPR gRNA sequence
gccaggcatggtggctcatg

SEQ ID NO: 455367 - DNA, 20 bp, Artificial
  CRISPR gRNA sequence
atgcctgtaatcccagcatt

SEQ ID NO: 455368 - DNA, 20 bp, Artificial
  CRISPR gRNA sequence
taatcccagcattttgggag

SEQ ID NO: 455369 - DNA, 20 bp, Artificial
  CRISPR gRNA sequence
tgggaggctgaggtaggcag

SEQ ID NO: 455370 - DNA, 20 bp, Artificial
  CRISPR gRNA sequence
gggaggctgaggtaggcaga

SEQ ID NO: 455371 - DNA, 20 bp, Artificial
  CRISPR gRNA sequence
ggaggctgaggtaggcagat

SEQ ID NO: 455372 - DNA, 20 bp, Artificial
  CRISPR gRNA sequence
aggtaggcagatcacccgag

SEQ ID NO: 455373 - DNA, 20 bp, Artificial
  CRISPR gRNA sequence
aagatcagcctagccaacat

SEQ ID NO: 455374 - DNA, 20 bp, Artificial
  CRISPR gRNA sequence
gccaacatggagaaaccctg

SEQ ID NO: 455375 - DNA, 20 bp, Artificial
  CRISPR gRNA sequence
tctctactaaaaatacaaaa

SEQ ID NO: 455376 - DNA, 20 bp, Artificial
  CRISPR gRNA sequence
tactaaaaatacaaaattag

SEQ ID NO: 455377 - DNA, 20 bp, Artificial
  CRISPR gRNA sequence
ctaaaaatacaaaattagcc

SEQ ID NO: 455378 - DNA, 20 bp, Artificial
  CRISPR gRNA sequence
aaaatacaaaattagccggg

SEQ ID NO: 455379 - DNA, 20 bp, Artificial
  CRISPR gRNA sequence
gccgggtgtggtggcgcatg

SEQ ID NO: 455380 - DNA, 20 bp, Artificial
  CRISPR gRNA sequence
taatcccagctactcaggag

SEQ ID NO: 455381 - DNA, 20 bp, Artificial
  CRISPR gRNA sequence
ctcaggaggctaaggcaaga

SEQ ID NO: 455382 - DNA, 20 bp, Artificial
  CRISPR gRNA sequence
aggaggctaaggcaagagaa

SEQ ID NO: 455383 - DNA, 20 bp, Artificial
  CRISPR gRNA sequence
aggcaagagaatcgcttgaa

SEQ ID NO: 455384 - DNA, 20 bp, Artificial
  CRISPR gRNA sequence
gaacctgggaggcggaggtt

SEQ ID NO: 455385 - DNA, 20 bp, Artificial
  CRISPR gRNA sequence
aacctgggaggcggaggttg

SEQ ID NO: 455386 - DNA, 20 bp, Artificial
  CRISPR gRNA sequence
ggaggcggaggttgcagtga

SEQ ID NO: 455387 - DNA, 20 bp, Artificial
  CRISPR gRNA sequence
cagtgagccgagattgtgcc

SEQ ID NO: 455388 - DNA, 20 bp, Artificial
  CRISPR gRNA sequence
tgccattgcactctatcttg

SEQ ID NO: 455389 - DNA, 20 bp, Artificial
  CRISPR gRNA sequence
cactctatcttgggcaacta

SEQ ID NO: 455390 - DNA, 20 bp, Artificial
  CRISPR gRNA sequence
tatcttgggcaactagagcg

SEQ ID NO: 455391 - DNA, 20 bp, Artificial
  CRISPR gRNA sequence
tcttgggcaactagagcgaa

SEQ ID NO: 455392 - DNA, 20 bp, Artificial
  CRISPR gRNA sequence
gggcaactagagcgaaactg

SEQ ID NO: 455393 - DNA, 20 bp, Artificial
  CRISPR gRNA sequence
ggcaactagagcgaaactgt

SEQ ID NO: 455394 - DNA, 20 bp, Artificial
  CRISPR gRNA sequence
gagcgaaactgtgtctcaaa

SEQ ID NO: 455395 - DNA, 20 bp, Artificial
  CRISPR gRNA sequence
tgtctcaaaaaaataaaaaa

SEQ ID NO: 455396 - DNA, 20 bp, Artificial
  CRISPR gRNA sequence
aaaaaaataaaaaacaagaa

SEQ ID NO: 455397 - DNA, 20 bp, Artificial
  CRISPR gRNA sequence
ggcctcctgattcccaattc

SEQ ID NO: 455398 - DNA, 20 bp, Artificial
  CRISPR gRNA sequence
ctgattcccaattcagaact

SEQ ID NO: 455399 - DNA, 20 bp, Artificial
  CRISPR gRNA sequence
attcccaattcagaactctc

SEQ ID NO: 455400 - DNA, 20 bp, Artificial
  CRISPR gRNA sequence
ccaattcagaactctcccag

SEQ ID NO: 455401 - DNA, 20 bp, Artificial
  CRISPR gRNA sequence
agaactctcccagaaatgtg

SEQ ID NO: 455402 - DNA, 20 bp, Artificial
  CRISPR gRNA sequence
tcccagaaatgtggctatat

SEQ ID NO: 455403 - DNA, 20 bp, Artificial
  CRISPR gRNA sequence
ccagaaatgtggctatattt

SEQ ID NO: 455404 - DNA, 20 bp, Artificial
  CRISPR gRNA sequence
tatttctaaattcaggcaga

SEQ ID NO: 455405 - DNA, 20 bp, Artificial
  CRISPR gRNA sequence
ctaaattcaggcagacaacg

SEQ ID NO: 455406 - DNA, 20 bp, Artificial
  CRISPR gRNA sequence
taaattcaggcagacaacga

SEQ ID NO: 455407 - DNA, 20 bp, Artificial
  CRISPR gRNA sequence
aattcaggcagacaacgaga

SEQ ID NO: 455408 - DNA, 20 bp, Artificial
  CRISPR gRNA sequence
aggcagacaacgagattagg

SEQ ID NO: 455409 - DNA, 20 bp, Artificial
  CRISPR gRNA sequence
ggtttgagataatatgggtg

SEQ ID NO: 455410 - DNA, 20 bp, Artificial
  CRISPR gRNA sequence
gagataatatgggtgtctgt

SEQ ID NO: 455411 - DNA, 20 bp, Artificial
  CRISPR gRNA sequence
agataatatgggtgtctgtc

SEQ ID NO: 455412 - DNA, 20 bp, Artificial
  CRISPR gRNA sequence
tcttaaggagcatttagttg

SEQ ID NO: 455413 - DNA, 20 bp, Artificial
  CRISPR gRNA sequence
aaggagcatttagttggagg

SEQ ID NO: 455414 - DNA, 20 bp, Artificial
  CRISPR gRNA sequence
aggagcatttagttggagga

SEQ ID NO: 455415 - DNA, 20 bp, Artificial
  CRISPR gRNA sequence
agttggaggaaacagaaacc

SEQ ID NO: 455416 - DNA, 20 bp, Artificial
  CRISPR gRNA sequence
gttggaggaaacagaaacca

SEQ ID NO: 455417 - DNA, 20 bp, Artificial
  CRISPR gRNA sequence
gaggaaacagaaaccaattc

SEQ ID NO: 455418 - DNA, 20 bp, Artificial
  CRISPR gRNA sequence
aaagtaccatagattaaagg

SEQ ID NO: 455419 - DNA, 20 bp, Artificial
  CRISPR gRNA sequence
aaggaggaaaaaataaaaaa

SEQ ID NO: 455420 - DNA, 20 bp, Artificial
  CRISPR gRNA sequence
gccctcatgagttctagctc

SEQ ID NO: 455421 - DNA, 20 bp, Artificial
  CRISPR gRNA sequence
atgagttctagctcctggaa

SEQ ID NO: 455422 - DNA, 20 bp, Artificial
  CRISPR gRNA sequence
tagctcctggaatcagaaac

SEQ ID NO: 455423 - DNA, 20 bp, Artificial
  CRISPR gRNA sequence
gctcctggaatcagaaacta

SEQ ID NO: 455424 - DNA, 20 bp, Artificial
  CRISPR gRNA sequence
ctggaatcagaaactagaaa

SEQ ID NO: 455425 - DNA, 20 bp, Artificial
  CRISPR gRNA sequence
gaatcagaaactagaaaggg

SEQ ID NO: 455426 - DNA, 20 bp, Artificial
  CRISPR gRNA sequence
gaaaggggacaggacgcaaa

SEQ ID NO: 455427 - DNA, 20 bp, Artificial
  CRISPR gRNA sequence
ccgtttcaaactgtgaggca

SEQ ID NO: 455428 - DNA, 20 bp, Artificial
  CRISPR gRNA sequence
caaactgtgaggcagcaagg

SEQ ID NO: 455429 - DNA, 20 bp, Artificial
  CRISPR gRNA sequence
aaactgtgaggcagcaaggc

SEQ ID NO: 455430 - DNA, 20 bp, Artificial
  CRISPR gRNA sequence
tgaggcagcaaggcctctgg

SEQ ID NO: 455431 - DNA, 20 bp, Artificial
  CRISPR gRNA sequence
tggcttctgcatctgtcttt

SEQ ID NO: 455432 - DNA, 20 bp, Artificial
  CRISPR gRNA sequence
gcttctgcatctgtctttca

SEQ ID NO: 455433 - DNA, 20 bp, Artificial
  CRISPR gRNA sequence
ctgcatctgtctttcactct

SEQ ID NO: 455434 - DNA, 20 bp, Artificial
  CRISPR gRNA sequence
tgcatctgtctttcactcta

SEQ ID NO: 455435 - DNA, 20 bp, Artificial
  CRISPR gRNA sequence
catctgtctttcactctatg

SEQ ID NO: 455436 - DNA, 20 bp, Artificial
  CRISPR gRNA sequence
tctttcactctatgcatgct

SEQ ID NO: 455437 - DNA, 20 bp, Artificial
  CRISPR gRNA sequence
tcactctatgcatgctcccc

SEQ ID NO: 455438 - DNA, 20 bp, Artificial
  CRISPR gRNA sequence
cactctatgcatgctccccc

SEQ ID NO: 455439 - DNA, 20 bp, Artificial
  CRISPR gRNA sequence
actctatgcatgctccccct

SEQ ID NO: 455440 - DNA, 20 bp, Artificial
  CRISPR gRNA sequence
tatgcatgctccccctgctc

SEQ ID NO: 455441 - DNA, 20 bp, Artificial
  CRISPR gRNA sequence
tgcatgctccccctgctcca

SEQ ID NO: 455442 - DNA, 20 bp, Artificial
  CRISPR gRNA sequence
cccctgctccattactactt

SEQ ID NO: 455443 - DNA, 20 bp, Artificial
  CRISPR gRNA sequence
ctccattactactttggcat

SEQ ID NO: 455444 - DNA, 20 bp, Artificial
  CRISPR gRNA sequence
cattactactttggcatatc

SEQ ID NO: 455445 - DNA, 20 bp, Artificial
  CRISPR gRNA sequence
ctactttggcatatcctaaa

SEQ ID NO: 455446 - DNA, 20 bp, Artificial
  CRISPR gRNA sequence
ctttggcatatcctaaatat

SEQ ID NO: 455447 - DNA, 20 bp, Artificial
  CRISPR gRNA sequence
tggcatatcctaaatatggc

SEQ ID NO: 455448 - DNA, 20 bp, Artificial
  CRISPR gRNA sequence
ggcatatcctaaatatggcc

SEQ ID NO: 455449 - DNA, 20 bp, Artificial
  CRISPR gRNA sequence
gcatatcctaaatatggcca

SEQ ID NO: 455450 - DNA, 20 bp, Artificial
  CRISPR gRNA sequence
aatatggccactccagcccc

SEQ ID NO: 455451 - DNA, 20 bp, Artificial
  CRISPR gRNA sequence
cagccccagctttaagtggc

SEQ ID NO: 455452 - DNA, 20 bp, Artificial
  CRISPR gRNA sequence
taagtggcttccttaagtca

SEQ ID NO: 455453 - DNA, 20 bp, Artificial
  CRISPR gRNA sequence
aagtggcttccttaagtcaa

SEQ ID NO: 455454 - DNA, 20 bp, Artificial
  CRISPR gRNA sequence
agtggcttccttaagtcaaa

SEQ ID NO: 455455 - DNA, 20 bp, Artificial
  CRISPR gRNA sequence
ccttaagtcaaattgtgccc

SEQ ID NO: 455456 - DNA, 20 bp, Artificial
  CRISPR gRNA sequence
cttaagtcaaattgtgccca

SEQ ID NO: 455457 - DNA, 20 bp, Artificial
  CRISPR gRNA sequence
aagtcaaattgtgcccaaca

SEQ ID NO: 455458 - DNA, 20 bp, Artificial
  CRISPR gRNA sequence
agtcaaattgtgcccaacag

SEQ ID NO: 455459 - DNA, 20 bp, Artificial
  CRISPR gRNA sequence
tgcccaacagaaagtgtctc

SEQ ID NO: 455460 - DNA, 20 bp, Artificial
  CRISPR gRNA sequence
tctgtgtaactatattccta

SEQ ID NO: 455461 - DNA, 20 bp, Artificial
  CRISPR gRNA sequence
tgtgtaactatattcctaga

SEQ ID NO: 455462 - DNA, 20 bp, Artificial
  CRISPR gRNA sequence
tgtaactatattcctagaca

SEQ ID NO: 455463 - DNA, 20 bp, Artificial
  CRISPR gRNA sequence
tattcctagacaatagagca

SEQ ID NO: 455464 - DNA, 20 bp, Artificial
  CRISPR gRNA sequence
ctagacaatagagcaagcct

SEQ ID NO: 455465 - DNA, 20 bp, Artificial
  CRISPR gRNA sequence
gacaatagagcaagccttca

SEQ ID NO: 455466 - DNA, 20 bp, Artificial
  CRISPR gRNA sequence
caaaattctgtgggaaaaaa

SEQ ID NO: 455467 - DNA, 20 bp, Artificial
  CRISPR gRNA sequence
aaaattctgtgggaaaaaaa

SEQ ID NO: 455468 - DNA, 20 bp, Artificial
  CRISPR gRNA sequence
tgtgggaaaaaaaaaattta

SEQ ID NO: 455469 - DNA, 20 bp, Artificial
  CRISPR gRNA sequence
tgggaaaaaaaaaatttacc

SEQ ID NO: 455470 - DNA, 20 bp, Artificial
  CRISPR gRNA sequence
acctagaattatatattcag

SEQ ID NO: 455471 - DNA, 20 bp, Artificial
  CRISPR gRNA sequence
cctagaattatatattcagc

SEQ ID NO: 455472 - DNA, 20 bp, Artificial
  CRISPR gRNA sequence
gaattatatattcagccaaa

SEQ ID NO: 455473 - DNA, 20 bp, Artificial
  CRISPR gRNA sequence
tatattcagccaaactataa

SEQ ID NO: 455474 - DNA, 20 bp, Artificial
  CRISPR gRNA sequence
agccaaactataaaccaaat

SEQ ID NO: 455475 - DNA, 20 bp, Artificial
  CRISPR gRNA sequence
taaaccaaatgtaaggaaag

SEQ ID NO: 455476 - DNA, 20 bp, Artificial
  CRISPR gRNA sequence
tcatgagatgcaatgactca

SEQ ID NO: 455477 - DNA, 20 bp, Artificial
  CRISPR gRNA sequence
aaaaaaatttgccttccatg

SEQ ID NO: 455478 - DNA, 20 bp, Artificial
  CRISPR gRNA sequence
gccttccatgtgatcttttc

SEQ ID NO: 455479 - DNA, 20 bp, Artificial
  CRISPR gRNA sequence
ccttccatgtgatcttttca

SEQ ID NO: 455480 - DNA, 20 bp, Artificial
  CRISPR gRNA sequence
ccatgtgatcttttcaaaga

SEQ ID NO: 455481 - DNA, 20 bp, Artificial
  CRISPR gRNA sequence
catgtgatcttttcaaagaa

SEQ ID NO: 455482 - DNA, 20 bp, Artificial
  CRISPR gRNA sequence
ttcaaagaagctaccagagg

SEQ ID NO: 455483 - DNA, 20 bp, Artificial
  CRISPR gRNA sequence
tcaaagaagctaccagagga

SEQ ID NO: 455484 - DNA, 20 bp, Artificial
  CRISPR gRNA sequence
caaagaagctaccagaggat

SEQ ID NO: 455485 - DNA, 20 bp, Artificial
  CRISPR gRNA sequence
aaagaagctaccagaggatg

SEQ ID NO: 455486 - DNA, 20 bp, Artificial
  CRISPR gRNA sequence
ccagaggatgtgcttcagta

SEQ ID NO: 455487 - DNA, 20 bp, Artificial
  CRISPR gRNA sequence
cagtaaaacaagaaagtgaa

SEQ ID NO: 455488 - DNA, 20 bp, Artificial
  CRISPR gRNA sequence
agtaaaacaagaaagtgaat

SEQ ID NO: 455489 - DNA, 20 bp, Artificial
  CRISPR gRNA sequence
acaaggaagttctaggctgg

SEQ ID NO: 455490 - DNA, 20 bp, Artificial
  CRISPR gRNA sequence
taggctggacacagtggctc

SEQ ID NO: 455491 - DNA, 20 bp, Artificial
  CRISPR gRNA sequence
ggctggacacagtggctcat

SEQ ID NO: 455492 - DNA, 20 bp, Artificial
  CRISPR gRNA sequence
gacacagtggctcatgccag

SEQ ID NO: 455493 - DNA, 20 bp, Artificial
  CRISPR gRNA sequence
atgccagcacttttggaggc

SEQ ID NO: 455494 - DNA, 20 bp, Artificial
  CRISPR gRNA sequence
ttggaggccaaggtgggagg

SEQ ID NO: 455495 - DNA, 20 bp, Artificial
  CRISPR gRNA sequence
tggaggccaaggtgggagga

SEQ ID NO: 455496 - DNA, 20 bp, Artificial
  CRISPR gRNA sequence
ggaggccaaggtgggaggat

SEQ ID NO: 455497 - DNA, 20 bp, Artificial
  CRISPR gRNA sequence
gaggccaaggtgggaggatc

SEQ ID NO: 455498 - DNA, 20 bp, Artificial
  CRISPR gRNA sequence
gagcccaggagttagagata

SEQ ID NO: 455499 - DNA, 20 bp, Artificial
  CRISPR gRNA sequence
agcccaggagttagagataa

SEQ ID NO: 455500 - DNA, 20 bp, Artificial
  CRISPR gRNA sequence
gagataagcctgggcaacac

SEQ ID NO: 455501 - DNA, 20 bp, Artificial
  CRISPR gRNA sequence
ggcaacacagggagacacca

SEQ ID NO: 455502 - DNA, 20 bp, Artificial
  CRISPR gRNA sequence
tagtggaaaagaaaaaaaaa

SEQ ID NO: 455503 - DNA, 20 bp, Artificial
  CRISPR gRNA sequence
gtggaaaagaaaaaaaaaag

SEQ ID NO: 455504 - DNA, 20 bp, Artificial
  CRISPR gRNA sequence
aagaattaaaaaagggcagt

SEQ ID NO: 455505 - DNA, 20 bp, Artificial
  CRISPR gRNA sequence
aaaaagggcagttagtccag

SEQ ID NO: 455506 - DNA, 20 bp, Artificial
  CRISPR gRNA sequence
gtccagaagagagcaagaga

SEQ ID NO: 455507 - DNA, 20 bp, Artificial
  CRISPR gRNA sequence
tggaagggagatctctagga

SEQ ID NO: 455508 - DNA, 20 bp, Artificial
  CRISPR gRNA sequence
gaagggagatctctaggagg

SEQ ID NO: 455509 - DNA, 20 bp, Artificial
  CRISPR gRNA sequence
taggaggtaaaaatggaatc

SEQ ID NO: 455510 - DNA, 20 bp, Artificial
  CRISPR gRNA sequence
ggaggtaaaaatggaatcga

SEQ ID NO: 455511 - DNA, 20 bp, Artificial
  CRISPR gRNA sequence
tctaaaggcccattaaagac

SEQ ID NO: 455512 - DNA, 20 bp, Artificial
  CRISPR gRNA sequence
ctaaaggcccattaaagacc

SEQ ID NO: 455513 - DNA, 20 bp, Artificial
  CRISPR gRNA sequence
taaaggcccattaaagaccc

SEQ ID NO: 455514 - DNA, 20 bp, Artificial
  CRISPR gRNA sequence
aaggcccattaaagacccaa

SEQ ID NO: 455515 - DNA, 20 bp, Artificial
  CRISPR gRNA sequence
aagacccaataaaaagatta

SEQ ID NO: 455516 - DNA, 20 bp, Artificial
  CRISPR gRNA sequence
aagaaatggatatggaaaac

SEQ ID NO: 455517 - DNA, 20 bp, Artificial
  CRISPR gRNA sequence
tgccagtaaaaaaataaaat

SEQ ID NO: 455518 - DNA, 20 bp, Artificial
  CRISPR gRNA sequence
ccagtaaaaaaataaaatca

SEQ ID NO: 455519 - DNA, 20 bp, Artificial
  CRISPR gRNA sequence
tagaaaaaactaaattttac

SEQ ID NO: 455520 - DNA, 20 bp, Artificial
  CRISPR gRNA sequence
gaaaaaactaaattttacaa

SEQ ID NO: 455521 - DNA, 20 bp, Artificial
  CRISPR gRNA sequence
aattttacaaaagaaacata

SEQ ID NO: 455522 - DNA, 20 bp, Artificial
  CRISPR gRNA sequence
tacaaaagaaacatagcgca

SEQ ID NO: 455523 - DNA, 20 bp, Artificial
  CRISPR gRNA sequence
acaaaagaaacatagcgcac

SEQ ID NO: 455524 - DNA, 20 bp, Artificial
  CRISPR gRNA sequence
caaaagaaacatagcgcaca

SEQ ID NO: 455525 - DNA, 20 bp, Artificial
  CRISPR gRNA sequence
gattttgcaaaaaataacac

SEQ ID NO: 455526 - DNA, 20 bp, Artificial
  CRISPR gRNA sequence
attttgcaaaaaataacaca

SEQ ID NO: 455527 - DNA, 20 bp, Artificial
  CRISPR gRNA sequence
tgcaaaaaataacacagaat

SEQ ID NO: 455528 - DNA, 20 bp, Artificial
  CRISPR gRNA sequence
gcaaaaaataacacagaatc

SEQ ID NO: 455529 - DNA, 20 bp, Artificial
  CRISPR gRNA sequence
caaaaaataacacagaatcc

SEQ ID NO: 455530 - DNA, 20 bp, Artificial
  CRISPR gRNA sequence
tgtaaacatgactaatttaa

SEQ ID NO: 455531 - DNA, 20 bp, Artificial
  CRISPR gRNA sequence
atttaaataaaatttgtggt

SEQ ID NO: 455532 - DNA, 20 bp, Artificial
  CRISPR gRNA sequence
aaataaaatttgtggtacaa

SEQ ID NO: 455533 - DNA, 20 bp, Artificial
  CRISPR gRNA sequence
aataaaatttgtggtacaat

SEQ ID NO: 455534 - DNA, 20 bp, Artificial
  CRISPR gRNA sequence
gtggtacaattatttttaga

SEQ ID NO: 455535 - DNA, 20 bp, Artificial
  CRISPR gRNA sequence
tggtacaattatttttagaa

SEQ ID NO: 455536 - DNA, 20 bp, Artificial
  CRISPR gRNA sequence
tttttagaagaatgcagaga

SEQ ID NO: 455537 - DNA, 20 bp, Artificial
  CRISPR gRNA sequence
ttagaagaatgcagagaagg

SEQ ID NO: 455538 - DNA, 20 bp, Artificial
  CRISPR gRNA sequence
tagaagaatgcagagaagga

SEQ ID NO: 455539 - DNA, 20 bp, Artificial
  CRISPR gRNA sequence
agaagaatgcagagaaggaa

SEQ ID NO: 455540 - DNA, 20 bp, Artificial
  CRISPR gRNA sequence
gaagaatgcagagaaggaaa

SEQ ID NO: 455541 - DNA, 20 bp, Artificial
  CRISPR gRNA sequence
atctactatattctagcaca

SEQ ID NO: 455542 - DNA, 20 bp, Artificial
  CRISPR gRNA sequence
ctatattctagcacatcttc

SEQ ID NO: 455543 - DNA, 20 bp, Artificial
  CRISPR gRNA sequence
tattctagcacatcttcatc

SEQ ID NO: 455544 - DNA, 20 bp, Artificial
  CRISPR gRNA sequence
tagcacatcttcatctactg

SEQ ID NO: 455545 - DNA, 20 bp, Artificial
  CRISPR gRNA sequence
gcacatcttcatctactgta

SEQ ID NO: 455546 - DNA, 20 bp, Artificial
  CRISPR gRNA sequence
catctactgtagcagaaagc

SEQ ID NO: 455547 - DNA, 20 bp, Artificial
  CRISPR gRNA sequence
atctactgtagcagaaagcc

SEQ ID NO: 455548 - DNA, 20 bp, Artificial
  CRISPR gRNA sequence
ctgtagcagaaagccaatag

SEQ ID NO: 455549 - DNA, 20 bp, Artificial
  CRISPR gRNA sequence
tagcagaaagccaatagaaa

SEQ ID NO: 455550 - DNA, 20 bp, Artificial
  CRISPR gRNA sequence
aattttatcactaggaagca

SEQ ID NO: 455551 - DNA, 20 bp, Artificial
  CRISPR gRNA sequence
tatcactaggaagcagcaat

SEQ ID NO: 455552 - DNA, 20 bp, Artificial
  CRISPR gRNA sequence
atcactaggaagcagcaata

SEQ ID NO: 455553 - DNA, 20 bp, Artificial
  CRISPR gRNA sequence
tcactaggaagcagcaatat

SEQ ID NO: 455554 - DNA, 20 bp, Artificial
  CRISPR gRNA sequence
ggaagcagcaatatgagcat

SEQ ID NO: 455555 - DNA, 20 bp, Artificial
  CRISPR gRNA sequence
tttaggaatataataagaca

SEQ ID NO: 455556 - DNA, 20 bp, Artificial
  CRISPR gRNA sequence
aggaatataataagacatct

SEQ ID NO: 455557 - DNA, 20 bp, Artificial
  CRISPR gRNA sequence
ggaatataataagacatctc

SEQ ID NO: 455558 - DNA, 20 bp, Artificial
  CRISPR gRNA sequence
gaagagttgacagtggttgt

SEQ ID NO: 455559 - DNA, 20 bp, Artificial
  CRISPR gRNA sequence
acagtggttgtctcagacaa

SEQ ID NO: 455560 - DNA, 20 bp, Artificial
  CRISPR gRNA sequence
tctcagacaataagcctagg

SEQ ID NO: 455561 - DNA, 20 bp, Artificial
  CRISPR gRNA sequence
agacaataagcctaggagga

SEQ ID NO: 455562 - DNA, 20 bp, Artificial
  CRISPR gRNA sequence
ggaggacaaaagggcactgc

SEQ ID NO: 455563 - DNA, 20 bp, Artificial
  CRISPR gRNA sequence
ctattattctctatgaactt

SEQ ID NO: 455564 - DNA, 20 bp, Artificial
  CRISPR gRNA sequence
ttattctctatgaactttta

SEQ ID NO: 455565 - DNA, 20 bp, Artificial
  CRISPR gRNA sequence
ttctctatgaacttttacaa

SEQ ID NO: 455566 - DNA, 20 bp, Artificial
  CRISPR gRNA sequence
tctatgaacttttacaacta

SEQ ID NO: 455567 - DNA, 20 bp, Artificial
  CRISPR gRNA sequence
tatgaacttttacaactatc

SEQ ID NO: 455568 - DNA, 20 bp, Artificial
  CRISPR gRNA sequence
tgaacttttacaactatctt

SEQ ID NO: 455569 - DNA, 20 bp, Artificial
  CRISPR gRNA sequence
ttacaactatcttacttctc

SEQ ID NO: 455570 - DNA, 20 bp, Artificial
  CRISPR gRNA sequence
tacaactatcttacttctcc

SEQ ID NO: 455571 - DNA, 20 bp, Artificial
  CRISPR gRNA sequence
acaactatcttacttctcca

SEQ ID NO: 455572 - DNA, 20 bp, Artificial
  CRISPR gRNA sequence
caactatcttacttctccat

SEQ ID NO: 455573 - DNA, 20 bp, Artificial
  CRISPR gRNA sequence
tcttacttctccatgaactt

SEQ ID NO: 455574 - DNA, 20 bp, Artificial
  CRISPR gRNA sequence
acttctccatgaacttacaa

SEQ ID NO: 455575 - DNA, 20 bp, Artificial
  CRISPR gRNA sequence
cttctccatgaacttacaac

SEQ ID NO: 455576 - DNA, 20 bp, Artificial
  CRISPR gRNA sequence
ctccatgaacttacaactat

SEQ ID NO: 455577 - DNA, 20 bp, Artificial
  CRISPR gRNA sequence
tccatgaacttacaactatc

SEQ ID NO: 455578 - DNA, 20 bp, Artificial
  CRISPR gRNA sequence
catgaacttacaactatctt

SEQ ID NO: 455579 - DNA, 20 bp, Artificial
  CRISPR gRNA sequence
acaactatcttacttttttt

SEQ ID NO: 455580 - DNA, 20 bp, Artificial
  CRISPR gRNA sequence
caactatcttactttttttt

SEQ ID NO: 455581 - DNA, 20 bp, Artificial
  CRISPR gRNA sequence
tcttacttttttttttcttt

SEQ ID NO: 455582 - DNA, 20 bp, Artificial
  CRISPR gRNA sequence
acttttttttttctttttct

SEQ ID NO: 455583 - DNA, 20 bp, Artificial
  CRISPR gRNA sequence
cttttttttttctttttctt

SEQ ID NO: 455584 - DNA, 20 bp, Artificial
  CRISPR gRNA sequence
ttttttttctttttctttga

SEQ ID NO: 455585 - DNA, 20 bp, Artificial
  CRISPR gRNA sequence
tttttttctttttctttgat

SEQ ID NO: 455586 - DNA, 20 bp, Artificial
  CRISPR gRNA sequence
ttttttctttttctttgatt

SEQ ID NO: 455587 - DNA, 20 bp, Artificial
  CRISPR gRNA sequence
tttttctttttctttgattt

SEQ ID NO: 455588 - DNA, 20 bp, Artificial
  CRISPR gRNA sequence
ttttctttttctttgatttt

SEQ ID NO: 455589 - DNA, 20 bp, Artificial
  CRISPR gRNA sequence
tttctttttctttgattttt

SEQ ID NO: 455590 - DNA, 20 bp, Artificial
  CRISPR gRNA sequence
ttctttttctttgatttttt

SEQ ID NO: 455591 - DNA, 20 bp, Artificial
  CRISPR gRNA sequence
tctttttctttgattttttg

SEQ ID NO: 455592 - DNA, 20 bp, Artificial
  CRISPR gRNA sequence
ctttttctttgattttttga

SEQ ID NO: 455593 - DNA, 20 bp, Artificial
  CRISPR gRNA sequence
tttttctttgattttttgag

SEQ ID NO: 455594 - DNA, 20 bp, Artificial
  CRISPR gRNA sequence
tttctttgattttttgagac

SEQ ID NO: 455595 - DNA, 20 bp, Artificial
  CRISPR gRNA sequence
ttctttgattttttgagaca

SEQ ID NO: 455596 - DNA, 20 bp, Artificial
  CRISPR gRNA sequence
tctttgattttttgagacag

SEQ ID NO: 455597 - DNA, 20 bp, Artificial
  CRISPR gRNA sequence
ctttgattttttgagacaga

SEQ ID NO: 455598 - DNA, 20 bp, Artificial
  CRISPR gRNA sequence
tttgattttttgagacagac

SEQ ID NO: 455599 - DNA, 20 bp, Artificial
  CRISPR gRNA sequence
tgattttttgagacagactc

SEQ ID NO: 455600 - DNA, 20 bp, Artificial
  CRISPR gRNA sequence
gattttttgagacagactct

SEQ ID NO: 455601 - DNA, 20 bp, Artificial
  CRISPR gRNA sequence
attttttgagacagactctc

SEQ ID NO: 455602 - DNA, 20 bp, Artificial
  CRISPR gRNA sequence
tttgagacagactctcactc

SEQ ID NO: 455603 - DNA, 20 bp, Artificial
  CRISPR gRNA sequence
ttgagacagactctcactct

SEQ ID NO: 455604 - DNA, 20 bp, Artificial
  CRISPR gRNA sequence
tgagacagactctcactctg

SEQ ID NO: 455605 - DNA, 20 bp, Artificial
  CRISPR gRNA sequence
gagacagactctcactctgt

SEQ ID NO: 455606 - DNA, 20 bp, Artificial
  CRISPR gRNA sequence
agacagactctcactctgtg

SEQ ID NO: 455607 - DNA, 20 bp, Artificial
  CRISPR gRNA sequence
tcactctgtggtccgggctg

SEQ ID NO: 455608 - DNA, 20 bp, Artificial
  CRISPR gRNA sequence
actctgtggtccgggctgga

SEQ ID NO: 455609 - DNA, 20 bp, Artificial
  CRISPR gRNA sequence
tgtggtccgggctggagagc

SEQ ID NO: 455610 - DNA, 20 bp, Artificial
  CRISPR gRNA sequence
tggtccgggctggagagcag

SEQ ID NO: 455611 - DNA, 20 bp, Artificial
  CRISPR gRNA sequence
gagagcagtggcgtgatctc

SEQ ID NO: 455612 - DNA, 20 bp, Artificial
  CRISPR gRNA sequence
tgctcactgcaacctccacc

SEQ ID NO: 455613 - DNA, 20 bp, Artificial
  CRISPR gRNA sequence
ctcactgcaacctccacctc

SEQ ID NO: 455614 - DNA, 20 bp, Artificial
  CRISPR gRNA sequence
actgcaacctccacctccaa

SEQ ID NO: 455615 - DNA, 20 bp, Artificial
  CRISPR gRNA sequence
caacctccacctccaaggtt

SEQ ID NO: 455616 - DNA, 20 bp, Artificial
  CRISPR gRNA sequence
cacctccaaggttcaagtga

SEQ ID NO: 455617 - DNA, 20 bp, Artificial
  CRISPR gRNA sequence
caaggttcaagtgattctcc

SEQ ID NO: 455618 - DNA, 20 bp, Artificial
  CRISPR gRNA sequence
aagtgattctcctgcctcag

SEQ ID NO: 455619 - DNA, 20 bp, Artificial
  CRISPR gRNA sequence
tcctgcctcagccgcccaaa

SEQ ID NO: 455620 - DNA, 20 bp, Artificial
  CRISPR gRNA sequence
ctgcctcagccgcccaaata

SEQ ID NO: 455621 - DNA, 20 bp, Artificial
  CRISPR gRNA sequence
cctcagccgcccaaatagct

SEQ ID NO: 455622 - DNA, 20 bp, Artificial
  CRISPR gRNA sequence
agccgcccaaatagctggga

SEQ ID NO: 455623 - DNA, 20 bp, Artificial
  CRISPR gRNA sequence
ggactacaggcacacgccac

SEQ ID NO: 455624 - DNA, 20 bp, Artificial
  CRISPR gRNA sequence
caggcacacgccaccaccca

SEQ ID NO: 455625 - DNA, 20 bp, Artificial
  CRISPR gRNA sequence
attttttttgtatttttagt

SEQ ID NO: 455626 - DNA, 20 bp, Artificial
  CRISPR gRNA sequence
tttttgtatttttagttgag

SEQ ID NO: 455627 - DNA, 20 bp, Artificial
  CRISPR gRNA sequence
ttttgtatttttagttgaga

SEQ ID NO: 455628 - DNA, 20 bp, Artificial
  CRISPR gRNA sequence
tttgtatttttagttgagac

SEQ ID NO: 455629 - DNA, 20 bp, Artificial
  CRISPR gRNA sequence
ttgtatttttagttgagacg

SEQ ID NO: 455630 - DNA, 20 bp, Artificial
  CRISPR gRNA sequence
tgtatttttagttgagacgg

SEQ ID NO: 455631 - DNA, 20 bp, Artificial
  CRISPR gRNA sequence
gtatttttagttgagacggg

SEQ ID NO: 455632 - DNA, 20 bp, Artificial
  CRISPR gRNA sequence
tatttttagttgagacgggg

SEQ ID NO: 455633 - DNA, 20 bp, Artificial
  CRISPR gRNA sequence
ttagttgagacggggttttg

SEQ ID NO: 455634 - DNA, 20 bp, Artificial
  CRISPR gRNA sequence
tagttgagacggggttttgc

SEQ ID NO: 455635 - DNA, 20 bp, Artificial
  CRISPR gRNA sequence
agttgagacggggttttgcc

SEQ ID NO: 455636 - DNA, 20 bp, Artificial
  CRISPR gRNA sequence
gttgagacggggttttgcca

SEQ ID NO: 455637 - DNA, 20 bp, Artificial
  CRISPR gRNA sequence
agacggggttttgccatgac

SEQ ID NO: 455638 - DNA, 20 bp, Artificial
  CRISPR gRNA sequence
tgccatgacggccaggctgg

SEQ ID NO: 455639 - DNA, 20 bp, Artificial
  CRISPR gRNA sequence
gccatgacggccaggctggt

SEQ ID NO: 455640 - DNA, 20 bp, Artificial
  CRISPR gRNA sequence
ccatgacggccaggctggtc

SEQ ID NO: 455641 - DNA, 20 bp, Artificial
  CRISPR gRNA sequence
gtctcaaactcctgacctca

SEQ ID NO: 455642 - DNA, 20 bp, Artificial
  CRISPR gRNA sequence
aaactcctgacctcaggtga

SEQ ID NO: 455643 - DNA, 20 bp, Artificial
  CRISPR gRNA sequence
ctgacctcaggtgatctatc

SEQ ID NO: 455644 - DNA, 20 bp, Artificial
  CRISPR gRNA sequence
acctcaggtgatctatccgc

SEQ ID NO: 455645 - DNA, 20 bp, Artificial
  CRISPR gRNA sequence
aggtgatctatccgcctcag

SEQ ID NO: 455646 - DNA, 20 bp, Artificial
  CRISPR gRNA sequence
tccgcctcagcctagccaaa

SEQ ID NO: 455647 - DNA, 20 bp, Artificial
  CRISPR gRNA sequence
agcctagccaaagtgctggg

SEQ ID NO: 455648 - DNA, 20 bp, Artificial
  CRISPR gRNA sequence
gccaaagtgctgggattaca

SEQ ID NO: 455649 - DNA, 20 bp, Artificial
  CRISPR gRNA sequence
ggattacaggtgtgagccac

SEQ ID NO: 455650 - DNA, 20 bp, Artificial
  CRISPR gRNA sequence
caggtgtgagccaccgtgcc

SEQ ID NO: 455651 - DNA, 20 bp, Artificial
  CRISPR gRNA sequence
gcctatcttactttttaaga

SEQ ID NO: 455652 - DNA, 20 bp, Artificial
  CRISPR gRNA sequence
tcttactttttaagaaaaac

SEQ ID NO: 455653 - DNA, 20 bp, Artificial
  CRISPR gRNA sequence
actttttaagaaaaacaagt

SEQ ID NO: 455654 - DNA, 20 bp, Artificial
  CRISPR gRNA sequence
ctttttaagaaaaacaagta

SEQ ID NO: 455655 - DNA, 20 bp, Artificial
  CRISPR gRNA sequence
tttaagaaaaacaagtataa

SEQ ID NO: 455656 - DNA, 20 bp, Artificial
  CRISPR gRNA sequence
ttaagaaaaacaagtataaa

SEQ ID NO: 455657 - DNA, 20 bp, Artificial
  CRISPR gRNA sequence
taagaaaaacaagtataaat

SEQ ID NO: 455658 - DNA, 20 bp, Artificial
  CRISPR gRNA sequence
aagaaaaacaagtataaatt

SEQ ID NO: 455659 - DNA, 20 bp, Artificial
  CRISPR gRNA sequence
agaaaaacaagtataaatta

SEQ ID NO: 455660 - DNA, 20 bp, Artificial
  CRISPR gRNA sequence
cccactcaccaccctccccc

SEQ ID NO: 455661 - DNA, 20 bp, Artificial
  CRISPR gRNA sequence
accaccctccccccatgaaa

SEQ ID NO: 455662 - DNA, 20 bp, Artificial
  CRISPR gRNA sequence
cccccatgaaaaactggccc

SEQ ID NO: 455663 - DNA, 20 bp, Artificial
  CRISPR gRNA sequence
gcccagagcctttgaacaaa

SEQ ID NO: 455664 - DNA, 20 bp, Artificial
  CRISPR gRNA sequence
tgaacaaatgtttctaatca

SEQ ID NO: 455665 - DNA, 20 bp, Artificial
  CRISPR gRNA sequence
gaacaaatgtttctaatcac

SEQ ID NO: 455666 - DNA, 20 bp, Artificial
  CRISPR gRNA sequence
aacaaatgtttctaatcacc

SEQ ID NO: 455667 - DNA, 20 bp, Artificial
  CRISPR gRNA sequence
ctaatcacctcctatggttc

SEQ ID NO: 455668 - DNA, 20 bp, Artificial
  CRISPR gRNA sequence
taatcacctcctatggttcc

SEQ ID NO: 455669 - DNA, 20 bp, Artificial
  CRISPR gRNA sequence
atcacctcctatggttccta

SEQ ID NO: 455670 - DNA, 20 bp, Artificial
  CRISPR gRNA sequence
ctatggttcctagttaattc

SEQ ID NO: 455671 - DNA, 20 bp, Artificial
  CRISPR gRNA sequence
tggttcctagttaattcaaa

SEQ ID NO: 455672 - DNA, 20 bp, Artificial
  CRISPR gRNA sequence
ctagttaattcaaattttca

SEQ ID NO: 455673 - DNA, 20 bp, Artificial
  CRISPR gRNA sequence
gttaattcaaattttcaact

SEQ ID NO: 455674 - DNA, 20 bp, Artificial
  CRISPR gRNA sequence
attcaaattttcaacttgtt

SEQ ID NO: 455675 - DNA, 20 bp, Artificial
  CRISPR gRNA sequence
aaattttcaacttgtttagt

SEQ ID NO: 455676 - DNA, 20 bp, Artificial
  CRISPR gRNA sequence
tcaacttgtttagtttgact

SEQ ID NO: 455677 - DNA, 20 bp, Artificial
  CRISPR gRNA sequence
caacttgtttagtttgactg

SEQ ID NO: 455678 - DNA, 20 bp, Artificial
  CRISPR gRNA sequence
aacttgtttagtttgactga

SEQ ID NO: 455679 - DNA, 20 bp, Artificial
  CRISPR gRNA sequence
gtttagtttgactgactttg

SEQ ID NO: 455680 - DNA, 20 bp, Artificial
  CRISPR gRNA sequence
tttagtttgactgactttgt

SEQ ID NO: 455681 - DNA, 20 bp, Artificial
  CRISPR gRNA sequence
agtttgactgactttgttcc

SEQ ID NO: 455682 - DNA, 20 bp, Artificial
  CRISPR gRNA sequence
gtttgactgactttgttcct

SEQ ID NO: 455683 - DNA, 20 bp, Artificial
  CRISPR gRNA sequence
gactgactttgttccttgct

SEQ ID NO: 455684 - DNA, 20 bp, Artificial
  CRISPR gRNA sequence
actgactttgttccttgctt

SEQ ID NO: 455685 - DNA, 20 bp, Artificial
  CRISPR gRNA sequence
actttgttccttgcttcctg

SEQ ID NO: 455686 - DNA, 20 bp, Artificial
  CRISPR gRNA sequence
tgttccttgcttcctggtgt

SEQ ID NO: 455687 - DNA, 20 bp, Artificial
  CRISPR gRNA sequence
gttccttgcttcctggtgtc

SEQ ID NO: 455688 - DNA, 20 bp, Artificial
  CRISPR gRNA sequence
ttccttgcttcctggtgtct

SEQ ID NO: 455689 - DNA, 20 bp, Artificial
  CRISPR gRNA sequence
cttgcttcctggtgtcttcc

SEQ ID NO: 455690 - DNA, 20 bp, Artificial
  CRISPR gRNA sequence
gcttcctggtgtcttcctgt

SEQ ID NO: 455691 - DNA, 20 bp, Artificial
  CRISPR gRNA sequence
cttcctggtgtcttcctgtc

SEQ ID NO: 455692 - DNA, 20 bp, Artificial
  CRISPR gRNA sequence
cctggtgtcttcctgtctga

SEQ ID NO: 455693 - DNA, 20 bp, Artificial
  CRISPR gRNA sequence
ctggtgtcttcctgtctgac

SEQ ID NO: 455694 - DNA, 20 bp, Artificial
  CRISPR gRNA sequence
gtgtcttcctgtctgaccta

SEQ ID NO: 455695 - DNA, 20 bp, Artificial
  CRISPR gRNA sequence
cctgtctgacctagctatag

SEQ ID NO: 455696 - DNA, 20 bp, Artificial
  CRISPR gRNA sequence
ctgtctgacctagctatagc

SEQ ID NO: 455697 - DNA, 20 bp, Artificial
  CRISPR gRNA sequence
tctgacctagctatagcatt

SEQ ID NO: 455698 - DNA, 20 bp, Artificial
  CRISPR gRNA sequence
acctagctatagcattcagc

SEQ ID NO: 455699 - DNA, 20 bp, Artificial
  CRISPR gRNA sequence
gctatagcattcagcacttc

SEQ ID NO: 455700 - DNA, 20 bp, Artificial
  CRISPR gRNA sequence
tagcattcagcacttctgac

SEQ ID NO: 455701 - DNA, 20 bp, Artificial
  CRISPR gRNA sequence
agcacttctgactattccct

SEQ ID NO: 455702 - DNA, 20 bp, Artificial
  CRISPR gRNA sequence
ctgactattccctccttcat

SEQ ID NO: 455703 - DNA, 20 bp, Artificial
  CRISPR gRNA sequence
tgactattccctccttcatc

SEQ ID NO: 455704 - DNA, 20 bp, Artificial
  CRISPR gRNA sequence
actattccctccttcatcaa

SEQ ID NO: 455705 - DNA, 20 bp, Artificial
  CRISPR gRNA sequence
ttccctccttcatcaaactg

SEQ ID NO: 455706 - DNA, 20 bp, Artificial
  CRISPR gRNA sequence
cctccttcatcaaactgtca

SEQ ID NO: 455707 - DNA, 20 bp, Artificial
  CRISPR gRNA sequence
cttcatcaaactgtcatctc

SEQ ID NO: 455708 - DNA, 20 bp, Artificial
  CRISPR gRNA sequence
catcaaactgtcatctccag

SEQ ID NO: 455709 - DNA, 20 bp, Artificial
  CRISPR gRNA sequence
atcaaactgtcatctccagt

SEQ ID NO: 455710 - DNA, 20 bp, Artificial
  CRISPR gRNA sequence
tcatctccagtggcttctgt

SEQ ID NO: 455711 - DNA, 20 bp, Artificial
  CRISPR gRNA sequence
cagtggcttctgtgactgta

SEQ ID NO: 455712 - DNA, 20 bp, Artificial
  CRISPR gRNA sequence
ctgtgactgtactcccctgg

SEQ ID NO: 455713 - DNA, 20 bp, Artificial
  CRISPR gRNA sequence
tgtgactgtactcccctggc

SEQ ID NO: 455714 - DNA, 20 bp, Artificial
  CRISPR gRNA sequence
tgactgtactcccctggctg

SEQ ID NO: 455715 - DNA, 20 bp, Artificial
  CRISPR gRNA sequence
tactcccctggctgttctac

SEQ ID NO: 455716 - DNA, 20 bp, Artificial
  CRISPR gRNA sequence
ccctggctgttctacccacc

SEQ ID NO: 455717 - DNA, 20 bp, Artificial
  CRISPR gRNA sequence
gctgttctacccacctggct

SEQ ID NO: 455718 - DNA, 20 bp, Artificial
  CRISPR gRNA sequence
ttctacccacctggctgttc

SEQ ID NO: 455719 - DNA, 20 bp, Artificial
  CRISPR gRNA sequence
tacccacctggctgttcttt

SEQ ID NO: 455720 - DNA, 20 bp, Artificial
  CRISPR gRNA sequence
cccacctggctgttcttttg

SEQ ID NO: 455721 - DNA, 20 bp, Artificial
  CRISPR gRNA sequence
gctgttcttttgtcttctct

SEQ ID NO: 455722 - DNA, 20 bp, Artificial
  CRISPR gRNA sequence
ttcttttgtcttctctattt

SEQ ID NO: 455723 - DNA, 20 bp, Artificial
  CRISPR gRNA sequence
ttttgtcttctctatttcct

SEQ ID NO: 455724 - DNA, 20 bp, Artificial
  CRISPR gRNA sequence
ttgtcttctctatttcctcc

SEQ ID NO: 455725 - DNA, 20 bp, Artificial
  CRISPR gRNA sequence
tgtcttctctatttcctcct

SEQ ID NO: 455726 - DNA, 20 bp, Artificial
  CRISPR gRNA sequence
gtcttctctatttcctcctc

SEQ ID NO: 455727 - DNA, 20 bp, Artificial
  CRISPR gRNA sequence
tcttctctatttcctcctcc

SEQ ID NO: 455728 - DNA, 20 bp, Artificial
  CRISPR gRNA sequence
ctctatttcctcctcccacc

SEQ ID NO: 455729 - DNA, 20 bp, Artificial
  CRISPR gRNA sequence
tctatttcctcctcccacct

SEQ ID NO: 455730 - DNA, 20 bp, Artificial
  CRISPR gRNA sequence
tatttcctcctcccacctct

SEQ ID NO: 455731 - DNA, 20 bp, Artificial
  CRISPR gRNA sequence
tttcctcctcccacctctca

SEQ ID NO: 455732 - DNA, 20 bp, Artificial
  CRISPR gRNA sequence
cctcctcccacctctcaaac

SEQ ID NO: 455733 - DNA, 20 bp, Artificial
  CRISPR gRNA sequence
ctcctcccacctctcaaaca

SEQ ID NO: 455734 - DNA, 20 bp, Artificial
  CRISPR gRNA sequence
ctcccacctctcaaacatga

SEQ ID NO: 455735 - DNA, 20 bp, Artificial
  CRISPR gRNA sequence
ccacctctcaaacatgagta

SEQ ID NO: 455736 - DNA, 20 bp, Artificial
  CRISPR gRNA sequence
tcaaacatgagtattcccca

SEQ ID NO: 455737 - DNA, 20 bp, Artificial
  CRISPR gRNA sequence
aaacatgagtattccccaag

SEQ ID NO: 455738 - DNA, 20 bp, Artificial
  CRISPR gRNA sequence
cccaagactcacttctcacc

SEQ ID NO: 455739 - DNA, 20 bp, Artificial
  CRISPR gRNA sequence
acttctcaccccttcaacct

SEQ ID NO: 455740 - DNA, 20 bp, Artificial
  CRISPR gRNA sequence
ctcaccccttcaaccttttc

SEQ ID NO: 455741 - DNA, 20 bp, Artificial
  CRISPR gRNA sequence
tcaccccttcaaccttttct

SEQ ID NO: 455742 - DNA, 20 bp, Artificial
  CRISPR gRNA sequence
accccttcaaccttttctct

SEQ ID NO: 455743 - DNA, 20 bp, Artificial
  CRISPR gRNA sequence
caaccttttctctttactct

SEQ ID NO: 455744 - DNA, 20 bp, Artificial
  CRISPR gRNA sequence
aaccttttctctttactctc

SEQ ID NO: 455745 - DNA, 20 bp, Artificial
  CRISPR gRNA sequence
ttctctttactctctctccc

SEQ ID NO: 455746 - DNA, 20 bp, Artificial
  CRISPR gRNA sequence
tctctttactctctctccct

SEQ ID NO: 455747 - DNA, 20 bp, Artificial
  CRISPR gRNA sequence
ctctttactctctctcccta

SEQ ID NO: 455748 - DNA, 20 bp, Artificial
  CRISPR gRNA sequence
tctttactctctctccctag

SEQ ID NO: 455749 - DNA, 20 bp, Artificial
  CRISPR gRNA sequence
tttactctctctccctagtt

SEQ ID NO: 455750 - DNA, 20 bp, Artificial
  CRISPR gRNA sequence
tactctctctccctagttct

SEQ ID NO: 455751 - DNA, 20 bp, Artificial
  CRISPR gRNA sequence
actctctctccctagttctc

SEQ ID NO: 455752 - DNA, 20 bp, Artificial
  CRISPR gRNA sequence
ctctctctccctagttctca

SEQ ID NO: 455753 - DNA, 20 bp, Artificial
  CRISPR gRNA sequence
tctctccctagttctcatct

SEQ ID NO: 455754 - DNA, 20 bp, Artificial
  CRISPR gRNA sequence
tctccctagttctcatctac

SEQ ID NO: 455755 - DNA, 20 bp, Artificial
  CRISPR gRNA sequence
tccctagttctcatctaccc

SEQ ID NO: 455756 - DNA, 20 bp, Artificial
  CRISPR gRNA sequence
cctagttctcatctacccac

SEQ ID NO: 455757 - DNA, 20 bp, Artificial
  CRISPR gRNA sequence
gttctcatctacccacgatt

SEQ ID NO: 455758 - DNA, 20 bp, Artificial
  CRISPR gRNA sequence
tcatctacccacgatttaaa

SEQ ID NO: 455759 - DNA, 20 bp, Artificial
  CRISPR gRNA sequence
atctacccacgatttaaacc

SEQ ID NO: 455760 - DNA, 20 bp, Artificial
  CRISPR gRNA sequence
cccacgatttaaaccagcat

SEQ ID NO: 455761 - DNA, 20 bp, Artificial
  CRISPR gRNA sequence
aaaccagcatctccctgcaa

SEQ ID NO: 455762 - DNA, 20 bp, Artificial
  CRISPR gRNA sequence
aaccagcatctccctgcaac

SEQ ID NO: 455763 - DNA, 20 bp, Artificial
  CRISPR gRNA sequence
cctgcaactgaccagcaaat

SEQ ID NO: 455764 - DNA, 20 bp, Artificial
  CRISPR gRNA sequence
caactgaccagcaaatcaac

SEQ ID NO: 455765 - DNA, 20 bp, Artificial
  CRISPR gRNA sequence
accagcaaatcaacttctcc

SEQ ID NO: 455766 - DNA, 20 bp, Artificial
  CRISPR gRNA sequence
ctccagcttgaacacctttc

SEQ ID NO: 455767 - DNA, 20 bp, Artificial
  CRISPR gRNA sequence
tccagcttgaacacctttcc

SEQ ID NO: 455768 - DNA, 20 bp, Artificial
  CRISPR gRNA sequence
cagcttgaacacctttccta

SEQ ID NO: 455769 - DNA, 20 bp, Artificial
  CRISPR gRNA sequence
gaacacctttcctaagtttt

SEQ ID NO: 455770 - DNA, 20 bp, Artificial
  CRISPR gRNA sequence
aacacctttcctaagtttta

SEQ ID NO: 455771 - DNA, 20 bp, Artificial
  CRISPR gRNA sequence
tcctaagttttaattaaacg

SEQ ID NO: 455772 - DNA, 20 bp, Artificial
  CRISPR gRNA sequence
cctaagttttaattaaacgt

SEQ ID NO: 455773 - DNA, 20 bp, Artificial
  CRISPR gRNA sequence
ctaagttttaattaaacgtt

SEQ ID NO: 455774 - DNA, 20 bp, Artificial
  CRISPR gRNA sequence
agttttaattaaacgtttaa

SEQ ID NO: 455775 - DNA, 20 bp, Artificial
  CRISPR gRNA sequence
taattaaacgtttaaactaa

SEQ ID NO: 455776 - DNA, 20 bp, Artificial
  CRISPR gRNA sequence
aattaaacgtttaaactaaa

SEQ ID NO: 455777 - DNA, 20 bp, Artificial
  CRISPR gRNA sequence
attaaacgtttaaactaaaa

SEQ ID NO: 455778 - DNA, 20 bp, Artificial
  CRISPR gRNA sequence
aacgtttaaactaaaaactg

SEQ ID NO: 455779 - DNA, 20 bp, Artificial
  CRISPR gRNA sequence
aaactaaaaactgtactcct

SEQ ID NO: 455780 - DNA, 20 bp, Artificial
  CRISPR gRNA sequence
aactaaaaactgtactccta

SEQ ID NO: 455781 - DNA, 20 bp, Artificial
  CRISPR gRNA sequence
aaaactgtactcctagctcc

SEQ ID NO: 455782 - DNA, 20 bp, Artificial
  CRISPR gRNA sequence
tactcctagctcctggatgt

SEQ ID NO: 455783 - DNA, 20 bp, Artificial
  CRISPR gRNA sequence
ctagctcctggatgtcccac

SEQ ID NO: 455784 - DNA, 20 bp, Artificial
  CRISPR gRNA sequence
gctcctggatgtcccaccat

SEQ ID NO: 455785 - DNA, 20 bp, Artificial
  CRISPR gRNA sequence
ctggatgtcccaccatttcc

SEQ ID NO: 455786 - DNA, 20 bp, Artificial
  CRISPR gRNA sequence
gatgtcccaccatttcctca

SEQ ID NO: 455787 - DNA, 20 bp, Artificial
  CRISPR gRNA sequence
cctcaaactcagtatcaaag

SEQ ID NO: 455788 - DNA, 20 bp, Artificial
  CRISPR gRNA sequence
ctcaaactcagtatcaaagc

SEQ ID NO: 455789 - DNA, 20 bp, Artificial
  CRISPR gRNA sequence
aaactcagtatcaaagctat

SEQ ID NO: 455790 - DNA, 20 bp, Artificial
  CRISPR gRNA sequence
agtatcaaagctatcctcct

SEQ ID NO: 455791 - DNA, 20 bp, Artificial
  CRISPR gRNA sequence
tcctcctgagaccctatttc

SEQ ID NO: 455792 - DNA, 20 bp, Artificial
  CRISPR gRNA sequence
ctgagaccctatttctgttc

SEQ ID NO: 455793 - DNA, 20 bp, Artificial
  CRISPR gRNA sequence
agaccctatttctgttcatg

SEQ ID NO: 455794 - DNA, 20 bp, Artificial
  CRISPR gRNA sequence
tttctgttcatgacggagtc

SEQ ID NO: 455795 - DNA, 20 bp, Artificial
  CRISPR gRNA sequence
ctgttcatgacggagtcaac

SEQ ID NO: 455796 - DNA, 20 bp, Artificial
  CRISPR gRNA sequence
tgttcatgacggagtcaact

SEQ ID NO: 455797 - DNA, 20 bp, Artificial
  CRISPR gRNA sequence
ttcatgacggagtcaacttt

SEQ ID NO: 455798 - DNA, 20 bp, Artificial
  CRISPR gRNA sequence
atgacggagtcaactttggt

SEQ ID NO: 455799 - DNA, 20 bp, Artificial
  CRISPR gRNA sequence
tggttcctccttttttctta

SEQ ID NO: 455800 - DNA, 20 bp, Artificial
  CRISPR gRNA sequence
ggttcctccttttttcttaa

SEQ ID NO: 455801 - DNA, 20 bp, Artificial
  CRISPR gRNA sequence
gttcctccttttttcttaac

SEQ ID NO: 455802 - DNA, 20 bp, Artificial
  CRISPR gRNA sequence
ctccttttttcttaaccccc

SEQ ID NO: 455803 - DNA, 20 bp, Artificial
  CRISPR gRNA sequence
cttttttcttaacccccaat

SEQ ID NO: 455804 - DNA, 20 bp, Artificial
  CRISPR gRNA sequence
ttttcttaacccccaattca

SEQ ID NO: 455805 - DNA, 20 bp, Artificial
  CRISPR gRNA sequence
tttcttaacccccaattcag

SEQ ID NO: 455806 - DNA, 20 bp, Artificial
  CRISPR gRNA sequence
ttcttaacccccaattcaga

SEQ ID NO: 455807 - DNA, 20 bp, Artificial
  CRISPR gRNA sequence
tcttaacccccaattcagag

SEQ ID NO: 455808 - DNA, 20 bp, Artificial
  CRISPR gRNA sequence
cttaacccccaattcagaga

SEQ ID NO: 455809 - DNA, 20 bp, Artificial
  CRISPR gRNA sequence
ttaacccccaattcagagag

SEQ ID NO: 455810 - DNA, 20 bp, Artificial
  CRISPR gRNA sequence
aacccccaattcagagagtt

SEQ ID NO: 455811 - DNA, 20 bp, Artificial
  CRISPR gRNA sequence
acccccaattcagagagtta

SEQ ID NO: 455812 - DNA, 20 bp, Artificial
  CRISPR gRNA sequence
agagagttactaagtactgc

SEQ ID NO: 455813 - DNA, 20 bp, Artificial
  CRISPR gRNA sequence
ctaagtactgctgttcttcc

SEQ ID NO: 455814 - DNA, 20 bp, Artificial
  CRISPR gRNA sequence
agtactgctgttcttccgca

SEQ ID NO: 455815 - DNA, 20 bp, Artificial
  CRISPR gRNA sequence
ctgttcttccgcacagcagt

SEQ ID NO: 455816 - DNA, 20 bp, Artificial
  CRISPR gRNA sequence
ttcttccgcacagcagtact

SEQ ID NO: 455817 - DNA, 20 bp, Artificial
  CRISPR gRNA sequence
ttccgcacagcagtacttag

SEQ ID NO: 455818 - DNA, 20 bp, Artificial
  CRISPR gRNA sequence
ccgcacagcagtacttagtg

SEQ ID NO: 455819 - DNA, 20 bp, Artificial
  CRISPR gRNA sequence
cgcacagcagtacttagtgg

SEQ ID NO: 455820 - DNA, 20 bp, Artificial
  CRISPR gRNA sequence
agtggggaagaatagcagta

SEQ ID NO: 455821 - DNA, 20 bp, Artificial
  CRISPR gRNA sequence
gtggggaagaatagcagtac

SEQ ID NO: 455822 - DNA, 20 bp, Artificial
  CRISPR gRNA sequence
tgttattcctttccttccaa

SEQ ID NO: 455823 - DNA, 20 bp, Artificial
  CRISPR gRNA sequence
gttattcctttccttccaaa

SEQ ID NO: 455824 - DNA, 20 bp, Artificial
  CRISPR gRNA sequence
ttattcctttccttccaaag

SEQ ID NO: 455825 - DNA, 20 bp, Artificial
  CRISPR gRNA sequence
ttcctttccttccaaaggtg

SEQ ID NO: 455826 - DNA, 20 bp, Artificial
  CRISPR gRNA sequence
ctttccttccaaaggtgttt

SEQ ID NO: 455827 - DNA, 20 bp, Artificial
  CRISPR gRNA sequence
tccttccaaaggtgtttttc

SEQ ID NO: 455828 - DNA, 20 bp, Artificial
  CRISPR gRNA sequence
ccttccaaaggtgtttttca

SEQ ID NO: 455829 - DNA, 20 bp, Artificial
  CRISPR gRNA sequence
cttccaaaggtgtttttcag

SEQ ID NO: 455830 - DNA, 20 bp, Artificial
  CRISPR gRNA sequence
ccaaaggtgtttttcaggtc

SEQ ID NO: 455831 - DNA, 20 bp, Artificial
  CRISPR gRNA sequence
caaaggtgtttttcaggtct

SEQ ID NO: 455832 - DNA, 20 bp, Artificial
  CRISPR gRNA sequence
ttcaggtcttcatcacctca

SEQ ID NO: 455833 - DNA, 20 bp, Artificial
  CRISPR gRNA sequence
tcaggtcttcatcacctcac

SEQ ID NO: 455834 - DNA, 20 bp, Artificial
  CRISPR gRNA sequence
caggtcttcatcacctcaca

SEQ ID NO: 455835 - DNA, 20 bp, Artificial
  CRISPR gRNA sequence
aggtcttcatcacctcacac

SEQ ID NO: 455836 - DNA, 20 bp, Artificial
  CRISPR gRNA sequence
catcacctcacacttaacat

SEQ ID NO: 455837 - DNA, 20 bp, Artificial
  CRISPR gRNA sequence
atcacctcacacttaacata

SEQ ID NO: 455838 - DNA, 20 bp, Artificial
  CRISPR gRNA sequence
acacttaacatattcctata

SEQ ID NO: 455839 - DNA, 20 bp, Artificial
  CRISPR gRNA sequence
aacatattcctatagtctcc

SEQ ID NO: 455840 - DNA, 20 bp, Artificial
  CRISPR gRNA sequence
acatattcctatagtctcct

SEQ ID NO: 455841 - DNA, 20 bp, Artificial
  CRISPR gRNA sequence
ctatagtctcctaactagtg

SEQ ID NO: 455842 - DNA, 20 bp, Artificial
  CRISPR gRNA sequence
tagtctcctaactagtgagt

SEQ ID NO: 455843 - DNA, 20 bp, Artificial
  CRISPR gRNA sequence
ctaactagtgagtcccttga

SEQ ID NO: 455844 - DNA, 20 bp, Artificial
  CRISPR gRNA sequence
actagtgagtcccttgagtt

SEQ ID NO: 455845 - DNA, 20 bp, Artificial
  CRISPR gRNA sequence
gtgagtcccttgagttcagc

SEQ ID NO: 455846 - DNA, 20 bp, Artificial
  CRISPR gRNA sequence
gagttcagcaactgtgccct

SEQ ID NO: 455847 - DNA, 20 bp, Artificial
  CRISPR gRNA sequence
agttcagcaactgtgcccta

SEQ ID NO: 455848 - DNA, 20 bp, Artificial
  CRISPR gRNA sequence
agcaactgtgccctagtcac

SEQ ID NO: 455849 - DNA, 20 bp, Artificial
  CRISPR gRNA sequence
tgccctagtcacctttgtat

SEQ ID NO: 455850 - DNA, 20 bp, Artificial
  CRISPR gRNA sequence
gtcacctttgtatctcccac

SEQ ID NO: 455851 - DNA, 20 bp, Artificial
  CRISPR gRNA sequence
tgtatctcccacacctacca

SEQ ID NO: 455852 - DNA, 20 bp, Artificial
  CRISPR gRNA sequence
gtatctcccacacctaccac

SEQ ID NO: 455853 - DNA, 20 bp, Artificial
  CRISPR gRNA sequence
tatctcccacacctaccaca

SEQ ID NO: 455854 - DNA, 20 bp, Artificial
  CRISPR gRNA sequence
ccacacctaccacagggcct

SEQ ID NO: 455855 - DNA, 20 bp, Artificial
  CRISPR gRNA sequence
ccacagggcctagcactgag

SEQ ID NO: 455856 - DNA, 20 bp, Artificial
  CRISPR gRNA sequence
gcactgagctgttgcctaat

SEQ ID NO: 455857 - DNA, 20 bp, Artificial
  CRISPR gRNA sequence
agctgttgcctaatggtcca

SEQ ID NO: 455858 - DNA, 20 bp, Artificial
  CRISPR gRNA sequence
ttgcctaatggtccagcaac

SEQ ID NO: 455859 - DNA, 20 bp, Artificial
  CRISPR gRNA sequence
cctaatggtccagcaactct

SEQ ID NO: 455860 - DNA, 20 bp, Artificial
  CRISPR gRNA sequence
atggtccagcaactctaaat

SEQ ID NO: 455861 - DNA, 20 bp, Artificial
  CRISPR gRNA sequence
taaatactgtttctgcctcc

SEQ ID NO: 455862 - DNA, 20 bp, Artificial
  CRISPR gRNA sequence
aatactgtttctgcctccaa

SEQ ID NO: 455863 - DNA, 20 bp, Artificial
  CRISPR gRNA sequence
tttctgcctccaatccattc

SEQ ID NO: 455864 - DNA, 20 bp, Artificial
  CRISPR gRNA sequence
ctgcctccaatccattctac

SEQ ID NO: 455865 - DNA, 20 bp, Artificial
  CRISPR gRNA sequence
tgcctccaatccattctaca

SEQ ID NO: 455866 - DNA, 20 bp, Artificial
  CRISPR gRNA sequence
cctccaatccattctacata

SEQ ID NO: 455867 - DNA, 20 bp, Artificial
  CRISPR gRNA sequence
caatccattctacatactac

SEQ ID NO: 455868 - DNA, 20 bp, Artificial
  CRISPR gRNA sequence
tacatactaccaccagcttg

SEQ ID NO: 455869 - DNA, 20 bp, Artificial
  CRISPR gRNA sequence
catactaccaccagcttgtc

SEQ ID NO: 455870 - DNA, 20 bp, Artificial
  CRISPR gRNA sequence
ccaccagcttgtctttccaa

SEQ ID NO: 455871 - DNA, 20 bp, Artificial
  CRISPR gRNA sequence
gtctttccaaaatgctaatt

SEQ ID NO: 455872 - DNA, 20 bp, Artificial
  CRISPR gRNA sequence
tctttccaaaatgctaattt

SEQ ID NO: 455873 - DNA, 20 bp, Artificial
  CRISPR gRNA sequence
tccaaaatgctaatttgtac

SEQ ID NO: 455874 - DNA, 20 bp, Artificial
  CRISPR gRNA sequence
ccaaaatgctaatttgtaca

SEQ ID NO: 455875 - DNA, 20 bp, Artificial
  CRISPR gRNA sequence
caaaatgctaatttgtacat

SEQ ID NO: 455876 - DNA, 20 bp, Artificial
  CRISPR gRNA sequence
atttgtacatgccacatcac

SEQ ID NO: 455877 - DNA, 20 bp, Artificial
  CRISPR gRNA sequence
gtacatgccacatcactcaa

SEQ ID NO: 455878 - DNA, 20 bp, Artificial
  CRISPR gRNA sequence
tacatgccacatcactcaaa

SEQ ID NO: 455879 - DNA, 20 bp, Artificial
  CRISPR gRNA sequence
aaagttttaatggcttctca

SEQ ID NO: 455880 - DNA, 20 bp, Artificial
  CRISPR gRNA sequence
taatggcttctcactgtcta

SEQ ID NO: 455881 - DNA, 20 bp, Artificial
  CRISPR gRNA sequence
aatggcttctcactgtctat

SEQ ID NO: 455882 - DNA, 20 bp, Artificial
  CRISPR gRNA sequence
atggcttctcactgtctatg

SEQ ID NO: 455883 - DNA, 20 bp, Artificial
  CRISPR gRNA sequence
ctcactgtctatggaataaa

SEQ ID NO: 455884 - DNA, 20 bp, Artificial
  CRISPR gRNA sequence
tcactgtctatggaataaag

SEQ ID NO: 455885 - DNA, 20 bp, Artificial
  CRISPR gRNA sequence
actgtctatggaataaagtc

SEQ ID NO: 455886 - DNA, 20 bp, Artificial
  CRISPR gRNA sequence
tctatggaataaagtctaaa

SEQ ID NO: 455887 - DNA, 20 bp, Artificial
  CRISPR gRNA sequence
tggaataaagtctaaattac

SEQ ID NO: 455888 - DNA, 20 bp, Artificial
  CRISPR gRNA sequence
aattacattagcctggcact

SEQ ID NO: 455889 - DNA, 20 bp, Artificial
  CRISPR gRNA sequence
cattagcctggcactagaga

SEQ ID NO: 455890 - DNA, 20 bp, Artificial
  CRISPR gRNA sequence
gcctggcactagagactcta

SEQ ID NO: 455891 - DNA, 20 bp, Artificial
  CRISPR gRNA sequence
gcactagagactctatagca

SEQ ID NO: 455892 - DNA, 20 bp, Artificial
  CRISPR gRNA sequence
gagactctatagcatttcat

SEQ ID NO: 455893 - DNA, 20 bp, Artificial
  CRISPR gRNA sequence
tatagcatttcattctattt

SEQ ID NO: 455894 - DNA, 20 bp, Artificial
  CRISPR gRNA sequence
tagcatttcattctatttat

SEQ ID NO: 455895 - DNA, 20 bp, Artificial
  CRISPR gRNA sequence
cattctatttatgtgaatac

SEQ ID NO: 455896 - DNA, 20 bp, Artificial
  CRISPR gRNA sequence
attctatttatgtgaataca

SEQ ID NO: 455897 - DNA, 20 bp, Artificial
  CRISPR gRNA sequence
tatttatgtgaatacattgc

SEQ ID NO: 455898 - DNA, 20 bp, Artificial
  CRISPR gRNA sequence
tttatgtgaatacattgctt

SEQ ID NO: 455899 - DNA, 20 bp, Artificial
  CRISPR gRNA sequence
atgtgaatacattgcttcag

SEQ ID NO: 455900 - DNA, 20 bp, Artificial
  CRISPR gRNA sequence
tgtgaatacattgcttcagt

SEQ ID NO: 455901 - DNA, 20 bp, Artificial
  CRISPR gRNA sequence
cttcagttaaactgcactag

SEQ ID NO: 455902 - DNA, 20 bp, Artificial
  CRISPR gRNA sequence
cagttaaactgcactagtgg

SEQ ID NO: 455903 - DNA, 20 bp, Artificial
  CRISPR gRNA sequence
agttaaactgcactagtgga

SEQ ID NO: 455904 - DNA, 20 bp, Artificial
  CRISPR gRNA sequence
aactgcactagtggatactc

SEQ ID NO: 455905 - DNA, 20 bp, Artificial
  CRISPR gRNA sequence
cactagtggatactcctctt

SEQ ID NO: 455906 - DNA, 20 bp, Artificial
  CRISPR gRNA sequence
gtggatactcctctttcatt

SEQ ID NO: 455907 - DNA, 20 bp, Artificial
  CRISPR gRNA sequence
ctctttcattcatctaacaa

SEQ ID NO: 455908 - DNA, 20 bp, Artificial
  CRISPR gRNA sequence
tttcattcatctaacaaata

SEQ ID NO: 455909 - DNA, 20 bp, Artificial
  CRISPR gRNA sequence
tcattcatctaacaaatatg

SEQ ID NO: 455910 - DNA, 20 bp, Artificial
  CRISPR gRNA sequence
cattcatctaacaaatatgt

SEQ ID NO: 455911 - DNA, 20 bp, Artificial
  CRISPR gRNA sequence
attcatctaacaaatatgta

SEQ ID NO: 455912 - DNA, 20 bp, Artificial
  CRISPR gRNA sequence
atctaacaaatatgtattgt

SEQ ID NO: 455913 - DNA, 20 bp, Artificial
  CRISPR gRNA sequence
acaaatatgtattgtgcatc

SEQ ID NO: 455914 - DNA, 20 bp, Artificial
  CRISPR gRNA sequence
tgcatcccaggcccagcgct

SEQ ID NO: 455915 - DNA, 20 bp, Artificial
  CRISPR gRNA sequence
tgccttggagaacagaatga

SEQ ID NO: 455916 - DNA, 20 bp, Artificial
  CRISPR gRNA sequence
ggagaacagaatgaggtata

SEQ ID NO: 455917 - DNA, 20 bp, Artificial
  CRISPR gRNA sequence
gagaacagaatgaggtataa

SEQ ID NO: 455918 - DNA, 20 bp, Artificial
  CRISPR gRNA sequence
gctccttataacctaaatcc

SEQ ID NO: 455919 - DNA, 20 bp, Artificial
  CRISPR gRNA sequence
ctccttataacctaaatcct

SEQ ID NO: 455920 - DNA, 20 bp, Artificial
  CRISPR gRNA sequence
cttataacctaaatcctgtt

SEQ ID NO: 455921 - DNA, 20 bp, Artificial
  CRISPR gRNA sequence
ataacctaaatcctgttctc

SEQ ID NO: 455922 - DNA, 20 bp, Artificial
  CRISPR gRNA sequence
taacctaaatcctgttctcc

SEQ ID NO: 455923 - DNA, 20 bp, Artificial
  CRISPR gRNA sequence
aatcctgttctcctaatata

SEQ ID NO: 455924 - DNA, 20 bp, Artificial
  CRISPR gRNA sequence
ttctcctaatatattgtttt

SEQ ID NO: 455925 - DNA, 20 bp, Artificial
  CRISPR gRNA sequence
tcctaatatattgttttagt

SEQ ID NO: 455926 - DNA, 20 bp, Artificial
  CRISPR gRNA sequence
ctaatatattgttttagttg

SEQ ID NO: 455927 - DNA, 20 bp, Artificial
  CRISPR gRNA sequence
atatattgttttagttgtga

SEQ ID NO: 455928 - DNA, 20 bp, Artificial
  CRISPR gRNA sequence
ttttagttgtgaagattctc

SEQ ID NO: 455929 - DNA, 20 bp, Artificial
  CRISPR gRNA sequence
tagttgtgaagattctccct

SEQ ID NO: 455930 - DNA, 20 bp, Artificial
  CRISPR gRNA sequence
agttgtgaagattctcccta

SEQ ID NO: 455931 - DNA, 20 bp, Artificial
  CRISPR gRNA sequence
gttgtgaagattctccctaa

SEQ ID NO: 455932 - DNA, 20 bp, Artificial
  CRISPR gRNA sequence
tgaagattctccctaaggaa

SEQ ID NO: 455933 - DNA, 20 bp, Artificial
  CRISPR gRNA sequence
tccctaaggaagaatgcttt

SEQ ID NO: 455934 - DNA, 20 bp, Artificial
  CRISPR gRNA sequence
cctaaggaagaatgcttttc

SEQ ID NO: 455935 - DNA, 20 bp, Artificial
  CRISPR gRNA sequence
aggaagaatgcttttctcat

SEQ ID NO: 455936 - DNA, 20 bp, Artificial
  CRISPR gRNA sequence
ttctcatcttctcagcatat

SEQ ID NO: 455937 - DNA, 20 bp, Artificial
  CRISPR gRNA sequence
tctcatcttctcagcatatt

SEQ ID NO: 455938 - DNA, 20 bp, Artificial
  CRISPR gRNA sequence
ctcatcttctcagcatattt

SEQ ID NO: 455939 - DNA, 20 bp, Artificial
  CRISPR gRNA sequence
tcatcttctcagcatattta

SEQ ID NO: 455940 - DNA, 20 bp, Artificial
  CRISPR gRNA sequence
atcttctcagcatatttaag

SEQ ID NO: 455941 - DNA, 20 bp, Artificial
  CRISPR gRNA sequence
ctcagcatatttaagtatta

SEQ ID NO: 455942 - DNA, 20 bp, Artificial
  CRISPR gRNA sequence
tcagcatatttaagtattag

SEQ ID NO: 455943 - DNA, 20 bp, Artificial
  CRISPR gRNA sequence
agcatatttaagtattagag

SEQ ID NO: 455944 - DNA, 20 bp, Artificial
  CRISPR gRNA sequence
aagtattagagtcagcacat

SEQ ID NO: 455945 - DNA, 20 bp, Artificial
  CRISPR gRNA sequence
agtattagagtcagcacatc

SEQ ID NO: 455946 - DNA, 20 bp, Artificial
  CRISPR gRNA sequence
gagtcagcacatctagatgg

SEQ ID NO: 455947 - DNA, 20 bp, Artificial
  CRISPR gRNA sequence
gatggttccccaagtgtgga

SEQ ID NO: 455948 - DNA, 20 bp, Artificial
  CRISPR gRNA sequence
cccaagtgtggaaattaggt

SEQ ID NO: 455949 - DNA, 20 bp, Artificial
  CRISPR gRNA sequence
ggtgcattttggaaggtaaa

SEQ ID NO: 455950 - DNA, 20 bp, Artificial
  CRISPR gRNA sequence
tggaaggtaaaactagttaa

SEQ ID NO: 455951 - DNA, 20 bp, Artificial
  CRISPR gRNA sequence
ggaaggtaaaactagttaag

SEQ ID NO: 455952 - DNA, 20 bp, Artificial
  CRISPR gRNA sequence
gaaggtaaaactagttaaga

SEQ ID NO: 455953 - DNA, 20 bp, Artificial
  CRISPR gRNA sequence
gttaagaagagacaggtaat

SEQ ID NO: 455954 - DNA, 20 bp, Artificial
  CRISPR gRNA sequence
agaagagacaggtaataaac

SEQ ID NO: 455955 - DNA, 20 bp, Artificial
  CRISPR gRNA sequence
acgcctgtaatcccagcact

SEQ ID NO: 455956 - DNA, 20 bp, Artificial
  CRISPR gRNA sequence
taatcccagcacttcaggag

SEQ ID NO: 455957 - DNA, 20 bp, Artificial
  CRISPR gRNA sequence
caggaggctgaggctggcag

SEQ ID NO: 455958 - DNA, 20 bp, Artificial
  CRISPR gRNA sequence
aggaggctgaggctggcaga

SEQ ID NO: 455959 - DNA, 20 bp, Artificial
  CRISPR gRNA sequence
aggctggcagatcatttgag

SEQ ID NO: 455960 - DNA, 20 bp, Artificial
  CRISPR gRNA sequence
gcagatcatttgagatcagg

SEQ ID NO: 455961 - DNA, 20 bp, Artificial
  CRISPR gRNA sequence
gagatcaggagttcgagaca

SEQ ID NO: 455962 - DNA, 20 bp, Artificial
  CRISPR gRNA sequence
agatcaggagttcgagacaa

SEQ ID NO: 455963 - DNA, 20 bp, Artificial
  CRISPR gRNA sequence
gagacaagcctggccaacat

SEQ ID NO: 455964 - DNA, 20 bp, Artificial
  CRISPR gRNA sequence
gccaacatggtgaaaccctg

SEQ ID NO: 455965 - DNA, 20 bp, Artificial
  CRISPR gRNA sequence
tctctactaaaaatacaaaa

SEQ ID NO: 455966 - DNA, 20 bp, Artificial
  CRISPR gRNA sequence
tactaaaaatacaaaaaata

SEQ ID NO: 455967 - DNA, 20 bp, Artificial
  CRISPR gRNA sequence
ctaaaaatacaaaaaatagc

SEQ ID NO: 455968 - DNA, 20 bp, Artificial
  CRISPR gRNA sequence
aaaatacaaaaaatagccga

SEQ ID NO: 455969 - DNA, 20 bp, Artificial
  CRISPR gRNA sequence
taatcccagctacttgggag

SEQ ID NO: 455970 - DNA, 20 bp, Artificial
  CRISPR gRNA sequence
cttgggaggctgaggcagga

SEQ ID NO: 455971 - DNA, 20 bp, Artificial
  CRISPR gRNA sequence
gggaggctgaggcaggagaa

SEQ ID NO: 455972 - DNA, 20 bp, Artificial
  CRISPR gRNA sequence
ggaggctgaggcaggagaat

SEQ ID NO: 455973 - DNA, 20 bp, Artificial
  CRISPR gRNA sequence
aggcaggagaatcacttgaa

SEQ ID NO: 455974 - DNA, 20 bp, Artificial
  CRISPR gRNA sequence
gaacccgggaagcagaggtt

SEQ ID NO: 455975 - DNA, 20 bp, Artificial
  CRISPR gRNA sequence
aacccgggaagcagaggttg

SEQ ID NO: 455976 - DNA, 20 bp, Artificial
  CRISPR gRNA sequence
cagtgagccgagattgcgcc

SEQ ID NO: 455977 - DNA, 20 bp, Artificial
  CRISPR gRNA sequence
cgccactgcactcgagcctg

SEQ ID NO: 455978 - DNA, 20 bp, Artificial
  CRISPR gRNA sequence
cactcgagcctgggcgacag

SEQ ID NO: 455979 - DNA, 20 bp, Artificial
  CRISPR gRNA sequence
gagcctgggcgacagagcca

SEQ ID NO: 455980 - DNA, 20 bp, Artificial
  CRISPR gRNA sequence
ggcgacagagccagactctg

SEQ ID NO: 455981 - DNA, 20 bp, Artificial
  CRISPR gRNA sequence
tgtctcaaaaaaagaaataa

SEQ ID NO: 455982 - DNA, 20 bp, Artificial
  CRISPR gRNA sequence
tctcaaaaaaagaaataata

SEQ ID NO: 455983 - DNA, 20 bp, Artificial
  CRISPR gRNA sequence
aaaaaaagaaataataaaat

SEQ ID NO: 455984 - DNA, 20 bp, Artificial
  CRISPR gRNA sequence
ccatttactgagtgcttact

SEQ ID NO: 455985 - DNA, 20 bp, Artificial
  CRISPR gRNA sequence
actgagtgcttactgtgggc

SEQ ID NO: 455986 - DNA, 20 bp, Artificial
  CRISPR gRNA sequence
ctgagtgcttactgtgggcc

SEQ ID NO: 455987 - DNA, 20 bp, Artificial
  CRISPR gRNA sequence
agtgcttactgtgggccagg

SEQ ID NO: 455988 - DNA, 20 bp, Artificial
  CRISPR gRNA sequence
actgtgggccaggcattgtg

SEQ ID NO: 455989 - DNA, 20 bp, Artificial
  CRISPR gRNA sequence
ctgtgggccaggcattgtgc

SEQ ID NO: 455990 - DNA, 20 bp, Artificial
  CRISPR gRNA sequence
tgggccaggcattgtgctaa

SEQ ID NO: 455991 - DNA, 20 bp, Artificial
  CRISPR gRNA sequence
tgctaagtgatattatatta

SEQ ID NO: 455992 - DNA, 20 bp, Artificial
  CRISPR gRNA sequence
agtgatattatattatttaa

SEQ ID NO: 455993 - DNA, 20 bp, Artificial
  CRISPR gRNA sequence
tattatttaatctccatggt

SEQ ID NO: 455994 - DNA, 20 bp, Artificial
  CRISPR gRNA sequence
tttaatctccatggtctttt

SEQ ID NO: 455995 - DNA, 20 bp, Artificial
  CRISPR gRNA sequence
aatctccatggtcttttgag

SEQ ID NO: 455996 - DNA, 20 bp, Artificial
  CRISPR gRNA sequence
atctccatggtcttttgagc

SEQ ID NO: 455997 - DNA, 20 bp, Artificial
  CRISPR gRNA sequence
catggtcttttgagctattg

SEQ ID NO: 455998 - DNA, 20 bp, Artificial
  CRISPR gRNA sequence
ttgagctattgtcctgtgat

SEQ ID NO: 455999 - DNA, 20 bp, Artificial
  CRISPR gRNA sequence
tgagctattgtcctgtgata

SEQ ID NO: 456000 - DNA, 20 bp, Artificial
  CRISPR gRNA sequence
gagctattgtcctgtgataa

SEQ ID NO: 456001 - DNA, 20 bp, Artificial
  CRISPR gRNA sequence
agctattgtcctgtgataac

SEQ ID NO: 456002 - DNA, 20 bp, Artificial
  CRISPR gRNA sequence
ttgtcctgtgataactcaag

SEQ ID NO: 456003 - DNA, 20 bp, Artificial
  CRISPR gRNA sequence
tcctgtgataactcaagctt

SEQ ID NO: 456004 - DNA, 20 bp, Artificial
  CRISPR gRNA sequence
tgataactcaagcttgaaga

SEQ ID NO: 456005 - DNA, 20 bp, Artificial
  CRISPR gRNA sequence
aagcttgaagataatttatg

SEQ ID NO: 456006 - DNA, 20 bp, Artificial
  CRISPR gRNA sequence
gaagataatttatgttcatc

SEQ ID NO: 456007 - DNA, 20 bp, Artificial
  CRISPR gRNA sequence
aagataatttatgttcatcc

SEQ ID NO: 456008 - DNA, 20 bp, Artificial
  CRISPR gRNA sequence
atgttcatccaacagtaaat

SEQ ID NO: 456009 - DNA, 20 bp, Artificial
  CRISPR gRNA sequence
tgttcatccaacagtaaatg

SEQ ID NO: 456010 - DNA, 20 bp, Artificial
  CRISPR gRNA sequence
atccaacagtaaatgatgga

SEQ ID NO: 456011 - DNA, 20 bp, Artificial
  CRISPR gRNA sequence
gtccaggtgcagtgtctcat

SEQ ID NO: 456012 - DNA, 20 bp, Artificial
  CRISPR gRNA sequence
atgcctgtaaccccagcact

SEQ ID NO: 456013 - DNA, 20 bp, Artificial
  CRISPR gRNA sequence
taaccccagcacttagggag

SEQ ID NO: 456014 - DNA, 20 bp, Artificial
  CRISPR gRNA sequence
agggaggccaaggcaggtgc

SEQ ID NO: 456015 - DNA, 20 bp, Artificial
  CRISPR gRNA sequence
gggaggccaaggcaggtgca

SEQ ID NO: 456016 - DNA, 20 bp, Artificial
  CRISPR gRNA sequence
gaacccaggagttcgagacc

SEQ ID NO: 456017 - DNA, 20 bp, Artificial
  CRISPR gRNA sequence
aacccaggagttcgagacca

SEQ ID NO: 456018 - DNA, 20 bp, Artificial
  CRISPR gRNA sequence
gagaccagcctgggcaacac

SEQ ID NO: 456019 - DNA, 20 bp, Artificial
  CRISPR gRNA sequence
ggcaacacagtgaaaacctg

SEQ ID NO: 456020 - DNA, 20 bp, Artificial
  CRISPR gRNA sequence
tctctacaaaaaatacaaaa

SEQ ID NO: 456021 - DNA, 20 bp, Artificial
  CRISPR gRNA sequence
tacaaaaaatacaaaaattg

SEQ ID NO: 456022 - DNA, 20 bp, Artificial
  CRISPR gRNA sequence
caaaaaatacaaaaattggc

SEQ ID NO: 456023 - DNA, 20 bp, Artificial
  CRISPR gRNA sequence
gctgggcgtggtggcacatg

SEQ ID NO: 456024 - DNA, 20 bp, Artificial
  CRISPR gRNA sequence
ggcgtggtggcacatgcctg

SEQ ID NO: 456025 - DNA, 20 bp, Artificial
  CRISPR gRNA sequence
tagtcccagctactagggaa

SEQ ID NO: 456026 - DNA, 20 bp, Artificial
  CRISPR gRNA sequence
ctagggaagctgaggtggga

SEQ ID NO: 456027 - DNA, 20 bp, Artificial
  CRISPR gRNA sequence
gggaagctgaggtgggagga

SEQ ID NO: 456028 - DNA, 20 bp, Artificial
  CRISPR gRNA sequence
aggtgggaggatcgattggg

SEQ ID NO: 456029 - DNA, 20 bp, Artificial
  CRISPR gRNA sequence
ggctcggggcatgaggctgc

SEQ ID NO: 456030 - DNA, 20 bp, Artificial
  CRISPR gRNA sequence
ggggcatgaggctgcagtga

SEQ ID NO: 456031 - DNA, 20 bp, Artificial
  CRISPR gRNA sequence
cagtgacccatgatcatgcc

SEQ ID NO: 456032 - DNA, 20 bp, Artificial
  CRISPR gRNA sequence
tactctagcctggatgacag

SEQ ID NO: 456033 - DNA, 20 bp, Artificial
  CRISPR gRNA sequence
tagcctggatgacagagcaa

SEQ ID NO: 456034 - DNA, 20 bp, Artificial
  CRISPR gRNA sequence
gcctggatgacagagcaaga

SEQ ID NO: 456035 - DNA, 20 bp, Artificial
  CRISPR gRNA sequence
gatgacagagcaagaccctg

SEQ ID NO: 456036 - DNA, 20 bp, Artificial
  CRISPR gRNA sequence
tctcaaaaaaacaaaaacaa

SEQ ID NO: 456037 - DNA, 20 bp, Artificial
  CRISPR gRNA sequence
aaaaaaacaaaaacaaaaca

SEQ ID NO: 456038 - DNA, 20 bp, Artificial
  CRISPR gRNA sequence
ttccaaaagggcaagatttt

SEQ ID NO: 456039 - DNA, 20 bp, Artificial
  CRISPR gRNA sequence
caaaagggcaagattttaac

SEQ ID NO: 456040 - DNA, 20 bp, Artificial
  CRISPR gRNA sequence
taacttatgctagattgctt

SEQ ID NO: 456041 - DNA, 20 bp, Artificial
  CRISPR gRNA sequence
aacttatgctagattgcttg

SEQ ID NO: 456042 - DNA, 20 bp, Artificial
  CRISPR gRNA sequence
acttatgctagattgcttga

SEQ ID NO: 456043 - DNA, 20 bp, Artificial
  CRISPR gRNA sequence
atgctagattgcttgaacca

SEQ ID NO: 456044 - DNA, 20 bp, Artificial
  CRISPR gRNA sequence
tgctagattgcttgaaccac

SEQ ID NO: 456045 - DNA, 20 bp, Artificial
  CRISPR gRNA sequence
gattgcttgaaccactctag

SEQ ID NO: 456046 - DNA, 20 bp, Artificial
  CRISPR gRNA sequence
cttgaaccactctagaaaat

SEQ ID NO: 456047 - DNA, 20 bp, Artificial
  CRISPR gRNA sequence
gaaccactctagaaaatggg

SEQ ID NO: 456048 - DNA, 20 bp, Artificial
  CRISPR gRNA sequence
aaccactctagaaaatgggg

SEQ ID NO: 456049 - DNA, 20 bp, Artificial
  CRISPR gRNA sequence
tagaaaatggggctatttgg

SEQ ID NO: 456050 - DNA, 20 bp, Artificial
  CRISPR gRNA sequence
gaaaatggggctatttgggg

SEQ ID NO: 456051 - DNA, 20 bp, Artificial
  CRISPR gRNA sequence
tttggggatacccaagtcca

SEQ ID NO: 456052 - DNA, 20 bp, Artificial
  CRISPR gRNA sequence
ggggatacccaagtccaagg

SEQ ID NO: 456053 - DNA, 20 bp, Artificial
  CRISPR gRNA sequence
gggatacccaagtccaaggc

SEQ ID NO: 456054 - DNA, 20 bp, Artificial
  CRISPR gRNA sequence
agctgtttcagctatctctg

SEQ ID NO: 456055 - DNA, 20 bp, Artificial
  CRISPR gRNA sequence
tttcagctatctctgtggca

SEQ ID NO: 456056 - DNA, 20 bp, Artificial
  CRISPR gRNA sequence
cagctatctctgtggcaaaa

SEQ ID NO: 456057 - DNA, 20 bp, Artificial
  CRISPR gRNA sequence
agctatctctgtggcaaaac

SEQ ID NO: 456058 - DNA, 20 bp, Artificial
  CRISPR gRNA sequence
tctctgtggcaaaactttag

SEQ ID NO: 456059 - DNA, 20 bp, Artificial
  CRISPR gRNA sequence
tgtggcaaaactttagaatt

SEQ ID NO: 456060 - DNA, 20 bp, Artificial
  CRISPR gRNA sequence
tggcaaaactttagaattac

SEQ ID NO: 456061 - DNA, 20 bp, Artificial
  CRISPR gRNA sequence
tagaattactttaagatcta

SEQ ID NO: 456062 - DNA, 20 bp, Artificial
  CRISPR gRNA sequence
agaattactttaagatctat

SEQ ID NO: 456063 - DNA, 20 bp, Artificial
  CRISPR gRNA sequence
gaattactttaagatctatc

SEQ ID NO: 456064 - DNA, 20 bp, Artificial
  CRISPR gRNA sequence
ctttaagatctatctgcatc

SEQ ID NO: 456065 - DNA, 20 bp, Artificial
  CRISPR gRNA sequence
taagatctatctgcatccct

SEQ ID NO: 456066 - DNA, 20 bp, Artificial
  CRISPR gRNA sequence
aagatctatctgcatcccta

SEQ ID NO: 456067 - DNA, 20 bp, Artificial
  CRISPR gRNA sequence
agatctatctgcatccctag

SEQ ID NO: 456068 - DNA, 20 bp, Artificial
  CRISPR gRNA sequence
tctgcatccctagtgtctga

SEQ ID NO: 456069 - DNA, 20 bp, Artificial
  CRISPR gRNA sequence
catccctagtgtctgacaca

SEQ ID NO: 456070 - DNA, 20 bp, Artificial
  CRISPR gRNA sequence
gtgtctgacacacaggagat

SEQ ID NO: 456071 - DNA, 20 bp, Artificial
  CRISPR gRNA sequence
acacacaggagattctatac

SEQ ID NO: 456072 - DNA, 20 bp, Artificial
  CRISPR gRNA sequence
tatacttatttatggctgcc

SEQ ID NO: 456073 - DNA, 20 bp, Artificial
  CRISPR gRNA sequence
tacttatttatggctgccta

SEQ ID NO: 456074 - DNA, 20 bp, Artificial
  CRISPR gRNA sequence
atttatggctgcctaagtac

SEQ ID NO: 456075 - DNA, 20 bp, Artificial
  CRISPR gRNA sequence
tttatggctgcctaagtaca

SEQ ID NO: 456076 - DNA, 20 bp, Artificial
  CRISPR gRNA sequence
atggctgcctaagtacatca

SEQ ID NO: 456077 - DNA, 20 bp, Artificial
  CRISPR gRNA sequence
tggctgcctaagtacatcat

SEQ ID NO: 456078 - DNA, 20 bp, Artificial
  CRISPR gRNA sequence
cctaagtacatcatcattac

SEQ ID NO: 456079 - DNA, 20 bp, Artificial
  CRISPR gRNA sequence
agtacatcatcattacccac

SEQ ID NO: 456080 - DNA, 20 bp, Artificial
  CRISPR gRNA sequence
cccacaatgttaaaaatact

SEQ ID NO: 456081 - DNA, 20 bp, Artificial
  CRISPR gRNA sequence
aaaatacttatttgggcaac

SEQ ID NO: 456082 - DNA, 20 bp, Artificial
  CRISPR gRNA sequence
atttgggcaacgaattacag

SEQ ID NO: 456083 - DNA, 20 bp, Artificial
  CRISPR gRNA sequence
tttgggcaacgaattacaga

SEQ ID NO: 456084 - DNA, 20 bp, Artificial
  CRISPR gRNA sequence
gggcaacgaattacagaggg

SEQ ID NO: 456085 - DNA, 20 bp, Artificial
  CRISPR gRNA sequence
ggcaacgaattacagaggga

SEQ ID NO: 456086 - DNA, 20 bp, Artificial
  CRISPR gRNA sequence
cagagggaggaatccttgga

SEQ ID NO: 456087 - DNA, 20 bp, Artificial
  CRISPR gRNA sequence
ggagatcataaaagagatgt

SEQ ID NO: 456088 - DNA, 20 bp, Artificial
  CRISPR gRNA sequence
gagatcataaaagagatgtt

SEQ ID NO: 456089 - DNA, 20 bp, Artificial
  CRISPR gRNA sequence
tgagatgatgcaaaaggaga

SEQ ID NO: 456090 - DNA, 20 bp, Artificial
  CRISPR gRNA sequence
atgatttctgaaaccctccc

SEQ ID NO: 456091 - DNA, 20 bp, Artificial
  CRISPR gRNA sequence
ctgaaaccctcccctgatcc

SEQ ID NO: 456092 - DNA, 20 bp, Artificial
  CRISPR gRNA sequence
tgaaaccctcccctgatcca

SEQ ID NO: 456093 - DNA, 20 bp, Artificial
  CRISPR gRNA sequence
aaaccctcccctgatccatg

SEQ ID NO: 456094 - DNA, 20 bp, Artificial
  CRISPR gRNA sequence
ccctgatccatgattctctt

SEQ ID NO: 456095 - DNA, 20 bp, Artificial
  CRISPR gRNA sequence
atccatgattctcttttgaa

SEQ ID NO: 456096 - DNA, 20 bp, Artificial
  CRISPR gRNA sequence
tcttttgaaccagagacagg

SEQ ID NO: 456097 - DNA, 20 bp, Artificial
  CRISPR gRNA sequence
ttttgaaccagagacaggga

SEQ ID NO: 456098 - DNA, 20 bp, Artificial
  CRISPR gRNA sequence
ttgaaccagagacagggaac

SEQ ID NO: 456099 - DNA, 20 bp, Artificial
  CRISPR gRNA sequence
tgaaccagagacagggaact

SEQ ID NO: 456100 - DNA, 20 bp, Artificial
  CRISPR gRNA sequence
gaaccagagacagggaacta

SEQ ID NO: 456101 - DNA, 20 bp, Artificial
  CRISPR gRNA sequence
aaccagagacagggaactac

SEQ ID NO: 456102 - DNA, 20 bp, Artificial
  CRISPR gRNA sequence
cacagtgacgggattgaaac

SEQ ID NO: 456103 - DNA, 20 bp, Artificial
  CRISPR gRNA sequence
aaacaaagacaacaccttga

SEQ ID NO: 456104 - DNA, 20 bp, Artificial
  CRISPR gRNA sequence
gagttcagccataatgaagg

SEQ ID NO: 456105 - DNA, 20 bp, Artificial
  CRISPR gRNA sequence
agttcagccataatgaaggc

SEQ ID NO: 456106 - DNA, 20 bp, Artificial
  CRISPR gRNA sequence
agccataatgaaggcactct

SEQ ID NO: 456107 - DNA, 20 bp, Artificial
  CRISPR gRNA sequence
tcagttcaggcttcctacaa

SEQ ID NO: 456108 - DNA, 20 bp, Artificial
  CRISPR gRNA sequence
agttcaggcttcctacaaga

SEQ ID NO: 456109 - DNA, 20 bp, Artificial
  CRISPR gRNA sequence
aggcttcctacaagaaaagg

SEQ ID NO: 456110 - DNA, 20 bp, Artificial
  CRISPR gRNA sequence
cctacaagaaaaggtctggg

SEQ ID NO: 456111 - DNA, 20 bp, Artificial
  CRISPR gRNA sequence
ctacaagaaaaggtctgggt

SEQ ID NO: 456112 - DNA, 20 bp, Artificial
  CRISPR gRNA sequence
caagaaaaggtctgggtaat

SEQ ID NO: 456113 - DNA, 20 bp, Artificial
  CRISPR gRNA sequence
ggtaatgctggtcaccagcc

SEQ ID NO: 456114 - DNA, 20 bp, Artificial
  CRISPR gRNA sequence
gtcaccagccttgtggccct

SEQ ID NO: 456115 - DNA, 20 bp, Artificial
  CRISPR gRNA sequence
gtggcccttcaaggtatgtc

SEQ ID NO: 456116 - DNA, 20 bp, Artificial
  CRISPR gRNA sequence
tggcccttcaaggtatgtcc

SEQ ID NO: 456117 - DNA, 20 bp, Artificial
  CRISPR gRNA sequence
caaggtatgtccaaaagagc

SEQ ID NO: 456118 - DNA, 20 bp, Artificial
  CRISPR gRNA sequence
aaggtatgtccaaaagagcc

SEQ ID NO: 456119 - DNA, 20 bp, Artificial
  CRISPR gRNA sequence
ttatatttctgccaccttgg

SEQ ID NO: 456120 - DNA, 20 bp, Artificial
  CRISPR gRNA sequence
tatttctgccaccttggtta

SEQ ID NO: 456121 - DNA, 20 bp, Artificial
  CRISPR gRNA sequence
ctgccaccttggttattctc

SEQ ID NO: 456122 - DNA, 20 bp, Artificial
  CRISPR gRNA sequence
tgccaccttggttattctcc

SEQ ID NO: 456123 - DNA, 20 bp, Artificial
  CRISPR gRNA sequence
ccaccttggttattctccag

SEQ ID NO: 456124 - DNA, 20 bp, Artificial
  CRISPR gRNA sequence
ggttattctccaggaggaga

SEQ ID NO: 456125 - DNA, 20 bp, Artificial
  CRISPR gRNA sequence
gttattctccaggaggagaa

SEQ ID NO: 456126 - DNA, 20 bp, Artificial
  CRISPR gRNA sequence
ttctccaggaggagaaggtt

SEQ ID NO: 456127 - DNA, 20 bp, Artificial
  CRISPR gRNA sequence
tccaggaggagaaggttgga

SEQ ID NO: 456128 - DNA, 20 bp, Artificial
  CRISPR gRNA sequence
caggaggagaaggttggaaa

SEQ ID NO: 456129 - DNA, 20 bp, Artificial
  CRISPR gRNA sequence
gaaaggatgtccagggggag

SEQ ID NO: 456130 - DNA, 20 bp, Artificial
  CRISPR gRNA sequence
ctcaagccctggctatccac

SEQ ID NO: 456131 - DNA, 20 bp, Artificial
  CRISPR gRNA sequence
aagccctggctatccacagg

SEQ ID NO: 456132 - DNA, 20 bp, Artificial
  CRISPR gRNA sequence
gctatccacaggaaagttca

SEQ ID NO: 456133 - DNA, 20 bp, Artificial
  CRISPR gRNA sequence
tccacaggaaagttcaaacc

SEQ ID NO: 456134 - DNA, 20 bp, Artificial
  CRISPR gRNA sequence
aaaccagtttcactgatcca

SEQ ID NO: 456135 - DNA, 20 bp, Artificial
  CRISPR gRNA sequence
cactgatccaaaggcactaa

SEQ ID NO: 456136 - DNA, 20 bp, Artificial
  CRISPR gRNA sequence
actgatccaaaggcactaag

SEQ ID NO: 456137 - DNA, 20 bp, Artificial
  CRISPR gRNA sequence
atccaaaggcactaaggagg

SEQ ID NO: 456138 - DNA, 20 bp, Artificial
  CRISPR gRNA sequence
aggaggaagacagataaatc

SEQ ID NO: 456139 - DNA, 20 bp, Artificial
  CRISPR gRNA sequence
ttcaatgggtaggaggtaag

SEQ ID NO: 456140 - DNA, 20 bp, Artificial
  CRISPR gRNA sequence
tcaatgggtaggaggtaaga

SEQ ID NO: 456141 - DNA, 20 bp, Artificial
  CRISPR gRNA sequence
caatgggtaggaggtaagac

SEQ ID NO: 456142 - DNA, 20 bp, Artificial
  CRISPR gRNA sequence
aatgggtaggaggtaagact

SEQ ID NO: 456143 - DNA, 20 bp, Artificial
  CRISPR gRNA sequence
attaggaatgaaggcctgtg

SEQ ID NO: 456144 - DNA, 20 bp, Artificial
  CRISPR gRNA sequence
ggaatgaaggcctgtgagag

SEQ ID NO: 456145 - DNA, 20 bp, Artificial
  CRISPR gRNA sequence
tgagagaggcaagttagtac

SEQ ID NO: 456146 - DNA, 20 bp, Artificial
  CRISPR gRNA sequence
gtacaactacctctactcac

SEQ ID NO: 456147 - DNA, 20 bp, Artificial
  CRISPR gRNA sequence
cctctactcactgcatgaac

SEQ ID NO: 456148 - DNA, 20 bp, Artificial
  CRISPR gRNA sequence
tactcactgcatgaacagag

SEQ ID NO: 456149 - DNA, 20 bp, Artificial
  CRISPR gRNA sequence
ctcactgcatgaacagaggg

SEQ ID NO: 456150 - DNA, 20 bp, Artificial
  CRISPR gRNA sequence
actgcatgaacagagggcta

SEQ ID NO: 456151 - DNA, 20 bp, Artificial
  CRISPR gRNA sequence
catgaacagagggctacaag

SEQ ID NO: 456152 - DNA, 20 bp, Artificial
  CRISPR gRNA sequence
caagttgaagcaacagattt

SEQ ID NO: 456153 - DNA, 20 bp, Artificial
  CRISPR gRNA sequence
aagcaacagattttcagcta

SEQ ID NO: 456154 - DNA, 20 bp, Artificial
  CRISPR gRNA sequence
tcagctattagaggaagaaa

SEQ ID NO: 456155 - DNA, 20 bp, Artificial
  CRISPR gRNA sequence
cagctattagaggaagaaaa

SEQ ID NO: 456156 - DNA, 20 bp, Artificial
  CRISPR gRNA sequence
agctattagaggaagaaaag

SEQ ID NO: 456157 - DNA, 20 bp, Artificial
  CRISPR gRNA sequence
ttagaggaagaaaaggcaag

SEQ ID NO: 456158 - DNA, 20 bp, Artificial
  CRISPR gRNA sequence
gaggaagaaaaggcaagaga

SEQ ID NO: 456159 - DNA, 20 bp, Artificial
  CRISPR gRNA sequence
ggtttggagatgggttttga

SEQ ID NO: 456160 - DNA, 20 bp, Artificial
  CRISPR gRNA sequence
gtttggagatgggttttgaa

SEQ ID NO: 456161 - DNA, 20 bp, Artificial
  CRISPR gRNA sequence
ggagatgggttttgaacaat

SEQ ID NO: 456162 - DNA, 20 bp, Artificial
  CRISPR gRNA sequence
gagatgggttttgaacaatg

SEQ ID NO: 456163 - DNA, 20 bp, Artificial
  CRISPR gRNA sequence
tgaacaatgcggctcctcag

SEQ ID NO: 456164 - DNA, 20 bp, Artificial
  CRISPR gRNA sequence
gaacaatgcggctcctcagc

SEQ ID NO: 456165 - DNA, 20 bp, Artificial
  CRISPR gRNA sequence
aacaatgcggctcctcagca

SEQ ID NO: 456166 - DNA, 20 bp, Artificial
  CRISPR gRNA sequence
ctcagcaaaggctgatggcc

SEQ ID NO: 456167 - DNA, 20 bp, Artificial
  CRISPR gRNA sequence
agcaaaggctgatggccaga

SEQ ID NO: 456168 - DNA, 20 bp, Artificial
  CRISPR gRNA sequence
atggccagattgagtatatt

SEQ ID NO: 456169 - DNA, 20 bp, Artificial
  CRISPR gRNA sequence
agtatattaaacacatgtag

SEQ ID NO: 456170 - DNA, 20 bp, Artificial
  CRISPR gRNA sequence
aacacatgtagctgagtcct

SEQ ID NO: 456171 - DNA, 20 bp, Artificial
  CRISPR gRNA sequence
agtcctctgaaaaccattta

SEQ ID NO: 456172 - DNA, 20 bp, Artificial
  CRISPR gRNA sequence
tgaaaaccatttaccaatat

SEQ ID NO: 456173 - DNA, 20 bp, Artificial
  CRISPR gRNA sequence
aaaaccatttaccaatatag

SEQ ID NO: 456174 - DNA, 20 bp, Artificial
  CRISPR gRNA sequence
accaatatagattagcgttt

SEQ ID NO: 456175 - DNA, 20 bp, Artificial
  CRISPR gRNA sequence
ccaatatagattagcgtttt

SEQ ID NO: 456176 - DNA, 20 bp, Artificial
  CRISPR gRNA sequence
gcgttttccctattagataa

SEQ ID NO: 456177 - DNA, 20 bp, Artificial
  CRISPR gRNA sequence
tccctattagataacaaaaa

SEQ ID NO: 456178 - DNA, 20 bp, Artificial
  CRISPR gRNA sequence
ccctattagataacaaaaag

SEQ ID NO: 456179 - DNA, 20 bp, Artificial
  CRISPR gRNA sequence
cctattagataacaaaaagt

SEQ ID NO: 456180 - DNA, 20 bp, Artificial
  CRISPR gRNA sequence
ttagataacaaaaagtgaaa

SEQ ID NO: 456181 - DNA, 20 bp, Artificial
  CRISPR gRNA sequence
gataacaaaaagtgaaactt

SEQ ID NO: 456182 - DNA, 20 bp, Artificial
  CRISPR gRNA sequence
ccaataatttgtcataacgt

SEQ ID NO: 456183 - DNA, 20 bp, Artificial
  CRISPR gRNA sequence
caataatttgtcataacgtt

SEQ ID NO: 456184 - DNA, 20 bp, Artificial
  CRISPR gRNA sequence
gtcataacgtttttgcataa

SEQ ID NO: 456185 - DNA, 20 bp, Artificial
  CRISPR gRNA sequence
tcataacgtttttgcataac

SEQ ID NO: 456186 - DNA, 20 bp, Artificial
  CRISPR gRNA sequence
ttgcataacaagcaactgat

SEQ ID NO: 456187 - DNA, 20 bp, Artificial
  CRISPR gRNA sequence
tgcataacaagcaactgatt

SEQ ID NO: 456188 - DNA, 20 bp, Artificial
  CRISPR gRNA sequence
gcataacaagcaactgattc

SEQ ID NO: 456189 - DNA, 20 bp, Artificial
  CRISPR gRNA sequence
cataacaagcaactgattca

SEQ ID NO: 456190 - DNA, 20 bp, Artificial
  CRISPR gRNA sequence
attcaggtttttgcctggcc

SEQ ID NO: 456191 - DNA, 20 bp, Artificial
  CRISPR gRNA sequence
aggtttttgcctggccttgg

SEQ ID NO: 456192 - DNA, 20 bp, Artificial
  CRISPR gRNA sequence
ttgcctggccttggcattct

SEQ ID NO: 456193 - DNA, 20 bp, Artificial
  CRISPR gRNA sequence
tgcctggccttggcattctt

SEQ ID NO: 456194 - DNA, 20 bp, Artificial
  CRISPR gRNA sequence
gcctggccttggcattctta

SEQ ID NO: 456195 - DNA, 20 bp, Artificial
  CRISPR gRNA sequence
cctggccttggcattcttaa

SEQ ID NO: 456196 - DNA, 20 bp, Artificial
  CRISPR gRNA sequence
gccttggcattcttaactcc

SEQ ID NO: 456197 - DNA, 20 bp, Artificial
  CRISPR gRNA sequence
ggcattcttaactccatttt

SEQ ID NO: 456198 - DNA, 20 bp, Artificial
  CRISPR gRNA sequence
gcattcttaactccatttta

SEQ ID NO: 456199 - DNA, 20 bp, Artificial
  CRISPR gRNA sequence
ttaactccattttatttagg

SEQ ID NO: 456200 - DNA, 20 bp, Artificial
  CRISPR gRNA sequence
aactccattttatttaggca

SEQ ID NO: 456201 - DNA, 20 bp, Artificial
  CRISPR gRNA sequence
actccattttatttaggcat

SEQ ID NO: 456202 - DNA, 20 bp, Artificial
  CRISPR gRNA sequence
cattttatttaggcattcct

SEQ ID NO: 456203 - DNA, 20 bp, Artificial
  CRISPR gRNA sequence
tatttaggcattcctcaaat

SEQ ID NO: 456204 - DNA, 20 bp, Artificial
  CRISPR gRNA sequence
atttaggcattcctcaaatc

SEQ ID NO: 456205 - DNA, 20 bp, Artificial
  CRISPR gRNA sequence
tttaggcattcctcaaatca

SEQ ID NO: 456206 - DNA, 20 bp, Artificial
  CRISPR gRNA sequence
aggcattcctcaaatcaata

SEQ ID NO: 456207 - DNA, 20 bp, Artificial
  CRISPR gRNA sequence
ggcattcctcaaatcaataa

SEQ ID NO: 456208 - DNA, 20 bp, Artificial
  CRISPR gRNA sequence
ctcaaatcaataactaccac

SEQ ID NO: 456209 - DNA, 20 bp, Artificial
  CRISPR gRNA sequence
aaatcaataactaccactgt

SEQ ID NO: 456210 - DNA, 20 bp, Artificial
  CRISPR gRNA sequence
ccactgttttgaatggcatc

SEQ ID NO: 456211 - DNA, 20 bp, Artificial
  CRISPR gRNA sequence
ttttgaatggcatcagaatg

SEQ ID NO: 456212 - DNA, 20 bp, Artificial
  CRISPR gRNA sequence
tgaatggcatcagaatgtaa

SEQ ID NO: 456213 - DNA, 20 bp, Artificial
  CRISPR gRNA sequence
gaatggcatcagaatgtaag

SEQ ID NO: 456214 - DNA, 20 bp, Artificial
  CRISPR gRNA sequence
aatggcatcagaatgtaagc

SEQ ID NO: 456215 - DNA, 20 bp, Artificial
  CRISPR gRNA sequence
tatatatatgtaaggacttt

SEQ ID NO: 456216 - DNA, 20 bp, Artificial
  CRISPR gRNA sequence
tatatatgtaaggactttgt

SEQ ID NO: 456217 - DNA, 20 bp, Artificial
  CRISPR gRNA sequence
tgtcttctttaccccaacga

SEQ ID NO: 456218 - DNA, 20 bp, Artificial
  CRISPR gRNA sequence
gtcttctttaccccaacgaa

SEQ ID NO: 456219 - DNA, 20 bp, Artificial
  CRISPR gRNA sequence
tcttctttaccccaacgaaa

SEQ ID NO: 456220 - DNA, 20 bp, Artificial
  CRISPR gRNA sequence
ctttaccccaacgaaaagtc

SEQ ID NO: 456221 - DNA, 20 bp, Artificial
  CRISPR gRNA sequence
tttaccccaacgaaaagtcc

SEQ ID NO: 456222 - DNA, 20 bp, Artificial
  CRISPR gRNA sequence
taccccaacgaaaagtccca

SEQ ID NO: 456223 - DNA, 20 bp, Artificial
  CRISPR gRNA sequence
accccaacgaaaagtcccac

SEQ ID NO: 456224 - DNA, 20 bp, Artificial
  CRISPR gRNA sequence
ccccaacgaaaagtcccaca

SEQ ID NO: 456225 - DNA, 20 bp, Artificial
  CRISPR gRNA sequence
ttaataaatttgttaaaaaa

SEQ ID NO: 456226 - DNA, 20 bp, Artificial
  CRISPR gRNA sequence
aataaatttgttaaaaaacc

SEQ ID NO: 456227 - DNA, 20 bp, Artificial
  CRISPR gRNA sequence
ataaatttgttaaaaaacct

SEQ ID NO: 456228 - DNA, 20 bp, Artificial
  CRISPR gRNA sequence
gttaaaaaacctgtatgatg

SEQ ID NO: 456229 - DNA, 20 bp, Artificial
  CRISPR gRNA sequence
ttaaaaaacctgtatgatga

SEQ ID NO: 456230 - DNA, 20 bp, Artificial
  CRISPR gRNA sequence
aaaaacctgtatgatgaatc

SEQ ID NO: 456231 - DNA, 20 bp, Artificial
  CRISPR gRNA sequence
tatgatgaatcagatgcttt

SEQ ID NO: 456232 - DNA, 20 bp, Artificial
  CRISPR gRNA sequence
tacacatgatgattctaacc

SEQ ID NO: 456233 - DNA, 20 bp, Artificial
  CRISPR gRNA sequence
acacatgatgattctaacct

SEQ ID NO: 456234 - DNA, 20 bp, Artificial
  CRISPR gRNA sequence
cacatgatgattctaacctt

SEQ ID NO: 456235 - DNA, 20 bp, Artificial
  CRISPR gRNA sequence
taaccttatacaacccttgc

SEQ ID NO: 456236 - DNA, 20 bp, Artificial
  CRISPR gRNA sequence
accttatacaacccttgcaa

SEQ ID NO: 456237 - DNA, 20 bp, Artificial
  CRISPR gRNA sequence
atacaacccttgcaagcaaa

SEQ ID NO: 456238 - DNA, 20 bp, Artificial
  CRISPR gRNA sequence
tacaacccttgcaagcaaac

SEQ ID NO: 456239 - DNA, 20 bp, Artificial
  CRISPR gRNA sequence
gcaagcaaacatcccctggt

SEQ ID NO: 456240 - DNA, 20 bp, Artificial
  CRISPR gRNA sequence
caagcaaacatcccctggtt

SEQ ID NO: 456241 - DNA, 20 bp, Artificial
  CRISPR gRNA sequence
gttactcatcaggaaacaga

SEQ ID NO: 456242 - DNA, 20 bp, Artificial
  CRISPR gRNA sequence
ctcatcaggaaacagacaca

SEQ ID NO: 456243 - DNA, 20 bp, Artificial
  CRISPR gRNA sequence
atcaggaaacagacacaagg

SEQ ID NO: 456244 - DNA, 20 bp, Artificial
  CRISPR gRNA sequence
aatagggcctggtgcggtgg

SEQ ID NO: 456245 - DNA, 20 bp, Artificial
  CRISPR gRNA sequence
gtgcggtggctcacgcctgt

SEQ ID NO: 456246 - DNA, 20 bp, Artificial
  CRISPR gRNA sequence
acgcctgtaatcccagcact

SEQ ID NO: 456247 - DNA, 20 bp, Artificial
  CRISPR gRNA sequence
taatcccagcactttgggag

SEQ ID NO: 456248 - DNA, 20 bp, Artificial
  CRISPR gRNA sequence
tgggaggccaaggcaggcag

SEQ ID NO: 456249 - DNA, 20 bp, Artificial
  CRISPR gRNA sequence
gggaggccaaggcaggcaga

SEQ ID NO: 456250 - DNA, 20 bp, Artificial
  CRISPR gRNA sequence
ggaggccaaggcaggcagat

SEQ ID NO: 456251 - DNA, 20 bp, Artificial
  CRISPR gRNA sequence
tgagcctaggagtttgaggc

SEQ ID NO: 456252 - DNA, 20 bp, Artificial
  CRISPR gRNA sequence
gagcctaggagtttgaggcc

SEQ ID NO: 456253 - DNA, 20 bp, Artificial
  CRISPR gRNA sequence
agcctaggagtttgaggcca

SEQ ID NO: 456254 - DNA, 20 bp, Artificial
  CRISPR gRNA sequence
ggagtttgaggccagtctgg

SEQ ID NO: 456255 - DNA, 20 bp, Artificial
  CRISPR gRNA sequence
gaggccagtctgggcaacat

SEQ ID NO: 456256 - DNA, 20 bp, Artificial
  CRISPR gRNA sequence
aggccagtctgggcaacatg

SEQ ID NO: 456257 - DNA, 20 bp, Artificial
  CRISPR gRNA sequence
ggcaacatggcaaaacccca

SEQ ID NO: 456258 - DNA, 20 bp, Artificial
  CRISPR gRNA sequence
gggttttgccatgttgccca

SEQ ID NO: 456259 - DNA, 20 bp, Artificial
  CRISPR gRNA sequence
tgccatgttgcccagactgg

SEQ ID NO: 456260 - DNA, 20 bp, Artificial
  CRISPR gRNA sequence
gccatgttgcccagactggc

SEQ ID NO: 456261 - DNA, 20 bp, Artificial
  CRISPR gRNA sequence
ccatgttgcccagactggcc

SEQ ID NO: 456262 - DNA, 20 bp, Artificial
  CRISPR gRNA sequence
cccagactggcctcaaactc

SEQ ID NO: 456263 - DNA, 20 bp, Artificial
  CRISPR gRNA sequence
gcctcaaactcctaggctca

SEQ ID NO: 456264 - DNA, 20 bp, Artificial
  CRISPR gRNA sequence
aaactcctaggctcaaagga

SEQ ID NO: 456265 - DNA, 20 bp, Artificial
  CRISPR gRNA sequence
ctaggctcaaaggatctgcc

SEQ ID NO: 456266 - DNA, 20 bp, Artificial
  CRISPR gRNA sequence
ggctcaaaggatctgcctgc

SEQ ID NO: 456267 - DNA, 20 bp, Artificial
  CRISPR gRNA sequence
aaaggatctgcctgccttgg

SEQ ID NO: 456268 - DNA, 20 bp, Artificial
  CRISPR gRNA sequence
cctgccttggcctcccaaag

SEQ ID NO: 456269 - DNA, 20 bp, Artificial
  CRISPR gRNA sequence
ccttggcctcccaaagtgct

SEQ ID NO: 456270 - DNA, 20 bp, Artificial
  CRISPR gRNA sequence
ggcctcccaaagtgctggga

SEQ ID NO: 456271 - DNA, 20 bp, Artificial
  CRISPR gRNA sequence
gcctcccaaagtgctgggat

SEQ ID NO: 456272 - DNA, 20 bp, Artificial
  CRISPR gRNA sequence
ccaaagtgctgggattacag

SEQ ID NO: 456273 - DNA, 20 bp, Artificial
  CRISPR gRNA sequence
ggattacaggcgtgagccac

SEQ ID NO: 456274 - DNA, 20 bp, Artificial
  CRISPR gRNA sequence
caggcgtgagccaccgcacc

SEQ ID NO: 456275 - DNA, 20 bp, Artificial
  CRISPR gRNA sequence
tttaacttccttgtgtctgt

SEQ ID NO: 456276 - DNA, 20 bp, Artificial
  CRISPR gRNA sequence
aacttccttgtgtctgtttc

SEQ ID NO: 456277 - DNA, 20 bp, Artificial
  CRISPR gRNA sequence
acttccttgtgtctgtttcc

SEQ ID NO: 456278 - DNA, 20 bp, Artificial
  CRISPR gRNA sequence
ccttgtgtctgtttcctgat

SEQ ID NO: 456279 - DNA, 20 bp, Artificial
  CRISPR gRNA sequence
cttgtgtctgtttcctgatg

SEQ ID NO: 456280 - DNA, 20 bp, Artificial
  CRISPR gRNA sequence
gtgtctgtttcctgatgagt

SEQ ID NO: 456281 - DNA, 20 bp, Artificial
  CRISPR gRNA sequence
tgtctgtttcctgatgagta

SEQ ID NO: 456282 - DNA, 20 bp, Artificial
  CRISPR gRNA sequence
tttcctgatgagtaaccagg

SEQ ID NO: 456283 - DNA, 20 bp, Artificial
  CRISPR gRNA sequence
cctgatgagtaaccagggga

SEQ ID NO: 456284 - DNA, 20 bp, Artificial
  CRISPR gRNA sequence
ctgatgagtaaccaggggat

SEQ ID NO: 456285 - DNA, 20 bp, Artificial
  CRISPR gRNA sequence
atgagtaaccaggggatgtt

SEQ ID NO: 456286 - DNA, 20 bp, Artificial
  CRISPR gRNA sequence
gcttgcaagggttgtataag

SEQ ID NO: 456287 - DNA, 20 bp, Artificial
  CRISPR gRNA sequence
cttgcaagggttgtataagg

SEQ ID NO: 456288 - DNA, 20 bp, Artificial
  CRISPR gRNA sequence
gcaagggttgtataaggtta

SEQ ID NO: 456289 - DNA, 20 bp, Artificial
  CRISPR gRNA sequence
caagggttgtataaggttag

SEQ ID NO: 456290 - DNA, 20 bp, Artificial
  CRISPR gRNA sequence
tataaggttagaatcatcat

SEQ ID NO: 456291 - DNA, 20 bp, Artificial
  CRISPR gRNA sequence
gaatcatcatgtgtaaagca

SEQ ID NO: 456292 - DNA, 20 bp, Artificial
  CRISPR gRNA sequence
attcatcatacaggtttttt

SEQ ID NO: 456293 - DNA, 20 bp, Artificial
  CRISPR gRNA sequence
atcatacaggttttttaaca

SEQ ID NO: 456294 - DNA, 20 bp, Artificial
  CRISPR gRNA sequence
tttaacaaatttattaagag

SEQ ID NO: 456295 - DNA, 20 bp, Artificial
  CRISPR gRNA sequence
ttaacaaatttattaagagc

SEQ ID NO: 456296 - DNA, 20 bp, Artificial
  CRISPR gRNA sequence
taacaaatttattaagagcc

SEQ ID NO: 456297 - DNA, 20 bp, Artificial
  CRISPR gRNA sequence
aacaaatttattaagagcct

SEQ ID NO: 456298 - DNA, 20 bp, Artificial
  CRISPR gRNA sequence
acaaatttattaagagcctg

SEQ ID NO: 456299 - DNA, 20 bp, Artificial
  CRISPR gRNA sequence
attaagagcctgccatatgt

SEQ ID NO: 456300 - DNA, 20 bp, Artificial
  CRISPR gRNA sequence
ttaagagcctgccatatgtg

SEQ ID NO: 456301 - DNA, 20 bp, Artificial
  CRISPR gRNA sequence
agagcctgccatatgtgtgg

SEQ ID NO: 456302 - DNA, 20 bp, Artificial
  CRISPR gRNA sequence
ccatatgtgtgggacttttc

SEQ ID NO: 456303 - DNA, 20 bp, Artificial
  CRISPR gRNA sequence
ttcgttggggtaaagaagac

SEQ ID NO: 456304 - DNA, 20 bp, Artificial
  CRISPR gRNA sequence
tcgttggggtaaagaagaca

SEQ ID NO: 456305 - DNA, 20 bp, Artificial
  CRISPR gRNA sequence
cgttggggtaaagaagacaa

SEQ ID NO: 456306 - DNA, 20 bp, Artificial
  CRISPR gRNA sequence
gttggggtaaagaagacaaa

SEQ ID NO: 456307 - DNA, 20 bp, Artificial
  CRISPR gRNA sequence
gggtaaagaagacaaagtcc

SEQ ID NO: 456308 - DNA, 20 bp, Artificial
  CRISPR gRNA sequence
acatatatatagagcttaca

SEQ ID NO: 456309 - DNA, 20 bp, Artificial
  CRISPR gRNA sequence
catatatatagagcttacat

SEQ ID NO: 456310 - DNA, 20 bp, Artificial
  CRISPR gRNA sequence
acattctgatgccattcaaa

SEQ ID NO: 456311 - DNA, 20 bp, Artificial
  CRISPR gRNA sequence
cattctgatgccattcaaaa

SEQ ID NO: 456312 - DNA, 20 bp, Artificial
  CRISPR gRNA sequence
tgatgccattcaaaacagtg

SEQ ID NO: 456313 - DNA, 20 bp, Artificial
  CRISPR gRNA sequence
atgccattcaaaacagtggt

SEQ ID NO: 456314 - DNA, 20 bp, Artificial
  CRISPR gRNA sequence
aaaacagtggtagttattga

SEQ ID NO: 456315 - DNA, 20 bp, Artificial
  CRISPR gRNA sequence
ttgatttgaggaatgcctaa

SEQ ID NO: 456316 - DNA, 20 bp, Artificial
  CRISPR gRNA sequence
atttgaggaatgcctaaata

SEQ ID NO: 456317 - DNA, 20 bp, Artificial
  CRISPR gRNA sequence
gaggaatgcctaaataaaat

SEQ ID NO: 456318 - DNA, 20 bp, Artificial
  CRISPR gRNA sequence
aggaatgcctaaataaaatg

SEQ ID NO: 456319 - DNA, 20 bp, Artificial
  CRISPR gRNA sequence
aataaaatggagttaagaat

SEQ ID NO: 456320 - DNA, 20 bp, Artificial
  CRISPR gRNA sequence
agaatgccaaggccaggcaa

SEQ ID NO: 456321 - DNA, 20 bp, Artificial
  CRISPR gRNA sequence
aatcagttgcttgttatgca

SEQ ID NO: 456322 - DNA, 20 bp, Artificial
  CRISPR gRNA sequence
cttgttatgcaaaaacgtta

SEQ ID NO: 456323 - DNA, 20 bp, Artificial
  CRISPR gRNA sequence
gttatgcaaaaacgttatga

SEQ ID NO: 456324 - DNA, 20 bp, Artificial
  CRISPR gRNA sequence
ttatgcaaaaacgttatgac

SEQ ID NO: 456325 - DNA, 20 bp, Artificial
  CRISPR gRNA sequence
tgcaaaaacgttatgacaaa

SEQ ID NO: 456326 - DNA, 20 bp, Artificial
  CRISPR gRNA sequence
tgacaaattattggaagttt

SEQ ID NO: 456327 - DNA, 20 bp, Artificial
  CRISPR gRNA sequence
ttggaagtttcactttttgt

SEQ ID NO: 456328 - DNA, 20 bp, Artificial
  CRISPR gRNA sequence
gaagtttcactttttgttat

SEQ ID NO: 456329 - DNA, 20 bp, Artificial
  CRISPR gRNA sequence
cactttttgttatctaatag

SEQ ID NO: 456330 - DNA, 20 bp, Artificial
  CRISPR gRNA sequence
actttttgttatctaatagg

SEQ ID NO: 456331 - DNA, 20 bp, Artificial
  CRISPR gRNA sequence
tttgttatctaatagggaaa

SEQ ID NO: 456332 - DNA, 20 bp, Artificial
  CRISPR gRNA sequence
ttgttatctaatagggaaaa

SEQ ID NO: 456333 - DNA, 20 bp, Artificial
  CRISPR gRNA sequence
tgttatctaatagggaaaac

SEQ ID NO: 456334 - DNA, 20 bp, Artificial
  CRISPR gRNA sequence
gttatctaatagggaaaacg

SEQ ID NO: 456335 - DNA, 20 bp, Artificial
  CRISPR gRNA sequence
ttatctaatagggaaaacgc

SEQ ID NO: 456336 - DNA, 20 bp, Artificial
  CRISPR gRNA sequence
tctaatagggaaaacgctaa

SEQ ID NO: 456337 - DNA, 20 bp, Artificial
  CRISPR gRNA sequence
atagggaaaacgctaatcta

SEQ ID NO: 456338 - DNA, 20 bp, Artificial
  CRISPR gRNA sequence
atctatattggtaaatggtt

SEQ ID NO: 456339 - DNA, 20 bp, Artificial
  CRISPR gRNA sequence
tattggtaaatggttttcag

SEQ ID NO: 456340 - DNA, 20 bp, Artificial
  CRISPR gRNA sequence
gtaaatggttttcagaggac

SEQ ID NO: 456341 - DNA, 20 bp, Artificial
  CRISPR gRNA sequence
tcagaggactcagctacatg

SEQ ID NO: 456342 - DNA, 20 bp, Artificial
  CRISPR gRNA sequence
cagaggactcagctacatgt

SEQ ID NO: 456343 - DNA, 20 bp, Artificial
  CRISPR gRNA sequence
agaggactcagctacatgtg

SEQ ID NO: 456344 - DNA, 20 bp, Artificial
  CRISPR gRNA sequence
agctacatgtgtttaatata

SEQ ID NO: 456345 - DNA, 20 bp, Artificial
  CRISPR gRNA sequence
catgtgtttaatatactcaa

SEQ ID NO: 456346 - DNA, 20 bp, Artificial
  CRISPR gRNA sequence
aatatactcaatctggccat

SEQ ID NO: 456347 - DNA, 20 bp, Artificial
  CRISPR gRNA sequence
atatactcaatctggccatc

SEQ ID NO: 456348 - DNA, 20 bp, Artificial
  CRISPR gRNA sequence
aatctggccatcagcctttg

SEQ ID NO: 456349 - DNA, 20 bp, Artificial
  CRISPR gRNA sequence
gccatcagcctttgctgagg

SEQ ID NO: 456350 - DNA, 20 bp, Artificial
  CRISPR gRNA sequence
tgctgaggagccgcattgtt

SEQ ID NO: 456351 - DNA, 20 bp, Artificial
  CRISPR gRNA sequence
gctgaggagccgcattgttc

SEQ ID NO: 456352 - DNA, 20 bp, Artificial
  CRISPR gRNA sequence
ctgaggagccgcattgttca

SEQ ID NO: 456353 - DNA, 20 bp, Artificial
  CRISPR gRNA sequence
aggagccgcattgttcaaaa

SEQ ID NO: 456354 - DNA, 20 bp, Artificial
  CRISPR gRNA sequence
ttcaaaacccatctccaaac

SEQ ID NO: 456355 - DNA, 20 bp, Artificial
  CRISPR gRNA sequence
aaaacccatctccaaaccaa

SEQ ID NO: 456356 - DNA, 20 bp, Artificial
  CRISPR gRNA sequence
caaaccaagtctgtctcttg

SEQ ID NO: 456357 - DNA, 20 bp, Artificial
  CRISPR gRNA sequence
tctcttgccttttcttcctc

SEQ ID NO: 456358 - DNA, 20 bp, Artificial
  CRISPR gRNA sequence
ttgccttttcttcctctaat

SEQ ID NO: 456359 - DNA, 20 bp, Artificial
  CRISPR gRNA sequence
gccttttcttcctctaatag

SEQ ID NO: 456360 - DNA, 20 bp, Artificial
  CRISPR gRNA sequence
ccttttcttcctctaatagc

SEQ ID NO: 456361 - DNA, 20 bp, Artificial
  CRISPR gRNA sequence
ttcttcctctaatagctgaa

SEQ ID NO: 456362 - DNA, 20 bp, Artificial
  CRISPR gRNA sequence
tcttcctctaatagctgaaa

SEQ ID NO: 456363 - DNA, 20 bp, Artificial
  CRISPR gRNA sequence
cttcctctaatagctgaaaa

SEQ ID NO: 456364 - DNA, 20 bp, Artificial
  CRISPR gRNA sequence
ttcctctaatagctgaaaat

SEQ ID NO: 456365 - DNA, 20 bp, Artificial
  CRISPR gRNA sequence
cctctaatagctgaaaatct

SEQ ID NO: 456366 - DNA, 20 bp, Artificial
  CRISPR gRNA sequence
ctctaatagctgaaaatctg

SEQ ID NO: 456367 - DNA, 20 bp, Artificial
  CRISPR gRNA sequence
taatagctgaaaatctgttg

SEQ ID NO: 456368 - DNA, 20 bp, Artificial
  CRISPR gRNA sequence
atagctgaaaatctgttgct

SEQ ID NO: 456369 - DNA, 20 bp, Artificial
  CRISPR gRNA sequence
aaaatctgttgcttcaactt

SEQ ID NO: 456370 - DNA, 20 bp, Artificial
  CRISPR gRNA sequence
ttgcttcaacttgtagccct

SEQ ID NO: 456371 - DNA, 20 bp, Artificial
  CRISPR gRNA sequence
cttcaacttgtagccctctg

SEQ ID NO: 456372 - DNA, 20 bp, Artificial
  CRISPR gRNA sequence
caacttgtagccctctgttc

SEQ ID NO: 456373 - DNA, 20 bp, Artificial
  CRISPR gRNA sequence
aacttgtagccctctgttca

SEQ ID NO: 456374 - DNA, 20 bp, Artificial
  CRISPR gRNA sequence
gtagccctctgttcatgcag

SEQ ID NO: 456375 - DNA, 20 bp, Artificial
  CRISPR gRNA sequence
tagccctctgttcatgcagt

SEQ ID NO: 456376 - DNA, 20 bp, Artificial
  CRISPR gRNA sequence
tgttcatgcagtgagtagag

SEQ ID NO: 456377 - DNA, 20 bp, Artificial
  CRISPR gRNA sequence
ttcatgcagtgagtagaggt

SEQ ID NO: 456378 - DNA, 20 bp, Artificial
  CRISPR gRNA sequence
atgcagtgagtagaggtagt

SEQ ID NO: 456379 - DNA, 20 bp, Artificial
  CRISPR gRNA sequence
tactaacttgcctctctcac

SEQ ID NO: 456380 - DNA, 20 bp, Artificial
  CRISPR gRNA sequence
acttgcctctctcacaggcc

SEQ ID NO: 456381 - DNA, 20 bp, Artificial
  CRISPR gRNA sequence
gcctctctcacaggccttca

SEQ ID NO: 456382 - DNA, 20 bp, Artificial
  CRISPR gRNA sequence
cctctctcacaggccttcat

SEQ ID NO: 456383 - DNA, 20 bp, Artificial
  CRISPR gRNA sequence
tctcacaggccttcattcct

SEQ ID NO: 456384 - DNA, 20 bp, Artificial
  CRISPR gRNA sequence
tcacaggccttcattcctaa

SEQ ID NO: 456385 - DNA, 20 bp, Artificial
  CRISPR gRNA sequence
acaggccttcattcctaatg

SEQ ID NO: 456386 - DNA, 20 bp, Artificial
  CRISPR gRNA sequence
cattcctaatgagtcttacc

SEQ ID NO: 456387 - DNA, 20 bp, Artificial
  CRISPR gRNA sequence
attcctaatgagtcttacct

SEQ ID NO: 456388 - DNA, 20 bp, Artificial
  CRISPR gRNA sequence
ctaatgagtcttacctccta

SEQ ID NO: 456389 - DNA, 20 bp, Artificial
  CRISPR gRNA sequence
atgagtcttacctcctaccc

SEQ ID NO: 456390 - DNA, 20 bp, Artificial
  CRISPR gRNA sequence
acctcctacccattgaaaag

SEQ ID NO: 456391 - DNA, 20 bp, Artificial
  CRISPR gRNA sequence
cctcctacccattgaaaagt

SEQ ID NO: 456392 - DNA, 20 bp, Artificial
  CRISPR gRNA sequence
ctacccattgaaaagtctga

SEQ ID NO: 456393 - DNA, 20 bp, Artificial
  CRISPR gRNA sequence
cccattgaaaagtctgattt

SEQ ID NO: 456394 - DNA, 20 bp, Artificial
  CRISPR gRNA sequence
aaaagtctgatttatctgtc

SEQ ID NO: 456395 - DNA, 20 bp, Artificial
  CRISPR gRNA sequence
atttatctgtcttcctcctt

SEQ ID NO: 456396 - DNA, 20 bp, Artificial
  CRISPR gRNA sequence
atctgtcttcctccttagtg

SEQ ID NO: 456397 - DNA, 20 bp, Artificial
  CRISPR gRNA sequence
tctgtcttcctccttagtgc

SEQ ID NO: 456398 - DNA, 20 bp, Artificial
  CRISPR gRNA sequence
tcttcctccttagtgccttt

SEQ ID NO: 456399 - DNA, 20 bp, Artificial
  CRISPR gRNA sequence
cctccttagtgcctttggat

SEQ ID NO: 456400 - DNA, 20 bp, Artificial
  CRISPR gRNA sequence
ctccttagtgcctttggatc

SEQ ID NO: 456401 - DNA, 20 bp, Artificial
  CRISPR gRNA sequence
cttagtgcctttggatcagt

SEQ ID NO: 456402 - DNA, 20 bp, Artificial
  CRISPR gRNA sequence
agtgcctttggatcagtgaa

SEQ ID NO: 456403 - DNA, 20 bp, Artificial
  CRISPR gRNA sequence
gtgcctttggatcagtgaaa

SEQ ID NO: 456404 - DNA, 20 bp, Artificial
  CRISPR gRNA sequence
tggatcagtgaaactggttt

SEQ ID NO: 456405 - DNA, 20 bp, Artificial
  CRISPR gRNA sequence
ggatcagtgaaactggtttg

SEQ ID NO: 456406 - DNA, 20 bp, Artificial
  CRISPR gRNA sequence
gatcagtgaaactggtttga

SEQ ID NO: 456407 - DNA, 20 bp, Artificial
  CRISPR gRNA sequence
gtttgaactttcctgtggat

SEQ ID NO: 456408 - DNA, 20 bp, Artificial
  CRISPR gRNA sequence
gaactttcctgtggatagcc

SEQ ID NO: 456409 - DNA, 20 bp, Artificial
  CRISPR gRNA sequence
aactttcctgtggatagcca

SEQ ID NO: 456410 - DNA, 20 bp, Artificial
  CRISPR gRNA sequence
tcctgtggatagccagggct

SEQ ID NO: 456411 - DNA, 20 bp, Artificial
  CRISPR gRNA sequence
cctgtggatagccagggctt

SEQ ID NO: 456412 - DNA, 20 bp, Artificial
  CRISPR gRNA sequence
ctgtggatagccagggcttg

SEQ ID NO: 456413 - DNA, 20 bp, Artificial
  CRISPR gRNA sequence
tggatagccagggcttgagt

SEQ ID NO: 456414 - DNA, 20 bp, Artificial
  CRISPR gRNA sequence
gagtaacatttttctctccc

SEQ ID NO: 456415 - DNA, 20 bp, Artificial
  CRISPR gRNA sequence
agtaacatttttctctcccc

SEQ ID NO: 456416 - DNA, 20 bp, Artificial
  CRISPR gRNA sequence
ttctctccccctggacatcc

SEQ ID NO: 456417 - DNA, 20 bp, Artificial
  CRISPR gRNA sequence
tctctccccctggacatcct

SEQ ID NO: 456418 - DNA, 20 bp, Artificial
  CRISPR gRNA sequence
ctctccccctggacatcctt

SEQ ID NO: 456419 - DNA, 20 bp, Artificial
  CRISPR gRNA sequence
tctccccctggacatccttt

SEQ ID NO: 456420 - DNA, 20 bp, Artificial
  CRISPR gRNA sequence
tccccctggacatcctttcc

SEQ ID NO: 456421 - DNA, 20 bp, Artificial
  CRISPR gRNA sequence
cccctggacatcctttccaa

SEQ ID NO: 456422 - DNA, 20 bp, Artificial
  CRISPR gRNA sequence
gacatcctttccaaccttct

SEQ ID NO: 456423 - DNA, 20 bp, Artificial
  CRISPR gRNA sequence
tccaaccttctcctcctgga

SEQ ID NO: 456424 - DNA, 20 bp, Artificial
  CRISPR gRNA sequence
ccaaccttctcctcctggag

SEQ ID NO: 456425 - DNA, 20 bp, Artificial
  CRISPR gRNA sequence
caaccttctcctcctggaga

SEQ ID NO: 456426 - DNA, 20 bp, Artificial
  CRISPR gRNA sequence
ctcctcctggagaataacca

SEQ ID NO: 456427 - DNA, 20 bp, Artificial
  CRISPR gRNA sequence
tcctcctggagaataaccaa

SEQ ID NO: 456428 - DNA, 20 bp, Artificial
  CRISPR gRNA sequence
ctcctggagaataaccaagg

SEQ ID NO: 456429 - DNA, 20 bp, Artificial
  CRISPR gRNA sequence
ctggagaataaccaaggtgg

SEQ ID NO: 456430 - DNA, 20 bp, Artificial
  CRISPR gRNA sequence
gagaataaccaaggtggcag

SEQ ID NO: 456431 - DNA, 20 bp, Artificial
  CRISPR gRNA sequence
attgcttggggtgcttacgg

SEQ ID NO: 456432 - DNA, 20 bp, Artificial
  CRISPR gRNA sequence
cttggggtgcttacggctct

SEQ ID NO: 456433 - DNA, 20 bp, Artificial
  CRISPR gRNA sequence
ggggtgcttacggctctttt

SEQ ID NO: 456434 - DNA, 20 bp, Artificial
  CRISPR gRNA sequence
gggtgcttacggctcttttg

SEQ ID NO: 456435 - DNA, 20 bp, Artificial
  CRISPR gRNA sequence
acggctcttttggacatacc

SEQ ID NO: 456436 - DNA, 20 bp, Artificial
  CRISPR gRNA sequence
cggctcttttggacatacct

SEQ ID NO: 456437 - DNA, 20 bp, Artificial
  CRISPR gRNA sequence
ttttggacataccttgaagg

SEQ ID NO: 456438 - DNA, 20 bp, Artificial
  CRISPR gRNA sequence
ttggacataccttgaagggc

SEQ ID NO: 456439 - DNA, 20 bp, Artificial
  CRISPR gRNA sequence
tggacataccttgaagggcc

SEQ ID NO: 456440 - DNA, 20 bp, Artificial
  CRISPR gRNA sequence
ggacataccttgaagggcca

SEQ ID NO: 456441 - DNA, 20 bp, Artificial
  CRISPR gRNA sequence
gacataccttgaagggccac

SEQ ID NO: 456442 - DNA, 20 bp, Artificial
  CRISPR gRNA sequence
gaagggccacaaggctggtg

SEQ ID NO: 456443 - DNA, 20 bp, Artificial
  CRISPR gRNA sequence
aagggccacaaggctggtga

SEQ ID NO: 456444 - DNA, 20 bp, Artificial
  CRISPR gRNA sequence
gtgaccagcattacccagac

SEQ ID NO: 456445 - DNA, 20 bp, Artificial
  CRISPR gRNA sequence
cccagaccttttcttgtagg

SEQ ID NO: 456446 - DNA, 20 bp, Artificial
  CRISPR gRNA sequence
ttcttgtaggaagcctgaac

SEQ ID NO: 456447 - DNA, 20 bp, Artificial
  CRISPR gRNA sequence
tcttgtaggaagcctgaact

SEQ ID NO: 456448 - DNA, 20 bp, Artificial
  CRISPR gRNA sequence
cttgtaggaagcctgaactg

SEQ ID NO: 456449 - DNA, 20 bp, Artificial
  CRISPR gRNA sequence
ttgtaggaagcctgaactga

SEQ ID NO: 456450 - DNA, 20 bp, Artificial
  CRISPR gRNA sequence
gtaggaagcctgaactgaga

SEQ ID NO: 456451 - DNA, 20 bp, Artificial
  CRISPR gRNA sequence
taggaagcctgaactgagag

SEQ ID NO: 456452 - DNA, 20 bp, Artificial
  CRISPR gRNA sequence
aactgagagtgccttcatta

SEQ ID NO: 456453 - DNA, 20 bp, Artificial
  CRISPR gRNA sequence
agagtgccttcattatggct

SEQ ID NO: 456454 - DNA, 20 bp, Artificial
  CRISPR gRNA sequence
cattatggctgaactcaagg

SEQ ID NO: 456455 - DNA, 20 bp, Artificial
  CRISPR gRNA sequence
attatggctgaactcaaggt

SEQ ID NO: 456456 - DNA, 20 bp, Artificial
  CRISPR gRNA sequence
tggctgaactcaaggtgttg

SEQ ID NO: 456457 - DNA, 20 bp, Artificial
  CRISPR gRNA sequence
aactcaaggtgttgtctttg

SEQ ID NO: 456458 - DNA, 20 bp, Artificial
  CRISPR gRNA sequence
aaggtgttgtctttgtttca

SEQ ID NO: 456459 - DNA, 20 bp, Artificial
  CRISPR gRNA sequence
tctttgtttcaatcccgtca

SEQ ID NO: 456460 - DNA, 20 bp, Artificial
  CRISPR gRNA sequence
tgtttcaatcccgtcactgt

SEQ ID NO: 456461 - DNA, 20 bp, Artificial
  CRISPR gRNA sequence
gtttcaatcccgtcactgtg

SEQ ID NO: 456462 - DNA, 20 bp, Artificial
  CRISPR gRNA sequence
tttcaatcccgtcactgtgt

SEQ ID NO: 456463 - DNA, 20 bp, Artificial
  CRISPR gRNA sequence
caatcccgtcactgtgtagt

SEQ ID NO: 456464 - DNA, 20 bp, Artificial
  CRISPR gRNA sequence
aatcccgtcactgtgtagtt

SEQ ID NO: 456465 - DNA, 20 bp, Artificial
  CRISPR gRNA sequence
tgtagttccctgtctctggt

SEQ ID NO: 456466 - DNA, 20 bp, Artificial
  CRISPR gRNA sequence
cctgtctctggttcaaaaga

SEQ ID NO: 456467 - DNA, 20 bp, Artificial
  CRISPR gRNA sequence
tctctggttcaaaagagaat

SEQ ID NO: 456468 - DNA, 20 bp, Artificial
  CRISPR gRNA sequence
tggttcaaaagagaatcatg

SEQ ID NO: 456469 - DNA, 20 bp, Artificial
  CRISPR gRNA sequence
gttcaaaagagaatcatgga

SEQ ID NO: 456470 - DNA, 20 bp, Artificial
  CRISPR gRNA sequence
aaaagagaatcatggatcag

SEQ ID NO: 456471 - DNA, 20 bp, Artificial
  CRISPR gRNA sequence
cagaaatcatcagtatctcc

SEQ ID NO: 456472 - DNA, 20 bp, Artificial
  CRISPR gRNA sequence
agaaatcatcagtatctcct

SEQ ID NO: 456473 - DNA, 20 bp, Artificial
  CRISPR gRNA sequence
cttttgcatcatctcataac

SEQ ID NO: 456474 - DNA, 20 bp, Artificial
  CRISPR gRNA sequence
ttgcatcatctcataacatc

SEQ ID NO: 456475 - DNA, 20 bp, Artificial
  CRISPR gRNA sequence
tgcatcatctcataacatct

SEQ ID NO: 456476 - DNA, 20 bp, Artificial
  CRISPR gRNA sequence
gcatcatctcataacatctc

SEQ ID NO: 456477 - DNA, 20 bp, Artificial
  CRISPR gRNA sequence
catcatctcataacatctct

SEQ ID NO: 456478 - DNA, 20 bp, Artificial
  CRISPR gRNA sequence
ataacatctcttttatgatc

SEQ ID NO: 456479 - DNA, 20 bp, Artificial
  CRISPR gRNA sequence
ttttatgatctccaaggatt

SEQ ID NO: 456480 - DNA, 20 bp, Artificial
  CRISPR gRNA sequence
ttatgatctccaaggattcc

SEQ ID NO: 456481 - DNA, 20 bp, Artificial
  CRISPR gRNA sequence
tatgatctccaaggattcct

SEQ ID NO: 456482 - DNA, 20 bp, Artificial
  CRISPR gRNA sequence
atgatctccaaggattcctc

SEQ ID NO: 456483 - DNA, 20 bp, Artificial
  CRISPR gRNA sequence
tgatctccaaggattcctcc

SEQ ID NO: 456484 - DNA, 20 bp, Artificial
  CRISPR gRNA sequence
caaggattcctccctctgta

SEQ ID NO: 456485 - DNA, 20 bp, Artificial
  CRISPR gRNA sequence
ctccctctgtaattcgttgc

SEQ ID NO: 456486 - DNA, 20 bp, Artificial
  CRISPR gRNA sequence
cctctgtaattcgttgccca

SEQ ID NO: 456487 - DNA, 20 bp, Artificial
  CRISPR gRNA sequence
tgtaattcgttgcccaaata

SEQ ID NO: 456488 - DNA, 20 bp, Artificial
  CRISPR gRNA sequence
taattcgttgcccaaataag

SEQ ID NO: 456489 - DNA, 20 bp, Artificial
  CRISPR gRNA sequence
gttgcccaaataagtatttt

SEQ ID NO: 456490 - DNA, 20 bp, Artificial
  CRISPR gRNA sequence
cccaaataagtatttttaac

SEQ ID NO: 456491 - DNA, 20 bp, Artificial
  CRISPR gRNA sequence
ttaacattgtgggtaatgat

SEQ ID NO: 456492 - DNA, 20 bp, Artificial
  CRISPR gRNA sequence
taacattgtgggtaatgatg

SEQ ID NO: 456493 - DNA, 20 bp, Artificial
  CRISPR gRNA sequence
aacattgtgggtaatgatga

SEQ ID NO: 456494 - DNA, 20 bp, Artificial
  CRISPR gRNA sequence
acattgtgggtaatgatgat

SEQ ID NO: 456495 - DNA, 20 bp, Artificial
  CRISPR gRNA sequence
tgggtaatgatgatgtactt

SEQ ID NO: 456496 - DNA, 20 bp, Artificial
  CRISPR gRNA sequence
aggcagccataaataagtat

SEQ ID NO: 456497 - DNA, 20 bp, Artificial
  CRISPR gRNA sequence
ggcagccataaataagtata

SEQ ID NO: 456498 - DNA, 20 bp, Artificial
  CRISPR gRNA sequence
ctgtgtgtcagacactaggg

SEQ ID NO: 456499 - DNA, 20 bp, Artificial
  CRISPR gRNA sequence
tgtgtcagacactagggatg

SEQ ID NO: 456500 - DNA, 20 bp, Artificial
  CRISPR gRNA sequence
gggatgcagatagatcttaa

SEQ ID NO: 456501 - DNA, 20 bp, Artificial
  CRISPR gRNA sequence
aaagtaattctaaagttttg

SEQ ID NO: 456502 - DNA, 20 bp, Artificial
  CRISPR gRNA sequence
aagtaattctaaagttttgc

SEQ ID NO: 456503 - DNA, 20 bp, Artificial
  CRISPR gRNA sequence
taaagttttgccacagagat

SEQ ID NO: 456504 - DNA, 20 bp, Artificial
  CRISPR gRNA sequence
aagttttgccacagagatag

SEQ ID NO: 456505 - DNA, 20 bp, Artificial
  CRISPR gRNA sequence
tgccacagagatagctgaaa

SEQ ID NO: 456506 - DNA, 20 bp, Artificial
  CRISPR gRNA sequence
gccacagagatagctgaaac

SEQ ID NO: 456507 - DNA, 20 bp, Artificial
  CRISPR gRNA sequence
ccacagagatagctgaaaca

SEQ ID NO: 456508 - DNA, 20 bp, Artificial
  CRISPR gRNA sequence
aaacagcttagtcgccttgg

SEQ ID NO: 456509 - DNA, 20 bp, Artificial
  CRISPR gRNA sequence
agtcgccttggacttgggta

SEQ ID NO: 456510 - DNA, 20 bp, Artificial
  CRISPR gRNA sequence
gtcgccttggacttgggtat

SEQ ID NO: 456511 - DNA, 20 bp, Artificial
  CRISPR gRNA sequence
ggacttgggtatccccaaat

SEQ ID NO: 456512 - DNA, 20 bp, Artificial
  CRISPR gRNA sequence
gacttgggtatccccaaata

SEQ ID NO: 456513 - DNA, 20 bp, Artificial
  CRISPR gRNA sequence
gggtatccccaaatagcccc

SEQ ID NO: 456514 - DNA, 20 bp, Artificial
  CRISPR gRNA sequence
ggtatccccaaatagcccca

SEQ ID NO: 456515 - DNA, 20 bp, Artificial
  CRISPR gRNA sequence
tctagagtggttcaagcaat

SEQ ID NO: 456516 - DNA, 20 bp, Artificial
  CRISPR gRNA sequence
ctagagtggttcaagcaatc

SEQ ID NO: 456517 - DNA, 20 bp, Artificial
  CRISPR gRNA sequence
tagagtggttcaagcaatct

SEQ ID NO: 456518 - DNA, 20 bp, Artificial
  CRISPR gRNA sequence
gagtggttcaagcaatctag

SEQ ID NO: 456519 - DNA, 20 bp, Artificial
  CRISPR gRNA sequence
aagcaatctagcataagtta

SEQ ID NO: 456520 - DNA, 20 bp, Artificial
  CRISPR gRNA sequence
gcataagttaaaatcttgcc

SEQ ID NO: 456521 - DNA, 20 bp, Artificial
  CRISPR gRNA sequence
aaatcttgcccttttggaat

SEQ ID NO: 456522 - DNA, 20 bp, Artificial
  CRISPR gRNA sequence
gcccttttggaatagatctg

SEQ ID NO: 456523 - DNA, 20 bp, Artificial
  CRISPR gRNA sequence
cccttttggaatagatctgg

SEQ ID NO: 456524 - DNA, 20 bp, Artificial
  CRISPR gRNA sequence
ttggaatagatctgggtttt

SEQ ID NO: 456525 - DNA, 20 bp, Artificial
  CRISPR gRNA sequence
tggaatagatctgggttttt

SEQ ID NO: 456526 - DNA, 20 bp, Artificial
  CRISPR gRNA sequence
ggaatagatctgggtttttt

SEQ ID NO: 456527 - DNA, 20 bp, Artificial
  CRISPR gRNA sequence
gaatagatctgggttttttt

SEQ ID NO: 456528 - DNA, 20 bp, Artificial
  CRISPR gRNA sequence
ggttttttttgtttgtttgt

SEQ ID NO: 456529 - DNA, 20 bp, Artificial
  CRISPR gRNA sequence
tttttgtttgtttgtttgtt

SEQ ID NO: 456530 - DNA, 20 bp, Artificial
  CRISPR gRNA sequence
ttttgtttgtttgtttgttt

SEQ ID NO: 456531 - DNA, 20 bp, Artificial
  CRISPR gRNA sequence
tttgtttgtttgtttgtttt

SEQ ID NO: 456532 - DNA, 20 bp, Artificial
  CRISPR gRNA sequence
ttgtttgtttgtttgttttg

SEQ ID NO: 456533 - DNA, 20 bp, Artificial
  CRISPR gRNA sequence
tgtttgtttgtttgttttgt

SEQ ID NO: 456534 - DNA, 20 bp, Artificial
  CRISPR gRNA sequence
gtttgtttgtttgttttgtt

SEQ ID NO: 456535 - DNA, 20 bp, Artificial
  CRISPR gRNA sequence
tttgtttgtttgttttgttt

SEQ ID NO: 456536 - DNA, 20 bp, Artificial
  CRISPR gRNA sequence
gtttgtttgttttgtttttg

SEQ ID NO: 456537 - DNA, 20 bp, Artificial
  CRISPR gRNA sequence
tttgtttgttttgtttttgt

SEQ ID NO: 456538 - DNA, 20 bp, Artificial
  CRISPR gRNA sequence
gtttgttttgtttttgtttt

SEQ ID NO: 456539 - DNA, 20 bp, Artificial
  CRISPR gRNA sequence
tttgttttgtttttgttttt

SEQ ID NO: 456540 - DNA, 20 bp, Artificial
  CRISPR gRNA sequence
gttttgtttttgtttttttg

SEQ ID NO: 456541 - DNA, 20 bp, Artificial
  CRISPR gRNA sequence
ttttgtttttgtttttttga

SEQ ID NO: 456542 - DNA, 20 bp, Artificial
  CRISPR gRNA sequence
tgtttttgtttttttgagac

SEQ ID NO: 456543 - DNA, 20 bp, Artificial
  CRISPR gRNA sequence
gtttttgtttttttgagaca

SEQ ID NO: 456544 - DNA, 20 bp, Artificial
  CRISPR gRNA sequence
tttttgtttttttgagacag

SEQ ID NO: 456545 - DNA, 20 bp, Artificial
  CRISPR gRNA sequence
ttgtttttttgagacagggt

SEQ ID NO: 456546 - DNA, 20 bp, Artificial
  CRISPR gRNA sequence
tgtttttttgagacagggtc

SEQ ID NO: 456547 - DNA, 20 bp, Artificial
  CRISPR gRNA sequence
gtttttttgagacagggtct

SEQ ID NO: 456548 - DNA, 20 bp, Artificial
  CRISPR gRNA sequence
tttttttgagacagggtctt

SEQ ID NO: 456549 - DNA, 20 bp, Artificial
  CRISPR gRNA sequence
ttttgagacagggtcttgct

SEQ ID NO: 456550 - DNA, 20 bp, Artificial
  CRISPR gRNA sequence
tttgagacagggtcttgctc

SEQ ID NO: 456551 - DNA, 20 bp, Artificial
  CRISPR gRNA sequence
ttgagacagggtcttgctct

SEQ ID NO: 456552 - DNA, 20 bp, Artificial
  CRISPR gRNA sequence
tgagacagggtcttgctctg

SEQ ID NO: 456553 - DNA, 20 bp, Artificial
  CRISPR gRNA sequence
gagacagggtcttgctctgt

SEQ ID NO: 456554 - DNA, 20 bp, Artificial
  CRISPR gRNA sequence
agacagggtcttgctctgtc

SEQ ID NO: 456555 - DNA, 20 bp, Artificial
  CRISPR gRNA sequence
gctctgtcatccaggctaga

SEQ ID NO: 456556 - DNA, 20 bp, Artificial
  CRISPR gRNA sequence
ctctgtcatccaggctagag

SEQ ID NO: 456557 - DNA, 20 bp, Artificial
  CRISPR gRNA sequence
tgtcatccaggctagagtac

SEQ ID NO: 456558 - DNA, 20 bp, Artificial
  CRISPR gRNA sequence
tcatccaggctagagtacag

SEQ ID NO: 456559 - DNA, 20 bp, Artificial
  CRISPR gRNA sequence
gagtacagtggcatgatcat

SEQ ID NO: 456560 - DNA, 20 bp, Artificial
  CRISPR gRNA sequence
cagcctcatgccccgagccc

SEQ ID NO: 456561 - DNA, 20 bp, Artificial
  CRISPR gRNA sequence
atgccccgagcccaatcgat

SEQ ID NO: 456562 - DNA, 20 bp, Artificial
  CRISPR gRNA sequence
ccacctcagcttccctagta

SEQ ID NO: 456563 - DNA, 20 bp, Artificial
  CRISPR gRNA sequence
agcttccctagtagctggga

SEQ ID NO: 456564 - DNA, 20 bp, Artificial
  CRISPR gRNA sequence
ccctagtagctgggactaca

SEQ ID NO: 456565 - DNA, 20 bp, Artificial
  CRISPR gRNA sequence
cctagtagctgggactacag

SEQ ID NO: 456566 - DNA, 20 bp, Artificial
  CRISPR gRNA sequence
gtagctgggactacaggcat

SEQ ID NO: 456567 - DNA, 20 bp, Artificial
  CRISPR gRNA sequence
ggactacaggcatgtgccac

SEQ ID NO: 456568 - DNA, 20 bp, Artificial
  CRISPR gRNA sequence
caggcatgtgccaccacgcc

SEQ ID NO: 456569 - DNA, 20 bp, Artificial
  CRISPR gRNA sequence
ttgtattttttgtagagaca

SEQ ID NO: 456570 - DNA, 20 bp, Artificial
  CRISPR gRNA sequence
tgtattttttgtagagacag

SEQ ID NO: 456571 - DNA, 20 bp, Artificial
  CRISPR gRNA sequence
gtattttttgtagagacagg

SEQ ID NO: 456572 - DNA, 20 bp, Artificial
  CRISPR gRNA sequence
tattttttgtagagacaggt

SEQ ID NO: 456573 - DNA, 20 bp, Artificial
  CRISPR gRNA sequence
tttgtagagacaggttttca

SEQ ID NO: 456574 - DNA, 20 bp, Artificial
  CRISPR gRNA sequence
ttgtagagacaggttttcac

SEQ ID NO: 456575 - DNA, 20 bp, Artificial
  CRISPR gRNA sequence
tgtagagacaggttttcact

SEQ ID NO: 456576 - DNA, 20 bp, Artificial
  CRISPR gRNA sequence
gtagagacaggttttcactg

SEQ ID NO: 456577 - DNA, 20 bp, Artificial
  CRISPR gRNA sequence
tagagacaggttttcactgt

SEQ ID NO: 456578 - DNA, 20 bp, Artificial
  CRISPR gRNA sequence
tcactgtgttgcccaggctg

SEQ ID NO: 456579 - DNA, 20 bp, Artificial
  CRISPR gRNA sequence
cactgtgttgcccaggctgg

SEQ ID NO: 456580 - DNA, 20 bp, Artificial
  CRISPR gRNA sequence
actgtgttgcccaggctggt

SEQ ID NO: 456581 - DNA, 20 bp, Artificial
  CRISPR gRNA sequence
tgttgcccaggctggtctcg

SEQ ID NO: 456582 - DNA, 20 bp, Artificial
  CRISPR gRNA sequence
cccaggctggtctcgaactc

SEQ ID NO: 456583 - DNA, 20 bp, Artificial
  CRISPR gRNA sequence
gtctcgaactcctgggttca

SEQ ID NO: 456584 - DNA, 20 bp, Artificial
  CRISPR gRNA sequence
gaactcctgggttcaagtga

SEQ ID NO: 456585 - DNA, 20 bp, Artificial
  CRISPR gRNA sequence
ctgggttcaagtgatgcacc

SEQ ID NO: 456586 - DNA, 20 bp, Artificial
  CRISPR gRNA sequence
ggttcaagtgatgcacctgc

SEQ ID NO: 456587 - DNA, 20 bp, Artificial
  CRISPR gRNA sequence
aagtgatgcacctgccttgg

SEQ ID NO: 456588 - DNA, 20 bp, Artificial
  CRISPR gRNA sequence
ccttggcctccctaagtgct

SEQ ID NO: 456589 - DNA, 20 bp, Artificial
  CRISPR gRNA sequence
ggcctccctaagtgctgggg

SEQ ID NO: 456590 - DNA, 20 bp, Artificial
  CRISPR gRNA sequence
gcctccctaagtgctggggt

SEQ ID NO: 456591 - DNA, 20 bp, Artificial
  CRISPR gRNA sequence
cctaagtgctggggttacag

SEQ ID NO: 456592 - DNA, 20 bp, Artificial
  CRISPR gRNA sequence
agtgctggggttacaggcat

SEQ ID NO: 456593 - DNA, 20 bp, Artificial
  CRISPR gRNA sequence
gggttacaggcatgagacac

SEQ ID NO: 456594 - DNA, 20 bp, Artificial
  CRISPR gRNA sequence
caggcatgagacactgcacc

SEQ ID NO: 456595 - DNA, 20 bp, Artificial
  CRISPR gRNA sequence
cacctggactagatctggat

SEQ ID NO: 456596 - DNA, 20 bp, Artificial
  CRISPR gRNA sequence
gactagatctggatttttat

SEQ ID NO: 456597 - DNA, 20 bp, Artificial
  CRISPR gRNA sequence
gatctggatttttatccatc

SEQ ID NO: 456598 - DNA, 20 bp, Artificial
  CRISPR gRNA sequence
gatttttatccatcatttac

SEQ ID NO: 456599 - DNA, 20 bp, Artificial
  CRISPR gRNA sequence
ttatccatcatttactgttg

SEQ ID NO: 456600 - DNA, 20 bp, Artificial
  CRISPR gRNA sequence
tatccatcatttactgttgg

SEQ ID NO: 456601 - DNA, 20 bp, Artificial
  CRISPR gRNA sequence
atccatcatttactgttgga

SEQ ID NO: 456602 - DNA, 20 bp, Artificial
  CRISPR gRNA sequence
tccatcatttactgttggat

SEQ ID NO: 456603 - DNA, 20 bp, Artificial
  CRISPR gRNA sequence
actgttggatgaacataaat

SEQ ID NO: 456604 - DNA, 20 bp, Artificial
  CRISPR gRNA sequence
ctgttggatgaacataaatt

SEQ ID NO: 456605 - DNA, 20 bp, Artificial
  CRISPR gRNA sequence
ttggatgaacataaattatc

SEQ ID NO: 456606 - DNA, 20 bp, Artificial
  CRISPR gRNA sequence
gatgaacataaattatcttc

SEQ ID NO: 456607 - DNA, 20 bp, Artificial
  CRISPR gRNA sequence
tcttcaagcttgagttatca

SEQ ID NO: 456608 - DNA, 20 bp, Artificial
  CRISPR gRNA sequence
caagcttgagttatcacagg

SEQ ID NO: 456609 - DNA, 20 bp, Artificial
  CRISPR gRNA sequence
aagcttgagttatcacagga

SEQ ID NO: 456610 - DNA, 20 bp, Artificial
  CRISPR gRNA sequence
gagttatcacaggacaatag

SEQ ID NO: 456611 - DNA, 20 bp, Artificial
  CRISPR gRNA sequence
agttatcacaggacaatagc

SEQ ID NO: 456612 - DNA, 20 bp, Artificial
  CRISPR gRNA sequence
tcacaggacaatagctcaaa

SEQ ID NO: 456613 - DNA, 20 bp, Artificial
  CRISPR gRNA sequence
aaaagaccatggagattaaa

SEQ ID NO: 456614 - DNA, 20 bp, Artificial
  CRISPR gRNA sequence
aataatataatatcacttag

SEQ ID NO: 456615 - DNA, 20 bp, Artificial
  CRISPR gRNA sequence
agcacaatgcctggcccaca

SEQ ID NO: 456616 - DNA, 20 bp, Artificial
  CRISPR gRNA sequence
gcacaatgcctggcccacag

SEQ ID NO: 456617 - DNA, 20 bp, Artificial
  CRISPR gRNA sequence
gcccacagtaagcactcagt

SEQ ID NO: 456618 - DNA, 20 bp, Artificial
  CRISPR gRNA sequence
agtaaatggcagacattgtt

SEQ ID NO: 456619 - DNA, 20 bp, Artificial
  CRISPR gRNA sequence
ttttttattttattttatta

SEQ ID NO: 456620 - DNA, 20 bp, Artificial
  CRISPR gRNA sequence
tttattttattttattattt

SEQ ID NO: 456621 - DNA, 20 bp, Artificial
  CRISPR gRNA sequence
ttattttattttattatttc

SEQ ID NO: 456622 - DNA, 20 bp, Artificial
  CRISPR gRNA sequence
tattttattttattatttct

SEQ ID NO: 456623 - DNA, 20 bp, Artificial
  CRISPR gRNA sequence
attttattttattatttctt

SEQ ID NO: 456624 - DNA, 20 bp, Artificial
  CRISPR gRNA sequence
ttttattttattatttcttt

SEQ ID NO: 456625 - DNA, 20 bp, Artificial
  CRISPR gRNA sequence
tattttattatttctttttt

SEQ ID NO: 456626 - DNA, 20 bp, Artificial
  CRISPR gRNA sequence
attttattatttcttttttt

SEQ ID NO: 456627 - DNA, 20 bp, Artificial
  CRISPR gRNA sequence
ttttattatttctttttttg

SEQ ID NO: 456628 - DNA, 20 bp, Artificial
  CRISPR gRNA sequence
tattatttctttttttgaga

SEQ ID NO: 456629 - DNA, 20 bp, Artificial
  CRISPR gRNA sequence
attatttctttttttgagac

SEQ ID NO: 456630 - DNA, 20 bp, Artificial
  CRISPR gRNA sequence
ttatttctttttttgagaca

SEQ ID NO: 456631 - DNA, 20 bp, Artificial
  CRISPR gRNA sequence
tttctttttttgagacagag

SEQ ID NO: 456632 - DNA, 20 bp, Artificial
  CRISPR gRNA sequence
ctttttttgagacagagtct

SEQ ID NO: 456633 - DNA, 20 bp, Artificial
  CRISPR gRNA sequence
tttttttgagacagagtctg

SEQ ID NO: 456634 - DNA, 20 bp, Artificial
  CRISPR gRNA sequence
tttttgagacagagtctggc

SEQ ID NO: 456635 - DNA, 20 bp, Artificial
  CRISPR gRNA sequence
ttttgagacagagtctggct

SEQ ID NO: 456636 - DNA, 20 bp, Artificial
  CRISPR gRNA sequence
tttgagacagagtctggctc

SEQ ID NO: 456637 - DNA, 20 bp, Artificial
  CRISPR gRNA sequence
ttgagacagagtctggctct

SEQ ID NO: 456638 - DNA, 20 bp, Artificial
  CRISPR gRNA sequence
tgagacagagtctggctctg

SEQ ID NO: 456639 - DNA, 20 bp, Artificial
  CRISPR gRNA sequence
gagacagagtctggctctgt

SEQ ID NO: 456640 - DNA, 20 bp, Artificial
  CRISPR gRNA sequence
agacagagtctggctctgtc

SEQ ID NO: 456641 - DNA, 20 bp, Artificial
  CRISPR gRNA sequence
gctctgtcgcccaggctcga

SEQ ID NO: 456642 - DNA, 20 bp, Artificial
  CRISPR gRNA sequence
tgtcgcccaggctcgagtgc

SEQ ID NO: 456643 - DNA, 20 bp, Artificial
  CRISPR gRNA sequence
tcgcccaggctcgagtgcag

SEQ ID NO: 456644 - DNA, 20 bp, Artificial
  CRISPR gRNA sequence
gagtgcagtggcgcaatctc

SEQ ID NO: 456645 - DNA, 20 bp, Artificial
  CRISPR gRNA sequence
ggctcactgcaacctctgct

SEQ ID NO: 456646 - DNA, 20 bp, Artificial
  CRISPR gRNA sequence
actgcaacctctgcttcccg

SEQ ID NO: 456647 - DNA, 20 bp, Artificial
  CRISPR gRNA sequence
caacctctgcttcccgggtt

SEQ ID NO: 456648 - DNA, 20 bp, Artificial
  CRISPR gRNA sequence
tgcttcccgggttcaagtga

SEQ ID NO: 456649 - DNA, 20 bp, Artificial
  CRISPR gRNA sequence
cttcccgggttcaagtgatt

SEQ ID NO: 456650 - DNA, 20 bp, Artificial
  CRISPR gRNA sequence
cccgggttcaagtgattctc

SEQ ID NO: 456651 - DNA, 20 bp, Artificial
  CRISPR gRNA sequence
ccgggttcaagtgattctcc

SEQ ID NO: 456652 - DNA, 20 bp, Artificial
  CRISPR gRNA sequence
aagtgattctcctgcctcag

SEQ ID NO: 456653 - DNA, 20 bp, Artificial
  CRISPR gRNA sequence
tcctgcctcagcctcccaag

SEQ ID NO: 456654 - DNA, 20 bp, Artificial
  CRISPR gRNA sequence
ctgcctcagcctcccaagta

SEQ ID NO: 456655 - DNA, 20 bp, Artificial
  CRISPR gRNA sequence
cctcagcctcccaagtagct

SEQ ID NO: 456656 - DNA, 20 bp, Artificial
  CRISPR gRNA sequence
agcctcccaagtagctggga

SEQ ID NO: 456657 - DNA, 20 bp, Artificial
  CRISPR gRNA sequence
ccaagtagctgggattacag

SEQ ID NO: 456658 - DNA, 20 bp, Artificial
  CRISPR gRNA sequence
ggattacaggtgcgtgctac

SEQ ID NO: 456659 - DNA, 20 bp, Artificial
  CRISPR gRNA sequence
caggtgcgtgctaccacact

SEQ ID NO: 456660 - DNA, 20 bp, Artificial
  CRISPR gRNA sequence
ccacactcggctattttttg

SEQ ID NO: 456661 - DNA, 20 bp, Artificial
  CRISPR gRNA sequence
ggctattttttgtattttta

SEQ ID NO: 456662 - DNA, 20 bp, Artificial
  CRISPR gRNA sequence
ttttttgtatttttagtaga

SEQ ID NO: 456663 - DNA, 20 bp, Artificial
  CRISPR gRNA sequence
tttgtatttttagtagagac

SEQ ID NO: 456664 - DNA, 20 bp, Artificial
  CRISPR gRNA sequence
ttgtatttttagtagagaca

SEQ ID NO: 456665 - DNA, 20 bp, Artificial
  CRISPR gRNA sequence
tgtatttttagtagagacag

SEQ ID NO: 456666 - DNA, 20 bp, Artificial
  CRISPR gRNA sequence
gtatttttagtagagacagg

SEQ ID NO: 456667 - DNA, 20 bp, Artificial
  CRISPR gRNA sequence
tatttttagtagagacaggg

SEQ ID NO: 456668 - DNA, 20 bp, Artificial
  CRISPR gRNA sequence
ttagtagagacagggtttca

SEQ ID NO: 456669 - DNA, 20 bp, Artificial
  CRISPR gRNA sequence
tagtagagacagggtttcac

SEQ ID NO: 456670 - DNA, 20 bp, Artificial
  CRISPR gRNA sequence
agtagagacagggtttcacc

SEQ ID NO: 456671 - DNA, 20 bp, Artificial
  CRISPR gRNA sequence
gtagagacagggtttcacca

SEQ ID NO: 456672 - DNA, 20 bp, Artificial
  CRISPR gRNA sequence
caccatgttggccaggcttg

SEQ ID NO: 456673 - DNA, 20 bp, Artificial
  CRISPR gRNA sequence
accatgttggccaggcttgt

SEQ ID NO: 456674 - DNA, 20 bp, Artificial
  CRISPR gRNA sequence
gccaggcttgtctcgaactc

SEQ ID NO: 456675 - DNA, 20 bp, Artificial
  CRISPR gRNA sequence
gtctcgaactcctgatctca

SEQ ID NO: 456676 - DNA, 20 bp, Artificial
  CRISPR gRNA sequence
tctcgaactcctgatctcaa

SEQ ID NO: 456677 - DNA, 20 bp, Artificial
  CRISPR gRNA sequence
gaactcctgatctcaaatga

SEQ ID NO: 456678 - DNA, 20 bp, Artificial
  CRISPR gRNA sequence
ctgatctcaaatgatctgcc

SEQ ID NO: 456679 - DNA, 20 bp, Artificial
  CRISPR gRNA sequence
atctcaaatgatctgccagc

SEQ ID NO: 456680 - DNA, 20 bp, Artificial
  CRISPR gRNA sequence
aaatgatctgccagcctcag

SEQ ID NO: 456681 - DNA, 20 bp, Artificial
  CRISPR gRNA sequence
ccagcctcagcctcctgaag

SEQ ID NO: 456682 - DNA, 20 bp, Artificial
  CRISPR gRNA sequence
agcctcctgaagtgctggga

SEQ ID NO: 456683 - DNA, 20 bp, Artificial
  CRISPR gRNA sequence
ctgaagtgctgggattacag

SEQ ID NO: 456684 - DNA, 20 bp, Artificial
  CRISPR gRNA sequence
aagtgctgggattacaggcg

SEQ ID NO: 456685 - DNA, 20 bp, Artificial
  CRISPR gRNA sequence
ggattacaggcgtgagccac

SEQ ID NO: 456686 - DNA, 20 bp, Artificial
  CRISPR gRNA sequence
caggcgtgagccaccaccca

SEQ ID NO: 456687 - DNA, 20 bp, Artificial
  CRISPR gRNA sequence
acattgtttattacctgtct

SEQ ID NO: 456688 - DNA, 20 bp, Artificial
  CRISPR gRNA sequence
tttattacctgtctcttctt

SEQ ID NO: 456689 - DNA, 20 bp, Artificial
  CRISPR gRNA sequence
attacctgtctcttcttaac

SEQ ID NO: 456690 - DNA, 20 bp, Artificial
  CRISPR gRNA sequence
ttacctgtctcttcttaact

SEQ ID NO: 456691 - DNA, 20 bp, Artificial
  CRISPR gRNA sequence
cctgtctcttcttaactagt

SEQ ID NO: 456692 - DNA, 20 bp, Artificial
  CRISPR gRNA sequence
tctcttcttaactagtttta

SEQ ID NO: 456693 - DNA, 20 bp, Artificial
  CRISPR gRNA sequence
ttcttaactagttttacctt

SEQ ID NO: 456694 - DNA, 20 bp, Artificial
  CRISPR gRNA sequence
cttaactagttttaccttcc

SEQ ID NO: 456695 - DNA, 20 bp, Artificial
  CRISPR gRNA sequence
ttaactagttttaccttcca

SEQ ID NO: 456696 - DNA, 20 bp, Artificial
  CRISPR gRNA sequence
aactagttttaccttccaaa

SEQ ID NO: 456697 - DNA, 20 bp, Artificial
  CRISPR gRNA sequence
actagttttaccttccaaaa

SEQ ID NO: 456698 - DNA, 20 bp, Artificial
  CRISPR gRNA sequence
gttttaccttccaaaatgca

SEQ ID NO: 456699 - DNA, 20 bp, Artificial
  CRISPR gRNA sequence
taccttccaaaatgcaccta

SEQ ID NO: 456700 - DNA, 20 bp, Artificial
  CRISPR gRNA sequence
accttccaaaatgcacctaa

SEQ ID NO: 456701 - DNA, 20 bp, Artificial
  CRISPR gRNA sequence
ccttccaaaatgcacctaat

SEQ ID NO: 456702 - DNA, 20 bp, Artificial
  CRISPR gRNA sequence
ccaaaatgcacctaatttcc

SEQ ID NO: 456703 - DNA, 20 bp, Artificial
  CRISPR gRNA sequence
caaaatgcacctaatttcca

SEQ ID NO: 456704 - DNA, 20 bp, Artificial
  CRISPR gRNA sequence
atttccacacttggggaacc

SEQ ID NO: 456705 - DNA, 20 bp, Artificial
  CRISPR gRNA sequence
ccacacttggggaaccatct

SEQ ID NO: 456706 - DNA, 20 bp, Artificial
  CRISPR gRNA sequence
cacacttggggaaccatcta

SEQ ID NO: 456707 - DNA, 20 bp, Artificial
  CRISPR gRNA sequence
ggggaaccatctagatgtgc

SEQ ID NO: 456708 - DNA, 20 bp, Artificial
  CRISPR gRNA sequence
gggaaccatctagatgtgct

SEQ ID NO: 456709 - DNA, 20 bp, Artificial
  CRISPR gRNA sequence
gatgtgctgactctaatact

SEQ ID NO: 456710 - DNA, 20 bp, Artificial
  CRISPR gRNA sequence
actctaatacttaaatatgc

SEQ ID NO: 456711 - DNA, 20 bp, Artificial
  CRISPR gRNA sequence
taatacttaaatatgctgag

SEQ ID NO: 456712 - DNA, 20 bp, Artificial
  CRISPR gRNA sequence
atacttaaatatgctgagaa

SEQ ID NO: 456713 - DNA, 20 bp, Artificial
  CRISPR gRNA sequence
aaatatgctgagaagatgag

SEQ ID NO: 456714 - DNA, 20 bp, Artificial
  CRISPR gRNA sequence
aatatgctgagaagatgaga

SEQ ID NO: 456715 - DNA, 20 bp, Artificial
  CRISPR gRNA sequence
agaagatgagaaaagcattc

SEQ ID NO: 456716 - DNA, 20 bp, Artificial
  CRISPR gRNA sequence
ttccttagggagaatcttca

SEQ ID NO: 456717 - DNA, 20 bp, Artificial
  CRISPR gRNA sequence
ccttagggagaatcttcaca

SEQ ID NO: 456718 - DNA, 20 bp, Artificial
  CRISPR gRNA sequence
cttagggagaatcttcacaa

SEQ ID NO: 456719 - DNA, 20 bp, Artificial
  CRISPR gRNA sequence
agggagaatcttcacaacta

SEQ ID NO: 456720 - DNA, 20 bp, Artificial
  CRISPR gRNA sequence
gggagaatcttcacaactaa

SEQ ID NO: 456721 - DNA, 20 bp, Artificial
  CRISPR gRNA sequence
cacaactaaaacaatatatt

SEQ ID NO: 456722 - DNA, 20 bp, Artificial
  CRISPR gRNA sequence
acaactaaaacaatatatta

SEQ ID NO: 456723 - DNA, 20 bp, Artificial
  CRISPR gRNA sequence
aaacaatatattaggagaac

SEQ ID NO: 456724 - DNA, 20 bp, Artificial
  CRISPR gRNA sequence
ggagaacaggatttaggtta

SEQ ID NO: 456725 - DNA, 20 bp, Artificial
  CRISPR gRNA sequence
aggttataaggagcaaggac

SEQ ID NO: 456726 - DNA, 20 bp, Artificial
  CRISPR gRNA sequence
ggttataaggagcaaggact

SEQ ID NO: 456727 - DNA, 20 bp, Artificial
  CRISPR gRNA sequence
taaggagcaaggactgtgtt

SEQ ID NO: 456728 - DNA, 20 bp, Artificial
  CRISPR gRNA sequence
tgttatacctcattctgttc

SEQ ID NO: 456729 - DNA, 20 bp, Artificial
  CRISPR gRNA sequence
tacctcattctgttctccaa

SEQ ID NO: 456730 - DNA, 20 bp, Artificial
  CRISPR gRNA sequence
attctgttctccaaggcata

SEQ ID NO: 456731 - DNA, 20 bp, Artificial
  CRISPR gRNA sequence
tgttctccaaggcatagcgc

SEQ ID NO: 456732 - DNA, 20 bp, Artificial
  CRISPR gRNA sequence
ttctccaaggcatagcgctg

SEQ ID NO: 456733 - DNA, 20 bp, Artificial
  CRISPR gRNA sequence
tccaaggcatagcgctgggc

SEQ ID NO: 456734 - DNA, 20 bp, Artificial
  CRISPR gRNA sequence
caaggcatagcgctgggcct

SEQ ID NO: 456735 - DNA, 20 bp, Artificial
  CRISPR gRNA sequence
ggcctgggatgcacaataca

SEQ ID NO: 456736 - DNA, 20 bp, Artificial
  CRISPR gRNA sequence
ggatgcacaatacatatttg

SEQ ID NO: 456737 - DNA, 20 bp, Artificial
  CRISPR gRNA sequence
gttagatgaatgaaagagga

SEQ ID NO: 456738 - DNA, 20 bp, Artificial
  CRISPR gRNA sequence
ttagatgaatgaaagaggag

SEQ ID NO: 456739 - DNA, 20 bp, Artificial
  CRISPR gRNA sequence
gatgaatgaaagaggagtat

SEQ ID NO: 456740 - DNA, 20 bp, Artificial
  CRISPR gRNA sequence
gtgcagtttaactgaagcaa

SEQ ID NO: 456741 - DNA, 20 bp, Artificial
  CRISPR gRNA sequence
aactgaagcaatgtattcac

SEQ ID NO: 456742 - DNA, 20 bp, Artificial
  CRISPR gRNA sequence
actgaagcaatgtattcaca

SEQ ID NO: 456743 - DNA, 20 bp, Artificial
  CRISPR gRNA sequence
aagcaatgtattcacataaa

SEQ ID NO: 456744 - DNA, 20 bp, Artificial
  CRISPR gRNA sequence
acataaatagaatgaaatgc

SEQ ID NO: 456745 - DNA, 20 bp, Artificial
  CRISPR gRNA sequence
tagagtctctagtgccaggc

SEQ ID NO: 456746 - DNA, 20 bp, Artificial
  CRISPR gRNA sequence
tagtgccaggctaatgtaat

SEQ ID NO: 456747 - DNA, 20 bp, Artificial
  CRISPR gRNA sequence
gtgccaggctaatgtaattt

SEQ ID NO: 456748 - DNA, 20 bp, Artificial
  CRISPR gRNA sequence
atgtaatttagactttattc

SEQ ID NO: 456749 - DNA, 20 bp, Artificial
  CRISPR gRNA sequence
agactttattccatagacag

SEQ ID NO: 456750 - DNA, 20 bp, Artificial
  CRISPR gRNA sequence
gactttattccatagacagt

SEQ ID NO: 456751 - DNA, 20 bp, Artificial
  CRISPR gRNA sequence
tattccatagacagtgagaa

SEQ ID NO: 456752 - DNA, 20 bp, Artificial
  CRISPR gRNA sequence
attccatagacagtgagaag

SEQ ID NO: 456753 - DNA, 20 bp, Artificial
  CRISPR gRNA sequence
ttccatagacagtgagaagc

SEQ ID NO: 456754 - DNA, 20 bp, Artificial
  CRISPR gRNA sequence
catagacagtgagaagccat

SEQ ID NO: 456755 - DNA, 20 bp, Artificial
  CRISPR gRNA sequence
aaactttgagtgatgtggca

SEQ ID NO: 456756 - DNA, 20 bp, Artificial
  CRISPR gRNA sequence
tgagtgatgtggcatgtaca

SEQ ID NO: 456757 - DNA, 20 bp, Artificial
  CRISPR gRNA sequence
gagtgatgtggcatgtacaa

SEQ ID NO: 456758 - DNA, 20 bp, Artificial
  CRISPR gRNA sequence
agtgatgtggcatgtacaaa

SEQ ID NO: 456759 - DNA, 20 bp, Artificial
  CRISPR gRNA sequence
gcattttggaaagacaagct

SEQ ID NO: 456760 - DNA, 20 bp, Artificial
  CRISPR gRNA sequence
tggaaagacaagctggtggt

SEQ ID NO: 456761 - DNA, 20 bp, Artificial
  CRISPR gRNA sequence
ggaaagacaagctggtggta

SEQ ID NO: 456762 - DNA, 20 bp, Artificial
  CRISPR gRNA sequence
gaaagacaagctggtggtag

SEQ ID NO: 456763 - DNA, 20 bp, Artificial
  CRISPR gRNA sequence
gtggtagtatgtagaatgga

SEQ ID NO: 456764 - DNA, 20 bp, Artificial
  CRISPR gRNA sequence
gaggcagaaacagtatttag

SEQ ID NO: 456765 - DNA, 20 bp, Artificial
  CRISPR gRNA sequence
agagttgctggaccattagg

SEQ ID NO: 456766 - DNA, 20 bp, Artificial
  CRISPR gRNA sequence
gagttgctggaccattaggc

SEQ ID NO: 456767 - DNA, 20 bp, Artificial
  CRISPR gRNA sequence
ctggaccattaggcaacagc

SEQ ID NO: 456768 - DNA, 20 bp, Artificial
  CRISPR gRNA sequence
gaccattaggcaacagctca

SEQ ID NO: 456769 - DNA, 20 bp, Artificial
  CRISPR gRNA sequence
ggcaacagctcagtgctagg

SEQ ID NO: 456770 - DNA, 20 bp, Artificial
  CRISPR gRNA sequence
agtgctaggccctgtggtag

SEQ ID NO: 456771 - DNA, 20 bp, Artificial
  CRISPR gRNA sequence
ggccctgtggtaggtgtggg

SEQ ID NO: 456772 - DNA, 20 bp, Artificial
  CRISPR gRNA sequence
tggtaggtgtgggagataca

SEQ ID NO: 456773 - DNA, 20 bp, Artificial
  CRISPR gRNA sequence
gggcacagttgctgaactca

SEQ ID NO: 456774 - DNA, 20 bp, Artificial
  CRISPR gRNA sequence
ctgaactcaagggactcact

SEQ ID NO: 456775 - DNA, 20 bp, Artificial
  CRISPR gRNA sequence
aactcaagggactcactagt

SEQ ID NO: 456776 - DNA, 20 bp, Artificial
  CRISPR gRNA sequence
aagggactcactagttagga

SEQ ID NO: 456777 - DNA, 20 bp, Artificial
  CRISPR gRNA sequence
actagttaggagactatagg

SEQ ID NO: 456778 - DNA, 20 bp, Artificial
  CRISPR gRNA sequence
gttaggagactataggaata

SEQ ID NO: 456779 - DNA, 20 bp, Artificial
  CRISPR gRNA sequence
ggagactataggaatatgtt

SEQ ID NO: 456780 - DNA, 20 bp, Artificial
  CRISPR gRNA sequence
taggaatatgttaagtgtga

SEQ ID NO: 456781 - DNA, 20 bp, Artificial
  CRISPR gRNA sequence
agtgtgaggtgatgaagacc

SEQ ID NO: 456782 - DNA, 20 bp, Artificial
  CRISPR gRNA sequence
aaaaacacctttggaaggaa

SEQ ID NO: 456783 - DNA, 20 bp, Artificial
  CRISPR gRNA sequence
tggaaggaaaggaataacaa

SEQ ID NO: 456784 - DNA, 20 bp, Artificial
  CRISPR gRNA sequence
ggaaggaaaggaataacaaa

SEQ ID NO: 456785 - DNA, 20 bp, Artificial
  CRISPR gRNA sequence
gaaggaaaggaataacaaag

SEQ ID NO: 456786 - DNA, 20 bp, Artificial
  CRISPR gRNA sequence
ctattcttccccactaagta

SEQ ID NO: 456787 - DNA, 20 bp, Artificial
  CRISPR gRNA sequence
ttcttccccactaagtactg

SEQ ID NO: 456788 - DNA, 20 bp, Artificial
  CRISPR gRNA sequence
ttccccactaagtactgctg

SEQ ID NO: 456789 - DNA, 20 bp, Artificial
  CRISPR gRNA sequence
ccccactaagtactgctgtg

SEQ ID NO: 456790 - DNA, 20 bp, Artificial
  CRISPR gRNA sequence
cccactaagtactgctgtgc

SEQ ID NO: 456791 - DNA, 20 bp, Artificial
  CRISPR gRNA sequence
agtactgctgtgcggaagaa

SEQ ID NO: 456792 - DNA, 20 bp, Artificial
  CRISPR gRNA sequence
ctgtgcggaagaacagcagt

SEQ ID NO: 456793 - DNA, 20 bp, Artificial
  CRISPR gRNA sequence
tgcggaagaacagcagtact

SEQ ID NO: 456794 - DNA, 20 bp, Artificial
  CRISPR gRNA sequence
agtaactctctgaattgggg

SEQ ID NO: 456795 - DNA, 20 bp, Artificial
  CRISPR gRNA sequence
gtaactctctgaattggggg

SEQ ID NO: 456796 - DNA, 20 bp, Artificial
  CRISPR gRNA sequence
tctgaattgggggttaagaa

SEQ ID NO: 456797 - DNA, 20 bp, Artificial
  CRISPR gRNA sequence
tgaattgggggttaagaaaa

SEQ ID NO: 456798 - DNA, 20 bp, Artificial
  CRISPR gRNA sequence
aattgggggttaagaaaaaa

SEQ ID NO: 456799 - DNA, 20 bp, Artificial
  CRISPR gRNA sequence
ggggttaagaaaaaaggagg

SEQ ID NO: 456800 - DNA, 20 bp, Artificial
  CRISPR gRNA sequence
agaaaaaaggaggaaccaaa

SEQ ID NO: 456801 - DNA, 20 bp, Artificial
  CRISPR gRNA sequence
actccgtcatgaacagaaat

SEQ ID NO: 456802 - DNA, 20 bp, Artificial
  CRISPR gRNA sequence
cgtcatgaacagaaataggg

SEQ ID NO: 456803 - DNA, 20 bp, Artificial
  CRISPR gRNA sequence
aggaggatagctttgatact

SEQ ID NO: 456804 - DNA, 20 bp, Artificial
  CRISPR gRNA sequence
tgatactgagtttgaggaaa

SEQ ID NO: 456805 - DNA, 20 bp, Artificial
  CRISPR gRNA sequence
gatactgagtttgaggaaat

SEQ ID NO: 456806 - DNA, 20 bp, Artificial
  CRISPR gRNA sequence
atactgagtttgaggaaatg

SEQ ID NO: 456807 - DNA, 20 bp, Artificial
  CRISPR gRNA sequence
agtttgaggaaatggtggga

SEQ ID NO: 456808 - DNA, 20 bp, Artificial
  CRISPR gRNA sequence
gaggaaatggtgggacatcc

SEQ ID NO: 456809 - DNA, 20 bp, Artificial
  CRISPR gRNA sequence
aggaaatggtgggacatcca

SEQ ID NO: 456810 - DNA, 20 bp, Artificial
  CRISPR gRNA sequence
ggagtacagtttttagttta

SEQ ID NO: 456811 - DNA, 20 bp, Artificial
  CRISPR gRNA sequence
ttagtttaaacgtttaatta

SEQ ID NO: 456812 - DNA, 20 bp, Artificial
  CRISPR gRNA sequence
tagtttaaacgtttaattaa

SEQ ID NO: 456813 - DNA, 20 bp, Artificial
  CRISPR gRNA sequence
agtttaaacgtttaattaaa

SEQ ID NO: 456814 - DNA, 20 bp, Artificial
  CRISPR gRNA sequence
gtttaaacgtttaattaaaa

SEQ ID NO: 456815 - DNA, 20 bp, Artificial
  CRISPR gRNA sequence
aaacgtttaattaaaactta

SEQ ID NO: 456816 - DNA, 20 bp, Artificial
  CRISPR gRNA sequence
aacgtttaattaaaacttag

SEQ ID NO: 456817 - DNA, 20 bp, Artificial
  CRISPR gRNA sequence
aattaaaacttaggaaaggt

SEQ ID NO: 456818 - DNA, 20 bp, Artificial
  CRISPR gRNA sequence
attaaaacttaggaaaggtg

SEQ ID NO: 456819 - DNA, 20 bp, Artificial
  CRISPR gRNA sequence
aaacttaggaaaggtgttca

SEQ ID NO: 456820 - DNA, 20 bp, Artificial
  CRISPR gRNA sequence
aggaaaggtgttcaagctgg

SEQ ID NO: 456821 - DNA, 20 bp, Artificial
  CRISPR gRNA sequence
ggaaaggtgttcaagctgga

SEQ ID NO: 456822 - DNA, 20 bp, Artificial
  CRISPR gRNA sequence
aagctggagaagttgatttg

SEQ ID NO: 456823 - DNA, 20 bp, Artificial
  CRISPR gRNA sequence
gagaagttgatttgctggtc

SEQ ID NO: 456824 - DNA, 20 bp, Artificial
  CRISPR gRNA sequence
atttgctggtcagttgcagg

SEQ ID NO: 456825 - DNA, 20 bp, Artificial
  CRISPR gRNA sequence
gctggtcagttgcagggaga

SEQ ID NO: 456826 - DNA, 20 bp, Artificial
  CRISPR gRNA sequence
ctggtcagttgcagggagat

SEQ ID NO: 456827 - DNA, 20 bp, Artificial
  CRISPR gRNA sequence
gtcagttgcagggagatgct

SEQ ID NO: 456828 - DNA, 20 bp, Artificial
  CRISPR gRNA sequence
cagggagatgctggtttaaa

SEQ ID NO: 456829 - DNA, 20 bp, Artificial
  CRISPR gRNA sequence
gtttaaatcgtgggtagatg

SEQ ID NO: 456830 - DNA, 20 bp, Artificial
  CRISPR gRNA sequence
aaatcgtgggtagatgagaa

SEQ ID NO: 456831 - DNA, 20 bp, Artificial
  CRISPR gRNA sequence
aatcgtgggtagatgagaac

SEQ ID NO: 456832 - DNA, 20 bp, Artificial
  CRISPR gRNA sequence
gggagagagagtaaagagaa

SEQ ID NO: 456833 - DNA, 20 bp, Artificial
  CRISPR gRNA sequence
aaggggtgagaagtgagtct

SEQ ID NO: 456834 - DNA, 20 bp, Artificial
  CRISPR gRNA sequence
ggggaatactcatgtttgag

SEQ ID NO: 456835 - DNA, 20 bp, Artificial
  CRISPR gRNA sequence
gggaatactcatgtttgaga

SEQ ID NO: 456836 - DNA, 20 bp, Artificial
  CRISPR gRNA sequence
atgtttgagaggtgggagga

SEQ ID NO: 456837 - DNA, 20 bp, Artificial
  CRISPR gRNA sequence
gagaggtgggaggaggaaat

SEQ ID NO: 456838 - DNA, 20 bp, Artificial
  CRISPR gRNA sequence
agaggtgggaggaggaaata

SEQ ID NO: 456839 - DNA, 20 bp, Artificial
  CRISPR gRNA sequence
gagatgacagtttgatgaag

SEQ ID NO: 456840 - DNA, 20 bp, Artificial
  CRISPR gRNA sequence
gatgaaggagggaatagtca

SEQ ID NO: 456841 - DNA, 20 bp, Artificial
  CRISPR gRNA sequence
atgaaggagggaatagtcag

SEQ ID NO: 456842 - DNA, 20 bp, Artificial
  CRISPR gRNA sequence
aatgctatagctaggtcaga

SEQ ID NO: 456843 - DNA, 20 bp, Artificial
  CRISPR gRNA sequence
tagctaggtcagacaggaag

SEQ ID NO: 456844 - DNA, 20 bp, Artificial
  CRISPR gRNA sequence
ggtcagacaggaagacacca

SEQ ID NO: 456845 - DNA, 20 bp, Artificial
  CRISPR gRNA sequence
aacaagttgaaaatttgaat

SEQ ID NO: 456846 - DNA, 20 bp, Artificial
  CRISPR gRNA sequence
aaaatttgaattaactagga

SEQ ID NO: 456847 - DNA, 20 bp, Artificial
  CRISPR gRNA sequence
gaattaactaggaaccatag

SEQ ID NO: 456848 - DNA, 20 bp, Artificial
  CRISPR gRNA sequence
aattaactaggaaccatagg

SEQ ID NO: 456849 - DNA, 20 bp, Artificial
  CRISPR gRNA sequence
actaggaaccataggaggtg

SEQ ID NO: 456850 - DNA, 20 bp, Artificial
  CRISPR gRNA sequence
ggaaccataggaggtgatta

SEQ ID NO: 456851 - DNA, 20 bp, Artificial
  CRISPR gRNA sequence
gaaacatttgttcaaaggct

SEQ ID NO: 456852 - DNA, 20 bp, Artificial
  CRISPR gRNA sequence
gttcaaaggctctgggccag

SEQ ID NO: 456853 - DNA, 20 bp, Artificial
  CRISPR gRNA sequence
ttcaaaggctctgggccagt

SEQ ID NO: 456854 - DNA, 20 bp, Artificial
  CRISPR gRNA sequence
aaaggctctgggccagtttt

SEQ ID NO: 456855 - DNA, 20 bp, Artificial
  CRISPR gRNA sequence
tgggccagtttttcatgggg

SEQ ID NO: 456856 - DNA, 20 bp, Artificial
  CRISPR gRNA sequence
ggccagtttttcatgggggg

SEQ ID NO: 456857 - DNA, 20 bp, Artificial
  CRISPR gRNA sequence
ttcatggggggagggtggtg

SEQ ID NO: 456858 - DNA, 20 bp, Artificial
  CRISPR gRNA sequence
tcatggggggagggtggtga

SEQ ID NO: 456859 - DNA, 20 bp, Artificial
  CRISPR gRNA sequence
catggggggagggtggtgag

SEQ ID NO: 456860 - DNA, 20 bp, Artificial
  CRISPR gRNA sequence
atggggggagggtggtgagt

SEQ ID NO: 456861 - DNA, 20 bp, Artificial
  CRISPR gRNA sequence
atacttgtttttcttaaaaa

SEQ ID NO: 456862 - DNA, 20 bp, Artificial
  CRISPR gRNA sequence
tacttgtttttcttaaaaag

SEQ ID NO: 456863 - DNA, 20 bp, Artificial
  CRISPR gRNA sequence
gtttttcttaaaaagtaaga

SEQ ID NO: 456864 - DNA, 20 bp, Artificial
  CRISPR gRNA sequence
tttttcttaaaaagtaagat

SEQ ID NO: 456865 - DNA, 20 bp, Artificial
  CRISPR gRNA sequence
ttcttaaaaagtaagatagg

SEQ ID NO: 456866 - DNA, 20 bp, Artificial
  CRISPR gRNA sequence
tcttaaaaagtaagataggc

SEQ ID NO: 456867 - DNA, 20 bp, Artificial
  CRISPR gRNA sequence
cttaaaaagtaagataggcc

SEQ ID NO: 456868 - DNA, 20 bp, Artificial
  CRISPR gRNA sequence
ttaaaaagtaagataggcca

SEQ ID NO: 456869 - DNA, 20 bp, Artificial
  CRISPR gRNA sequence
aaaaagtaagataggccagg

SEQ ID NO: 456870 - DNA, 20 bp, Artificial
  CRISPR gRNA sequence
aaaagtaagataggccaggc

SEQ ID NO: 456871 - DNA, 20 bp, Artificial
  CRISPR gRNA sequence
acacctgtaatcccagcact

SEQ ID NO: 456872 - DNA, 20 bp, Artificial
  CRISPR gRNA sequence
taatcccagcactttggcta

SEQ ID NO: 456873 - DNA, 20 bp, Artificial
  CRISPR gRNA sequence
tggctaggctgaggcggata

SEQ ID NO: 456874 - DNA, 20 bp, Artificial
  CRISPR gRNA sequence
ggctaggctgaggcggatag

SEQ ID NO: 456875 - DNA, 20 bp, Artificial
  CRISPR gRNA sequence
gctaggctgaggcggataga

SEQ ID NO: 456876 - DNA, 20 bp, Artificial
  CRISPR gRNA sequence
ggctgaggcggatagatcac

SEQ ID NO: 456877 - DNA, 20 bp, Artificial
  CRISPR gRNA sequence
aggcggatagatcacctgag

SEQ ID NO: 456878 - DNA, 20 bp, Artificial
  CRISPR gRNA sequence
aggtcaggagtttgagacca

SEQ ID NO: 456879 - DNA, 20 bp, Artificial
  CRISPR gRNA sequence
gagaccagcctggccgtcat

SEQ ID NO: 456880 - DNA, 20 bp, Artificial
  CRISPR gRNA sequence
agaccagcctggccgtcatg

SEQ ID NO: 456881 - DNA, 20 bp, Artificial
  CRISPR gRNA sequence
gccgtcatggcaaaaccccg

SEQ ID NO: 456882 - DNA, 20 bp, Artificial
  CRISPR gRNA sequence
aactaaaaatacaaaaaaaa

SEQ ID NO: 456883 - DNA, 20 bp, Artificial
  CRISPR gRNA sequence
aaaatacaaaaaaaattagt

SEQ ID NO: 456884 - DNA, 20 bp, Artificial
  CRISPR gRNA sequence
gttggatgggtggtggcgtg

SEQ ID NO: 456885 - DNA, 20 bp, Artificial
  CRISPR gRNA sequence
gatgggtggtggcgtgtgcc

SEQ ID NO: 456886 - DNA, 20 bp, Artificial
  CRISPR gRNA sequence
tagtcccagctatttgggcg

SEQ ID NO: 456887 - DNA, 20 bp, Artificial
  CRISPR gRNA sequence
tttgggcggctgaggcagga

SEQ ID NO: 456888 - DNA, 20 bp, Artificial
  CRISPR gRNA sequence
gggcggctgaggcaggagaa

SEQ ID NO: 456889 - DNA, 20 bp, Artificial
  CRISPR gRNA sequence
ggcggctgaggcaggagaat

SEQ ID NO: 456890 - DNA, 20 bp, Artificial
  CRISPR gRNA sequence
aggcaggagaatcacttgaa

SEQ ID NO: 456891 - DNA, 20 bp, Artificial
  CRISPR gRNA sequence
gaaccttggaggtggaggtt

SEQ ID NO: 456892 - DNA, 20 bp, Artificial
  CRISPR gRNA sequence
aaccttggaggtggaggttg

SEQ ID NO: 456893 - DNA, 20 bp, Artificial
  CRISPR gRNA sequence
ggaggtggaggttgcagtga

SEQ ID NO: 456894 - DNA, 20 bp, Artificial
  CRISPR gRNA sequence
gaggtggaggttgcagtgag

SEQ ID NO: 456895 - DNA, 20 bp, Artificial
  CRISPR gRNA sequence
cagtgagcagagatcacgcc

SEQ ID NO: 456896 - DNA, 20 bp, Artificial
  CRISPR gRNA sequence
ctctccagcccggaccacag

SEQ ID NO: 456897 - DNA, 20 bp, Artificial
  CRISPR gRNA sequence
tccagcccggaccacagagt

SEQ ID NO: 456898 - DNA, 20 bp, Artificial
  CRISPR gRNA sequence
cagcccggaccacagagtga

SEQ ID NO: 456899 - DNA, 20 bp, Artificial
  CRISPR gRNA sequence
tctcaaaaaatcaaagaaaa

SEQ ID NO: 456900 - DNA, 20 bp, Artificial
  CRISPR gRNA sequence
aaaaaatcaaagaaaaagaa

SEQ ID NO: 456901 - DNA, 20 bp, Artificial
  CRISPR gRNA sequence
taagttcatggagaagtaag

SEQ ID NO: 456902 - DNA, 20 bp, Artificial
  CRISPR gRNA sequence
atggagaagtaagatagttg

SEQ ID NO: 456903 - DNA, 20 bp, Artificial
  CRISPR gRNA sequence
taaaagttcatagagaataa

SEQ ID NO: 456904 - DNA, 20 bp, Artificial
  CRISPR gRNA sequence
atagagaataatagcagtgc

SEQ ID NO: 456905 - DNA, 20 bp, Artificial
  CRISPR gRNA sequence
ttgtcctcctaggcttattg

SEQ ID NO: 456906 - DNA, 20 bp, Artificial
  CRISPR gRNA sequence
tgtcctcctaggcttattgt

SEQ ID NO: 456907 - DNA, 20 bp, Artificial
  CRISPR gRNA sequence
gtcctcctaggcttattgtc

SEQ ID NO: 456908 - DNA, 20 bp, Artificial
  CRISPR gRNA sequence
tcctcctaggcttattgtct

SEQ ID NO: 456909 - DNA, 20 bp, Artificial
  CRISPR gRNA sequence
ctaggcttattgtctgagac

SEQ ID NO: 456910 - DNA, 20 bp, Artificial
  CRISPR gRNA sequence
ggcttattgtctgagacaac

SEQ ID NO: 456911 - DNA, 20 bp, Artificial
  CRISPR gRNA sequence
attgtctgagacaaccactg

SEQ ID NO: 456912 - DNA, 20 bp, Artificial
  CRISPR gRNA sequence
ttgtctgagacaaccactgt

SEQ ID NO: 456913 - DNA, 20 bp, Artificial
  CRISPR gRNA sequence
tctgagacaaccactgtcaa

SEQ ID NO: 456914 - DNA, 20 bp, Artificial
  CRISPR gRNA sequence
agacaaccactgtcaactct

SEQ ID NO: 456915 - DNA, 20 bp, Artificial
  CRISPR gRNA sequence
tcaactcttcgagatgtctt

SEQ ID NO: 456916 - DNA, 20 bp, Artificial
  CRISPR gRNA sequence
ttcgagatgtcttattatat

SEQ ID NO: 456917 - DNA, 20 bp, Artificial
  CRISPR gRNA sequence
cgagatgtcttattatattc

SEQ ID NO: 456918 - DNA, 20 bp, Artificial
  CRISPR gRNA sequence
gagatgtcttattatattcc

SEQ ID NO: 456919 - DNA, 20 bp, Artificial
  CRISPR gRNA sequence
attatattcctaaataatat

SEQ ID NO: 456920 - DNA, 20 bp, Artificial
  CRISPR gRNA sequence
ttatattcctaaataatatg

SEQ ID NO: 456921 - DNA, 20 bp, Artificial
  CRISPR gRNA sequence
tattcctaaataatatgctc

SEQ ID NO: 456922 - DNA, 20 bp, Artificial
  CRISPR gRNA sequence
ctaaataatatgctcatatt

SEQ ID NO: 456923 - DNA, 20 bp, Artificial
  CRISPR gRNA sequence
aataatatgctcatattgct

SEQ ID NO: 456924 - DNA, 20 bp, Artificial
  CRISPR gRNA sequence
atattgctgcttcctagtga

SEQ ID NO: 456925 - DNA, 20 bp, Artificial
  CRISPR gRNA sequence
ctgcttcctagtgataaaat

SEQ ID NO: 456926 - DNA, 20 bp, Artificial
  CRISPR gRNA sequence
cttcctagtgataaaattta

SEQ ID NO: 456927 - DNA, 20 bp, Artificial
  CRISPR gRNA sequence
cctagtgataaaatttagac

SEQ ID NO: 456928 - DNA, 20 bp, Artificial
  CRISPR gRNA sequence
ctagtgataaaatttagaca

SEQ ID NO: 456929 - DNA, 20 bp, Artificial
  CRISPR gRNA sequence
gtgataaaatttagacattt

SEQ ID NO: 456930 - DNA, 20 bp, Artificial
  CRISPR gRNA sequence
agacattttctattggcttt

SEQ ID NO: 456931 - DNA, 20 bp, Artificial
  CRISPR gRNA sequence
gacattttctattggctttc

SEQ ID NO: 456932 - DNA, 20 bp, Artificial
  CRISPR gRNA sequence
tctattggctttctgctaca

SEQ ID NO: 456933 - DNA, 20 bp, Artificial
  CRISPR gRNA sequence
ctattggctttctgctacag

SEQ ID NO: 456934 - DNA, 20 bp, Artificial
  CRISPR gRNA sequence
tattggctttctgctacagt

SEQ ID NO: 456935 - DNA, 20 bp, Artificial
  CRISPR gRNA sequence
ttggctttctgctacagtag

SEQ ID NO: 456936 - DNA, 20 bp, Artificial
  CRISPR gRNA sequence
gctttctgctacagtagatg

SEQ ID NO: 456937 - DNA, 20 bp, Artificial
  CRISPR gRNA sequence
tctgctacagtagatgaaga

SEQ ID NO: 456938 - DNA, 20 bp, Artificial
  CRISPR gRNA sequence
ctgctacagtagatgaagat

SEQ ID NO: 456939 - DNA, 20 bp, Artificial
  CRISPR gRNA sequence
tgctacagtagatgaagatg

SEQ ID NO: 456940 - DNA, 20 bp, Artificial
  CRISPR gRNA sequence
ctacagtagatgaagatgtg

SEQ ID NO: 456941 - DNA, 20 bp, Artificial
  CRISPR gRNA sequence
cagtagatgaagatgtgcta

SEQ ID NO: 456942 - DNA, 20 bp, Artificial
  CRISPR gRNA sequence
gaatatagtagatgaggatt

SEQ ID NO: 456943 - DNA, 20 bp, Artificial
  CRISPR gRNA sequence
tactttcacccattttcctt

SEQ ID NO: 456944 - DNA, 20 bp, Artificial
  CRISPR gRNA sequence
tcacccattttccttctctg

SEQ ID NO: 456945 - DNA, 20 bp, Artificial
  CRISPR gRNA sequence
cacccattttccttctctgc

SEQ ID NO: 456946 - DNA, 20 bp, Artificial
  CRISPR gRNA sequence
acccattttccttctctgca

SEQ ID NO: 456947 - DNA, 20 bp, Artificial
  CRISPR gRNA sequence
tccttctctgcattcttcta

SEQ ID NO: 456948 - DNA, 20 bp, Artificial
  CRISPR gRNA sequence
ccttctctgcattcttctaa

SEQ ID NO: 456949 - DNA, 20 bp, Artificial
  CRISPR gRNA sequence
cttctctgcattcttctaaa

SEQ ID NO: 456950 - DNA, 20 bp, Artificial
  CRISPR gRNA sequence
ctctgcattcttctaaaaat

SEQ ID NO: 456951 - DNA, 20 bp, Artificial
  CRISPR gRNA sequence
tctgcattcttctaaaaata

SEQ ID NO: 456952 - DNA, 20 bp, Artificial
  CRISPR gRNA sequence
tgcattcttctaaaaataat

SEQ ID NO: 456953 - DNA, 20 bp, Artificial
  CRISPR gRNA sequence
cattcttctaaaaataattg

SEQ ID NO: 456954 - DNA, 20 bp, Artificial
  CRISPR gRNA sequence
ttctaaaaataattgtacca

SEQ ID NO: 456955 - DNA, 20 bp, Artificial
  CRISPR gRNA sequence
ctaaaaataattgtaccaca

SEQ ID NO: 456956 - DNA, 20 bp, Artificial
  CRISPR gRNA sequence
taaaaataattgtaccacaa

SEQ ID NO: 456957 - DNA, 20 bp, Artificial
  CRISPR gRNA sequence
aaaataattgtaccacaaat

SEQ ID NO: 456958 - DNA, 20 bp, Artificial
  CRISPR gRNA sequence
taccacaaattttatttaaa

SEQ ID NO: 456959 - DNA, 20 bp, Artificial
  CRISPR gRNA sequence
tatttaaattagtcatgttt

SEQ ID NO: 456960 - DNA, 20 bp, Artificial
  CRISPR gRNA sequence
atttaaattagtcatgttta

SEQ ID NO: 456961 - DNA, 20 bp, Artificial
  CRISPR gRNA sequence
tttaaattagtcatgtttac

SEQ ID NO: 456962 - DNA, 20 bp, Artificial
  CRISPR gRNA sequence
aaattagtcatgtttacata

SEQ ID NO: 456963 - DNA, 20 bp, Artificial
  CRISPR gRNA sequence
aattagtcatgtttacataa

SEQ ID NO: 456964 - DNA, 20 bp, Artificial
  CRISPR gRNA sequence
gtcatgtttacataatttgg

SEQ ID NO: 456965 - DNA, 20 bp, Artificial
  CRISPR gRNA sequence
acataatttggattctgtgt

SEQ ID NO: 456966 - DNA, 20 bp, Artificial
  CRISPR gRNA sequence
cataatttggattctgtgtt

SEQ ID NO: 456967 - DNA, 20 bp, Artificial
  CRISPR gRNA sequence
ggattctgtgttattttttg

SEQ ID NO: 456968 - DNA, 20 bp, Artificial
  CRISPR gRNA sequence
gattctgtgttattttttgc

SEQ ID NO: 456969 - DNA, 20 bp, Artificial
  CRISPR gRNA sequence
tgtgttattttttgcaaaat

SEQ ID NO: 456970 - DNA, 20 bp, Artificial
  CRISPR gRNA sequence
tgttattttttgcaaaatca

SEQ ID NO: 456971 - DNA, 20 bp, Artificial
  CRISPR gRNA sequence
ttttttgcaaaatcaagttg

SEQ ID NO: 456972 - DNA, 20 bp, Artificial
  CRISPR gRNA sequence
tttgcaaaatcaagttgtgc

SEQ ID NO: 456973 - DNA, 20 bp, Artificial
  CRISPR gRNA sequence
ttgcaaaatcaagttgtgcg

SEQ ID NO: 456974 - DNA, 20 bp, Artificial
  CRISPR gRNA sequence
tgcaaaatcaagttgtgcgc

SEQ ID NO: 456975 - DNA, 20 bp, Artificial
  CRISPR gRNA sequence
gcaaaatcaagttgtgcgct

SEQ ID NO: 456976 - DNA, 20 bp, Artificial
  CRISPR gRNA sequence
caaaatcaagttgtgcgcta

SEQ ID NO: 456977 - DNA, 20 bp, Artificial
  CRISPR gRNA sequence
tgcgctatgtttcttttgta

SEQ ID NO: 456978 - DNA, 20 bp, Artificial
  CRISPR gRNA sequence
tgtttcttttgtaaaattta

SEQ ID NO: 456979 - DNA, 20 bp, Artificial
  CRISPR gRNA sequence
cttttgtaaaatttagtttt

SEQ ID NO: 456980 - DNA, 20 bp, Artificial
  CRISPR gRNA sequence
ttttgtaaaatttagttttt

SEQ ID NO: 456981 - DNA, 20 bp, Artificial
  CRISPR gRNA sequence
ttgtaaaatttagttttttc

SEQ ID NO: 456982 - DNA, 20 bp, Artificial
  CRISPR gRNA sequence
tgtaaaatttagttttttct

SEQ ID NO: 456983 - DNA, 20 bp, Artificial
  CRISPR gRNA sequence
gtaaaatttagttttttcta

SEQ ID NO: 456984 - DNA, 20 bp, Artificial
  CRISPR gRNA sequence
taaaatttagttttttctag

SEQ ID NO: 456985 - DNA, 20 bp, Artificial
  CRISPR gRNA sequence
agttttttctagagcctgat

SEQ ID NO: 456986 - DNA, 20 bp, Artificial
  CRISPR gRNA sequence
gttttttctagagcctgatt

SEQ ID NO: 456987 - DNA, 20 bp, Artificial
  CRISPR gRNA sequence
tttctagagcctgattttat

SEQ ID NO: 456988 - DNA, 20 bp, Artificial
  CRISPR gRNA sequence
ttctagagcctgattttatt

SEQ ID NO: 456989 - DNA, 20 bp, Artificial
  CRISPR gRNA sequence
tctagagcctgattttattt

SEQ ID NO: 456990 - DNA, 20 bp, Artificial
  CRISPR gRNA sequence
ctagagcctgattttatttt

SEQ ID NO: 456991 - DNA, 20 bp, Artificial
  CRISPR gRNA sequence
tagagcctgattttattttt

SEQ ID NO: 456992 - DNA, 20 bp, Artificial
  CRISPR gRNA sequence
gagcctgattttattttttt

SEQ ID NO: 456993 - DNA, 20 bp, Artificial
  CRISPR gRNA sequence
attttatttttttactggca

SEQ ID NO: 456994 - DNA, 20 bp, Artificial
  CRISPR gRNA sequence
tatttttttactggcagagt

SEQ ID NO: 456995 - DNA, 20 bp, Artificial
  CRISPR gRNA sequence
atttttttactggcagagtt

SEQ ID NO: 456996 - DNA, 20 bp, Artificial
  CRISPR gRNA sequence
tttttttactggcagagttt

SEQ ID NO: 456997 - DNA, 20 bp, Artificial
  CRISPR gRNA sequence
ttttactggcagagttttcc

SEQ ID NO: 456998 - DNA, 20 bp, Artificial
  CRISPR gRNA sequence
tttactggcagagttttcca

SEQ ID NO: 456999 - DNA, 20 bp, Artificial
  CRISPR gRNA sequence
ttactggcagagttttccat

SEQ ID NO: 457000 - DNA, 20 bp, Artificial
  CRISPR gRNA sequence
tactggcagagttttccata

SEQ ID NO: 457001 - DNA, 20 bp, Artificial
  CRISPR gRNA sequence
actggcagagttttccatat

SEQ ID NO: 457002 - DNA, 20 bp, Artificial
  CRISPR gRNA sequence
ctggcagagttttccatatc

SEQ ID NO: 457003 - DNA, 20 bp, Artificial
  CRISPR gRNA sequence
gcagagttttccatatccat

SEQ ID NO: 457004 - DNA, 20 bp, Artificial
  CRISPR gRNA sequence
tccatatccatttctttaat

SEQ ID NO: 457005 - DNA, 20 bp, Artificial
  CRISPR gRNA sequence
ccatatccatttctttaatc

SEQ ID NO: 457006 - DNA, 20 bp, Artificial
  CRISPR gRNA sequence
catatccatttctttaatct

SEQ ID NO: 457007 - DNA, 20 bp, Artificial
  CRISPR gRNA sequence
ctttaatctttttattgggt

SEQ ID NO: 457008 - DNA, 20 bp, Artificial
  CRISPR gRNA sequence
tttaatctttttattgggtc

SEQ ID NO: 457009 - DNA, 20 bp, Artificial
  CRISPR gRNA sequence
taatctttttattgggtctt

SEQ ID NO: 457010 - DNA, 20 bp, Artificial
  CRISPR gRNA sequence
aatctttttattgggtcttt

SEQ ID NO: 457011 - DNA, 20 bp, Artificial
  CRISPR gRNA sequence
atctttttattgggtcttta

SEQ ID NO: 457012 - DNA, 20 bp, Artificial
  CRISPR gRNA sequence
tttattgggtctttaatggg

SEQ ID NO: 457013 - DNA, 20 bp, Artificial
  CRISPR gRNA sequence
ttattgggtctttaatgggc

SEQ ID NO: 457014 - DNA, 20 bp, Artificial
  CRISPR gRNA sequence
tattgggtctttaatgggcc

SEQ ID NO: 457015 - DNA, 20 bp, Artificial
  CRISPR gRNA sequence
attgggtctttaatgggcct

SEQ ID NO: 457016 - DNA, 20 bp, Artificial
  CRISPR gRNA sequence
ttgggtctttaatgggcctt

SEQ ID NO: 457017 - DNA, 20 bp, Artificial
  CRISPR gRNA sequence
ggtctttaatgggcctttag

SEQ ID NO: 457018 - DNA, 20 bp, Artificial
  CRISPR gRNA sequence
taatgggcctttagaaagat

SEQ ID NO: 457019 - DNA, 20 bp, Artificial
  CRISPR gRNA sequence
aatgggcctttagaaagatg

SEQ ID NO: 457020 - DNA, 20 bp, Artificial
  CRISPR gRNA sequence
atgggcctttagaaagatga

SEQ ID NO: 457021 - DNA, 20 bp, Artificial
  CRISPR gRNA sequence
tagaaagatgatatgtcgat

SEQ ID NO: 457022 - DNA, 20 bp, Artificial
  CRISPR gRNA sequence
agaaagatgatatgtcgatt

SEQ ID NO: 457023 - DNA, 20 bp, Artificial
  CRISPR gRNA sequence
gaaagatgatatgtcgattc

SEQ ID NO: 457024 - DNA, 20 bp, Artificial
  CRISPR gRNA sequence
catttttacctcctagagat

SEQ ID NO: 457025 - DNA, 20 bp, Artificial
  CRISPR gRNA sequence
ttacctcctagagatctccc

SEQ ID NO: 457026 - DNA, 20 bp, Artificial
  CRISPR gRNA sequence
tacctcctagagatctccct

SEQ ID NO: 457027 - DNA, 20 bp, Artificial
  CRISPR gRNA sequence
acctcctagagatctccctt

SEQ ID NO: 457028 - DNA, 20 bp, Artificial
  CRISPR gRNA sequence
cctcctagagatctcccttc

SEQ ID NO: 457029 - DNA, 20 bp, Artificial
  CRISPR gRNA sequence
ctagagatctcccttccaga

SEQ ID NO: 457030 - DNA, 20 bp, Artificial
  CRISPR gRNA sequence
gagatctcccttccagagtc

SEQ ID NO: 457031 - DNA, 20 bp, Artificial
  CRISPR gRNA sequence
ccttccagagtcgtctttct

SEQ ID NO: 457032 - DNA, 20 bp, Artificial
  CRISPR gRNA sequence
ccagagtcgtctttctcttg

SEQ ID NO: 457033 - DNA, 20 bp, Artificial
  CRISPR gRNA sequence
cagagtcgtctttctcttgc

SEQ ID NO: 457034 - DNA, 20 bp, Artificial
  CRISPR gRNA sequence
tctcttgctctcttctggac

SEQ ID NO: 457035 - DNA, 20 bp, Artificial
  CRISPR gRNA sequence
ctcttgctctcttctggact

SEQ ID NO: 457036 - DNA, 20 bp, Artificial
  CRISPR gRNA sequence
tcttgctctcttctggacta

SEQ ID NO: 457037 - DNA, 20 bp, Artificial
  CRISPR gRNA sequence
ttgctctcttctggactaac

SEQ ID NO: 457038 - DNA, 20 bp, Artificial
  CRISPR gRNA sequence
gctctcttctggactaactg

SEQ ID NO: 457039 - DNA, 20 bp, Artificial
  CRISPR gRNA sequence
ctctcttctggactaactgc

SEQ ID NO: 457040 - DNA, 20 bp, Artificial
  CRISPR gRNA sequence
tcttctggactaactgccct

SEQ ID NO: 457041 - DNA, 20 bp, Artificial
  CRISPR gRNA sequence
ttctggactaactgcccttt

SEQ ID NO: 457042 - DNA, 20 bp, Artificial
  CRISPR gRNA sequence
ctggactaactgcccttttt

SEQ ID NO: 457043 - DNA, 20 bp, Artificial
  CRISPR gRNA sequence
tggactaactgccctttttt

SEQ ID NO: 457044 - DNA, 20 bp, Artificial
  CRISPR gRNA sequence
gactaactgcccttttttaa

SEQ ID NO: 457045 - DNA, 20 bp, Artificial
  CRISPR gRNA sequence
actgcccttttttaattctt

SEQ ID NO: 457046 - DNA, 20 bp, Artificial
  CRISPR gRNA sequence
cccttttttaattcttgaat

SEQ ID NO: 457047 - DNA, 20 bp, Artificial
  CRISPR gRNA sequence
ttttaattcttgaatttcct

SEQ ID NO: 457048 - DNA, 20 bp, Artificial
  CRISPR gRNA sequence
tttaattcttgaatttcctt

SEQ ID NO: 457049 - DNA, 20 bp, Artificial
  CRISPR gRNA sequence
ttaattcttgaatttccttt

SEQ ID NO: 457050 - DNA, 20 bp, Artificial
  CRISPR gRNA sequence
taattcttgaatttcctttt

SEQ ID NO: 457051 - DNA, 20 bp, Artificial
  CRISPR gRNA sequence
aattcttgaatttccttttt

SEQ ID NO: 457052 - DNA, 20 bp, Artificial
  CRISPR gRNA sequence
attcttgaatttcctttttt

SEQ ID NO: 457053 - DNA, 20 bp, Artificial
  CRISPR gRNA sequence
ttgaatttcctttttttttt

SEQ ID NO: 457054 - DNA, 20 bp, Artificial
  CRISPR gRNA sequence
gaatttccttttttttttct

SEQ ID NO: 457055 - DNA, 20 bp, Artificial
  CRISPR gRNA sequence
aatttccttttttttttctt

SEQ ID NO: 457056 - DNA, 20 bp, Artificial
  CRISPR gRNA sequence
ccttttttttttcttttcca

SEQ ID NO: 457057 - DNA, 20 bp, Artificial
  CRISPR gRNA sequence
cttttttttttcttttccac

SEQ ID NO: 457058 - DNA, 20 bp, Artificial
  CRISPR gRNA sequence
ttttttttcttttccactag

SEQ ID NO: 457059 - DNA, 20 bp, Artificial
  CRISPR gRNA sequence
tttttttcttttccactaga

SEQ ID NO: 457060 - DNA, 20 bp, Artificial
  CRISPR gRNA sequence
ttttttcttttccactagag

SEQ ID NO: 457061 - DNA, 20 bp, Artificial
  CRISPR gRNA sequence
tttttcttttccactagaga

SEQ ID NO: 457062 - DNA, 20 bp, Artificial
  CRISPR gRNA sequence
ttttcttttccactagagat

SEQ ID NO: 457063 - DNA, 20 bp, Artificial
  CRISPR gRNA sequence
tttcttttccactagagatg

SEQ ID NO: 457064 - DNA, 20 bp, Artificial
  CRISPR gRNA sequence
ttcttttccactagagatgg

SEQ ID NO: 457065 - DNA, 20 bp, Artificial
  CRISPR gRNA sequence
tcttttccactagagatggt

SEQ ID NO: 457066 - DNA, 20 bp, Artificial
  CRISPR gRNA sequence
cttttccactagagatggtg

SEQ ID NO: 457067 - DNA, 20 bp, Artificial
  CRISPR gRNA sequence
ttttccactagagatggtgt

SEQ ID NO: 457068 - DNA, 20 bp, Artificial
  CRISPR gRNA sequence
ttccactagagatggtgtct

SEQ ID NO: 457069 - DNA, 20 bp, Artificial
  CRISPR gRNA sequence
tccactagagatggtgtctc

SEQ ID NO: 457070 - DNA, 20 bp, Artificial
  CRISPR gRNA sequence
ccactagagatggtgtctcc

SEQ ID NO: 457071 - DNA, 20 bp, Artificial
  CRISPR gRNA sequence
cactagagatggtgtctccc

SEQ ID NO: 457072 - DNA, 20 bp, Artificial
  CRISPR gRNA sequence
gagatggtgtctccctgtgt

SEQ ID NO: 457073 - DNA, 20 bp, Artificial
  CRISPR gRNA sequence
cctgtgttgcccaggcttat

SEQ ID NO: 457074 - DNA, 20 bp, Artificial
  CRISPR gRNA sequence
tgttgcccaggcttatctct

SEQ ID NO: 457075 - DNA, 20 bp, Artificial
  CRISPR gRNA sequence
cccaggcttatctctaactc

SEQ ID NO: 457076 - DNA, 20 bp, Artificial
  CRISPR gRNA sequence
atctctaactcctgggctca

SEQ ID NO: 457077 - DNA, 20 bp, Artificial
  CRISPR gRNA sequence
tctctaactcctgggctcaa

SEQ ID NO: 457078 - DNA, 20 bp, Artificial
  CRISPR gRNA sequence
taactcctgggctcaagtga

SEQ ID NO: 457079 - DNA, 20 bp, Artificial
  CRISPR gRNA sequence
actcctgggctcaagtgatc

SEQ ID NO: 457080 - DNA, 20 bp, Artificial
  CRISPR gRNA sequence
ctgggctcaagtgatcctcc

SEQ ID NO: 457081 - DNA, 20 bp, Artificial
  CRISPR gRNA sequence
ggctcaagtgatcctcccac

SEQ ID NO: 457082 - DNA, 20 bp, Artificial
  CRISPR gRNA sequence
aagtgatcctcccaccttgg

SEQ ID NO: 457083 - DNA, 20 bp, Artificial
  CRISPR gRNA sequence
ccaccttggcctccaaaagt

SEQ ID NO: 457084 - DNA, 20 bp, Artificial
  CRISPR gRNA sequence
ggcctccaaaagtgctggca

SEQ ID NO: 457085 - DNA, 20 bp, Artificial
  CRISPR gRNA sequence
gcctccaaaagtgctggcat

SEQ ID NO: 457086 - DNA, 20 bp, Artificial
  CRISPR gRNA sequence
caaaagtgctggcatgagcc

SEQ ID NO: 457087 - DNA, 20 bp, Artificial
  CRISPR gRNA sequence
gcatgagccactgtgtccag

SEQ ID NO: 457088 - DNA, 20 bp, Artificial
  CRISPR gRNA sequence
tgtccagcctagaacttcct

SEQ ID NO: 457089 - DNA, 20 bp, Artificial
  CRISPR gRNA sequence
gaacttccttgttagactcc

SEQ ID NO: 457090 - DNA, 20 bp, Artificial
  CRISPR gRNA sequence
ccttgttagactccttgttt

SEQ ID NO: 457091 - DNA, 20 bp, Artificial
  CRISPR gRNA sequence
cttgttagactccttgtttc

SEQ ID NO: 457092 - DNA, 20 bp, Artificial
  CRISPR gRNA sequence
gttagactccttgtttcctg

SEQ ID NO: 457093 - DNA, 20 bp, Artificial
  CRISPR gRNA sequence
ttagactccttgtttcctgt

SEQ ID NO: 457094 - DNA, 20 bp, Artificial
  CRISPR gRNA sequence
gactccttgtttcctgtatg

SEQ ID NO: 457095 - DNA, 20 bp, Artificial
  CRISPR gRNA sequence
cttgtttcctgtatgtcatt

SEQ ID NO: 457096 - DNA, 20 bp, Artificial
  CRISPR gRNA sequence
gtttcctgtatgtcatttta

SEQ ID NO: 457097 - DNA, 20 bp, Artificial
  CRISPR gRNA sequence
tttcctgtatgtcattttat

SEQ ID NO: 457098 - DNA, 20 bp, Artificial
  CRISPR gRNA sequence
cctgtatgtcattttatccc

SEQ ID NO: 457099 - DNA, 20 bp, Artificial
  CRISPR gRNA sequence
ctgtatgtcattttatcccc

SEQ ID NO: 457100 - DNA, 20 bp, Artificial
  CRISPR gRNA sequence
tatgtcattttatccccttt

SEQ ID NO: 457101 - DNA, 20 bp, Artificial
  CRISPR gRNA sequence
tatcccctttatggattcac

SEQ ID NO: 457102 - DNA, 20 bp, Artificial
  CRISPR gRNA sequence
atcccctttatggattcact

SEQ ID NO: 457103 - DNA, 20 bp, Artificial
  CRISPR gRNA sequence
tcccctttatggattcactt

SEQ ID NO: 457104 - DNA, 20 bp, Artificial
  CRISPR gRNA sequence
tatggattcactttcttgtt

SEQ ID NO: 457105 - DNA, 20 bp, Artificial
  CRISPR gRNA sequence
atggattcactttcttgttt

SEQ ID NO: 457106 - DNA, 20 bp, Artificial
  CRISPR gRNA sequence
tggattcactttcttgtttt

SEQ ID NO: 457107 - DNA, 20 bp, Artificial
  CRISPR gRNA sequence
actttcttgttttactgaag

SEQ ID NO: 457108 - DNA, 20 bp, Artificial
  CRISPR gRNA sequence
tcttgttttactgaagcaca

SEQ ID NO: 457109 - DNA, 20 bp, Artificial
  CRISPR gRNA sequence
cttgttttactgaagcacat

SEQ ID NO: 457110 - DNA, 20 bp, Artificial
  CRISPR gRNA sequence
ttgttttactgaagcacatc

SEQ ID NO: 457111 - DNA, 20 bp, Artificial
  CRISPR gRNA sequence
gttttactgaagcacatcct

SEQ ID NO: 457112 - DNA, 20 bp, Artificial
  CRISPR gRNA sequence
ttttactgaagcacatcctc

SEQ ID NO: 457113 - DNA, 20 bp, Artificial
  CRISPR gRNA sequence
tactgaagcacatcctctgg

SEQ ID NO: 457114 - DNA, 20 bp, Artificial
  CRISPR gRNA sequence
actgaagcacatcctctggt

SEQ ID NO: 457115 - DNA, 20 bp, Artificial
  CRISPR gRNA sequence
ctgaagcacatcctctggta

SEQ ID NO: 457116 - DNA, 20 bp, Artificial
  CRISPR gRNA sequence
aagcacatcctctggtagct

SEQ ID NO: 457117 - DNA, 20 bp, Artificial
  CRISPR gRNA sequence
tggtagcttctttgaaaaga

SEQ ID NO: 457118 - DNA, 20 bp, Artificial
  CRISPR gRNA sequence
gtagcttctttgaaaagatc

SEQ ID NO: 457119 - DNA, 20 bp, Artificial
  CRISPR gRNA sequence
ctttgaaaagatcacatgga

SEQ ID NO: 457120 - DNA, 20 bp, Artificial
  CRISPR gRNA sequence
tttgaaaagatcacatggaa

SEQ ID NO: 457121 - DNA, 20 bp, Artificial
  CRISPR gRNA sequence
tgaaaagatcacatggaagg

SEQ ID NO: 457122 - DNA, 20 bp, Artificial
  CRISPR gRNA sequence
gaaaagatcacatggaaggc

SEQ ID NO: 457123 - DNA, 20 bp, Artificial
  CRISPR gRNA sequence
aaaagatcacatggaaggca

SEQ ID NO: 457124 - DNA, 20 bp, Artificial
  CRISPR gRNA sequence
ttttgagtcattgcatctca

SEQ ID NO: 457125 - DNA, 20 bp, Artificial
  CRISPR gRNA sequence
tttgagtcattgcatctcat

SEQ ID NO: 457126 - DNA, 20 bp, Artificial
  CRISPR gRNA sequence
ttgagtcattgcatctcatg

SEQ ID NO: 457127 - DNA, 20 bp, Artificial
  CRISPR gRNA sequence
tgagtcattgcatctcatga

SEQ ID NO: 457128 - DNA, 20 bp, Artificial
  CRISPR gRNA sequence
gagtcattgcatctcatgat

SEQ ID NO: 457129 - DNA, 20 bp, Artificial
  CRISPR gRNA sequence
agtcattgcatctcatgata

SEQ ID NO: 457130 - DNA, 20 bp, Artificial
  CRISPR gRNA sequence
catctcatgatagtgtcttt

SEQ ID NO: 457131 - DNA, 20 bp, Artificial
  CRISPR gRNA sequence
atgatagtgtcttttttctt

SEQ ID NO: 457132 - DNA, 20 bp, Artificial
  CRISPR gRNA sequence
ttttctttccttacatttgg

SEQ ID NO: 457133 - DNA, 20 bp, Artificial
  CRISPR gRNA sequence
tttctttccttacatttggt

SEQ ID NO: 457134 - DNA, 20 bp, Artificial
  CRISPR gRNA sequence
ttctttccttacatttggtt

SEQ ID NO: 457135 - DNA, 20 bp, Artificial
  CRISPR gRNA sequence
tctttccttacatttggttt

SEQ ID NO: 457136 - DNA, 20 bp, Artificial
  CRISPR gRNA sequence
ctttccttacatttggttta

SEQ ID NO: 457137 - DNA, 20 bp, Artificial
  CRISPR gRNA sequence
tttccttacatttggtttat

SEQ ID NO: 457138 - DNA, 20 bp, Artificial
  CRISPR gRNA sequence
tccttacatttggtttatag

SEQ ID NO: 457139 - DNA, 20 bp, Artificial
  CRISPR gRNA sequence
ccttacatttggtttatagt

SEQ ID NO: 457140 - DNA, 20 bp, Artificial
  CRISPR gRNA sequence
cttacatttggtttatagtt

SEQ ID NO: 457141 - DNA, 20 bp, Artificial
  CRISPR gRNA sequence
acatttggtttatagtttgg

SEQ ID NO: 457142 - DNA, 20 bp, Artificial
  CRISPR gRNA sequence
catttggtttatagtttggc

SEQ ID NO: 457143 - DNA, 20 bp, Artificial
  CRISPR gRNA sequence
ggtttatagtttggctgaat

SEQ ID NO: 457144 - DNA, 20 bp, Artificial
  CRISPR gRNA sequence
gtttatagtttggctgaata

SEQ ID NO: 457145 - DNA, 20 bp, Artificial
  CRISPR gRNA sequence
atagtttggctgaatatata

SEQ ID NO: 457146 - DNA, 20 bp, Artificial
  CRISPR gRNA sequence
tagtttggctgaatatataa

SEQ ID NO: 457147 - DNA, 20 bp, Artificial
  CRISPR gRNA sequence
ggctgaatatataattctag

SEQ ID NO: 457148 - DNA, 20 bp, Artificial
  CRISPR gRNA sequence
gctgaatatataattctagg

SEQ ID NO: 457149 - DNA, 20 bp, Artificial
  CRISPR gRNA sequence
aatatataattctaggtaaa

SEQ ID NO: 457150 - DNA, 20 bp, Artificial
  CRISPR gRNA sequence
taggtaaattttttttttcc

SEQ ID NO: 457151 - DNA, 20 bp, Artificial
  CRISPR gRNA sequence
ggtaaattttttttttccca

SEQ ID NO: 457152 - DNA, 20 bp, Artificial
  CRISPR gRNA sequence
tttttttcccacagaatttt

SEQ ID NO: 457153 - DNA, 20 bp, Artificial
  CRISPR gRNA sequence
ttttttcccacagaattttg

SEQ ID NO: 457154 - DNA, 20 bp, Artificial
  CRISPR gRNA sequence
tttttcccacagaattttga

SEQ ID NO: 457155 - DNA, 20 bp, Artificial
  CRISPR gRNA sequence
ttttcccacagaattttgaa

SEQ ID NO: 457156 - DNA, 20 bp, Artificial
  CRISPR gRNA sequence
tttcccacagaattttgaag

SEQ ID NO: 457157 - DNA, 20 bp, Artificial
  CRISPR gRNA sequence
ttcccacagaattttgaagg

SEQ ID NO: 457158 - DNA, 20 bp, Artificial
  CRISPR gRNA sequence
tcccacagaattttgaaggc

SEQ ID NO: 457159 - DNA, 20 bp, Artificial
  CRISPR gRNA sequence
cccacagaattttgaaggct

SEQ ID NO: 457160 - DNA, 20 bp, Artificial
  CRISPR gRNA sequence
ccacagaattttgaaggctt

SEQ ID NO: 457161 - DNA, 20 bp, Artificial
  CRISPR gRNA sequence
tgaaggcttgctctattgtc

SEQ ID NO: 457162 - DNA, 20 bp, Artificial
  CRISPR gRNA sequence
gaaggcttgctctattgtct

SEQ ID NO: 457163 - DNA, 20 bp, Artificial
  CRISPR gRNA sequence
aaggcttgctctattgtcta

SEQ ID NO: 457164 - DNA, 20 bp, Artificial
  CRISPR gRNA sequence
gctctattgtctaggaatat

SEQ ID NO: 457165 - DNA, 20 bp, Artificial
  CRISPR gRNA sequence
ctctattgtctaggaatata

SEQ ID NO: 457166 - DNA, 20 bp, Artificial
  CRISPR gRNA sequence
tattgtctaggaatatagtt

SEQ ID NO: 457167 - DNA, 20 bp, Artificial
  CRISPR gRNA sequence
ttgtctaggaatatagttac

SEQ ID NO: 457168 - DNA, 20 bp, Artificial
  CRISPR gRNA sequence
tctaggaatatagttacaca

SEQ ID NO: 457169 - DNA, 20 bp, Artificial
  CRISPR gRNA sequence
ggaatatagttacacagaga

SEQ ID NO: 457170 - DNA, 20 bp, Artificial
  CRISPR gRNA sequence
cacagagagacactttctgt

SEQ ID NO: 457171 - DNA, 20 bp, Artificial
  CRISPR gRNA sequence
tctgttgggcacaatttgac

SEQ ID NO: 457172 - DNA, 20 bp, Artificial
  CRISPR gRNA sequence
ctgttgggcacaatttgact

SEQ ID NO: 457173 - DNA, 20 bp, Artificial
  CRISPR gRNA sequence
tgttgggcacaatttgactt

SEQ ID NO: 457174 - DNA, 20 bp, Artificial
  CRISPR gRNA sequence
ttgggcacaatttgacttaa

SEQ ID NO: 457175 - DNA, 20 bp, Artificial
  CRISPR gRNA sequence
ggcacaatttgacttaagga

SEQ ID NO: 457176 - DNA, 20 bp, Artificial
  CRISPR gRNA sequence
gacttaaggaagccacttaa

SEQ ID NO: 457177 - DNA, 20 bp, Artificial
  CRISPR gRNA sequence
acttaaggaagccacttaaa

SEQ ID NO: 457178 - DNA, 20 bp, Artificial
  CRISPR gRNA sequence
aaggaagccacttaaagctg

SEQ ID NO: 457179 - DNA, 20 bp, Artificial
  CRISPR gRNA sequence
aggaagccacttaaagctgg

SEQ ID NO: 457180 - DNA, 20 bp, Artificial
  CRISPR gRNA sequence
aaagctggggctggagtggc

SEQ ID NO: 457181 - DNA, 20 bp, Artificial
  CRISPR gRNA sequence
aagctggggctggagtggcc

SEQ ID NO: 457182 - DNA, 20 bp, Artificial
  CRISPR gRNA sequence
gggctggagtggccatattt

SEQ ID NO: 457183 - DNA, 20 bp, Artificial
  CRISPR gRNA sequence
gagtggccatatttaggata

SEQ ID NO: 457184 - DNA, 20 bp, Artificial
  CRISPR gRNA sequence
aggatatgccaaagtagtaa

SEQ ID NO: 457185 - DNA, 20 bp, Artificial
  CRISPR gRNA sequence
ggatatgccaaagtagtaat

SEQ ID NO: 457186 - DNA, 20 bp, Artificial
  CRISPR gRNA sequence
gctgcctcacagtttgaaac

SEQ ID NO: 457187 - DNA, 20 bp, Artificial
  CRISPR gRNA sequence
ctgcctcacagtttgaaacg

SEQ ID NO: 457188 - DNA, 20 bp, Artificial
  CRISPR gRNA sequence
cctcacagtttgaaacggta

SEQ ID NO: 457189 - DNA, 20 bp, Artificial
  CRISPR gRNA sequence
acagtttgaaacggtaactg

SEQ ID NO: 457190 - DNA, 20 bp, Artificial
  CRISPR gRNA sequence
gaaacggtaactgttttgcg

SEQ ID NO: 457191 - DNA, 20 bp, Artificial
  CRISPR gRNA sequence
aaacggtaactgttttgcgt

SEQ ID NO: 457192 - DNA, 20 bp, Artificial
  CRISPR gRNA sequence
ttttgcgtcctgtccccttt

SEQ ID NO: 457193 - DNA, 20 bp, Artificial
  CRISPR gRNA sequence
tgcgtcctgtcccctttcta

SEQ ID NO: 457194 - DNA, 20 bp, Artificial
  CRISPR gRNA sequence
gcgtcctgtcccctttctag

SEQ ID NO: 457195 - DNA, 20 bp, Artificial
  CRISPR gRNA sequence
cgtcctgtcccctttctagt

SEQ ID NO: 457196 - DNA, 20 bp, Artificial
  CRISPR gRNA sequence
tcccctttctagtttctgat

SEQ ID NO: 457197 - DNA, 20 bp, Artificial
  CRISPR gRNA sequence
tctagtttctgattccagga

SEQ ID NO: 457198 - DNA, 20 bp, Artificial
  CRISPR gRNA sequence
ctagtttctgattccaggag

SEQ ID NO: 457199 - DNA, 20 bp, Artificial
  CRISPR gRNA sequence
tagtttctgattccaggagc

SEQ ID NO: 457200 - DNA, 20 bp, Artificial
  CRISPR gRNA sequence
gtttctgattccaggagcta

SEQ ID NO: 457201 - DNA, 20 bp, Artificial
  CRISPR gRNA sequence
ctgattccaggagctagaac

SEQ ID NO: 457202 - DNA, 20 bp, Artificial
  CRISPR gRNA sequence
tgattccaggagctagaact

SEQ ID NO: 457203 - DNA, 20 bp, Artificial
  CRISPR gRNA sequence
attccaggagctagaactca

SEQ ID NO: 457204 - DNA, 20 bp, Artificial
  CRISPR gRNA sequence
caggagctagaactcatgag

SEQ ID NO: 457205 - DNA, 20 bp, Artificial
  CRISPR gRNA sequence
gaactcatgagggccagctg

SEQ ID NO: 457206 - DNA, 20 bp, Artificial
  CRISPR gRNA sequence
atgagggccagctgtacttt

SEQ ID NO: 457207 - DNA, 20 bp, Artificial
  CRISPR gRNA sequence
tacttttttattttttcctc

SEQ ID NO: 457208 - DNA, 20 bp, Artificial
  CRISPR gRNA sequence
ttttattttttcctccttta

SEQ ID NO: 457209 - DNA, 20 bp, Artificial
  CRISPR gRNA sequence
tttattttttcctcctttaa

SEQ ID NO: 457210 - DNA, 20 bp, Artificial
  CRISPR gRNA sequence
ttattttttcctcctttaat

SEQ ID NO: 457211 - DNA, 20 bp, Artificial
  CRISPR gRNA sequence
tattttttcctcctttaatc

SEQ ID NO: 457212 - DNA, 20 bp, Artificial
  CRISPR gRNA sequence
attttttcctcctttaatct

SEQ ID NO: 457213 - DNA, 20 bp, Artificial
  CRISPR gRNA sequence
ttttttcctcctttaatcta

SEQ ID NO: 457214 - DNA, 20 bp, Artificial
  CRISPR gRNA sequence
tttcctcctttaatctatgg

SEQ ID NO: 457215 - DNA, 20 bp, Artificial
  CRISPR gRNA sequence
ttcctcctttaatctatggt

SEQ ID NO: 457216 - DNA, 20 bp, Artificial
  CRISPR gRNA sequence
tcctcctttaatctatggta

SEQ ID NO: 457217 - DNA, 20 bp, Artificial
  CRISPR gRNA sequence
cctcctttaatctatggtac

SEQ ID NO: 457218 - DNA, 20 bp, Artificial
  CRISPR gRNA sequence
ctcctttaatctatggtact

SEQ ID NO: 457219 - DNA, 20 bp, Artificial
  CRISPR gRNA sequence
ctttaatctatggtactttg

SEQ ID NO: 457220 - DNA, 20 bp, Artificial
  CRISPR gRNA sequence
taatctatggtactttgaat

SEQ ID NO: 457221 - DNA, 20 bp, Artificial
  CRISPR gRNA sequence
aatctatggtactttgaatt

SEQ ID NO: 457222 - DNA, 20 bp, Artificial
  CRISPR gRNA sequence
atctatggtactttgaattg

SEQ ID NO: 457223 - DNA, 20 bp, Artificial
  CRISPR gRNA sequence
tggtactttgaattggtttc

SEQ ID NO: 457224 - DNA, 20 bp, Artificial
  CRISPR gRNA sequence
tgaattggtttctgtttcct

SEQ ID NO: 457225 - DNA, 20 bp, Artificial
  CRISPR gRNA sequence
gaattggtttctgtttcctc

SEQ ID NO: 457226 - DNA, 20 bp, Artificial
  CRISPR gRNA sequence
aattggtttctgtttcctcc

SEQ ID NO: 457227 - DNA, 20 bp, Artificial
  CRISPR gRNA sequence
gtttctgtttcctccaacta

SEQ ID NO: 457228 - DNA, 20 bp, Artificial
  CRISPR gRNA sequence
ctgtttcctccaactaaatg

SEQ ID NO: 457229 - DNA, 20 bp, Artificial
  CRISPR gRNA sequence
tgtttcctccaactaaatgc

SEQ ID NO: 457230 - DNA, 20 bp, Artificial
  CRISPR gRNA sequence
tttcctccaactaaatgctc

SEQ ID NO: 457231 - DNA, 20 bp, Artificial
  CRISPR gRNA sequence
cctccaactaaatgctcctt

SEQ ID NO: 457232 - DNA, 20 bp, Artificial
  CRISPR gRNA sequence
ctccaactaaatgctcctta

SEQ ID NO: 457233 - DNA, 20 bp, Artificial
  CRISPR gRNA sequence
caactaaatgctccttaaga

SEQ ID NO: 457234 - DNA, 20 bp, Artificial
  CRISPR gRNA sequence
aatgctccttaagacagaca

SEQ ID NO: 457235 - DNA, 20 bp, Artificial
  CRISPR gRNA sequence
cttaagacagacacccatat

SEQ ID NO: 457236 - DNA, 20 bp, Artificial
  CRISPR gRNA sequence
aagacagacacccatattat

SEQ ID NO: 457237 - DNA, 20 bp, Artificial
  CRISPR gRNA sequence
agacagacacccatattatc

SEQ ID NO: 457238 - DNA, 20 bp, Artificial
  CRISPR gRNA sequence
tctcaaacctaatctcgttg

SEQ ID NO: 457239 - DNA, 20 bp, Artificial
  CRISPR gRNA sequence
aaacctaatctcgttgtctg

SEQ ID NO: 457240 - DNA, 20 bp, Artificial
  CRISPR gRNA sequence
atctcgttgtctgcctgaat

SEQ ID NO: 457241 - DNA, 20 bp, Artificial
  CRISPR gRNA sequence
gttgtctgcctgaatttaga

SEQ ID NO: 457242 - DNA, 20 bp, Artificial
  CRISPR gRNA sequence
tctgcctgaatttagaaata

SEQ ID NO: 457243 - DNA, 20 bp, Artificial
  CRISPR gRNA sequence
cctgaatttagaaatatagc

SEQ ID NO: 457244 - DNA, 20 bp, Artificial
  CRISPR gRNA sequence
aatttagaaatatagccaca

SEQ ID NO: 457245 - DNA, 20 bp, Artificial
  CRISPR gRNA sequence
agaaatatagccacatttct

SEQ ID NO: 457246 - DNA, 20 bp, Artificial
  CRISPR gRNA sequence
gaaatatagccacatttctg

SEQ ID NO: 457247 - DNA, 20 bp, Artificial
  CRISPR gRNA sequence
ctgggagagttctgaattgg

SEQ ID NO: 457248 - DNA, 20 bp, Artificial
  CRISPR gRNA sequence
tgggagagttctgaattggg

SEQ ID NO: 457249 - DNA, 20 bp, Artificial
  CRISPR gRNA sequence
ggagagttctgaattgggaa

SEQ ID NO: 457250 - DNA, 20 bp, Artificial
  CRISPR gRNA sequence
tgaattgggaatcaggaggc

SEQ ID NO: 457251 - DNA, 20 bp, Artificial
  CRISPR gRNA sequence
aattgggaatcaggaggcct

SEQ ID NO: 457252 - DNA, 20 bp, Artificial
  CRISPR gRNA sequence
ggaatcaggaggcctaattt

SEQ ID NO: 457253 - DNA, 20 bp, Artificial
  CRISPR gRNA sequence
atttctttcttttcttttct

SEQ ID NO: 457254 - DNA, 20 bp, Artificial
  CRISPR gRNA sequence
ctttcttttcttttcttgtt

SEQ ID NO: 457255 - DNA, 20 bp, Artificial
  CRISPR gRNA sequence
tttcttttcttttcttgttt

SEQ ID NO: 457256 - DNA, 20 bp, Artificial
  CRISPR gRNA sequence
tcttttcttttcttgttttt

SEQ ID NO: 457257 - DNA, 20 bp, Artificial
  CRISPR gRNA sequence
cttttcttttcttgtttttt

SEQ ID NO: 457258 - DNA, 20 bp, Artificial
  CRISPR gRNA sequence
ttttcttttcttgtttttta

SEQ ID NO: 457259 - DNA, 20 bp, Artificial
  CRISPR gRNA sequence
ttcttttcttgttttttatt

SEQ ID NO: 457260 - DNA, 20 bp, Artificial
  CRISPR gRNA sequence
tcttttcttgttttttattt

SEQ ID NO: 457261 - DNA, 20 bp, Artificial
  CRISPR gRNA sequence
cttttcttgttttttatttt

SEQ ID NO: 457262 - DNA, 20 bp, Artificial
  CRISPR gRNA sequence
ttttcttgttttttattttt

SEQ ID NO: 457263 - DNA, 20 bp, Artificial
  CRISPR gRNA sequence
ttcttgttttttattttttt

SEQ ID NO: 457264 - DNA, 20 bp, Artificial
  CRISPR gRNA sequence
tcttgttttttatttttttg

SEQ ID NO: 457265 - DNA, 20 bp, Artificial
  CRISPR gRNA sequence
cttgttttttatttttttga

SEQ ID NO: 457266 - DNA, 20 bp, Artificial
  CRISPR gRNA sequence
ttgttttttatttttttgag

SEQ ID NO: 457267 - DNA, 20 bp, Artificial
  CRISPR gRNA sequence
gttttttatttttttgagac

SEQ ID NO: 457268 - DNA, 20 bp, Artificial
  CRISPR gRNA sequence
ttttttatttttttgagaca

SEQ ID NO: 457269 - DNA, 20 bp, Artificial
  CRISPR gRNA sequence
tttatttttttgagacacag

SEQ ID NO: 457270 - DNA, 20 bp, Artificial
  CRISPR gRNA sequence
ttatttttttgagacacagt

SEQ ID NO: 457271 - DNA, 20 bp, Artificial
  CRISPR gRNA sequence
tatttttttgagacacagtt

SEQ ID NO: 457272 - DNA, 20 bp, Artificial
  CRISPR gRNA sequence
atttttttgagacacagttt

SEQ ID NO: 457273 - DNA, 20 bp, Artificial
  CRISPR gRNA sequence
tttttttgagacacagtttc

SEQ ID NO: 457274 - DNA, 20 bp, Artificial
  CRISPR gRNA sequence
ttttgagacacagtttcgct

SEQ ID NO: 457275 - DNA, 20 bp, Artificial
  CRISPR gRNA sequence
tttgagacacagtttcgctc

SEQ ID NO: 457276 - DNA, 20 bp, Artificial
  CRISPR gRNA sequence
ttgagacacagtttcgctct

SEQ ID NO: 457277 - DNA, 20 bp, Artificial
  CRISPR gRNA sequence
tgagacacagtttcgctcta

SEQ ID NO: 457278 - DNA, 20 bp, Artificial
  CRISPR gRNA sequence
gagacacagtttcgctctag

SEQ ID NO: 457279 - DNA, 20 bp, Artificial
  CRISPR gRNA sequence
agacacagtttcgctctagt

SEQ ID NO: 457280 - DNA, 20 bp, Artificial
  CRISPR gRNA sequence
cgctctagttgcccaagata

SEQ ID NO: 457281 - DNA, 20 bp, Artificial
  CRISPR gRNA sequence
gctctagttgcccaagatag

SEQ ID NO: 457282 - DNA, 20 bp, Artificial
  CRISPR gRNA sequence
tagttgcccaagatagagtg

SEQ ID NO: 457283 - DNA, 20 bp, Artificial
  CRISPR gRNA sequence
gttgcccaagatagagtgca

SEQ ID NO: 457284 - DNA, 20 bp, Artificial
  CRISPR gRNA sequence
cccaagatagagtgcaatgg

SEQ ID NO: 457285 - DNA, 20 bp, Artificial
  CRISPR gRNA sequence
ggctcactgcaacctccgcc

SEQ ID NO: 457286 - DNA, 20 bp, Artificial
  CRISPR gRNA sequence
actgcaacctccgcctccca

SEQ ID NO: 457287 - DNA, 20 bp, Artificial
  CRISPR gRNA sequence
caacctccgcctcccaggtt

SEQ ID NO: 457288 - DNA, 20 bp, Artificial
  CRISPR gRNA sequence
cgcctcccaggttcaagcga

SEQ ID NO: 457289 - DNA, 20 bp, Artificial
  CRISPR gRNA sequence
ccaggttcaagcgattctct

SEQ ID NO: 457290 - DNA, 20 bp, Artificial
  CRISPR gRNA sequence
aagcgattctcttgccttag

SEQ ID NO: 457291 - DNA, 20 bp, Artificial
  CRISPR gRNA sequence
tcttgccttagcctcctgag

SEQ ID NO: 457292 - DNA, 20 bp, Artificial
  CRISPR gRNA sequence
ttgccttagcctcctgagta

SEQ ID NO: 457293 - DNA, 20 bp, Artificial
  CRISPR gRNA sequence
gccttagcctcctgagtagc

SEQ ID NO: 457294 - DNA, 20 bp, Artificial
  CRISPR gRNA sequence
ccttagcctcctgagtagct

SEQ ID NO: 457295 - DNA, 20 bp, Artificial
  CRISPR gRNA sequence
agcctcctgagtagctggga

SEQ ID NO: 457296 - DNA, 20 bp, Artificial
  CRISPR gRNA sequence
gcctcctgagtagctgggat

SEQ ID NO: 457297 - DNA, 20 bp, Artificial
  CRISPR gRNA sequence
ctgagtagctgggattacag

SEQ ID NO: 457298 - DNA, 20 bp, Artificial
  CRISPR gRNA sequence
agtagctgggattacaggca

SEQ ID NO: 457299 - DNA, 20 bp, Artificial
  CRISPR gRNA sequence
ggattacaggcatgcgccac

SEQ ID NO: 457300 - DNA, 20 bp, Artificial
  CRISPR gRNA sequence
caggcatgcgccaccacacc

SEQ ID NO: 457301 - DNA, 20 bp, Artificial
  CRISPR gRNA sequence
attttgtatttttagtagag

SEQ ID NO: 457302 - DNA, 20 bp, Artificial
  CRISPR gRNA sequence
tgtatttttagtagagacag

SEQ ID NO: 457303 - DNA, 20 bp, Artificial
  CRISPR gRNA sequence
gtatttttagtagagacagg

SEQ ID NO: 457304 - DNA, 20 bp, Artificial
  CRISPR gRNA sequence
tatttttagtagagacaggg

SEQ ID NO: 457305 - DNA, 20 bp, Artificial
  CRISPR gRNA sequence
ttagtagagacagggtttct

SEQ ID NO: 457306 - DNA, 20 bp, Artificial
  CRISPR gRNA sequence
tagtagagacagggtttctc

SEQ ID NO: 457307 - DNA, 20 bp, Artificial
  CRISPR gRNA sequence
agtagagacagggtttctcc

SEQ ID NO: 457308 - DNA, 20 bp, Artificial
  CRISPR gRNA sequence
gtagagacagggtttctcca

SEQ ID NO: 457309 - DNA, 20 bp, Artificial
  CRISPR gRNA sequence
ctccatgttggctaggctga

SEQ ID NO: 457310 - DNA, 20 bp, Artificial
  CRISPR gRNA sequence
tccatgttggctaggctgat

SEQ ID NO: 457311 - DNA, 20 bp, Artificial
  CRISPR gRNA sequence
catgttggctaggctgatct

SEQ ID NO: 457312 - DNA, 20 bp, Artificial
  CRISPR gRNA sequence
gctaggctgatctttaactc

SEQ ID NO: 457313 - DNA, 20 bp, Artificial
  CRISPR gRNA sequence
ggctgatctttaactcctga

SEQ ID NO: 457314 - DNA, 20 bp, Artificial
  CRISPR gRNA sequence
atctttaactcctgacctcg

SEQ ID NO: 457315 - DNA, 20 bp, Artificial
  CRISPR gRNA sequence
taactcctgacctcgggtga

SEQ ID NO: 457316 - DNA, 20 bp, Artificial
  CRISPR gRNA sequence
aactcctgacctcgggtgat

SEQ ID NO: 457317 - DNA, 20 bp, Artificial
  CRISPR gRNA sequence
actcctgacctcgggtgatc

SEQ ID NO: 457318 - DNA, 20 bp, Artificial
  CRISPR gRNA sequence
ctgacctcgggtgatctgcc

SEQ ID NO: 457319 - DNA, 20 bp, Artificial
  CRISPR gRNA sequence
acctcgggtgatctgcctac

SEQ ID NO: 457320 - DNA, 20 bp, Artificial
  CRISPR gRNA sequence
gggtgatctgcctacctcag

SEQ ID NO: 457321 - DNA, 20 bp, Artificial
  CRISPR gRNA sequence
cctacctcagcctcccaaaa

SEQ ID NO: 457322 - DNA, 20 bp, Artificial
  CRISPR gRNA sequence
cctcagcctcccaaaatgct

SEQ ID NO: 457323 - DNA, 20 bp, Artificial
  CRISPR gRNA sequence
agcctcccaaaatgctggga

SEQ ID NO: 457324 - DNA, 20 bp, Artificial
  CRISPR gRNA sequence
ccaaaatgctgggattacag

SEQ ID NO: 457325 - DNA, 20 bp, Artificial
  CRISPR gRNA sequence
ggattacaggcatgagccac

SEQ ID NO: 457326 - DNA, 20 bp, Artificial
  CRISPR gRNA sequence
caggcatgagccaccatgcc

SEQ ID NO: 457327 - DNA, 20 bp, Artificial
  CRISPR gRNA sequence
gccaggaagcctaatttcta

SEQ ID NO: 457328 - DNA, 20 bp, Artificial
  CRISPR gRNA sequence
atttctatctgtttttactt

SEQ ID NO: 457329 - DNA, 20 bp, Artificial
  CRISPR gRNA sequence
ctatctgtttttactttcac

SEQ ID NO: 457330 - DNA, 20 bp, Artificial
  CRISPR gRNA sequence
tatctgtttttactttcacc

SEQ ID NO: 457331 - DNA, 20 bp, Artificial
  CRISPR gRNA sequence
tctgtttttactttcaccag

SEQ ID NO: 457332 - DNA, 20 bp, Artificial
  CRISPR gRNA sequence
tttttactttcaccagtgag

SEQ ID NO: 457333 - DNA, 20 bp, Artificial
  CRISPR gRNA sequence
ttactttcaccagtgagtag

SEQ ID NO: 457334 - DNA, 20 bp, Artificial
  CRISPR gRNA sequence
tactttcaccagtgagtagc

SEQ ID NO: 457335 - DNA, 20 bp, Artificial
  CRISPR gRNA sequence
actttcaccagtgagtagca

SEQ ID NO: 457336 - DNA, 20 bp, Artificial
  CRISPR gRNA sequence
ctttcaccagtgagtagcac

SEQ ID NO: 457337 - DNA, 20 bp, Artificial
  CRISPR gRNA sequence
tcaccagtgagtagcactgg

SEQ ID NO: 457338 - DNA, 20 bp, Artificial
  CRISPR gRNA sequence
caccagtgagtagcactgga

SEQ ID NO: 457339 - DNA, 20 bp, Artificial
  CRISPR gRNA sequence
accagtgagtagcactggac

SEQ ID NO: 457340 - DNA, 20 bp, Artificial
  CRISPR gRNA sequence
gacaagtctcttcaacccct

SEQ ID NO: 457341 - DNA, 20 bp, Artificial
  CRISPR gRNA sequence
ttcaacccctgtgtcaccat

SEQ ID NO: 457342 - DNA, 20 bp, Artificial
  CRISPR gRNA sequence
caacccctgtgtcaccatct

SEQ ID NO: 457343 - DNA, 20 bp, Artificial
  CRISPR gRNA sequence
aacccctgtgtcaccatctc

SEQ ID NO: 457344 - DNA, 20 bp, Artificial
  CRISPR gRNA sequence
tgtcaccatctccctgtcag

SEQ ID NO: 457345 - DNA, 20 bp, Artificial
  CRISPR gRNA sequence
cctgtcagtaaaaatgcaat

SEQ ID NO: 457346 - DNA, 20 bp, Artificial
  CRISPR gRNA sequence
tcagtaaaaatgcaatggcc

SEQ ID NO: 457347 - DNA, 20 bp, Artificial
  CRISPR gRNA sequence
taaaattaaagacaaaatga

SEQ ID NO: 457348 - DNA, 20 bp, Artificial
  CRISPR gRNA sequence
aaattaaagacaaaatgaga

SEQ ID NO: 457349 - DNA, 20 bp, Artificial
  CRISPR gRNA sequence
aagacaaaatgagattatgt

SEQ ID NO: 457350 - DNA, 20 bp, Artificial
  CRISPR gRNA sequence
tgtttgtgtgtgcgctttga

SEQ ID NO: 457351 - DNA, 20 bp, Artificial
  CRISPR gRNA sequence
gtgtgtgcgctttgaagaaa

SEQ ID NO: 457352 - DNA, 20 bp, Artificial
  CRISPR gRNA sequence
tgtgtgcgctttgaagaaag

SEQ ID NO: 457353 - DNA, 20 bp, Artificial
  CRISPR gRNA sequence
tgaagaaaggcagcatctgc

SEQ ID NO: 457354 - DNA, 20 bp, Artificial
  CRISPR gRNA sequence
gaagaaaggcagcatctgcc

SEQ ID NO: 457355 - DNA, 20 bp, Artificial
  CRISPR gRNA sequence
aagaaaggcagcatctgcca

SEQ ID NO: 457356 - DNA, 20 bp, Artificial
  CRISPR gRNA sequence
ccaatggggatgttggaaaa

SEQ ID NO: 457357 - DNA, 20 bp, Artificial
  CRISPR gRNA sequence
gaaaaggattgaggaagaag

SEQ ID NO: 457358 - DNA, 20 bp, Artificial
  CRISPR gRNA sequence
aggaagaaggaaactgcctt

SEQ ID NO: 457359 - DNA, 20 bp, Artificial
  CRISPR gRNA sequence
cctttccaggacctgaacta

SEQ ID NO: 457360 - DNA, 20 bp, Artificial
  CRISPR gRNA sequence
tccaggacctgaactatctg

SEQ ID NO: 457361 - DNA, 20 bp, Artificial
  CRISPR gRNA sequence
ccaggacctgaactatctgg

SEQ ID NO: 457362 - DNA, 20 bp, Artificial
  CRISPR gRNA sequence
caggacctgaactatctggt

SEQ ID NO: 457363 - DNA, 20 bp, Artificial
  CRISPR gRNA sequence
aactatctggttacatctcc

SEQ ID NO: 457364 - DNA, 20 bp, Artificial
  CRISPR gRNA sequence
tctggttacatctccactgt

SEQ ID NO: 457365 - DNA, 20 bp, Artificial
  CRISPR gRNA sequence
gttacatctccactgtcaac

SEQ ID NO: 457366 - DNA, 20 bp, Artificial
  CRISPR gRNA sequence
catctccactgtcaaccctg

SEQ ID NO: 457367 - DNA, 20 bp, Artificial
  CRISPR gRNA sequence
cactgtcaaccctgctcact

SEQ ID NO: 457368 - DNA, 20 bp, Artificial
  CRISPR gRNA sequence
tcaaccctgctcactgtccc

SEQ ID NO: 457369 - DNA, 20 bp, Artificial
  CRISPR gRNA sequence
ctcactgtcccacctggtgg

SEQ ID NO: 457370 - DNA, 20 bp, Artificial
  CRISPR gRNA sequence
actgtcccacctggtggcat

SEQ ID NO: 457371 - DNA, 20 bp, Artificial
  CRISPR gRNA sequence
tcccacctggtggcattagg

SEQ ID NO: 457372 - DNA, 20 bp, Artificial
  CRISPR gRNA sequence
gtggcattaggagtatttga

SEQ ID NO: 457373 - DNA, 20 bp, Artificial
  CRISPR gRNA sequence
ggagtatttgagcactcacc

SEQ ID NO: 457374 - DNA, 20 bp, Artificial
  CRISPR gRNA sequence
gagcactcacctgtgaatag

SEQ ID NO: 457375 - DNA, 20 bp, Artificial
  CRISPR gRNA sequence
agcactcacctgtgaataga

SEQ ID NO: 457376 - DNA, 20 bp, Artificial
  CRISPR gRNA sequence
acctgtgaatagaatggaga

SEQ ID NO: 457377 - DNA, 20 bp, Artificial
  CRISPR gRNA sequence
tgaatagaatggagaaaaaa

SEQ ID NO: 457378 - DNA, 20 bp, Artificial
  CRISPR gRNA sequence
aaggcggatacctgacttct

SEQ ID NO: 457379 - DNA, 20 bp, Artificial
  CRISPR gRNA sequence
acttctggcttctggcacaa

SEQ ID NO: 457380 - DNA, 20 bp, Artificial
  CRISPR gRNA sequence
ctggcttctggcacaacact

SEQ ID NO: 457381 - DNA, 20 bp, Artificial
  CRISPR gRNA sequence
tggcttctggcacaacactg

SEQ ID NO: 457382 - DNA, 20 bp, Artificial
  CRISPR gRNA sequence
gcttctggcacaacactggt

SEQ ID NO: 457383 - DNA, 20 bp, Artificial
  CRISPR gRNA sequence
ctggcacaacactggtaggt

SEQ ID NO: 457384 - DNA, 20 bp, Artificial
  CRISPR gRNA sequence
tggcacaacactggtaggtc

SEQ ID NO: 457385 - DNA, 20 bp, Artificial
  CRISPR gRNA sequence
gcacaacactggtaggtccc

SEQ ID NO: 457386 - DNA, 20 bp, Artificial
  CRISPR gRNA sequence
gtaggtcccactgtgcaacg

SEQ ID NO: 457387 - DNA, 20 bp, Artificial
  CRISPR gRNA sequence
tgcaacggtgtgacttggct

SEQ ID NO: 457388 - DNA, 20 bp, Artificial
  CRISPR gRNA sequence
ggcttatggtgaacatcaac

SEQ ID NO: 457389 - DNA, 20 bp, Artificial
  CRISPR gRNA sequence
gcttatggtgaacatcaact

SEQ ID NO: 457390 - DNA, 20 bp, Artificial
  CRISPR gRNA sequence
atggtgaacatcaactgaga

SEQ ID NO: 457391 - DNA, 20 bp, Artificial
  CRISPR gRNA sequence
tggtgaacatcaactgagat

SEQ ID NO: 457392 - DNA, 20 bp, Artificial
  CRISPR gRNA sequence
agatgatatttcaccaacac

SEQ ID NO: 457393 - DNA, 20 bp, Artificial
  CRISPR gRNA sequence
caccaacaccatctatccca

SEQ ID NO: 457394 - DNA, 20 bp, Artificial
  CRISPR gRNA sequence
accaacaccatctatcccag

SEQ ID NO: 457395 - DNA, 20 bp, Artificial
  CRISPR gRNA sequence
tcccaggatcccttttaagt

SEQ ID NO: 457396 - DNA, 20 bp, Artificial
  CRISPR gRNA sequence
ttaagtctcagctgttttaa

SEQ ID NO: 457397 - DNA, 20 bp, Artificial
  CRISPR gRNA sequence
taagtctcagctgttttaaa

SEQ ID NO: 457398 - DNA, 20 bp, Artificial
  CRISPR gRNA sequence
aagtctcagctgttttaaac

SEQ ID NO: 457399 - DNA, 20 bp, Artificial
  CRISPR gRNA sequence
agtctcagctgttttaaact

SEQ ID NO: 457400 - DNA, 20 bp, Artificial
  CRISPR gRNA sequence
agctgttttaaactggtctc

SEQ ID NO: 457401 - DNA, 20 bp, Artificial
  CRISPR gRNA sequence
ttttaaactggtctcaggag

SEQ ID NO: 457402 - DNA, 20 bp, Artificial
  CRISPR gRNA sequence
taaactggtctcaggagaac

SEQ ID NO: 457403 - DNA, 20 bp, Artificial
  CRISPR gRNA sequence
aaactggtctcaggagaaca

SEQ ID NO: 457404 - DNA, 20 bp, Artificial
  CRISPR gRNA sequence
aactggtctcaggagaacag

SEQ ID NO: 457405 - DNA, 20 bp, Artificial
  CRISPR gRNA sequence
gtctcaggagaacagtctcc

SEQ ID NO: 457406 - DNA, 20 bp, Artificial
  CRISPR gRNA sequence
aggagaacagtctccagacc

SEQ ID NO: 457407 - DNA, 20 bp, Artificial
  CRISPR gRNA sequence
cagacctgtccttgcacaaa

SEQ ID NO: 457408 - DNA, 20 bp, Artificial
  CRISPR gRNA sequence
tccttgcacaaaaacactac

SEQ ID NO: 457409 - DNA, 20 bp, Artificial
  CRISPR gRNA sequence
gcacaaaaacactacaaacc

SEQ ID NO: 457410 - DNA, 20 bp, Artificial
  CRISPR gRNA sequence
cacaaaaacactacaaaccc

SEQ ID NO: 457411 - DNA, 20 bp, Artificial
  CRISPR gRNA sequence
caaacccctcagcctcttct

SEQ ID NO: 457412 - DNA, 20 bp, Artificial
  CRISPR gRNA sequence
agcctcttctttcttatgcc

SEQ ID NO: 457413 - DNA, 20 bp, Artificial
  CRISPR gRNA sequence
ttctttcttatgccatacag

SEQ ID NO: 457414 - DNA, 20 bp, Artificial
  CRISPR gRNA sequence
ctttcttatgccatacagta

SEQ ID NO: 457415 - DNA, 20 bp, Artificial
  CRISPR gRNA sequence
tttcttatgccatacagtac

SEQ ID NO: 457416 - DNA, 20 bp, Artificial
  CRISPR gRNA sequence
tcttatgccatacagtacag

SEQ ID NO: 457417 - DNA, 20 bp, Artificial
  CRISPR gRNA sequence
cttatgccatacagtacaga

SEQ ID NO: 457418 - DNA, 20 bp, Artificial
  CRISPR gRNA sequence
ttatgccatacagtacagat

SEQ ID NO: 457419 - DNA, 20 bp, Artificial
  CRISPR gRNA sequence
atgccatacagtacagatta

SEQ ID NO: 457420 - DNA, 20 bp, Artificial
  CRISPR gRNA sequence
tgccatacagtacagattaa

SEQ ID NO: 457421 - DNA, 20 bp, Artificial
  CRISPR gRNA sequence
agtttagtcgcgttccttcc

SEQ ID NO: 457422 - DNA, 20 bp, Artificial
  CRISPR gRNA sequence
agtcgcgttccttcctggga

SEQ ID NO: 457423 - DNA, 20 bp, Artificial
  CRISPR gRNA sequence
gtcgcgttccttcctgggaa

SEQ ID NO: 457424 - DNA, 20 bp, Artificial
  CRISPR gRNA sequence
cttcctgggaagctgagctg

SEQ ID NO: 457425 - DNA, 20 bp, Artificial
  CRISPR gRNA sequence
cctgggaagctgagctggtg

SEQ ID NO: 457426 - DNA, 20 bp, Artificial
  CRISPR gRNA sequence
ctgggaagctgagctggtga

SEQ ID NO: 457427 - DNA, 20 bp, Artificial
  CRISPR gRNA sequence
ggaagctgagctggtgatgt

SEQ ID NO: 457428 - DNA, 20 bp, Artificial
  CRISPR gRNA sequence
agctggtgatgttaatgcat

SEQ ID NO: 457429 - DNA, 20 bp, Artificial
  CRISPR gRNA sequence
gtgatgttaatgcatcctgg

SEQ ID NO: 457430 - DNA, 20 bp, Artificial
  CRISPR gRNA sequence
atgcatcctggaatggaaag

SEQ ID NO: 457431 - DNA, 20 bp, Artificial
  CRISPR gRNA sequence
gaatggaaagggaagaatta

SEQ ID NO: 457432 - DNA, 20 bp, Artificial
  CRISPR gRNA sequence
cccagaggtcaggtagcatt

SEQ ID NO: 457433 - DNA, 20 bp, Artificial
  CRISPR gRNA sequence
tgtgaatttcaccgtaactg

SEQ ID NO: 457434 - DNA, 20 bp, Artificial
  CRISPR gRNA sequence
tgaatttcaccgtaactgct

SEQ ID NO: 457435 - DNA, 20 bp, Artificial
  CRISPR gRNA sequence
caccgtaactgctccttatc

SEQ ID NO: 457436 - DNA, 20 bp, Artificial
  CRISPR gRNA sequence
accgtaactgctccttatca

SEQ ID NO: 457437 - DNA, 20 bp, Artificial
  CRISPR gRNA sequence
ctccttatcactagaagtct

SEQ ID NO: 457438 - DNA, 20 bp, Artificial
  CRISPR gRNA sequence
cttatcactagaagtcttca

SEQ ID NO: 457439 - DNA, 20 bp, Artificial
  CRISPR gRNA sequence
atcactagaagtcttcaagg

SEQ ID NO: 457440 - DNA, 20 bp, Artificial
  CRISPR gRNA sequence
tcactagaagtcttcaagga

SEQ ID NO: 457441 - DNA, 20 bp, Artificial
  CRISPR gRNA sequence
gaagtcttcaaggaaggact

SEQ ID NO: 457442 - DNA, 20 bp, Artificial
  CRISPR gRNA sequence
caaggaaggactgaagcaga

SEQ ID NO: 457443 - DNA, 20 bp, Artificial
  CRISPR gRNA sequence
aaggaaggactgaagcagaa

SEQ ID NO: 457444 - DNA, 20 bp, Artificial
  CRISPR gRNA sequence
aagcagaacctggcagtagt

SEQ ID NO: 457445 - DNA, 20 bp, Artificial
  CRISPR gRNA sequence
gcagtagtgctggcagacag

SEQ ID NO: 457446 - DNA, 20 bp, Artificial
  CRISPR gRNA sequence
gcagacaggaaatacaaatt

SEQ ID NO: 457447 - DNA, 20 bp, Artificial
  CRISPR gRNA sequence
cagctctatcgatggctgtg

SEQ ID NO: 457448 - DNA, 20 bp, Artificial
  CRISPR gRNA sequence
tatcgatggctgtgtgactg

SEQ ID NO: 457449 - DNA, 20 bp, Artificial
  CRISPR gRNA sequence
tcgatggctgtgtgactgta

SEQ ID NO: 457450 - DNA, 20 bp, Artificial
  CRISPR gRNA sequence
tgtgactgtaagcaagttac

SEQ ID NO: 457451 - DNA, 20 bp, Artificial
  CRISPR gRNA sequence
taagcaagttacctaactcc

SEQ ID NO: 457452 - DNA, 20 bp, Artificial
  CRISPR gRNA sequence
cctaactccttgggcagtag

SEQ ID NO: 457453 - DNA, 20 bp, Artificial
  CRISPR gRNA sequence
actccttgggcagtagttta

SEQ ID NO: 457454 - DNA, 20 bp, Artificial
  CRISPR gRNA sequence
cttgggcagtagtttattca

SEQ ID NO: 457455 - DNA, 20 bp, Artificial
  CRISPR gRNA sequence
gggcagtagtttattcatct

SEQ ID NO: 457456 - DNA, 20 bp, Artificial
  CRISPR gRNA sequence
ggcagtagtttattcatctg

SEQ ID NO: 457457 - DNA, 20 bp, Artificial
  CRISPR gRNA sequence
attcatctggaaaatgaaaa

SEQ ID NO: 457458 - DNA, 20 bp, Artificial
  CRISPR gRNA sequence
ttcatctggaaaatgaaaat

SEQ ID NO: 457459 - DNA, 20 bp, Artificial
  CRISPR gRNA sequence
atctggaaaatgaaaattaa

SEQ ID NO: 457460 - DNA, 20 bp, Artificial
  CRISPR gRNA sequence
gaaaatgaaaattaagggac

SEQ ID NO: 457461 - DNA, 20 bp, Artificial
  CRISPR gRNA sequence
agggactaaataatatgctc

SEQ ID NO: 457462 - DNA, 20 bp, Artificial
  CRISPR gRNA sequence
aataatatgctcaaagcatc

SEQ ID NO: 457463 - DNA, 20 bp, Artificial
  CRISPR gRNA sequence
aaagcatccattaattcata

SEQ ID NO: 457464 - DNA, 20 bp, Artificial
  CRISPR gRNA sequence
attcataggtttatttgttc

SEQ ID NO: 457465 - DNA, 20 bp, Artificial
  CRISPR gRNA sequence
ataggtttatttgttcctcc

SEQ ID NO: 457466 - DNA, 20 bp, Artificial
  CRISPR gRNA sequence
atttgttcctccacttaaca

SEQ ID NO: 457467 - DNA, 20 bp, Artificial
  CRISPR gRNA sequence
tttgttcctccacttaacaa

SEQ ID NO: 457468 - DNA, 20 bp, Artificial
  CRISPR gRNA sequence
gttcctccacttaacaaata

SEQ ID NO: 457469 - DNA, 20 bp, Artificial
  CRISPR gRNA sequence
ttcctccacttaacaaatac

SEQ ID NO: 457470 - DNA, 20 bp, Artificial
  CRISPR gRNA sequence
ctccacttaacaaatacgtt

SEQ ID NO: 457471 - DNA, 20 bp, Artificial
  CRISPR gRNA sequence
cacttaacaaatacgtttag

SEQ ID NO: 457472 - DNA, 20 bp, Artificial
  CRISPR gRNA sequence
aacaaatacgtttaggtatt

SEQ ID NO: 457473 - DNA, 20 bp, Artificial
  CRISPR gRNA sequence
acaaatacgtttaggtattc

SEQ ID NO: 457474 - DNA, 20 bp, Artificial
  CRISPR gRNA sequence
aggtattcactctgccaagc

SEQ ID NO: 457475 - DNA, 20 bp, Artificial
  CRISPR gRNA sequence
ggtattcactctgccaagcc

SEQ ID NO: 457476 - DNA, 20 bp, Artificial
  CRISPR gRNA sequence
actctgccaagccctgctgg

SEQ ID NO: 457477 - DNA, 20 bp, Artificial
  CRISPR gRNA sequence
tgccaagccctgctggggct

SEQ ID NO: 457478 - DNA, 20 bp, Artificial
  CRISPR gRNA sequence
ccaagccctgctggggctat

SEQ ID NO: 457479 - DNA, 20 bp, Artificial
  CRISPR gRNA sequence
ctggggctatgaggactagg

SEQ ID NO: 457480 - DNA, 20 bp, Artificial
  CRISPR gRNA sequence
gggctatgaggactaggacg

SEQ ID NO: 457481 - DNA, 20 bp, Artificial
  CRISPR gRNA sequence
tgaggactaggacgtgagcc

SEQ ID NO: 457482 - DNA, 20 bp, Artificial
  CRISPR gRNA sequence
ggacgtgagccctactgtca

SEQ ID NO: 457483 - DNA, 20 bp, Artificial
  CRISPR gRNA sequence
ctgtcagaacttttttttcc

SEQ ID NO: 457484 - DNA, 20 bp, Artificial
  CRISPR gRNA sequence
tcagaacttttttttcccct

SEQ ID NO: 457485 - DNA, 20 bp, Artificial
  CRISPR gRNA sequence
ttttttcccctaaccattag

SEQ ID NO: 457486 - DNA, 20 bp, Artificial
  CRISPR gRNA sequence
tttttcccctaaccattaga

SEQ ID NO: 457487 - DNA, 20 bp, Artificial
  CRISPR gRNA sequence
ttttcccctaaccattagat

SEQ ID NO: 457488 - DNA, 20 bp, Artificial
  CRISPR gRNA sequence
tttcccctaaccattagatg

SEQ ID NO: 457489 - DNA, 20 bp, Artificial
  CRISPR gRNA sequence
ttcccctaaccattagatga

SEQ ID NO: 457490 - DNA, 20 bp, Artificial
  CRISPR gRNA sequence
tcccctaaccattagatgac

SEQ ID NO: 457491 - DNA, 20 bp, Artificial
  CRISPR gRNA sequence
cccctaaccattagatgacc

SEQ ID NO: 457492 - DNA, 20 bp, Artificial
  CRISPR gRNA sequence
ccctaaccattagatgaccg

SEQ ID NO: 457493 - DNA, 20 bp, Artificial
  CRISPR gRNA sequence
accattagatgaccggggat

SEQ ID NO: 457494 - DNA, 20 bp, Artificial
  CRISPR gRNA sequence
gatgaccggggatttttaat

SEQ ID NO: 457495 - DNA, 20 bp, Artificial
  CRISPR gRNA sequence
ttaatttaaaaaattttttt

SEQ ID NO: 457496 - DNA, 20 bp, Artificial
  CRISPR gRNA sequence
taatttaaaaaatttttttt

SEQ ID NO: 457497 - DNA, 20 bp, Artificial
  CRISPR gRNA sequence
aatttaaaaaattttttttt

SEQ ID NO: 457498 - DNA, 20 bp, Artificial
  CRISPR gRNA sequence
atttaaaaaattttttttta

SEQ ID NO: 457499 - DNA, 20 bp, Artificial
  CRISPR gRNA sequence
aaaaaatttttttttaaaac

SEQ ID NO: 457500 - DNA, 20 bp, Artificial
  CRISPR gRNA sequence
aaaaatttttttttaaaaca

SEQ ID NO: 457501 - DNA, 20 bp, Artificial
  CRISPR gRNA sequence
ttttttaaaacaaggtcttg

SEQ ID NO: 457502 - DNA, 20 bp, Artificial
  CRISPR gRNA sequence
tttttaaaacaaggtcttgc

SEQ ID NO: 457503 - DNA, 20 bp, Artificial
  CRISPR gRNA sequence
ttttaaaacaaggtcttgct

SEQ ID NO: 457504 - DNA, 20 bp, Artificial
  CRISPR gRNA sequence
tttaaaacaaggtcttgctg

SEQ ID NO: 457505 - DNA, 20 bp, Artificial
  CRISPR gRNA sequence
ttaaaacaaggtcttgctgt

SEQ ID NO: 457506 - DNA, 20 bp, Artificial
  CRISPR gRNA sequence
taaaacaaggtcttgctgtg

SEQ ID NO: 457507 - DNA, 20 bp, Artificial
  CRISPR gRNA sequence
aaaacaaggtcttgctgtgt

SEQ ID NO: 457508 - DNA, 20 bp, Artificial
  CRISPR gRNA sequence
aaacaaggtcttgctgtgtc

SEQ ID NO: 457509 - DNA, 20 bp, Artificial
  CRISPR gRNA sequence
gctgtgtcacccaggctgga

SEQ ID NO: 457510 - DNA, 20 bp, Artificial
  CRISPR gRNA sequence
ctgtgtcacccaggctggag

SEQ ID NO: 457511 - DNA, 20 bp, Artificial
  CRISPR gRNA sequence
tgtcacccaggctggagggc

SEQ ID NO: 457512 - DNA, 20 bp, Artificial
  CRISPR gRNA sequence
gagggcagtggcacaatcgt

SEQ ID NO: 457513 - DNA, 20 bp, Artificial
  CRISPR gRNA sequence
actgcacctttgaactcctg

SEQ ID NO: 457514 - DNA, 20 bp, Artificial
  CRISPR gRNA sequence
cacctttgaactcctgggct

SEQ ID NO: 457515 - DNA, 20 bp, Artificial
  CRISPR gRNA sequence
tgaactcctgggctcaagca

SEQ ID NO: 457516 - DNA, 20 bp, Artificial
  CRISPR gRNA sequence
gaactcctgggctcaagcaa

SEQ ID NO: 457517 - DNA, 20 bp, Artificial
  CRISPR gRNA sequence
aactcctgggctcaagcaat

SEQ ID NO: 457518 - DNA, 20 bp, Artificial
  CRISPR gRNA sequence
ctgggctcaagcaatcctcc

SEQ ID NO: 457519 - DNA, 20 bp, Artificial
  CRISPR gRNA sequence
ggctcaagcaatcctcctgc

SEQ ID NO: 457520 - DNA, 20 bp, Artificial
  CRISPR gRNA sequence
aagcaatcctcctgcttccg

SEQ ID NO: 457521 - DNA, 20 bp, Artificial
  CRISPR gRNA sequence
ctgcttccgccttccgaata

SEQ ID NO: 457522 - DNA, 20 bp, Artificial
  CRISPR gRNA sequence
cttccgccttccgaatagct

SEQ ID NO: 457523 - DNA, 20 bp, Artificial
  CRISPR gRNA sequence
ccgccttccgaatagctaac

SEQ ID NO: 457524 - DNA, 20 bp, Artificial
  CRISPR gRNA sequence
cgccttccgaatagctaaca

SEQ ID NO: 457525 - DNA, 20 bp, Artificial
  CRISPR gRNA sequence
ccgaatagctaacactacag

SEQ ID NO: 457526 - DNA, 20 bp, Artificial
  CRISPR gRNA sequence
cgaatagctaacactacagg

SEQ ID NO: 457527 - DNA, 20 bp, Artificial
  CRISPR gRNA sequence
acactacaggtatgcaccac

SEQ ID NO: 457528 - DNA, 20 bp, Artificial
  CRISPR gRNA sequence
caggtatgcaccactatgcc

SEQ ID NO: 457529 - DNA, 20 bp, Artificial
  CRISPR gRNA sequence
tgcctggctaattttttatt

SEQ ID NO: 457530 - DNA, 20 bp, Artificial
  CRISPR gRNA sequence
gctaattttttattttgtag

SEQ ID NO: 457531 - DNA, 20 bp, Artificial
  CRISPR gRNA sequence
attttttattttgtagagac

SEQ ID NO: 457532 - DNA, 20 bp, Artificial
  CRISPR gRNA sequence
tttattttgtagagacagat

SEQ ID NO: 457533 - DNA, 20 bp, Artificial
  CRISPR gRNA sequence
ttattttgtagagacagatt

SEQ ID NO: 457534 - DNA, 20 bp, Artificial
  CRISPR gRNA sequence
tattttgtagagacagattc

SEQ ID NO: 457535 - DNA, 20 bp, Artificial
  CRISPR gRNA sequence
attttgtagagacagattct

SEQ ID NO: 457536 - DNA, 20 bp, Artificial
  CRISPR gRNA sequence
ttttgtagagacagattctc

SEQ ID NO: 457537 - DNA, 20 bp, Artificial
  CRISPR gRNA sequence
tgtagagacagattctcact

SEQ ID NO: 457538 - DNA, 20 bp, Artificial
  CRISPR gRNA sequence
gtagagacagattctcacta

SEQ ID NO: 457539 - DNA, 20 bp, Artificial
  CRISPR gRNA sequence
tagagacagattctcactat

SEQ ID NO: 457540 - DNA, 20 bp, Artificial
  CRISPR gRNA sequence
tcactatgttgtccaggcta

SEQ ID NO: 457541 - DNA, 20 bp, Artificial
  CRISPR gRNA sequence
actatgttgtccaggctagt

SEQ ID NO: 457542 - DNA, 20 bp, Artificial
  CRISPR gRNA sequence
tgttgtccaggctagtcttg

SEQ ID NO: 457543 - DNA, 20 bp, Artificial
  CRISPR gRNA sequence
tccaggctagtcttgaactc

SEQ ID NO: 457544 - DNA, 20 bp, Artificial
  CRISPR gRNA sequence
gtcttgaactctaggcatca

SEQ ID NO: 457545 - DNA, 20 bp, Artificial
  CRISPR gRNA sequence
gaactctaggcatcaagcaa

SEQ ID NO: 457546 - DNA, 20 bp, Artificial
  CRISPR gRNA sequence
aactctaggcatcaagcaac

SEQ ID NO: 457547 - DNA, 20 bp, Artificial
  CRISPR gRNA sequence
taggcatcaagcaaccctcc

SEQ ID NO: 457548 - DNA, 20 bp, Artificial
  CRISPR gRNA sequence
ggcatcaagcaaccctcctg

SEQ ID NO: 457549 - DNA, 20 bp, Artificial
  CRISPR gRNA sequence
ctgcctctgcctcccaaact

SEQ ID NO: 457550 - DNA, 20 bp, Artificial
  CRISPR gRNA sequence
cctctgcctcccaaactgct

SEQ ID NO: 457551 - DNA, 20 bp, Artificial
  CRISPR gRNA sequence
tgcctcccaaactgctggga

SEQ ID NO: 457552 - DNA, 20 bp, Artificial
  CRISPR gRNA sequence
cctcccaaactgctgggatt

SEQ ID NO: 457553 - DNA, 20 bp, Artificial
  CRISPR gRNA sequence
ccaaactgctgggattacag

SEQ ID NO: 457554 - DNA, 20 bp, Artificial
  CRISPR gRNA sequence
ctgggattacaggcatgaac

SEQ ID NO: 457555 - DNA, 20 bp, Artificial
  CRISPR gRNA sequence
ggattacaggcatgaaccac

SEQ ID NO: 457556 - DNA, 20 bp, Artificial
  CRISPR gRNA sequence
caggcatgaaccactgtgcc

SEQ ID NO: 457557 - DNA, 20 bp, Artificial
  CRISPR gRNA sequence
tgcctggccactctcagagt

SEQ ID NO: 457558 - DNA, 20 bp, Artificial
  CRISPR gRNA sequence
gccactctcagagtttaaag

SEQ ID NO: 457559 - DNA, 20 bp, Artificial
  CRISPR gRNA sequence
tcagagtttaaagcctaatg

SEQ ID NO: 457560 - DNA, 20 bp, Artificial
  CRISPR gRNA sequence
agagtttaaagcctaatgta

SEQ ID NO: 457561 - DNA, 20 bp, Artificial
  CRISPR gRNA sequence
aaagcctaatgtaaaaacaa

SEQ ID NO: 457562 - DNA, 20 bp, Artificial
  CRISPR gRNA sequence
aagcctaatgtaaaaacaaa

SEQ ID NO: 457563 - DNA, 20 bp, Artificial
  CRISPR gRNA sequence
atgtaaaaacaaattagcaa

SEQ ID NO: 457564 - DNA, 20 bp, Artificial
  CRISPR gRNA sequence
gcaaaaagttacaatttaat

SEQ ID NO: 457565 - DNA, 20 bp, Artificial
  CRISPR gRNA sequence
caatttaattccacagttat

SEQ ID NO: 457566 - DNA, 20 bp, Artificial
  CRISPR gRNA sequence
aattccacagttattataat

SEQ ID NO: 457567 - DNA, 20 bp, Artificial
  CRISPR gRNA sequence
attccacagttattataatt

SEQ ID NO: 457568 - DNA, 20 bp, Artificial
  CRISPR gRNA sequence
cacagttattataattgagg

SEQ ID NO: 457569 - DNA, 20 bp, Artificial
  CRISPR gRNA sequence
ttataattgaggaatcttag

SEQ ID NO: 457570 - DNA, 20 bp, Artificial
  CRISPR gRNA sequence
taattgaggaatcttagaga

SEQ ID NO: 457571 - DNA, 20 bp, Artificial
  CRISPR gRNA sequence
aggaatcttagagattcctg

SEQ ID NO: 457572 - DNA, 20 bp, Artificial
  CRISPR gRNA sequence
agagattcctgagtctgaag

SEQ ID NO: 457573 - DNA, 20 bp, Artificial
  CRISPR gRNA sequence
gagattcctgagtctgaagc

SEQ ID NO: 457574 - DNA, 20 bp, Artificial
  CRISPR gRNA sequence
ctgagtctgaagcatcaggg

SEQ ID NO: 457575 - DNA, 20 bp, Artificial
  CRISPR gRNA sequence
agtctgaagcatcagggaaa

SEQ ID NO: 457576 - DNA, 20 bp, Artificial
  CRISPR gRNA sequence
aagcatcagggaaacttcac

SEQ ID NO: 457577 - DNA, 20 bp, Artificial
  CRISPR gRNA sequence
cacagtgaagttagtgctgg

SEQ ID NO: 457578 - DNA, 20 bp, Artificial
  CRISPR gRNA sequence
acagtgaagttagtgctgga

SEQ ID NO: 457579 - DNA, 20 bp, Artificial
  CRISPR gRNA sequence
gtgctggagctgacttgaag

SEQ ID NO: 457580 - DNA, 20 bp, Artificial
  CRISPR gRNA sequence
gagctgacttgaaggatgag

SEQ ID NO: 457581 - DNA, 20 bp, Artificial
  CRISPR gRNA sequence
acttgaaggatgagtaaaag

SEQ ID NO: 457582 - DNA, 20 bp, Artificial
  CRISPR gRNA sequence
gaaggatgagtaaaagtttt

SEQ ID NO: 457583 - DNA, 20 bp, Artificial
  CRISPR gRNA sequence
aaggatgagtaaaagttttt

SEQ ID NO: 457584 - DNA, 20 bp, Artificial
  CRISPR gRNA sequence
ttctaagaaatataggatga

SEQ ID NO: 457585 - DNA, 20 bp, Artificial
  CRISPR gRNA sequence
tctaagaaatataggatgag

SEQ ID NO: 457586 - DNA, 20 bp, Artificial
  CRISPR gRNA sequence
ctaagaaatataggatgaga

SEQ ID NO: 457587 - DNA, 20 bp, Artificial
  CRISPR gRNA sequence
taagaaatataggatgagag

SEQ ID NO: 457588 - DNA, 20 bp, Artificial
  CRISPR gRNA sequence
agaaatataggatgagagag

SEQ ID NO: 457589 - DNA, 20 bp, Artificial
  CRISPR gRNA sequence
aaaacagccactgtgtggaa

SEQ ID NO: 457590 - DNA, 20 bp, Artificial
  CRISPR gRNA sequence
tgtggaaatggagtgagaat

SEQ ID NO: 457591 - DNA, 20 bp, Artificial
  CRISPR gRNA sequence
gagaaacagactaattattg

SEQ ID NO: 457592 - DNA, 20 bp, Artificial
  CRISPR gRNA sequence
attattgagggaccattgat

SEQ ID NO: 457593 - DNA, 20 bp, Artificial
  CRISPR gRNA sequence
ttgagggaccattgatatcc

SEQ ID NO: 457594 - DNA, 20 bp, Artificial
  CRISPR gRNA sequence
agggaccattgatatccaaa

SEQ ID NO: 457595 - DNA, 20 bp, Artificial
  CRISPR gRNA sequence
atatccaaagaccatgactc

SEQ ID NO: 457596 - DNA, 20 bp, Artificial
  CRISPR gRNA sequence
tgatggtgccagtctgccca

SEQ ID NO: 457597 - DNA, 20 bp, Artificial
  CRISPR gRNA sequence
atggtgccagtctgcccact

SEQ ID NO: 457598 - DNA, 20 bp, Artificial
  CRISPR gRNA sequence
cccacttgattttccctgta

SEQ ID NO: 457599 - DNA, 20 bp, Artificial
  CRISPR gRNA sequence
gattttccctgtaagtaatc

SEQ ID NO: 457600 - DNA, 20 bp, Artificial
  CRISPR gRNA sequence
attttccctgtaagtaatct

SEQ ID NO: 457601 - DNA, 20 bp, Artificial
  CRISPR gRNA sequence
tccctgtaagtaatctgtaa

SEQ ID NO: 457602 - DNA, 20 bp, Artificial
  CRISPR gRNA sequence
ccctgtaagtaatctgtaac

SEQ ID NO: 457603 - DNA, 20 bp, Artificial
  CRISPR gRNA sequence
cctgtaagtaatctgtaacc

SEQ ID NO: 457604 - DNA, 20 bp, Artificial
  CRISPR gRNA sequence
taagtaatctgtaacctgga

SEQ ID NO: 457605 - DNA, 20 bp, Artificial
  CRISPR gRNA sequence
taacctggatacagaagtgg

SEQ ID NO: 457606 - DNA, 20 bp, Artificial
  CRISPR gRNA sequence
gatacagaagtggagaaaat

SEQ ID NO: 457607 - DNA, 20 bp, Artificial
  CRISPR gRNA sequence
ggttaacccaggatgttttg

SEQ ID NO: 457608 - DNA, 20 bp, Artificial
  CRISPR gRNA sequence
acccaggatgttttggctcg

SEQ ID NO: 457609 - DNA, 20 bp, Artificial
  CRISPR gRNA sequence
tggctcgatgggtgtctctg

SEQ ID NO: 457610 - DNA, 20 bp, Artificial
  CRISPR gRNA sequence
ggctcgatgggtgtctctga

SEQ ID NO: 457611 - DNA, 20 bp, Artificial
  CRISPR gRNA sequence
gctcgatgggtgtctctgac

SEQ ID NO: 457612 - DNA, 20 bp, Artificial
  CRISPR gRNA sequence
gatgggtgtctctgacctaa

SEQ ID NO: 457613 - DNA, 20 bp, Artificial
  CRISPR gRNA sequence
tgacctaattttgcaatgca

SEQ ID NO: 457614 - DNA, 20 bp, Artificial
  CRISPR gRNA sequence
acctaattttgcaatgcatt

SEQ ID NO: 457615 - DNA, 20 bp, Artificial
  CRISPR gRNA sequence
attttgcaatgcattggccc

SEQ ID NO: 457616 - DNA, 20 bp, Artificial
  CRISPR gRNA sequence
tgcaatgcattggccctgcc

SEQ ID NO: 457617 - DNA, 20 bp, Artificial
  CRISPR gRNA sequence
gcaatgcattggccctgcca

SEQ ID NO: 457618 - DNA, 20 bp, Artificial
  CRISPR gRNA sequence
caatgcattggccctgccaa

SEQ ID NO: 457619 - DNA, 20 bp, Artificial
  CRISPR gRNA sequence
gccctgccaactttgtactg

SEQ ID NO: 457620 - DNA, 20 bp, Artificial
  CRISPR gRNA sequence
ccaactttgtactgcccctc

SEQ ID NO: 457621 - DNA, 20 bp, Artificial
  CRISPR gRNA sequence
tgtactgcccctcactctcc

SEQ ID NO: 457622 - DNA, 20 bp, Artificial
  CRISPR gRNA sequence
gtactgcccctcactctcct

SEQ ID NO: 457623 - DNA, 20 bp, Artificial
  CRISPR gRNA sequence
tactgcccctcactctcctc

SEQ ID NO: 457624 - DNA, 20 bp, Artificial
  CRISPR gRNA sequence
cccctcactctcctcaaact

SEQ ID NO: 457625 - DNA, 20 bp, Artificial
  CRISPR gRNA sequence
actctcctcaaacttcactt

SEQ ID NO: 457626 - DNA, 20 bp, Artificial
  CRISPR gRNA sequence
tcctcaaacttcacttcctt

SEQ ID NO: 457627 - DNA, 20 bp, Artificial
  CRISPR gRNA sequence
ctcaaacttcacttccttct

SEQ ID NO: 457628 - DNA, 20 bp, Artificial
  CRISPR gRNA sequence
aaacttcacttccttctgta

SEQ ID NO: 457629 - DNA, 20 bp, Artificial
  CRISPR gRNA sequence
cacttccttctgtagtttat

SEQ ID NO: 457630 - DNA, 20 bp, Artificial
  CRISPR gRNA sequence
acttccttctgtagtttata

SEQ ID NO: 457631 - DNA, 20 bp, Artificial
  CRISPR gRNA sequence
ccttctgtagtttatatttt

SEQ ID NO: 457632 - DNA, 20 bp, Artificial
  CRISPR gRNA sequence
cttctgtagtttatattttg

SEQ ID NO: 457633 - DNA, 20 bp, Artificial
  CRISPR gRNA sequence
ctgtagtttatattttgtag

SEQ ID NO: 457634 - DNA, 20 bp, Artificial
  CRISPR gRNA sequence
tgtagtttatattttgtagt

SEQ ID NO: 457635 - DNA, 20 bp, Artificial
  CRISPR gRNA sequence
tagtttatattttgtagtcc

SEQ ID NO: 457636 - DNA, 20 bp, Artificial
  CRISPR gRNA sequence
atattttgtagtccattatt

SEQ ID NO: 457637 - DNA, 20 bp, Artificial
  CRISPR gRNA sequence
tattttgtagtccattatta

SEQ ID NO: 457638 - DNA, 20 bp, Artificial
  CRISPR gRNA sequence
tgtagtccattattataatc

SEQ ID NO: 457639 - DNA, 20 bp, Artificial
  CRISPR gRNA sequence
gtagtccattattataatct

SEQ ID NO: 457640 - DNA, 20 bp, Artificial
  CRISPR gRNA sequence
tagtccattattataatctc

SEQ ID NO: 457641 - DNA, 20 bp, Artificial
  CRISPR gRNA sequence
ttataatctctcccttatat

SEQ ID NO: 457642 - DNA, 20 bp, Artificial
  CRISPR gRNA sequence
taatctctcccttatatcca

SEQ ID NO: 457643 - DNA, 20 bp, Artificial
  CRISPR gRNA sequence
tcccttatatccaccctcag

SEQ ID NO: 457644 - DNA, 20 bp, Artificial
  CRISPR gRNA sequence
ccttatatccaccctcagct

SEQ ID NO: 457645 - DNA, 20 bp, Artificial
  CRISPR gRNA sequence
atatccaccctcagctccct

SEQ ID NO: 457646 - DNA, 20 bp, Artificial
  CRISPR gRNA sequence
tatccaccctcagctccctt

SEQ ID NO: 457647 - DNA, 20 bp, Artificial
  CRISPR gRNA sequence
agctcccttagctttactcc

SEQ ID NO: 457648 - DNA, 20 bp, Artificial
  CRISPR gRNA sequence
ccttagctttactcctactg

SEQ ID NO: 457649 - DNA, 20 bp, Artificial
  CRISPR gRNA sequence
agctttactcctactgtgat

SEQ ID NO: 457650 - DNA, 20 bp, Artificial
  CRISPR gRNA sequence
gctttactcctactgtgatg

SEQ ID NO: 457651 - DNA, 20 bp, Artificial
  CRISPR gRNA sequence
tactcctactgtgatggatc

SEQ ID NO: 457652 - DNA, 20 bp, Artificial
  CRISPR gRNA sequence
actcctactgtgatggatcc

SEQ ID NO: 457653 - DNA, 20 bp, Artificial
  CRISPR gRNA sequence
ctcctactgtgatggatcct

SEQ ID NO: 457654 - DNA, 20 bp, Artificial
  CRISPR gRNA sequence
ctactgtgatggatcctcgc

SEQ ID NO: 457655 - DNA, 20 bp, Artificial
  CRISPR gRNA sequence
ctgtgatggatcctcgcaaa

SEQ ID NO: 457656 - DNA, 20 bp, Artificial
  CRISPR gRNA sequence
tgatggatcctcgcaaaacc

SEQ ID NO: 457657 - DNA, 20 bp, Artificial
  CRISPR gRNA sequence
gcaaaaccccaacctcggtt

SEQ ID NO: 457658 - DNA, 20 bp, Artificial
  CRISPR gRNA sequence
ggttaaatccagctctctgc

SEQ ID NO: 457659 - DNA, 20 bp, Artificial
  CRISPR gRNA sequence
aatccagctctctgctgaaa

SEQ ID NO: 457660 - DNA, 20 bp, Artificial
  CRISPR gRNA sequence
tctgctgaaaactcatccgg

SEQ ID NO: 457661 - DNA, 20 bp, Artificial
  CRISPR gRNA sequence
tgctgaaaactcatccggca

SEQ ID NO: 457662 - DNA, 20 bp, Artificial
  CRISPR gRNA sequence
ctgaaaactcatccggcaga

SEQ ID NO: 457663 - DNA, 20 bp, Artificial
  CRISPR gRNA sequence
aaaactcatccggcagatgc

SEQ ID NO: 457664 - DNA, 20 bp, Artificial
  CRISPR gRNA sequence
atccggcagatgctgaggct

SEQ ID NO: 457665 - DNA, 20 bp, Artificial
  CRISPR gRNA sequence
aggctgccagccccctcccc

SEQ ID NO: 457666 - DNA, 20 bp, Artificial
  CRISPR gRNA sequence
ccagccccctcccccactcc

SEQ ID NO: 457667 - DNA, 20 bp, Artificial
  CRISPR gRNA sequence
ccccactcccttggcagctt

SEQ ID NO: 457668 - DNA, 20 bp, Artificial
  CRISPR gRNA sequence
ccttggcagcttgatccgct

SEQ ID NO: 457669 - DNA, 20 bp, Artificial
  CRISPR gRNA sequence
ggcagcttgatccgctatga

SEQ ID NO: 457670 - DNA, 20 bp, Artificial
  CRISPR gRNA sequence
gcagcttgatccgctatgac

SEQ ID NO: 457671 - DNA, 20 bp, Artificial
  CRISPR gRNA sequence
gatccgctatgacttgcttt

SEQ ID NO: 457672 - DNA, 20 bp, Artificial
  CRISPR gRNA sequence
atccgctatgacttgctttt

SEQ ID NO: 457673 - DNA, 20 bp, Artificial
  CRISPR gRNA sequence
tgacttgcttttccttttaa

SEQ ID NO: 457674 - DNA, 20 bp, Artificial
  CRISPR gRNA sequence
gcttttccttttaagactcc

SEQ ID NO: 457675 - DNA, 20 bp, Artificial
  CRISPR gRNA sequence
cttttccttttaagactccc

SEQ ID NO: 457676 - DNA, 20 bp, Artificial
  CRISPR gRNA sequence
ttccttttaagactcccctt

SEQ ID NO: 457677 - DNA, 20 bp, Artificial
  CRISPR gRNA sequence
tccttttaagactccccttg

SEQ ID NO: 457678 - DNA, 20 bp, Artificial
  CRISPR gRNA sequence
ccttttaagactccccttgg

SEQ ID NO: 457679 - DNA, 20 bp, Artificial
  CRISPR gRNA sequence
cttttaagactccccttggt

SEQ ID NO: 457680 - DNA, 20 bp, Artificial
  CRISPR gRNA sequence
ttaagactccccttggtata

SEQ ID NO: 457681 - DNA, 20 bp, Artificial
  CRISPR gRNA sequence
taagactccccttggtatac

SEQ ID NO: 457682 - DNA, 20 bp, Artificial
  CRISPR gRNA sequence
aagactccccttggtataca

SEQ ID NO: 457683 - DNA, 20 bp, Artificial
  CRISPR gRNA sequence
agactccccttggtatacat

SEQ ID NO: 457684 - DNA, 20 bp, Artificial
  CRISPR gRNA sequence
cccttggtatacatagtaaa

SEQ ID NO: 457685 - DNA, 20 bp, Artificial
  CRISPR gRNA sequence
ggtatacatagtaaactaaa

SEQ ID NO: 457686 - DNA, 20 bp, Artificial
  CRISPR gRNA sequence
gtatacatagtaaactaaat

SEQ ID NO: 457687 - DNA, 20 bp, Artificial
  CRISPR gRNA sequence
aattcactctcatgaaaacg

SEQ ID NO: 457688 - DNA, 20 bp, Artificial
  CRISPR gRNA sequence
actctcatgaaaacggtgaa

SEQ ID NO: 457689 - DNA, 20 bp, Artificial
  CRISPR gRNA sequence
tcatgaaaacggtgaagagg

SEQ ID NO: 457690 - DNA, 20 bp, Artificial
  CRISPR gRNA sequence
atgaaaacggtgaagaggca

SEQ ID NO: 457691 - DNA, 20 bp, Artificial
  CRISPR gRNA sequence
ccccctgcatattgaatgcc

SEQ ID NO: 457692 - DNA, 20 bp, Artificial
  CRISPR gRNA sequence
catattgaatgccattctcc

SEQ ID NO: 457693 - DNA, 20 bp, Artificial
  CRISPR gRNA sequence
aatgccattctcctacaaga

SEQ ID NO: 457694 - DNA, 20 bp, Artificial
  CRISPR gRNA sequence
tcctacaagagtaagagata

SEQ ID NO: 457695 - DNA, 20 bp, Artificial
  CRISPR gRNA sequence
ctacaagagtaagagatatg

SEQ ID NO: 457696 - DNA, 20 bp, Artificial
  CRISPR gRNA sequence
caagagtaagagatatgggt

SEQ ID NO: 457697 - DNA, 20 bp, Artificial
  CRISPR gRNA sequence
ccaagacccatatctgaggg

SEQ ID NO: 457698 - DNA, 20 bp, Artificial
  CRISPR gRNA sequence
caagacccatatctgaggga

SEQ ID NO: 457699 - DNA, 20 bp, Artificial
  CRISPR gRNA sequence
agggagacctgcaatcccag

SEQ ID NO: 457700 - DNA, 20 bp, Artificial
  CRISPR gRNA sequence
caatcccagccattgattca

SEQ ID NO: 457701 - DNA, 20 bp, Artificial
  CRISPR gRNA sequence
attcactccaaaatggttta

SEQ ID NO: 457702 - DNA, 20 bp, Artificial
  CRISPR gRNA sequence
actccaaaatggtttatatt

SEQ ID NO: 457703 - DNA, 20 bp, Artificial
  CRISPR gRNA sequence
caaaatggtttatattttat

SEQ ID NO: 457704 - DNA, 20 bp, Artificial
  CRISPR gRNA sequence
atattttatttctactttcc

SEQ ID NO: 457705 - DNA, 20 bp, Artificial
  CRISPR gRNA sequence
tattttatttctactttcca

SEQ ID NO: 457706 - DNA, 20 bp, Artificial
  CRISPR gRNA sequence
tatttctactttccagctgg

SEQ ID NO: 457707 - DNA, 20 bp, Artificial
  CRISPR gRNA sequence
atttctactttccagctgga

SEQ ID NO: 457708 - DNA, 20 bp, Artificial
  CRISPR gRNA sequence
tttctactttccagctggaa

SEQ ID NO: 457709 - DNA, 20 bp, Artificial
  CRISPR gRNA sequence
ctactttccagctggaactt

SEQ ID NO: 457710 - DNA, 20 bp, Artificial
  CRISPR gRNA sequence
tactttccagctggaacttc

SEQ ID NO: 457711 - DNA, 20 bp, Artificial
  CRISPR gRNA sequence
ctttccagctggaacttcta

SEQ ID NO: 457712 - DNA, 20 bp, Artificial
  CRISPR gRNA sequence
tccagctggaacttctatag

SEQ ID NO: 457713 - DNA, 20 bp, Artificial
  CRISPR gRNA sequence
ccagctggaacttctatagg

SEQ ID NO: 457714 - DNA, 20 bp, Artificial
  CRISPR gRNA sequence
cagctggaacttctataggg

SEQ ID NO: 457715 - DNA, 20 bp, Artificial
  CRISPR gRNA sequence
gaacttctatagggtctctg

SEQ ID NO: 457716 - DNA, 20 bp, Artificial
  CRISPR gRNA sequence
ctatagggtctctgttagag

SEQ ID NO: 457717 - DNA, 20 bp, Artificial
  CRISPR gRNA sequence
tatagggtctctgttagagt

SEQ ID NO: 457718 - DNA, 20 bp, Artificial
  CRISPR gRNA sequence
tagggtctctgttagagtgc

SEQ ID NO: 457719 - DNA, 20 bp, Artificial
  CRISPR gRNA sequence
tgttagagtgcttttctgta

SEQ ID NO: 457720 - DNA, 20 bp, Artificial
  CRISPR gRNA sequence
ttagagtgcttttctgtata

SEQ ID NO: 457721 - DNA, 20 bp, Artificial
  CRISPR gRNA sequence
gagtgcttttctgtatatca

SEQ ID NO: 457722 - DNA, 20 bp, Artificial
  CRISPR gRNA sequence
ttctgtatatcaaatcctca

SEQ ID NO: 457723 - DNA, 20 bp, Artificial
  CRISPR gRNA sequence
tctgtatatcaaatcctcag

SEQ ID NO: 457724 - DNA, 20 bp, Artificial
  CRISPR gRNA sequence
ctgtatatcaaatcctcagt

SEQ ID NO: 457725 - DNA, 20 bp, Artificial
  CRISPR gRNA sequence
tgtatatcaaatcctcagta

SEQ ID NO: 457726 - DNA, 20 bp, Artificial
  CRISPR gRNA sequence
tatatcaaatcctcagtata

SEQ ID NO: 457727 - DNA, 20 bp, Artificial
  CRISPR gRNA sequence
agtatagccatagagggcag

SEQ ID NO: 457728 - DNA, 20 bp, Artificial
  CRISPR gRNA sequence
ctcttcccattttataaata

SEQ ID NO: 457729 - DNA, 20 bp, Artificial
  CRISPR gRNA sequence
ttcccattttataaatacac

SEQ ID NO: 457730 - DNA, 20 bp, Artificial
  CRISPR gRNA sequence
cccattttataaatacacaa

SEQ ID NO: 457731 - DNA, 20 bp, Artificial
  CRISPR gRNA sequence
ccattttataaatacacaaa

SEQ ID NO: 457732 - DNA, 20 bp, Artificial
  CRISPR gRNA sequence
tataaatacacaaattgagg

SEQ ID NO: 457733 - DNA, 20 bp, Artificial
  CRISPR gRNA sequence
ataaatacacaaattgaggc

SEQ ID NO: 457734 - DNA, 20 bp, Artificial
  CRISPR gRNA sequence
taaatacacaaattgaggca

SEQ ID NO: 457735 - DNA, 20 bp, Artificial
  CRISPR gRNA sequence
aggcacagagtggttaaact

SEQ ID NO: 457736 - DNA, 20 bp, Artificial
  CRISPR gRNA sequence
aactagctgctgaagttaat

SEQ ID NO: 457737 - DNA, 20 bp, Artificial
  CRISPR gRNA sequence
gctgctgaagttaatgaaga

SEQ ID NO: 457738 - DNA, 20 bp, Artificial
  CRISPR gRNA sequence
ctgaagttaatgaagattgc

SEQ ID NO: 457739 - DNA, 20 bp, Artificial
  CRISPR gRNA sequence
aagttaatgaagattgcagt

SEQ ID NO: 457740 - DNA, 20 bp, Artificial
  CRISPR gRNA sequence
atgaagattgcagtatctgg

SEQ ID NO: 457741 - DNA, 20 bp, Artificial
  CRISPR gRNA sequence
cagtatctggatctcaaacc

SEQ ID NO: 457742 - DNA, 20 bp, Artificial
  CRISPR gRNA sequence
gatctcaaacctggatttca

SEQ ID NO: 457743 - DNA, 20 bp, Artificial
  CRISPR gRNA sequence
aaacctggatttcataaatt

SEQ ID NO: 457744 - DNA, 20 bp, Artificial
  CRISPR gRNA sequence
gatttcataaatttatagta

SEQ ID NO: 457745 - DNA, 20 bp, Artificial
  CRISPR gRNA sequence
cataaatttatagtatataa

SEQ ID NO: 457746 - DNA, 20 bp, Artificial
  CRISPR gRNA sequence
ataaatttatagtatataag

SEQ ID NO: 457747 - DNA, 20 bp, Artificial
  CRISPR gRNA sequence
atagtatataagagcctaaa

SEQ ID NO: 457748 - DNA, 20 bp, Artificial
  CRISPR gRNA sequence
tagtatataagagcctaaag

SEQ ID NO: 457749 - DNA, 20 bp, Artificial
  CRISPR gRNA sequence
aaggaatcttaggttgaggc

SEQ ID NO: 457750 - DNA, 20 bp, Artificial
  CRISPR gRNA sequence
aggttgaggcgcagattgcc

SEQ ID NO: 457751 - DNA, 20 bp, Artificial
  CRISPR gRNA sequence
ggttgaggcgcagattgcca

SEQ ID NO: 457752 - DNA, 20 bp, Artificial
  CRISPR gRNA sequence
aggcgcagattgccaggctc

SEQ ID NO: 457753 - DNA, 20 bp, Artificial
  CRISPR gRNA sequence
ccaggctctttgaaacatat

SEQ ID NO: 457754 - DNA, 20 bp, Artificial
  CRISPR gRNA sequence
tttgaaacatatagcagaga

SEQ ID NO: 457755 - DNA, 20 bp, Artificial
  CRISPR gRNA sequence
tgaaacatatagcagagaca

SEQ ID NO: 457756 - DNA, 20 bp, Artificial
  CRISPR gRNA sequence
gaaacatatagcagagacag

SEQ ID NO: 457757 - DNA, 20 bp, Artificial
  CRISPR gRNA sequence
aaacatatagcagagacaga

SEQ ID NO: 457758 - DNA, 20 bp, Artificial
  CRISPR gRNA sequence
atagagaggcaatagtatca

SEQ ID NO: 457759 - DNA, 20 bp, Artificial
  CRISPR gRNA sequence
taatgaaaaagaaaaagaca

SEQ ID NO: 457760 - DNA, 20 bp, Artificial
  CRISPR gRNA sequence
atgaaaaagaaaaagacaat

SEQ ID NO: 457761 - DNA, 20 bp, Artificial
  CRISPR gRNA sequence
tttaccctttccttaatgtc

SEQ ID NO: 457762 - DNA, 20 bp, Artificial
  CRISPR gRNA sequence
taccctttccttaatgtcaa

SEQ ID NO: 457763 - DNA, 20 bp, Artificial
  CRISPR gRNA sequence
accctttccttaatgtcaag

SEQ ID NO: 457764 - DNA, 20 bp, Artificial
  CRISPR gRNA sequence
ccctttccttaatgtcaagg

SEQ ID NO: 457765 - DNA, 20 bp, Artificial
  CRISPR gRNA sequence
tccttaatgtcaaggagagt

SEQ ID NO: 457766 - DNA, 20 bp, Artificial
  CRISPR gRNA sequence
ccttaatgtcaaggagagtg

SEQ ID NO: 457767 - DNA, 20 bp, Artificial
  CRISPR gRNA sequence
cttaatgtcaaggagagtga

SEQ ID NO: 457768 - DNA, 20 bp, Artificial
  CRISPR gRNA sequence
aatgtcaaggagagtgagtc

SEQ ID NO: 457769 - DNA, 20 bp, Artificial
  CRISPR gRNA sequence
atgtcaaggagagtgagtca

SEQ ID NO: 457770 - DNA, 20 bp, Artificial
  CRISPR gRNA sequence
aggatcacctgaggtcaggc

SEQ ID NO: 457771 - DNA, 20 bp, Artificial
  CRISPR gRNA sequence
aggtcaggcagagttcgagg

SEQ ID NO: 457772 - DNA, 20 bp, Artificial
  CRISPR gRNA sequence
gaggccagcctgaccaatat

SEQ ID NO: 457773 - DNA, 20 bp, Artificial
  CRISPR gRNA sequence
accaatatggtgaaaccccg

SEQ ID NO: 457774 - DNA, 20 bp, Artificial
  CRISPR gRNA sequence
tactaaaaatacaaaaatta

SEQ ID NO: 457775 - DNA, 20 bp, Artificial
  CRISPR gRNA sequence
ctaaaaatacaaaaattagc

SEQ ID NO: 457776 - DNA, 20 bp, Artificial
  CRISPR gRNA sequence
aaaatacaaaaattagccgg

SEQ ID NO: 457777 - DNA, 20 bp, Artificial
  CRISPR gRNA sequence
gccggcggtggcggcataag

SEQ ID NO: 457778 - DNA, 20 bp, Artificial
  CRISPR gRNA sequence
tagtcccagctactcgggaa

SEQ ID NO: 457779 - DNA, 20 bp, Artificial
  CRISPR gRNA sequence
ctcgggaagctgagccagca

SEQ ID NO: 457780 - DNA, 20 bp, Artificial
  CRISPR gRNA sequence
gggaagctgagccagcagaa

SEQ ID NO: 457781 - DNA, 20 bp, Artificial
  CRISPR gRNA sequence
agccagcagaattgcttgaa

SEQ ID NO: 457782 - DNA, 20 bp, Artificial
  CRISPR gRNA sequence
cttgaacatgggaggcggag

SEQ ID NO: 457783 - DNA, 20 bp, Artificial
  CRISPR gRNA sequence
gaacatgggaggcggaggtt

SEQ ID NO: 457784 - DNA, 20 bp, Artificial
  CRISPR gRNA sequence
aacatgggaggcggaggttg

SEQ ID NO: 457785 - DNA, 20 bp, Artificial
  CRISPR gRNA sequence
cagtgagccgagatcgcgcc

SEQ ID NO: 457786 - DNA, 20 bp, Artificial
  CRISPR gRNA sequence
cactccagcctgggtgacag

SEQ ID NO: 457787 - DNA, 20 bp, Artificial
  CRISPR gRNA sequence
cagcctgggtgacagagcga

SEQ ID NO: 457788 - DNA, 20 bp, Artificial
  CRISPR gRNA sequence
ggtgacagagcgagactccc

SEQ ID NO: 457789 - DNA, 20 bp, Artificial
  CRISPR gRNA sequence
cctcaaaaaaaaaaaaaaaa

SEQ ID NO: 457790 - DNA, 20 bp, Artificial
  CRISPR gRNA sequence
aaaaaaaaaaaaaaaaaaaa

SEQ ID NO: 457791 - DNA, 20 bp, Artificial
  CRISPR gRNA sequence
tgtttccccactagagaaaa

SEQ ID NO: 457792 - DNA, 20 bp, Artificial
  CRISPR gRNA sequence
gtttccccactagagaaaat

SEQ ID NO: 457793 - DNA, 20 bp, Artificial
  CRISPR gRNA sequence
tttccccactagagaaaatc

SEQ ID NO: 457794 - DNA, 20 bp, Artificial
  CRISPR gRNA sequence
ccccactagagaaaatcacg

SEQ ID NO: 457795 - DNA, 20 bp, Artificial
  CRISPR gRNA sequence
cccactagagaaaatcacgg

SEQ ID NO: 457796 - DNA, 20 bp, Artificial
  CRISPR gRNA sequence
gagaaaatcacgggatccag

SEQ ID NO: 457797 - DNA, 20 bp, Artificial
  CRISPR gRNA sequence
cccacaagcccaggatcctc

SEQ ID NO: 457798 - DNA, 20 bp, Artificial
  CRISPR gRNA sequence
ccacaagcccaggatcctcc

SEQ ID NO: 457799 - DNA, 20 bp, Artificial
  CRISPR gRNA sequence
cccatggccgtctctgctct

SEQ ID NO: 457800 - DNA, 20 bp, Artificial
  CRISPR gRNA sequence
tgctctagggtctatcctca

SEQ ID NO: 457801 - DNA, 20 bp, Artificial
  CRISPR gRNA sequence
ctctagggtctatcctcacc

SEQ ID NO: 457802 - DNA, 20 bp, Artificial
  CRISPR gRNA sequence
tagggtctatcctcaccacc

SEQ ID NO: 457803 - DNA, 20 bp, Artificial
  CRISPR gRNA sequence
gggtctatcctcaccaccag

SEQ ID NO: 457804 - DNA, 20 bp, Artificial
  CRISPR gRNA sequence
tcctcaccaccagactggat

SEQ ID NO: 457805 - DNA, 20 bp, Artificial
  CRISPR gRNA sequence
accaccagactggatgtcca

SEQ ID NO: 457806 - DNA, 20 bp, Artificial
  CRISPR gRNA sequence
gatgtccacaattgccagca

SEQ ID NO: 457807 - DNA, 20 bp, Artificial
  CRISPR gRNA sequence
ccagcaggatggccagggca

SEQ ID NO: 457808 - DNA, 20 bp, Artificial
  CRISPR gRNA sequence
tgccgggttccaacagcatc

SEQ ID NO: 457809 - DNA, 20 bp, Artificial
  CRISPR gRNA sequence
ccgggttccaacagcatcct

SEQ ID NO: 457810 - DNA, 20 bp, Artificial
  CRISPR gRNA sequence
caacagcatcctgcacgctg

SEQ ID NO: 457811 - DNA, 20 bp, Artificial
  CRISPR gRNA sequence
cacgctgtcagcaggcccag

SEQ ID NO: 457812 - DNA, 20 bp, Artificial
  CRISPR gRNA sequence
tcagcaggcccaggaacttg

SEQ ID NO: 457813 - DNA, 20 bp, Artificial
  CRISPR gRNA sequence
gaagcaaatgttggctctgc

SEQ ID NO: 457814 - DNA, 20 bp, Artificial
  CRISPR gRNA sequence
aagcaaatgttggctctgct

SEQ ID NO: 457815 - DNA, 20 bp, Artificial
  CRISPR gRNA sequence
gctctgctggtatccttggc

SEQ ID NO: 457816 - DNA, 20 bp, Artificial
  CRISPR gRNA sequence
tgctggtatccttggcttca

SEQ ID NO: 457817 - DNA, 20 bp, Artificial
  CRISPR gRNA sequence
ctggtatccttggcttcagt

SEQ ID NO: 457818 - DNA, 20 bp, Artificial
  CRISPR gRNA sequence
gtatccttggcttcagtctc

SEQ ID NO: 457819 - DNA, 20 bp, Artificial
  CRISPR gRNA sequence
ggcttcagtctcctaaaagc

SEQ ID NO: 457820 - DNA, 20 bp, Artificial
  CRISPR gRNA sequence
gcttcagtctcctaaaagca

SEQ ID NO: 457821 - DNA, 20 bp, Artificial
  CRISPR gRNA sequence
cagtctcctaaaagcacagg

SEQ ID NO: 457822 - DNA, 20 bp, Artificial
  CRISPR gRNA sequence
agtctcctaaaagcacaggg

SEQ ID NO: 457823 - DNA, 20 bp, Artificial
  CRISPR gRNA sequence
ctaaaagcacagggggaccc

SEQ ID NO: 457824 - DNA, 20 bp, Artificial
  CRISPR gRNA sequence
aaagcacagggggacccact

SEQ ID NO: 457825 - DNA, 20 bp, Artificial
  CRISPR gRNA sequence
gacaaagccttccagggttc

SEQ ID NO: 457826 - DNA, 20 bp, Artificial
  CRISPR gRNA sequence
ccagggttccaagaccattt

SEQ ID NO: 457827 - DNA, 20 bp, Artificial
  CRISPR gRNA sequence
cagggttccaagaccatttc

SEQ ID NO: 457828 - DNA, 20 bp, Artificial
  CRISPR gRNA sequence
caagaccatttccccatccc

SEQ ID NO: 457829 - DNA, 20 bp, Artificial
  CRISPR gRNA sequence
ccccatcccaggctctagct

SEQ ID NO: 457830 - DNA, 20 bp, Artificial
  CRISPR gRNA sequence
cccatcccaggctctagctt

SEQ ID NO: 457831 - DNA, 20 bp, Artificial
  CRISPR gRNA sequence
tagctttgattggctagagt

SEQ ID NO: 457832 - DNA, 20 bp, Artificial
  CRISPR gRNA sequence
gctttgattggctagagtat

SEQ ID NO: 457833 - DNA, 20 bp, Artificial
  CRISPR gRNA sequence
tgattggctagagtatgatg

SEQ ID NO: 457834 - DNA, 20 bp, Artificial
  CRISPR gRNA sequence
gattggctagagtatgatgg

SEQ ID NO: 457835 - DNA, 20 bp, Artificial
  CRISPR gRNA sequence
attggctagagtatgatgga

SEQ ID NO: 457836 - DNA, 20 bp, Artificial
  CRISPR gRNA sequence
gctagagtatgatggaggta

SEQ ID NO: 457837 - DNA, 20 bp, Artificial
  CRISPR gRNA sequence
gagtatgatggaggtagagg

SEQ ID NO: 457838 - DNA, 20 bp, Artificial
  CRISPR gRNA sequence
gggcatgagagtccagctgg

SEQ ID NO: 457839 - DNA, 20 bp, Artificial
  CRISPR gRNA sequence
ggcatgagagtccagctggc

SEQ ID NO: 457840 - DNA, 20 bp, Artificial
  CRISPR gRNA sequence
gctgggaagtgaggcggtaa

SEQ ID NO: 457841 - DNA, 20 bp, Artificial
  CRISPR gRNA sequence
ggaagtgaggcggtaaacca

SEQ ID NO: 457842 - DNA, 20 bp, Artificial
  CRISPR gRNA sequence
ggagccggggagggaggggc

SEQ ID NO: 457843 - DNA, 20 bp, Artificial
  CRISPR gRNA sequence
aaggctattttctcatatat

SEQ ID NO: 457844 - DNA, 20 bp, Artificial
  CRISPR gRNA sequence
ttttctcatatatatttttt

SEQ ID NO: 457845 - DNA, 20 bp, Artificial
  CRISPR gRNA sequence
tctcatatatatttttttaa

SEQ ID NO: 457846 - DNA, 20 bp, Artificial
  CRISPR gRNA sequence
ctcatatatatttttttaag

SEQ ID NO: 457847 - DNA, 20 bp, Artificial
  CRISPR gRNA sequence
tcatatatatttttttaagt

SEQ ID NO: 457848 - DNA, 20 bp, Artificial
  CRISPR gRNA sequence
atatatatttttttaagtta

SEQ ID NO: 457849 - DNA, 20 bp, Artificial
  CRISPR gRNA sequence
ttttaagttaaattggattg

SEQ ID NO: 457850 - DNA, 20 bp, Artificial
  CRISPR gRNA sequence
tttaagttaaattggattgc

SEQ ID NO: 457851 - DNA, 20 bp, Artificial
  CRISPR gRNA sequence
ttaagttaaattggattgct

SEQ ID NO: 457852 - DNA, 20 bp, Artificial
  CRISPR gRNA sequence
taagttaaattggattgctg

SEQ ID NO: 457853 - DNA, 20 bp, Artificial
  CRISPR gRNA sequence
aagttaaattggattgctgc

SEQ ID NO: 457854 - DNA, 20 bp, Artificial
  CRISPR gRNA sequence
agttaaattggattgctgcg

SEQ ID NO: 457855 - DNA, 20 bp, Artificial
  CRISPR gRNA sequence
aattggattgctgcgtcaaa

SEQ ID NO: 457856 - DNA, 20 bp, Artificial
  CRISPR gRNA sequence
gattgctgcgtcaaagaata

SEQ ID NO: 457857 - DNA, 20 bp, Artificial
  CRISPR gRNA sequence
ctgcgtcaaagaatatgatg

SEQ ID NO: 457858 - DNA, 20 bp, Artificial
  CRISPR gRNA sequence
cgtcaaagaatatgatgatt

SEQ ID NO: 457859 - DNA, 20 bp, Artificial
  CRISPR gRNA sequence
aaactttttttctactataa

SEQ ID NO: 457860 - DNA, 20 bp, Artificial
  CRISPR gRNA sequence
tttttctactataatcagat

SEQ ID NO: 457861 - DNA, 20 bp, Artificial
  CRISPR gRNA sequence
ttttctactataatcagatt

SEQ ID NO: 457862 - DNA, 20 bp, Artificial
  CRISPR gRNA sequence
tttctactataatcagattg

SEQ ID NO: 457863 - DNA, 20 bp, Artificial
  CRISPR gRNA sequence
ttctactataatcagattgc

SEQ ID NO: 457864 - DNA, 20 bp, Artificial
  CRISPR gRNA sequence
tctactataatcagattgct

SEQ ID NO: 457865 - DNA, 20 bp, Artificial
  CRISPR gRNA sequence
ctactataatcagattgctc

SEQ ID NO: 457866 - DNA, 20 bp, Artificial
  CRISPR gRNA sequence
tactataatcagattgctct

SEQ ID NO: 457867 - DNA, 20 bp, Artificial
  CRISPR gRNA sequence
ctataatcagattgctctcc

SEQ ID NO: 457868 - DNA, 20 bp, Artificial
  CRISPR gRNA sequence
taatcagattgctctccaaa

SEQ ID NO: 457869 - DNA, 20 bp, Artificial
  CRISPR gRNA sequence
ctctccaaaaaggctgttga

SEQ ID NO: 457870 - DNA, 20 bp, Artificial
  CRISPR gRNA sequence
tccaaaaaggctgttgataa

SEQ ID NO: 457871 - DNA, 20 bp, Artificial
  CRISPR gRNA sequence
caaaaaggctgttgataatc

SEQ ID NO: 457872 - DNA, 20 bp, Artificial
  CRISPR gRNA sequence
ttgataatcagatgttcacc

SEQ ID NO: 457873 - DNA, 20 bp, Artificial
  CRISPR gRNA sequence
ataatcagatgttcaccaag

SEQ ID NO: 457874 - DNA, 20 bp, Artificial
  CRISPR gRNA sequence
accaagaatgcttgatagtg

SEQ ID NO: 457875 - DNA, 20 bp, Artificial
  CRISPR gRNA sequence
gatagtgtacatttcctcgt

SEQ ID NO: 457876 - DNA, 20 bp, Artificial
  CRISPR gRNA sequence
atagtgtacatttcctcgtg

SEQ ID NO: 457877 - DNA, 20 bp, Artificial
  CRISPR gRNA sequence
cctcgtgcccttgctagctc

SEQ ID NO: 457878 - DNA, 20 bp, Artificial
  CRISPR gRNA sequence
ctcgtgcccttgctagctct

SEQ ID NO: 457879 - DNA, 20 bp, Artificial
  CRISPR gRNA sequence
gtgcccttgctagctctggg

SEQ ID NO: 457880 - DNA, 20 bp, Artificial
  CRISPR gRNA sequence
gctagctctgggtattatct

SEQ ID NO: 457881 - DNA, 20 bp, Artificial
  CRISPR gRNA sequence
ctagctctgggtattatctg

SEQ ID NO: 457882 - DNA, 20 bp, Artificial
  CRISPR gRNA sequence
gctctgggtattatctgtac

SEQ ID NO: 457883 - DNA, 20 bp, Artificial
  CRISPR gRNA sequence
tgggtattatctgtacttta

SEQ ID NO: 457884 - DNA, 20 bp, Artificial
  CRISPR gRNA sequence
ggtattatctgtactttaac

SEQ ID NO: 457885 - DNA, 20 bp, Artificial
  CRISPR gRNA sequence
tctgtactttaacatttttg

SEQ ID NO: 457886 - DNA, 20 bp, Artificial
  CRISPR gRNA sequence
tactttaacatttttgccaa

SEQ ID NO: 457887 - DNA, 20 bp, Artificial
  CRISPR gRNA sequence
taacatttttgccaatctga

SEQ ID NO: 457888 - DNA, 20 bp, Artificial
  CRISPR gRNA sequence
aacatttttgccaatctgat

SEQ ID NO: 457889 - DNA, 20 bp, Artificial
  CRISPR gRNA sequence
acatttttgccaatctgatg

SEQ ID NO: 457890 - DNA, 20 bp, Artificial
  CRISPR gRNA sequence
ttgccaatctgatggatgaa

SEQ ID NO: 457891 - DNA, 20 bp, Artificial
  CRISPR gRNA sequence
tgccaatctgatggatgaaa

SEQ ID NO: 457892 - DNA, 20 bp, Artificial
  CRISPR gRNA sequence
gccaatctgatggatgaaaa

SEQ ID NO: 457893 - DNA, 20 bp, Artificial
  CRISPR gRNA sequence
ccaatctgatggatgaaaaa

SEQ ID NO: 457894 - DNA, 20 bp, Artificial
  CRISPR gRNA sequence
atggatgaaaaattagacct

SEQ ID NO: 457895 - DNA, 20 bp, Artificial
  CRISPR gRNA sequence
gacctgctttatgttgcatt

SEQ ID NO: 457896 - DNA, 20 bp, Artificial
  CRISPR gRNA sequence
ctttatgttgcatttccatg

SEQ ID NO: 457897 - DNA, 20 bp, Artificial
  CRISPR gRNA sequence
tatgttgcatttccatgatt

SEQ ID NO: 457898 - DNA, 20 bp, Artificial
  CRISPR gRNA sequence
atgttgcatttccatgatta

SEQ ID NO: 457899 - DNA, 20 bp, Artificial
  CRISPR gRNA sequence
tgttgcatttccatgattag

SEQ ID NO: 457900 - DNA, 20 bp, Artificial
  CRISPR gRNA sequence
catttccatgattagtgaag

SEQ ID NO: 457901 - DNA, 20 bp, Artificial
  CRISPR gRNA sequence
ccatgattagtgaagttgag

SEQ ID NO: 457902 - DNA, 20 bp, Artificial
  CRISPR gRNA sequence
catgattagtgaagttgagg

SEQ ID NO: 457903 - DNA, 20 bp, Artificial
  CRISPR gRNA sequence
gtgaagttgaggatcttttc

SEQ ID NO: 457904 - DNA, 20 bp, Artificial
  CRISPR gRNA sequence
aggatcttttcatatgctta

SEQ ID NO: 457905 - DNA, 20 bp, Artificial
  CRISPR gRNA sequence
ttcatatgcttattggtcat

SEQ ID NO: 457906 - DNA, 20 bp, Artificial
  CRISPR gRNA sequence
tcatatgcttattggtcatt

SEQ ID NO: 457907 - DNA, 20 bp, Artificial
  CRISPR gRNA sequence
catatgcttattggtcatta

SEQ ID NO: 457908 - DNA, 20 bp, Artificial
  CRISPR gRNA sequence
atatgcttattggtcattag

SEQ ID NO: 457909 - DNA, 20 bp, Artificial
  CRISPR gRNA sequence
attggtcattagtattccct

SEQ ID NO: 457910 - DNA, 20 bp, Artificial
  CRISPR gRNA sequence
ttggtcattagtattccctt

SEQ ID NO: 457911 - DNA, 20 bp, Artificial
  CRISPR gRNA sequence
gtcattagtattcccttgtc

SEQ ID NO: 457912 - DNA, 20 bp, Artificial
  CRISPR gRNA sequence
gtattcccttgtctgtgaat

SEQ ID NO: 457913 - DNA, 20 bp, Artificial
  CRISPR gRNA sequence
ccttgtctgtgaattgtgtg

SEQ ID NO: 457914 - DNA, 20 bp, Artificial
  CRISPR gRNA sequence
gtctgtgaattgtgtgttca

SEQ ID NO: 457915 - DNA, 20 bp, Artificial
  CRISPR gRNA sequence
tctgtgaattgtgtgttcat

SEQ ID NO: 457916 - DNA, 20 bp, Artificial
  CRISPR gRNA sequence
tgaattgtgtgttcatattc

SEQ ID NO: 457917 - DNA, 20 bp, Artificial
  CRISPR gRNA sequence
tgtgttcatattcttcacat

SEQ ID NO: 457918 - DNA, 20 bp, Artificial
  CRISPR gRNA sequence
atattcttcacatttcttaa

SEQ ID NO: 457919 - DNA, 20 bp, Artificial
  CRISPR gRNA sequence
ttcacatttcttaactttta

SEQ ID NO: 457920 - DNA, 20 bp, Artificial
  CRISPR gRNA sequence
cacatttcttaacttttagg

SEQ ID NO: 457921 - DNA, 20 bp, Artificial
  CRISPR gRNA sequence
acatttcttaacttttaggc

SEQ ID NO: 457922 - DNA, 20 bp, Artificial
  CRISPR gRNA sequence
cttaacttttaggcactttc

SEQ ID NO: 457923 - DNA, 20 bp, Artificial
  CRISPR gRNA sequence
ttaacttttaggcactttct

SEQ ID NO: 457924 - DNA, 20 bp, Artificial
  CRISPR gRNA sequence
aacttttaggcactttctcc

SEQ ID NO: 457925 - DNA, 20 bp, Artificial
  CRISPR gRNA sequence
acttttaggcactttctccg

SEQ ID NO: 457926 - DNA, 20 bp, Artificial
  CRISPR gRNA sequence
ttaggcactttctccgtatt

SEQ ID NO: 457927 - DNA, 20 bp, Artificial
  CRISPR gRNA sequence
taggcactttctccgtatta

SEQ ID NO: 457928 - DNA, 20 bp, Artificial
  CRISPR gRNA sequence
aggcactttctccgtattag

SEQ ID NO: 457929 - DNA, 20 bp, Artificial
  CRISPR gRNA sequence
ggcactttctccgtattaga

SEQ ID NO: 457930 - DNA, 20 bp, Artificial
  CRISPR gRNA sequence
tctccgtattagagatatta

SEQ ID NO: 457931 - DNA, 20 bp, Artificial
  CRISPR gRNA sequence
ctccgtattagagatattaa

SEQ ID NO: 457932 - DNA, 20 bp, Artificial
  CRISPR gRNA sequence
tccgtattagagatattaac

SEQ ID NO: 457933 - DNA, 20 bp, Artificial
  CRISPR gRNA sequence
cgtattagagatattaaccc

SEQ ID NO: 457934 - DNA, 20 bp, Artificial
  CRISPR gRNA sequence
gagatattaacccatctgcc

SEQ ID NO: 457935 - DNA, 20 bp, Artificial
  CRISPR gRNA sequence
acccatctgccattttttta

SEQ ID NO: 457936 - DNA, 20 bp, Artificial
  CRISPR gRNA sequence
ccatttttttaggcaaatac

SEQ ID NO: 457937 - DNA, 20 bp, Artificial
  CRISPR gRNA sequence
ttttaggcaaatactttctc

SEQ ID NO: 457938 - DNA, 20 bp, Artificial
  CRISPR gRNA sequence
tttaggcaaatactttctcc

SEQ ID NO: 457939 - DNA, 20 bp, Artificial
  CRISPR gRNA sequence
ttaggcaaatactttctccc

SEQ ID NO: 457940 - DNA, 20 bp, Artificial
  CRISPR gRNA sequence
taggcaaatactttctccca

SEQ ID NO: 457941 - DNA, 20 bp, Artificial
  CRISPR gRNA sequence
aggcaaatactttctcccaa

SEQ ID NO: 457942 - DNA, 20 bp, Artificial
  CRISPR gRNA sequence
ggcaaatactttctcccaat

SEQ ID NO: 457943 - DNA, 20 bp, Artificial
  CRISPR gRNA sequence
tctcccaatttgttgtttgt

SEQ ID NO: 457944 - DNA, 20 bp, Artificial
  CRISPR gRNA sequence
ctcccaatttgttgtttgtc

SEQ ID NO: 457945 - DNA, 20 bp, Artificial
  CRISPR gRNA sequence
tcccaatttgttgtttgtct

SEQ ID NO: 457946 - DNA, 20 bp, Artificial
  CRISPR gRNA sequence
ccaatttgttgtttgtctct

SEQ ID NO: 457947 - DNA, 20 bp, Artificial
  CRISPR gRNA sequence
gttgtttgtctcttcacttt

SEQ ID NO: 457948 - DNA, 20 bp, Artificial
  CRISPR gRNA sequence
ttgtttgtctcttcactttt

SEQ ID NO: 457949 - DNA, 20 bp, Artificial
  CRISPR gRNA sequence
tttgtctcttcacttttttt

SEQ ID NO: 457950 - DNA, 20 bp, Artificial
  CRISPR gRNA sequence
gtctcttcactttttttatg

SEQ ID NO: 457951 - DNA, 20 bp, Artificial
  CRISPR gRNA sequence
tctcttcactttttttatga

SEQ ID NO: 457952 - DNA, 20 bp, Artificial
  CRISPR gRNA sequence
ttcactttttttatgaggct

SEQ ID NO: 457953 - DNA, 20 bp, Artificial
  CRISPR gRNA sequence
cactttttttatgaggcttt

SEQ ID NO: 457954 - DNA, 20 bp, Artificial
  CRISPR gRNA sequence
actttttttatgaggctttt

SEQ ID NO: 457955 - DNA, 20 bp, Artificial
  CRISPR gRNA sequence
tttttatgaggctttttttt

SEQ ID NO: 457956 - DNA, 20 bp, Artificial
  CRISPR gRNA sequence
ttttatgaggcttttttttc

SEQ ID NO: 457957 - DNA, 20 bp, Artificial
  CRISPR gRNA sequence
tttatgaggcttttttttca

SEQ ID NO: 457958 - DNA, 20 bp, Artificial
  CRISPR gRNA sequence
ttatgaggcttttttttcac

SEQ ID NO: 457959 - DNA, 20 bp, Artificial
  CRISPR gRNA sequence
tatgaggcttttttttcaca

SEQ ID NO: 457960 - DNA, 20 bp, Artificial
  CRISPR gRNA sequence
atgaggcttttttttcacaa

SEQ ID NO: 457961 - DNA, 20 bp, Artificial
  CRISPR gRNA sequence
tgaggcttttttttcacaag

SEQ ID NO: 457962 - DNA, 20 bp, Artificial
  CRISPR gRNA sequence
ttttttcacaaggaaagttt

SEQ ID NO: 457963 - DNA, 20 bp, Artificial
  CRISPR gRNA sequence
tttttcacaaggaaagttta

SEQ ID NO: 457964 - DNA, 20 bp, Artificial
  CRISPR gRNA sequence
ttttcacaaggaaagtttac

SEQ ID NO: 457965 - DNA, 20 bp, Artificial
  CRISPR gRNA sequence
tttcacaaggaaagtttaca

SEQ ID NO: 457966 - DNA, 20 bp, Artificial
  CRISPR gRNA sequence
ttcacaaggaaagtttacat

SEQ ID NO: 457967 - DNA, 20 bp, Artificial
  CRISPR gRNA sequence
tcacaaggaaagtttacatt

SEQ ID NO: 457968 - DNA, 20 bp, Artificial
  CRISPR gRNA sequence
cacaaggaaagtttacattg

SEQ ID NO: 457969 - DNA, 20 bp, Artificial
  CRISPR gRNA sequence
acaaggaaagtttacattgt

SEQ ID NO: 457970 - DNA, 20 bp, Artificial
  CRISPR gRNA sequence
acattgtatgtaattaaata

SEQ ID NO: 457971 - DNA, 20 bp, Artificial
  CRISPR gRNA sequence
cattgtatgtaattaaatac

SEQ ID NO: 457972 - DNA, 20 bp, Artificial
  CRISPR gRNA sequence
tatgtaattaaatacaacat

SEQ ID NO: 457973 - DNA, 20 bp, Artificial
  CRISPR gRNA sequence
aatacaacatatctatcttt

SEQ ID NO: 457974 - DNA, 20 bp, Artificial
  CRISPR gRNA sequence
tcttttcctttaagttgtct

SEQ ID NO: 457975 - DNA, 20 bp, Artificial
  CRISPR gRNA sequence
ttcctttaagttgtctgggt

SEQ ID NO: 457976 - DNA, 20 bp, Artificial
  CRISPR gRNA sequence
tcctttaagttgtctgggtt

SEQ ID NO: 457977 - DNA, 20 bp, Artificial
  CRISPR gRNA sequence
cctttaagttgtctgggttt

SEQ ID NO: 457978 - DNA, 20 bp, Artificial
  CRISPR gRNA sequence
ctttaagttgtctgggtttc

SEQ ID NO: 457979 - DNA, 20 bp, Artificial
  CRISPR gRNA sequence
taagttgtctgggtttcctg

SEQ ID NO: 457980 - DNA, 20 bp, Artificial
  CRISPR gRNA sequence
aagttgtctgggtttcctgc

SEQ ID NO: 457981 - DNA, 20 bp, Artificial
  CRISPR gRNA sequence
agttgtctgggtttcctgca

SEQ ID NO: 457982 - DNA, 20 bp, Artificial
  CRISPR gRNA sequence
tctgggtttcctgcattgtt

SEQ ID NO: 457983 - DNA, 20 bp, Artificial
  CRISPR gRNA sequence
ggtttcctgcattgtttagg

SEQ ID NO: 457984 - DNA, 20 bp, Artificial
  CRISPR gRNA sequence
cctgcattgtttaggaaagt

SEQ ID NO: 457985 - DNA, 20 bp, Artificial
  CRISPR gRNA sequence
ctgcattgtttaggaaagtt

SEQ ID NO: 457986 - DNA, 20 bp, Artificial
  CRISPR gRNA sequence
cattgtttaggaaagtttcc

SEQ ID NO: 457987 - DNA, 20 bp, Artificial
  CRISPR gRNA sequence
tttaggaaagtttccctcca

SEQ ID NO: 457988 - DNA, 20 bp, Artificial
  CRISPR gRNA sequence
aggaaagtttccctccaatt

SEQ ID NO: 457989 - DNA, 20 bp, Artificial
  CRISPR gRNA sequence
ggaaagtttccctccaattg

SEQ ID NO: 457990 - DNA, 20 bp, Artificial
  CRISPR gRNA sequence
ccctccaattgaggctataa

SEQ ID NO: 457991 - DNA, 20 bp, Artificial
  CRISPR gRNA sequence
cctccaattgaggctataat

SEQ ID NO: 457992 - DNA, 20 bp, Artificial
  CRISPR gRNA sequence
caattgaggctataattttc

SEQ ID NO: 457993 - DNA, 20 bp, Artificial
  CRISPR gRNA sequence
aggctataattttctttcaa

SEQ ID NO: 457994 - DNA, 20 bp, Artificial
  CRISPR gRNA sequence
taattttctttcaatatttt

SEQ ID NO: 457995 - DNA, 20 bp, Artificial
  CRISPR gRNA sequence
tctttcaatatttttattgt

SEQ ID NO: 457996 - DNA, 20 bp, Artificial
  CRISPR gRNA sequence
ctttcaatatttttattgtt

SEQ ID NO: 457997 - DNA, 20 bp, Artificial
  CRISPR gRNA sequence
tttcaatatttttattgttt

SEQ ID NO: 457998 - DNA, 20 bp, Artificial
  CRISPR gRNA sequence
tcaatatttttattgtttta

SEQ ID NO: 457999 - DNA, 20 bp, Artificial
  CRISPR gRNA sequence
caatatttttattgttttac

SEQ ID NO: 458000 - DNA, 20 bp, Artificial
  CRISPR gRNA sequence
aatatttttattgttttact

SEQ ID NO: 458001 - DNA, 20 bp, Artificial
  CRISPR gRNA sequence
ttattgttttactttttata

SEQ ID NO: 458002 - DNA, 20 bp, Artificial
  CRISPR gRNA sequence
tattgttttactttttatag

SEQ ID NO: 458003 - DNA, 20 bp, Artificial
  CRISPR gRNA sequence
attgttttactttttatagt

SEQ ID NO: 458004 - DNA, 20 bp, Artificial
  CRISPR gRNA sequence
ttgttttactttttatagtt

SEQ ID NO: 458005 - DNA, 20 bp, Artificial
  CRISPR gRNA sequence
ttttactttttatagttaca

SEQ ID NO: 458006 - DNA, 20 bp, Artificial
  CRISPR gRNA sequence
tactttttatagttacatct

SEQ ID NO: 458007 - DNA, 20 bp, Artificial
  CRISPR gRNA sequence
actttttatagttacatctt

SEQ ID NO: 458008 - DNA, 20 bp, Artificial
  CRISPR gRNA sequence
ctttttatagttacatcttc

SEQ ID NO: 458009 - DNA, 20 bp, Artificial
  CRISPR gRNA sequence
tttatagttacatcttctaa

SEQ ID NO: 458010 - DNA, 20 bp, Artificial
  CRISPR gRNA sequence
ttatagttacatcttctaat

SEQ ID NO: 458011 - DNA, 20 bp, Artificial
  CRISPR gRNA sequence
tatagttacatcttctaatc

SEQ ID NO: 458012 - DNA, 20 bp, Artificial
  CRISPR gRNA sequence
atagttacatcttctaatcc

SEQ ID NO: 458013 - DNA, 20 bp, Artificial
  CRISPR gRNA sequence
tagttacatcttctaatcct

SEQ ID NO: 458014 - DNA, 20 bp, Artificial
  CRISPR gRNA sequence
catcttctaatcctggctaa

SEQ ID NO: 458015 - DNA, 20 bp, Artificial
  CRISPR gRNA sequence
ctaatcctggctaagaaaaa

SEQ ID NO: 458016 - DNA, 20 bp, Artificial
  CRISPR gRNA sequence
taatcctggctaagaaaaat

SEQ ID NO: 458017 - DNA, 20 bp, Artificial
  CRISPR gRNA sequence
atcctggctaagaaaaatta

SEQ ID NO: 458018 - DNA, 20 bp, Artificial
  CRISPR gRNA sequence
gctaagaaaaattactcctg

SEQ ID NO: 458019 - DNA, 20 bp, Artificial
  CRISPR gRNA sequence
agaaaaattactcctgtttc

SEQ ID NO: 458020 - DNA, 20 bp, Artificial
  CRISPR gRNA sequence
ctcctgtttcaaaataaaca

SEQ ID NO: 458021 - DNA, 20 bp, Artificial
  CRISPR gRNA sequence
ctgtttcaaaataaacaaac

SEQ ID NO: 458022 - DNA, 20 bp, Artificial
  CRISPR gRNA sequence
tttcaaaataaacaaactga

SEQ ID NO: 458023 - DNA, 20 bp, Artificial
  CRISPR gRNA sequence
caaaataaacaaactgaaga

SEQ ID NO: 458024 - DNA, 20 bp, Artificial
  CRISPR gRNA sequence
aaaataaacaaactgaagaa

SEQ ID NO: 458025 - DNA, 20 bp, Artificial
  CRISPR gRNA sequence
aagaaaaacaaacacttgaa

SEQ ID NO: 458026 - DNA, 20 bp, Artificial
  CRISPR gRNA sequence
gaatttcatcaatagggaaa

SEQ ID NO: 458027 - DNA, 20 bp, Artificial
  CRISPR gRNA sequence
aatttcatcaatagggaaaa

SEQ ID NO: 458028 - DNA, 20 bp, Artificial
  CRISPR gRNA sequence
catcaatagggaaaatggtt

SEQ ID NO: 458029 - DNA, 20 bp, Artificial
  CRISPR gRNA sequence
atcaatagggaaaatggttt

SEQ ID NO: 458030 - DNA, 20 bp, Artificial
  CRISPR gRNA sequence
aataagtttcaattaatcta

SEQ ID NO: 458031 - DNA, 20 bp, Artificial
  CRISPR gRNA sequence
ataagtttcaattaatctat

SEQ ID NO: 458032 - DNA, 20 bp, Artificial
  CRISPR gRNA sequence
caattaatctatgtgacaaa

SEQ ID NO: 458033 - DNA, 20 bp, Artificial
  CRISPR gRNA sequence
aattaatctatgtgacaaaa

SEQ ID NO: 458034 - DNA, 20 bp, Artificial
  CRISPR gRNA sequence
atctatgtgacaaaatatta

SEQ ID NO: 458035 - DNA, 20 bp, Artificial
  CRISPR gRNA sequence
tgtgacaaaatattatatat

SEQ ID NO: 458036 - DNA, 20 bp, Artificial
  CRISPR gRNA sequence
tatattattaaaagaatgag

SEQ ID NO: 458037 - DNA, 20 bp, Artificial
  CRISPR gRNA sequence
ttaaaagaatgagatacttc

SEQ ID NO: 458038 - DNA, 20 bp, Artificial
  CRISPR gRNA sequence
aaagaatgagatacttctat

SEQ ID NO: 458039 - DNA, 20 bp, Artificial
  CRISPR gRNA sequence
ctataaatatgggcctggag

SEQ ID NO: 458040 - DNA, 20 bp, Artificial
  CRISPR gRNA sequence
tataaatatgggcctggagg

SEQ ID NO: 458041 - DNA, 20 bp, Artificial
  CRISPR gRNA sequence
taaatatgggcctggaggga

SEQ ID NO: 458042 - DNA, 20 bp, Artificial
  CRISPR gRNA sequence
gagggatgttcatgatatag

SEQ ID NO: 458043 - DNA, 20 bp, Artificial
  CRISPR gRNA sequence
atgatatagcattaggtcaa

SEQ ID NO: 458044 - DNA, 20 bp, Artificial
  CRISPR gRNA sequence
ggtcaaaaagggcaaattgc

SEQ ID NO: 458045 - DNA, 20 bp, Artificial
  CRISPR gRNA sequence
caattatgtatataaaataa

SEQ ID NO: 458046 - DNA, 20 bp, Artificial
  CRISPR gRNA sequence
tgtatataaaataaatacat

SEQ ID NO: 458047 - DNA, 20 bp, Artificial
  CRISPR gRNA sequence
ttattttaaaaaatcctctc

SEQ ID NO: 458048 - DNA, 20 bp, Artificial
  CRISPR gRNA sequence
tattttaaaaaatcctctct

SEQ ID NO: 458049 - DNA, 20 bp, Artificial
  CRISPR gRNA sequence
attttaaaaaatcctctcta

SEQ ID NO: 458050 - DNA, 20 bp, Artificial
  CRISPR gRNA sequence
ttttaaaaaatcctctctat

SEQ ID NO: 458051 - DNA, 20 bp, Artificial
  CRISPR gRNA sequence
taaaaaatcctctctatgtg

SEQ ID NO: 458052 - DNA, 20 bp, Artificial
  CRISPR gRNA sequence
aaaaaatcctctctatgtgt

SEQ ID NO: 458053 - DNA, 20 bp, Artificial
  CRISPR gRNA sequence
aaaaatcctctctatgtgtg

SEQ ID NO: 458054 - DNA, 20 bp, Artificial
  CRISPR gRNA sequence
tctatgtgtgtatgtgtttt

SEQ ID NO: 458055 - DNA, 20 bp, Artificial
  CRISPR gRNA sequence
tatgtgtgtatgtgttttaa

SEQ ID NO: 458056 - DNA, 20 bp, Artificial
  CRISPR gRNA sequence
tgtgtgtatgtgttttaaaa

SEQ ID NO: 458057 - DNA, 20 bp, Artificial
  CRISPR gRNA sequence
taaaaatatatttaaggttt

SEQ ID NO: 458058 - DNA, 20 bp, Artificial
  CRISPR gRNA sequence
aaaaatatatttaaggtttt

SEQ ID NO: 458059 - DNA, 20 bp, Artificial
  CRISPR gRNA sequence
aaaatatatttaaggttttg

SEQ ID NO: 458060 - DNA, 20 bp, Artificial
  CRISPR gRNA sequence
aaggttttgtagtttataac

SEQ ID NO: 458061 - DNA, 20 bp, Artificial
  CRISPR gRNA sequence
aggttttgtagtttataact

SEQ ID NO: 458062 - DNA, 20 bp, Artificial
  CRISPR gRNA sequence
tgtagtttataacttttgaa

SEQ ID NO: 458063 - DNA, 20 bp, Artificial
  CRISPR gRNA sequence
gtagtttataacttttgaag

SEQ ID NO: 458064 - DNA, 20 bp, Artificial
  CRISPR gRNA sequence
tagtttataacttttgaagt

SEQ ID NO: 458065 - DNA, 20 bp, Artificial
  CRISPR gRNA sequence
ataacttttgaagtggtaat

SEQ ID NO: 458066 - DNA, 20 bp, Artificial
  CRISPR gRNA sequence
taacttttgaagtggtaatt

SEQ ID NO: 458067 - DNA, 20 bp, Artificial
  CRISPR gRNA sequence
ttgaagtggtaattacattc

SEQ ID NO: 458068 - DNA, 20 bp, Artificial
  CRISPR gRNA sequence
tgaagtggtaattacattca

SEQ ID NO: 458069 - DNA, 20 bp, Artificial
  CRISPR gRNA sequence
gaagtggtaattacattcac

SEQ ID NO: 458070 - DNA, 20 bp, Artificial
  CRISPR gRNA sequence
aagtggtaattacattcaca

SEQ ID NO: 458071 - DNA, 20 bp, Artificial
  CRISPR gRNA sequence
cattcacagcatttaaaatt

SEQ ID NO: 458072 - DNA, 20 bp, Artificial
  CRISPR gRNA sequence
acagcatttaaaattcaaaa

SEQ ID NO: 458073 - DNA, 20 bp, Artificial
  CRISPR gRNA sequence
aaaattcaaaaggggaaaac

SEQ ID NO: 458074 - DNA, 20 bp, Artificial
  CRISPR gRNA sequence
aaattcaaaaggggaaaaca

SEQ ID NO: 458075 - DNA, 20 bp, Artificial
  CRISPR gRNA sequence
aaaaggggaaaacaagaatt

SEQ ID NO: 458076 - DNA, 20 bp, Artificial
  CRISPR gRNA sequence
ttctataaatttatttttct

SEQ ID NO: 458077 - DNA, 20 bp, Artificial
  CRISPR gRNA sequence
tctataaatttatttttctg

SEQ ID NO: 458078 - DNA, 20 bp, Artificial
  CRISPR gRNA sequence
ctataaatttatttttctga

SEQ ID NO: 458079 - DNA, 20 bp, Artificial
  CRISPR gRNA sequence
tataaatttatttttctgat

SEQ ID NO: 458080 - DNA, 20 bp, Artificial
  CRISPR gRNA sequence
taaatttatttttctgattt

SEQ ID NO: 458081 - DNA, 20 bp, Artificial
  CRISPR gRNA sequence
atttttctgatttttataat

SEQ ID NO: 458082 - DNA, 20 bp, Artificial
  CRISPR gRNA sequence
tttttctgatttttataatc

SEQ ID NO: 458083 - DNA, 20 bp, Artificial
  CRISPR gRNA sequence
ttctgatttttataatcagc

SEQ ID NO: 458084 - DNA, 20 bp, Artificial
  CRISPR gRNA sequence
tctgatttttataatcagct

SEQ ID NO: 458085 - DNA, 20 bp, Artificial
  CRISPR gRNA sequence
ctgatttttataatcagctt

SEQ ID NO: 458086 - DNA, 20 bp, Artificial
  CRISPR gRNA sequence
tgatttttataatcagcttg

SEQ ID NO: 458087 - DNA, 20 bp, Artificial
  CRISPR gRNA sequence
atttttataatcagcttgtc

SEQ ID NO: 458088 - DNA, 20 bp, Artificial
  CRISPR gRNA sequence
ttataatcagcttgtctagt

SEQ ID NO: 458089 - DNA, 20 bp, Artificial
  CRISPR gRNA sequence
tataatcagcttgtctagtc

SEQ ID NO: 458090 - DNA, 20 bp, Artificial
  CRISPR gRNA sequence
ataatcagcttgtctagtct

SEQ ID NO: 458091 - DNA, 20 bp, Artificial
  CRISPR gRNA sequence
taatcagcttgtctagtctt

SEQ ID NO: 458092 - DNA, 20 bp, Artificial
  CRISPR gRNA sequence
gtctagtcttgcccttccta

SEQ ID NO: 458093 - DNA, 20 bp, Artificial
  CRISPR gRNA sequence
tctagtcttgcccttcctac

SEQ ID NO: 458094 - DNA, 20 bp, Artificial
  CRISPR gRNA sequence
gtcttgcccttcctactgtg

SEQ ID NO: 458095 - DNA, 20 bp, Artificial
  CRISPR gRNA sequence
gcccttcctactgtgtgtac

SEQ ID NO: 458096 - DNA, 20 bp, Artificial
  CRISPR gRNA sequence
cccttcctactgtgtgtacc

SEQ ID NO: 458097 - DNA, 20 bp, Artificial
  CRISPR gRNA sequence
cctactgtgtgtaccatcaa

SEQ ID NO: 458098 - DNA, 20 bp, Artificial
  CRISPR gRNA sequence
ctactgtgtgtaccatcaag

SEQ ID NO: 458099 - DNA, 20 bp, Artificial
  CRISPR gRNA sequence
ctgtgtgtaccatcaagaaa

SEQ ID NO: 458100 - DNA, 20 bp, Artificial
  CRISPR gRNA sequence
tgtgtaccatcaagaaaaag

SEQ ID NO: 458101 - DNA, 20 bp, Artificial
  CRISPR gRNA sequence
ttggtattttaaaattggga

SEQ ID NO: 458102 - DNA, 20 bp, Artificial
  CRISPR gRNA sequence
gtattttaaaattgggatat

SEQ ID NO: 458103 - DNA, 20 bp, Artificial
  CRISPR gRNA sequence
taaaattgggatatgttcaa

SEQ ID NO: 458104 - DNA, 20 bp, Artificial
  CRISPR gRNA sequence
aaaattgggatatgttcaat

SEQ ID NO: 458105 - DNA, 20 bp, Artificial
  CRISPR gRNA sequence
aaattgggatatgttcaatt

SEQ ID NO: 458106 - DNA, 20 bp, Artificial
  CRISPR gRNA sequence
ggatatgttcaatttatatt

SEQ ID NO: 458107 - DNA, 20 bp, Artificial
  CRISPR gRNA sequence
aatttatattttaacttagg

SEQ ID NO: 458108 - DNA, 20 bp, Artificial
  CRISPR gRNA sequence
atattttaacttagggagaa

SEQ ID NO: 458109 - DNA, 20 bp, Artificial
  CRISPR gRNA sequence
tattttaacttagggagaac

SEQ ID NO: 458110 - DNA, 20 bp, Artificial
  CRISPR gRNA sequence
taacttagggagaactgaat

SEQ ID NO: 458111 - DNA, 20 bp, Artificial
  CRISPR gRNA sequence
aacttagggagaactgaatt

SEQ ID NO: 458112 - DNA, 20 bp, Artificial
  CRISPR gRNA sequence
acttagggagaactgaattt

SEQ ID NO: 458113 - DNA, 20 bp, Artificial
  CRISPR gRNA sequence
agggagaactgaatttgttg

SEQ ID NO: 458114 - DNA, 20 bp, Artificial
  CRISPR gRNA sequence
gggagaactgaatttgttgt

SEQ ID NO: 458115 - DNA, 20 bp, Artificial
  CRISPR gRNA sequence
aatttgttgtgacattgatt

SEQ ID NO: 458116 - DNA, 20 bp, Artificial
  CRISPR gRNA sequence
gttgtgacattgattctttt

SEQ ID NO: 458117 - DNA, 20 bp, Artificial
  CRISPR gRNA sequence
ttgtgacattgattcttttg

SEQ ID NO: 458118 - DNA, 20 bp, Artificial
  CRISPR gRNA sequence
tgacattgattcttttgatc

SEQ ID NO: 458119 - DNA, 20 bp, Artificial
  CRISPR gRNA sequence
attcttttgatccgagaatg

SEQ ID NO: 458120 - DNA, 20 bp, Artificial
  CRISPR gRNA sequence
ttttgatccgagaatgtgat

SEQ ID NO: 458121 - DNA, 20 bp, Artificial
  CRISPR gRNA sequence
ttgatccgagaatgtgatat

SEQ ID NO: 458122 - DNA, 20 bp, Artificial
  CRISPR gRNA sequence
tgatccgagaatgtgatatt

SEQ ID NO: 458123 - DNA, 20 bp, Artificial
  CRISPR gRNA sequence
gatccgagaatgtgatattc

SEQ ID NO: 458124 - DNA, 20 bp, Artificial
  CRISPR gRNA sequence
atccgagaatgtgatattca

SEQ ID NO: 458125 - DNA, 20 bp, Artificial
  CRISPR gRNA sequence
atttttcaaatatgtgtgtc

SEQ ID NO: 458126 - DNA, 20 bp, Artificial
  CRISPR gRNA sequence
ttcaaatatgtgtgtctcag

SEQ ID NO: 458127 - DNA, 20 bp, Artificial
  CRISPR gRNA sequence
tcaaatatgtgtgtctcagg

SEQ ID NO: 458128 - DNA, 20 bp, Artificial
  CRISPR gRNA sequence
caaatatgtgtgtctcaggt

SEQ ID NO: 458129 - DNA, 20 bp, Artificial
  CRISPR gRNA sequence
aaatatgtgtgtctcaggta

SEQ ID NO: 458130 - DNA, 20 bp, Artificial
  CRISPR gRNA sequence
aggtatgtatagaagttttc

SEQ ID NO: 458131 - DNA, 20 bp, Artificial
  CRISPR gRNA sequence
tcttcataaagtcctcgtcc

SEQ ID NO: 458132 - DNA, 20 bp, Artificial
  CRISPR gRNA sequence
cttcataaagtcctcgtcca

SEQ ID NO: 458133 - DNA, 20 bp, Artificial
  CRISPR gRNA sequence
ttcataaagtcctcgtccat

SEQ ID NO: 458134 - DNA, 20 bp, Artificial
  CRISPR gRNA sequence
cataaagtcctcgtccattt

SEQ ID NO: 458135 - DNA, 20 bp, Artificial
  CRISPR gRNA sequence
ataaagtcctcgtccatttc

SEQ ID NO: 458136 - DNA, 20 bp, Artificial
  CRISPR gRNA sequence
gtccatttcttagctaagtt

SEQ ID NO: 458137 - DNA, 20 bp, Artificial
  CRISPR gRNA sequence
cttagctaagtttgtttctt

SEQ ID NO: 458138 - DNA, 20 bp, Artificial
  CRISPR gRNA sequence
ttagctaagtttgtttcttg

SEQ ID NO: 458139 - DNA, 20 bp, Artificial
  CRISPR gRNA sequence
agctaagtttgtttcttgag

SEQ ID NO: 458140 - DNA, 20 bp, Artificial
  CRISPR gRNA sequence
gctaagtttgtttcttgagt

SEQ ID NO: 458141 - DNA, 20 bp, Artificial
  CRISPR gRNA sequence
agtttgtttcttgagtaatt

SEQ ID NO: 458142 - DNA, 20 bp, Artificial
  CRISPR gRNA sequence
gtttcttgagtaattcatat

SEQ ID NO: 458143 - DNA, 20 bp, Artificial
  CRISPR gRNA sequence
tttcttgagtaattcatatt

SEQ ID NO: 458144 - DNA, 20 bp, Artificial
  CRISPR gRNA sequence
cttgagtaattcatattttt

SEQ ID NO: 458145 - DNA, 20 bp, Artificial
  CRISPR gRNA sequence
ttgagtaattcatatttttt

SEQ ID NO: 458146 - DNA, 20 bp, Artificial
  CRISPR gRNA sequence
gagtaattcatattttttca

SEQ ID NO: 458147 - DNA, 20 bp, Artificial
  CRISPR gRNA sequence
agtaattcatattttttcac

SEQ ID NO: 458148 - DNA, 20 bp, Artificial
  CRISPR gRNA sequence
atattttttcactattgaaa

SEQ ID NO: 458149 - DNA, 20 bp, Artificial
  CRISPR gRNA sequence
tttcactattgaaaatgtca

SEQ ID NO: 458150 - DNA, 20 bp, Artificial
  CRISPR gRNA sequence
ttcactattgaaaatgtcat

SEQ ID NO: 458151 - DNA, 20 bp, Artificial
  CRISPR gRNA sequence
tcactattgaaaatgtcatc

SEQ ID NO: 458152 - DNA, 20 bp, Artificial
  CRISPR gRNA sequence
cactattgaaaatgtcatct

SEQ ID NO: 458153 - DNA, 20 bp, Artificial
  CRISPR gRNA sequence
actattgaaaatgtcatctt

SEQ ID NO: 458154 - DNA, 20 bp, Artificial
  CRISPR gRNA sequence
ttgaaaatgtcatcttttac

SEQ ID NO: 458155 - DNA, 20 bp, Artificial
  CRISPR gRNA sequence
aaaatgtcatcttttaccca

SEQ ID NO: 458156 - DNA, 20 bp, Artificial
  CRISPR gRNA sequence
ttacccattatatctttttt

SEQ ID NO: 458157 - DNA, 20 bp, Artificial
  CRISPR gRNA sequence
tacccattatatcttttttt

SEQ ID NO: 458158 - DNA, 20 bp, Artificial
  CRISPR gRNA sequence
acccattatatctttttttt

SEQ ID NO: 458159 - DNA, 20 bp, Artificial
  CRISPR gRNA sequence
cccattatatctttttttta

SEQ ID NO: 458160 - DNA, 20 bp, Artificial
  CRISPR gRNA sequence
tatcttttttttaatatact

SEQ ID NO: 458161 - DNA, 20 bp, Artificial
  CRISPR gRNA sequence
ttttttaatatactttaagt

SEQ ID NO: 458162 - DNA, 20 bp, Artificial
  CRISPR gRNA sequence
tttttaatatactttaagtt

SEQ ID NO: 458163 - DNA, 20 bp, Artificial
  CRISPR gRNA sequence
ttttaatatactttaagttc

SEQ ID NO: 458164 - DNA, 20 bp, Artificial
  CRISPR gRNA sequence
tttaatatactttaagttct

SEQ ID NO: 458165 - DNA, 20 bp, Artificial
  CRISPR gRNA sequence
ttaatatactttaagttcta

SEQ ID NO: 458166 - DNA, 20 bp, Artificial
  CRISPR gRNA sequence
taatatactttaagttctag

SEQ ID NO: 458167 - DNA, 20 bp, Artificial
  CRISPR gRNA sequence
aatatactttaagttctagg

SEQ ID NO: 458168 - DNA, 20 bp, Artificial
  CRISPR gRNA sequence
atatactttaagttctaggg

SEQ ID NO: 458169 - DNA, 20 bp, Artificial
  CRISPR gRNA sequence
taagttctagggtacatgtg

SEQ ID NO: 458170 - DNA, 20 bp, Artificial
  CRISPR gRNA sequence
aagttctagggtacatgtgc

SEQ ID NO: 458171 - DNA, 20 bp, Artificial
  CRISPR gRNA sequence
agttctagggtacatgtgca

SEQ ID NO: 458172 - DNA, 20 bp, Artificial
  CRISPR gRNA sequence
tagggtacatgtgcacaatg

SEQ ID NO: 458173 - DNA, 20 bp, Artificial
  CRISPR gRNA sequence
gggtacatgtgcacaatgtg

SEQ ID NO: 458174 - DNA, 20 bp, Artificial
  CRISPR gRNA sequence
gttacatagttgtacatgtt

SEQ ID NO: 458175 - DNA, 20 bp, Artificial
  CRISPR gRNA sequence
ttacatagttgtacatgttt

SEQ ID NO: 458176 - DNA, 20 bp, Artificial
  CRISPR gRNA sequence
catagttgtacatgtttcat

SEQ ID NO: 458177 - DNA, 20 bp, Artificial
  CRISPR gRNA sequence
tacatgtttcatgttggttt

SEQ ID NO: 458178 - DNA, 20 bp, Artificial
  CRISPR gRNA sequence
catgttggtttgctgcaccc

SEQ ID NO: 458179 - DNA, 20 bp, Artificial
  CRISPR gRNA sequence
atgttggtttgctgcaccca

SEQ ID NO: 458180 - DNA, 20 bp, Artificial
  CRISPR gRNA sequence
gtttgctgcacccatcaact

SEQ ID NO: 458181 - DNA, 20 bp, Artificial
  CRISPR gRNA sequence
gctgcacccatcaacttgtc

SEQ ID NO: 458182 - DNA, 20 bp, Artificial
  CRISPR gRNA sequence
ctgcacccatcaacttgtca

SEQ ID NO: 458183 - DNA, 20 bp, Artificial
  CRISPR gRNA sequence
cacccatcaacttgtcattt

SEQ ID NO: 458184 - DNA, 20 bp, Artificial
  CRISPR gRNA sequence
gtcatttacattaggtattt

SEQ ID NO: 458185 - DNA, 20 bp, Artificial
  CRISPR gRNA sequence
tcatttacattaggtatttc

SEQ ID NO: 458186 - DNA, 20 bp, Artificial
  CRISPR gRNA sequence
acattaggtatttctcctaa

SEQ ID NO: 458187 - DNA, 20 bp, Artificial
  CRISPR gRNA sequence
cattaggtatttctcctaat

SEQ ID NO: 458188 - DNA, 20 bp, Artificial
  CRISPR gRNA sequence
ggtatttctcctaatgctat

SEQ ID NO: 458189 - DNA, 20 bp, Artificial
  CRISPR gRNA sequence
ctcctaatgctatccctccc

SEQ ID NO: 458190 - DNA, 20 bp, Artificial
  CRISPR gRNA sequence
tcctaatgctatccctcccc

SEQ ID NO: 458191 - DNA, 20 bp, Artificial
  CRISPR gRNA sequence
ctaatgctatccctcccccg

SEQ ID NO: 458192 - DNA, 20 bp, Artificial
  CRISPR gRNA sequence
atgctatccctcccccgggc

SEQ ID NO: 458193 - DNA, 20 bp, Artificial
  CRISPR gRNA sequence
tccctcccccgggcccccac

SEQ ID NO: 458194 - DNA, 20 bp, Artificial
  CRISPR gRNA sequence
ccccgggcccccacccgtgg

SEQ ID NO: 458195 - DNA, 20 bp, Artificial
  CRISPR gRNA sequence
cccaccctgggttcatgtgt

SEQ ID NO: 458196 - DNA, 20 bp, Artificial
  CRISPR gRNA sequence
ggttcatgtgttctcattgt

SEQ ID NO: 458197 - DNA, 20 bp, Artificial
  CRISPR gRNA sequence
atgtgttctcattgttcaac

SEQ ID NO: 458198 - DNA, 20 bp, Artificial
  CRISPR gRNA sequence
tcattgttcaactcctactt

SEQ ID NO: 458199 - DNA, 20 bp, Artificial
  CRISPR gRNA sequence
attgttcaactcctacttat

SEQ ID NO: 458200 - DNA, 20 bp, Artificial
  CRISPR gRNA sequence
ttcaactcctacttatgagc

SEQ ID NO: 458201 - DNA, 20 bp, Artificial
  CRISPR gRNA sequence
aactcctacttatgagcgag

SEQ ID NO: 458202 - DNA, 20 bp, Artificial
  CRISPR gRNA sequence
ctacttatgagcgagaacat

SEQ ID NO: 458203 - DNA, 20 bp, Artificial
  CRISPR gRNA sequence
cttatgagcgagaacatgca

SEQ ID NO: 458204 - DNA, 20 bp, Artificial
  CRISPR gRNA sequence
atgagcgagaacatgcagtg

SEQ ID NO: 458205 - DNA, 20 bp, Artificial
  CRISPR gRNA sequence
tgagcgagaacatgcagtgt

SEQ ID NO: 458206 - DNA, 20 bp, Artificial
  CRISPR gRNA sequence
ggtttcctgtccttgtgaca

SEQ ID NO: 458207 - DNA, 20 bp, Artificial
  CRISPR gRNA sequence
gtttcctgtccttgtgacag

SEQ ID NO: 458208 - DNA, 20 bp, Artificial
  CRISPR gRNA sequence
cctgtccttgtgacagtttg

SEQ ID NO: 458209 - DNA, 20 bp, Artificial
  CRISPR gRNA sequence
ctgtccttgtgacagtttgc

SEQ ID NO: 458210 - DNA, 20 bp, Artificial
  CRISPR gRNA sequence
tccttgtgacagtttgctta

SEQ ID NO: 458211 - DNA, 20 bp, Artificial
  CRISPR gRNA sequence
gtgacagtttgcttagaatg

SEQ ID NO: 458212 - DNA, 20 bp, Artificial
  CRISPR gRNA sequence
tgacagtttgcttagaatga

SEQ ID NO: 458213 - DNA, 20 bp, Artificial
  CRISPR gRNA sequence
gcttagaatgatggtttcca

SEQ ID NO: 458214 - DNA, 20 bp, Artificial
  CRISPR gRNA sequence
cttagaatgatggtttccag

SEQ ID NO: 458215 - DNA, 20 bp, Artificial
  CRISPR gRNA sequence
agaatgatggtttccagctt

SEQ ID NO: 458216 - DNA, 20 bp, Artificial
  CRISPR gRNA sequence
gaatgatggtttccagcttc

SEQ ID NO: 458217 - DNA, 20 bp, Artificial
  CRISPR gRNA sequence
ccagcttcatctatgtccct

SEQ ID NO: 458218 - DNA, 20 bp, Artificial
  CRISPR gRNA sequence
cagcttcatctatgtccctg

SEQ ID NO: 458219 - DNA, 20 bp, Artificial
  CRISPR gRNA sequence
catctatgtccctgcaaagg

SEQ ID NO: 458220 - DNA, 20 bp, Artificial
  CRISPR gRNA sequence
atctatgtccctgcaaagga

SEQ ID NO: 458221 - DNA, 20 bp, Artificial
  CRISPR gRNA sequence
tgtccctgcaaaggacatga

SEQ ID NO: 458222 - DNA, 20 bp, Artificial
  CRISPR gRNA sequence
caaaggacatgaactcatcc

SEQ ID NO: 458223 - DNA, 20 bp, Artificial
  CRISPR gRNA sequence
atccttttttatggctgcat

SEQ ID NO: 458224 - DNA, 20 bp, Artificial
  CRISPR gRNA sequence
ttttatggctgcatagtatt

SEQ ID NO: 458225 - DNA, 20 bp, Artificial
  CRISPR gRNA sequence
tttatggctgcatagtattc

SEQ ID NO: 458226 - DNA, 20 bp, Artificial
  CRISPR gRNA sequence
ttatggctgcatagtattcc

SEQ ID NO: 458227 - DNA, 20 bp, Artificial
  CRISPR gRNA sequence
tatggctgcatagtattcca

SEQ ID NO: 458228 - DNA, 20 bp, Artificial
  CRISPR gRNA sequence
atggctgcatagtattccat

SEQ ID NO: 458229 - DNA, 20 bp, Artificial
  CRISPR gRNA sequence
tggctgcatagtattccatg

SEQ ID NO: 458230 - DNA, 20 bp, Artificial
  CRISPR gRNA sequence
catagtattccatggtgtat

SEQ ID NO: 458231 - DNA, 20 bp, Artificial
  CRISPR gRNA sequence
catggtgtatatgtgccaca

SEQ ID NO: 458232 - DNA, 20 bp, Artificial
  CRISPR gRNA sequence
tcttaatccagtctatcatt

SEQ ID NO: 458233 - DNA, 20 bp, Artificial
  CRISPR gRNA sequence
cttaatccagtctatcattg

SEQ ID NO: 458234 - DNA, 20 bp, Artificial
  CRISPR gRNA sequence
ttaatccagtctatcattga

SEQ ID NO: 458235 - DNA, 20 bp, Artificial
  CRISPR gRNA sequence
aatccagtctatcattgatg

SEQ ID NO: 458236 - DNA, 20 bp, Artificial
  CRISPR gRNA sequence
atccagtctatcattgatgg

SEQ ID NO: 458237 - DNA, 20 bp, Artificial
  CRISPR gRNA sequence
tcattgatggacatttgggt

SEQ ID NO: 458238 - DNA, 20 bp, Artificial
  CRISPR gRNA sequence
atggacatttgggttggttc

SEQ ID NO: 458239 - DNA, 20 bp, Artificial
  CRISPR gRNA sequence
gggttggttcccaggctttg

SEQ ID NO: 458240 - DNA, 20 bp, Artificial
  CRISPR gRNA sequence
ggttggttcccaggctttgc

SEQ ID NO: 458241 - DNA, 20 bp, Artificial
  CRISPR gRNA sequence
gttcccaggctttgctattg

SEQ ID NO: 458242 - DNA, 20 bp, Artificial
  CRISPR gRNA sequence
ccaggctttgctattgtgaa

SEQ ID NO: 458243 - DNA, 20 bp, Artificial
  CRISPR gRNA sequence
tgctattgtgaatagtacca

SEQ ID NO: 458244 - DNA, 20 bp, Artificial
  CRISPR gRNA sequence
gctattgtgaatagtaccac

SEQ ID NO: 458245 - DNA, 20 bp, Artificial
  CRISPR gRNA sequence
ctattgtgaatagtaccaca

SEQ ID NO: 458246 - DNA, 20 bp, Artificial
  CRISPR gRNA sequence
ttgtgaatagtaccacaata

SEQ ID NO: 458247 - DNA, 20 bp, Artificial
  CRISPR gRNA sequence
tgaatagtaccacaataaac

SEQ ID NO: 458248 - DNA, 20 bp, Artificial
  CRISPR gRNA sequence
gtgcatctttatcgtagaat

SEQ ID NO: 458249 - DNA, 20 bp, Artificial
  CRISPR gRNA sequence
tgcatctttatcgtagaatg

SEQ ID NO: 458250 - DNA, 20 bp, Artificial
  CRISPR gRNA sequence
tatcgtagaatgatttataa

SEQ ID NO: 458251 - DNA, 20 bp, Artificial
  CRISPR gRNA sequence
atcgtagaatgatttataat

SEQ ID NO: 458252 - DNA, 20 bp, Artificial
  CRISPR gRNA sequence
tcgtagaatgatttataatc

SEQ ID NO: 458253 - DNA, 20 bp, Artificial
  CRISPR gRNA sequence
ataatcctttgggtatatgc

SEQ ID NO: 458254 - DNA, 20 bp, Artificial
  CRISPR gRNA sequence
taatcctttgggtatatgcc

SEQ ID NO: 458255 - DNA, 20 bp, Artificial
  CRISPR gRNA sequence
tgggtatatgcccagtaatg

SEQ ID NO: 458256 - DNA, 20 bp, Artificial
  CRISPR gRNA sequence
gggtatatgcccagtaatga

SEQ ID NO: 458257 - DNA, 20 bp, Artificial
  CRISPR gRNA sequence
ggtatatgcccagtaatgag

SEQ ID NO: 458258 - DNA, 20 bp, Artificial
  CRISPR gRNA sequence
ctgggtcaaatggtatttct

SEQ ID NO: 458259 - DNA, 20 bp, Artificial
  CRISPR gRNA sequence
ggtcaaatggtatttctagt

SEQ ID NO: 458260 - DNA, 20 bp, Artificial
  CRISPR gRNA sequence
ctagttctagatccttgagg

SEQ ID NO: 458261 - DNA, 20 bp, Artificial
  CRISPR gRNA sequence
tagttctagatccttgagga

SEQ ID NO: 458262 - DNA, 20 bp, Artificial
  CRISPR gRNA sequence
gttctagatccttgaggaat

SEQ ID NO: 458263 - DNA, 20 bp, Artificial
  CRISPR gRNA sequence
tagatccttgaggaatcccc

SEQ ID NO: 458264 - DNA, 20 bp, Artificial
  CRISPR gRNA sequence
gatccttgaggaatccccac

SEQ ID NO: 458265 - DNA, 20 bp, Artificial
  CRISPR gRNA sequence
gaggaatccccacactgtct

SEQ ID NO: 458266 - DNA, 20 bp, Artificial
  CRISPR gRNA sequence
aggaatccccacactgtctt

SEQ ID NO: 458267 - DNA, 20 bp, Artificial
  CRISPR gRNA sequence
tcttccacagtggttgaact

SEQ ID NO: 458268 - DNA, 20 bp, Artificial
  CRISPR gRNA sequence
ccacagtggttgaactaatt

SEQ ID NO: 458269 - DNA, 20 bp, Artificial
  CRISPR gRNA sequence
cacagtggttgaactaattt

SEQ ID NO: 458270 - DNA, 20 bp, Artificial
  CRISPR gRNA sequence
aactaatttacactcccatc

SEQ ID NO: 458271 - DNA, 20 bp, Artificial
  CRISPR gRNA sequence
atttacactcccatcaacag

SEQ ID NO: 458272 - DNA, 20 bp, Artificial
  CRISPR gRNA sequence
acactcccatcaacagtgta

SEQ ID NO: 458273 - DNA, 20 bp, Artificial
  CRISPR gRNA sequence
cactcccatcaacagtgtaa

SEQ ID NO: 458274 - DNA, 20 bp, Artificial
  CRISPR gRNA sequence
ccatcaacagtgtaaaagca

SEQ ID NO: 458275 - DNA, 20 bp, Artificial
  CRISPR gRNA sequence
ctatttctccacatcttctc

SEQ ID NO: 458276 - DNA, 20 bp, Artificial
  CRISPR gRNA sequence
tttctccacatcttctccag

SEQ ID NO: 458277 - DNA, 20 bp, Artificial
  CRISPR gRNA sequence
ctccacatcttctccagcat

SEQ ID NO: 458278 - DNA, 20 bp, Artificial
  CRISPR gRNA sequence
tccacatcttctccagcatc

SEQ ID NO: 458279 - DNA, 20 bp, Artificial
  CRISPR gRNA sequence
cacatcttctccagcatctg

SEQ ID NO: 458280 - DNA, 20 bp, Artificial
  CRISPR gRNA sequence
ctccagcatctgttgtttcc

SEQ ID NO: 458281 - DNA, 20 bp, Artificial
  CRISPR gRNA sequence
tccagcatctgttgtttcca

SEQ ID NO: 458282 - DNA, 20 bp, Artificial
  CRISPR gRNA sequence
cagcatctgttgtttccact

SEQ ID NO: 458283 - DNA, 20 bp, Artificial
  CRISPR gRNA sequence
ttgtttccactcgttgtatc

SEQ ID NO: 458284 - DNA, 20 bp, Artificial
  CRISPR gRNA sequence
tttccactcgttgtatcttt

SEQ ID NO: 458285 - DNA, 20 bp, Artificial
  CRISPR gRNA sequence
ccactcgttgtatcttttaa

SEQ ID NO: 458286 - DNA, 20 bp, Artificial
  CRISPR gRNA sequence
cactcgttgtatcttttaac

SEQ ID NO: 458287 - DNA, 20 bp, Artificial
  CRISPR gRNA sequence
gttgtatcttttaacttatt

SEQ ID NO: 458288 - DNA, 20 bp, Artificial
  CRISPR gRNA sequence
tatcttttaacttatttttt

SEQ ID NO: 458289 - DNA, 20 bp, Artificial
  CRISPR gRNA sequence
ttaacttattttttcagtct

SEQ ID NO: 458290 - DNA, 20 bp, Artificial
  CRISPR gRNA sequence
taacttattttttcagtctc

SEQ ID NO: 458291 - DNA, 20 bp, Artificial
  CRISPR gRNA sequence
aacttattttttcagtctct

SEQ ID NO: 458292 - DNA, 20 bp, Artificial
  CRISPR gRNA sequence
acttattttttcagtctctt

SEQ ID NO: 458293 - DNA, 20 bp, Artificial
  CRISPR gRNA sequence
attttttcagtctctttata

SEQ ID NO: 458294 - DNA, 20 bp, Artificial
  CRISPR gRNA sequence
ttttttcagtctctttatat

SEQ ID NO: 458295 - DNA, 20 bp, Artificial
  CRISPR gRNA sequence
tttcagtctctttatatcat

SEQ ID NO: 458296 - DNA, 20 bp, Artificial
  CRISPR gRNA sequence
ttcagtctctttatatcatt

SEQ ID NO: 458297 - DNA, 20 bp, Artificial
  CRISPR gRNA sequence
tcagtctctttatatcattc

SEQ ID NO: 458298 - DNA, 20 bp, Artificial
  CRISPR gRNA sequence
cagtctctttatatcattca

SEQ ID NO: 458299 - DNA, 20 bp, Artificial
  CRISPR gRNA sequence
agtctctttatatcattcat

SEQ ID NO: 458300 - DNA, 20 bp, Artificial
  CRISPR gRNA sequence
tttatatcattcattatatc

SEQ ID NO: 458301 - DNA, 20 bp, Artificial
  CRISPR gRNA sequence
tatatcattcattatatctt

SEQ ID NO: 458302 - DNA, 20 bp, Artificial
  CRISPR gRNA sequence
atatcattcattatatcttt

SEQ ID NO: 458303 - DNA, 20 bp, Artificial
  CRISPR gRNA sequence
tatcattcattatatctttt

SEQ ID NO: 458304 - DNA, 20 bp, Artificial
  CRISPR gRNA sequence
attatatcttttaatttttc

SEQ ID NO: 458305 - DNA, 20 bp, Artificial
  CRISPR gRNA sequence
tatcttttaatttttcatta

SEQ ID NO: 458306 - DNA, 20 bp, Artificial
  CRISPR gRNA sequence
ttaatttttcattattgttc

SEQ ID NO: 458307 - DNA, 20 bp, Artificial
  CRISPR gRNA sequence
taatttttcattattgttca

SEQ ID NO: 458308 - DNA, 20 bp, Artificial
  CRISPR gRNA sequence
aatttttcattattgttcat

SEQ ID NO: 458309 - DNA, 20 bp, Artificial
  CRISPR gRNA sequence
atttttcattattgttcata

SEQ ID NO: 458310 - DNA, 20 bp, Artificial
  CRISPR gRNA sequence
ttcattattgttcatatatg

SEQ ID NO: 458311 - DNA, 20 bp, Artificial
  CRISPR gRNA sequence
tcattattgttcatatatga

SEQ ID NO: 458312 - DNA, 20 bp, Artificial
  CRISPR gRNA sequence
cattattgttcatatatgaa

SEQ ID NO: 458313 - DNA, 20 bp, Artificial
  CRISPR gRNA sequence
attattgttcatatatgaaa

SEQ ID NO: 458314 - DNA, 20 bp, Artificial
  CRISPR gRNA sequence
ttgttcatatatgaaaggct

SEQ ID NO: 458315 - DNA, 20 bp, Artificial
  CRISPR gRNA sequence
ttcatatatgaaaggctatt

SEQ ID NO: 458316 - DNA, 20 bp, Artificial
  CRISPR gRNA sequence
atatatgaaaggctatttgt

SEQ ID NO: 458317 - DNA, 20 bp, Artificial
  CRISPR gRNA sequence
tttgttttactagatattaa

SEQ ID NO: 458318 - DNA, 20 bp, Artificial
  CRISPR gRNA sequence
gttttactagatattaattt

SEQ ID NO: 458319 - DNA, 20 bp, Artificial
  CRISPR gRNA sequence
ttttactagatattaatttc

SEQ ID NO: 458320 - DNA, 20 bp, Artificial
  CRISPR gRNA sequence
tactagatattaatttcata

SEQ ID NO: 458321 - DNA, 20 bp, Artificial
  CRISPR gRNA sequence
actagatattaatttcatac

SEQ ID NO: 458322 - DNA, 20 bp, Artificial
  CRISPR gRNA sequence
ctagatattaatttcatacc

SEQ ID NO: 458323 - DNA, 20 bp, Artificial
  CRISPR gRNA sequence
gatattaatttcatacccag

SEQ ID NO: 458324 - DNA, 20 bp, Artificial
  CRISPR gRNA sequence
atttcatacccagctcccct

SEQ ID NO: 458325 - DNA, 20 bp, Artificial
  CRISPR gRNA sequence
catacccagctcccctccct

SEQ ID NO: 458326 - DNA, 20 bp, Artificial
  CRISPR gRNA sequence
atacccagctcccctccctt

SEQ ID NO: 458327 - DNA, 20 bp, Artificial
  CRISPR gRNA sequence
ccctcccttaattctatcat

SEQ ID NO: 458328 - DNA, 20 bp, Artificial
  CRISPR gRNA sequence
ccttaattctatcatttttc

SEQ ID NO: 458329 - DNA, 20 bp, Artificial
  CRISPR gRNA sequence
aattctatcatttttcagtt

SEQ ID NO: 458330 - DNA, 20 bp, Artificial
  CRISPR gRNA sequence
attctatcatttttcagttg

SEQ ID NO: 458331 - DNA, 20 bp, Artificial
  CRISPR gRNA sequence
tatcatttttcagttgattc

SEQ ID NO: 458332 - DNA, 20 bp, Artificial
  CRISPR gRNA sequence
tcatttttcagttgattctc

SEQ ID NO: 458333 - DNA, 20 bp, Artificial
  CRISPR gRNA sequence
ttcagttgattctcttggat

SEQ ID NO: 458334 - DNA, 20 bp, Artificial
  CRISPR gRNA sequence
tcagttgattctcttggatt

SEQ ID NO: 458335 - DNA, 20 bp, Artificial
  CRISPR gRNA sequence
cagttgattctcttggattt

SEQ ID NO: 458336 - DNA, 20 bp, Artificial
  CRISPR gRNA sequence
agttgattctcttggatttt

SEQ ID NO: 458337 - DNA, 20 bp, Artificial
  CRISPR gRNA sequence
attctcttggattttccagt

SEQ ID NO: 458338 - DNA, 20 bp, Artificial
  CRISPR gRNA sequence
tcttggattttccagttatg

SEQ ID NO: 458339 - DNA, 20 bp, Artificial
  CRISPR gRNA sequence
ttggattttccagttatgca

SEQ ID NO: 458340 - DNA, 20 bp, Artificial
  CRISPR gRNA sequence
ggattttccagttatgcaat

SEQ ID NO: 458341 - DNA, 20 bp, Artificial
  CRISPR gRNA sequence
gattttccagttatgcaatc

SEQ ID NO: 458342 - DNA, 20 bp, Artificial
  CRISPR gRNA sequence
tccagttatgcaatcatatt

SEQ ID NO: 458343 - DNA, 20 bp, Artificial
  CRISPR gRNA sequence
ccagttatgcaatcatatta

SEQ ID NO: 458344 - DNA, 20 bp, Artificial
  CRISPR gRNA sequence
cagttatgcaatcatattat

SEQ ID NO: 458345 - DNA, 20 bp, Artificial
  CRISPR gRNA sequence
tgcaatcatattatgtgtac

SEQ ID NO: 458346 - DNA, 20 bp, Artificial
  CRISPR gRNA sequence
tgtgtacataatgataatta

SEQ ID NO: 458347 - DNA, 20 bp, Artificial
  CRISPR gRNA sequence
cttccttttctattttatat

SEQ ID NO: 458348 - DNA, 20 bp, Artificial
  CRISPR gRNA sequence
ccttttctattttatatctc

SEQ ID NO: 458349 - DNA, 20 bp, Artificial
  CRISPR gRNA sequence
cttttctattttatatctct

SEQ ID NO: 458350 - DNA, 20 bp, Artificial
  CRISPR gRNA sequence
ttctattttatatctctgat

SEQ ID NO: 458351 - DNA, 20 bp, Artificial
  CRISPR gRNA sequence
tctattttatatctctgatt

SEQ ID NO: 458352 - DNA, 20 bp, Artificial
  CRISPR gRNA sequence
ctattttatatctctgattt

SEQ ID NO: 458353 - DNA, 20 bp, Artificial
  CRISPR gRNA sequence
tattttatatctctgatttc

SEQ ID NO: 458354 - DNA, 20 bp, Artificial
  CRISPR gRNA sequence
ttttatatctctgatttctt

SEQ ID NO: 458355 - DNA, 20 bp, Artificial
  CRISPR gRNA sequence
tatatctctgatttctttct

SEQ ID NO: 458356 - DNA, 20 bp, Artificial
  CRISPR gRNA sequence
atatctctgatttctttctt

SEQ ID NO: 458357 - DNA, 20 bp, Artificial
  CRISPR gRNA sequence
tatctctgatttctttcttc

SEQ ID NO: 458358 - DNA, 20 bp, Artificial
  CRISPR gRNA sequence
tgatttctttcttctaattg

SEQ ID NO: 458359 - DNA, 20 bp, Artificial
  CRISPR gRNA sequence
atttctttcttctaattgtg

SEQ ID NO: 458360 - DNA, 20 bp, Artificial
  CRISPR gRNA sequence
ctttcttctaattgtgttgg

SEQ ID NO: 458361 - DNA, 20 bp, Artificial
  CRISPR gRNA sequence
tttcttctaattgtgttggt

SEQ ID NO: 458362 - DNA, 20 bp, Artificial
  CRISPR gRNA sequence
tcttctaattgtgttggtta

SEQ ID NO: 458363 - DNA, 20 bp, Artificial
  CRISPR gRNA sequence
cttctaattgtgttggttaa

SEQ ID NO: 458364 - DNA, 20 bp, Artificial
  CRISPR gRNA sequence
ttctaattgtgttggttaat

SEQ ID NO: 458365 - DNA, 20 bp, Artificial
  CRISPR gRNA sequence
ctaattgtgttggttaatat

SEQ ID NO: 458366 - DNA, 20 bp, Artificial
  CRISPR gRNA sequence
taattgtgttggttaatatc

SEQ ID NO: 458367 - DNA, 20 bp, Artificial
  CRISPR gRNA sequence
attgtgttggttaatatctc

SEQ ID NO: 458368 - DNA, 20 bp, Artificial
  CRISPR gRNA sequence
tgttggttaatatctccaga

SEQ ID NO: 458369 - DNA, 20 bp, Artificial
  CRISPR gRNA sequence
gttaatatctccagaaaaat

SEQ ID NO: 458370 - DNA, 20 bp, Artificial
  CRISPR gRNA sequence
atatctccagaaaaatatta

SEQ ID NO: 458371 - DNA, 20 bp, Artificial
  CRISPR gRNA sequence
cagaaaaatattaaataata

SEQ ID NO: 458372 - DNA, 20 bp, Artificial
  CRISPR gRNA sequence
aataataatggtaataatga

SEQ ID NO: 458373 - DNA, 20 bp, Artificial
  CRISPR gRNA sequence
tgtcttttttctaagtttaa

SEQ ID NO: 458374 - DNA, 20 bp, Artificial
  CRISPR gRNA sequence
tcttttttctaagtttaatg

SEQ ID NO: 458375 - DNA, 20 bp, Artificial
  CRISPR gRNA sequence
ttttctaagtttaatggggg

SEQ ID NO: 458376 - DNA, 20 bp, Artificial
  CRISPR gRNA sequence
tttctaagtttaatggggga

SEQ ID NO: 458377 - DNA, 20 bp, Artificial
  CRISPR gRNA sequence
ttctaagtttaatgggggat

SEQ ID NO: 458378 - DNA, 20 bp, Artificial
  CRISPR gRNA sequence
tctaagtttaatgggggatg

SEQ ID NO: 458379 - DNA, 20 bp, Artificial
  CRISPR gRNA sequence
ctaagtttaatgggggatgc

SEQ ID NO: 458380 - DNA, 20 bp, Artificial
  CRISPR gRNA sequence
taagtttaatgggggatgct

SEQ ID NO: 458381 - DNA, 20 bp, Artificial
  CRISPR gRNA sequence
agtttaatgggggatgctta

SEQ ID NO: 458382 - DNA, 20 bp, Artificial
  CRISPR gRNA sequence
aatgggggatgcttaaatgt

SEQ ID NO: 458383 - DNA, 20 bp, Artificial
  CRISPR gRNA sequence
atgggggatgcttaaatgtt

SEQ ID NO: 458384 - DNA, 20 bp, Artificial
  CRISPR gRNA sequence
aaatgtttccttattaagta

SEQ ID NO: 458385 - DNA, 20 bp, Artificial
  CRISPR gRNA sequence
aatgtttccttattaagtat

SEQ ID NO: 458386 - DNA, 20 bp, Artificial
  CRISPR gRNA sequence
ccttattaagtattatagta

SEQ ID NO: 458387 - DNA, 20 bp, Artificial
  CRISPR gRNA sequence
cttattaagtattatagtag

SEQ ID NO: 458388 - DNA, 20 bp, Artificial
  CRISPR gRNA sequence
attaagtattatagtagctt

SEQ ID NO: 458389 - DNA, 20 bp, Artificial
  CRISPR gRNA sequence
ttaagtattatagtagcttt

SEQ ID NO: 458390 - DNA, 20 bp, Artificial
  CRISPR gRNA sequence
agtattatagtagctttgag

SEQ ID NO: 458391 - DNA, 20 bp, Artificial
  CRISPR gRNA sequence
tagtagctttgagaatgaga

SEQ ID NO: 458392 - DNA, 20 bp, Artificial
  CRISPR gRNA sequence
tgagaatgagatgtatttta

SEQ ID NO: 458393 - DNA, 20 bp, Artificial
  CRISPR gRNA sequence
gagaatgagatgtattttat

SEQ ID NO: 458394 - DNA, 20 bp, Artificial
  CRISPR gRNA sequence
agaatgagatgtattttatt

SEQ ID NO: 458395 - DNA, 20 bp, Artificial
  CRISPR gRNA sequence
tattatgttaaggaatatac

SEQ ID NO: 458396 - DNA, 20 bp, Artificial
  CRISPR gRNA sequence
attatgttaaggaatataca

SEQ ID NO: 458397 - DNA, 20 bp, Artificial
  CRISPR gRNA sequence
ttatgttaaggaatatacat

SEQ ID NO: 458398 - DNA, 20 bp, Artificial
  CRISPR gRNA sequence
tgttaaggaatatacattta

SEQ ID NO: 458399 - DNA, 20 bp, Artificial
  CRISPR gRNA sequence
aggaatatacatttatttct

SEQ ID NO: 458400 - DNA, 20 bp, Artificial
  CRISPR gRNA sequence
atttctattttattaagagt

SEQ ID NO: 458401 - DNA, 20 bp, Artificial
  CRISPR gRNA sequence
tttctattttattaagagtt

SEQ ID NO: 458402 - DNA, 20 bp, Artificial
  CRISPR gRNA sequence
ctattttattaagagtttta

SEQ ID NO: 458403 - DNA, 20 bp, Artificial
  CRISPR gRNA sequence
tattttattaagagttttaa

SEQ ID NO: 458404 - DNA, 20 bp, Artificial
  CRISPR gRNA sequence
ttttattaagagttttaaaa

SEQ ID NO: 458405 - DNA, 20 bp, Artificial
  CRISPR gRNA sequence
tattaagagttttaaaatgt

SEQ ID NO: 458406 - DNA, 20 bp, Artificial
  CRISPR gRNA sequence
attaagagttttaaaatgtc

SEQ ID NO: 458407 - DNA, 20 bp, Artificial
  CRISPR gRNA sequence
ttaagagttttaaaatgtca

SEQ ID NO: 458408 - DNA, 20 bp, Artificial
  CRISPR gRNA sequence
agagttttaaaatgtcaagg

SEQ ID NO: 458409 - DNA, 20 bp, Artificial
  CRISPR gRNA sequence
taaaatgtcaaggatggatg

SEQ ID NO: 458410 - DNA, 20 bp, Artificial
  CRISPR gRNA sequence
aaaatgtcaaggatggatgt

SEQ ID NO: 458411 - DNA, 20 bp, Artificial
  CRISPR gRNA sequence
aaatgtcaaggatggatgtg

SEQ ID NO: 458412 - DNA, 20 bp, Artificial
  CRISPR gRNA sequence
tattaattgcctttaaatat

SEQ ID NO: 458413 - DNA, 20 bp, Artificial
  CRISPR gRNA sequence
attaattgcctttaaatatc

SEQ ID NO: 458414 - DNA, 20 bp, Artificial
  CRISPR gRNA sequence
ttaattgcctttaaatatca

SEQ ID NO: 458415 - DNA, 20 bp, Artificial
  CRISPR gRNA sequence
attgcctttaaatatcaact

SEQ ID NO: 458416 - DNA, 20 bp, Artificial
  CRISPR gRNA sequence
cctttaaatatcaactaaaa

SEQ ID NO: 458417 - DNA, 20 bp, Artificial
  CRISPR gRNA sequence
taaatatcaactaaaatgat

SEQ ID NO: 458418 - DNA, 20 bp, Artificial
  CRISPR gRNA sequence
aaatatcaactaaaatgata

SEQ ID NO: 458419 - DNA, 20 bp, Artificial
  CRISPR gRNA sequence
aatatcaactaaaatgatat

SEQ ID NO: 458420 - DNA, 20 bp, Artificial
  CRISPR gRNA sequence
aaatgatattatttttcttt

SEQ ID NO: 458421 - DNA, 20 bp, Artificial
  CRISPR gRNA sequence
tttttctttaagatatatta

SEQ ID NO: 458422 - DNA, 20 bp, Artificial
  CRISPR gRNA sequence
ttctttaagatatattaaga

SEQ ID NO: 458423 - DNA, 20 bp, Artificial
  CRISPR gRNA sequence
tctttaagatatattaagat

SEQ ID NO: 458424 - DNA, 20 bp, Artificial
  CRISPR gRNA sequence
ctttaagatatattaagatg

SEQ ID NO: 458425 - DNA, 20 bp, Artificial
  CRISPR gRNA sequence
tttaagatatattaagatgg

SEQ ID NO: 458426 - DNA, 20 bp, Artificial
  CRISPR gRNA sequence
taagatatattaagatggcg

SEQ ID NO: 458427 - DNA, 20 bp, Artificial
  CRISPR gRNA sequence
aagatatattaagatggcga

SEQ ID NO: 458428 - DNA, 20 bp, Artificial
  CRISPR gRNA sequence
agatatattaagatggcgat

SEQ ID NO: 458429 - DNA, 20 bp, Artificial
  CRISPR gRNA sequence
agatggcgatctacattaat

SEQ ID NO: 458430 - DNA, 20 bp, Artificial
  CRISPR gRNA sequence
cattaatagatttcctaaaa

SEQ ID NO: 458431 - DNA, 20 bp, Artificial
  CRISPR gRNA sequence
atagatttcctaaaattgat

SEQ ID NO: 458432 - DNA, 20 bp, Artificial
  CRISPR gRNA sequence
cctaaaattgatacatcttt

SEQ ID NO: 458433 - DNA, 20 bp, Artificial
  CRISPR gRNA sequence
ctaaaattgatacatctttg

SEQ ID NO: 458434 - DNA, 20 bp, Artificial
  CRISPR gRNA sequence
aaattgatacatctttgcag

SEQ ID NO: 458435 - DNA, 20 bp, Artificial
  CRISPR gRNA sequence
atacatctttgcagtcccag

SEQ ID NO: 458436 - DNA, 20 bp, Artificial
  CRISPR gRNA sequence
tgcagtcccagacaaacaaa

SEQ ID NO: 458437 - DNA, 20 bp, Artificial
  CRISPR gRNA sequence
gcagtcccagacaaacaaac

SEQ ID NO: 458438 - DNA, 20 bp, Artificial
  CRISPR gRNA sequence
cagtcccagacaaacaaaca

SEQ ID NO: 458439 - DNA, 20 bp, Artificial
  CRISPR gRNA sequence
aagccatttggtcatagtat

SEQ ID NO: 458440 - DNA, 20 bp, Artificial
  CRISPR gRNA sequence
ggtcatagtatgttgttatt

SEQ ID NO: 458441 - DNA, 20 bp, Artificial
  CRISPR gRNA sequence
gtcatagtatgttgttattt

SEQ ID NO: 458442 - DNA, 20 bp, Artificial
  CRISPR gRNA sequence
ttattttcttttgagacaga

SEQ ID NO: 458443 - DNA, 20 bp, Artificial
  CRISPR gRNA sequence
ttttcttttgagacagagtc

SEQ ID NO: 458444 - DNA, 20 bp, Artificial
  CRISPR gRNA sequence
tcttttgagacagagtctca

SEQ ID NO: 458445 - DNA, 20 bp, Artificial
  CRISPR gRNA sequence
cttttgagacagagtctcac

SEQ ID NO: 458446 - DNA, 20 bp, Artificial
  CRISPR gRNA sequence
ttttgagacagagtctcact

SEQ ID NO: 458447 - DNA, 20 bp, Artificial
  CRISPR gRNA sequence
ttgagacagagtctcactct

SEQ ID NO: 458448 - DNA, 20 bp, Artificial
  CRISPR gRNA sequence
tgagacagagtctcactctg

SEQ ID NO: 458449 - DNA, 20 bp, Artificial
  CRISPR gRNA sequence
gagacagagtctcactctgt

SEQ ID NO: 458450 - DNA, 20 bp, Artificial
  CRISPR gRNA sequence
agacagagtctcactctgtc

SEQ ID NO: 458451 - DNA, 20 bp, Artificial
  CRISPR gRNA sequence
actctgtcgcccaggctgga

SEQ ID NO: 458452 - DNA, 20 bp, Artificial
  CRISPR gRNA sequence
tgtcgcccaggctggagtgc

SEQ ID NO: 458453 - DNA, 20 bp, Artificial
  CRISPR gRNA sequence
tcgcccaggctggagtgcag

SEQ ID NO: 458454 - DNA, 20 bp, Artificial
  CRISPR gRNA sequence
gagtgcagtggcacgatctt

SEQ ID NO: 458455 - DNA, 20 bp, Artificial
  CRISPR gRNA sequence
ggcttactgcaacttccacc

SEQ ID NO: 458456 - DNA, 20 bp, Artificial
  CRISPR gRNA sequence
gcttactgcaacttccacct

SEQ ID NO: 458457 - DNA, 20 bp, Artificial
  CRISPR gRNA sequence
actgcaacttccacctcctg

SEQ ID NO: 458458 - DNA, 20 bp, Artificial
  CRISPR gRNA sequence
ctgcaacttccacctcctgg

SEQ ID NO: 458459 - DNA, 20 bp, Artificial
  CRISPR gRNA sequence
caacttccacctcctgggtt

SEQ ID NO: 458460 - DNA, 20 bp, Artificial
  CRISPR gRNA sequence
ccacctcctgggttcaagcg

SEQ ID NO: 458461 - DNA, 20 bp, Artificial
  CRISPR gRNA sequence
cacctcctgggttcaagcga

SEQ ID NO: 458462 - DNA, 20 bp, Artificial
  CRISPR gRNA sequence
ctgggttcaagcgattctcc

SEQ ID NO: 458463 - DNA, 20 bp, Artificial
  CRISPR gRNA sequence
ggttcaagcgattctcctgc

SEQ ID NO: 458464 - DNA, 20 bp, Artificial
  CRISPR gRNA sequence
aagcgattctcctgcctcag

SEQ ID NO: 458465 - DNA, 20 bp, Artificial
  CRISPR gRNA sequence
tcctgcctcagcctgccgag

SEQ ID NO: 458466 - DNA, 20 bp, Artificial
  CRISPR gRNA sequence
ctgcctcagcctgccgagta

SEQ ID NO: 458467 - DNA, 20 bp, Artificial
  CRISPR gRNA sequence
cctcagcctgccgagtatct

SEQ ID NO: 458468 - DNA, 20 bp, Artificial
  CRISPR gRNA sequence
agcctgccgagtatctggga

SEQ ID NO: 458469 - DNA, 20 bp, Artificial
  CRISPR gRNA sequence
ccgagtatctgggattacag

SEQ ID NO: 458470 - DNA, 20 bp, Artificial
  CRISPR gRNA sequence
ggattacaggcgcctgccga

SEQ ID NO: 458471 - DNA, 20 bp, Artificial
  CRISPR gRNA sequence
caggcgcctgccgagtatct

SEQ ID NO: 458472 - DNA, 20 bp, Artificial
  CRISPR gRNA sequence
ccgagtatctgggattacag

SEQ ID NO: 458473 - DNA, 20 bp, Artificial
  CRISPR gRNA sequence
ggattacaggcgcctgccac

SEQ ID NO: 458474 - DNA, 20 bp, Artificial
  CRISPR gRNA sequence
caggcgcctgccactgcgct

SEQ ID NO: 458475 - DNA, 20 bp, Artificial
  CRISPR gRNA sequence
ccactgcgctcggctaattt

SEQ ID NO: 458476 - DNA, 20 bp, Artificial
  CRISPR gRNA sequence
cgctcggctaatttttgtat

SEQ ID NO: 458477 - DNA, 20 bp, Artificial
  CRISPR gRNA sequence
ggctaatttttgtattttta

SEQ ID NO: 458478 - DNA, 20 bp, Artificial
  CRISPR gRNA sequence
atttttgtatttttagtaga

SEQ ID NO: 458479 - DNA, 20 bp, Artificial
  CRISPR gRNA sequence
ttgtatttttagtagagacg

SEQ ID NO: 458480 - DNA, 20 bp, Artificial
  CRISPR gRNA sequence
tgtatttttagtagagacgg

SEQ ID NO: 458481 - DNA, 20 bp, Artificial
  CRISPR gRNA sequence
gtatttttagtagagacggg

SEQ ID NO: 458482 - DNA, 20 bp, Artificial
  CRISPR gRNA sequence
tatttttagtagagacgggg

SEQ ID NO: 458483 - DNA, 20 bp, Artificial
  CRISPR gRNA sequence
ttagtagagacggggtttca

SEQ ID NO: 458484 - DNA, 20 bp, Artificial
  CRISPR gRNA sequence
tagtagagacggggtttcac

SEQ ID NO: 458485 - DNA, 20 bp, Artificial
  CRISPR gRNA sequence
agtagagacggggtttcacc

SEQ ID NO: 458486 - DNA, 20 bp, Artificial
  CRISPR gRNA sequence
gtagagacggggtttcacca

SEQ ID NO: 458487 - DNA, 20 bp, Artificial
  CRISPR gRNA sequence
caccatcttggccagggtga

SEQ ID NO: 458488 - DNA, 20 bp, Artificial
  CRISPR gRNA sequence
accatcttggccagggtgat

SEQ ID NO: 458489 - DNA, 20 bp, Artificial
  CRISPR gRNA sequence
ggccagggtgatcttgaact

SEQ ID NO: 458490 - DNA, 20 bp, Artificial
  CRISPR gRNA sequence
gccagggtgatcttgaactc

SEQ ID NO: 458491 - DNA, 20 bp, Artificial
  CRISPR gRNA sequence
gaactcctaaccttgtgatc

SEQ ID NO: 458492 - DNA, 20 bp, Artificial
  CRISPR gRNA sequence
aactcctaaccttgtgatcc

SEQ ID NO: 458493 - DNA, 20 bp, Artificial
  CRISPR gRNA sequence
ctaaccttgtgatccaccca

SEQ ID NO: 458494 - DNA, 20 bp, Artificial
  CRISPR gRNA sequence
accttgtgatccacccacct

SEQ ID NO: 458495 - DNA, 20 bp, Artificial
  CRISPR gRNA sequence
gtgatccacccaccttggcc

SEQ ID NO: 458496 - DNA, 20 bp, Artificial
  CRISPR gRNA sequence
tgatccacccaccttggcct

SEQ ID NO: 458497 - DNA, 20 bp, Artificial
  CRISPR gRNA sequence
ggcctcccaaagtgctggga

SEQ ID NO: 458498 - DNA, 20 bp, Artificial
  CRISPR gRNA sequence
gcctcccaaagtgctgggat

SEQ ID NO: 458499 - DNA, 20 bp, Artificial
  CRISPR gRNA sequence
ccaaagtgctgggattacag

SEQ ID NO: 458500 - DNA, 20 bp, Artificial
  CRISPR gRNA sequence
ggattacaggcgtgaaccac

SEQ ID NO: 458501 - DNA, 20 bp, Artificial
  CRISPR gRNA sequence
caggcgtgaaccaccacgcc

SEQ ID NO: 458502 - DNA, 20 bp, Artificial
  CRISPR gRNA sequence
gtatgttattcttttcatgt

SEQ ID NO: 458503 - DNA, 20 bp, Artificial
  CRISPR gRNA sequence
ttcttttcatgtgctgctgt

SEQ ID NO: 458504 - DNA, 20 bp, Artificial
  CRISPR gRNA sequence
ttttcatgtgctgctgtatt

SEQ ID NO: 458505 - DNA, 20 bp, Artificial
  CRISPR gRNA sequence
ttcatgtgctgctgtattct

SEQ ID NO: 458506 - DNA, 20 bp, Artificial
  CRISPR gRNA sequence
tcatgtgctgctgtattctg

SEQ ID NO: 458507 - DNA, 20 bp, Artificial
  CRISPR gRNA sequence
catgtgctgctgtattctgt

SEQ ID NO: 458508 - DNA, 20 bp, Artificial
  CRISPR gRNA sequence
atgtgctgctgtattctgtt

SEQ ID NO: 458509 - DNA, 20 bp, Artificial
  CRISPR gRNA sequence
ctgtattctgttttataata

SEQ ID NO: 458510 - DNA, 20 bp, Artificial
  CRISPR gRNA sequence
tattctgttttataatatta

SEQ ID NO: 458511 - DNA, 20 bp, Artificial
  CRISPR gRNA sequence
tgttttataatattatattt

SEQ ID NO: 458512 - DNA, 20 bp, Artificial
  CRISPR gRNA sequence
ttttataatattatatttaa

SEQ ID NO: 458513 - DNA, 20 bp, Artificial
  CRISPR gRNA sequence
tataatattatatttaaatt

SEQ ID NO: 458514 - DNA, 20 bp, Artificial
  CRISPR gRNA sequence
ataatattatatttaaattt

SEQ ID NO: 458515 - DNA, 20 bp, Artificial
  CRISPR gRNA sequence
taatattatatttaaatttt

SEQ ID NO: 458516 - DNA, 20 bp, Artificial
  CRISPR gRNA sequence
tatttaaatttttaaaaatt

SEQ ID NO: 458517 - DNA, 20 bp, Artificial
  CRISPR gRNA sequence
aaatttttaaaaattgaaag

SEQ ID NO: 458518 - DNA, 20 bp, Artificial
  CRISPR gRNA sequence
aatttttaaaaattgaaagg

SEQ ID NO: 458519 - DNA, 20 bp, Artificial
  CRISPR gRNA sequence
ttaaaaattgaaaggcccag

SEQ ID NO: 458520 - DNA, 20 bp, Artificial
  CRISPR gRNA sequence
taaaaattgaaaggcccagt

SEQ ID NO: 458521 - DNA, 20 bp, Artificial
  CRISPR gRNA sequence
aaaaattgaaaggcccagtt

SEQ ID NO: 458522 - DNA, 20 bp, Artificial
  CRISPR gRNA sequence
aaaattgaaaggcccagttg

SEQ ID NO: 458523 - DNA, 20 bp, Artificial
  CRISPR gRNA sequence
aaaggcccagttgcggtggc

SEQ ID NO: 458524 - DNA, 20 bp, Artificial
  CRISPR gRNA sequence
cggtggctcacgcctgtaat

SEQ ID NO: 458525 - DNA, 20 bp, Artificial
  CRISPR gRNA sequence
acgcctgtaatcccaagcct

SEQ ID NO: 458526 - DNA, 20 bp, Artificial
  CRISPR gRNA sequence
taatcccaagcctttgggag

SEQ ID NO: 458527 - DNA, 20 bp, Artificial
  CRISPR gRNA sequence
tgggaggccgaggtgggagg

SEQ ID NO: 458528 - DNA, 20 bp, Artificial
  CRISPR gRNA sequence
gggaggccgaggtgggagga

SEQ ID NO: 458529 - DNA, 20 bp, Artificial
  CRISPR gRNA sequence
ggaggccgaggtgggaggat

SEQ ID NO: 458530 - DNA, 20 bp, Artificial
  CRISPR gRNA sequence
gagcccaggagtttgagacc

SEQ ID NO: 458531 - DNA, 20 bp, Artificial
  CRISPR gRNA sequence
agcccaggagtttgagacca

SEQ ID NO: 458532 - DNA, 20 bp, Artificial
  CRISPR gRNA sequence
gagaccagcctgggcagcaa

SEQ ID NO: 458533 - DNA, 20 bp, Artificial
  CRISPR gRNA sequence
agaccagcctgggcagcaaa

SEQ ID NO: 458534 - DNA, 20 bp, Artificial
  CRISPR gRNA sequence
ggcagcaaagtgagaccatg

SEQ ID NO: 458535 - DNA, 20 bp, Artificial
  CRISPR gRNA sequence
tacaaaaaatacaaaaatta

SEQ ID NO: 458536 - DNA, 20 bp, Artificial
  CRISPR gRNA sequence
acaaaaaatacaaaaattag

SEQ ID NO: 458537 - DNA, 20 bp, Artificial
  CRISPR gRNA sequence
caaaaaatacaaaaattagc

SEQ ID NO: 458538 - DNA, 20 bp, Artificial
  CRISPR gRNA sequence
gccacgtgtggtggtgcgta

SEQ ID NO: 458539 - DNA, 20 bp, Artificial
  CRISPR gRNA sequence
aagtcccagctactcaagag

SEQ ID NO: 458540 - DNA, 20 bp, Artificial
  CRISPR gRNA sequence
ctcaagagacttaggtggga

SEQ ID NO: 458541 - DNA, 20 bp, Artificial
  CRISPR gRNA sequence
aagagacttaggtgggagga

SEQ ID NO: 458542 - DNA, 20 bp, Artificial
  CRISPR gRNA sequence
aggtgggaggagcccgggag

SEQ ID NO: 458543 - DNA, 20 bp, Artificial
  CRISPR gRNA sequence
ggtgggaggagcccgggagt

SEQ ID NO: 458544 - DNA, 20 bp, Artificial
  CRISPR gRNA sequence
acggatgtagtgaggtatga

SEQ ID NO: 458545 - DNA, 20 bp, Artificial
  CRISPR gRNA sequence
cactgcactctggcctggtt

SEQ ID NO: 458546 - DNA, 20 bp, Artificial
  CRISPR gRNA sequence
actgcactctggcctggttg

SEQ ID NO: 458547 - DNA, 20 bp, Artificial
  CRISPR gRNA sequence
cactctggcctggttgacag

SEQ ID NO: 458548 - DNA, 20 bp, Artificial
  CRISPR gRNA sequence
tggcctggttgacagtgaga

SEQ ID NO: 458549 - DNA, 20 bp, Artificial
  CRISPR gRNA sequence
gcctggttgacagtgagacc

SEQ ID NO: 458550 - DNA, 20 bp, Artificial
  CRISPR gRNA sequence
gttgacagtgagaccctgtc

SEQ ID NO: 458551 - DNA, 20 bp, Artificial
  CRISPR gRNA sequence
acagtgagaccctgtctcaa

SEQ ID NO: 458552 - DNA, 20 bp, Artificial
  CRISPR gRNA sequence
tctcaagaaaaccaaaatca

SEQ ID NO: 458553 - DNA, 20 bp, Artificial
  CRISPR gRNA sequence
aagaaaaccaaaatcaaaaa

SEQ ID NO: 458554 - DNA, 20 bp, Artificial
  CRISPR gRNA sequence
cacacacacacaaattaacc

SEQ ID NO: 458555 - DNA, 20 bp, Artificial
  CRISPR gRNA sequence
accaatcatacaagatatta

SEQ ID NO: 458556 - DNA, 20 bp, Artificial
  CRISPR gRNA sequence
aaaatataatacaccatgac

SEQ ID NO: 458557 - DNA, 20 bp, Artificial
  CRISPR gRNA sequence
catttttagaaattcttgga

SEQ ID NO: 458558 - DNA, 20 bp, Artificial
  CRISPR gRNA sequence
atttttagaaattcttggat

SEQ ID NO: 458559 - DNA, 20 bp, Artificial
  CRISPR gRNA sequence
ttagaaattcttggatgatt

SEQ ID NO: 458560 - DNA, 20 bp, Artificial
  CRISPR gRNA sequence
tagaaattcttggatgattt

SEQ ID NO: 458561 - DNA, 20 bp, Artificial
  CRISPR gRNA sequence
agaaattcttggatgattta

SEQ ID NO: 458562 - DNA, 20 bp, Artificial
  CRISPR gRNA sequence
gaaattcttggatgatttaa

SEQ ID NO: 458563 - DNA, 20 bp, Artificial
  CRISPR gRNA sequence
ttggatgatttaatattagg

SEQ ID NO: 458564 - DNA, 20 bp, Artificial
  CRISPR gRNA sequence
ggatgatttaatattaggaa

SEQ ID NO: 458565 - DNA, 20 bp, Artificial
  CRISPR gRNA sequence
gatgatttaatattaggaaa

SEQ ID NO: 458566 - DNA, 20 bp, Artificial
  CRISPR gRNA sequence
aatattaggaaatctattaa

SEQ ID NO: 458567 - DNA, 20 bp, Artificial
  CRISPR gRNA sequence
atattaggaaatctattaat

SEQ ID NO: 458568 - DNA, 20 bp, Artificial
  CRISPR gRNA sequence
ggaaatctattaattaacat

SEQ ID NO: 458569 - DNA, 20 bp, Artificial
  CRISPR gRNA sequence
ttaattaacatactactgga

SEQ ID NO: 458570 - DNA, 20 bp, Artificial
  CRISPR gRNA sequence
attaacatactactggataa

SEQ ID NO: 458571 - DNA, 20 bp, Artificial
  CRISPR gRNA sequence
acatactactggataaaaaa

SEQ ID NO: 458572 - DNA, 20 bp, Artificial
  CRISPR gRNA sequence
ctggataaaaaagaaagtca

SEQ ID NO: 458573 - DNA, 20 bp, Artificial
  CRISPR gRNA sequence
gataaaaaagaaagtcaata

SEQ ID NO: 458574 - DNA, 20 bp, Artificial
  CRISPR gRNA sequence
ccttctgataacatcttaca

SEQ ID NO: 458575 - DNA, 20 bp, Artificial
  CRISPR gRNA sequence
ctgataacatcttacattaa

SEQ ID NO: 458576 - DNA, 20 bp, Artificial
  CRISPR gRNA sequence
tgataacatcttacattaat

SEQ ID NO: 458577 - DNA, 20 bp, Artificial
  CRISPR gRNA sequence
ataacatcttacattaattc

SEQ ID NO: 458578 - DNA, 20 bp, Artificial
  CRISPR gRNA sequence
acattaattcccactaaaat

SEQ ID NO: 458579 - DNA, 20 bp, Artificial
  CRISPR gRNA sequence
cattaattcccactaaaatc

SEQ ID NO: 458580 - DNA, 20 bp, Artificial
  CRISPR gRNA sequence
attcccactaaaatcctaag

SEQ ID NO: 458581 - DNA, 20 bp, Artificial
  CRISPR gRNA sequence
ccactaaaatcctaagtaaa

SEQ ID NO: 458582 - DNA, 20 bp, Artificial
  CRISPR gRNA sequence
aaatcctaagtaaaatggta

SEQ ID NO: 458583 - DNA, 20 bp, Artificial
  CRISPR gRNA sequence
agtaaaatggtaatggatga

SEQ ID NO: 458584 - DNA, 20 bp, Artificial
  CRISPR gRNA sequence
ttcaatataatggagaaatg

SEQ ID NO: 458585 - DNA, 20 bp, Artificial
  CRISPR gRNA sequence
aatataatggagaaatgtat

SEQ ID NO: 458586 - DNA, 20 bp, Artificial
  CRISPR gRNA sequence
agataaaattgcagcatcat

SEQ ID NO: 458587 - DNA, 20 bp, Artificial
  CRISPR gRNA sequence
cagcatcatatttaatggta

SEQ ID NO: 458588 - DNA, 20 bp, Artificial
  CRISPR gRNA sequence
aatggtaaaatatgggataa

SEQ ID NO: 458589 - DNA, 20 bp, Artificial
  CRISPR gRNA sequence
atggtaaaatatgggataat

SEQ ID NO: 458590 - DNA, 20 bp, Artificial
  CRISPR gRNA sequence
ctattaatattaggagcaag

SEQ ID NO: 458591 - DNA, 20 bp, Artificial
  CRISPR gRNA sequence
tattaatattaggagcaagg

SEQ ID NO: 458592 - DNA, 20 bp, Artificial
  CRISPR gRNA sequence
ttaatattaggagcaaggca

SEQ ID NO: 458593 - DNA, 20 bp, Artificial
  CRISPR gRNA sequence
atattaggagcaaggcagag

SEQ ID NO: 458594 - DNA, 20 bp, Artificial
  CRISPR gRNA sequence
ggagcaaggcagagatgctt

SEQ ID NO: 458595 - DNA, 20 bp, Artificial
  CRISPR gRNA sequence
cctattatttctgttatttc

SEQ ID NO: 458596 - DNA, 20 bp, Artificial
  CRISPR gRNA sequence
ctattatttctgttatttca

SEQ ID NO: 458597 - DNA, 20 bp, Artificial
  CRISPR gRNA sequence
ttatttctgttatttcacat

SEQ ID NO: 458598 - DNA, 20 bp, Artificial
  CRISPR gRNA sequence
tttctgttatttcacattgt

SEQ ID NO: 458599 - DNA, 20 bp, Artificial
  CRISPR gRNA sequence
ctgttatttcacattgttct

SEQ ID NO: 458600 - DNA, 20 bp, Artificial
  CRISPR gRNA sequence
tgttatttcacattgttctg

SEQ ID NO: 458601 - DNA, 20 bp, Artificial
  CRISPR gRNA sequence
ttatttcacattgttctgaa

SEQ ID NO: 458602 - DNA, 20 bp, Artificial
  CRISPR gRNA sequence
tttcacattgttctgaaagt

SEQ ID NO: 458603 - DNA, 20 bp, Artificial
  CRISPR gRNA sequence
cacattgttctgaaagtgtt

SEQ ID NO: 458604 - DNA, 20 bp, Artificial
  CRISPR gRNA sequence
acattgttctgaaagtgttt

SEQ ID NO: 458605 - DNA, 20 bp, Artificial
  CRISPR gRNA sequence
ttctgaaagtgtttgccatt

SEQ ID NO: 458606 - DNA, 20 bp, Artificial
  CRISPR gRNA sequence
tgaaagtgtttgccattata

SEQ ID NO: 458607 - DNA, 20 bp, Artificial
  CRISPR gRNA sequence
aaagtgtttgccattatatt

SEQ ID NO: 458608 - DNA, 20 bp, Artificial
  CRISPR gRNA sequence
gccattatatttagacaaga

SEQ ID NO: 458609 - DNA, 20 bp, Artificial
  CRISPR gRNA sequence
ccattatatttagacaagaa

SEQ ID NO: 458610 - DNA, 20 bp, Artificial
  CRISPR gRNA sequence
tatttagacaagaaaataaa

SEQ ID NO: 458611 - DNA, 20 bp, Artificial
  CRISPR gRNA sequence
agacaagaaaataaagcaaa

SEQ ID NO: 458612 - DNA, 20 bp, Artificial
  CRISPR gRNA sequence
gacaagaaaataaagcaaag

SEQ ID NO: 458613 - DNA, 20 bp, Artificial
  CRISPR gRNA sequence
gaaatcttaaggcaaattta

SEQ ID NO: 458614 - DNA, 20 bp, Artificial
  CRISPR gRNA sequence
aaggcaaatttattactatt

SEQ ID NO: 458615 - DNA, 20 bp, Artificial
  CRISPR gRNA sequence
aggcaaatttattactattt

SEQ ID NO: 458616 - DNA, 20 bp, Artificial
  CRISPR gRNA sequence
attactatttatatgtgata

SEQ ID NO: 458617 - DNA, 20 bp, Artificial
  CRISPR gRNA sequence
ttactatttatatgtgatat

SEQ ID NO: 458618 - DNA, 20 bp, Artificial
  CRISPR gRNA sequence
ctatttatatgtgatataac

SEQ ID NO: 458619 - DNA, 20 bp, Artificial
  CRISPR gRNA sequence
tttatatgtgatataactta

SEQ ID NO: 458620 - DNA, 20 bp, Artificial
  CRISPR gRNA sequence
atatgtgatataacttacat

SEQ ID NO: 458621 - DNA, 20 bp, Artificial
  CRISPR gRNA sequence
tatgtgatataacttacatc

SEQ ID NO: 458622 - DNA, 20 bp, Artificial
  CRISPR gRNA sequence
acatctagaaaacccaagaa

SEQ ID NO: 458623 - DNA, 20 bp, Artificial
  CRISPR gRNA sequence
catctagaaaacccaagaaa

SEQ ID NO: 458624 - DNA, 20 bp, Artificial
  CRISPR gRNA sequence
gaaaacccaagaaacttaat

SEQ ID NO: 458625 - DNA, 20 bp, Artificial
  CRISPR gRNA sequence
aattgagaattattagaaac

SEQ ID NO: 458626 - DNA, 20 bp, Artificial
  CRISPR gRNA sequence
attgagaattattagaaaca

SEQ ID NO: 458627 - DNA, 20 bp, Artificial
  CRISPR gRNA sequence
agaattattagaaacaataa

SEQ ID NO: 458628 - DNA, 20 bp, Artificial
  CRISPR gRNA sequence
ttagaaacaataaaagagta

SEQ ID NO: 458629 - DNA, 20 bp, Artificial
  CRISPR gRNA sequence
gaaacaataaaagagtatct

SEQ ID NO: 458630 - DNA, 20 bp, Artificial
  CRISPR gRNA sequence
aataggcagttcacaaaaga

SEQ ID NO: 458631 - DNA, 20 bp, Artificial
  CRISPR gRNA sequence
acaaaagacgaaatgcaata

SEQ ID NO: 458632 - DNA, 20 bp, Artificial
  CRISPR gRNA sequence
ttcagttttacaagtattca

SEQ ID NO: 458633 - DNA, 20 bp, Artificial
  CRISPR gRNA sequence
tcagttttacaagtattcag

SEQ ID NO: 458634 - DNA, 20 bp, Artificial
  CRISPR gRNA sequence
cagttttacaagtattcagg

SEQ ID NO: 458635 - DNA, 20 bp, Artificial
  CRISPR gRNA sequence
agttttacaagtattcaggg

SEQ ID NO: 458636 - DNA, 20 bp, Artificial
  CRISPR gRNA sequence
tacaagtattcagggaagta

SEQ ID NO: 458637 - DNA, 20 bp, Artificial
  CRISPR gRNA sequence
acaagtattcagggaagtac

SEQ ID NO: 458638 - DNA, 20 bp, Artificial
  CRISPR gRNA sequence
caagtattcagggaagtaca

SEQ ID NO: 458639 - DNA, 20 bp, Artificial
  CRISPR gRNA sequence
agggaagtacaaattaaaaa

SEQ ID NO: 458640 - DNA, 20 bp, Artificial
  CRISPR gRNA sequence
aaaattcagagttcagaatt

SEQ ID NO: 458641 - DNA, 20 bp, Artificial
  CRISPR gRNA sequence
agagttcagaatttcagaat

SEQ ID NO: 458642 - DNA, 20 bp, Artificial
  CRISPR gRNA sequence
agaatttcagaattaccacc

SEQ ID NO: 458643 - DNA, 20 bp, Artificial
  CRISPR gRNA sequence
cagaattaccacctgttaag

SEQ ID NO: 458644 - DNA, 20 bp, Artificial
  CRISPR gRNA sequence
agaattaccacctgttaagt

SEQ ID NO: 458645 - DNA, 20 bp, Artificial
  CRISPR gRNA sequence
ccacctgttaagtgaacaaa

SEQ ID NO: 458646 - DNA, 20 bp, Artificial
  CRISPR gRNA sequence
ttaagtgaacaaaaatttaa

SEQ ID NO: 458647 - DNA, 20 bp, Artificial
  CRISPR gRNA sequence
agtgaacaaaaatttaaaag

SEQ ID NO: 458648 - DNA, 20 bp, Artificial
  CRISPR gRNA sequence
aaaagataaatcaaattttg

SEQ ID NO: 458649 - DNA, 20 bp, Artificial
  CRISPR gRNA sequence
aaagataaatcaaattttgg

SEQ ID NO: 458650 - DNA, 20 bp, Artificial
  CRISPR gRNA sequence
tggtaagggtaagaagaaat

SEQ ID NO: 458651 - DNA, 20 bp, Artificial
  CRISPR gRNA sequence
ggtaagggtaagaagaaata

SEQ ID NO: 458652 - DNA, 20 bp, Artificial
  CRISPR gRNA sequence
gtaagggtaagaagaaatat

SEQ ID NO: 458653 - DNA, 20 bp, Artificial
  CRISPR gRNA sequence
actctaggtagaactataca

SEQ ID NO: 458654 - DNA, 20 bp, Artificial
  CRISPR gRNA sequence
taggtagaactatacattgt

SEQ ID NO: 458655 - DNA, 20 bp, Artificial
  CRISPR gRNA sequence
ggtagaactatacattgtta

SEQ ID NO: 458656 - DNA, 20 bp, Artificial
  CRISPR gRNA sequence
tacattgttacggagctttg

SEQ ID NO: 458657 - DNA, 20 bp, Artificial
  CRISPR gRNA sequence
ttacggagctttgggggaat

SEQ ID NO: 458658 - DNA, 20 bp, Artificial
  CRISPR gRNA sequence
cggagctttgggggaatact

SEQ ID NO: 458659 - DNA, 20 bp, Artificial
  CRISPR gRNA sequence
tgggggaatactcattatat

SEQ ID NO: 458660 - DNA, 20 bp, Artificial
  CRISPR gRNA sequence
gggggaatactcattatata

SEQ ID NO: 458661 - DNA, 20 bp, Artificial
  CRISPR gRNA sequence
ggggaatactcattatatat

SEQ ID NO: 458662 - DNA, 20 bp, Artificial
  CRISPR gRNA sequence
attatatattaacatttcaa

SEQ ID NO: 458663 - DNA, 20 bp, Artificial
  CRISPR gRNA sequence
tatattaacatttcaaatgc

SEQ ID NO: 458664 - DNA, 20 bp, Artificial
  CRISPR gRNA sequence
acatttcaaatgcacatacc

SEQ ID NO: 458665 - DNA, 20 bp, Artificial
  CRISPR gRNA sequence
caaatgcacataccctgtcc

SEQ ID NO: 458666 - DNA, 20 bp, Artificial
  CRISPR gRNA sequence
aaatgcacataccctgtccc

SEQ ID NO: 458667 - DNA, 20 bp, Artificial
  CRISPR gRNA sequence
tccctttggctatagcttac

SEQ ID NO: 458668 - DNA, 20 bp, Artificial
  CRISPR gRNA sequence
tggctatagcttacagaaat

SEQ ID NO: 458669 - DNA, 20 bp, Artificial
  CRISPR gRNA sequence
ggctatagcttacagaaata

SEQ ID NO: 458670 - DNA, 20 bp, Artificial
  CRISPR gRNA sequence
gctatagcttacagaaataa

SEQ ID NO: 458671 - DNA, 20 bp, Artificial
  CRISPR gRNA sequence
tagcttacagaaataaaagc

SEQ ID NO: 458672 - DNA, 20 bp, Artificial
  CRISPR gRNA sequence
acagaaataaaagcatgagt

SEQ ID NO: 458673 - DNA, 20 bp, Artificial
  CRISPR gRNA sequence
cagaaataaaagcatgagtg

SEQ ID NO: 458674 - DNA, 20 bp, Artificial
  CRISPR gRNA sequence
gtatagatgtacaaggatat

SEQ ID NO: 458675 - DNA, 20 bp, Artificial
  CRISPR gRNA sequence
actgcagcattttttataat

SEQ ID NO: 458676 - DNA, 20 bp, Artificial
  CRISPR gRNA sequence
cagcattttttataatacca

SEQ ID NO: 458677 - DNA, 20 bp, Artificial
  CRISPR gRNA sequence
tttataataccaaaaaaata

SEQ ID NO: 458678 - DNA, 20 bp, Artificial
  CRISPR gRNA sequence
ttataataccaaaaaaatag

SEQ ID NO: 458679 - DNA, 20 bp, Artificial
  CRISPR gRNA sequence
tataataccaaaaaaataga

SEQ ID NO: 458680 - DNA, 20 bp, Artificial
  CRISPR gRNA sequence
ataataccaaaaaaatagaa

SEQ ID NO: 458681 - DNA, 20 bp, Artificial
  CRISPR gRNA sequence
taataccaaaaaaatagaaa

SEQ ID NO: 458682 - DNA, 20 bp, Artificial
  CRISPR gRNA sequence
acacctgtaatcccagcact

SEQ ID NO: 458683 - DNA, 20 bp, Artificial
  CRISPR gRNA sequence
taatcccagcactttgggag

SEQ ID NO: 458684 - DNA, 20 bp, Artificial
  CRISPR gRNA sequence
tgggaggcgtgcggatcacc

SEQ ID NO: 458685 - DNA, 20 bp, Artificial
  CRISPR gRNA sequence
gggaggcgtgcggatcacct

SEQ ID NO: 458686 - DNA, 20 bp, Artificial
  CRISPR gRNA sequence
ggaggcgtgcggatcacctg

SEQ ID NO: 458687 - DNA, 20 bp, Artificial
  CRISPR gRNA sequence
aggtcaggagttcgagacca

SEQ ID NO: 458688 - DNA, 20 bp, Artificial
  CRISPR gRNA sequence
gagaccagcctggcccacat

SEQ ID NO: 458689 - DNA, 20 bp, Artificial
  CRISPR gRNA sequence
gcccacatggtgaaaccctg

SEQ ID NO: 458690 - DNA, 20 bp, Artificial
  CRISPR gRNA sequence
gctctactaaaaatgcaaaa

SEQ ID NO: 458691 - DNA, 20 bp, Artificial
  CRISPR gRNA sequence
tactaaaaatgcaaaaatta

SEQ ID NO: 458692 - DNA, 20 bp, Artificial
  CRISPR gRNA sequence
ctaaaaatgcaaaaattagc

SEQ ID NO: 458693 - DNA, 20 bp, Artificial
  CRISPR gRNA sequence
aaaatgcaaaaattagctgg

SEQ ID NO: 458694 - DNA, 20 bp, Artificial
  CRISPR gRNA sequence
gctgggtgttgtagcaggtg

SEQ ID NO: 458695 - DNA, 20 bp, Artificial
  CRISPR gRNA sequence
ggtgttgtagcaggtgcctg

SEQ ID NO: 458696 - DNA, 20 bp, Artificial
  CRISPR gRNA sequence
tagcaggtgcctgtgatccc

SEQ ID NO: 458697 - DNA, 20 bp, Artificial
  CRISPR gRNA sequence
tgatcccacctactcaggag

SEQ ID NO: 458698 - DNA, 20 bp, Artificial
  CRISPR gRNA sequence
ctcaggaggctgaggcagga

SEQ ID NO: 458699 - DNA, 20 bp, Artificial
  CRISPR gRNA sequence
aggaggctgaggcaggataa

SEQ ID NO: 458700 - DNA, 20 bp, Artificial
  CRISPR gRNA sequence
aggcaggataattgcttgaa

SEQ ID NO: 458701 - DNA, 20 bp, Artificial
  CRISPR gRNA sequence
cttgaacctgggaggcagag

SEQ ID NO: 458702 - DNA, 20 bp, Artificial
  CRISPR gRNA sequence
gaacctgggaggcagagatt

SEQ ID NO: 458703 - DNA, 20 bp, Artificial
  CRISPR gRNA sequence
aacctgggaggcagagattg

SEQ ID NO: 458704 - DNA, 20 bp, Artificial
  CRISPR gRNA sequence
ggaggcagagattgcagtga

SEQ ID NO: 458705 - DNA, 20 bp, Artificial
  CRISPR gRNA sequence
cagtgagccaagatcacgcc

SEQ ID NO: 458706 - DNA, 20 bp, Artificial
  CRISPR gRNA sequence
cactccagcctgggcaacag

SEQ ID NO: 458707 - DNA, 20 bp, Artificial
  CRISPR gRNA sequence
cagcctgggcaacagagcaa

SEQ ID NO: 458708 - DNA, 20 bp, Artificial
  CRISPR gRNA sequence
ggcaacagagcaaaactttg

SEQ ID NO: 458709 - DNA, 20 bp, Artificial
  CRISPR gRNA sequence
tgtcgccttcctgcccccat

SEQ ID NO: 458710 - DNA, 20 bp, Artificial
  CRISPR gRNA sequence
gtcgccttcctgcccccata

SEQ ID NO: 458711 - DNA, 20 bp, Artificial
  CRISPR gRNA sequence
tcgccttcctgcccccataa

SEQ ID NO: 458712 - DNA, 20 bp, Artificial
  CRISPR gRNA sequence
cctgcccccataaaaaaagg

SEQ ID NO: 458713 - DNA, 20 bp, Artificial
  CRISPR gRNA sequence
ctgcccccataaaaaaagga

SEQ ID NO: 458714 - DNA, 20 bp, Artificial
  CRISPR gRNA sequence
cccccataaaaaaaggaaac

SEQ ID NO: 458715 - DNA, 20 bp, Artificial
  CRISPR gRNA sequence
gtgagaatggttgaataaat

SEQ ID NO: 458716 - DNA, 20 bp, Artificial
  CRISPR gRNA sequence
aataaattattgcagatcca

SEQ ID NO: 458717 - DNA, 20 bp, Artificial
  CRISPR gRNA sequence
ttgcagatccacagaataga

SEQ ID NO: 458718 - DNA, 20 bp, Artificial
  CRISPR gRNA sequence
cagatccacagaatagaatg

SEQ ID NO: 458719 - DNA, 20 bp, Artificial
  CRISPR gRNA sequence
tgtaattatagtttgtataa

SEQ ID NO: 458720 - DNA, 20 bp, Artificial
  CRISPR gRNA sequence
tagtttgtataaaacaataa

SEQ ID NO: 458721 - DNA, 20 bp, Artificial
  CRISPR gRNA sequence
gtataaaacaataaactaaa

SEQ ID NO: 458722 - DNA, 20 bp, Artificial
  CRISPR gRNA sequence
tataaaacaataaactaaat

SEQ ID NO: 458723 - DNA, 20 bp, Artificial
  CRISPR gRNA sequence
aattagtgtatatacataca

SEQ ID NO: 458724 - DNA, 20 bp, Artificial
  CRISPR gRNA sequence
gtgtatatacatacaattta

SEQ ID NO: 458725 - DNA, 20 bp, Artificial
  CRISPR gRNA sequence
aataaggtacttattaatac

SEQ ID NO: 458726 - DNA, 20 bp, Artificial
  CRISPR gRNA sequence
ataaggtacttattaataca

SEQ ID NO: 458727 - DNA, 20 bp, Artificial
  CRISPR gRNA sequence
attaatacataagattaaaa

SEQ ID NO: 458728 - DNA, 20 bp, Artificial
  CRISPR gRNA sequence
ttaatacataagattaaaaa

SEQ ID NO: 458729 - DNA, 20 bp, Artificial
  CRISPR gRNA sequence
atacataagattaaaaattt

SEQ ID NO: 458730 - DNA, 20 bp, Artificial
  CRISPR gRNA sequence
aaaattttcctggatataat

SEQ ID NO: 458731 - DNA, 20 bp, Artificial
  CRISPR gRNA sequence
tcctggatataattattagt

SEQ ID NO: 458732 - DNA, 20 bp, Artificial
  CRISPR gRNA sequence
cctggatataattattagtc

SEQ ID NO: 458733 - DNA, 20 bp, Artificial
  CRISPR gRNA sequence
ctggatataattattagtca

SEQ ID NO: 458734 - DNA, 20 bp, Artificial
  CRISPR gRNA sequence
gatataattattagtcagaa

SEQ ID NO: 458735 - DNA, 20 bp, Artificial
  CRISPR gRNA sequence
ttagtcagaaaatatggtag

SEQ ID NO: 458736 - DNA, 20 bp, Artificial
  CRISPR gRNA sequence
gtcagaaaatatggtagaag

SEQ ID NO: 458737 - DNA, 20 bp, Artificial
  CRISPR gRNA sequence
cattcattatagcaaccaaa

SEQ ID NO: 458738 - DNA, 20 bp, Artificial
  CRISPR gRNA sequence
attatagcaaccaaaaaacc

SEQ ID NO: 458739 - DNA, 20 bp, Artificial
  CRISPR gRNA sequence
tagcaaccaaaaaacccatc

SEQ ID NO: 458740 - DNA, 20 bp, Artificial
  CRISPR gRNA sequence
cgaataggacctataggata

SEQ ID NO: 458741 - DNA, 20 bp, Artificial
  CRISPR gRNA sequence
taggatacaaactatacagt

SEQ ID NO: 458742 - DNA, 20 bp, Artificial
  CRISPR gRNA sequence
tacagtactattaaggaaca

SEQ ID NO: 458743 - DNA, 20 bp, Artificial
  CRISPR gRNA sequence
ttaaggaacataaaagaaaa

SEQ ID NO: 458744 - DNA, 20 bp, Artificial
  CRISPR gRNA sequence
aggaacataaaagaaaatct

SEQ ID NO: 458745 - DNA, 20 bp, Artificial
  CRISPR gRNA sequence
agtagagacgattgttaaat

SEQ ID NO: 458746 - DNA, 20 bp, Artificial
  CRISPR gRNA sequence
ttaaattcttctgtacttat

SEQ ID NO: 458747 - DNA, 20 bp, Artificial
  CRISPR gRNA sequence
aattcttctgtacttatcta

SEQ ID NO: 458748 - DNA, 20 bp, Artificial
  CRISPR gRNA sequence
ttctgtacttatctatacat

SEQ ID NO: 458749 - DNA, 20 bp, Artificial
  CRISPR gRNA sequence
ctgtacttatctatacattt

SEQ ID NO: 458750 - DNA, 20 bp, Artificial
  CRISPR gRNA sequence
tgtacttatctatacatttg

SEQ ID NO: 458751 - DNA, 20 bp, Artificial
  CRISPR gRNA sequence
tacttatctatacatttgtc

SEQ ID NO: 458752 - DNA, 20 bp, Artificial
  CRISPR gRNA sequence
atctatacatttgtcacaat

SEQ ID NO: 458753 - DNA, 20 bp, Artificial
  CRISPR gRNA sequence
tctatacatttgtcacaatc

SEQ ID NO: 458754 - DNA, 20 bp, Artificial
  CRISPR gRNA sequence
tacatttgtcacaatcctaa

SEQ ID NO: 458755 - DNA, 20 bp, Artificial
  CRISPR gRNA sequence
gtcacaatcctaataaaaca

SEQ ID NO: 458756 - DNA, 20 bp, Artificial
  CRISPR gRNA sequence
tcacaatcctaataaaacat

SEQ ID NO: 458757 - DNA, 20 bp, Artificial
  CRISPR gRNA sequence
ataaaacatcccagcagcag

SEQ ID NO: 458758 - DNA, 20 bp, Artificial
  CRISPR gRNA sequence
atggtatggccccaatgtcc

SEQ ID NO: 458759 - DNA, 20 bp, Artificial
  CRISPR gRNA sequence
tcctagccttgacctctcct

SEQ ID NO: 458760 - DNA, 20 bp, Artificial
  CRISPR gRNA sequence
cctagccttgacctctcctt

SEQ ID NO: 458761 - DNA, 20 bp, Artificial
  CRISPR gRNA sequence
ctagccttgacctctccttg

SEQ ID NO: 458762 - DNA, 20 bp, Artificial
  CRISPR gRNA sequence
gccttgacctctccttgttc

SEQ ID NO: 458763 - DNA, 20 bp, Artificial
  CRISPR gRNA sequence
gacctctccttgttccttct

SEQ ID NO: 458764 - DNA, 20 bp, Artificial
  CRISPR gRNA sequence
acctctccttgttccttctc

SEQ ID NO: 458765 - DNA, 20 bp, Artificial
  CRISPR gRNA sequence
tccttgttccttctcctgtg

SEQ ID NO: 458766 - DNA, 20 bp, Artificial
  CRISPR gRNA sequence
cttgttccttctcctgtgtt

SEQ ID NO: 458767 - DNA, 20 bp, Artificial
  CRISPR gRNA sequence
gttccttctcctgtgttatc

SEQ ID NO: 458768 - DNA, 20 bp, Artificial
  CRISPR gRNA sequence
ttccttctcctgtgttatca

SEQ ID NO: 458769 - DNA, 20 bp, Artificial
  CRISPR gRNA sequence
cttctcctgtgttatcatac

SEQ ID NO: 458770 - DNA, 20 bp, Artificial
  CRISPR gRNA sequence
ctcctgtgttatcatacctt

SEQ ID NO: 458771 - DNA, 20 bp, Artificial
  CRISPR gRNA sequence
tcctgtgttatcataccttc

SEQ ID NO: 458772 - DNA, 20 bp, Artificial
  CRISPR gRNA sequence
ctgtgttatcataccttcat

SEQ ID NO: 458773 - DNA, 20 bp, Artificial
  CRISPR gRNA sequence
tgttatcataccttcatgct

SEQ ID NO: 458774 - DNA, 20 bp, Artificial
  CRISPR gRNA sequence
tcataccttcatgctacacc

SEQ ID NO: 458775 - DNA, 20 bp, Artificial
  CRISPR gRNA sequence
catgctacaccagaatgtcc

SEQ ID NO: 458776 - DNA, 20 bp, Artificial
  CRISPR gRNA sequence
atgctacaccagaatgtcct

SEQ ID NO: 458777 - DNA, 20 bp, Artificial
  CRISPR gRNA sequence
caccagaatgtcctggtgac

SEQ ID NO: 458778 - DNA, 20 bp, Artificial
  CRISPR gRNA sequence
gtgactcttgaaacatggaa

SEQ ID NO: 458779 - DNA, 20 bp, Artificial
  CRISPR gRNA sequence
ttgaaacatggaatattaag

SEQ ID NO: 458780 - DNA, 20 bp, Artificial
  CRISPR gRNA sequence
gaaacatggaatattaagtg

SEQ ID NO: 458781 - DNA, 20 bp, Artificial
  CRISPR gRNA sequence
aaacatggaatattaagtga

SEQ ID NO: 458782 - DNA, 20 bp, Artificial
  CRISPR gRNA sequence
agtgacaaagaggataaatg

SEQ ID NO: 458783 - DNA, 20 bp, Artificial
  CRISPR gRNA sequence
tattcaaagaggaagacaaa

SEQ ID NO: 458784 - DNA, 20 bp, Artificial
  CRISPR gRNA sequence
attcaaagaggaagacaaag

SEQ ID NO: 458785 - DNA, 20 bp, Artificial
  CRISPR gRNA sequence
ttcaaagaggaagacaaaga

SEQ ID NO: 458786 - DNA, 20 bp, Artificial
  CRISPR gRNA sequence
aaagaggaagacaaagaagg

SEQ ID NO: 458787 - DNA, 20 bp, Artificial
  CRISPR gRNA sequence
caattattcattcagcccag

SEQ ID NO: 458788 - DNA, 20 bp, Artificial
  CRISPR gRNA sequence
ttcattcagcccagaattat

SEQ ID NO: 458789 - DNA, 20 bp, Artificial
  CRISPR gRNA sequence
attcagcccagaattatggt

SEQ ID NO: 458790 - DNA, 20 bp, Artificial
  CRISPR gRNA sequence
agcccagaattatggttaaa

SEQ ID NO: 458791 - DNA, 20 bp, Artificial
  CRISPR gRNA sequence
tggttaaaaagcgtagactc

SEQ ID NO: 458792 - DNA, 20 bp, Artificial
  CRISPR gRNA sequence
aaaagcgtagactctagagc

SEQ ID NO: 458793 - DNA, 20 bp, Artificial
  CRISPR gRNA sequence
tagagccagagtgtttgtgt

SEQ ID NO: 458794 - DNA, 20 bp, Artificial
  CRISPR gRNA sequence
gagccagagtgtttgtgttc

SEQ ID NO: 458795 - DNA, 20 bp, Artificial
  CRISPR gRNA sequence
gtgttcaaatcctggtccta

SEQ ID NO: 458796 - DNA, 20 bp, Artificial
  CRISPR gRNA sequence
tgttcaaatcctggtcctaa

SEQ ID NO: 458797 - DNA, 20 bp, Artificial
  CRISPR gRNA sequence
aaatcctggtcctaaaactt

SEQ ID NO: 458798 - DNA, 20 bp, Artificial
  CRISPR gRNA sequence
gtcctaaaacttaatagtgg

SEQ ID NO: 458799 - DNA, 20 bp, Artificial
  CRISPR gRNA sequence
aaacttaatagtggcgccgg

SEQ ID NO: 458800 - DNA, 20 bp, Artificial
  CRISPR gRNA sequence
aatagtggcgccgggcgcgg

SEQ ID NO: 458801 - DNA, 20 bp, Artificial
  CRISPR gRNA sequence
atagtggcgccgggcgcggt

SEQ ID NO: 458802 - DNA, 20 bp, Artificial
  CRISPR gRNA sequence
acgcctgtaatcccagcact

SEQ ID NO: 458803 - DNA, 20 bp, Artificial
  CRISPR gRNA sequence
taatcccagcactttgggag

SEQ ID NO: 458804 - DNA, 20 bp, Artificial
  CRISPR gRNA sequence
tgggaggccgaggtgggcag

SEQ ID NO: 458805 - DNA, 20 bp, Artificial
  CRISPR gRNA sequence
gggaggccgaggtgggcaga

SEQ ID NO: 458806 - DNA, 20 bp, Artificial
  CRISPR gRNA sequence
ggaggccgaggtgggcagat

SEQ ID NO: 458807 - DNA, 20 bp, Artificial
  CRISPR gRNA sequence
gctaacacggtgaaacccca

SEQ ID NO: 458808 - DNA, 20 bp, Artificial
  CRISPR gRNA sequence
acacggtgaaaccccatctc

SEQ ID NO: 458809 - DNA, 20 bp, Artificial
  CRISPR gRNA sequence
tactaaaaaaaatacaaaaa

SEQ ID NO: 458810 - DNA, 20 bp, Artificial
  CRISPR gRNA sequence
ctaaaaaaaatacaaaaaat

SEQ ID NO: 458811 - DNA, 20 bp, Artificial
  CRISPR gRNA sequence
aaaaaaatacaaaaaattag

SEQ ID NO: 458812 - DNA, 20 bp, Artificial
  CRISPR gRNA sequence
gccgggcgtggtggcgggcg

SEQ ID NO: 458813 - DNA, 20 bp, Artificial
  CRISPR gRNA sequence
tagtcccagctactcgggag

SEQ ID NO: 458814 - DNA, 20 bp, Artificial
  CRISPR gRNA sequence
ctcgggaggctgaggcagga

SEQ ID NO: 458815 - DNA, 20 bp, Artificial
  CRISPR gRNA sequence
gggaggctgaggcaggagaa

SEQ ID NO: 458816 - DNA, 20 bp, Artificial
  CRISPR gRNA sequence
aggcaggagaatggcgtgag

SEQ ID NO: 458817 - DNA, 20 bp, Artificial
  CRISPR gRNA sequence
gcagtgagctgagatcgcgc

SEQ ID NO: 458818 - DNA, 20 bp, Artificial
  CRISPR gRNA sequence
cagtgagctgagatcgcgct

SEQ ID NO: 458819 - DNA, 20 bp, Artificial
  CRISPR gRNA sequence
agatcgcgctactgcactcc

SEQ ID NO: 458820 - DNA, 20 bp, Artificial
  CRISPR gRNA sequence
ctgcactccagcctgggcga

SEQ ID NO: 458821 - DNA, 20 bp, Artificial
  CRISPR gRNA sequence
cactccagcctgggcgacag

SEQ ID NO: 458822 - DNA, 20 bp, Artificial
  CRISPR gRNA sequence
cagcctgggcgacagagcaa

SEQ ID NO: 458823 - DNA, 20 bp, Artificial
  CRISPR gRNA sequence
ggcgacagagcaagattctg

SEQ ID NO: 458824 - DNA, 20 bp, Artificial
  CRISPR gRNA sequence
tgtctcgaaaaaacaaaaat

SEQ ID NO: 458825 - DNA, 20 bp, Artificial
  CRISPR gRNA sequence
tctcgaaaaaacaaaaataa

SEQ ID NO: 458826 - DNA, 20 bp, Artificial
  CRISPR gRNA sequence
gaaaaaacaaaaataaaaac

SEQ ID NO: 458827 - DNA, 20 bp, Artificial
  CRISPR gRNA sequence
aatagttgcatgactcggtc

SEQ ID NO: 458828 - DNA, 20 bp, Artificial
  CRISPR gRNA sequence
atagttgcatgactcggtca

SEQ ID NO: 458829 - DNA, 20 bp, Artificial
  CRISPR gRNA sequence
catgactcggtcaagtttct

SEQ ID NO: 458830 - DNA, 20 bp, Artificial
  CRISPR gRNA sequence
ggtcaagtttcttaggctcc

SEQ ID NO: 458831 - DNA, 20 bp, Artificial
  CRISPR gRNA sequence
cttaggctcctgggccaggc

SEQ ID NO: 458832 - DNA, 20 bp, Artificial
  CRISPR gRNA sequence
ttaggctcctgggccaggcg

SEQ ID NO: 458833 - DNA, 20 bp, Artificial
  CRISPR gRNA sequence
aggctcctgggccaggcgct

SEQ ID NO: 458834 - DNA, 20 bp, Artificial
  CRISPR gRNA sequence
ggctcctgggccaggcgcta

SEQ ID NO: 458835 - DNA, 20 bp, Artificial
  CRISPR gRNA sequence
ctgggccaggcgctatgctc

SEQ ID NO: 458836 - DNA, 20 bp, Artificial
  CRISPR gRNA sequence
ggccaggcgctatgctcagc

SEQ ID NO: 458837 - DNA, 20 bp, Artificial
  CRISPR gRNA sequence
tgctcagcctttaataaata

SEQ ID NO: 458838 - DNA, 20 bp, Artificial
  CRISPR gRNA sequence
agcctttaataaatagacat

SEQ ID NO: 458839 - DNA, 20 bp, Artificial
  CRISPR gRNA sequence
taataaatagacatatttca

SEQ ID NO: 458840 - DNA, 20 bp, Artificial
  CRISPR gRNA sequence
aataaatagacatatttcag

SEQ ID NO: 458841 - DNA, 20 bp, Artificial
  CRISPR gRNA sequence
ataaatagacatatttcaga

SEQ ID NO: 458842 - DNA, 20 bp, Artificial
  CRISPR gRNA sequence
cagaaacacggagcatctat

SEQ ID NO: 458843 - DNA, 20 bp, Artificial
  CRISPR gRNA sequence
agaaacacggagcatctata

SEQ ID NO: 458844 - DNA, 20 bp, Artificial
  CRISPR gRNA sequence
taatgtgtcagacaccatgg

SEQ ID NO: 458845 - DNA, 20 bp, Artificial
  CRISPR gRNA sequence
acacagcagaggcggacgtt

SEQ ID NO: 458846 - DNA, 20 bp, Artificial
  CRISPR gRNA sequence
tagtggttaaatggtctcta

SEQ ID NO: 458847 - DNA, 20 bp, Artificial
  CRISPR gRNA sequence
agtggttaaatggtctctag

SEQ ID NO: 458848 - DNA, 20 bp, Artificial
  CRISPR gRNA sequence
gtggttaaatggtctctaga

SEQ ID NO: 458849 - DNA, 20 bp, Artificial
  CRISPR gRNA sequence
aatggtctctagagtcagac

SEQ ID NO: 458850 - DNA, 20 bp, Artificial
  CRISPR gRNA sequence
tagagtcagaccaggatgtt

SEQ ID NO: 458851 - DNA, 20 bp, Artificial
  CRISPR gRNA sequence
gagtcagaccaggatgtttc

SEQ ID NO: 458852 - DNA, 20 bp, Artificial
  CRISPR gRNA sequence
cagatctggctttgaaactt

SEQ ID NO: 458853 - DNA, 20 bp, Artificial
  CRISPR gRNA sequence
agatctggctttgaaactta

SEQ ID NO: 458854 - DNA, 20 bp, Artificial
  CRISPR gRNA sequence
gctttgaaacttaactatct

SEQ ID NO: 458855 - DNA, 20 bp, Artificial
  CRISPR gRNA sequence
tgaaacttaactatctgtgt

SEQ ID NO: 458856 - DNA, 20 bp, Artificial
  CRISPR gRNA sequence
gaaacttaactatctgtgta

SEQ ID NO: 458857 - DNA, 20 bp, Artificial
  CRISPR gRNA sequence
aaacttaactatctgtgtaa

SEQ ID NO: 458858 - DNA, 20 bp, Artificial
  CRISPR gRNA sequence
aactatctgtgtaatattgg

SEQ ID NO: 458859 - DNA, 20 bp, Artificial
  CRISPR gRNA sequence
actatctgtgtaatattggg

SEQ ID NO: 458860 - DNA, 20 bp, Artificial
  CRISPR gRNA sequence
tctgtgtaatattgggcaag

SEQ ID NO: 458861 - DNA, 20 bp, Artificial
  CRISPR gRNA sequence
tgtaatattgggcaagtttc

SEQ ID NO: 458862 - DNA, 20 bp, Artificial
  CRISPR gRNA sequence
ggcaagtttcttaatctctt

SEQ ID NO: 458863 - DNA, 20 bp, Artificial
  CRISPR gRNA sequence
cttaatctcttaatgaccta

SEQ ID NO: 458864 - DNA, 20 bp, Artificial
  CRISPR gRNA sequence
ttaatctcttaatgacctat

SEQ ID NO: 458865 - DNA, 20 bp, Artificial
  CRISPR gRNA sequence
aatctcttaatgacctataa

SEQ ID NO: 458866 - DNA, 20 bp, Artificial
  CRISPR gRNA sequence
atctcttaatgacctataaa

SEQ ID NO: 458867 - DNA, 20 bp, Artificial
  CRISPR gRNA sequence
ttaatgacctataaaatggt

SEQ ID NO: 458868 - DNA, 20 bp, Artificial
  CRISPR gRNA sequence
aatgacctataaaatggtga

SEQ ID NO: 458869 - DNA, 20 bp, Artificial
  CRISPR gRNA sequence
atgacctataaaatggtgac

SEQ ID NO: 458870 - DNA, 20 bp, Artificial
  CRISPR gRNA sequence
taaaatggtgacaaaatatt

SEQ ID NO: 458871 - DNA, 20 bp, Artificial
  CRISPR gRNA sequence
tcttccttgggttgtgaggg

SEQ ID NO: 458872 - DNA, 20 bp, Artificial
  CRISPR gRNA sequence
ttccttgggttgtgagggtc

SEQ ID NO: 458873 - DNA, 20 bp, Artificial
  CRISPR gRNA sequence
ccttgggttgtgagggtcaa

SEQ ID NO: 458874 - DNA, 20 bp, Artificial
  CRISPR gRNA sequence
cttgggttgtgagggtcaaa

SEQ ID NO: 458875 - DNA, 20 bp, Artificial
  CRISPR gRNA sequence
gggttgtgagggtcaaatga

SEQ ID NO: 458876 - DNA, 20 bp, Artificial
  CRISPR gRNA sequence
ggttgtgagggtcaaatgag

SEQ ID NO: 458877 - DNA, 20 bp, Artificial
  CRISPR gRNA sequence
tgagggtcaaatgaggtcac

SEQ ID NO: 458878 - DNA, 20 bp, Artificial
  CRISPR gRNA sequence
tgtaaattacttagcacagt

SEQ ID NO: 458879 - DNA, 20 bp, Artificial
  CRISPR gRNA sequence
cttagcacagtgcctggcag

SEQ ID NO: 458880 - DNA, 20 bp, Artificial
  CRISPR gRNA sequence
agcacagtgcctggcagaga

SEQ ID NO: 458881 - DNA, 20 bp, Artificial
  CRISPR gRNA sequence
gcacagtgcctggcagagag

SEQ ID NO: 458882 - DNA, 20 bp, Artificial
  CRISPR gRNA sequence
gcagagagtaagggctcaat

SEQ ID NO: 458883 - DNA, 20 bp, Artificial
  CRISPR gRNA sequence
aataaatgatagctatgatt

SEQ ID NO: 458884 - DNA, 20 bp, Artificial
  CRISPR gRNA sequence
tgattagttttatgctttct

SEQ ID NO: 458885 - DNA, 20 bp, Artificial
  CRISPR gRNA sequence
gttttatgctttcttatatt

SEQ ID NO: 458886 - DNA, 20 bp, Artificial
  CRISPR gRNA sequence
tatgctttcttatattggaa

SEQ ID NO: 458887 - DNA, 20 bp, Artificial
  CRISPR gRNA sequence
atgctttcttatattggaat

SEQ ID NO: 458888 - DNA, 20 bp, Artificial
  CRISPR gRNA sequence
tgctttcttatattggaatc

SEQ ID NO: 458889 - DNA, 20 bp, Artificial
  CRISPR gRNA sequence
tcttatattggaatcaatgg

SEQ ID NO: 458890 - DNA, 20 bp, Artificial
  CRISPR gRNA sequence
cttatattggaatcaatgga

SEQ ID NO: 458891 - DNA, 20 bp, Artificial
  CRISPR gRNA sequence
ttatattggaatcaatggac

SEQ ID NO: 458892 - DNA, 20 bp, Artificial
  CRISPR gRNA sequence
atattggaatcaatggacag

SEQ ID NO: 458893 - DNA, 20 bp, Artificial
  CRISPR gRNA sequence
tattggaatcaatggacagt

SEQ ID NO: 458894 - DNA, 20 bp, Artificial
  CRISPR gRNA sequence
gaatcaatggacagtgttcc

SEQ ID NO: 458895 - DNA, 20 bp, Artificial
  CRISPR gRNA sequence
caggcacatctacctgcaag

SEQ ID NO: 458896 - DNA, 20 bp, Artificial
  CRISPR gRNA sequence
cctgcaagactgtgtttagt

SEQ ID NO: 458897 - DNA, 20 bp, Artificial
  CRISPR gRNA sequence
caagactgtgtttagtcctt

SEQ ID NO: 458898 - DNA, 20 bp, Artificial
  CRISPR gRNA sequence
tgtttagtccttataaaaca

SEQ ID NO: 458899 - DNA, 20 bp, Artificial
  CRISPR gRNA sequence
agtccttataaaacactaag

SEQ ID NO: 458900 - DNA, 20 bp, Artificial
  CRISPR gRNA sequence
gtccttataaaacactaagc

SEQ ID NO: 458901 - DNA, 20 bp, Artificial
  CRISPR gRNA sequence
ataaaacactaagccattat

SEQ ID NO: 458902 - DNA, 20 bp, Artificial
  CRISPR gRNA sequence
taaaacactaagccattatt

SEQ ID NO: 458903 - DNA, 20 bp, Artificial
  CRISPR gRNA sequence
agccattattattttctaaa

SEQ ID NO: 458904 - DNA, 20 bp, Artificial
  CRISPR gRNA sequence
ttattttctaaaatttatta

SEQ ID NO: 458905 - DNA, 20 bp, Artificial
  CRISPR gRNA sequence
ttttctaaaatttattattt

SEQ ID NO: 458906 - DNA, 20 bp, Artificial
  CRISPR gRNA sequence
tctaaaatttattatttgta

SEQ ID NO: 458907 - DNA, 20 bp, Artificial
  CRISPR gRNA sequence
ctaaaatttattatttgtac

SEQ ID NO: 458908 - DNA, 20 bp, Artificial
  CRISPR gRNA sequence
taaaatttattatttgtacg

SEQ ID NO: 458909 - DNA, 20 bp, Artificial
  CRISPR gRNA sequence
aaatttattatttgtacgaa

SEQ ID NO: 458910 - DNA, 20 bp, Artificial
  CRISPR gRNA sequence
attatttgtacgaagcatat

SEQ ID NO: 458911 - DNA, 20 bp, Artificial
  CRISPR gRNA sequence
ttatttgtacgaagcatata

SEQ ID NO: 458912 - DNA, 20 bp, Artificial
  CRISPR gRNA sequence
tttgtacgaagcatatagag

SEQ ID NO: 458913 - DNA, 20 bp, Artificial
  CRISPR gRNA sequence
gtacgaagcatatagaggct

SEQ ID NO: 458914 - DNA, 20 bp, Artificial
  CRISPR gRNA sequence
tacgaagcatatagaggctt

SEQ ID NO: 458915 - DNA, 20 bp, Artificial
  CRISPR gRNA sequence
ggaggggacttgtgacttgc

SEQ ID NO: 458916 - DNA, 20 bp, Artificial
  CRISPR gRNA sequence
gaggggacttgtgacttgct

SEQ ID NO: 458917 - DNA, 20 bp, Artificial
  CRISPR gRNA sequence
gtgacttgcttaaaatcaca

SEQ ID NO: 458918 - DNA, 20 bp, Artificial
  CRISPR gRNA sequence
tgacttgcttaaaatcacag

SEQ ID NO: 458919 - DNA, 20 bp, Artificial
  CRISPR gRNA sequence
gcttaaaatcacagctccta

SEQ ID NO: 458920 - DNA, 20 bp, Artificial
  CRISPR gRNA sequence
cttaaaatcacagctcctaa

SEQ ID NO: 458921 - DNA, 20 bp, Artificial
  CRISPR gRNA sequence
aaaatcacagctcctaagtt

SEQ ID NO: 458922 - DNA, 20 bp, Artificial
  CRISPR gRNA sequence
aaatcacagctcctaagttg

SEQ ID NO: 458923 - DNA, 20 bp, Artificial
  CRISPR gRNA sequence
ctaagttggggagcaggact

SEQ ID NO: 458924 - DNA, 20 bp, Artificial
  CRISPR gRNA sequence
agttggggagcaggactcta

SEQ ID NO: 458925 - DNA, 20 bp, Artificial
  CRISPR gRNA sequence
gggagcaggactctaaccca

SEQ ID NO: 458926 - DNA, 20 bp, Artificial
  CRISPR gRNA sequence
taacccaagttatgagagtc

SEQ ID NO: 458927 - DNA, 20 bp, Artificial
  CRISPR gRNA sequence
acccaagttatgagagtctt

SEQ ID NO: 458928 - DNA, 20 bp, Artificial
  CRISPR gRNA sequence
tgagagtctttctcttggag

SEQ ID NO: 458929 - DNA, 20 bp, Artificial
  CRISPR gRNA sequence
tctcttggagtcccctttgt

SEQ ID NO: 458930 - DNA, 20 bp, Artificial
  CRISPR gRNA sequence
ctcttggagtcccctttgtc

SEQ ID NO: 458931 - DNA, 20 bp, Artificial
  CRISPR gRNA sequence
tcttggagtcccctttgtcc

SEQ ID NO: 458932 - DNA, 20 bp, Artificial
  CRISPR gRNA sequence
ttggagtcccctttgtccct

SEQ ID NO: 458933 - DNA, 20 bp, Artificial
  CRISPR gRNA sequence
ggagtcccctttgtccctct

SEQ ID NO: 458934 - DNA, 20 bp, Artificial
  CRISPR gRNA sequence
gagtcccctttgtccctctc

SEQ ID NO: 458935 - DNA, 20 bp, Artificial
  CRISPR gRNA sequence
tgtccctctcctcacagccg

SEQ ID NO: 458936 - DNA, 20 bp, Artificial
  CRISPR gRNA sequence
gtccctctcctcacagccgc

SEQ ID NO: 458937 - DNA, 20 bp, Artificial
  CRISPR gRNA sequence
tccctctcctcacagccgct

SEQ ID NO: 458938 - DNA, 20 bp, Artificial
  CRISPR gRNA sequence
tcctcacagccgctcatcca

SEQ ID NO: 458939 - DNA, 20 bp, Artificial
  CRISPR gRNA sequence
ctcacagccgctcatccatt

SEQ ID NO: 458940 - DNA, 20 bp, Artificial
  CRISPR gRNA sequence
acagccgctcatccattcac

SEQ ID NO: 458941 - DNA, 20 bp, Artificial
  CRISPR gRNA sequence
atccattcacgaacagctgt

SEQ ID NO: 458942 - DNA, 20 bp, Artificial
  CRISPR gRNA sequence
acgaacagctgttaacacaa

SEQ ID NO: 458943 - DNA, 20 bp, Artificial
  CRISPR gRNA sequence
ttaacacaagaacgactgta

SEQ ID NO: 458944 - DNA, 20 bp, Artificial
  CRISPR gRNA sequence
acacaagaacgactgtacta

SEQ ID NO: 458945 - DNA, 20 bp, Artificial
  CRISPR gRNA sequence
tactaagtaataaggtcata

SEQ ID NO: 458946 - DNA, 20 bp, Artificial
  CRISPR gRNA sequence
agtaataaggtcataaagtg

SEQ ID NO: 458947 - DNA, 20 bp, Artificial
  CRISPR gRNA sequence
tggatgagggatgtggaaag

SEQ ID NO: 458948 - DNA, 20 bp, Artificial
  CRISPR gRNA sequence
gatgagggatgtggaaaggc

SEQ ID NO: 458949 - DNA, 20 bp, Artificial
  CRISPR gRNA sequence
caagatggcaatgaagttag

SEQ ID NO: 458950 - DNA, 20 bp, Artificial
  CRISPR gRNA sequence
ggccttcatagttgtttgtg

SEQ ID NO: 458951 - DNA, 20 bp, Artificial
  CRISPR gRNA sequence
catagttgtttgtgggctct

SEQ ID NO: 458952 - DNA, 20 bp, Artificial
  CRISPR gRNA sequence
atagttgtttgtgggctctc

SEQ ID NO: 458953 - DNA, 20 bp, Artificial
  CRISPR gRNA sequence
tttgtgggctctcgggagct

SEQ ID NO: 458954 - DNA, 20 bp, Artificial
  CRISPR gRNA sequence
gtgggctctcgggagctggt

SEQ ID NO: 458955 - DNA, 20 bp, Artificial
  CRISPR gRNA sequence
tgggctctcgggagctggtg

SEQ ID NO: 458956 - DNA, 20 bp, Artificial
  CRISPR gRNA sequence
tcgggagctggtgactaaag

SEQ ID NO: 458957 - DNA, 20 bp, Artificial
  CRISPR gRNA sequence
gggagctggtgactaaagaa

SEQ ID NO: 458958 - DNA, 20 bp, Artificial
  CRISPR gRNA sequence
gtgactaaagaatacggtgg

SEQ ID NO: 458959 - DNA, 20 bp, Artificial
  CRISPR gRNA sequence
aagaatacggtgggtgaatt

SEQ ID NO: 458960 - DNA, 20 bp, Artificial
  CRISPR gRNA sequence
aggtggggaatgggctgagg

SEQ ID NO: 458961 - DNA, 20 bp, Artificial
  CRISPR gRNA sequence
aggagatctggcttccagtc

SEQ ID NO: 458962 - DNA, 20 bp, Artificial
  CRISPR gRNA sequence
gcttccagtcctggctccgc

SEQ ID NO: 458963 - DNA, 20 bp, Artificial
  CRISPR gRNA sequence
ccagtcctggctccgcacta

SEQ ID NO: 458964 - DNA, 20 bp, Artificial
  CRISPR gRNA sequence
cagtcctggctccgcactag

SEQ ID NO: 458965 - DNA, 20 bp, Artificial
  CRISPR gRNA sequence
gctccgcactaggtagctgt

SEQ ID NO: 458966 - DNA, 20 bp, Artificial
  CRISPR gRNA sequence
cgcactaggtagctgtggaa

SEQ ID NO: 458967 - DNA, 20 bp, Artificial
  CRISPR gRNA sequence
ggtagctgtggaatgttgac

SEQ ID NO: 458968 - DNA, 20 bp, Artificial
  CRISPR gRNA sequence
tggaatgttgacaaggtcgt

SEQ ID NO: 458969 - DNA, 20 bp, Artificial
  CRISPR gRNA sequence
acaaggtcgtgtcccttctc

SEQ ID NO: 458970 - DNA, 20 bp, Artificial
  CRISPR gRNA sequence
ctctaggcgtgtttcctaag

SEQ ID NO: 458971 - DNA, 20 bp, Artificial
  CRISPR gRNA sequence
tctaggcgtgtttcctaagg

SEQ ID NO: 458972 - DNA, 20 bp, Artificial
  CRISPR gRNA sequence
taggcgtgtttcctaaggga

SEQ ID NO: 458973 - DNA, 20 bp, Artificial
  CRISPR gRNA sequence
ggcgtgtttcctaagggact

SEQ ID NO: 458974 - DNA, 20 bp, Artificial
  CRISPR gRNA sequence
cctaagggactggtgcagcg

SEQ ID NO: 458975 - DNA, 20 bp, Artificial
  CRISPR gRNA sequence
ctaagggactggtgcagcgg

SEQ ID NO: 458976 - DNA, 20 bp, Artificial
  CRISPR gRNA sequence
agggactggtgcagcgggat

SEQ ID NO: 458977 - DNA, 20 bp, Artificial
  CRISPR gRNA sequence
gtgcagcgggatgggagggg

SEQ ID NO: 458978 - DNA, 20 bp, Artificial
  CRISPR gRNA sequence
ccaaggagagagaggacagg

SEQ ID NO: 458979 - DNA, 20 bp, Artificial
  CRISPR gRNA sequence
caaggagagagaggacaggc

SEQ ID NO: 458980 - DNA, 20 bp, Artificial
  CRISPR gRNA sequence
atgcagctggtcactccgct

SEQ ID NO: 458981 - DNA, 20 bp, Artificial
  CRISPR gRNA sequence
gtcactccgctggagtggcc

SEQ ID NO: 458982 - DNA, 20 bp, Artificial
  CRISPR gRNA sequence
cgctggagtggccagacttc

SEQ ID NO: 458983 - DNA, 20 bp, Artificial
  CRISPR gRNA sequence
gagtggccagacttcgcggt

SEQ ID NO: 458984 - DNA, 20 bp, Artificial
  CRISPR gRNA sequence
cgcggtgcctagggccgagt

SEQ ID NO: 458985 - DNA, 20 bp, Artificial
  CRISPR gRNA sequence
gcggtgcctagggccgagtt

SEQ ID NO: 458986 - DNA, 20 bp, Artificial
  CRISPR gRNA sequence
gggccgagttgaagaagagc

SEQ ID NO: 458987 - DNA, 20 bp, Artificial
  CRISPR gRNA sequence
aagaagagcatgtaagtctg

SEQ ID NO: 458988 - DNA, 20 bp, Artificial
  CRISPR gRNA sequence
ttgtgggcccctcaccagcg

SEQ ID NO: 458989 - DNA, 20 bp, Artificial
  CRISPR gRNA sequence
tgggcccctcaccagcgctg

SEQ ID NO: 458990 - DNA, 20 bp, Artificial
  CRISPR gRNA sequence
accagcgctggggggcagcg

SEQ ID NO: 458991 - DNA, 20 bp, Artificial
  CRISPR gRNA sequence
gggggcagcgaggtcactgg

SEQ ID NO: 458992 - DNA, 20 bp, Artificial
  CRISPR gRNA sequence
ggcaaggatgctctgggaag

SEQ ID NO: 458993 - DNA, 20 bp, Artificial
  CRISPR gRNA sequence
tgggaagtgaccttggtgcc

SEQ ID NO: 458994 - DNA, 20 bp, Artificial
  CRISPR gRNA sequence
ggaagtgaccttggtgcccg

SEQ ID NO: 458995 - DNA, 20 bp, Artificial
  CRISPR gRNA sequence
ggtgcccgggaggggagcac

SEQ ID NO: 458996 - DNA, 20 bp, Artificial
  CRISPR gRNA sequence
gtgcccgggaggggagcacc

SEQ ID NO: 458997 - DNA, 20 bp, Artificial
  CRISPR gRNA sequence
ttgtgatgcaggcggggcag

SEQ ID NO: 458998 - DNA, 20 bp, Artificial
  CRISPR gRNA sequence
tgatgcaggcggggcagcgc

SEQ ID NO: 458999 - DNA, 20 bp, Artificial
  CRISPR gRNA sequence
atttcgcactctggccgcta

SEQ ID NO: 459000 - DNA, 20 bp, Artificial
  CRISPR gRNA sequence
cgcactctggccgctagagg

SEQ ID NO: 459001 - DNA, 20 bp, Artificial
  CRISPR gRNA sequence
gcactctggccgctagaggg

SEQ ID NO: 459002 - DNA, 20 bp, Artificial
  CRISPR gRNA sequence
tggccgctagagggcgctgc

SEQ ID NO: 459003 - DNA, 20 bp, Artificial
  CRISPR gRNA sequence
gccgctagagggcgctgcct

SEQ ID NO: 459004 - DNA, 20 bp, Artificial
  CRISPR gRNA sequence
gagggcgctgcctttcagcc

SEQ ID NO: 459005 - DNA, 20 bp, Artificial
  CRISPR gRNA sequence
cctttcagccaaagccgagt

SEQ ID NO: 459006 - DNA, 20 bp, Artificial
  CRISPR gRNA sequence
tcagccaaagccgagtgacc

SEQ ID NO: 459007 - DNA, 20 bp, Artificial
  CRISPR gRNA sequence
cagccaaagccgagtgaccc

SEQ ID NO: 459008 - DNA, 20 bp, Artificial
  CRISPR gRNA sequence
agccaaagccgagtgacccc

SEQ ID NO: 459009 - DNA, 20 bp, Artificial
  CRISPR gRNA sequence
cctgccccgcgttggcccgc

SEQ ID NO: 459010 - DNA, 20 bp, Artificial
  CRISPR gRNA sequence
ccccgcgttggcccgcgtca

SEQ ID NO: 459011 - DNA, 20 bp, Artificial
  CRISPR gRNA sequence
gcccgcgtcactccagccat

SEQ ID NO: 459012 - DNA, 20 bp, Artificial
  CRISPR gRNA sequence
cagccatgggccatccagcg

SEQ ID NO: 459013 - DNA, 20 bp, Artificial
  CRISPR gRNA sequence
gccagggaaagtctaaacta

SEQ ID NO: 459014 - DNA, 20 bp, Artificial
  CRISPR gRNA sequence
aactaggaggggagatgagg

SEQ ID NO: 459015 - DNA, 20 bp, Artificial
  CRISPR gRNA sequence
ggaggggagatgagggggtg

SEQ ID NO: 459016 - DNA, 20 bp, Artificial
  CRISPR gRNA sequence
ggcctggtgggtcctgggga

SEQ ID NO: 459017 - DNA, 20 bp, Artificial
  CRISPR gRNA sequence
gtgggtcctggggacgcagc

SEQ ID NO: 459018 - DNA, 20 bp, Artificial
  CRISPR gRNA sequence
gggacgcagcatgtactaga

SEQ ID NO: 459019 - DNA, 20 bp, Artificial
  CRISPR gRNA sequence
gagcggcacctggccctcaa

SEQ ID NO: 459020 - DNA, 20 bp, Artificial
  CRISPR gRNA sequence
gccctcaacagaggggagag

SEQ ID NO: 459021 - DNA, 20 bp, Artificial
  CRISPR gRNA sequence
aacagaggggagagcgggtg

SEQ ID NO: 459022 - DNA, 20 bp, Artificial
  CRISPR gRNA sequence
ggaattttccgggcccacta

SEQ ID NO: 459023 - DNA, 20 bp, Artificial
  CRISPR gRNA sequence
tccgggcccactacacgcca

SEQ ID NO: 459024 - DNA, 20 bp, Artificial
  CRISPR gRNA sequence
ccgggcccactacacgccag

SEQ ID NO: 459025 - DNA, 20 bp, Artificial
  CRISPR gRNA sequence
cgggcccactacacgccagg

SEQ ID NO: 459026 - DNA, 20 bp, Artificial
  CRISPR gRNA sequence
cacgccaggggcgggtctcc

SEQ ID NO: 459027 - DNA, 20 bp, Artificial
  CRISPR gRNA sequence
ccctcttaaaacgttgtgag

SEQ ID NO: 459028 - DNA, 20 bp, Artificial
  CRISPR gRNA sequence
ttaaaacgttgtgagcccca

SEQ ID NO: 459029 - DNA, 20 bp, Artificial
  CRISPR gRNA sequence
aaaacgttgtgagccccagc

SEQ ID NO: 459030 - DNA, 20 bp, Artificial
  CRISPR gRNA sequence
aaacgttgtgagccccagcg

SEQ ID NO: 459031 - DNA, 20 bp, Artificial
  CRISPR gRNA sequence
tgagccccagcgcgggcagg

SEQ ID NO: 459032 - DNA, 20 bp, Artificial
  CRISPR gRNA sequence
gcatcctcatctttgatggt

SEQ ID NO: 459033 - DNA, 20 bp, Artificial
  CRISPR gRNA sequence
atctttgatggtccccgggg

SEQ ID NO: 459034 - DNA, 20 bp, Artificial
  CRISPR gRNA sequence
tgatggtccccggggctcct

SEQ ID NO: 459035 - DNA, 20 bp, Artificial
  CRISPR gRNA sequence
gatggtccccggggctcctg

SEQ ID NO: 459036 - DNA, 20 bp, Artificial
  CRISPR gRNA sequence
atggtccccggggctcctga

SEQ ID NO: 459037 - DNA, 20 bp, Artificial
  CRISPR gRNA sequence
ctgagctgcgctggtggccc

SEQ ID NO: 459038 - DNA, 20 bp, Artificial
  CRISPR gRNA sequence
agctgcgctggtggccccag

SEQ ID NO: 459039 - DNA, 20 bp, Artificial
  CRISPR gRNA sequence
cgctggtggccccagggctc

SEQ ID NO: 459040 - DNA, 20 bp, Artificial
  CRISPR gRNA sequence
gtggccccagggctcggtgc

SEQ ID NO: 459041 - DNA, 20 bp, Artificial
  CRISPR gRNA sequence
ggtgcctctctcaggcgaca

SEQ ID NO: 459042 - DNA, 20 bp, Artificial
  CRISPR gRNA sequence
tctcaggcgacagctcacag

SEQ ID NO: 459043 - DNA, 20 bp, Artificial
  CRISPR gRNA sequence
tcaggcgacagctcacagac

SEQ ID NO: 459044 - DNA, 20 bp, Artificial
  CRISPR gRNA sequence
aggcgacagctcacagacgg

SEQ ID NO: 459045 - DNA, 20 bp, Artificial
  CRISPR gRNA sequence
acagacggcgggaaactctt

SEQ ID NO: 459046 - DNA, 20 bp, Artificial
  CRISPR gRNA sequence
ttccctcccgcaccttcgga

SEQ ID NO: 459047 - DNA, 20 bp, Artificial
  CRISPR gRNA sequence
ccctcccgcaccttcggagg

SEQ ID NO: 459048 - DNA, 20 bp, Artificial
  CRISPR gRNA sequence
cctcccgcaccttcggaggc

SEQ ID NO: 459049 - DNA, 20 bp, Artificial
  CRISPR gRNA sequence
ccgcaccttcggaggcggtc

SEQ ID NO: 459050 - DNA, 20 bp, Artificial
  CRISPR gRNA sequence
cggaggcggtcctggagtct

SEQ ID NO: 459051 - DNA, 20 bp, Artificial
  CRISPR gRNA sequence
ggaggcggtcctggagtctt

SEQ ID NO: 459052 - DNA, 20 bp, Artificial
  CRISPR gRNA sequence
gagtcttgtggactcctggg

SEQ ID NO: 459053 - DNA, 20 bp, Artificial
  CRISPR gRNA sequence
gtggactcctgggttcaaat

SEQ ID NO: 459054 - DNA, 20 bp, Artificial
  CRISPR gRNA sequence
tggactcctgggttcaaatc

SEQ ID NO: 459055 - DNA, 20 bp, Artificial
  CRISPR gRNA sequence
ctgggttcaaatccaagctt

SEQ ID NO: 459056 - DNA, 20 bp, Artificial
  CRISPR gRNA sequence
ggttcaaatccaagctttgt

SEQ ID NO: 459057 - DNA, 20 bp, Artificial
  CRISPR gRNA sequence
aaatccaagctttgtgtgac

SEQ ID NO: 459058 - DNA, 20 bp, Artificial
  CRISPR gRNA sequence
tgtgtgaccagcacattgct

SEQ ID NO: 459059 - DNA, 20 bp, Artificial
  CRISPR gRNA sequence
gtgtgaccagcacattgctg

SEQ ID NO: 459060 - DNA, 20 bp, Artificial
  CRISPR gRNA sequence
tgtgaccagcacattgctgg

SEQ ID NO: 459061 - DNA, 20 bp, Artificial
  CRISPR gRNA sequence
ctggacctcactcagcctca

SEQ ID NO: 459062 - DNA, 20 bp, Artificial
  CRISPR gRNA sequence
gacctcactcagcctcacat

SEQ ID NO: 459063 - DNA, 20 bp, Artificial
  CRISPR gRNA sequence
actcagcctcacattcctct

SEQ ID NO: 459064 - DNA, 20 bp, Artificial
  CRISPR gRNA sequence
agcctcacattcctcttgtg

SEQ ID NO: 459065 - DNA, 20 bp, Artificial
  CRISPR gRNA sequence
acattcctcttgtgtttaaa

SEQ ID NO: 459066 - DNA, 20 bp, Artificial
  CRISPR gRNA sequence
ctcttgtgtttaaaactacc

SEQ ID NO: 459067 - DNA, 20 bp, Artificial
  CRISPR gRNA sequence
ttgtgtttaaaactacctca

SEQ ID NO: 459068 - DNA, 20 bp, Artificial
  CRISPR gRNA sequence
gtgtttaaaactacctcata

SEQ ID NO: 459069 - DNA, 20 bp, Artificial
  CRISPR gRNA sequence
tgtttaaaactacctcatag

SEQ ID NO: 459070 - DNA, 20 bp, Artificial
  CRISPR gRNA sequence
aaaactacctcataggaatg

SEQ ID NO: 459071 - DNA, 20 bp, Artificial
  CRISPR gRNA sequence
aaactacctcataggaatgt

SEQ ID NO: 459072 - DNA, 20 bp, Artificial
  CRISPR gRNA sequence
cctcataggaatgtggtgac

SEQ ID NO: 459073 - DNA, 20 bp, Artificial
  CRISPR gRNA sequence
ataggaatgtggtgacggtt

SEQ ID NO: 459074 - DNA, 20 bp, Artificial
  CRISPR gRNA sequence
gatgacacataaagctttgc

SEQ ID NO: 459075 - DNA, 20 bp, Artificial
  CRISPR gRNA sequence
tgccagaggttttctgggga

SEQ ID NO: 459076 - DNA, 20 bp, Artificial
  CRISPR gRNA sequence
gccagaggttttctggggag

SEQ ID NO: 459077 - DNA, 20 bp, Artificial
  CRISPR gRNA sequence
ccagaggttttctggggagg

SEQ ID NO: 459078 - DNA, 20 bp, Artificial
  CRISPR gRNA sequence
tctggggagggtggggacaa

SEQ ID NO: 459079 - DNA, 20 bp, Artificial
  CRISPR gRNA sequence
ctggggagggtggggacaag

SEQ ID NO: 459080 - DNA, 20 bp, Artificial
  CRISPR gRNA sequence
tggggagggtggggacaaga

SEQ ID NO: 459081 - DNA, 20 bp, Artificial
  CRISPR gRNA sequence
gggagggtggggacaagagg

SEQ ID NO: 459082 - DNA, 20 bp, Artificial
  CRISPR gRNA sequence
catttcctctgccaccggag

SEQ ID NO: 459083 - DNA, 20 bp, Artificial
  CRISPR gRNA sequence
cctctgccaccggagcccgg

SEQ ID NO: 459084 - DNA, 20 bp, Artificial
  CRISPR gRNA sequence
ctctgccaccggagcccgga

SEQ ID NO: 459085 - DNA, 20 bp, Artificial
  CRISPR gRNA sequence
tgccaccggagcccggatct

SEQ ID NO: 459086 - DNA, 20 bp, Artificial
  CRISPR gRNA sequence
ccaccggagcccggatctaa

SEQ ID NO: 459087 - DNA, 20 bp, Artificial
  CRISPR gRNA sequence
acctctcagaggagctggaa

SEQ ID NO: 459088 - DNA, 20 bp, Artificial
  CRISPR gRNA sequence
tcagaggagctggaaggtca

SEQ ID NO: 459089 - DNA, 20 bp, Artificial
  CRISPR gRNA sequence
agaggagctggaaggtcagc

SEQ ID NO: 459090 - DNA, 20 bp, Artificial
  CRISPR gRNA sequence
gaaggtcagctctgagctcc

SEQ ID NO: 459091 - DNA, 20 bp, Artificial
  CRISPR gRNA sequence
tgagctccacaaatacctct

SEQ ID NO: 459092 - DNA, 20 bp, Artificial
  CRISPR gRNA sequence
agctccacaaatacctctgt

SEQ ID NO: 459093 - DNA, 20 bp, Artificial
  CRISPR gRNA sequence
cacaaatacctctgtataca

SEQ ID NO: 459094 - DNA, 20 bp, Artificial
  CRISPR gRNA sequence
tgtatacagatctcccacga

SEQ ID NO: 459095 - DNA, 20 bp, Artificial
  CRISPR gRNA sequence
tatacagatctcccacgaca

SEQ ID NO: 459096 - DNA, 20 bp, Artificial
  CRISPR gRNA sequence
ccacgacactgaaaaagatg

SEQ ID NO: 459097 - DNA, 20 bp, Artificial
  CRISPR gRNA sequence
aaaaagatgcccagaaagat

SEQ ID NO: 459098 - DNA, 20 bp, Artificial
  CRISPR gRNA sequence
atttgcagctgtgaaggggc

SEQ ID NO: 459099 - DNA, 20 bp, Artificial
  CRISPR gRNA sequence
gcagctgtgaaggggcttct

SEQ ID NO: 459100 - DNA, 20 bp, Artificial
  CRISPR gRNA sequence
cagctgtgaaggggcttctt

SEQ ID NO: 459101 - DNA, 20 bp, Artificial
  CRISPR gRNA sequence
tgaaggggcttctttttcaa

SEQ ID NO: 459102 - DNA, 20 bp, Artificial
  CRISPR gRNA sequence
ctttttcaatctccacaacc

SEQ ID NO: 459103 - DNA, 20 bp, Artificial
  CRISPR gRNA sequence
tttttcaatctccacaaccc

SEQ ID NO: 459104 - DNA, 20 bp, Artificial
  CRISPR gRNA sequence
tttcaatctccacaacccca

SEQ ID NO: 459105 - DNA, 20 bp, Artificial
  CRISPR gRNA sequence
ttcaatctccacaaccccaa

SEQ ID NO: 459106 - DNA, 20 bp, Artificial
  CRISPR gRNA sequence
tcaatctccacaaccccaac

SEQ ID NO: 459107 - DNA, 20 bp, Artificial
  CRISPR gRNA sequence
caatctccacaaccccaact

SEQ ID NO: 459108 - DNA, 20 bp, Artificial
  CRISPR gRNA sequence
aatctccacaaccccaactg

SEQ ID NO: 459109 - DNA, 20 bp, Artificial
  CRISPR gRNA sequence
cacaaccccaactgccttaa

SEQ ID NO: 459110 - DNA, 20 bp, Artificial
  CRISPR gRNA sequence
ccttaaagtagaaccagact

SEQ ID NO: 459111 - DNA, 20 bp, Artificial
  CRISPR gRNA sequence
aaagtagaaccagacttgtt

SEQ ID NO: 459112 - DNA, 20 bp, Artificial
  CRISPR gRNA sequence
aagtagaaccagacttgtta

SEQ ID NO: 459113 - DNA, 20 bp, Artificial
  CRISPR gRNA sequence
gttagtagacagaggtttgg

SEQ ID NO: 459114 - DNA, 20 bp, Artificial
  CRISPR gRNA sequence
ttagtagacagaggtttggg

SEQ ID NO: 459115 - DNA, 20 bp, Artificial
  CRISPR gRNA sequence
gtagacagaggtttgggctg

SEQ ID NO: 459116 - DNA, 20 bp, Artificial
  CRISPR gRNA sequence
gggctggggggcccttgaag

SEQ ID NO: 459117 - DNA, 20 bp, Artificial
  CRISPR gRNA sequence
ggctggggggcccttgaagc

SEQ ID NO: 459118 - DNA, 20 bp, Artificial
  CRISPR gRNA sequence
gggggcccttgaagctcttg

SEQ ID NO: 459119 - DNA, 20 bp, Artificial
  CRISPR gRNA sequence
gaagctcttgtctgagatct

SEQ ID NO: 459120 - DNA, 20 bp, Artificial
  CRISPR gRNA sequence
aagctcttgtctgagatctc

SEQ ID NO: 459121 - DNA, 20 bp, Artificial
  CRISPR gRNA sequence
ttgtctgagatctcaggctt

SEQ ID NO: 459122 - DNA, 20 bp, Artificial
  CRISPR gRNA sequence
gtctgagatctcaggcttcc

SEQ ID NO: 459123 - DNA, 20 bp, Artificial
  CRISPR gRNA sequence
tctgagatctcaggcttcct

SEQ ID NO: 459124 - DNA, 20 bp, Artificial
  CRISPR gRNA sequence
agatctcaggcttcctgctc

SEQ ID NO: 459125 - DNA, 20 bp, Artificial
  CRISPR gRNA sequence
aggcttcctgctcaacacac

SEQ ID NO: 459126 - DNA, 20 bp, Artificial
  CRISPR gRNA sequence
cctgctcaacacaccaaagc

SEQ ID NO: 459127 - DNA, 20 bp, Artificial
  CRISPR gRNA sequence
ctgctcaacacaccaaagca

SEQ ID NO: 459128 - DNA, 20 bp, Artificial
  CRISPR gRNA sequence
ctcaacacaccaaagcaggt

SEQ ID NO: 459129 - DNA, 20 bp, Artificial
  CRISPR gRNA sequence
aacacaccaaagcaggtgcc

SEQ ID NO: 459130 - DNA, 20 bp, Artificial
  CRISPR gRNA sequence
acataaaggcgccatggacc

SEQ ID NO: 459131 - DNA, 20 bp, Artificial
  CRISPR gRNA sequence
tttggtggtctgggaaggca

SEQ ID NO: 459132 - DNA, 20 bp, Artificial
  CRISPR gRNA sequence
tggtggtctgggaaggcata

SEQ ID NO: 459133 - DNA, 20 bp, Artificial
  CRISPR gRNA sequence
ggtggtctgggaaggcatat

SEQ ID NO: 459134 - DNA, 20 bp, Artificial
  CRISPR gRNA sequence
gtggtctgggaaggcatatg

SEQ ID NO: 459135 - DNA, 20 bp, Artificial
  CRISPR gRNA sequence
ggaaggcatatggagtccct

SEQ ID NO: 459136 - DNA, 20 bp, Artificial
  CRISPR gRNA sequence
ctcagaacaacatttaaaaa

SEQ ID NO: 459137 - DNA, 20 bp, Artificial
  CRISPR gRNA sequence
tcagaacaacatttaaaaat

SEQ ID NO: 459138 - DNA, 20 bp, Artificial
  CRISPR gRNA sequence
agaacaacatttaaaaatta

SEQ ID NO: 459139 - DNA, 20 bp, Artificial
  CRISPR gRNA sequence
aaaaattaataagatacatg

SEQ ID NO: 459140 - DNA, 20 bp, Artificial
  CRISPR gRNA sequence
aaaattaataagatacatgg

SEQ ID NO: 459141 - DNA, 20 bp, Artificial
  CRISPR gRNA sequence
ataagatacatgggataata

SEQ ID NO: 459142 - DNA, 20 bp, Artificial
  CRISPR gRNA sequence
tgacaagacagttgtcaaaa

SEQ ID NO: 459143 - DNA, 20 bp, Artificial
  CRISPR gRNA sequence
tcaaaacattagaagaatgt

SEQ ID NO: 459144 - DNA, 20 bp, Artificial
  CRISPR gRNA sequence
gaagaatgtgtggtagagca

SEQ ID NO: 459145 - DNA, 20 bp, Artificial
  CRISPR gRNA sequence
ctttagatttgacatcagcc

SEQ ID NO: 459146 - DNA, 20 bp, Artificial
  CRISPR gRNA sequence
tttagatttgacatcagcct

SEQ ID NO: 459147 - DNA, 20 bp, Artificial
  CRISPR gRNA sequence
tagatttgacatcagcctaa

SEQ ID NO: 459148 - DNA, 20 bp, Artificial
  CRISPR gRNA sequence
agatttgacatcagcctaat

SEQ ID NO: 459149 - DNA, 20 bp, Artificial
  CRISPR gRNA sequence
gatttgacatcagcctaata

SEQ ID NO: 459150 - DNA, 20 bp, Artificial
  CRISPR gRNA sequence
gacatcagcctaataactgt

SEQ ID NO: 459151 - DNA, 20 bp, Artificial
  CRISPR gRNA sequence
acatcagcctaataactgtt

SEQ ID NO: 459152 - DNA, 20 bp, Artificial
  CRISPR gRNA sequence
ataactgttgtaattctgta

SEQ ID NO: 459153 - DNA, 20 bp, Artificial
  CRISPR gRNA sequence
ttgtaattctgtagtagtgc

SEQ ID NO: 459154 - DNA, 20 bp, Artificial
  CRISPR gRNA sequence
taattctgtagtagtgctga

SEQ ID NO: 459155 - DNA, 20 bp, Artificial
  CRISPR gRNA sequence
tgtagtagtgctgagcgtta

SEQ ID NO: 459156 - DNA, 20 bp, Artificial
  CRISPR gRNA sequence
tagtagtgctgagcgttaag

SEQ ID NO: 459157 - DNA, 20 bp, Artificial
  CRISPR gRNA sequence
agcgttaaggacatttggag

SEQ ID NO: 459158 - DNA, 20 bp, Artificial
  CRISPR gRNA sequence
aggacatttggagaaatcta

SEQ ID NO: 459159 - DNA, 20 bp, Artificial
  CRISPR gRNA sequence
ggagaaatctataaaaactg

SEQ ID NO: 459160 - DNA, 20 bp, Artificial
  CRISPR gRNA sequence
gagaaatctataaaaactgt

SEQ ID NO: 459161 - DNA, 20 bp, Artificial
  CRISPR gRNA sequence
taaaaactgtaatgagattt

SEQ ID NO: 459162 - DNA, 20 bp, Artificial
  CRISPR gRNA sequence
taatgagatttgaaaatatt

SEQ ID NO: 459163 - DNA, 20 bp, Artificial
  CRISPR gRNA sequence
gaaaatatttgtgttttcta

SEQ ID NO: 459164 - DNA, 20 bp, Artificial
  CRISPR gRNA sequence
aaaatatttgtgttttctat

SEQ ID NO: 459165 - DNA, 20 bp, Artificial
  CRISPR gRNA sequence
gtgttttctattgatggcaa

SEQ ID NO: 459166 - DNA, 20 bp, Artificial
  CRISPR gRNA sequence
tgttttctattgatggcaaa

SEQ ID NO: 459167 - DNA, 20 bp, Artificial
  CRISPR gRNA sequence
tctattgatggcaaattcta

SEQ ID NO: 459168 - DNA, 20 bp, Artificial
  CRISPR gRNA sequence
ctattgatggcaaattctat

SEQ ID NO: 459169 - DNA, 20 bp, Artificial
  CRISPR gRNA sequence
tattgatggcaaattctatt

SEQ ID NO: 459170 - DNA, 20 bp, Artificial
  CRISPR gRNA sequence
ttgatggcaaattctattgt

SEQ ID NO: 459171 - DNA, 20 bp, Artificial
  CRISPR gRNA sequence
atggcaaattctattgtggt

SEQ ID NO: 459172 - DNA, 20 bp, Artificial
  CRISPR gRNA sequence
tattgtggttcattgtctac

SEQ ID NO: 459173 - DNA, 20 bp, Artificial
  CRISPR gRNA sequence
ttgtggttcattgtctacat

SEQ ID NO: 459174 - DNA, 20 bp, Artificial
  CRISPR gRNA sequence
tggttcattgtctacattca

SEQ ID NO: 459175 - DNA, 20 bp, Artificial
  CRISPR gRNA sequence
attgtctacattcataactg

SEQ ID NO: 459176 - DNA, 20 bp, Artificial
  CRISPR gRNA sequence
tctacattcataactgaagc

SEQ ID NO: 459177 - DNA, 20 bp, Artificial
  CRISPR gRNA sequence
cattcataactgaagcaagt

SEQ ID NO: 459178 - DNA, 20 bp, Artificial
  CRISPR gRNA sequence
ataactgaagcaagtgctga

SEQ ID NO: 459179 - DNA, 20 bp, Artificial
  CRISPR gRNA sequence
aagcaagtgctgactttcaa

SEQ ID NO: 459180 - DNA, 20 bp, Artificial
  CRISPR gRNA sequence
actttcaattaaagattagt

SEQ ID NO: 459181 - DNA, 20 bp, Artificial
  CRISPR gRNA sequence
tcaattaaagattagtgaaa

SEQ ID NO: 459182 - DNA, 20 bp, Artificial
  CRISPR gRNA sequence
caattaaagattagtgaaaa

SEQ ID NO: 459183 - DNA, 20 bp, Artificial
  CRISPR gRNA sequence
aattaaagattagtgaaaat

SEQ ID NO: 459184 - DNA, 20 bp, Artificial
  CRISPR gRNA sequence
aagattagtgaaaataaaga

SEQ ID NO: 459185 - DNA, 20 bp, Artificial
  CRISPR gRNA sequence
gtgaaaataaagatgtattt

SEQ ID NO: 459186 - DNA, 20 bp, Artificial
  CRISPR gRNA sequence
ttccccccaattcacaaatc

SEQ ID NO: 459187 - DNA, 20 bp, Artificial
  CRISPR gRNA sequence
tccccccaattcacaaatcc

SEQ ID NO: 459188 - DNA, 20 bp, Artificial
  CRISPR gRNA sequence
ccccccaattcacaaatccc

SEQ ID NO: 459189 - DNA, 20 bp, Artificial
  CRISPR gRNA sequence
cccccaattcacaaatccca

SEQ ID NO: 459190 - DNA, 20 bp, Artificial
  CRISPR gRNA sequence
acaaatcccatgaataaatc

SEQ ID NO: 459191 - DNA, 20 bp, Artificial
  CRISPR gRNA sequence
ttcacggacctccaagaggt

SEQ ID NO: 459192 - DNA, 20 bp, Artificial
  CRISPR gRNA sequence
acggacctccaagaggtcca

SEQ ID NO: 459193 - DNA, 20 bp, Artificial
  CRISPR gRNA sequence
caagaggtccatgacgtgaa

SEQ ID NO: 459194 - DNA, 20 bp, Artificial
  CRISPR gRNA sequence
ggacatgaacttcccccgga

SEQ ID NO: 459195 - DNA, 20 bp, Artificial
  CRISPR gRNA sequence
cccccggaggtgcctcacag

SEQ ID NO: 459196 - DNA, 20 bp, Artificial
  CRISPR gRNA sequence
ccccggaggtgcctcacagg

SEQ ID NO: 459197 - DNA, 20 bp, Artificial
  CRISPR gRNA sequence
acagggccagctccaagccc

SEQ ID NO: 459198 - DNA, 20 bp, Artificial
  CRISPR gRNA sequence
caagccccgtggcacctccc

SEQ ID NO: 459199 - DNA, 20 bp, Artificial
  CRISPR gRNA sequence
ccggcttgtctcaggccaat

SEQ ID NO: 459200 - DNA, 20 bp, Artificial
  CRISPR gRNA sequence
gtctcaggccaatccttgaa

SEQ ID NO: 459201 - DNA, 20 bp, Artificial
  CRISPR gRNA sequence
tctcaggccaatccttgaag

SEQ ID NO: 459202 - DNA, 20 bp, Artificial
  CRISPR gRNA sequence
aggccaatccttgaagagct

SEQ ID NO: 459203 - DNA, 20 bp, Artificial
  CRISPR gRNA sequence
gaagagctccagcagatcta

SEQ ID NO: 459204 - DNA, 20 bp, Artificial
  CRISPR gRNA sequence
aagagctccagcagatctaa

SEQ ID NO: 459205 - DNA, 20 bp, Artificial
  CRISPR gRNA sequence
cagcagatctaaactttggt

SEQ ID NO: 459206 - DNA, 20 bp, Artificial
  CRISPR gRNA sequence
aactttggtaactttcctct

SEQ ID NO: 459207 - DNA, 20 bp, Artificial
  CRISPR gRNA sequence
tggtaactttcctctggtaa

SEQ ID NO: 459208 - DNA, 20 bp, Artificial
  CRISPR gRNA sequence
ggtaactttcctctggtaat

SEQ ID NO: 459209 - DNA, 20 bp, Artificial
  CRISPR gRNA sequence
gtaactttcctctggtaatt

SEQ ID NO: 459210 - DNA, 20 bp, Artificial
  CRISPR gRNA sequence
tcctctggtaatttgaggaa

SEQ ID NO: 459211 - DNA, 20 bp, Artificial
  CRISPR gRNA sequence
cctctggtaatttgaggaat

SEQ ID NO: 459212 - DNA, 20 bp, Artificial
  CRISPR gRNA sequence
ctctggtaatttgaggaatt

SEQ ID NO: 459213 - DNA, 20 bp, Artificial
  CRISPR gRNA sequence
tggtaatttgaggaattcct

SEQ ID NO: 459214 - DNA, 20 bp, Artificial
  CRISPR gRNA sequence
gtaatttgaggaattcctcc

SEQ ID NO: 459215 - DNA, 20 bp, Artificial
  CRISPR gRNA sequence
gaggaattcctccatttgag

SEQ ID NO: 459216 - DNA, 20 bp, Artificial
  CRISPR gRNA sequence
aggaattcctccatttgagg

SEQ ID NO: 459217 - DNA, 20 bp, Artificial
  CRISPR gRNA sequence
ctccatttgaggaatgtcag

SEQ ID NO: 459218 - DNA, 20 bp, Artificial
  CRISPR gRNA sequence
catttgaggaatgtcagaat

SEQ ID NO: 459219 - DNA, 20 bp, Artificial
  CRISPR gRNA sequence
gaggaatgtcagaatggggc

SEQ ID NO: 459220 - DNA, 20 bp, Artificial
  CRISPR gRNA sequence
aggaatgtcagaatggggcc

SEQ ID NO: 459221 - DNA, 20 bp, Artificial
  CRISPR gRNA sequence
ctgaatgcccatggaagaaa

SEQ ID NO: 459222 - DNA, 20 bp, Artificial
  CRISPR gRNA sequence
aatgcccatggaagaaaagc

SEQ ID NO: 459223 - DNA, 20 bp, Artificial
  CRISPR gRNA sequence
gtctggcgggcagaaataac

SEQ ID NO: 459224 - DNA, 20 bp, Artificial
  CRISPR gRNA sequence
gcgggcagaaataaccttct

SEQ ID NO: 459225 - DNA, 20 bp, Artificial
  CRISPR gRNA sequence
ctccccaggctccagagggc

SEQ ID NO: 459226 - DNA, 20 bp, Artificial
  CRISPR gRNA sequence
tccccaggctccagagggca

SEQ ID NO: 459227 - DNA, 20 bp, Artificial
  CRISPR gRNA sequence
cccaggctccagagggcaga

SEQ ID NO: 459228 - DNA, 20 bp, Artificial
  CRISPR gRNA sequence
cagagggcagaggacatttc

SEQ ID NO: 459229 - DNA, 20 bp, Artificial
  CRISPR gRNA sequence
ccctccaaaaggcaagtttc

SEQ ID NO: 459230 - DNA, 20 bp, Artificial
  CRISPR gRNA sequence
cctccaaaaggcaagtttct

SEQ ID NO: 459231 - DNA, 20 bp, Artificial
  CRISPR gRNA sequence
caaaaggcaagtttctcagg

SEQ ID NO: 459232 - DNA, 20 bp, Artificial
  CRISPR gRNA sequence
ctcagggacctcatgagaag

SEQ ID NO: 459233 - DNA, 20 bp, Artificial
  CRISPR gRNA sequence
tcagggacctcatgagaagc

SEQ ID NO: 459234 - DNA, 20 bp, Artificial
  CRISPR gRNA sequence
agggacctcatgagaagcct

SEQ ID NO: 459235 - DNA, 20 bp, Artificial
  CRISPR gRNA sequence
atgagaagcctgtcctcacc

SEQ ID NO: 459236 - DNA, 20 bp, Artificial
  CRISPR gRNA sequence
tcctcacctgagcagttctg

SEQ ID NO: 459237 - DNA, 20 bp, Artificial
  CRISPR gRNA sequence
acctgagcagttctgtcaac

SEQ ID NO: 459238 - DNA, 20 bp, Artificial
  CRISPR gRNA sequence
agcagttctgtcaaccatcc

SEQ ID NO: 459239 - DNA, 20 bp, Artificial
  CRISPR gRNA sequence
tgtcaaccatcccatccctt

SEQ ID NO: 459240 - DNA, 20 bp, Artificial
  CRISPR gRNA sequence
tcaaccatcccatcccttca

SEQ ID NO: 459241 - DNA, 20 bp, Artificial
  CRISPR gRNA sequence
cacctggaccccaggtcccc

SEQ ID NO: 459242 - DNA, 20 bp, Artificial
  CRISPR gRNA sequence
acctggaccccaggtcccca

SEQ ID NO: 459243 - DNA, 20 bp, Artificial
  CRISPR gRNA sequence
gaccccaggtccccagcagg

SEQ ID NO: 459244 - DNA, 20 bp, Artificial
  CRISPR gRNA sequence
tttacctcgagacagaagtt

SEQ ID NO: 459245 - DNA, 20 bp, Artificial
  CRISPR gRNA sequence
ttacctcgagacagaagttc

SEQ ID NO: 459246 - DNA, 20 bp, Artificial
  CRISPR gRNA sequence
tacctcgagacagaagttct

SEQ ID NO: 459247 - DNA, 20 bp, Artificial
  CRISPR gRNA sequence
acctcgagacagaagttctt

SEQ ID NO: 459248 - DNA, 20 bp, Artificial
  CRISPR gRNA sequence
cctcgagacagaagttcttc

SEQ ID NO: 459249 - DNA, 20 bp, Artificial
  CRISPR gRNA sequence
gagacagaagttcttctttc

SEQ ID NO: 459250 - DNA, 20 bp, Artificial
  CRISPR gRNA sequence
ttctttcttgttctcagact

SEQ ID NO: 459251 - DNA, 20 bp, Artificial
  CRISPR gRNA sequence
ctttcttgttctcagactgg

SEQ ID NO: 459252 - DNA, 20 bp, Artificial
  CRISPR gRNA sequence
tttcttgttctcagactggg

SEQ ID NO: 459253 - DNA, 20 bp, Artificial
  CRISPR gRNA sequence
tcttgttctcagactggggg

SEQ ID NO: 459254 - DNA, 20 bp, Artificial
  CRISPR gRNA sequence
cttgttctcagactgggggc

SEQ ID NO: 459255 - DNA, 20 bp, Artificial
  CRISPR gRNA sequence
ttgttctcagactgggggct

SEQ ID NO: 459256 - DNA, 20 bp, Artificial
  CRISPR gRNA sequence
gttctcagactgggggctca

SEQ ID NO: 459257 - DNA, 20 bp, Artificial
  CRISPR gRNA sequence
ttctcagactgggggctcac

SEQ ID NO: 459258 - DNA, 20 bp, Artificial
  CRISPR gRNA sequence
tcagactgggggctcacgtt

SEQ ID NO: 459259 - DNA, 20 bp, Artificial
  CRISPR gRNA sequence
agactgggggctcacgttga

SEQ ID NO: 459260 - DNA, 20 bp, Artificial
  CRISPR gRNA sequence
ggggctcacgttgaaatggc

SEQ ID NO: 459261 - DNA, 20 bp, Artificial
  CRISPR gRNA sequence
acgttgaaatggctctcagt

SEQ ID NO: 459262 - DNA, 20 bp, Artificial
  CRISPR gRNA sequence
aaatggctctcagtcctcag

SEQ ID NO: 459263 - DNA, 20 bp, Artificial
  CRISPR gRNA sequence
tcagtcctcagattgtcctt

SEQ ID NO: 459264 - DNA, 20 bp, Artificial
  CRISPR gRNA sequence
agtcctcagattgtccttgc

SEQ ID NO: 459265 - DNA, 20 bp, Artificial
  CRISPR gRNA sequence
agattgtccttgcatcttgt

SEQ ID NO: 459266 - DNA, 20 bp, Artificial
  CRISPR gRNA sequence
tccttgcatcttgttaaaac

SEQ ID NO: 459267 - DNA, 20 bp, Artificial
  CRISPR gRNA sequence
gcatcttgttaaaaccctat

SEQ ID NO: 459268 - DNA, 20 bp, Artificial
  CRISPR gRNA sequence
catcttgttaaaaccctatc

SEQ ID NO: 459269 - DNA, 20 bp, Artificial
  CRISPR gRNA sequence
gttaaaaccctatctctcca

SEQ ID NO: 459270 - DNA, 20 bp, Artificial
  CRISPR gRNA sequence
ttaaaaccctatctctccag

SEQ ID NO: 459271 - DNA, 20 bp, Artificial
  CRISPR gRNA sequence
aaaccctatctctccagttt

SEQ ID NO: 459272 - DNA, 20 bp, Artificial
  CRISPR gRNA sequence
tctctccagtttcgtcattg

SEQ ID NO: 459273 - DNA, 20 bp, Artificial
  CRISPR gRNA sequence
tccagtttcgtcattgctca

SEQ ID NO: 459274 - DNA, 20 bp, Artificial
  CRISPR gRNA sequence
cagtttcgtcattgctcaca

SEQ ID NO: 459275 - DNA, 20 bp, Artificial
  CRISPR gRNA sequence
cgtcattgctcacactttca

SEQ ID NO: 459276 - DNA, 20 bp, Artificial
  CRISPR gRNA sequence
gtcattgctcacactttcat

SEQ ID NO: 459277 - DNA, 20 bp, Artificial
  CRISPR gRNA sequence
ctcacactttcatagctgtt

SEQ ID NO: 459278 - DNA, 20 bp, Artificial
  CRISPR gRNA sequence
acactttcatagctgttatt

SEQ ID NO: 459279 - DNA, 20 bp, Artificial
  CRISPR gRNA sequence
tcatagctgttattatattc

SEQ ID NO: 459280 - DNA, 20 bp, Artificial
  CRISPR gRNA sequence
catagctgttattatattcg

SEQ ID NO: 459281 - DNA, 20 bp, Artificial
  CRISPR gRNA sequence
atagctgttattatattcgc

SEQ ID NO: 459282 - DNA, 20 bp, Artificial
  CRISPR gRNA sequence
ttattatattcgctctttga

SEQ ID NO: 459283 - DNA, 20 bp, Artificial
  CRISPR gRNA sequence
ttatattcgctctttgaaaa

SEQ ID NO: 459284 - DNA, 20 bp, Artificial
  CRISPR gRNA sequence
tattcgctctttgaaaacca

SEQ ID NO: 459285 - DNA, 20 bp, Artificial
  CRISPR gRNA sequence
gctctttgaaaaccacagaa

SEQ ID NO: 459286 - DNA, 20 bp, Artificial
  CRISPR gRNA sequence
tttgaaaaccacagaatggg

SEQ ID NO: 459287 - DNA, 20 bp, Artificial
  CRISPR gRNA sequence
tgaaaaccacagaatgggtt

SEQ ID NO: 459288 - DNA, 20 bp, Artificial
  CRISPR gRNA sequence
gaaaaccacagaatgggttg

SEQ ID NO: 459289 - DNA, 20 bp, Artificial
  CRISPR gRNA sequence
aaaaccacagaatgggttgt

SEQ ID NO: 459290 - DNA, 20 bp, Artificial
  CRISPR gRNA sequence
ttagaagtcatagatcttcc

SEQ ID NO: 459291 - DNA, 20 bp, Artificial
  CRISPR gRNA sequence
gaagtcatagatcttccgcc

SEQ ID NO: 459292 - DNA, 20 bp, Artificial
  CRISPR gRNA sequence
ccgccacccccactgtggat

SEQ ID NO: 459293 - DNA, 20 bp, Artificial
  CRISPR gRNA sequence
cgccacccccactgtggatt

SEQ ID NO: 459294 - DNA, 20 bp, Artificial
  CRISPR gRNA sequence
tggatttttttctcctttct

SEQ ID NO: 459295 - DNA, 20 bp, Artificial
  CRISPR gRNA sequence
ttcgggtcgcttttatgtgt

SEQ ID NO: 459296 - DNA, 20 bp, Artificial
  CRISPR gRNA sequence
tcgggtcgcttttatgtgtc

SEQ ID NO: 459297 - DNA, 20 bp, Artificial
  CRISPR gRNA sequence
cgggtcgcttttatgtgtca

SEQ ID NO: 459298 - DNA, 20 bp, Artificial
  CRISPR gRNA sequence
gggtcgcttttatgtgtcag

SEQ ID NO: 459299 - DNA, 20 bp, Artificial
  CRISPR gRNA sequence
ggtcgcttttatgtgtcagg

SEQ ID NO: 459300 - DNA, 20 bp, Artificial
  CRISPR gRNA sequence
ttttatgtgtcagggggttt

SEQ ID NO: 459301 - DNA, 20 bp, Artificial
  CRISPR gRNA sequence
gtgtcagggggtttaagaat

SEQ ID NO: 459302 - DNA, 20 bp, Artificial
  CRISPR gRNA sequence
ctattcatgtccacacattt

SEQ ID NO: 459303 - DNA, 20 bp, Artificial
  CRISPR gRNA sequence
tattcatgtccacacatttt

SEQ ID NO: 459304 - DNA, 20 bp, Artificial
  CRISPR gRNA sequence
attcatgtccacacattttg

SEQ ID NO: 459305 - DNA, 20 bp, Artificial
  CRISPR gRNA sequence
cacattttggggtacaaaat

SEQ ID NO: 459306 - DNA, 20 bp, Artificial
  CRISPR gRNA sequence
atgccaaattgatttcaaat

SEQ ID NO: 459307 - DNA, 20 bp, Artificial
  CRISPR gRNA sequence
aataactttaccttctcatt

SEQ ID NO: 459308 - DNA, 20 bp, Artificial
  CRISPR gRNA sequence
ttctcattgagcacaatcac

SEQ ID NO: 459309 - DNA, 20 bp, Artificial
  CRISPR gRNA sequence
cctctataaactaatgaaat

SEQ ID NO: 459310 - DNA, 20 bp, Artificial
  CRISPR gRNA sequence
gaaataagccatgtaaataa

SEQ ID NO: 459311 - DNA, 20 bp, Artificial
  CRISPR gRNA sequence
aagccatgtaaataatagtg

SEQ ID NO: 459312 - DNA, 20 bp, Artificial
  CRISPR gRNA sequence
ccatgtaaataatagtgaag

SEQ ID NO: 459313 - DNA, 20 bp, Artificial
  CRISPR gRNA sequence
atgtaaataatagtgaagta

SEQ ID NO: 459314 - DNA, 20 bp, Artificial
  CRISPR gRNA sequence
aatagtgaagtagagtcatt

SEQ ID NO: 459315 - DNA, 20 bp, Artificial
  CRISPR gRNA sequence
atagtgaagtagagtcattt

SEQ ID NO: 459316 - DNA, 20 bp, Artificial
  CRISPR gRNA sequence
gtctctgacaccattttgaa

SEQ ID NO: 459317 - DNA, 20 bp, Artificial
  CRISPR gRNA sequence
tctctgacaccattttgaaa

SEQ ID NO: 459318 - DNA, 20 bp, Artificial
  CRISPR gRNA sequence
acataaatgatttgtgattt

SEQ ID NO: 459319 - DNA, 20 bp, Artificial
  CRISPR gRNA sequence
tgatttgtgattttggcaaa

SEQ ID NO: 459320 - DNA, 20 bp, Artificial
  CRISPR gRNA sequence
acaaatatattaatacatct

SEQ ID NO: 459321 - DNA, 20 bp, Artificial
  CRISPR gRNA sequence
aaatatattaatacatctta

SEQ ID NO: 459322 - DNA, 20 bp, Artificial
  CRISPR gRNA sequence
cttagagatgaaatcattat

SEQ ID NO: 459323 - DNA, 20 bp, Artificial
  CRISPR gRNA sequence
atcagcattatctttactat

SEQ ID NO: 459324 - DNA, 20 bp, Artificial
  CRISPR gRNA sequence
tctttactataagacatact

SEQ ID NO: 459325 - DNA, 20 bp, Artificial
  CRISPR gRNA sequence
ctttactataagacatacta

SEQ ID NO: 459326 - DNA, 20 bp, Artificial
  CRISPR gRNA sequence
atactaaggatattttaaat

SEQ ID NO: 459327 - DNA, 20 bp, Artificial
  CRISPR gRNA sequence
taaggatattttaaataaga

SEQ ID NO: 459328 - DNA, 20 bp, Artificial
  CRISPR gRNA sequence
gacagaaatattttgctttt

SEQ ID NO: 459329 - DNA, 20 bp, Artificial
  CRISPR gRNA sequence
aatattttgcttttaagttt

SEQ ID NO: 459330 - DNA, 20 bp, Artificial
  CRISPR gRNA sequence
tattttgcttttaagtttga

SEQ ID NO: 459331 - DNA, 20 bp, Artificial
  CRISPR gRNA sequence
ttaagtttgagagaatcatg

SEQ ID NO: 459332 - DNA, 20 bp, Artificial
  CRISPR gRNA sequence
taagtttgagagaatcatga

SEQ ID NO: 459333 - DNA, 20 bp, Artificial
  CRISPR gRNA sequence
atttcgtgtgttcatctgat

SEQ ID NO: 459334 - DNA, 20 bp, Artificial
  CRISPR gRNA sequence
ttcgtgtgttcatctgataa

SEQ ID NO: 459335 - DNA, 20 bp, Artificial
  CRISPR gRNA sequence
tcgtgtgttcatctgataag

SEQ ID NO: 459336 - DNA, 20 bp, Artificial
  CRISPR gRNA sequence
gtgttcatctgataagagga

SEQ ID NO: 459337 - DNA, 20 bp, Artificial
  CRISPR gRNA sequence
tatttcctgtttctattttt

SEQ ID NO: 459338 - DNA, 20 bp, Artificial
  CRISPR gRNA sequence
tctatttttaagaataccac

SEQ ID NO: 459339 - DNA, 20 bp, Artificial
  CRISPR gRNA sequence
atttttaagaataccacaag

SEQ ID NO: 459340 - DNA, 20 bp, Artificial
  CRISPR gRNA sequence
ctaacatgtctttcttacat

SEQ ID NO: 459341 - DNA, 20 bp, Artificial
  CRISPR gRNA sequence
acataagttgtccacaaatg

SEQ ID NO: 459342 - DNA, 20 bp, Artificial
  CRISPR gRNA sequence
agttgtccacaaatgcagcc

SEQ ID NO: 459343 - DNA, 20 bp, Artificial
  CRISPR gRNA sequence
caaatgcagcctggctaaaa

SEQ ID NO: 459344 - DNA, 20 bp, Artificial
  CRISPR gRNA sequence
taaaacagcctatctcgaat

SEQ ID NO: 459345 - DNA, 20 bp, Artificial
  CRISPR gRNA sequence
gaattggttgcttgaaattc

SEQ ID NO: 459346 - DNA, 20 bp, Artificial
  CRISPR gRNA sequence
aattggttgcttgaaattct

SEQ ID NO: 459347 - DNA, 20 bp, Artificial
  CRISPR gRNA sequence
cttgaaattctaggtgtaat

SEQ ID NO: 459348 - DNA, 20 bp, Artificial
  CRISPR gRNA sequence
aggtgtaattggcaaaataa

SEQ ID NO: 459349 - DNA, 20 bp, Artificial
  CRISPR gRNA sequence
gcaaaataacagtgactcaa

SEQ ID NO: 459350 - DNA, 20 bp, Artificial
  CRISPR gRNA sequence
atatttgcacccccaaatct

SEQ ID NO: 459351 - DNA, 20 bp, Artificial
  CRISPR gRNA sequence
tatttgcacccccaaatcta

SEQ ID NO: 459352 - DNA, 20 bp, Artificial
  CRISPR gRNA sequence
tttgcacccccaaatctaag

SEQ ID NO: 459353 - DNA, 20 bp, Artificial
  CRISPR gRNA sequence
aaggagctaaaacttaatgc

SEQ ID NO: 459354 - DNA, 20 bp, Artificial
  CRISPR gRNA sequence
acttaatgccagtgttactt

SEQ ID NO: 459355 - DNA, 20 bp, Artificial
  CRISPR gRNA sequence
atctctccaccacaaaacct

SEQ ID NO: 459356 - DNA, 20 bp, Artificial
  CRISPR gRNA sequence
ctttaatgacccatttactc

SEQ ID NO: 459357 - DNA, 20 bp, Artificial
  CRISPR gRNA sequence
cccatttactctagtatttt

SEQ ID NO: 459358 - DNA, 20 bp, Artificial
  CRISPR gRNA sequence
tctagtattttgagcttcat

SEQ ID NO: 459359 - DNA, 20 bp, Artificial
  CRISPR gRNA sequence
aaatataatgtcaatttgat

SEQ ID NO: 459360 - DNA, 20 bp, Artificial
  CRISPR gRNA sequence
acacatcacattcctttgtg

SEQ ID NO: 459361 - DNA, 20 bp, Artificial
  CRISPR gRNA sequence
catcacattcctttgtgcag

SEQ ID NO: 459362 - DNA, 20 bp, Artificial
  CRISPR gRNA sequence
cattcctttgtgcagcagct

SEQ ID NO: 459363 - DNA, 20 bp, Artificial
  CRISPR gRNA sequence
agctcacatatttgttgaaa

SEQ ID NO: 459364 - DNA, 20 bp, Artificial
  CRISPR gRNA sequence
tttgctatccactttgtatg

SEQ ID NO: 459365 - DNA, 20 bp, Artificial
  CRISPR gRNA sequence
atgaagactattacattatt

SEQ ID NO: 459366 - DNA, 20 bp, Artificial
  CRISPR gRNA sequence
aagactattacattattcag

SEQ ID NO: 459367 - DNA, 20 bp, Artificial
  CRISPR gRNA sequence
actattacattattcagtag

SEQ ID NO: 459368 - DNA, 20 bp, Artificial
  CRISPR gRNA sequence
attattcagtagcagcacct

SEQ ID NO: 459369 - DNA, 20 bp, Artificial
  CRISPR gRNA sequence
gcagcacctgagaattcgaa

SEQ ID NO: 459370 - DNA, 20 bp, Artificial
  CRISPR gRNA sequence
caaactgttgaataaaatta

SEQ ID NO: 459371 - DNA, 20 bp, Artificial
  CRISPR gRNA sequence
aaactgttgaataaaattat

SEQ ID NO: 459372 - DNA, 20 bp, Artificial
  CRISPR gRNA sequence
attataggctatttttgaaa

SEQ ID NO: 459373 - DNA, 20 bp, Artificial
  CRISPR gRNA sequence
tttttgaaatagtttaactc

SEQ ID NO: 459374 - DNA, 20 bp, Artificial
  CRISPR gRNA sequence
atagtttaactcaagtactt

SEQ ID NO: 459375 - DNA, 20 bp, Artificial
  CRISPR gRNA sequence
tttaactcaagtactttgga

SEQ ID NO: 459376 - DNA, 20 bp, Artificial
  CRISPR gRNA sequence
ccatcttttgctatactctt

SEQ ID NO: 459377 - DNA, 20 bp, Artificial
  CRISPR gRNA sequence
tcttttgctatactcttaag

SEQ ID NO: 459378 - DNA, 20 bp, Artificial
  CRISPR gRNA sequence
ctcttaagtggctgcaacct

SEQ ID NO: 459379 - DNA, 20 bp, Artificial
  CRISPR gRNA sequence
agtattttaaaataaatgat

SEQ ID NO: 459380 - DNA, 20 bp, Artificial
  CRISPR gRNA sequence
caaactaaaatatgtcacta

SEQ ID NO: 459381 - DNA, 20 bp, Artificial
  CRISPR gRNA sequence
gatgatttgccctgattcct

SEQ ID NO: 459382 - DNA, 20 bp, Artificial
  CRISPR gRNA sequence
atttgccctgattccttagt

SEQ ID NO: 459383 - DNA, 20 bp, Artificial
  CRISPR gRNA sequence
tgccctgattccttagtaag

SEQ ID NO: 459384 - DNA, 20 bp, Artificial
  CRISPR gRNA sequence
tgattccttagtaagaagaa

SEQ ID NO: 459385 - DNA, 20 bp, Artificial
  CRISPR gRNA sequence
tccttagtaagaagaacagc

SEQ ID NO: 459386 - DNA, 20 bp, Artificial
  CRISPR gRNA sequence
gtaagaagaacagcaagatg

SEQ ID NO: 459387 - DNA, 20 bp, Artificial
  CRISPR gRNA sequence
agaacagcaagatgcagatg

SEQ ID NO: 459388 - DNA, 20 bp, Artificial
  CRISPR gRNA sequence
gatgcagatgtggtgaatga

SEQ ID NO: 459389 - DNA, 20 bp, Artificial
  CRISPR gRNA sequence
tgaaagcaaattgaccccta

SEQ ID NO: 459390 - DNA, 20 bp, Artificial
  CRISPR gRNA sequence
tacagaccaattaaatattc

SEQ ID NO: 459391 - DNA, 20 bp, Artificial
  CRISPR gRNA sequence
acagaccaattaaatattct

SEQ ID NO: 459392 - DNA, 20 bp, Artificial
  CRISPR gRNA sequence
ttgcactttaacttgctatc

SEQ ID NO: 459393 - DNA, 20 bp, Artificial
  CRISPR gRNA sequence
ctttaacttgctatcaagtc

SEQ ID NO: 459394 - DNA, 20 bp, Artificial
  CRISPR gRNA sequence
ttgctatcaagtcaagcatg

SEQ ID NO: 459395 - DNA, 20 bp, Artificial
  CRISPR gRNA sequence
ctatcaagtcaagcatgaag

SEQ ID NO: 459396 - DNA, 20 bp, Artificial
  CRISPR gRNA sequence
agtcaagcatgaagcagttt

SEQ ID NO: 459397 - DNA, 20 bp, Artificial
  CRISPR gRNA sequence
ttaagctatcttcacttgcc

SEQ ID NO: 459398 - DNA, 20 bp, Artificial
  CRISPR gRNA sequence
tgactaacttttaaactatt

SEQ ID NO: 459399 - DNA, 20 bp, Artificial
  CRISPR gRNA sequence
taaactattcagatgcccat

SEQ ID NO: 459400 - DNA, 20 bp, Artificial
  CRISPR gRNA sequence
tgcccataagtatattaatt

SEQ ID NO: 459401 - DNA, 20 bp, Artificial
  CRISPR gRNA sequence
ccataagtatattaattcag

SEQ ID NO: 459402 - DNA, 20 bp, Artificial
  CRISPR gRNA sequence
tatgtcacattcctatccat

SEQ ID NO: 459403 - DNA, 20 bp, Artificial
  CRISPR gRNA sequence
atccattagtctatgtgacc

SEQ ID NO: 459404 - DNA, 20 bp, Artificial
  CRISPR gRNA sequence
attagtctatgtgacccagt

SEQ ID NO: 459405 - DNA, 20 bp, Artificial
  CRISPR gRNA sequence
atatttgcttatcaatctaa

SEQ ID NO: 459406 - DNA, 20 bp, Artificial
  CRISPR gRNA sequence
atttgcttatcaatctaaca

SEQ ID NO: 459407 - DNA, 20 bp, Artificial
  CRISPR gRNA sequence
tgcttatcaatctaacagag

SEQ ID NO: 459408 - DNA, 20 bp, Artificial
  CRISPR gRNA sequence
caatctaacagagtagatat

SEQ ID NO: 459409 - DNA, 20 bp, Artificial
  CRISPR gRNA sequence
agatataagcatttgtttgc

SEQ ID NO: 459410 - DNA, 20 bp, Artificial
  CRISPR gRNA sequence
gatataagcatttgtttgcc

SEQ ID NO: 459411 - DNA, 20 bp, Artificial
  CRISPR gRNA sequence
gcatttgtttgccaggtatg

SEQ ID NO: 459412 - DNA, 20 bp, Artificial
  CRISPR gRNA sequence
acatctaccctatatccaat

SEQ ID NO: 459413 - DNA, 20 bp, Artificial
  CRISPR gRNA sequence
tattttcattttcttacatc

SEQ ID NO: 459414 - DNA, 20 bp, Artificial
  CRISPR gRNA sequence
atgatttctcctttgcattt

SEQ ID NO: 459415 - DNA, 20 bp, Artificial
  CRISPR gRNA sequence
catttaagaaacaccattct

SEQ ID NO: 459416 - DNA, 20 bp, Artificial
  CRISPR gRNA sequence
acaccattcttagactgaca

SEQ ID NO: 459417 - DNA, 20 bp, Artificial
  CRISPR gRNA sequence
acagcaaaaatttcttattt

SEQ ID NO: 459418 - DNA, 20 bp, Artificial
  CRISPR gRNA sequence
gcaaaaatttcttattttgg

SEQ ID NO: 459419 - DNA, 20 bp, Artificial
  CRISPR gRNA sequence
tacaatcattactgtattta

SEQ ID NO: 459420 - DNA, 20 bp, Artificial
  CRISPR gRNA sequence
atcattactgtatttatggt

SEQ ID NO: 459421 - DNA, 20 bp, Artificial
  CRISPR gRNA sequence
ttactgtatttatggttggt

SEQ ID NO: 459422 - DNA, 20 bp, Artificial
  CRISPR gRNA sequence
ttatggttggttagtcaaat

SEQ ID NO: 459423 - DNA, 20 bp, Artificial
  CRISPR gRNA sequence
tatggttggttagtcaaatt

SEQ ID NO: 459424 - DNA, 20 bp, Artificial
  CRISPR gRNA sequence
aattgggacattttgttttc

SEQ ID NO: 459425 - DNA, 20 bp, Artificial
  CRISPR gRNA sequence
ttgggacattttgttttcaa

SEQ ID NO: 459426 - DNA, 20 bp, Artificial
  CRISPR gRNA sequence
attttgttttcaagagtgtg

SEQ ID NO: 459427 - DNA, 20 bp, Artificial
  CRISPR gRNA sequence
gagtgtgtagtgaactgatg

SEQ ID NO: 459428 - DNA, 20 bp, Artificial
  CRISPR gRNA sequence
agtgtgtagtgaactgatgc

SEQ ID NO: 459429 - DNA, 20 bp, Artificial
  CRISPR gRNA sequence
cacaaacctcttttccctac

SEQ ID NO: 459430 - DNA, 20 bp, Artificial
  CRISPR gRNA sequence
ttccctacaagtctttccaa

SEQ ID NO: 459431 - DNA, 20 bp, Artificial
  CRISPR gRNA sequence
aagtctttccaatagcttca

SEQ ID NO: 459432 - DNA, 20 bp, Artificial
  CRISPR gRNA sequence
agtctttccaatagcttcaa

SEQ ID NO: 459433 - DNA, 20 bp, Artificial
  CRISPR gRNA sequence
tttccaatagcttcaaaggc

SEQ ID NO: 459434 - DNA, 20 bp, Artificial
  CRISPR gRNA sequence
atagcttcaaaggcaagatc

SEQ ID NO: 459435 - DNA, 20 bp, Artificial
  CRISPR gRNA sequence
gcaagatcgagtttgtatat

SEQ ID NO: 459436 - DNA, 20 bp, Artificial
  CRISPR gRNA sequence
caagatcgagtttgtatatt

SEQ ID NO: 459437 - DNA, 20 bp, Artificial
  CRISPR gRNA sequence
tttgtatattgggtaaaatg

SEQ ID NO: 459438 - DNA, 20 bp, Artificial
  CRISPR gRNA sequence
atattgggtaaaatgtagct

SEQ ID NO: 459439 - DNA, 20 bp, Artificial
  CRISPR gRNA sequence
ctgctactcatgatgtcaac

SEQ ID NO: 459440 - DNA, 20 bp, Artificial
  CRISPR gRNA sequence
ctcatgatgtcaaccagttt

SEQ ID NO: 459441 - DNA, 20 bp, Artificial
  CRISPR gRNA sequence
catgatgtcaaccagttttg

SEQ ID NO: 459442 - DNA, 20 bp, Artificial
  CRISPR gRNA sequence
tgatgtcaaccagttttgga

SEQ ID NO: 459443 - DNA, 20 bp, Artificial
  CRISPR gRNA sequence
ttggagagattttgttattc

SEQ ID NO: 459444 - DNA, 20 bp, Artificial
  CRISPR gRNA sequence
tggagagattttgttattca

SEQ ID NO: 459445 - DNA, 20 bp, Artificial
  CRISPR gRNA sequence
attcaaggctataatataaa

SEQ ID NO: 459446 - DNA, 20 bp, Artificial
  CRISPR gRNA sequence
aatataaaaagctcccaaat

SEQ ID NO: 459447 - DNA, 20 bp, Artificial
  CRISPR gRNA sequence
aagctcccaaataagtttct

SEQ ID NO: 459448 - DNA, 20 bp, Artificial
  CRISPR gRNA sequence
gctcccaaataagtttctga

SEQ ID NO: 459449 - DNA, 20 bp, Artificial
  CRISPR gRNA sequence
aattttaatcatttatccta

SEQ ID NO: 459450 - DNA, 20 bp, Artificial
  CRISPR gRNA sequence
catttatcctatggaccctt

SEQ ID NO: 459451 - DNA, 20 bp, Artificial
  CRISPR gRNA sequence
cctatggacccttaagaccc

SEQ ID NO: 459452 - DNA, 20 bp, Artificial
  CRISPR gRNA sequence
cactaacatgaacatttcta

SEQ ID NO: 459453 - DNA, 20 bp, Artificial
  CRISPR gRNA sequence
aaagtaaaaattctcaaatt

SEQ ID NO: 459454 - DNA, 20 bp, Artificial
  CRISPR gRNA sequence
atattatttgacatcctgtt

SEQ ID NO: 459455 - DNA, 20 bp, Artificial
  CRISPR gRNA sequence
atttgacatcctgttgagcc

SEQ ID NO: 459456 - DNA, 20 bp, Artificial
  CRISPR gRNA sequence
tcaacatgctgatcattcaa

SEQ ID NO: 459457 - DNA, 20 bp, Artificial
  CRISPR gRNA sequence
gatcattcaatggtccctgt

SEQ ID NO: 459458 - DNA, 20 bp, Artificial
  CRISPR gRNA sequence
tcattcaatggtccctgttg

SEQ ID NO: 459459 - DNA, 20 bp, Artificial
  CRISPR gRNA sequence
tcaatggtccctgttggagt

SEQ ID NO: 459460 - DNA, 20 bp, Artificial
  CRISPR gRNA sequence
gtccctgttggagtcagaaa

SEQ ID NO: 459461 - DNA, 20 bp, Artificial
  CRISPR gRNA sequence
gacttaactcctcacacata

SEQ ID NO: 459462 - DNA, 20 bp, Artificial
  CRISPR gRNA sequence
catatggatgcatattctgt

SEQ ID NO: 459463 - DNA, 20 bp, Artificial
  CRISPR gRNA sequence
gcttcttttacatttcttgc

SEQ ID NO: 459464 - DNA, 20 bp, Artificial
  CRISPR gRNA sequence
ttacatttcttgccagtctt

SEQ ID NO: 459465 - DNA, 20 bp, Artificial
  CRISPR gRNA sequence
tttcttgccagtcttgagtt

SEQ ID NO: 459466 - DNA, 20 bp, Artificial
  CRISPR gRNA sequence
tcttgagttcggtccaatga

SEQ ID NO: 459467 - DNA, 20 bp, Artificial
  CRISPR gRNA sequence
agttcggtccaatgacagaa

SEQ ID NO: 459468 - DNA, 20 bp, Artificial
  CRISPR gRNA sequence
ggtccaatgacagaatggtt

SEQ ID NO: 459469 - DNA, 20 bp, Artificial
  CRISPR gRNA sequence
gtccaatgacagaatggttc

SEQ ID NO: 459470 - DNA, 20 bp, Artificial
  CRISPR gRNA sequence
tccaatgacagaatggttca

SEQ ID NO: 459471 - DNA, 20 bp, Artificial
  CRISPR gRNA sequence
aatgacagaatggttcaggg

SEQ ID NO: 459472 - DNA, 20 bp, Artificial
  CRISPR gRNA sequence
agggaagcataaacaatgcc

SEQ ID NO: 459473 - DNA, 20 bp, Artificial
  CRISPR gRNA sequence
atgcctggtttgttttcttc

SEQ ID NO: 459474 - DNA, 20 bp, Artificial
  CRISPR gRNA sequence
tgcctggtttgttttcttcc

SEQ ID NO: 459475 - DNA, 20 bp, Artificial
  CRISPR gRNA sequence
ggtttgttttcttccaggca

SEQ ID NO: 459476 - DNA, 20 bp, Artificial
  CRISPR gRNA sequence
gttttcttccaggcatggat

SEQ ID NO: 459477 - DNA, 20 bp, Artificial
  CRISPR gRNA sequence
gcatggattagaataaactt

SEQ ID NO: 459478 - DNA, 20 bp, Artificial
  CRISPR gRNA sequence
ccttcctgcatcctgaaaca

SEQ ID NO: 459479 - DNA, 20 bp, Artificial
  CRISPR gRNA sequence
cttcctgcatcctgaaacaa

SEQ ID NO: 459480 - DNA, 20 bp, Artificial
  CRISPR gRNA sequence
ctgcatcctgaaacaaaggt

SEQ ID NO: 459481 - DNA, 20 bp, Artificial
  CRISPR gRNA sequence
tgcatcctgaaacaaaggtc

SEQ ID NO: 459482 - DNA, 20 bp, Artificial
  CRISPR gRNA sequence
gcatcctgaaacaaaggtca

SEQ ID NO: 459483 - DNA, 20 bp, Artificial
  CRISPR gRNA sequence
agggtcattatcataaattc

SEQ ID NO: 459484 - DNA, 20 bp, Artificial
  CRISPR gRNA sequence
tcataaattccagtttctga

SEQ ID NO: 459485 - DNA, 20 bp, Artificial
  CRISPR gRNA sequence
taaattccagtttctgatag

SEQ ID NO: 459486 - DNA, 20 bp, Artificial
  CRISPR gRNA sequence
cagtttctgatagcagtact

SEQ ID NO: 459487 - DNA, 20 bp, Artificial
  CRISPR gRNA sequence
agtttctgatagcagtactt

SEQ ID NO: 459488 - DNA, 20 bp, Artificial
  CRISPR gRNA sequence
cagtacttgggaattttgcc

SEQ ID NO: 459489 - DNA, 20 bp, Artificial
  CRISPR gRNA sequence
gcttctgtttgctcactctt

SEQ ID NO: 459490 - DNA, 20 bp, Artificial
  CRISPR gRNA sequence
cttctgtttgctcactctta

SEQ ID NO: 459491 - DNA, 20 bp, Artificial
  CRISPR gRNA sequence
tgtttgctcactcttaaggt

SEQ ID NO: 459492 - DNA, 20 bp, Artificial
  CRISPR gRNA sequence
aggtgagcatcaacctacaa

SEQ ID NO: 459493 - DNA, 20 bp, Artificial
  CRISPR gRNA sequence
atcaacctacaatagaaaaa

SEQ ID NO: 459494 - DNA, 20 bp, Artificial
  CRISPR gRNA sequence
acctacaatagaaaaaaaga

SEQ ID NO: 459495 - DNA, 20 bp, Artificial
  CRISPR gRNA sequence
atagaaaaaaagatggtttt

SEQ ID NO: 459496 - DNA, 20 bp, Artificial
  CRISPR gRNA sequence
atggttttaagtgacactta

SEQ ID NO: 459497 - DNA, 20 bp, Artificial
  CRISPR gRNA sequence
ttaagtgacacttacggcca

SEQ ID NO: 459498 - DNA, 20 bp, Artificial
  CRISPR gRNA sequence
agtgacacttacggccatgg

SEQ ID NO: 459499 - DNA, 20 bp, Artificial
  CRISPR gRNA sequence
ccatggtagtgcatattcat

SEQ ID NO: 459500 - DNA, 20 bp, Artificial
  CRISPR gRNA sequence
attagcaaactatgaatgaa

SEQ ID NO: 459501 - DNA, 20 bp, Artificial
  CRISPR gRNA sequence
ctatgaatgaaaagcttaaa

SEQ ID NO: 459502 - DNA, 20 bp, Artificial
  CRISPR gRNA sequence
atgaatgaaaagcttaaatg

SEQ ID NO: 459503 - DNA, 20 bp, Artificial
  CRISPR gRNA sequence
aatggagtcatgtccattgt

SEQ ID NO: 459504 - DNA, 20 bp, Artificial
  CRISPR gRNA sequence
tctgctgacatctacacttt

SEQ ID NO: 459505 - DNA, 20 bp, Artificial
  CRISPR gRNA sequence
cagctaaatttcaattatta

SEQ ID NO: 459506 - DNA, 20 bp, Artificial
  CRISPR gRNA sequence
agctaaatttcaattattaa

SEQ ID NO: 459507 - DNA, 20 bp, Artificial
  CRISPR gRNA sequence
tttcaattattaaaggatga

SEQ ID NO: 459508 - DNA, 20 bp, Artificial
  CRISPR gRNA sequence
ttcaattattaaaggatgaa

SEQ ID NO: 459509 - DNA, 20 bp, Artificial
  CRISPR gRNA sequence
tattaaaggatgaaaggctt

SEQ ID NO: 459510 - DNA, 20 bp, Artificial
  CRISPR gRNA sequence
atcactatgtcacccctaaa

SEQ ID NO: 459511 - DNA, 20 bp, Artificial
  CRISPR gRNA sequence
gttattttgtgctttattac

SEQ ID NO: 459512 - DNA, 20 bp, Artificial
  CRISPR gRNA sequence
ctttattactggtcactttt

SEQ ID NO: 459513 - DNA, 20 bp, Artificial
  CRISPR gRNA sequence
tttattactggtcacttttg

SEQ ID NO: 459514 - DNA, 20 bp, Artificial
  CRISPR gRNA sequence
actggtcacttttgaggtca

SEQ ID NO: 459515 - DNA, 20 bp, Artificial
  CRISPR gRNA sequence
acattttttaatcccccttc

SEQ ID NO: 459516 - DNA, 20 bp, Artificial
  CRISPR gRNA sequence
taatcccccttcaagataaa

SEQ ID NO: 459517 - DNA, 20 bp, Artificial
  CRISPR gRNA sequence
ccccttcaagataaaaagca

SEQ ID NO: 459518 - DNA, 20 bp, Artificial
  CRISPR gRNA sequence
aaaagcatagcccaaattga

SEQ ID NO: 459519 - DNA, 20 bp, Artificial
  CRISPR gRNA sequence
atagcccaaattgatggaaa

SEQ ID NO: 459520 - DNA, 20 bp, Artificial
  CRISPR gRNA sequence
aaaatatcctatgaaaactt

SEQ ID NO: 459521 - DNA, 20 bp, Artificial
  CRISPR gRNA sequence
aaatatcctatgaaaacttc

SEQ ID NO: 459522 - DNA, 20 bp, Artificial
  CRISPR gRNA sequence
tatcctatgaaaacttcagg

SEQ ID NO: 459523 - DNA, 20 bp, Artificial
  CRISPR gRNA sequence
gcagtttataacatgatgaa

SEQ ID NO: 459524 - DNA, 20 bp, Artificial
  CRISPR gRNA sequence
atgatgaatagtatttaatg

SEQ ID NO: 459525 - DNA, 20 bp, Artificial
  CRISPR gRNA sequence
gaatagtatttaatgcagtt

SEQ ID NO: 459526 - DNA, 20 bp, Artificial
  CRISPR gRNA sequence
ttaatgcagtttagaataaa

SEQ ID NO: 459527 - DNA, 20 bp, Artificial
  CRISPR gRNA sequence
cagtttagaataaaaagatt

SEQ ID NO: 459528 - DNA, 20 bp, Artificial
  CRISPR gRNA sequence
agtttagaataaaaagatta

SEQ ID NO: 459529 - DNA, 20 bp, Artificial
  CRISPR gRNA sequence
gaataaaaagattaaggata

SEQ ID NO: 459530 - DNA, 20 bp, Artificial
  CRISPR gRNA sequence
taaaaagattaaggataaag

SEQ ID NO: 459531 - DNA, 20 bp, Artificial
  CRISPR gRNA sequence
aagcagaacaaataccccct

SEQ ID NO: 459532 - DNA, 20 bp, Artificial
  CRISPR gRNA sequence
gcagaacaaataccccctaa

SEQ ID NO: 459533 - DNA, 20 bp, Artificial
  CRISPR gRNA sequence
cagaacaaataccccctaag

SEQ ID NO: 459534 - DNA, 20 bp, Artificial
  CRISPR gRNA sequence
agaacaaataccccctaaga

SEQ ID NO: 459535 - DNA, 20 bp, Artificial
  CRISPR gRNA sequence
acaaataccccctaagaggg

SEQ ID NO: 459536 - DNA, 20 bp, Artificial
  CRISPR gRNA sequence
gcagaaacaataaatattat

SEQ ID NO: 459537 - DNA, 20 bp, Artificial
  CRISPR gRNA sequence
aaacaataaatattatgagt

SEQ ID NO: 459538 - DNA, 20 bp, Artificial
  CRISPR gRNA sequence
ataaatattatgagttagcc

SEQ ID NO: 459539 - DNA, 20 bp, Artificial
  CRISPR gRNA sequence
aagatatattattataattt

SEQ ID NO: 459540 - DNA, 20 bp, Artificial
  CRISPR gRNA sequence
ttaaattaaaaaattgatgt

SEQ ID NO: 459541 - DNA, 20 bp, Artificial
  CRISPR gRNA sequence
taaaaaattgatgtcagttt

SEQ ID NO: 459542 - DNA, 20 bp, Artificial
  CRISPR gRNA sequence
aaattgatgtcagttttgga

SEQ ID NO: 459543 - DNA, 20 bp, Artificial
  CRISPR gRNA sequence
atgtcagttttggaaagata

SEQ ID NO: 459544 - DNA, 20 bp, Artificial
  CRISPR gRNA sequence
agttttggaaagataaagct

SEQ ID NO: 459545 - DNA, 20 bp, Artificial
  CRISPR gRNA sequence
ggaaagataaagcttagaaa

SEQ ID NO: 459546 - DNA, 20 bp, Artificial
  CRISPR gRNA sequence
gcttagaaaaagttccaaaa

SEQ ID NO: 459547 - DNA, 20 bp, Artificial
  CRISPR gRNA sequence
aaagttccaaaacagtattc

SEQ ID NO: 459548 - DNA, 20 bp, Artificial
  CRISPR gRNA sequence
ccagttgttattcctatcaa

SEQ ID NO: 459549 - DNA, 20 bp, Artificial
  CRISPR gRNA sequence
tctttttttttttttttttt

SEQ ID NO: 459550 - DNA, 20 bp, Artificial
  CRISPR gRNA sequence
ttttttttttttttttgaga

SEQ ID NO: 459551 - DNA, 20 bp, Artificial
  CRISPR gRNA sequence
ttttttttttttttgagacg

SEQ ID NO: 459552 - DNA, 20 bp, Artificial
  CRISPR gRNA sequence
ttgagacggagtcttgccta

SEQ ID NO: 459553 - DNA, 20 bp, Artificial
  CRISPR gRNA sequence
acggagtcttgcctatagcc

SEQ ID NO: 459554 - DNA, 20 bp, Artificial
  CRISPR gRNA sequence
cggagtcttgcctatagccc

SEQ ID NO: 459555 - DNA, 20 bp, Artificial
  CRISPR gRNA sequence
gtcttgcctatagcccaggc

SEQ ID NO: 459556 - DNA, 20 bp, Artificial
  CRISPR gRNA sequence
cttgcctatagcccaggctg

SEQ ID NO: 459557 - DNA, 20 bp, Artificial
  CRISPR gRNA sequence
ctatagcccaggctggagtg

SEQ ID NO: 459558 - DNA, 20 bp, Artificial
  CRISPR gRNA sequence
tagcccaggctggagtgcag

SEQ ID NO: 459559 - DNA, 20 bp, Artificial
  CRISPR gRNA sequence
ggagtgcagtggtgcgatct

SEQ ID NO: 459560 - DNA, 20 bp, Artificial
  CRISPR gRNA sequence
gtgcgatctcggctcaccgc

SEQ ID NO: 459561 - DNA, 20 bp, Artificial
  CRISPR gRNA sequence
tcaccgcaagctccgcctcc

SEQ ID NO: 459562 - DNA, 20 bp, Artificial
  CRISPR gRNA sequence
ttcacgccattctcctgcct

SEQ ID NO: 459563 - DNA, 20 bp, Artificial
  CRISPR gRNA sequence
ttctcctgcctcagcctccc

SEQ ID NO: 459564 - DNA, 20 bp, Artificial
  CRISPR gRNA sequence
tcctgcctcagcctcccgag

SEQ ID NO: 459565 - DNA, 20 bp, Artificial
  CRISPR gRNA sequence
gcctcagcctcccgagtagc

SEQ ID NO: 459566 - DNA, 20 bp, Artificial
  CRISPR gRNA sequence
cctcagcctcccgagtagct

SEQ ID NO: 459567 - DNA, 20 bp, Artificial
  CRISPR gRNA sequence
ctcccgagtagctgggacta

SEQ ID NO: 459568 - DNA, 20 bp, Artificial
  CRISPR gRNA sequence
tcccgagtagctgggactac

SEQ ID NO: 459569 - DNA, 20 bp, Artificial
  CRISPR gRNA sequence
caggcgcccgccacctcgcc

SEQ ID NO: 459570 - DNA, 20 bp, Artificial
  CRISPR gRNA sequence
ctaatttttttttgtatttt

SEQ ID NO: 459571 - DNA, 20 bp, Artificial
  CRISPR gRNA sequence
atttttttttgtatttttag

SEQ ID NO: 459572 - DNA, 20 bp, Artificial
  CRISPR gRNA sequence
ttttttttgtatttttagta

SEQ ID NO: 459573 - DNA, 20 bp, Artificial
  CRISPR gRNA sequence
ttttgtatttttagtagaga

SEQ ID NO: 459574 - DNA, 20 bp, Artificial
  CRISPR gRNA sequence
tttgtatttttagtagagac

SEQ ID NO: 459575 - DNA, 20 bp, Artificial
  CRISPR gRNA sequence
ttgtatttttagtagagacg

SEQ ID NO: 459576 - DNA, 20 bp, Artificial
  CRISPR gRNA sequence
gagacggggtttcaccattt

SEQ ID NO: 459577 - DNA, 20 bp, Artificial
  CRISPR gRNA sequence
cggggtttcaccattttagc

SEQ ID NO: 459578 - DNA, 20 bp, Artificial
  CRISPR gRNA sequence
ggggtttcaccattttagcc

SEQ ID NO: 459579 - DNA, 20 bp, Artificial
  CRISPR gRNA sequence
tttcaccattttagccagga

SEQ ID NO: 459580 - DNA, 20 bp, Artificial
  CRISPR gRNA sequence
acctcgtgatccgcccgcct

SEQ ID NO: 459581 - DNA, 20 bp, Artificial
  CRISPR gRNA sequence
ccgcccgcctcggcctccca

SEQ ID NO: 459582 - DNA, 20 bp, Artificial
  CRISPR gRNA sequence
gcctcggcctcccaaagtgc

SEQ ID NO: 459583 - DNA, 20 bp, Artificial
  CRISPR gRNA sequence
cctcggcctcccaaagtgcg

SEQ ID NO: 459584 - DNA, 20 bp, Artificial
  CRISPR gRNA sequence
ctcccaaagtgcgaggatta

SEQ ID NO: 459585 - DNA, 20 bp, Artificial
  CRISPR gRNA sequence
agtgcgaggattatagacgt

SEQ ID NO: 459586 - DNA, 20 bp, Artificial
  CRISPR gRNA sequence
tagacgtgagccaccactcc

SEQ ID NO: 459587 - DNA, 20 bp, Artificial
  CRISPR gRNA sequence
cgtgagccaccactcccggc

SEQ ID NO: 459588 - DNA, 20 bp, Artificial
  CRISPR gRNA sequence
aattcttaccgtttcaaata

SEQ ID NO: 459589 - DNA, 20 bp, Artificial
  CRISPR gRNA sequence
tcaaatatagccaaatatct

SEQ ID NO: 459590 - DNA, 20 bp, Artificial
  CRISPR gRNA sequence
aaatatagccaaatatctta

SEQ ID NO: 459591 - DNA, 20 bp, Artificial
  CRISPR gRNA sequence
ccaaatatcttagagcttct

SEQ ID NO: 459592 - DNA, 20 bp, Artificial
  CRISPR gRNA sequence
atatcttagagcttctaaga

SEQ ID NO: 459593 - DNA, 20 bp, Artificial
  CRISPR gRNA sequence
atcttagagcttctaagaaa

SEQ ID NO: 459594 - DNA, 20 bp, Artificial
  CRISPR gRNA sequence
tcttagagcttctaagaaag

SEQ ID NO: 459595 - DNA, 20 bp, Artificial
  CRISPR gRNA sequence
ggtgaatttgtaaaaacaaa

SEQ ID NO: 459596 - DNA, 20 bp, Artificial
  CRISPR gRNA sequence
gtaaaaacaaaaagtaaaat

SEQ ID NO: 459597 - DNA, 20 bp, Artificial
  CRISPR gRNA sequence
cctgatgttttctcactctt

SEQ ID NO: 459598 - DNA, 20 bp, Artificial
  CRISPR gRNA sequence
ctcactcttcagttatttat

SEQ ID NO: 459599 - DNA, 20 bp, Artificial
  CRISPR gRNA sequence
tagccgctcctacctataca

SEQ ID NO: 459600 - DNA, 20 bp, Artificial
  CRISPR gRNA sequence
agccgctcctacctatacaa

SEQ ID NO: 459601 - DNA, 20 bp, Artificial
  CRISPR gRNA sequence
atacaaaggttcacctgaca

SEQ ID NO: 459602 - DNA, 20 bp, Artificial
  CRISPR gRNA sequence
caaaggttcacctgacaaag

SEQ ID NO: 459603 - DNA, 20 bp, Artificial
  CRISPR gRNA sequence
caaagaagatgtgttcattc

SEQ ID NO: 459604 - DNA, 20 bp, Artificial
  CRISPR gRNA sequence
aaagaagatgtgttcattct

SEQ ID NO: 459605 - DNA, 20 bp, Artificial
  CRISPR gRNA sequence
aagaagatgtgttcattcta

SEQ ID NO: 459606 - DNA, 20 bp, Artificial
  CRISPR gRNA sequence
agaagatgtgttcattctag

SEQ ID NO: 459607 - DNA, 20 bp, Artificial
  CRISPR gRNA sequence
gttcattctaggggctattt

SEQ ID NO: 459608 - DNA, 20 bp, Artificial
  CRISPR gRNA sequence
tatttcagttttttaaattc

SEQ ID NO: 459609 - DNA, 20 bp, Artificial
  CRISPR gRNA sequence
cgatttccgttcttgacatc

SEQ ID NO: 459610 - DNA, 20 bp, Artificial
  CRISPR gRNA sequence
acatctggcctaactccttt

SEQ ID NO: 459611 - DNA, 20 bp, Artificial
  CRISPR gRNA sequence
catctggcctaactccttta

SEQ ID NO: 459612 - DNA, 20 bp, Artificial
  CRISPR gRNA sequence
cctaactcctttaaggtatc

SEQ ID NO: 459613 - DNA, 20 bp, Artificial
  CRISPR gRNA sequence
atcaagtccactgtctttga

SEQ ID NO: 459614 - DNA, 20 bp, Artificial
  CRISPR gRNA sequence
gaaagtcaacatactttgtc

SEQ ID NO: 459615 - DNA, 20 bp, Artificial
  CRISPR gRNA sequence
catcctcattgtgatgtgtg

SEQ ID NO: 459616 - DNA, 20 bp, Artificial
  CRISPR gRNA sequence
cctcattgtgatgtgtgcag

SEQ ID NO: 459617 - DNA, 20 bp, Artificial
  CRISPR gRNA sequence
ctcattgtgatgtgtgcagt

SEQ ID NO: 459618 - DNA, 20 bp, Artificial
  CRISPR gRNA sequence
tgtgtgcagtaggatgtcta

SEQ ID NO: 459619 - DNA, 20 bp, Artificial
  CRISPR gRNA sequence
gtgcagtaggatgtctatgg

SEQ ID NO: 459620 - DNA, 20 bp, Artificial
  CRISPR gRNA sequence
atgtctatggcagatttcct

SEQ ID NO: 459621 - DNA, 20 bp, Artificial
  CRISPR gRNA sequence
tctatggcagatttccttgg

SEQ ID NO: 459622 - DNA, 20 bp, Artificial
  CRISPR gRNA sequence
tatggcagatttccttggca

SEQ ID NO: 459623 - DNA, 20 bp, Artificial
  CRISPR gRNA sequence
ttggcagagctctatcatgc

SEQ ID NO: 459624 - DNA, 20 bp, Artificial
  CRISPR gRNA sequence
ctctatcatgcaagcatgtc

SEQ ID NO: 459625 - DNA, 20 bp, Artificial
  CRISPR gRNA sequence
agcatgtctggctttaccct

SEQ ID NO: 459626 - DNA, 20 bp, Artificial
  CRISPR gRNA sequence
atgtctggctttaccctgag

SEQ ID NO: 459627 - DNA, 20 bp, Artificial
  CRISPR gRNA sequence
tttaccctgagaagctatgt

SEQ ID NO: 459628 - DNA, 20 bp, Artificial
  CRISPR gRNA sequence
ctatgtaagaattcctgata

SEQ ID NO: 459629 - DNA, 20 bp, Artificial
  CRISPR gRNA sequence
tacagtgccaccctctgatg

SEQ ID NO: 459630 - DNA, 20 bp, Artificial
  CRISPR gRNA sequence
agtgccaccctctgatgtgg

SEQ ID NO: 459631 - DNA, 20 bp, Artificial
  CRISPR gRNA sequence
tggtggctgcccaaaaataa

SEQ ID NO: 459632 - DNA, 20 bp, Artificial
  CRISPR gRNA sequence
ggctgcccaaaaataacagt

SEQ ID NO: 459633 - DNA, 20 bp, Artificial
  CRISPR gRNA sequence
gctgcccaaaaataacagta

SEQ ID NO: 459634 - DNA, 20 bp, Artificial
  CRISPR gRNA sequence
ccaaaaataacagtaaggct

SEQ ID NO: 459635 - DNA, 20 bp, Artificial
  CRISPR gRNA sequence
cagtaaggctgagcgactga

SEQ ID NO: 459636 - DNA, 20 bp, Artificial
  CRISPR gRNA sequence
gtaaggctgagcgactgaaa

SEQ ID NO: 459637 - DNA, 20 bp, Artificial
  CRISPR gRNA sequence
taaggctgagcgactgaaag

SEQ ID NO: 459638 - DNA, 20 bp, Artificial
  CRISPR gRNA sequence
ggctgagcgactgaaagagg

SEQ ID NO: 459639 - DNA, 20 bp, Artificial
  CRISPR gRNA sequence
ctgagcgactgaaagaggca

SEQ ID NO: 459640 - DNA, 20 bp, Artificial
  CRISPR gRNA sequence
tgagcgactgaaagaggcag

SEQ ID NO: 459641 - DNA, 20 bp, Artificial
  CRISPR gRNA sequence
tgaaagaggcagaggctgct

SEQ ID NO: 459642 - DNA, 20 bp, Artificial
  CRISPR gRNA sequence
gaggcagaggctgcttggct

SEQ ID NO: 459643 - DNA, 20 bp, Artificial
  CRISPR gRNA sequence
ggctgcttggctaagataaa

SEQ ID NO: 459644 - DNA, 20 bp, Artificial
  CRISPR gRNA sequence
gtactcccaactccactgaa

SEQ ID NO: 459645 - DNA, 20 bp, Artificial
  CRISPR gRNA sequence
actcccaactccactgaaaa

SEQ ID NO: 459646 - DNA, 20 bp, Artificial
  CRISPR gRNA sequence
caactccactgaaaagagcc

SEQ ID NO: 459647 - DNA, 20 bp, Artificial
  CRISPR gRNA sequence
ccactgaaaagagcctggtt

SEQ ID NO: 459648 - DNA, 20 bp, Artificial
  CRISPR gRNA sequence
cactgaaaagagcctggttg

SEQ ID NO: 459649 - DNA, 20 bp, Artificial
  CRISPR gRNA sequence
gaaaagagcctggttgaggt

SEQ ID NO: 459650 - DNA, 20 bp, Artificial
  CRISPR gRNA sequence
aagagcctggttgaggtcag

SEQ ID NO: 459651 - DNA, 20 bp, Artificial
  CRISPR gRNA sequence
agagcctggttgaggtcagt

SEQ ID NO: 459652 - DNA, 20 bp, Artificial
  CRISPR gRNA sequence
gcctggttgaggtcagtagg

SEQ ID NO: 459653 - DNA, 20 bp, Artificial
  CRISPR gRNA sequence
ggtcagtaggtggcacacta

SEQ ID NO: 459654 - DNA, 20 bp, Artificial
  CRISPR gRNA sequence
cagtaggtggcacactaaag

SEQ ID NO: 459655 - DNA, 20 bp, Artificial
  CRISPR gRNA sequence
gcacactaaagaagactgtc

SEQ ID NO: 459656 - DNA, 20 bp, Artificial
  CRISPR gRNA sequence
ctgtcaagtgaactgaaaaa

SEQ ID NO: 459657 - DNA, 20 bp, Artificial
  CRISPR gRNA sequence
gtgaactgaaaaatagcctt

SEQ ID NO: 459658 - DNA, 20 bp, Artificial
  CRISPR gRNA sequence
tagtcctcaatatatcaaca

SEQ ID NO: 459659 - DNA, 20 bp, Artificial
  CRISPR gRNA sequence
tgatacttttcaatctgttt

SEQ ID NO: 459660 - DNA, 20 bp, Artificial
  CRISPR gRNA sequence
atctgtttaagcctgtcaat

SEQ ID NO: 459661 - DNA, 20 bp, Artificial
  CRISPR gRNA sequence
tctgtttaagcctgtcaatt

SEQ ID NO: 459662 - DNA, 20 bp, Artificial
  CRISPR gRNA sequence
ggttccctgtctctcatccc

SEQ ID NO: 459663 - DNA, 20 bp, Artificial
  CRISPR gRNA sequence
ctgtctctcatcccaagaaa

SEQ ID NO: 459664 - DNA, 20 bp, Artificial
  CRISPR gRNA sequence
aaaaattttgttaaaatgaa

SEQ ID NO: 459665 - DNA, 20 bp, Artificial
  CRISPR gRNA sequence
aaattttgttaaaatgaatg

SEQ ID NO: 459666 - DNA, 20 bp, Artificial
  CRISPR gRNA sequence
tgttaaaatgaatggagcaa

SEQ ID NO: 459667 - DNA, 20 bp, Artificial
  CRISPR gRNA sequence
gaatggagcaaaagaaaata

SEQ ID NO: 459668 - DNA, 20 bp, Artificial
  CRISPR gRNA sequence
aaagaaaatatagtgctctg

SEQ ID NO: 459669 - DNA, 20 bp, Artificial
  CRISPR gRNA sequence
gctctgcagcacccctgctg

SEQ ID NO: 459670 - DNA, 20 bp, Artificial
  CRISPR gRNA sequence
cctgctgtggcaccccgtca

SEQ ID NO: 459671 - DNA, 20 bp, Artificial
  CRISPR gRNA sequence
gctgtggcaccccgtcaaag

SEQ ID NO: 459672 - DNA, 20 bp, Artificial
  CRISPR gRNA sequence
tggcaccccgtcaaagtggc

SEQ ID NO: 459673 - DNA, 20 bp, Artificial
  CRISPR gRNA sequence
ggcaccccgtcaaagtggct

SEQ ID NO: 459674 - DNA, 20 bp, Artificial
  CRISPR gRNA sequence
tcaaagtggctgggtgccac

SEQ ID NO: 459675 - DNA, 20 bp, Artificial
  CRISPR gRNA sequence
caaagtggctgggtgccaca

SEQ ID NO: 459676 - DNA, 20 bp, Artificial
  CRISPR gRNA sequence
aaggccaatgcaccacaatg

SEQ ID NO: 459677 - DNA, 20 bp, Artificial
  CRISPR gRNA sequence
gccaatgcaccacaatgtgg

SEQ ID NO: 459678 - DNA, 20 bp, Artificial
  CRISPR gRNA sequence
atgcaccacaatgtggtgga

SEQ ID NO: 459679 - DNA, 20 bp, Artificial
  CRISPR gRNA sequence
gcaccacaatgtggtggata

SEQ ID NO: 459680 - DNA, 20 bp, Artificial
  CRISPR gRNA sequence
tgtggtggatagagatgata

SEQ ID NO: 459681 - DNA, 20 bp, Artificial
  CRISPR gRNA sequence
gtggatagagatgataaagc

SEQ ID NO: 459682 - DNA, 20 bp, Artificial
  CRISPR gRNA sequence
agagatgataaagccagaaa

SEQ ID NO: 459683 - DNA, 20 bp, Artificial
  CRISPR gRNA sequence
aatcccaccttacattccta

SEQ ID NO: 459684 - DNA, 20 bp, Artificial
  CRISPR gRNA sequence
cccaccttacattcctatgg

SEQ ID NO: 459685 - DNA, 20 bp, Artificial
  CRISPR gRNA sequence
ccaccttacattcctatggc

SEQ ID NO: 459686 - DNA, 20 bp, Artificial
  CRISPR gRNA sequence
tacattcctatggcaggtta

SEQ ID NO: 459687 - DNA, 20 bp, Artificial
  CRISPR gRNA sequence
atggcaggttacagtataca

SEQ ID NO: 459688 - DNA, 20 bp, Artificial
  CRISPR gRNA sequence
cattttaaaatttgtattta

SEQ ID NO: 459689 - DNA, 20 bp, Artificial
  CRISPR gRNA sequence
ttgtatttatagtatatgtt

SEQ ID NO: 459690 - DNA, 20 bp, Artificial
  CRISPR gRNA sequence
gccataaaattcaccctttt

SEQ ID NO: 459691 - DNA, 20 bp, Artificial
  CRISPR gRNA sequence
acccttttaagtgtacaatt

SEQ ID NO: 459692 - DNA, 20 bp, Artificial
  CRISPR gRNA sequence
cttttaagtgtacaattcag

SEQ ID NO: 459693 - DNA, 20 bp, Artificial
  CRISPR gRNA sequence
tacaattcagtggtttttat

SEQ ID NO: 459694 - DNA, 20 bp, Artificial
  CRISPR gRNA sequence
acaattcagtggtttttatt

SEQ ID NO: 459695 - DNA, 20 bp, Artificial
  CRISPR gRNA sequence
ttcagtggtttttattaggc

SEQ ID NO: 459696 - DNA, 20 bp, Artificial
  CRISPR gRNA sequence
gcaagcactttataccctca

SEQ ID NO: 459697 - DNA, 20 bp, Artificial
  CRISPR gRNA sequence
caagcactttataccctcaa

SEQ ID NO: 459698 - DNA, 20 bp, Artificial
  CRISPR gRNA sequence
ataccctcaaaggaccgttt

SEQ ID NO: 459699 - DNA, 20 bp, Artificial
  CRISPR gRNA sequence
tcaaaggaccgttttggatt

SEQ ID NO: 459700 - DNA, 20 bp, Artificial
  CRISPR gRNA sequence
ggaccgttttggattaagat

SEQ ID NO: 459701 - DNA, 20 bp, Artificial
  CRISPR gRNA sequence
accgttttggattaagatca

SEQ ID NO: 459702 - DNA, 20 bp, Artificial
  CRISPR gRNA sequence
ttggattaagatcagagctt

SEQ ID NO: 459703 - DNA, 20 bp, Artificial
  CRISPR gRNA sequence
tgtacctgttacatttgtac

SEQ ID NO: 459704 - DNA, 20 bp, Artificial
  CRISPR gRNA sequence
ctttcctgtcatgtttatac

SEQ ID NO: 459705 - DNA, 20 bp, Artificial
  CRISPR gRNA sequence
tctgtactttgatttctcca

SEQ ID NO: 459706 - DNA, 20 bp, Artificial
  CRISPR gRNA sequence
tttctccacagttcccaaac

SEQ ID NO: 459707 - DNA, 20 bp, Artificial
  CRISPR gRNA sequence
tcccaaactagttttatgtt

SEQ ID NO: 459708 - DNA, 20 bp, Artificial
  CRISPR gRNA sequence
gttttatgttaagaaatatt

SEQ ID NO: 459709 - DNA, 20 bp, Artificial
  CRISPR gRNA sequence
gttaagaaatatttagcccc

SEQ ID NO: 459710 - DNA, 20 bp, Artificial
  CRISPR gRNA sequence
ttaagaaatatttagcccca

SEQ ID NO: 459711 - DNA, 20 bp, Artificial
  CRISPR gRNA sequence
taagaaatatttagccccaa

SEQ ID NO: 459712 - DNA, 20 bp, Artificial
  CRISPR gRNA sequence
ttagccccaagggtataata

SEQ ID NO: 459713 - DNA, 20 bp, Artificial
  CRISPR gRNA sequence
ttgattattttctgaaatgc

SEQ ID NO: 459714 - DNA, 20 bp, Artificial
  CRISPR gRNA sequence
gaaatgctagacaactgaaa

SEQ ID NO: 459715 - DNA, 20 bp, Artificial
  CRISPR gRNA sequence
aaatgctagacaactgaaat

SEQ ID NO: 459716 - DNA, 20 bp, Artificial
  CRISPR gRNA sequence
aatgctagacaactgaaatg

SEQ ID NO: 459717 - DNA, 20 bp, Artificial
  CRISPR gRNA sequence
aatcttcaaattcctgttaa

SEQ ID NO: 459718 - DNA, 20 bp, Artificial
  CRISPR gRNA sequence
acgctttaaaacaaacttcc

SEQ ID NO: 459719 - DNA, 20 bp, Artificial
  CRISPR gRNA sequence
ttcccagacaattgcacata

SEQ ID NO: 459720 - DNA, 20 bp, Artificial
  CRISPR gRNA sequence
agaaaatacccttttgaatt

SEQ ID NO: 459721 - DNA, 20 bp, Artificial
  CRISPR gRNA sequence
gcttcaaatcataatttatc

SEQ ID NO: 459722 - DNA, 20 bp, Artificial
  CRISPR gRNA sequence
cataatttatccagcctacc

SEQ ID NO: 459723 - DNA, 20 bp, Artificial
  CRISPR gRNA sequence
ataatttatccagcctaccc

SEQ ID NO: 459724 - DNA, 20 bp, Artificial
  CRISPR gRNA sequence
atttatccagcctacccagg

SEQ ID NO: 459725 - DNA, 20 bp, Artificial
  CRISPR gRNA sequence
cccaggaagaacaatgtcca

SEQ ID NO: 459726 - DNA, 20 bp, Artificial
  CRISPR gRNA sequence
tgtccacagcttaaccaacc

SEQ ID NO: 459727 - DNA, 20 bp, Artificial
  CRISPR gRNA sequence
gtccacagcttaaccaacct

SEQ ID NO: 459728 - DNA, 20 bp, Artificial
  CRISPR gRNA sequence
caacctgggttttacttgca

SEQ ID NO: 459729 - DNA, 20 bp, Artificial
  CRISPR gRNA sequence
tacttgcacagtaaattatt

SEQ ID NO: 459730 - DNA, 20 bp, Artificial
  CRISPR gRNA sequence
ttttatcttaaataatttca

SEQ ID NO: 459731 - DNA, 20 bp, Artificial
  CRISPR gRNA sequence
taaataatttcatagctccc

SEQ ID NO: 459732 - DNA, 20 bp, Artificial
  CRISPR gRNA sequence
tccctggccttattgtaatc

SEQ ID NO: 459733 - DNA, 20 bp, Artificial
  CRISPR gRNA sequence
atttttattattatttacta

SEQ ID NO: 459734 - DNA, 20 bp, Artificial
  CRISPR gRNA sequence
ttattattatttactataga

SEQ ID NO: 459735 - DNA, 20 bp, Artificial
  CRISPR gRNA sequence
atagaaagaaaataatattt

SEQ ID NO: 459736 - DNA, 20 bp, Artificial
  CRISPR gRNA sequence
ttaagaaaatttccctattt

SEQ ID NO: 459737 - DNA, 20 bp, Artificial
  CRISPR gRNA sequence
taagaaaatttccctatttg

SEQ ID NO: 459738 - DNA, 20 bp, Artificial
  CRISPR gRNA sequence
aagaaaatttccctatttga

SEQ ID NO: 459739 - DNA, 20 bp, Artificial
  CRISPR gRNA sequence
tttccctatttgagggaaca

SEQ ID NO: 459740 - DNA, 20 bp, Artificial
  CRISPR gRNA sequence
tatttgagggaacaaagcct

SEQ ID NO: 459741 - DNA, 20 bp, Artificial
  CRISPR gRNA sequence
caaagccttagcaccctaca

SEQ ID NO: 459742 - DNA, 20 bp, Artificial
  CRISPR gRNA sequence
tgatgctaatgaaaacttaa

SEQ ID NO: 459743 - DNA, 20 bp, Artificial
  CRISPR gRNA sequence
tgctaatgaaaacttaatag

SEQ ID NO: 459744 - DNA, 20 bp, Artificial
  CRISPR gRNA sequence
aaacttaatagaagtttgtc

SEQ ID NO: 459745 - DNA, 20 bp, Artificial
  CRISPR gRNA sequence
taatagaagtttgtcaagtt

SEQ ID NO: 459746 - DNA, 20 bp, Artificial
  CRISPR gRNA sequence
tttgtcaagttgagtgtatt

SEQ ID NO: 459747 - DNA, 20 bp, Artificial
  CRISPR gRNA sequence
caagttgagtgtatttggtc

SEQ ID NO: 459748 - DNA, 20 bp, Artificial
  CRISPR gRNA sequence
atttggtctggtttaaaatt

SEQ ID NO: 459749 - DNA, 20 bp, Artificial
  CRISPR gRNA sequence
tggtctggtttaaaattaag

SEQ ID NO: 459750 - DNA, 20 bp, Artificial
  CRISPR gRNA sequence
tggtttaaaattaagcagct

SEQ ID NO: 459751 - DNA, 20 bp, Artificial
  CRISPR gRNA sequence
tttaaaattaagcagcttgg

SEQ ID NO: 459752 - DNA, 20 bp, Artificial
  CRISPR gRNA sequence
ttaaaattaagcagcttggt

SEQ ID NO: 459753 - DNA, 20 bp, Artificial
  CRISPR gRNA sequence
taaaattaagcagcttggtg

SEQ ID NO: 459754 - DNA, 20 bp, Artificial
  CRISPR gRNA sequence
atgccatttaatattatata

SEQ ID NO: 459755 - DNA, 20 bp, Artificial
  CRISPR gRNA sequence
aatattatatatagaattat

SEQ ID NO: 459756 - DNA, 20 bp, Artificial
  CRISPR gRNA sequence
tgtatcgattttgtcttttg

SEQ ID NO: 459757 - DNA, 20 bp, Artificial
  CRISPR gRNA sequence
ttgtcttttgtggaattttt

SEQ ID NO: 459758 - DNA, 20 bp, Artificial
  CRISPR gRNA sequence
gtcttttgtggaatttttaa

SEQ ID NO: 459759 - DNA, 20 bp, Artificial
  CRISPR gRNA sequence
tcttttgtggaatttttaag

SEQ ID NO: 459760 - DNA, 20 bp, Artificial
  CRISPR gRNA sequence
cttttgtggaatttttaaga

SEQ ID NO: 459761 - DNA, 20 bp, Artificial
  CRISPR gRNA sequence
ttgaaacacacacacacatc

SEQ ID NO: 459762 - DNA, 20 bp, Artificial
  CRISPR gRNA sequence
acacacatcaagttcctttg

SEQ ID NO: 459763 - DNA, 20 bp, Artificial
  CRISPR gRNA sequence
gtatctcatttatgactgtt

SEQ ID NO: 459764 - DNA, 20 bp, Artificial
  CRISPR gRNA sequence
tatgactgtttagttttaat

SEQ ID NO: 459765 - DNA, 20 bp, Artificial
  CRISPR gRNA sequence
tgactgtttagttttaatta

SEQ ID NO: 459766 - DNA, 20 bp, Artificial
  CRISPR gRNA sequence
actgtttagttttaattaga

SEQ ID NO: 459767 - DNA, 20 bp, Artificial
  CRISPR gRNA sequence
tagttttaattagagagctt

SEQ ID NO: 459768 - DNA, 20 bp, Artificial
  CRISPR gRNA sequence
cctcatcttgcattcttttt

SEQ ID NO: 459769 - DNA, 20 bp, Artificial
  CRISPR gRNA sequence
ctccacaacattcaactcaa

SEQ ID NO: 459770 - DNA, 20 bp, Artificial
  CRISPR gRNA sequence
caacattcaactcaaaagaa

SEQ ID NO: 459771 - DNA, 20 bp, Artificial
  CRISPR gRNA sequence
catttacattccaaacctta

SEQ ID NO: 459772 - DNA, 20 bp, Artificial
  CRISPR gRNA sequence
atttacattccaaaccttat

SEQ ID NO: 459773 - DNA, 20 bp, Artificial
  CRISPR gRNA sequence
acattccaaaccttatagga

SEQ ID NO: 459774 - DNA, 20 bp, Artificial
  CRISPR gRNA sequence
actccaaaattcccttcctt

SEQ ID NO: 459775 - DNA, 20 bp, Artificial
  CRISPR gRNA sequence
aaattcccttcctttagtct

SEQ ID NO: 459776 - DNA, 20 bp, Artificial
  CRISPR gRNA sequence
ttcccttcctttagtctgag

SEQ ID NO: 459777 - DNA, 20 bp, Artificial
  CRISPR gRNA sequence
tgagtggtcccttccttgat

SEQ ID NO: 459778 - DNA, 20 bp, Artificial
  CRISPR gRNA sequence
gatgagcccatacacattgc

SEQ ID NO: 459779 - DNA, 20 bp, Artificial
  CRISPR gRNA sequence
atgagcccatacacattgcc

SEQ ID NO: 459780 - DNA, 20 bp, Artificial
  CRISPR gRNA sequence
tgagcccatacacattgcca

SEQ ID NO: 459781 - DNA, 20 bp, Artificial
  CRISPR gRNA sequence
gggacctctgtgtaataact

SEQ ID NO: 459782 - DNA, 20 bp, Artificial
  CRISPR gRNA sequence
tctgtgtaataactaagcca

SEQ ID NO: 459783 - DNA, 20 bp, Artificial
  CRISPR gRNA sequence
agatcatgtctctattttgc

SEQ ID NO: 459784 - DNA, 20 bp, Artificial
  CRISPR gRNA sequence
ttttgctggtgctatttatg

SEQ ID NO: 459785 - DNA, 20 bp, Artificial
  CRISPR gRNA sequence
aagatatctaatcattttat

SEQ ID NO: 459786 - DNA, 20 bp, Artificial
  CRISPR gRNA sequence
agatatctaatcattttatg

SEQ ID NO: 459787 - DNA, 20 bp, Artificial
  CRISPR gRNA sequence
tcattttatgaggttatttg

SEQ ID NO: 459788 - DNA, 20 bp, Artificial
  CRISPR gRNA sequence
cattttatgaggttatttgt

SEQ ID NO: 459789 - DNA, 20 bp, Artificial
  CRISPR gRNA sequence
ttgtgggttcattctttcat

SEQ ID NO: 459790 - DNA, 20 bp, Artificial
  CRISPR gRNA sequence
atcagctccctactctcttc

SEQ ID NO: 459791 - DNA, 20 bp, Artificial
  CRISPR gRNA sequence
gctccctactctcttccaga

SEQ ID NO: 459792 - DNA, 20 bp, Artificial
  CRISPR gRNA sequence
ctctcttccagaaagacctt

SEQ ID NO: 459793 - DNA, 20 bp, Artificial
  CRISPR gRNA sequence
tctcttccagaaagacctta

SEQ ID NO: 459794 - DNA, 20 bp, Artificial
  CRISPR gRNA sequence
ttacataaaaaataaatgaa

SEQ ID NO: 459795 - DNA, 20 bp, Artificial
  CRISPR gRNA sequence
aaaaataaatgaatagcctg

SEQ ID NO: 459796 - DNA, 20 bp, Artificial
  CRISPR gRNA sequence
aatagcctgaagccacataa

SEQ ID NO: 459797 - DNA, 20 bp, Artificial
  CRISPR gRNA sequence
atagcctgaagccacataac

SEQ ID NO: 459798 - DNA, 20 bp, Artificial
  CRISPR gRNA sequence
cctgaagccacataacaggc

SEQ ID NO: 459799 - DNA, 20 bp, Artificial
  CRISPR gRNA sequence
tgaagccacataacaggcaa

SEQ ID NO: 459800 - DNA, 20 bp, Artificial
  CRISPR gRNA sequence
agccacataacaggcaagag

SEQ ID NO: 459801 - DNA, 20 bp, Artificial
  CRISPR gRNA sequence
ccacataacaggcaagagca

SEQ ID NO: 459802 - DNA, 20 bp, Artificial
  CRISPR gRNA sequence
taacaggcaagagcagagtc

SEQ ID NO: 459803 - DNA, 20 bp, Artificial
  CRISPR gRNA sequence
agagcagagtcaagtttgta

SEQ ID NO: 459804 - DNA, 20 bp, Artificial
  CRISPR gRNA sequence
agagtcaagtttgtatggtt

SEQ ID NO: 459805 - DNA, 20 bp, Artificial
  CRISPR gRNA sequence
agtctctgacttttctgtct

SEQ ID NO: 459806 - DNA, 20 bp, Artificial
  CRISPR gRNA sequence
tgacttttctgtcttggatc

SEQ ID NO: 459807 - DNA, 20 bp, Artificial
  CRISPR gRNA sequence
ctgccttccatgaacttcca

SEQ ID NO: 459808 - DNA, 20 bp, Artificial
  CRISPR gRNA sequence
tccaaagaaccacttattac

SEQ ID NO: 459809 - DNA, 20 bp, Artificial
  CRISPR gRNA sequence
tacgagacttgttaacccta

SEQ ID NO: 459810 - DNA, 20 bp, Artificial
  CRISPR gRNA sequence
cgagacttgttaaccctaaa

SEQ ID NO: 459811 - DNA, 20 bp, Artificial
  CRISPR gRNA sequence
cctaaagagtctttgctgca

SEQ ID NO: 459812 - DNA, 20 bp, Artificial
  CRISPR gRNA sequence
taaagagtctttgctgcata

SEQ ID NO: 459813 - DNA, 20 bp, Artificial
  CRISPR gRNA sequence
aagagtctttgctgcataga

SEQ ID NO: 459814 - DNA, 20 bp, Artificial
  CRISPR gRNA sequence
agtctttgctgcatagagag

SEQ ID NO: 459815 - DNA, 20 bp, Artificial
  CRISPR gRNA sequence
aaaattcacatttttaaaaa

SEQ ID NO: 459816 - DNA, 20 bp, Artificial
  CRISPR gRNA sequence
aaattcacatttttaaaaat

SEQ ID NO: 459817 - DNA, 20 bp, Artificial
  CRISPR gRNA sequence
tatatatatatatatatata

SEQ ID NO: 459818 - DNA, 20 bp, Artificial
  CRISPR gRNA sequence
atatatatatatatagtaca

SEQ ID NO: 459819 - DNA, 20 bp, Artificial
  CRISPR gRNA sequence
atagtacatagaataatgcc

SEQ ID NO: 459820 - DNA, 20 bp, Artificial
  CRISPR gRNA sequence
atagaataatgcctggcaca

SEQ ID NO: 459821 - DNA, 20 bp, Artificial
  CRISPR gRNA sequence
attgaataaataaataaaca

SEQ ID NO: 459822 - DNA, 20 bp, Artificial
  CRISPR gRNA sequence
acaaattgcatttgtttcaa

SEQ ID NO: 459823 - DNA, 20 bp, Artificial
  CRISPR gRNA sequence
tttgtttcaacagctacatc

SEQ ID NO: 459824 - DNA, 20 bp, Artificial
  CRISPR gRNA sequence
aacagctacatcaagcttac

SEQ ID NO: 459825 - DNA, 20 bp, Artificial
  CRISPR gRNA sequence
acagctacatcaagcttacc

SEQ ID NO: 459826 - DNA, 20 bp, Artificial
  CRISPR gRNA sequence
aatttcccttcctgctgtgt

SEQ ID NO: 459827 - DNA, 20 bp, Artificial
  CRISPR gRNA sequence
tttcccttcctgctgtgtca

SEQ ID NO: 459828 - DNA, 20 bp, Artificial
  CRISPR gRNA sequence
tcccttcctgctgtgtcaga

SEQ ID NO: 459829 - DNA, 20 bp, Artificial
  CRISPR gRNA sequence
gagagttcattttgctttcc

SEQ ID NO: 459830 - DNA, 20 bp, Artificial
  CRISPR gRNA sequence
agttcattttgctttcctgg

SEQ ID NO: 459831 - DNA, 20 bp, Artificial
  CRISPR gRNA sequence
ttgctttcctggaagacaaa

SEQ ID NO: 459832 - DNA, 20 bp, Artificial
  CRISPR gRNA sequence
tcctggaagacaaaaagaaa

SEQ ID NO: 459833 - DNA, 20 bp, Artificial
  CRISPR gRNA sequence
tggaagacaaaaagaaaaag

SEQ ID NO: 459834 - DNA, 20 bp, Artificial
  CRISPR gRNA sequence
aaagaaaaagaagtaatcaa

SEQ ID NO: 459835 - DNA, 20 bp, Artificial
  CRISPR gRNA sequence
aagaaaaagaagtaatcaaa

SEQ ID NO: 459836 - DNA, 20 bp, Artificial
  CRISPR gRNA sequence
gaaaaagaagtaatcaaaag

SEQ ID NO: 459837 - DNA, 20 bp, Artificial
  CRISPR gRNA sequence
agaagtaatcaaaaggagta

SEQ ID NO: 459838 - DNA, 20 bp, Artificial
  CRISPR gRNA sequence
gtaatcaaaaggagtaaaga

SEQ ID NO: 459839 - DNA, 20 bp, Artificial
  CRISPR gRNA sequence
atcaaaaggagtaaagaaag

SEQ ID NO: 459840 - DNA, 20 bp, Artificial
  CRISPR gRNA sequence
aaaaggagtaaagaaagcag

SEQ ID NO: 459841 - DNA, 20 bp, Artificial
  CRISPR gRNA sequence
atgcttatcctgttgaatgc

SEQ ID NO: 459842 - DNA, 20 bp, Artificial
  CRISPR gRNA sequence
tgcttatcctgttgaatgcc

SEQ ID NO: 459843 - DNA, 20 bp, Artificial
  CRISPR gRNA sequence
gcttatcctgttgaatgcca

SEQ ID NO: 459844 - DNA, 20 bp, Artificial
  CRISPR gRNA sequence
atcctgttgaatgccaggga

SEQ ID NO: 459845 - DNA, 20 bp, Artificial
  CRISPR gRNA sequence
aatgccagggatagtgttgt

SEQ ID NO: 459846 - DNA, 20 bp, Artificial
  CRISPR gRNA sequence
agggatagtgttgttagttt

SEQ ID NO: 459847 - DNA, 20 bp, Artificial
  CRISPR gRNA sequence
gcttgttaatttgctttgcc

SEQ ID NO: 459848 - DNA, 20 bp, Artificial
  CRISPR gRNA sequence
ttgtgataattcacactgac

SEQ ID NO: 459849 - DNA, 20 bp, Artificial
  CRISPR gRNA sequence
acactgaccagctctctctc

SEQ ID NO: 459850 - DNA, 20 bp, Artificial
  CRISPR gRNA sequence
ctctctggttcatcactttt

SEQ ID NO: 459851 - DNA, 20 bp, Artificial
  CRISPR gRNA sequence
tcatcacttttcagtccaca

SEQ ID NO: 459852 - DNA, 20 bp, Artificial
  CRISPR gRNA sequence
tttcagtccacatagcccca

SEQ ID NO: 459853 - DNA, 20 bp, Artificial
  CRISPR gRNA sequence
tagccccatggcatatctaa

SEQ ID NO: 459854 - DNA, 20 bp, Artificial
  CRISPR gRNA sequence
agccccatggcatatctaaa

SEQ ID NO: 459855 - DNA, 20 bp, Artificial
  CRISPR gRNA sequence
cccatggcatatctaaaagg

SEQ ID NO: 459856 - DNA, 20 bp, Artificial
  CRISPR gRNA sequence
ccatggcatatctaaaagga

SEQ ID NO: 459857 - DNA, 20 bp, Artificial
  CRISPR gRNA sequence
catggcatatctaaaaggaa

SEQ ID NO: 459858 - DNA, 20 bp, Artificial
  CRISPR gRNA sequence
atggcatatctaaaaggaag

SEQ ID NO: 459859 - DNA, 20 bp, Artificial
  CRISPR gRNA sequence
ggcatatctaaaaggaaggg

SEQ ID NO: 459860 - DNA, 20 bp, Artificial
  CRISPR gRNA sequence
gcatatctaaaaggaagggg

SEQ ID NO: 459861 - DNA, 20 bp, Artificial
  CRISPR gRNA sequence
catatctaaaaggaagggga

SEQ ID NO: 459862 - DNA, 20 bp, Artificial
  CRISPR gRNA sequence
taaaaggaaggggagggatc

SEQ ID NO: 459863 - DNA, 20 bp, Artificial
  CRISPR gRNA sequence
gagggatctagtatatcact

SEQ ID NO: 459864 - DNA, 20 bp, Artificial
  CRISPR gRNA sequence
ggatctagtatatcacttgg

SEQ ID NO: 459865 - DNA, 20 bp, Artificial
  CRISPR gRNA sequence
atctagtatatcacttggaa

SEQ ID NO: 459866 - DNA, 20 bp, Artificial
  CRISPR gRNA sequence
gtatatcacttggaagagac

SEQ ID NO: 459867 - DNA, 20 bp, Artificial
  CRISPR gRNA sequence
tatcacttggaagagactgg

SEQ ID NO: 459868 - DNA, 20 bp, Artificial
  CRISPR gRNA sequence
gagactggaagtccttgctc

SEQ ID NO: 459869 - DNA, 20 bp, Artificial
  CRISPR gRNA sequence
agactggaagtccttgctct

SEQ ID NO: 459870 - DNA, 20 bp, Artificial
  CRISPR gRNA sequence
gactggaagtccttgctctg

SEQ ID NO: 459871 - DNA, 20 bp, Artificial
  CRISPR gRNA sequence
ggacattccatactcaatgc

SEQ ID NO: 459872 - DNA, 20 bp, Artificial
  CRISPR gRNA sequence
ctgctgtcctgtcacctatg

SEQ ID NO: 459873 - DNA, 20 bp, Artificial
  CRISPR gRNA sequence
gtcctgtcacctatgtagcc

SEQ ID NO: 459874 - DNA, 20 bp, Artificial
  CRISPR gRNA sequence
agccaagatctcctactacc

SEQ ID NO: 459875 - DNA, 20 bp, Artificial
  CRISPR gRNA sequence
tcctactacctagttcactt

SEQ ID NO: 459876 - DNA, 20 bp, Artificial
  CRISPR gRNA sequence
tacctagttcactttggatg

SEQ ID NO: 459877 - DNA, 20 bp, Artificial
  CRISPR gRNA sequence
ctttggatgtggtaaatcaa

SEQ ID NO: 459878 - DNA, 20 bp, Artificial
  CRISPR gRNA sequence
tatccctgactccttttctg

SEQ ID NO: 459879 - DNA, 20 bp, Artificial
  CRISPR gRNA sequence
gactccttttctgaagttct

SEQ ID NO: 459880 - DNA, 20 bp, Artificial
  CRISPR gRNA sequence
ctccttttctgaagttctga

SEQ ID NO: 459881 - DNA, 20 bp, Artificial
  CRISPR gRNA sequence
ccttttctgaagttctgaga

SEQ ID NO: 459882 - DNA, 20 bp, Artificial
  CRISPR gRNA sequence
cttttctgaagttctgagag

SEQ ID NO: 459883 - DNA, 20 bp, Artificial
  CRISPR gRNA sequence
tgaagttctgagagaggttc

SEQ ID NO: 459884 - DNA, 20 bp, Artificial
  CRISPR gRNA sequence
agttctgagagaggttccag

SEQ ID NO: 459885 - DNA, 20 bp, Artificial
  CRISPR gRNA sequence
agagaggttccagcagtctc

SEQ ID NO: 459886 - DNA, 20 bp, Artificial
  CRISPR gRNA sequence
aggttccagcagtctcaaga

SEQ ID NO: 459887 - DNA, 20 bp, Artificial
  CRISPR gRNA sequence
agtctcaagaaagatgatga

SEQ ID NO: 459888 - DNA, 20 bp, Artificial
  CRISPR gRNA sequence
aagaaagatgatgaaagata

SEQ ID NO: 459889 - DNA, 20 bp, Artificial
  CRISPR gRNA sequence
gaaagatgatgaaagataca

SEQ ID NO: 459890 - DNA, 20 bp, Artificial
  CRISPR gRNA sequence
aagatgatgaaagatacaga

SEQ ID NO: 459891 - DNA, 20 bp, Artificial
  CRISPR gRNA sequence
agatgatgaaagatacagag

SEQ ID NO: 459892 - DNA, 20 bp, Artificial
  CRISPR gRNA sequence
tgaaagatacagagaggcca

SEQ ID NO: 459893 - DNA, 20 bp, Artificial
  CRISPR gRNA sequence
agatacagagaggccataga

SEQ ID NO: 459894 - DNA, 20 bp, Artificial
  CRISPR gRNA sequence
atacagagaggccatagaaa

SEQ ID NO: 459895 - DNA, 20 bp, Artificial
  CRISPR gRNA sequence
agaggccatagaaagagcca

SEQ ID NO: 459896 - DNA, 20 bp, Artificial
  CRISPR gRNA sequence
aggccatagaaagagccatg

SEQ ID NO: 459897 - DNA, 20 bp, Artificial
  CRISPR gRNA sequence
tagaaagagccatggagttg

SEQ ID NO: 459898 - DNA, 20 bp, Artificial
  CRISPR gRNA sequence
gagccatggagttgcagatg

SEQ ID NO: 459899 - DNA, 20 bp, Artificial
  CRISPR gRNA sequence
tggagttgcagatgaagaat

SEQ ID NO: 459900 - DNA, 20 bp, Artificial
  CRISPR gRNA sequence
ggagttgcagatgaagaatt

SEQ ID NO: 459901 - DNA, 20 bp, Artificial
  CRISPR gRNA sequence
gagttgcagatgaagaattg

SEQ ID NO: 459902 - DNA, 20 bp, Artificial
  CRISPR gRNA sequence
tgcagatgaagaattggggt

SEQ ID NO: 459903 - DNA, 20 bp, Artificial
  CRISPR gRNA sequence
cagatgaagaattggggtaa

SEQ ID NO: 459904 - DNA, 20 bp, Artificial
  CRISPR gRNA sequence
gatgaagaattggggtaaga

SEQ ID NO: 459905 - DNA, 20 bp, Artificial
  CRISPR gRNA sequence
tggggtaagagagaattctt

SEQ ID NO: 459906 - DNA, 20 bp, Artificial
  CRISPR gRNA sequence
agagagaattcttcagaatc

SEQ ID NO: 459907 - DNA, 20 bp, Artificial
  CRISPR gRNA sequence
agagaattcttcagaatcca

SEQ ID NO: 459908 - DNA, 20 bp, Artificial
  CRISPR gRNA sequence
gaattcttcagaatccagag

SEQ ID NO: 459909 - DNA, 20 bp, Artificial
  CRISPR gRNA sequence
aattcttcagaatccagaga

SEQ ID NO: 459910 - DNA, 20 bp, Artificial
  CRISPR gRNA sequence
ccagagaaggttctgaactc

SEQ ID NO: 459911 - DNA, 20 bp, Artificial
  CRISPR gRNA sequence
gagaaggttctgaactccag

SEQ ID NO: 459912 - DNA, 20 bp, Artificial
  CRISPR gRNA sequence
aagttctcactccaaaatac

SEQ ID NO: 459913 - DNA, 20 bp, Artificial
  CRISPR gRNA sequence
ttctcactccaaaataccag

SEQ ID NO: 459914 - DNA, 20 bp, Artificial
  CRISPR gRNA sequence
ataccagaagcacttttgcc

SEQ ID NO: 459915 - DNA, 20 bp, Artificial
  CRISPR gRNA sequence
gaagcacttttgcccagtca

SEQ ID NO: 459916 - DNA, 20 bp, Artificial
  CRISPR gRNA sequence
aagcacttttgcccagtcaa

SEQ ID NO: 459917 - DNA, 20 bp, Artificial
  CRISPR gRNA sequence
aaggttattcctgtgtcaca

SEQ ID NO: 459918 - DNA, 20 bp, Artificial
  CRISPR gRNA sequence
attcctgtgtcacacagaat

SEQ ID NO: 459919 - DNA, 20 bp, Artificial
  CRISPR gRNA sequence
agaataagtgttgctctatc

SEQ ID NO: 459920 - DNA, 20 bp, Artificial
  CRISPR gRNA sequence
aagtgttgctctatctagct

SEQ ID NO: 459921 - DNA, 20 bp, Artificial
  CRISPR gRNA sequence
tctatctagctcagtttcta

SEQ ID NO: 459922 - DNA, 20 bp, Artificial
  CRISPR gRNA sequence
cagtttctatagctacactg

SEQ ID NO: 459923 - DNA, 20 bp, Artificial
  CRISPR gRNA sequence
ttctatagctacactgtagc

SEQ ID NO: 459924 - DNA, 20 bp, Artificial
  CRISPR gRNA sequence
tgtagctggtgttgtgaaaa

SEQ ID NO: 459925 - DNA, 20 bp, Artificial
  CRISPR gRNA sequence
gtagctggtgttgtgaaaac

SEQ ID NO: 459926 - DNA, 20 bp, Artificial
  CRISPR gRNA sequence
tgttgtgaaaacaggaatgt

SEQ ID NO: 459927 - DNA, 20 bp, Artificial
  CRISPR gRNA sequence
ttgtgaaaacaggaatgtga

SEQ ID NO: 459928 - DNA, 20 bp, Artificial
  CRISPR gRNA sequence
tgtgaaaacaggaatgtgag

SEQ ID NO: 459929 - DNA, 20 bp, Artificial
  CRISPR gRNA sequence
aaaacaggaatgtgagagga

SEQ ID NO: 459930 - DNA, 20 bp, Artificial
  CRISPR gRNA sequence
aacaggaatgtgagaggatg

SEQ ID NO: 459931 - DNA, 20 bp, Artificial
  CRISPR gRNA sequence
acaggaatgtgagaggatgg

SEQ ID NO: 459932 - DNA, 20 bp, Artificial
  CRISPR gRNA sequence
aggaatgtgagaggatggag

SEQ ID NO: 459933 - DNA, 20 bp, Artificial
  CRISPR gRNA sequence
aatgtgagaggatggaggag

SEQ ID NO: 459934 - DNA, 20 bp, Artificial
  CRISPR gRNA sequence
agaggatggaggagaagaaa

SEQ ID NO: 459935 - DNA, 20 bp, Artificial
  CRISPR gRNA sequence
gaggatggaggagaagaaaa

SEQ ID NO: 459936 - DNA, 20 bp, Artificial
  CRISPR gRNA sequence
atggaggagaagaaaaagga

SEQ ID NO: 459937 - DNA, 20 bp, Artificial
  CRISPR gRNA sequence
ggaggagaagaaaaaggaaa

SEQ ID NO: 459938 - DNA, 20 bp, Artificial
  CRISPR gRNA sequence
aaaaaggaaagagaaaactg

SEQ ID NO: 459939 - DNA, 20 bp, Artificial
  CRISPR gRNA sequence
aaggaaagagaaaactgaag

SEQ ID NO: 459940 - DNA, 20 bp, Artificial
  CRISPR gRNA sequence
aagagaaaactgaagtagtt

SEQ ID NO: 459941 - DNA, 20 bp, Artificial
  CRISPR gRNA sequence
agagaaaactgaagtagttc

SEQ ID NO: 459942 - DNA, 20 bp, Artificial
  CRISPR gRNA sequence
aactgaagtagttcaggcca

SEQ ID NO: 459943 - DNA, 20 bp, Artificial
  CRISPR gRNA sequence
gaagtagttcaggccaaagc

SEQ ID NO: 459944 - DNA, 20 bp, Artificial
  CRISPR gRNA sequence
agttcaggccaaagctagat

SEQ ID NO: 459945 - DNA, 20 bp, Artificial
  CRISPR gRNA sequence
cctctcttacttaacatatt

SEQ ID NO: 459946 - DNA, 20 bp, Artificial
  CRISPR gRNA sequence
acatatttggtcatgacatt

SEQ ID NO: 459947 - DNA, 20 bp, Artificial
  CRISPR gRNA sequence
atatttggtcatgacattga

SEQ ID NO: 459948 - DNA, 20 bp, Artificial
  CRISPR gRNA sequence
atttggtcatgacattgaga

SEQ ID NO: 459949 - DNA, 20 bp, Artificial
  CRISPR gRNA sequence
cattgagagagttcttgcaa

SEQ ID NO: 459950 - DNA, 20 bp, Artificial
  CRISPR gRNA sequence
tgagagagttcttgcaaaag

SEQ ID NO: 459951 - DNA, 20 bp, Artificial
  CRISPR gRNA sequence
agagttcttgcaaaagtaga

SEQ ID NO: 459952 - DNA, 20 bp, Artificial
  CRISPR gRNA sequence
gagttcttgcaaaagtagaa

SEQ ID NO: 459953 - DNA, 20 bp, Artificial
  CRISPR gRNA sequence
atatcacaccattcccatca

SEQ ID NO: 459954 - DNA, 20 bp, Artificial
  CRISPR gRNA sequence
tttttcatatgcattattgt

SEQ ID NO: 459955 - DNA, 20 bp, Artificial
  CRISPR gRNA sequence
ttttcatatgcattattgtt

SEQ ID NO: 459956 - DNA, 20 bp, Artificial
  CRISPR gRNA sequence
catatgcattattgttgggt

SEQ ID NO: 459957 - DNA, 20 bp, Artificial
  CRISPR gRNA sequence
attattgttgggtaagaatt

SEQ ID NO: 459958 - DNA, 20 bp, Artificial
  CRISPR gRNA sequence
ttattgttgggtaagaattc

SEQ ID NO: 459959 - DNA, 20 bp, Artificial
  CRISPR gRNA sequence
gttgggtaagaattcaggtc

SEQ ID NO: 459960 - DNA, 20 bp, Artificial
  CRISPR gRNA sequence
ggtcaagcatatgtttataa

SEQ ID NO: 459961 - DNA, 20 bp, Artificial
  CRISPR gRNA sequence
gcatatgtttataatggcaa

SEQ ID NO: 459962 - DNA, 20 bp, Artificial
  CRISPR gRNA sequence
tataatggcaatagaaaata

SEQ ID NO: 459963 - DNA, 20 bp, Artificial
  CRISPR gRNA sequence
acagacatattaattttctc

SEQ ID NO: 459964 - DNA, 20 bp, Artificial
  CRISPR gRNA sequence
cagacatattaattttctct

SEQ ID NO: 459965 - DNA, 20 bp, Artificial
  CRISPR gRNA sequence
agacatattaattttctctg

SEQ ID NO: 459966 - DNA, 20 bp, Artificial
  CRISPR gRNA sequence
ttaattttctctggggacat

SEQ ID NO: 459967 - DNA, 20 bp, Artificial
  CRISPR gRNA sequence
ctctggggacattggttctt

SEQ ID NO: 459968 - DNA, 20 bp, Artificial
  CRISPR gRNA sequence
cattggttcttcagttacat

SEQ ID NO: 459969 - DNA, 20 bp, Artificial
  CRISPR gRNA sequence
attggttcttcagttacata

SEQ ID NO: 459970 - DNA, 20 bp, Artificial
  CRISPR gRNA sequence
ttggttcttcagttacataa

SEQ ID NO: 459971 - DNA, 20 bp, Artificial
  CRISPR gRNA sequence
cagttacataagggtgtgtg

SEQ ID NO: 459972 - DNA, 20 bp, Artificial
  CRISPR gRNA sequence
agttacataagggtgtgtgt

SEQ ID NO: 459973 - DNA, 20 bp, Artificial
  CRISPR gRNA sequence
cataagggtgtgtgtgggat

SEQ ID NO: 459974 - DNA, 20 bp, Artificial
  CRISPR gRNA sequence
tgtgtgggattggcatgatg

SEQ ID NO: 459975 - DNA, 20 bp, Artificial
  CRISPR gRNA sequence
gggattggcatgatgtggtg

SEQ ID NO: 459976 - DNA, 20 bp, Artificial
  CRISPR gRNA sequence
tgatgtggtgtggctgtgaa

SEQ ID NO: 459977 - DNA, 20 bp, Artificial
  CRISPR gRNA sequence
atgtggtgtggctgtgaaaa

SEQ ID NO: 459978 - DNA, 20 bp, Artificial
  CRISPR gRNA sequence
tgtggtgtggctgtgaaaag

SEQ ID NO: 459979 - DNA, 20 bp, Artificial
  CRISPR gRNA sequence
aaagaggataatacaaaata

SEQ ID NO: 459980 - DNA, 20 bp, Artificial
  CRISPR gRNA sequence
gaggataatacaaaataaag

SEQ ID NO: 459981 - DNA, 20 bp, Artificial
  CRISPR gRNA sequence
taaagcagatatcttgatct

SEQ ID NO: 459982 - DNA, 20 bp, Artificial
  CRISPR gRNA sequence
aagcagatatcttgatctga

SEQ ID NO: 459983 - DNA, 20 bp, Artificial
  CRISPR gRNA sequence
tttcaacttccaatcctgtt

SEQ ID NO: 459984 - DNA, 20 bp, Artificial
  CRISPR gRNA sequence
ttcaacttccaatcctgtta

SEQ ID NO: 459985 - DNA, 20 bp, Artificial
  CRISPR gRNA sequence
cttccaatcctgttaaggtt

SEQ ID NO: 459986 - DNA, 20 bp, Artificial
  CRISPR gRNA sequence
ccaatcctgttaaggtttag

SEQ ID NO: 459987 - DNA, 20 bp, Artificial
  CRISPR gRNA sequence
aatcctgttaaggtttagaa

SEQ ID NO: 459988 - DNA, 20 bp, Artificial
  CRISPR gRNA sequence
gctctttctcacacaaacct

SEQ ID NO: 459989 - DNA, 20 bp, Artificial
  CRISPR gRNA sequence
acaaacctaagattgatgca

SEQ ID NO: 459990 - DNA, 20 bp, Artificial
  CRISPR gRNA sequence
aaacctaagattgatgcaaa

SEQ ID NO: 459991 - DNA, 20 bp, Artificial
  CRISPR gRNA sequence
ttgatgcaaagagaatgatg

SEQ ID NO: 459992 - DNA, 20 bp, Artificial
  CRISPR gRNA sequence
caaagagaatgatgaagtct

SEQ ID NO: 459993 - DNA, 20 bp, Artificial
  CRISPR gRNA sequence
tgctatgctcgccacaactc

SEQ ID NO: 459994 - DNA, 20 bp, Artificial
  CRISPR gRNA sequence
atgctcgccacaactctagc

SEQ ID NO: 459995 - DNA, 20 bp, Artificial
  CRISPR gRNA sequence
tctagctggaatactgtgcg

SEQ ID NO: 459996 - DNA, 20 bp, Artificial
  CRISPR gRNA sequence
gctggaatactgtgcgtggt

SEQ ID NO: 459997 - DNA, 20 bp, Artificial
  CRISPR gRNA sequence
gcatgcctctcccgtgactc

SEQ ID NO: 459998 - DNA, 20 bp, Artificial
  CRISPR gRNA sequence
catgcctctcccgtgactca

SEQ ID NO: 459999 - DNA, 20 bp, Artificial
  CRISPR gRNA sequence
atgcctctcccgtgactcaa

SEQ ID NO: 460000 - DNA, 20 bp, Artificial
  CRISPR gRNA sequence
gcctctcccgtgactcaagg

SEQ ID NO: 460001 - DNA, 20 bp, Artificial
  CRISPR gRNA sequence
ggagccccaaccaacctatt

SEQ ID NO: 460002 - DNA, 20 bp, Artificial
  CRISPR gRNA sequence
aaccaacctatttagctttt

SEQ ID NO: 460003 - DNA, 20 bp, Artificial
  CRISPR gRNA sequence
tagctttttagcgcaaatat

SEQ ID NO: 460004 - DNA, 20 bp, Artificial
  CRISPR gRNA sequence
cgcaaatatgagttgtcttc

SEQ ID NO: 460005 - DNA, 20 bp, Artificial
  CRISPR gRNA sequence
gcaaatatgagttgtcttct

SEQ ID NO: 460006 - DNA, 20 bp, Artificial
  CRISPR gRNA sequence
ttctaggaaatcattatcca

SEQ ID NO: 460007 - DNA, 20 bp, Artificial
  CRISPR gRNA sequence
aaatcattatccatggttta

SEQ ID NO: 460008 - DNA, 20 bp, Artificial
  CRISPR gRNA sequence
aatcattatccatggtttac

SEQ ID NO: 460009 - DNA, 20 bp, Artificial
  CRISPR gRNA sequence
ttatccatggtttacaggat

SEQ ID NO: 460010 - DNA, 20 bp, Artificial
  CRISPR gRNA sequence
tatccatggtttacaggatt

SEQ ID NO: 460011 - DNA, 20 bp, Artificial
  CRISPR gRNA sequence
catggtttacaggattggga

SEQ ID NO: 460012 - DNA, 20 bp, Artificial
  CRISPR gRNA sequence
aggattgggaaagaaaacaa

SEQ ID NO: 460013 - DNA, 20 bp, Artificial
  CRISPR gRNA sequence
ggattgggaaagaaaacaac

SEQ ID NO: 460014 - DNA, 20 bp, Artificial
  CRISPR gRNA sequence
ttgggaaagaaaacaacagg

SEQ ID NO: 460015 - DNA, 20 bp, Artificial
  CRISPR gRNA sequence
ggaagaaactaaaaatcctt

SEQ ID NO: 460016 - DNA, 20 bp, Artificial
  CRISPR gRNA sequence
aactaaaaatcctttagccc

SEQ ID NO: 460017 - DNA, 20 bp, Artificial
  CRISPR gRNA sequence
aatcctttagccccagaaat

SEQ ID NO: 460018 - DNA, 20 bp, Artificial
  CRISPR gRNA sequence
tttagccccagaaataagaa

SEQ ID NO: 460019 - DNA, 20 bp, Artificial
  CRISPR gRNA sequence
taagaatggccccaaatgtg

SEQ ID NO: 460020 - DNA, 20 bp, Artificial
  CRISPR gRNA sequence
tggccccaaatgtgtggtac

SEQ ID NO: 460021 - DNA, 20 bp, Artificial
  CRISPR gRNA sequence
ggccccaaatgtgtggtact

SEQ ID NO: 460022 - DNA, 20 bp, Artificial
  CRISPR gRNA sequence
gccccaaatgtgtggtactg

SEQ ID NO: 460023 - DNA, 20 bp, Artificial
  CRISPR gRNA sequence
ccccaaatgtgtggtactgg

SEQ ID NO: 460024 - DNA, 20 bp, Artificial
  CRISPR gRNA sequence
caaatgtgtggtactggggg

SEQ ID NO: 460025 - DNA, 20 bp, Artificial
  CRISPR gRNA sequence
aatgtgtggtactgggggca

SEQ ID NO: 460026 - DNA, 20 bp, Artificial
  CRISPR gRNA sequence
atgtgtggtactgggggcag

SEQ ID NO: 460027 - DNA, 20 bp, Artificial
  CRISPR gRNA sequence
tgtgtggtactgggggcaga

SEQ ID NO: 460028 - DNA, 20 bp, Artificial
  CRISPR gRNA sequence
tactgggggcagagggaaaa

SEQ ID NO: 460029 - DNA, 20 bp, Artificial
  CRISPR gRNA sequence
agggaaaatagaacccacct

SEQ ID NO: 460030 - DNA, 20 bp, Artificial
  CRISPR gRNA sequence
aacccaccttggtgccttct

SEQ ID NO: 460031 - DNA, 20 bp, Artificial
  CRISPR gRNA sequence
acccaccttggtgccttctc

SEQ ID NO: 460032 - DNA, 20 bp, Artificial
  CRISPR gRNA sequence
caccttggtgccttctcagg

SEQ ID NO: 460033 - DNA, 20 bp, Artificial
  CRISPR gRNA sequence
cttggtgccttctcaggcag

SEQ ID NO: 460034 - DNA, 20 bp, Artificial
  CRISPR gRNA sequence
tgccttctcaggcagcagaa

SEQ ID NO: 460035 - DNA, 20 bp, Artificial
  CRISPR gRNA sequence
gccttctcaggcagcagaac

SEQ ID NO: 460036 - DNA, 20 bp, Artificial
  CRISPR gRNA sequence
ttctcaggcagcagaacagg

SEQ ID NO: 460037 - DNA, 20 bp, Artificial
  CRISPR gRNA sequence
ggcagcagaacaggcagaaa

SEQ ID NO: 460038 - DNA, 20 bp, Artificial
  CRISPR gRNA sequence
gcagcagaacaggcagaaac

SEQ ID NO: 460039 - DNA, 20 bp, Artificial
  CRISPR gRNA sequence
gcagaacaggcagaaacagg

SEQ ID NO: 460040 - DNA, 20 bp, Artificial
  CRISPR gRNA sequence
aggcagaaacaggtagtgat

SEQ ID NO: 460041 - DNA, 20 bp, Artificial
  CRISPR gRNA sequence
cagaaacaggtagtgatgag

SEQ ID NO: 460042 - DNA, 20 bp, Artificial
  CRISPR gRNA sequence
gaaacaggtagtgatgagta

SEQ ID NO: 460043 - DNA, 20 bp, Artificial
  CRISPR gRNA sequence
aaacaggtagtgatgagtag

SEQ ID NO: 460044 - DNA, 20 bp, Artificial
  CRISPR gRNA sequence
gagtagaggcaatcccccca

SEQ ID NO: 460045 - DNA, 20 bp, Artificial
  CRISPR gRNA sequence
agtagaggcaatccccccaa

SEQ ID NO: 460046 - DNA, 20 bp, Artificial
  CRISPR gRNA sequence
agaggcaatccccccaaagg

SEQ ID NO: 460047 - DNA, 20 bp, Artificial
  CRISPR gRNA sequence
cccaaaggaagtaaacgata

SEQ ID NO: 460048 - DNA, 20 bp, Artificial
  CRISPR gRNA sequence
ccaaaggaagtaaacgatac

SEQ ID NO: 460049 - DNA, 20 bp, Artificial
  CRISPR gRNA sequence
aaaggaagtaaacgatacag

SEQ ID NO: 460050 - DNA, 20 bp, Artificial
  CRISPR gRNA sequence
gaagtaaacgatacaggagc

SEQ ID NO: 460051 - DNA, 20 bp, Artificial
  CRISPR gRNA sequence
aagtaaacgatacaggagcc

SEQ ID NO: 460052 - DNA, 20 bp, Artificial
  CRISPR gRNA sequence
agtaaacgatacaggagcca

SEQ ID NO: 460053 - DNA, 20 bp, Artificial
  CRISPR gRNA sequence
tctgcttgccatttcgtcct

SEQ ID NO: 460054 - DNA, 20 bp, Artificial
  CRISPR gRNA sequence
tgcttgccatttcgtccttg

SEQ ID NO: 460055 - DNA, 20 bp, Artificial
  CRISPR gRNA sequence
gcttgccatttcgtccttgg

SEQ ID NO: 460056 - DNA, 20 bp, Artificial
  CRISPR gRNA sequence
cttgccatttcgtccttgga

SEQ ID NO: 460057 - DNA, 20 bp, Artificial
  CRISPR gRNA sequence
cgtccttggagggtcgttct

SEQ ID NO: 460058 - DNA, 20 bp, Artificial
  CRISPR gRNA sequence
gtccttggagggtcgttctg

SEQ ID NO: 460059 - DNA, 20 bp, Artificial
  CRISPR gRNA sequence
tctgaggcactttttacatc

SEQ ID NO: 460060 - DNA, 20 bp, Artificial
  CRISPR gRNA sequence
actttttacatctggaatgt

SEQ ID NO: 460061 - DNA, 20 bp, Artificial
  CRISPR gRNA sequence
tggaatgttagtaaatgcta

SEQ ID NO: 460062 - DNA, 20 bp, Artificial
  CRISPR gRNA sequence
gaatgttagtaaatgctaaa

SEQ ID NO: 460063 - DNA, 20 bp, Artificial
  CRISPR gRNA sequence
atgttagtaaatgctaaaga

SEQ ID NO: 460064 - DNA, 20 bp, Artificial
  CRISPR gRNA sequence
tagtaaatgctaaagagagt

SEQ ID NO: 460065 - DNA, 20 bp, Artificial
  CRISPR gRNA sequence
agtaaatgctaaagagagtt

SEQ ID NO: 460066 - DNA, 20 bp, Artificial
  CRISPR gRNA sequence
taaagagagttaggaaatct

SEQ ID NO: 460067 - DNA, 20 bp, Artificial
  CRISPR gRNA sequence
ttaggaaatctgagatatat

SEQ ID NO: 460068 - DNA, 20 bp, Artificial
  CRISPR gRNA sequence
taggaaatctgagatatatt

SEQ ID NO: 460069 - DNA, 20 bp, Artificial
  CRISPR gRNA sequence
aatctgagatatattgggat

SEQ ID NO: 460070 - DNA, 20 bp, Artificial
  CRISPR gRNA sequence
ctgagatatattgggatcag

SEQ ID NO: 460071 - DNA, 20 bp, Artificial
  CRISPR gRNA sequence
gcggcacccctctgcattgt

SEQ ID NO: 460072 - DNA, 20 bp, Artificial
  CRISPR gRNA sequence
cctctgcattgtcagaactt

SEQ ID NO: 460073 - DNA, 20 bp, Artificial
  CRISPR gRNA sequence
gcattgtcagaacttgagtg

SEQ ID NO: 460074 - DNA, 20 bp, Artificial
  CRISPR gRNA sequence
cattgtcagaacttgagtga

SEQ ID NO: 460075 - DNA, 20 bp, Artificial
  CRISPR gRNA sequence
ttgtcagaacttgagtgaag

SEQ ID NO: 460076 - DNA, 20 bp, Artificial
  CRISPR gRNA sequence
aacttgagtgaaggagattt

SEQ ID NO: 460077 - DNA, 20 bp, Artificial
  CRISPR gRNA sequence
acttgagtgaaggagatttc

SEQ ID NO: 460078 - DNA, 20 bp, Artificial
  CRISPR gRNA sequence
caatgcctccatttcccctt

SEQ ID NO: 460079 - DNA, 20 bp, Artificial
  CRISPR gRNA sequence
atgcctccatttccccttca

SEQ ID NO: 460080 - DNA, 20 bp, Artificial
  CRISPR gRNA sequence
tgcctccatttccccttcag

SEQ ID NO: 460081 - DNA, 20 bp, Artificial
  CRISPR gRNA sequence
ccccttcagaggcattcctc

SEQ ID NO: 460082 - DNA, 20 bp, Artificial
  CRISPR gRNA sequence
gaggcattcctcaagaatcc

SEQ ID NO: 460083 - DNA, 20 bp, Artificial
  CRISPR gRNA sequence
ctcaagaatcccagtgccct

SEQ ID NO: 460084 - DNA, 20 bp, Artificial
  CRISPR gRNA sequence
ccacctcttgctttcttgct

SEQ ID NO: 460085 - DNA, 20 bp, Artificial
  CRISPR gRNA sequence
cctcttgctttcttgctgag

SEQ ID NO: 460086 - DNA, 20 bp, Artificial
  CRISPR gRNA sequence
gctttcttgctgagcagacg

SEQ ID NO: 460087 - DNA, 20 bp, Artificial
  CRISPR gRNA sequence
ctgcgataatttatcttttg

SEQ ID NO: 460088 - DNA, 20 bp, Artificial
  CRISPR gRNA sequence
gcagaaattctttattctga

SEQ ID NO: 460089 - DNA, 20 bp, Artificial
  CRISPR gRNA sequence
agaaattctttattctgata

SEQ ID NO: 460090 - DNA, 20 bp, Artificial
  CRISPR gRNA sequence
ctgatagagttaatcttcca

SEQ ID NO: 460091 - DNA, 20 bp, Artificial
  CRISPR gRNA sequence
acaatcttcatgataactgt

SEQ ID NO: 460092 - DNA, 20 bp, Artificial
  CRISPR gRNA sequence
atcttcatgataactgtcag

SEQ ID NO: 460093 - DNA, 20 bp, Artificial
  CRISPR gRNA sequence
tcttcatgataactgtcaga

SEQ ID NO: 460094 - DNA, 20 bp, Artificial
  CRISPR gRNA sequence
ctgtcagaaggtacttcatt

SEQ ID NO: 460095 - DNA, 20 bp, Artificial
  CRISPR gRNA sequence
tcattaagcctttctattta

SEQ ID NO: 460096 - DNA, 20 bp, Artificial
  CRISPR gRNA sequence
aactctcatattcatcactt

SEQ ID NO: 460097 - DNA, 20 bp, Artificial
  CRISPR gRNA sequence
tctcatattcatcacttaag

SEQ ID NO: 460098 - DNA, 20 bp, Artificial
  CRISPR gRNA sequence
ctcatattcatcacttaagt

SEQ ID NO: 460099 - DNA, 20 bp, Artificial
  CRISPR gRNA sequence
cattgtctttattttgtccc

SEQ ID NO: 460100 - DNA, 20 bp, Artificial
  CRISPR gRNA sequence
ttgtctttattttgtcccaa

SEQ ID NO: 460101 - DNA, 20 bp, Artificial
  CRISPR gRNA sequence
tttgtcccaagagttgctcc

SEQ ID NO: 460102 - DNA, 20 bp, Artificial
  CRISPR gRNA sequence
tcccaagagttgctccaagt

SEQ ID NO: 460103 - DNA, 20 bp, Artificial
  CRISPR gRNA sequence
aagagttgctccaagtcaga

SEQ ID NO: 460104 - DNA, 20 bp, Artificial
  CRISPR gRNA sequence
gttgctccaagtcagatagc

SEQ ID NO: 460105 - DNA, 20 bp, Artificial
  CRISPR gRNA sequence
ctccaagtcagatagctagt

SEQ ID NO: 460106 - DNA, 20 bp, Artificial
  CRISPR gRNA sequence
caagtcagatagctagtgag

SEQ ID NO: 460107 - DNA, 20 bp, Artificial
  CRISPR gRNA sequence
agatagctagtgagtggcaa

SEQ ID NO: 460108 - DNA, 20 bp, Artificial
  CRISPR gRNA sequence
gatagctagtgagtggcaat

SEQ ID NO: 460109 - DNA, 20 bp, Artificial
  CRISPR gRNA sequence
gtgagtggcaatgggaactc

SEQ ID NO: 460110 - DNA, 20 bp, Artificial
  CRISPR gRNA sequence
tcaagccaacatgtttgtaa

SEQ ID NO: 460111 - DNA, 20 bp, Artificial
  CRISPR gRNA sequence
caagccaacatgtttgtaac

SEQ ID NO: 460112 - DNA, 20 bp, Artificial
  CRISPR gRNA sequence
atgtttgtaacaggaaattc

SEQ ID NO: 460113 - DNA, 20 bp, Artificial
  CRISPR gRNA sequence
ttccttgtctcgtaacttat

SEQ ID NO: 460114 - DNA, 20 bp, Artificial
  CRISPR gRNA sequence
caaatatcaaatacttttga

SEQ ID NO: 460115 - DNA, 20 bp, Artificial
  CRISPR gRNA sequence
aatacttttgatagccttaa

SEQ ID NO: 460116 - DNA, 20 bp, Artificial
  CRISPR gRNA sequence
agccttaaaagtgctctgca

SEQ ID NO: 460117 - DNA, 20 bp, Artificial
  CRISPR gRNA sequence
aaagtgctctgcatggcaca

SEQ ID NO: 460118 - DNA, 20 bp, Artificial
  CRISPR gRNA sequence
gatcaatgttaatacgcatt

SEQ ID NO: 460119 - DNA, 20 bp, Artificial
  CRISPR gRNA sequence
atcaatgttaatacgcattg

SEQ ID NO: 460120 - DNA, 20 bp, Artificial
  CRISPR gRNA sequence
attgaggccctgtttgtctg

SEQ ID NO: 460121 - DNA, 20 bp, Artificial
  CRISPR gRNA sequence
tgtttgtctgcagttgttca

SEQ ID NO: 460122 - DNA, 20 bp, Artificial
  CRISPR gRNA sequence
tgcagttgttcacagctcat

SEQ ID NO: 460123 - DNA, 20 bp, Artificial
  CRISPR gRNA sequence
agttgttcacagctcattag

SEQ ID NO: 460124 - DNA, 20 bp, Artificial
  CRISPR gRNA sequence
gttgttcacagctcattagc

SEQ ID NO: 460125 - DNA, 20 bp, Artificial
  CRISPR gRNA sequence
tagcaggttgtgaaacaatt

SEQ ID NO: 460126 - DNA, 20 bp, Artificial
  CRISPR gRNA sequence
acaatttagtatgtcacaaa

SEQ ID NO: 460127 - DNA, 20 bp, Artificial
  CRISPR gRNA sequence
tagcattttaaaaaatgaaa

SEQ ID NO: 460128 - DNA, 20 bp, Artificial
  CRISPR gRNA sequence
cattttaaaaaatgaaacag

SEQ ID NO: 460129 - DNA, 20 bp, Artificial
  CRISPR gRNA sequence
ttttaaaaaatgaaacagaa

SEQ ID NO: 460130 - DNA, 20 bp, Artificial
  CRISPR gRNA sequence
tttaaaaaatgaaacagaag

SEQ ID NO: 460131 - DNA, 20 bp, Artificial
  CRISPR gRNA sequence
aaaaatgaaacagaagagga

SEQ ID NO: 460132 - DNA, 20 bp, Artificial
  CRISPR gRNA sequence
cagaagaggatagaaatcat

SEQ ID NO: 460133 - DNA, 20 bp, Artificial
  CRISPR gRNA sequence
tcagaatgcatcacacacac

SEQ ID NO: 460134 - DNA, 20 bp, Artificial
  CRISPR gRNA sequence
agaatgcatcacacacacta

SEQ ID NO: 460135 - DNA, 20 bp, Artificial
  CRISPR gRNA sequence
atgcatcacacacactagag

SEQ ID NO: 460136 - DNA, 20 bp, Artificial
  CRISPR gRNA sequence
catcacacacactagagcag

SEQ ID NO: 460137 - DNA, 20 bp, Artificial
  CRISPR gRNA sequence
acactagagcagtggttctc

SEQ ID NO: 460138 - DNA, 20 bp, Artificial
  CRISPR gRNA sequence
ctagagcagtggttctcaag

SEQ ID NO: 460139 - DNA, 20 bp, Artificial
  CRISPR gRNA sequence
tagagcagtggttctcaagc

SEQ ID NO: 460140 - DNA, 20 bp, Artificial
  CRISPR gRNA sequence
agagcagtggttctcaagca

SEQ ID NO: 460141 - DNA, 20 bp, Artificial
  CRISPR gRNA sequence
tctcaagcagggaacatgtg

SEQ ID NO: 460142 - DNA, 20 bp, Artificial
  CRISPR gRNA sequence
ggaacatgtgtggcaatgtc

SEQ ID NO: 460143 - DNA, 20 bp, Artificial
  CRISPR gRNA sequence
aacatgtgtggcaatgtctg

SEQ ID NO: 460144 - DNA, 20 bp, Artificial
  CRISPR gRNA sequence
gcaatgtctggagacatttt

SEQ ID NO: 460145 - DNA, 20 bp, Artificial
  CRISPR gRNA sequence
gagacatttttggctgtaac

SEQ ID NO: 460146 - DNA, 20 bp, Artificial
  CRISPR gRNA sequence
agacatttttggctgtaaca

SEQ ID NO: 460147 - DNA, 20 bp, Artificial
  CRISPR gRNA sequence
catttttggctgtaacaagg

SEQ ID NO: 460148 - DNA, 20 bp, Artificial
  CRISPR gRNA sequence
atttttggctgtaacaaggt

SEQ ID NO: 460149 - DNA, 20 bp, Artificial
  CRISPR gRNA sequence
tttttggctgtaacaaggta

SEQ ID NO: 460150 - DNA, 20 bp, Artificial
  CRISPR gRNA sequence
ttttggctgtaacaaggtag

SEQ ID NO: 460151 - DNA, 20 bp, Artificial
  CRISPR gRNA sequence
tttggctgtaacaaggtagg

SEQ ID NO: 460152 - DNA, 20 bp, Artificial
  CRISPR gRNA sequence
tggctgtaacaaggtagggg

SEQ ID NO: 460153 - DNA, 20 bp, Artificial
  CRISPR gRNA sequence
ggctgtaacaaggtaggggg

SEQ ID NO: 460154 - DNA, 20 bp, Artificial
  CRISPR gRNA sequence
gctgtaacaaggtaggggga

SEQ ID NO: 460155 - DNA, 20 bp, Artificial
  CRISPR gRNA sequence
tgtaacaaggtagggggagg

SEQ ID NO: 460156 - DNA, 20 bp, Artificial
  CRISPR gRNA sequence
gtaacaaggtagggggaggg

SEQ ID NO: 460157 - DNA, 20 bp, Artificial
  CRISPR gRNA sequence
caaggtagggggagggaggc

SEQ ID NO: 460158 - DNA, 20 bp, Artificial
  CRISPR gRNA sequence
gggggagggaggctggcaac

SEQ ID NO: 460159 - DNA, 20 bp, Artificial
  CRISPR gRNA sequence
gagggaggctggcaaccagt

SEQ ID NO: 460160 - DNA, 20 bp, Artificial
  CRISPR gRNA sequence
ggaggctggcaaccagtgag

SEQ ID NO: 460161 - DNA, 20 bp, Artificial
  CRISPR gRNA sequence
ggctggcaaccagtgagtag

SEQ ID NO: 460162 - DNA, 20 bp, Artificial
  CRISPR gRNA sequence
ggcaaccagtgagtagaagc

SEQ ID NO: 460163 - DNA, 20 bp, Artificial
  CRISPR gRNA sequence
gcaaccagtgagtagaagcc

SEQ ID NO: 460164 - DNA, 20 bp, Artificial
  CRISPR gRNA sequence
caaccagtgagtagaagccg

SEQ ID NO: 460165 - DNA, 20 bp, Artificial
  CRISPR gRNA sequence
gctaaacaccctacactata

SEQ ID NO: 460166 - DNA, 20 bp, Artificial
  CRISPR gRNA sequence
ctaaacaccctacactatac

SEQ ID NO: 460167 - DNA, 20 bp, Artificial
  CRISPR gRNA sequence
tacaggatgcaacccccact

SEQ ID NO: 460168 - DNA, 20 bp, Artificial
  CRISPR gRNA sequence
tagtgcaacaaaacattatc

SEQ ID NO: 460169 - DNA, 20 bp, Artificial
  CRISPR gRNA sequence
acaaaacattatccagacca

SEQ ID NO: 460170 - DNA, 20 bp, Artificial
  CRISPR gRNA sequence
tatccagaccaaagtgtcaa

SEQ ID NO: 460171 - DNA, 20 bp, Artificial
  CRISPR gRNA sequence
tccagaccaaagtgtcaatg

SEQ ID NO: 460172 - DNA, 20 bp, Artificial
  CRISPR gRNA sequence
aatggagaaactctgtctta

SEQ ID NO: 460173 - DNA, 20 bp, Artificial
  CRISPR gRNA sequence
agaaactctgtcttatggtt

SEQ ID NO: 460174 - DNA, 20 bp, Artificial
  CRISPR gRNA sequence
ttttatatttgtgtgcatta

SEQ ID NO: 460175 - DNA, 20 bp, Artificial
  CRISPR gRNA sequence
tttatatttgtgtgcattat

SEQ ID NO: 460176 - DNA, 20 bp, Artificial
  CRISPR gRNA sequence
tgcattatgggttgtgatgt

SEQ ID NO: 460177 - DNA, 20 bp, Artificial
  CRISPR gRNA sequence
atgggttgtgatgtaagatc

SEQ ID NO: 460178 - DNA, 20 bp, Artificial
  CRISPR gRNA sequence
gttgttgttttttttaattt

SEQ ID NO: 460179 - DNA, 20 bp, Artificial
  CRISPR gRNA sequence
ttgttgttttttttaatttt

SEQ ID NO: 460180 - DNA, 20 bp, Artificial
  CRISPR gRNA sequence
ttttttttaattttgggtta

SEQ ID NO: 460181 - DNA, 20 bp, Artificial
  CRISPR gRNA sequence
attttgggttacagttaaca

SEQ ID NO: 460182 - DNA, 20 bp, Artificial
  CRISPR gRNA sequence
taacacagtatgaaaaatac

SEQ ID NO: 460183 - DNA, 20 bp, Artificial
  CRISPR gRNA sequence
acacagtatgaaaaatactg

SEQ ID NO: 460184 - DNA, 20 bp, Artificial
  CRISPR gRNA sequence
agtatgaaaaatactggagt

SEQ ID NO: 460185 - DNA, 20 bp, Artificial
  CRISPR gRNA sequence
atactggagtaagatattct

SEQ ID NO: 460186 - DNA, 20 bp, Artificial
  CRISPR gRNA sequence
tactggagtaagatattcta

SEQ ID NO: 460187 - DNA, 20 bp, Artificial
  CRISPR gRNA sequence
gagtaagatattctaaggtc

SEQ ID NO: 460188 - DNA, 20 bp, Artificial
  CRISPR gRNA sequence
agatattctaaggtctggcc

SEQ ID NO: 460189 - DNA, 20 bp, Artificial
  CRISPR gRNA sequence
tattctaaggtctggcctgg

SEQ ID NO: 460190 - DNA, 20 bp, Artificial
  CRISPR gRNA sequence
gtggctcacacctgtaatct

SEQ ID NO: 460191 - DNA, 20 bp, Artificial
  CRISPR gRNA sequence
cacctgtaatctcagcactt

SEQ ID NO: 460192 - DNA, 20 bp, Artificial
  CRISPR gRNA sequence
acctgtaatctcagcacttt

SEQ ID NO: 460193 - DNA, 20 bp, Artificial
  CRISPR gRNA sequence
ctgtaatctcagcactttgg

SEQ ID NO: 460194 - DNA, 20 bp, Artificial
  CRISPR gRNA sequence
tgtaatctcagcactttggg

SEQ ID NO: 460195 - DNA, 20 bp, Artificial
  CRISPR gRNA sequence
tctcagcactttgggaggcc

SEQ ID NO: 460196 - DNA, 20 bp, Artificial
  CRISPR gRNA sequence
ctcagcactttgggaggccg

SEQ ID NO: 460197 - DNA, 20 bp, Artificial
  CRISPR gRNA sequence
agcactttgggaggccgagg

SEQ ID NO: 460198 - DNA, 20 bp, Artificial
  CRISPR gRNA sequence
gcactttgggaggccgaggt

SEQ ID NO: 460199 - DNA, 20 bp, Artificial
  CRISPR gRNA sequence
ctttgggaggccgaggtagg

SEQ ID NO: 460200 - DNA, 20 bp, Artificial
  CRISPR gRNA sequence
ccgaggtaggcggatcactt

SEQ ID NO: 460201 - DNA, 20 bp, Artificial
  CRISPR gRNA sequence
gtaggcggatcacttgagat

SEQ ID NO: 460202 - DNA, 20 bp, Artificial
  CRISPR gRNA sequence
taggcggatcacttgagatc

SEQ ID NO: 460203 - DNA, 20 bp, Artificial
  CRISPR gRNA sequence
ggcggatcacttgagatcag

SEQ ID NO: 460204 - DNA, 20 bp, Artificial
  CRISPR gRNA sequence
tcacttgagatcaggagttc

SEQ ID NO: 460205 - DNA, 20 bp, Artificial
  CRISPR gRNA sequence
tgagatcaggagttcgagac

SEQ ID NO: 460206 - DNA, 20 bp, Artificial
  CRISPR gRNA sequence
tcaggagttcgagaccagca

SEQ ID NO: 460207 - DNA, 20 bp, Artificial
  CRISPR gRNA sequence
cgagaccagcatggccaaaa

SEQ ID NO: 460208 - DNA, 20 bp, Artificial
  CRISPR gRNA sequence
tctactaaaaatacaaaaat

SEQ ID NO: 460209 - DNA, 20 bp, Artificial
  CRISPR gRNA sequence
ctaaaaatacaaaaattagc

SEQ ID NO: 460210 - DNA, 20 bp, Artificial
  CRISPR gRNA sequence
taaaaatacaaaaattagct

SEQ ID NO: 460211 - DNA, 20 bp, Artificial
  CRISPR gRNA sequence
atacaaaaattagctgggcg

SEQ ID NO: 460212 - DNA, 20 bp, Artificial
  CRISPR gRNA sequence
gtggtatgcacctgtaatcc

SEQ ID NO: 460213 - DNA, 20 bp, Artificial
  CRISPR gRNA sequence
tggtatgcacctgtaatccc

SEQ ID NO: 460214 - DNA, 20 bp, Artificial
  CRISPR gRNA sequence
cacctgtaatcccaggtaca

SEQ ID NO: 460215 - DNA, 20 bp, Artificial
  CRISPR gRNA sequence
acctgtaatcccaggtacat

SEQ ID NO: 460216 - DNA, 20 bp, Artificial
  CRISPR gRNA sequence
ctgtaatcccaggtacatgg

SEQ ID NO: 460217 - DNA, 20 bp, Artificial
  CRISPR gRNA sequence
tgtaatcccaggtacatggg

SEQ ID NO: 460218 - DNA, 20 bp, Artificial
  CRISPR gRNA sequence
tcccaggtacatgggaggct

SEQ ID NO: 460219 - DNA, 20 bp, Artificial
  CRISPR gRNA sequence
aggtacatgggaggctgaga

SEQ ID NO: 460220 - DNA, 20 bp, Artificial
  CRISPR gRNA sequence
ggtacatgggaggctgagac

SEQ ID NO: 460221 - DNA, 20 bp, Artificial
  CRISPR gRNA sequence
tacatgggaggctgagacag

SEQ ID NO: 460222 - DNA, 20 bp, Artificial
  CRISPR gRNA sequence
acaggagaatcgcttgaact

SEQ ID NO: 460223 - DNA, 20 bp, Artificial
  CRISPR gRNA sequence
ggagaatcgcttgaactcgg

SEQ ID NO: 460224 - DNA, 20 bp, Artificial
  CRISPR gRNA sequence
gagaatcgcttgaactcggt

SEQ ID NO: 460225 - DNA, 20 bp, Artificial
  CRISPR gRNA sequence
aatcgcttgaactcggtagg

SEQ ID NO: 460226 - DNA, 20 bp, Artificial
  CRISPR gRNA sequence
tcgcttgaactcggtaggtg

SEQ ID NO: 460227 - DNA, 20 bp, Artificial
  CRISPR gRNA sequence
aactcggtaggtggagactt

SEQ ID NO: 460228 - DNA, 20 bp, Artificial
  CRISPR gRNA sequence
ggtggagacttcggtgaacc

SEQ ID NO: 460229 - DNA, 20 bp, Artificial
  CRISPR gRNA sequence
gagacttcggtgaaccgaga

SEQ ID NO: 460230 - DNA, 20 bp, Artificial
  CRISPR gRNA sequence
cgagatggtaccactgcact

SEQ ID NO: 460231 - DNA, 20 bp, Artificial
  CRISPR gRNA sequence
tggtaccactgcactcagcc

SEQ ID NO: 460232 - DNA, 20 bp, Artificial
  CRISPR gRNA sequence
ggtaccactgcactcagcct

SEQ ID NO: 460233 - DNA, 20 bp, Artificial
  CRISPR gRNA sequence
actgcactcagcctgggtga

SEQ ID NO: 460234 - DNA, 20 bp, Artificial
  CRISPR gRNA sequence
tgcactcagcctgggtgaca

SEQ ID NO: 460235 - DNA, 20 bp, Artificial
  CRISPR gRNA sequence
ctcagcctgggtgacagagt

SEQ ID NO: 460236 - DNA, 20 bp, Artificial
  CRISPR gRNA sequence
tattataatgttattttgtt

SEQ ID NO: 460237 - DNA, 20 bp, Artificial
  CRISPR gRNA sequence
ataatgttattttgtttggc

SEQ ID NO: 460238 - DNA, 20 bp, Artificial
  CRISPR gRNA sequence
attttgtttggctagatgct

SEQ ID NO: 460239 - DNA, 20 bp, Artificial
  CRISPR gRNA sequence
ttttgtttggctagatgctt

SEQ ID NO: 460240 - DNA, 20 bp, Artificial
  CRISPR gRNA sequence
tttggctagatgcttaggtt

SEQ ID NO: 460241 - DNA, 20 bp, Artificial
  CRISPR gRNA sequence
ttggctagatgcttaggttt

SEQ ID NO: 460242 - DNA, 20 bp, Artificial
  CRISPR gRNA sequence
tggctagatgcttaggtttg

SEQ ID NO: 460243 - DNA, 20 bp, Artificial
  CRISPR gRNA sequence
aggtttggggtaaaaatgat

SEQ ID NO: 460244 - DNA, 20 bp, Artificial
  CRISPR gRNA sequence
gtttggggtaaaaatgatta

SEQ ID NO: 460245 - DNA, 20 bp, Artificial
  CRISPR gRNA sequence
tttggggtaaaaatgattag

SEQ ID NO: 460246 - DNA, 20 bp, Artificial
  CRISPR gRNA sequence
aaaatgattagaggcaactg

SEQ ID NO: 460247 - DNA, 20 bp, Artificial
  CRISPR gRNA sequence
ggcaactgaagttgcacaaa

SEQ ID NO: 460248 - DNA, 20 bp, Artificial
  CRISPR gRNA sequence
aactgaagttgcacaaaaag

SEQ ID NO: 460249 - DNA, 20 bp, Artificial
  CRISPR gRNA sequence
aagttgcacaaaaagtggtt

SEQ ID NO: 460250 - DNA, 20 bp, Artificial
  CRISPR gRNA sequence
caaaaagtggtttggttatt

SEQ ID NO: 460251 - DNA, 20 bp, Artificial
  CRISPR gRNA sequence
aaaagtggtttggttattca

SEQ ID NO: 460252 - DNA, 20 bp, Artificial
  CRISPR gRNA sequence
agtggtttggttattcagag

SEQ ID NO: 460253 - DNA, 20 bp, Artificial
  CRISPR gRNA sequence
aatgttgtctattgatgttg

SEQ ID NO: 460254 - DNA, 20 bp, Artificial
  CRISPR gRNA sequence
ttgatgttgcagctgctgtt

SEQ ID NO: 460255 - DNA, 20 bp, Artificial
  CRISPR gRNA sequence
tgatgttgcagctgctgttt

SEQ ID NO: 460256 - DNA, 20 bp, Artificial
  CRISPR gRNA sequence
gttgcagctgctgtttaggt

SEQ ID NO: 460257 - DNA, 20 bp, Artificial
  CRISPR gRNA sequence
cagctgctgtttaggttagc

SEQ ID NO: 460258 - DNA, 20 bp, Artificial
  CRISPR gRNA sequence
ctgctgtttaggttagcgag

SEQ ID NO: 460259 - DNA, 20 bp, Artificial
  CRISPR gRNA sequence
gcgagcagccaaaccactgc

SEQ ID NO: 460260 - DNA, 20 bp, Artificial
  CRISPR gRNA sequence
cgagcagccaaaccactgcc

SEQ ID NO: 460261 - DNA, 20 bp, Artificial
  CRISPR gRNA sequence
agcagccaaaccactgccag

SEQ ID NO: 460262 - DNA, 20 bp, Artificial
  CRISPR gRNA sequence
caaaccactgccaggagtgc

SEQ ID NO: 460263 - DNA, 20 bp, Artificial
  CRISPR gRNA sequence
actgccaggagtgccagaaa

SEQ ID NO: 460264 - DNA, 20 bp, Artificial
  CRISPR gRNA sequence
gagtgccagaaacagctgcc

SEQ ID NO: 460265 - DNA, 20 bp, Artificial
  CRISPR gRNA sequence
agtgccagaaacagctgcct

SEQ ID NO: 460266 - DNA, 20 bp, Artificial
  CRISPR gRNA sequence
gtgccagaaacagctgcctg

SEQ ID NO: 460267 - DNA, 20 bp, Artificial
  CRISPR gRNA sequence
tgccagaaacagctgcctgg

SEQ ID NO: 460268 - DNA, 20 bp, Artificial
  CRISPR gRNA sequence
ccagaaacagctgcctgggg

SEQ ID NO: 460269 - DNA, 20 bp, Artificial
  CRISPR gRNA sequence
cagaaacagctgcctggggg

SEQ ID NO: 460270 - DNA, 20 bp, Artificial
  CRISPR gRNA sequence
agaaacagctgcctggggga

SEQ ID NO: 460271 - DNA, 20 bp, Artificial
  CRISPR gRNA sequence
agctgcctgggggagggtct

SEQ ID NO: 460272 - DNA, 20 bp, Artificial
  CRISPR gRNA sequence
gcctgggggagggtcttgga

SEQ ID NO: 460273 - DNA, 20 bp, Artificial
  CRISPR gRNA sequence
gggagggtcttggatagcaa

SEQ ID NO: 460274 - DNA, 20 bp, Artificial
  CRISPR gRNA sequence
ggagggtcttggatagcaat

SEQ ID NO: 460275 - DNA, 20 bp, Artificial
  CRISPR gRNA sequence
gagggtcttggatagcaatg

SEQ ID NO: 460276 - DNA, 20 bp, Artificial
  CRISPR gRNA sequence
cttggatagcaatggggact

SEQ ID NO: 460277 - DNA, 20 bp, Artificial
  CRISPR gRNA sequence
ttggatagcaatggggacta

SEQ ID NO: 460278 - DNA, 20 bp, Artificial
  CRISPR gRNA sequence
ggggactaaggtttctacaa

SEQ ID NO: 460279 - DNA, 20 bp, Artificial
  CRISPR gRNA sequence
aacagataccctaatacaaa

SEQ ID NO: 460280 - DNA, 20 bp, Artificial
  CRISPR gRNA sequence
cctaatacaaacagatctgc

SEQ ID NO: 460281 - DNA, 20 bp, Artificial
  CRISPR gRNA sequence
acaaacagatctgctggatc

SEQ ID NO: 460282 - DNA, 20 bp, Artificial
  CRISPR gRNA sequence
aacagatctgctggatcaag

SEQ ID NO: 460283 - DNA, 20 bp, Artificial
  CRISPR gRNA sequence
tttccttaattttacttgat

SEQ ID NO: 460284 - DNA, 20 bp, Artificial
  CRISPR gRNA sequence
ttgatcaaataaaactaatt

SEQ ID NO: 460285 - DNA, 20 bp, Artificial
  CRISPR gRNA sequence
aacaaactgtttctctattt

SEQ ID NO: 460286 - DNA, 20 bp, Artificial
  CRISPR gRNA sequence
aactccccctaacttatttt

SEQ ID NO: 460287 - DNA, 20 bp, Artificial
  CRISPR gRNA sequence
attttgagtttgttctgaaa

SEQ ID NO: 460288 - DNA, 20 bp, Artificial
  CRISPR gRNA sequence
tttgagtttgttctgaaata

SEQ ID NO: 460289 - DNA, 20 bp, Artificial
  CRISPR gRNA sequence
ttgttctgaaatagagaaac

SEQ ID NO: 460290 - DNA, 20 bp, Artificial
  CRISPR gRNA sequence
tgttctgaaatagagaaaca

SEQ ID NO: 460291 - DNA, 20 bp, Artificial
  CRISPR gRNA sequence
gtaaataactgaaattgatt

SEQ ID NO: 460292 - DNA, 20 bp, Artificial
  CRISPR gRNA sequence
aaattgattgagaaaatgat

SEQ ID NO: 460293 - DNA, 20 bp, Artificial
  CRISPR gRNA sequence
aattgattgagaaaatgatg

SEQ ID NO: 460294 - DNA, 20 bp, Artificial
  CRISPR gRNA sequence
attgattgagaaaatgatga

SEQ ID NO: 460295 - DNA, 20 bp, Artificial
  CRISPR gRNA sequence
tactctcacgtgtccaaaac

SEQ ID NO: 460296 - DNA, 20 bp, Artificial
  CRISPR gRNA sequence
ctctcacgtgtccaaaacca

SEQ ID NO: 460297 - DNA, 20 bp, Artificial
  CRISPR gRNA sequence
cacgtgtccaaaaccagagc

SEQ ID NO: 460298 - DNA, 20 bp, Artificial
  CRISPR gRNA sequence
tccaaaaccagagctagcct

SEQ ID NO: 460299 - DNA, 20 bp, Artificial
  CRISPR gRNA sequence
ccaaaaccagagctagcctt

SEQ ID NO: 460300 - DNA, 20 bp, Artificial
  CRISPR gRNA sequence
caaaaccagagctagccttg

SEQ ID NO: 460301 - DNA, 20 bp, Artificial
  CRISPR gRNA sequence
aaaccagagctagccttggg

SEQ ID NO: 460302 - DNA, 20 bp, Artificial
  CRISPR gRNA sequence
aaccagagctagccttgggg

SEQ ID NO: 460303 - DNA, 20 bp, Artificial
  CRISPR gRNA sequence
gctagccttggggaggattc

SEQ ID NO: 460304 - DNA, 20 bp, Artificial
  CRISPR gRNA sequence
ttccagtgtttgcacactac

SEQ ID NO: 460305 - DNA, 20 bp, Artificial
  CRISPR gRNA sequence
ccagtgtttgcacactacca

SEQ ID NO: 460306 - DNA, 20 bp, Artificial
  CRISPR gRNA sequence
agaatccaacaatctatctc

SEQ ID NO: 460307 - DNA, 20 bp, Artificial
  CRISPR gRNA sequence
ccaacaatctatctcaagat

SEQ ID NO: 460308 - DNA, 20 bp, Artificial
  CRISPR gRNA sequence
caatctatctcaagatcagt

SEQ ID NO: 460309 - DNA, 20 bp, Artificial
  CRISPR gRNA sequence
agatcagtaagcacaatttg

SEQ ID NO: 460310 - DNA, 20 bp, Artificial
  CRISPR gRNA sequence
accccacgatcattgacaca

SEQ ID NO: 460311 - DNA, 20 bp, Artificial
  CRISPR gRNA sequence
attgacacaaagtaaatatc

SEQ ID NO: 460312 - DNA, 20 bp, Artificial
  CRISPR gRNA sequence
ttgacacaaagtaaatatct

SEQ ID NO: 460313 - DNA, 20 bp, Artificial
  CRISPR gRNA sequence
aaatatctgggcttattttg

SEQ ID NO: 460314 - DNA, 20 bp, Artificial
  CRISPR gRNA sequence
cttattttgaagctcactga

SEQ ID NO: 460315 - DNA, 20 bp, Artificial
  CRISPR gRNA sequence
tcacctcttccccattcctt

SEQ ID NO: 460316 - DNA, 20 bp, Artificial
  CRISPR gRNA sequence
cttccccattccttaagcat

SEQ ID NO: 460317 - DNA, 20 bp, Artificial
  CRISPR gRNA sequence
ttccccattccttaagcata

SEQ ID NO: 460318 - DNA, 20 bp, Artificial
  CRISPR gRNA sequence
attccttaagcataaggaca

SEQ ID NO: 460319 - DNA, 20 bp, Artificial
  CRISPR gRNA sequence
ttaagcataaggacacagta

SEQ ID NO: 460320 - DNA, 20 bp, Artificial
  CRISPR gRNA sequence
agtctgcacaatgatatctc

SEQ ID NO: 460321 - DNA, 20 bp, Artificial
  CRISPR gRNA sequence
acaatgatatctctggcacc

SEQ ID NO: 460322 - DNA, 20 bp, Artificial
  CRISPR gRNA sequence
atatctctggcacctggaat

SEQ ID NO: 460323 - DNA, 20 bp, Artificial
  CRISPR gRNA sequence
tctctggcacctggaataag

SEQ ID NO: 460324 - DNA, 20 bp, Artificial
  CRISPR gRNA sequence
tctggcacctggaataagaa

SEQ ID NO: 460325 - DNA, 20 bp, Artificial
  CRISPR gRNA sequence
ctggcacctggaataagaag

SEQ ID NO: 460326 - DNA, 20 bp, Artificial
  CRISPR gRNA sequence
ggaataagaagaggcacatt

SEQ ID NO: 460327 - DNA, 20 bp, Artificial
  CRISPR gRNA sequence
ataagaagaggcacattcag

SEQ ID NO: 460328 - DNA, 20 bp, Artificial
  CRISPR gRNA sequence
taagaagaggcacattcagc

SEQ ID NO: 460329 - DNA, 20 bp, Artificial
  CRISPR gRNA sequence
attcagcaggtgctccaaat

SEQ ID NO: 460330 - DNA, 20 bp, Artificial
  CRISPR gRNA sequence
ttcagcaggtgctccaaatc

SEQ ID NO: 460331 - DNA, 20 bp, Artificial
  CRISPR gRNA sequence
tcagcaggtgctccaaatca

SEQ ID NO: 460332 - DNA, 20 bp, Artificial
  CRISPR gRNA sequence
gcaggtgctccaaatcaggg

SEQ ID NO: 460333 - DNA, 20 bp, Artificial
  CRISPR gRNA sequence
ggtgctccaaatcagggtgg

SEQ ID NO: 460334 - DNA, 20 bp, Artificial
  CRISPR gRNA sequence
aaatcagggtggaagcccac

SEQ ID NO: 460335 - DNA, 20 bp, Artificial
  CRISPR gRNA sequence
aatcagggtggaagcccaca

SEQ ID NO: 460336 - DNA, 20 bp, Artificial
  CRISPR gRNA sequence
ccacacccactttcctgcca

SEQ ID NO: 460337 - DNA, 20 bp, Artificial
  CRISPR gRNA sequence
cacagataatgatcacattt

SEQ ID NO: 460338 - DNA, 20 bp, Artificial
  CRISPR gRNA sequence
acagataatgatcacatttt

SEQ ID NO: 460339 - DNA, 20 bp, Artificial
  CRISPR gRNA sequence
cagataatgatcacattttg

SEQ ID NO: 460340 - DNA, 20 bp, Artificial
  CRISPR gRNA sequence
ataatgatcacattttgggg

SEQ ID NO: 460341 - DNA, 20 bp, Artificial
  CRISPR gRNA sequence
tttttttttttttttttttt

SEQ ID NO: 460342 - DNA, 20 bp, Artificial
  CRISPR gRNA sequence
ttttttttttttttttgaga

SEQ ID NO: 460343 - DNA, 20 bp, Artificial
  CRISPR gRNA sequence
ttttttttttttttgagatg

SEQ ID NO: 460344 - DNA, 20 bp, Artificial
  CRISPR gRNA sequence
tggagtctcgctctatcacc

SEQ ID NO: 460345 - DNA, 20 bp, Artificial
  CRISPR gRNA sequence
ggagtctcgctctatcaccc

SEQ ID NO: 460346 - DNA, 20 bp, Artificial
  CRISPR gRNA sequence
tctcgctctatcacccaggc

SEQ ID NO: 460347 - DNA, 20 bp, Artificial
  CRISPR gRNA sequence
tcgctctatcacccaggctg

SEQ ID NO: 460348 - DNA, 20 bp, Artificial
  CRISPR gRNA sequence
ctatcacccaggctggagtg

SEQ ID NO: 460349 - DNA, 20 bp, Artificial
  CRISPR gRNA sequence
tcacccaggctggagtgcag

SEQ ID NO: 460350 - DNA, 20 bp, Artificial
  CRISPR gRNA sequence
ggagtgcagtggtgcaatct

SEQ ID NO: 460351 - DNA, 20 bp, Artificial
  CRISPR gRNA sequence
ggtgcaatctcggttcactg

SEQ ID NO: 460352 - DNA, 20 bp, Artificial
  CRISPR gRNA sequence
tcactgcagcctccacctcc

SEQ ID NO: 460353 - DNA, 20 bp, Artificial
  CRISPR gRNA sequence
cactgcagcctccacctcct

SEQ ID NO: 460354 - DNA, 20 bp, Artificial
  CRISPR gRNA sequence
agcctccacctcctgggttc

SEQ ID NO: 460355 - DNA, 20 bp, Artificial
  CRISPR gRNA sequence
ttcaagtgattctcctgctt

SEQ ID NO: 460356 - DNA, 20 bp, Artificial
  CRISPR gRNA sequence
ttctcctgcttcagcctcct

SEQ ID NO: 460357 - DNA, 20 bp, Artificial
  CRISPR gRNA sequence
tcctgcttcagcctcctgag

SEQ ID NO: 460358 - DNA, 20 bp, Artificial
  CRISPR gRNA sequence
gcttcagcctcctgagtagt

SEQ ID NO: 460359 - DNA, 20 bp, Artificial
  CRISPR gRNA sequence
cttcagcctcctgagtagtt

SEQ ID NO: 460360 - DNA, 20 bp, Artificial
  CRISPR gRNA sequence
ctcctgagtagttgggatta

SEQ ID NO: 460361 - DNA, 20 bp, Artificial
  CRISPR gRNA sequence
tcctgagtagttgggattac

SEQ ID NO: 460362 - DNA, 20 bp, Artificial
  CRISPR gRNA sequence
caggcgcctcccaccgtgcc

SEQ ID NO: 460363 - DNA, 20 bp, Artificial
  CRISPR gRNA sequence
cagtttattttttgtatttt

SEQ ID NO: 460364 - DNA, 20 bp, Artificial
  CRISPR gRNA sequence
tttattttttgtatttttag

SEQ ID NO: 460365 - DNA, 20 bp, Artificial
  CRISPR gRNA sequence
tattttttgtatttttagta

SEQ ID NO: 460366 - DNA, 20 bp, Artificial
  CRISPR gRNA sequence
ttttgtatttttagtagaga

SEQ ID NO: 460367 - DNA, 20 bp, Artificial
  CRISPR gRNA sequence
tttgtatttttagtagagat

SEQ ID NO: 460368 - DNA, 20 bp, Artificial
  CRISPR gRNA sequence
ttgtatttttagtagagata

SEQ ID NO: 460369 - DNA, 20 bp, Artificial
  CRISPR gRNA sequence
tagggtttcaccatgttgac

SEQ ID NO: 460370 - DNA, 20 bp, Artificial
  CRISPR gRNA sequence
agggtttcaccatgttgacc

SEQ ID NO: 460371 - DNA, 20 bp, Artificial
  CRISPR gRNA sequence
gatctcaaactcctgacctc

SEQ ID NO: 460372 - DNA, 20 bp, Artificial
  CRISPR gRNA sequence
ctcaagtgatttgttcgtct

SEQ ID NO: 460373 - DNA, 20 bp, Artificial
  CRISPR gRNA sequence
ttgttcgtcttggcctccca

SEQ ID NO: 460374 - DNA, 20 bp, Artificial
  CRISPR gRNA sequence
gtcttggcctcccaaagtgc

SEQ ID NO: 460375 - DNA, 20 bp, Artificial
  CRISPR gRNA sequence
tcttggcctcccaaagtgct

SEQ ID NO: 460376 - DNA, 20 bp, Artificial
  CRISPR gRNA sequence
ctcccaaagtgctaggatta

SEQ ID NO: 460377 - DNA, 20 bp, Artificial
  CRISPR gRNA sequence
agtgctaggattacagatgt

SEQ ID NO: 460378 - DNA, 20 bp, Artificial
  CRISPR gRNA sequence
cagatgtgagccaccacgcc

SEQ ID NO: 460379 - DNA, 20 bp, Artificial
  CRISPR gRNA sequence
tgagccaccacgcccagcct

SEQ ID NO: 460380 - DNA, 20 bp, Artificial
  CRISPR gRNA sequence
gagccaccacgcccagcctt

SEQ ID NO: 460381 - DNA, 20 bp, Artificial
  CRISPR gRNA sequence
agccaccacgcccagccttg

SEQ ID NO: 460382 - DNA, 20 bp, Artificial
  CRISPR gRNA sequence
caccacgcccagccttgggg

SEQ ID NO: 460383 - DNA, 20 bp, Artificial
  CRISPR gRNA sequence
ttcttaatctgaaactgacc

SEQ ID NO: 460384 - DNA, 20 bp, Artificial
  CRISPR gRNA sequence
tcttaatctgaaactgacca

SEQ ID NO: 460385 - DNA, 20 bp, Artificial
  CRISPR gRNA sequence
cttaatctgaaactgaccaa

SEQ ID NO: 460386 - DNA, 20 bp, Artificial
  CRISPR gRNA sequence
aatctgaaactgaccaaggg

SEQ ID NO: 460387 - DNA, 20 bp, Artificial
  CRISPR gRNA sequence
gaaactgaccaagggaagtt

SEQ ID NO: 460388 - DNA, 20 bp, Artificial
  CRISPR gRNA sequence
aaactgaccaagggaagttt

SEQ ID NO: 460389 - DNA, 20 bp, Artificial
  CRISPR gRNA sequence
ctgaccaagggaagtttggg

SEQ ID NO: 460390 - DNA, 20 bp, Artificial
  CRISPR gRNA sequence
tgaccaagggaagtttggga

SEQ ID NO: 460391 - DNA, 20 bp, Artificial
  CRISPR gRNA sequence
gaccaagggaagtttgggaa

SEQ ID NO: 460392 - DNA, 20 bp, Artificial
  CRISPR gRNA sequence
agggaagtttgggaagggtg

SEQ ID NO: 460393 - DNA, 20 bp, Artificial
  CRISPR gRNA sequence
gaagtttgggaagggtgaag

SEQ ID NO: 460394 - DNA, 20 bp, Artificial
  CRISPR gRNA sequence
gtttgggaagggtgaagtgg

SEQ ID NO: 460395 - DNA, 20 bp, Artificial
  CRISPR gRNA sequence
tttgggaagggtgaagtggc

SEQ ID NO: 460396 - DNA, 20 bp, Artificial
  CRISPR gRNA sequence
agggtgaagtggcaggccaa

SEQ ID NO: 460397 - DNA, 20 bp, Artificial
  CRISPR gRNA sequence
ggcaggccaatggatgtttc

SEQ ID NO: 460398 - DNA, 20 bp, Artificial
  CRISPR gRNA sequence
gcaggccaatggatgtttca

SEQ ID NO: 460399 - DNA, 20 bp, Artificial
  CRISPR gRNA sequence
caggccaatggatgtttcaa

SEQ ID NO: 460400 - DNA, 20 bp, Artificial
  CRISPR gRNA sequence
atgtttcaagggctgttccc

SEQ ID NO: 460401 - DNA, 20 bp, Artificial
  CRISPR gRNA sequence
agctctgtcaacttttcccc

SEQ ID NO: 460402 - DNA, 20 bp, Artificial
  CRISPR gRNA sequence
gctctgtcaacttttcccct

SEQ ID NO: 460403 - DNA, 20 bp, Artificial
  CRISPR gRNA sequence
caacttttcccctaggactt

SEQ ID NO: 460404 - DNA, 20 bp, Artificial
  CRISPR gRNA sequence
aggactttggcttgttgtgc

SEQ ID NO: 460405 - DNA, 20 bp, Artificial
  CRISPR gRNA sequence
ggactttggcttgttgtgca

SEQ ID NO: 460406 - DNA, 20 bp, Artificial
  CRISPR gRNA sequence
caaggtgcttttcttcattc

SEQ ID NO: 460407 - DNA, 20 bp, Artificial
  CRISPR gRNA sequence
aaggtgcttttcttcattct

SEQ ID NO: 460408 - DNA, 20 bp, Artificial
  CRISPR gRNA sequence
ggtgcttttcttcattctgg

SEQ ID NO: 460409 - DNA, 20 bp, Artificial
  CRISPR gRNA sequence
ttttcttcattctgggagaa

SEQ ID NO: 460410 - DNA, 20 bp, Artificial
  CRISPR gRNA sequence
tgggagaatagtgctttccc

SEQ ID NO: 460411 - DNA, 20 bp, Artificial
  CRISPR gRNA sequence
ggagaatagtgctttcccaa

SEQ ID NO: 460412 - DNA, 20 bp, Artificial
  CRISPR gRNA sequence
gtgctttcccaagagcatcc

SEQ ID NO: 460413 - DNA, 20 bp, Artificial
  CRISPR gRNA sequence
tccaagccccaactctgtca

SEQ ID NO: 460414 - DNA, 20 bp, Artificial
  CRISPR gRNA sequence
acttttaacttgaacataaa

SEQ ID NO: 460415 - DNA, 20 bp, Artificial
  CRISPR gRNA sequence
aacttgaacataaacagcaa

SEQ ID NO: 460416 - DNA, 20 bp, Artificial
  CRISPR gRNA sequence
tgaacataaacagcaaaaga

SEQ ID NO: 460417 - DNA, 20 bp, Artificial
  CRISPR gRNA sequence
agaaagtcacttataaaaac

SEQ ID NO: 460418 - DNA, 20 bp, Artificial
  CRISPR gRNA sequence
gaaaatgtccaaaatcactt

SEQ ID NO: 460419 - DNA, 20 bp, Artificial
  CRISPR gRNA sequence
cacttcggaaatatatttca

SEQ ID NO: 460420 - DNA, 20 bp, Artificial
  CRISPR gRNA sequence
acttcggaaatatatttcac

SEQ ID NO: 460421 - DNA, 20 bp, Artificial
  CRISPR gRNA sequence
aaaaataaaatattttttat

SEQ ID NO: 460422 - DNA, 20 bp, Artificial
  CRISPR gRNA sequence
ctccaaaatttctttatgaa

SEQ ID NO: 460423 - DNA, 20 bp, Artificial
  CRISPR gRNA sequence
aaatttctttatgaaaagca

SEQ ID NO: 460424 - DNA, 20 bp, Artificial
  CRISPR gRNA sequence
ttttctcctcaccttatact

SEQ ID NO: 460425 - DNA, 20 bp, Artificial
  CRISPR gRNA sequence
caccttatacttagttcact

SEQ ID NO: 460426 - DNA, 20 bp, Artificial
  CRISPR gRNA sequence
cttagttcactgagcacttt

SEQ ID NO: 460427 - DNA, 20 bp, Artificial
  CRISPR gRNA sequence
ttagttcactgagcactttc

SEQ ID NO: 460428 - DNA, 20 bp, Artificial
  CRISPR gRNA sequence
tcactgagcactttcaggtt

SEQ ID NO: 460429 - DNA, 20 bp, Artificial
  CRISPR gRNA sequence
ctgagcactttcaggttcag

SEQ ID NO: 460430 - DNA, 20 bp, Artificial
  CRISPR gRNA sequence
tgagcactttcaggttcaga

SEQ ID NO: 460431 - DNA, 20 bp, Artificial
  CRISPR gRNA sequence
actttcaggttcagaaggaa

SEQ ID NO: 460432 - DNA, 20 bp, Artificial
  CRISPR gRNA sequence
ctttcaggttcagaaggaaa

SEQ ID NO: 460433 - DNA, 20 bp, Artificial
  CRISPR gRNA sequence
ttgttttcaccacttcacta

SEQ ID NO: 460434 - DNA, 20 bp, Artificial
  CRISPR gRNA sequence
actaaagaaaaatgcacacc

SEQ ID NO: 460435 - DNA, 20 bp, Artificial
  CRISPR gRNA sequence
aatgcacacctagattaaat

SEQ ID NO: 460436 - DNA, 20 bp, Artificial
  CRISPR gRNA sequence
aaattagttttaaatccaca

SEQ ID NO: 460437 - DNA, 20 bp, Artificial
  CRISPR gRNA sequence
attagttttaaatccacaca

SEQ ID NO: 460438 - DNA, 20 bp, Artificial
  CRISPR gRNA sequence
tccacacagagtttaaatta

SEQ ID NO: 460439 - DNA, 20 bp, Artificial
  CRISPR gRNA sequence
taaacaatttaccttttgtg

SEQ ID NO: 460440 - DNA, 20 bp, Artificial
  CRISPR gRNA sequence
aaacaatttaccttttgtga

SEQ ID NO: 460441 - DNA, 20 bp, Artificial
  CRISPR gRNA sequence
caatttaccttttgtgaagg

SEQ ID NO: 460442 - DNA, 20 bp, Artificial
  CRISPR gRNA sequence
ccttttgtgaaggaagttaa

SEQ ID NO: 460443 - DNA, 20 bp, Artificial
  CRISPR gRNA sequence
aagttaaaagaaaaaaaaaa

SEQ ID NO: 460444 - DNA, 20 bp, Artificial
  CRISPR gRNA sequence
aagaaatattacacaaattc

SEQ ID NO: 460445 - DNA, 20 bp, Artificial
  CRISPR gRNA sequence
ttacacaaattccagccttc

SEQ ID NO: 460446 - DNA, 20 bp, Artificial
  CRISPR gRNA sequence
tacacaaattccagccttcc

SEQ ID NO: 460447 - DNA, 20 bp, Artificial
  CRISPR gRNA sequence
caggacattataatctttca

SEQ ID NO: 460448 - DNA, 20 bp, Artificial
  CRISPR gRNA sequence
aggacattataatctttcat

SEQ ID NO: 460449 - DNA, 20 bp, Artificial
  CRISPR gRNA sequence
taatctttcatgggacctaa

SEQ ID NO: 460450 - DNA, 20 bp, Artificial
  CRISPR gRNA sequence
gacatttccacacattacta

SEQ ID NO: 460451 - DNA, 20 bp, Artificial
  CRISPR gRNA sequence
tccacacattactacagtga

SEQ ID NO: 460452 - DNA, 20 bp, Artificial
  CRISPR gRNA sequence
ccacacattactacagtgaa

SEQ ID NO: 460453 - DNA, 20 bp, Artificial
  CRISPR gRNA sequence
agtgaaaggaaatgataaat

SEQ ID NO: 460454 - DNA, 20 bp, Artificial
  CRISPR gRNA sequence
tgaaaggaaatgataaatga

SEQ ID NO: 460455 - DNA, 20 bp, Artificial
  CRISPR gRNA sequence
gaaaggaaatgataaatgag

SEQ ID NO: 460456 - DNA, 20 bp, Artificial
  CRISPR gRNA sequence
gaaatgataaatgagaggca

SEQ ID NO: 460457 - DNA, 20 bp, Artificial
  CRISPR gRNA sequence
atgagaggcacagacttaaa

SEQ ID NO: 460458 - DNA, 20 bp, Artificial
  CRISPR gRNA sequence
gacttaaatggcataaaaat

SEQ ID NO: 460459 - DNA, 20 bp, Artificial
  CRISPR gRNA sequence
atggcataaaaattggtaaa

SEQ ID NO: 460460 - DNA, 20 bp, Artificial
  CRISPR gRNA sequence
tggcataaaaattggtaaaa

SEQ ID NO: 460461 - DNA, 20 bp, Artificial
  CRISPR gRNA sequence
gcataaaaattggtaaaaag

SEQ ID NO: 460462 - DNA, 20 bp, Artificial
  CRISPR gRNA sequence
aaggagtgatcccttcccct

SEQ ID NO: 460463 - DNA, 20 bp, Artificial
  CRISPR gRNA sequence
aggagtgatcccttcccctc

SEQ ID NO: 460464 - DNA, 20 bp, Artificial
  CRISPR gRNA sequence
tcccctcaggtgatcatgaa

SEQ ID NO: 460465 - DNA, 20 bp, Artificial
  CRISPR gRNA sequence
tgatcatgaaaagcttcctt

SEQ ID NO: 460466 - DNA, 20 bp, Artificial
  CRISPR gRNA sequence
gaaaagcttccttaagaact

SEQ ID NO: 460467 - DNA, 20 bp, Artificial
  CRISPR gRNA sequence
tccttaagaacttggaaaat

SEQ ID NO: 460468 - DNA, 20 bp, Artificial
  CRISPR gRNA sequence
aagaacttggaaaattagct

SEQ ID NO: 460469 - DNA, 20 bp, Artificial
  CRISPR gRNA sequence
ggaaaattagctgagattga

SEQ ID NO: 460470 - DNA, 20 bp, Artificial
  CRISPR gRNA sequence
gaaaattagctgagattgaa

SEQ ID NO: 460471 - DNA, 20 bp, Artificial
  CRISPR gRNA sequence
aaattagctgagattgaaag

SEQ ID NO: 460472 - DNA, 20 bp, Artificial
  CRISPR gRNA sequence
aattagctgagattgaaagg

SEQ ID NO: 460473 - DNA, 20 bp, Artificial
  CRISPR gRNA sequence
attagctgagattgaaagga

SEQ ID NO: 460474 - DNA, 20 bp, Artificial
  CRISPR gRNA sequence
ttagctgagattgaaaggag

SEQ ID NO: 460475 - DNA, 20 bp, Artificial
  CRISPR gRNA sequence
gctgagattgaaaggagggg

SEQ ID NO: 460476 - DNA, 20 bp, Artificial
  CRISPR gRNA sequence
aaggaggggtagaatttcca

SEQ ID NO: 460477 - DNA, 20 bp, Artificial
  CRISPR gRNA sequence
aggaggggtagaatttccat

SEQ ID NO: 460478 - DNA, 20 bp, Artificial
  CRISPR gRNA sequence
aggggtagaatttccatagg

SEQ ID NO: 460479 - DNA, 20 bp, Artificial
  CRISPR gRNA sequence
gggtagaatttccataggtg

SEQ ID NO: 460480 - DNA, 20 bp, Artificial
  CRISPR gRNA sequence
agaatttccataggtggaga

SEQ ID NO: 460481 - DNA, 20 bp, Artificial
  CRISPR gRNA sequence
cataggtggagacagatgaa

SEQ ID NO: 460482 - DNA, 20 bp, Artificial
  CRISPR gRNA sequence
ataggtggagacagatgaat

SEQ ID NO: 460483 - DNA, 20 bp, Artificial
  CRISPR gRNA sequence
cagatgaatgggtgctctac

SEQ ID NO: 460484 - DNA, 20 bp, Artificial
  CRISPR gRNA sequence
atgaatgggtgctctacaag

SEQ ID NO: 460485 - DNA, 20 bp, Artificial
  CRISPR gRNA sequence
atgggtgctctacaagtggc

SEQ ID NO: 460486 - DNA, 20 bp, Artificial
  CRISPR gRNA sequence
gggtgctctacaagtggcaa

SEQ ID NO: 460487 - DNA, 20 bp, Artificial
  CRISPR gRNA sequence
tgctctacaagtggcaagag

SEQ ID NO: 460488 - DNA, 20 bp, Artificial
  CRISPR gRNA sequence
agtggcaagagcagcataca

SEQ ID NO: 460489 - DNA, 20 bp, Artificial
  CRISPR gRNA sequence
gtggcaagagcagcatacac

SEQ ID NO: 460490 - DNA, 20 bp, Artificial
  CRISPR gRNA sequence
tggcaagagcagcatacaca

SEQ ID NO: 460491 - DNA, 20 bp, Artificial
  CRISPR gRNA sequence
cagcatacacagggcaatga

SEQ ID NO: 460492 - DNA, 20 bp, Artificial
  CRISPR gRNA sequence
gcatacacagggcaatgatg

SEQ ID NO: 460493 - DNA, 20 bp, Artificial
  CRISPR gRNA sequence
acagggcaatgatggagatg

SEQ ID NO: 460494 - DNA, 20 bp, Artificial
  CRISPR gRNA sequence
caatgatggagatgtggtta

SEQ ID NO: 460495 - DNA, 20 bp, Artificial
  CRISPR gRNA sequence
gatggagatgtggttatggc

SEQ ID NO: 460496 - DNA, 20 bp, Artificial
  CRISPR gRNA sequence
gagatgtggttatggcaagt

SEQ ID NO: 460497 - DNA, 20 bp, Artificial
  CRISPR gRNA sequence
agatgtggttatggcaagta

SEQ ID NO: 460498 - DNA, 20 bp, Artificial
  CRISPR gRNA sequence
gttatggcaagtaaggccgt

SEQ ID NO: 460499 - DNA, 20 bp, Artificial
  CRISPR gRNA sequence
ttatggcaagtaaggccgtc

SEQ ID NO: 460500 - DNA, 20 bp, Artificial
  CRISPR gRNA sequence
aaggccgtcaggctgcaatt

SEQ ID NO: 460501 - DNA, 20 bp, Artificial
  CRISPR gRNA sequence
ggccgtcaggctgcaattga

SEQ ID NO: 460502 - DNA, 20 bp, Artificial
  CRISPR gRNA sequence
gccgtcaggctgcaattgag

SEQ ID NO: 460503 - DNA, 20 bp, Artificial
  CRISPR gRNA sequence
tgcaattgagaggctgtata

SEQ ID NO: 460504 - DNA, 20 bp, Artificial
  CRISPR gRNA sequence
gagaggctgtatatggaatc

SEQ ID NO: 460505 - DNA, 20 bp, Artificial
  CRISPR gRNA sequence
tatggaatccagaaacaatc

SEQ ID NO: 460506 - DNA, 20 bp, Artificial
  CRISPR gRNA sequence
gaatccagaaacaatctaga

SEQ ID NO: 460507 - DNA, 20 bp, Artificial
  CRISPR gRNA sequence
aatccagaaacaatctagaa

SEQ ID NO: 460508 - DNA, 20 bp, Artificial
  CRISPR gRNA sequence
ccagaaacaatctagaaagg

SEQ ID NO: 460509 - DNA, 20 bp, Artificial
  CRISPR gRNA sequence
gaaacaatctagaaaggtgg

SEQ ID NO: 460510 - DNA, 20 bp, Artificial
  CRISPR gRNA sequence
aaacaatctagaaaggtggt

SEQ ID NO: 460511 - DNA, 20 bp, Artificial
  CRISPR gRNA sequence
aaggtggtgggatcaaactg

SEQ ID NO: 460512 - DNA, 20 bp, Artificial
  CRISPR gRNA sequence
gtggtgggatcaaactgtgg

SEQ ID NO: 460513 - DNA, 20 bp, Artificial
  CRISPR gRNA sequence
ctgtggaagactttgaatgc

SEQ ID NO: 460514 - DNA, 20 bp, Artificial
  CRISPR gRNA sequence
actttgaatgctggttaaca

SEQ ID NO: 460515 - DNA, 20 bp, Artificial
  CRISPR gRNA sequence
gaatgctggttaacaaagat

SEQ ID NO: 460516 - DNA, 20 bp, Artificial
  CRISPR gRNA sequence
gagcccaatattgtgaccac

SEQ ID NO: 460517 - DNA, 20 bp, Artificial
  CRISPR gRNA sequence
agcccaatattgtgaccact

SEQ ID NO: 460518 - DNA, 20 bp, Artificial
  CRISPR gRNA sequence
gcccaatattgtgaccactg

SEQ ID NO: 460519 - DNA, 20 bp, Artificial
  CRISPR gRNA sequence
gaccactggggatgctatgc

SEQ ID NO: 460520 - DNA, 20 bp, Artificial
  CRISPR gRNA sequence
ccactggggatgctatgcaa

SEQ ID NO: 460521 - DNA, 20 bp, Artificial
  CRISPR gRNA sequence
actggggatgctatgcaaga

SEQ ID NO: 460522 - DNA, 20 bp, Artificial
  CRISPR gRNA sequence
tgcaagagagtgttgttatg

SEQ ID NO: 460523 - DNA, 20 bp, Artificial
  CRISPR gRNA sequence
gcaagagagtgttgttatga

SEQ ID NO: 460524 - DNA, 20 bp, Artificial
  CRISPR gRNA sequence
agagagtgttgttatgaagg

SEQ ID NO: 460525 - DNA, 20 bp, Artificial
  CRISPR gRNA sequence
ttgttatgaaggaagtgtat

SEQ ID NO: 460526 - DNA, 20 bp, Artificial
  CRISPR gRNA sequence
tgttatgaaggaagtgtatg

SEQ ID NO: 460527 - DNA, 20 bp, Artificial
  CRISPR gRNA sequence
ggaagtgtatgaggtaattt

SEQ ID NO: 460528 - DNA, 20 bp, Artificial
  CRISPR gRNA sequence
tgaggtaatttaagtgtatt

SEQ ID NO: 460529 - DNA, 20 bp, Artificial
  CRISPR gRNA sequence
ttggctgaaattgaccaaaa

SEQ ID NO: 460530 - DNA, 20 bp, Artificial
  CRISPR gRNA sequence
tggctgaaattgaccaaaat

SEQ ID NO: 460531 - DNA, 20 bp, Artificial
  CRISPR gRNA sequence
ggctgaaattgaccaaaatg

SEQ ID NO: 460532 - DNA, 20 bp, Artificial
  CRISPR gRNA sequence
accaaaatggggaaatacta

SEQ ID NO: 460533 - DNA, 20 bp, Artificial
  CRISPR gRNA sequence
atggggaaatactaaagaca

SEQ ID NO: 460534 - DNA, 20 bp, Artificial
  CRISPR gRNA sequence
ggggaaatactaaagacaaa

SEQ ID NO: 460535 - DNA, 20 bp, Artificial
  CRISPR gRNA sequence
aaagacaaagagtccaatca

SEQ ID NO: 460536 - DNA, 20 bp, Artificial
  CRISPR gRNA sequence
agtccaatcatagaattaat

SEQ ID NO: 460537 - DNA, 20 bp, Artificial
  CRISPR gRNA sequence
tagaattaattggaattatt

SEQ ID NO: 460538 - DNA, 20 bp, Artificial
  CRISPR gRNA sequence
aattaattggaattatttag

SEQ ID NO: 460539 - DNA, 20 bp, Artificial
  CRISPR gRNA sequence
attaattggaattatttaga

SEQ ID NO: 460540 - DNA, 20 bp, Artificial
  CRISPR gRNA sequence
aattggaattatttagaagg

SEQ ID NO: 460541 - DNA, 20 bp, Artificial
  CRISPR gRNA sequence
atttagaaggaagataatga

SEQ ID NO: 460542 - DNA, 20 bp, Artificial
  CRISPR gRNA sequence
aaggaagataatgatggtgc

SEQ ID NO: 460543 - DNA, 20 bp, Artificial
  CRISPR gRNA sequence
atgatggtgcgagatgctta

SEQ ID NO: 460544 - DNA, 20 bp, Artificial
  CRISPR gRNA sequence
atggtgcgagatgcttatag

SEQ ID NO: 460545 - DNA, 20 bp, Artificial
  CRISPR gRNA sequence
gagatgcttatagaagcaat

SEQ ID NO: 460546 - DNA, 20 bp, Artificial
  CRISPR gRNA sequence
gatgcttatagaagcaattg

SEQ ID NO: 460547 - DNA, 20 bp, Artificial
  CRISPR gRNA sequence
atgcttatagaagcaattgg

SEQ ID NO: 460548 - DNA, 20 bp, Artificial
  CRISPR gRNA sequence
caattggaggaaacacatca

SEQ ID NO: 460549 - DNA, 20 bp, Artificial
  CRISPR gRNA sequence
attggaggaaacacatcaca

SEQ ID NO: 460550 - DNA, 20 bp, Artificial
  CRISPR gRNA sequence
ggaggaaacacatcacagag

SEQ ID NO: 460551 - DNA, 20 bp, Artificial
  CRISPR gRNA sequence
catcacagagtggaatgttg

SEQ ID NO: 460552 - DNA, 20 bp, Artificial
  CRISPR gRNA sequence
tcacagagtggaatgttgtg

SEQ ID NO: 460553 - DNA, 20 bp, Artificial
  CRISPR gRNA sequence
acagagtggaatgttgtgga

SEQ ID NO: 460554 - DNA, 20 bp, Artificial
  CRISPR gRNA sequence
gtggaatgttgtggagagac

SEQ ID NO: 460555 - DNA, 20 bp, Artificial
  CRISPR gRNA sequence
ggaatgttgtggagagacaa

SEQ ID NO: 460556 - DNA, 20 bp, Artificial
  CRISPR gRNA sequence
atgttgtggagagacaagag

SEQ ID NO: 460557 - DNA, 20 bp, Artificial
  CRISPR gRNA sequence
tgttgtggagagacaagagt

SEQ ID NO: 460558 - DNA, 20 bp, Artificial
  CRISPR gRNA sequence
tgtggagagacaagagtagg

SEQ ID NO: 460559 - DNA, 20 bp, Artificial
  CRISPR gRNA sequence
gagacaagagtaggaagcca

SEQ ID NO: 460560 - DNA, 20 bp, Artificial
  CRISPR gRNA sequence
ggaagccaaagaaaattctc

SEQ ID NO: 460561 - DNA, 20 bp, Artificial
  CRISPR gRNA sequence
gaagccaaagaaaattctct

SEQ ID NO: 460562 - DNA, 20 bp, Artificial
  CRISPR gRNA sequence
aattctctgggattttccat

SEQ ID NO: 460563 - DNA, 20 bp, Artificial
  CRISPR gRNA sequence
attctctgggattttccatg

SEQ ID NO: 460564 - DNA, 20 bp, Artificial
  CRISPR gRNA sequence
tgggattttccatgaggatc

SEQ ID NO: 460565 - DNA, 20 bp, Artificial
  CRISPR gRNA sequence
ggattttccatgaggatcaa

SEQ ID NO: 460566 - DNA, 20 bp, Artificial
  CRISPR gRNA sequence
gcattaattaacaaactgat

SEQ ID NO: 460567 - DNA, 20 bp, Artificial
  CRISPR gRNA sequence
cattaattaacaaactgata

SEQ ID NO: 460568 - DNA, 20 bp, Artificial
  CRISPR gRNA sequence
taattaacaaactgataagg

SEQ ID NO: 460569 - DNA, 20 bp, Artificial
  CRISPR gRNA sequence
aattaacaaactgataagga

SEQ ID NO: 460570 - DNA, 20 bp, Artificial
  CRISPR gRNA sequence
attaacaaactgataaggaa

SEQ ID NO: 460571 - DNA, 20 bp, Artificial
  CRISPR gRNA sequence
taacaaactgataaggaagg

SEQ ID NO: 460572 - DNA, 20 bp, Artificial
  CRISPR gRNA sequence
actgataaggaagggagtga

SEQ ID NO: 460573 - DNA, 20 bp, Artificial
  CRISPR gRNA sequence
ctgataaggaagggagtgat

SEQ ID NO: 460574 - DNA, 20 bp, Artificial
  CRISPR gRNA sequence
ataaggaagggagtgatagg

SEQ ID NO: 460575 - DNA, 20 bp, Artificial
  CRISPR gRNA sequence
taaggaagggagtgatagga

SEQ ID NO: 460576 - DNA, 20 bp, Artificial
  CRISPR gRNA sequence
gaagggagtgataggaagga

SEQ ID NO: 460577 - DNA, 20 bp, Artificial
  CRISPR gRNA sequence
aagggagtgataggaaggat

SEQ ID NO: 460578 - DNA, 20 bp, Artificial
  CRISPR gRNA sequence
gagtgataggaaggataggt

SEQ ID NO: 460579 - DNA, 20 bp, Artificial
  CRISPR gRNA sequence
tgataggaaggataggtgag

SEQ ID NO: 460580 - DNA, 20 bp, Artificial
  CRISPR gRNA sequence
gataggaaggataggtgagt

SEQ ID NO: 460581 - DNA, 20 bp, Artificial
  CRISPR gRNA sequence
ggataggtgagtaggaaact

SEQ ID NO: 460582 - DNA, 20 bp, Artificial
  CRISPR gRNA sequence
ataggtgagtaggaaactaa

SEQ ID NO: 460583 - DNA, 20 bp, Artificial
  CRISPR gRNA sequence
aggtgagtaggaaactaaga

SEQ ID NO: 460584 - DNA, 20 bp, Artificial
  CRISPR gRNA sequence
tgagtaggaaactaagagag

SEQ ID NO: 460585 - DNA, 20 bp, Artificial
  CRISPR gRNA sequence
agagagtagaaatgttcaaa

SEQ ID NO: 460586 - DNA, 20 bp, Artificial
  CRISPR gRNA sequence
atgttcaaaaagaaactgac

SEQ ID NO: 460587 - DNA, 20 bp, Artificial
  CRISPR gRNA sequence
tgttcaaaaagaaactgaca

SEQ ID NO: 460588 - DNA, 20 bp, Artificial
  CRISPR gRNA sequence
ggcccttcatgtctcctatt

SEQ ID NO: 460589 - DNA, 20 bp, Artificial
  CRISPR gRNA sequence
catgtctcctatttagctct

SEQ ID NO: 460590 - DNA, 20 bp, Artificial
  CRISPR gRNA sequence
tttgttccataaaacccccc

SEQ ID NO: 460591 - DNA, 20 bp, Artificial
  CRISPR gRNA sequence
ttgttccataaaacccccca

SEQ ID NO: 460592 - DNA, 20 bp, Artificial
  CRISPR gRNA sequence
ccataaaaccccccaaggca

SEQ ID NO: 460593 - DNA, 20 bp, Artificial
  CRISPR gRNA sequence
cataaaaccccccaaggcac

SEQ ID NO: 460594 - DNA, 20 bp, Artificial
  CRISPR gRNA sequence
accccccaaggcacaggatt

SEQ ID NO: 460595 - DNA, 20 bp, Artificial
  CRISPR gRNA sequence
ccccccaaggcacaggattt

SEQ ID NO: 460596 - DNA, 20 bp, Artificial
  CRISPR gRNA sequence
ccccaaggcacaggatttag

SEQ ID NO: 460597 - DNA, 20 bp, Artificial
  CRISPR gRNA sequence
cccaaggcacaggatttagg

SEQ ID NO: 460598 - DNA, 20 bp, Artificial
  CRISPR gRNA sequence
ccaaggcacaggatttagga

SEQ ID NO: 460599 - DNA, 20 bp, Artificial
  CRISPR gRNA sequence
atgttattccctttccccta

SEQ ID NO: 460600 - DNA, 20 bp, Artificial
  CRISPR gRNA sequence
tattccctttcccctaaagt

SEQ ID NO: 460601 - DNA, 20 bp, Artificial
  CRISPR gRNA sequence
attccctttcccctaaagtt

SEQ ID NO: 460602 - DNA, 20 bp, Artificial
  CRISPR gRNA sequence
gggttctttcctccacaaaa

SEQ ID NO: 460603 - DNA, 20 bp, Artificial
  CRISPR gRNA sequence
tctttcctccacaaaataga

SEQ ID NO: 460604 - DNA, 20 bp, Artificial
  CRISPR gRNA sequence
tagattgttgatcctaatct

SEQ ID NO: 460605 - DNA, 20 bp, Artificial
  CRISPR gRNA sequence
ctcagccccaacttgatccc

SEQ ID NO: 460606 - DNA, 20 bp, Artificial
  CRISPR gRNA sequence
ccccaacttgatccctagaa

SEQ ID NO: 460607 - DNA, 20 bp, Artificial
  CRISPR gRNA sequence
cccaacttgatccctagaac

SEQ ID NO: 460608 - DNA, 20 bp, Artificial
  CRISPR gRNA sequence
tttatgcactttacaaacta

SEQ ID NO: 460609 - DNA, 20 bp, Artificial
  CRISPR gRNA sequence
tacaaactacagattatctt

SEQ ID NO: 460610 - DNA, 20 bp, Artificial
  CRISPR gRNA sequence
catcatgaatgacccaaata

SEQ ID NO: 460611 - DNA, 20 bp, Artificial
  CRISPR gRNA sequence
atcatgaatgacccaaatat

SEQ ID NO: 460612 - DNA, 20 bp, Artificial
  CRISPR gRNA sequence
tgaatgacccaaatatggga

SEQ ID NO: 460613 - DNA, 20 bp, Artificial
  CRISPR gRNA sequence
aatgacccaaatatgggata

SEQ ID NO: 460614 - DNA, 20 bp, Artificial
  CRISPR gRNA sequence
gacccaaatatgggatagag

SEQ ID NO: 460615 - DNA, 20 bp, Artificial
  CRISPR gRNA sequence
gcaatgctacttttgtgtaa

SEQ ID NO: 460616 - DNA, 20 bp, Artificial
  CRISPR gRNA sequence
tctgacctttcatctgacct

SEQ ID NO: 460617 - DNA, 20 bp, Artificial
  CRISPR gRNA sequence
ggctaaattcatgtctcgta

SEQ ID NO: 460618 - DNA, 20 bp, Artificial
  CRISPR gRNA sequence
taaattcatgtctcgtatag

SEQ ID NO: 460619 - DNA, 20 bp, Artificial
  CRISPR gRNA sequence
attcatgtctcgtatagaag

SEQ ID NO: 460620 - DNA, 20 bp, Artificial
  CRISPR gRNA sequence
tgtctcgtatagaagtagat

SEQ ID NO: 460621 - DNA, 20 bp, Artificial
  CRISPR gRNA sequence
gaagtagattagttcccata

SEQ ID NO: 460622 - DNA, 20 bp, Artificial
  CRISPR gRNA sequence
tagattagttcccataaaga

SEQ ID NO: 460623 - DNA, 20 bp, Artificial
  CRISPR gRNA sequence
aaagaaagactgaattacac

SEQ ID NO: 460624 - DNA, 20 bp, Artificial
  CRISPR gRNA sequence
aagaaagactgaattacaca

SEQ ID NO: 460625 - DNA, 20 bp, Artificial
  CRISPR gRNA sequence
ttacacaaggcttctcttcc

SEQ ID NO: 460626 - DNA, 20 bp, Artificial
  CRISPR gRNA sequence
tacacaaggcttctcttcca

SEQ ID NO: 460627 - DNA, 20 bp, Artificial
  CRISPR gRNA sequence
acaaggcttctcttccaagg

SEQ ID NO: 460628 - DNA, 20 bp, Artificial
  CRISPR gRNA sequence
caaggcttctcttccaagga

SEQ ID NO: 460629 - DNA, 20 bp, Artificial
  CRISPR gRNA sequence
ggcttctcttccaaggaagg

SEQ ID NO: 460630 - DNA, 20 bp, Artificial
  CRISPR gRNA sequence
tgttaatatattatataaat

SEQ ID NO: 460631 - DNA, 20 bp, Artificial
  CRISPR gRNA sequence
atattatataaattagttaa

SEQ ID NO: 460632 - DNA, 20 bp, Artificial
  CRISPR gRNA sequence
aatagcacttatttattcaa

SEQ ID NO: 460633 - DNA, 20 bp, Artificial
  CRISPR gRNA sequence
ttcaatagtatatatcattc

SEQ ID NO: 460634 - DNA, 20 bp, Artificial
  CRISPR gRNA sequence
attctagaattaatattttg

SEQ ID NO: 460635 - DNA, 20 bp, Artificial
  CRISPR gRNA sequence
tattttacctgtttaaaaaa

SEQ ID NO: 460636 - DNA, 20 bp, Artificial
  CRISPR gRNA sequence
attaataatgcaattctttc

SEQ ID NO: 460637 - DNA, 20 bp, Artificial
  CRISPR gRNA sequence
ataatgcaattctttccaga

SEQ ID NO: 460638 - DNA, 20 bp, Artificial
  CRISPR gRNA sequence
cattccatacatccttaata

SEQ ID NO: 460639 - DNA, 20 bp, Artificial
  CRISPR gRNA sequence
atccttaatatagccttctc

SEQ ID NO: 460640 - DNA, 20 bp, Artificial
  CRISPR gRNA sequence
tccttaatatagccttctcc

SEQ ID NO: 460641 - DNA, 20 bp, Artificial
  CRISPR gRNA sequence
tagccttctccaggttgatg

SEQ ID NO: 460642 - DNA, 20 bp, Artificial
  CRISPR gRNA sequence
tgttctttaattcatttaca

SEQ ID NO: 460643 - DNA, 20 bp, Artificial
  CRISPR gRNA sequence
ttcatttacaaagaaatatt

SEQ ID NO: 460644 - DNA, 20 bp, Artificial
  CRISPR gRNA sequence
tttacaaagaaatatttagt

SEQ ID NO: 460645 - DNA, 20 bp, Artificial
  CRISPR gRNA sequence
agtgagcccctaccatgtgc

SEQ ID NO: 460646 - DNA, 20 bp, Artificial
  CRISPR gRNA sequence
gtgagcccctaccatgtgcc

SEQ ID NO: 460647 - DNA, 20 bp, Artificial
  CRISPR gRNA sequence
gtaccctgccatccatcata

SEQ ID NO: 460648 - DNA, 20 bp, Artificial
  CRISPR gRNA sequence
accctgccatccatcataca

SEQ ID NO: 460649 - DNA, 20 bp, Artificial
  CRISPR gRNA sequence
gccatccatcatacagagca

SEQ ID NO: 460650 - DNA, 20 bp, Artificial
  CRISPR gRNA sequence
catacagagcaaagatgttt

SEQ ID NO: 460651 - DNA, 20 bp, Artificial
  CRISPR gRNA sequence
gagcaaagatgtttaagaca

SEQ ID NO: 460652 - DNA, 20 bp, Artificial
  CRISPR gRNA sequence
aagacacagcttccatcctg

SEQ ID NO: 460653 - DNA, 20 bp, Artificial
  CRISPR gRNA sequence
gacacagcttccatcctgaa

SEQ ID NO: 460654 - DNA, 20 bp, Artificial
  CRISPR gRNA sequence
acacagcttccatcctgaag

SEQ ID NO: 460655 - DNA, 20 bp, Artificial
  CRISPR gRNA sequence
tccatcctgaagaggtttat

SEQ ID NO: 460656 - DNA, 20 bp, Artificial
  CRISPR gRNA sequence
tcctgaagaggtttataagc

SEQ ID NO: 460657 - DNA, 20 bp, Artificial
  CRISPR gRNA sequence
gaggtttataagccagtgca

SEQ ID NO: 460658 - DNA, 20 bp, Artificial
  CRISPR gRNA sequence
tttataagccagtgcatgga

SEQ ID NO: 460659 - DNA, 20 bp, Artificial
  CRISPR gRNA sequence
gccagtgcatggatggtcac

SEQ ID NO: 460660 - DNA, 20 bp, Artificial
  CRISPR gRNA sequence
catggatggtcacaagtaac

SEQ ID NO: 460661 - DNA, 20 bp, Artificial
  CRISPR gRNA sequence
ggtcacaagtaactagcacc

SEQ ID NO: 460662 - DNA, 20 bp, Artificial
  CRISPR gRNA sequence
gcttcacgctatatttgcaa

SEQ ID NO: 460663 - DNA, 20 bp, Artificial
  CRISPR gRNA sequence
tcacgctatatttgcaaaag

SEQ ID NO: 460664 - DNA, 20 bp, Artificial
  CRISPR gRNA sequence
acgctatatttgcaaaagca

SEQ ID NO: 460665 - DNA, 20 bp, Artificial
  CRISPR gRNA sequence
ttcttctatatttcataatt

SEQ ID NO: 460666 - DNA, 20 bp, Artificial
  CRISPR gRNA sequence
tcttctatatttcataattg

SEQ ID NO: 460667 - DNA, 20 bp, Artificial
  CRISPR gRNA sequence
cttctatatttcataattga

SEQ ID NO: 460668 - DNA, 20 bp, Artificial
  CRISPR gRNA sequence
tatttcataattgagggttg

SEQ ID NO: 460669 - DNA, 20 bp, Artificial
  CRISPR gRNA sequence
aactgctatgcattttttca

SEQ ID NO: 460670 - DNA, 20 bp, Artificial
  CRISPR gRNA sequence
ttttttcatggtgctgctgt

SEQ ID NO: 460671 - DNA, 20 bp, Artificial
  CRISPR gRNA sequence
agaaattttaaactaaccta

SEQ ID NO: 460672 - DNA, 20 bp, Artificial
  CRISPR gRNA sequence
actaacctaaagcattttaa

SEQ ID NO: 460673 - DNA, 20 bp, Artificial
  CRISPR gRNA sequence
gcattttaaaagaatttcaa

SEQ ID NO: 460674 - DNA, 20 bp, Artificial
  CRISPR gRNA sequence
atttcaatggattccttcac

SEQ ID NO: 460675 - DNA, 20 bp, Artificial
  CRISPR gRNA sequence
tttcaatggattccttcact

SEQ ID NO: 460676 - DNA, 20 bp, Artificial
  CRISPR gRNA sequence
ttccttcactgggctacttt

SEQ ID NO: 460677 - DNA, 20 bp, Artificial
  CRISPR gRNA sequence
tccttcactgggctacttta

SEQ ID NO: 460678 - DNA, 20 bp, Artificial
  CRISPR gRNA sequence
ccttcactgggctactttaa

SEQ ID NO: 460679 - DNA, 20 bp, Artificial
  CRISPR gRNA sequence
ttcactgggctactttaagg

SEQ ID NO: 460680 - DNA, 20 bp, Artificial
  CRISPR gRNA sequence
ggctactttaagggagttga

SEQ ID NO: 460681 - DNA, 20 bp, Artificial
  CRISPR gRNA sequence
gggagttgaaagacactcaa

SEQ ID NO: 460682 - DNA, 20 bp, Artificial
  CRISPR gRNA sequence
gttgaaagacactcaaaagt

SEQ ID NO: 460683 - DNA, 20 bp, Artificial
  CRISPR gRNA sequence
cactcaaaagtaagcatata

SEQ ID NO: 460684 - DNA, 20 bp, Artificial
  CRISPR gRNA sequence
agtaacaaattaattttaaa

SEQ ID NO: 460685 - DNA, 20 bp, Artificial
  CRISPR gRNA sequence
caaattaattttaaaaagat

SEQ ID NO: 460686 - DNA, 20 bp, Artificial
  CRISPR gRNA sequence
gttgtaaaatgtatgcattc

SEQ ID NO: 460687 - DNA, 20 bp, Artificial
  CRISPR gRNA sequence
tcaagtgaatgatgtccata

SEQ ID NO: 460688 - DNA, 20 bp, Artificial
  CRISPR gRNA sequence
caagtgaatgatgtccataa

SEQ ID NO: 460689 - DNA, 20 bp, Artificial
  CRISPR gRNA sequence
ataaaggaactaaactgtac

SEQ ID NO: 460690 - DNA, 20 bp, Artificial
  CRISPR gRNA sequence
taaaggaactaaactgtacg

SEQ ID NO: 460691 - DNA, 20 bp, Artificial
  CRISPR gRNA sequence
aaactgtacgaggttgcatc

SEQ ID NO: 460692 - DNA, 20 bp, Artificial
  CRISPR gRNA sequence
actgtacgaggttgcatcca

SEQ ID NO: 460693 - DNA, 20 bp, Artificial
  CRISPR gRNA sequence
acgaggttgcatccagagtt

SEQ ID NO: 460694 - DNA, 20 bp, Artificial
  CRISPR gRNA sequence
cttttgaaatttctccttcc

SEQ ID NO: 460695 - DNA, 20 bp, Artificial
  CRISPR gRNA sequence
ttctccttcccagtaacttt

SEQ ID NO: 460696 - DNA, 20 bp, Artificial
  CRISPR gRNA sequence
tctccttcccagtaacttta

SEQ ID NO: 460697 - DNA, 20 bp, Artificial
  CRISPR gRNA sequence
ctccttcccagtaactttaa

SEQ ID NO: 460698 - DNA, 20 bp, Artificial
  CRISPR gRNA sequence
aactttaagggtcaatttat

SEQ ID NO: 460699 - DNA, 20 bp, Artificial
  CRISPR gRNA sequence
ggtcaatttatgagcaacaa

SEQ ID NO: 460700 - DNA, 20 bp, Artificial
  CRISPR gRNA sequence
cacattatttcttataatta

SEQ ID NO: 460701 - DNA, 20 bp, Artificial
  CRISPR gRNA sequence
acattatttcttataattaa

SEQ ID NO: 460702 - DNA, 20 bp, Artificial
  CRISPR gRNA sequence
cattatttcttataattaaa

SEQ ID NO: 460703 - DNA, 20 bp, Artificial
  CRISPR gRNA sequence
atccaaatatatttttattg

SEQ ID NO: 460704 - DNA, 20 bp, Artificial
  CRISPR gRNA sequence
gtaaaatacatataacataa

SEQ ID NO: 460705 - DNA, 20 bp, Artificial
  CRISPR gRNA sequence
atttaaaatgtacaattaaa

SEQ ID NO: 460706 - DNA, 20 bp, Artificial
  CRISPR gRNA sequence
tgtacaattaaatggcatgt

SEQ ID NO: 460707 - DNA, 20 bp, Artificial
  CRISPR gRNA sequence
ttgcaaacgtgactacgatc

SEQ ID NO: 460708 - DNA, 20 bp, Artificial
  CRISPR gRNA sequence
acgtgactacgatctagatt

SEQ ID NO: 460709 - DNA, 20 bp, Artificial
  CRISPR gRNA sequence
gaacatatttatcaccccaa

SEQ ID NO: 460710 - DNA, 20 bp, Artificial
  CRISPR gRNA sequence
aacatatttatcaccccaaa

SEQ ID NO: 460711 - DNA, 20 bp, Artificial
  CRISPR gRNA sequence
atatttatcaccccaaaagg

SEQ ID NO: 460712 - DNA, 20 bp, Artificial
  CRISPR gRNA sequence
aaggaagccctctacctatt

SEQ ID NO: 460713 - DNA, 20 bp, Artificial
  CRISPR gRNA sequence
gaagccctctacctatttag

SEQ ID NO: 460714 - DNA, 20 bp, Artificial
  CRISPR gRNA sequence
tgtcacattctttatttcct

SEQ ID NO: 460715 - DNA, 20 bp, Artificial
  CRISPR gRNA sequence
ttctttatttcctcagcccc

SEQ ID NO: 460716 - DNA, 20 bp, Artificial
  CRISPR gRNA sequence
ctcagcccctggcaaccacc

SEQ ID NO: 460717 - DNA, 20 bp, Artificial
  CRISPR gRNA sequence
caagctactttctgtctcta

SEQ ID NO: 460718 - DNA, 20 bp, Artificial
  CRISPR gRNA sequence
ctctatggatttgcctattt

SEQ ID NO: 460719 - DNA, 20 bp, Artificial
  CRISPR gRNA sequence
ttttggatatttcatataat

SEQ ID NO: 460720 - DNA, 20 bp, Artificial
  CRISPR gRNA sequence
aacctttttcttcttttact

SEQ ID NO: 460721 - DNA, 20 bp, Artificial
  CRISPR gRNA sequence
ttacttagcgtaatgcttct

SEQ ID NO: 460722 - DNA, 20 bp, Artificial
  CRISPR gRNA sequence
tacttagcgtaatgcttctg

SEQ ID NO: 460723 - DNA, 20 bp, Artificial
  CRISPR gRNA sequence
tctgaggttcatcaatgttg

SEQ ID NO: 460724 - DNA, 20 bp, Artificial
  CRISPR gRNA sequence
atcaatgttgtagcatacat

SEQ ID NO: 460725 - DNA, 20 bp, Artificial
  CRISPR gRNA sequence
actgaataatattccgtgtg

SEQ ID NO: 460726 - DNA, 20 bp, Artificial
  CRISPR gRNA sequence
catttcctttatccattcat

SEQ ID NO: 460727 - DNA, 20 bp, Artificial
  CRISPR gRNA sequence
ccattcatcagctgaacatt

SEQ ID NO: 460728 - DNA, 20 bp, Artificial
  CRISPR gRNA sequence
cattcatcagctgaacattt

SEQ ID NO: 460729 - DNA, 20 bp, Artificial
  CRISPR gRNA sequence
tttaggttgtttctaccttt

SEQ ID NO: 460730 - DNA, 20 bp, Artificial
  CRISPR gRNA sequence
taccttttggctattgtgaa

SEQ ID NO: 460731 - DNA, 20 bp, Artificial
  CRISPR gRNA sequence
atagtgctgtgataaacatt

SEQ ID NO: 460732 - DNA, 20 bp, Artificial
  CRISPR gRNA sequence
tagtgctgtgataaacattc

SEQ ID NO: 460733 - DNA, 20 bp, Artificial
  CRISPR gRNA sequence
tgtgataaacattcaggaac

SEQ ID NO: 460734 - DNA, 20 bp, Artificial
  CRISPR gRNA sequence
gtgataaacattcaggaaca

SEQ ID NO: 460735 - DNA, 20 bp, Artificial
  CRISPR gRNA sequence
catatattttaatttcattt

SEQ ID NO: 460736 - DNA, 20 bp, Artificial
  CRISPR gRNA sequence
atttcatttgagtatttacc

SEQ ID NO: 460737 - DNA, 20 bp, Artificial
  CRISPR gRNA sequence
tttcatttgagtatttacct

SEQ ID NO: 460738 - DNA, 20 bp, Artificial
  CRISPR gRNA sequence
tttgagtatttacctaggaa

SEQ ID NO: 460739 - DNA, 20 bp, Artificial
  CRISPR gRNA sequence
ttacctaggaatagaattac

SEQ ID NO: 460740 - DNA, 20 bp, Artificial
  CRISPR gRNA sequence
tacctaggaatagaattact

SEQ ID NO: 460741 - DNA, 20 bp, Artificial
  CRISPR gRNA sequence
gaattactgggtactgtgac

SEQ ID NO: 460742 - DNA, 20 bp, Artificial
  CRISPR gRNA sequence
ttactgggtactgtgacaag

SEQ ID NO: 460743 - DNA, 20 bp, Artificial
  CRISPR gRNA sequence
tactgggtactgtgacaagt

SEQ ID NO: 460744 - DNA, 20 bp, Artificial
  CRISPR gRNA sequence
aggttttatcttttgatttt

SEQ ID NO: 460745 - DNA, 20 bp, Artificial
  CRISPR gRNA sequence
ggttttatcttttgattttg

SEQ ID NO: 460746 - DNA, 20 bp, Artificial
  CRISPR gRNA sequence
ttttgattttgaggaactgt

SEQ ID NO: 460747 - DNA, 20 bp, Artificial
  CRISPR gRNA sequence
aactgttagaccactttcta

SEQ ID NO: 460748 - DNA, 20 bp, Artificial
  CRISPR gRNA sequence
gcaccattttacattctcct

SEQ ID NO: 460749 - DNA, 20 bp, Artificial
  CRISPR gRNA sequence
ttttacattctcctcagcaa

SEQ ID NO: 460750 - DNA, 20 bp, Artificial
  CRISPR gRNA sequence
acattctcctcagcaatgga

SEQ ID NO: 460751 - DNA, 20 bp, Artificial
  CRISPR gRNA sequence
cattctcctcagcaatggat

SEQ ID NO: 460752 - DNA, 20 bp, Artificial
  CRISPR gRNA sequence
attctcctcagcaatggata

SEQ ID NO: 460753 - DNA, 20 bp, Artificial
  CRISPR gRNA sequence
tgtgttttttttttttattc

SEQ ID NO: 460754 - DNA, 20 bp, Artificial
  CRISPR gRNA sequence
tttttattctagtcattcga

SEQ ID NO: 460755 - DNA, 20 bp, Artificial
  CRISPR gRNA sequence
ttttattctagtcattcgat

SEQ ID NO: 460756 - DNA, 20 bp, Artificial
  CRISPR gRNA sequence
ctagtcattcgatgggtgtg

SEQ ID NO: 460757 - DNA, 20 bp, Artificial
  CRISPR gRNA sequence
gtcattcgatgggtgtgaag

SEQ ID NO: 460758 - DNA, 20 bp, Artificial
  CRISPR gRNA sequence
tcattcgatgggtgtgaagt

SEQ ID NO: 460759 - DNA, 20 bp, Artificial
  CRISPR gRNA sequence
gactttgatttgcatttctc

SEQ ID NO: 460760 - DNA, 20 bp, Artificial
  CRISPR gRNA sequence
ctccagtaactaatgacatt

SEQ ID NO: 460761 - DNA, 20 bp, Artificial
  CRISPR gRNA sequence
catttttttcatatgtttat

SEQ ID NO: 460762 - DNA, 20 bp, Artificial
  CRISPR gRNA sequence
ctttgatgaaatgtctattc

SEQ ID NO: 460763 - DNA, 20 bp, Artificial
  CRISPR gRNA sequence
tcctttgctcattttaaaat

SEQ ID NO: 460764 - DNA, 20 bp, Artificial
  CRISPR gRNA sequence
cctttgctcattttaaaatt

SEQ ID NO: 460765 - DNA, 20 bp, Artificial
  CRISPR gRNA sequence
tcattttaaaattaggttgc

SEQ ID NO: 460766 - DNA, 20 bp, Artificial
  CRISPR gRNA sequence
gtctatttgttgttgaattt

SEQ ID NO: 460767 - DNA, 20 bp, Artificial
  CRISPR gRNA sequence
ttttagtatcttttgatgca

SEQ ID NO: 460768 - DNA, 20 bp, Artificial
  CRISPR gRNA sequence
tagtatcttttgatgcacag

SEQ ID NO: 460769 - DNA, 20 bp, Artificial
  CRISPR gRNA sequence
agaagtgtttaatttttatg

SEQ ID NO: 460770 - DNA, 20 bp, Artificial
  CRISPR gRNA sequence
aagtccaatttatctatttt

SEQ ID NO: 460771 - DNA, 20 bp, Artificial
  CRISPR gRNA sequence
tgattatgcttttgtaatca

SEQ ID NO: 460772 - DNA, 20 bp, Artificial
  CRISPR gRNA sequence
atgcttttgtaatcatagct

SEQ ID NO: 460773 - DNA, 20 bp, Artificial
  CRISPR gRNA sequence
aagaaaacactgctaaatcc

SEQ ID NO: 460774 - DNA, 20 bp, Artificial
  CRISPR gRNA sequence
aacactgctaaatccaagat

SEQ ID NO: 460775 - DNA, 20 bp, Artificial
  CRISPR gRNA sequence
ttatccctatgttttctcct

SEQ ID NO: 460776 - DNA, 20 bp, Artificial
  CRISPR gRNA sequence
tatgttttctcctaagaaat

SEQ ID NO: 460777 - DNA, 20 bp, Artificial
  CRISPR gRNA sequence
tgttttctcctaagaaatca

SEQ ID NO: 460778 - DNA, 20 bp, Artificial
  CRISPR gRNA sequence
ttttattgttttatataatg

SEQ ID NO: 460779 - DNA, 20 bp, Artificial
  CRISPR gRNA sequence
tttatataatgcagttttta

SEQ ID NO: 460780 - DNA, 20 bp, Artificial
  CRISPR gRNA sequence
taatgcagtttttatagttt

SEQ ID NO: 460781 - DNA, 20 bp, Artificial
  CRISPR gRNA sequence
tattttgattgcttaaaata

SEQ ID NO: 460782 - DNA, 20 bp, Artificial
  CRISPR gRNA sequence
ttttgattgcttaaaatatg

SEQ ID NO: 460783 - DNA, 20 bp, Artificial
  CRISPR gRNA sequence
gattgcttaaaatatggagt

SEQ ID NO: 460784 - DNA, 20 bp, Artificial
  CRISPR gRNA sequence
cttaaaatatggagtgagat

SEQ ID NO: 460785 - DNA, 20 bp, Artificial
  CRISPR gRNA sequence
ttaaaatatggagtgagatg

SEQ ID NO: 460786 - DNA, 20 bp, Artificial
  CRISPR gRNA sequence
taaaatatggagtgagatga

SEQ ID NO: 460787 - DNA, 20 bp, Artificial
  CRISPR gRNA sequence
atatgaatatccaattatcc

SEQ ID NO: 460788 - DNA, 20 bp, Artificial
  CRISPR gRNA sequence
ttatcctggcaccatttatt

SEQ ID NO: 460789 - DNA, 20 bp, Artificial
  CRISPR gRNA sequence
ctttccccactgaataatct

SEQ ID NO: 460790 - DNA, 20 bp, Artificial
  CRISPR gRNA sequence
tatcaaaaatcaattgacta

SEQ ID NO: 460791 - DNA, 20 bp, Artificial
  CRISPR gRNA sequence
atcaattgactacggatgta

SEQ ID NO: 460792 - DNA, 20 bp, Artificial
  CRISPR gRNA sequence
caattgactacggatgtatg

SEQ ID NO: 460793 - DNA, 20 bp, Artificial
  CRISPR gRNA sequence
cggatgtatggagtttattc

SEQ ID NO: 460794 - DNA, 20 bp, Artificial
  CRISPR gRNA sequence
tttttttaactgtcattttg

SEQ ID NO: 460795 - DNA, 20 bp, Artificial
  CRISPR gRNA sequence
tttaactgtcattttgtagt

SEQ ID NO: 460796 - DNA, 20 bp, Artificial
  CRISPR gRNA sequence
ttttgtagtaagttttgaaa

SEQ ID NO: 460797 - DNA, 20 bp, Artificial
  CRISPR gRNA sequence
tttgtagtaagttttgaaat

SEQ ID NO: 460798 - DNA, 20 bp, Artificial
  CRISPR gRNA sequence
ttgtagtaagttttgaaata

SEQ ID NO: 460799 - DNA, 20 bp, Artificial
  CRISPR gRNA sequence
tagtaagttttgaaataggg

SEQ ID NO: 460800 - DNA, 20 bp, Artificial
  CRISPR gRNA sequence
gttttgaaatagggaagtct

SEQ ID NO: 460801 - DNA, 20 bp, Artificial
  CRISPR gRNA sequence
aaatagggaagtcttagctt

SEQ ID NO: 460802 - DNA, 20 bp, Artificial
  CRISPR gRNA sequence
cttcagttttgttctttttc

SEQ ID NO: 460803 - DNA, 20 bp, Artificial
  CRISPR gRNA sequence
gttctttttcaagattgttt

SEQ ID NO: 460804 - DNA, 20 bp, Artificial
  CRISPR gRNA sequence
caagattgttttggcaattc

SEQ ID NO: 460805 - DNA, 20 bp, Artificial
  CRISPR gRNA sequence
aagattgttttggcaattct

SEQ ID NO: 460806 - DNA, 20 bp, Artificial
  CRISPR gRNA sequence
ttgcaactcaatgtgaattt

SEQ ID NO: 460807 - DNA, 20 bp, Artificial
  CRISPR gRNA sequence
tgcaactcaatgtgaatttt

SEQ ID NO: 460808 - DNA, 20 bp, Artificial
  CRISPR gRNA sequence
ctcaatgtgaattttaggat

SEQ ID NO: 460809 - DNA, 20 bp, Artificial
  CRISPR gRNA sequence
cagcttttttatttctgcaa

SEQ ID NO: 460810 - DNA, 20 bp, Artificial
  CRISPR gRNA sequence
atttctgcaatagcaacaaa

SEQ ID NO: 460811 - DNA, 20 bp, Artificial
  CRISPR gRNA sequence
caatagcaacaaaaagctgt

SEQ ID NO: 460812 - DNA, 20 bp, Artificial
  CRISPR gRNA sequence
aatagcaacaaaaagctgtt

SEQ ID NO: 460813 - DNA, 20 bp, Artificial
  CRISPR gRNA sequence
acaaaaagctgttaggattt

SEQ ID NO: 460814 - DNA, 20 bp, Artificial
  CRISPR gRNA sequence
aaaagctgttaggattttag

SEQ ID NO: 460815 - DNA, 20 bp, Artificial
  CRISPR gRNA sequence
gtggaactgcattgaatctg

SEQ ID NO: 460816 - DNA, 20 bp, Artificial
  CRISPR gRNA sequence
attgaatctgtagatcacct

SEQ ID NO: 460817 - DNA, 20 bp, Artificial
  CRISPR gRNA sequence
ttgaatctgtagatcacctt

SEQ ID NO: 460818 - DNA, 20 bp, Artificial
  CRISPR gRNA sequence
tgaatctgtagatcaccttg

SEQ ID NO: 460819 - DNA, 20 bp, Artificial
  CRISPR gRNA sequence
ctttacaatattacatcttt

SEQ ID NO: 460820 - DNA, 20 bp, Artificial
  CRISPR gRNA sequence
catctttcagtccatgaata

SEQ ID NO: 460821 - DNA, 20 bp, Artificial
  CRISPR gRNA sequence
acatattcttgaatttcttt

SEQ ID NO: 460822 - DNA, 20 bp, Artificial
  CRISPR gRNA sequence
tcagccatgctttctttgtt

SEQ ID NO: 460823 - DNA, 20 bp, Artificial
  CRISPR gRNA sequence
gtacaactcttatacctctt

SEQ ID NO: 460824 - DNA, 20 bp, Artificial
  CRISPR gRNA sequence
cattttgatgctattgtaaa

SEQ ID NO: 460825 - DNA, 20 bp, Artificial
  CRISPR gRNA sequence
tgtttccttaattttctttg

SEQ ID NO: 460826 - DNA, 20 bp, Artificial
  CRISPR gRNA sequence
ctttgtggattgtttattgc

SEQ ID NO: 460827 - DNA, 20 bp, Artificial
  CRISPR gRNA sequence
gattgtttattgctagtgta

SEQ ID NO: 460828 - DNA, 20 bp, Artificial
  CRISPR gRNA sequence
tgtgttgatcctgtatcatg

SEQ ID NO: 460829 - DNA, 20 bp, Artificial
  CRISPR gRNA sequence
gaattgctaaattcatgtat

SEQ ID NO: 460830 - DNA, 20 bp, Artificial
  CRISPR gRNA sequence
aattcatgtattagctttaa

SEQ ID NO: 460831 - DNA, 20 bp, Artificial
  CRISPR gRNA sequence
atagttttaaacaaattttt

SEQ ID NO: 460832 - DNA, 20 bp, Artificial
  CRISPR gRNA sequence
ttaagaatttttctacacat

SEQ ID NO: 460833 - DNA, 20 bp, Artificial
  CRISPR gRNA sequence
gttcatgccatctgtgaata

SEQ ID NO: 460834 - DNA, 20 bp, Artificial
  CRISPR gRNA sequence
agttttacttctttttttct

SEQ ID NO: 460835 - DNA, 20 bp, Artificial
  CRISPR gRNA sequence
ttacttctttttttctaagt

SEQ ID NO: 460836 - DNA, 20 bp, Artificial
  CRISPR gRNA sequence
ttgttcttgcctgtttgctc

SEQ ID NO: 460837 - DNA, 20 bp, Artificial
  CRISPR gRNA sequence
tcttgcctgtttgctctggc

SEQ ID NO: 460838 - DNA, 20 bp, Artificial
  CRISPR gRNA sequence
tttgctctggctagaatttt

SEQ ID NO: 460839 - DNA, 20 bp, Artificial
  CRISPR gRNA sequence
attttcagtttaatgttaaa

SEQ ID NO: 460840 - DNA, 20 bp, Artificial
  CRISPR gRNA sequence
agtttaatgttaaatggaaa

SEQ ID NO: 460841 - DNA, 20 bp, Artificial
  CRISPR gRNA sequence
atgttaaatggaaatggcaa

SEQ ID NO: 460842 - DNA, 20 bp, Artificial
  CRISPR gRNA sequence
taaatggaaatggcaaaagc

SEQ ID NO: 460843 - DNA, 20 bp, Artificial
  CRISPR gRNA sequence
aaatggaaatggcaaaagca

SEQ ID NO: 460844 - DNA, 20 bp, Artificial
  CRISPR gRNA sequence
ccatgtcttgttcctgttct

SEQ ID NO: 460845 - DNA, 20 bp, Artificial
  CRISPR gRNA sequence
catgtcttgttcctgttctt

SEQ ID NO: 460846 - DNA, 20 bp, Artificial
  CRISPR gRNA sequence
atgtcttgttcctgttctta

SEQ ID NO: 460847 - DNA, 20 bp, Artificial
  CRISPR gRNA sequence
tgtcttgttcctgttcttag

SEQ ID NO: 460848 - DNA, 20 bp, Artificial
  CRISPR gRNA sequence
gtcttgttcctgttcttagg

SEQ ID NO: 460849 - DNA, 20 bp, Artificial
  CRISPR gRNA sequence
tgttcctgttcttaggggga

SEQ ID NO: 460850 - DNA, 20 bp, Artificial
  CRISPR gRNA sequence
gttcttagggggaaagctct

SEQ ID NO: 460851 - DNA, 20 bp, Artificial
  CRISPR gRNA sequence
ttcaccattgaatatgatgt

SEQ ID NO: 460852 - DNA, 20 bp, Artificial
  CRISPR gRNA sequence
ctataaaatttttataaacc

SEQ ID NO: 460853 - DNA, 20 bp, Artificial
  CRISPR gRNA sequence
gtattttttcatgttttatt

SEQ ID NO: 460854 - DNA, 20 bp, Artificial
  CRISPR gRNA sequence
ttttcatgttttattcagct

SEQ ID NO: 460855 - DNA, 20 bp, Artificial
  CRISPR gRNA sequence
ttattcagcttggtttcccc

SEQ ID NO: 460856 - DNA, 20 bp, Artificial
  CRISPR gRNA sequence
aacttctatctgtccttcct

SEQ ID NO: 460857 - DNA, 20 bp, Artificial
  CRISPR gRNA sequence
ctgtccttcctcagttgtca

SEQ ID NO: 460858 - DNA, 20 bp, Artificial
  CRISPR gRNA sequence
tcagttgtcaaagcatatta

SEQ ID NO: 460859 - DNA, 20 bp, Artificial
  CRISPR gRNA sequence
cagttgtcaaagcatattaa

SEQ ID NO: 460860 - DNA, 20 bp, Artificial
  CRISPR gRNA sequence
agcatattaaaggcctcttt

SEQ ID NO: 460861 - DNA, 20 bp, Artificial
  CRISPR gRNA sequence
gcatattaaaggcctctttc

SEQ ID NO: 460862 - DNA, 20 bp, Artificial
  CRISPR gRNA sequence
catattaaaggcctctttcg

SEQ ID NO: 460863 - DNA, 20 bp, Artificial
  CRISPR gRNA sequence
taaaggcctctttcggggaa

SEQ ID NO: 460864 - DNA, 20 bp, Artificial
  CRISPR gRNA sequence
aaaggcctctttcggggaac

SEQ ID NO: 460865 - DNA, 20 bp, Artificial
  CRISPR gRNA sequence
aaggcctctttcggggaaca

SEQ ID NO: 460866 - DNA, 20 bp, Artificial
  CRISPR gRNA sequence
gcctctttcggggaacaggg

SEQ ID NO: 460867 - DNA, 20 bp, Artificial
  CRISPR gRNA sequence
ctctttcggggaacagggaa

SEQ ID NO: 460868 - DNA, 20 bp, Artificial
  CRISPR gRNA sequence
ctttcggggaacagggaaga

SEQ ID NO: 460869 - DNA, 20 bp, Artificial
  CRISPR gRNA sequence
gggaacagggaagagagatg

SEQ ID NO: 460870 - DNA, 20 bp, Artificial
  CRISPR gRNA sequence
gatgaagctctgaatattcc

SEQ ID NO: 460871 - DNA, 20 bp, Artificial
  CRISPR gRNA sequence
gaatattcccagaaaatcac

SEQ ID NO: 460872 - DNA, 20 bp, Artificial
  CRISPR gRNA sequence
aatattcccagaaaatcact

SEQ ID NO: 460873 - DNA, 20 bp, Artificial
  CRISPR gRNA sequence
attcccagaaaatcactagg

SEQ ID NO: 460874 - DNA, 20 bp, Artificial
  CRISPR gRNA sequence
ccagaaaatcactaggaagt

SEQ ID NO: 460875 - DNA, 20 bp, Artificial
  CRISPR gRNA sequence
aaaatcactaggaagtcagt

SEQ ID NO: 460876 - DNA, 20 bp, Artificial
  CRISPR gRNA sequence
taaacaaactgtgaactatt

SEQ ID NO: 460877 - DNA, 20 bp, Artificial
  CRISPR gRNA sequence
acaaactgtgaactattaag

SEQ ID NO: 460878 - DNA, 20 bp, Artificial
  CRISPR gRNA sequence
taagaagtgtttaattgcct

SEQ ID NO: 460879 - DNA, 20 bp, Artificial
  CRISPR gRNA sequence
agcaccacaaacataacttc

SEQ ID NO: 460880 - DNA, 20 bp, Artificial
  CRISPR gRNA sequence
caagaaattgtaatgaacaa

SEQ ID NO: 460881 - DNA, 20 bp, Artificial
  CRISPR gRNA sequence
aattgtaatgaacaaaagta

SEQ ID NO: 460882 - DNA, 20 bp, Artificial
  CRISPR gRNA sequence
tgtaatgaacaaaagtaaag

SEQ ID NO: 460883 - DNA, 20 bp, Artificial
  CRISPR gRNA sequence
taatgaacaaaagtaaagaa

SEQ ID NO: 460884 - DNA, 20 bp, Artificial
  CRISPR gRNA sequence
aaaagtaaagaagagaaaaa

SEQ ID NO: 460885 - DNA, 20 bp, Artificial
  CRISPR gRNA sequence
aaagtaaagaagagaaaaat

SEQ ID NO: 460886 - DNA, 20 bp, Artificial
  CRISPR gRNA sequence
aagaagagaaaaatgggaaa

SEQ ID NO: 460887 - DNA, 20 bp, Artificial
  CRISPR gRNA sequence
gaagagaaaaatgggaaaaa

SEQ ID NO: 460888 - DNA, 20 bp, Artificial
  CRISPR gRNA sequence
aagagaaaaaaaaaacaaca

SEQ ID NO: 460889 - DNA, 20 bp, Artificial
  CRISPR gRNA sequence
agaaaaaaaaaacaacaaag

SEQ ID NO: 460890 - DNA, 20 bp, Artificial
  CRISPR gRNA sequence
gaaaaaaaaaacaacaaaga

SEQ ID NO: 460891 - DNA, 20 bp, Artificial
  CRISPR gRNA sequence
aaaaaacaacaaagaaggac

SEQ ID NO: 460892 - DNA, 20 bp, Artificial
  CRISPR gRNA sequence
caaagaaggacaagcaatca

SEQ ID NO: 460893 - DNA, 20 bp, Artificial
  CRISPR gRNA sequence
aagaaggacaagcaatcaca

SEQ ID NO: 460894 - DNA, 20 bp, Artificial
  CRISPR gRNA sequence
cacagagctattcgcaacta

SEQ ID NO: 460895 - DNA, 20 bp, Artificial
  CRISPR gRNA sequence
acagagctattcgcaactat

SEQ ID NO: 460896 - DNA, 20 bp, Artificial
  CRISPR gRNA sequence
ttataattttttcaatattt

SEQ ID NO: 460897 - DNA, 20 bp, Artificial
  CRISPR gRNA sequence
taattttttcaatatttcag

SEQ ID NO: 460898 - DNA, 20 bp, Artificial
  CRISPR gRNA sequence
atatttcagtggtctacttt

SEQ ID NO: 460899 - DNA, 20 bp, Artificial
  CRISPR gRNA sequence
aataaattttataatcccta

SEQ ID NO: 460900 - DNA, 20 bp, Artificial
  CRISPR gRNA sequence
acacacacatatgtacacac

SEQ ID NO: 460901 - DNA, 20 bp, Artificial
  CRISPR gRNA sequence
actggcacataacaatctgt

SEQ ID NO: 460902 - DNA, 20 bp, Artificial
  CRISPR gRNA sequence
ctggcacataacaatctgtg

SEQ ID NO: 460903 - DNA, 20 bp, Artificial
  CRISPR gRNA sequence
acataacaatctgtgaggtg

SEQ ID NO: 460904 - DNA, 20 bp, Artificial
  CRISPR gRNA sequence
taacaatctgtgaggtgtag

SEQ ID NO: 460905 - DNA, 20 bp, Artificial
  CRISPR gRNA sequence
ctgtgaggtgtagcagattt

SEQ ID NO: 460906 - DNA, 20 bp, Artificial
  CRISPR gRNA sequence
agcagatttcagatgtgcta

SEQ ID NO: 460907 - DNA, 20 bp, Artificial
  CRISPR gRNA sequence
gcagatttcagatgtgctat

SEQ ID NO: 460908 - DNA, 20 bp, Artificial
  CRISPR gRNA sequence
agatttcagatgtgctatag

SEQ ID NO: 460909 - DNA, 20 bp, Artificial
  CRISPR gRNA sequence
ttcagatgtgctataggagt

SEQ ID NO: 460910 - DNA, 20 bp, Artificial
  CRISPR gRNA sequence
gctttctaacataatcactt

SEQ ID NO: 460911 - DNA, 20 bp, Artificial
  CRISPR gRNA sequence
aaactgaacccccctcttcc

SEQ ID NO: 460912 - DNA, 20 bp, Artificial
  CRISPR gRNA sequence
cctcttcctggaaacattat

SEQ ID NO: 460913 - DNA, 20 bp, Artificial
  CRISPR gRNA sequence
aaacattataagaaaaatat

SEQ ID NO: 460914 - DNA, 20 bp, Artificial
  CRISPR gRNA sequence
attataagaaaaatatcaga

SEQ ID NO: 460915 - DNA, 20 bp, Artificial
  CRISPR gRNA sequence
aagaaaaatatcagatggtc

SEQ ID NO: 460916 - DNA, 20 bp, Artificial
  CRISPR gRNA sequence
agaaaaatatcagatggtct

SEQ ID NO: 460917 - DNA, 20 bp, Artificial
  CRISPR gRNA sequence
tatcagatggtctaggtgtt

SEQ ID NO: 460918 - DNA, 20 bp, Artificial
  CRISPR gRNA sequence
gagaactcacctgtcacata

SEQ ID NO: 460919 - DNA, 20 bp, Artificial
  CRISPR gRNA sequence
gaactcacctgtcacataaa

SEQ ID NO: 460920 - DNA, 20 bp, Artificial
  CRISPR gRNA sequence
ctgtcacataaagagttgtt

SEQ ID NO: 460921 - DNA, 20 bp, Artificial
  CRISPR gRNA sequence
tcacataaagagttgttgag

SEQ ID NO: 460922 - DNA, 20 bp, Artificial
  CRISPR gRNA sequence
gttgttgagtggctttcaat

SEQ ID NO: 460923 - DNA, 20 bp, Artificial
  CRISPR gRNA sequence
tgagtggctttcaatgagat

SEQ ID NO: 460924 - DNA, 20 bp, Artificial
  CRISPR gRNA sequence
gagattagactgaaaatttg

SEQ ID NO: 460925 - DNA, 20 bp, Artificial
  CRISPR gRNA sequence
tagactgaaaatttgcagaa

SEQ ID NO: 460926 - DNA, 20 bp, Artificial
  CRISPR gRNA sequence
actgaaaatttgcagaacag

SEQ ID NO: 460927 - DNA, 20 bp, Artificial
  CRISPR gRNA sequence
gcggtatgacccattgtcat

SEQ ID NO: 460928 - DNA, 20 bp, Artificial
  CRISPR gRNA sequence
cggtatgacccattgtcatt

SEQ ID NO: 460929 - DNA, 20 bp, Artificial
  CRISPR gRNA sequence
tatgacccattgtcattagg

SEQ ID NO: 460930 - DNA, 20 bp, Artificial
  CRISPR gRNA sequence
ccattgtcattaggaagcac

SEQ ID NO: 460931 - DNA, 20 bp, Artificial
  CRISPR gRNA sequence
ggaagcactggttcaaaatg

SEQ ID NO: 460932 - DNA, 20 bp, Artificial
  CRISPR gRNA sequence
caacttgtttgtctatcttc

SEQ ID NO: 460933 - DNA, 20 bp, Artificial
  CRISPR gRNA sequence
tttacacatgttgttccatt

SEQ ID NO: 460934 - DNA, 20 bp, Artificial
  CRISPR gRNA sequence
tgttccattgagcttgcacc

SEQ ID NO: 460935 - DNA, 20 bp, Artificial
  CRISPR gRNA sequence
gagcttgcaccaagtcacat

SEQ ID NO: 460936 - DNA, 20 bp, Artificial
  CRISPR gRNA sequence
agcttgcaccaagtcacatg

SEQ ID NO: 460937 - DNA, 20 bp, Artificial
  CRISPR gRNA sequence
ccaagtcacatgaggcctgt

SEQ ID NO: 460938 - DNA, 20 bp, Artificial
  CRISPR gRNA sequence
tcacatgaggcctgttagca

SEQ ID NO: 460939 - DNA, 20 bp, Artificial
  CRISPR gRNA sequence
cctgttagcacagtatttca

SEQ ID NO: 460940 - DNA, 20 bp, Artificial
  CRISPR gRNA sequence
ctgttagcacagtatttcac

SEQ ID NO: 460941 - DNA, 20 bp, Artificial
  CRISPR gRNA sequence
tgttagcacagtatttcaca

SEQ ID NO: 460942 - DNA, 20 bp, Artificial
  CRISPR gRNA sequence
cagtatttcacagggcattc

SEQ ID NO: 460943 - DNA, 20 bp, Artificial
  CRISPR gRNA sequence
tcacagggcattctagttca

SEQ ID NO: 460944 - DNA, 20 bp, Artificial
  CRISPR gRNA sequence
cacagggcattctagttcaa

SEQ ID NO: 460945 - DNA, 20 bp, Artificial
  CRISPR gRNA sequence
acagggcattctagttcaaa

SEQ ID NO: 460946 - DNA, 20 bp, Artificial
  CRISPR gRNA sequence
gttcaaagggatctcctgct

SEQ ID NO: 460947 - DNA, 20 bp, Artificial
  CRISPR gRNA sequence
aaagggatctcctgctaaga

SEQ ID NO: 460948 - DNA, 20 bp, Artificial
  CRISPR gRNA sequence
agggatctcctgctaagatg

SEQ ID NO: 460949 - DNA, 20 bp, Artificial
  CRISPR gRNA sequence
tcctgctaagatggagtgtt

SEQ ID NO: 460950 - DNA, 20 bp, Artificial
  CRISPR gRNA sequence
tcagattgtctctttatata

SEQ ID NO: 460951 - DNA, 20 bp, Artificial
  CRISPR gRNA sequence
tcacatgattctttccctaa

SEQ ID NO: 460952 - DNA, 20 bp, Artificial
  CRISPR gRNA sequence
taaaatcaaatatgttcttc

SEQ ID NO: 460953 - DNA, 20 bp, Artificial
  CRISPR gRNA sequence
aatcaaatatgttcttctgg

SEQ ID NO: 460954 - DNA, 20 bp, Artificial
  CRISPR gRNA sequence
ccatatatatgtgacttcaa

SEQ ID NO: 460955 - DNA, 20 bp, Artificial
  CRISPR gRNA sequence
atgtgacttcaatagttctc

SEQ ID NO: 460956 - DNA, 20 bp, Artificial
  CRISPR gRNA sequence
aatagttctcaagcattatt

SEQ ID NO: 460957 - DNA, 20 bp, Artificial
  CRISPR gRNA sequence
aaaaacaaccccccaatttc

SEQ ID NO: 460958 - DNA, 20 bp, Artificial
  CRISPR gRNA sequence
ccccccaatttctagtaatt

SEQ ID NO: 460959 - DNA, 20 bp, Artificial
  CRISPR gRNA sequence
ttctagtaattaagccttac

SEQ ID NO: 460960 - DNA, 20 bp, Artificial
  CRISPR gRNA sequence
tagtaattaagccttactag

SEQ ID NO: 460961 - DNA, 20 bp, Artificial
  CRISPR gRNA sequence
gcagaatgtctcatacatat

SEQ ID NO: 460962 - DNA, 20 bp, Artificial
  CRISPR gRNA sequence
cagaatgtctcatacatatt

SEQ ID NO: 460963 - DNA, 20 bp, Artificial
  CRISPR gRNA sequence
tcatttaatcctctgtctgt

SEQ ID NO: 460964 - DNA, 20 bp, Artificial
  CRISPR gRNA sequence
catttaatcctctgtctgtc

SEQ ID NO: 460965 - DNA, 20 bp, Artificial
  CRISPR gRNA sequence
cctctgtctgtcaggccttt

SEQ ID NO: 460966 - DNA, 20 bp, Artificial
  CRISPR gRNA sequence
tctgtcaggcctttgagccc

SEQ ID NO: 460967 - DNA, 20 bp, Artificial
  CRISPR gRNA sequence
caggcctttgagcccaagct

SEQ ID NO: 460968 - DNA, 20 bp, Artificial
  CRISPR gRNA sequence
gtgacctgcacgtatacatc

SEQ ID NO: 460969 - DNA, 20 bp, Artificial
  CRISPR gRNA sequence
cctgcacgtatacatccaga

SEQ ID NO: 460970 - DNA, 20 bp, Artificial
  CRISPR gRNA sequence
gtatacatccagatggcctg

SEQ ID NO: 460971 - DNA, 20 bp, Artificial
  CRISPR gRNA sequence
cagatggcctgaagcaactg

SEQ ID NO: 460972 - DNA, 20 bp, Artificial
  CRISPR gRNA sequence
aagcaactgaagatccacaa

SEQ ID NO: 460973 - DNA, 20 bp, Artificial
  CRISPR gRNA sequence
caactgaagatccacaaaag

SEQ ID NO: 460974 - DNA, 20 bp, Artificial
  CRISPR gRNA sequence
atccacaaaagaagtgaaaa

SEQ ID NO: 460975 - DNA, 20 bp, Artificial
  CRISPR gRNA sequence
ttgtaatctcccccaccctt

SEQ ID NO: 460976 - DNA, 20 bp, Artificial
  CRISPR gRNA sequence
taatctcccccacccttaag

SEQ ID NO: 460977 - DNA, 20 bp, Artificial
  CRISPR gRNA sequence
ttgtaattctccccaccctt

SEQ ID NO: 460978 - DNA, 20 bp, Artificial
  CRISPR gRNA sequence
cccttgagaatgtattttgt

SEQ ID NO: 460979 - DNA, 20 bp, Artificial
  CRISPR gRNA sequence
ctgcctatcccaaaacctat

SEQ ID NO: 460980 - DNA, 20 bp, Artificial
  CRISPR gRNA sequence
tcatttgctgactctctttt

SEQ ID NO: 460981 - DNA, 20 bp, Artificial
  CRISPR gRNA sequence
gctgactctctttttggact

SEQ ID NO: 460982 - DNA, 20 bp, Artificial
  CRISPR gRNA sequence
tttggactcagcccgcctgc

SEQ ID NO: 460983 - DNA, 20 bp, Artificial
  CRISPR gRNA sequence
ttggactcagcccgcctgca

SEQ ID NO: 460984 - DNA, 20 bp, Artificial
  CRISPR gRNA sequence
cgcctgcaaggtgaaataaa

SEQ ID NO: 460985 - DNA, 20 bp, Artificial
  CRISPR gRNA sequence
acagccttgttgctcacaca

SEQ ID NO: 460986 - DNA, 20 bp, Artificial
  CRISPR gRNA sequence
ttgctcacacaaagcctgtt

SEQ ID NO: 460987 - DNA, 20 bp, Artificial
  CRISPR gRNA sequence
ctcacacaaagcctgtttgg

SEQ ID NO: 460988 - DNA, 20 bp, Artificial
  CRISPR gRNA sequence
tgtttggtggtctctacaca

SEQ ID NO: 460989 - DNA, 20 bp, Artificial
  CRISPR gRNA sequence
gtctctacacacggacacat

SEQ ID NO: 460990 - DNA, 20 bp, Artificial
  CRISPR gRNA sequence
ggacacatgagacactgtct

SEQ ID NO: 460991 - DNA, 20 bp, Artificial
  CRISPR gRNA sequence
tgtcttagtctgttttctgc

SEQ ID NO: 460992 - DNA, 20 bp, Artificial
  CRISPR gRNA sequence
tctgttttctgctagtataa

SEQ ID NO: 460993 - DNA, 20 bp, Artificial
  CRISPR gRNA sequence
gctagtataacagaatacct

SEQ ID NO: 460994 - DNA, 20 bp, Artificial
  CRISPR gRNA sequence
tataacagaatacctgagat

SEQ ID NO: 460995 - DNA, 20 bp, Artificial
  CRISPR gRNA sequence
attggataatttttgaatca

SEQ ID NO: 460996 - DNA, 20 bp, Artificial
  CRISPR gRNA sequence
ggataatttttgaatcacag

SEQ ID NO: 460997 - DNA, 20 bp, Artificial
  CRISPR gRNA sequence
tgaatcacagaagttttatt

SEQ ID NO: 460998 - DNA, 20 bp, Artificial
  CRISPR gRNA sequence
cagaagttttatttggctca

SEQ ID NO: 460999 - DNA, 20 bp, Artificial
  CRISPR gRNA sequence
ttatttggctcatggctctg

SEQ ID NO: 461000 - DNA, 20 bp, Artificial
  CRISPR gRNA sequence
tatttggctcatggctctgt

SEQ ID NO: 461001 - DNA, 20 bp, Artificial
  CRISPR gRNA sequence
tggctcatggctctgtaggc

SEQ ID NO: 461002 - DNA, 20 bp, Artificial
  CRISPR gRNA sequence
ggctcatggctctgtaggct

SEQ ID NO: 461003 - DNA, 20 bp, Artificial
  CRISPR gRNA sequence
tcatggctctgtaggctggg

SEQ ID NO: 461004 - DNA, 20 bp, Artificial
  CRISPR gRNA sequence
ctctgtaggctgggaagtcc

SEQ ID NO: 461005 - DNA, 20 bp, Artificial
  CRISPR gRNA sequence
ctgtaggctgggaagtccaa

SEQ ID NO: 461006 - DNA, 20 bp, Artificial
  CRISPR gRNA sequence
ggctgggaagtccaagagca

SEQ ID NO: 461007 - DNA, 20 bp, Artificial
  CRISPR gRNA sequence
gaagtccaagagcatggtgc

SEQ ID NO: 461008 - DNA, 20 bp, Artificial
  CRISPR gRNA sequence
aagagcatggtgccagcatc

SEQ ID NO: 461009 - DNA, 20 bp, Artificial
  CRISPR gRNA sequence
catggtgccagcatctagca

SEQ ID NO: 461010 - DNA, 20 bp, Artificial
  CRISPR gRNA sequence
atggtgccagcatctagcaa

SEQ ID NO: 461011 - DNA, 20 bp, Artificial
  CRISPR gRNA sequence
ctttgtgctgcattatctca

SEQ ID NO: 461012 - DNA, 20 bp, Artificial
  CRISPR gRNA sequence
tgtgctgcattatctcatgg

SEQ ID NO: 461013 - DNA, 20 bp, Artificial
  CRISPR gRNA sequence
ctgcattatctcatggcaga

SEQ ID NO: 461014 - DNA, 20 bp, Artificial
  CRISPR gRNA sequence
cattatctcatggcagaaag

SEQ ID NO: 461015 - DNA, 20 bp, Artificial
  CRISPR gRNA sequence
atctcatggcagaaagcaga

SEQ ID NO: 461016 - DNA, 20 bp, Artificial
  CRISPR gRNA sequence
tcatggcagaaagcagaaag

SEQ ID NO: 461017 - DNA, 20 bp, Artificial
  CRISPR gRNA sequence
tggcagaaagcagaaagtgg

SEQ ID NO: 461018 - DNA, 20 bp, Artificial
  CRISPR gRNA sequence
ggcagaaagcagaaagtgga

SEQ ID NO: 461019 - DNA, 20 bp, Artificial
  CRISPR gRNA sequence
gcagaaagcagaaagtggaa

SEQ ID NO: 461020 - DNA, 20 bp, Artificial
  CRISPR gRNA sequence
agaaagcagaaagtggaagg

SEQ ID NO: 461021 - DNA, 20 bp, Artificial
  CRISPR gRNA sequence
gaaagtggaagggagcacac

SEQ ID NO: 461022 - DNA, 20 bp, Artificial
  CRISPR gRNA sequence
gtggaagggagcacacaaga

SEQ ID NO: 461023 - DNA, 20 bp, Artificial
  CRISPR gRNA sequence
ggaagggagcacacaagaca

SEQ ID NO: 461024 - DNA, 20 bp, Artificial
  CRISPR gRNA sequence
gcacacaagacagagaaaaa

SEQ ID NO: 461025 - DNA, 20 bp, Artificial
  CRISPR gRNA sequence
cacacaagacagagaaaaat

SEQ ID NO: 461026 - DNA, 20 bp, Artificial
  CRISPR gRNA sequence
acacaagacagagaaaaatg

SEQ ID NO: 461027 - DNA, 20 bp, Artificial
  CRISPR gRNA sequence
cacaagacagagaaaaatgg

SEQ ID NO: 461028 - DNA, 20 bp, Artificial
  CRISPR gRNA sequence
gccaaaatttatccttttat

SEQ ID NO: 461029 - DNA, 20 bp, Artificial
  CRISPR gRNA sequence
ccaaaatttatccttttatc

SEQ ID NO: 461030 - DNA, 20 bp, Artificial
  CRISPR gRNA sequence
aacgaatccattcctacaat

SEQ ID NO: 461031 - DNA, 20 bp, Artificial
  CRISPR gRNA sequence
acgaatccattcctacaata

SEQ ID NO: 461032 - DNA, 20 bp, Artificial
  CRISPR gRNA sequence
cgaatccattcctacaataa

SEQ ID NO: 461033 - DNA, 20 bp, Artificial
  CRISPR gRNA sequence
tcataacctctgatctctta

SEQ ID NO: 461034 - DNA, 20 bp, Artificial
  CRISPR gRNA sequence
cataacctctgatctcttaa

SEQ ID NO: 461035 - DNA, 20 bp, Artificial
  CRISPR gRNA sequence
acctcacaaaactgttacaa

SEQ ID NO: 461036 - DNA, 20 bp, Artificial
  CRISPR gRNA sequence
taaaatttcaacatgaattt

SEQ ID NO: 461037 - DNA, 20 bp, Artificial
  CRISPR gRNA sequence
aaatttcaacatgaattttg

SEQ ID NO: 461038 - DNA, 20 bp, Artificial
  CRISPR gRNA sequence
aatttcaacatgaattttgg

SEQ ID NO: 461039 - DNA, 20 bp, Artificial
  CRISPR gRNA sequence
atttcaacatgaattttgga

SEQ ID NO: 461040 - DNA, 20 bp, Artificial
  CRISPR gRNA sequence
tttcaacatgaattttggag

SEQ ID NO: 461041 - DNA, 20 bp, Artificial
  CRISPR gRNA sequence
ttcaacatgaattttggagg

SEQ ID NO: 461042 - DNA, 20 bp, Artificial
  CRISPR gRNA sequence
tggagggggcattcaaacca

SEQ ID NO: 461043 - DNA, 20 bp, Artificial
  CRISPR gRNA sequence
aaaccatagcattctgcccc

SEQ ID NO: 461044 - DNA, 20 bp, Artificial
  CRISPR gRNA sequence
atacattcattccatctcaa

SEQ ID NO: 461045 - DNA, 20 bp, Artificial
  CRISPR gRNA sequence
ttccatctcaatagccccaa

SEQ ID NO: 461046 - DNA, 20 bp, Artificial
  CRISPR gRNA sequence
ccaaaagttttaatttattg

SEQ ID NO: 461047 - DNA, 20 bp, Artificial
  CRISPR gRNA sequence
tcaattcaaaacactaaatt

SEQ ID NO: 461048 - DNA, 20 bp, Artificial
  CRISPR gRNA sequence
aattcaaaacactaaattca

SEQ ID NO: 461049 - DNA, 20 bp, Artificial
  CRISPR gRNA sequence
attcagagtcttatctaaac

SEQ ID NO: 461050 - DNA, 20 bp, Artificial
  CRISPR gRNA sequence
agtcttatctaaaccagata

SEQ ID NO: 461051 - DNA, 20 bp, Artificial
  CRISPR gRNA sequence
gtcttatctaaaccagatat

SEQ ID NO: 461052 - DNA, 20 bp, Artificial
  CRISPR gRNA sequence
tatctaaaccagatatgggt

SEQ ID NO: 461053 - DNA, 20 bp, Artificial
  CRISPR gRNA sequence
accagatatgggtaagattc

SEQ ID NO: 461054 - DNA, 20 bp, Artificial
  CRISPR gRNA sequence
ccagatatgggtaagattca

SEQ ID NO: 461055 - DNA, 20 bp, Artificial
  CRISPR gRNA sequence
tcaaggcacgattcattatg

SEQ ID NO: 461056 - DNA, 20 bp, Artificial
  CRISPR gRNA sequence
atgatcatgtaaatcaaaac

SEQ ID NO: 461057 - DNA, 20 bp, Artificial
  CRISPR gRNA sequence
agttatctacttccaaaata

SEQ ID NO: 461058 - DNA, 20 bp, Artificial
  CRISPR gRNA sequence
tatctacttccaaaatatag

SEQ ID NO: 461059 - DNA, 20 bp, Artificial
  CRISPR gRNA sequence
ctacttccaaaatatagtgg

SEQ ID NO: 461060 - DNA, 20 bp, Artificial
  CRISPR gRNA sequence
tacttccaaaatatagtggt

SEQ ID NO: 461061 - DNA, 20 bp, Artificial
  CRISPR gRNA sequence
tccaaaatatagtggtagga

SEQ ID NO: 461062 - DNA, 20 bp, Artificial
  CRISPR gRNA sequence
tatagtggtaggacagatat

SEQ ID NO: 461063 - DNA, 20 bp, Artificial
  CRISPR gRNA sequence
gtggtaggacagatataaga

SEQ ID NO: 461064 - DNA, 20 bp, Artificial
  CRISPR gRNA sequence
gatagatattcccattccaa

SEQ ID NO: 461065 - DNA, 20 bp, Artificial
  CRISPR gRNA sequence
atagatattcccattccaaa

SEQ ID NO: 461066 - DNA, 20 bp, Artificial
  CRISPR gRNA sequence
tagatattcccattccaaaa

SEQ ID NO: 461067 - DNA, 20 bp, Artificial
  CRISPR gRNA sequence
gatattcccattccaaaagg

SEQ ID NO: 461068 - DNA, 20 bp, Artificial
  CRISPR gRNA sequence
cccattccaaaagggagaaa

SEQ ID NO: 461069 - DNA, 20 bp, Artificial
  CRISPR gRNA sequence
ccattccaaaagggagaaat

SEQ ID NO: 461070 - DNA, 20 bp, Artificial
  CRISPR gRNA sequence
agggagaaataggcaaaaat

SEQ ID NO: 461071 - DNA, 20 bp, Artificial
  CRISPR gRNA sequence
agaaataggcaaaaatgaga

SEQ ID NO: 461072 - DNA, 20 bp, Artificial
  CRISPR gRNA sequence
aggcaaaaatgagaaagtaa

SEQ ID NO: 461073 - DNA, 20 bp, Artificial
  CRISPR gRNA sequence
atgagaaagtaacagttcct

SEQ ID NO: 461074 - DNA, 20 bp, Artificial
  CRISPR gRNA sequence
gaaagtaacagttcctaagt

SEQ ID NO: 461075 - DNA, 20 bp, Artificial
  CRISPR gRNA sequence
taagtaagtccaaaacccaa

SEQ ID NO: 461076 - DNA, 20 bp, Artificial
  CRISPR gRNA sequence
agtaagtccaaaacccaaca

SEQ ID NO: 461077 - DNA, 20 bp, Artificial
  CRISPR gRNA sequence
aacccaacagagaaataaaa

SEQ ID NO: 461078 - DNA, 20 bp, Artificial
  CRISPR gRNA sequence
gagaaataaaatggcattgc

SEQ ID NO: 461079 - DNA, 20 bp, Artificial
  CRISPR gRNA sequence
agaaataaaatggcattgct

SEQ ID NO: 461080 - DNA, 20 bp, Artificial
  CRISPR gRNA sequence
taaaatggcattgctgggct

SEQ ID NO: 461081 - DNA, 20 bp, Artificial
  CRISPR gRNA sequence
gctgggcttggttgatgctt

SEQ ID NO: 461082 - DNA, 20 bp, Artificial
  CRISPR gRNA sequence
gttgatgcttcagcactcac

SEQ ID NO: 461083 - DNA, 20 bp, Artificial
  CRISPR gRNA sequence
atgcttcagcactcacaagt

SEQ ID NO: 461084 - DNA, 20 bp, Artificial
  CRISPR gRNA sequence
gcttcagcactcacaagttg

SEQ ID NO: 461085 - DNA, 20 bp, Artificial
  CRISPR gRNA sequence
aagttggagactcctacctg

SEQ ID NO: 461086 - DNA, 20 bp, Artificial
  CRISPR gRNA sequence
actcctacctgcagctctcc

SEQ ID NO: 461087 - DNA, 20 bp, Artificial
  CRISPR gRNA sequence
ctcctacctgcagctctccc

SEQ ID NO: 461088 - DNA, 20 bp, Artificial
  CRISPR gRNA sequence
gctctcccaggctaatgctt

SEQ ID NO: 461089 - DNA, 20 bp, Artificial
  CRISPR gRNA sequence
ctctcccaggctaatgcttc

SEQ ID NO: 461090 - DNA, 20 bp, Artificial
  CRISPR gRNA sequence
aggctaatgcttcaggctaa

SEQ ID NO: 461091 - DNA, 20 bp, Artificial
  CRISPR gRNA sequence
gcttcaggctaatagctcca

SEQ ID NO: 461092 - DNA, 20 bp, Artificial
  CRISPR gRNA sequence
ggctaatagctccacagttc

SEQ ID NO: 461093 - DNA, 20 bp, Artificial
  CRISPR gRNA sequence
gctaatagctccacagttct

SEQ ID NO: 461094 - DNA, 20 bp, Artificial
  CRISPR gRNA sequence
ctaatagctccacagttctg

SEQ ID NO: 461095 - DNA, 20 bp, Artificial
  CRISPR gRNA sequence
gctccacagttctggggtct

SEQ ID NO: 461096 - DNA, 20 bp, Artificial
  CRISPR gRNA sequence
ccacagttctggggtctcag

SEQ ID NO: 461097 - DNA, 20 bp, Artificial
  CRISPR gRNA sequence
cagttctggggtctcagtgg

SEQ ID NO: 461098 - DNA, 20 bp, Artificial
  CRISPR gRNA sequence
tcagtggcagtccactccca

SEQ ID NO: 461099 - DNA, 20 bp, Artificial
  CRISPR gRNA sequence
gtccactcccatggctctac

SEQ ID NO: 461100 - DNA, 20 bp, Artificial
  CRISPR gRNA sequence
tccactcccatggctctact

SEQ ID NO: 461101 - DNA, 20 bp, Artificial
  CRISPR gRNA sequence
ggctctactaggcactgaca

SEQ ID NO: 461102 - DNA, 20 bp, Artificial
  CRISPR gRNA sequence
gctctactaggcactgacat

SEQ ID NO: 461103 - DNA, 20 bp, Artificial
  CRISPR gRNA sequence
tctactaggcactgacatgg

SEQ ID NO: 461104 - DNA, 20 bp, Artificial
  CRISPR gRNA sequence
actaggcactgacatgggag

SEQ ID NO: 461105 - DNA, 20 bp, Artificial
  CRISPR gRNA sequence
acatgggagtggactcttcc

SEQ ID NO: 461106 - DNA, 20 bp, Artificial
  CRISPR gRNA sequence
catgggagtggactcttcct

SEQ ID NO: 461107 - DNA, 20 bp, Artificial
  CRISPR gRNA sequence
gtggactcttcctgggccct

SEQ ID NO: 461108 - DNA, 20 bp, Artificial
  CRISPR gRNA sequence
tggactcttcctgggccctc

SEQ ID NO: 461109 - DNA, 20 bp, Artificial
  CRISPR gRNA sequence
aacatcctttgaaatctaca

SEQ ID NO: 461110 - DNA, 20 bp, Artificial
  CRISPR gRNA sequence
catcctttgaaatctacatg

SEQ ID NO: 461111 - DNA, 20 bp, Artificial
  CRISPR gRNA sequence
atcctttgaaatctacatgg

SEQ ID NO: 461112 - DNA, 20 bp, Artificial
  CRISPR gRNA sequence
ctttgaaatctacatggagg

SEQ ID NO: 461113 - DNA, 20 bp, Artificial
  CRISPR gRNA sequence
ccacacctcttgcattctgc

SEQ ID NO: 461114 - DNA, 20 bp, Artificial
  CRISPR gRNA sequence
attctgctagcctgcacact

SEQ ID NO: 461115 - DNA, 20 bp, Artificial
  CRISPR gRNA sequence
tgctagcctgcacacttagc

SEQ ID NO: 461116 - DNA, 20 bp, Artificial
  CRISPR gRNA sequence
tagcctgcacacttagcaag

SEQ ID NO: 461117 - DNA, 20 bp, Artificial
  CRISPR gRNA sequence
agcctgcacacttagcaagt

SEQ ID NO: 461118 - DNA, 20 bp, Artificial
  CRISPR gRNA sequence
cttagcaagtgggtgccacc

SEQ ID NO: 461119 - DNA, 20 bp, Artificial
  CRISPR gRNA sequence
ttagcaagtgggtgccacca

SEQ ID NO: 461120 - DNA, 20 bp, Artificial
  CRISPR gRNA sequence
ggcttaccaattgcacctta

SEQ ID NO: 461121 - DNA, 20 bp, Artificial
  CRISPR gRNA sequence
cttaccaattgcaccttatg

SEQ ID NO: 461122 - DNA, 20 bp, Artificial
  CRISPR gRNA sequence
accaattgcaccttatggag

SEQ ID NO: 461123 - DNA, 20 bp, Artificial
  CRISPR gRNA sequence
aattgcaccttatggagtgg

SEQ ID NO: 461124 - DNA, 20 bp, Artificial
  CRISPR gRNA sequence
attgcaccttatggagtggt

SEQ ID NO: 461125 - DNA, 20 bp, Artificial
  CRISPR gRNA sequence
gtggtgggttgaactgcacc

SEQ ID NO: 461126 - DNA, 20 bp, Artificial
  CRISPR gRNA sequence
tggtgggttgaactgcacct

SEQ ID NO: 461127 - DNA, 20 bp, Artificial
  CRISPR gRNA sequence
aactgcacctgggctcactt

SEQ ID NO: 461128 - DNA, 20 bp, Artificial
  CRISPR gRNA sequence
acctgggctcacttgagcca

SEQ ID NO: 461129 - DNA, 20 bp, Artificial
  CRISPR gRNA sequence
gggctcacttgagccatggc

SEQ ID NO: 461130 - DNA, 20 bp, Artificial
  CRISPR gRNA sequence
gctcacttgagccatggctg

SEQ ID NO: 461131 - DNA, 20 bp, Artificial
  CRISPR gRNA sequence
cacttgagccatggctggag

SEQ ID NO: 461132 - DNA, 20 bp, Artificial
  CRISPR gRNA sequence
gagccatggctggagcagct

SEQ ID NO: 461133 - DNA, 20 bp, Artificial
  CRISPR gRNA sequence
agccatggctggagcagcta

SEQ ID NO: 461134 - DNA, 20 bp, Artificial
  CRISPR gRNA sequence
ccatggctggagcagctaag

SEQ ID NO: 461135 - DNA, 20 bp, Artificial
  CRISPR gRNA sequence
gcagctaaggagcactgtgc

SEQ ID NO: 461136 - DNA, 20 bp, Artificial
  CRISPR gRNA sequence
aggagcactgtgctggaatt

SEQ ID NO: 461137 - DNA, 20 bp, Artificial
  CRISPR gRNA sequence
gagcactgtgctggaattca

SEQ ID NO: 461138 - DNA, 20 bp, Artificial
  CRISPR gRNA sequence
ctgtgctggaattcagagaa

SEQ ID NO: 461139 - DNA, 20 bp, Artificial
  CRISPR gRNA sequence
aattcagagaacagaaacct

SEQ ID NO: 461140 - DNA, 20 bp, Artificial
  CRISPR gRNA sequence
attcagagaacagaaacctg

SEQ ID NO: 461141 - DNA, 20 bp, Artificial
  CRISPR gRNA sequence
cagagaacagaaacctgagg

SEQ ID NO: 461142 - DNA, 20 bp, Artificial
  CRISPR gRNA sequence
acagaaacctgaggcagatc

SEQ ID NO: 461143 - DNA, 20 bp, Artificial
  CRISPR gRNA sequence
cagaaacctgaggcagatct

SEQ ID NO: 461144 - DNA, 20 bp, Artificial
  CRISPR gRNA sequence
aaacctgaggcagatctggg

SEQ ID NO: 461145 - DNA, 20 bp, Artificial
  CRISPR gRNA sequence
ctgaggcagatctgggcagc

SEQ ID NO: 461146 - DNA, 20 bp, Artificial
  CRISPR gRNA sequence
atctgggcagcaagcctgta

SEQ ID NO: 461147 - DNA, 20 bp, Artificial
  CRISPR gRNA sequence
tctgggcagcaagcctgtaa

SEQ ID NO: 461148 - DNA, 20 bp, Artificial
  CRISPR gRNA sequence
ctgggcagcaagcctgtaaa

SEQ ID NO: 461149 - DNA, 20 bp, Artificial
  CRISPR gRNA sequence
caagcctgtaaagggcattc

SEQ ID NO: 461150 - DNA, 20 bp, Artificial
  CRISPR gRNA sequence
ctgaaatcaatttgccctct

SEQ ID NO: 461151 - DNA, 20 bp, Artificial
  CRISPR gRNA sequence
caatttgccctctgagctct

SEQ ID NO: 461152 - DNA, 20 bp, Artificial
  CRISPR gRNA sequence
tctgagctctgagcctatga

SEQ ID NO: 461153 - DNA, 20 bp, Artificial
  CRISPR gRNA sequence
ctgagctctgagcctatgat

SEQ ID NO: 461154 - DNA, 20 bp, Artificial
  CRISPR gRNA sequence
gagctctgagcctatgatgg

SEQ ID NO: 461155 - DNA, 20 bp, Artificial
  CRISPR gRNA sequence
agctctgagcctatgatggg

SEQ ID NO: 461156 - DNA, 20 bp, Artificial
  CRISPR gRNA sequence
gctctgagcctatgatggga

SEQ ID NO: 461157 - DNA, 20 bp, Artificial
  CRISPR gRNA sequence
ctctgagcctatgatgggag

SEQ ID NO: 461158 - DNA, 20 bp, Artificial
  CRISPR gRNA sequence
tgagcctatgatgggagggg

SEQ ID NO: 461159 - DNA, 20 bp, Artificial
  CRISPR gRNA sequence
tgatgggaggggcagcctca

SEQ ID NO: 461160 - DNA, 20 bp, Artificial
  CRISPR gRNA sequence
gatgggaggggcagcctcaa

SEQ ID NO: 461161 - DNA, 20 bp, Artificial
  CRISPR gRNA sequence
caaaggctttgaaatgcctt

SEQ ID NO: 461162 - DNA, 20 bp, Artificial
  CRISPR gRNA sequence
aaaggctttgaaatgccttc

SEQ ID NO: 461163 - DNA, 20 bp, Artificial
  CRISPR gRNA sequence
aaggctttgaaatgccttca

SEQ ID NO: 461164 - DNA, 20 bp, Artificial
  CRISPR gRNA sequence
ctttttctcaacttcttgaa

SEQ ID NO: 461165 - DNA, 20 bp, Artificial
  CRISPR gRNA sequence
catattaatctctttaacaa

SEQ ID NO: 461166 - DNA, 20 bp, Artificial
  CRISPR gRNA sequence
atctctttaacaatggtcac

SEQ ID NO: 461167 - DNA, 20 bp, Artificial
  CRISPR gRNA sequence
tctctttaacaatggtcact

SEQ ID NO: 461168 - DNA, 20 bp, Artificial
  CRISPR gRNA sequence
tggtcactaggccacaccct

SEQ ID NO: 461169 - DNA, 20 bp, Artificial
  CRISPR gRNA sequence
atgccttttcactttttata

SEQ ID NO: 461170 - DNA, 20 bp, Artificial
  CRISPR gRNA sequence
cttttcactttttatatggc

SEQ ID NO: 461171 - DNA, 20 bp, Artificial
  CRISPR gRNA sequence
ttttcactttttatatggct

SEQ ID NO: 461172 - DNA, 20 bp, Artificial
  CRISPR gRNA sequence
tcactttttatatggctagg

SEQ ID NO: 461173 - DNA, 20 bp, Artificial
  CRISPR gRNA sequence
taattataaattccattttt

SEQ ID NO: 461174 - DNA, 20 bp, Artificial
  CRISPR gRNA sequence
ctcctgcctcttactgtatg

SEQ ID NO: 461175 - DNA, 20 bp, Artificial
  CRISPR gRNA sequence
ctcttactgtatgcagttaa

SEQ ID NO: 461176 - DNA, 20 bp, Artificial
  CRISPR gRNA sequence
ttactgtatgcagttaaaag

SEQ ID NO: 461177 - DNA, 20 bp, Artificial
  CRISPR gRNA sequence
tgcagttaaaagtagccaca

SEQ ID NO: 461178 - DNA, 20 bp, Artificial
  CRISPR gRNA sequence
agttaaaagtagccacacag

SEQ ID NO: 461179 - DNA, 20 bp, Artificial
  CRISPR gRNA sequence
acagcagcctaaatgctttg

SEQ ID NO: 461180 - DNA, 20 bp, Artificial
  CRISPR gRNA sequence
agcctaaatgctttgcggct

SEQ ID NO: 461181 - DNA, 20 bp, Artificial
  CRISPR gRNA sequence
ggcttagatatttcttccac

SEQ ID NO: 461182 - DNA, 20 bp, Artificial
  CRISPR gRNA sequence
cttaatttctgctttccgta

SEQ ID NO: 461183 - DNA, 20 bp, Artificial
  CRISPR gRNA sequence
tctgctttccgtaaagtcct

SEQ ID NO: 461184 - DNA, 20 bp, Artificial
  CRISPR gRNA sequence
ttccgtaaagtcctaagaca

SEQ ID NO: 461185 - DNA, 20 bp, Artificial
  CRISPR gRNA sequence
gacatagatacatttccacc

SEQ ID NO: 461186 - DNA, 20 bp, Artificial
  CRISPR gRNA sequence
atacatttccaccaagttct

SEQ ID NO: 461187 - DNA, 20 bp, Artificial
  CRISPR gRNA sequence
gttcttagcaactgtatgac

SEQ ID NO: 461188 - DNA, 20 bp, Artificial
  CRISPR gRNA sequence
tagcaactgtatgacaagaa

SEQ ID NO: 461189 - DNA, 20 bp, Artificial
  CRISPR gRNA sequence
gacaagaatggcctttactc

SEQ ID NO: 461190 - DNA, 20 bp, Artificial
  CRISPR gRNA sequence
gcctttactccagtttccaa

SEQ ID NO: 461191 - DNA, 20 bp, Artificial
  CRISPR gRNA sequence
gcttgtttctcatttccttt

SEQ ID NO: 461192 - DNA, 20 bp, Artificial
  CRISPR gRNA sequence
tttccttttagttatgcact

SEQ ID NO: 461193 - DNA, 20 bp, Artificial
  CRISPR gRNA sequence
atttgtatttttttattttc

SEQ ID NO: 461194 - DNA, 20 bp, Artificial
  CRISPR gRNA sequence
tatttttttattttccagta

SEQ ID NO: 461195 - DNA, 20 bp, Artificial
  CRISPR gRNA sequence
ttttattttccagtaaagtt

SEQ ID NO: 461196 - DNA, 20 bp, Artificial
  CRISPR gRNA sequence
tttattttccagtaaagtta

SEQ ID NO: 461197 - DNA, 20 bp, Artificial
  CRISPR gRNA sequence
tttccagtaaagttaaggct

SEQ ID NO: 461198 - DNA, 20 bp, Artificial
  CRISPR gRNA sequence
ggctaagcacgtgatcctaa

SEQ ID NO: 461199 - DNA, 20 bp, Artificial
  CRISPR gRNA sequence
tatttttttctccactctta

SEQ ID NO: 461200 - DNA, 20 bp, Artificial
  CRISPR gRNA sequence
ccactcttacagttctttct

SEQ ID NO: 461201 - DNA, 20 bp, Artificial
  CRISPR gRNA sequence
ttttgaactaccgtctctct

SEQ ID NO: 461202 - DNA, 20 bp, Artificial
  CRISPR gRNA sequence
ccgtctctcttagcaatgtc

SEQ ID NO: 461203 - DNA, 20 bp, Artificial
  CRISPR gRNA sequence
ttttcatgcattcttctgaa

SEQ ID NO: 461204 - DNA, 20 bp, Artificial
  CRISPR gRNA sequence
cattcttctgaatagatgta

SEQ ID NO: 461205 - DNA, 20 bp, Artificial
  CRISPR gRNA sequence
agatgtacagtatcatacat

SEQ ID NO: 461206 - DNA, 20 bp, Artificial
  CRISPR gRNA sequence
atcatacattagaatgacat

SEQ ID NO: 461207 - DNA, 20 bp, Artificial
  CRISPR gRNA sequence
ttagaatgacataagtgtaa

SEQ ID NO: 461208 - DNA, 20 bp, Artificial
  CRISPR gRNA sequence
agaatgacataagtgtaaca

SEQ ID NO: 461209 - DNA, 20 bp, Artificial
  CRISPR gRNA sequence
cataagtgtaacagagatga

SEQ ID NO: 461210 - DNA, 20 bp, Artificial
  CRISPR gRNA sequence
aaaactctcttttaaataca

SEQ ID NO: 461211 - DNA, 20 bp, Artificial
  CRISPR gRNA sequence
ctctcttttaaatacaaaga

SEQ ID NO: 461212 - DNA, 20 bp, Artificial
  CRISPR gRNA sequence
tttaaatacaaagacagcta

SEQ ID NO: 461213 - DNA, 20 bp, Artificial
  CRISPR gRNA sequence
ttaaatacaaagacagctaa

SEQ ID NO: 461214 - DNA, 20 bp, Artificial
  CRISPR gRNA sequence
aggccttgcctgtgatcaca

SEQ ID NO: 461215 - DNA, 20 bp, Artificial
  CRISPR gRNA sequence
cctgtgatcacacagcttgt

SEQ ID NO: 461216 - DNA, 20 bp, Artificial
  CRISPR gRNA sequence
agcttgtcagatgttgaacc

SEQ ID NO: 461217 - DNA, 20 bp, Artificial
  CRISPR gRNA sequence
gcttgtcagatgttgaacca

SEQ ID NO: 461218 - DNA, 20 bp, Artificial
  CRISPR gRNA sequence
ttgtcagatgttgaaccaag

SEQ ID NO: 461219 - DNA, 20 bp, Artificial
  CRISPR gRNA sequence
aaggagcaaattttgaccct

SEQ ID NO: 461220 - DNA, 20 bp, Artificial
  CRISPR gRNA sequence
gtttctcatacatgtctatc

SEQ ID NO: 461221 - DNA, 20 bp, Artificial
  CRISPR gRNA sequence
catacatgtctatccagaac

SEQ ID NO: 461222 - DNA, 20 bp, Artificial
  CRISPR gRNA sequence
atacatgtctatccagaaca

SEQ ID NO: 461223 - DNA, 20 bp, Artificial
  CRISPR gRNA sequence
ccttatttctacacccttgc

SEQ ID NO: 461224 - DNA, 20 bp, Artificial
  CRISPR gRNA sequence
acatctcatgaatctctgct

SEQ ID NO: 461225 - DNA, 20 bp, Artificial
  CRISPR gRNA sequence
tgaatctctgctcagaataa

SEQ ID NO: 461226 - DNA, 20 bp, Artificial
  CRISPR gRNA sequence
agaataatagaaacctgatt

SEQ ID NO: 461227 - DNA, 20 bp, Artificial
  CRISPR gRNA sequence
tagaaacctgattgagtttc

SEQ ID NO: 461228 - DNA, 20 bp, Artificial
  CRISPR gRNA sequence
agaaacctgattgagtttcc

SEQ ID NO: 461229 - DNA, 20 bp, Artificial
  CRISPR gRNA sequence
ctgattgagtttccaggaat

SEQ ID NO: 461230 - DNA, 20 bp, Artificial
  CRISPR gRNA sequence
gattgagtttccaggaatca

SEQ ID NO: 461231 - DNA, 20 bp, Artificial
  CRISPR gRNA sequence
gagtttccaggaatcagagt

SEQ ID NO: 461232 - DNA, 20 bp, Artificial
  CRISPR gRNA sequence
ccaggaatcagagtgagaaa

SEQ ID NO: 461233 - DNA, 20 bp, Artificial
  CRISPR gRNA sequence
caggaatcagagtgagaaaa

SEQ ID NO: 461234 - DNA, 20 bp, Artificial
  CRISPR gRNA sequence
agagtgagaaaaaggacctg

SEQ ID NO: 461235 - DNA, 20 bp, Artificial
  CRISPR gRNA sequence
aaggacctgcagacaacttt

SEQ ID NO: 461236 - DNA, 20 bp, Artificial
  CRISPR gRNA sequence
tatttatttataattgcttt

SEQ ID NO: 461237 - DNA, 20 bp, Artificial
  CRISPR gRNA sequence
tataattgctttgagacctc

SEQ ID NO: 461238 - DNA, 20 bp, Artificial
  CRISPR gRNA sequence
attgctttgagacctcaagc

SEQ ID NO: 461239 - DNA, 20 bp, Artificial
  CRISPR gRNA sequence
acctcaagcaagttcacttt

SEQ ID NO: 461240 - DNA, 20 bp, Artificial
  CRISPR gRNA sequence
cactttaagacttcttaatt

SEQ ID NO: 461241 - DNA, 20 bp, Artificial
  CRISPR gRNA sequence
cttaattcagttgcttccaa

SEQ ID NO: 461242 - DNA, 20 bp, Artificial
  CRISPR gRNA sequence
ttcagttgcttccaaaagtt

SEQ ID NO: 461243 - DNA, 20 bp, Artificial
  CRISPR gRNA sequence
ctaaaatgaaaccaaactga

SEQ ID NO: 461244 - DNA, 20 bp, Artificial
  CRISPR gRNA sequence
taaaatgaaaccaaactgaa

SEQ ID NO: 461245 - DNA, 20 bp, Artificial
  CRISPR gRNA sequence
atgaaaccaaactgaaaggt

SEQ ID NO: 461246 - DNA, 20 bp, Artificial
  CRISPR gRNA sequence
caaactgaaaggtaagttat

SEQ ID NO: 461247 - DNA, 20 bp, Artificial
  CRISPR gRNA sequence
aaactgaaaggtaagttata

SEQ ID NO: 461248 - DNA, 20 bp, Artificial
  CRISPR gRNA sequence
gaaaggtaagttataaggat

SEQ ID NO: 461249 - DNA, 20 bp, Artificial
  CRISPR gRNA sequence
aaaggtaagttataaggatg

SEQ ID NO: 461250 - DNA, 20 bp, Artificial
  CRISPR gRNA sequence
atgaggttttcaaaaaaatg

SEQ ID NO: 461251 - DNA, 20 bp, Artificial
  CRISPR gRNA sequence
gaggttttcaaaaaaatgaa

SEQ ID NO: 461252 - DNA, 20 bp, Artificial
  CRISPR gRNA sequence
ttttcaaaaaaatgaagaga

SEQ ID NO: 461253 - DNA, 20 bp, Artificial
  CRISPR gRNA sequence
tttcaaaaaaatgaagagaa

SEQ ID NO: 461254 - DNA, 20 bp, Artificial
  CRISPR gRNA sequence
ttcaaaaaaatgaagagaaa

SEQ ID NO: 461255 - DNA, 20 bp, Artificial
  CRISPR gRNA sequence
agggtaaaatattttaccaa

SEQ ID NO: 461256 - DNA, 20 bp, Artificial
  CRISPR gRNA sequence
gggtaaaatattttaccaaa

SEQ ID NO: 461257 - DNA, 20 bp, Artificial
  CRISPR gRNA sequence
taaaatattttaccaaaagg

SEQ ID NO: 461258 - DNA, 20 bp, Artificial
  CRISPR gRNA sequence
aaaggaagtgtacctgaatg

SEQ ID NO: 461259 - DNA, 20 bp, Artificial
  CRISPR gRNA sequence
gaagtgtacctgaatgtggt

SEQ ID NO: 461260 - DNA, 20 bp, Artificial
  CRISPR gRNA sequence
tacctgaatgtggttagact

SEQ ID NO: 461261 - DNA, 20 bp, Artificial
  CRISPR gRNA sequence
acctgaatgtggttagactt

SEQ ID NO: 461262 - DNA, 20 bp, Artificial
  CRISPR gRNA sequence
ggttagacttaggacaaaaa

SEQ ID NO: 461263 - DNA, 20 bp, Artificial
  CRISPR gRNA sequence
agacttaggacaaaaaaagt

SEQ ID NO: 461264 - DNA, 20 bp, Artificial
  CRISPR gRNA sequence
cttaggacaaaaaaagtaag

SEQ ID NO: 461265 - DNA, 20 bp, Artificial
  CRISPR gRNA sequence
ttaggacaaaaaaagtaaga

SEQ ID NO: 461266 - DNA, 20 bp, Artificial
  CRISPR gRNA sequence
gacaaaaaaagtaagaaggc

SEQ ID NO: 461267 - DNA, 20 bp, Artificial
  CRISPR gRNA sequence
caaaaaaagtaagaaggcca

SEQ ID NO: 461268 - DNA, 20 bp, Artificial
  CRISPR gRNA sequence
aaaaaaagtaagaaggccag

SEQ ID NO: 461269 - DNA, 20 bp, Artificial
  CRISPR gRNA sequence
aaaagtaagaaggccagagg

SEQ ID NO: 461270 - DNA, 20 bp, Artificial
  CRISPR gRNA sequence
gtaagaaggccagaggcaga

SEQ ID NO: 461271 - DNA, 20 bp, Artificial
  CRISPR gRNA sequence
taagaaggccagaggcagaa

SEQ ID NO: 461272 - DNA, 20 bp, Artificial
  CRISPR gRNA sequence
aggccagaggcagaaaggtc

SEQ ID NO: 461273 - DNA, 20 bp, Artificial
  CRISPR gRNA sequence
tcaagtgaaactcttgtttc

SEQ ID NO: 461274 - DNA, 20 bp, Artificial
  CRISPR gRNA sequence
agtgaaactcttgtttccag

SEQ ID NO: 461275 - DNA, 20 bp, Artificial
  CRISPR gRNA sequence
gaagtccgttcctctccctg

SEQ ID NO: 461276 - DNA, 20 bp, Artificial
  CRISPR gRNA sequence
gttcctctccctgaagttaa

SEQ ID NO: 461277 - DNA, 20 bp, Artificial
  CRISPR gRNA sequence
ctgaagttaatagactccct

SEQ ID NO: 461278 - DNA, 20 bp, Artificial
  CRISPR gRNA sequence
aacttcccttttcattttct

SEQ ID NO: 461279 - DNA, 20 bp, Artificial
  CRISPR gRNA sequence
cccttttcattttcttggat

SEQ ID NO: 461280 - DNA, 20 bp, Artificial
  CRISPR gRNA sequence
tttcttggataagtcaataa

SEQ ID NO: 461281 - DNA, 20 bp, Artificial
  CRISPR gRNA sequence
gataagtcaataatggttta

SEQ ID NO: 461282 - DNA, 20 bp, Artificial
  CRISPR gRNA sequence
taagtcaataatggtttatg

SEQ ID NO: 461283 - DNA, 20 bp, Artificial
  CRISPR gRNA sequence
taatggtttatggagcctct

SEQ ID NO: 461284 - DNA, 20 bp, Artificial
  CRISPR gRNA sequence
tggagcctctaagtctgtgc

SEQ ID NO: 461285 - DNA, 20 bp, Artificial
  CRISPR gRNA sequence
ctagaattataaaaaacaat

SEQ ID NO: 461286 - DNA, 20 bp, Artificial
  CRISPR gRNA sequence
aattataaaaaacaatgaga

SEQ ID NO: 461287 - DNA, 20 bp, Artificial
  CRISPR gRNA sequence
aaaaaacaatgagatggtta

SEQ ID NO: 461288 - DNA, 20 bp, Artificial
  CRISPR gRNA sequence
caatgagatggttatagaca

SEQ ID NO: 461289 - DNA, 20 bp, Artificial
  CRISPR gRNA sequence
acaaagatcttttaccctca

SEQ ID NO: 461290 - DNA, 20 bp, Artificial
  CRISPR gRNA sequence
aaagatcttttaccctcaaa

SEQ ID NO: 461291 - DNA, 20 bp, Artificial
  CRISPR gRNA sequence
caaagagtttaccatttaat

SEQ ID NO: 461292 - DNA, 20 bp, Artificial
  CRISPR gRNA sequence
gagtttaccatttaattggt

SEQ ID NO: 461293 - DNA, 20 bp, Artificial
  CRISPR gRNA sequence
accatttaattggtaagccc

SEQ ID NO: 461294 - DNA, 20 bp, Artificial
  CRISPR gRNA sequence
ccatttaattggtaagcccc

SEQ ID NO: 461295 - DNA, 20 bp, Artificial
  CRISPR gRNA sequence
atttaattggtaagccccag

SEQ ID NO: 461296 - DNA, 20 bp, Artificial
  CRISPR gRNA sequence
agccccaggagtatctaaca

SEQ ID NO: 461297 - DNA, 20 bp, Artificial
  CRISPR gRNA sequence
ccccaggagtatctaacaaa

SEQ ID NO: 461298 - DNA, 20 bp, Artificial
  CRISPR gRNA sequence
cccaggagtatctaacaaag

SEQ ID NO: 461299 - DNA, 20 bp, Artificial
  CRISPR gRNA sequence
ccaggagtatctaacaaaga

SEQ ID NO: 461300 - DNA, 20 bp, Artificial
  CRISPR gRNA sequence
tttttttttttttttttttt

SEQ ID NO: 461301 - DNA, 20 bp, Artificial
  CRISPR gRNA sequence
tttttttttttttttgagac

SEQ ID NO: 461302 - DNA, 20 bp, Artificial
  CRISPR gRNA sequence
tttttttttttttgagacaa

SEQ ID NO: 461303 - DNA, 20 bp, Artificial
  CRISPR gRNA sequence
agagtttcactcttgttgca

SEQ ID NO: 461304 - DNA, 20 bp, Artificial
  CRISPR gRNA sequence
gagtttcactcttgttgcac

SEQ ID NO: 461305 - DNA, 20 bp, Artificial
  CRISPR gRNA sequence
ttcactcttgttgcacaggc

SEQ ID NO: 461306 - DNA, 20 bp, Artificial
  CRISPR gRNA sequence
ttgcacaggctggaatgcaa

SEQ ID NO: 461307 - DNA, 20 bp, Artificial
  CRISPR gRNA sequence
ggaatgcaatggcatgatct

SEQ ID NO: 461308 - DNA, 20 bp, Artificial
  CRISPR gRNA sequence
tcaccgtaacctctgcctcc

SEQ ID NO: 461309 - DNA, 20 bp, Artificial
  CRISPR gRNA sequence
caccgtaacctctgcctccc

SEQ ID NO: 461310 - DNA, 20 bp, Artificial
  CRISPR gRNA sequence
aacctctgcctcccgggttt

SEQ ID NO: 461311 - DNA, 20 bp, Artificial
  CRISPR gRNA sequence
tttaagcgattctcctgcct

SEQ ID NO: 461312 - DNA, 20 bp, Artificial
  CRISPR gRNA sequence
attctcctgcctcagcctcc

SEQ ID NO: 461313 - DNA, 20 bp, Artificial
  CRISPR gRNA sequence
ttctcctgcctcagcctccc

SEQ ID NO: 461314 - DNA, 20 bp, Artificial
  CRISPR gRNA sequence
gcctcagcctcccgggtaac

SEQ ID NO: 461315 - DNA, 20 bp, Artificial
  CRISPR gRNA sequence
cctcagcctcccgggtaact

SEQ ID NO: 461316 - DNA, 20 bp, Artificial
  CRISPR gRNA sequence
ctcccgggtaactgggatta

SEQ ID NO: 461317 - DNA, 20 bp, Artificial
  CRISPR gRNA sequence
tcccgggtaactgggattac

SEQ ID NO: 461318 - DNA, 20 bp, Artificial
  CRISPR gRNA sequence
caggcgcccaccaccacgcc

SEQ ID NO: 461319 - DNA, 20 bp, Artificial
  CRISPR gRNA sequence
cccagctgattttgtatttt

SEQ ID NO: 461320 - DNA, 20 bp, Artificial
  CRISPR gRNA sequence
ctgattttgtatttttagta

SEQ ID NO: 461321 - DNA, 20 bp, Artificial
  CRISPR gRNA sequence
ttttgtatttttagtaaaga

SEQ ID NO: 461322 - DNA, 20 bp, Artificial
  CRISPR gRNA sequence
tttgtatttttagtaaagac

SEQ ID NO: 461323 - DNA, 20 bp, Artificial
  CRISPR gRNA sequence
aagacgggatttctttatgt

SEQ ID NO: 461324 - DNA, 20 bp, Artificial
  CRISPR gRNA sequence
cgggatttctttatgttggt

SEQ ID NO: 461325 - DNA, 20 bp, Artificial
  CRISPR gRNA sequence
gggatttctttatgttggtc

SEQ ID NO: 461326 - DNA, 20 bp, Artificial
  CRISPR gRNA sequence
tttctttatgttggtcaggc

SEQ ID NO: 461327 - DNA, 20 bp, Artificial
  CRISPR gRNA sequence
tggtcttgaactcccaacct

SEQ ID NO: 461328 - DNA, 20 bp, Artificial
  CRISPR gRNA sequence
ggtcttgaactcccaacctg

SEQ ID NO: 461329 - DNA, 20 bp, Artificial
  CRISPR gRNA sequence
aactcccaacctgaggtgat

SEQ ID NO: 461330 - DNA, 20 bp, Artificial
  CRISPR gRNA sequence
ctgaggtgatcagctcatct

SEQ ID NO: 461331 - DNA, 20 bp, Artificial
  CRISPR gRNA sequence
cagctcatctcggcctccca

SEQ ID NO: 461332 - DNA, 20 bp, Artificial
  CRISPR gRNA sequence
atctcggcctcccaaagtgc

SEQ ID NO: 461333 - DNA, 20 bp, Artificial
  CRISPR gRNA sequence
tctcggcctcccaaagtgct

SEQ ID NO: 461334 - DNA, 20 bp, Artificial
  CRISPR gRNA sequence
ctcccaaagtgctgggatta

SEQ ID NO: 461335 - DNA, 20 bp, Artificial
  CRISPR gRNA sequence
tcccaaagtgctgggattac

SEQ ID NO: 461336 - DNA, 20 bp, Artificial
  CRISPR gRNA sequence
agtgctgggattacaggctt

SEQ ID NO: 461337 - DNA, 20 bp, Artificial
  CRISPR gRNA sequence
caggcttgagccaccacacc

SEQ ID NO: 461338 - DNA, 20 bp, Artificial
  CRISPR gRNA sequence
cttgagccaccacacctggc

SEQ ID NO: 461339 - DNA, 20 bp, Artificial
  CRISPR gRNA sequence
gccagaatcaatttaccttc

SEQ ID NO: 461340 - DNA, 20 bp, Artificial
  CRISPR gRNA sequence
ttaccttctagacacttttc

SEQ ID NO: 461341 - DNA, 20 bp, Artificial
  CRISPR gRNA sequence
agaatcaatttactatatac

SEQ ID NO: 461342 - DNA, 20 bp, Artificial
  CRISPR gRNA sequence
ataccagtctttatttcttt

SEQ ID NO: 461343 - DNA, 20 bp, Artificial
  CRISPR gRNA sequence
tttatttctttcagtttact

SEQ ID NO: 461344 - DNA, 20 bp, Artificial
  CRISPR gRNA sequence
ctttcagtttactgagctga

SEQ ID NO: 461345 - DNA, 20 bp, Artificial
  CRISPR gRNA sequence
cagtttactgagctgaaagc

SEQ ID NO: 461346 - DNA, 20 bp, Artificial
  CRISPR gRNA sequence
ctgagctgaaagcaagcctt

SEQ ID NO: 461347 - DNA, 20 bp, Artificial
  CRISPR gRNA sequence
tgagctgaaagcaagccttg

SEQ ID NO: 461348 - DNA, 20 bp, Artificial
  CRISPR gRNA sequence
gagctgaaagcaagccttga

SEQ ID NO: 461349 - DNA, 20 bp, Artificial
  CRISPR gRNA sequence
ccttgagggacgttgcatgc

SEQ ID NO: 461350 - DNA, 20 bp, Artificial
  CRISPR gRNA sequence
ggacgttgcatgctggttgt

SEQ ID NO: 461351 - DNA, 20 bp, Artificial
  CRISPR gRNA sequence
gacgttgcatgctggttgtt

SEQ ID NO: 461352 - DNA, 20 bp, Artificial
  CRISPR gRNA sequence
gttgcatgctggttgttagg

SEQ ID NO: 461353 - DNA, 20 bp, Artificial
  CRISPR gRNA sequence
atgctggttgttaggaagcc

SEQ ID NO: 461354 - DNA, 20 bp, Artificial
  CRISPR gRNA sequence
tgctggttgttaggaagcct

SEQ ID NO: 461355 - DNA, 20 bp, Artificial
  CRISPR gRNA sequence
taggaagcctaggaataaat

SEQ ID NO: 461356 - DNA, 20 bp, Artificial
  CRISPR gRNA sequence
aagcctaggaataaatcaga

SEQ ID NO: 461357 - DNA, 20 bp, Artificial
  CRISPR gRNA sequence
agcctaggaataaatcagat

SEQ ID NO: 461358 - DNA, 20 bp, Artificial
  CRISPR gRNA sequence
agataggatgtctgcatttg

SEQ ID NO: 461359 - DNA, 20 bp, Artificial
  CRISPR gRNA sequence
ataggatgtctgcatttgtg

SEQ ID NO: 461360 - DNA, 20 bp, Artificial
  CRISPR gRNA sequence
ttgtggagcttgccttctaa

SEQ ID NO: 461361 - DNA, 20 bp, Artificial
  CRISPR gRNA sequence
tgtggagcttgccttctaat

SEQ ID NO: 461362 - DNA, 20 bp, Artificial
  CRISPR gRNA sequence
taatgggaaataaaaatgaa

SEQ ID NO: 461363 - DNA, 20 bp, Artificial
  CRISPR gRNA sequence
aaataaaaatgaatggcaat

SEQ ID NO: 461364 - DNA, 20 bp, Artificial
  CRISPR gRNA sequence
aataaaaatgaatggcaatt

SEQ ID NO: 461365 - DNA, 20 bp, Artificial
  CRISPR gRNA sequence
taaaaatgaatggcaattgg

SEQ ID NO: 461366 - DNA, 20 bp, Artificial
  CRISPR gRNA sequence
aaaatgaatggcaattggga

SEQ ID NO: 461367 - DNA, 20 bp, Artificial
  CRISPR gRNA sequence
gagtgttatataacactgta

SEQ ID NO: 461368 - DNA, 20 bp, Artificial
  CRISPR gRNA sequence
gtgttatataacactgtaaa

SEQ ID NO: 461369 - DNA, 20 bp, Artificial
  CRISPR gRNA sequence
tgttatataacactgtaaag

SEQ ID NO: 461370 - DNA, 20 bp, Artificial
  CRISPR gRNA sequence
cactgtaaagaggtacaaac

SEQ ID NO: 461371 - DNA, 20 bp, Artificial
  CRISPR gRNA sequence
actgtaaagaggtacaaaca

SEQ ID NO: 461372 - DNA, 20 bp, Artificial
  CRISPR gRNA sequence
taaagaggtacaaacaaggc

SEQ ID NO: 461373 - DNA, 20 bp, Artificial
  CRISPR gRNA sequence
aaagaggtacaaacaaggcc

SEQ ID NO: 461374 - DNA, 20 bp, Artificial
  CRISPR gRNA sequence
ggtacaaacaaggccgggca

SEQ ID NO: 461375 - DNA, 20 bp, Artificial
  CRISPR gRNA sequence
acaaacaaggccgggcatgg

SEQ ID NO: 461376 - DNA, 20 bp, Artificial
  CRISPR gRNA sequence
gtggctcacgcctgtaatcc

SEQ ID NO: 461377 - DNA, 20 bp, Artificial
  CRISPR gRNA sequence
cgcctgtaatcccagcactt

SEQ ID NO: 461378 - DNA, 20 bp, Artificial
  CRISPR gRNA sequence
gcctgtaatcccagcacttt

SEQ ID NO: 461379 - DNA, 20 bp, Artificial
  CRISPR gRNA sequence
ctgtaatcccagcactttgg

SEQ ID NO: 461380 - DNA, 20 bp, Artificial
  CRISPR gRNA sequence
tgtaatcccagcactttggg

SEQ ID NO: 461381 - DNA, 20 bp, Artificial
  CRISPR gRNA sequence
tcccagcactttgggaggcc

SEQ ID NO: 461382 - DNA, 20 bp, Artificial
  CRISPR gRNA sequence
cccagcactttgggaggccg

SEQ ID NO: 461383 - DNA, 20 bp, Artificial
  CRISPR gRNA sequence
ccagcactttgggaggccga

SEQ ID NO: 461384 - DNA, 20 bp, Artificial
  CRISPR gRNA sequence
agcactttgggaggccgagg

SEQ ID NO: 461385 - DNA, 20 bp, Artificial
  CRISPR gRNA sequence
gcactttgggaggccgaggg

SEQ ID NO: 461386 - DNA, 20 bp, Artificial
  CRISPR gRNA sequence
ctttgggaggccgagggagg

SEQ ID NO: 461387 - DNA, 20 bp, Artificial
  CRISPR gRNA sequence
ccgagggaggtggatcacct

SEQ ID NO: 461388 - DNA, 20 bp, Artificial
  CRISPR gRNA sequence
cgagggaggtggatcacctg

SEQ ID NO: 461389 - DNA, 20 bp, Artificial
  CRISPR gRNA sequence
ggaggtggatcacctgaggt

SEQ ID NO: 461390 - DNA, 20 bp, Artificial
  CRISPR gRNA sequence
gaggtggatcacctgaggtc

SEQ ID NO: 461391 - DNA, 20 bp, Artificial
  CRISPR gRNA sequence
ggtggatcacctgaggtcag

SEQ ID NO: 461392 - DNA, 20 bp, Artificial
  CRISPR gRNA sequence
tcacctgaggtcaggagttt

SEQ ID NO: 461393 - DNA, 20 bp, Artificial
  CRISPR gRNA sequence
tgaggtcaggagtttaagac

SEQ ID NO: 461394 - DNA, 20 bp, Artificial
  CRISPR gRNA sequence
taagaccagcctgaccaaca

SEQ ID NO: 461395 - DNA, 20 bp, Artificial
  CRISPR gRNA sequence
tttactaaaaatacaaaaat

SEQ ID NO: 461396 - DNA, 20 bp, Artificial
  CRISPR gRNA sequence
ctaaaaatacaaaaattagc

SEQ ID NO: 461397 - DNA, 20 bp, Artificial
  CRISPR gRNA sequence
taaaaatacaaaaattagcc

SEQ ID NO: 461398 - DNA, 20 bp, Artificial
  CRISPR gRNA sequence
atacaaaaattagccaggtg

SEQ ID NO: 461399 - DNA, 20 bp, Artificial
  CRISPR gRNA sequence
caaaaattagccaggtgtgg

SEQ ID NO: 461400 - DNA, 20 bp, Artificial
  CRISPR gRNA sequence
gtggtgcgtgcctgtaatcc

SEQ ID NO: 461401 - DNA, 20 bp, Artificial
  CRISPR gRNA sequence
gcctgtaatcccagctactc

SEQ ID NO: 461402 - DNA, 20 bp, Artificial
  CRISPR gRNA sequence
ctgtaatcccagctactcaa

SEQ ID NO: 461403 - DNA, 20 bp, Artificial
  CRISPR gRNA sequence
tgtaatcccagctactcaag

SEQ ID NO: 461404 - DNA, 20 bp, Artificial
  CRISPR gRNA sequence
tcccagctactcaagaggct

SEQ ID NO: 461405 - DNA, 20 bp, Artificial
  CRISPR gRNA sequence
cccagctactcaagaggctg

SEQ ID NO: 461406 - DNA, 20 bp, Artificial
  CRISPR gRNA sequence
agctactcaagaggctgagg

SEQ ID NO: 461407 - DNA, 20 bp, Artificial
  CRISPR gRNA sequence
gctactcaagaggctgaggc

SEQ ID NO: 461408 - DNA, 20 bp, Artificial
  CRISPR gRNA sequence
tactcaagaggctgaggcag

SEQ ID NO: 461409 - DNA, 20 bp, Artificial
  CRISPR gRNA sequence
gcaggagaattgcttgaacc

SEQ ID NO: 461410 - DNA, 20 bp, Artificial
  CRISPR gRNA sequence
caggagaattgcttgaaccc

SEQ ID NO: 461411 - DNA, 20 bp, Artificial
  CRISPR gRNA sequence
aattgcttgaacccaggaac

SEQ ID NO: 461412 - DNA, 20 bp, Artificial
  CRISPR gRNA sequence
ttgcttgaacccaggaactg

SEQ ID NO: 461413 - DNA, 20 bp, Artificial
  CRISPR gRNA sequence
tgcttgaacccaggaactgg

SEQ ID NO: 461414 - DNA, 20 bp, Artificial
  CRISPR gRNA sequence
aacccaggaactggaggttc

SEQ ID NO: 461415 - DNA, 20 bp, Artificial
  CRISPR gRNA sequence
caggaactggaggttccagt

SEQ ID NO: 461416 - DNA, 20 bp, Artificial
  CRISPR gRNA sequence
actggaggttccagtgagct

SEQ ID NO: 461417 - DNA, 20 bp, Artificial
  CRISPR gRNA sequence
gagatcatgccactgcactc

SEQ ID NO: 461418 - DNA, 20 bp, Artificial
  CRISPR gRNA sequence
catgccactgcactccagcc

SEQ ID NO: 461419 - DNA, 20 bp, Artificial
  CRISPR gRNA sequence
atgccactgcactccagcct

SEQ ID NO: 461420 - DNA, 20 bp, Artificial
  CRISPR gRNA sequence
gcactccagcctgggcaaca

SEQ ID NO: 461421 - DNA, 20 bp, Artificial
  CRISPR gRNA sequence
tccagcctgggcaacacagt

SEQ ID NO: 461422 - DNA, 20 bp, Artificial
  CRISPR gRNA sequence
ctgtctcaaaaaaaaaaaaa

SEQ ID NO: 461423 - DNA, 20 bp, Artificial
  CRISPR gRNA sequence
aagatacaaacaactttgca

SEQ ID NO: 461424 - DNA, 20 bp, Artificial
  CRISPR gRNA sequence
agatacaaacaactttgcat

SEQ ID NO: 461425 - DNA, 20 bp, Artificial
  CRISPR gRNA sequence
aacaactttgcatgggtctg

SEQ ID NO: 461426 - DNA, 20 bp, Artificial
  CRISPR gRNA sequence
aactttgcatgggtctgcag

SEQ ID NO: 461427 - DNA, 20 bp, Artificial
  CRISPR gRNA sequence
actttgcatgggtctgcaga

SEQ ID NO: 461428 - DNA, 20 bp, Artificial
  CRISPR gRNA sequence
ggtctgcagaaggttaactt

SEQ ID NO: 461429 - DNA, 20 bp, Artificial
  CRISPR gRNA sequence
tgcagaaggttaacttcagc

SEQ ID NO: 461430 - DNA, 20 bp, Artificial
  CRISPR gRNA sequence
gcagaaggttaacttcagcc

SEQ ID NO: 461431 - DNA, 20 bp, Artificial
  CRISPR gRNA sequence
cagaaggttaacttcagccg

SEQ ID NO: 461432 - DNA, 20 bp, Artificial
  CRISPR gRNA sequence
ggttaacttcagccggggca

SEQ ID NO: 461433 - DNA, 20 bp, Artificial
  CRISPR gRNA sequence
tcagccggggcaaagcttca

SEQ ID NO: 461434 - DNA, 20 bp, Artificial
  CRISPR gRNA sequence
ccggggcaaagcttcatgga

SEQ ID NO: 461435 - DNA, 20 bp, Artificial
  CRISPR gRNA sequence
cggggcaaagcttcatggaa

SEQ ID NO: 461436 - DNA, 20 bp, Artificial
  CRISPR gRNA sequence
ttcatggaaaggctatactt

SEQ ID NO: 461437 - DNA, 20 bp, Artificial
  CRISPR gRNA sequence
gctatacttgagctgaacct

SEQ ID NO: 461438 - DNA, 20 bp, Artificial
  CRISPR gRNA sequence
tgagctgaaccttggtgaat

SEQ ID NO: 461439 - DNA, 20 bp, Artificial
  CRISPR gRNA sequence
gctgaaccttggtgaatgag

SEQ ID NO: 461440 - DNA, 20 bp, Artificial
  CRISPR gRNA sequence
ttggtgaatgagtagccctt

SEQ ID NO: 461441 - DNA, 20 bp, Artificial
  CRISPR gRNA sequence
atgagtagccctttggcaat

SEQ ID NO: 461442 - DNA, 20 bp, Artificial
  CRISPR gRNA sequence
gagtagccctttggcaatca

SEQ ID NO: 461443 - DNA, 20 bp, Artificial
  CRISPR gRNA sequence
tagccctttggcaatcagag

SEQ ID NO: 461444 - DNA, 20 bp, Artificial
  CRISPR gRNA sequence
ttggcaatcagagcagtgca

SEQ ID NO: 461445 - DNA, 20 bp, Artificial
  CRISPR gRNA sequence
tggcaatcagagcagtgcat

SEQ ID NO: 461446 - DNA, 20 bp, Artificial
  CRISPR gRNA sequence
aatcagagcagtgcatggga

SEQ ID NO: 461447 - DNA, 20 bp, Artificial
  CRISPR gRNA sequence
tcagagcagtgcatgggaca

SEQ ID NO: 461448 - DNA, 20 bp, Artificial
  CRISPR gRNA sequence
cagagcagtgcatgggacag

SEQ ID NO: 461449 - DNA, 20 bp, Artificial
  CRISPR gRNA sequence
gagcagtgcatgggacagag

SEQ ID NO: 461450 - DNA, 20 bp, Artificial
  CRISPR gRNA sequence
agcagtgcatgggacagagg

SEQ ID NO: 461451 - DNA, 20 bp, Artificial
  CRISPR gRNA sequence
tgggacagaggaggtatttt

SEQ ID NO: 461452 - DNA, 20 bp, Artificial
  CRISPR gRNA sequence
ggacagaggaggtattttaa

SEQ ID NO: 461453 - DNA, 20 bp, Artificial
  CRISPR gRNA sequence
agaggaggtattttaagagt

SEQ ID NO: 461454 - DNA, 20 bp, Artificial
  CRISPR gRNA sequence
gaggaggtattttaagagtg

SEQ ID NO: 461455 - DNA, 20 bp, Artificial
  CRISPR gRNA sequence
gtattttaagagtgaggaaa

SEQ ID NO: 461456 - DNA, 20 bp, Artificial
  CRISPR gRNA sequence
ttaagagtgaggaaatggaa

SEQ ID NO: 461457 - DNA, 20 bp, Artificial
  CRISPR gRNA sequence
agtgaggaaatggaacggaa

SEQ ID NO: 461458 - DNA, 20 bp, Artificial
  CRISPR gRNA sequence
gaaatggaacggaaaagtct

SEQ ID NO: 461459 - DNA, 20 bp, Artificial
  CRISPR gRNA sequence
aaatggaacggaaaagtctt

SEQ ID NO: 461460 - DNA, 20 bp, Artificial
  CRISPR gRNA sequence
aatggaacggaaaagtctta

SEQ ID NO: 461461 - DNA, 20 bp, Artificial
  CRISPR gRNA sequence
aacggaaaagtcttagggac

SEQ ID NO: 461462 - DNA, 20 bp, Artificial
  CRISPR gRNA sequence
acggaaaagtcttagggacc

SEQ ID NO: 461463 - DNA, 20 bp, Artificial
  CRISPR gRNA sequence
agggaccaggaatctcatga

SEQ ID NO: 461464 - DNA, 20 bp, Artificial
  CRISPR gRNA sequence
caggaatctcatgatagatt

SEQ ID NO: 461465 - DNA, 20 bp, Artificial
  CRISPR gRNA sequence
ttagatcattgatacacaac

SEQ ID NO: 461466 - DNA, 20 bp, Artificial
  CRISPR gRNA sequence
attgatacacaactggatca

SEQ ID NO: 461467 - DNA, 20 bp, Artificial
  CRISPR gRNA sequence
tggatcatggttttctgact

SEQ ID NO: 461468 - DNA, 20 bp, Artificial
  CRISPR gRNA sequence
ggttttctgacttagtgata

SEQ ID NO: 461469 - DNA, 20 bp, Artificial
  CRISPR gRNA sequence
ttttctgacttagtgatatg

SEQ ID NO: 461470 - DNA, 20 bp, Artificial
  CRISPR gRNA sequence
cttagtgatatggagaccac

SEQ ID NO: 461471 - DNA, 20 bp, Artificial
  CRISPR gRNA sequence
atggagaccactggttgttt

SEQ ID NO: 461472 - DNA, 20 bp, Artificial
  CRISPR gRNA sequence
actggttgtttcagaacaaa

SEQ ID NO: 461473 - DNA, 20 bp, Artificial
  CRISPR gRNA sequence
tgtttcagaacaaatggaat

SEQ ID NO: 461474 - DNA, 20 bp, Artificial
  CRISPR gRNA sequence
agaacaaatggaataagcat

SEQ ID NO: 461475 - DNA, 20 bp, Artificial
  CRISPR gRNA sequence
gaacaaatggaataagcatt

SEQ ID NO: 461476 - DNA, 20 bp, Artificial
  CRISPR gRNA sequence
caaatggaataagcattagg

SEQ ID NO: 461477 - DNA, 20 bp, Artificial
  CRISPR gRNA sequence
aaatggaataagcattaggc

SEQ ID NO: 461478 - DNA, 20 bp, Artificial
  CRISPR gRNA sequence
atggaataagcattaggcag

SEQ ID NO: 461479 - DNA, 20 bp, Artificial
  CRISPR gRNA sequence
aaactttgcttatccaccat

SEQ ID NO: 461480 - DNA, 20 bp, Artificial
  CRISPR gRNA sequence
gaaaatacaatgcctaattt

SEQ ID NO: 461481 - DNA, 20 bp, Artificial
  CRISPR gRNA sequence
aaaatacaatgcctaatttt

SEQ ID NO: 461482 - DNA, 20 bp, Artificial
  CRISPR gRNA sequence
aaatacaatgcctaattttg

SEQ ID NO: 461483 - DNA, 20 bp, Artificial
  CRISPR gRNA sequence
aatacaatgcctaattttgg

SEQ ID NO: 461484 - DNA, 20 bp, Artificial
  CRISPR gRNA sequence
atacaatgcctaattttggg

SEQ ID NO: 461485 - DNA, 20 bp, Artificial
  CRISPR gRNA sequence
attttggggggatatttata

SEQ ID NO: 461486 - DNA, 20 bp, Artificial
  CRISPR gRNA sequence
ttttggggggatatttataa

SEQ ID NO: 461487 - DNA, 20 bp, Artificial
  CRISPR gRNA sequence
tttggggggatatttataaa

SEQ ID NO: 461488 - DNA, 20 bp, Artificial
  CRISPR gRNA sequence
ggggatatttataaagggca

SEQ ID NO: 461489 - DNA, 20 bp, Artificial
  CRISPR gRNA sequence
atttataaagggcacggaaa

SEQ ID NO: 461490 - DNA, 20 bp, Artificial
  CRISPR gRNA sequence
gcacggaaatagctacaaat

SEQ ID NO: 461491 - DNA, 20 bp, Artificial
  CRISPR gRNA sequence
gtttcaaatgctaacacatt

SEQ ID NO: 461492 - DNA, 20 bp, Artificial
  CRISPR gRNA sequence
aacacattgagcgaatttga

SEQ ID NO: 461493 - DNA, 20 bp, Artificial
  CRISPR gRNA sequence
gagcgaatttgatagtcccc

SEQ ID NO: 461494 - DNA, 20 bp, Artificial
  CRISPR gRNA sequence
tgatagtcccccagttttgc

SEQ ID NO: 461495 - DNA, 20 bp, Artificial
  CRISPR gRNA sequence
cccccagttttgctggtcct

SEQ ID NO: 461496 - DNA, 20 bp, Artificial
  CRISPR gRNA sequence
gtcctcagtttcttcaaaat

SEQ ID NO: 461497 - DNA, 20 bp, Artificial
  CRISPR gRNA sequence
gtttcttcaaaataagatga

SEQ ID NO: 461498 - DNA, 20 bp, Artificial
  CRISPR gRNA sequence
tttcttcaaaataagatgaa

SEQ ID NO: 461499 - DNA, 20 bp, Artificial
  CRISPR gRNA sequence
atgaaaggattgaactgtaa

SEQ ID NO: 461500 - DNA, 20 bp, Artificial
  CRISPR gRNA sequence
aaaggattgaactgtaaaag

SEQ ID NO: 461501 - DNA, 20 bp, Artificial
  CRISPR gRNA sequence
aaggattgaactgtaaaagt

SEQ ID NO: 461502 - DNA, 20 bp, Artificial
  CRISPR gRNA sequence
attgaactgtaaaagtagga

SEQ ID NO: 461503 - DNA, 20 bp, Artificial
  CRISPR gRNA sequence
tgaaactacgaaaccacttc

SEQ ID NO: 461504 - DNA, 20 bp, Artificial
  CRISPR gRNA sequence
caatatattacctttctatt

SEQ ID NO: 461505 - DNA, 20 bp, Artificial
  CRISPR gRNA sequence
attacctttctatttagcca

SEQ ID NO: 461506 - DNA, 20 bp, Artificial
  CRISPR gRNA sequence
ttacctttctatttagccat

SEQ ID NO: 461507 - DNA, 20 bp, Artificial
  CRISPR gRNA sequence
tacctttctatttagccata

SEQ ID NO: 461508 - DNA, 20 bp, Artificial
  CRISPR gRNA sequence
atagggctatcacttgatgt

SEQ ID NO: 461509 - DNA, 20 bp, Artificial
  CRISPR gRNA sequence
gggctatcacttgatgttag

SEQ ID NO: 461510 - DNA, 20 bp, Artificial
  CRISPR gRNA sequence
cttgatgttagtggcacaat

SEQ ID NO: 461511 - DNA, 20 bp, Artificial
  CRISPR gRNA sequence
gcacaattagacatcacttc

SEQ ID NO: 461512 - DNA, 20 bp, Artificial
  CRISPR gRNA sequence
tcttttgtgactgtatgctc

SEQ ID NO: 461513 - DNA, 20 bp, Artificial
  CRISPR gRNA sequence
ttttgtgactgtatgctccg

SEQ ID NO: 461514 - DNA, 20 bp, Artificial
  CRISPR gRNA sequence
tgtgactgtatgctccggag

SEQ ID NO: 461515 - DNA, 20 bp, Artificial
  CRISPR gRNA sequence
atgctccggagcagtgcgca

SEQ ID NO: 461516 - DNA, 20 bp, Artificial
  CRISPR gRNA sequence
ctccggagcagtgcgcaaag

SEQ ID NO: 461517 - DNA, 20 bp, Artificial
  CRISPR gRNA sequence
tccggagcagtgcgcaaagt

SEQ ID NO: 461518 - DNA, 20 bp, Artificial
  CRISPR gRNA sequence
gagcagtgcgcaaagtgggt

SEQ ID NO: 461519 - DNA, 20 bp, Artificial
  CRISPR gRNA sequence
agcagtgcgcaaagtgggtt

SEQ ID NO: 461520 - DNA, 20 bp, Artificial
  CRISPR gRNA sequence
gcagtgcgcaaagtgggtta

SEQ ID NO: 461521 - DNA, 20 bp, Artificial
  CRISPR gRNA sequence
cagtgcgcaaagtgggttag

SEQ ID NO: 461522 - DNA, 20 bp, Artificial
  CRISPR gRNA sequence
tgcgcaaagtgggttagggg

SEQ ID NO: 461523 - DNA, 20 bp, Artificial
  CRISPR gRNA sequence
cgcaaagtgggttaggggtg

SEQ ID NO: 461524 - DNA, 20 bp, Artificial
  CRISPR gRNA sequence
agtgggttaggggtggagaa

SEQ ID NO: 461525 - DNA, 20 bp, Artificial
  CRISPR gRNA sequence
tgggttaggggtggagaaaa

SEQ ID NO: 461526 - DNA, 20 bp, Artificial
  CRISPR gRNA sequence
ttaggggtggagaaaagagc

SEQ ID NO: 461527 - DNA, 20 bp, Artificial
  CRISPR gRNA sequence
aaagagctagctttttgtgt

SEQ ID NO: 461528 - DNA, 20 bp, Artificial
  CRISPR gRNA sequence
gagctagctttttgtgttgg

SEQ ID NO: 461529 - DNA, 20 bp, Artificial
  CRISPR gRNA sequence
gtggcatcactgattcacaa

SEQ ID NO: 461530 - DNA, 20 bp, Artificial
  CRISPR gRNA sequence
tggcatcactgattcacaat

SEQ ID NO: 461531 - DNA, 20 bp, Artificial
  CRISPR gRNA sequence
actgattcacaataggatta

SEQ ID NO: 461532 - DNA, 20 bp, Artificial
  CRISPR gRNA sequence
ataggattatggaaacattg

SEQ ID NO: 461533 - DNA, 20 bp, Artificial
  CRISPR gRNA sequence
cagttcctaaatattcttat

SEQ ID NO: 461534 - DNA, 20 bp, Artificial
  CRISPR gRNA sequence
ttcctaaatattcttatcag

SEQ ID NO: 461535 - DNA, 20 bp, Artificial
  CRISPR gRNA sequence
tcctaaatattcttatcagc

SEQ ID NO: 461536 - DNA, 20 bp, Artificial
  CRISPR gRNA sequence
tcattgacaaccacactgac

SEQ ID NO: 461537 - DNA, 20 bp, Artificial
  CRISPR gRNA sequence
gacaaccacactgactggca

SEQ ID NO: 461538 - DNA, 20 bp, Artificial
  CRISPR gRNA sequence
acaaccacactgactggcac

SEQ ID NO: 461539 - DNA, 20 bp, Artificial
  CRISPR gRNA sequence
gcacaggaatttttcttgaa

SEQ ID NO: 461540 - DNA, 20 bp, Artificial
  CRISPR gRNA sequence
acaggaatttttcttgaatg

SEQ ID NO: 461541 - DNA, 20 bp, Artificial
  CRISPR gRNA sequence
caggaatttttcttgaatgg

SEQ ID NO: 461542 - DNA, 20 bp, Artificial
  CRISPR gRNA sequence
gaatgaaccgatgatgaatg

SEQ ID NO: 461543 - DNA, 20 bp, Artificial
  CRISPR gRNA sequence
aatgaaccgatgatgaatgt

SEQ ID NO: 461544 - DNA, 20 bp, Artificial
  CRISPR gRNA sequence
gatgatgaatgtaggcttgc

SEQ ID NO: 461545 - DNA, 20 bp, Artificial
  CRISPR gRNA sequence
gatgaatgtaggcttgcaag

SEQ ID NO: 461546 - DNA, 20 bp, Artificial
  CRISPR gRNA sequence
atgaatgtaggcttgcaagc

SEQ ID NO: 461547 - DNA, 20 bp, Artificial
  CRISPR gRNA sequence
gtaggcttgcaagcaggcat

SEQ ID NO: 461548 - DNA, 20 bp, Artificial
  CRISPR gRNA sequence
gcaagcaggcattagaaatc

SEQ ID NO: 461549 - DNA, 20 bp, Artificial
  CRISPR gRNA sequence
aagcaggcattagaaatcaa

SEQ ID NO: 461550 - DNA, 20 bp, Artificial
  CRISPR gRNA sequence
tactccctctgtgcacaaac

SEQ ID NO: 461551 - DNA, 20 bp, Artificial
  CRISPR gRNA sequence
actccctctgtgcacaaaca

SEQ ID NO: 461552 - DNA, 20 bp, Artificial
  CRISPR gRNA sequence
ttataatacctcctatctct

SEQ ID NO: 461553 - DNA, 20 bp, Artificial
  CRISPR gRNA sequence
ataatacctcctatctctca

SEQ ID NO: 461554 - DNA, 20 bp, Artificial
  CRISPR gRNA sequence
taatacctcctatctctcag

SEQ ID NO: 461555 - DNA, 20 bp, Artificial
  CRISPR gRNA sequence
gaggctaacactgatgtttg

SEQ ID NO: 461556 - DNA, 20 bp, Artificial
  CRISPR gRNA sequence
tagtgtaaaaatgacacact

SEQ ID NO: 461557 - DNA, 20 bp, Artificial
  CRISPR gRNA sequence
aaatgacacactgagacaaa

SEQ ID NO: 461558 - DNA, 20 bp, Artificial
  CRISPR gRNA sequence
ttaattaatttatttttttt

SEQ ID NO: 461559 - DNA, 20 bp, Artificial
  CRISPR gRNA sequence
aatttattttttttgagatg

SEQ ID NO: 461560 - DNA, 20 bp, Artificial
  CRISPR gRNA sequence
gaagtctcgctcttgttgcc

SEQ ID NO: 461561 - DNA, 20 bp, Artificial
  CRISPR gRNA sequence
aagtctcgctcttgttgccc

SEQ ID NO: 461562 - DNA, 20 bp, Artificial
  CRISPR gRNA sequence
ctcgctcttgttgcccaggc

SEQ ID NO: 461563 - DNA, 20 bp, Artificial
  CRISPR gRNA sequence
cgctcttgttgcccaggctg

SEQ ID NO: 461564 - DNA, 20 bp, Artificial
  CRISPR gRNA sequence
ttgttgcccaggctggagta

SEQ ID NO: 461565 - DNA, 20 bp, Artificial
  CRISPR gRNA sequence
ggagtacagtgatgcaattt

SEQ ID NO: 461566 - DNA, 20 bp, Artificial
  CRISPR gRNA sequence
gatgcaatttcggctcactg

SEQ ID NO: 461567 - DNA, 20 bp, Artificial
  CRISPR gRNA sequence
tcactgcagcctccgcctcc

SEQ ID NO: 461568 - DNA, 20 bp, Artificial
  CRISPR gRNA sequence
cactgcagcctccgcctccc

SEQ ID NO: 461569 - DNA, 20 bp, Artificial
  CRISPR gRNA sequence
agcctccgcctcccaggttc

SEQ ID NO: 461570 - DNA, 20 bp, Artificial
  CRISPR gRNA sequence
ttcaagcgattctcctgcct

SEQ ID NO: 461571 - DNA, 20 bp, Artificial
  CRISPR gRNA sequence
ttctcctgcctcagcctccc

SEQ ID NO: 461572 - DNA, 20 bp, Artificial
  CRISPR gRNA sequence
tcctgcctcagcctccccgg

SEQ ID NO: 461573 - DNA, 20 bp, Artificial
  CRISPR gRNA sequence
gcctcagcctccccggtggc

SEQ ID NO: 461574 - DNA, 20 bp, Artificial
  CRISPR gRNA sequence
cctcagcctccccggtggct

SEQ ID NO: 461575 - DNA, 20 bp, Artificial
  CRISPR gRNA sequence
ctccccggtggctgggatta

SEQ ID NO: 461576 - DNA, 20 bp, Artificial
  CRISPR gRNA sequence
tccccggtggctgggattac

SEQ ID NO: 461577 - DNA, 20 bp, Artificial
  CRISPR gRNA sequence
caggcacccacaaccacgcc

SEQ ID NO: 461578 - DNA, 20 bp, Artificial
  CRISPR gRNA sequence
ccggctaatttttgtatttt

SEQ ID NO: 461579 - DNA, 20 bp, Artificial
  CRISPR gRNA sequence
gctaatttttgtatttttag

SEQ ID NO: 461580 - DNA, 20 bp, Artificial
  CRISPR gRNA sequence
ctaatttttgtatttttagt

SEQ ID NO: 461581 - DNA, 20 bp, Artificial
  CRISPR gRNA sequence
taatttttgtatttttagta

SEQ ID NO: 461582 - DNA, 20 bp, Artificial
  CRISPR gRNA sequence
ttttgtatttttagtaggga

SEQ ID NO: 461583 - DNA, 20 bp, Artificial
  CRISPR gRNA sequence
tttgtatttttagtagggac

SEQ ID NO: 461584 - DNA, 20 bp, Artificial
  CRISPR gRNA sequence
ttgtatttttagtagggacg

SEQ ID NO: 461585 - DNA, 20 bp, Artificial
  CRISPR gRNA sequence
gggacggggtttcgccatgt

SEQ ID NO: 461586 - DNA, 20 bp, Artificial
  CRISPR gRNA sequence
cggggtttcgccatgttagc

SEQ ID NO: 461587 - DNA, 20 bp, Artificial
  CRISPR gRNA sequence
ggggtttcgccatgttagcc

SEQ ID NO: 461588 - DNA, 20 bp, Artificial
  CRISPR gRNA sequence
tgatctcgaactcctgacct

SEQ ID NO: 461589 - DNA, 20 bp, Artificial
  CRISPR gRNA sequence
gatctcgaactcctgacctc

SEQ ID NO: 461590 - DNA, 20 bp, Artificial
  CRISPR gRNA sequence
ccacccgcctctgcctcaca

SEQ ID NO: 461591 - DNA, 20 bp, Artificial
  CRISPR gRNA sequence
gcctctgcctcacaaagtgc

SEQ ID NO: 461592 - DNA, 20 bp, Artificial
  CRISPR gRNA sequence
cctctgcctcacaaagtgct

SEQ ID NO: 461593 - DNA, 20 bp, Artificial
  CRISPR gRNA sequence
ctcacaaagtgctgggatta

SEQ ID NO: 461594 - DNA, 20 bp, Artificial
  CRISPR gRNA sequence
tcacaaagtgctgggattac

SEQ ID NO: 461595 - DNA, 20 bp, Artificial
  CRISPR gRNA sequence
acaaagtgctgggattacag

SEQ ID NO: 461596 - DNA, 20 bp, Artificial
  CRISPR gRNA sequence
agtgctgggattacaggagt

SEQ ID NO: 461597 - DNA, 20 bp, Artificial
  CRISPR gRNA sequence
ggattacaggagtgagccac

SEQ ID NO: 461598 - DNA, 20 bp, Artificial
  CRISPR gRNA sequence
acaggagtgagccaccggcc

SEQ ID NO: 461599 - DNA, 20 bp, Artificial
  CRISPR gRNA sequence
ccaccggcctggccgacaaa

SEQ ID NO: 461600 - DNA, 20 bp, Artificial
  CRISPR gRNA sequence
attctaattgtccatctgac

SEQ ID NO: 461601 - DNA, 20 bp, Artificial
  CRISPR gRNA sequence
catatccatcttatgatact

SEQ ID NO: 461602 - DNA, 20 bp, Artificial
  CRISPR gRNA sequence
atatccatcttatgatactt

SEQ ID NO: 461603 - DNA, 20 bp, Artificial
  CRISPR gRNA sequence
tatgatacttaggacacaca

SEQ ID NO: 461604 - DNA, 20 bp, Artificial
  CRISPR gRNA sequence
cacacaaagctatcccccaa

SEQ ID NO: 461605 - DNA, 20 bp, Artificial
  CRISPR gRNA sequence
tatcaaataaatatttcccg

SEQ ID NO: 461606 - DNA, 20 bp, Artificial
  CRISPR gRNA sequence
tcaaataaatatttcccgaa

SEQ ID NO: 461607 - DNA, 20 bp, Artificial
  CRISPR gRNA sequence
caaataaatatttcccgaag

SEQ ID NO: 461608 - DNA, 20 bp, Artificial
  CRISPR gRNA sequence
ccgaagaggaataactatca

SEQ ID NO: 461609 - DNA, 20 bp, Artificial
  CRISPR gRNA sequence
ataactatcacagttgcttt

SEQ ID NO: 461610 - DNA, 20 bp, Artificial
  CRISPR gRNA sequence
gttactcaacttccaattat

SEQ ID NO: 461611 - DNA, 20 bp, Artificial
  CRISPR gRNA sequence
tttttatttatgtatttttt

SEQ ID NO: 461612 - DNA, 20 bp, Artificial
  CRISPR gRNA sequence
tatttatgtattttttgaga

SEQ ID NO: 461613 - DNA, 20 bp, Artificial
  CRISPR gRNA sequence
tttatgtattttttgagacg

SEQ ID NO: 461614 - DNA, 20 bp, Artificial
  CRISPR gRNA sequence
ggagttttgctcttgttgcc

SEQ ID NO: 461615 - DNA, 20 bp, Artificial
  CRISPR gRNA sequence
gagttttgctcttgttgccc

SEQ ID NO: 461616 - DNA, 20 bp, Artificial
  CRISPR gRNA sequence
tttgctcttgttgcccaggc

SEQ ID NO: 461617 - DNA, 20 bp, Artificial
  CRISPR gRNA sequence
tgctcttgttgcccaggctg

SEQ ID NO: 461618 - DNA, 20 bp, Artificial
  CRISPR gRNA sequence
ttgcccaggctggagtgcaa

SEQ ID NO: 461619 - DNA, 20 bp, Artificial
  CRISPR gRNA sequence
gcccaggctggagtgcaatg

SEQ ID NO: 461620 - DNA, 20 bp, Artificial
  CRISPR gRNA sequence
ggagtgcaatggagcgatct

SEQ ID NO: 461621 - DNA, 20 bp, Artificial
  CRISPR gRNA sequence
ttcactgcaacctccatccc

SEQ ID NO: 461622 - DNA, 20 bp, Artificial
  CRISPR gRNA sequence
tcactgcaacctccatcccc

SEQ ID NO: 461623 - DNA, 20 bp, Artificial
  CRISPR gRNA sequence
caacctccatccccgggttc

SEQ ID NO: 461624 - DNA, 20 bp, Artificial
  CRISPR gRNA sequence
ttcaagcgattctcctgcct

SEQ ID NO: 461625 - DNA, 20 bp, Artificial
  CRISPR gRNA sequence
ttctcctgcctcagcctccc

SEQ ID NO: 461626 - DNA, 20 bp, Artificial
  CRISPR gRNA sequence
tcctgcctcagcctcccaag

SEQ ID NO: 461627 - DNA, 20 bp, Artificial
  CRISPR gRNA sequence
gcctcagcctcccaagtagc

SEQ ID NO: 461628 - DNA, 20 bp, Artificial
  CRISPR gRNA sequence
tcccaagtagccggaaccat

SEQ ID NO: 461629 - DNA, 20 bp, Artificial
  CRISPR gRNA sequence
ttatctctgctgtttttctc

SEQ ID NO: 461630 - DNA, 20 bp, Artificial
  CRISPR gRNA sequence
caagcattcatatctgatga

SEQ ID NO: 461631 - DNA, 20 bp, Artificial
  CRISPR gRNA sequence
aagcattcatatctgatgac

SEQ ID NO: 461632 - DNA, 20 bp, Artificial
  CRISPR gRNA sequence
atgattaaaataaatacatg

SEQ ID NO: 461633 - DNA, 20 bp, Artificial
  CRISPR gRNA sequence
aaaataaatacatgcagtaa

SEQ ID NO: 461634 - DNA, 20 bp, Artificial
  CRISPR gRNA sequence
agtaaaagaataaaaacttc

SEQ ID NO: 461635 - DNA, 20 bp, Artificial
  CRISPR gRNA sequence
aaagaataaaaacttctggc

SEQ ID NO: 461636 - DNA, 20 bp, Artificial
  CRISPR gRNA sequence
aagaataaaaacttctggcc

SEQ ID NO: 461637 - DNA, 20 bp, Artificial
  CRISPR gRNA sequence
taaaaacttctggccgggca

SEQ ID NO: 461638 - DNA, 20 bp, Artificial
  CRISPR gRNA sequence
aaacttctggccgggcacgg

SEQ ID NO: 461639 - DNA, 20 bp, Artificial
  CRISPR gRNA sequence
ggcacggtggctcacgcctg

SEQ ID NO: 461640 - DNA, 20 bp, Artificial
  CRISPR gRNA sequence
gtggctcacgcctgtggtcc

SEQ ID NO: 461641 - DNA, 20 bp, Artificial
  CRISPR gRNA sequence
cgcctgtggtcccagcactt

SEQ ID NO: 461642 - DNA, 20 bp, Artificial
  CRISPR gRNA sequence
gcctgtggtcccagcacttt

SEQ ID NO: 461643 - DNA, 20 bp, Artificial
  CRISPR gRNA sequence
ctgtggtcccagcactttgg

SEQ ID NO: 461644 - DNA, 20 bp, Artificial
  CRISPR gRNA sequence
tgtggtcccagcactttggg

SEQ ID NO: 461645 - DNA, 20 bp, Artificial
  CRISPR gRNA sequence
tcccagcactttgggaggcc

SEQ ID NO: 461646 - DNA, 20 bp, Artificial
  CRISPR gRNA sequence
cccagcactttgggaggccg

SEQ ID NO: 461647 - DNA, 20 bp, Artificial
  CRISPR gRNA sequence
gcactttgggaggccgaggc

SEQ ID NO: 461648 - DNA, 20 bp, Artificial
  CRISPR gRNA sequence
ctttgggaggccgaggcgag

SEQ ID NO: 461649 - DNA, 20 bp, Artificial
  CRISPR gRNA sequence
ggccgaggcgagtggatcac

SEQ ID NO: 461650 - DNA, 20 bp, Artificial
  CRISPR gRNA sequence
gccgaggcgagtggatcacg

SEQ ID NO: 461651 - DNA, 20 bp, Artificial
  CRISPR gRNA sequence
aggcgagtggatcacgaggt

SEQ ID NO: 461652 - DNA, 20 bp, Artificial
  CRISPR gRNA sequence
ggcgagtggatcacgaggtc

SEQ ID NO: 461653 - DNA, 20 bp, Artificial
  CRISPR gRNA sequence
cgagtggatcacgaggtcag

SEQ ID NO: 461654 - DNA, 20 bp, Artificial
  CRISPR gRNA sequence
tggatcacgaggtcaggaga

SEQ ID NO: 461655 - DNA, 20 bp, Artificial
  CRISPR gRNA sequence
gatcacgaggtcaggagata

SEQ ID NO: 461656 - DNA, 20 bp, Artificial
  CRISPR gRNA sequence
tcaggagatagagaccatcc

SEQ ID NO: 461657 - DNA, 20 bp, Artificial
  CRISPR gRNA sequence
agagaccatcccggctaaca

SEQ ID NO: 461658 - DNA, 20 bp, Artificial
  CRISPR gRNA sequence
aaaaatacaaaacaaaaaat

SEQ ID NO: 461659 - DNA, 20 bp, Artificial
  CRISPR gRNA sequence
atacaaaacaaaaaattagc

SEQ ID NO: 461660 - DNA, 20 bp, Artificial
  CRISPR gRNA sequence
tacaaaacaaaaaattagcc

SEQ ID NO: 461661 - DNA, 20 bp, Artificial
  CRISPR gRNA sequence
aacaaaaaattagccgggcg

SEQ ID NO: 461662 - DNA, 20 bp, Artificial
  CRISPR gRNA sequence
aaaaaattagccgggcgtgg

SEQ ID NO: 461663 - DNA, 20 bp, Artificial
  CRISPR gRNA sequence
aaattagccgggcgtggtgg

SEQ ID NO: 461664 - DNA, 20 bp, Artificial
  CRISPR gRNA sequence
aattagccgggcgtggtggc

SEQ ID NO: 461665 - DNA, 20 bp, Artificial
  CRISPR gRNA sequence
ttagccgggcgtggtggcgg

SEQ ID NO: 461666 - DNA, 20 bp, Artificial
  CRISPR gRNA sequence
ggcgtggtggcgggagcctg

SEQ ID NO: 461667 - DNA, 20 bp, Artificial
  CRISPR gRNA sequence
gtggcgggagcctgtagtcc

SEQ ID NO: 461668 - DNA, 20 bp, Artificial
  CRISPR gRNA sequence
agcctgtagtcccagctgct

SEQ ID NO: 461669 - DNA, 20 bp, Artificial
  CRISPR gRNA sequence
ctgtagtcccagctgctcgg

SEQ ID NO: 461670 - DNA, 20 bp, Artificial
  CRISPR gRNA sequence
tcccagctgctcggcagact

SEQ ID NO: 461671 - DNA, 20 bp, Artificial
  CRISPR gRNA sequence
cccagctgctcggcagactg

SEQ ID NO: 461672 - DNA, 20 bp, Artificial
  CRISPR gRNA sequence
agctgctcggcagactgagg

SEQ ID NO: 461673 - DNA, 20 bp, Artificial
  CRISPR gRNA sequence
gctgctcggcagactgaggc

SEQ ID NO: 461674 - DNA, 20 bp, Artificial
  CRISPR gRNA sequence
tgctcggcagactgaggcag

SEQ ID NO: 461675 - DNA, 20 bp, Artificial
  CRISPR gRNA sequence
ggcagactgaggcaggagaa

SEQ ID NO: 461676 - DNA, 20 bp, Artificial
  CRISPR gRNA sequence
ggagaatggcgtgaacccgc

SEQ ID NO: 461677 - DNA, 20 bp, Artificial
  CRISPR gRNA sequence
gagaatggcgtgaacccgcg

SEQ ID NO: 461678 - DNA, 20 bp, Artificial
  CRISPR gRNA sequence
aatggcgtgaacccgcgagg

SEQ ID NO: 461679 - DNA, 20 bp, Artificial
  CRISPR gRNA sequence
tggcgtgaacccgcgaggcg

SEQ ID NO: 461680 - DNA, 20 bp, Artificial
  CRISPR gRNA sequence
cgcgaggcggagcttccaat

SEQ ID NO: 461681 - DNA, 20 bp, Artificial
  CRISPR gRNA sequence
ggcggagcttccaatgagcc

SEQ ID NO: 461682 - DNA, 20 bp, Artificial
  CRISPR gRNA sequence
tagatcgcgccactgcactc

SEQ ID NO: 461683 - DNA, 20 bp, Artificial
  CRISPR gRNA sequence
cgcgccactgcactccagcc

SEQ ID NO: 461684 - DNA, 20 bp, Artificial
  CRISPR gRNA sequence
gcgccactgcactccagcct

SEQ ID NO: 461685 - DNA, 20 bp, Artificial
  CRISPR gRNA sequence
ctgcactccagcctgggtga

SEQ ID NO: 461686 - DNA, 20 bp, Artificial
  CRISPR gRNA sequence
gcactccagcctgggtgaca

SEQ ID NO: 461687 - DNA, 20 bp, Artificial
  CRISPR gRNA sequence
tccagcctgggtgacagagc

SEQ ID NO: 461688 - DNA, 20 bp, Artificial
  CRISPR gRNA sequence
cagcctgggtgacagagcga

SEQ ID NO: 461689 - DNA, 20 bp, Artificial
  CRISPR gRNA sequence
aaaaaacaaaccaacaaaca

SEQ ID NO: 461690 - DNA, 20 bp, Artificial
  CRISPR gRNA sequence
taaaaacttctactcccccc

SEQ ID NO: 461691 - DNA, 20 bp, Artificial
  CRISPR gRNA sequence
aaaaacttctactccccccc

SEQ ID NO: 461692 - DNA, 20 bp, Artificial
  CRISPR gRNA sequence
ataatgaaatatcccttgtt

SEQ ID NO: 461693 - DNA, 20 bp, Artificial
  CRISPR gRNA sequence
tatcccttgttaagtcacta

SEQ ID NO: 461694 - DNA, 20 bp, Artificial
  CRISPR gRNA sequence
atcccttgttaagtcactat

SEQ ID NO: 461695 - DNA, 20 bp, Artificial
  CRISPR gRNA sequence
ttgttaagtcactataggtt

SEQ ID NO: 461696 - DNA, 20 bp, Artificial
  CRISPR gRNA sequence
aaaatttttatcaaaaccac

SEQ ID NO: 461697 - DNA, 20 bp, Artificial
  CRISPR gRNA sequence
atttttatcaaaaccactag

SEQ ID NO: 461698 - DNA, 20 bp, Artificial
  CRISPR gRNA sequence
tggtatatatattccacgat

SEQ ID NO: 461699 - DNA, 20 bp, Artificial
  CRISPR gRNA sequence
ggtatatatattccacgatc

SEQ ID NO: 461700 - DNA, 20 bp, Artificial
  CRISPR gRNA sequence
atatatattccacgatcagg

SEQ ID NO: 461701 - DNA, 20 bp, Artificial
  CRISPR gRNA sequence
gtaccgatgatattttattt

SEQ ID NO: 461702 - DNA, 20 bp, Artificial
  CRISPR gRNA sequence
taccgatgatattttatttt

SEQ ID NO: 461703 - DNA, 20 bp, Artificial
  CRISPR gRNA sequence
atgatattttattttaggtc

SEQ ID NO: 461704 - DNA, 20 bp, Artificial
  CRISPR gRNA sequence
gatattttattttaggtcta

SEQ ID NO: 461705 - DNA, 20 bp, Artificial
  CRISPR gRNA sequence
aggtctagagtacatcattt

SEQ ID NO: 461706 - DNA, 20 bp, Artificial
  CRISPR gRNA sequence
tctatacataaaaatatttt

SEQ ID NO: 461707 - DNA, 20 bp, Artificial
  CRISPR gRNA sequence
atattttcagaaataatcat

SEQ ID NO: 461708 - DNA, 20 bp, Artificial
  CRISPR gRNA sequence
aaataatcatgagataaaac

SEQ ID NO: 461709 - DNA, 20 bp, Artificial
  CRISPR gRNA sequence
agataaaacaagtaataaaa

SEQ ID NO: 461710 - DNA, 20 bp, Artificial
  CRISPR gRNA sequence
aaaacaagtaataaaatggc

SEQ ID NO: 461711 - DNA, 20 bp, Artificial
  CRISPR gRNA sequence
aagtaataaaatggccagaa

SEQ ID NO: 461712 - DNA, 20 bp, Artificial
  CRISPR gRNA sequence
aaatggccagaaaagaaata

SEQ ID NO: 461713 - DNA, 20 bp, Artificial
  CRISPR gRNA sequence
aaaaaattaaaatacaaaaa

SEQ ID NO: 461714 - DNA, 20 bp, Artificial
  CRISPR gRNA sequence
tacaaaaaaagaaaaatgca

SEQ ID NO: 461715 - DNA, 20 bp, Artificial
  CRISPR gRNA sequence
acaaaaaaagaaaaatgcac

SEQ ID NO: 461716 - DNA, 20 bp, Artificial
  CRISPR gRNA sequence
catttttatatccacctaaa

SEQ ID NO: 461717 - DNA, 20 bp, Artificial
  CRISPR gRNA sequence
cagtatgaactttgattctt

SEQ ID NO: 461718 - DNA, 20 bp, Artificial
  CRISPR gRNA sequence
gaactttgattctttagtta

SEQ ID NO: 461719 - DNA, 20 bp, Artificial
  CRISPR gRNA sequence
ttagttatagtctgatataa

SEQ ID NO: 461720 - DNA, 20 bp, Artificial
  CRISPR gRNA sequence
gatataatagtttatgtaaa

SEQ ID NO: 461721 - DNA, 20 bp, Artificial
  CRISPR gRNA sequence
gttgtccaataactaataaa

SEQ ID NO: 461722 - DNA, 20 bp, Artificial
  CRISPR gRNA sequence
attaaaactgaaattctgca

SEQ ID NO: 461723 - DNA, 20 bp, Artificial
  CRISPR gRNA sequence
aattctgcaaagatacaatt

SEQ ID NO: 461724 - DNA, 20 bp, Artificial
  CRISPR gRNA sequence
attctgcaaagatacaattt

SEQ ID NO: 461725 - DNA, 20 bp, Artificial
  CRISPR gRNA sequence
actactaaattgtaacacta

SEQ ID NO: 461726 - DNA, 20 bp, Artificial
  CRISPR gRNA sequence
cactaaagttttattttcta

SEQ ID NO: 461727 - DNA, 20 bp, Artificial
  CRISPR gRNA sequence
aaagttttattttctaaagt

SEQ ID NO: 461728 - DNA, 20 bp, Artificial
  CRISPR gRNA sequence
aacattttatgcatgaaata

SEQ ID NO: 461729 - DNA, 20 bp, Artificial
  CRISPR gRNA sequence
atgcatgaaataaagttgcc

SEQ ID NO: 461730 - DNA, 20 bp, Artificial
  CRISPR gRNA sequence
gaaataaagttgccaagccg

SEQ ID NO: 461731 - DNA, 20 bp, Artificial
  CRISPR gRNA sequence
gccgaagattttatatatca

SEQ ID NO: 461732 - DNA, 20 bp, Artificial
  CRISPR gRNA sequence
ttaaacacaaataaaaattc

SEQ ID NO: 461733 - DNA, 20 bp, Artificial
  CRISPR gRNA sequence
aacacaaataaaaattcaag

SEQ ID NO: 461734 - DNA, 20 bp, Artificial
  CRISPR gRNA sequence
accaaatgacaaaaatgaaa

SEQ ID NO: 461735 - DNA, 20 bp, Artificial
  CRISPR gRNA sequence
cctgttctgcttctttgtct

SEQ ID NO: 461736 - DNA, 20 bp, Artificial
  CRISPR gRNA sequence
ctttgtctcagcattctctg

SEQ ID NO: 461737 - DNA, 20 bp, Artificial
  CRISPR gRNA sequence
tatttaaaattgaatgttga

SEQ ID NO: 461738 - DNA, 20 bp, Artificial
  CRISPR gRNA sequence
atttaaaattgaatgttgaa

SEQ ID NO: 461739 - DNA, 20 bp, Artificial
  CRISPR gRNA sequence
aaaattgaatgttgaaaggc

SEQ ID NO: 461740 - DNA, 20 bp, Artificial
  CRISPR gRNA sequence
aattgaatgttgaaaggctg

SEQ ID NO: 461741 - DNA, 20 bp, Artificial
  CRISPR gRNA sequence
tgttgaaaggctggagtatg

SEQ ID NO: 461742 - DNA, 20 bp, Artificial
  CRISPR gRNA sequence
ggctggagtatgtagtacca

SEQ ID NO: 461743 - DNA, 20 bp, Artificial
  CRISPR gRNA sequence
ctggagtatgtagtaccaca

SEQ ID NO: 461744 - DNA, 20 bp, Artificial
  CRISPR gRNA sequence
gtatgtagtaccacagagat

SEQ ID NO: 461745 - DNA, 20 bp, Artificial
  CRISPR gRNA sequence
tatgtagtaccacagagatg

SEQ ID NO: 461746 - DNA, 20 bp, Artificial
  CRISPR gRNA sequence
accacagagatgaggacaca

SEQ ID NO: 461747 - DNA, 20 bp, Artificial
  CRISPR gRNA sequence
atgaggacacaaagtgtcct

SEQ ID NO: 461748 - DNA, 20 bp, Artificial
  CRISPR gRNA sequence
gaggacacaaagtgtccttg

SEQ ID NO: 461749 - DNA, 20 bp, Artificial
  CRISPR gRNA sequence
aggacacaaagtgtccttgg

SEQ ID NO: 461750 - DNA, 20 bp, Artificial
  CRISPR gRNA sequence
aaagtgtccttggaggaaac

SEQ ID NO: 461751 - DNA, 20 bp, Artificial
  CRISPR gRNA sequence
agtgtccttggaggaaactg

SEQ ID NO: 461752 - DNA, 20 bp, Artificial
  CRISPR gRNA sequence
ggaggaaactggagtgatcc

SEQ ID NO: 461753 - DNA, 20 bp, Artificial
  CRISPR gRNA sequence
tttgctatcaaaatgaacac

SEQ ID NO: 461754 - DNA, 20 bp, Artificial
  CRISPR gRNA sequence
gctatcaaaatgaacacaag

SEQ ID NO: 461755 - DNA, 20 bp, Artificial
  CRISPR gRNA sequence
aatgaacacaagtagctgaa

SEQ ID NO: 461756 - DNA, 20 bp, Artificial
  CRISPR gRNA sequence
tagctgaatggtatatgtcc

SEQ ID NO: 461757 - DNA, 20 bp, Artificial
  CRISPR gRNA sequence
agctgaatggtatatgtcca

SEQ ID NO: 461758 - DNA, 20 bp, Artificial
  CRISPR gRNA sequence
gaatggtatatgtccaaggc

SEQ ID NO: 461759 - DNA, 20 bp, Artificial
  CRISPR gRNA sequence
tccaaggccagctgtataac

SEQ ID NO: 461760 - DNA, 20 bp, Artificial
  CRISPR gRNA sequence
ccaaggccagctgtataact

SEQ ID NO: 461761 - DNA, 20 bp, Artificial
  CRISPR gRNA sequence
aggccagctgtataactggg

SEQ ID NO: 461762 - DNA, 20 bp, Artificial
  CRISPR gRNA sequence
gtataactgggaagttctct

SEQ ID NO: 461763 - DNA, 20 bp, Artificial
  CRISPR gRNA sequence
agttctctgagttaacttgc

SEQ ID NO: 461764 - DNA, 20 bp, Artificial
  CRISPR gRNA sequence
tctctgagttaacttgcaag

SEQ ID NO: 461765 - DNA, 20 bp, Artificial
  CRISPR gRNA sequence
actacaaatgtgctaatttg

SEQ ID NO: 461766 - DNA, 20 bp, Artificial
  CRISPR gRNA sequence
atatatatcataaaactcaa

SEQ ID NO: 461767 - DNA, 20 bp, Artificial
  CRISPR gRNA sequence
ataaaactcaacagtaacca

SEQ ID NO: 461768 - DNA, 20 bp, Artificial
  CRISPR gRNA sequence
tcaacagtaaccatagtatt

SEQ ID NO: 461769 - DNA, 20 bp, Artificial
  CRISPR gRNA sequence
taaccatagtatttagaact

SEQ ID NO: 461770 - DNA, 20 bp, Artificial
  CRISPR gRNA sequence
cttagaccaaaaatattttg

SEQ ID NO: 461771 - DNA, 20 bp, Artificial
  CRISPR gRNA sequence
ttagaccaaaaatattttga

SEQ ID NO: 461772 - DNA, 20 bp, Artificial
  CRISPR gRNA sequence
tagaccaaaaatattttgaa

SEQ ID NO: 461773 - DNA, 20 bp, Artificial
  CRISPR gRNA sequence
ctgacattgttcatgtttgc

SEQ ID NO: 461774 - DNA, 20 bp, Artificial
  CRISPR gRNA sequence
tgttcatgtttgctagtatg

SEQ ID NO: 461775 - DNA, 20 bp, Artificial
  CRISPR gRNA sequence
tagtatgtggtgataattaa

SEQ ID NO: 461776 - DNA, 20 bp, Artificial
  CRISPR gRNA sequence
agtatgtggtgataattaaa

SEQ ID NO: 461777 - DNA, 20 bp, Artificial
  CRISPR gRNA sequence
ggtgataattaaaaggaaac

SEQ ID NO: 461778 - DNA, 20 bp, Artificial
  CRISPR gRNA sequence
ataattaaaaggaaaccggc

SEQ ID NO: 461779 - DNA, 20 bp, Artificial
  CRISPR gRNA sequence
taattaaaaggaaaccggcc

SEQ ID NO: 461780 - DNA, 20 bp, Artificial
  CRISPR gRNA sequence
aaaaggaaaccggccgggcg

SEQ ID NO: 461781 - DNA, 20 bp, Artificial
  CRISPR gRNA sequence
gtgactcatgcctgtaatcc

SEQ ID NO: 461782 - DNA, 20 bp, Artificial
  CRISPR gRNA sequence
tgcctgtaatcccagcactt

SEQ ID NO: 461783 - DNA, 20 bp, Artificial
  CRISPR gRNA sequence
gcctgtaatcccagcacttt

SEQ ID NO: 461784 - DNA, 20 bp, Artificial
  CRISPR gRNA sequence
ctgtaatcccagcactttgg

SEQ ID NO: 461785 - DNA, 20 bp, Artificial
  CRISPR gRNA sequence
tgtaatcccagcactttggg

SEQ ID NO: 461786 - DNA, 20 bp, Artificial
  CRISPR gRNA sequence
atcccagcactttgggaggc

SEQ ID NO: 461787 - DNA, 20 bp, Artificial
  CRISPR gRNA sequence
tcccagcactttgggaggcc

SEQ ID NO: 461788 - DNA, 20 bp, Artificial
  CRISPR gRNA sequence
cccagcactttgggaggcca

SEQ ID NO: 461789 - DNA, 20 bp, Artificial
  CRISPR gRNA sequence
agcactttgggaggccaggg

SEQ ID NO: 461790 - DNA, 20 bp, Artificial
  CRISPR gRNA sequence
gcactttgggaggccagggc

SEQ ID NO: 461791 - DNA, 20 bp, Artificial
  CRISPR gRNA sequence
ctttgggaggccagggcggg

SEQ ID NO: 461792 - DNA, 20 bp, Artificial
  CRISPR gRNA sequence
ggccagggcgggcggatcac

SEQ ID NO: 461793 - DNA, 20 bp, Artificial
  CRISPR gRNA sequence
ccagggcgggcggatcacca

SEQ ID NO: 461794 - DNA, 20 bp, Artificial
  CRISPR gRNA sequence
cagggcgggcggatcaccag

SEQ ID NO: 461795 - DNA, 20 bp, Artificial
  CRISPR gRNA sequence
gcgggcggatcaccagaggt

SEQ ID NO: 461796 - DNA, 20 bp, Artificial
  CRISPR gRNA sequence
cgggcggatcaccagaggtc

SEQ ID NO: 461797 - DNA, 20 bp, Artificial
  CRISPR gRNA sequence
ggcggatcaccagaggtcgg

SEQ ID NO: 461798 - DNA, 20 bp, Artificial
  CRISPR gRNA sequence
tcaccagaggtcgggagttt

SEQ ID NO: 461799 - DNA, 20 bp, Artificial
  CRISPR gRNA sequence
agaggtcgggagtttgagac

SEQ ID NO: 461800 - DNA, 20 bp, Artificial
  CRISPR gRNA sequence
tgagaccagcctaaccaaca

SEQ ID NO: 461801 - DNA, 20 bp, Artificial
  CRISPR gRNA sequence
agaccagcctaaccaacatg

SEQ ID NO: 461802 - DNA, 20 bp, Artificial
  CRISPR gRNA sequence
tctattaaaaaatacaaaat

SEQ ID NO: 461803 - DNA, 20 bp, Artificial
  CRISPR gRNA sequence
ttaaaaaatacaaaattagc

SEQ ID NO: 461804 - DNA, 20 bp, Artificial
  CRISPR gRNA sequence
taaaaaatacaaaattagct

SEQ ID NO: 461805 - DNA, 20 bp, Artificial
  CRISPR gRNA sequence
aatacaaaattagctgggta

SEQ ID NO: 461806 - DNA, 20 bp, Artificial
  CRISPR gRNA sequence
acaaaattagctgggtatgg

SEQ ID NO: 461807 - DNA, 20 bp, Artificial
  CRISPR gRNA sequence
gtggcgcatgcctgtaatcc

SEQ ID NO: 461808 - DNA, 20 bp, Artificial
  CRISPR gRNA sequence
tgcctgtaatcccagctact

SEQ ID NO: 461809 - DNA, 20 bp, Artificial
  CRISPR gRNA sequence
gcctgtaatcccagctactc

SEQ ID NO: 461810 - DNA, 20 bp, Artificial
  CRISPR gRNA sequence
ctgtaatcccagctactcag

SEQ ID NO: 461811 - DNA, 20 bp, Artificial
  CRISPR gRNA sequence
tgtaatcccagctactcagg

SEQ ID NO: 461812 - DNA, 20 bp, Artificial
  CRISPR gRNA sequence
tcccagctactcaggaggct

SEQ ID NO: 461813 - DNA, 20 bp, Artificial
  CRISPR gRNA sequence
cccagctactcaggaggctg

SEQ ID NO: 461814 - DNA, 20 bp, Artificial
  CRISPR gRNA sequence
agctactcaggaggctgagg

SEQ ID NO: 461815 - DNA, 20 bp, Artificial
  CRISPR gRNA sequence
gctactcaggaggctgaggc

SEQ ID NO: 461816 - DNA, 20 bp, Artificial
  CRISPR gRNA sequence
tactcaggaggctgaggcag

SEQ ID NO: 461817 - DNA, 20 bp, Artificial
  CRISPR gRNA sequence
aggaggctgaggcaggagaa

SEQ ID NO: 461818 - DNA, 20 bp, Artificial
  CRISPR gRNA sequence
gcaggagaatagcttgaacc

SEQ ID NO: 461819 - DNA, 20 bp, Artificial
  CRISPR gRNA sequence
caggagaatagcttgaaccc

SEQ ID NO: 461820 - DNA, 20 bp, Artificial
  CRISPR gRNA sequence
ggagaatagcttgaacccag

SEQ ID NO: 461821 - DNA, 20 bp, Artificial
  CRISPR gRNA sequence
gagaatagcttgaacccagg

SEQ ID NO: 461822 - DNA, 20 bp, Artificial
  CRISPR gRNA sequence
aatagcttgaacccaggagg

SEQ ID NO: 461823 - DNA, 20 bp, Artificial
  CRISPR gRNA sequence
tagcttgaacccaggaggcg

SEQ ID NO: 461824 - DNA, 20 bp, Artificial
  CRISPR gRNA sequence
agcttgaacccaggaggcgg

SEQ ID NO: 461825 - DNA, 20 bp, Artificial
  CRISPR gRNA sequence
aacccaggaggcggaggttg

SEQ ID NO: 461826 - DNA, 20 bp, Artificial
  CRISPR gRNA sequence
caggaggcggaggttgcggt

SEQ ID NO: 461827 - DNA, 20 bp, Artificial
  CRISPR gRNA sequence
ggcggaggttgcggtgagct

SEQ ID NO: 461828 - DNA, 20 bp, Artificial
  CRISPR gRNA sequence
gagatcgtgccattgcactc

SEQ ID NO: 461829 - DNA, 20 bp, Artificial
  CRISPR gRNA sequence
cgtgccattgcactccagcc

SEQ ID NO: 461830 - DNA, 20 bp, Artificial
  CRISPR gRNA sequence
gtgccattgcactccagcct

SEQ ID NO: 461831 - DNA, 20 bp, Artificial
  CRISPR gRNA sequence
tgcactccagcctgggcaac

SEQ ID NO: 461832 - DNA, 20 bp, Artificial
  CRISPR gRNA sequence
cactccagcctgggcaacaa

SEQ ID NO: 461833 - DNA, 20 bp, Artificial
  CRISPR gRNA sequence
atctgtgtcaaaaaaaaaaa

SEQ ID NO: 461834 - DNA, 20 bp, Artificial
  CRISPR gRNA sequence
tctgtgtcaaaaaaaaaaaa

SEQ ID NO: 461835 - DNA, 20 bp, Artificial
  CRISPR gRNA sequence
aaaaaaaggaaatcaacttt

SEQ ID NO: 461836 - DNA, 20 bp, Artificial
  CRISPR gRNA sequence
agttgtttttaaattcaata

SEQ ID NO: 461837 - DNA, 20 bp, Artificial
  CRISPR gRNA sequence
tttaaattcaatacagacaa

SEQ ID NO: 461838 - DNA, 20 bp, Artificial
  CRISPR gRNA sequence
taaattcaatacagacaatg

SEQ ID NO: 461839 - DNA, 20 bp, Artificial
  CRISPR gRNA sequence
tggagccacttgttcacacc

SEQ ID NO: 461840 - DNA, 20 bp, Artificial
  CRISPR gRNA sequence
ggagccacttgttcacaccc

SEQ ID NO: 461841 - DNA, 20 bp, Artificial
  CRISPR gRNA sequence
agccacttgttcacacccag

SEQ ID NO: 461842 - DNA, 20 bp, Artificial
  CRISPR gRNA sequence
cttgttcacacccaggagtc

SEQ ID NO: 461843 - DNA, 20 bp, Artificial
  CRISPR gRNA sequence
tcccactgtccttgacacat

SEQ ID NO: 461844 - DNA, 20 bp, Artificial
  CRISPR gRNA sequence
gtccttgacacattagtaac

SEQ ID NO: 461845 - DNA, 20 bp, Artificial
  CRISPR gRNA sequence
ttgacacattagtaacgaga

SEQ ID NO: 461846 - DNA, 20 bp, Artificial
  CRISPR gRNA sequence
attagtaacgagacagtttc

SEQ ID NO: 461847 - DNA, 20 bp, Artificial
  CRISPR gRNA sequence
acgagacagtttctagcaca

SEQ ID NO: 461848 - DNA, 20 bp, Artificial
  CRISPR gRNA sequence
agacagtttctagcacaaag

SEQ ID NO: 461849 - DNA, 20 bp, Artificial
  CRISPR gRNA sequence
acagtttctagcacaaagaa

SEQ ID NO: 461850 - DNA, 20 bp, Artificial
  CRISPR gRNA sequence
cagtttctagcacaaagaag

SEQ ID NO: 461851 - DNA, 20 bp, Artificial
  CRISPR gRNA sequence
tagcacaaagaagaggctga

SEQ ID NO: 461852 - DNA, 20 bp, Artificial
  CRISPR gRNA sequence
ccacttttcaattttgccat

SEQ ID NO: 461853 - DNA, 20 bp, Artificial
  CRISPR gRNA sequence
agatttttgttgtattattt

SEQ ID NO: 461854 - DNA, 20 bp, Artificial
  CRISPR gRNA sequence
ttggatatgatataatctct

SEQ ID NO: 461855 - DNA, 20 bp, Artificial
  CRISPR gRNA sequence
ggatatgatataatctctca

SEQ ID NO: 461856 - DNA, 20 bp, Artificial
  CRISPR gRNA sequence
atataatctctcagagcttt

SEQ ID NO: 461857 - DNA, 20 bp, Artificial
  CRISPR gRNA sequence
tcagagctttcagatccctc

SEQ ID NO: 461858 - DNA, 20 bp, Artificial
  CRISPR gRNA sequence
agagctttcagatccctcaa

SEQ ID NO: 461859 - DNA, 20 bp, Artificial
  CRISPR gRNA sequence
gagctttcagatccctcaag

SEQ ID NO: 461860 - DNA, 20 bp, Artificial
  CRISPR gRNA sequence
ctttcagatccctcaagagg

SEQ ID NO: 461861 - DNA, 20 bp, Artificial
  CRISPR gRNA sequence
cagatccctcaagaggaaga

SEQ ID NO: 461862 - DNA, 20 bp, Artificial
  CRISPR gRNA sequence
caagaggaagacagtctttc

SEQ ID NO: 461863 - DNA, 20 bp, Artificial
  CRISPR gRNA sequence
aggaagacagtctttctggc

SEQ ID NO: 461864 - DNA, 20 bp, Artificial
  CRISPR gRNA sequence
ggaagacagtctttctggct

SEQ ID NO: 461865 - DNA, 20 bp, Artificial
  CRISPR gRNA sequence
gtctttctggctgggtcaat

SEQ ID NO: 461866 - DNA, 20 bp, Artificial
  CRISPR gRNA sequence
tctttctggctgggtcaatc

SEQ ID NO: 461867 - DNA, 20 bp, Artificial
  CRISPR gRNA sequence
tctggctgggtcaatcagga

SEQ ID NO: 461868 - DNA, 20 bp, Artificial
  CRISPR gRNA sequence
ctggctgggtcaatcaggaa

SEQ ID NO: 461869 - DNA, 20 bp, Artificial
  CRISPR gRNA sequence
gtcaatcaggaaaggcttca

SEQ ID NO: 461870 - DNA, 20 bp, Artificial
  CRISPR gRNA sequence
tcaatcaggaaaggcttcat

SEQ ID NO: 461871 - DNA, 20 bp, Artificial
  CRISPR gRNA sequence
caatcaggaaaggcttcatg

SEQ ID NO: 461872 - DNA, 20 bp, Artificial
  CRISPR gRNA sequence
aatcaggaaaggcttcatgg

SEQ ID NO: 461873 - DNA, 20 bp, Artificial
  CRISPR gRNA sequence
caggaaaggcttcatggggg

SEQ ID NO: 461874 - DNA, 20 bp, Artificial
  CRISPR gRNA sequence
ataaatctctttcttcctcc

SEQ ID NO: 461875 - DNA, 20 bp, Artificial
  CRISPR gRNA sequence
tcttcctccaagccaacccc

SEQ ID NO: 461876 - DNA, 20 bp, Artificial
  CRISPR gRNA sequence
cttcctccaagccaaccccc

SEQ ID NO: 461877 - DNA, 20 bp, Artificial
  CRISPR gRNA sequence
agccaacccccaggcaaatt

SEQ ID NO: 461878 - DNA, 20 bp, Artificial
  CRISPR gRNA sequence
tggtcctcctctcattatca

SEQ ID NO: 461879 - DNA, 20 bp, Artificial
  CRISPR gRNA sequence
catcatctacctaatcacat

SEQ ID NO: 461880 - DNA, 20 bp, Artificial
  CRISPR gRNA sequence
atctacctaatcacattagc

SEQ ID NO: 461881 - DNA, 20 bp, Artificial
  CRISPR gRNA sequence
taatcacattagccagaacc

SEQ ID NO: 461882 - DNA, 20 bp, Artificial
  CRISPR gRNA sequence
aatcacattagccagaacct

SEQ ID NO: 461883 - DNA, 20 bp, Artificial
  CRISPR gRNA sequence
atcacattagccagaacctg

SEQ ID NO: 461884 - DNA, 20 bp, Artificial
  CRISPR gRNA sequence
cacattagccagaacctggg

SEQ ID NO: 461885 - DNA, 20 bp, Artificial
  CRISPR gRNA sequence
cagaacctggggagccatct

SEQ ID NO: 461886 - DNA, 20 bp, Artificial
  CRISPR gRNA sequence
ttgtcaccgtcccattccat

SEQ ID NO: 461887 - DNA, 20 bp, Artificial
  CRISPR gRNA sequence
gtcccattccatcagccatg

SEQ ID NO: 461888 - DNA, 20 bp, Artificial
  CRISPR gRNA sequence
gccatgaagttcaattgatt

SEQ ID NO: 461889 - DNA, 20 bp, Artificial
  CRISPR gRNA sequence
ccatgaagttcaattgattc

SEQ ID NO: 461890 - DNA, 20 bp, Artificial
  CRISPR gRNA sequence
gaagttcaattgattcagga

SEQ ID NO: 461891 - DNA, 20 bp, Artificial
  CRISPR gRNA sequence
tccatgacactgccttaatt

SEQ ID NO: 461892 - DNA, 20 bp, Artificial
  CRISPR gRNA sequence
ggatctcattctgtttcatg

SEQ ID NO: 461893 - DNA, 20 bp, Artificial
  CRISPR gRNA sequence
tttcatgtggattattgtca

SEQ ID NO: 461894 - DNA, 20 bp, Artificial
  CRISPR gRNA sequence
tattgtcacagcgtaccaaa

SEQ ID NO: 461895 - DNA, 20 bp, Artificial
  CRISPR gRNA sequence
ggtcttctacattccaaact

SEQ ID NO: 461896 - DNA, 20 bp, Artificial
  CRISPR gRNA sequence
aattctccacatcactgtca

SEQ ID NO: 461897 - DNA, 20 bp, Artificial
  CRISPR gRNA sequence
ttcttttttttttttttttt

SEQ ID NO: 461898 - DNA, 20 bp, Artificial
  CRISPR gRNA sequence
ttttttttttttttttgaga

SEQ ID NO: 461899 - DNA, 20 bp, Artificial
  CRISPR gRNA sequence
ttttttttttttttgagaca

SEQ ID NO: 461900 - DNA, 20 bp, Artificial
  CRISPR gRNA sequence
cagagtctcgctctgtcgcc

SEQ ID NO: 461901 - DNA, 20 bp, Artificial
  CRISPR gRNA sequence
agagtctcgctctgtcgccc

SEQ ID NO: 461902 - DNA, 20 bp, Artificial
  CRISPR gRNA sequence
tctcgctctgtcgcccaggc

SEQ ID NO: 461903 - DNA, 20 bp, Artificial
  CRISPR gRNA sequence
tcgctctgtcgcccaggctg

SEQ ID NO: 461904 - DNA, 20 bp, Artificial
  CRISPR gRNA sequence
ctgtcgcccaggctggagtg

SEQ ID NO: 461905 - DNA, 20 bp, Artificial
  CRISPR gRNA sequence
tcgcccaggctggagtgcag

SEQ ID NO: 461906 - DNA, 20 bp, Artificial
  CRISPR gRNA sequence
gcgcaatctccgctcactgc

SEQ ID NO: 461907 - DNA, 20 bp, Artificial
  CRISPR gRNA sequence
tccgctcactgcaagcctcc

SEQ ID NO: 461908 - DNA, 20 bp, Artificial
  CRISPR gRNA sequence
ccgctcactgcaagcctccc

SEQ ID NO: 461909 - DNA, 20 bp, Artificial
  CRISPR gRNA sequence
ttcacgccattctcctgcct

SEQ ID NO: 461910 - DNA, 20 bp, Artificial
  CRISPR gRNA sequence
ttctcctgcctcagcctcct

SEQ ID NO: 461911 - DNA, 20 bp, Artificial
  CRISPR gRNA sequence
tcctgcctcagcctcctgag

SEQ ID NO: 461912 - DNA, 20 bp, Artificial
  CRISPR gRNA sequence
gcctcagcctcctgagtagc

SEQ ID NO: 461913 - DNA, 20 bp, Artificial
  CRISPR gRNA sequence
cctcagcctcctgagtagct

SEQ ID NO: 461914 - DNA, 20 bp, Artificial
  CRISPR gRNA sequence
ctcctgagtagctgggacta

SEQ ID NO: 461915 - DNA, 20 bp, Artificial
  CRISPR gRNA sequence
tcctgagtagctgggactat

SEQ ID NO: 461916 - DNA, 20 bp, Artificial
  CRISPR gRNA sequence
taggtgcccaccaccacgcc

SEQ ID NO: 461917 - DNA, 20 bp, Artificial
  CRISPR gRNA sequence
cggctaattttttgtatttt

SEQ ID NO: 461918 - DNA, 20 bp, Artificial
  CRISPR gRNA sequence
ctaattttttgtatttttag

SEQ ID NO: 461919 - DNA, 20 bp, Artificial
  CRISPR gRNA sequence
aattttttgtatttttagta

SEQ ID NO: 461920 - DNA, 20 bp, Artificial
  CRISPR gRNA sequence
ttttgtatttttagtagaga

SEQ ID NO: 461921 - DNA, 20 bp, Artificial
  CRISPR gRNA sequence
tttgtatttttagtagagac

SEQ ID NO: 461922 - DNA, 20 bp, Artificial
  CRISPR gRNA sequence
ttgtatttttagtagagacg

SEQ ID NO: 461923 - DNA, 20 bp, Artificial
  CRISPR gRNA sequence
agtagagacggggttttacc

SEQ ID NO: 461924 - DNA, 20 bp, Artificial
  CRISPR gRNA sequence
cggggttttacccggttaac

SEQ ID NO: 461925 - DNA, 20 bp, Artificial
  CRISPR gRNA sequence
ggggttttacccggttaacc

SEQ ID NO: 461926 - DNA, 20 bp, Artificial
  CRISPR gRNA sequence
ttttacccggttaaccagga

SEQ ID NO: 461927 - DNA, 20 bp, Artificial
  CRISPR gRNA sequence
acctcgtgatccgcccgcct

SEQ ID NO: 461928 - DNA, 20 bp, Artificial
  CRISPR gRNA sequence
cctcgtgatccgcccgcctc

SEQ ID NO: 461929 - DNA, 20 bp, Artificial
  CRISPR gRNA sequence
ccgcccgcctcgggctccca

SEQ ID NO: 461930 - DNA, 20 bp, Artificial
  CRISPR gRNA sequence
gcctcgggctcccaaagtgc

SEQ ID NO: 461931 - DNA, 20 bp, Artificial
  CRISPR gRNA sequence
cctcgggctcccaaagtgct

SEQ ID NO: 461932 - DNA, 20 bp, Artificial
  CRISPR gRNA sequence
ctcccaaagtgctgggatta

SEQ ID NO: 461933 - DNA, 20 bp, Artificial
  CRISPR gRNA sequence
tcccaaagtgctgggattac

SEQ ID NO: 461934 - DNA, 20 bp, Artificial
  CRISPR gRNA sequence
agtgctgggattacaggcgt

SEQ ID NO: 461935 - DNA, 20 bp, Artificial
  CRISPR gRNA sequence
acaggcgtgagccaccgcac

SEQ ID NO: 461936 - DNA, 20 bp, Artificial
  CRISPR gRNA sequence
caggcgtgagccaccgcact

SEQ ID NO: 461937 - DNA, 20 bp, Artificial
  CRISPR gRNA sequence
gtgagccaccgcactgggcc

SEQ ID NO: 461938 - DNA, 20 bp, Artificial
  CRISPR gRNA sequence
ccaccgcactgggcctagcc

SEQ ID NO: 461939 - DNA, 20 bp, Artificial
  CRISPR gRNA sequence
cgcactgggcctagcccagt

SEQ ID NO: 461940 - DNA, 20 bp, Artificial
  CRISPR gRNA sequence
accctcatatccccactccc

SEQ ID NO: 461941 - DNA, 20 bp, Artificial
  CRISPR gRNA sequence
tgtctgatgctattttgtgt

SEQ ID NO: 461942 - DNA, 20 bp, Artificial
  CRISPR gRNA sequence
ccttttttgttgttgttgtt

SEQ ID NO: 461943 - DNA, 20 bp, Artificial
  CRISPR gRNA sequence
ttttgttgttgttgttgaga

SEQ ID NO: 461944 - DNA, 20 bp, Artificial
  CRISPR gRNA sequence
ttgttgttgttgttgagacg

SEQ ID NO: 461945 - DNA, 20 bp, Artificial
  CRISPR gRNA sequence
cggagtctcgctctgtcacc

SEQ ID NO: 461946 - DNA, 20 bp, Artificial
  CRISPR gRNA sequence
ggagtctcgctctgtcaccc

SEQ ID NO: 461947 - DNA, 20 bp, Artificial
  CRISPR gRNA sequence
tctcgctctgtcacccaggc

SEQ ID NO: 461948 - DNA, 20 bp, Artificial
  CRISPR gRNA sequence
tcgctctgtcacccaggctg

SEQ ID NO: 461949 - DNA, 20 bp, Artificial
  CRISPR gRNA sequence
ctgtcacccaggctggagtg

SEQ ID NO: 461950 - DNA, 20 bp, Artificial
  CRISPR gRNA sequence
tcacccaggctggagtgcag

SEQ ID NO: 461951 - DNA, 20 bp, Artificial
  CRISPR gRNA sequence
ggagtgcagtggcgcgatct

SEQ ID NO: 461952 - DNA, 20 bp, Artificial
  CRISPR gRNA sequence
tcactgcaacctccacccac

SEQ ID NO: 461953 - DNA, 20 bp, Artificial
  CRISPR gRNA sequence
cactgcaacctccacccacc

SEQ ID NO: 461954 - DNA, 20 bp, Artificial
  CRISPR gRNA sequence
aacctccacccaccgggttc

SEQ ID NO: 461955 - DNA, 20 bp, Artificial
  CRISPR gRNA sequence
ttcaagcaattctgctgcct

SEQ ID NO: 461956 - DNA, 20 bp, Artificial
  CRISPR gRNA sequence
aattctgctgcctcagcctc

SEQ ID NO: 461957 - DNA, 20 bp, Artificial
  CRISPR gRNA sequence
ttctgctgcctcagcctctg

SEQ ID NO: 461958 - DNA, 20 bp, Artificial
  CRISPR gRNA sequence
tgctgcctcagcctctggag

SEQ ID NO: 461959 - DNA, 20 bp, Artificial
  CRISPR gRNA sequence
gcctcagcctctggagcagc

SEQ ID NO: 461960 - DNA, 20 bp, Artificial
  CRISPR gRNA sequence
cctcagcctctggagcagct

SEQ ID NO: 461961 - DNA, 20 bp, Artificial
  CRISPR gRNA sequence
ctctggagcagctgggaata

SEQ ID NO: 461962 - DNA, 20 bp, Artificial
  CRISPR gRNA sequence
tctggagcagctgggaatac

SEQ ID NO: 461963 - DNA, 20 bp, Artificial
  CRISPR gRNA sequence
caggcacctgccactgcgcc

SEQ ID NO: 461964 - DNA, 20 bp, Artificial
  CRISPR gRNA sequence
aggcacctgccactgcgccc

SEQ ID NO: 461965 - DNA, 20 bp, Artificial
  CRISPR gRNA sequence
ggcacctgccactgcgcccg

SEQ ID NO: 461966 - DNA, 20 bp, Artificial
  CRISPR gRNA sequence
ccggggaatttttatatttt

SEQ ID NO: 461967 - DNA, 20 bp, Artificial
  CRISPR gRNA sequence
gggaatttttatatttttag

SEQ ID NO: 461968 - DNA, 20 bp, Artificial
  CRISPR gRNA sequence
gaatttttatatttttagta

SEQ ID NO: 461969 - DNA, 20 bp, Artificial
  CRISPR gRNA sequence
ttttatatttttagtagaga

SEQ ID NO: 461970 - DNA, 20 bp, Artificial
  CRISPR gRNA sequence
tttatatttttagtagagat

SEQ ID NO: 461971 - DNA, 20 bp, Artificial
  CRISPR gRNA sequence
ttatatttttagtagagatg

SEQ ID NO: 461972 - DNA, 20 bp, Artificial
  CRISPR gRNA sequence
gagatggggattcaccatgt

SEQ ID NO: 461973 - DNA, 20 bp, Artificial
  CRISPR gRNA sequence
tggggattcaccatgttggc

SEQ ID NO: 461974 - DNA, 20 bp, Artificial
  CRISPR gRNA sequence
ggggattcaccatgttggcc

SEQ ID NO: 461975 - DNA, 20 bp, Artificial
  CRISPR gRNA sequence
attcaccatgttggccaggc

SEQ ID NO: 461976 - DNA, 20 bp, Artificial
  CRISPR gRNA sequence
accttgtgatccacccgcct

SEQ ID NO: 461977 - DNA, 20 bp, Artificial
  CRISPR gRNA sequence
ccacccgccttggcctccca

SEQ ID NO: 461978 - DNA, 20 bp, Artificial
  CRISPR gRNA sequence
gccttggcctcccaaagtgc

SEQ ID NO: 461979 - DNA, 20 bp, Artificial
  CRISPR gRNA sequence
ctcccaaagtgctagtatta

SEQ ID NO: 461980 - DNA, 20 bp, Artificial
  CRISPR gRNA sequence
tcccaaagtgctagtattac

SEQ ID NO: 461981 - DNA, 20 bp, Artificial
  CRISPR gRNA sequence
agtgctagtattacaggcat

SEQ ID NO: 461982 - DNA, 20 bp, Artificial
  CRISPR gRNA sequence
caggcatgagccaccgcacc

SEQ ID NO: 461983 - DNA, 20 bp, Artificial
  CRISPR gRNA sequence
tcatgtttctgtcttctatc

SEQ ID NO: 461984 - DNA, 20 bp, Artificial
  CRISPR gRNA sequence
ctagtctgctacttccttga

SEQ ID NO: 461985 - DNA, 20 bp, Artificial
  CRISPR gRNA sequence
tggtgtgttacctttctatg

SEQ ID NO: 461986 - DNA, 20 bp, Artificial
  CRISPR gRNA sequence
gttacctttctatgtagtac

SEQ ID NO: 461987 - DNA, 20 bp, Artificial
  CRISPR gRNA sequence
tctatgtagtactggttgca

SEQ ID NO: 461988 - DNA, 20 bp, Artificial
  CRISPR gRNA sequence
atgtagtactggttgcacag

SEQ ID NO: 461989 - DNA, 20 bp, Artificial
  CRISPR gRNA sequence
gtagtactggttgcacagca

SEQ ID NO: 461990 - DNA, 20 bp, Artificial
  CRISPR gRNA sequence
tactggttgcacagcagaga

SEQ ID NO: 461991 - DNA, 20 bp, Artificial
  CRISPR gRNA sequence
gttgcacagcagagacagct

SEQ ID NO: 461992 - DNA, 20 bp, Artificial
  CRISPR gRNA sequence
agcagagacagctaagccct

SEQ ID NO: 461993 - DNA, 20 bp, Artificial
  CRISPR gRNA sequence
cagagacagctaagccctta

SEQ ID NO: 461994 - DNA, 20 bp, Artificial
  CRISPR gRNA sequence
gagacagctaagcccttaga

SEQ ID NO: 461995 - DNA, 20 bp, Artificial
  CRISPR gRNA sequence
agacagctaagcccttagag

SEQ ID NO: 461996 - DNA, 20 bp, Artificial
  CRISPR gRNA sequence
cagctaagcccttagagagg

SEQ ID NO: 461997 - DNA, 20 bp, Artificial
  CRISPR gRNA sequence
agctaagcccttagagaggt

SEQ ID NO: 461998 - DNA, 20 bp, Artificial
  CRISPR gRNA sequence
cccttagagaggtgggctaa

SEQ ID NO: 461999 - DNA, 20 bp, Artificial
  CRISPR gRNA sequence
ccttagagaggtgggctaaa

SEQ ID NO: 462000 - DNA, 20 bp, Artificial
  CRISPR gRNA sequence
gaggtgggctaaaaggcact

SEQ ID NO: 462001 - DNA, 20 bp, Artificial
  CRISPR gRNA sequence
aggtgggctaaaaggcactg

SEQ ID NO: 462002 - DNA, 20 bp, Artificial
  CRISPR gRNA sequence
ggctaaaaggcactgaggtg

SEQ ID NO: 462003 - DNA, 20 bp, Artificial
  CRISPR gRNA sequence
actgaggtgaagaacatatg

SEQ ID NO: 462004 - DNA, 20 bp, Artificial
  CRISPR gRNA sequence
atgcagctcaacatacctta

SEQ ID NO: 462005 - DNA, 20 bp, Artificial
  CRISPR gRNA sequence
cagctcaacataccttacag

SEQ ID NO: 462006 - DNA, 20 bp, Artificial
  CRISPR gRNA sequence
caacataccttacagtggtt

SEQ ID NO: 462007 - DNA, 20 bp, Artificial
  CRISPR gRNA sequence
tggttaagttataactacca

SEQ ID NO: 462008 - DNA, 20 bp, Artificial
  CRISPR gRNA sequence
aagttataactaccaaagaa

SEQ ID NO: 462009 - DNA, 20 bp, Artificial
  CRISPR gRNA sequence
tataactaccaaagaaaagc

SEQ ID NO: 462010 - DNA, 20 bp, Artificial
  CRISPR gRNA sequence
aaagaaaagctagactttac

SEQ ID NO: 462011 - DNA, 20 bp, Artificial
  CRISPR gRNA sequence
agctagactttacaagtatt

SEQ ID NO: 462012 - DNA, 20 bp, Artificial
  CRISPR gRNA sequence
ttacaagtattcagtttgaa

SEQ ID NO: 462013 - DNA, 20 bp, Artificial
  CRISPR gRNA sequence
tacaagtattcagtttgaaa

SEQ ID NO: 462014 - DNA, 20 bp, Artificial
  CRISPR gRNA sequence
aggcctgatttatgtccact

SEQ ID NO: 462015 - DNA, 20 bp, Artificial
  CRISPR gRNA sequence
ggcctgatttatgtccactc

SEQ ID NO: 462016 - DNA, 20 bp, Artificial
  CRISPR gRNA sequence
gcctgatttatgtccactca

SEQ ID NO: 462017 - DNA, 20 bp, Artificial
  CRISPR gRNA sequence
cctgatttatgtccactcag

SEQ ID NO: 462018 - DNA, 20 bp, Artificial
  CRISPR gRNA sequence
gatttatgtccactcagggg

SEQ ID NO: 462019 - DNA, 20 bp, Artificial
  CRISPR gRNA sequence
ggatattaaaaatatttaac

SEQ ID NO: 462020 - DNA, 20 bp, Artificial
  CRISPR gRNA sequence
atttaacaagtgacactcca

SEQ ID NO: 462021 - DNA, 20 bp, Artificial
  CRISPR gRNA sequence
agtgacactccatggccatc

SEQ ID NO: 462022 - DNA, 20 bp, Artificial
  CRISPR gRNA sequence
tccatggccatccagctaca

SEQ ID NO: 462023 - DNA, 20 bp, Artificial
  CRISPR gRNA sequence
ggccatccagctacacagat

SEQ ID NO: 462024 - DNA, 20 bp, Artificial
  CRISPR gRNA sequence
agctacacagatcagctgat

SEQ ID NO: 462025 - DNA, 20 bp, Artificial
  CRISPR gRNA sequence
acacagatcagctgatcaga

SEQ ID NO: 462026 - DNA, 20 bp, Artificial
  CRISPR gRNA sequence
cacagatcagctgatcagaa

SEQ ID NO: 462027 - DNA, 20 bp, Artificial
  CRISPR gRNA sequence
cagatcagctgatcagaaag

SEQ ID NO: 462028 - DNA, 20 bp, Artificial
  CRISPR gRNA sequence
agctgatcagaaaggagtgc

SEQ ID NO: 462029 - DNA, 20 bp, Artificial
  CRISPR gRNA sequence
gccagccacaaacaactgta

SEQ ID NO: 462030 - DNA, 20 bp, Artificial
  CRISPR gRNA sequence
ctgtatagtctcgtaactcc

SEQ ID NO: 462031 - DNA, 20 bp, Artificial
  CRISPR gRNA sequence
tagtctcgtaactcccagct

SEQ ID NO: 462032 - DNA, 20 bp, Artificial
  CRISPR gRNA sequence
ctcgtaactcccagctgagc

SEQ ID NO: 462033 - DNA, 20 bp, Artificial
  CRISPR gRNA sequence
aactcccagctgagcaagtg

SEQ ID NO: 462034 - DNA, 20 bp, Artificial
  CRISPR gRNA sequence
gctgagcaagtgtagttgct

SEQ ID NO: 462035 - DNA, 20 bp, Artificial
  CRISPR gRNA sequence
caagtgtagttgctgagctg

SEQ ID NO: 462036 - DNA, 20 bp, Artificial
  CRISPR gRNA sequence
agtgtagttgctgagctgaa

SEQ ID NO: 462037 - DNA, 20 bp, Artificial
  CRISPR gRNA sequence
tgtagttgctgagctgaaga

SEQ ID NO: 462038 - DNA, 20 bp, Artificial
  CRISPR gRNA sequence
agttgctgagctgaagagag

SEQ ID NO: 462039 - DNA, 20 bp, Artificial
  CRISPR gRNA sequence
gttgctgagctgaagagagt

SEQ ID NO: 462040 - DNA, 20 bp, Artificial
  CRISPR gRNA sequence
aggtaatttttgaaaccaat

SEQ ID NO: 462041 - DNA, 20 bp, Artificial
  CRISPR gRNA sequence
caatcagccatttaaaaaaa

SEQ ID NO: 462042 - DNA, 20 bp, Artificial
  CRISPR gRNA sequence
atcagccatttaaaaaaaaa

SEQ ID NO: 462043 - DNA, 20 bp, Artificial
  CRISPR gRNA sequence
tcagccatttaaaaaaaaag

SEQ ID NO: 462044 - DNA, 20 bp, Artificial
  CRISPR gRNA sequence
cagccatttaaaaaaaaaga

SEQ ID NO: 462045 - DNA, 20 bp, Artificial
  CRISPR gRNA sequence
ttgattataaccattatcat

SEQ ID NO: 462046 - DNA, 20 bp, Artificial
  CRISPR gRNA sequence
tgattataaccattatcatg

SEQ ID NO: 462047 - DNA, 20 bp, Artificial
  CRISPR gRNA sequence
tcatgaggaaaatctcacct

SEQ ID NO: 462048 - DNA, 20 bp, Artificial
  CRISPR gRNA sequence
gaaaaattcttacaaattta

SEQ ID NO: 462049 - DNA, 20 bp, Artificial
  CRISPR gRNA sequence
acaaatttatggaaacttca

SEQ ID NO: 462050 - DNA, 20 bp, Artificial
  CRISPR gRNA sequence
aatttatggaaacttcaaag

SEQ ID NO: 462051 - DNA, 20 bp, Artificial
  CRISPR gRNA sequence
atgaatgactgtaatgaatg

SEQ ID NO: 462052 - DNA, 20 bp, Artificial
  CRISPR gRNA sequence
aatgcagattgccttaactt

SEQ ID NO: 462053 - DNA, 20 bp, Artificial
  CRISPR gRNA sequence
agattgccttaacttgagct

SEQ ID NO: 462054 - DNA, 20 bp, Artificial
  CRISPR gRNA sequence
tgccttaacttgagctaaga

SEQ ID NO: 462055 - DNA, 20 bp, Artificial
  CRISPR gRNA sequence
aacttgagctaagaaagtgt

SEQ ID NO: 462056 - DNA, 20 bp, Artificial
  CRISPR gRNA sequence
cttgagctaagaaagtgtca

SEQ ID NO: 462057 - DNA, 20 bp, Artificial
  CRISPR gRNA sequence
gaaagtgtcagagtttaaca

SEQ ID NO: 462058 - DNA, 20 bp, Artificial
  CRISPR gRNA sequence
aattaaacaaatgatttttt

SEQ ID NO: 462059 - DNA, 20 bp, Artificial
  CRISPR gRNA sequence
gaaactaaaatgattactaa

SEQ ID NO: 462060 - DNA, 20 bp, Artificial
  CRISPR gRNA sequence
taattttctgtgacatcaac

SEQ ID NO: 462061 - DNA, 20 bp, Artificial
  CRISPR gRNA sequence
aattttctgtgacatcaacc

SEQ ID NO: 462062 - DNA, 20 bp, Artificial
  CRISPR gRNA sequence
tgtgacatcaaccaggattt

SEQ ID NO: 462063 - DNA, 20 bp, Artificial
  CRISPR gRNA sequence
accaggattttagcttctat

SEQ ID NO: 462064 - DNA, 20 bp, Artificial
  CRISPR gRNA sequence
tctatcagaaaatactatca

SEQ ID NO: 462065 - DNA, 20 bp, Artificial
  CRISPR gRNA sequence
tactatcacagacaaacaac

SEQ ID NO: 462066 - DNA, 20 bp, Artificial
  CRISPR gRNA sequence
caacaagcaaaccaaaactt

SEQ ID NO: 462067 - DNA, 20 bp, Artificial
  CRISPR gRNA sequence
ccaaaacttcagacgcatgc

SEQ ID NO: 462068 - DNA, 20 bp, Artificial
  CRISPR gRNA sequence
caaaacttcagacgcatgct

SEQ ID NO: 462069 - DNA, 20 bp, Artificial
  CRISPR gRNA sequence
aaaacttcagacgcatgctg

SEQ ID NO: 462070 - DNA, 20 bp, Artificial
  CRISPR gRNA sequence
aacttcagacgcatgctggg

SEQ ID NO: 462071 - DNA, 20 bp, Artificial
  CRISPR gRNA sequence
acttcagacgcatgctgggg

SEQ ID NO: 462072 - DNA, 20 bp, Artificial
  CRISPR gRNA sequence
gacgcatgctggggaggcta

SEQ ID NO: 462073 - DNA, 20 bp, Artificial
  CRISPR gRNA sequence
gcatgctggggaggctacag

SEQ ID NO: 462074 - DNA, 20 bp, Artificial
  CRISPR gRNA sequence
catgctggggaggctacaga

SEQ ID NO: 462075 - DNA, 20 bp, Artificial
  CRISPR gRNA sequence
gggaggctacagaaggaatg

SEQ ID NO: 462076 - DNA, 20 bp, Artificial
  CRISPR gRNA sequence
aggaatgaagtctttacact

SEQ ID NO: 462077 - DNA, 20 bp, Artificial
  CRISPR gRNA sequence
ggaatgaagtctttacactc

SEQ ID NO: 462078 - DNA, 20 bp, Artificial
  CRISPR gRNA sequence
aatgaagtctttacactcag

SEQ ID NO: 462079 - DNA, 20 bp, Artificial
  CRISPR gRNA sequence
tctttacactcaggagcaaa

SEQ ID NO: 462080 - DNA, 20 bp, Artificial
  CRISPR gRNA sequence
ctttacactcaggagcaaaa

SEQ ID NO: 462081 - DNA, 20 bp, Artificial
  CRISPR gRNA sequence
ctcaggagcaaaaaggcatc

SEQ ID NO: 462082 - DNA, 20 bp, Artificial
  CRISPR gRNA sequence
ggagcaaaaaggcatccaga

SEQ ID NO: 462083 - DNA, 20 bp, Artificial
  CRISPR gRNA sequence
tggtatgttctgccttactt

SEQ ID NO: 462084 - DNA, 20 bp, Artificial
  CRISPR gRNA sequence
tatgttctgccttactttag

SEQ ID NO: 462085 - DNA, 20 bp, Artificial
  CRISPR gRNA sequence
atgttctgccttactttaga

SEQ ID NO: 462086 - DNA, 20 bp, Artificial
  CRISPR gRNA sequence
tctgccttactttagaaggc

SEQ ID NO: 462087 - DNA, 20 bp, Artificial
  CRISPR gRNA sequence
cttactttagaaggctggaa

SEQ ID NO: 462088 - DNA, 20 bp, Artificial
  CRISPR gRNA sequence
actttagaaggctggaatgg

SEQ ID NO: 462089 - DNA, 20 bp, Artificial
  CRISPR gRNA sequence
tttagaaggctggaatggta

SEQ ID NO: 462090 - DNA, 20 bp, Artificial
  CRISPR gRNA sequence
tagaaggctggaatggtaga

SEQ ID NO: 462091 - DNA, 20 bp, Artificial
  CRISPR gRNA sequence
agaaggctggaatggtagag

SEQ ID NO: 462092 - DNA, 20 bp, Artificial
  CRISPR gRNA sequence
aaggctggaatggtagagag

SEQ ID NO: 462093 - DNA, 20 bp, Artificial
  CRISPR gRNA sequence
aggctggaatggtagagagg

SEQ ID NO: 462094 - DNA, 20 bp, Artificial
  CRISPR gRNA sequence
ggctggaatggtagagagga

SEQ ID NO: 462095 - DNA, 20 bp, Artificial
  CRISPR gRNA sequence
gctggaatggtagagaggag

SEQ ID NO: 462096 - DNA, 20 bp, Artificial
  CRISPR gRNA sequence
tggaatggtagagaggaggg

SEQ ID NO: 462097 - DNA, 20 bp, Artificial
  CRISPR gRNA sequence
gaatggtagagaggagggga

SEQ ID NO: 462098 - DNA, 20 bp, Artificial
  CRISPR gRNA sequence
agagaggaggggagagatga

SEQ ID NO: 462099 - DNA, 20 bp, Artificial
  CRISPR gRNA sequence
aggggagagatgatggccac

SEQ ID NO: 462100 - DNA, 20 bp, Artificial
  CRISPR gRNA sequence
ggggagagatgatggccacc

SEQ ID NO: 462101 - DNA, 20 bp, Artificial
  CRISPR gRNA sequence
gggagagatgatggccacca

SEQ ID NO: 462102 - DNA, 20 bp, Artificial
  CRISPR gRNA sequence
agagatgatggccaccaggg

SEQ ID NO: 462103 - DNA, 20 bp, Artificial
  CRISPR gRNA sequence
gagatgatggccaccaggga

SEQ ID NO: 462104 - DNA, 20 bp, Artificial
  CRISPR gRNA sequence
agatgatggccaccagggaa

SEQ ID NO: 462105 - DNA, 20 bp, Artificial
  CRISPR gRNA sequence
ctcaaatcttcccttgaaat

SEQ ID NO: 462106 - DNA, 20 bp, Artificial
  CRISPR gRNA sequence
caaatcttcccttgaaatta

SEQ ID NO: 462107 - DNA, 20 bp, Artificial
  CRISPR gRNA sequence
cttcccttgaaattagagtt

SEQ ID NO: 462108 - DNA, 20 bp, Artificial
  CRISPR gRNA sequence
ttcccttgaaattagagttt

SEQ ID NO: 462109 - DNA, 20 bp, Artificial
  CRISPR gRNA sequence
tcccttgaaattagagttta

SEQ ID NO: 462110 - DNA, 20 bp, Artificial
  CRISPR gRNA sequence
ttagagtttagggatcccat

SEQ ID NO: 462111 - DNA, 20 bp, Artificial
  CRISPR gRNA sequence
tagagtttagggatcccata

SEQ ID NO: 462112 - DNA, 20 bp, Artificial
  CRISPR gRNA sequence
agtttagggatcccataagg

SEQ ID NO: 462113 - DNA, 20 bp, Artificial
  CRISPR gRNA sequence
ttagggatcccataaggcag

SEQ ID NO: 462114 - DNA, 20 bp, Artificial
  CRISPR gRNA sequence
ataaggcagtggtttgtaca

SEQ ID NO: 462115 - DNA, 20 bp, Artificial
  CRISPR gRNA sequence
ggcagtggtttgtacatagt

SEQ ID NO: 462116 - DNA, 20 bp, Artificial
  CRISPR gRNA sequence
gcagtggtttgtacatagtc

SEQ ID NO: 462117 - DNA, 20 bp, Artificial
  CRISPR gRNA sequence
cagtggtttgtacatagtca

SEQ ID NO: 462118 - DNA, 20 bp, Artificial
  CRISPR gRNA sequence
agtcagggcaaatccacaca

SEQ ID NO: 462119 - DNA, 20 bp, Artificial
  CRISPR gRNA sequence
ggcaaatccacacacagcaa

SEQ ID NO: 462120 - DNA, 20 bp, Artificial
  CRISPR gRNA sequence
aaatccacacacagcaatag

SEQ ID NO: 462121 - DNA, 20 bp, Artificial
  CRISPR gRNA sequence
acacacagcaatagcagcca

SEQ ID NO: 462122 - DNA, 20 bp, Artificial
  CRISPR gRNA sequence
cagccatggaaccatacttc

SEQ ID NO: 462123 - DNA, 20 bp, Artificial
  CRISPR gRNA sequence
agccatggaaccatacttca

SEQ ID NO: 462124 - DNA, 20 bp, Artificial
  CRISPR gRNA sequence
gaaccatacttcaaggatct

SEQ ID NO: 462125 - DNA, 20 bp, Artificial
  CRISPR gRNA sequence
aaccatacttcaaggatctt

SEQ ID NO: 462126 - DNA, 20 bp, Artificial
  CRISPR gRNA sequence
ccatacttcaaggatcttgg

SEQ ID NO: 462127 - DNA, 20 bp, Artificial
  CRISPR gRNA sequence
catacttcaaggatcttggg

SEQ ID NO: 462128 - DNA, 20 bp, Artificial
  CRISPR gRNA sequence
ggacattgacttgcatacct

SEQ ID NO: 462129 - DNA, 20 bp, Artificial
  CRISPR gRNA sequence
gacattgacttgcatacctt

SEQ ID NO: 462130 - DNA, 20 bp, Artificial
  CRISPR gRNA sequence
gcataccttgggaaatcaca

SEQ ID NO: 462131 - DNA, 20 bp, Artificial
  CRISPR gRNA sequence
ggaaatcacacggacgacat

SEQ ID NO: 462132 - DNA, 20 bp, Artificial
  CRISPR gRNA sequence
acggacgacatcagaaaacc

SEQ ID NO: 462133 - DNA, 20 bp, Artificial
  CRISPR gRNA sequence
cggacgacatcagaaaaccc

SEQ ID NO: 462134 - DNA, 20 bp, Artificial
  CRISPR gRNA sequence
acgacatcagaaaacccagg

SEQ ID NO: 462135 - DNA, 20 bp, Artificial
  CRISPR gRNA sequence
catactttcccatcataaac

SEQ ID NO: 462136 - DNA, 20 bp, Artificial
  CRISPR gRNA sequence
ctcacatacactcacaaaat

SEQ ID NO: 462137 - DNA, 20 bp, Artificial
  CRISPR gRNA sequence
cactcacaaaatcagaaatg

SEQ ID NO: 462138 - DNA, 20 bp, Artificial
  CRISPR gRNA sequence
aatcagaaatgtggtgacat

SEQ ID NO: 462139 - DNA, 20 bp, Artificial
  CRISPR gRNA sequence
atcagaaatgtggtgacatg

SEQ ID NO: 462140 - DNA, 20 bp, Artificial
  CRISPR gRNA sequence
gaaatgtggtgacatgaggt

SEQ ID NO: 462141 - DNA, 20 bp, Artificial
  CRISPR gRNA sequence
aaatgtggtgacatgaggtt

SEQ ID NO: 462142 - DNA, 20 bp, Artificial
  CRISPR gRNA sequence
aatgtggtgacatgaggtta

SEQ ID NO: 462143 - DNA, 20 bp, Artificial
  CRISPR gRNA sequence
gtggtgacatgaggttaggg

SEQ ID NO: 462144 - DNA, 20 bp, Artificial
  CRISPR gRNA sequence
tggtgacatgaggttagggt

SEQ ID NO: 462145 - DNA, 20 bp, Artificial
  CRISPR gRNA sequence
ggtgacatgaggttagggtg

SEQ ID NO: 462146 - DNA, 20 bp, Artificial
  CRISPR gRNA sequence
gtgacatgaggttagggtgg

SEQ ID NO: 462147 - DNA, 20 bp, Artificial
  CRISPR gRNA sequence
gacatgaggttagggtgggg

SEQ ID NO: 462148 - DNA, 20 bp, Artificial
  CRISPR gRNA sequence
tgggggagttccacctcata

SEQ ID NO: 462149 - DNA, 20 bp, Artificial
  CRISPR gRNA sequence
ggagttccacctcatataga

SEQ ID NO: 462150 - DNA, 20 bp, Artificial
  CRISPR gRNA sequence
gtattatgtaatgtctatta

SEQ ID NO: 462151 - DNA, 20 bp, Artificial
  CRISPR gRNA sequence
tattatgtaatgtctattaa

SEQ ID NO: 462152 - DNA, 20 bp, Artificial
  CRISPR gRNA sequence
aaggtattactttaactctg

SEQ ID NO: 462153 - DNA, 20 bp, Artificial
  CRISPR gRNA sequence
tggtaaataaaccactccat

SEQ ID NO: 462154 - DNA, 20 bp, Artificial
  CRISPR gRNA sequence
aaataaaccactccataagt

SEQ ID NO: 462155 - DNA, 20 bp, Artificial
  CRISPR gRNA sequence
ctccataagtcagatattct

SEQ ID NO: 462156 - DNA, 20 bp, Artificial
  CRISPR gRNA sequence
cataagtcagatattctcag

SEQ ID NO: 462157 - DNA, 20 bp, Artificial
  CRISPR gRNA sequence
tcagatattctcagaagtac

SEQ ID NO: 462158 - DNA, 20 bp, Artificial
  CRISPR gRNA sequence
cagatattctcagaagtact

SEQ ID NO: 462159 - DNA, 20 bp, Artificial
  CRISPR gRNA sequence
tcagaagtactaggaatacc

SEQ ID NO: 462160 - DNA, 20 bp, Artificial
  CRISPR gRNA sequence
agaagtactaggaatacctg

SEQ ID NO: 462161 - DNA, 20 bp, Artificial
  CRISPR gRNA sequence
aggaatacctggagaaaatt

SEQ ID NO: 462162 - DNA, 20 bp, Artificial
  CRISPR gRNA sequence
atacctggagaaaattaagt

SEQ ID NO: 462163 - DNA, 20 bp, Artificial
  CRISPR gRNA sequence
acacaaacatatgttaaaat

SEQ ID NO: 462164 - DNA, 20 bp, Artificial
  CRISPR gRNA sequence
acaaacatatgttaaaatca

SEQ ID NO: 462165 - DNA, 20 bp, Artificial
  CRISPR gRNA sequence
aatcagagcttcttttgtaa

SEQ ID NO: 462166 - DNA, 20 bp, Artificial
  CRISPR gRNA sequence
aaagtgactattgttacttt

SEQ ID NO: 462167 - DNA, 20 bp, Artificial
  CRISPR gRNA sequence
aagtgactattgttacttta

SEQ ID NO: 462168 - DNA, 20 bp, Artificial
  CRISPR gRNA sequence
aaccctgtgattgttctcac

SEQ ID NO: 462169 - DNA, 20 bp, Artificial
  CRISPR gRNA sequence
tgtgattgttctcacgagta

SEQ ID NO: 462170 - DNA, 20 bp, Artificial
  CRISPR gRNA sequence
cgagtacagtgaaaactgac

SEQ ID NO: 462171 - DNA, 20 bp, Artificial
  CRISPR gRNA sequence
agtgaaaactgactggccct

SEQ ID NO: 462172 - DNA, 20 bp, Artificial
  CRISPR gRNA sequence
cagtcccttctgtaaaatga

SEQ ID NO: 462173 - DNA, 20 bp, Artificial
  CRISPR gRNA sequence
tttcctgaaaaacaacacta

SEQ ID NO: 462174 - DNA, 20 bp, Artificial
  CRISPR gRNA sequence
gaaaaacaacactaaagata

SEQ ID NO: 462175 - DNA, 20 bp, Artificial
  CRISPR gRNA sequence
aacactaaagatacagatca

SEQ ID NO: 462176 - DNA, 20 bp, Artificial
  CRISPR gRNA sequence
gatacagatcatagacaata

SEQ ID NO: 462177 - DNA, 20 bp, Artificial
  CRISPR gRNA sequence
atcatagacaatacagatca

SEQ ID NO: 462178 - DNA, 20 bp, Artificial
  CRISPR gRNA sequence
agacaatacagatcacagac

SEQ ID NO: 462179 - DNA, 20 bp, Artificial
  CRISPR gRNA sequence
gacaatacagatcacagaca

SEQ ID NO: 462180 - DNA, 20 bp, Artificial
  CRISPR gRNA sequence
acagatcacagacaaggatg

SEQ ID NO: 462181 - DNA, 20 bp, Artificial
  CRISPR gRNA sequence
gacaaggatgtagtatgcaa

SEQ ID NO: 462182 - DNA, 20 bp, Artificial
  CRISPR gRNA sequence
aaggatgtagtatgcaatag

SEQ ID NO: 462183 - DNA, 20 bp, Artificial
  CRISPR gRNA sequence
tagatttaacttattctctg

SEQ ID NO: 462184 - DNA, 20 bp, Artificial
  CRISPR gRNA sequence
tatcacctgatattgctctt

SEQ ID NO: 462185 - DNA, 20 bp, Artificial
  CRISPR gRNA sequence
cctgatattgctctttagac

SEQ ID NO: 462186 - DNA, 20 bp, Artificial
  CRISPR gRNA sequence
gatattgctctttagacaag

SEQ ID NO: 462187 - DNA, 20 bp, Artificial
  CRISPR gRNA sequence
tattgctctttagacaagaa

SEQ ID NO: 462188 - DNA, 20 bp, Artificial
  CRISPR gRNA sequence
aagaagagccattttctccc

SEQ ID NO: 462189 - DNA, 20 bp, Artificial
  CRISPR gRNA sequence
agaagagccattttctccct

SEQ ID NO: 462190 - DNA, 20 bp, Artificial
  CRISPR gRNA sequence
taaaatttccttcacaaaaa

SEQ ID NO: 462191 - DNA, 20 bp, Artificial
  CRISPR gRNA sequence
ttccttcacaaaaatggaac

SEQ ID NO: 462192 - DNA, 20 bp, Artificial
  CRISPR gRNA sequence
ttcacaaaaatggaactgga

SEQ ID NO: 462193 - DNA, 20 bp, Artificial
  CRISPR gRNA sequence
aactggaaagtattaatgcc

SEQ ID NO: 462194 - DNA, 20 bp, Artificial
  CRISPR gRNA sequence
gtattaatgccaagaataca

SEQ ID NO: 462195 - DNA, 20 bp, Artificial
  CRISPR gRNA sequence
tattaatgccaagaatacac

SEQ ID NO: 462196 - DNA, 20 bp, Artificial
  CRISPR gRNA sequence
attaatgccaagaatacaca

SEQ ID NO: 462197 - DNA, 20 bp, Artificial
  CRISPR gRNA sequence
gcccattatttaaaaaaaaa

SEQ ID NO: 462198 - DNA, 20 bp, Artificial
  CRISPR gRNA sequence
aaaaaaagcaaccatgaaac

SEQ ID NO: 462199 - DNA, 20 bp, Artificial
  CRISPR gRNA sequence
aaccatgaaacaagaaaatt

SEQ ID NO: 462200 - DNA, 20 bp, Artificial
  CRISPR gRNA sequence
ccatgaaacaagaaaattga

SEQ ID NO: 462201 - DNA, 20 bp, Artificial
  CRISPR gRNA sequence
catttatgaaatttttcttt

SEQ ID NO: 462202 - DNA, 20 bp, Artificial
  CRISPR gRNA sequence
tctttaagtttactttcata

SEQ ID NO: 462203 - DNA, 20 bp, Artificial
  CRISPR gRNA sequence
agtttactttcatatggtat

SEQ ID NO: 462204 - DNA, 20 bp, Artificial
  CRISPR gRNA sequence
tatggtattagcacacttta

SEQ ID NO: 462205 - DNA, 20 bp, Artificial
  CRISPR gRNA sequence
ctttaaagcaatttcttcta

SEQ ID NO: 462206 - DNA, 20 bp, Artificial
  CRISPR gRNA sequence
aaagcaatttcttctacagt

SEQ ID NO: 462207 - DNA, 20 bp, Artificial
  CRISPR gRNA sequence
cagttagaatttctcattgt

SEQ ID NO: 462208 - DNA, 20 bp, Artificial
  CRISPR gRNA sequence
agaatttctcattgttagtg

SEQ ID NO: 462209 - DNA, 20 bp, Artificial
  CRISPR gRNA sequence
gttagtgtagtatgactatt

SEQ ID NO: 462210 - DNA, 20 bp, Artificial
  CRISPR gRNA sequence
gtgtagtatgactatttggc

SEQ ID NO: 462211 - DNA, 20 bp, Artificial
  CRISPR gRNA sequence
ctatttggcaagtaaatttg

SEQ ID NO: 462212 - DNA, 20 bp, Artificial
  CRISPR gRNA sequence
gaagactgatctcttcaatg

SEQ ID NO: 462213 - DNA, 20 bp, Artificial
  CRISPR gRNA sequence
ctcttcaatgcagttgtatt

SEQ ID NO: 462214 - DNA, 20 bp, Artificial
  CRISPR gRNA sequence
gcagttgtattgagccactg

SEQ ID NO: 462215 - DNA, 20 bp, Artificial
  CRISPR gRNA sequence
attgagccactgaagacttt

SEQ ID NO: 462216 - DNA, 20 bp, Artificial
  CRISPR gRNA sequence
gaacttgttttgtctaaaat

SEQ ID NO: 462217 - DNA, 20 bp, Artificial
  CRISPR gRNA sequence
ttgtctaaaatcagtcattc

SEQ ID NO: 462218 - DNA, 20 bp, Artificial
  CRISPR gRNA sequence
tcattgctttttccgacatt

SEQ ID NO: 462219 - DNA, 20 bp, Artificial
  CRISPR gRNA sequence
gctttttccgacatttagca

SEQ ID NO: 462220 - DNA, 20 bp, Artificial
  CRISPR gRNA sequence
gacatttagcaaagcttaca

SEQ ID NO: 462221 - DNA, 20 bp, Artificial
  CRISPR gRNA sequence
ccatgtcatttcctctcctt

SEQ ID NO: 462222 - DNA, 20 bp, Artificial
  CRISPR gRNA sequence
ttcctctccttgagatattt

SEQ ID NO: 462223 - DNA, 20 bp, Artificial
  CRISPR gRNA sequence
cctctccttgagatatttaa

SEQ ID NO: 462224 - DNA, 20 bp, Artificial
  CRISPR gRNA sequence
ctccttgagatatttaagag

SEQ ID NO: 462225 - DNA, 20 bp, Artificial
  CRISPR gRNA sequence
gagatatttaagagtagaac

SEQ ID NO: 462226 - DNA, 20 bp, Artificial
  CRISPR gRNA sequence
atatttaagagtagaacaag

SEQ ID NO: 462227 - DNA, 20 bp, Artificial
  CRISPR gRNA sequence
atttaagagtagaacaagaa

SEQ ID NO: 462228 - DNA, 20 bp, Artificial
  CRISPR gRNA sequence
gtagaacaagaagagaacct

SEQ ID NO: 462229 - DNA, 20 bp, Artificial
  CRISPR gRNA sequence
agaacaagaagagaacctta

SEQ ID NO: 462230 - DNA, 20 bp, Artificial
  CRISPR gRNA sequence
gaacaagaagagaaccttag

SEQ ID NO: 462231 - DNA, 20 bp, Artificial
  CRISPR gRNA sequence
aagagaaccttagaggtcat

SEQ ID NO: 462232 - DNA, 20 bp, Artificial
  CRISPR gRNA sequence
agagaaccttagaggtcatg

SEQ ID NO: 462233 - DNA, 20 bp, Artificial
  CRISPR gRNA sequence
aaccttagaggtcatgaggt

SEQ ID NO: 462234 - DNA, 20 bp, Artificial
  CRISPR gRNA sequence
tcatgaggtcagatgcccaa

SEQ ID NO: 462235 - DNA, 20 bp, Artificial
  CRISPR gRNA sequence
gaggtcagatgcccaatgga

SEQ ID NO: 462236 - DNA, 20 bp, Artificial
  CRISPR gRNA sequence
agatgcccaatggaaagttt

SEQ ID NO: 462237 - DNA, 20 bp, Artificial
  CRISPR gRNA sequence
tggaaagtttaagttacatt

SEQ ID NO: 462238 - DNA, 20 bp, Artificial
  CRISPR gRNA sequence
ggaaagtttaagttacattt

SEQ ID NO: 462239 - DNA, 20 bp, Artificial
  CRISPR gRNA sequence
aaagtttaagttacatttag

SEQ ID NO: 462240 - DNA, 20 bp, Artificial
  CRISPR gRNA sequence
tacatttaggagatcacctc

SEQ ID NO: 462241 - DNA, 20 bp, Artificial
  CRISPR gRNA sequence
cattctttgccacttgccca

SEQ ID NO: 462242 - DNA, 20 bp, Artificial
  CRISPR gRNA sequence
attctttgccacttgcccac

SEQ ID NO: 462243 - DNA, 20 bp, Artificial
  CRISPR gRNA sequence
ctcacattatctatatactg

SEQ ID NO: 462244 - DNA, 20 bp, Artificial
  CRISPR gRNA sequence
tatatactgtagacccaacc

SEQ ID NO: 462245 - DNA, 20 bp, Artificial
  CRISPR gRNA sequence
acctagatccatcttaacac

SEQ ID NO: 462246 - DNA, 20 bp, Artificial
  CRISPR gRNA sequence
cctagatccatcttaacacg

SEQ ID NO: 462247 - DNA, 20 bp, Artificial
  CRISPR gRNA sequence
catcttaacacgaggaaaaa

SEQ ID NO: 462248 - DNA, 20 bp, Artificial
  CRISPR gRNA sequence
gaatatgactaatattttca

SEQ ID NO: 462249 - DNA, 20 bp, Artificial
  CRISPR gRNA sequence
attttcaaagttcttattat

SEQ ID NO: 462250 - DNA, 20 bp, Artificial
  CRISPR gRNA sequence
ttttcaaagttcttattatg

SEQ ID NO: 462251 - DNA, 20 bp, Artificial
  CRISPR gRNA sequence
tcaaagttcttattatgagg

SEQ ID NO: 462252 - DNA, 20 bp, Artificial
  CRISPR gRNA sequence
caaagttcttattatgaggt

SEQ ID NO: 462253 - DNA, 20 bp, Artificial
  CRISPR gRNA sequence
tattatgaggtaggcacttt

SEQ ID NO: 462254 - DNA, 20 bp, Artificial
  CRISPR gRNA sequence
gaccctcacaatgattttat

SEQ ID NO: 462255 - DNA, 20 bp, Artificial
  CRISPR gRNA sequence
accctcacaatgattttatg

SEQ ID NO: 462256 - DNA, 20 bp, Artificial
  CRISPR gRNA sequence
ccctcacaatgattttatga

SEQ ID NO: 462257 - DNA, 20 bp, Artificial
  CRISPR gRNA sequence
ttatgagggaattactatta

SEQ ID NO: 462258 - DNA, 20 bp, Artificial
  CRISPR gRNA sequence
attatggcctttattttttt

SEQ ID NO: 462259 - DNA, 20 bp, Artificial
  CRISPR gRNA sequence
ggcctttatttttttaagtt

SEQ ID NO: 462260 - DNA, 20 bp, Artificial
  CRISPR gRNA sequence
gcctttatttttttaagttg

SEQ ID NO: 462261 - DNA, 20 bp, Artificial
  CRISPR gRNA sequence
tttttttaagttgaggaaac

SEQ ID NO: 462262 - DNA, 20 bp, Artificial
  CRISPR gRNA sequence
ttttttaagttgaggaaact

SEQ ID NO: 462263 - DNA, 20 bp, Artificial
  CRISPR gRNA sequence
aagttgaggaaactgggtat

SEQ ID NO: 462264 - DNA, 20 bp, Artificial
  CRISPR gRNA sequence
gttgaggaaactgggtatta

SEQ ID NO: 462265 - DNA, 20 bp, Artificial
  CRISPR gRNA sequence
aactgggtattagagaatat

SEQ ID NO: 462266 - DNA, 20 bp, Artificial
  CRISPR gRNA sequence
agaatataagccacttgccc

SEQ ID NO: 462267 - DNA, 20 bp, Artificial
  CRISPR gRNA sequence
agccacttgcccaagatcac

SEQ ID NO: 462268 - DNA, 20 bp, Artificial
  CRISPR gRNA sequence
acttgcccaagatcaccagc

SEQ ID NO: 462269 - DNA, 20 bp, Artificial
  CRISPR gRNA sequence
tgcccaagatcaccagctgg

SEQ ID NO: 462270 - DNA, 20 bp, Artificial
  CRISPR gRNA sequence
gcccaagatcaccagctggt

SEQ ID NO: 462271 - DNA, 20 bp, Artificial
  CRISPR gRNA sequence
ccaagatcaccagctggtag

SEQ ID NO: 462272 - DNA, 20 bp, Artificial
  CRISPR gRNA sequence
caagatcaccagctggtagg

SEQ ID NO: 462273 - DNA, 20 bp, Artificial
  CRISPR gRNA sequence
gatcaccagctggtaggagg

SEQ ID NO: 462274 - DNA, 20 bp, Artificial
  CRISPR gRNA sequence
tcaccagctggtaggaggaa

SEQ ID NO: 462275 - DNA, 20 bp, Artificial
  CRISPR gRNA sequence
agctggtaggaggaagagtc

SEQ ID NO: 462276 - DNA, 20 bp, Artificial
  CRISPR gRNA sequence
gctggtaggaggaagagtca

SEQ ID NO: 462277 - DNA, 20 bp, Artificial
  CRISPR gRNA sequence
gtaggaggaagagtcaaggc

SEQ ID NO: 462278 - DNA, 20 bp, Artificial
  CRISPR gRNA sequence
taggaggaagagtcaaggct

SEQ ID NO: 462279 - DNA, 20 bp, Artificial
  CRISPR gRNA sequence
tcaaggctaggactttaacc

SEQ ID NO: 462280 - DNA, 20 bp, Artificial
  CRISPR gRNA sequence
caaggctaggactttaaccc

SEQ ID NO: 462281 - DNA, 20 bp, Artificial
  CRISPR gRNA sequence
ctaggactttaacccaggtg

SEQ ID NO: 462282 - DNA, 20 bp, Artificial
  CRISPR gRNA sequence
cccaggtgtggctaactcca

SEQ ID NO: 462283 - DNA, 20 bp, Artificial
  CRISPR gRNA sequence
tgtggctaactccaaagcac

SEQ ID NO: 462284 - DNA, 20 bp, Artificial
  CRISPR gRNA sequence
ccaaagcacaagctcttatc

SEQ ID NO: 462285 - DNA, 20 bp, Artificial
  CRISPR gRNA sequence
aagcacaagctcttatccag

SEQ ID NO: 462286 - DNA, 20 bp, Artificial
  CRISPR gRNA sequence
agcacaagctcttatccagt

SEQ ID NO: 462287 - DNA, 20 bp, Artificial
  CRISPR gRNA sequence
gcacaagctcttatccagta

SEQ ID NO: 462288 - DNA, 20 bp, Artificial
  CRISPR gRNA sequence
atccagtagggttgttgtga

SEQ ID NO: 462289 - DNA, 20 bp, Artificial
  CRISPR gRNA sequence
gggttgttgtgaaagcaaat

SEQ ID NO: 462290 - DNA, 20 bp, Artificial
  CRISPR gRNA sequence
tgaaagcaaatgagaacata

SEQ ID NO: 462291 - DNA, 20 bp, Artificial
  CRISPR gRNA sequence
gaaagcaaatgagaacatat

SEQ ID NO: 462292 - DNA, 20 bp, Artificial
  CRISPR gRNA sequence
gaacatataggaaatattct

SEQ ID NO: 462293 - DNA, 20 bp, Artificial
  CRISPR gRNA sequence
aatattcttagcactatgct

SEQ ID NO: 462294 - DNA, 20 bp, Artificial
  CRISPR gRNA sequence
tggcacataacaacaacata

SEQ ID NO: 462295 - DNA, 20 bp, Artificial
  CRISPR gRNA sequence
ataacaacaacataaagtac

SEQ ID NO: 462296 - DNA, 20 bp, Artificial
  CRISPR gRNA sequence
gatattattatgttttctga

SEQ ID NO: 462297 - DNA, 20 bp, Artificial
  CRISPR gRNA sequence
atattattatgttttctgat

SEQ ID NO: 462298 - DNA, 20 bp, Artificial
  CRISPR gRNA sequence
gttttctgataggatgaatt

SEQ ID NO: 462299 - DNA, 20 bp, Artificial
  CRISPR gRNA sequence
ttttctgataggatgaattt

SEQ ID NO: 462300 - DNA, 20 bp, Artificial
  CRISPR gRNA sequence
tttctgataggatgaattta

SEQ ID NO: 462301 - DNA, 20 bp, Artificial
  CRISPR gRNA sequence
atgaatttagggaaatcaca

SEQ ID NO: 462302 - DNA, 20 bp, Artificial
  CRISPR gRNA sequence
aatttagggaaatcacacag

SEQ ID NO: 462303 - DNA, 20 bp, Artificial
  CRISPR gRNA sequence
agggaaatcacacagaagtt

SEQ ID NO: 462304 - DNA, 20 bp, Artificial
  CRISPR gRNA sequence
acagaagttgagtcattgtc

SEQ ID NO: 462305 - DNA, 20 bp, Artificial
  CRISPR gRNA sequence
agaagttgagtcattgtcca

SEQ ID NO: 462306 - DNA, 20 bp, Artificial
  CRISPR gRNA sequence
gaagttgagtcattgtccag

SEQ ID NO: 462307 - DNA, 20 bp, Artificial
  CRISPR gRNA sequence
agtcattgtccagaggtgta

SEQ ID NO: 462308 - DNA, 20 bp, Artificial
  CRISPR gRNA sequence
agaggtgtaaagcctatgaa

SEQ ID NO: 462309 - DNA, 20 bp, Artificial
  CRISPR gRNA sequence
tgtaaagcctatgaatggta

SEQ ID NO: 462310 - DNA, 20 bp, Artificial
  CRISPR gRNA sequence
agcctatgaatggtaaagac

SEQ ID NO: 462311 - DNA, 20 bp, Artificial
  CRISPR gRNA sequence
tatgaatggtaaagacaaga

SEQ ID NO: 462312 - DNA, 20 bp, Artificial
  CRISPR gRNA sequence
gtaaagacaagatggaaaca

SEQ ID NO: 462313 - DNA, 20 bp, Artificial
  CRISPR gRNA sequence
aagacaagatggaaacacag

SEQ ID NO: 462314 - DNA, 20 bp, Artificial
  CRISPR gRNA sequence
attacccccaacaaccattc

SEQ ID NO: 462315 - DNA, 20 bp, Artificial
  CRISPR gRNA sequence
ttacccccaacaaccattct

SEQ ID NO: 462316 - DNA, 20 bp, Artificial
  CRISPR gRNA sequence
tacccccaacaaccattcta

SEQ ID NO: 462317 - DNA, 20 bp, Artificial
  CRISPR gRNA sequence
ccaacaaccattctagggat

SEQ ID NO: 462318 - DNA, 20 bp, Artificial
  CRISPR gRNA sequence
acaaccattctagggatcag

SEQ ID NO: 462319 - DNA, 20 bp, Artificial
  CRISPR gRNA sequence
accattctagggatcagcag

SEQ ID NO: 462320 - DNA, 20 bp, Artificial
  CRISPR gRNA sequence
cagcagtggtgcataataac

SEQ ID NO: 462321 - DNA, 20 bp, Artificial
  CRISPR gRNA sequence
ataataactagtatatacac

SEQ ID NO: 462322 - DNA, 20 bp, Artificial
  CRISPR gRNA sequence
taataactagtatatacacc

SEQ ID NO: 462323 - DNA, 20 bp, Artificial
  CRISPR gRNA sequence
gcaaaaatatatctatataa

SEQ ID NO: 462324 - DNA, 20 bp, Artificial
  CRISPR gRNA sequence
aaaaatatatctatataata

SEQ ID NO: 462325 - DNA, 20 bp, Artificial
  CRISPR gRNA sequence
aaatatatctatataataga

SEQ ID NO: 462326 - DNA, 20 bp, Artificial
  CRISPR gRNA sequence
tatatctatataatagagag

SEQ ID NO: 462327 - DNA, 20 bp, Artificial
  CRISPR gRNA sequence
tctatataatagagagaaga

SEQ ID NO: 462328 - DNA, 20 bp, Artificial
  CRISPR gRNA sequence
ctatataatagagagaagaa

SEQ ID NO: 462329 - DNA, 20 bp, Artificial
  CRISPR gRNA sequence
tataatagagagaagaaagg

SEQ ID NO: 462330 - DNA, 20 bp, Artificial
  CRISPR gRNA sequence
aaaggcagcacatccaatat

SEQ ID NO: 462331 - DNA, 20 bp, Artificial
  CRISPR gRNA sequence
aagcatgctcttcttttatg

SEQ ID NO: 462332 - DNA, 20 bp, Artificial
  CRISPR gRNA sequence
agcatgctcttcttttatgt

SEQ ID NO: 462333 - DNA, 20 bp, Artificial
  CRISPR gRNA sequence
catgctcttcttttatgtgg

SEQ ID NO: 462334 - DNA, 20 bp, Artificial
  CRISPR gRNA sequence
tgctcttcttttatgtggga

SEQ ID NO: 462335 - DNA, 20 bp, Artificial
  CRISPR gRNA sequence
gctcttcttttatgtgggag

SEQ ID NO: 462336 - DNA, 20 bp, Artificial
  CRISPR gRNA sequence
atgtgggagaggaaactcta

SEQ ID NO: 462337 - DNA, 20 bp, Artificial
  CRISPR gRNA sequence
ctctacagaaatatattaac

SEQ ID NO: 462338 - DNA, 20 bp, Artificial
  CRISPR gRNA sequence
acagaaatatattaaccagc

SEQ ID NO: 462339 - DNA, 20 bp, Artificial
  CRISPR gRNA sequence
cagaaatatattaaccagca

SEQ ID NO: 462340 - DNA, 20 bp, Artificial
  CRISPR gRNA sequence
ttaaccagcaaggcttgcct

SEQ ID NO: 462341 - DNA, 20 bp, Artificial
  CRISPR gRNA sequence
aggcttgccttggtcaaaac

SEQ ID NO: 462342 - DNA, 20 bp, Artificial
  CRISPR gRNA sequence
ttgtcctttgataattttct

SEQ ID NO: 462343 - DNA, 20 bp, Artificial
  CRISPR gRNA sequence
taattttctaagcttgcttt

SEQ ID NO: 462344 - DNA, 20 bp, Artificial
  CRISPR gRNA sequence
aattttctaagcttgctttc

SEQ ID NO: 462345 - DNA, 20 bp, Artificial
  CRISPR gRNA sequence
ttcttcattacatctctgcc

SEQ ID NO: 462346 - DNA, 20 bp, Artificial
  CRISPR gRNA sequence
aagtcacaaatgtccccttg

SEQ ID NO: 462347 - DNA, 20 bp, Artificial
  CRISPR gRNA sequence
cccttgcagatctaccctac

SEQ ID NO: 462348 - DNA, 20 bp, Artificial
  CRISPR gRNA sequence
ggtcactgactttgcttctc

SEQ ID NO: 462349 - DNA, 20 bp, Artificial
  CRISPR gRNA sequence
gtcactgactttgcttctct

SEQ ID NO: 462350 - DNA, 20 bp, Artificial
  CRISPR gRNA sequence
ctgactttgcttctctaggc

SEQ ID NO: 462351 - DNA, 20 bp, Artificial
  CRISPR gRNA sequence
gactttgcttctctaggcca

SEQ ID NO: 462352 - DNA, 20 bp, Artificial
  CRISPR gRNA sequence
actttgcttctctaggccag

SEQ ID NO: 462353 - DNA, 20 bp, Artificial
  CRISPR gRNA sequence
ttcatatgcattgcactcct

SEQ ID NO: 462354 - DNA, 20 bp, Artificial
  CRISPR gRNA sequence
catatgcattgcactcctta

SEQ ID NO: 462355 - DNA, 20 bp, Artificial
  CRISPR gRNA sequence
ccctgtctactctgtgtaac

SEQ ID NO: 462356 - DNA, 20 bp, Artificial
  CRISPR gRNA sequence
cctgtctactctgtgtaaca

SEQ ID NO: 462357 - DNA, 20 bp, Artificial
  CRISPR gRNA sequence
ctactctgtgtaacaaggat

SEQ ID NO: 462358 - DNA, 20 bp, Artificial
  CRISPR gRNA sequence
gtgtaacaaggatgagtttc

SEQ ID NO: 462359 - DNA, 20 bp, Artificial
  CRISPR gRNA sequence
taacaaggatgagtttctgg

SEQ ID NO: 462360 - DNA, 20 bp, Artificial
  CRISPR gRNA sequence
ggatgagtttctggtggttt

SEQ ID NO: 462361 - DNA, 20 bp, Artificial
  CRISPR gRNA sequence
gagtttctggtggttttagt

SEQ ID NO: 462362 - DNA, 20 bp, Artificial
  CRISPR gRNA sequence
atgtaattatcgcccttgaa

SEQ ID NO: 462363 - DNA, 20 bp, Artificial
  CRISPR gRNA sequence
ttatcgcccttgaatagtaa

SEQ ID NO: 462364 - DNA, 20 bp, Artificial
  CRISPR gRNA sequence
ccttgaatagtaaaagcttc

SEQ ID NO: 462365 - DNA, 20 bp, Artificial
  CRISPR gRNA sequence
aagcttctagtcaacttaat

SEQ ID NO: 462366 - DNA, 20 bp, Artificial
  CRISPR gRNA sequence
agtcaacttaatgagtccta

SEQ ID NO: 462367 - DNA, 20 bp, Artificial
  CRISPR gRNA sequence
agtcctaaagaacaatgatt

SEQ ID NO: 462368 - DNA, 20 bp, Artificial
  CRISPR gRNA sequence
tcctaaagaacaatgattta

SEQ ID NO: 462369 - DNA, 20 bp, Artificial
  CRISPR gRNA sequence
ctaaagaacaatgatttaga

SEQ ID NO: 462370 - DNA, 20 bp, Artificial
  CRISPR gRNA sequence
ctttgattgcctgttacaca

SEQ ID NO: 462371 - DNA, 20 bp, Artificial
  CRISPR gRNA sequence
tttgattgcctgttacacat

SEQ ID NO: 462372 - DNA, 20 bp, Artificial
  CRISPR gRNA sequence
tacacataggccctgtcctt

SEQ ID NO: 462373 - DNA, 20 bp, Artificial
  CRISPR gRNA sequence
cacataggccctgtccttca

SEQ ID NO: 462374 - DNA, 20 bp, Artificial
  CRISPR gRNA sequence
cataggccctgtccttcaga

SEQ ID NO: 462375 - DNA, 20 bp, Artificial
  CRISPR gRNA sequence
ataggccctgtccttcagag

SEQ ID NO: 462376 - DNA, 20 bp, Artificial
  CRISPR gRNA sequence
taaattttccacctttgtca

SEQ ID NO: 462377 - DNA, 20 bp, Artificial
  CRISPR gRNA sequence
aaattttccacctttgtcac

SEQ ID NO: 462378 - DNA, 20 bp, Artificial
  CRISPR gRNA sequence
aattttccacctttgtcaca

SEQ ID NO: 462379 - DNA, 20 bp, Artificial
  CRISPR gRNA sequence
cacctttgtcacagggattt

SEQ ID NO: 462380 - DNA, 20 bp, Artificial
  CRISPR gRNA sequence
acctttgtcacagggatttc

SEQ ID NO: 462381 - DNA, 20 bp, Artificial
  CRISPR gRNA sequence
tttgtcacagggatttcagg

SEQ ID NO: 462382 - DNA, 20 bp, Artificial
  CRISPR gRNA sequence
agggatttcaggaagaaaca

SEQ ID NO: 462383 - DNA, 20 bp, Artificial
  CRISPR gRNA sequence
gggatttcaggaagaaacat

SEQ ID NO: 462384 - DNA, 20 bp, Artificial
  CRISPR gRNA sequence
ggatttcaggaagaaacata

SEQ ID NO: 462385 - DNA, 20 bp, Artificial
  CRISPR gRNA sequence
tttcaggaagaaacataggg

SEQ ID NO: 462386 - DNA, 20 bp, Artificial
  CRISPR gRNA sequence
gaaacatagggcagcaaatg

SEQ ID NO: 462387 - DNA, 20 bp, Artificial
  CRISPR gRNA sequence
catagggcagcaaatgtaga

SEQ ID NO: 462388 - DNA, 20 bp, Artificial
  CRISPR gRNA sequence
caaatgtagacagcatacct

SEQ ID NO: 462389 - DNA, 20 bp, Artificial
  CRISPR gRNA sequence
atgtagacagcatacctgag

SEQ ID NO: 462390 - DNA, 20 bp, Artificial
  CRISPR gRNA sequence
catacctgagaagctgttga

SEQ ID NO: 462391 - DNA, 20 bp, Artificial
  CRISPR gRNA sequence
acctgagaagctgttgacag

SEQ ID NO: 462392 - DNA, 20 bp, Artificial
  CRISPR gRNA sequence
gaagctgttgacagtagcat

SEQ ID NO: 462393 - DNA, 20 bp, Artificial
  CRISPR gRNA sequence
ctgttgacagtagcatcagt

SEQ ID NO: 462394 - DNA, 20 bp, Artificial
  CRISPR gRNA sequence
gtagcatcagtgagtgcctc

SEQ ID NO: 462395 - DNA, 20 bp, Artificial
  CRISPR gRNA sequence
gagtgcctctggcatttgat

SEQ ID NO: 462396 - DNA, 20 bp, Artificial
  CRISPR gRNA sequence
atttgatcagaaaccaacat

SEQ ID NO: 462397 - DNA, 20 bp, Artificial
  CRISPR gRNA sequence
gtatttctaaatattgactt

SEQ ID NO: 462398 - DNA, 20 bp, Artificial
  CRISPR gRNA sequence
tttctaaatattgacttcag

SEQ ID NO: 462399 - DNA, 20 bp, Artificial
  CRISPR gRNA sequence
ctaaatattgacttcagtgg

SEQ ID NO: 462400 - DNA, 20 bp, Artificial
  CRISPR gRNA sequence
taaatattgacttcagtgga

SEQ ID NO: 462401 - DNA, 20 bp, Artificial
  CRISPR gRNA sequence
ggattgttacttgtgatgtt

SEQ ID NO: 462402 - DNA, 20 bp, Artificial
  CRISPR gRNA sequence
ttacttgtgatgttcagatt

SEQ ID NO: 462403 - DNA, 20 bp, Artificial
  CRISPR gRNA sequence
tgtgatgttcagattaagtg

SEQ ID NO: 462404 - DNA, 20 bp, Artificial
  CRISPR gRNA sequence
tgtggcttatgtattatgat

SEQ ID NO: 462405 - DNA, 20 bp, Artificial
  CRISPR gRNA sequence
gcttatgtattatgattgga

SEQ ID NO: 462406 - DNA, 20 bp, Artificial
  CRISPR gRNA sequence
cttatgtattatgattggaa

SEQ ID NO: 462407 - DNA, 20 bp, Artificial
  CRISPR gRNA sequence
ttatgtattatgattggaaa

SEQ ID NO: 462408 - DNA, 20 bp, Artificial
  CRISPR gRNA sequence
gtattatgattggaaaggga

SEQ ID NO: 462409 - DNA, 20 bp, Artificial
  CRISPR gRNA sequence
gtccatctctactttcttcc

SEQ ID NO: 462410 - DNA, 20 bp, Artificial
  CRISPR gRNA sequence
atctctaatacattctacca

SEQ ID NO: 462411 - DNA, 20 bp, Artificial
  CRISPR gRNA sequence
tctaccacagacatcacact

SEQ ID NO: 462412 - DNA, 20 bp, Artificial
  CRISPR gRNA sequence
gacatcacactgagattcac

SEQ ID NO: 462413 - DNA, 20 bp, Artificial
  CRISPR gRNA sequence
gagattcactggcattttca

SEQ ID NO: 462414 - DNA, 20 bp, Artificial
  CRISPR gRNA sequence
tggcattttcaaagcccttg

SEQ ID NO: 462415 - DNA, 20 bp, Artificial
  CRISPR gRNA sequence
gatactaaacaatacttatg

SEQ ID NO: 462416 - DNA, 20 bp, Artificial
  CRISPR gRNA sequence
ctaaacaatacttatgtgga

SEQ ID NO: 462417 - DNA, 20 bp, Artificial
  CRISPR gRNA sequence
attctcatcttctaatatta

SEQ ID NO: 462418 - DNA, 20 bp, Artificial
  CRISPR gRNA sequence
tctcatcttctaatattata

SEQ ID NO: 462419 - DNA, 20 bp, Artificial
  CRISPR gRNA sequence
ctcatcttctaatattatag

SEQ ID NO: 462420 - DNA, 20 bp, Artificial
  CRISPR gRNA sequence
taatattatagaggaaaatg

SEQ ID NO: 462421 - DNA, 20 bp, Artificial
  CRISPR gRNA sequence
tattatagaggaaaatgaag

SEQ ID NO: 462422 - DNA, 20 bp, Artificial
  CRISPR gRNA sequence
attatagaggaaaatgaagt

SEQ ID NO: 462423 - DNA, 20 bp, Artificial
  CRISPR gRNA sequence
ttatagaggaaaatgaagtg

SEQ ID NO: 462424 - DNA, 20 bp, Artificial
  CRISPR gRNA sequence
gaagtggggccataaccccc

SEQ ID NO: 462425 - DNA, 20 bp, Artificial
  CRISPR gRNA sequence
agataaaaatctcaatgccc

SEQ ID NO: 462426 - DNA, 20 bp, Artificial
  CRISPR gRNA sequence
caatgccccagcctcccttg

SEQ ID NO: 462427 - DNA, 20 bp, Artificial
  CRISPR gRNA sequence
cctcccttgtagccaaatac

SEQ ID NO: 462428 - DNA, 20 bp, Artificial
  CRISPR gRNA sequence
tgtagccaaatactggataa

SEQ ID NO: 462429 - DNA, 20 bp, Artificial
  CRISPR gRNA sequence
gtagccaaatactggataat

SEQ ID NO: 462430 - DNA, 20 bp, Artificial
  CRISPR gRNA sequence
aggccatttgtgatgtgtgt

SEQ ID NO: 462431 - DNA, 20 bp, Artificial
  CRISPR gRNA sequence
tttgtgatgtgtgtgagttc

SEQ ID NO: 462432 - DNA, 20 bp, Artificial
  CRISPR gRNA sequence
ttgtgatgtgtgtgagttcc

SEQ ID NO: 462433 - DNA, 20 bp, Artificial
  CRISPR gRNA sequence
gagttccaggttgtgcttat

SEQ ID NO: 462434 - DNA, 20 bp, Artificial
  CRISPR gRNA sequence
ttgtgcttataagatgaaca

SEQ ID NO: 462435 - DNA, 20 bp, Artificial
  CRISPR gRNA sequence
ataagatgaacatggttatc

SEQ ID NO: 462436 - DNA, 20 bp, Artificial
  CRISPR gRNA sequence
agatgaacatggttatcaag

SEQ ID NO: 462437 - DNA, 20 bp, Artificial
  CRISPR gRNA sequence
gatgaacatggttatcaaga

SEQ ID NO: 462438 - DNA, 20 bp, Artificial
  CRISPR gRNA sequence
gaacatggttatcaagaagg

SEQ ID NO: 462439 - DNA, 20 bp, Artificial
  CRISPR gRNA sequence
gttatcaagaaggcagaaaa

SEQ ID NO: 462440 - DNA, 20 bp, Artificial
  CRISPR gRNA sequence
aaggcagaaaaaagaaatta

SEQ ID NO: 462441 - DNA, 20 bp, Artificial
  CRISPR gRNA sequence
ggcagaaaaaagaaattaaa

SEQ ID NO: 462442 - DNA, 20 bp, Artificial
  CRISPR gRNA sequence
aagaaattaaagagctctgc

SEQ ID NO: 462443 - DNA, 20 bp, Artificial
  CRISPR gRNA sequence
agctaaacttgatgttttcc

SEQ ID NO: 462444 - DNA, 20 bp, Artificial
  CRISPR gRNA sequence
gctaaacttgatgttttcct

SEQ ID NO: 462445 - DNA, 20 bp, Artificial
  CRISPR gRNA sequence
ggactgatctaacactcttc

SEQ ID NO: 462446 - DNA, 20 bp, Artificial
  CRISPR gRNA sequence
actcttctggactctgttct

SEQ ID NO: 462447 - DNA, 20 bp, Artificial
  CRISPR gRNA sequence
cacctctgcatgcatacaca

SEQ ID NO: 462448 - DNA, 20 bp, Artificial
  CRISPR gRNA sequence
cacagacacatgctgcacac

SEQ ID NO: 462449 - DNA, 20 bp, Artificial
  CRISPR gRNA sequence
cacaagccacttcttccatt

SEQ ID NO: 462450 - DNA, 20 bp, Artificial
  CRISPR gRNA sequence
attgagataaacatgtaaat

SEQ ID NO: 462451 - DNA, 20 bp, Artificial
  CRISPR gRNA sequence
ttgagataaacatgtaaatc

SEQ ID NO: 462452 - DNA, 20 bp, Artificial
  CRISPR gRNA sequence
taaatcaggtccataaccat

SEQ ID NO: 462453 - DNA, 20 bp, Artificial
  CRISPR gRNA sequence
aatcaggtccataaccatga

SEQ ID NO: 462454 - DNA, 20 bp, Artificial
  CRISPR gRNA sequence
ccataaccatgagagtatac

SEQ ID NO: 462455 - DNA, 20 bp, Artificial
  CRISPR gRNA sequence
aaccatgagagtataccaga

SEQ ID NO: 462456 - DNA, 20 bp, Artificial
  CRISPR gRNA sequence
accatgagagtataccagaa

SEQ ID NO: 462457 - DNA, 20 bp, Artificial
  CRISPR gRNA sequence
ccagaaaggtacaaaatatt

SEQ ID NO: 462458 - DNA, 20 bp, Artificial
  CRISPR gRNA sequence
caaaatattgagcttatttt

SEQ ID NO: 462459 - DNA, 20 bp, Artificial
  CRISPR gRNA sequence
aaaatattgagcttattttg

SEQ ID NO: 462460 - DNA, 20 bp, Artificial
  CRISPR gRNA sequence
tattgagcttattttgaggt

SEQ ID NO: 462461 - DNA, 20 bp, Artificial
  CRISPR gRNA sequence
ttgagcttattttgaggtaa

SEQ ID NO: 462462 - DNA, 20 bp, Artificial
  CRISPR gRNA sequence
cttattttgaggtaagagaa

SEQ ID NO: 462463 - DNA, 20 bp, Artificial
  CRISPR gRNA sequence
tattttgaggtaagagaatg

SEQ ID NO: 462464 - DNA, 20 bp, Artificial
  CRISPR gRNA sequence
ttttgaggtaagagaatgga

SEQ ID NO: 462465 - DNA, 20 bp, Artificial
  CRISPR gRNA sequence
ggtaagagaatggagagtat

SEQ ID NO: 462466 - DNA, 20 bp, Artificial
  CRISPR gRNA sequence
gagaatggagagtattagaa

SEQ ID NO: 462467 - DNA, 20 bp, Artificial
  CRISPR gRNA sequence
tggagagtattagaaaagtg

SEQ ID NO: 462468 - DNA, 20 bp, Artificial
  CRISPR gRNA sequence
tcactgacacaatacaactc

SEQ ID NO: 462469 - DNA, 20 bp, Artificial
  CRISPR gRNA sequence
aactcaagcgcatgattctc

SEQ ID NO: 462470 - DNA, 20 bp, Artificial
  CRISPR gRNA sequence
gcatgattctcaagcactat

SEQ ID NO: 462471 - DNA, 20 bp, Artificial
  CRISPR gRNA sequence
caagcactattagcttttct

SEQ ID NO: 462472 - DNA, 20 bp, Artificial
  CRISPR gRNA sequence
attagcttttcttggtgacc

SEQ ID NO: 462473 - DNA, 20 bp, Artificial
  CRISPR gRNA sequence
ttagcttttcttggtgacca

SEQ ID NO: 462474 - DNA, 20 bp, Artificial
  CRISPR gRNA sequence
ttttcttggtgaccaaggat

SEQ ID NO: 462475 - DNA, 20 bp, Artificial
  CRISPR gRNA sequence
ttcttggtgaccaaggataa

SEQ ID NO: 462476 - DNA, 20 bp, Artificial
  CRISPR gRNA sequence
ttggtgaccaaggataagag

SEQ ID NO: 462477 - DNA, 20 bp, Artificial
  CRISPR gRNA sequence
ataagagtagataatgcttt

SEQ ID NO: 462478 - DNA, 20 bp, Artificial
  CRISPR gRNA sequence
cttttggcatttttctcaca

SEQ ID NO: 462479 - DNA, 20 bp, Artificial
  CRISPR gRNA sequence
cttcatgacataaatgccaa

SEQ ID NO: 462480 - DNA, 20 bp, Artificial
  CRISPR gRNA sequence
aaagcaattgcaacaaactg

SEQ ID NO: 462481 - DNA, 20 bp, Artificial
  CRISPR gRNA sequence
caaactgaagaacttctgca

SEQ ID NO: 462482 - DNA, 20 bp, Artificial
  CRISPR gRNA sequence
gaagaacttctgcacagcaa

SEQ ID NO: 462483 - DNA, 20 bp, Artificial
  CRISPR gRNA sequence
acagcaaaagaaactctcat

SEQ ID NO: 462484 - DNA, 20 bp, Artificial
  CRISPR gRNA sequence
agcaaaagaaactctcatca

SEQ ID NO: 462485 - DNA, 20 bp, Artificial
  CRISPR gRNA sequence
gaaactctcatcagagcaaa

SEQ ID NO: 462486 - DNA, 20 bp, Artificial
  CRISPR gRNA sequence
aaactctcatcagagcaaaa

SEQ ID NO: 462487 - DNA, 20 bp, Artificial
  CRISPR gRNA sequence
cagagcaaaaaggcaaccta

SEQ ID NO: 462488 - DNA, 20 bp, Artificial
  CRISPR gRNA sequence
caaaaaggcaacctacagaa

SEQ ID NO: 462489 - DNA, 20 bp, Artificial
  CRISPR gRNA sequence
aaaaaggcaacctacagaat

SEQ ID NO: 462490 - DNA, 20 bp, Artificial
  CRISPR gRNA sequence
aaaggcaacctacagaatgg

SEQ ID NO: 462491 - DNA, 20 bp, Artificial
  CRISPR gRNA sequence
tgcaatctacccatctgaaa

SEQ ID NO: 462492 - DNA, 20 bp, Artificial
  CRISPR gRNA sequence
gcaatctacccatctgaaaa

SEQ ID NO: 462493 - DNA, 20 bp, Artificial
  CRISPR gRNA sequence
tctgaaaaaggcctaatatc

SEQ ID NO: 462494 - DNA, 20 bp, Artificial
  CRISPR gRNA sequence
gcctaatatccagaatttac

SEQ ID NO: 462495 - DNA, 20 bp, Artificial
  CRISPR gRNA sequence
aatttacaagaaacttaaat

SEQ ID NO: 462496 - DNA, 20 bp, Artificial
  CRISPR gRNA sequence
agaaacttaaataagtttac

SEQ ID NO: 462497 - DNA, 20 bp, Artificial
  CRISPR gRNA sequence
aaacaaacaaccgcatcaaa

SEQ ID NO: 462498 - DNA, 20 bp, Artificial
  CRISPR gRNA sequence
caaacaaccgcatcaaaaag

SEQ ID NO: 462499 - DNA, 20 bp, Artificial
  CRISPR gRNA sequence
aaacaaccgcatcaaaaagt

SEQ ID NO: 462500 - DNA, 20 bp, Artificial
  CRISPR gRNA sequence
accgcatcaaaaagtgggca

SEQ ID NO: 462501 - DNA, 20 bp, Artificial
  CRISPR gRNA sequence
ccgcatcaaaaagtgggcaa

SEQ ID NO: 462502 - DNA, 20 bp, Artificial
  CRISPR gRNA sequence
gggcaaaggatatgaacaca

SEQ ID NO: 462503 - DNA, 20 bp, Artificial
  CRISPR gRNA sequence
cagttctctctgtttttttt

SEQ ID NO: 462504 - DNA, 20 bp, Artificial
  CRISPR gRNA sequence
gttctctctgtttttttttg

SEQ ID NO: 462505 - DNA, 20 bp, Artificial
  CRISPR gRNA sequence
tctctgtttttttttggaga

SEQ ID NO: 462506 - DNA, 20 bp, Artificial
  CRISPR gRNA sequence
tctgtttttttttggagaca

SEQ ID NO: 462507 - DNA, 20 bp, Artificial
  CRISPR gRNA sequence
cagagtctcactctgttacc

SEQ ID NO: 462508 - DNA, 20 bp, Artificial
  CRISPR gRNA sequence
gtctcactctgttacccagc

SEQ ID NO: 462509 - DNA, 20 bp, Artificial
  CRISPR gRNA sequence
ctcactctgttacccagctg

SEQ ID NO: 462510 - DNA, 20 bp, Artificial
  CRISPR gRNA sequence
tctgttacccagctggagtg

SEQ ID NO: 462511 - DNA, 20 bp, Artificial
  CRISPR gRNA sequence
gttacccagctggagtgcag

SEQ ID NO: 462512 - DNA, 20 bp, Artificial
  CRISPR gRNA sequence
tggagtgcagtggtgcaacc

SEQ ID NO: 462513 - DNA, 20 bp, Artificial
  CRISPR gRNA sequence
aacctggctcactgcaactt

SEQ ID NO: 462514 - DNA, 20 bp, Artificial
  CRISPR gRNA sequence
tcactgcaacttcagtctcc

SEQ ID NO: 462515 - DNA, 20 bp, Artificial
  CRISPR gRNA sequence
cactgcaacttcagtctcct

SEQ ID NO: 462516 - DNA, 20 bp, Artificial
  CRISPR gRNA sequence
aacttcagtctcctgggttc

SEQ ID NO: 462517 - DNA, 20 bp, Artificial
  CRISPR gRNA sequence
gggttcaagcaattctgcct

SEQ ID NO: 462518 - DNA, 20 bp, Artificial
  CRISPR gRNA sequence
caattctgcctcagcctccc

SEQ ID NO: 462519 - DNA, 20 bp, Artificial
  CRISPR gRNA sequence
ttctgcctcagcctcccaag

SEQ ID NO: 462520 - DNA, 20 bp, Artificial
  CRISPR gRNA sequence
gcctcagcctcccaagtagc

SEQ ID NO: 462521 - DNA, 20 bp, Artificial
  CRISPR gRNA sequence
ctcccaagtagctggtctta

SEQ ID NO: 462522 - DNA, 20 bp, Artificial
  CRISPR gRNA sequence
tcccaagtagctggtcttac

SEQ ID NO: 462523 - DNA, 20 bp, Artificial
  CRISPR gRNA sequence
caggcgtgtcccaccacgcc

SEQ ID NO: 462524 - DNA, 20 bp, Artificial
  CRISPR gRNA sequence
ccagctaatttttgtatttt

SEQ ID NO: 462525 - DNA, 20 bp, Artificial
  CRISPR gRNA sequence
taatttttgtatttttagta

SEQ ID NO: 462526 - DNA, 20 bp, Artificial
  CRISPR gRNA sequence
ttttgtatttttagtacaga

SEQ ID NO: 462527 - DNA, 20 bp, Artificial
  CRISPR gRNA sequence
tttgtatttttagtacagac

SEQ ID NO: 462528 - DNA, 20 bp, Artificial
  CRISPR gRNA sequence
ttgtatttttagtacagaca

SEQ ID NO: 462529 - DNA, 20 bp, Artificial
  CRISPR gRNA sequence
cagacagggtttcactatgc

SEQ ID NO: 462530 - DNA, 20 bp, Artificial
  CRISPR gRNA sequence
cagggtttcactatgctggc

SEQ ID NO: 462531 - DNA, 20 bp, Artificial
  CRISPR gRNA sequence
ctcaaatgacccgccctcct

SEQ ID NO: 462532 - DNA, 20 bp, Artificial
  CRISPR gRNA sequence
ccgccctcctcagcttcctg

SEQ ID NO: 462533 - DNA, 20 bp, Artificial
  CRISPR gRNA sequence
tcctcagcttcctgaagtgc

SEQ ID NO: 462534 - DNA, 20 bp, Artificial
  CRISPR gRNA sequence
cctcagcttcctgaagtgct

SEQ ID NO: 462535 - DNA, 20 bp, Artificial
  CRISPR gRNA sequence
ttcctgaagtgctgggatta

SEQ ID NO: 462536 - DNA, 20 bp, Artificial
  CRISPR gRNA sequence
tcctgaagtgctgggattac

SEQ ID NO: 462537 - DNA, 20 bp, Artificial
  CRISPR gRNA sequence
gaagtgctgggattacaggc

SEQ ID NO: 462538 - DNA, 20 bp, Artificial
  CRISPR gRNA sequence
agtgctgggattacaggcga

SEQ ID NO: 462539 - DNA, 20 bp, Artificial
  CRISPR gRNA sequence
caggcgagagccactacacc

SEQ ID NO: 462540 - DNA, 20 bp, Artificial
  CRISPR gRNA sequence
gccactacacccagcctaaa

SEQ ID NO: 462541 - DNA, 20 bp, Artificial
  CRISPR gRNA sequence
cctaaacagacacttctcaa

SEQ ID NO: 462542 - DNA, 20 bp, Artificial
  CRISPR gRNA sequence
aaacagacacttctcaaaag

SEQ ID NO: 462543 - DNA, 20 bp, Artificial
  CRISPR gRNA sequence
cacttctcaaaagaagacac

SEQ ID NO: 462544 - DNA, 20 bp, Artificial
  CRISPR gRNA sequence
tctcaaaagaagacactggc

SEQ ID NO: 462545 - DNA, 20 bp, Artificial
  CRISPR gRNA sequence
ctcaaaagaagacactggct

SEQ ID NO: 462546 - DNA, 20 bp, Artificial
  CRISPR gRNA sequence
aagaagacactggctgggcg

SEQ ID NO: 462547 - DNA, 20 bp, Artificial
  CRISPR gRNA sequence
aagacactggctgggcgcgg

SEQ ID NO: 462548 - DNA, 20 bp, Artificial
  CRISPR gRNA sequence
gtggctcacgcctgtaatcc

SEQ ID NO: 462549 - DNA, 20 bp, Artificial
  CRISPR gRNA sequence
cgcctgtaatcccagcactt

SEQ ID NO: 462550 - DNA, 20 bp, Artificial
  CRISPR gRNA sequence
gcctgtaatcccagcacttt

SEQ ID NO: 462551 - DNA, 20 bp, Artificial
  CRISPR gRNA sequence
ctgtaatcccagcactttgg

SEQ ID NO: 462552 - DNA, 20 bp, Artificial
  CRISPR gRNA sequence
tgtaatcccagcactttggg

SEQ ID NO: 462553 - DNA, 20 bp, Artificial
  CRISPR gRNA sequence
tcccagcactttgggaggcc

SEQ ID NO: 462554 - DNA, 20 bp, Artificial
  CRISPR gRNA sequence
agcactttgggaggccgaga

SEQ ID NO: 462555 - DNA, 20 bp, Artificial
  CRISPR gRNA sequence
gcactttgggaggccgagac

SEQ ID NO: 462556 - DNA, 20 bp, Artificial
  CRISPR gRNA sequence
ctttgggaggccgagacagg

SEQ ID NO: 462557 - DNA, 20 bp, Artificial
  CRISPR gRNA sequence
ggccgagacaggtggatcat

SEQ ID NO: 462558 - DNA, 20 bp, Artificial
  CRISPR gRNA sequence
gccgagacaggtggatcatg

SEQ ID NO: 462559 - DNA, 20 bp, Artificial
  CRISPR gRNA sequence
agacaggtggatcatgaggt

SEQ ID NO: 462560 - DNA, 20 bp, Artificial
  CRISPR gRNA sequence
gacaggtggatcatgaggtc

SEQ ID NO: 462561 - DNA, 20 bp, Artificial
  CRISPR gRNA sequence
caggtggatcatgaggtcag

SEQ ID NO: 462562 - DNA, 20 bp, Artificial
  CRISPR gRNA sequence
gatcatgaggtcaggagatc

SEQ ID NO: 462563 - DNA, 20 bp, Artificial
  CRISPR gRNA sequence
caagaccatcctgactaaca

SEQ ID NO: 462564 - DNA, 20 bp, Artificial
  CRISPR gRNA sequence
gtactaaaaatacaaaaaat

SEQ ID NO: 462565 - DNA, 20 bp, Artificial
  CRISPR gRNA sequence
taaaaatacaaaaaattagc

SEQ ID NO: 462566 - DNA, 20 bp, Artificial
  CRISPR gRNA sequence
aaaaatacaaaaaattagcc

SEQ ID NO: 462567 - DNA, 20 bp, Artificial
  CRISPR gRNA sequence
tacaaaaaattagccaggcg

SEQ ID NO: 462568 - DNA, 20 bp, Artificial
  CRISPR gRNA sequence
aaaaaattagccaggcgtgg

SEQ ID NO: 462569 - DNA, 20 bp, Artificial
  CRISPR gRNA sequence
aaattagccaggcgtggtgg

SEQ ID NO: 462570 - DNA, 20 bp, Artificial
  CRISPR gRNA sequence
ggcgtggtggcagccgcctg

SEQ ID NO: 462571 - DNA, 20 bp, Artificial
  CRISPR gRNA sequence
gtggcagccgcctgtagtcc

SEQ ID NO: 462572 - DNA, 20 bp, Artificial
  CRISPR gRNA sequence
cgcctgtagtcccagctact

SEQ ID NO: 462573 - DNA, 20 bp, Artificial
  CRISPR gRNA sequence
gcctgtagtcccagctactc

SEQ ID NO: 462574 - DNA, 20 bp, Artificial
  CRISPR gRNA sequence
ctgtagtcccagctactcgg

SEQ ID NO: 462575 - DNA, 20 bp, Artificial
  CRISPR gRNA sequence
tgtagtcccagctactcggg

SEQ ID NO: 462576 - DNA, 20 bp, Artificial
  CRISPR gRNA sequence
tcccagctactcgggaggct

SEQ ID NO: 462577 - DNA, 20 bp, Artificial
  CRISPR gRNA sequence
agctactcgggaggctgagt

SEQ ID NO: 462578 - DNA, 20 bp, Artificial
  CRISPR gRNA sequence
gctactcgggaggctgagtt

SEQ ID NO: 462579 - DNA, 20 bp, Artificial
  CRISPR gRNA sequence
tactcgggaggctgagttag

SEQ ID NO: 462580 - DNA, 20 bp, Artificial
  CRISPR gRNA sequence
gggaggctgagttaggagaa

SEQ ID NO: 462581 - DNA, 20 bp, Artificial
  CRISPR gRNA sequence
ctgagttaggagaatggcat

SEQ ID NO: 462582 - DNA, 20 bp, Artificial
  CRISPR gRNA sequence
ttaggagaatggcatgagcc

SEQ ID NO: 462583 - DNA, 20 bp, Artificial
  CRISPR gRNA sequence
taggagaatggcatgagccc

SEQ ID NO: 462584 - DNA, 20 bp, Artificial
  CRISPR gRNA sequence
ggagaatggcatgagcccgg

SEQ ID NO: 462585 - DNA, 20 bp, Artificial
  CRISPR gRNA sequence
gagaatggcatgagcccggg

SEQ ID NO: 462586 - DNA, 20 bp, Artificial
  CRISPR gRNA sequence
aatggcatgagcccgggagg

SEQ ID NO: 462587 - DNA, 20 bp, Artificial
  CRISPR gRNA sequence
tggcatgagcccgggaggca

SEQ ID NO: 462588 - DNA, 20 bp, Artificial
  CRISPR gRNA sequence
agcccgggaggcagagcttg

SEQ ID NO: 462589 - DNA, 20 bp, Artificial
  CRISPR gRNA sequence
cgggaggcagagcttgcagt

SEQ ID NO: 462590 - DNA, 20 bp, Artificial
  CRISPR gRNA sequence
gaggcagagcttgcagtgag

SEQ ID NO: 462591 - DNA, 20 bp, Artificial
  CRISPR gRNA sequence
ggcagagcttgcagtgagcg

SEQ ID NO: 462592 - DNA, 20 bp, Artificial
  CRISPR gRNA sequence
gagattgcgccactgcactc

SEQ ID NO: 462593 - DNA, 20 bp, Artificial
  CRISPR gRNA sequence
tgcgccactgcactccagcc

SEQ ID NO: 462594 - DNA, 20 bp, Artificial
  CRISPR gRNA sequence
gcgccactgcactccagcct

SEQ ID NO: 462595 - DNA, 20 bp, Artificial
  CRISPR gRNA sequence
ctgcactccagcctgggcga

SEQ ID NO: 462596 - DNA, 20 bp, Artificial
  CRISPR gRNA sequence
gcactccagcctgggcgaca

SEQ ID NO: 462597 - DNA, 20 bp, Artificial
  CRISPR gRNA sequence
cactctatctcaaaaaaaaa

SEQ ID NO: 462598 - DNA, 20 bp, Artificial
  CRISPR gRNA sequence
tctatctcaaaaaaaaaaag

SEQ ID NO: 462599 - DNA, 20 bp, Artificial
  CRISPR gRNA sequence
tttatgccaccaacaaacat

SEQ ID NO: 462600 - DNA, 20 bp, Artificial
  CRISPR gRNA sequence
accaacaaacataagaataa

SEQ ID NO: 462601 - DNA, 20 bp, Artificial
  CRISPR gRNA sequence
taaaagctcaacatcactga

SEQ ID NO: 462602 - DNA, 20 bp, Artificial
  CRISPR gRNA sequence
agctcaacatcactgatggt

SEQ ID NO: 462603 - DNA, 20 bp, Artificial
  CRISPR gRNA sequence
ctcaacatcactgatggtca

SEQ ID NO: 462604 - DNA, 20 bp, Artificial
  CRISPR gRNA sequence
gaaatgtaaatcaaaaccac

SEQ ID NO: 462605 - DNA, 20 bp, Artificial
  CRISPR gRNA sequence
aaatgtaaatcaaaaccaca

SEQ ID NO: 462606 - DNA, 20 bp, Artificial
  CRISPR gRNA sequence
atgtaaatcaaaaccacaag

SEQ ID NO: 462607 - DNA, 20 bp, Artificial
  CRISPR gRNA sequence
aaggagataacatctcacgc

SEQ ID NO: 462608 - DNA, 20 bp, Artificial
  CRISPR gRNA sequence
agataacatctcacgccagt

SEQ ID NO: 462609 - DNA, 20 bp, Artificial
  CRISPR gRNA sequence
acatctcacgccagtcagaa

SEQ ID NO: 462610 - DNA, 20 bp, Artificial
  CRISPR gRNA sequence
tcagaatggtgattattaaa

SEQ ID NO: 462611 - DNA, 20 bp, Artificial
  CRISPR gRNA sequence
aatggtgattattaaaaagt

SEQ ID NO: 462612 - DNA, 20 bp, Artificial
  CRISPR gRNA sequence
atggtgattattaaaaagtc

SEQ ID NO: 462613 - DNA, 20 bp, Artificial
  CRISPR gRNA sequence
attaaaaagtcaggaaacaa

SEQ ID NO: 462614 - DNA, 20 bp, Artificial
  CRISPR gRNA sequence
ttaaaaagtcaggaaacaat

SEQ ID NO: 462615 - DNA, 20 bp, Artificial
  CRISPR gRNA sequence
agtcaggaaacaataggtgc

SEQ ID NO: 462616 - DNA, 20 bp, Artificial
  CRISPR gRNA sequence
aggaaacaataggtgctggc

SEQ ID NO: 462617 - DNA, 20 bp, Artificial
  CRISPR gRNA sequence
aataggtgctggcaagtctg

SEQ ID NO: 462618 - DNA, 20 bp, Artificial
  CRISPR gRNA sequence
taggtgctggcaagtctgtg

SEQ ID NO: 462619 - DNA, 20 bp, Artificial
  CRISPR gRNA sequence
ctggcaagtctgtggagaat

SEQ ID NO: 462620 - DNA, 20 bp, Artificial
  CRISPR gRNA sequence
tggcaagtctgtggagaatt

SEQ ID NO: 462621 - DNA, 20 bp, Artificial
  CRISPR gRNA sequence
gaattaggaatgcttttaca

SEQ ID NO: 462622 - DNA, 20 bp, Artificial
  CRISPR gRNA sequence
taggaatgcttttacacggt

SEQ ID NO: 462623 - DNA, 20 bp, Artificial
  CRISPR gRNA sequence
gaatgcttttacacggttgg

SEQ ID NO: 462624 - DNA, 20 bp, Artificial
  CRISPR gRNA sequence
aatgcttttacacggttggt

SEQ ID NO: 462625 - DNA, 20 bp, Artificial
  CRISPR gRNA sequence
tgcttttacacggttggtgg

SEQ ID NO: 462626 - DNA, 20 bp, Artificial
  CRISPR gRNA sequence
cggttggtgggagtgtaaat

SEQ ID NO: 462627 - DNA, 20 bp, Artificial
  CRISPR gRNA sequence
gtaaattagttcaaccattg

SEQ ID NO: 462628 - DNA, 20 bp, Artificial
  CRISPR gRNA sequence
aattagttcaaccattgtgg

SEQ ID NO: 462629 - DNA, 20 bp, Artificial
  CRISPR gRNA sequence
agttcaaccattgtggaaga

SEQ ID NO: 462630 - DNA, 20 bp, Artificial
  CRISPR gRNA sequence
aaccattgtggaagacagta

SEQ ID NO: 462631 - DNA, 20 bp, Artificial
  CRISPR gRNA sequence
agtatggcaattcctcgatc

SEQ ID NO: 462632 - DNA, 20 bp, Artificial
  CRISPR gRNA sequence
gcaattcctcgatctagaac

SEQ ID NO: 462633 - DNA, 20 bp, Artificial
  CRISPR gRNA sequence
accagaaataccatttgacc

SEQ ID NO: 462634 - DNA, 20 bp, Artificial
  CRISPR gRNA sequence
tgacccagcaatcccgttac

SEQ ID NO: 462635 - DNA, 20 bp, Artificial
  CRISPR gRNA sequence
gacccagcaatcccgttact

SEQ ID NO: 462636 - DNA, 20 bp, Artificial
  CRISPR gRNA sequence
cgttactgggtatatactca

SEQ ID NO: 462637 - DNA, 20 bp, Artificial
  CRISPR gRNA sequence
gttactgggtatatactcaa

SEQ ID NO: 462638 - DNA, 20 bp, Artificial
  CRISPR gRNA sequence
atataaatcattctactata

SEQ ID NO: 462639 - DNA, 20 bp, Artificial
  CRISPR gRNA sequence
atgcacacgtatgtttattg

SEQ ID NO: 462640 - DNA, 20 bp, Artificial
  CRISPR gRNA sequence
tattgcagcactatttacaa

SEQ ID NO: 462641 - DNA, 20 bp, Artificial
  CRISPR gRNA sequence
cagcactatttacaatagca

SEQ ID NO: 462642 - DNA, 20 bp, Artificial
  CRISPR gRNA sequence
tatttacaatagcaaagaca

SEQ ID NO: 462643 - DNA, 20 bp, Artificial
  CRISPR gRNA sequence
acccaaatgcccatcaatga

SEQ ID NO: 462644 - DNA, 20 bp, Artificial
  CRISPR gRNA sequence
aatgcccatcaatgatagac

SEQ ID NO: 462645 - DNA, 20 bp, Artificial
  CRISPR gRNA sequence
catcaatgatagactggaaa

SEQ ID NO: 462646 - DNA, 20 bp, Artificial
  CRISPR gRNA sequence
tagactggaaaaagaaaata

SEQ ID NO: 462647 - DNA, 20 bp, Artificial
  CRISPR gRNA sequence
aatatggtacatatacaccg

SEQ ID NO: 462648 - DNA, 20 bp, Artificial
  CRISPR gRNA sequence
atacaccgtggaatactatg

SEQ ID NO: 462649 - DNA, 20 bp, Artificial
  CRISPR gRNA sequence
aatactatgcagccataaaa

SEQ ID NO: 462650 - DNA, 20 bp, Artificial
  CRISPR gRNA sequence
atgcagccataaaaaagaat

SEQ ID NO: 462651 - DNA, 20 bp, Artificial
  CRISPR gRNA sequence
gaatgagatcatgccctttg

SEQ ID NO: 462652 - DNA, 20 bp, Artificial
  CRISPR gRNA sequence
aatgagatcatgccctttgc

SEQ ID NO: 462653 - DNA, 20 bp, Artificial
  CRISPR gRNA sequence
atgagatcatgccctttgca

SEQ ID NO: 462654 - DNA, 20 bp, Artificial
  CRISPR gRNA sequence
tcatgccctttgcagggaca

SEQ ID NO: 462655 - DNA, 20 bp, Artificial
  CRISPR gRNA sequence
cctttgcagggacatggatg

SEQ ID NO: 462656 - DNA, 20 bp, Artificial
  CRISPR gRNA sequence
tgcagggacatggatgaagc

SEQ ID NO: 462657 - DNA, 20 bp, Artificial
  CRISPR gRNA sequence
agggacatggatgaagctgg

SEQ ID NO: 462658 - DNA, 20 bp, Artificial
  CRISPR gRNA sequence
aagctggaagccatcatcct

SEQ ID NO: 462659 - DNA, 20 bp, Artificial
  CRISPR gRNA sequence
tcatcctaagcaaactaaca

SEQ ID NO: 462660 - DNA, 20 bp, Artificial
  CRISPR gRNA sequence
catcctaagcaaactaacac

SEQ ID NO: 462661 - DNA, 20 bp, Artificial
  CRISPR gRNA sequence
taagcaaactaacacaggaa

SEQ ID NO: 462662 - DNA, 20 bp, Artificial
  CRISPR gRNA sequence
cactgcatgttctcactcat

SEQ ID NO: 462663 - DNA, 20 bp, Artificial
  CRISPR gRNA sequence
tgcatgttctcactcataag

SEQ ID NO: 462664 - DNA, 20 bp, Artificial
  CRISPR gRNA sequence
atgttctcactcataagtgg

SEQ ID NO: 462665 - DNA, 20 bp, Artificial
  CRISPR gRNA sequence
cataagtggaagttgaaaat

SEQ ID NO: 462666 - DNA, 20 bp, Artificial
  CRISPR gRNA sequence
aagttgaaaatgagaatata

SEQ ID NO: 462667 - DNA, 20 bp, Artificial
  CRISPR gRNA sequence
aaaatgagaatatatggaca

SEQ ID NO: 462668 - DNA, 20 bp, Artificial
  CRISPR gRNA sequence
aatgagaatatatggacaca

SEQ ID NO: 462669 - DNA, 20 bp, Artificial
  CRISPR gRNA sequence
tgagaatatatggacacaga

SEQ ID NO: 462670 - DNA, 20 bp, Artificial
  CRISPR gRNA sequence
gagaatatatggacacagag

SEQ ID NO: 462671 - DNA, 20 bp, Artificial
  CRISPR gRNA sequence
agaatatatggacacagaga

SEQ ID NO: 462672 - DNA, 20 bp, Artificial
  CRISPR gRNA sequence
gaatatatggacacagagag

SEQ ID NO: 462673 - DNA, 20 bp, Artificial
  CRISPR gRNA sequence
gagaggggaataacacaaac

SEQ ID NO: 462674 - DNA, 20 bp, Artificial
  CRISPR gRNA sequence
gaggggaataacacaaacca

SEQ ID NO: 462675 - DNA, 20 bp, Artificial
  CRISPR gRNA sequence
taacacaaaccagagcctgt

SEQ ID NO: 462676 - DNA, 20 bp, Artificial
  CRISPR gRNA sequence
aacacaaaccagagcctgtt

SEQ ID NO: 462677 - DNA, 20 bp, Artificial
  CRISPR gRNA sequence
acacaaaccagagcctgttg

SEQ ID NO: 462678 - DNA, 20 bp, Artificial
  CRISPR gRNA sequence
acaaaccagagcctgttggg

SEQ ID NO: 462679 - DNA, 20 bp, Artificial
  CRISPR gRNA sequence
aaccagagcctgttggggag

SEQ ID NO: 462680 - DNA, 20 bp, Artificial
  CRISPR gRNA sequence
accagagcctgttggggagt

SEQ ID NO: 462681 - DNA, 20 bp, Artificial
  CRISPR gRNA sequence
ccagagcctgttggggagta

SEQ ID NO: 462682 - DNA, 20 bp, Artificial
  CRISPR gRNA sequence
cagagcctgttggggagtag

SEQ ID NO: 462683 - DNA, 20 bp, Artificial
  CRISPR gRNA sequence
agagcctgttggggagtagg

SEQ ID NO: 462684 - DNA, 20 bp, Artificial
  CRISPR gRNA sequence
agcctgttggggagtagggg

SEQ ID NO: 462685 - DNA, 20 bp, Artificial
  CRISPR gRNA sequence
cctgttggggagtaggggga

SEQ ID NO: 462686 - DNA, 20 bp, Artificial
  CRISPR gRNA sequence
ctgttggggagtagggggag

SEQ ID NO: 462687 - DNA, 20 bp, Artificial
  CRISPR gRNA sequence
gttggggagtagggggagag

SEQ ID NO: 462688 - DNA, 20 bp, Artificial
  CRISPR gRNA sequence
tggggagtagggggagagga

SEQ ID NO: 462689 - DNA, 20 bp, Artificial
  CRISPR gRNA sequence
ggggagtagggggagaggag

SEQ ID NO: 462690 - DNA, 20 bp, Artificial
  CRISPR gRNA sequence
gggagtagggggagaggaga

SEQ ID NO: 462691 - DNA, 20 bp, Artificial
  CRISPR gRNA sequence
gggggagaggagagggaact

SEQ ID NO: 462692 - DNA, 20 bp, Artificial
  CRISPR gRNA sequence
gggagaggagagggaactta

SEQ ID NO: 462693 - DNA, 20 bp, Artificial
  CRISPR gRNA sequence
ggagaggagagggaacttag

SEQ ID NO: 462694 - DNA, 20 bp, Artificial
  CRISPR gRNA sequence
aggagagggaacttagagga

SEQ ID NO: 462695 - DNA, 20 bp, Artificial
  CRISPR gRNA sequence
ggagagggaacttagaggat

SEQ ID NO: 462696 - DNA, 20 bp, Artificial
  CRISPR gRNA sequence
gaacttagaggatgggtcaa

SEQ ID NO: 462697 - DNA, 20 bp, Artificial
  CRISPR gRNA sequence
aacttagaggatgggtcaat

SEQ ID NO: 462698 - DNA, 20 bp, Artificial
  CRISPR gRNA sequence
agaggatgggtcaataggtt

SEQ ID NO: 462699 - DNA, 20 bp, Artificial
  CRISPR gRNA sequence
ataggttaagcaaaccatca

SEQ ID NO: 462700 - DNA, 20 bp, Artificial
  CRISPR gRNA sequence
tgtatcctgttttccttttt

SEQ ID NO: 462701 - DNA, 20 bp, Artificial
  CRISPR gRNA sequence
atcctgttttccttttttag

SEQ ID NO: 462702 - DNA, 20 bp, Artificial
  CRISPR gRNA sequence
ttccttttttagaagaaata

SEQ ID NO: 462703 - DNA, 20 bp, Artificial
  CRISPR gRNA sequence
tagaagaaataaagaaaaaa

SEQ ID NO: 462704 - DNA, 20 bp, Artificial
  CRISPR gRNA sequence
gaagaaataaagaaaaaaaa

SEQ ID NO: 462705 - DNA, 20 bp, Artificial
  CRISPR gRNA sequence
gaaataaagaaaaaaaagag

SEQ ID NO: 462706 - DNA, 20 bp, Artificial
  CRISPR gRNA sequence
aaagagtagataataatatc

SEQ ID NO: 462707 - DNA, 20 bp, Artificial
  CRISPR gRNA sequence
agagtagataataatatcaa

SEQ ID NO: 462708 - DNA, 20 bp, Artificial
  CRISPR gRNA sequence
ataatatcaagagtaattta

SEQ ID NO: 462709 - DNA, 20 bp, Artificial
  CRISPR gRNA sequence
atatcaagagtaatttatag

SEQ ID NO: 462710 - DNA, 20 bp, Artificial
  CRISPR gRNA sequence
gaactccaaatttttatttg

SEQ ID NO: 462711 - DNA, 20 bp, Artificial
  CRISPR gRNA sequence
gtcacccaatgttactttaa

SEQ ID NO: 462712 - DNA, 20 bp, Artificial
  CRISPR gRNA sequence
tcacccaatgttactttaac

SEQ ID NO: 462713 - DNA, 20 bp, Artificial
  CRISPR gRNA sequence
ctattaaactaatgaaatgt

SEQ ID NO: 462714 - DNA, 20 bp, Artificial
  CRISPR gRNA sequence
ctaatgaaatgttggactaa

SEQ ID NO: 462715 - DNA, 20 bp, Artificial
  CRISPR gRNA sequence
tggactaaaagaaaaaaaat

SEQ ID NO: 462716 - DNA, 20 bp, Artificial
  CRISPR gRNA sequence
aaaaattagctaaatataca

SEQ ID NO: 462717 - DNA, 20 bp, Artificial
  CRISPR gRNA sequence
taaatatacacagcactgaa

SEQ ID NO: 462718 - DNA, 20 bp, Artificial
  CRISPR gRNA sequence
ggcatgccatgcactattct

SEQ ID NO: 462719 - DNA, 20 bp, Artificial
  CRISPR gRNA sequence
gcactattctaagtgtttta

SEQ ID NO: 462720 - DNA, 20 bp, Artificial
  CRISPR gRNA sequence
tacagaattaattcacttaa

SEQ ID NO: 462721 - DNA, 20 bp, Artificial
  CRISPR gRNA sequence
aatagtcacaacaaccttat

SEQ ID NO: 462722 - DNA, 20 bp, Artificial
  CRISPR gRNA sequence
agattattctcccatttttt

SEQ ID NO: 462723 - DNA, 20 bp, Artificial
  CRISPR gRNA sequence
attctcccatttttttagat

SEQ ID NO: 462724 - DNA, 20 bp, Artificial
  CRISPR gRNA sequence
tttttttagatgagaaaact

SEQ ID NO: 462725 - DNA, 20 bp, Artificial
  CRISPR gRNA sequence
tagatgagaaaactgagaac

SEQ ID NO: 462726 - DNA, 20 bp, Artificial
  CRISPR gRNA sequence
gatgagaaaactgagaacca

SEQ ID NO: 462727 - DNA, 20 bp, Artificial
  CRISPR gRNA sequence
actgagaaccagagatttta

SEQ ID NO: 462728 - DNA, 20 bp, Artificial
  CRISPR gRNA sequence
atagtcacaaaaccattaaa

SEQ ID NO: 462729 - DNA, 20 bp, Artificial
  CRISPR gRNA sequence
gtcacaaaaccattaaatgg

SEQ ID NO: 462730 - DNA, 20 bp, Artificial
  CRISPR gRNA sequence
aaaccattaaatggcagaca

SEQ ID NO: 462731 - DNA, 20 bp, Artificial
  CRISPR gRNA sequence
aaccattaaatggcagacat

SEQ ID NO: 462732 - DNA, 20 bp, Artificial
  CRISPR gRNA sequence
agacataggatactaatcca

SEQ ID NO: 462733 - DNA, 20 bp, Artificial
  CRISPR gRNA sequence
acataggatactaatccatg

SEQ ID NO: 462734 - DNA, 20 bp, Artificial
  CRISPR gRNA sequence
ggatactaatccatggagtc

SEQ ID NO: 462735 - DNA, 20 bp, Artificial
  CRISPR gRNA sequence
taatccatggagtctggctt

SEQ ID NO: 462736 - DNA, 20 bp, Artificial
  CRISPR gRNA sequence
atccatggagtctggcttta

SEQ ID NO: 462737 - DNA, 20 bp, Artificial
  CRISPR gRNA sequence
ggctttagagtccctgatct

SEQ ID NO: 462738 - DNA, 20 bp, Artificial
  CRISPR gRNA sequence
atcttagccactataccaca

SEQ ID NO: 462739 - DNA, 20 bp, Artificial
  CRISPR gRNA sequence
ctataccacacagcttctcc

SEQ ID NO: 462740 - DNA, 20 bp, Artificial
  CRISPR gRNA sequence
tataccacacagcttctcca

SEQ ID NO: 462741 - DNA, 20 bp, Artificial
  CRISPR gRNA sequence
cacagcttctccaaggaaaa

SEQ ID NO: 462742 - DNA, 20 bp, Artificial
  CRISPR gRNA sequence
aaaagaaaatgattattttt

SEQ ID NO: 462743 - DNA, 20 bp, Artificial
  CRISPR gRNA sequence
acaattctgaactctacata

SEQ ID NO: 462744 - DNA, 20 bp, Artificial
  CRISPR gRNA sequence
aagatgaaactcacaaataa

SEQ ID NO: 462745 - DNA, 20 bp, Artificial
  CRISPR gRNA sequence
actcacaaataatggaaatt

SEQ ID NO: 462746 - DNA, 20 bp, Artificial
  CRISPR gRNA sequence
cacaaataatggaaattaag

SEQ ID NO: 462747 - DNA, 20 bp, Artificial
  CRISPR gRNA sequence
acaaataatggaaattaagt

SEQ ID NO: 462748 - DNA, 20 bp, Artificial
  CRISPR gRNA sequence
ataatggaaattaagtagga

SEQ ID NO: 462749 - DNA, 20 bp, Artificial
  CRISPR gRNA sequence
ttaagtaggaaagtcccaat

SEQ ID NO: 462750 - DNA, 20 bp, Artificial
  CRISPR gRNA sequence
taagtaggaaagtcccaatg

SEQ ID NO: 462751 - DNA, 20 bp, Artificial
  CRISPR gRNA sequence
taggaaagtcccaatgaggc

SEQ ID NO: 462752 - DNA, 20 bp, Artificial
  CRISPR gRNA sequence
tcccaatgaggcaagataaa

SEQ ID NO: 462753 - DNA, 20 bp, Artificial
  CRISPR gRNA sequence
ttttgacgtcaactttacaa

SEQ ID NO: 462754 - DNA, 20 bp, Artificial
  CRISPR gRNA sequence
ttgacgtcaactttacaata

SEQ ID NO: 462755 - DNA, 20 bp, Artificial
  CRISPR gRNA sequence
tgacgtcaactttacaatag

SEQ ID NO: 462756 - DNA, 20 bp, Artificial
  CRISPR gRNA sequence
ctttacaatagaggaaactt

SEQ ID NO: 462757 - DNA, 20 bp, Artificial
  CRISPR gRNA sequence
tacaatagaggaaactttgg

SEQ ID NO: 462758 - DNA, 20 bp, Artificial
  CRISPR gRNA sequence
aatagaggaaactttggtag

SEQ ID NO: 462759 - DNA, 20 bp, Artificial
  CRISPR gRNA sequence
atagaggaaactttggtagt

SEQ ID NO: 462760 - DNA, 20 bp, Artificial
  CRISPR gRNA sequence
aggaaactttggtagtagga

SEQ ID NO: 462761 - DNA, 20 bp, Artificial
  CRISPR gRNA sequence
gaaactttggtagtaggaca

SEQ ID NO: 462762 - DNA, 20 bp, Artificial
  CRISPR gRNA sequence
aaactttggtagtaggacag

SEQ ID NO: 462763 - DNA, 20 bp, Artificial
  CRISPR gRNA sequence
ctttggtagtaggacagagg

SEQ ID NO: 462764 - DNA, 20 bp, Artificial
  CRISPR gRNA sequence
ggtagtaggacagaggaagc

SEQ ID NO: 462765 - DNA, 20 bp, Artificial
  CRISPR gRNA sequence
atttaaaaacttctctgtga

SEQ ID NO: 462766 - DNA, 20 bp, Artificial
  CRISPR gRNA sequence
tttaaaaacttctctgtgat

SEQ ID NO: 462767 - DNA, 20 bp, Artificial
  CRISPR gRNA sequence
aaacttctctgtgataggaa

SEQ ID NO: 462768 - DNA, 20 bp, Artificial
  CRISPR gRNA sequence
gtgataggaaaagtatattc

SEQ ID NO: 462769 - DNA, 20 bp, Artificial
  CRISPR gRNA sequence
tgataggaaaagtatattca

SEQ ID NO: 462770 - DNA, 20 bp, Artificial
  CRISPR gRNA sequence
agtatattcaaggctgcaat

SEQ ID NO: 462771 - DNA, 20 bp, Artificial
  CRISPR gRNA sequence
ttcaaggctgcaatgagcac

SEQ ID NO: 462772 - DNA, 20 bp, Artificial
  CRISPR gRNA sequence
tcaaggctgcaatgagcaca

SEQ ID NO: 462773 - DNA, 20 bp, Artificial
  CRISPR gRNA sequence
atcttttcatgctttaattc

SEQ ID NO: 462774 - DNA, 20 bp, Artificial
  CRISPR gRNA sequence
ttttcatgctttaattcaag

SEQ ID NO: 462775 - DNA, 20 bp, Artificial
  CRISPR gRNA sequence
ttcaagaagtcctgtaacca

SEQ ID NO: 462776 - DNA, 20 bp, Artificial
  CRISPR gRNA sequence
ctaaacatttatttaatata

SEQ ID NO: 462777 - DNA, 20 bp, Artificial
  CRISPR gRNA sequence
aacatttatttaatatatgg

SEQ ID NO: 462778 - DNA, 20 bp, Artificial
  CRISPR gRNA sequence
acatttatttaatatatggc

SEQ ID NO: 462779 - DNA, 20 bp, Artificial
  CRISPR gRNA sequence
ggcattgttgtaacaataca

SEQ ID NO: 462780 - DNA, 20 bp, Artificial
  CRISPR gRNA sequence
gcattgttgtaacaatacat

SEQ ID NO: 462781 - DNA, 20 bp, Artificial
  CRISPR gRNA sequence
tgtaacaatacataggcact

SEQ ID NO: 462782 - DNA, 20 bp, Artificial
  CRISPR gRNA sequence
aacaatacataggcacttgg

SEQ ID NO: 462783 - DNA, 20 bp, Artificial
  CRISPR gRNA sequence
aatacataggcacttggcag

SEQ ID NO: 462784 - DNA, 20 bp, Artificial
  CRISPR gRNA sequence
cataggcacttggcagaaga

SEQ ID NO: 462785 - DNA, 20 bp, Artificial
  CRISPR gRNA sequence
taggcacttggcagaagaca

SEQ ID NO: 462786 - DNA, 20 bp, Artificial
  CRISPR gRNA sequence
agaagacagagctctatctc

SEQ ID NO: 462787 - DNA, 20 bp, Artificial
  CRISPR gRNA sequence
ctccatatgcacatttcaat

SEQ ID NO: 462788 - DNA, 20 bp, Artificial
  CRISPR gRNA sequence
cacatttcaataagaacaaa

SEQ ID NO: 462789 - DNA, 20 bp, Artificial
  CRISPR gRNA sequence
tcaataagaacaaatagctg

SEQ ID NO: 462790 - DNA, 20 bp, Artificial
  CRISPR gRNA sequence
agaacaaatagctgaagcca

SEQ ID NO: 462791 - DNA, 20 bp, Artificial
  CRISPR gRNA sequence
ccatagaaatatgccttata

SEQ ID NO: 462792 - DNA, 20 bp, Artificial
  CRISPR gRNA sequence
tgctacaaaacctgaacttc

SEQ ID NO: 462793 - DNA, 20 bp, Artificial
  CRISPR gRNA sequence
gctacaaaacctgaacttca

SEQ ID NO: 462794 - DNA, 20 bp, Artificial
  CRISPR gRNA sequence
gaatgatattttttgaccca

SEQ ID NO: 462795 - DNA, 20 bp, Artificial
  CRISPR gRNA sequence
tattttttgacccaaagata

SEQ ID NO: 462796 - DNA, 20 bp, Artificial
  CRISPR gRNA sequence
ttttgacccaaagatatggc

SEQ ID NO: 462797 - DNA, 20 bp, Artificial
  CRISPR gRNA sequence
ccaaagatatggccagtttg

SEQ ID NO: 462798 - DNA, 20 bp, Artificial
  CRISPR gRNA sequence
aagatatggccagtttgtag

SEQ ID NO: 462799 - DNA, 20 bp, Artificial
  CRISPR gRNA sequence
gatatggccagtttgtagta

SEQ ID NO: 462800 - DNA, 20 bp, Artificial
  CRISPR gRNA sequence
gtagagcaaaacaatctgtg

SEQ ID NO: 462801 - DNA, 20 bp, Artificial
  CRISPR gRNA sequence
tagagcaaaacaatctgtgt

SEQ ID NO: 462802 - DNA, 20 bp, Artificial
  CRISPR gRNA sequence
aaaacaatctgtgtgggatg

SEQ ID NO: 462803 - DNA, 20 bp, Artificial
  CRISPR gRNA sequence
tctgtgtgggatgtggaaca

SEQ ID NO: 462804 - DNA, 20 bp, Artificial
  CRISPR gRNA sequence
atgtggaacacggtgtttaa

SEQ ID NO: 462805 - DNA, 20 bp, Artificial
  CRISPR gRNA sequence
ggaacacggtgtttaaaagc

SEQ ID NO: 462806 - DNA, 20 bp, Artificial
  CRISPR gRNA sequence
ggtgtttaaaagctggtcca

SEQ ID NO: 462807 - DNA, 20 bp, Artificial
  CRISPR gRNA sequence
agctggtccatggaccatac

SEQ ID NO: 462808 - DNA, 20 bp, Artificial
  CRISPR gRNA sequence
catactggaccatcataata

SEQ ID NO: 462809 - DNA, 20 bp, Artificial
  CRISPR gRNA sequence
atactggaccatcataataa

SEQ ID NO: 462810 - DNA, 20 bp, Artificial
  CRISPR gRNA sequence
tactggaccatcataataaa

SEQ ID NO: 462811 - DNA, 20 bp, Artificial
  CRISPR gRNA sequence
taaagggaaaaaaatgacac

SEQ ID NO: 462812 - DNA, 20 bp, Artificial
  CRISPR gRNA sequence
gggaaaaaaatgacacaagc

SEQ ID NO: 462813 - DNA, 20 bp, Artificial
  CRISPR gRNA sequence
tgacacaagccagaccaaaa

SEQ ID NO: 462814 - DNA, 20 bp, Artificial
  CRISPR gRNA sequence
acacaagccagaccaaaatg

SEQ ID NO: 462815 - DNA, 20 bp, Artificial
  CRISPR gRNA sequence
gccagaccaaaatggagaca

SEQ ID NO: 462816 - DNA, 20 bp, Artificial
  CRISPR gRNA sequence
cctaaccactgtattctcaa

SEQ ID NO: 462817 - DNA, 20 bp, Artificial
  CRISPR gRNA sequence
taaccactgtattctcaaaa

SEQ ID NO: 462818 - DNA, 20 bp, Artificial
  CRISPR gRNA sequence
cactgtattctcaaaagagc

SEQ ID NO: 462819 - DNA, 20 bp, Artificial
  CRISPR gRNA sequence
ttctcaaaagagccagaata

SEQ ID NO: 462820 - DNA, 20 bp, Artificial
  CRISPR gRNA sequence
tctcaaaagagccagaatac

SEQ ID NO: 462821 - DNA, 20 bp, Artificial
  CRISPR gRNA sequence
gtgtctttcccttactgaac

SEQ ID NO: 462822 - DNA, 20 bp, Artificial
  CRISPR gRNA sequence
tttcccttactgaaccagac

SEQ ID NO: 462823 - DNA, 20 bp, Artificial
  CRISPR gRNA sequence
ttcccttactgaaccagact

SEQ ID NO: 462824 - DNA, 20 bp, Artificial
  CRISPR gRNA sequence
tttttaaaaatcacaataac

SEQ ID NO: 462825 - DNA, 20 bp, Artificial
  CRISPR gRNA sequence
ataaccagtaatcaatcaaa

SEQ ID NO: 462826 - DNA, 20 bp, Artificial
  CRISPR gRNA sequence
cctttattctgcatcatata

SEQ ID NO: 462827 - DNA, 20 bp, Artificial
  CRISPR gRNA sequence
ttctgcatcatatatggtgt

SEQ ID NO: 462828 - DNA, 20 bp, Artificial
  CRISPR gRNA sequence
tatatggtgttggtgatacc

SEQ ID NO: 462829 - DNA, 20 bp, Artificial
  CRISPR gRNA sequence
tgatacccagacattaactg

SEQ ID NO: 462830 - DNA, 20 bp, Artificial
  CRISPR gRNA sequence
cagtgttcctgcctgcctaa

SEQ ID NO: 462831 - DNA, 20 bp, Artificial
  CRISPR gRNA sequence
tgttcctgcctgcctaaaag

SEQ ID NO: 462832 - DNA, 20 bp, Artificial
  CRISPR gRNA sequence
ctgcctaaaagtggaatcct

SEQ ID NO: 462833 - DNA, 20 bp, Artificial
  CRISPR gRNA sequence
tggttgatcctcaactgaac

SEQ ID NO: 462834 - DNA, 20 bp, Artificial
  CRISPR gRNA sequence
ggttgatcctcaactgaact

SEQ ID NO: 462835 - DNA, 20 bp, Artificial
  CRISPR gRNA sequence
gttgatcctcaactgaacta

SEQ ID NO: 462836 - DNA, 20 bp, Artificial
  CRISPR gRNA sequence
tcctcaactgaactagggtc

SEQ ID NO: 462837 - DNA, 20 bp, Artificial
  CRISPR gRNA sequence
cctcaactgaactagggtct

SEQ ID NO: 462838 - DNA, 20 bp, Artificial
  CRISPR gRNA sequence
ctcaactgaactagggtcta

SEQ ID NO: 462839 - DNA, 20 bp, Artificial
  CRISPR gRNA sequence
aactgaactagggtctaggg

SEQ ID NO: 462840 - DNA, 20 bp, Artificial
  CRISPR gRNA sequence
actagggtctagggcagcct

SEQ ID NO: 462841 - DNA, 20 bp, Artificial
  CRISPR gRNA sequence
ctagggcagcctcagacaaa

SEQ ID NO: 462842 - DNA, 20 bp, Artificial
  CRISPR gRNA sequence
gcagcctcagacaaatggtc

SEQ ID NO: 462843 - DNA, 20 bp, Artificial
  CRISPR gRNA sequence
cagcctcagacaaatggtcc

SEQ ID NO: 462844 - DNA, 20 bp, Artificial
  CRISPR gRNA sequence
agacaaatggtccaggatga

SEQ ID NO: 462845 - DNA, 20 bp, Artificial
  CRISPR gRNA sequence
gacaaatggtccaggatgac

SEQ ID NO: 462846 - DNA, 20 bp, Artificial
  CRISPR gRNA sequence
acaaatggtccaggatgaca

SEQ ID NO: 462847 - DNA, 20 bp, Artificial
  CRISPR gRNA sequence
aatggtccaggatgacaggg

SEQ ID NO: 462848 - DNA, 20 bp, Artificial
  CRISPR gRNA sequence
atggtccaggatgacagggc

SEQ ID NO: 462849 - DNA, 20 bp, Artificial
  CRISPR gRNA sequence
caggatgacagggcaggcaa

SEQ ID NO: 462850 - DNA, 20 bp, Artificial
  CRISPR gRNA sequence
atgacagggcaggcaatgga

SEQ ID NO: 462851 - DNA, 20 bp, Artificial
  CRISPR gRNA sequence
gacagggcaggcaatggaca

SEQ ID NO: 462852 - DNA, 20 bp, Artificial
  CRISPR gRNA sequence
gacagagacacttccacttg

SEQ ID NO: 462853 - DNA, 20 bp, Artificial
  CRISPR gRNA sequence
agacacttccacttgcagtc

SEQ ID NO: 462854 - DNA, 20 bp, Artificial
  CRISPR gRNA sequence
acttgcagtctagatcttgc

SEQ ID NO: 462855 - DNA, 20 bp, Artificial
  CRISPR gRNA sequence
gccagcatgatctgcccatg

SEQ ID NO: 462856 - DNA, 20 bp, Artificial
  CRISPR gRNA sequence
ccagcatgatctgcccatga

SEQ ID NO: 462857 - DNA, 20 bp, Artificial
  CRISPR gRNA sequence
cagcatgatctgcccatgaa

SEQ ID NO: 462858 - DNA, 20 bp, Artificial
  CRISPR gRNA sequence
catgatctgcccatgaaggg

SEQ ID NO: 462859 - DNA, 20 bp, Artificial
  CRISPR gRNA sequence
gacatttttattacttctat

SEQ ID NO: 462860 - DNA, 20 bp, Artificial
  CRISPR gRNA sequence
acatttttattacttctatc

SEQ ID NO: 462861 - DNA, 20 bp, Artificial
  CRISPR gRNA sequence
ttttattacttctatcagga

SEQ ID NO: 462862 - DNA, 20 bp, Artificial
  CRISPR gRNA sequence
gaaactgtatgccacacact

SEQ ID NO: 462863 - DNA, 20 bp, Artificial
  CRISPR gRNA sequence
aaactgtatgccacacactg

SEQ ID NO: 462864 - DNA, 20 bp, Artificial
  CRISPR gRNA sequence
aactgtatgccacacactga

SEQ ID NO: 462865 - DNA, 20 bp, Artificial
  CRISPR gRNA sequence
actgtatgccacacactgag

SEQ ID NO: 462866 - DNA, 20 bp, Artificial
  CRISPR gRNA sequence
tatgccacacactgaggggc

SEQ ID NO: 462867 - DNA, 20 bp, Artificial
  CRISPR gRNA sequence
ggcaagtttctctaattttt

SEQ ID NO: 462868 - DNA, 20 bp, Artificial
  CRISPR gRNA sequence
caagtttctctaatttttta

SEQ ID NO: 462869 - DNA, 20 bp, Artificial
  CRISPR gRNA sequence
attttttagagaaacacaaa

SEQ ID NO: 462870 - DNA, 20 bp, Artificial
  CRISPR gRNA sequence
tttagagaaacacaaaaagt

SEQ ID NO: 462871 - DNA, 20 bp, Artificial
  CRISPR gRNA sequence
gagaaacacaaaaagtaagc

SEQ ID NO: 462872 - DNA, 20 bp, Artificial
  CRISPR gRNA sequence
gcaagcatacttttgtaata

SEQ ID NO: 462873 - DNA, 20 bp, Artificial
  CRISPR gRNA sequence
agcatacttttgtaataaag

SEQ ID NO: 462874 - DNA, 20 bp, Artificial
  CRISPR gRNA sequence
gcatacttttgtaataaaga

SEQ ID NO: 462875 - DNA, 20 bp, Artificial
  CRISPR gRNA sequence
taataaagaaggaccttaaa

SEQ ID NO: 462876 - DNA, 20 bp, Artificial
  CRISPR gRNA sequence
aataaagaaggaccttaaac

SEQ ID NO: 462877 - DNA, 20 bp, Artificial
  CRISPR gRNA sequence
aaagaaggaccttaaacagg

SEQ ID NO: 462878 - DNA, 20 bp, Artificial
  CRISPR gRNA sequence
gaccttaaacaggaagtttg

SEQ ID NO: 462879 - DNA, 20 bp, Artificial
  CRISPR gRNA sequence
ccttaaacaggaagtttgta

SEQ ID NO: 462880 - DNA, 20 bp, Artificial
  CRISPR gRNA sequence
agagaacattacattttttc

SEQ ID NO: 462881 - DNA, 20 bp, Artificial
  CRISPR gRNA sequence
ttccagccttattatatatg

SEQ ID NO: 462882 - DNA, 20 bp, Artificial
  CRISPR gRNA sequence
tatatatgcagcctcactcc

SEQ ID NO: 462883 - DNA, 20 bp, Artificial
  CRISPR gRNA sequence
atatatgcagcctcactcct

SEQ ID NO: 462884 - DNA, 20 bp, Artificial
  CRISPR gRNA sequence
gcagcctcactcctaggaac

SEQ ID NO: 462885 - DNA, 20 bp, Artificial
  CRISPR gRNA sequence
cagcctcactcctaggaaca

SEQ ID NO: 462886 - DNA, 20 bp, Artificial
  CRISPR gRNA sequence
cactcctaggaacaaggaca

SEQ ID NO: 462887 - DNA, 20 bp, Artificial
  CRISPR gRNA sequence
acggatctcacattgctttg

SEQ ID NO: 462888 - DNA, 20 bp, Artificial
  CRISPR gRNA sequence
gatctcacattgctttgaag

SEQ ID NO: 462889 - DNA, 20 bp, Artificial
  CRISPR gRNA sequence
atctcacattgctttgaagt

SEQ ID NO: 462890 - DNA, 20 bp, Artificial
  CRISPR gRNA sequence
tctcacattgctttgaagta

SEQ ID NO: 462891 - DNA, 20 bp, Artificial
  CRISPR gRNA sequence
ctcacattgctttgaagtag

SEQ ID NO: 462892 - DNA, 20 bp, Artificial
  CRISPR gRNA sequence
tcacattgctttgaagtagg

SEQ ID NO: 462893 - DNA, 20 bp, Artificial
  CRISPR gRNA sequence
gtagggggaaaaaatcttca

SEQ ID NO: 462894 - DNA, 20 bp, Artificial
  CRISPR gRNA sequence
tagggggaaaaaatcttcaa

SEQ ID NO: 462895 - DNA, 20 bp, Artificial
  CRISPR gRNA sequence
actgaaaatgtattactgta

SEQ ID NO: 462896 - DNA, 20 bp, Artificial
  CRISPR gRNA sequence
atgtattactgtaaagaact

SEQ ID NO: 462897 - DNA, 20 bp, Artificial
  CRISPR gRNA sequence
ctgtaaagaactcagcaatt

SEQ ID NO: 462898 - DNA, 20 bp, Artificial
  CRISPR gRNA sequence
ctcagcaattaagtaaatca

SEQ ID NO: 462899 - DNA, 20 bp, Artificial
  CRISPR gRNA sequence
tcagcaattaagtaaatcac

SEQ ID NO: 462900 - DNA, 20 bp, Artificial
  CRISPR gRNA sequence
gtaaatcacaggaaatcccc

SEQ ID NO: 462901 - DNA, 20 bp, Artificial
  CRISPR gRNA sequence
acaggaaatccccaagatat

SEQ ID NO: 462902 - DNA, 20 bp, Artificial
  CRISPR gRNA sequence
caggaaatccccaagatata

SEQ ID NO: 462903 - DNA, 20 bp, Artificial
  CRISPR gRNA sequence
aagatataaggtatttaatg

SEQ ID NO: 462904 - DNA, 20 bp, Artificial
  CRISPR gRNA sequence
aaggtatttaatgtggtttt

SEQ ID NO: 462905 - DNA, 20 bp, Artificial
  CRISPR gRNA sequence
tttaatgtggttttaagaaa

SEQ ID NO: 462906 - DNA, 20 bp, Artificial
  CRISPR gRNA sequence
taatgtggttttaagaaatg

SEQ ID NO: 462907 - DNA, 20 bp, Artificial
  CRISPR gRNA sequence
gttttaagaaatggagccat

SEQ ID NO: 462908 - DNA, 20 bp, Artificial
  CRISPR gRNA sequence
atggagccatcagctctgcc

SEQ ID NO: 462909 - DNA, 20 bp, Artificial
  CRISPR gRNA sequence
tggagccatcagctctgcct

SEQ ID NO: 462910 - DNA, 20 bp, Artificial
  CRISPR gRNA sequence
gagccatcagctctgcctgg

SEQ ID NO: 462911 - DNA, 20 bp, Artificial
  CRISPR gRNA sequence
atgttccttctcttaaccta

SEQ ID NO: 462912 - DNA, 20 bp, Artificial
  CRISPR gRNA sequence
ctgcaatccattatatcaac

SEQ ID NO: 462913 - DNA, 20 bp, Artificial
  CRISPR gRNA sequence
tcaactggtatatatctgac

SEQ ID NO: 462914 - DNA, 20 bp, Artificial
  CRISPR gRNA sequence
atctgaccagtacttcactc

SEQ ID NO: 462915 - DNA, 20 bp, Artificial
  CRISPR gRNA sequence
agtctttccctttttttttt

SEQ ID NO: 462916 - DNA, 20 bp, Artificial
  CRISPR gRNA sequence
ttcccttttttttttgagtg

SEQ ID NO: 462917 - DNA, 20 bp, Artificial
  CRISPR gRNA sequence
ccttttttttttgagtgcag

SEQ ID NO: 462918 - DNA, 20 bp, Artificial
  CRISPR gRNA sequence
tgagtgcagtggtgtgatct

SEQ ID NO: 462919 - DNA, 20 bp, Artificial
  CRISPR gRNA sequence
tcactgcaacctctgcctcc

SEQ ID NO: 462920 - DNA, 20 bp, Artificial
  CRISPR gRNA sequence
cactgcaacctctgcctcct

SEQ ID NO: 462921 - DNA, 20 bp, Artificial
  CRISPR gRNA sequence
aacctctgcctcctgggttc

SEQ ID NO: 462922 - DNA, 20 bp, Artificial
  CRISPR gRNA sequence
ttcaagctattctcctgtct

SEQ ID NO: 462923 - DNA, 20 bp, Artificial
  CRISPR gRNA sequence
ttctcctgtctcggcctccc

SEQ ID NO: 462924 - DNA, 20 bp, Artificial
  CRISPR gRNA sequence
tcctgtctcggcctcccgag

SEQ ID NO: 462925 - DNA, 20 bp, Artificial
  CRISPR gRNA sequence
gtctcggcctcccgagtagc

SEQ ID NO: 462926 - DNA, 20 bp, Artificial
  CRISPR gRNA sequence
tctcggcctcccgagtagct

SEQ ID NO: 462927 - DNA, 20 bp, Artificial
  CRISPR gRNA sequence
ctcccgagtagctgggacta

SEQ ID NO: 462928 - DNA, 20 bp, Artificial
  CRISPR gRNA sequence
tcccgagtagctgggactac

SEQ ID NO: 462929 - DNA, 20 bp, Artificial
  CRISPR gRNA sequence
caggcacctcccaacacacc

SEQ ID NO: 462930 - DNA, 20 bp, Artificial
  CRISPR gRNA sequence
ccagcaaatttttatatttt

SEQ ID NO: 462931 - DNA, 20 bp, Artificial
  CRISPR gRNA sequence
gcaaatttttatatttttag

SEQ ID NO: 462932 - DNA, 20 bp, Artificial
  CRISPR gRNA sequence
aaatttttatatttttagta

SEQ ID NO: 462933 - DNA, 20 bp, Artificial
  CRISPR gRNA sequence
ttttatatttttagtagaga

SEQ ID NO: 462934 - DNA, 20 bp, Artificial
  CRISPR gRNA sequence
tttatatttttagtagagac

SEQ ID NO: 462935 - DNA, 20 bp, Artificial
  CRISPR gRNA sequence
ttatatttttagtagagacg

SEQ ID NO: 462936 - DNA, 20 bp, Artificial
  CRISPR gRNA sequence
cggggtttcaccatgttgac

SEQ ID NO: 462937 - DNA, 20 bp, Artificial
  CRISPR gRNA sequence
tttcaccatgttgaccagtc

SEQ ID NO: 462938 - DNA, 20 bp, Artificial
  CRISPR gRNA sequence
tggtcttaaactcctgacct

SEQ ID NO: 462939 - DNA, 20 bp, Artificial
  CRISPR gRNA sequence
ggtcttaaactcctgacctc

SEQ ID NO: 462940 - DNA, 20 bp, Artificial
  CRISPR gRNA sequence
ctcaggtgatctgcccgtct

SEQ ID NO: 462941 - DNA, 20 bp, Artificial
  CRISPR gRNA sequence
ctgcccgtcttggcttccca

SEQ ID NO: 462942 - DNA, 20 bp, Artificial
  CRISPR gRNA sequence
tcttggcttcccaaagtgct

SEQ ID NO: 462943 - DNA, 20 bp, Artificial
  CRISPR gRNA sequence
ttcccaaagtgctgagacta

SEQ ID NO: 462944 - DNA, 20 bp, Artificial
  CRISPR gRNA sequence
tcccaaagtgctgagactaa

SEQ ID NO: 462945 - DNA, 20 bp, Artificial
  CRISPR gRNA sequence
aaagtgctgagactaaaggc

SEQ ID NO: 462946 - DNA, 20 bp, Artificial
  CRISPR gRNA sequence
aagtgctgagactaaaggct

SEQ ID NO: 462947 - DNA, 20 bp, Artificial
  CRISPR gRNA sequence
agtgctgagactaaaggcta

SEQ ID NO: 462948 - DNA, 20 bp, Artificial
  CRISPR gRNA sequence
gagactaaaggctagggcca

SEQ ID NO: 462949 - DNA, 20 bp, Artificial
  CRISPR gRNA sequence
aaggctagggccatggctcc

SEQ ID NO: 462950 - DNA, 20 bp, Artificial
  CRISPR gRNA sequence
taatttgattcactatattt

SEQ ID NO: 462951 - DNA, 20 bp, Artificial
  CRISPR gRNA sequence
aatttgattcactatatttt

SEQ ID NO: 462952 - DNA, 20 bp, Artificial
  CRISPR gRNA sequence
ataattctcatttaattaca

SEQ ID NO: 462953 - DNA, 20 bp, Artificial
  CRISPR gRNA sequence
aattctcatttaattacata

SEQ ID NO: 462954 - DNA, 20 bp, Artificial
  CRISPR gRNA sequence
attctcatttaattacatag

SEQ ID NO: 462955 - DNA, 20 bp, Artificial
  CRISPR gRNA sequence
ttaattacatagaggttgca

SEQ ID NO: 462956 - DNA, 20 bp, Artificial
  CRISPR gRNA sequence
gttgcatggtgaaaataatt

SEQ ID NO: 462957 - DNA, 20 bp, Artificial
  CRISPR gRNA sequence
ttgcatggtgaaaataattt

SEQ ID NO: 462958 - DNA, 20 bp, Artificial
  CRISPR gRNA sequence
aaataccactaacatttact

SEQ ID NO: 462959 - DNA, 20 bp, Artificial
  CRISPR gRNA sequence
aatacgtgcacttactatgc

SEQ ID NO: 462960 - DNA, 20 bp, Artificial
  CRISPR gRNA sequence
atacgtgcacttactatgcg

SEQ ID NO: 462961 - DNA, 20 bp, Artificial
  CRISPR gRNA sequence
tacccatattattgcatcta

SEQ ID NO: 462962 - DNA, 20 bp, Artificial
  CRISPR gRNA sequence
tattgcatctacagtcttca

SEQ ID NO: 462963 - DNA, 20 bp, Artificial
  CRISPR gRNA sequence
tgcatctacagtcttcacag

SEQ ID NO: 462964 - DNA, 20 bp, Artificial
  CRISPR gRNA sequence
ttcacagcagccccataatt

SEQ ID NO: 462965 - DNA, 20 bp, Artificial
  CRISPR gRNA sequence
tcacagcagccccataattt

SEQ ID NO: 462966 - DNA, 20 bp, Artificial
  CRISPR gRNA sequence
attacctgtattgtacaaat

SEQ ID NO: 462967 - DNA, 20 bp, Artificial
  CRISPR gRNA sequence
ttacctgtattgtacaaatg

SEQ ID NO: 462968 - DNA, 20 bp, Artificial
  CRISPR gRNA sequence
ttgtacaaatgaggaaacta

SEQ ID NO: 462969 - DNA, 20 bp, Artificial
  CRISPR gRNA sequence
gtacaaatgaggaaactaaa

SEQ ID NO: 462970 - DNA, 20 bp, Artificial
  CRISPR gRNA sequence
caaatgaggaaactaaagag

SEQ ID NO: 462971 - DNA, 20 bp, Artificial
  CRISPR gRNA sequence
aatgaggaaactaaagagaa

SEQ ID NO: 462972 - DNA, 20 bp, Artificial
  CRISPR gRNA sequence
gaggaaactaaagagaagag

SEQ ID NO: 462973 - DNA, 20 bp, Artificial
  CRISPR gRNA sequence
ggaaactaaagagaagagaa

SEQ ID NO: 462974 - DNA, 20 bp, Artificial
  CRISPR gRNA sequence
gagacttaatcaatgccata

SEQ ID NO: 462975 - DNA, 20 bp, Artificial
  CRISPR gRNA sequence
cttaatcaatgccatacagt

SEQ ID NO: 462976 - DNA, 20 bp, Artificial
  CRISPR gRNA sequence
aatcaatgccatacagtaag

SEQ ID NO: 462977 - DNA, 20 bp, Artificial
  CRISPR gRNA sequence
caatgccatacagtaagtgg

SEQ ID NO: 462978 - DNA, 20 bp, Artificial
  CRISPR gRNA sequence
atgccatacagtaagtggca

SEQ ID NO: 462979 - DNA, 20 bp, Artificial
  CRISPR gRNA sequence
catacagtaagtggcagagc

SEQ ID NO: 462980 - DNA, 20 bp, Artificial
  CRISPR gRNA sequence
gcagagccagtaaattaacc

SEQ ID NO: 462981 - DNA, 20 bp, Artificial
  CRISPR gRNA sequence
gtaaattaacccagttctaa

SEQ ID NO: 462982 - DNA, 20 bp, Artificial
  CRISPR gRNA sequence
ttaacccagttctaacagcc

SEQ ID NO: 462983 - DNA, 20 bp, Artificial
  CRISPR gRNA sequence
aagttcacttttgcaaatgc

SEQ ID NO: 462984 - DNA, 20 bp, Artificial
  CRISPR gRNA sequence
agttcacttttgcaaatgct

SEQ ID NO: 462985 - DNA, 20 bp, Artificial
  CRISPR gRNA sequence
gcaaatgctaggttgcacat

SEQ ID NO: 462986 - DNA, 20 bp, Artificial
  CRISPR gRNA sequence
caaatgctaggttgcacatt

SEQ ID NO: 462987 - DNA, 20 bp, Artificial
  CRISPR gRNA sequence
aatgctaggttgcacattgg

SEQ ID NO: 462988 - DNA, 20 bp, Artificial
  CRISPR gRNA sequence
gttgcacattgggagaaata

SEQ ID NO: 462989 - DNA, 20 bp, Artificial
  CRISPR gRNA sequence
ttgcacattgggagaaataa

SEQ ID NO: 462990 - DNA, 20 bp, Artificial
  CRISPR gRNA sequence
gtcttaccccaccatcaatg

SEQ ID NO: 462991 - DNA, 20 bp, Artificial
  CRISPR gRNA sequence
accccaccatcaatgtggtt

SEQ ID NO: 462992 - DNA, 20 bp, Artificial
  CRISPR gRNA sequence
actcattgttcttaatttca

SEQ ID NO: 462993 - DNA, 20 bp, Artificial
  CRISPR gRNA sequence
tcattgttcttaatttcata

SEQ ID NO: 462994 - DNA, 20 bp, Artificial
  CRISPR gRNA sequence
attgttcttaatttcataga

SEQ ID NO: 462995 - DNA, 20 bp, Artificial
  CRISPR gRNA sequence
gttcttaatttcatagagag

SEQ ID NO: 462996 - DNA, 20 bp, Artificial
  CRISPR gRNA sequence
tagtttatgtatccttcaaa

SEQ ID NO: 462997 - DNA, 20 bp, Artificial
  CRISPR gRNA sequence
agtttatgtatccttcaaat

SEQ ID NO: 462998 - DNA, 20 bp, Artificial
  CRISPR gRNA sequence
gtttatgtatccttcaaatg

SEQ ID NO: 462999 - DNA, 20 bp, Artificial
  CRISPR gRNA sequence
tatgtatccttcaaatgggg

SEQ ID NO: 463000 - DNA, 20 bp, Artificial
  CRISPR gRNA sequence
tatttaataatatttgactc

SEQ ID NO: 463001 - DNA, 20 bp, Artificial
  CRISPR gRNA sequence
ataatatttgactccagttg

SEQ ID NO: 463002 - DNA, 20 bp, Artificial
  CRISPR gRNA sequence
cagttgtagctatgtgactg

SEQ ID NO: 463003 - DNA, 20 bp, Artificial
  CRISPR gRNA sequence
agttgtagctatgtgactgt

SEQ ID NO: 463004 - DNA, 20 bp, Artificial
  CRISPR gRNA sequence
atgtgactgtaggcatctga

SEQ ID NO: 463005 - DNA, 20 bp, Artificial
  CRISPR gRNA sequence
tgactgtaggcatctgatgg

SEQ ID NO: 463006 - DNA, 20 bp, Artificial
  CRISPR gRNA sequence
gactgtaggcatctgatgga

SEQ ID NO: 463007 - DNA, 20 bp, Artificial
  CRISPR gRNA sequence
tgtaggcatctgatggaagg

SEQ ID NO: 463008 - DNA, 20 bp, Artificial
  CRISPR gRNA sequence
ctgatggaaggtggaaaatt

SEQ ID NO: 463009 - DNA, 20 bp, Artificial
  CRISPR gRNA sequence
gaaaattcagtcaaccatct

SEQ ID NO: 463010 - DNA, 20 bp, Artificial
  CRISPR gRNA sequence
cagtcaaccatctaagcacc

SEQ ID NO: 463011 - DNA, 20 bp, Artificial
  CRISPR gRNA sequence
gcacctagttgacttaatac

SEQ ID NO: 463012 - DNA, 20 bp, Artificial
  CRISPR gRNA sequence
actagatacttacaaacata

SEQ ID NO: 463013 - DNA, 20 bp, Artificial
  CRISPR gRNA sequence
ttacaaacataaagatgttt

SEQ ID NO: 463014 - DNA, 20 bp, Artificial
  CRISPR gRNA sequence
ataaagatgtttgagtaact

SEQ ID NO: 463015 - DNA, 20 bp, Artificial
  CRISPR gRNA sequence
taaagatgtttgagtaacta

SEQ ID NO: 463016 - DNA, 20 bp, Artificial
  CRISPR gRNA sequence
ggacttttttactttgcact

SEQ ID NO: 463017 - DNA, 20 bp, Artificial
  CRISPR gRNA sequence
ttactttgcacttggttgtg

SEQ ID NO: 463018 - DNA, 20 bp, Artificial
  CRISPR gRNA sequence
cacttggttgtgtggcatcc

SEQ ID NO: 463019 - DNA, 20 bp, Artificial
  CRISPR gRNA sequence
tgtgtggcatcctggcatca

SEQ ID NO: 463020 - DNA, 20 bp, Artificial
  CRISPR gRNA sequence
tgtggcatcctggcatcata

SEQ ID NO: 463021 - DNA, 20 bp, Artificial
  CRISPR gRNA sequence
gagacatattccaaactaca

SEQ ID NO: 463022 - DNA, 20 bp, Artificial
  CRISPR gRNA sequence
aactacacagtttaaaatta

SEQ ID NO: 463023 - DNA, 20 bp, Artificial
  CRISPR gRNA sequence
acacagtttaaaattataga

SEQ ID NO: 463024 - DNA, 20 bp, Artificial
  CRISPR gRNA sequence
aattatagatagactttcca

SEQ ID NO: 463025 - DNA, 20 bp, Artificial
  CRISPR gRNA sequence
atagactttccatagaacct

SEQ ID NO: 463026 - DNA, 20 bp, Artificial
  CRISPR gRNA sequence
gactttccatagaacctcag

SEQ ID NO: 463027 - DNA, 20 bp, Artificial
  CRISPR gRNA sequence
ttccatagaacctcagtggc

SEQ ID NO: 463028 - DNA, 20 bp, Artificial
  CRISPR gRNA sequence
gattttctaatttaaaattg

SEQ ID NO: 463029 - DNA, 20 bp, Artificial
  CRISPR gRNA sequence
tttctaatttaaaattgcag

SEQ ID NO: 463030 - DNA, 20 bp, Artificial
  CRISPR gRNA sequence
aactgataaatgtgtgcttg

SEQ ID NO: 463031 - DNA, 20 bp, Artificial
  CRISPR gRNA sequence
actgataaatgtgtgcttgt

SEQ ID NO: 463032 - DNA, 20 bp, Artificial
  CRISPR gRNA sequence
ctgataaatgtgtgcttgta

SEQ ID NO: 463033 - DNA, 20 bp, Artificial
  CRISPR gRNA sequence
gtgtgcttgtagggaataat

SEQ ID NO: 463034 - DNA, 20 bp, Artificial
  CRISPR gRNA sequence
gcttgtagggaataataaga

SEQ ID NO: 463035 - DNA, 20 bp, Artificial
  CRISPR gRNA sequence
tttaaaacctgaaaaatcac

SEQ ID NO: 463036 - DNA, 20 bp, Artificial
  CRISPR gRNA sequence
ttaaaacctgaaaaatcact

SEQ ID NO: 463037 - DNA, 20 bp, Artificial
  CRISPR gRNA sequence
acctgaaaaatcactgggca

SEQ ID NO: 463038 - DNA, 20 bp, Artificial
  CRISPR gRNA sequence
tgaaaaatcactgggcatgg

SEQ ID NO: 463039 - DNA, 20 bp, Artificial
  CRISPR gRNA sequence
gtggctcatacctgtaatcc

SEQ ID NO: 463040 - DNA, 20 bp, Artificial
  CRISPR gRNA sequence
tacctgtaatcctagcactt

SEQ ID NO: 463041 - DNA, 20 bp, Artificial
  CRISPR gRNA sequence
acctgtaatcctagcacttt

SEQ ID NO: 463042 - DNA, 20 bp, Artificial
  CRISPR gRNA sequence
ctgtaatcctagcactttgg

SEQ ID NO: 463043 - DNA, 20 bp, Artificial
  CRISPR gRNA sequence
tgtaatcctagcactttggg

SEQ ID NO: 463044 - DNA, 20 bp, Artificial
  CRISPR gRNA sequence
tcctagcactttgggaggct

SEQ ID NO: 463045 - DNA, 20 bp, Artificial
  CRISPR gRNA sequence
cctagcactttgggaggctg

SEQ ID NO: 463046 - DNA, 20 bp, Artificial
  CRISPR gRNA sequence
agcactttgggaggctgagg

SEQ ID NO: 463047 - DNA, 20 bp, Artificial
  CRISPR gRNA sequence
gcactttgggaggctgaggc

SEQ ID NO: 463048 - DNA, 20 bp, Artificial
  CRISPR gRNA sequence
ctttgggaggctgaggcagg

SEQ ID NO: 463049 - DNA, 20 bp, Artificial
  CRISPR gRNA sequence
ctgaggcaggtggatcactt

SEQ ID NO: 463050 - DNA, 20 bp, Artificial
  CRISPR gRNA sequence
tgaggcaggtggatcacttg

SEQ ID NO: 463051 - DNA, 20 bp, Artificial
  CRISPR gRNA sequence
gcaggtggatcacttgaggt

SEQ ID NO: 463052 - DNA, 20 bp, Artificial
  CRISPR gRNA sequence
caggtggatcacttgaggtc

SEQ ID NO: 463053 - DNA, 20 bp, Artificial
  CRISPR gRNA sequence
ggtggatcacttgaggtcag

SEQ ID NO: 463054 - DNA, 20 bp, Artificial
  CRISPR gRNA sequence
tcacttgaggtcaggagctc

SEQ ID NO: 463055 - DNA, 20 bp, Artificial
  CRISPR gRNA sequence
tgaggtcaggagctccagac

SEQ ID NO: 463056 - DNA, 20 bp, Artificial
  CRISPR gRNA sequence
cccaacatgcattgcatcca

SEQ ID NO: 463057 - DNA, 20 bp, Artificial
  CRISPR gRNA sequence
catgcattgcatccatagct

SEQ ID NO: 463058 - DNA, 20 bp, Artificial
  CRISPR gRNA sequence
tggctgactttcttaaaaaa

SEQ ID NO: 463059 - DNA, 20 bp, Artificial
  CRISPR gRNA sequence
ggctgactttcttaaaaaac

SEQ ID NO: 463060 - DNA, 20 bp, Artificial
  CRISPR gRNA sequence
tttcttaaaaaacaggttga

SEQ ID NO: 463061 - DNA, 20 bp, Artificial
  CRISPR gRNA sequence
ttaaaaaacaggttgatggc

SEQ ID NO: 463062 - DNA, 20 bp, Artificial
  CRISPR gRNA sequence
aaacaggttgatggcaagaa

SEQ ID NO: 463063 - DNA, 20 bp, Artificial
  CRISPR gRNA sequence
acaggttgatggcaagaaaa

SEQ ID NO: 463064 - DNA, 20 bp, Artificial
  CRISPR gRNA sequence
gatggcaagaaaagagaact

SEQ ID NO: 463065 - DNA, 20 bp, Artificial
  CRISPR gRNA sequence
ggcaagaaaagagaactgag

SEQ ID NO: 463066 - DNA, 20 bp, Artificial
  CRISPR gRNA sequence
aactgagtagatgttataaa

SEQ ID NO: 463067 - DNA, 20 bp, Artificial
  CRISPR gRNA sequence
agtagatgttataaatagtt

SEQ ID NO: 463068 - DNA, 20 bp, Artificial
  CRISPR gRNA sequence
ctacttcttgcgaaaatgct

SEQ ID NO: 463069 - DNA, 20 bp, Artificial
  CRISPR gRNA sequence
tacttcttgcgaaaatgctc

SEQ ID NO: 463070 - DNA, 20 bp, Artificial
  CRISPR gRNA sequence
gctgccacactgatgatgaa

SEQ ID NO: 463071 - DNA, 20 bp, Artificial
  CRISPR gRNA sequence
ccacactgatgatgaataga

SEQ ID NO: 463072 - DNA, 20 bp, Artificial
  CRISPR gRNA sequence
tagctcgttcttcccaaact

SEQ ID NO: 463073 - DNA, 20 bp, Artificial
  CRISPR gRNA sequence
cgttcttcccaaactgagtg

SEQ ID NO: 463074 - DNA, 20 bp, Artificial
  CRISPR gRNA sequence
tcttcccaaactgagtgcag

SEQ ID NO: 463075 - DNA, 20 bp, Artificial
  CRISPR gRNA sequence
ttcccaaactgagtgcagta

SEQ ID NO: 463076 - DNA, 20 bp, Artificial
  CRISPR gRNA sequence
ctgagtgcagtagagtgttg

SEQ ID NO: 463077 - DNA, 20 bp, Artificial
  CRISPR gRNA sequence
cagtagagtgttgcagtgct

SEQ ID NO: 463078 - DNA, 20 bp, Artificial
  CRISPR gRNA sequence
agagtgttgcagtgctcagt

SEQ ID NO: 463079 - DNA, 20 bp, Artificial
  CRISPR gRNA sequence
gagtgttgcagtgctcagtt

SEQ ID NO: 463080 - DNA, 20 bp, Artificial
  CRISPR gRNA sequence
tgttgcagtgctcagttggg

SEQ ID NO: 463081 - DNA, 20 bp, Artificial
  CRISPR gRNA sequence
gttgcagtgctcagttgggt

SEQ ID NO: 463082 - DNA, 20 bp, Artificial
  CRISPR gRNA sequence
cagtgctcagttgggtagga

SEQ ID NO: 463083 - DNA, 20 bp, Artificial
  CRISPR gRNA sequence
cagttgggtaggacagatgt

SEQ ID NO: 463084 - DNA, 20 bp, Artificial
  CRISPR gRNA sequence
taggacagatgttggataat

SEQ ID NO: 463085 - DNA, 20 bp, Artificial
  CRISPR gRNA sequence
aggacagatgttggataatt

SEQ ID NO: 463086 - DNA, 20 bp, Artificial
  CRISPR gRNA sequence
ggacagatgttggataattg

SEQ ID NO: 463087 - DNA, 20 bp, Artificial
  CRISPR gRNA sequence
tctactaaaaatacaaaaat

SEQ ID NO: 463088 - DNA, 20 bp, Artificial
  CRISPR gRNA sequence
atacaaaaattagctgtgcg

SEQ ID NO: 463089 - DNA, 20 bp, Artificial
  CRISPR gRNA sequence
caaaaattagctgtgcgtgg

SEQ ID NO: 463090 - DNA, 20 bp, Artificial
  CRISPR gRNA sequence
aaattagctgtgcgtggtgg

SEQ ID NO: 463091 - DNA, 20 bp, Artificial
  CRISPR gRNA sequence
aattagctgtgcgtggtgga

SEQ ID NO: 463092 - DNA, 20 bp, Artificial
  CRISPR gRNA sequence
gtggaaggtgcctgtaatcc

SEQ ID NO: 463093 - DNA, 20 bp, Artificial
  CRISPR gRNA sequence
gtgcctgtaatcccagctac

SEQ ID NO: 463094 - DNA, 20 bp, Artificial
  CRISPR gRNA sequence
tgcctgtaatcccagctact

SEQ ID NO: 463095 - DNA, 20 bp, Artificial
  CRISPR gRNA sequence
gcctgtaatcccagctacta

SEQ ID NO: 463096 - DNA, 20 bp, Artificial
  CRISPR gRNA sequence
tcccagctactagggacgct

SEQ ID NO: 463097 - DNA, 20 bp, Artificial
  CRISPR gRNA sequence
cccagctactagggacgctg

SEQ ID NO: 463098 - DNA, 20 bp, Artificial
  CRISPR gRNA sequence
agctactagggacgctgagg

SEQ ID NO: 463099 - DNA, 20 bp, Artificial
  CRISPR gRNA sequence
gctactagggacgctgaggc

SEQ ID NO: 463100 - DNA, 20 bp, Artificial
  CRISPR gRNA sequence
tactagggacgctgaggcag

SEQ ID NO: 463101 - DNA, 20 bp, Artificial
  CRISPR gRNA sequence
gcaggagaataaattgaacc

SEQ ID NO: 463102 - DNA, 20 bp, Artificial
  CRISPR gRNA sequence
caggagaataaattgaaccc

SEQ ID NO: 463103 - DNA, 20 bp, Artificial
  CRISPR gRNA sequence
ggagaataaattgaacccgg

SEQ ID NO: 463104 - DNA, 20 bp, Artificial
  CRISPR gRNA sequence
gagaataaattgaacccggg

SEQ ID NO: 463105 - DNA, 20 bp, Artificial
  CRISPR gRNA sequence
aataaattgaacccgggagg

SEQ ID NO: 463106 - DNA, 20 bp, Artificial
  CRISPR gRNA sequence
aaattgaacccgggaggaag

SEQ ID NO: 463107 - DNA, 20 bp, Artificial
  CRISPR gRNA sequence
gaagaagaatcgattgaacc

SEQ ID NO: 463108 - DNA, 20 bp, Artificial
  CRISPR gRNA sequence
aagaagaatcgattgaaccc

SEQ ID NO: 463109 - DNA, 20 bp, Artificial
  CRISPR gRNA sequence
gaagaatcgattgaacccgg

SEQ ID NO: 463110 - DNA, 20 bp, Artificial
  CRISPR gRNA sequence
aagaatcgattgaacccggg

SEQ ID NO: 463111 - DNA, 20 bp, Artificial
  CRISPR gRNA sequence
aatcgattgaacccgggagg

SEQ ID NO: 463112 - DNA, 20 bp, Artificial
  CRISPR gRNA sequence
tcgattgaacccgggaggca

SEQ ID NO: 463113 - DNA, 20 bp, Artificial
  CRISPR gRNA sequence
cgattgaacccgggaggcag

SEQ ID NO: 463114 - DNA, 20 bp, Artificial
  CRISPR gRNA sequence
aacccgggaggcagaggatg

SEQ ID NO: 463115 - DNA, 20 bp, Artificial
  CRISPR gRNA sequence
cgggaggcagaggatgcagt

SEQ ID NO: 463116 - DNA, 20 bp, Artificial
  CRISPR gRNA sequence
gggaggcagaggatgcagtg

SEQ ID NO: 463117 - DNA, 20 bp, Artificial
  CRISPR gRNA sequence
aggcagaggatgcagtgagg

SEQ ID NO: 463118 - DNA, 20 bp, Artificial
  CRISPR gRNA sequence
ggcagaggatgcagtgaggc

SEQ ID NO: 463119 - DNA, 20 bp, Artificial
  CRISPR gRNA sequence
gggatcacgccattgcactc

SEQ ID NO: 463120 - DNA, 20 bp, Artificial
  CRISPR gRNA sequence
cacgccattgcactccagcc

SEQ ID NO: 463121 - DNA, 20 bp, Artificial
  CRISPR gRNA sequence
acgccattgcactccagcct

SEQ ID NO: 463122 - DNA, 20 bp, Artificial
  CRISPR gRNA sequence
tgcactccagcctgggtgac

SEQ ID NO: 463123 - DNA, 20 bp, Artificial
  CRISPR gRNA sequence
cactccagcctgggtgacga

SEQ ID NO: 463124 - DNA, 20 bp, Artificial
  CRISPR gRNA sequence
aaaaataaaacctgaaaaat

SEQ ID NO: 463125 - DNA, 20 bp, Artificial
  CRISPR gRNA sequence
aataaaacctgaaaaatcag

SEQ ID NO: 463126 - DNA, 20 bp, Artificial
  CRISPR gRNA sequence
aaaaatcagaagcttctgat

SEQ ID NO: 463127 - DNA, 20 bp, Artificial
  CRISPR gRNA sequence
agcttctgatgagccactca

SEQ ID NO: 463128 - DNA, 20 bp, Artificial
  CRISPR gRNA sequence
gcttctgatgagccactcat

SEQ ID NO: 463129 - DNA, 20 bp, Artificial
  CRISPR gRNA sequence
cttttcctcttgataatatg

SEQ ID NO: 463130 - DNA, 20 bp, Artificial
  CRISPR gRNA sequence
ttttcctcttgataatatgt

SEQ ID NO: 463131 - DNA, 20 bp, Artificial
  CRISPR gRNA sequence
tgtgggttcctatgcaatat

SEQ ID NO: 463132 - DNA, 20 bp, Artificial
  CRISPR gRNA sequence
gtgggttcctatgcaatata

SEQ ID NO: 463133 - DNA, 20 bp, Artificial
  CRISPR gRNA sequence
ggttcctatgcaatataagg

SEQ ID NO: 463134 - DNA, 20 bp, Artificial
  CRISPR gRNA sequence
gttcctatgcaatataaggt

SEQ ID NO: 463135 - DNA, 20 bp, Artificial
  CRISPR gRNA sequence
cctatgcaatataaggtagg

SEQ ID NO: 463136 - DNA, 20 bp, Artificial
  CRISPR gRNA sequence
gaagcgactttacaataaaa

SEQ ID NO: 463137 - DNA, 20 bp, Artificial
  CRISPR gRNA sequence
tttttttttttgcctgtata

SEQ ID NO: 463138 - DNA, 20 bp, Artificial
  CRISPR gRNA sequence
ttgcctgtataaagtctttg

SEQ ID NO: 463139 - DNA, 20 bp, Artificial
  CRISPR gRNA sequence
tgcctgtataaagtctttgc

SEQ ID NO: 463140 - DNA, 20 bp, Artificial
  CRISPR gRNA sequence
gcctgtataaagtctttgca

SEQ ID NO: 463141 - DNA, 20 bp, Artificial
  CRISPR gRNA sequence
cctgtataaagtctttgcag

SEQ ID NO: 463142 - DNA, 20 bp, Artificial
  CRISPR gRNA sequence
gtataaagtctttgcagggg

SEQ ID NO: 463143 - DNA, 20 bp, Artificial
  CRISPR gRNA sequence
gtggctaaatatcatctttg

SEQ ID NO: 463144 - DNA, 20 bp, Artificial
  CRISPR gRNA sequence
tctgtgttcaattgacaacc

SEQ ID NO: 463145 - DNA, 20 bp, Artificial
  CRISPR gRNA sequence
gtgttcaattgacaaccaag

SEQ ID NO: 463146 - DNA, 20 bp, Artificial
  CRISPR gRNA sequence
tgttcaattgacaaccaagt

SEQ ID NO: 463147 - DNA, 20 bp, Artificial
  CRISPR gRNA sequence
accattccctttcaacaaaa

SEQ ID NO: 463148 - DNA, 20 bp, Artificial
  CRISPR gRNA sequence
attccctttcaacaaaatag

SEQ ID NO: 463149 - DNA, 20 bp, Artificial
  CRISPR gRNA sequence
aaaatagaagcaatgacgaa

SEQ ID NO: 463150 - DNA, 20 bp, Artificial
  CRISPR gRNA sequence
agttctgctcctatattttg

SEQ ID NO: 463151 - DNA, 20 bp, Artificial
  CRISPR gRNA sequence
ttttgtagcattttctcaat

SEQ ID NO: 463152 - DNA, 20 bp, Artificial
  CRISPR gRNA sequence
ttttctcaatcggtattctc

SEQ ID NO: 463153 - DNA, 20 bp, Artificial
  CRISPR gRNA sequence
tttctcaatcggtattctca

SEQ ID NO: 463154 - DNA, 20 bp, Artificial
  CRISPR gRNA sequence
tcaaggcatacatcccaatg

SEQ ID NO: 463155 - DNA, 20 bp, Artificial
  CRISPR gRNA sequence
ggcatacatcccaatgaagc

SEQ ID NO: 463156 - DNA, 20 bp, Artificial
  CRISPR gRNA sequence
acatcccaatgaagcaagta

SEQ ID NO: 463157 - DNA, 20 bp, Artificial
  CRISPR gRNA sequence
atcccaatgaagcaagtata

SEQ ID NO: 463158 - DNA, 20 bp, Artificial
  CRISPR gRNA sequence
gcaagtatagagattttatt

SEQ ID NO: 463159 - DNA, 20 bp, Artificial
  CRISPR gRNA sequence
aagtatagagattttattta

SEQ ID NO: 463160 - DNA, 20 bp, Artificial
  CRISPR gRNA sequence
agtatagagattttatttag

SEQ ID NO: 463161 - DNA, 20 bp, Artificial
  CRISPR gRNA sequence
atttagaggtaatattattt

SEQ ID NO: 463162 - DNA, 20 bp, Artificial
  CRISPR gRNA sequence
tttagaggtaatattatttg

SEQ ID NO: 463163 - DNA, 20 bp, Artificial
  CRISPR gRNA sequence
ttagaggtaatattatttga

SEQ ID NO: 463164 - DNA, 20 bp, Artificial
  CRISPR gRNA sequence
atattatttgagggtaacca

SEQ ID NO: 463165 - DNA, 20 bp, Artificial
  CRISPR gRNA sequence
attatttgagggtaaccatg

SEQ ID NO: 463166 - DNA, 20 bp, Artificial
  CRISPR gRNA sequence
aacaactgtcctacccaact

SEQ ID NO: 463167 - DNA, 20 bp, Artificial
  CRISPR gRNA sequence
tcctacccaactgagcactg

SEQ ID NO: 463168 - DNA, 20 bp, Artificial
  CRISPR gRNA sequence
ctgcagcactctactgcact

SEQ ID NO: 463169 - DNA, 20 bp, Artificial
  CRISPR gRNA sequence
gcactctactgcactcagtt

SEQ ID NO: 463170 - DNA, 20 bp, Artificial
  CRISPR gRNA sequence
tctactgcactcagtttgga

SEQ ID NO: 463171 - DNA, 20 bp, Artificial
  CRISPR gRNA sequence
gcactcagtttggaaagaac

SEQ ID NO: 463172 - DNA, 20 bp, Artificial
  CRISPR gRNA sequence
acgagctatctattcattat

SEQ ID NO: 463173 - DNA, 20 bp, Artificial
  CRISPR gRNA sequence
ctatctattcattatcagta

SEQ ID NO: 463174 - DNA, 20 bp, Artificial
  CRISPR gRNA sequence
tctattcattatcagtatgg

SEQ ID NO: 463175 - DNA, 20 bp, Artificial
  CRISPR gRNA sequence
ttcattatcagtatggcagc

SEQ ID NO: 463176 - DNA, 20 bp, Artificial
  CRISPR gRNA sequence
cattatcagtatggcagcca

SEQ ID NO: 463177 - DNA, 20 bp, Artificial
  CRISPR gRNA sequence
ggcagccagagcatttttgc

SEQ ID NO: 463178 - DNA, 20 bp, Artificial
  CRISPR gRNA sequence
agccagagcatttttgcaag

SEQ ID NO: 463179 - DNA, 20 bp, Artificial
  CRISPR gRNA sequence
cagagcatttttgcaagaag

SEQ ID NO: 463180 - DNA, 20 bp, Artificial
  CRISPR gRNA sequence
atttttgcaagaagtagtga

SEQ ID NO: 463181 - DNA, 20 bp, Artificial
  CRISPR gRNA sequence
aactatttataacatctact

SEQ ID NO: 463182 - DNA, 20 bp, Artificial
  CRISPR gRNA sequence
cctaccatcaacatgttttt

SEQ ID NO: 463183 - DNA, 20 bp, Artificial
  CRISPR gRNA sequence
ccatcaacatgtttttaaga

SEQ ID NO: 463184 - DNA, 20 bp, Artificial
  CRISPR gRNA sequence
caacatgtttttaagaaagt

SEQ ID NO: 463185 - DNA, 20 bp, Artificial
  CRISPR gRNA sequence
tgtttttaagaaagtcagcc

SEQ ID NO: 463186 - DNA, 20 bp, Artificial
  CRISPR gRNA sequence
attgatgcgatgcctatgat

SEQ ID NO: 463187 - DNA, 20 bp, Artificial
  CRISPR gRNA sequence
ttgatgcgatgcctatgatt

SEQ ID NO: 463188 - DNA, 20 bp, Artificial
  CRISPR gRNA sequence
atgcgatgcctatgattagg

SEQ ID NO: 463189 - DNA, 20 bp, Artificial
  CRISPR gRNA sequence
tgcgatgcctatgattaggc

SEQ ID NO: 463190 - DNA, 20 bp, Artificial
  CRISPR gRNA sequence
gtgaatactatgttctaatt

SEQ ID NO: 463191 - DNA, 20 bp, Artificial
  CRISPR gRNA sequence
tttatgctctacgatgtctt

SEQ ID NO: 463192 - DNA, 20 bp, Artificial
  CRISPR gRNA sequence
tgctctacgatgtcttcggt

SEQ ID NO: 463193 - DNA, 20 bp, Artificial
  CRISPR gRNA sequence
tcttcggtaagcaaatgtaa

SEQ ID NO: 463194 - DNA, 20 bp, Artificial
  CRISPR gRNA sequence
ggtaagcaaatgtaacagct

SEQ ID NO: 463195 - DNA, 20 bp, Artificial
  CRISPR gRNA sequence
tataaacgttacaccgtact

SEQ ID NO: 463196 - DNA, 20 bp, Artificial
  CRISPR gRNA sequence
acgttacaccgtactaagtt

SEQ ID NO: 463197 - DNA, 20 bp, Artificial
  CRISPR gRNA sequence
tacaccgtactaagttcagc

SEQ ID NO: 463198 - DNA, 20 bp, Artificial
  CRISPR gRNA sequence
acaccgtactaagttcagca

SEQ ID NO: 463199 - DNA, 20 bp, Artificial
  CRISPR gRNA sequence
caccgtactaagttcagcaa

SEQ ID NO: 463200 - DNA, 20 bp, Artificial
  CRISPR gRNA sequence
ccgtactaagttcagcaagg

SEQ ID NO: 463201 - DNA, 20 bp, Artificial
  CRISPR gRNA sequence
caagggagaatgttgcctcc

SEQ ID NO: 463202 - DNA, 20 bp, Artificial
  CRISPR gRNA sequence
tgttgcctccaagaccccct

SEQ ID NO: 463203 - DNA, 20 bp, Artificial
  CRISPR gRNA sequence
gaccccctgagaaataaaac

SEQ ID NO: 463204 - DNA, 20 bp, Artificial
  CRISPR gRNA sequence
aataaaaccagaaataacct

SEQ ID NO: 463205 - DNA, 20 bp, Artificial
  CRISPR gRNA sequence
aaaaccagaaataacctaag

SEQ ID NO: 463206 - DNA, 20 bp, Artificial
  CRISPR gRNA sequence
aaaccagaaataacctaagc

SEQ ID NO: 463207 - DNA, 20 bp, Artificial
  CRISPR gRNA sequence
cctaagcaggtgccttacca

SEQ ID NO: 463208 - DNA, 20 bp, Artificial
  CRISPR gRNA sequence
gtgccttaccatggatgttc

SEQ ID NO: 463209 - DNA, 20 bp, Artificial
  CRISPR gRNA sequence
ccatggatgttccagatgtc

SEQ ID NO: 463210 - DNA, 20 bp, Artificial
  CRISPR gRNA sequence
atgttccagatgtccagata

SEQ ID NO: 463211 - DNA, 20 bp, Artificial
  CRISPR gRNA sequence
tgttccagatgtccagatat

SEQ ID NO: 463212 - DNA, 20 bp, Artificial
  CRISPR gRNA sequence
agatgtccagatatgggatt

SEQ ID NO: 463213 - DNA, 20 bp, Artificial
  CRISPR gRNA sequence
tgtccagatatgggattaag

SEQ ID NO: 463214 - DNA, 20 bp, Artificial
  CRISPR gRNA sequence
ccagatatgggattaagaag

SEQ ID NO: 463215 - DNA, 20 bp, Artificial
  CRISPR gRNA sequence
gaagacccaaaataatttcc

SEQ ID NO: 463216 - DNA, 20 bp, Artificial
  CRISPR gRNA sequence
caaaataatttcccagttcc

SEQ ID NO: 463217 - DNA, 20 bp, Artificial
  CRISPR gRNA sequence
taatttcccagttccaagca

SEQ ID NO: 463218 - DNA, 20 bp, Artificial
  CRISPR gRNA sequence
tttcccagttccaagcatgg

SEQ ID NO: 463219 - DNA, 20 bp, Artificial
  CRISPR gRNA sequence
ttcccagttccaagcatggc

SEQ ID NO: 463220 - DNA, 20 bp, Artificial
  CRISPR gRNA sequence
tcttcatttcctgcacatat

SEQ ID NO: 463221 - DNA, 20 bp, Artificial
  CRISPR gRNA sequence
tttcctgcacatatcagtga

SEQ ID NO: 463222 - DNA, 20 bp, Artificial
  CRISPR gRNA sequence
cagtgatggaaaaactgctc

SEQ ID NO: 463223 - DNA, 20 bp, Artificial
  CRISPR gRNA sequence
tgatggaaaaactgctcaag

SEQ ID NO: 463224 - DNA, 20 bp, Artificial
  CRISPR gRNA sequence
tggaaaaactgctcaagtag

SEQ ID NO: 463225 - DNA, 20 bp, Artificial
  CRISPR gRNA sequence
ggaaaaactgctcaagtaga

SEQ ID NO: 463226 - DNA, 20 bp, Artificial
  CRISPR gRNA sequence
aaggctttgcttcgtcttct

SEQ ID NO: 463227 - DNA, 20 bp, Artificial
  CRISPR gRNA sequence
gcttcgtcttctgagtgctg

SEQ ID NO: 463228 - DNA, 20 bp, Artificial
  CRISPR gRNA sequence
ttcgtcttctgagtgctgca

SEQ ID NO: 463229 - DNA, 20 bp, Artificial
  CRISPR gRNA sequence
tcttctgagtgctgcagagt

SEQ ID NO: 463230 - DNA, 20 bp, Artificial
  CRISPR gRNA sequence
cttctgagtgctgcagagtt

SEQ ID NO: 463231 - DNA, 20 bp, Artificial
  CRISPR gRNA sequence
tgagtgctgcagagttgggt

SEQ ID NO: 463232 - DNA, 20 bp, Artificial
  CRISPR gRNA sequence
ttgggtcagtttacctaccc

SEQ ID NO: 463233 - DNA, 20 bp, Artificial
  CRISPR gRNA sequence
ggtcagtttacctaccccag

SEQ ID NO: 463234 - DNA, 20 bp, Artificial
  CRISPR gRNA sequence
ataactaaaaaaaaaaaaaa

SEQ ID NO: 463235 - DNA, 20 bp, Artificial
  CRISPR gRNA sequence
actaaaaaaaaaaaaaaaag

SEQ ID NO: 463236 - DNA, 20 bp, Artificial
  CRISPR gRNA sequence
taaaaaaaaaaaaaaaagaa

SEQ ID NO: 463237 - DNA, 20 bp, Artificial
  CRISPR gRNA sequence
aaaaaaaaaaaaaaagaaga

SEQ ID NO: 463238 - DNA, 20 bp, Artificial
  CRISPR gRNA sequence
aaaaaaaaaaaaagaagaga

SEQ ID NO: 463239 - DNA, 20 bp, Artificial
  CRISPR gRNA sequence
aaaaaaaaaaaagaagagag

SEQ ID NO: 463240 - DNA, 20 bp, Artificial
  CRISPR gRNA sequence
aaaaaaaaagaagagagagg

SEQ ID NO: 463241 - DNA, 20 bp, Artificial
  CRISPR gRNA sequence
aaaaagaagagagaggtggt

SEQ ID NO: 463242 - DNA, 20 bp, Artificial
  CRISPR gRNA sequence
aaagaagagagaggtggtaa

SEQ ID NO: 463243 - DNA, 20 bp, Artificial
  CRISPR gRNA sequence
agaagagagaggtggtaaga

SEQ ID NO: 463244 - DNA, 20 bp, Artificial
  CRISPR gRNA sequence
gaagagagaggtggtaagag

SEQ ID NO: 463245 - DNA, 20 bp, Artificial
  CRISPR gRNA sequence
agagagaggtggtaagagag

SEQ ID NO: 463246 - DNA, 20 bp, Artificial
  CRISPR gRNA sequence
agagaggtggtaagagagga

SEQ ID NO: 463247 - DNA, 20 bp, Artificial
  CRISPR gRNA sequence
gaggtggtaagagaggagag

SEQ ID NO: 463248 - DNA, 20 bp, Artificial
  CRISPR gRNA sequence
aggtggtaagagaggagagt

SEQ ID NO: 463249 - DNA, 20 bp, Artificial
  CRISPR gRNA sequence
tggtaagagaggagagtagg

SEQ ID NO: 463250 - DNA, 20 bp, Artificial
  CRISPR gRNA sequence
gtaagagaggagagtaggaa

SEQ ID NO: 463251 - DNA, 20 bp, Artificial
  CRISPR gRNA sequence
agaggagagtaggaagagcc

SEQ ID NO: 463252 - DNA, 20 bp, Artificial
  CRISPR gRNA sequence
ctggatgattttgtgaaaaa

SEQ ID NO: 463253 - DNA, 20 bp, Artificial
  CRISPR gRNA sequence
attttgtgaaaaaaagtgaa

SEQ ID NO: 463254 - DNA, 20 bp, Artificial
  CRISPR gRNA sequence
tgtgaaaaaaagtgaacaga

SEQ ID NO: 463255 - DNA, 20 bp, Artificial
  CRISPR gRNA sequence
aagtgaacagaaagacgatg

SEQ ID NO: 463256 - DNA, 20 bp, Artificial
  CRISPR gRNA sequence
cgatgtggtactctgttctg

SEQ ID NO: 463257 - DNA, 20 bp, Artificial
  CRISPR gRNA sequence
ctgtggtttttgcttcttgt

SEQ ID NO: 463258 - DNA, 20 bp, Artificial
  CRISPR gRNA sequence
tgtggtttttgcttcttgtc

SEQ ID NO: 463259 - DNA, 20 bp, Artificial
  CRISPR gRNA sequence
gtttttgcttcttgtcaggt

SEQ ID NO: 463260 - DNA, 20 bp, Artificial
  CRISPR gRNA sequence
ttcaaacactgtgatctgca

SEQ ID NO: 463261 - DNA, 20 bp, Artificial
  CRISPR gRNA sequence
aaacactgtgatctgcaaag

SEQ ID NO: 463262 - DNA, 20 bp, Artificial
  CRISPR gRNA sequence
ctgtgatctgcaaagcagct

SEQ ID NO: 463263 - DNA, 20 bp, Artificial
  CRISPR gRNA sequence
gctctaccacgtttttgccc

SEQ ID NO: 463264 - DNA, 20 bp, Artificial
  CRISPR gRNA sequence
ctctaccacgtttttgcccc

SEQ ID NO: 463265 - DNA, 20 bp, Artificial
  CRISPR gRNA sequence
ccacgtttttgccccaggtt

SEQ ID NO: 463266 - DNA, 20 bp, Artificial
  CRISPR gRNA sequence
cacgtttttgccccaggttg

SEQ ID NO: 463267 - DNA, 20 bp, Artificial
  CRISPR gRNA sequence
tttttcctgcactcaatgtt

SEQ ID NO: 463268 - DNA, 20 bp, Artificial
  CRISPR gRNA sequence
cactcaatgttcagtgaaat

SEQ ID NO: 463269 - DNA, 20 bp, Artificial
  CRISPR gRNA sequence
aaatgagcaattaaacttta

SEQ ID NO: 463270 - DNA, 20 bp, Artificial
  CRISPR gRNA sequence
taaagaaatctgtattgttg

SEQ ID NO: 463271 - DNA, 20 bp, Artificial
  CRISPR gRNA sequence
tctgtattgttgcagtcttt

SEQ ID NO: 463272 - DNA, 20 bp, Artificial
  CRISPR gRNA sequence
attgttgcagtctttaagtt

SEQ ID NO: 463273 - DNA, 20 bp, Artificial
  CRISPR gRNA sequence
gttgagattttaatcaaatt

SEQ ID NO: 463274 - DNA, 20 bp, Artificial
  CRISPR gRNA sequence
ttgagattttaatcaaatta

SEQ ID NO: 463275 - DNA, 20 bp, Artificial
  CRISPR gRNA sequence
gattttaatcaaattaaggt

SEQ ID NO: 463276 - DNA, 20 bp, Artificial
  CRISPR gRNA sequence
attttaatcaaattaaggtc

SEQ ID NO: 463277 - DNA, 20 bp, Artificial
  CRISPR gRNA sequence
ttgattaaaatctcaactta

SEQ ID NO: 463278 - DNA, 20 bp, Artificial
  CRISPR gRNA sequence
acttaaagactgcaacaata

SEQ ID NO: 463279 - DNA, 20 bp, Artificial
  CRISPR gRNA sequence
caacaatacagatttcttta

SEQ ID NO: 463280 - DNA, 20 bp, Artificial
  CRISPR gRNA sequence
tgctcatttcactgaacatt

SEQ ID NO: 463281 - DNA, 20 bp, Artificial
  CRISPR gRNA sequence
atttcactgaacattgagtg

SEQ ID NO: 463282 - DNA, 20 bp, Artificial
  CRISPR gRNA sequence
tttcactgaacattgagtgc

SEQ ID NO: 463283 - DNA, 20 bp, Artificial
  CRISPR gRNA sequence
gtgcaggaaaaacctcaacc

SEQ ID NO: 463284 - DNA, 20 bp, Artificial
  CRISPR gRNA sequence
tgcaggaaaaacctcaacct

SEQ ID NO: 463285 - DNA, 20 bp, Artificial
  CRISPR gRNA sequence
gcaggaaaaacctcaacctg

SEQ ID NO: 463286 - DNA, 20 bp, Artificial
  CRISPR gRNA sequence
ctcaacctggggcaaaaacg

SEQ ID NO: 463287 - DNA, 20 bp, Artificial
  CRISPR gRNA sequence
aacctggggcaaaaacgtgg

SEQ ID NO: 463288 - DNA, 20 bp, Artificial
  CRISPR gRNA sequence
cctggggcaaaaacgtggta

SEQ ID NO: 463289 - DNA, 20 bp, Artificial
  CRISPR gRNA sequence
ggggcaaaaacgtggtagag

SEQ ID NO: 463290 - DNA, 20 bp, Artificial
  CRISPR gRNA sequence
gcaaaaacgtggtagagcgg

SEQ ID NO: 463291 - DNA, 20 bp, Artificial
  CRISPR gRNA sequence
caaaaacgtggtagagcgga

SEQ ID NO: 463292 - DNA, 20 bp, Artificial
  CRISPR gRNA sequence
aaaacgtggtagagcggaag

SEQ ID NO: 463293 - DNA, 20 bp, Artificial
  CRISPR gRNA sequence
acgtggtagagcggaaggag

SEQ ID NO: 463294 - DNA, 20 bp, Artificial
  CRISPR gRNA sequence
gtagagcggaaggagaagtt

SEQ ID NO: 463295 - DNA, 20 bp, Artificial
  CRISPR gRNA sequence
tagagcggaaggagaagtta

SEQ ID NO: 463296 - DNA, 20 bp, Artificial
  CRISPR gRNA sequence
ggaaggagaagttaaggact

SEQ ID NO: 463297 - DNA, 20 bp, Artificial
  CRISPR gRNA sequence
ttaaggactgagctgctttg

SEQ ID NO: 463298 - DNA, 20 bp, Artificial
  CRISPR gRNA sequence
ctgagctgctttgcagatca

SEQ ID NO: 463299 - DNA, 20 bp, Artificial
  CRISPR gRNA sequence
ttgcagatcacagtgtttga

SEQ ID NO: 463300 - DNA, 20 bp, Artificial
  CRISPR gRNA sequence
tcacagtgtttgaaagtgaa

SEQ ID NO: 463301 - DNA, 20 bp, Artificial
  CRISPR gRNA sequence
aagtgaacagccaacctgac

SEQ ID NO: 463302 - DNA, 20 bp, Artificial
  CRISPR gRNA sequence
tgaacagccaacctgacaag

SEQ ID NO: 463303 - DNA, 20 bp, Artificial
  CRISPR gRNA sequence
ctgacaagaagcaaaaacca

SEQ ID NO: 463304 - DNA, 20 bp, Artificial
  CRISPR gRNA sequence
aagaagcaaaaaccacagaa

SEQ ID NO: 463305 - DNA, 20 bp, Artificial
  CRISPR gRNA sequence
gaagcaaaaaccacagaaca

SEQ ID NO: 463306 - DNA, 20 bp, Artificial
  CRISPR gRNA sequence
ctttttttcacaaaatcatc

SEQ ID NO: 463307 - DNA, 20 bp, Artificial
  CRISPR gRNA sequence
tttttttcacaaaatcatcc

SEQ ID NO: 463308 - DNA, 20 bp, Artificial
  CRISPR gRNA sequence
tcttcttttttttttttttt

SEQ ID NO: 463309 - DNA, 20 bp, Artificial
  CRISPR gRNA sequence
ttttttttttagttatttca

SEQ ID NO: 463310 - DNA, 20 bp, Artificial
  CRISPR gRNA sequence
agttatttcacagatgccac

SEQ ID NO: 463311 - DNA, 20 bp, Artificial
  CRISPR gRNA sequence
gttatttcacagatgccact

SEQ ID NO: 463312 - DNA, 20 bp, Artificial
  CRISPR gRNA sequence
ttatttcacagatgccactg

SEQ ID NO: 463313 - DNA, 20 bp, Artificial
  CRISPR gRNA sequence
tttcacagatgccactgggg

SEQ ID NO: 463314 - DNA, 20 bp, Artificial
  CRISPR gRNA sequence
ttcacagatgccactggggt

SEQ ID NO: 463315 - DNA, 20 bp, Artificial
  CRISPR gRNA sequence
ggtaaactgacccaactctg

SEQ ID NO: 463316 - DNA, 20 bp, Artificial
  CRISPR gRNA sequence
tgacccaactctgcagcact

SEQ ID NO: 463317 - DNA, 20 bp, Artificial
  CRISPR gRNA sequence
cccaactctgcagcactcag

SEQ ID NO: 463318 - DNA, 20 bp, Artificial
  CRISPR gRNA sequence
tctgcagcactcagaagacg

SEQ ID NO: 463319 - DNA, 20 bp, Artificial
  CRISPR gRNA sequence
agcactcagaagacgaagca

SEQ ID NO: 463320 - DNA, 20 bp, Artificial
  CRISPR gRNA sequence
cgaagcaaagccttctactt

SEQ ID NO: 463321 - DNA, 20 bp, Artificial
  CRISPR gRNA sequence
agcaaagccttctacttgag

SEQ ID NO: 463322 - DNA, 20 bp, Artificial
  CRISPR gRNA sequence
ttttccatcactgatatgtg

SEQ ID NO: 463323 - DNA, 20 bp, Artificial
  CRISPR gRNA sequence
tttccatcactgatatgtgc

SEQ ID NO: 463324 - DNA, 20 bp, Artificial
  CRISPR gRNA sequence
actgatatgtgcaggaaatg

SEQ ID NO: 463325 - DNA, 20 bp, Artificial
  CRISPR gRNA sequence
aagacattgcctgccatgct

SEQ ID NO: 463326 - DNA, 20 bp, Artificial
  CRISPR gRNA sequence
ttgcctgccatgcttggaac

SEQ ID NO: 463327 - DNA, 20 bp, Artificial
  CRISPR gRNA sequence
tgcctgccatgcttggaact

SEQ ID NO: 463328 - DNA, 20 bp, Artificial
  CRISPR gRNA sequence
ttggaactgggaaattattt

SEQ ID NO: 463329 - DNA, 20 bp, Artificial
  CRISPR gRNA sequence
tggaactgggaaattatttt

SEQ ID NO: 463330 - DNA, 20 bp, Artificial
  CRISPR gRNA sequence
cttcttcttaatcccatatc

SEQ ID NO: 463331 - DNA, 20 bp, Artificial
  CRISPR gRNA sequence
taatcccatatctggacatc

SEQ ID NO: 463332 - DNA, 20 bp, Artificial
  CRISPR gRNA sequence
ctggacatctggaacatcca

SEQ ID NO: 463333 - DNA, 20 bp, Artificial
  CRISPR gRNA sequence
acatctggaacatccatggt

SEQ ID NO: 463334 - DNA, 20 bp, Artificial
  CRISPR gRNA sequence
catctggaacatccatggta

SEQ ID NO: 463335 - DNA, 20 bp, Artificial
  CRISPR gRNA sequence
tccatggtaaggcacctgct

SEQ ID NO: 463336 - DNA, 20 bp, Artificial
  CRISPR gRNA sequence
ccatggtaaggcacctgctt

SEQ ID NO: 463337 - DNA, 20 bp, Artificial
  CRISPR gRNA sequence
gcacctgcttaggttatttc

SEQ ID NO: 463338 - DNA, 20 bp, Artificial
  CRISPR gRNA sequence
ttatttctggttttatttct

SEQ ID NO: 463339 - DNA, 20 bp, Artificial
  CRISPR gRNA sequence
tatttctggttttatttctc

SEQ ID NO: 463340 - DNA, 20 bp, Artificial
  CRISPR gRNA sequence
atttctggttttatttctca

SEQ ID NO: 463341 - DNA, 20 bp, Artificial
  CRISPR gRNA sequence
tttctggttttatttctcag

SEQ ID NO: 463342 - DNA, 20 bp, Artificial
  CRISPR gRNA sequence
ttctggttttatttctcagg

SEQ ID NO: 463343 - DNA, 20 bp, Artificial
  CRISPR gRNA sequence
ttttatttctcagggggtct

SEQ ID NO: 463344 - DNA, 20 bp, Artificial
  CRISPR gRNA sequence
ttatttctcagggggtcttg

SEQ ID NO: 463345 - DNA, 20 bp, Artificial
  CRISPR gRNA sequence
tatttctcagggggtcttgg

SEQ ID NO: 463346 - DNA, 20 bp, Artificial
  CRISPR gRNA sequence
acattctcccttgctgaact

SEQ ID NO: 463347 - DNA, 20 bp, Artificial
  CRISPR gRNA sequence
ctcccttgctgaacttagta

SEQ ID NO: 463348 - DNA, 20 bp, Artificial
  CRISPR gRNA sequence
tacggtgtaacgtttatacg

SEQ ID NO: 463349 - DNA, 20 bp, Artificial
  CRISPR gRNA sequence
ggtgtaacgtttatacgaag

SEQ ID NO: 463350 - DNA, 20 bp, Artificial
  CRISPR gRNA sequence
gtgtaacgtttatacgaagt

SEQ ID NO: 463351 - DNA, 20 bp, Artificial
  CRISPR gRNA sequence
ttatacgaagtgggtaatcg

SEQ ID NO: 463352 - DNA, 20 bp, Artificial
  CRISPR gRNA sequence
gggtaatcgtagatgaaacc

SEQ ID NO: 463353 - DNA, 20 bp, Artificial
  CRISPR gRNA sequence
gctgttacatttgcttaccg

SEQ ID NO: 463354 - DNA, 20 bp, Artificial
  CRISPR gRNA sequence
tttgcttaccgaagacatcg

SEQ ID NO: 463355 - DNA, 20 bp, Artificial
  CRISPR gRNA sequence
tgcttaccgaagacatcgta

SEQ ID NO: 463356 - DNA, 20 bp, Artificial
  CRISPR gRNA sequence
tcgtagagcataaaccaaat

SEQ ID NO: 463357 - DNA, 20 bp, Artificial
  CRISPR gRNA sequence
gcataaaccaaattagaaca

SEQ ID NO: 463358 - DNA, 20 bp, Artificial
  CRISPR gRNA sequence
agtattcacctgcctaatca

SEQ ID NO: 463359 - DNA, 20 bp, Artificial
  CRISPR gRNA sequence
gtattcacctgcctaatcat

SEQ ID NO: 463360 - DNA, 20 bp, Artificial
  CRISPR gRNA sequence
aatcataggcatcgcatcaa

SEQ ID NO: 463361 - DNA, 20 bp, Artificial
  CRISPR gRNA sequence
taggcatcgcatcaatagct

SEQ ID NO: 463362 - DNA, 20 bp, Artificial
  CRISPR gRNA sequence
ctttcttaaaaacatgttga

SEQ ID NO: 463363 - DNA, 20 bp, Artificial
  CRISPR gRNA sequence
tcttaaaaacatgttgatgg

SEQ ID NO: 463364 - DNA, 20 bp, Artificial
  CRISPR gRNA sequence
cttaaaaacatgttgatggt

SEQ ID NO: 463365 - DNA, 20 bp, Artificial
  CRISPR gRNA sequence
aaacatgttgatggtaggaa

SEQ ID NO: 463366 - DNA, 20 bp, Artificial
  CRISPR gRNA sequence
acatgttgatggtaggaaaa

SEQ ID NO: 463367 - DNA, 20 bp, Artificial
  CRISPR gRNA sequence
gatggtaggaaaagagaact

SEQ ID NO: 463368 - DNA, 20 bp, Artificial
  CRISPR gRNA sequence
ggtaggaaaagagaactgag

SEQ ID NO: 463369 - DNA, 20 bp, Artificial
  CRISPR gRNA sequence
aactgagtagatgttataaa

SEQ ID NO: 463370 - DNA, 20 bp, Artificial
  CRISPR gRNA sequence
agtagatgttataaatagtt

SEQ ID NO: 463371 - DNA, 20 bp, Artificial
  CRISPR gRNA sequence
tacttcttgcaaaaatgctc

SEQ ID NO: 463372 - DNA, 20 bp, Artificial
  CRISPR gRNA sequence
gctgccatactgataatgaa

SEQ ID NO: 463373 - DNA, 20 bp, Artificial
  CRISPR gRNA sequence
ccatactgataatgaataga

SEQ ID NO: 463374 - DNA, 20 bp, Artificial
  CRISPR gRNA sequence
tagctcgttctttccaaact

SEQ ID NO: 463375 - DNA, 20 bp, Artificial
  CRISPR gRNA sequence
cgttctttccaaactgagtg

SEQ ID NO: 463376 - DNA, 20 bp, Artificial
  CRISPR gRNA sequence
tctttccaaactgagtgcag

SEQ ID NO: 463377 - DNA, 20 bp, Artificial
  CRISPR gRNA sequence
tttccaaactgagtgcagta

SEQ ID NO: 463378 - DNA, 20 bp, Artificial
  CRISPR gRNA sequence
ctgagtgcagtagagtgctg

SEQ ID NO: 463379 - DNA, 20 bp, Artificial
  CRISPR gRNA sequence
cagtagagtgctgcagtgct

SEQ ID NO: 463380 - DNA, 20 bp, Artificial
  CRISPR gRNA sequence
agagtgctgcagtgctcagt

SEQ ID NO: 463381 - DNA, 20 bp, Artificial
  CRISPR gRNA sequence
gagtgctgcagtgctcagtt

SEQ ID NO: 463382 - DNA, 20 bp, Artificial
  CRISPR gRNA sequence
tgctgcagtgctcagttggg

SEQ ID NO: 463383 - DNA, 20 bp, Artificial
  CRISPR gRNA sequence
gctgcagtgctcagttgggt

SEQ ID NO: 463384 - DNA, 20 bp, Artificial
  CRISPR gRNA sequence
cagtgctcagttgggtagga

SEQ ID NO: 463385 - DNA, 20 bp, Artificial
  CRISPR gRNA sequence
cagttgggtaggacagttgt

SEQ ID NO: 463386 - DNA, 20 bp, Artificial
  CRISPR gRNA sequence
taggacagttgttggataat

SEQ ID NO: 463387 - DNA, 20 bp, Artificial
  CRISPR gRNA sequence
cggaattatacatatctcca

SEQ ID NO: 463388 - DNA, 20 bp, Artificial
  CRISPR gRNA sequence
aatctctatacttgcttcat

SEQ ID NO: 463389 - DNA, 20 bp, Artificial
  CRISPR gRNA sequence
atctctatacttgcttcatt

SEQ ID NO: 463390 - DNA, 20 bp, Artificial
  CRISPR gRNA sequence
ttcattgggatgtatgcctt

SEQ ID NO: 463391 - DNA, 20 bp, Artificial
  CRISPR gRNA sequence
atgccttgagaataccgatt

SEQ ID NO: 463392 - DNA, 20 bp, Artificial
  CRISPR gRNA sequence
tgagaaaatgctacaaaata

SEQ ID NO: 463393 - DNA, 20 bp, Artificial
  CRISPR gRNA sequence
gagaaaatgctacaaaatat

SEQ ID NO: 463394 - DNA, 20 bp, Artificial
  CRISPR gRNA sequence
gaaaatgctacaaaatatag

SEQ ID NO: 463395 - DNA, 20 bp, Artificial
  CRISPR gRNA sequence
aatgctacaaaatataggag

SEQ ID NO: 463396 - DNA, 20 bp, Artificial
  CRISPR gRNA sequence
cattgcttctattttgttga

SEQ ID NO: 463397 - DNA, 20 bp, Artificial
  CRISPR gRNA sequence
attgcttctattttgttgaa

SEQ ID NO: 463398 - DNA, 20 bp, Artificial
  CRISPR gRNA sequence
ttgcttctattttgttgaaa

SEQ ID NO: 463399 - DNA, 20 bp, Artificial
  CRISPR gRNA sequence
tctattttgttgaaagggaa

SEQ ID NO: 463400 - DNA, 20 bp, Artificial
  CRISPR gRNA sequence
gaaagggaatggttcctact

SEQ ID NO: 463401 - DNA, 20 bp, Artificial
  CRISPR gRNA sequence
acttggttgtcaattgaaca

SEQ ID NO: 463402 - DNA, 20 bp, Artificial
  CRISPR gRNA sequence
gtcaattgaacacagaaaat

SEQ ID NO: 463403 - DNA, 20 bp, Artificial
  CRISPR gRNA sequence
attgaacacagaaaataagt

SEQ ID NO: 463404 - DNA, 20 bp, Artificial
  CRISPR gRNA sequence
aaaataagttggattctgca

SEQ ID NO: 463405 - DNA, 20 bp, Artificial
  CRISPR gRNA sequence
gattctgcaaagatgatatt

SEQ ID NO: 463406 - DNA, 20 bp, Artificial
  CRISPR gRNA sequence
gatatttagccacccctgca

SEQ ID NO: 463407 - DNA, 20 bp, Artificial
  CRISPR gRNA sequence
acccctgcaaagactttata

SEQ ID NO: 463408 - DNA, 20 bp, Artificial
  CRISPR gRNA sequence
cccctgcaaagactttatac

SEQ ID NO: 463409 - DNA, 20 bp, Artificial
  CRISPR gRNA sequence
aaaaaaaaaaaaaaaaaaaa

SEQ ID NO: 463410 - DNA, 20 bp, Artificial
  CRISPR gRNA sequence
aaaaaaaaaaaaaaaaaaaa

SEQ ID NO: 463411 - DNA, 20 bp, Artificial
  CRISPR gRNA sequence
gcaatttcttttttattgta

SEQ ID NO: 463412 - DNA, 20 bp, Artificial
  CRISPR gRNA sequence
gcttcctaccttatattgca

SEQ ID NO: 463413 - DNA, 20 bp, Artificial
  CRISPR gRNA sequence
cttcctaccttatattgcat

SEQ ID NO: 463414 - DNA, 20 bp, Artificial
  CRISPR gRNA sequence
ataggaacccacatattatc

SEQ ID NO: 463415 - DNA, 20 bp, Artificial
  CRISPR gRNA sequence
aggaacccacatattatcaa

SEQ ID NO: 463416 - DNA, 20 bp, Artificial
  CRISPR gRNA sequence
ggaacccacatattatcaag

SEQ ID NO: 463417 - DNA, 20 bp, Artificial
  CRISPR gRNA sequence
ccacatattatcaagaggaa

SEQ ID NO: 463418 - DNA, 20 bp, Artificial
  CRISPR gRNA sequence
tatcaagaggaaaagcctat

SEQ ID NO: 463419 - DNA, 20 bp, Artificial
  CRISPR gRNA sequence
caagaggaaaagcctatgag

SEQ ID NO: 463420 - DNA, 20 bp, Artificial
  CRISPR gRNA sequence
aaagcctatgagtggctcat

SEQ ID NO: 463421 - DNA, 20 bp, Artificial
  CRISPR gRNA sequence
gcctatgagtggctcatcag

SEQ ID NO: 463422 - DNA, 20 bp, Artificial
  CRISPR gRNA sequence
atcagaagcttctgattttt

SEQ ID NO: 463423 - DNA, 20 bp, Artificial
  CRISPR gRNA sequence
tcagaagcttctgatttttc

SEQ ID NO: 463424 - DNA, 20 bp, Artificial
  CRISPR gRNA sequence
ttttatttttttattttttt

SEQ ID NO: 463425 - DNA, 20 bp, Artificial
  CRISPR gRNA sequence
tttttttatttttttgagac

SEQ ID NO: 463426 - DNA, 20 bp, Artificial
  CRISPR gRNA sequence
tttttatttttttgagacaa

SEQ ID NO: 463427 - DNA, 20 bp, Artificial
  CRISPR gRNA sequence
agagttttgctctcgtcacc

SEQ ID NO: 463428 - DNA, 20 bp, Artificial
  CRISPR gRNA sequence
gagttttgctctcgtcaccc

SEQ ID NO: 463429 - DNA, 20 bp, Artificial
  CRISPR gRNA sequence
tttgctctcgtcacccaggc

SEQ ID NO: 463430 - DNA, 20 bp, Artificial
  CRISPR gRNA sequence
tgctctcgtcacccaggctg

SEQ ID NO: 463431 - DNA, 20 bp, Artificial
  CRISPR gRNA sequence
tcacccaggctggagtgcaa

SEQ ID NO: 463432 - DNA, 20 bp, Artificial
  CRISPR gRNA sequence
tcactgcatcctctgcctcc

SEQ ID NO: 463433 - DNA, 20 bp, Artificial
  CRISPR gRNA sequence
cactgcatcctctgcctccc

SEQ ID NO: 463434 - DNA, 20 bp, Artificial
  CRISPR gRNA sequence
caatcgattcttcttcctcc

SEQ ID NO: 463435 - DNA, 20 bp, Artificial
  CRISPR gRNA sequence
aatcgattcttcttcctccc

SEQ ID NO: 463436 - DNA, 20 bp, Artificial
  CRISPR gRNA sequence
ttcaatttattctcctgcct

SEQ ID NO: 463437 - DNA, 20 bp, Artificial
  CRISPR gRNA sequence
ttctcctgcctcagcgtccc

SEQ ID NO: 463438 - DNA, 20 bp, Artificial
  CRISPR gRNA sequence
tcctgcctcagcgtccctag

SEQ ID NO: 463439 - DNA, 20 bp, Artificial
  CRISPR gRNA sequence
gcctcagcgtccctagtagc

SEQ ID NO: 463440 - DNA, 20 bp, Artificial
  CRISPR gRNA sequence
cctcagcgtccctagtagct

SEQ ID NO: 463441 - DNA, 20 bp, Artificial
  CRISPR gRNA sequence
gtccctagtagctgggatta

SEQ ID NO: 463442 - DNA, 20 bp, Artificial
  CRISPR gRNA sequence
tccctagtagctgggattac

SEQ ID NO: 463443 - DNA, 20 bp, Artificial
  CRISPR gRNA sequence
caggcaccttccaccacgca

SEQ ID NO: 463444 - DNA, 20 bp, Artificial
  CRISPR gRNA sequence
acagctaatttttgtatttt

SEQ ID NO: 463445 - DNA, 20 bp, Artificial
  CRISPR gRNA sequence
gctaatttttgtatttttag

SEQ ID NO: 463446 - DNA, 20 bp, Artificial
  CRISPR gRNA sequence
taatttttgtatttttagta

SEQ ID NO: 463447 - DNA, 20 bp, Artificial
  CRISPR gRNA sequence
tgtatttttagtagagatgt

SEQ ID NO: 463448 - DNA, 20 bp, Artificial
  CRISPR gRNA sequence
aacatctgtcctacccaact

SEQ ID NO: 463449 - DNA, 20 bp, Artificial
  CRISPR gRNA sequence
ctgcaacactctactgcact

SEQ ID NO: 463450 - DNA, 20 bp, Artificial
  CRISPR gRNA sequence
acactctactgcactcagtt

SEQ ID NO: 463451 - DNA, 20 bp, Artificial
  CRISPR gRNA sequence
cactctactgcactcagttt

SEQ ID NO: 463452 - DNA, 20 bp, Artificial
  CRISPR gRNA sequence
tctactgcactcagtttggg

SEQ ID NO: 463453 - DNA, 20 bp, Artificial
  CRISPR gRNA sequence
gcactcagtttgggaagaac

SEQ ID NO: 463454 - DNA, 20 bp, Artificial
  CRISPR gRNA sequence
acgagctatctattcatcat

SEQ ID NO: 463455 - DNA, 20 bp, Artificial
  CRISPR gRNA sequence
ctatctattcatcatcagtg

SEQ ID NO: 463456 - DNA, 20 bp, Artificial
  CRISPR gRNA sequence
tctattcatcatcagtgtgg

SEQ ID NO: 463457 - DNA, 20 bp, Artificial
  CRISPR gRNA sequence
catcatcagtgtggcagcct

SEQ ID NO: 463458 - DNA, 20 bp, Artificial
  CRISPR gRNA sequence
ggcagcctgagcattttcgc

SEQ ID NO: 463459 - DNA, 20 bp, Artificial
  CRISPR gRNA sequence
agcctgagcattttcgcaag

SEQ ID NO: 463460 - DNA, 20 bp, Artificial
  CRISPR gRNA sequence
ctgagcattttcgcaagaag

SEQ ID NO: 463461 - DNA, 20 bp, Artificial
  CRISPR gRNA sequence
attttcgcaagaagtagtga

SEQ ID NO: 463462 - DNA, 20 bp, Artificial
  CRISPR gRNA sequence
aactatttataacatctact

SEQ ID NO: 463463 - DNA, 20 bp, Artificial
  CRISPR gRNA sequence
ttgccatcaacctgtttttt

SEQ ID NO: 463464 - DNA, 20 bp, Artificial
  CRISPR gRNA sequence
catcaacctgttttttaaga

SEQ ID NO: 463465 - DNA, 20 bp, Artificial
  CRISPR gRNA sequence
aacctgttttttaagaaagt

SEQ ID NO: 463466 - DNA, 20 bp, Artificial
  CRISPR gRNA sequence
gttttttaagaaagtcagcc

SEQ ID NO: 463467 - DNA, 20 bp, Artificial
  CRISPR gRNA sequence
taagaaagtcagccaagcta

SEQ ID NO: 463468 - DNA, 20 bp, Artificial
  CRISPR gRNA sequence
gctatggatgcaatgcatgt

SEQ ID NO: 463469 - DNA, 20 bp, Artificial
  CRISPR gRNA sequence
ctatggatgcaatgcatgtt

SEQ ID NO: 463470 - DNA, 20 bp, Artificial
  CRISPR gRNA sequence
tggatgcaatgcatgttggg

SEQ ID NO: 463471 - DNA, 20 bp, Artificial
  CRISPR gRNA sequence
ggatgcaatgcatgttgggc

SEQ ID NO: 463472 - DNA, 20 bp, Artificial
  CRISPR gRNA sequence
gcaatgcatgttgggcaggc

SEQ ID NO: 463473 - DNA, 20 bp, Artificial
  CRISPR gRNA sequence
gcatgttgggcaggctggtc

SEQ ID NO: 463474 - DNA, 20 bp, Artificial
  CRISPR gRNA sequence
atgttgggcaggctggtctg

SEQ ID NO: 463475 - DNA, 20 bp, Artificial
  CRISPR gRNA sequence
ggtctggagctcctgacctc

SEQ ID NO: 463476 - DNA, 20 bp, Artificial
  CRISPR gRNA sequence
ctcaagtgatccacctgcct

SEQ ID NO: 463477 - DNA, 20 bp, Artificial
  CRISPR gRNA sequence
ccacctgcctcagcctccca

SEQ ID NO: 463478 - DNA, 20 bp, Artificial
  CRISPR gRNA sequence
gcctcagcctcccaaagtgc

SEQ ID NO: 463479 - DNA, 20 bp, Artificial
  CRISPR gRNA sequence
cctcagcctcccaaagtgct

SEQ ID NO: 463480 - DNA, 20 bp, Artificial
  CRISPR gRNA sequence
ctcccaaagtgctaggatta

SEQ ID NO: 463481 - DNA, 20 bp, Artificial
  CRISPR gRNA sequence
tcccaaagtgctaggattac

SEQ ID NO: 463482 - DNA, 20 bp, Artificial
  CRISPR gRNA sequence
agtgctaggattacaggtat

SEQ ID NO: 463483 - DNA, 20 bp, Artificial
  CRISPR gRNA sequence
caggtatgagccaccatgcc

SEQ ID NO: 463484 - DNA, 20 bp, Artificial
  CRISPR gRNA sequence
caccatgcccagtgattttt

SEQ ID NO: 463485 - DNA, 20 bp, Artificial
  CRISPR gRNA sequence
accatgcccagtgatttttc

SEQ ID NO: 463486 - DNA, 20 bp, Artificial
  CRISPR gRNA sequence
tctgtcttattattccctac

SEQ ID NO: 463487 - DNA, 20 bp, Artificial
  CRISPR gRNA sequence
ccctacaagcacacatttat

SEQ ID NO: 463488 - DNA, 20 bp, Artificial
  CRISPR gRNA sequence
caagcacacatttatcagtt

SEQ ID NO: 463489 - DNA, 20 bp, Artificial
  CRISPR gRNA sequence
tggctactgcaattttaaat

SEQ ID NO: 463490 - DNA, 20 bp, Artificial
  CRISPR gRNA sequence
caattttaaattagaaaatc

SEQ ID NO: 463491 - DNA, 20 bp, Artificial
  CRISPR gRNA sequence
aattagaaaatctggccact

SEQ ID NO: 463492 - DNA, 20 bp, Artificial
  CRISPR gRNA sequence
attagaaaatctggccactg

SEQ ID NO: 463493 - DNA, 20 bp, Artificial
  CRISPR gRNA sequence
atctggccactgaggttcta

SEQ ID NO: 463494 - DNA, 20 bp, Artificial
  CRISPR gRNA sequence
ggccactgaggttctatgga

SEQ ID NO: 463495 - DNA, 20 bp, Artificial
  CRISPR gRNA sequence
atctataattttaaactgtg

SEQ ID NO: 463496 - DNA, 20 bp, Artificial
  CRISPR gRNA sequence
taattttaaactgtgtagtt

SEQ ID NO: 463497 - DNA, 20 bp, Artificial
  CRISPR gRNA sequence
ggaatatgtctctatgatgc

SEQ ID NO: 463498 - DNA, 20 bp, Artificial
  CRISPR gRNA sequence
gaatatgtctctatgatgcc

SEQ ID NO: 463499 - DNA, 20 bp, Artificial
  CRISPR gRNA sequence
tgccaggatgccacacaacc

SEQ ID NO: 463500 - DNA, 20 bp, Artificial
  CRISPR gRNA sequence
atgccacacaaccaagtgca

SEQ ID NO: 463501 - DNA, 20 bp, Artificial
  CRISPR gRNA sequence
caaccaagtgcaaagtaaaa

SEQ ID NO: 463502 - DNA, 20 bp, Artificial
  CRISPR gRNA sequence
gtgcaaagtaaaaaagtcct

SEQ ID NO: 463503 - DNA, 20 bp, Artificial
  CRISPR gRNA sequence
tcaaacatctttatgtttgt

SEQ ID NO: 463504 - DNA, 20 bp, Artificial
  CRISPR gRNA sequence
tctttatgtttgtaagtatc

SEQ ID NO: 463505 - DNA, 20 bp, Artificial
  CRISPR gRNA sequence
gtttgtaagtatctagtatt

SEQ ID NO: 463506 - DNA, 20 bp, Artificial
  CRISPR gRNA sequence
gtatctagtattaagtcaac

SEQ ID NO: 463507 - DNA, 20 bp, Artificial
  CRISPR gRNA sequence
tatctagtattaagtcaact

SEQ ID NO: 463508 - DNA, 20 bp, Artificial
  CRISPR gRNA sequence
tattaagtcaactaggtgct

SEQ ID NO: 463509 - DNA, 20 bp, Artificial
  CRISPR gRNA sequence
aagtcaactaggtgcttaga

SEQ ID NO: 463510 - DNA, 20 bp, Artificial
  CRISPR gRNA sequence
ctgaattttccaccttccat

SEQ ID NO: 463511 - DNA, 20 bp, Artificial
  CRISPR gRNA sequence
caccttccatcagatgccta

SEQ ID NO: 463512 - DNA, 20 bp, Artificial
  CRISPR gRNA sequence
atcagatgcctacagtcaca

SEQ ID NO: 463513 - DNA, 20 bp, Artificial
  CRISPR gRNA sequence
tacagtcacatagctacaac

SEQ ID NO: 463514 - DNA, 20 bp, Artificial
  CRISPR gRNA sequence
cagtcacatagctacaactg

SEQ ID NO: 463515 - DNA, 20 bp, Artificial
  CRISPR gRNA sequence
tggagtcaaatattattaaa

SEQ ID NO: 463516 - DNA, 20 bp, Artificial
  CRISPR gRNA sequence
atagatttcttccccatttg

SEQ ID NO: 463517 - DNA, 20 bp, Artificial
  CRISPR gRNA sequence
tagatttcttccccatttga

SEQ ID NO: 463518 - DNA, 20 bp, Artificial
  CRISPR gRNA sequence
aaactactctctatgaaatt

SEQ ID NO: 463519 - DNA, 20 bp, Artificial
  CRISPR gRNA sequence
tctatgaaattaagaacaat

SEQ ID NO: 463520 - DNA, 20 bp, Artificial
  CRISPR gRNA sequence
aaattaagaacaatgagttt

SEQ ID NO: 463521 - DNA, 20 bp, Artificial
  CRISPR gRNA sequence
tcagtgctaaaccacattga

SEQ ID NO: 463522 - DNA, 20 bp, Artificial
  CRISPR gRNA sequence
gtgctaaaccacattgatgg

SEQ ID NO: 463523 - DNA, 20 bp, Artificial
  CRISPR gRNA sequence
tgctaaaccacattgatggt

SEQ ID NO: 463524 - DNA, 20 bp, Artificial
  CRISPR gRNA sequence
gctaaaccacattgatggtg

SEQ ID NO: 463525 - DNA, 20 bp, Artificial
  CRISPR gRNA sequence
aaccacattgatggtggggt

SEQ ID NO: 463526 - DNA, 20 bp, Artificial
  CRISPR gRNA sequence
atttctcccaatgtgcaacc

SEQ ID NO: 463527 - DNA, 20 bp, Artificial
  CRISPR gRNA sequence
gtgcaacctagcatttgcaa

SEQ ID NO: 463528 - DNA, 20 bp, Artificial
  CRISPR gRNA sequence
agcatttgcaaaagtgaact

SEQ ID NO: 463529 - DNA, 20 bp, Artificial
  CRISPR gRNA sequence
gcaaaagtgaacttggctgt

SEQ ID NO: 463530 - DNA, 20 bp, Artificial
  CRISPR gRNA sequence
gtgaacttggctgttagaac

SEQ ID NO: 463531 - DNA, 20 bp, Artificial
  CRISPR gRNA sequence
tgaacttggctgttagaact

SEQ ID NO: 463532 - DNA, 20 bp, Artificial
  CRISPR gRNA sequence
ttagaactgggttaatttac

SEQ ID NO: 463533 - DNA, 20 bp, Artificial
  CRISPR gRNA sequence
tggctctgccacttactgta

SEQ ID NO: 463534 - DNA, 20 bp, Artificial
  CRISPR gRNA sequence
cttactgtatggcattgatt

SEQ ID NO: 463535 - DNA, 20 bp, Artificial
  CRISPR gRNA sequence
taagtctcttctcttctctt

SEQ ID NO: 463536 - DNA, 20 bp, Artificial
  CRISPR gRNA sequence
gtttcctcatttgtacaata

SEQ ID NO: 463537 - DNA, 20 bp, Artificial
  CRISPR gRNA sequence
tttcctcatttgtacaatac

SEQ ID NO: 463538 - DNA, 20 bp, Artificial
  CRISPR gRNA sequence
taataattgtacctaaatta

SEQ ID NO: 463539 - DNA, 20 bp, Artificial
  CRISPR gRNA sequence
aataattgtacctaaattat

SEQ ID NO: 463540 - DNA, 20 bp, Artificial
  CRISPR gRNA sequence
ataattgtacctaaattatg

SEQ ID NO: 463541 - DNA, 20 bp, Artificial
  CRISPR gRNA sequence
taaattatggggctgctgtg

SEQ ID NO: 463542 - DNA, 20 bp, Artificial
  CRISPR gRNA sequence
tggggctgctgtgaagactg

SEQ ID NO: 463543 - DNA, 20 bp, Artificial
  CRISPR gRNA sequence
agactgtagatgcaataata

SEQ ID NO: 463544 - DNA, 20 bp, Artificial
  CRISPR gRNA sequence
gactgtagatgcaataatat

SEQ ID NO: 463545 - DNA, 20 bp, Artificial
  CRISPR gRNA sequence
tagatgcaataatatgggta

SEQ ID NO: 463546 - DNA, 20 bp, Artificial
  CRISPR gRNA sequence
tatgggtaaagtgcctcgca

SEQ ID NO: 463547 - DNA, 20 bp, Artificial
  CRISPR gRNA sequence
ggtaaagtgcctcgcatagt

SEQ ID NO: 463548 - DNA, 20 bp, Artificial
  CRISPR gRNA sequence
atagtaagtgcacgtattta

SEQ ID NO: 463549 - DNA, 20 bp, Artificial
  CRISPR gRNA sequence
aagtgcacgtatttaaagct

SEQ ID NO: 463550 - DNA, 20 bp, Artificial
  CRISPR gRNA sequence
atttaaagctcagtaaatgt

SEQ ID NO: 463551 - DNA, 20 bp, Artificial
  CRISPR gRNA sequence
taaagctcagtaaatgttag

SEQ ID NO: 463552 - DNA, 20 bp, Artificial
  CRISPR gRNA sequence
caacctctatgtaattaaat

SEQ ID NO: 463553 - DNA, 20 bp, Artificial
  CRISPR gRNA sequence
tttaacattattatttaaaa

SEQ ID NO: 463554 - DNA, 20 bp, Artificial
  CRISPR gRNA sequence
cattattatttaaaatagtt

SEQ ID NO: 463555 - DNA, 20 bp, Artificial
  CRISPR gRNA sequence
ttaaaatagttgagttttta

SEQ ID NO: 463556 - DNA, 20 bp, Artificial
  CRISPR gRNA sequence
aagttaaaaataaaataaat

SEQ ID NO: 463557 - DNA, 20 bp, Artificial
  CRISPR gRNA sequence
aatatattttgcaatatatt

SEQ ID NO: 463558 - DNA, 20 bp, Artificial
  CRISPR gRNA sequence
aatatatttagcccaaaata

SEQ ID NO: 463559 - DNA, 20 bp, Artificial
  CRISPR gRNA sequence
atatagtgaatcaaattatt

SEQ ID NO: 463560 - DNA, 20 bp, Artificial
  CRISPR gRNA sequence
attattcagaaaatgaaata

SEQ ID NO: 463561 - DNA, 20 bp, Artificial
  CRISPR gRNA sequence
ttcagaaaatgaaatatggc

SEQ ID NO: 463562 - DNA, 20 bp, Artificial
  CRISPR gRNA sequence
tcagaaaatgaaatatggct

SEQ ID NO: 463563 - DNA, 20 bp, Artificial
  CRISPR gRNA sequence
agaaaatgaaatatggctgg

SEQ ID NO: 463564 - DNA, 20 bp, Artificial
  CRISPR gRNA sequence
tgaaatatggctgggagcca

SEQ ID NO: 463565 - DNA, 20 bp, Artificial
  CRISPR gRNA sequence
atggctgggagccatggccc

SEQ ID NO: 463566 - DNA, 20 bp, Artificial
  CRISPR gRNA sequence
ggagccatggccctagcctt

SEQ ID NO: 463567 - DNA, 20 bp, Artificial
  CRISPR gRNA sequence
atggccctagcctttagtct

SEQ ID NO: 463568 - DNA, 20 bp, Artificial
  CRISPR gRNA sequence
agcctttagtctcagcactt

SEQ ID NO: 463569 - DNA, 20 bp, Artificial
  CRISPR gRNA sequence
gcctttagtctcagcacttt

SEQ ID NO: 463570 - DNA, 20 bp, Artificial
  CRISPR gRNA sequence
tttagtctcagcactttggg

SEQ ID NO: 463571 - DNA, 20 bp, Artificial
  CRISPR gRNA sequence
tctcagcactttgggaagcc

SEQ ID NO: 463572 - DNA, 20 bp, Artificial
  CRISPR gRNA sequence
agcactttgggaagccaaga

SEQ ID NO: 463573 - DNA, 20 bp, Artificial
  CRISPR gRNA sequence
gcactttgggaagccaagac

SEQ ID NO: 463574 - DNA, 20 bp, Artificial
  CRISPR gRNA sequence
ctttgggaagccaagacggg

SEQ ID NO: 463575 - DNA, 20 bp, Artificial
  CRISPR gRNA sequence
ccaagacgggcagatcacct

SEQ ID NO: 463576 - DNA, 20 bp, Artificial
  CRISPR gRNA sequence
caagacgggcagatcacctg

SEQ ID NO: 463577 - DNA, 20 bp, Artificial
  CRISPR gRNA sequence
acgggcagatcacctgaggt

SEQ ID NO: 463578 - DNA, 20 bp, Artificial
  CRISPR gRNA sequence
cgggcagatcacctgaggtc

SEQ ID NO: 463579 - DNA, 20 bp, Artificial
  CRISPR gRNA sequence
ggcagatcacctgaggtcag

SEQ ID NO: 463580 - DNA, 20 bp, Artificial
  CRISPR gRNA sequence
tcacctgaggtcaggagttt

SEQ ID NO: 463581 - DNA, 20 bp, Artificial
  CRISPR gRNA sequence
tgaggtcaggagtttaagac

SEQ ID NO: 463582 - DNA, 20 bp, Artificial
  CRISPR gRNA sequence
tcaggagtttaagaccagac

SEQ ID NO: 463583 - DNA, 20 bp, Artificial
  CRISPR gRNA sequence
taagaccagactggtcaaca

SEQ ID NO: 463584 - DNA, 20 bp, Artificial
  CRISPR gRNA sequence
ctaaaaatataaaaatttgc

SEQ ID NO: 463585 - DNA, 20 bp, Artificial
  CRISPR gRNA sequence
taaaaatataaaaatttgct

SEQ ID NO: 463586 - DNA, 20 bp, Artificial
  CRISPR gRNA sequence
taaaaatttgctgggtgtgt

SEQ ID NO: 463587 - DNA, 20 bp, Artificial
  CRISPR gRNA sequence
aaaaatttgctgggtgtgtt

SEQ ID NO: 463588 - DNA, 20 bp, Artificial
  CRISPR gRNA sequence
aaatttgctgggtgtgttgg

SEQ ID NO: 463589 - DNA, 20 bp, Artificial
  CRISPR gRNA sequence
aatttgctgggtgtgttggg

SEQ ID NO: 463590 - DNA, 20 bp, Artificial
  CRISPR gRNA sequence
ggtgtgttgggaggtgcctg

SEQ ID NO: 463591 - DNA, 20 bp, Artificial
  CRISPR gRNA sequence
ttgggaggtgcctgtagtcc

SEQ ID NO: 463592 - DNA, 20 bp, Artificial
  CRISPR gRNA sequence
tgcctgtagtcccagctact

SEQ ID NO: 463593 - DNA, 20 bp, Artificial
  CRISPR gRNA sequence
gcctgtagtcccagctactc

SEQ ID NO: 463594 - DNA, 20 bp, Artificial
  CRISPR gRNA sequence
ctgtagtcccagctactcgg

SEQ ID NO: 463595 - DNA, 20 bp, Artificial
  CRISPR gRNA sequence
tgtagtcccagctactcggg

SEQ ID NO: 463596 - DNA, 20 bp, Artificial
  CRISPR gRNA sequence
tcccagctactcgggaggcc

SEQ ID NO: 463597 - DNA, 20 bp, Artificial
  CRISPR gRNA sequence
agctactcgggaggccgaga

SEQ ID NO: 463598 - DNA, 20 bp, Artificial
  CRISPR gRNA sequence
gctactcgggaggccgagac

SEQ ID NO: 463599 - DNA, 20 bp, Artificial
  CRISPR gRNA sequence
tactcgggaggccgagacag

SEQ ID NO: 463600 - DNA, 20 bp, Artificial
  CRISPR gRNA sequence
gggaggccgagacaggagaa

SEQ ID NO: 463601 - DNA, 20 bp, Artificial
  CRISPR gRNA sequence
acaggagaatagcttgaacc

SEQ ID NO: 463602 - DNA, 20 bp, Artificial
  CRISPR gRNA sequence
caggagaatagcttgaaccc

SEQ ID NO: 463603 - DNA, 20 bp, Artificial
  CRISPR gRNA sequence
ggagaatagcttgaacccag

SEQ ID NO: 463604 - DNA, 20 bp, Artificial
  CRISPR gRNA sequence
gagaatagcttgaacccagg

SEQ ID NO: 463605 - DNA, 20 bp, Artificial
  CRISPR gRNA sequence
aatagcttgaacccaggagg

SEQ ID NO: 463606 - DNA, 20 bp, Artificial
  CRISPR gRNA sequence
tagcttgaacccaggaggca

SEQ ID NO: 463607 - DNA, 20 bp, Artificial
  CRISPR gRNA sequence
agcttgaacccaggaggcag

SEQ ID NO: 463608 - DNA, 20 bp, Artificial
  CRISPR gRNA sequence
aacccaggaggcagaggttg

SEQ ID NO: 463609 - DNA, 20 bp, Artificial
  CRISPR gRNA sequence
caggaggcagaggttgcagt

SEQ ID NO: 463610 - DNA, 20 bp, Artificial
  CRISPR gRNA sequence
ggcagaggttgcagtgagct

SEQ ID NO: 463611 - DNA, 20 bp, Artificial
  CRISPR gRNA sequence
accactgcactcaaaaaaaa

SEQ ID NO: 463612 - DNA, 20 bp, Artificial
  CRISPR gRNA sequence
ccactgcactcaaaaaaaaa

SEQ ID NO: 463613 - DNA, 20 bp, Artificial
  CRISPR gRNA sequence
cactgcactcaaaaaaaaaa

SEQ ID NO: 463614 - DNA, 20 bp, Artificial
  CRISPR gRNA sequence
gcactcaaaaaaaaaaggga

SEQ ID NO: 463615 - DNA, 20 bp, Artificial
  CRISPR gRNA sequence
aaaaaaaaagggaaagactt

SEQ ID NO: 463616 - DNA, 20 bp, Artificial
  CRISPR gRNA sequence
aaaagggaaagacttgagtg

SEQ ID NO: 463617 - DNA, 20 bp, Artificial
  CRISPR gRNA sequence
gaaagacttgagtgaagtac

SEQ ID NO: 463618 - DNA, 20 bp, Artificial
  CRISPR gRNA sequence
gacttgagtgaagtactggt

SEQ ID NO: 463619 - DNA, 20 bp, Artificial
  CRISPR gRNA sequence
agtactggtcagatatatac

SEQ ID NO: 463620 - DNA, 20 bp, Artificial
  CRISPR gRNA sequence
atatataccagttgatataa

SEQ ID NO: 463621 - DNA, 20 bp, Artificial
  CRISPR gRNA sequence
ccagttgatataatggattg

SEQ ID NO: 463622 - DNA, 20 bp, Artificial
  CRISPR gRNA sequence
gttgatataatggattgcag

SEQ ID NO: 463623 - DNA, 20 bp, Artificial
  CRISPR gRNA sequence
gatataatggattgcagcag

SEQ ID NO: 463624 - DNA, 20 bp, Artificial
  CRISPR gRNA sequence
gcagcagttgcattaaatta

SEQ ID NO: 463625 - DNA, 20 bp, Artificial
  CRISPR gRNA sequence
gttgcattaaattaaagcta

SEQ ID NO: 463626 - DNA, 20 bp, Artificial
  CRISPR gRNA sequence
ttgcattaaattaaagctat

SEQ ID NO: 463627 - DNA, 20 bp, Artificial
  CRISPR gRNA sequence
ttaaattaaagctataggtt

SEQ ID NO: 463628 - DNA, 20 bp, Artificial
  CRISPR gRNA sequence
aaattaaagctataggttaa

SEQ ID NO: 463629 - DNA, 20 bp, Artificial
  CRISPR gRNA sequence
ttaaagctataggttaagag

SEQ ID NO: 463630 - DNA, 20 bp, Artificial
  CRISPR gRNA sequence
taaagctataggttaagaga

SEQ ID NO: 463631 - DNA, 20 bp, Artificial
  CRISPR gRNA sequence
aggttaagagaaggaacatt

SEQ ID NO: 463632 - DNA, 20 bp, Artificial
  CRISPR gRNA sequence
tttggtgaaatttgttctcc

SEQ ID NO: 463633 - DNA, 20 bp, Artificial
  CRISPR gRNA sequence
ttggtgaaatttgttctccc

SEQ ID NO: 463634 - DNA, 20 bp, Artificial
  CRISPR gRNA sequence
gtgaaatttgttctcccagg

SEQ ID NO: 463635 - DNA, 20 bp, Artificial
  CRISPR gRNA sequence
gaaatttgttctcccaggca

SEQ ID NO: 463636 - DNA, 20 bp, Artificial
  CRISPR gRNA sequence
gttctcccaggcagagctga

SEQ ID NO: 463637 - DNA, 20 bp, Artificial
  CRISPR gRNA sequence
acattaaataccttatatct

SEQ ID NO: 463638 - DNA, 20 bp, Artificial
  CRISPR gRNA sequence
cattaaataccttatatctt

SEQ ID NO: 463639 - DNA, 20 bp, Artificial
  CRISPR gRNA sequence
attaaataccttatatcttg

SEQ ID NO: 463640 - DNA, 20 bp, Artificial
  CRISPR gRNA sequence
ctgtgatttacttaattgct

SEQ ID NO: 463641 - DNA, 20 bp, Artificial
  CRISPR gRNA sequence
cttaattgctgagttcttta

SEQ ID NO: 463642 - DNA, 20 bp, Artificial
  CRISPR gRNA sequence
tctttacagtaatacatttt

SEQ ID NO: 463643 - DNA, 20 bp, Artificial
  CRISPR gRNA sequence
taatacattttcagtgttta

SEQ ID NO: 463644 - DNA, 20 bp, Artificial
  CRISPR gRNA sequence
acattttcagtgtttaaaga

SEQ ID NO: 463645 - DNA, 20 bp, Artificial
  CRISPR gRNA sequence
gtgtttaaagatagcctttg

SEQ ID NO: 463646 - DNA, 20 bp, Artificial
  CRISPR gRNA sequence
gattttttccccctacttca

SEQ ID NO: 463647 - DNA, 20 bp, Artificial
  CRISPR gRNA sequence
cccctacttcaaagcaatgt

SEQ ID NO: 463648 - DNA, 20 bp, Artificial
  CRISPR gRNA sequence
gagatccgtgtccttgttcc

SEQ ID NO: 463649 - DNA, 20 bp, Artificial
  CRISPR gRNA sequence
agatccgtgtccttgttcct

SEQ ID NO: 463650 - DNA, 20 bp, Artificial
  CRISPR gRNA sequence
atccgtgtccttgttcctag

SEQ ID NO: 463651 - DNA, 20 bp, Artificial
  CRISPR gRNA sequence
gtgtccttgttcctaggagt

SEQ ID NO: 463652 - DNA, 20 bp, Artificial
  CRISPR gRNA sequence
tgtccttgttcctaggagtg

SEQ ID NO: 463653 - DNA, 20 bp, Artificial
  CRISPR gRNA sequence
agtgaggctgcatatataat

SEQ ID NO: 463654 - DNA, 20 bp, Artificial
  CRISPR gRNA sequence
gtgaggctgcatatataata

SEQ ID NO: 463655 - DNA, 20 bp, Artificial
  CRISPR gRNA sequence
ggctgcatatataataaggc

SEQ ID NO: 463656 - DNA, 20 bp, Artificial
  CRISPR gRNA sequence
tctctacaaacttcctgttt

SEQ ID NO: 463657 - DNA, 20 bp, Artificial
  CRISPR gRNA sequence
ctctacaaacttcctgttta

SEQ ID NO: 463658 - DNA, 20 bp, Artificial
  CRISPR gRNA sequence
aaggtccttctttattacaa

SEQ ID NO: 463659 - DNA, 20 bp, Artificial
  CRISPR gRNA sequence
tttgtgtttctctaaaaaat

SEQ ID NO: 463660 - DNA, 20 bp, Artificial
  CRISPR gRNA sequence
tgtgtttctctaaaaaatta

SEQ ID NO: 463661 - DNA, 20 bp, Artificial
  CRISPR gRNA sequence
aattagagaaacttgcccct

SEQ ID NO: 463662 - DNA, 20 bp, Artificial
  CRISPR gRNA sequence
gaaacttgcccctcagtgtg

SEQ ID NO: 463663 - DNA, 20 bp, Artificial
  CRISPR gRNA sequence
gcccctcagtgtgtggcata

SEQ ID NO: 463664 - DNA, 20 bp, Artificial
  CRISPR gRNA sequence
gcatacagtttctgtcctga

SEQ ID NO: 463665 - DNA, 20 bp, Artificial
  CRISPR gRNA sequence
tacagtttctgtcctgatag

SEQ ID NO: 463666 - DNA, 20 bp, Artificial
  CRISPR gRNA sequence
atgtcaatatcttcccttca

SEQ ID NO: 463667 - DNA, 20 bp, Artificial
  CRISPR gRNA sequence
tgtcaatatcttcccttcat

SEQ ID NO: 463668 - DNA, 20 bp, Artificial
  CRISPR gRNA sequence
caatatcttcccttcatggg

SEQ ID NO: 463669 - DNA, 20 bp, Artificial
  CRISPR gRNA sequence
ccttcatgggcagatcatgc

SEQ ID NO: 463670 - DNA, 20 bp, Artificial
  CRISPR gRNA sequence
catgggcagatcatgctggc

SEQ ID NO: 463671 - DNA, 20 bp, Artificial
  CRISPR gRNA sequence
cagatcatgctggcaagatc

SEQ ID NO: 463672 - DNA, 20 bp, Artificial
  CRISPR gRNA sequence
gctggcaagatctagactgc

SEQ ID NO: 463673 - DNA, 20 bp, Artificial
  CRISPR gRNA sequence
ggcaagatctagactgcaag

SEQ ID NO: 463674 - DNA, 20 bp, Artificial
  CRISPR gRNA sequence
aagatctagactgcaagtgg

SEQ ID NO: 463675 - DNA, 20 bp, Artificial
  CRISPR gRNA sequence
cattgcctgccctgtcatcc

SEQ ID NO: 463676 - DNA, 20 bp, Artificial
  CRISPR gRNA sequence
tcatcctggaccatttgtct

SEQ ID NO: 463677 - DNA, 20 bp, Artificial
  CRISPR gRNA sequence
catcctggaccatttgtctg

SEQ ID NO: 463678 - DNA, 20 bp, Artificial
  CRISPR gRNA sequence
ccatttgtctgaggctgccc

SEQ ID NO: 463679 - DNA, 20 bp, Artificial
  CRISPR gRNA sequence
tctgaggctgccctagaccc

SEQ ID NO: 463680 - DNA, 20 bp, Artificial
  CRISPR gRNA sequence
ggctgccctagaccctagtt

SEQ ID NO: 463681 - DNA, 20 bp, Artificial
  CRISPR gRNA sequence
ccctagaccctagttcagtt

SEQ ID NO: 463682 - DNA, 20 bp, Artificial
  CRISPR gRNA sequence
cctagaccctagttcagttg

SEQ ID NO: 463683 - DNA, 20 bp, Artificial
  CRISPR gRNA sequence
agttcagttgaggatcaacc

SEQ ID NO: 463684 - DNA, 20 bp, Artificial
  CRISPR gRNA sequence
gttcagttgaggatcaacca

SEQ ID NO: 463685 - DNA, 20 bp, Artificial
  CRISPR gRNA sequence
tcaaccaaggattccacttt

SEQ ID NO: 463686 - DNA, 20 bp, Artificial
  CRISPR gRNA sequence
caaccaaggattccactttt

SEQ ID NO: 463687 - DNA, 20 bp, Artificial
  CRISPR gRNA sequence
ccaaggattccacttttagg

SEQ ID NO: 463688 - DNA, 20 bp, Artificial
  CRISPR gRNA sequence
caaggattccacttttaggc

SEQ ID NO: 463689 - DNA, 20 bp, Artificial
  CRISPR gRNA sequence
ggattccacttttaggcagg

SEQ ID NO: 463690 - DNA, 20 bp, Artificial
  CRISPR gRNA sequence
gattccacttttaggcaggc

SEQ ID NO: 463691 - DNA, 20 bp, Artificial
  CRISPR gRNA sequence
ttaggcaggcaggaacactg

SEQ ID NO: 463692 - DNA, 20 bp, Artificial
  CRISPR gRNA sequence
ggaacactgcagttaatgtc

SEQ ID NO: 463693 - DNA, 20 bp, Artificial
  CRISPR gRNA sequence
gaacactgcagttaatgtct

SEQ ID NO: 463694 - DNA, 20 bp, Artificial
  CRISPR gRNA sequence
caccaacaccatatatgatg

SEQ ID NO: 463695 - DNA, 20 bp, Artificial
  CRISPR gRNA sequence
accatatatgatgcagaata

SEQ ID NO: 463696 - DNA, 20 bp, Artificial
  CRISPR gRNA sequence
ccatatatgatgcagaataa

SEQ ID NO: 463697 - DNA, 20 bp, Artificial
  CRISPR gRNA sequence
tatatgatgcagaataaagg

SEQ ID NO: 463698 - DNA, 20 bp, Artificial
  CRISPR gRNA sequence
tgatgcagaataaaggcagt

SEQ ID NO: 463699 - DNA, 20 bp, Artificial
  CRISPR gRNA sequence
ggaactgtttgattgattac

SEQ ID NO: 463700 - DNA, 20 bp, Artificial
  CRISPR gRNA sequence
gttattgtgatttttaaaaa

SEQ ID NO: 463701 - DNA, 20 bp, Artificial
  CRISPR gRNA sequence
atttttaaaaaaagcaatcc

SEQ ID NO: 463702 - DNA, 20 bp, Artificial
  CRISPR gRNA sequence
taaaaaaagcaatcctagtc

SEQ ID NO: 463703 - DNA, 20 bp, Artificial
  CRISPR gRNA sequence
aaagcaatcctagtctggtt

SEQ ID NO: 463704 - DNA, 20 bp, Artificial
  CRISPR gRNA sequence
caatcctagtctggttcagt

SEQ ID NO: 463705 - DNA, 20 bp, Artificial
  CRISPR gRNA sequence
aatcctagtctggttcagta

SEQ ID NO: 463706 - DNA, 20 bp, Artificial
  CRISPR gRNA sequence
atcctagtctggttcagtaa

SEQ ID NO: 463707 - DNA, 20 bp, Artificial
  CRISPR gRNA sequence
tagtctggttcagtaaggga

SEQ ID NO: 463708 - DNA, 20 bp, Artificial
  CRISPR gRNA sequence
agggaaagacacctgtattc

SEQ ID NO: 463709 - DNA, 20 bp, Artificial
  CRISPR gRNA sequence
acctgtattctggctctttt

SEQ ID NO: 463710 - DNA, 20 bp, Artificial
  CRISPR gRNA sequence
ttctggctcttttgagaata

SEQ ID NO: 463711 - DNA, 20 bp, Artificial
  CRISPR gRNA sequence
tggctcttttgagaatacag

SEQ ID NO: 463712 - DNA, 20 bp, Artificial
  CRISPR gRNA sequence
tcttttgagaatacagtggt

SEQ ID NO: 463713 - DNA, 20 bp, Artificial
  CRISPR gRNA sequence
cttttgagaatacagtggtt

SEQ ID NO: 463714 - DNA, 20 bp, Artificial
  CRISPR gRNA sequence
ttttgagaatacagtggtta

SEQ ID NO: 463715 - DNA, 20 bp, Artificial
  CRISPR gRNA sequence
ttagggctatgtctccattt

SEQ ID NO: 463716 - DNA, 20 bp, Artificial
  CRISPR gRNA sequence
gctatgtctccattttggtc

SEQ ID NO: 463717 - DNA, 20 bp, Artificial
  CRISPR gRNA sequence
tttttttccctttattatga

SEQ ID NO: 463718 - DNA, 20 bp, Artificial
  CRISPR gRNA sequence
ttccctttattatgatggtc

SEQ ID NO: 463719 - DNA, 20 bp, Artificial
  CRISPR gRNA sequence
tttattatgatggtccagta

SEQ ID NO: 463720 - DNA, 20 bp, Artificial
  CRISPR gRNA sequence
tgatggtccagtatggtcca

SEQ ID NO: 463721 - DNA, 20 bp, Artificial
  CRISPR gRNA sequence
gtccagtatggtccatggac

SEQ ID NO: 463722 - DNA, 20 bp, Artificial
  CRISPR gRNA sequence
accgtgttccacatcccaca

SEQ ID NO: 463723 - DNA, 20 bp, Artificial
  CRISPR gRNA sequence
tgttttgctctactacaaac

SEQ ID NO: 463724 - DNA, 20 bp, Artificial
  CRISPR gRNA sequence
ctacaaactggccatatctt

SEQ ID NO: 463725 - DNA, 20 bp, Artificial
  CRISPR gRNA sequence
tacaaactggccatatcttt

SEQ ID NO: 463726 - DNA, 20 bp, Artificial
  CRISPR gRNA sequence
tcaaaaaatatcattccttg

SEQ ID NO: 463727 - DNA, 20 bp, Artificial
  CRISPR gRNA sequence
aaatatcattccttgaagtt

SEQ ID NO: 463728 - DNA, 20 bp, Artificial
  CRISPR gRNA sequence
aatatcattccttgaagttc

SEQ ID NO: 463729 - DNA, 20 bp, Artificial
  CRISPR gRNA sequence
tccttgaagttcaggttttg

SEQ ID NO: 463730 - DNA, 20 bp, Artificial
  CRISPR gRNA sequence
gaagttcaggttttgtagca

SEQ ID NO: 463731 - DNA, 20 bp, Artificial
  CRISPR gRNA sequence
ttgtagcacagtatctttat

SEQ ID NO: 463732 - DNA, 20 bp, Artificial
  CRISPR gRNA sequence
tgtagcacagtatctttata

SEQ ID NO: 463733 - DNA, 20 bp, Artificial
  CRISPR gRNA sequence
ctttataaggcatatttcta

SEQ ID NO: 463734 - DNA, 20 bp, Artificial
  CRISPR gRNA sequence
aaggcatatttctatggctt

SEQ ID NO: 463735 - DNA, 20 bp, Artificial
  CRISPR gRNA sequence
ttcttattgaaatgtgcata

SEQ ID NO: 463736 - DNA, 20 bp, Artificial
  CRISPR gRNA sequence
cttattgaaatgtgcatatg

SEQ ID NO: 463737 - DNA, 20 bp, Artificial
  CRISPR gRNA sequence
ttattgaaatgtgcatatgg

SEQ ID NO: 463738 - DNA, 20 bp, Artificial
  CRISPR gRNA sequence
atgtgcatatggaggaatgc

SEQ ID NO: 463739 - DNA, 20 bp, Artificial
  CRISPR gRNA sequence
gtgcatatggaggaatgcta

SEQ ID NO: 463740 - DNA, 20 bp, Artificial
  CRISPR gRNA sequence
atatggaggaatgctagaga

SEQ ID NO: 463741 - DNA, 20 bp, Artificial
  CRISPR gRNA sequence
atggaggaatgctagagata

SEQ ID NO: 463742 - DNA, 20 bp, Artificial
  CRISPR gRNA sequence
atagagctctgtcttctgcc

SEQ ID NO: 463743 - DNA, 20 bp, Artificial
  CRISPR gRNA sequence
ccatatattaaataaatgtt

SEQ ID NO: 463744 - DNA, 20 bp, Artificial
  CRISPR gRNA sequence
catatattaaataaatgttt

SEQ ID NO: 463745 - DNA, 20 bp, Artificial
  CRISPR gRNA sequence
atgtttaggaatgcattctg

SEQ ID NO: 463746 - DNA, 20 bp, Artificial
  CRISPR gRNA sequence
aggaatgcattctgtggtta

SEQ ID NO: 463747 - DNA, 20 bp, Artificial
  CRISPR gRNA sequence
ggaatgcattctgtggttac

SEQ ID NO: 463748 - DNA, 20 bp, Artificial
  CRISPR gRNA sequence
ttacaggacttcttgaatta

SEQ ID NO: 463749 - DNA, 20 bp, Artificial
  CRISPR gRNA sequence
ttcttgaattaaagcatgaa

SEQ ID NO: 463750 - DNA, 20 bp, Artificial
  CRISPR gRNA sequence
gattaaccttgtgctcattg

SEQ ID NO: 463751 - DNA, 20 bp, Artificial
  CRISPR gRNA sequence
tgaatatacttttcctatca

SEQ ID NO: 463752 - DNA, 20 bp, Artificial
  CRISPR gRNA sequence
aatatacttttcctatcaca

SEQ ID NO: 463753 - DNA, 20 bp, Artificial
  CRISPR gRNA sequence
atacttttcctatcacagag

SEQ ID NO: 463754 - DNA, 20 bp, Artificial
  CRISPR gRNA sequence
cttcctctgtcctactacca

SEQ ID NO: 463755 - DNA, 20 bp, Artificial
  CRISPR gRNA sequence
ccaaagtttcctctattgta

SEQ ID NO: 463756 - DNA, 20 bp, Artificial
  CRISPR gRNA sequence
aactatttatcttgcctcat

SEQ ID NO: 463757 - DNA, 20 bp, Artificial
  CRISPR gRNA sequence
actatttatcttgcctcatt

SEQ ID NO: 463758 - DNA, 20 bp, Artificial
  CRISPR gRNA sequence
acttaatttccattatttgt

SEQ ID NO: 463759 - DNA, 20 bp, Artificial
  CRISPR gRNA sequence
ttgtgagtttcatctttatg

SEQ ID NO: 463760 - DNA, 20 bp, Artificial
  CRISPR gRNA sequence
gtgagtttcatctttatgta

SEQ ID NO: 463761 - DNA, 20 bp, Artificial
  CRISPR gRNA sequence
tttcatctttatgtagagtt

SEQ ID NO: 463762 - DNA, 20 bp, Artificial
  CRISPR gRNA sequence
gtagagttcagaattgttaa

SEQ ID NO: 463763 - DNA, 20 bp, Artificial
  CRISPR gRNA sequence
tgttaaaagaaaaatattta

SEQ ID NO: 463764 - DNA, 20 bp, Artificial
  CRISPR gRNA sequence
gttaaaagaaaaatatttac

SEQ ID NO: 463765 - DNA, 20 bp, Artificial
  CRISPR gRNA sequence
tatttacaggcatttgtaat

SEQ ID NO: 463766 - DNA, 20 bp, Artificial
  CRISPR gRNA sequence
atttacaggcatttgtaatc

SEQ ID NO: 463767 - DNA, 20 bp, Artificial
  CRISPR gRNA sequence
taatcattttcttttttcct

SEQ ID NO: 463768 - DNA, 20 bp, Artificial
  CRISPR gRNA sequence
atcattttcttttttccttg

SEQ ID NO: 463769 - DNA, 20 bp, Artificial
  CRISPR gRNA sequence
attttcttttttccttggag

SEQ ID NO: 463770 - DNA, 20 bp, Artificial
  CRISPR gRNA sequence
ttttccttggagaagctgtg

SEQ ID NO: 463771 - DNA, 20 bp, Artificial
  CRISPR gRNA sequence
cttggagaagctgtgtggta

SEQ ID NO: 463772 - DNA, 20 bp, Artificial
  CRISPR gRNA sequence
ggagaagctgtgtggtatag

SEQ ID NO: 463773 - DNA, 20 bp, Artificial
  CRISPR gRNA sequence
agctgtgtggtatagtggct

SEQ ID NO: 463774 - DNA, 20 bp, Artificial
  CRISPR gRNA sequence
tgtggtatagtggctaagat

SEQ ID NO: 463775 - DNA, 20 bp, Artificial
  CRISPR gRNA sequence
gtggtatagtggctaagatc

SEQ ID NO: 463776 - DNA, 20 bp, Artificial
  CRISPR gRNA sequence
tggtatagtggctaagatca

SEQ ID NO: 463777 - DNA, 20 bp, Artificial
  CRISPR gRNA sequence
ggctaagatcagggactcta

SEQ ID NO: 463778 - DNA, 20 bp, Artificial
  CRISPR gRNA sequence
aagatcagggactctaaagc

SEQ ID NO: 463779 - DNA, 20 bp, Artificial
  CRISPR gRNA sequence
gactctaaagccagactcca

SEQ ID NO: 463780 - DNA, 20 bp, Artificial
  CRISPR gRNA sequence
taaagccagactccatggat

SEQ ID NO: 463781 - DNA, 20 bp, Artificial
  CRISPR gRNA sequence
atcctatgtctgccatttaa

SEQ ID NO: 463782 - DNA, 20 bp, Artificial
  CRISPR gRNA sequence
ttttgtgactataaaatctc

SEQ ID NO: 463783 - DNA, 20 bp, Artificial
  CRISPR gRNA sequence
actataaaatctctggttct

SEQ ID NO: 463784 - DNA, 20 bp, Artificial
  CRISPR gRNA sequence
agttttctcatctaaaaaaa

SEQ ID NO: 463785 - DNA, 20 bp, Artificial
  CRISPR gRNA sequence
gttttctcatctaaaaaaat

SEQ ID NO: 463786 - DNA, 20 bp, Artificial
  CRISPR gRNA sequence
tttctcatctaaaaaaatgg

SEQ ID NO: 463787 - DNA, 20 bp, Artificial
  CRISPR gRNA sequence
aaatgggagaataatcttat

SEQ ID NO: 463788 - DNA, 20 bp, Artificial
  CRISPR gRNA sequence
aatgggagaataatcttata

SEQ ID NO: 463789 - DNA, 20 bp, Artificial
  CRISPR gRNA sequence
ataaggttgttgtgactatt

SEQ ID NO: 463790 - DNA, 20 bp, Artificial
  CRISPR gRNA sequence
aattaattctgtaaaacact

SEQ ID NO: 463791 - DNA, 20 bp, Artificial
  CRISPR gRNA sequence
attctgtaaaacacttagaa

SEQ ID NO: 463792 - DNA, 20 bp, Artificial
  CRISPR gRNA sequence
aaaacacttagaatagtgca

SEQ ID NO: 463793 - DNA, 20 bp, Artificial
  CRISPR gRNA sequence
atagtgcatggcatgccatt

SEQ ID NO: 463794 - DNA, 20 bp, Artificial
  CRISPR gRNA sequence
cattcagtgctgtgtatatt

SEQ ID NO: 463795 - DNA, 20 bp, Artificial
  CRISPR gRNA sequence
ttagctaattttttttcttt

SEQ ID NO: 463796 - DNA, 20 bp, Artificial
  CRISPR gRNA sequence
cttttagtccaacatttcat

SEQ ID NO: 463797 - DNA, 20 bp, Artificial
  CRISPR gRNA sequence
ccaacatttcattagtttaa

SEQ ID NO: 463798 - DNA, 20 bp, Artificial
  CRISPR gRNA sequence
ttagtttaatagtcctgtta

SEQ ID NO: 463799 - DNA, 20 bp, Artificial
  CRISPR gRNA sequence
tagtcctgttaaagtaacat

SEQ ID NO: 463800 - DNA, 20 bp, Artificial
  CRISPR gRNA sequence
agtcctgttaaagtaacatt

SEQ ID NO: 463801 - DNA, 20 bp, Artificial
  CRISPR gRNA sequence
aagtaacattgggtgacaat

SEQ ID NO: 463802 - DNA, 20 bp, Artificial
  CRISPR gRNA sequence
agtaacattgggtgacaatt

SEQ ID NO: 463803 - DNA, 20 bp, Artificial
  CRISPR gRNA sequence
atcaaccacaaataaaaatt

SEQ ID NO: 463804 - DNA, 20 bp, Artificial
  CRISPR gRNA sequence
caaccacaaataaaaatttg

SEQ ID NO: 463805 - DNA, 20 bp, Artificial
  CRISPR gRNA sequence
taaaaatttggagttcacaa

SEQ ID NO: 463806 - DNA, 20 bp, Artificial
  CRISPR gRNA sequence
tttctttatttcttctaaaa

SEQ ID NO: 463807 - DNA, 20 bp, Artificial
  CRISPR gRNA sequence
ttctttatttcttctaaaaa

SEQ ID NO: 463808 - DNA, 20 bp, Artificial
  CRISPR gRNA sequence
tttcttctaaaaaaggaaaa

SEQ ID NO: 463809 - DNA, 20 bp, Artificial
  CRISPR gRNA sequence
ttcttctaaaaaaggaaaac

SEQ ID NO: 463810 - DNA, 20 bp, Artificial
  CRISPR gRNA sequence
aggaaaacaggatacatgtg

SEQ ID NO: 463811 - DNA, 20 bp, Artificial
  CRISPR gRNA sequence
gatacatgtgcagaaatgta

SEQ ID NO: 463812 - DNA, 20 bp, Artificial
  CRISPR gRNA sequence
atacatgtgcagaaatgtac

SEQ ID NO: 463813 - DNA, 20 bp, Artificial
  CRISPR gRNA sequence
aaatgtacaggtttgttaca

SEQ ID NO: 463814 - DNA, 20 bp, Artificial
  CRISPR gRNA sequence
aatgtacaggtttgttacat

SEQ ID NO: 463815 - DNA, 20 bp, Artificial
  CRISPR gRNA sequence
taggtatacgtgtgccatga

SEQ ID NO: 463816 - DNA, 20 bp, Artificial
  CRISPR gRNA sequence
aacctattgacccatcctct

SEQ ID NO: 463817 - DNA, 20 bp, Artificial
  CRISPR gRNA sequence
cctctccccctactccccaa

SEQ ID NO: 463818 - DNA, 20 bp, Artificial
  CRISPR gRNA sequence
ctctccccctactccccaac

SEQ ID NO: 463819 - DNA, 20 bp, Artificial
  CRISPR gRNA sequence
ccctactccccaacaggctc

SEQ ID NO: 463820 - DNA, 20 bp, Artificial
  CRISPR gRNA sequence
cattttcaacttccacttat

SEQ ID NO: 463821 - DNA, 20 bp, Artificial
  CRISPR gRNA sequence
ttcaacttccacttatgagt

SEQ ID NO: 463822 - DNA, 20 bp, Artificial
  CRISPR gRNA sequence
cacttatgagtgagaacatg

SEQ ID NO: 463823 - DNA, 20 bp, Artificial
  CRISPR gRNA sequence
gagtgagaacatgcagtgtt

SEQ ID NO: 463824 - DNA, 20 bp, Artificial
  CRISPR gRNA sequence
ttggttttctgttcctgtgt

SEQ ID NO: 463825 - DNA, 20 bp, Artificial
  CRISPR gRNA sequence
tgttcctgtgttagtttgct

SEQ ID NO: 463826 - DNA, 20 bp, Artificial
  CRISPR gRNA sequence
gttcctgtgttagtttgctt

SEQ ID NO: 463827 - DNA, 20 bp, Artificial
  CRISPR gRNA sequence
tgttagtttgcttaggatga

SEQ ID NO: 463828 - DNA, 20 bp, Artificial
  CRISPR gRNA sequence
ttgcttaggatgatggcttc

SEQ ID NO: 463829 - DNA, 20 bp, Artificial
  CRISPR gRNA sequence
gcttcatccatgtccctgca

SEQ ID NO: 463830 - DNA, 20 bp, Artificial
  CRISPR gRNA sequence
cttcatccatgtccctgcaa

SEQ ID NO: 463831 - DNA, 20 bp, Artificial
  CRISPR gRNA sequence
ttcatccatgtccctgcaaa

SEQ ID NO: 463832 - DNA, 20 bp, Artificial
  CRISPR gRNA sequence
catgatctcattctttttta

SEQ ID NO: 463833 - DNA, 20 bp, Artificial
  CRISPR gRNA sequence
cattcttttttatggctgca

SEQ ID NO: 463834 - DNA, 20 bp, Artificial
  CRISPR gRNA sequence
tatggctgcatagtattcca

SEQ ID NO: 463835 - DNA, 20 bp, Artificial
  CRISPR gRNA sequence
tgtaccatattttctttttc

SEQ ID NO: 463836 - DNA, 20 bp, Artificial
  CRISPR gRNA sequence
tttttccagtctatcattga

SEQ ID NO: 463837 - DNA, 20 bp, Artificial
  CRISPR gRNA sequence
ttttccagtctatcattgat

SEQ ID NO: 463838 - DNA, 20 bp, Artificial
  CRISPR gRNA sequence
gtctatcattgatgggcatt

SEQ ID NO: 463839 - DNA, 20 bp, Artificial
  CRISPR gRNA sequence
tctatcattgatgggcattt

SEQ ID NO: 463840 - DNA, 20 bp, Artificial
  CRISPR gRNA sequence
tcattgatgggcatttgggt

SEQ ID NO: 463841 - DNA, 20 bp, Artificial
  CRISPR gRNA sequence
cgtgtctttgctattgtaaa

SEQ ID NO: 463842 - DNA, 20 bp, Artificial
  CRISPR gRNA sequence
tacgtgtgcatgtgtcttta

SEQ ID NO: 463843 - DNA, 20 bp, Artificial
  CRISPR gRNA sequence
gtgtgcatgtgtctttatag

SEQ ID NO: 463844 - DNA, 20 bp, Artificial
  CRISPR gRNA sequence
agaatgatttatattccttt

SEQ ID NO: 463845 - DNA, 20 bp, Artificial
  CRISPR gRNA sequence
tattcctttgagtatatacc

SEQ ID NO: 463846 - DNA, 20 bp, Artificial
  CRISPR gRNA sequence
tttgagtatatacccagtaa

SEQ ID NO: 463847 - DNA, 20 bp, Artificial
  CRISPR gRNA sequence
ttgagtatatacccagtaac

SEQ ID NO: 463848 - DNA, 20 bp, Artificial
  CRISPR gRNA sequence
atacccagtaacgggattgc

SEQ ID NO: 463849 - DNA, 20 bp, Artificial
  CRISPR gRNA sequence
tacccagtaacgggattgct

SEQ ID NO: 463850 - DNA, 20 bp, Artificial
  CRISPR gRNA sequence
aacgggattgctgggtcaaa

SEQ ID NO: 463851 - DNA, 20 bp, Artificial
  CRISPR gRNA sequence
gctgggtcaaatggtatttc

SEQ ID NO: 463852 - DNA, 20 bp, Artificial
  CRISPR gRNA sequence
tcaaatggtatttctggttc

SEQ ID NO: 463853 - DNA, 20 bp, Artificial
  CRISPR gRNA sequence
ggtatttctggttctagatc

SEQ ID NO: 463854 - DNA, 20 bp, Artificial
  CRISPR gRNA sequence
gtatttctggttctagatcg

SEQ ID NO: 463855 - DNA, 20 bp, Artificial
  CRISPR gRNA sequence
tgccatactgtcttccacaa

SEQ ID NO: 463856 - DNA, 20 bp, Artificial
  CRISPR gRNA sequence
cactcccaccaaccgtgtaa

SEQ ID NO: 463857 - DNA, 20 bp, Artificial
  CRISPR gRNA sequence
aaagcattcctaattctcca

SEQ ID NO: 463858 - DNA, 20 bp, Artificial
  CRISPR gRNA sequence
ctaattctccacagacttgc

SEQ ID NO: 463859 - DNA, 20 bp, Artificial
  CRISPR gRNA sequence
ttaataatcaccattctgac

SEQ ID NO: 463860 - DNA, 20 bp, Artificial
  CRISPR gRNA sequence
atcaccattctgactggcgt

SEQ ID NO: 463861 - DNA, 20 bp, Artificial
  CRISPR gRNA sequence
cgtgagatgttatctccttg

SEQ ID NO: 463862 - DNA, 20 bp, Artificial
  CRISPR gRNA sequence
atttacatttctctgaccat

SEQ ID NO: 463863 - DNA, 20 bp, Artificial
  CRISPR gRNA sequence
ctctgaccatcagtgatgtt

SEQ ID NO: 463864 - DNA, 20 bp, Artificial
  CRISPR gRNA sequence
gcttttattcttatgtttgt

SEQ ID NO: 463865 - DNA, 20 bp, Artificial
  CRISPR gRNA sequence
tttattcttatgtttgttgg

SEQ ID NO: 463866 - DNA, 20 bp, Artificial
  CRISPR gRNA sequence
aatgtcttcttttttttttt

SEQ ID NO: 463867 - DNA, 20 bp, Artificial
  CRISPR gRNA sequence
tcttctttttttttttgaga

SEQ ID NO: 463868 - DNA, 20 bp, Artificial
  CRISPR gRNA sequence
ttctttttttttttgagata

SEQ ID NO: 463869 - DNA, 20 bp, Artificial
  CRISPR gRNA sequence
tagagtgtcgctctgtcgcc

SEQ ID NO: 463870 - DNA, 20 bp, Artificial
  CRISPR gRNA sequence
agagtgtcgctctgtcgccc

SEQ ID NO: 463871 - DNA, 20 bp, Artificial
  CRISPR gRNA sequence
tgtcgctctgtcgcccaggc

SEQ ID NO: 463872 - DNA, 20 bp, Artificial
  CRISPR gRNA sequence
tcgctctgtcgcccaggctg

SEQ ID NO: 463873 - DNA, 20 bp, Artificial
  CRISPR gRNA sequence
ctgtcgcccaggctggagtg

SEQ ID NO: 463874 - DNA, 20 bp, Artificial
  CRISPR gRNA sequence
tcgcccaggctggagtgcag

SEQ ID NO: 463875 - DNA, 20 bp, Artificial
  CRISPR gRNA sequence
gcgcaatctccgctcactgc

SEQ ID NO: 463876 - DNA, 20 bp, Artificial
  CRISPR gRNA sequence
tcactgcaagctctgcctcc

SEQ ID NO: 463877 - DNA, 20 bp, Artificial
  CRISPR gRNA sequence
cactgcaagctctgcctccc

SEQ ID NO: 463878 - DNA, 20 bp, Artificial
  CRISPR gRNA sequence
ctcatgccattctcctaact

SEQ ID NO: 463879 - DNA, 20 bp, Artificial
  CRISPR gRNA sequence
ttctcctaactcagcctccc

SEQ ID NO: 463880 - DNA, 20 bp, Artificial
  CRISPR gRNA sequence
tcctaactcagcctcccgag

SEQ ID NO: 463881 - DNA, 20 bp, Artificial
  CRISPR gRNA sequence
aactcagcctcccgagtagc

SEQ ID NO: 463882 - DNA, 20 bp, Artificial
  CRISPR gRNA sequence
actcagcctcccgagtagct

SEQ ID NO: 463883 - DNA, 20 bp, Artificial
  CRISPR gRNA sequence
ctcccgagtagctgggacta

SEQ ID NO: 463884 - DNA, 20 bp, Artificial
  CRISPR gRNA sequence
tcccgagtagctgggactac

SEQ ID NO: 463885 - DNA, 20 bp, Artificial
  CRISPR gRNA sequence
cgagtagctgggactacagg

SEQ ID NO: 463886 - DNA, 20 bp, Artificial
  CRISPR gRNA sequence
caggcggctgccaccacgcc

SEQ ID NO: 463887 - DNA, 20 bp, Artificial
  CRISPR gRNA sequence
tggctaattttttgtatttt

SEQ ID NO: 463888 - DNA, 20 bp, Artificial
  CRISPR gRNA sequence
aattttttgtatttttagta

SEQ ID NO: 463889 - DNA, 20 bp, Artificial
  CRISPR gRNA sequence
tttttgtatttttagtacag

SEQ ID NO: 463890 - DNA, 20 bp, Artificial
  CRISPR gRNA sequence
ttttgtatttttagtacaga

SEQ ID NO: 463891 - DNA, 20 bp, Artificial
  CRISPR gRNA sequence
tacagaaggtttcaccgtgt

SEQ ID NO: 463892 - DNA, 20 bp, Artificial
  CRISPR gRNA sequence
gaaggtttcaccgtgttagt

SEQ ID NO: 463893 - DNA, 20 bp, Artificial
  CRISPR gRNA sequence
aaggtttcaccgtgttagtc

SEQ ID NO: 463894 - DNA, 20 bp, Artificial
  CRISPR gRNA sequence
tttcaccgtgttagtcagga

SEQ ID NO: 463895 - DNA, 20 bp, Artificial
  CRISPR gRNA sequence
acctcatgatccacctgtct

SEQ ID NO: 463896 - DNA, 20 bp, Artificial
  CRISPR gRNA sequence
ccacctgtctcggcctccca

SEQ ID NO: 463897 - DNA, 20 bp, Artificial
  CRISPR gRNA sequence
gtctcggcctcccaaagtgc

SEQ ID NO: 463898 - DNA, 20 bp, Artificial
  CRISPR gRNA sequence
tctcggcctcccaaagtgct

SEQ ID NO: 463899 - DNA, 20 bp, Artificial
  CRISPR gRNA sequence
ctcccaaagtgctgggatta

SEQ ID NO: 463900 - DNA, 20 bp, Artificial
  CRISPR gRNA sequence
tcccaaagtgctgggattac

SEQ ID NO: 463901 - DNA, 20 bp, Artificial
  CRISPR gRNA sequence
agtgctgggattacaggcgt

SEQ ID NO: 463902 - DNA, 20 bp, Artificial
  CRISPR gRNA sequence
caggcgtgagccaccgcgcc

SEQ ID NO: 463903 - DNA, 20 bp, Artificial
  CRISPR gRNA sequence
cgtgagccaccgcgcccagc

SEQ ID NO: 463904 - DNA, 20 bp, Artificial
  CRISPR gRNA sequence
cccagccagtgtcttctttt

SEQ ID NO: 463905 - DNA, 20 bp, Artificial
  CRISPR gRNA sequence
agccagtgtcttcttttgag

SEQ ID NO: 463906 - DNA, 20 bp, Artificial
  CRISPR gRNA sequence
tcttttgagaagtgtctgtt

SEQ ID NO: 463907 - DNA, 20 bp, Artificial
  CRISPR gRNA sequence
cttttgagaagtgtctgttt

SEQ ID NO: 463908 - DNA, 20 bp, Artificial
  CRISPR gRNA sequence
tgagaagtgtctgtttaggc

SEQ ID NO: 463909 - DNA, 20 bp, Artificial
  CRISPR gRNA sequence
gagaagtgtctgtttaggct

SEQ ID NO: 463910 - DNA, 20 bp, Artificial
  CRISPR gRNA sequence
gtgtctgtttaggctgggtg

SEQ ID NO: 463911 - DNA, 20 bp, Artificial
  CRISPR gRNA sequence
tctgtttaggctgggtgtag

SEQ ID NO: 463912 - DNA, 20 bp, Artificial
  CRISPR gRNA sequence
gtggctctcgcctgtaatcc

SEQ ID NO: 463913 - DNA, 20 bp, Artificial
  CRISPR gRNA sequence
cgcctgtaatcccagcactt

SEQ ID NO: 463914 - DNA, 20 bp, Artificial
  CRISPR gRNA sequence
gcctgtaatcccagcacttc

SEQ ID NO: 463915 - DNA, 20 bp, Artificial
  CRISPR gRNA sequence
tgtaatcccagcacttcagg

SEQ ID NO: 463916 - DNA, 20 bp, Artificial
  CRISPR gRNA sequence
tcccagcacttcaggaagct

SEQ ID NO: 463917 - DNA, 20 bp, Artificial
  CRISPR gRNA sequence
cccagcacttcaggaagctg

SEQ ID NO: 463918 - DNA, 20 bp, Artificial
  CRISPR gRNA sequence
cagcacttcaggaagctgag

SEQ ID NO: 463919 - DNA, 20 bp, Artificial
  CRISPR gRNA sequence
agcacttcaggaagctgagg

SEQ ID NO: 463920 - DNA, 20 bp, Artificial
  CRISPR gRNA sequence
gcacttcaggaagctgagga

SEQ ID NO: 463921 - DNA, 20 bp, Artificial
  CRISPR gRNA sequence
cttcaggaagctgaggaggg

SEQ ID NO: 463922 - DNA, 20 bp, Artificial
  CRISPR gRNA sequence
ttcaggaagctgaggagggc

SEQ ID NO: 463923 - DNA, 20 bp, Artificial
  CRISPR gRNA sequence
ctgaggagggcgggtcattt

SEQ ID NO: 463924 - DNA, 20 bp, Artificial
  CRISPR gRNA sequence
tgaggagggcgggtcatttg

SEQ ID NO: 463925 - DNA, 20 bp, Artificial
  CRISPR gRNA sequence
gagggcgggtcatttgaggt

SEQ ID NO: 463926 - DNA, 20 bp, Artificial
  CRISPR gRNA sequence
agggcgggtcatttgaggtc

SEQ ID NO: 463927 - DNA, 20 bp, Artificial
  CRISPR gRNA sequence
ggcgggtcatttgaggtcag

SEQ ID NO: 463928 - DNA, 20 bp, Artificial
  CRISPR gRNA sequence
tcatttgaggtcaggagttc

SEQ ID NO: 463929 - DNA, 20 bp, Artificial
  CRISPR gRNA sequence
atttgaggtcaggagttcaa

SEQ ID NO: 463930 - DNA, 20 bp, Artificial
  CRISPR gRNA sequence
tgaggtcaggagttcaagag

SEQ ID NO: 463931 - DNA, 20 bp, Artificial
  CRISPR gRNA sequence
tcaggagttcaagagcagtc

SEQ ID NO: 463932 - DNA, 20 bp, Artificial
  CRISPR gRNA sequence
gagttcaagagcagtctggc

SEQ ID NO: 463933 - DNA, 20 bp, Artificial
  CRISPR gRNA sequence
caagagcagtctggccagca

SEQ ID NO: 463934 - DNA, 20 bp, Artificial
  CRISPR gRNA sequence
tgtactaaaaatacaaaaat

SEQ ID NO: 463935 - DNA, 20 bp, Artificial
  CRISPR gRNA sequence
ctaaaaatacaaaaattagc

SEQ ID NO: 463936 - DNA, 20 bp, Artificial
  CRISPR gRNA sequence
taaaaatacaaaaattagct

SEQ ID NO: 463937 - DNA, 20 bp, Artificial
  CRISPR gRNA sequence
atacaaaaattagctgggcg

SEQ ID NO: 463938 - DNA, 20 bp, Artificial
  CRISPR gRNA sequence
caaaaattagctgggcgtgg

SEQ ID NO: 463939 - DNA, 20 bp, Artificial
  CRISPR gRNA sequence
aaaaattagctgggcgtggt

SEQ ID NO: 463940 - DNA, 20 bp, Artificial
  CRISPR gRNA sequence
gcgtggtgggacacgcctgt

SEQ ID NO: 463941 - DNA, 20 bp, Artificial
  CRISPR gRNA sequence
gtgggacacgcctgtaagac

SEQ ID NO: 463942 - DNA, 20 bp, Artificial
  CRISPR gRNA sequence
cgcctgtaagaccagctact

SEQ ID NO: 463943 - DNA, 20 bp, Artificial
  CRISPR gRNA sequence
gcctgtaagaccagctactt

SEQ ID NO: 463944 - DNA, 20 bp, Artificial
  CRISPR gRNA sequence
ctgtaagaccagctacttgg

SEQ ID NO: 463945 - DNA, 20 bp, Artificial
  CRISPR gRNA sequence
tgtaagaccagctacttggg

SEQ ID NO: 463946 - DNA, 20 bp, Artificial
  CRISPR gRNA sequence
gaccagctacttgggaggct

SEQ ID NO: 463947 - DNA, 20 bp, Artificial
  CRISPR gRNA sequence
accagctacttgggaggctg

SEQ ID NO: 463948 - DNA, 20 bp, Artificial
  CRISPR gRNA sequence
agctacttgggaggctgagg

SEQ ID NO: 463949 - DNA, 20 bp, Artificial
  CRISPR gRNA sequence
gaggcagaattgcttgaacc

SEQ ID NO: 463950 - DNA, 20 bp, Artificial
  CRISPR gRNA sequence
aggcagaattgcttgaaccc

SEQ ID NO: 463951 - DNA, 20 bp, Artificial
  CRISPR gRNA sequence
gcagaattgcttgaacccag

SEQ ID NO: 463952 - DNA, 20 bp, Artificial
  CRISPR gRNA sequence
tgcttgaacccaggagactg

SEQ ID NO: 463953 - DNA, 20 bp, Artificial
  CRISPR gRNA sequence
aacccaggagactgaagttg

SEQ ID NO: 463954 - DNA, 20 bp, Artificial
  CRISPR gRNA sequence
caggagactgaagttgcagt

SEQ ID NO: 463955 - DNA, 20 bp, Artificial
  CRISPR gRNA sequence
agactgaagttgcagtgagc

SEQ ID NO: 463956 - DNA, 20 bp, Artificial
  CRISPR gRNA sequence
gactgaagttgcagtgagcc

SEQ ID NO: 463957 - DNA, 20 bp, Artificial
  CRISPR gRNA sequence
caggttgcaccactgcactc

SEQ ID NO: 463958 - DNA, 20 bp, Artificial
  CRISPR gRNA sequence
ttgcaccactgcactccagc

SEQ ID NO: 463959 - DNA, 20 bp, Artificial
  CRISPR gRNA sequence
tgcaccactgcactccagct

SEQ ID NO: 463960 - DNA, 20 bp, Artificial
  CRISPR gRNA sequence
actgcactccagctgggtaa

SEQ ID NO: 463961 - DNA, 20 bp, Artificial
  CRISPR gRNA sequence
tgcactccagctgggtaaca

SEQ ID NO: 463962 - DNA, 20 bp, Artificial
  CRISPR gRNA sequence
ctccagctgggtaacagagt

SEQ ID NO: 463963 - DNA, 20 bp, Artificial
  CRISPR gRNA sequence
actctgtctccaaaaaaaaa

SEQ ID NO: 463964 - DNA, 20 bp, Artificial
  CRISPR gRNA sequence
tctgtctccaaaaaaaaaca

SEQ ID NO: 463965 - DNA, 20 bp, Artificial
  CRISPR gRNA sequence
tgtctccaaaaaaaaacaga

SEQ ID NO: 463966 - DNA, 20 bp, Artificial
  CRISPR gRNA sequence
cctttgcccactttttgatg

SEQ ID NO: 463967 - DNA, 20 bp, Artificial
  CRISPR gRNA sequence
tttttcttgtaaacttattt

SEQ ID NO: 463968 - DNA, 20 bp, Artificial
  CRISPR gRNA sequence
tttaagtttcttgtaaattc

SEQ ID NO: 463969 - DNA, 20 bp, Artificial
  CRISPR gRNA sequence
ttcttgtaaattctggatat

SEQ ID NO: 463970 - DNA, 20 bp, Artificial
  CRISPR gRNA sequence
tcttgtaaattctggatatt

SEQ ID NO: 463971 - DNA, 20 bp, Artificial
  CRISPR gRNA sequence
tctggatattaggccttttt

SEQ ID NO: 463972 - DNA, 20 bp, Artificial
  CRISPR gRNA sequence
gatattaggcctttttcaga

SEQ ID NO: 463973 - DNA, 20 bp, Artificial
  CRISPR gRNA sequence
atattaggcctttttcagat

SEQ ID NO: 463974 - DNA, 20 bp, Artificial
  CRISPR gRNA sequence
ttaggcctttttcagatggg

SEQ ID NO: 463975 - DNA, 20 bp, Artificial
  CRISPR gRNA sequence
aaaaattttctcccattctg

SEQ ID NO: 463976 - DNA, 20 bp, Artificial
  CRISPR gRNA sequence
aaaattttctcccattctgt

SEQ ID NO: 463977 - DNA, 20 bp, Artificial
  CRISPR gRNA sequence
ggttgcctttttgctctgat

SEQ ID NO: 463978 - DNA, 20 bp, Artificial
  CRISPR gRNA sequence
ttgcctttttgctctgatga

SEQ ID NO: 463979 - DNA, 20 bp, Artificial
  CRISPR gRNA sequence
tgagagtttcttttgctgtg

SEQ ID NO: 463980 - DNA, 20 bp, Artificial
  CRISPR gRNA sequence
gagtttcttttgctgtgcag

SEQ ID NO: 463981 - DNA, 20 bp, Artificial
  CRISPR gRNA sequence
tttgctgtgcagaagttctt

SEQ ID NO: 463982 - DNA, 20 bp, Artificial
  CRISPR gRNA sequence
cagtttgttgcaattgcttt

SEQ ID NO: 463983 - DNA, 20 bp, Artificial
  CRISPR gRNA sequence
cttttggcatttatgtcatg

SEQ ID NO: 463984 - DNA, 20 bp, Artificial
  CRISPR gRNA sequence
ttatgtcatgaagactttgt

SEQ ID NO: 463985 - DNA, 20 bp, Artificial
  CRISPR gRNA sequence
ctttgtgagaaaaatgccaa

SEQ ID NO: 463986 - DNA, 20 bp, Artificial
  CRISPR gRNA sequence
gcattatctactcttatcct

SEQ ID NO: 463987 - DNA, 20 bp, Artificial
  CRISPR gRNA sequence
tactcttatccttggtcacc

SEQ ID NO: 463988 - DNA, 20 bp, Artificial
  CRISPR gRNA sequence
ttatccttggtcaccaagaa

SEQ ID NO: 463989 - DNA, 20 bp, Artificial
  CRISPR gRNA sequence
tggtcaccaagaaaagctaa

SEQ ID NO: 463990 - DNA, 20 bp, Artificial
  CRISPR gRNA sequence
aagaaaagctaatagtgctt

SEQ ID NO: 463991 - DNA, 20 bp, Artificial
  CRISPR gRNA sequence
tgcttgagaatcatgcgctt

SEQ ID NO: 463992 - DNA, 20 bp, Artificial
  CRISPR gRNA sequence
gcgcttgagttgtattgtgt

SEQ ID NO: 463993 - DNA, 20 bp, Artificial
  CRISPR gRNA sequence
ccattctcttacctcaaaat

SEQ ID NO: 463994 - DNA, 20 bp, Artificial
  CRISPR gRNA sequence
ctcaatattttgtacctttc

SEQ ID NO: 463995 - DNA, 20 bp, Artificial
  CRISPR gRNA sequence
acctttctggtatactctca

SEQ ID NO: 463996 - DNA, 20 bp, Artificial
  CRISPR gRNA sequence
ctggtatactctcatggtta

SEQ ID NO: 463997 - DNA, 20 bp, Artificial
  CRISPR gRNA sequence
gatttacatgtttatctcaa

SEQ ID NO: 463998 - DNA, 20 bp, Artificial
  CRISPR gRNA sequence
ttacatgtttatctcaatgg

SEQ ID NO: 463999 - DNA, 20 bp, Artificial
  CRISPR gRNA sequence
catgtttatctcaatggaag

SEQ ID NO: 464000 - DNA, 20 bp, Artificial
  CRISPR gRNA sequence
gtttatctcaatggaagaag

SEQ ID NO: 464001 - DNA, 20 bp, Artificial
  CRISPR gRNA sequence
tggaagaagtggcttgtgtg

SEQ ID NO: 464002 - DNA, 20 bp, Artificial
  CRISPR gRNA sequence
tgtgtctgtgtgtatgcatg

SEQ ID NO: 464003 - DNA, 20 bp, Artificial
  CRISPR gRNA sequence
tgtctgtgtgtatgcatgca

SEQ ID NO: 464004 - DNA, 20 bp, Artificial
  CRISPR gRNA sequence
gtctgtgtgtatgcatgcag

SEQ ID NO: 464005 - DNA, 20 bp, Artificial
  CRISPR gRNA sequence
gcagaggtgtcatacaattt

SEQ ID NO: 464006 - DNA, 20 bp, Artificial
  CRISPR gRNA sequence
catacaatttgagattcact

SEQ ID NO: 464007 - DNA, 20 bp, Artificial
  CRISPR gRNA sequence
aatttgagattcacttagaa

SEQ ID NO: 464008 - DNA, 20 bp, Artificial
  CRISPR gRNA sequence
tttgagattcacttagaaca

SEQ ID NO: 464009 - DNA, 20 bp, Artificial
  CRISPR gRNA sequence
gattcacttagaacagagtc

SEQ ID NO: 464010 - DNA, 20 bp, Artificial
  CRISPR gRNA sequence
tcacttagaacagagtccag

SEQ ID NO: 464011 - DNA, 20 bp, Artificial
  CRISPR gRNA sequence
acttagaacagagtccagaa

SEQ ID NO: 464012 - DNA, 20 bp, Artificial
  CRISPR gRNA sequence
aacagagtccagaagagtgt

SEQ ID NO: 464013 - DNA, 20 bp, Artificial
  CRISPR gRNA sequence
agtccagaagagtgttagat

SEQ ID NO: 464014 - DNA, 20 bp, Artificial
  CRISPR gRNA sequence
gaagagtgttagatcagtcc

SEQ ID NO: 464015 - DNA, 20 bp, Artificial
  CRISPR gRNA sequence
aagagtgttagatcagtccc

SEQ ID NO: 464016 - DNA, 20 bp, Artificial
  CRISPR gRNA sequence
atcagtcccaggaaaacatc

SEQ ID NO: 464017 - DNA, 20 bp, Artificial
  CRISPR gRNA sequence
tcccaggaaaacatcaagtt

SEQ ID NO: 464018 - DNA, 20 bp, Artificial
  CRISPR gRNA sequence
aggaaaacatcaagtttagc

SEQ ID NO: 464019 - DNA, 20 bp, Artificial
  CRISPR gRNA sequence
aaaacatcaagtttagctgg

SEQ ID NO: 464020 - DNA, 20 bp, Artificial
  CRISPR gRNA sequence
aacatcaagtttagctggca

SEQ ID NO: 464021 - DNA, 20 bp, Artificial
  CRISPR gRNA sequence
gataaccatgttcatcttat

SEQ ID NO: 464022 - DNA, 20 bp, Artificial
  CRISPR gRNA sequence
ttcatcttataagcacaacc

SEQ ID NO: 464023 - DNA, 20 bp, Artificial
  CRISPR gRNA sequence
gaactcacacacatcacaaa

SEQ ID NO: 464024 - DNA, 20 bp, Artificial
  CRISPR gRNA sequence
atcacaaatggcctattatc

SEQ ID NO: 464025 - DNA, 20 bp, Artificial
  CRISPR gRNA sequence
atggcctattatccagtatt

SEQ ID NO: 464026 - DNA, 20 bp, Artificial
  CRISPR gRNA sequence
attatccagtatttggctac

SEQ ID NO: 464027 - DNA, 20 bp, Artificial
  CRISPR gRNA sequence
ttatccagtatttggctaca

SEQ ID NO: 464028 - DNA, 20 bp, Artificial
  CRISPR gRNA sequence
tatccagtatttggctacaa

SEQ ID NO: 464029 - DNA, 20 bp, Artificial
  CRISPR gRNA sequence
tccagtatttggctacaagg

SEQ ID NO: 464030 - DNA, 20 bp, Artificial
  CRISPR gRNA sequence
ccagtatttggctacaaggg

SEQ ID NO: 464031 - DNA, 20 bp, Artificial
  CRISPR gRNA sequence
tatttggctacaagggaggc

SEQ ID NO: 464032 - DNA, 20 bp, Artificial
  CRISPR gRNA sequence
atttggctacaagggaggct

SEQ ID NO: 464033 - DNA, 20 bp, Artificial
  CRISPR gRNA sequence
tttggctacaagggaggctg

SEQ ID NO: 464034 - DNA, 20 bp, Artificial
  CRISPR gRNA sequence
acaagggaggctggggcatt

SEQ ID NO: 464035 - DNA, 20 bp, Artificial
  CRISPR gRNA sequence
ggggcattgagatttttatc

SEQ ID NO: 464036 - DNA, 20 bp, Artificial
  CRISPR gRNA sequence
gggcattgagatttttatct

SEQ ID NO: 464037 - DNA, 20 bp, Artificial
  CRISPR gRNA sequence
ggcattgagatttttatctg

SEQ ID NO: 464038 - DNA, 20 bp, Artificial
  CRISPR gRNA sequence
gcattgagatttttatctgg

SEQ ID NO: 464039 - DNA, 20 bp, Artificial
  CRISPR gRNA sequence
cattgagatttttatctggg

SEQ ID NO: 464040 - DNA, 20 bp, Artificial
  CRISPR gRNA sequence
gatttttatctggggggtta

SEQ ID NO: 464041 - DNA, 20 bp, Artificial
  CRISPR gRNA sequence
ttcattttcctctataatat

SEQ ID NO: 464042 - DNA, 20 bp, Artificial
  CRISPR gRNA sequence
attttcctctataatattag

SEQ ID NO: 464043 - DNA, 20 bp, Artificial
  CRISPR gRNA sequence
cctctataatattagaagat

SEQ ID NO: 464044 - DNA, 20 bp, Artificial
  CRISPR gRNA sequence
tagaagatgagaattaatat

SEQ ID NO: 464045 - DNA, 20 bp, Artificial
  CRISPR gRNA sequence
aagatgagaattaatattgg

SEQ ID NO: 464046 - DNA, 20 bp, Artificial
  CRISPR gRNA sequence
aattaatattggaagacatt

SEQ ID NO: 464047 - DNA, 20 bp, Artificial
  CRISPR gRNA sequence
taatattggaagacatttag

SEQ ID NO: 464048 - DNA, 20 bp, Artificial
  CRISPR gRNA sequence
ttagcagattctgtccacat

SEQ ID NO: 464049 - DNA, 20 bp, Artificial
  CRISPR gRNA sequence
ctgtccacataagtattgtt

SEQ ID NO: 464050 - DNA, 20 bp, Artificial
  CRISPR gRNA sequence
aagtattgtttagtatcttc

SEQ ID NO: 464051 - DNA, 20 bp, Artificial
  CRISPR gRNA sequence
agtattgtttagtatcttca

SEQ ID NO: 464052 - DNA, 20 bp, Artificial
  CRISPR gRNA sequence
gtattgtttagtatcttcaa

SEQ ID NO: 464053 - DNA, 20 bp, Artificial
  CRISPR gRNA sequence
ttcaagggctttgaaaatgc

SEQ ID NO: 464054 - DNA, 20 bp, Artificial
  CRISPR gRNA sequence
ttgaaaatgccagtgaatct

SEQ ID NO: 464055 - DNA, 20 bp, Artificial
  CRISPR gRNA sequence
gaatctcagtgtgatgtctg

SEQ ID NO: 464056 - DNA, 20 bp, Artificial
  CRISPR gRNA sequence
tctcagtgtgatgtctgtgg

SEQ ID NO: 464057 - DNA, 20 bp, Artificial
  CRISPR gRNA sequence
atgtctgtggtagaatgtat

SEQ ID NO: 464058 - DNA, 20 bp, Artificial
  CRISPR gRNA sequence
gtctgtggtagaatgtatta

SEQ ID NO: 464059 - DNA, 20 bp, Artificial
  CRISPR gRNA sequence
gtagaatgtattagagatgt

SEQ ID NO: 464060 - DNA, 20 bp, Artificial
  CRISPR gRNA sequence
tagaatgtattagagatgtg

SEQ ID NO: 464061 - DNA, 20 bp, Artificial
  CRISPR gRNA sequence
aatgtattagagatgtgagg

SEQ ID NO: 464062 - DNA, 20 bp, Artificial
  CRISPR gRNA sequence
tagagatgtgaggaagtatc

SEQ ID NO: 464063 - DNA, 20 bp, Artificial
  CRISPR gRNA sequence
agagatgtgaggaagtatct

SEQ ID NO: 464064 - DNA, 20 bp, Artificial
  CRISPR gRNA sequence
gatgtgaggaagtatctggg

SEQ ID NO: 464065 - DNA, 20 bp, Artificial
  CRISPR gRNA sequence
tgaggaagtatctgggaaga

SEQ ID NO: 464066 - DNA, 20 bp, Artificial
  CRISPR gRNA sequence
ggaagtatctgggaagaaag

SEQ ID NO: 464067 - DNA, 20 bp, Artificial
  CRISPR gRNA sequence
aagtatctgggaagaaagta

SEQ ID NO: 464068 - DNA, 20 bp, Artificial
  CRISPR gRNA sequence
atctgggaagaaagtagaga

SEQ ID NO: 464069 - DNA, 20 bp, Artificial
  CRISPR gRNA sequence
cctttccaatcataatacat

SEQ ID NO: 464070 - DNA, 20 bp, Artificial
  CRISPR gRNA sequence
acacttaatctgaacatcac

SEQ ID NO: 464071 - DNA, 20 bp, Artificial
  CRISPR gRNA sequence
aagtaacaatccttccactg

SEQ ID NO: 464072 - DNA, 20 bp, Artificial
  CRISPR gRNA sequence
cttccactgaagtcaatatt

SEQ ID NO: 464073 - DNA, 20 bp, Artificial
  CRISPR gRNA sequence
atatttagaaatactcatgt

SEQ ID NO: 464074 - DNA, 20 bp, Artificial
  CRISPR gRNA sequence
gttggtttctgatcaaatgc

SEQ ID NO: 464075 - DNA, 20 bp, Artificial
  CRISPR gRNA sequence
tggtttctgatcaaatgcca

SEQ ID NO: 464076 - DNA, 20 bp, Artificial
  CRISPR gRNA sequence
ggtttctgatcaaatgccag

SEQ ID NO: 464077 - DNA, 20 bp, Artificial
  CRISPR gRNA sequence
ctcactgatgctactgtcaa

SEQ ID NO: 464078 - DNA, 20 bp, Artificial
  CRISPR gRNA sequence
tgctactgtcaacagcttct

SEQ ID NO: 464079 - DNA, 20 bp, Artificial
  CRISPR gRNA sequence
gctactgtcaacagcttctc

SEQ ID NO: 464080 - DNA, 20 bp, Artificial
  CRISPR gRNA sequence
ttcctgaaatccctgtgaca

SEQ ID NO: 464081 - DNA, 20 bp, Artificial
  CRISPR gRNA sequence
tcctgaaatccctgtgacaa

SEQ ID NO: 464082 - DNA, 20 bp, Artificial
  CRISPR gRNA sequence
tgaaatccctgtgacaaagg

SEQ ID NO: 464083 - DNA, 20 bp, Artificial
  CRISPR gRNA sequence
tgtgacaaaggtggaaaatt

SEQ ID NO: 464084 - DNA, 20 bp, Artificial
  CRISPR gRNA sequence
tggaaaatttagcctctctg

SEQ ID NO: 464085 - DNA, 20 bp, Artificial
  CRISPR gRNA sequence
ggaaaatttagcctctctga

SEQ ID NO: 464086 - DNA, 20 bp, Artificial
  CRISPR gRNA sequence
aatttagcctctctgaagga

SEQ ID NO: 464087 - DNA, 20 bp, Artificial
  CRISPR gRNA sequence
atttagcctctctgaaggac

SEQ ID NO: 464088 - DNA, 20 bp, Artificial
  CRISPR gRNA sequence
tttagcctctctgaaggaca

SEQ ID NO: 464089 - DNA, 20 bp, Artificial
  CRISPR gRNA sequence
aggacagggcctatgtgtaa

SEQ ID NO: 464090 - DNA, 20 bp, Artificial
  CRISPR gRNA sequence
ggacagggcctatgtgtaac

SEQ ID NO: 464091 - DNA, 20 bp, Artificial
  CRISPR gRNA sequence
ctatgtgtaacaggcaatca

SEQ ID NO: 464092 - DNA, 20 bp, Artificial
  CRISPR gRNA sequence
ctctctaaatcattgttctt

SEQ ID NO: 464093 - DNA, 20 bp, Artificial
  CRISPR gRNA sequence
tctctaaatcattgttcttt

SEQ ID NO: 464094 - DNA, 20 bp, Artificial
  CRISPR gRNA sequence
attgttctttaggactcatt

SEQ ID NO: 464095 - DNA, 20 bp, Artificial
  CRISPR gRNA sequence
ttaggactcattaagttgac

SEQ ID NO: 464096 - DNA, 20 bp, Artificial
  CRISPR gRNA sequence
ggactcattaagttgactag

SEQ ID NO: 464097 - DNA, 20 bp, Artificial
  CRISPR gRNA sequence
actagaagcttttactattc

SEQ ID NO: 464098 - DNA, 20 bp, Artificial
  CRISPR gRNA sequence
ctagaagcttttactattca

SEQ ID NO: 464099 - DNA, 20 bp, Artificial
  CRISPR gRNA sequence
tagaagcttttactattcaa

SEQ ID NO: 464100 - DNA, 20 bp, Artificial
  CRISPR gRNA sequence
tgttgaccaactaaaaccac

SEQ ID NO: 464101 - DNA, 20 bp, Artificial
  CRISPR gRNA sequence
agaaactcatccttgttaca

SEQ ID NO: 464102 - DNA, 20 bp, Artificial
  CRISPR gRNA sequence
aaactcatccttgttacaca

SEQ ID NO: 464103 - DNA, 20 bp, Artificial
  CRISPR gRNA sequence
ctcatccttgttacacagag

SEQ ID NO: 464104 - DNA, 20 bp, Artificial
  CRISPR gRNA sequence
tccttgttacacagagtaga

SEQ ID NO: 464105 - DNA, 20 bp, Artificial
  CRISPR gRNA sequence
ccttgttacacagagtagac

SEQ ID NO: 464106 - DNA, 20 bp, Artificial
  CRISPR gRNA sequence
cttgttacacagagtagaca

SEQ ID NO: 464107 - DNA, 20 bp, Artificial
  CRISPR gRNA sequence
cacagagtagacagggctct

SEQ ID NO: 464108 - DNA, 20 bp, Artificial
  CRISPR gRNA sequence
acagagtagacagggctcta

SEQ ID NO: 464109 - DNA, 20 bp, Artificial
  CRISPR gRNA sequence
agagtagacagggctctaag

SEQ ID NO: 464110 - DNA, 20 bp, Artificial
  CRISPR gRNA sequence
tgcaatgcatatgaatcctc

SEQ ID NO: 464111 - DNA, 20 bp, Artificial
  CRISPR gRNA sequence
tgcatatgaatcctctggcc

SEQ ID NO: 464112 - DNA, 20 bp, Artificial
  CRISPR gRNA sequence
catatgaatcctctggccta

SEQ ID NO: 464113 - DNA, 20 bp, Artificial
  CRISPR gRNA sequence
atgaatcctctggcctagag

SEQ ID NO: 464114 - DNA, 20 bp, Artificial
  CRISPR gRNA sequence
tcctctggcctagagaagca

SEQ ID NO: 464115 - DNA, 20 bp, Artificial
  CRISPR gRNA sequence
ctggcctagagaagcaaagt

SEQ ID NO: 464116 - DNA, 20 bp, Artificial
  CRISPR gRNA sequence
agagaagcaaagtcagtgac

SEQ ID NO: 464117 - DNA, 20 bp, Artificial
  CRISPR gRNA sequence
gaagcaaagtcagtgaccag

SEQ ID NO: 464118 - DNA, 20 bp, Artificial
  CRISPR gRNA sequence
aagcaaagtcagtgaccagt

SEQ ID NO: 464119 - DNA, 20 bp, Artificial
  CRISPR gRNA sequence
agcaaagtcagtgaccagta

SEQ ID NO: 464120 - DNA, 20 bp, Artificial
  CRISPR gRNA sequence
aaagtcagtgaccagtaggg

SEQ ID NO: 464121 - DNA, 20 bp, Artificial
  CRISPR gRNA sequence
gaccagtagggtagatctgc

SEQ ID NO: 464122 - DNA, 20 bp, Artificial
  CRISPR gRNA sequence
accagtagggtagatctgca

SEQ ID NO: 464123 - DNA, 20 bp, Artificial
  CRISPR gRNA sequence
ccagtagggtagatctgcaa

SEQ ID NO: 464124 - DNA, 20 bp, Artificial
  CRISPR gRNA sequence
cagtagggtagatctgcaag

SEQ ID NO: 464125 - DNA, 20 bp, Artificial
  CRISPR gRNA sequence
gcaaggggacatttgtgact

SEQ ID NO: 464126 - DNA, 20 bp, Artificial
  CRISPR gRNA sequence
aggggacatttgtgacttgg

SEQ ID NO: 464127 - DNA, 20 bp, Artificial
  CRISPR gRNA sequence
gggacatttgtgacttggca

SEQ ID NO: 464128 - DNA, 20 bp, Artificial
  CRISPR gRNA sequence
gacttggcagagatgtaatg

SEQ ID NO: 464129 - DNA, 20 bp, Artificial
  CRISPR gRNA sequence
ttggcagagatgtaatgaag

SEQ ID NO: 464130 - DNA, 20 bp, Artificial
  CRISPR gRNA sequence
atgtaatgaagaagtcctga

SEQ ID NO: 464131 - DNA, 20 bp, Artificial
  CRISPR gRNA sequence
aatgaagaagtcctgaaagc

SEQ ID NO: 464132 - DNA, 20 bp, Artificial
  CRISPR gRNA sequence
agaagtcctgaaagcaagct

SEQ ID NO: 464133 - DNA, 20 bp, Artificial
  CRISPR gRNA sequence
gcaagcttagaaaattatca

SEQ ID NO: 464134 - DNA, 20 bp, Artificial
  CRISPR gRNA sequence
caagcttagaaaattatcaa

SEQ ID NO: 464135 - DNA, 20 bp, Artificial
  CRISPR gRNA sequence
tagaaaattatcaaaggaca

SEQ ID NO: 464136 - DNA, 20 bp, Artificial
  CRISPR gRNA sequence
caaagtttttttcaatattc

SEQ ID NO: 464137 - DNA, 20 bp, Artificial
  CRISPR gRNA sequence
tcaatattctagttttgacc

SEQ ID NO: 464138 - DNA, 20 bp, Artificial
  CRISPR gRNA sequence
caatattctagttttgacca

SEQ ID NO: 464139 - DNA, 20 bp, Artificial
  CRISPR gRNA sequence
attctagttttgaccaaggc

SEQ ID NO: 464140 - DNA, 20 bp, Artificial
  CRISPR gRNA sequence
ttgaccaaggcaagccttgc

SEQ ID NO: 464141 - DNA, 20 bp, Artificial
  CRISPR gRNA sequence
tgctggttaatatatttctg

SEQ ID NO: 464142 - DNA, 20 bp, Artificial
  CRISPR gRNA sequence
ctggttaatatatttctgta

SEQ ID NO: 464143 - DNA, 20 bp, Artificial
  CRISPR gRNA sequence
gagtttcctctcccacataa

SEQ ID NO: 464144 - DNA, 20 bp, Artificial
  CRISPR gRNA sequence
tttcctctcccacataaaag

SEQ ID NO: 464145 - DNA, 20 bp, Artificial
  CRISPR gRNA sequence
tcctctcccacataaaagaa

SEQ ID NO: 464146 - DNA, 20 bp, Artificial
  CRISPR gRNA sequence
aaagaagagcatgcttatat

SEQ ID NO: 464147 - DNA, 20 bp, Artificial
  CRISPR gRNA sequence
cctttcttctctctattata

SEQ ID NO: 464148 - DNA, 20 bp, Artificial
  CRISPR gRNA sequence
tatatagatatatttttgcc

SEQ ID NO: 464149 - DNA, 20 bp, Artificial
  CRISPR gRNA sequence
tttttgcctggtgtatatac

SEQ ID NO: 464150 - DNA, 20 bp, Artificial
  CRISPR gRNA sequence
tatgcaccactgctgatccc

SEQ ID NO: 464151 - DNA, 20 bp, Artificial
  CRISPR gRNA sequence
accactgctgatccctagaa

SEQ ID NO: 464152 - DNA, 20 bp, Artificial
  CRISPR gRNA sequence
ctgatccctagaatggttgt

SEQ ID NO: 464153 - DNA, 20 bp, Artificial
  CRISPR gRNA sequence
tgatccctagaatggttgtt

SEQ ID NO: 464154 - DNA, 20 bp, Artificial
  CRISPR gRNA sequence
gatccctagaatggttgttg

SEQ ID NO: 464155 - DNA, 20 bp, Artificial
  CRISPR gRNA sequence
atccctagaatggttgttgg

SEQ ID NO: 464156 - DNA, 20 bp, Artificial
  CRISPR gRNA sequence
ttgttgggggtaatttttca

SEQ ID NO: 464157 - DNA, 20 bp, Artificial
  CRISPR gRNA sequence
ttgggggtaatttttcacag

SEQ ID NO: 464158 - DNA, 20 bp, Artificial
  CRISPR gRNA sequence
gggggtaatttttcacagca

SEQ ID NO: 464159 - DNA, 20 bp, Artificial
  CRISPR gRNA sequence
catcttgtctttaccattca

SEQ ID NO: 464160 - DNA, 20 bp, Artificial
  CRISPR gRNA sequence
atcttgtctttaccattcat

SEQ ID NO: 464161 - DNA, 20 bp, Artificial
  CRISPR gRNA sequence
attcataggctttacacctc

SEQ ID NO: 464162 - DNA, 20 bp, Artificial
  CRISPR gRNA sequence
tttccctaaattcatcctat

SEQ ID NO: 464163 - DNA, 20 bp, Artificial
  CRISPR gRNA sequence
tcagaaaacataataatatc

SEQ ID NO: 464164 - DNA, 20 bp, Artificial
  CRISPR gRNA sequence
ttatgttgttgttatgtgcc

SEQ ID NO: 464165 - DNA, 20 bp, Artificial
  CRISPR gRNA sequence
ttgttgttatgtgccaagca

SEQ ID NO: 464166 - DNA, 20 bp, Artificial
  CRISPR gRNA sequence
tatgtgccaagcatagtgct

SEQ ID NO: 464167 - DNA, 20 bp, Artificial
  CRISPR gRNA sequence
tgctttcacaacaaccctac

SEQ ID NO: 464168 - DNA, 20 bp, Artificial
  CRISPR gRNA sequence
tcacaacaaccctactggat

SEQ ID NO: 464169 - DNA, 20 bp, Artificial
  CRISPR gRNA sequence
acaacaaccctactggataa

SEQ ID NO: 464170 - DNA, 20 bp, Artificial
  CRISPR gRNA sequence
ctggataagagcttgtgctt

SEQ ID NO: 464171 - DNA, 20 bp, Artificial
  CRISPR gRNA sequence
ggataagagcttgtgctttg

SEQ ID NO: 464172 - DNA, 20 bp, Artificial
  CRISPR gRNA sequence
aagagcttgtgctttggagt

SEQ ID NO: 464173 - DNA, 20 bp, Artificial
  CRISPR gRNA sequence
gctttggagttagccacacc

SEQ ID NO: 464174 - DNA, 20 bp, Artificial
  CRISPR gRNA sequence
ctttggagttagccacacct

SEQ ID NO: 464175 - DNA, 20 bp, Artificial
  CRISPR gRNA sequence
agttagccacacctgggtta

SEQ ID NO: 464176 - DNA, 20 bp, Artificial
  CRISPR gRNA sequence
ccacacctgggttaaagtcc

SEQ ID NO: 464177 - DNA, 20 bp, Artificial
  CRISPR gRNA sequence
gccttgactcttcctcctac

SEQ ID NO: 464178 - DNA, 20 bp, Artificial
  CRISPR gRNA sequence
tgactcttcctcctaccagc

SEQ ID NO: 464179 - DNA, 20 bp, Artificial
  CRISPR gRNA sequence
ctcctaccagctggtgatct

SEQ ID NO: 464180 - DNA, 20 bp, Artificial
  CRISPR gRNA sequence
tcctaccagctggtgatctt

SEQ ID NO: 464181 - DNA, 20 bp, Artificial
  CRISPR gRNA sequence
accagctggtgatcttgggc

SEQ ID NO: 464182 - DNA, 20 bp, Artificial
  CRISPR gRNA sequence
agctggtgatcttgggcaag

SEQ ID NO: 464183 - DNA, 20 bp, Artificial
  CRISPR gRNA sequence
ggcttatattctctaatacc

SEQ ID NO: 464184 - DNA, 20 bp, Artificial
  CRISPR gRNA sequence
ttcctcaacttaaaaaaata

SEQ ID NO: 464185 - DNA, 20 bp, Artificial
  CRISPR gRNA sequence
tcctcaacttaaaaaaataa

SEQ ID NO: 464186 - DNA, 20 bp, Artificial
  CRISPR gRNA sequence
taaaaaaataaaggccataa

SEQ ID NO: 464187 - DNA, 20 bp, Artificial
  CRISPR gRNA sequence
ttccctcataaaatcattgt

SEQ ID NO: 464188 - DNA, 20 bp, Artificial
  CRISPR gRNA sequence
tccctcataaaatcattgtg

SEQ ID NO: 464189 - DNA, 20 bp, Artificial
  CRISPR gRNA sequence
ccctcataaaatcattgtga

SEQ ID NO: 464190 - DNA, 20 bp, Artificial
  CRISPR gRNA sequence
caaatgaaacaatacatgtt

SEQ ID NO: 464191 - DNA, 20 bp, Artificial
  CRISPR gRNA sequence
aatacatgtttggtatctaa

SEQ ID NO: 464192 - DNA, 20 bp, Artificial
  CRISPR gRNA sequence
aaaagtgcctacctcataat

SEQ ID NO: 464193 - DNA, 20 bp, Artificial
  CRISPR gRNA sequence
aataagaactttgaaaatat

SEQ ID NO: 464194 - DNA, 20 bp, Artificial
  CRISPR gRNA sequence
attctttttttcctcgtgtt

SEQ ID NO: 464195 - DNA, 20 bp, Artificial
  CRISPR gRNA sequence
tttttttcctcgtgttaaga

SEQ ID NO: 464196 - DNA, 20 bp, Artificial
  CRISPR gRNA sequence
tcctcgtgttaagatggatc

SEQ ID NO: 464197 - DNA, 20 bp, Artificial
  CRISPR gRNA sequence
cctcgtgttaagatggatct

SEQ ID NO: 464198 - DNA, 20 bp, Artificial
  CRISPR gRNA sequence
gtgttaagatggatctaggt

SEQ ID NO: 464199 - DNA, 20 bp, Artificial
  CRISPR gRNA sequence
tgttaagatggatctaggtt

SEQ ID NO: 464200 - DNA, 20 bp, Artificial
  CRISPR gRNA sequence
atggatctaggttgggtcta

SEQ ID NO: 464201 - DNA, 20 bp, Artificial
  CRISPR gRNA sequence
taggttgggtctacagtata

SEQ ID NO: 464202 - DNA, 20 bp, Artificial
  CRISPR gRNA sequence
ctacagtatatagataatgt

SEQ ID NO: 464203 - DNA, 20 bp, Artificial
  CRISPR gRNA sequence
tacagtatatagataatgtg

SEQ ID NO: 464204 - DNA, 20 bp, Artificial
  CRISPR gRNA sequence
agtatatagataatgtgagg

SEQ ID NO: 464205 - DNA, 20 bp, Artificial
  CRISPR gRNA sequence
tatatagataatgtgaggtg

SEQ ID NO: 464206 - DNA, 20 bp, Artificial
  CRISPR gRNA sequence
tgtgaggtggagtgtacctg

SEQ ID NO: 464207 - DNA, 20 bp, Artificial
  CRISPR gRNA sequence
gtgaggtggagtgtacctgt

SEQ ID NO: 464208 - DNA, 20 bp, Artificial
  CRISPR gRNA sequence
ggtggagtgtacctgtgggc

SEQ ID NO: 464209 - DNA, 20 bp, Artificial
  CRISPR gRNA sequence
ggagtgtacctgtgggcaag

SEQ ID NO: 464210 - DNA, 20 bp, Artificial
  CRISPR gRNA sequence
gtacctgtgggcaagtggca

SEQ ID NO: 464211 - DNA, 20 bp, Artificial
  CRISPR gRNA sequence
ggcaagtggcaaagaatgtg

SEQ ID NO: 464212 - DNA, 20 bp, Artificial
  CRISPR gRNA sequence
aagtggcaaagaatgtgtag

SEQ ID NO: 464213 - DNA, 20 bp, Artificial
  CRISPR gRNA sequence
agaatgtgtagcagtgattc

SEQ ID NO: 464214 - DNA, 20 bp, Artificial
  CRISPR gRNA sequence
aatgtgtagcagtgattcta

SEQ ID NO: 464215 - DNA, 20 bp, Artificial
  CRISPR gRNA sequence
atgtgtagcagtgattctag

SEQ ID NO: 464216 - DNA, 20 bp, Artificial
  CRISPR gRNA sequence
atgtaacttaaactttccat

SEQ ID NO: 464217 - DNA, 20 bp, Artificial
  CRISPR gRNA sequence
tgtaacttaaactttccatt

SEQ ID NO: 464218 - DNA, 20 bp, Artificial
  CRISPR gRNA sequence
catctgacctcatgacctct

SEQ ID NO: 464219 - DNA, 20 bp, Artificial
  CRISPR gRNA sequence
atctgacctcatgacctcta

SEQ ID NO: 464220 - DNA, 20 bp, Artificial
  CRISPR gRNA sequence
gttctactcttaaatatctc

SEQ ID NO: 464221 - DNA, 20 bp, Artificial
  CRISPR gRNA sequence
ttctactcttaaatatctca

SEQ ID NO: 464222 - DNA, 20 bp, Artificial
  CRISPR gRNA sequence
ctactcttaaatatctcaag

SEQ ID NO: 464223 - DNA, 20 bp, Artificial
  CRISPR gRNA sequence
actcttaaatatctcaagga

SEQ ID NO: 464224 - DNA, 20 bp, Artificial
  CRISPR gRNA sequence
ctcttaaatatctcaaggag

SEQ ID NO: 464225 - DNA, 20 bp, Artificial
  CRISPR gRNA sequence
ctcaaggagaggaaatgaca

SEQ ID NO: 464226 - DNA, 20 bp, Artificial
  CRISPR gRNA sequence
tcaaggagaggaaatgacat

SEQ ID NO: 464227 - DNA, 20 bp, Artificial
  CRISPR gRNA sequence
caaggagaggaaatgacatg

SEQ ID NO: 464228 - DNA, 20 bp, Artificial
  CRISPR gRNA sequence
aaatgacatggggactttgt

SEQ ID NO: 464229 - DNA, 20 bp, Artificial
  CRISPR gRNA sequence
ttgtaagctttgctaaatgt

SEQ ID NO: 464230 - DNA, 20 bp, Artificial
  CRISPR gRNA sequence
gctttgctaaatgtcggaaa

SEQ ID NO: 464231 - DNA, 20 bp, Artificial
  CRISPR gRNA sequence
gaaaaagcaatgacaaatac

SEQ ID NO: 464232 - DNA, 20 bp, Artificial
  CRISPR gRNA sequence
aatactagaatgactgattt

SEQ ID NO: 464233 - DNA, 20 bp, Artificial
  CRISPR gRNA sequence
tgactgattttagacaaaac

SEQ ID NO: 464234 - DNA, 20 bp, Artificial
  CRISPR gRNA sequence
gattttagacaaaacaagtt

SEQ ID NO: 464235 - DNA, 20 bp, Artificial
  CRISPR gRNA sequence
atttcaaacatgataaaatc

SEQ ID NO: 464236 - DNA, 20 bp, Artificial
  CRISPR gRNA sequence
ttcaaacatgataaaatcaa

SEQ ID NO: 464237 - DNA, 20 bp, Artificial
  CRISPR gRNA sequence
catgataaaatcaagagata

SEQ ID NO: 464238 - DNA, 20 bp, Artificial
  CRISPR gRNA sequence
tgataaaatcaagagataca

SEQ ID NO: 464239 - DNA, 20 bp, Artificial
  CRISPR gRNA sequence
atcaagagatacagagctta

SEQ ID NO: 464240 - DNA, 20 bp, Artificial
  CRISPR gRNA sequence
gatacagagcttaaagtctt

SEQ ID NO: 464241 - DNA, 20 bp, Artificial
  CRISPR gRNA sequence
acagagcttaaagtcttcag

SEQ ID NO: 464242 - DNA, 20 bp, Artificial
  CRISPR gRNA sequence
ggctcaatacaactgcattg

SEQ ID NO: 464243 - DNA, 20 bp, Artificial
  CRISPR gRNA sequence
ctcaatacaactgcattgaa

SEQ ID NO: 464244 - DNA, 20 bp, Artificial
  CRISPR gRNA sequence
tacaactgcattgaagagat

SEQ ID NO: 464245 - DNA, 20 bp, Artificial
  CRISPR gRNA sequence
cttcaaatttacttgccaaa

SEQ ID NO: 464246 - DNA, 20 bp, Artificial
  CRISPR gRNA sequence
agtcatactacactaacaat

SEQ ID NO: 464247 - DNA, 20 bp, Artificial
  CRISPR gRNA sequence
acaatgagaaattctaactg

SEQ ID NO: 464248 - DNA, 20 bp, Artificial
  CRISPR gRNA sequence
atgagaaattctaactgtag

SEQ ID NO: 464249 - DNA, 20 bp, Artificial
  CRISPR gRNA sequence
ctgtagaagaaattgcttta

SEQ ID NO: 464250 - DNA, 20 bp, Artificial
  CRISPR gRNA sequence
agtgtgctaataccatatga

SEQ ID NO: 464251 - DNA, 20 bp, Artificial
  CRISPR gRNA sequence
accatatgaaagtaaactta

SEQ ID NO: 464252 - DNA, 20 bp, Artificial
  CRISPR gRNA sequence
aaaatttcataaatgaatat

SEQ ID NO: 464253 - DNA, 20 bp, Artificial
  CRISPR gRNA sequence
atttcataaatgaatataag

SEQ ID NO: 464254 - DNA, 20 bp, Artificial
  CRISPR gRNA sequence
ataagaagatatgtttttat

SEQ ID NO: 464255 - DNA, 20 bp, Artificial
  CRISPR gRNA sequence
agaagatatgtttttataag

SEQ ID NO: 464256 - DNA, 20 bp, Artificial
  CRISPR gRNA sequence
gaagatatgtttttataaga

SEQ ID NO: 464257 - DNA, 20 bp, Artificial
  CRISPR gRNA sequence
aagatatgtttttataagaa

SEQ ID NO: 464258 - DNA, 20 bp, Artificial
  CRISPR gRNA sequence
agatatgtttttataagaag

SEQ ID NO: 464259 - DNA, 20 bp, Artificial
  CRISPR gRNA sequence
tttataagaaggggattttt

SEQ ID NO: 464260 - DNA, 20 bp, Artificial
  CRISPR gRNA sequence
tataagaaggggatttttaa

SEQ ID NO: 464261 - DNA, 20 bp, Artificial
  CRISPR gRNA sequence
ataagaaggggatttttaag

SEQ ID NO: 464262 - DNA, 20 bp, Artificial
  CRISPR gRNA sequence
ttaagaggaaataataataa

SEQ ID NO: 464263 - DNA, 20 bp, Artificial
  CRISPR gRNA sequence
ctctcaattttcttgtttca

SEQ ID NO: 464264 - DNA, 20 bp, Artificial
  CRISPR gRNA sequence
tgctttttttttttaaataa

SEQ ID NO: 464265 - DNA, 20 bp, Artificial
  CRISPR gRNA sequence
gctttttttttttaaataat

SEQ ID NO: 464266 - DNA, 20 bp, Artificial
  CRISPR gRNA sequence
ttaaataatgggcataaatg

SEQ ID NO: 464267 - DNA, 20 bp, Artificial
  CRISPR gRNA sequence
atttatgccctgtgtattct

SEQ ID NO: 464268 - DNA, 20 bp, Artificial
  CRISPR gRNA sequence
ttcttggcattaatactttc

SEQ ID NO: 464269 - DNA, 20 bp, Artificial
  CRISPR gRNA sequence
tttccagttccatttttgtg

SEQ ID NO: 464270 - DNA, 20 bp, Artificial
  CRISPR gRNA sequence
ttccagttccatttttgtga

SEQ ID NO: 464271 - DNA, 20 bp, Artificial
  CRISPR gRNA sequence
tgtgtgtgtgtgtgtttacc

SEQ ID NO: 464272 - DNA, 20 bp, Artificial
  CRISPR gRNA sequence
gtgtgtgtgtgtgtttaccc

SEQ ID NO: 464273 - DNA, 20 bp, Artificial
  CRISPR gRNA sequence
tgtgtgtgtgtgtttaccca

SEQ ID NO: 464274 - DNA, 20 bp, Artificial
  CRISPR gRNA sequence
tgtgtgtgtgtttacccagg

SEQ ID NO: 464275 - DNA, 20 bp, Artificial
  CRISPR gRNA sequence
gtgtttacccagggagaaaa

SEQ ID NO: 464276 - DNA, 20 bp, Artificial
  CRISPR gRNA sequence
aaaatggctcttcttgtcta

SEQ ID NO: 464277 - DNA, 20 bp, Artificial
  CRISPR gRNA sequence
aatggctcttcttgtctaaa

SEQ ID NO: 464278 - DNA, 20 bp, Artificial
  CRISPR gRNA sequence
tcttgtctaaagagcaatat

SEQ ID NO: 464279 - DNA, 20 bp, Artificial
  CRISPR gRNA sequence
cttgtctaaagagcaatatc

SEQ ID NO: 464280 - DNA, 20 bp, Artificial
  CRISPR gRNA sequence
gcaatatcaggtgatatcca

SEQ ID NO: 464281 - DNA, 20 bp, Artificial
  CRISPR gRNA sequence
aatatcaggtgatatccaca

SEQ ID NO: 464282 - DNA, 20 bp, Artificial
  CRISPR gRNA sequence
aggtgatatccacagagaat

SEQ ID NO: 464283 - DNA, 20 bp, Artificial
  CRISPR gRNA sequence
ttgtctatgatctgtatctt

SEQ ID NO: 464284 - DNA, 20 bp, Artificial
  CRISPR gRNA sequence
gtatctttagtgttgttttt

SEQ ID NO: 464285 - DNA, 20 bp, Artificial
  CRISPR gRNA sequence
tatctttagtgttgtttttc

SEQ ID NO: 464286 - DNA, 20 bp, Artificial
  CRISPR gRNA sequence
tttagtgttgtttttcagga

SEQ ID NO: 464287 - DNA, 20 bp, Artificial
  CRISPR gRNA sequence
gtaaataaactttcatttta

SEQ ID NO: 464288 - DNA, 20 bp, Artificial
  CRISPR gRNA sequence
aataaactttcattttacag

SEQ ID NO: 464289 - DNA, 20 bp, Artificial
  CRISPR gRNA sequence
ataaactttcattttacaga

SEQ ID NO: 464290 - DNA, 20 bp, Artificial
  CRISPR gRNA sequence
taaactttcattttacagaa

SEQ ID NO: 464291 - DNA, 20 bp, Artificial
  CRISPR gRNA sequence
ttcattttacagaagggact

SEQ ID NO: 464292 - DNA, 20 bp, Artificial
  CRISPR gRNA sequence
tcattttacagaagggactg

SEQ ID NO: 464293 - DNA, 20 bp, Artificial
  CRISPR gRNA sequence
cattttacagaagggactga

SEQ ID NO: 464294 - DNA, 20 bp, Artificial
  CRISPR gRNA sequence
ttacagaagggactgagggc

SEQ ID NO: 464295 - DNA, 20 bp, Artificial
  CRISPR gRNA sequence
agaagggactgagggccagt

SEQ ID NO: 464296 - DNA, 20 bp, Artificial
  CRISPR gRNA sequence
tcagttttcactgtactcgt

SEQ ID NO: 464297 - DNA, 20 bp, Artificial
  CRISPR gRNA sequence
tgtactcgtgagaacaatca

SEQ ID NO: 464298 - DNA, 20 bp, Artificial
  CRISPR gRNA sequence
gtactcgtgagaacaatcac

SEQ ID NO: 464299 - DNA, 20 bp, Artificial
  CRISPR gRNA sequence
tactcgtgagaacaatcaca

SEQ ID NO: 464300 - DNA, 20 bp, Artificial
  CRISPR gRNA sequence
caatcacagggttttcctta

SEQ ID NO: 464301 - DNA, 20 bp, Artificial
  CRISPR gRNA sequence
ggttttccttaaagtaacaa

SEQ ID NO: 464302 - DNA, 20 bp, Artificial
  CRISPR gRNA sequence
aacaatagtcacttttacaa

SEQ ID NO: 464303 - DNA, 20 bp, Artificial
  CRISPR gRNA sequence
aatagtcacttttacaaaag

SEQ ID NO: 464304 - DNA, 20 bp, Artificial
  CRISPR gRNA sequence
catacttacttaattttctc

SEQ ID NO: 464305 - DNA, 20 bp, Artificial
  CRISPR gRNA sequence
atacttacttaattttctcc

SEQ ID NO: 464306 - DNA, 20 bp, Artificial
  CRISPR gRNA sequence
taattttctccaggtattcc

SEQ ID NO: 464307 - DNA, 20 bp, Artificial
  CRISPR gRNA sequence
caggtattcctagtacttct

SEQ ID NO: 464308 - DNA, 20 bp, Artificial
  CRISPR gRNA sequence
ttctgagaatatctgactta

SEQ ID NO: 464309 - DNA, 20 bp, Artificial
  CRISPR gRNA sequence
ctgagaatatctgacttatg

SEQ ID NO: 464310 - DNA, 20 bp, Artificial
  CRISPR gRNA sequence
agaatatctgacttatggag

SEQ ID NO: 464311 - DNA, 20 bp, Artificial
  CRISPR gRNA sequence
atggagtggtttatttacca

SEQ ID NO: 464312 - DNA, 20 bp, Artificial
  CRISPR gRNA sequence
ggagtggtttatttaccaca

SEQ ID NO: 464313 - DNA, 20 bp, Artificial
  CRISPR gRNA sequence
gtttatttaccacagagtta

SEQ ID NO: 464314 - DNA, 20 bp, Artificial
  CRISPR gRNA sequence
agttaaagtaatacctttaa

SEQ ID NO: 464315 - DNA, 20 bp, Artificial
  CRISPR gRNA sequence
taaatgaatactttctatat

SEQ ID NO: 464316 - DNA, 20 bp, Artificial
  CRISPR gRNA sequence
aaatgaatactttctatatg

SEQ ID NO: 464317 - DNA, 20 bp, Artificial
  CRISPR gRNA sequence
tgaatactttctatatgagg

SEQ ID NO: 464318 - DNA, 20 bp, Artificial
  CRISPR gRNA sequence
caccacatttctgattttgt

SEQ ID NO: 464319 - DNA, 20 bp, Artificial
  CRISPR gRNA sequence
ctgattttgtgagtgtatgt

SEQ ID NO: 464320 - DNA, 20 bp, Artificial
  CRISPR gRNA sequence
ttttgtgagtgtatgtgagc

SEQ ID NO: 464321 - DNA, 20 bp, Artificial
  CRISPR gRNA sequence
gtatgtgagctagtttatga

SEQ ID NO: 464322 - DNA, 20 bp, Artificial
  CRISPR gRNA sequence
tatgtgagctagtttatgat

SEQ ID NO: 464323 - DNA, 20 bp, Artificial
  CRISPR gRNA sequence
tgagctagtttatgatggga

SEQ ID NO: 464324 - DNA, 20 bp, Artificial
  CRISPR gRNA sequence
tgatgggaaagtatgctacc

SEQ ID NO: 464325 - DNA, 20 bp, Artificial
  CRISPR gRNA sequence
gatgggaaagtatgctacct

SEQ ID NO: 464326 - DNA, 20 bp, Artificial
  CRISPR gRNA sequence
tgtcgtccgtgtgatttccc

SEQ ID NO: 464327 - DNA, 20 bp, Artificial
  CRISPR gRNA sequence
gtcgtccgtgtgatttccca

SEQ ID NO: 464328 - DNA, 20 bp, Artificial
  CRISPR gRNA sequence
tgtgatttcccaaggtatgc

SEQ ID NO: 464329 - DNA, 20 bp, Artificial
  CRISPR gRNA sequence
atgcaagtcaatgtcctccc

SEQ ID NO: 464330 - DNA, 20 bp, Artificial
  CRISPR gRNA sequence
atgtcctcccaagatccttg

SEQ ID NO: 464331 - DNA, 20 bp, Artificial
  CRISPR gRNA sequence
ctcccaagatccttgaagta

SEQ ID NO: 464332 - DNA, 20 bp, Artificial
  CRISPR gRNA sequence
atccttgaagtatggttcca

SEQ ID NO: 464333 - DNA, 20 bp, Artificial
  CRISPR gRNA sequence
atggctgctattgctgtgtg

SEQ ID NO: 464334 - DNA, 20 bp, Artificial
  CRISPR gRNA sequence
atgtacaaaccactgcctta

SEQ ID NO: 464335 - DNA, 20 bp, Artificial
  CRISPR gRNA sequence
tgtacaaaccactgccttat

SEQ ID NO: 464336 - DNA, 20 bp, Artificial
  CRISPR gRNA sequence
gatccctaaactctaatttc

SEQ ID NO: 464337 - DNA, 20 bp, Artificial
  CRISPR gRNA sequence
atccctaaactctaatttca

SEQ ID NO: 464338 - DNA, 20 bp, Artificial
  CRISPR gRNA sequence
tccctaaactctaatttcaa

SEQ ID NO: 464339 - DNA, 20 bp, Artificial
  CRISPR gRNA sequence
ctaaactctaatttcaaggg

SEQ ID NO: 464340 - DNA, 20 bp, Artificial
  CRISPR gRNA sequence
ctaatttcaagggaagattt

SEQ ID NO: 464341 - DNA, 20 bp, Artificial
  CRISPR gRNA sequence
aatttcaagggaagatttga

SEQ ID NO: 464342 - DNA, 20 bp, Artificial
  CRISPR gRNA sequence
tcaagggaagatttgagaga

SEQ ID NO: 464343 - DNA, 20 bp, Artificial
  CRISPR gRNA sequence
gacagattatttcccttccc

SEQ ID NO: 464344 - DNA, 20 bp, Artificial
  CRISPR gRNA sequence
agattatttcccttccctgg

SEQ ID NO: 464345 - DNA, 20 bp, Artificial
  CRISPR gRNA sequence
tcccctcctctctaccattc

SEQ ID NO: 464346 - DNA, 20 bp, Artificial
  CRISPR gRNA sequence
tctaccattccagccttcta

SEQ ID NO: 464347 - DNA, 20 bp, Artificial
  CRISPR gRNA sequence
ccattccagccttctaaagt

SEQ ID NO: 464348 - DNA, 20 bp, Artificial
  CRISPR gRNA sequence
cattccagccttctaaagta

SEQ ID NO: 464349 - DNA, 20 bp, Artificial
  CRISPR gRNA sequence
tccagccttctaaagtaagg

SEQ ID NO: 464350 - DNA, 20 bp, Artificial
  CRISPR gRNA sequence
gtaaggcagaacataccatc

SEQ ID NO: 464351 - DNA, 20 bp, Artificial
  CRISPR gRNA sequence
ctggatgcctttttgctcct

SEQ ID NO: 464352 - DNA, 20 bp, Artificial
  CRISPR gRNA sequence
cctttttgctcctgagtgta

SEQ ID NO: 464353 - DNA, 20 bp, Artificial
  CRISPR gRNA sequence
taaagacttcattccttctg

SEQ ID NO: 464354 - DNA, 20 bp, Artificial
  CRISPR gRNA sequence
cattccttctgtagcctccc

SEQ ID NO: 464355 - DNA, 20 bp, Artificial
  CRISPR gRNA sequence
gcctccccagcatgcgtctg

SEQ ID NO: 464356 - DNA, 20 bp, Artificial
  CRISPR gRNA sequence
ccagcatgcgtctgaagttt

SEQ ID NO: 464357 - DNA, 20 bp, Artificial
  CRISPR gRNA sequence
tgcttgttgtttgtctgtga

SEQ ID NO: 464358 - DNA, 20 bp, Artificial
  CRISPR gRNA sequence
tctgtgatagtattttctga

SEQ ID NO: 464359 - DNA, 20 bp, Artificial
  CRISPR gRNA sequence
gtgatagtattttctgatag

SEQ ID NO: 464360 - DNA, 20 bp, Artificial
  CRISPR gRNA sequence
tctgatagaagctaaaatcc

SEQ ID NO: 464361 - DNA, 20 bp, Artificial
  CRISPR gRNA sequence
taaaatcctggttgatgtca

SEQ ID NO: 464362 - DNA, 20 bp, Artificial
  CRISPR gRNA sequence
ttgatgtcacagaaaattat

SEQ ID NO: 464363 - DNA, 20 bp, Artificial
  CRISPR gRNA sequence
ttattggtttattataccgt

SEQ ID NO: 464364 - DNA, 20 bp, Artificial
  CRISPR gRNA sequence
tataccgttagtaatcattt

SEQ ID NO: 464365 - DNA, 20 bp, Artificial
  CRISPR gRNA sequence
gttaaactctgacactttct

SEQ ID NO: 464366 - DNA, 20 bp, Artificial
  CRISPR gRNA sequence
ctctgacactttcttagctc

SEQ ID NO: 464367 - DNA, 20 bp, Artificial
  CRISPR gRNA sequence
acactttcttagctcaagtt

SEQ ID NO: 464368 - DNA, 20 bp, Artificial
  CRISPR gRNA sequence
cactttcttagctcaagtta

SEQ ID NO: 464369 - DNA, 20 bp, Artificial
  CRISPR gRNA sequence
aaggcaatctgcattcatta

SEQ ID NO: 464370 - DNA, 20 bp, Artificial
  CRISPR gRNA sequence
cagtcattcatttatttgaa

SEQ ID NO: 464371 - DNA, 20 bp, Artificial
  CRISPR gRNA sequence
gaatggttgcaaccactttg

SEQ ID NO: 464372 - DNA, 20 bp, Artificial
  CRISPR gRNA sequence
tgaagtttccataaatttgt

SEQ ID NO: 464373 - DNA, 20 bp, Artificial
  CRISPR gRNA sequence
aatttgtaagaatttttcaa

SEQ ID NO: 464374 - DNA, 20 bp, Artificial
  CRISPR gRNA sequence
tttgtaagaatttttcaatg

SEQ ID NO: 464375 - DNA, 20 bp, Artificial
  CRISPR gRNA sequence
agaatttttcaatggagaca

SEQ ID NO: 464376 - DNA, 20 bp, Artificial
  CRISPR gRNA sequence
aatggagacatagtgaaact

SEQ ID NO: 464377 - DNA, 20 bp, Artificial
  CRISPR gRNA sequence
atggagacatagtgaaactc

SEQ ID NO: 464378 - DNA, 20 bp, Artificial
  CRISPR gRNA sequence
agacatagtgaaactcaggt

SEQ ID NO: 464379 - DNA, 20 bp, Artificial
  CRISPR gRNA sequence
tgagattttcctcatgataa

SEQ ID NO: 464380 - DNA, 20 bp, Artificial
  CRISPR gRNA sequence
atggttataatcaaaacata

SEQ ID NO: 464381 - DNA, 20 bp, Artificial
  CRISPR gRNA sequence
aacatatggtatttaaaaat

SEQ ID NO: 464382 - DNA, 20 bp, Artificial
  CRISPR gRNA sequence
taaccctctttttttttaaa

SEQ ID NO: 464383 - DNA, 20 bp, Artificial
  CRISPR gRNA sequence
tttttttttaaatggctgat

SEQ ID NO: 464384 - DNA, 20 bp, Artificial
  CRISPR gRNA sequence
caaaaattacctactctctt

SEQ ID NO: 464385 - DNA, 20 bp, Artificial
  CRISPR gRNA sequence
attacctactctcttcagct

SEQ ID NO: 464386 - DNA, 20 bp, Artificial
  CRISPR gRNA sequence
gctcagcaactacacttgct

SEQ ID NO: 464387 - DNA, 20 bp, Artificial
  CRISPR gRNA sequence
agcaactacacttgctcagc

SEQ ID NO: 464388 - DNA, 20 bp, Artificial
  CRISPR gRNA sequence
gcaactacacttgctcagct

SEQ ID NO: 464389 - DNA, 20 bp, Artificial
  CRISPR gRNA sequence
aactacacttgctcagctgg

SEQ ID NO: 464390 - DNA, 20 bp, Artificial
  CRISPR gRNA sequence
cttgctcagctgggagttac

SEQ ID NO: 464391 - DNA, 20 bp, Artificial
  CRISPR gRNA sequence
ctgggagttacgagactata

SEQ ID NO: 464392 - DNA, 20 bp, Artificial
  CRISPR gRNA sequence
cgagactatacagttgtttg

SEQ ID NO: 464393 - DNA, 20 bp, Artificial
  CRISPR gRNA sequence
actatacagttgtttgtggc

SEQ ID NO: 464394 - DNA, 20 bp, Artificial
  CRISPR gRNA sequence
ggctggcactcctttctgat

SEQ ID NO: 464395 - DNA, 20 bp, Artificial
  CRISPR gRNA sequence
ttctgatcagctgatctgtg

SEQ ID NO: 464396 - DNA, 20 bp, Artificial
  CRISPR gRNA sequence
gatcagctgatctgtgtagc

SEQ ID NO: 464397 - DNA, 20 bp, Artificial
  CRISPR gRNA sequence
agctgatctgtgtagctgga

SEQ ID NO: 464398 - DNA, 20 bp, Artificial
  CRISPR gRNA sequence
tctgtgtagctggatggcca

SEQ ID NO: 464399 - DNA, 20 bp, Artificial
  CRISPR gRNA sequence
tgtgtagctggatggccatg

SEQ ID NO: 464400 - DNA, 20 bp, Artificial
  CRISPR gRNA sequence
tatttttaatatccacccct

SEQ ID NO: 464401 - DNA, 20 bp, Artificial
  CRISPR gRNA sequence
ttttaatatccacccctgag

SEQ ID NO: 464402 - DNA, 20 bp, Artificial
  CRISPR gRNA sequence
acccctgagtggacataaat

SEQ ID NO: 464403 - DNA, 20 bp, Artificial
  CRISPR gRNA sequence
cccctgagtggacataaatc

SEQ ID NO: 464404 - DNA, 20 bp, Artificial
  CRISPR gRNA sequence
tttcaaactgaatacttgta

SEQ ID NO: 464405 - DNA, 20 bp, Artificial
  CRISPR gRNA sequence
aactgaatacttgtaaagtc

SEQ ID NO: 464406 - DNA, 20 bp, Artificial
  CRISPR gRNA sequence
tgtaaagtctagcttttctt

SEQ ID NO: 464407 - DNA, 20 bp, Artificial
  CRISPR gRNA sequence
aaagtctagcttttctttgg

SEQ ID NO: 464408 - DNA, 20 bp, Artificial
  CRISPR gRNA sequence
agttataacttaaccactgt

SEQ ID NO: 464409 - DNA, 20 bp, Artificial
  CRISPR gRNA sequence
gttataacttaaccactgta

SEQ ID NO: 464410 - DNA, 20 bp, Artificial
  CRISPR gRNA sequence
taaccactgtaaggtatgtt

SEQ ID NO: 464411 - DNA, 20 bp, Artificial
  CRISPR gRNA sequence
gctgcatatgttcttcacct

SEQ ID NO: 464412 - DNA, 20 bp, Artificial
  CRISPR gRNA sequence
ttcttcacctcagtgccttt

SEQ ID NO: 464413 - DNA, 20 bp, Artificial
  CRISPR gRNA sequence
gccttttagcccacctctct

SEQ ID NO: 464414 - DNA, 20 bp, Artificial
  CRISPR gRNA sequence
ccttttagcccacctctcta

SEQ ID NO: 464415 - DNA, 20 bp, Artificial
  CRISPR gRNA sequence
cttttagcccacctctctaa

SEQ ID NO: 464416 - DNA, 20 bp, Artificial
  CRISPR gRNA sequence
agcccacctctctaagggct

SEQ ID NO: 464417 - DNA, 20 bp, Artificial
  CRISPR gRNA sequence
agctgtctctgctgtgcaac

SEQ ID NO: 464418 - DNA, 20 bp, Artificial
  CRISPR gRNA sequence
gctgtgcaaccagtactaca

SEQ ID NO: 464419 - DNA, 20 bp, Artificial
  CRISPR gRNA sequence
tgcaaccagtactacataga

SEQ ID NO: 464420 - DNA, 20 bp, Artificial
  CRISPR gRNA sequence
gcaaccagtactacatagaa

SEQ ID NO: 464421 - DNA, 20 bp, Artificial
  CRISPR gRNA sequence
tagaaaggtaacacaccatc

SEQ ID NO: 464422 - DNA, 20 bp, Artificial
  CRISPR gRNA sequence
agaaaggtaacacaccatca

SEQ ID NO: 464423 - DNA, 20 bp, Artificial
  CRISPR gRNA sequence
aaggtaacacaccatcaagg

SEQ ID NO: 464424 - DNA, 20 bp, Artificial
  CRISPR gRNA sequence
gtaacacaccatcaaggaag

SEQ ID NO: 464425 - DNA, 20 bp, Artificial
  CRISPR gRNA sequence
acacaccatcaaggaagtag

SEQ ID NO: 464426 - DNA, 20 bp, Artificial
  CRISPR gRNA sequence
ccatcaaggaagtagcagac

SEQ ID NO: 464427 - DNA, 20 bp, Artificial
  CRISPR gRNA sequence
caaggaagtagcagactaga

SEQ ID NO: 464428 - DNA, 20 bp, Artificial
  CRISPR gRNA sequence
ggaagtagcagactagatag

SEQ ID NO: 464429 - DNA, 20 bp, Artificial
  CRISPR gRNA sequence
gtagcagactagatagaaga

SEQ ID NO: 464430 - DNA, 20 bp, Artificial
  CRISPR gRNA sequence
cagaaacatgaacacatatg

SEQ ID NO: 464431 - DNA, 20 bp, Artificial
  CRISPR gRNA sequence
tgaacacatatgtagttata

SEQ ID NO: 464432 - DNA, 20 bp, Artificial
  CRISPR gRNA sequence
aacacatatgtagttataaa

SEQ ID NO: 464433 - DNA, 20 bp, Artificial
  CRISPR gRNA sequence
ttataaagagtgatgcatgt

SEQ ID NO: 464434 - DNA, 20 bp, Artificial
  CRISPR gRNA sequence
aaagagtgatgcatgtcggc

SEQ ID NO: 464435 - DNA, 20 bp, Artificial
  CRISPR gRNA sequence
aagagtgatgcatgtcggct

SEQ ID NO: 464436 - DNA, 20 bp, Artificial
  CRISPR gRNA sequence
tgatgcatgtcggctgggtg

SEQ ID NO: 464437 - DNA, 20 bp, Artificial
  CRISPR gRNA sequence
tgcatgtcggctgggtgcgg

SEQ ID NO: 464438 - DNA, 20 bp, Artificial
  CRISPR gRNA sequence
gtggctcatgcctgtaatac

SEQ ID NO: 464439 - DNA, 20 bp, Artificial
  CRISPR gRNA sequence
tgcctgtaatactagcactt

SEQ ID NO: 464440 - DNA, 20 bp, Artificial
  CRISPR gRNA sequence
gcctgtaatactagcacttt

SEQ ID NO: 464441 - DNA, 20 bp, Artificial
  CRISPR gRNA sequence
ctgtaatactagcactttgg

SEQ ID NO: 464442 - DNA, 20 bp, Artificial
  CRISPR gRNA sequence
tgtaatactagcactttggg

SEQ ID NO: 464443 - DNA, 20 bp, Artificial
  CRISPR gRNA sequence
tactagcactttgggaggcc

SEQ ID NO: 464444 - DNA, 20 bp, Artificial
  CRISPR gRNA sequence
actagcactttgggaggcca

SEQ ID NO: 464445 - DNA, 20 bp, Artificial
  CRISPR gRNA sequence
agcactttgggaggccaagg

SEQ ID NO: 464446 - DNA, 20 bp, Artificial
  CRISPR gRNA sequence
gcactttgggaggccaaggc

SEQ ID NO: 464447 - DNA, 20 bp, Artificial
  CRISPR gRNA sequence
ctttgggaggccaaggcggg

SEQ ID NO: 464448 - DNA, 20 bp, Artificial
  CRISPR gRNA sequence
ggccaaggcgggtggatcac

SEQ ID NO: 464449 - DNA, 20 bp, Artificial
  CRISPR gRNA sequence
gccaaggcgggtggatcaca

SEQ ID NO: 464450 - DNA, 20 bp, Artificial
  CRISPR gRNA sequence
aggcgggtggatcacaaggt

SEQ ID NO: 464451 - DNA, 20 bp, Artificial
  CRISPR gRNA sequence
ggcgggtggatcacaaggtc

SEQ ID NO: 464452 - DNA, 20 bp, Artificial
  CRISPR gRNA sequence
cgggtggatcacaaggtcag

SEQ ID NO: 464453 - DNA, 20 bp, Artificial
  CRISPR gRNA sequence
gatcacaaggtcaggagttc

SEQ ID NO: 464454 - DNA, 20 bp, Artificial
  CRISPR gRNA sequence
caaggtcaggagttcaagac

SEQ ID NO: 464455 - DNA, 20 bp, Artificial
  CRISPR gRNA sequence
tcaggagttcaagaccagcc

SEQ ID NO: 464456 - DNA, 20 bp, Artificial
  CRISPR gRNA sequence
caagaccagcctggccaaca

SEQ ID NO: 464457 - DNA, 20 bp, Artificial
  CRISPR gRNA sequence
ctaaaaatataaaaattccc

SEQ ID NO: 464458 - DNA, 20 bp, Artificial
  CRISPR gRNA sequence
taaaaatataaaaattcccc

SEQ ID NO: 464459 - DNA, 20 bp, Artificial
  CRISPR gRNA sequence
atataaaaattccccgggcg

SEQ ID NO: 464460 - DNA, 20 bp, Artificial
  CRISPR gRNA sequence
taaaaattccccgggcgcag

SEQ ID NO: 464461 - DNA, 20 bp, Artificial
  CRISPR gRNA sequence
aaattccccgggcgcagtgg

SEQ ID NO: 464462 - DNA, 20 bp, Artificial
  CRISPR gRNA sequence
aattccccgggcgcagtggc

SEQ ID NO: 464463 - DNA, 20 bp, Artificial
  CRISPR gRNA sequence
gtggcaggtgcctgtattcc

SEQ ID NO: 464464 - DNA, 20 bp, Artificial
  CRISPR gRNA sequence
gcctgtattcccagctgctc

SEQ ID NO: 464465 - DNA, 20 bp, Artificial
  CRISPR gRNA sequence
ctgtattcccagctgctcca

SEQ ID NO: 464466 - DNA, 20 bp, Artificial
  CRISPR gRNA sequence
tgtattcccagctgctccag

SEQ ID NO: 464467 - DNA, 20 bp, Artificial
  CRISPR gRNA sequence
tcccagctgctccagaggct

SEQ ID NO: 464468 - DNA, 20 bp, Artificial
  CRISPR gRNA sequence
cccagctgctccagaggctg

SEQ ID NO: 464469 - DNA, 20 bp, Artificial
  CRISPR gRNA sequence
agctgctccagaggctgagg

SEQ ID NO: 464470 - DNA, 20 bp, Artificial
  CRISPR gRNA sequence
tgctccagaggctgaggcag

SEQ ID NO: 464471 - DNA, 20 bp, Artificial
  CRISPR gRNA sequence
gcagcagaattgcttgaacc

SEQ ID NO: 464472 - DNA, 20 bp, Artificial
  CRISPR gRNA sequence
gcagaattgcttgaacccgg

SEQ ID NO: 464473 - DNA, 20 bp, Artificial
  CRISPR gRNA sequence
cagaattgcttgaacccggt

SEQ ID NO: 464474 - DNA, 20 bp, Artificial
  CRISPR gRNA sequence
aattgcttgaacccggtggg

SEQ ID NO: 464475 - DNA, 20 bp, Artificial
  CRISPR gRNA sequence
ttgcttgaacccggtgggtg

SEQ ID NO: 464476 - DNA, 20 bp, Artificial
  CRISPR gRNA sequence
tgcttgaacccggtgggtgg

SEQ ID NO: 464477 - DNA, 20 bp, Artificial
  CRISPR gRNA sequence
aacccggtgggtggaggttg

SEQ ID NO: 464478 - DNA, 20 bp, Artificial
  CRISPR gRNA sequence
cggtgggtggaggttgcagt

SEQ ID NO: 464479 - DNA, 20 bp, Artificial
  CRISPR gRNA sequence
ggtggaggttgcagtgagct

SEQ ID NO: 464480 - DNA, 20 bp, Artificial
  CRISPR gRNA sequence
aagatcgcgccactgcactc

SEQ ID NO: 464481 - DNA, 20 bp, Artificial
  CRISPR gRNA sequence
cgcgccactgcactccagcc

SEQ ID NO: 464482 - DNA, 20 bp, Artificial
  CRISPR gRNA sequence
gcgccactgcactccagcct

SEQ ID NO: 464483 - DNA, 20 bp, Artificial
  CRISPR gRNA sequence
ctgcactccagcctgggtga

SEQ ID NO: 464484 - DNA, 20 bp, Artificial
  CRISPR gRNA sequence
gcactccagcctgggtgaca

SEQ ID NO: 464485 - DNA, 20 bp, Artificial
  CRISPR gRNA sequence
tccagcctgggtgacagagc

SEQ ID NO: 464486 - DNA, 20 bp, Artificial
  CRISPR gRNA sequence
tctcaacaacaacaacaaaa

SEQ ID NO: 464487 - DNA, 20 bp, Artificial
  CRISPR gRNA sequence
ctcaacaacaacaacaaaaa

SEQ ID NO: 464488 - DNA, 20 bp, Artificial
  CRISPR gRNA sequence
caacaacaacaacaaaaaag

SEQ ID NO: 464489 - DNA, 20 bp, Artificial
  CRISPR gRNA sequence
gtgatgcatctcacacaaaa

SEQ ID NO: 464490 - DNA, 20 bp, Artificial
  CRISPR gRNA sequence
catctcacacaaaatagcat

SEQ ID NO: 464491 - DNA, 20 bp, Artificial
  CRISPR gRNA sequence
aaatagcatcagacatttgc

SEQ ID NO: 464492 - DNA, 20 bp, Artificial
  CRISPR gRNA sequence
aatagcatcagacatttgct

SEQ ID NO: 464493 - DNA, 20 bp, Artificial
  CRISPR gRNA sequence
atagcatcagacatttgcta

SEQ ID NO: 464494 - DNA, 20 bp, Artificial
  CRISPR gRNA sequence
agcatcagacatttgctagg

SEQ ID NO: 464495 - DNA, 20 bp, Artificial
  CRISPR gRNA sequence
atcagacatttgctagggag

SEQ ID NO: 464496 - DNA, 20 bp, Artificial
  CRISPR gRNA sequence
tcagacatttgctagggagt

SEQ ID NO: 464497 - DNA, 20 bp, Artificial
  CRISPR gRNA sequence
cagacatttgctagggagtg

SEQ ID NO: 464498 - DNA, 20 bp, Artificial
  CRISPR gRNA sequence
ttgctagggagtggggatat

SEQ ID NO: 464499 - DNA, 20 bp, Artificial
  CRISPR gRNA sequence
tgctagggagtggggatatg

SEQ ID NO: 464500 - DNA, 20 bp, Artificial
  CRISPR gRNA sequence
gctagggagtggggatatga

SEQ ID NO: 464501 - DNA, 20 bp, Artificial
  CRISPR gRNA sequence
ggagtggggatatgagggta

SEQ ID NO: 464502 - DNA, 20 bp, Artificial
  CRISPR gRNA sequence
tggggatatgagggtatggt

SEQ ID NO: 464503 - DNA, 20 bp, Artificial
  CRISPR gRNA sequence
gtaagtttgcataaacttac

SEQ ID NO: 464504 - DNA, 20 bp, Artificial
  CRISPR gRNA sequence
taagtttgcataaacttact

SEQ ID NO: 464505 - DNA, 20 bp, Artificial
  CRISPR gRNA sequence
tttgcataaacttactgggc

SEQ ID NO: 464506 - DNA, 20 bp, Artificial
  CRISPR gRNA sequence
ttgcataaacttactgggct

SEQ ID NO: 464507 - DNA, 20 bp, Artificial
  CRISPR gRNA sequence
taaacttactgggctaggcc

SEQ ID NO: 464508 - DNA, 20 bp, Artificial
  CRISPR gRNA sequence
ttactgggctaggcccagtg

SEQ ID NO: 464509 - DNA, 20 bp, Artificial
  CRISPR gRNA sequence
ctgggctaggcccagtgcgg

SEQ ID NO: 464510 - DNA, 20 bp, Artificial
  CRISPR gRNA sequence
gtggctcacgcctgtaatcc

SEQ ID NO: 464511 - DNA, 20 bp, Artificial
  CRISPR gRNA sequence
cgcctgtaatcccagcactt

SEQ ID NO: 464512 - DNA, 20 bp, Artificial
  CRISPR gRNA sequence
gcctgtaatcccagcacttt

SEQ ID NO: 464513 - DNA, 20 bp, Artificial
  CRISPR gRNA sequence
ctgtaatcccagcactttgg

SEQ ID NO: 464514 - DNA, 20 bp, Artificial
  CRISPR gRNA sequence
tcccagcactttgggagccc

SEQ ID NO: 464515 - DNA, 20 bp, Artificial
  CRISPR gRNA sequence
cccagcactttgggagcccg

SEQ ID NO: 464516 - DNA, 20 bp, Artificial
  CRISPR gRNA sequence
agcactttgggagcccgagg

SEQ ID NO: 464517 - DNA, 20 bp, Artificial
  CRISPR gRNA sequence
gcactttgggagcccgaggc

SEQ ID NO: 464518 - DNA, 20 bp, Artificial
  CRISPR gRNA sequence
ctttgggagcccgaggcggg

SEQ ID NO: 464519 - DNA, 20 bp, Artificial
  CRISPR gRNA sequence
gcccgaggcgggcggatcac

SEQ ID NO: 464520 - DNA, 20 bp, Artificial
  CRISPR gRNA sequence
cccgaggcgggcggatcacg

SEQ ID NO: 464521 - DNA, 20 bp, Artificial
  CRISPR gRNA sequence
aggcgggcggatcacgaggt

SEQ ID NO: 464522 - DNA, 20 bp, Artificial
  CRISPR gRNA sequence
ggcgggcggatcacgaggtc

SEQ ID NO: 464523 - DNA, 20 bp, Artificial
  CRISPR gRNA sequence
cgggcggatcacgaggtcag

SEQ ID NO: 464524 - DNA, 20 bp, Artificial
  CRISPR gRNA sequence
gatcacgaggtcaggagatc

SEQ ID NO: 464525 - DNA, 20 bp, Artificial
  CRISPR gRNA sequence
tcaggagatcgagaccatcc

SEQ ID NO: 464526 - DNA, 20 bp, Artificial
  CRISPR gRNA sequence
tcgagaccatcctggttaac

SEQ ID NO: 464527 - DNA, 20 bp, Artificial
  CRISPR gRNA sequence
cgagaccatcctggttaacc

SEQ ID NO: 464528 - DNA, 20 bp, Artificial
  CRISPR gRNA sequence
ctactaaaaatacaaaaaat

SEQ ID NO: 464529 - DNA, 20 bp, Artificial
  CRISPR gRNA sequence
taaaaatacaaaaaattagc

SEQ ID NO: 464530 - DNA, 20 bp, Artificial
  CRISPR gRNA sequence
aaaaatacaaaaaattagcc

SEQ ID NO: 464531 - DNA, 20 bp, Artificial
  CRISPR gRNA sequence
tacaaaaaattagccgggcg

SEQ ID NO: 464532 - DNA, 20 bp, Artificial
  CRISPR gRNA sequence
aaaaaattagccgggcgtgg

SEQ ID NO: 464533 - DNA, 20 bp, Artificial
  CRISPR gRNA sequence
aaattagccgggcgtggtgg

SEQ ID NO: 464534 - DNA, 20 bp, Artificial
  CRISPR gRNA sequence
aattagccgggcgtggtggt

SEQ ID NO: 464535 - DNA, 20 bp, Artificial
  CRISPR gRNA sequence
ggcgtggtggtgggcaccta

SEQ ID NO: 464536 - DNA, 20 bp, Artificial
  CRISPR gRNA sequence
gtggtgggcacctatagtcc

SEQ ID NO: 464537 - DNA, 20 bp, Artificial
  CRISPR gRNA sequence
cacctatagtcccagctact

SEQ ID NO: 464538 - DNA, 20 bp, Artificial
  CRISPR gRNA sequence
acctatagtcccagctactc

SEQ ID NO: 464539 - DNA, 20 bp, Artificial
  CRISPR gRNA sequence
ctatagtcccagctactcag

SEQ ID NO: 464540 - DNA, 20 bp, Artificial
  CRISPR gRNA sequence
tatagtcccagctactcagg

SEQ ID NO: 464541 - DNA, 20 bp, Artificial
  CRISPR gRNA sequence
tcccagctactcaggaggct

SEQ ID NO: 464542 - DNA, 20 bp, Artificial
  CRISPR gRNA sequence
cccagctactcaggaggctg

SEQ ID NO: 464543 - DNA, 20 bp, Artificial
  CRISPR gRNA sequence
agctactcaggaggctgagg

SEQ ID NO: 464544 - DNA, 20 bp, Artificial
  CRISPR gRNA sequence
gctactcaggaggctgaggc

SEQ ID NO: 464545 - DNA, 20 bp, Artificial
  CRISPR gRNA sequence
tactcaggaggctgaggcag

SEQ ID NO: 464546 - DNA, 20 bp, Artificial
  CRISPR gRNA sequence
aggaggctgaggcaggagaa

SEQ ID NO: 464547 - DNA, 20 bp, Artificial
  CRISPR gRNA sequence
gcaggagaatggcgtgaacc

SEQ ID NO: 464548 - DNA, 20 bp, Artificial
  CRISPR gRNA sequence
caggagaatggcgtgaaccc

SEQ ID NO: 464549 - DNA, 20 bp, Artificial
  CRISPR gRNA sequence
ggagaatggcgtgaacccgg

SEQ ID NO: 464550 - DNA, 20 bp, Artificial
  CRISPR gRNA sequence
gagaatggcgtgaacccggg

SEQ ID NO: 464551 - DNA, 20 bp, Artificial
  CRISPR gRNA sequence
gcgtgaacccgggaggcttg

SEQ ID NO: 464552 - DNA, 20 bp, Artificial
  CRISPR gRNA sequence
gaacccgggaggcttgcagt

SEQ ID NO: 464553 - DNA, 20 bp, Artificial
  CRISPR gRNA sequence
cccgggaggcttgcagtgag

SEQ ID NO: 464554 - DNA, 20 bp, Artificial
  CRISPR gRNA sequence
cgggaggcttgcagtgagcg

SEQ ID NO: 464555 - DNA, 20 bp, Artificial
  CRISPR gRNA sequence
gagattgcgccactgcactc

SEQ ID NO: 464556 - DNA, 20 bp, Artificial
  CRISPR gRNA sequence
tgcgccactgcactccagcc

SEQ ID NO: 464557 - DNA, 20 bp, Artificial
  CRISPR gRNA sequence
gcgccactgcactccagcct

SEQ ID NO: 464558 - DNA, 20 bp, Artificial
  CRISPR gRNA sequence
ctgcactccagcctgggcga

SEQ ID NO: 464559 - DNA, 20 bp, Artificial
  CRISPR gRNA sequence
gcactccagcctgggcgaca

SEQ ID NO: 464560 - DNA, 20 bp, Artificial
  CRISPR gRNA sequence
tccagcctgggcgacagagc

SEQ ID NO: 464561 - DNA, 20 bp, Artificial
  CRISPR gRNA sequence
gtctcaaaaaaaaaaaaaaa

SEQ ID NO: 464562 - DNA, 20 bp, Artificial
  CRISPR gRNA sequence
aaaaaaaaaaaaaaagaaaa

SEQ ID NO: 464563 - DNA, 20 bp, Artificial
  CRISPR gRNA sequence
aaaaaaaagaaaaaagaaaa

SEQ ID NO: 464564 - DNA, 20 bp, Artificial
  CRISPR gRNA sequence
aaagaaaacggaaactgtga

SEQ ID NO: 464565 - DNA, 20 bp, Artificial
  CRISPR gRNA sequence
cggaaactgtgacagtgatg

SEQ ID NO: 464566 - DNA, 20 bp, Artificial
  CRISPR gRNA sequence
gaaactgtgacagtgatgtg

SEQ ID NO: 464567 - DNA, 20 bp, Artificial
  CRISPR gRNA sequence
tgacagtgatgtggagaatt

SEQ ID NO: 464568 - DNA, 20 bp, Artificial
  CRISPR gRNA sequence
gacagtgatgtggagaattg

SEQ ID NO: 464569 - DNA, 20 bp, Artificial
  CRISPR gRNA sequence
agtgatgtggagaattgagg

SEQ ID NO: 464570 - DNA, 20 bp, Artificial
  CRISPR gRNA sequence
tgatgtggagaattgaggtg

SEQ ID NO: 464571 - DNA, 20 bp, Artificial
  CRISPR gRNA sequence
gatgtggagaattgaggtgg

SEQ ID NO: 464572 - DNA, 20 bp, Artificial
  CRISPR gRNA sequence
atgtggagaattgaggtgga

SEQ ID NO: 464573 - DNA, 20 bp, Artificial
  CRISPR gRNA sequence
gtggagaattgaggtggagg

SEQ ID NO: 464574 - DNA, 20 bp, Artificial
  CRISPR gRNA sequence
tggagaattgaggtggaggg

SEQ ID NO: 464575 - DNA, 20 bp, Artificial
  CRISPR gRNA sequence
ggagaattgaggtggaggga

SEQ ID NO: 464576 - DNA, 20 bp, Artificial
  CRISPR gRNA sequence
tgaggtggagggagggaaac

SEQ ID NO: 464577 - DNA, 20 bp, Artificial
  CRISPR gRNA sequence
gaggtggagggagggaaaca

SEQ ID NO: 464578 - DNA, 20 bp, Artificial
  CRISPR gRNA sequence
ggagggagggaaacaaggcc

SEQ ID NO: 464579 - DNA, 20 bp, Artificial
  CRISPR gRNA sequence
gagggaaacaaggccaagtt

SEQ ID NO: 464580 - DNA, 20 bp, Artificial
  CRISPR gRNA sequence
acaaggccaagtttggaatg

SEQ ID NO: 464581 - DNA, 20 bp, Artificial
  CRISPR gRNA sequence
aggccaagtttggaatgtag

SEQ ID NO: 464582 - DNA, 20 bp, Artificial
  CRISPR gRNA sequence
ttggaatgtagaagaccatt

SEQ ID NO: 464583 - DNA, 20 bp, Artificial
  CRISPR gRNA sequence
tgacaataatccacatgaaa

SEQ ID NO: 464584 - DNA, 20 bp, Artificial
  CRISPR gRNA sequence
taatccacatgaaacagaat

SEQ ID NO: 464585 - DNA, 20 bp, Artificial
  CRISPR gRNA sequence
aacagaatgagatccaaatt

SEQ ID NO: 464586 - DNA, 20 bp, Artificial
  CRISPR gRNA sequence
acagaatgagatccaaatta

SEQ ID NO: 464587 - DNA, 20 bp, Artificial
  CRISPR gRNA sequence
gaatgagatccaaattaagg

SEQ ID NO: 464588 - DNA, 20 bp, Artificial
  CRISPR gRNA sequence
tccaaattaaggcagtgtca

SEQ ID NO: 464589 - DNA, 20 bp, Artificial
  CRISPR gRNA sequence
cagtgtcatggaaacaaata

SEQ ID NO: 464590 - DNA, 20 bp, Artificial
  CRISPR gRNA sequence
tgtcatggaaacaaatatgg

SEQ ID NO: 464591 - DNA, 20 bp, Artificial
  CRISPR gRNA sequence
cctgaatcaattgaacttca

SEQ ID NO: 464592 - DNA, 20 bp, Artificial
  CRISPR gRNA sequence
caattgaacttcatggctga

SEQ ID NO: 464593 - DNA, 20 bp, Artificial
  CRISPR gRNA sequence
gaacttcatggctgatggaa

SEQ ID NO: 464594 - DNA, 20 bp, Artificial
  CRISPR gRNA sequence
aacttcatggctgatggaat

SEQ ID NO: 464595 - DNA, 20 bp, Artificial
  CRISPR gRNA sequence
tcatggctgatggaatggga

SEQ ID NO: 464596 - DNA, 20 bp, Artificial
  CRISPR gRNA sequence
tgatggaatgggacggtgac

SEQ ID NO: 464597 - DNA, 20 bp, Artificial
  CRISPR gRNA sequence
gatggaatgggacggtgaca

SEQ ID NO: 464598 - DNA, 20 bp, Artificial
  CRISPR gRNA sequence
ggaatgggacggtgacaagg

SEQ ID NO: 464599 - DNA, 20 bp, Artificial
  CRISPR gRNA sequence
gaatgggacggtgacaagga

SEQ ID NO: 464600 - DNA, 20 bp, Artificial
  CRISPR gRNA sequence
atgggacggtgacaaggaag

SEQ ID NO: 464601 - DNA, 20 bp, Artificial
  CRISPR gRNA sequence
cggtgacaaggaaggagact

SEQ ID NO: 464602 - DNA, 20 bp, Artificial
  CRISPR gRNA sequence
gacaaggaaggagactaaga

SEQ ID NO: 464603 - DNA, 20 bp, Artificial
  CRISPR gRNA sequence
aggagactaagatggctccc

SEQ ID NO: 464604 - DNA, 20 bp, Artificial
  CRISPR gRNA sequence
ggagactaagatggctcccc

SEQ ID NO: 464605 - DNA, 20 bp, Artificial
  CRISPR gRNA sequence
taagatggctccccaggttc

SEQ ID NO: 464606 - DNA, 20 bp, Artificial
  CRISPR gRNA sequence
caggttctggctaatgtgat

SEQ ID NO: 464607 - DNA, 20 bp, Artificial
  CRISPR gRNA sequence
aggttctggctaatgtgatt

SEQ ID NO: 464608 - DNA, 20 bp, Artificial
  CRISPR gRNA sequence
ttctggctaatgtgattagg

SEQ ID NO: 464609 - DNA, 20 bp, Artificial
  CRISPR gRNA sequence
taatgtgattaggtagatga

SEQ ID NO: 464610 - DNA, 20 bp, Artificial
  CRISPR gRNA sequence
tggtattatactgtgataat

SEQ ID NO: 464611 - DNA, 20 bp, Artificial
  CRISPR gRNA sequence
gtattatactgtgataatga

SEQ ID NO: 464612 - DNA, 20 bp, Artificial
  CRISPR gRNA sequence
tattatactgtgataatgag

SEQ ID NO: 464613 - DNA, 20 bp, Artificial
  CRISPR gRNA sequence
ttatactgtgataatgagag

SEQ ID NO: 464614 - DNA, 20 bp, Artificial
  CRISPR gRNA sequence
tatactgtgataatgagagg

SEQ ID NO: 464615 - DNA, 20 bp, Artificial
  CRISPR gRNA sequence
agaggaggaccaaatttgcc

SEQ ID NO: 464616 - DNA, 20 bp, Artificial
  CRISPR gRNA sequence
gaggaggaccaaatttgcct

SEQ ID NO: 464617 - DNA, 20 bp, Artificial
  CRISPR gRNA sequence
aggaggaccaaatttgcctg

SEQ ID NO: 464618 - DNA, 20 bp, Artificial
  CRISPR gRNA sequence
ggaggaccaaatttgcctgg

SEQ ID NO: 464619 - DNA, 20 bp, Artificial
  CRISPR gRNA sequence
gaccaaatttgcctgggggt

SEQ ID NO: 464620 - DNA, 20 bp, Artificial
  CRISPR gRNA sequence
aatttgcctgggggttggct

SEQ ID NO: 464621 - DNA, 20 bp, Artificial
  CRISPR gRNA sequence
tttgcctgggggttggcttg

SEQ ID NO: 464622 - DNA, 20 bp, Artificial
  CRISPR gRNA sequence
ttgcctgggggttggcttgg

SEQ ID NO: 464623 - DNA, 20 bp, Artificial
  CRISPR gRNA sequence
cctgggggttggcttggagg

SEQ ID NO: 464624 - DNA, 20 bp, Artificial
  CRISPR gRNA sequence
ggggttggcttggaggaaga

SEQ ID NO: 464625 - DNA, 20 bp, Artificial
  CRISPR gRNA sequence
ggttggcttggaggaagaaa

SEQ ID NO: 464626 - DNA, 20 bp, Artificial
  CRISPR gRNA sequence
gagatttatcttcccccatg

SEQ ID NO: 464627 - DNA, 20 bp, Artificial
  CRISPR gRNA sequence
gaagcctttcctgattgacc

SEQ ID NO: 464628 - DNA, 20 bp, Artificial
  CRISPR gRNA sequence
cctttcctgattgacccagc

SEQ ID NO: 464629 - DNA, 20 bp, Artificial
  CRISPR gRNA sequence
tcctgattgacccagccaga

SEQ ID NO: 464630 - DNA, 20 bp, Artificial
  CRISPR gRNA sequence
agaaagactgtcttcctctt

SEQ ID NO: 464631 - DNA, 20 bp, Artificial
  CRISPR gRNA sequence
gaaagactgtcttcctcttg

SEQ ID NO: 464632 - DNA, 20 bp, Artificial
  CRISPR gRNA sequence
aaagactgtcttcctcttga

SEQ ID NO: 464633 - DNA, 20 bp, Artificial
  CRISPR gRNA sequence
cttcctcttgagggatctga

SEQ ID NO: 464634 - DNA, 20 bp, Artificial
  CRISPR gRNA sequence
ttgagggatctgaaagctct

SEQ ID NO: 464635 - DNA, 20 bp, Artificial
  CRISPR gRNA sequence
gagggatctgaaagctctga

SEQ ID NO: 464636 - DNA, 20 bp, Artificial
  CRISPR gRNA sequence
ataatacaacaaaaatctaa

SEQ ID NO: 464637 - DNA, 20 bp, Artificial
  CRISPR gRNA sequence
aatctaatggcaaaattgaa

SEQ ID NO: 464638 - DNA, 20 bp, Artificial
  CRISPR gRNA sequence
ctaatggcaaaattgaaaag

SEQ ID NO: 464639 - DNA, 20 bp, Artificial
  CRISPR gRNA sequence
gcaaaattgaaaagtggtgt

SEQ ID NO: 464640 - DNA, 20 bp, Artificial
  CRISPR gRNA sequence
gaaaagtggtgtaagacttt

SEQ ID NO: 464641 - DNA, 20 bp, Artificial
  CRISPR gRNA sequence
tttcagcctcttctttgtgc

SEQ ID NO: 464642 - DNA, 20 bp, Artificial
  CRISPR gRNA sequence
tgtctcgttactaatgtgtc

SEQ ID NO: 464643 - DNA, 20 bp, Artificial
  CRISPR gRNA sequence
gtctcgttactaatgtgtca

SEQ ID NO: 464644 - DNA, 20 bp, Artificial
  CRISPR gRNA sequence
cgttactaatgtgtcaagga

SEQ ID NO: 464645 - DNA, 20 bp, Artificial
  CRISPR gRNA sequence
tactaatgtgtcaaggacag

SEQ ID NO: 464646 - DNA, 20 bp, Artificial
  CRISPR gRNA sequence
actaatgtgtcaaggacagt

SEQ ID NO: 464647 - DNA, 20 bp, Artificial
  CRISPR gRNA sequence
gtcaaggacagtgggatatc

SEQ ID NO: 464648 - DNA, 20 bp, Artificial
  CRISPR gRNA sequence
cagtgggatatccagactcc

SEQ ID NO: 464649 - DNA, 20 bp, Artificial
  CRISPR gRNA sequence
agtgggatatccagactcct

SEQ ID NO: 464650 - DNA, 20 bp, Artificial
  CRISPR gRNA sequence
ccagactcctgggtgtgaac

SEQ ID NO: 464651 - DNA, 20 bp, Artificial
  CRISPR gRNA sequence
gactcctgggtgtgaacaag

SEQ ID NO: 464652 - DNA, 20 bp, Artificial
  CRISPR gRNA sequence
ttgaatttaaaaacaactaa

SEQ ID NO: 464653 - DNA, 20 bp, Artificial
  CRISPR gRNA sequence
tcctttttttttttttgaca

SEQ ID NO: 464654 - DNA, 20 bp, Artificial
  CRISPR gRNA sequence
agattttcgctcttgttgcc

SEQ ID NO: 464655 - DNA, 20 bp, Artificial
  CRISPR gRNA sequence
gattttcgctcttgttgccc

SEQ ID NO: 464656 - DNA, 20 bp, Artificial
  CRISPR gRNA sequence
ttcgctcttgttgcccaggc

SEQ ID NO: 464657 - DNA, 20 bp, Artificial
  CRISPR gRNA sequence
cgctcttgttgcccaggctg

SEQ ID NO: 464658 - DNA, 20 bp, Artificial
  CRISPR gRNA sequence
ttgcccaggctggagtgcaa

SEQ ID NO: 464659 - DNA, 20 bp, Artificial
  CRISPR gRNA sequence
ggagtgcaatggcacgatct

SEQ ID NO: 464660 - DNA, 20 bp, Artificial
  CRISPR gRNA sequence
tcaccgcaacctccgcctcc

SEQ ID NO: 464661 - DNA, 20 bp, Artificial
  CRISPR gRNA sequence
caccgcaacctccgcctcct

SEQ ID NO: 464662 - DNA, 20 bp, Artificial
  CRISPR gRNA sequence
aacctccgcctcctgggttc

SEQ ID NO: 464663 - DNA, 20 bp, Artificial
  CRISPR gRNA sequence
ttcaagctattctcctgcct

SEQ ID NO: 464664 - DNA, 20 bp, Artificial
  CRISPR gRNA sequence
ttctcctgcctcagcctcct

SEQ ID NO: 464665 - DNA, 20 bp, Artificial
  CRISPR gRNA sequence
tcctgcctcagcctcctgag

SEQ ID NO: 464666 - DNA, 20 bp, Artificial
  CRISPR gRNA sequence
gcctcagcctcctgagtagc

SEQ ID NO: 464667 - DNA, 20 bp, Artificial
  CRISPR gRNA sequence
cctcagcctcctgagtagct

SEQ ID NO: 464668 - DNA, 20 bp, Artificial
  CRISPR gRNA sequence
ctcctgagtagctgggatta

SEQ ID NO: 464669 - DNA, 20 bp, Artificial
  CRISPR gRNA sequence
tcctgagtagctgggattac

SEQ ID NO: 464670 - DNA, 20 bp, Artificial
  CRISPR gRNA sequence
caggcatgcgccaccatacc

SEQ ID NO: 464671 - DNA, 20 bp, Artificial
  CRISPR gRNA sequence
gctaattttgtattttttaa

SEQ ID NO: 464672 - DNA, 20 bp, Artificial
  CRISPR gRNA sequence
taattttgtattttttaata

SEQ ID NO: 464673 - DNA, 20 bp, Artificial
  CRISPR gRNA sequence
tttgtattttttaatagaga

SEQ ID NO: 464674 - DNA, 20 bp, Artificial
  CRISPR gRNA sequence
ttgtattttttaatagagac

SEQ ID NO: 464675 - DNA, 20 bp, Artificial
  CRISPR gRNA sequence
tgtattttttaatagagaca

SEQ ID NO: 464676 - DNA, 20 bp, Artificial
  CRISPR gRNA sequence
gagacagggtttctccatgt

SEQ ID NO: 464677 - DNA, 20 bp, Artificial
  CRISPR gRNA sequence
cagggtttctccatgttggt

SEQ ID NO: 464678 - DNA, 20 bp, Artificial
  CRISPR gRNA sequence
agggtttctccatgttggtt

SEQ ID NO: 464679 - DNA, 20 bp, Artificial
  CRISPR gRNA sequence
tttctccatgttggttaggc

SEQ ID NO: 464680 - DNA, 20 bp, Artificial
  CRISPR gRNA sequence
ggtctcaaactcccgacctc

SEQ ID NO: 464681 - DNA, 20 bp, Artificial
  CRISPR gRNA sequence
ctctggtgatccgcccgccc

SEQ ID NO: 464682 - DNA, 20 bp, Artificial
  CRISPR gRNA sequence
ccgcccgccctggcctccca

SEQ ID NO: 464683 - DNA, 20 bp, Artificial
  CRISPR gRNA sequence
gccctggcctcccaaagtgc

SEQ ID NO: 464684 - DNA, 20 bp, Artificial
  CRISPR gRNA sequence
ccctggcctcccaaagtgct

SEQ ID NO: 464685 - DNA, 20 bp, Artificial
  CRISPR gRNA sequence
ctcccaaagtgctgggatta

SEQ ID NO: 464686 - DNA, 20 bp, Artificial
  CRISPR gRNA sequence
tcccaaagtgctgggattac

SEQ ID NO: 464687 - DNA, 20 bp, Artificial
  CRISPR gRNA sequence
agtgctgggattacaggcat

SEQ ID NO: 464688 - DNA, 20 bp, Artificial
  CRISPR gRNA sequence
caggcatgagtcaccacgcc

SEQ ID NO: 464689 - DNA, 20 bp, Artificial
  CRISPR gRNA sequence
catgagtcaccacgcccggc

SEQ ID NO: 464690 - DNA, 20 bp, Artificial
  CRISPR gRNA sequence
ttttaattatcaccacatac

SEQ ID NO: 464691 - DNA, 20 bp, Artificial
  CRISPR gRNA sequence
ctagcaaacatgaacaatgt

SEQ ID NO: 464692 - DNA, 20 bp, Artificial
  CRISPR gRNA sequence
agcaaacatgaacaatgtca

SEQ ID NO: 464693 - DNA, 20 bp, Artificial
  CRISPR gRNA sequence
gcaaacatgaacaatgtcag

SEQ ID NO: 464694 - DNA, 20 bp, Artificial
  CRISPR gRNA sequence
tttacccttcaaaatatttt

SEQ ID NO: 464695 - DNA, 20 bp, Artificial
  CRISPR gRNA sequence
cttcaaaatatttttggtct

SEQ ID NO: 464696 - DNA, 20 bp, Artificial
  CRISPR gRNA sequence
ggtctaagttctaaatacta

SEQ ID NO: 464697 - DNA, 20 bp, Artificial
  CRISPR gRNA sequence
taaatactatggttactgtt

SEQ ID NO: 464698 - DNA, 20 bp, Artificial
  CRISPR gRNA sequence
tatatatgtaaacttcaaat

SEQ ID NO: 464699 - DNA, 20 bp, Artificial
  CRISPR gRNA sequence
acttcaaattagcacatttg

SEQ ID NO: 464700 - DNA, 20 bp, Artificial
  CRISPR gRNA sequence
aaacattgcattctacttgc

SEQ ID NO: 464701 - DNA, 20 bp, Artificial
  CRISPR gRNA sequence
attctacttgcaagttaact

SEQ ID NO: 464702 - DNA, 20 bp, Artificial
  CRISPR gRNA sequence
tctacttgcaagttaactca

SEQ ID NO: 464703 - DNA, 20 bp, Artificial
  CRISPR gRNA sequence
agttaactcagagaacttcc

SEQ ID NO: 464704 - DNA, 20 bp, Artificial
  CRISPR gRNA sequence
cagagaacttcccagttata

SEQ ID NO: 464705 - DNA, 20 bp, Artificial
  CRISPR gRNA sequence
gaacttcccagttatacagc

SEQ ID NO: 464706 - DNA, 20 bp, Artificial
  CRISPR gRNA sequence
cccagttatacagctggcct

SEQ ID NO: 464707 - DNA, 20 bp, Artificial
  CRISPR gRNA sequence
ggccttggacatataccatt

SEQ ID NO: 464708 - DNA, 20 bp, Artificial
  CRISPR gRNA sequence
gctacttgtgttcattttga

SEQ ID NO: 464709 - DNA, 20 bp, Artificial
  CRISPR gRNA sequence
attttgatagcaaatttata

SEQ ID NO: 464710 - DNA, 20 bp, Artificial
  CRISPR gRNA sequence
gatagcaaatttataaagtc

SEQ ID NO: 464711 - DNA, 20 bp, Artificial
  CRISPR gRNA sequence
atagcaaatttataaagtcc

SEQ ID NO: 464712 - DNA, 20 bp, Artificial
  CRISPR gRNA sequence
tataaagtccaggatcactc

SEQ ID NO: 464713 - DNA, 20 bp, Artificial
  CRISPR gRNA sequence
ggatcactccagtttcctcc

SEQ ID NO: 464714 - DNA, 20 bp, Artificial
  CRISPR gRNA sequence
gatcactccagtttcctcca

SEQ ID NO: 464715 - DNA, 20 bp, Artificial
  CRISPR gRNA sequence
actttgtgtcctcatctctg

SEQ ID NO: 464716 - DNA, 20 bp, Artificial
  CRISPR gRNA sequence
ctctgtggtactacatactc

SEQ ID NO: 464717 - DNA, 20 bp, Artificial
  CRISPR gRNA sequence
ttaaataaacaataatacca

SEQ ID NO: 464718 - DNA, 20 bp, Artificial
  CRISPR gRNA sequence
aaataaacaataataccaca

SEQ ID NO: 464719 - DNA, 20 bp, Artificial
  CRISPR gRNA sequence
ataataccacagagaatgct

SEQ ID NO: 464720 - DNA, 20 bp, Artificial
  CRISPR gRNA sequence
ccacagagaatgctgagaca

SEQ ID NO: 464721 - DNA, 20 bp, Artificial
  CRISPR gRNA sequence
cagagaatgctgagacaaag

SEQ ID NO: 464722 - DNA, 20 bp, Artificial
  CRISPR gRNA sequence
agaatgctgagacaaagaag

SEQ ID NO: 464723 - DNA, 20 bp, Artificial
  CRISPR gRNA sequence
gctgagacaaagaagcagaa

SEQ ID NO: 464724 - DNA, 20 bp, Artificial
  CRISPR gRNA sequence
ctgagacaaagaagcagaac

SEQ ID NO: 464725 - DNA, 20 bp, Artificial
  CRISPR gRNA sequence
gagacaaagaagcagaacag

SEQ ID NO: 464726 - DNA, 20 bp, Artificial
  CRISPR gRNA sequence
gctgtttcatttttgtcatt

SEQ ID NO: 464727 - DNA, 20 bp, Artificial
  CRISPR gRNA sequence
tttgtgtttaaaatttaaaa

SEQ ID NO: 464728 - DNA, 20 bp, Artificial
  CRISPR gRNA sequence
ttaaaatttaaaacagtgaa

SEQ ID NO: 464729 - DNA, 20 bp, Artificial
  CRISPR gRNA sequence
taaaatttaaaacagtgaaa

SEQ ID NO: 464730 - DNA, 20 bp, Artificial
  CRISPR gRNA sequence
actgtgatatataaaatctt

SEQ ID NO: 464731 - DNA, 20 bp, Artificial
  CRISPR gRNA sequence
gatatataaaatcttcggct

SEQ ID NO: 464732 - DNA, 20 bp, Artificial
  CRISPR gRNA sequence
ttatttcatgcataaaatgt

SEQ ID NO: 464733 - DNA, 20 bp, Artificial
  CRISPR gRNA sequence
tgttgttttaaaactaactt

SEQ ID NO: 464734 - DNA, 20 bp, Artificial
  CRISPR gRNA sequence
aactttagaaaataaaactt

SEQ ID NO: 464735 - DNA, 20 bp, Artificial
  CRISPR gRNA sequence
aaaactttagtgttacaatt

SEQ ID NO: 464736 - DNA, 20 bp, Artificial
  CRISPR gRNA sequence
actttagtgttacaatttag

SEQ ID NO: 464737 - DNA, 20 bp, Artificial
  CRISPR gRNA sequence
ttacctaaattgtatctttg

SEQ ID NO: 464738 - DNA, 20 bp, Artificial
  CRISPR gRNA sequence
attgtatctttgcagaattt

SEQ ID NO: 464739 - DNA, 20 bp, Artificial
  CRISPR gRNA sequence
ttttaatacaatccatttat

SEQ ID NO: 464740 - DNA, 20 bp, Artificial
  CRISPR gRNA sequence
acaatccatttattagttat

SEQ ID NO: 464741 - DNA, 20 bp, Artificial
  CRISPR gRNA sequence
atttacataaactattatat

SEQ ID NO: 464742 - DNA, 20 bp, Artificial
  CRISPR gRNA sequence
attatatcagactataacta

SEQ ID NO: 464743 - DNA, 20 bp, Artificial
  CRISPR gRNA sequence
agactataactaaagaatca

SEQ ID NO: 464744 - DNA, 20 bp, Artificial
  CRISPR gRNA sequence
gaatcaaagttcatactgtt

SEQ ID NO: 464745 - DNA, 20 bp, Artificial
  CRISPR gRNA sequence
aatcaaagttcatactgttt

SEQ ID NO: 464746 - DNA, 20 bp, Artificial
  CRISPR gRNA sequence
caaagttcatactgtttagg

SEQ ID NO: 464747 - DNA, 20 bp, Artificial
  CRISPR gRNA sequence
aaaacattttttcatttgta

SEQ ID NO: 464748 - DNA, 20 bp, Artificial
  CRISPR gRNA sequence
tttgtatggttttatacatg

SEQ ID NO: 464749 - DNA, 20 bp, Artificial
  CRISPR gRNA sequence
atggttttatacatgaagtt

SEQ ID NO: 464750 - DNA, 20 bp, Artificial
  CRISPR gRNA sequence
ttatacatgaagttcagcac

SEQ ID NO: 464751 - DNA, 20 bp, Artificial
  CRISPR gRNA sequence
cattgtctatatttcttttc

SEQ ID NO: 464752 - DNA, 20 bp, Artificial
  CRISPR gRNA sequence
tctgaaaatatttttatgta

SEQ ID NO: 464753 - DNA, 20 bp, Artificial
  CRISPR gRNA sequence
tgaaaatatttttatgtata

SEQ ID NO: 464754 - DNA, 20 bp, Artificial
  CRISPR gRNA sequence
aatatttttatgtatagaga

SEQ ID NO: 464755 - DNA, 20 bp, Artificial
  CRISPR gRNA sequence
atatttttatgtatagagaa

SEQ ID NO: 464756 - DNA, 20 bp, Artificial
  CRISPR gRNA sequence
tatttttatgtatagagaaa

SEQ ID NO: 464757 - DNA, 20 bp, Artificial
  CRISPR gRNA sequence
atttttatgtatagagaaag

SEQ ID NO: 464758 - DNA, 20 bp, Artificial
  CRISPR gRNA sequence
gttgctcaaatgatgtactc

SEQ ID NO: 464759 - DNA, 20 bp, Artificial
  CRISPR gRNA sequence
gacctaaaataaaatatcat

SEQ ID NO: 464760 - DNA, 20 bp, Artificial
  CRISPR gRNA sequence
tcatcggtaccacctgatcg

SEQ ID NO: 464761 - DNA, 20 bp, Artificial
  CRISPR gRNA sequence
tcgtggaatatatataccac

SEQ ID NO: 464762 - DNA, 20 bp, Artificial
  CRISPR gRNA sequence
tggaatatatataccactag

SEQ ID NO: 464763 - DNA, 20 bp, Artificial
  CRISPR gRNA sequence
gataaaaattttaaacatga

SEQ ID NO: 464764 - DNA, 20 bp, Artificial
  CRISPR gRNA sequence
tgaaagaatttctaaaccta

SEQ ID NO: 464765 - DNA, 20 bp, Artificial
  CRISPR gRNA sequence
taaacctatagtgacttaac

SEQ ID NO: 464766 - DNA, 20 bp, Artificial
  CRISPR gRNA sequence
aaacctatagtgacttaaca

SEQ ID NO: 464767 - DNA, 20 bp, Artificial
  CRISPR gRNA sequence
aacctatagtgacttaacaa

SEQ ID NO: 464768 - DNA, 20 bp, Artificial
  CRISPR gRNA sequence
caagggatatttcattatat

SEQ ID NO: 464769 - DNA, 20 bp, Artificial
  CRISPR gRNA sequence
agggatatttcattatataa

SEQ ID NO: 464770 - DNA, 20 bp, Artificial
  CRISPR gRNA sequence
tatttcattatataagagcc

SEQ ID NO: 464771 - DNA, 20 bp, Artificial
  CRISPR gRNA sequence
atttcattatataagagcct

SEQ ID NO: 464772 - DNA, 20 bp, Artificial
  CRISPR gRNA sequence
tttcattatataagagcctg

SEQ ID NO: 464773 - DNA, 20 bp, Artificial
  CRISPR gRNA sequence
ttcattatataagagcctgg

SEQ ID NO: 464774 - DNA, 20 bp, Artificial
  CRISPR gRNA sequence
tcattatataagagcctggg

SEQ ID NO: 464775 - DNA, 20 bp, Artificial
  CRISPR gRNA sequence
cattatataagagcctgggg

SEQ ID NO: 464776 - DNA, 20 bp, Artificial
  CRISPR gRNA sequence
ttatataagagcctgggggg

SEQ ID NO: 464777 - DNA, 20 bp, Artificial
  CRISPR gRNA sequence
tataagagcctgggggggag

SEQ ID NO: 464778 - DNA, 20 bp, Artificial
  CRISPR gRNA sequence
aagagcctgggggggagtag

SEQ ID NO: 464779 - DNA, 20 bp, Artificial
  CRISPR gRNA sequence
agtttttattctttgtttgt

SEQ ID NO: 464780 - DNA, 20 bp, Artificial
  CRISPR gRNA sequence
tgtttgttggtttgtttttt

SEQ ID NO: 464781 - DNA, 20 bp, Artificial
  CRISPR gRNA sequence
tgttggtttgttttttgaga

SEQ ID NO: 464782 - DNA, 20 bp, Artificial
  CRISPR gRNA sequence
tggactctcgctctgtcacc

SEQ ID NO: 464783 - DNA, 20 bp, Artificial
  CRISPR gRNA sequence
ggactctcgctctgtcaccc

SEQ ID NO: 464784 - DNA, 20 bp, Artificial
  CRISPR gRNA sequence
tctcgctctgtcacccaggc

SEQ ID NO: 464785 - DNA, 20 bp, Artificial
  CRISPR gRNA sequence
tcgctctgtcacccaggctg

SEQ ID NO: 464786 - DNA, 20 bp, Artificial
  CRISPR gRNA sequence
ctgtcacccaggctggagtg

SEQ ID NO: 464787 - DNA, 20 bp, Artificial
  CRISPR gRNA sequence
tcacccaggctggagtgcag

SEQ ID NO: 464788 - DNA, 20 bp, Artificial
  CRISPR gRNA sequence
tggagtgcagtggcgcgatc

SEQ ID NO: 464789 - DNA, 20 bp, Artificial
  CRISPR gRNA sequence
ggagtgcagtggcgcgatct

SEQ ID NO: 464790 - DNA, 20 bp, Artificial
  CRISPR gRNA sequence
gtggcgcgatctaggctcat

SEQ ID NO: 464791 - DNA, 20 bp, Artificial
  CRISPR gRNA sequence
gcgcgatctaggctcattgg

SEQ ID NO: 464792 - DNA, 20 bp, Artificial
  CRISPR gRNA sequence
tcattggaagctccgcctcg

SEQ ID NO: 464793 - DNA, 20 bp, Artificial
  CRISPR gRNA sequence
cattggaagctccgcctcgc

SEQ ID NO: 464794 - DNA, 20 bp, Artificial
  CRISPR gRNA sequence
ttcacgccattctcctgcct

SEQ ID NO: 464795 - DNA, 20 bp, Artificial
  CRISPR gRNA sequence
ttctcctgcctcagtctgcc

SEQ ID NO: 464796 - DNA, 20 bp, Artificial
  CRISPR gRNA sequence
tcctgcctcagtctgccgag

SEQ ID NO: 464797 - DNA, 20 bp, Artificial
  CRISPR gRNA sequence
gcctcagtctgccgagcagc

SEQ ID NO: 464798 - DNA, 20 bp, Artificial
  CRISPR gRNA sequence
cctcagtctgccgagcagct

SEQ ID NO: 464799 - DNA, 20 bp, Artificial
  CRISPR gRNA sequence
ctgccgagcagctgggacta

SEQ ID NO: 464800 - DNA, 20 bp, Artificial
  CRISPR gRNA sequence
tgccgagcagctgggactac

SEQ ID NO: 464801 - DNA, 20 bp, Artificial
  CRISPR gRNA sequence
caggctcccgccaccacgcc

SEQ ID NO: 464802 - DNA, 20 bp, Artificial
  CRISPR gRNA sequence
aattttttgttttgtatttt

SEQ ID NO: 464803 - DNA, 20 bp, Artificial
  CRISPR gRNA sequence
tttttgttttgtatttttag

SEQ ID NO: 464804 - DNA, 20 bp, Artificial
  CRISPR gRNA sequence
tttgttttgtatttttagta

SEQ ID NO: 464805 - DNA, 20 bp, Artificial
  CRISPR gRNA sequence
ttttgtatttttagtagaga

SEQ ID NO: 464806 - DNA, 20 bp, Artificial
  CRISPR gRNA sequence
tttgtatttttagtagagac

SEQ ID NO: 464807 - DNA, 20 bp, Artificial
  CRISPR gRNA sequence
ttgtatttttagtagagacg

SEQ ID NO: 464808 - DNA, 20 bp, Artificial
  CRISPR gRNA sequence
gagacggggtttcaccgtgt

SEQ ID NO: 464809 - DNA, 20 bp, Artificial
  CRISPR gRNA sequence
cggggtttcaccgtgttagc

SEQ ID NO: 464810 - DNA, 20 bp, Artificial
  CRISPR gRNA sequence
ggggtttcaccgtgttagcc

SEQ ID NO: 464811 - DNA, 20 bp, Artificial
  CRISPR gRNA sequence
tttcaccgtgttagccggga

SEQ ID NO: 464812 - DNA, 20 bp, Artificial
  CRISPR gRNA sequence
acctcgtgatccactcgcct

SEQ ID NO: 464813 - DNA, 20 bp, Artificial
  CRISPR gRNA sequence
ccactcgcctcggcctccca

SEQ ID NO: 464814 - DNA, 20 bp, Artificial
  CRISPR gRNA sequence
gcctcggcctcccaaagtgc

SEQ ID NO: 464815 - DNA, 20 bp, Artificial
  CRISPR gRNA sequence
cctcggcctcccaaagtgct

SEQ ID NO: 464816 - DNA, 20 bp, Artificial
  CRISPR gRNA sequence
ctcccaaagtgctgggacca

SEQ ID NO: 464817 - DNA, 20 bp, Artificial
  CRISPR gRNA sequence
tcccaaagtgctgggaccac

SEQ ID NO: 464818 - DNA, 20 bp, Artificial
  CRISPR gRNA sequence
agtgctgggaccacaggcgt

SEQ ID NO: 464819 - DNA, 20 bp, Artificial
  CRISPR gRNA sequence
caggcgtgagccaccgtgcc

SEQ ID NO: 464820 - DNA, 20 bp, Artificial
  CRISPR gRNA sequence
cgtgagccaccgtgcccggc

SEQ ID NO: 464821 - DNA, 20 bp, Artificial
  CRISPR gRNA sequence
gagccaccgtgcccggccag

SEQ ID NO: 464822 - DNA, 20 bp, Artificial
  CRISPR gRNA sequence
gtatttattttaatcatttt

SEQ ID NO: 464823 - DNA, 20 bp, Artificial
  CRISPR gRNA sequence
cattgaaaatttcctgtcat

SEQ ID NO: 464824 - DNA, 20 bp, Artificial
  CRISPR gRNA sequence
gtcatcagatatgaatgctt

SEQ ID NO: 464825 - DNA, 20 bp, Artificial
  CRISPR gRNA sequence
atatgaatgcttgagaaaaa

SEQ ID NO: 464826 - DNA, 20 bp, Artificial
  CRISPR gRNA sequence
tgaatgcttgagaaaaacag

SEQ ID NO: 464827 - DNA, 20 bp, Artificial
  CRISPR gRNA sequence
aatgcttgagaaaaacagca

SEQ ID NO: 464828 - DNA, 20 bp, Artificial
  CRISPR gRNA sequence
agaaaaacagcagagataat

SEQ ID NO: 464829 - DNA, 20 bp, Artificial
  CRISPR gRNA sequence
aaaaacagcagagataataa

SEQ ID NO: 464830 - DNA, 20 bp, Artificial
  CRISPR gRNA sequence
aacagcagagataataagag

SEQ ID NO: 464831 - DNA, 20 bp, Artificial
  CRISPR gRNA sequence
acagcagagataataagagc

SEQ ID NO: 464832 - DNA, 20 bp, Artificial
  CRISPR gRNA sequence
gcaggaataaaaataactga

SEQ ID NO: 464833 - DNA, 20 bp, Artificial
  CRISPR gRNA sequence
ataaaaataactgatggttc

SEQ ID NO: 464834 - DNA, 20 bp, Artificial
  CRISPR gRNA sequence
aactgatggttccggctact

SEQ ID NO: 464835 - DNA, 20 bp, Artificial
  CRISPR gRNA sequence
actgatggttccggctactt

SEQ ID NO: 464836 - DNA, 20 bp, Artificial
  CRISPR gRNA sequence
tgatggttccggctacttgg

SEQ ID NO: 464837 - DNA, 20 bp, Artificial
  CRISPR gRNA sequence
gatggttccggctacttggg

SEQ ID NO: 464838 - DNA, 20 bp, Artificial
  CRISPR gRNA sequence
ttccggctacttgggaggct

SEQ ID NO: 464839 - DNA, 20 bp, Artificial
  CRISPR gRNA sequence
tccggctacttgggaggctg

SEQ ID NO: 464840 - DNA, 20 bp, Artificial
  CRISPR gRNA sequence
ggctacttgggaggctgagg

SEQ ID NO: 464841 - DNA, 20 bp, Artificial
  CRISPR gRNA sequence
gctacttgggaggctgaggc

SEQ ID NO: 464842 - DNA, 20 bp, Artificial
  CRISPR gRNA sequence
tacttgggaggctgaggcag

SEQ ID NO: 464843 - DNA, 20 bp, Artificial
  CRISPR gRNA sequence
gcaggagaatcgcttgaacc

SEQ ID NO: 464844 - DNA, 20 bp, Artificial
  CRISPR gRNA sequence
caggagaatcgcttgaaccc

SEQ ID NO: 464845 - DNA, 20 bp, Artificial
  CRISPR gRNA sequence
aggagaatcgcttgaacccg

SEQ ID NO: 464846 - DNA, 20 bp, Artificial
  CRISPR gRNA sequence
gaatcgcttgaacccgggga

SEQ ID NO: 464847 - DNA, 20 bp, Artificial
  CRISPR gRNA sequence
atcgcttgaacccggggatg

SEQ ID NO: 464848 - DNA, 20 bp, Artificial
  CRISPR gRNA sequence
tcgcttgaacccggggatgg

SEQ ID NO: 464849 - DNA, 20 bp, Artificial
  CRISPR gRNA sequence
gaacccggggatggaggttg

SEQ ID NO: 464850 - DNA, 20 bp, Artificial
  CRISPR gRNA sequence
gatggaggttgcagtgaacc

SEQ ID NO: 464851 - DNA, 20 bp, Artificial
  CRISPR gRNA sequence
gagatcgctccattgcactc

SEQ ID NO: 464852 - DNA, 20 bp, Artificial
  CRISPR gRNA sequence
cgctccattgcactccagcc

SEQ ID NO: 464853 - DNA, 20 bp, Artificial
  CRISPR gRNA sequence
gctccattgcactccagcct

SEQ ID NO: 464854 - DNA, 20 bp, Artificial
  CRISPR gRNA sequence
tgcactccagcctgggcaac

SEQ ID NO: 464855 - DNA, 20 bp, Artificial
  CRISPR gRNA sequence
cactccagcctgggcaacaa

SEQ ID NO: 464856 - DNA, 20 bp, Artificial
  CRISPR gRNA sequence
gaaatcaaataactgataat

SEQ ID NO: 464857 - DNA, 20 bp, Artificial
  CRISPR gRNA sequence
atcaaataactgataattgg

SEQ ID NO: 464858 - DNA, 20 bp, Artificial
  CRISPR gRNA sequence
ataactgataattggaagtt

SEQ ID NO: 464859 - DNA, 20 bp, Artificial
  CRISPR gRNA sequence
gataattggaagttgagtaa

SEQ ID NO: 464860 - DNA, 20 bp, Artificial
  CRISPR gRNA sequence
ggaagttgagtaacagccaa

SEQ ID NO: 464861 - DNA, 20 bp, Artificial
  CRISPR gRNA sequence
acagccaaaagcaactgtga

SEQ ID NO: 464862 - DNA, 20 bp, Artificial
  CRISPR gRNA sequence
ctgtgatagttattcctctt

SEQ ID NO: 464863 - DNA, 20 bp, Artificial
  CRISPR gRNA sequence
tgtgatagttattcctcttc

SEQ ID NO: 464864 - DNA, 20 bp, Artificial
  CRISPR gRNA sequence
tcgggaaatatttatttgat

SEQ ID NO: 464865 - DNA, 20 bp, Artificial
  CRISPR gRNA sequence
tatttgataagacaaacttt

SEQ ID NO: 464866 - DNA, 20 bp, Artificial
  CRISPR gRNA sequence
atttgataagacaaactttt

SEQ ID NO: 464867 - DNA, 20 bp, Artificial
  CRISPR gRNA sequence
tttgataagacaaacttttg

SEQ ID NO: 464868 - DNA, 20 bp, Artificial
  CRISPR gRNA sequence
ttgataagacaaacttttgg

SEQ ID NO: 464869 - DNA, 20 bp, Artificial
  CRISPR gRNA sequence
taagacaaacttttggggga

SEQ ID NO: 464870 - DNA, 20 bp, Artificial
  CRISPR gRNA sequence
gggatagctttgtgtgtcct

SEQ ID NO: 464871 - DNA, 20 bp, Artificial
  CRISPR gRNA sequence
ttgtgtgtcctaagtatcat

SEQ ID NO: 464872 - DNA, 20 bp, Artificial
  CRISPR gRNA sequence
gtgtcctaagtatcataaga

SEQ ID NO: 464873 - DNA, 20 bp, Artificial
  CRISPR gRNA sequence
taagatggatatgcataatt

SEQ ID NO: 464874 - DNA, 20 bp, Artificial
  CRISPR gRNA sequence
tggatatgcataattcagaa

SEQ ID NO: 464875 - DNA, 20 bp, Artificial
  CRISPR gRNA sequence
ggatatgcataattcagaac

SEQ ID NO: 464876 - DNA, 20 bp, Artificial
  CRISPR gRNA sequence
tatgcataattcagaacagg

SEQ ID NO: 464877 - DNA, 20 bp, Artificial
  CRISPR gRNA sequence
ataattcagaacaggcagaa

SEQ ID NO: 464878 - DNA, 20 bp, Artificial
  CRISPR gRNA sequence
taattcagaacaggcagaaa

SEQ ID NO: 464879 - DNA, 20 bp, Artificial
  CRISPR gRNA sequence
aattcagaacaggcagaaaa

SEQ ID NO: 464880 - DNA, 20 bp, Artificial
  CRISPR gRNA sequence
attcagaacaggcagaaaag

SEQ ID NO: 464881 - DNA, 20 bp, Artificial
  CRISPR gRNA sequence
ggcagaaaaggggtgttaac

SEQ ID NO: 464882 - DNA, 20 bp, Artificial
  CRISPR gRNA sequence
aggggtgttaacaagcttgt

SEQ ID NO: 464883 - DNA, 20 bp, Artificial
  CRISPR gRNA sequence
gtgttaacaagcttgtcaga

SEQ ID NO: 464884 - DNA, 20 bp, Artificial
  CRISPR gRNA sequence
aagcttgtcagatggacaat

SEQ ID NO: 464885 - DNA, 20 bp, Artificial
  CRISPR gRNA sequence
attagaattgtgctatttgt

SEQ ID NO: 464886 - DNA, 20 bp, Artificial
  CRISPR gRNA sequence
gaattgtgctatttgtcggc

SEQ ID NO: 464887 - DNA, 20 bp, Artificial
  CRISPR gRNA sequence
aattgtgctatttgtcggcc

SEQ ID NO: 464888 - DNA, 20 bp, Artificial
  CRISPR gRNA sequence
gtgctatttgtcggccaggc

SEQ ID NO: 464889 - DNA, 20 bp, Artificial
  CRISPR gRNA sequence
ctatttgtcggccaggccgg

SEQ ID NO: 464890 - DNA, 20 bp, Artificial
  CRISPR gRNA sequence
gtggctcactcctgtaatcc

SEQ ID NO: 464891 - DNA, 20 bp, Artificial
  CRISPR gRNA sequence
ctgtaatcccagcactttgt

SEQ ID NO: 464892 - DNA, 20 bp, Artificial
  CRISPR gRNA sequence
tgtaatcccagcactttgtg

SEQ ID NO: 464893 - DNA, 20 bp, Artificial
  CRISPR gRNA sequence
aatcccagcactttgtgagg

SEQ ID NO: 464894 - DNA, 20 bp, Artificial
  CRISPR gRNA sequence
tcccagcactttgtgaggca

SEQ ID NO: 464895 - DNA, 20 bp, Artificial
  CRISPR gRNA sequence
cccagcactttgtgaggcag

SEQ ID NO: 464896 - DNA, 20 bp, Artificial
  CRISPR gRNA sequence
agcactttgtgaggcagagg

SEQ ID NO: 464897 - DNA, 20 bp, Artificial
  CRISPR gRNA sequence
gcactttgtgaggcagaggc

SEQ ID NO: 464898 - DNA, 20 bp, Artificial
  CRISPR gRNA sequence
ctttgtgaggcagaggcggg

SEQ ID NO: 464899 - DNA, 20 bp, Artificial
  CRISPR gRNA sequence
cagaggcgggtggatcacct

SEQ ID NO: 464900 - DNA, 20 bp, Artificial
  CRISPR gRNA sequence
agaggcgggtggatcacctg

SEQ ID NO: 464901 - DNA, 20 bp, Artificial
  CRISPR gRNA sequence
gcgggtggatcacctgaggt

SEQ ID NO: 464902 - DNA, 20 bp, Artificial
  CRISPR gRNA sequence
cgggtggatcacctgaggtc

SEQ ID NO: 464903 - DNA, 20 bp, Artificial
  CRISPR gRNA sequence
ggtggatcacctgaggtcag

SEQ ID NO: 464904 - DNA, 20 bp, Artificial
  CRISPR gRNA sequence
tcacctgaggtcaggagttc

SEQ ID NO: 464905 - DNA, 20 bp, Artificial
  CRISPR gRNA sequence
tgaggtcaggagttcgagat

SEQ ID NO: 464906 - DNA, 20 bp, Artificial
  CRISPR gRNA sequence
tcaggagttcgagatcagcc

SEQ ID NO: 464907 - DNA, 20 bp, Artificial
  CRISPR gRNA sequence
cgagatcagcctggctaaca

SEQ ID NO: 464908 - DNA, 20 bp, Artificial
  CRISPR gRNA sequence
cctactaaaaatacaaaaat

SEQ ID NO: 464909 - DNA, 20 bp, Artificial
  CRISPR gRNA sequence
ctaaaaatacaaaaattagc

SEQ ID NO: 464910 - DNA, 20 bp, Artificial
  CRISPR gRNA sequence
taaaaatacaaaaattagcc

SEQ ID NO: 464911 - DNA, 20 bp, Artificial
  CRISPR gRNA sequence
atacaaaaattagccgggcg

SEQ ID NO: 464912 - DNA, 20 bp, Artificial
  CRISPR gRNA sequence
aaattagccgggcgtggttg

SEQ ID NO: 464913 - DNA, 20 bp, Artificial
  CRISPR gRNA sequence
aattagccgggcgtggttgt

SEQ ID NO: 464914 - DNA, 20 bp, Artificial
  CRISPR gRNA sequence
gttgtgggtgcctgtaatcc

SEQ ID NO: 464915 - DNA, 20 bp, Artificial
  CRISPR gRNA sequence
gtgcctgtaatcccagccac

SEQ ID NO: 464916 - DNA, 20 bp, Artificial
  CRISPR gRNA sequence
tgcctgtaatcccagccacc

SEQ ID NO: 464917 - DNA, 20 bp, Artificial
  CRISPR gRNA sequence
gcctgtaatcccagccaccg

SEQ ID NO: 464918 - DNA, 20 bp, Artificial
  CRISPR gRNA sequence
ctgtaatcccagccaccggg

SEQ ID NO: 464919 - DNA, 20 bp, Artificial
  CRISPR gRNA sequence
tgtaatcccagccaccgggg

SEQ ID NO: 464920 - DNA, 20 bp, Artificial
  CRISPR gRNA sequence
tcccagccaccggggaggct

SEQ ID NO: 464921 - DNA, 20 bp, Artificial
  CRISPR gRNA sequence
cccagccaccggggaggctg

SEQ ID NO: 464922 - DNA, 20 bp, Artificial
  CRISPR gRNA sequence
agccaccggggaggctgagg

SEQ ID NO: 464923 - DNA, 20 bp, Artificial
  CRISPR gRNA sequence
gccaccggggaggctgaggc

SEQ ID NO: 464924 - DNA, 20 bp, Artificial
  CRISPR gRNA sequence
caccggggaggctgaggcag

SEQ ID NO: 464925 - DNA, 20 bp, Artificial
  CRISPR gRNA sequence
gcaggagaatcgcttgaacc

SEQ ID NO: 464926 - DNA, 20 bp, Artificial
  CRISPR gRNA sequence
caggagaatcgcttgaacct

SEQ ID NO: 464927 - DNA, 20 bp, Artificial
  CRISPR gRNA sequence
ggagaatcgcttgaacctgg

SEQ ID NO: 464928 - DNA, 20 bp, Artificial
  CRISPR gRNA sequence
gagaatcgcttgaacctggg

SEQ ID NO: 464929 - DNA, 20 bp, Artificial
  CRISPR gRNA sequence
aatcgcttgaacctgggagg

SEQ ID NO: 464930 - DNA, 20 bp, Artificial
  CRISPR gRNA sequence
tcgcttgaacctgggaggcg

SEQ ID NO: 464931 - DNA, 20 bp, Artificial
  CRISPR gRNA sequence
cgcttgaacctgggaggcgg

SEQ ID NO: 464932 - DNA, 20 bp, Artificial
  CRISPR gRNA sequence
aacctgggaggcggaggctg

SEQ ID NO: 464933 - DNA, 20 bp, Artificial
  CRISPR gRNA sequence
tgggaggcggaggctgcagt

SEQ ID NO: 464934 - DNA, 20 bp, Artificial
  CRISPR gRNA sequence
gaaattgcatcactgtactc

SEQ ID NO: 464935 - DNA, 20 bp, Artificial
  CRISPR gRNA sequence
tgcatcactgtactccagcc

SEQ ID NO: 464936 - DNA, 20 bp, Artificial
  CRISPR gRNA sequence
gcatcactgtactccagcct

SEQ ID NO: 464937 - DNA, 20 bp, Artificial
  CRISPR gRNA sequence
tgtactccagcctgggcaac

SEQ ID NO: 464938 - DNA, 20 bp, Artificial
  CRISPR gRNA sequence
tactccagcctgggcaacaa

SEQ ID NO: 464939 - DNA, 20 bp, Artificial
  CRISPR gRNA sequence
ccagcctgggcaacaagagc

SEQ ID NO: 464940 - DNA, 20 bp, Artificial
  CRISPR gRNA sequence
aataaattaattaaaaaaaa

SEQ ID NO: 464941 - DNA, 20 bp, Artificial
  CRISPR gRNA sequence
tagaattgtgctatttgtct

SEQ ID NO: 464942 - DNA, 20 bp, Artificial
  CRISPR gRNA sequence
catttttacactacaaacat

SEQ ID NO: 464943 - DNA, 20 bp, Artificial
  CRISPR gRNA sequence
tacactacaaacatcagtgt

SEQ ID NO: 464944 - DNA, 20 bp, Artificial
  CRISPR gRNA sequence
aaacatcagtgttagcctct

SEQ ID NO: 464945 - DNA, 20 bp, Artificial
  CRISPR gRNA sequence
acatcagtgttagcctctga

SEQ ID NO: 464946 - DNA, 20 bp, Artificial
  CRISPR gRNA sequence
cagtgttagcctctgagaga

SEQ ID NO: 464947 - DNA, 20 bp, Artificial
  CRISPR gRNA sequence
agtgttagcctctgagagat

SEQ ID NO: 464948 - DNA, 20 bp, Artificial
  CRISPR gRNA sequence
tgttagcctctgagagatag

SEQ ID NO: 464949 - DNA, 20 bp, Artificial
  CRISPR gRNA sequence
gttagcctctgagagatagg

SEQ ID NO: 464950 - DNA, 20 bp, Artificial
  CRISPR gRNA sequence
tataataccttgtttgtgca

SEQ ID NO: 464951 - DNA, 20 bp, Artificial
  CRISPR gRNA sequence
taataccttgtttgtgcaca

SEQ ID NO: 464952 - DNA, 20 bp, Artificial
  CRISPR gRNA sequence
aataccttgtttgtgcacag

SEQ ID NO: 464953 - DNA, 20 bp, Artificial
  CRISPR gRNA sequence
ataccttgtttgtgcacaga

SEQ ID NO: 464954 - DNA, 20 bp, Artificial
  CRISPR gRNA sequence
accttgtttgtgcacagagg

SEQ ID NO: 464955 - DNA, 20 bp, Artificial
  CRISPR gRNA sequence
gatttctaatgcctgcttgc

SEQ ID NO: 464956 - DNA, 20 bp, Artificial
  CRISPR gRNA sequence
tgcaagcctacattcatcat

SEQ ID NO: 464957 - DNA, 20 bp, Artificial
  CRISPR gRNA sequence
atcggttcattcctccattc

SEQ ID NO: 464958 - DNA, 20 bp, Artificial
  CRISPR gRNA sequence
ttcaagaaaaattcctgtgc

SEQ ID NO: 464959 - DNA, 20 bp, Artificial
  CRISPR gRNA sequence
agaaaaattcctgtgccagt

SEQ ID NO: 464960 - DNA, 20 bp, Artificial
  CRISPR gRNA sequence
aattcctgtgccagtcagtg

SEQ ID NO: 464961 - DNA, 20 bp, Artificial
  CRISPR gRNA sequence
atgatcattatcctgctgat

SEQ ID NO: 464962 - DNA, 20 bp, Artificial
  CRISPR gRNA sequence
atcctgctgataagaatatt

SEQ ID NO: 464963 - DNA, 20 bp, Artificial
  CRISPR gRNA sequence
tcctgctgataagaatattt

SEQ ID NO: 464964 - DNA, 20 bp, Artificial
  CRISPR gRNA sequence
tccataatcctattgtgaat

SEQ ID NO: 464965 - DNA, 20 bp, Artificial
  CRISPR gRNA sequence
agtgatgccaccaacacaaa

SEQ ID NO: 464966 - DNA, 20 bp, Artificial
  CRISPR gRNA sequence
atgccaccaacacaaaaagc

SEQ ID NO: 464967 - DNA, 20 bp, Artificial
  CRISPR gRNA sequence
acccactttgcgcactgctc

SEQ ID NO: 464968 - DNA, 20 bp, Artificial
  CRISPR gRNA sequence
ccactttgcgcactgctccg

SEQ ID NO: 464969 - DNA, 20 bp, Artificial
  CRISPR gRNA sequence
gcgcactgctccggagcata

SEQ ID NO: 464970 - DNA, 20 bp, Artificial
  CRISPR gRNA sequence
tccggagcatacagtcacaa

SEQ ID NO: 464971 - DNA, 20 bp, Artificial
  CRISPR gRNA sequence
gagcatacagtcacaaaaga

SEQ ID NO: 464972 - DNA, 20 bp, Artificial
  CRISPR gRNA sequence
gtcacaaaagacagaacttg

SEQ ID NO: 464973 - DNA, 20 bp, Artificial
  CRISPR gRNA sequence
ctaattgtgccactaacatc

SEQ ID NO: 464974 - DNA, 20 bp, Artificial
  CRISPR gRNA sequence
gtgccactaacatcaagtga

SEQ ID NO: 464975 - DNA, 20 bp, Artificial
  CRISPR gRNA sequence
aacatcaagtgatagcccta

SEQ ID NO: 464976 - DNA, 20 bp, Artificial
  CRISPR gRNA sequence
gtgatagccctatggctaaa

SEQ ID NO: 464977 - DNA, 20 bp, Artificial
  CRISPR gRNA sequence
tagccctatggctaaataga

SEQ ID NO: 464978 - DNA, 20 bp, Artificial
  CRISPR gRNA sequence
agccctatggctaaatagaa

SEQ ID NO: 464979 - DNA, 20 bp, Artificial
  CRISPR gRNA sequence
agaaaggtaatatattgtga

SEQ ID NO: 464980 - DNA, 20 bp, Artificial
  CRISPR gRNA sequence
gaaaggtaatatattgtgat

SEQ ID NO: 464981 - DNA, 20 bp, Artificial
  CRISPR gRNA sequence
gtaatatattgtgataggaa

SEQ ID NO: 464982 - DNA, 20 bp, Artificial
  CRISPR gRNA sequence
tgtgataggaatagaaattg

SEQ ID NO: 464983 - DNA, 20 bp, Artificial
  CRISPR gRNA sequence
gtgataggaatagaaattgc

SEQ ID NO: 464984 - DNA, 20 bp, Artificial
  CRISPR gRNA sequence
taggaatagaaattgcaggc

SEQ ID NO: 464985 - DNA, 20 bp, Artificial
  CRISPR gRNA sequence
gaatagaaattgcaggctag

SEQ ID NO: 464986 - DNA, 20 bp, Artificial
  CRISPR gRNA sequence
tagaaattgcaggctagaag

SEQ ID NO: 464987 - DNA, 20 bp, Artificial
  CRISPR gRNA sequence
gcaggctagaagtggtttcg

SEQ ID NO: 464988 - DNA, 20 bp, Artificial
  CRISPR gRNA sequence
tagaagtggtttcgtagttt

SEQ ID NO: 464989 - DNA, 20 bp, Artificial
  CRISPR gRNA sequence
cgtagtttcagtcacacatt

SEQ ID NO: 464990 - DNA, 20 bp, Artificial
  CRISPR gRNA sequence
gtagtttcagtcacacatta

SEQ ID NO: 464991 - DNA, 20 bp, Artificial
  CRISPR gRNA sequence
gtttcagtcacacattaagg

SEQ ID NO: 464992 - DNA, 20 bp, Artificial
  CRISPR gRNA sequence
tttcagtcacacattaagga

SEQ ID NO: 464993 - DNA, 20 bp, Artificial
  CRISPR gRNA sequence
gtcacacattaaggaaggtg

SEQ ID NO: 464994 - DNA, 20 bp, Artificial
  CRISPR gRNA sequence
tgaagttgtgtgtgtttgtg

SEQ ID NO: 464995 - DNA, 20 bp, Artificial
  CRISPR gRNA sequence
gttgtgtgtgtttgtgtggt

SEQ ID NO: 464996 - DNA, 20 bp, Artificial
  CRISPR gRNA sequence
ttgtgtgtgtttgtgtggtc

SEQ ID NO: 464997 - DNA, 20 bp, Artificial
  CRISPR gRNA sequence
tgtgtgtgtttgtgtggtca

SEQ ID NO: 464998 - DNA, 20 bp, Artificial
  CRISPR gRNA sequence
gtgtgtgtttgtgtggtcag

SEQ ID NO: 464999 - DNA, 20 bp, Artificial
  CRISPR gRNA sequence
gtgtttgtgtggtcagggga

SEQ ID NO: 465000 - DNA, 20 bp, Artificial
  CRISPR gRNA sequence
ttgtgtggtcaggggatggt

SEQ ID NO: 465001 - DNA, 20 bp, Artificial
  CRISPR gRNA sequence
gtggtcaggggatggtgagt

SEQ ID NO: 465002 - DNA, 20 bp, Artificial
  CRISPR gRNA sequence
ttagaactttcctactttta

SEQ ID NO: 465003 - DNA, 20 bp, Artificial
  CRISPR gRNA sequence
aatcctttcatcttattttg

SEQ ID NO: 465004 - DNA, 20 bp, Artificial
  CRISPR gRNA sequence
catcttattttgaagaaact

SEQ ID NO: 465005 - DNA, 20 bp, Artificial
  CRISPR gRNA sequence
atcttattttgaagaaactg

SEQ ID NO: 465006 - DNA, 20 bp, Artificial
  CRISPR gRNA sequence
attttgaagaaactgaggac

SEQ ID NO: 465007 - DNA, 20 bp, Artificial
  CRISPR gRNA sequence
aaactgaggaccagcaaaac

SEQ ID NO: 465008 - DNA, 20 bp, Artificial
  CRISPR gRNA sequence
aactgaggaccagcaaaact

SEQ ID NO: 465009 - DNA, 20 bp, Artificial
  CRISPR gRNA sequence
actgaggaccagcaaaactg

SEQ ID NO: 465010 - DNA, 20 bp, Artificial
  CRISPR gRNA sequence
ctgaggaccagcaaaactgg

SEQ ID NO: 465011 - DNA, 20 bp, Artificial
  CRISPR gRNA sequence
atcaaattcgctcaatgtgt

SEQ ID NO: 465012 - DNA, 20 bp, Artificial
  CRISPR gRNA sequence
caatgtgttagcatttgaaa

SEQ ID NO: 465013 - DNA, 20 bp, Artificial
  CRISPR gRNA sequence
aacagacatgttcaaatgaa

SEQ ID NO: 465014 - DNA, 20 bp, Artificial
  CRISPR gRNA sequence
caaatgaatagtctcatttg

SEQ ID NO: 465015 - DNA, 20 bp, Artificial
  CRISPR gRNA sequence
tataaatatccccccaaaat

SEQ ID NO: 465016 - DNA, 20 bp, Artificial
  CRISPR gRNA sequence
ataaatatccccccaaaatt

SEQ ID NO: 465017 - DNA, 20 bp, Artificial
  CRISPR gRNA sequence
ttaggcattgtattttctca

SEQ ID NO: 465018 - DNA, 20 bp, Artificial
  CRISPR gRNA sequence
ggcattgtattttctcatgg

SEQ ID NO: 465019 - DNA, 20 bp, Artificial
  CRISPR gRNA sequence
tgtattttctcatggtggat

SEQ ID NO: 465020 - DNA, 20 bp, Artificial
  CRISPR gRNA sequence
tttctcatggtggataagca

SEQ ID NO: 465021 - DNA, 20 bp, Artificial
  CRISPR gRNA sequence
tccatttgttctgaaacaac

SEQ ID NO: 465022 - DNA, 20 bp, Artificial
  CRISPR gRNA sequence
atttgttctgaaacaaccag

SEQ ID NO: 465023 - DNA, 20 bp, Artificial
  CRISPR gRNA sequence
ccagtggtctccatatcact

SEQ ID NO: 465024 - DNA, 20 bp, Artificial
  CRISPR gRNA sequence
tggtctccatatcactaagt

SEQ ID NO: 465025 - DNA, 20 bp, Artificial
  CRISPR gRNA sequence
taagtcagaaaaccatgatc

SEQ ID NO: 465026 - DNA, 20 bp, Artificial
  CRISPR gRNA sequence
caatgatctaaatctatcat

SEQ ID NO: 465027 - DNA, 20 bp, Artificial
  CRISPR gRNA sequence
taaatctatcatgagattcc

SEQ ID NO: 465028 - DNA, 20 bp, Artificial
  CRISPR gRNA sequence
tcatgagattcctggtccct

SEQ ID NO: 465029 - DNA, 20 bp, Artificial
  CRISPR gRNA sequence
atgcactgctctgattgcca

SEQ ID NO: 465030 - DNA, 20 bp, Artificial
  CRISPR gRNA sequence
tgcactgctctgattgccaa

SEQ ID NO: 465031 - DNA, 20 bp, Artificial
  CRISPR gRNA sequence
gcactgctctgattgccaaa

SEQ ID NO: 465032 - DNA, 20 bp, Artificial
  CRISPR gRNA sequence
caaagggctactcattcacc

SEQ ID NO: 465033 - DNA, 20 bp, Artificial
  CRISPR gRNA sequence
aaagggctactcattcacca

SEQ ID NO: 465034 - DNA, 20 bp, Artificial
  CRISPR gRNA sequence
gctactcattcaccaaggtt

SEQ ID NO: 465035 - DNA, 20 bp, Artificial
  CRISPR gRNA sequence
cattcaccaaggttcagctc

SEQ ID NO: 465036 - DNA, 20 bp, Artificial
  CRISPR gRNA sequence
accaaggttcagctcaagta

SEQ ID NO: 465037 - DNA, 20 bp, Artificial
  CRISPR gRNA sequence
tcaagtatagcctttccatg

SEQ ID NO: 465038 - DNA, 20 bp, Artificial
  CRISPR gRNA sequence
ctttccatgaagctttgccc

SEQ ID NO: 465039 - DNA, 20 bp, Artificial
  CRISPR gRNA sequence
atgaagctttgccccggctg

SEQ ID NO: 465040 - DNA, 20 bp, Artificial
  CRISPR gRNA sequence
cggctgaagttaaccttctg

SEQ ID NO: 465041 - DNA, 20 bp, Artificial
  CRISPR gRNA sequence
accttctgcagacccatgca

SEQ ID NO: 465042 - DNA, 20 bp, Artificial
  CRISPR gRNA sequence
gtatcttttttttttttttt

SEQ ID NO: 465043 - DNA, 20 bp, Artificial
  CRISPR gRNA sequence
ctttttttttttttttgaga

SEQ ID NO: 465044 - DNA, 20 bp, Artificial
  CRISPR gRNA sequence
ttttttttttttttgagaca

SEQ ID NO: 465045 - DNA, 20 bp, Artificial
  CRISPR gRNA sequence
cagagtcttactgtgttgcc

SEQ ID NO: 465046 - DNA, 20 bp, Artificial
  CRISPR gRNA sequence
agagtcttactgtgttgccc

SEQ ID NO: 465047 - DNA, 20 bp, Artificial
  CRISPR gRNA sequence
tcttactgtgttgcccaggc

SEQ ID NO: 465048 - DNA, 20 bp, Artificial
  CRISPR gRNA sequence
ttactgtgttgcccaggctg

SEQ ID NO: 465049 - DNA, 20 bp, Artificial
  CRISPR gRNA sequence
gtgttgcccaggctggagtg

SEQ ID NO: 465050 - DNA, 20 bp, Artificial
  CRISPR gRNA sequence
ttgcccaggctggagtgcag

SEQ ID NO: 465051 - DNA, 20 bp, Artificial
  CRISPR gRNA sequence
ggagtgcagtggcatgatct

SEQ ID NO: 465052 - DNA, 20 bp, Artificial
  CRISPR gRNA sequence
gtggcatgatctcagctcac

SEQ ID NO: 465053 - DNA, 20 bp, Artificial
  CRISPR gRNA sequence
tctcagctcactggaacctc

SEQ ID NO: 465054 - DNA, 20 bp, Artificial
  CRISPR gRNA sequence
tcactggaacctccagttcc

SEQ ID NO: 465055 - DNA, 20 bp, Artificial
  CRISPR gRNA sequence
cactggaacctccagttcct

SEQ ID NO: 465056 - DNA, 20 bp, Artificial
  CRISPR gRNA sequence
aacctccagttcctgggttc

SEQ ID NO: 465057 - DNA, 20 bp, Artificial
  CRISPR gRNA sequence
ttcaagcaattctcctgcct

SEQ ID NO: 465058 - DNA, 20 bp, Artificial
  CRISPR gRNA sequence
ttctcctgcctcagcctctt

SEQ ID NO: 465059 - DNA, 20 bp, Artificial
  CRISPR gRNA sequence
tcctgcctcagcctcttgag

SEQ ID NO: 465060 - DNA, 20 bp, Artificial
  CRISPR gRNA sequence
gcctcagcctcttgagtagc

SEQ ID NO: 465061 - DNA, 20 bp, Artificial
  CRISPR gRNA sequence
cctcagcctcttgagtagct

SEQ ID NO: 465062 - DNA, 20 bp, Artificial
  CRISPR gRNA sequence
ctcttgagtagctgggatta

SEQ ID NO: 465063 - DNA, 20 bp, Artificial
  CRISPR gRNA sequence
tcttgagtagctgggattac

SEQ ID NO: 465064 - DNA, 20 bp, Artificial
  CRISPR gRNA sequence
caggcacgcaccaccacacc

SEQ ID NO: 465065 - DNA, 20 bp, Artificial
  CRISPR gRNA sequence
ctggctaatttttgtatttt

SEQ ID NO: 465066 - DNA, 20 bp, Artificial
  CRISPR gRNA sequence
taatttttgtatttttagta

SEQ ID NO: 465067 - DNA, 20 bp, Artificial
  CRISPR gRNA sequence
ttttgtatttttagtaaaga

SEQ ID NO: 465068 - DNA, 20 bp, Artificial
  CRISPR gRNA sequence
aagacggtgtttcaccatgt

SEQ ID NO: 465069 - DNA, 20 bp, Artificial
  CRISPR gRNA sequence
cggtgtttcaccatgttggt

SEQ ID NO: 465070 - DNA, 20 bp, Artificial
  CRISPR gRNA sequence
ggtgtttcaccatgttggtc

SEQ ID NO: 465071 - DNA, 20 bp, Artificial
  CRISPR gRNA sequence
tttcaccatgttggtcaggc

SEQ ID NO: 465072 - DNA, 20 bp, Artificial
  CRISPR gRNA sequence
tggtcttaaactcctgacct

SEQ ID NO: 465073 - DNA, 20 bp, Artificial
  CRISPR gRNA sequence
ggtcttaaactcctgacctc

SEQ ID NO: 465074 - DNA, 20 bp, Artificial
  CRISPR gRNA sequence
ctcaggtgatccacctccct

SEQ ID NO: 465075 - DNA, 20 bp, Artificial
  CRISPR gRNA sequence
ccacctccctcggcctccca

SEQ ID NO: 465076 - DNA, 20 bp, Artificial
  CRISPR gRNA sequence
ccctcggcctcccaaagtgc

SEQ ID NO: 465077 - DNA, 20 bp, Artificial
  CRISPR gRNA sequence
cctcggcctcccaaagtgct

SEQ ID NO: 465078 - DNA, 20 bp, Artificial
  CRISPR gRNA sequence
ctcccaaagtgctgggatta

SEQ ID NO: 465079 - DNA, 20 bp, Artificial
  CRISPR gRNA sequence
tcccaaagtgctgggattac

SEQ ID NO: 465080 - DNA, 20 bp, Artificial
  CRISPR gRNA sequence
agtgctgggattacaggcgt

SEQ ID NO: 465081 - DNA, 20 bp, Artificial
  CRISPR gRNA sequence
caggcgtgagccaccatgcc

SEQ ID NO: 465082 - DNA, 20 bp, Artificial
  CRISPR gRNA sequence
gccttgtttgtacctcttta

SEQ ID NO: 465083 - DNA, 20 bp, Artificial
  CRISPR gRNA sequence
cattcatttttatttcccat

SEQ ID NO: 465084 - DNA, 20 bp, Artificial
  CRISPR gRNA sequence
tcatttttatttcccattag

SEQ ID NO: 465085 - DNA, 20 bp, Artificial
  CRISPR gRNA sequence
catttttatttcccattaga

SEQ ID NO: 465086 - DNA, 20 bp, Artificial
  CRISPR gRNA sequence
tttatttcccattagaaggc

SEQ ID NO: 465087 - DNA, 20 bp, Artificial
  CRISPR gRNA sequence
gaaggcaagctccacaaatg

SEQ ID NO: 465088 - DNA, 20 bp, Artificial
  CRISPR gRNA sequence
catcctatctgatttattcc

SEQ ID NO: 465089 - DNA, 20 bp, Artificial
  CRISPR gRNA sequence
atcctatctgatttattcct

SEQ ID NO: 465090 - DNA, 20 bp, Artificial
  CRISPR gRNA sequence
ttcctaggcttcctaacaac

SEQ ID NO: 465091 - DNA, 20 bp, Artificial
  CRISPR gRNA sequence
accagcatgcaacgtccctc

SEQ ID NO: 465092 - DNA, 20 bp, Artificial
  CRISPR gRNA sequence
ccagcatgcaacgtccctca

SEQ ID NO: 465093 - DNA, 20 bp, Artificial
  CRISPR gRNA sequence
cgtccctcaaggcttgcttt

SEQ ID NO: 465094 - DNA, 20 bp, Artificial
  CRISPR gRNA sequence
ctcaaggcttgctttcagct

SEQ ID NO: 465095 - DNA, 20 bp, Artificial
  CRISPR gRNA sequence
ctttcagctcagtaaactga

SEQ ID NO: 465096 - DNA, 20 bp, Artificial
  CRISPR gRNA sequence
tcagtaaactgaaagaaata

SEQ ID NO: 465097 - DNA, 20 bp, Artificial
  CRISPR gRNA sequence
aaactgaaagaaataaagac

SEQ ID NO: 465098 - DNA, 20 bp, Artificial
  CRISPR gRNA sequence
aagaaataaagactggtata

SEQ ID NO: 465099 - DNA, 20 bp, Artificial
  CRISPR gRNA sequence
ggtatatagtaaattgattc

SEQ ID NO: 465100 - DNA, 20 bp, Artificial
  CRISPR gRNA sequence
atagtaaattgattctagaa

SEQ ID NO: 465101 - DNA, 20 bp, Artificial
  CRISPR gRNA sequence
attgattctagaaaagtgtc

SEQ ID NO: 465102 - DNA, 20 bp, Artificial
  CRISPR gRNA sequence
gattctagaaaagtgtctag

SEQ ID NO: 465103 - DNA, 20 bp, Artificial
  CRISPR gRNA sequence
attctagaaaagtgtctaga

SEQ ID NO: 465104 - DNA, 20 bp, Artificial
  CRISPR gRNA sequence
tctagaaggtaaattgattc

SEQ ID NO: 465105 - DNA, 20 bp, Artificial
  CRISPR gRNA sequence
gaaggtaaattgattctggc

SEQ ID NO: 465106 - DNA, 20 bp, Artificial
  CRISPR gRNA sequence
aaggtaaattgattctggcc

SEQ ID NO: 465107 - DNA, 20 bp, Artificial
  CRISPR gRNA sequence
aaattgattctggccaggtg

SEQ ID NO: 465108 - DNA, 20 bp, Artificial
  CRISPR gRNA sequence
ttgattctggccaggtgtgg

SEQ ID NO: 465109 - DNA, 20 bp, Artificial
  CRISPR gRNA sequence
ctggccaggtgtggtggctc

SEQ ID NO: 465110 - DNA, 20 bp, Artificial
  CRISPR gRNA sequence
gtggctcaagcctgtaatcc

SEQ ID NO: 465111 - DNA, 20 bp, Artificial
  CRISPR gRNA sequence
agcctgtaatcccagcactt

SEQ ID NO: 465112 - DNA, 20 bp, Artificial
  CRISPR gRNA sequence
gcctgtaatcccagcacttt

SEQ ID NO: 465113 - DNA, 20 bp, Artificial
  CRISPR gRNA sequence
ctgtaatcccagcactttgg

SEQ ID NO: 465114 - DNA, 20 bp, Artificial
  CRISPR gRNA sequence
tgtaatcccagcactttggg

SEQ ID NO: 465115 - DNA, 20 bp, Artificial
  CRISPR gRNA sequence
tcccagcactttgggaggcc

SEQ ID NO: 465116 - DNA, 20 bp, Artificial
  CRISPR gRNA sequence
gcactttgggaggccgagat

SEQ ID NO: 465117 - DNA, 20 bp, Artificial
  CRISPR gRNA sequence
ccgagatgagctgatcacct

SEQ ID NO: 465118 - DNA, 20 bp, Artificial
  CRISPR gRNA sequence
cgagatgagctgatcacctc

SEQ ID NO: 465119 - DNA, 20 bp, Artificial
  CRISPR gRNA sequence
atgagctgatcacctcaggt

SEQ ID NO: 465120 - DNA, 20 bp, Artificial
  CRISPR gRNA sequence
tgagctgatcacctcaggtt

SEQ ID NO: 465121 - DNA, 20 bp, Artificial
  CRISPR gRNA sequence
agctgatcacctcaggttgg

SEQ ID NO: 465122 - DNA, 20 bp, Artificial
  CRISPR gRNA sequence
tcacctcaggttgggagttc

SEQ ID NO: 465123 - DNA, 20 bp, Artificial
  CRISPR gRNA sequence
tcaggttgggagttcaagac

SEQ ID NO: 465124 - DNA, 20 bp, Artificial
  CRISPR gRNA sequence
agaccagcctgaccaacata

SEQ ID NO: 465125 - DNA, 20 bp, Artificial
  CRISPR gRNA sequence
ctttactaaaaatacaaaat

SEQ ID NO: 465126 - DNA, 20 bp, Artificial
  CRISPR gRNA sequence
actaaaaatacaaaatcagc

SEQ ID NO: 465127 - DNA, 20 bp, Artificial
  CRISPR gRNA sequence
ctaaaaatacaaaatcagct

SEQ ID NO: 465128 - DNA, 20 bp, Artificial
  CRISPR gRNA sequence
aatacaaaatcagctgggcg

SEQ ID NO: 465129 - DNA, 20 bp, Artificial
  CRISPR gRNA sequence
acaaaatcagctgggcgtgg

SEQ ID NO: 465130 - DNA, 20 bp, Artificial
  CRISPR gRNA sequence
aaatcagctgggcgtggtgg

SEQ ID NO: 465131 - DNA, 20 bp, Artificial
  CRISPR gRNA sequence
aatcagctgggcgtggtggt

SEQ ID NO: 465132 - DNA, 20 bp, Artificial
  CRISPR gRNA sequence
gtggtgggcgcctgtaatcc

SEQ ID NO: 465133 - DNA, 20 bp, Artificial
  CRISPR gRNA sequence
cgcctgtaatcccagttacc

SEQ ID NO: 465134 - DNA, 20 bp, Artificial
  CRISPR gRNA sequence
gcctgtaatcccagttaccc

SEQ ID NO: 465135 - DNA, 20 bp, Artificial
  CRISPR gRNA sequence
ctgtaatcccagttacccgg

SEQ ID NO: 465136 - DNA, 20 bp, Artificial
  CRISPR gRNA sequence
tgtaatcccagttacccggg

SEQ ID NO: 465137 - DNA, 20 bp, Artificial
  CRISPR gRNA sequence
tcccagttacccgggaggct

SEQ ID NO: 465138 - DNA, 20 bp, Artificial
  CRISPR gRNA sequence
cccagttacccgggaggctg

SEQ ID NO: 465139 - DNA, 20 bp, Artificial
  CRISPR gRNA sequence
agttacccgggaggctgagg

SEQ ID NO: 465140 - DNA, 20 bp, Artificial
  CRISPR gRNA sequence
gttacccgggaggctgaggc

SEQ ID NO: 465141 - DNA, 20 bp, Artificial
  CRISPR gRNA sequence
tacccgggaggctgaggcag

SEQ ID NO: 465142 - DNA, 20 bp, Artificial
  CRISPR gRNA sequence
gcaggagaatcgcttaaacc

SEQ ID NO: 465143 - DNA, 20 bp, Artificial
  CRISPR gRNA sequence
caggagaatcgcttaaaccc

SEQ ID NO: 465144 - DNA, 20 bp, Artificial
  CRISPR gRNA sequence
ggagaatcgcttaaacccgg

SEQ ID NO: 465145 - DNA, 20 bp, Artificial
  CRISPR gRNA sequence
gagaatcgcttaaacccggg

SEQ ID NO: 465146 - DNA, 20 bp, Artificial
  CRISPR gRNA sequence
aatcgcttaaacccgggagg

SEQ ID NO: 465147 - DNA, 20 bp, Artificial
  CRISPR gRNA sequence
tcgcttaaacccgggaggca

SEQ ID NO: 465148 - DNA, 20 bp, Artificial
  CRISPR gRNA sequence
cgcttaaacccgggaggcag

SEQ ID NO: 465149 - DNA, 20 bp, Artificial
  CRISPR gRNA sequence
aacccgggaggcagaggtta

SEQ ID NO: 465150 - DNA, 20 bp, Artificial
  CRISPR gRNA sequence
cgggaggcagaggttacggt

SEQ ID NO: 465151 - DNA, 20 bp, Artificial
  CRISPR gRNA sequence
ggcagaggttacggtgagcc

SEQ ID NO: 465152 - DNA, 20 bp, Artificial
  CRISPR gRNA sequence
gagatcatgccattgcattc

SEQ ID NO: 465153 - DNA, 20 bp, Artificial
  CRISPR gRNA sequence
tgcattccagcctgtgcaac

SEQ ID NO: 465154 - DNA, 20 bp, Artificial
  CRISPR gRNA sequence
cattccagcctgtgcaacaa

SEQ ID NO: 465155 - DNA, 20 bp, Artificial
  CRISPR gRNA sequence
aaaaaaaaaaaaaaaaaaaa

SEQ ID NO: 465156 - DNA, 20 bp, Artificial
  CRISPR gRNA sequence
aaaaaaaaaaaaaaaaaaga

SEQ ID NO: 465157 - DNA, 20 bp, Artificial
  CRISPR gRNA sequence
aaaaaaaaaaaaaaaaagaa

SEQ ID NO: 465158 - DNA, 20 bp, Artificial
  CRISPR gRNA sequence
aagaaaggtgccctctttgt

SEQ ID NO: 465159 - DNA, 20 bp, Artificial
  CRISPR gRNA sequence
ccctctttgttagatactcc

SEQ ID NO: 465160 - DNA, 20 bp, Artificial
  CRISPR gRNA sequence
cctctttgttagatactcct

SEQ ID NO: 465161 - DNA, 20 bp, Artificial
  CRISPR gRNA sequence
ctctttgttagatactcctg

SEQ ID NO: 465162 - DNA, 20 bp, Artificial
  CRISPR gRNA sequence
cctggggcttaccaattaaa

SEQ ID NO: 465163 - DNA, 20 bp, Artificial
  CRISPR gRNA sequence
aattaaatggtaaactcttt

SEQ ID NO: 465164 - DNA, 20 bp, Artificial
  CRISPR gRNA sequence
attaaatggtaaactctttg

SEQ ID NO: 465165 - DNA, 20 bp, Artificial
  CRISPR gRNA sequence
ttaaatggtaaactctttga

SEQ ID NO: 465166 - DNA, 20 bp, Artificial
  CRISPR gRNA sequence
ggtaaactctttgagggtaa

SEQ ID NO: 465167 - DNA, 20 bp, Artificial
  CRISPR gRNA sequence
ctcattgttttttataattc

SEQ ID NO: 465168 - DNA, 20 bp, Artificial
  CRISPR gRNA sequence
tgttttttataattctagca

SEQ ID NO: 465169 - DNA, 20 bp, Artificial
  CRISPR gRNA sequence
ttataattctagcacagact

SEQ ID NO: 465170 - DNA, 20 bp, Artificial
  CRISPR gRNA sequence
ataattctagcacagactta

SEQ ID NO: 465171 - DNA, 20 bp, Artificial
  CRISPR gRNA sequence
taattctagcacagacttag

SEQ ID NO: 465172 - DNA, 20 bp, Artificial
  CRISPR gRNA sequence
aaaccattattgacttatcc

SEQ ID NO: 465173 - DNA, 20 bp, Artificial
  CRISPR gRNA sequence
gacttatccaagaaaatgaa

SEQ ID NO: 465174 - DNA, 20 bp, Artificial
  CRISPR gRNA sequence
acttatccaagaaaatgaaa

SEQ ID NO: 465175 - DNA, 20 bp, Artificial
  CRISPR gRNA sequence
cttatccaagaaaatgaaaa

SEQ ID NO: 465176 - DNA, 20 bp, Artificial
  CRISPR gRNA sequence
atccaagaaaatgaaaaggg

SEQ ID NO: 465177 - DNA, 20 bp, Artificial
  CRISPR gRNA sequence
aagaaaatgaaaagggaagt

SEQ ID NO: 465178 - DNA, 20 bp, Artificial
  CRISPR gRNA sequence
agaaaatgaaaagggaagtt

SEQ ID NO: 465179 - DNA, 20 bp, Artificial
  CRISPR gRNA sequence
aaaatgaaaagggaagttag

SEQ ID NO: 465180 - DNA, 20 bp, Artificial
  CRISPR gRNA sequence
aaatgaaaagggaagttagg

SEQ ID NO: 465181 - DNA, 20 bp, Artificial
  CRISPR gRNA sequence
aaaagggaagttaggaggct

SEQ ID NO: 465182 - DNA, 20 bp, Artificial
  CRISPR gRNA sequence
aaagggaagttaggaggctg

SEQ ID NO: 465183 - DNA, 20 bp, Artificial
  CRISPR gRNA sequence
aagggaagttaggaggctga

SEQ ID NO: 465184 - DNA, 20 bp, Artificial
  CRISPR gRNA sequence
gggaagttaggaggctgagg

SEQ ID NO: 465185 - DNA, 20 bp, Artificial
  CRISPR gRNA sequence
ctgagggagtctattaactt

SEQ ID NO: 465186 - DNA, 20 bp, Artificial
  CRISPR gRNA sequence
tgagggagtctattaacttc

SEQ ID NO: 465187 - DNA, 20 bp, Artificial
  CRISPR gRNA sequence
gagggagtctattaacttca

SEQ ID NO: 465188 - DNA, 20 bp, Artificial
  CRISPR gRNA sequence
gggagtctattaacttcagg

SEQ ID NO: 465189 - DNA, 20 bp, Artificial
  CRISPR gRNA sequence
gagtctattaacttcaggga

SEQ ID NO: 465190 - DNA, 20 bp, Artificial
  CRISPR gRNA sequence
agtctattaacttcagggag

SEQ ID NO: 465191 - DNA, 20 bp, Artificial
  CRISPR gRNA sequence
attaacttcagggagaggaa

SEQ ID NO: 465192 - DNA, 20 bp, Artificial
  CRISPR gRNA sequence
cagggagaggaacggacttc

SEQ ID NO: 465193 - DNA, 20 bp, Artificial
  CRISPR gRNA sequence
aggaacggacttctggaaac

SEQ ID NO: 465194 - DNA, 20 bp, Artificial
  CRISPR gRNA sequence
gaacggacttctggaaacaa

SEQ ID NO: 465195 - DNA, 20 bp, Artificial
  CRISPR gRNA sequence
tcacttgacctttctgcctc

SEQ ID NO: 465196 - DNA, 20 bp, Artificial
  CRISPR gRNA sequence
cttcttactttttttgtcct

SEQ ID NO: 465197 - DNA, 20 bp, Artificial
  CRISPR gRNA sequence
gtcctaagtctaaccacatt

SEQ ID NO: 465198 - DNA, 20 bp, Artificial
  CRISPR gRNA sequence
tcctaagtctaaccacattc

SEQ ID NO: 465199 - DNA, 20 bp, Artificial
  CRISPR gRNA sequence
cattcaggtacacttccttt

SEQ ID NO: 465200 - DNA, 20 bp, Artificial
  CRISPR gRNA sequence
catccttataacttaccttt

SEQ ID NO: 465201 - DNA, 20 bp, Artificial
  CRISPR gRNA sequence
ttataacttacctttcagtt

SEQ ID NO: 465202 - DNA, 20 bp, Artificial
  CRISPR gRNA sequence
ctttcagtttggtttcattt

SEQ ID NO: 465203 - DNA, 20 bp, Artificial
  CRISPR gRNA sequence
tcattttagttctaaacttt

SEQ ID NO: 465204 - DNA, 20 bp, Artificial
  CRISPR gRNA sequence
ttttagttctaaacttttgg

SEQ ID NO: 465205 - DNA, 20 bp, Artificial
  CRISPR gRNA sequence
cttttggaagcaactgaatt

SEQ ID NO: 465206 - DNA, 20 bp, Artificial
  CRISPR gRNA sequence
ttggaagcaactgaattaag

SEQ ID NO: 465207 - DNA, 20 bp, Artificial
  CRISPR gRNA sequence
aactgaattaagaagtctta

SEQ ID NO: 465208 - DNA, 20 bp, Artificial
  CRISPR gRNA sequence
gtcttaaagtgaacttgctt

SEQ ID NO: 465209 - DNA, 20 bp, Artificial
  CRISPR gRNA sequence
tcttaaagtgaacttgcttg

SEQ ID NO: 465210 - DNA, 20 bp, Artificial
  CRISPR gRNA sequence
tgaacttgcttgaggtctca

SEQ ID NO: 465211 - DNA, 20 bp, Artificial
  CRISPR gRNA sequence
attataaataaataaatatt

SEQ ID NO: 465212 - DNA, 20 bp, Artificial
  CRISPR gRNA sequence
tataaataaataaatattaa

SEQ ID NO: 465213 - DNA, 20 bp, Artificial
  CRISPR gRNA sequence
ataaataaataaatattaag

SEQ ID NO: 465214 - DNA, 20 bp, Artificial
  CRISPR gRNA sequence
taaatattaagaggttctaa

SEQ ID NO: 465215 - DNA, 20 bp, Artificial
  CRISPR gRNA sequence
gaggttctaaaagttgtctg

SEQ ID NO: 465216 - DNA, 20 bp, Artificial
  CRISPR gRNA sequence
aggttctaaaagttgtctgc

SEQ ID NO: 465217 - DNA, 20 bp, Artificial
  CRISPR gRNA sequence
ctttttctcactctgattcc

SEQ ID NO: 465218 - DNA, 20 bp, Artificial
  CRISPR gRNA sequence
ctgattcctggaaactcaat

SEQ ID NO: 465219 - DNA, 20 bp, Artificial
  CRISPR gRNA sequence
tgattcctggaaactcaatc

SEQ ID NO: 465220 - DNA, 20 bp, Artificial
  CRISPR gRNA sequence
aatcaggtttctattattct

SEQ ID NO: 465221 - DNA, 20 bp, Artificial
  CRISPR gRNA sequence
caggtttctattattctgag

SEQ ID NO: 465222 - DNA, 20 bp, Artificial
  CRISPR gRNA sequence
ggtttctattattctgagca

SEQ ID NO: 465223 - DNA, 20 bp, Artificial
  CRISPR gRNA sequence
tattctgagcagagattcat

SEQ ID NO: 465224 - DNA, 20 bp, Artificial
  CRISPR gRNA sequence
agcagagattcatgagatgt

SEQ ID NO: 465225 - DNA, 20 bp, Artificial
  CRISPR gRNA sequence
agagattcatgagatgtgag

SEQ ID NO: 465226 - DNA, 20 bp, Artificial
  CRISPR gRNA sequence
gagattcatgagatgtgagc

SEQ ID NO: 465227 - DNA, 20 bp, Artificial
  CRISPR gRNA sequence
attcatgagatgtgagcagg

SEQ ID NO: 465228 - DNA, 20 bp, Artificial
  CRISPR gRNA sequence
ttcatgagatgtgagcagga

SEQ ID NO: 465229 - DNA, 20 bp, Artificial
  CRISPR gRNA sequence
tcatgagatgtgagcaggaa

SEQ ID NO: 465230 - DNA, 20 bp, Artificial
  CRISPR gRNA sequence
tgtgagcaggaagggttttt

SEQ ID NO: 465231 - DNA, 20 bp, Artificial
  CRISPR gRNA sequence
gagcaggaagggtttttaag

SEQ ID NO: 465232 - DNA, 20 bp, Artificial
  CRISPR gRNA sequence
agcaggaagggtttttaagt

SEQ ID NO: 465233 - DNA, 20 bp, Artificial
  CRISPR gRNA sequence
agggtttttaagtaggatgt

SEQ ID NO: 465234 - DNA, 20 bp, Artificial
  CRISPR gRNA sequence
tttaagtaggatgtgagtga

SEQ ID NO: 465235 - DNA, 20 bp, Artificial
  CRISPR gRNA sequence
ttaagtaggatgtgagtgaa

SEQ ID NO: 465236 - DNA, 20 bp, Artificial
  CRISPR gRNA sequence
gatgtgagtgaaaggtgtat

SEQ ID NO: 465237 - DNA, 20 bp, Artificial
  CRISPR gRNA sequence
atgtgagtgaaaggtgtatt

SEQ ID NO: 465238 - DNA, 20 bp, Artificial
  CRISPR gRNA sequence
gtgaaaggtgtattaggtgt

SEQ ID NO: 465239 - DNA, 20 bp, Artificial
  CRISPR gRNA sequence
tgaaaggtgtattaggtgtg

SEQ ID NO: 465240 - DNA, 20 bp, Artificial
  CRISPR gRNA sequence
gtgtattaggtgtgaggaaa

SEQ ID NO: 465241 - DNA, 20 bp, Artificial
  CRISPR gRNA sequence
tgtgaggaaatagataaaat

SEQ ID NO: 465242 - DNA, 20 bp, Artificial
  CRISPR gRNA sequence
taaaatgagaatatttatgc

SEQ ID NO: 465243 - DNA, 20 bp, Artificial
  CRISPR gRNA sequence
atgagaatatttatgctggc

SEQ ID NO: 465244 - DNA, 20 bp, Artificial
  CRISPR gRNA sequence
tgagaatatttatgctggca

SEQ ID NO: 465245 - DNA, 20 bp, Artificial
  CRISPR gRNA sequence
gagaatatttatgctggcaa

SEQ ID NO: 465246 - DNA, 20 bp, Artificial
  CRISPR gRNA sequence
tatttatgctggcaagggtg

SEQ ID NO: 465247 - DNA, 20 bp, Artificial
  CRISPR gRNA sequence
gctggcaagggtgtagaaat

SEQ ID NO: 465248 - DNA, 20 bp, Artificial
  CRISPR gRNA sequence
ctggcaagggtgtagaaata

SEQ ID NO: 465249 - DNA, 20 bp, Artificial
  CRISPR gRNA sequence
aataaggtgaaaccttgttc

SEQ ID NO: 465250 - DNA, 20 bp, Artificial
  CRISPR gRNA sequence
aggtgaaaccttgttctgga

SEQ ID NO: 465251 - DNA, 20 bp, Artificial
  CRISPR gRNA sequence
tgttctggatagacatgtat

SEQ ID NO: 465252 - DNA, 20 bp, Artificial
  CRISPR gRNA sequence
atagacatgtatgagaaact

SEQ ID NO: 465253 - DNA, 20 bp, Artificial
  CRISPR gRNA sequence
tagacatgtatgagaaactc

SEQ ID NO: 465254 - DNA, 20 bp, Artificial
  CRISPR gRNA sequence
agacatgtatgagaaactca

SEQ ID NO: 465255 - DNA, 20 bp, Artificial
  CRISPR gRNA sequence
cagggtcaaaatttgctcct

SEQ ID NO: 465256 - DNA, 20 bp, Artificial
  CRISPR gRNA sequence
tccttggttcaacatctgac

SEQ ID NO: 465257 - DNA, 20 bp, Artificial
  CRISPR gRNA sequence
tctgacaagctgtgtgatca

SEQ ID NO: 465258 - DNA, 20 bp, Artificial
  CRISPR gRNA sequence
ctgacaagctgtgtgatcac

SEQ ID NO: 465259 - DNA, 20 bp, Artificial
  CRISPR gRNA sequence
caagctgtgtgatcacaggc

SEQ ID NO: 465260 - DNA, 20 bp, Artificial
  CRISPR gRNA sequence
aagctgtgtgatcacaggca

SEQ ID NO: 465261 - DNA, 20 bp, Artificial
  CRISPR gRNA sequence
gtgatcacaggcaaggcctt

SEQ ID NO: 465262 - DNA, 20 bp, Artificial
  CRISPR gRNA sequence
ttagctgtctttgtatttaa

SEQ ID NO: 465263 - DNA, 20 bp, Artificial
  CRISPR gRNA sequence
agctgtctttgtatttaaaa

SEQ ID NO: 465264 - DNA, 20 bp, Artificial
  CRISPR gRNA sequence
ctgtctttgtatttaaaaga

SEQ ID NO: 465265 - DNA, 20 bp, Artificial
  CRISPR gRNA sequence
ttgtatttaaaagagagttt

SEQ ID NO: 465266 - DNA, 20 bp, Artificial
  CRISPR gRNA sequence
tatgatactgtacatctatt

SEQ ID NO: 465267 - DNA, 20 bp, Artificial
  CRISPR gRNA sequence
gatactgtacatctattcag

SEQ ID NO: 465268 - DNA, 20 bp, Artificial
  CRISPR gRNA sequence
tcagaagaatgcatgaaaat

SEQ ID NO: 465269 - DNA, 20 bp, Artificial
  CRISPR gRNA sequence
atgagtgaaataaataaatg

SEQ ID NO: 465270 - DNA, 20 bp, Artificial
  CRISPR gRNA sequence
tgagtgaaataaataaatga

SEQ ID NO: 465271 - DNA, 20 bp, Artificial
  CRISPR gRNA sequence
agtgaaataaataaatgaag

SEQ ID NO: 465272 - DNA, 20 bp, Artificial
  CRISPR gRNA sequence
aataaatgaaggagatgaac

SEQ ID NO: 465273 - DNA, 20 bp, Artificial
  CRISPR gRNA sequence
gagatgaactagacattgct

SEQ ID NO: 465274 - DNA, 20 bp, Artificial
  CRISPR gRNA sequence
gatgaactagacattgctaa

SEQ ID NO: 465275 - DNA, 20 bp, Artificial
  CRISPR gRNA sequence
tgaactagacattgctaaga

SEQ ID NO: 465276 - DNA, 20 bp, Artificial
  CRISPR gRNA sequence
ctagacattgctaagagaga

SEQ ID NO: 465277 - DNA, 20 bp, Artificial
  CRISPR gRNA sequence
gacattgctaagagagacgg

SEQ ID NO: 465278 - DNA, 20 bp, Artificial
  CRISPR gRNA sequence
agagacggtagttcaaaaca

SEQ ID NO: 465279 - DNA, 20 bp, Artificial
  CRISPR gRNA sequence
acggtagttcaaaacataga

SEQ ID NO: 465280 - DNA, 20 bp, Artificial
  CRISPR gRNA sequence
tagttcaaaacatagaaaga

SEQ ID NO: 465281 - DNA, 20 bp, Artificial
  CRISPR gRNA sequence
agttcaaaacatagaaagaa

SEQ ID NO: 465282 - DNA, 20 bp, Artificial
  CRISPR gRNA sequence
aaaacatagaaagaaaggct

SEQ ID NO: 465283 - DNA, 20 bp, Artificial
  CRISPR gRNA sequence
catagaaagaaaggctaaga

SEQ ID NO: 465284 - DNA, 20 bp, Artificial
  CRISPR gRNA sequence
aaaggctaagaaagaactgt

SEQ ID NO: 465285 - DNA, 20 bp, Artificial
  CRISPR gRNA sequence
aggctaagaaagaactgtaa

SEQ ID NO: 465286 - DNA, 20 bp, Artificial
  CRISPR gRNA sequence
ctaagaaagaactgtaagag

SEQ ID NO: 465287 - DNA, 20 bp, Artificial
  CRISPR gRNA sequence
aagaaagaactgtaagagtg

SEQ ID NO: 465288 - DNA, 20 bp, Artificial
  CRISPR gRNA sequence
tggagaaaaaaataatttaa

SEQ ID NO: 465289 - DNA, 20 bp, Artificial
  CRISPR gRNA sequence
aatttaaaagaaaatacttt

SEQ ID NO: 465290 - DNA, 20 bp, Artificial
  CRISPR gRNA sequence
atttaaaagaaaatactttt

SEQ ID NO: 465291 - DNA, 20 bp, Artificial
  CRISPR gRNA sequence
tacttttaggatcacgtgct

SEQ ID NO: 465292 - DNA, 20 bp, Artificial
  CRISPR gRNA sequence
gtgcttagccttaactttac

SEQ ID NO: 465293 - DNA, 20 bp, Artificial
  CRISPR gRNA sequence
aaaaaatacaaatcaacacc

SEQ ID NO: 465294 - DNA, 20 bp, Artificial
  CRISPR gRNA sequence
aacaccaagtgcataactaa

SEQ ID NO: 465295 - DNA, 20 bp, Artificial
  CRISPR gRNA sequence
acaccaagtgcataactaaa

SEQ ID NO: 465296 - DNA, 20 bp, Artificial
  CRISPR gRNA sequence
gtgcataactaaaaggaaat

SEQ ID NO: 465297 - DNA, 20 bp, Artificial
  CRISPR gRNA sequence
actaaaaggaaatgagaaac

SEQ ID NO: 465298 - DNA, 20 bp, Artificial
  CRISPR gRNA sequence
ggaaatgagaaacaagccat

SEQ ID NO: 465299 - DNA, 20 bp, Artificial
  CRISPR gRNA sequence
agaaacaagccattggaaac

SEQ ID NO: 465300 - DNA, 20 bp, Artificial
  CRISPR gRNA sequence
aaacaagccattggaaactg

SEQ ID NO: 465301 - DNA, 20 bp, Artificial
  CRISPR gRNA sequence
agccattggaaactggagta

SEQ ID NO: 465302 - DNA, 20 bp, Artificial
  CRISPR gRNA sequence
gccattggaaactggagtaa

SEQ ID NO: 465303 - DNA, 20 bp, Artificial
  CRISPR gRNA sequence
taaaggccattcttgtcata

SEQ ID NO: 465304 - DNA, 20 bp, Artificial
  CRISPR gRNA sequence
attcttgtcatacagttgct

SEQ ID NO: 465305 - DNA, 20 bp, Artificial
  CRISPR gRNA sequence
tcatacagttgctaagaact

SEQ ID NO: 465306 - DNA, 20 bp, Artificial
  CRISPR gRNA sequence
tacagttgctaagaacttgg

SEQ ID NO: 465307 - DNA, 20 bp, Artificial
  CRISPR gRNA sequence
gtggaaatgtatctatgtct

SEQ ID NO: 465308 - DNA, 20 bp, Artificial
  CRISPR gRNA sequence
tggaaatgtatctatgtctt

SEQ ID NO: 465309 - DNA, 20 bp, Artificial
  CRISPR gRNA sequence
atctatgtcttaggacttta

SEQ ID NO: 465310 - DNA, 20 bp, Artificial
  CRISPR gRNA sequence
atgtcttaggactttacgga

SEQ ID NO: 465311 - DNA, 20 bp, Artificial
  CRISPR gRNA sequence
tcttaggactttacggaaag

SEQ ID NO: 465312 - DNA, 20 bp, Artificial
  CRISPR gRNA sequence
ctttacggaaagcagaaatt

SEQ ID NO: 465313 - DNA, 20 bp, Artificial
  CRISPR gRNA sequence
ttacggaaagcagaaattaa

SEQ ID NO: 465314 - DNA, 20 bp, Artificial
  CRISPR gRNA sequence
agaaattaagagcaataatt

SEQ ID NO: 465315 - DNA, 20 bp, Artificial
  CRISPR gRNA sequence
gaaattaagagcaataattc

SEQ ID NO: 465316 - DNA, 20 bp, Artificial
  CRISPR gRNA sequence
gagcaataattcaggatatc

SEQ ID NO: 465317 - DNA, 20 bp, Artificial
  CRISPR gRNA sequence
caataattcaggatatctgg

SEQ ID NO: 465318 - DNA, 20 bp, Artificial
  CRISPR gRNA sequence
taattcaggatatctggtgg

SEQ ID NO: 465319 - DNA, 20 bp, Artificial
  CRISPR gRNA sequence
atctggtggaagaaatatct

SEQ ID NO: 465320 - DNA, 20 bp, Artificial
  CRISPR gRNA sequence
gaagaaatatctaagccgca

SEQ ID NO: 465321 - DNA, 20 bp, Artificial
  CRISPR gRNA sequence
tatctaagccgcaaagcatt

SEQ ID NO: 465322 - DNA, 20 bp, Artificial
  CRISPR gRNA sequence
atctaagccgcaaagcattt

SEQ ID NO: 465323 - DNA, 20 bp, Artificial
  CRISPR gRNA sequence
aaagcatttaggctgctgtg

SEQ ID NO: 465324 - DNA, 20 bp, Artificial
  CRISPR gRNA sequence
tggctacttttaactgcata

SEQ ID NO: 465325 - DNA, 20 bp, Artificial
  CRISPR gRNA sequence
tacttttaactgcatacagt

SEQ ID NO: 465326 - DNA, 20 bp, Artificial
  CRISPR gRNA sequence
cttttaactgcatacagtaa

SEQ ID NO: 465327 - DNA, 20 bp, Artificial
  CRISPR gRNA sequence
ttttaactgcatacagtaag

SEQ ID NO: 465328 - DNA, 20 bp, Artificial
  CRISPR gRNA sequence
taactgcatacagtaagagg

SEQ ID NO: 465329 - DNA, 20 bp, Artificial
  CRISPR gRNA sequence
aactgcatacagtaagaggc

SEQ ID NO: 465330 - DNA, 20 bp, Artificial
  CRISPR gRNA sequence
ctgcatacagtaagaggcag

SEQ ID NO: 465331 - DNA, 20 bp, Artificial
  CRISPR gRNA sequence
tgcatacagtaagaggcagg

SEQ ID NO: 465332 - DNA, 20 bp, Artificial
  CRISPR gRNA sequence
gcatacagtaagaggcagga

SEQ ID NO: 465333 - DNA, 20 bp, Artificial
  CRISPR gRNA sequence
ggaaaaaaatgacttaaaaa

SEQ ID NO: 465334 - DNA, 20 bp, Artificial
  CRISPR gRNA sequence
aaaatggaatttataattaa

SEQ ID NO: 465335 - DNA, 20 bp, Artificial
  CRISPR gRNA sequence
aatggaatttataattaaaa

SEQ ID NO: 465336 - DNA, 20 bp, Artificial
  CRISPR gRNA sequence
ggaatttataattaaaagag

SEQ ID NO: 465337 - DNA, 20 bp, Artificial
  CRISPR gRNA sequence
atttataattaaaagagaag

SEQ ID NO: 465338 - DNA, 20 bp, Artificial
  CRISPR gRNA sequence
taattaaaagagaagcagaa

SEQ ID NO: 465339 - DNA, 20 bp, Artificial
  CRISPR gRNA sequence
taaaagagaagcagaataga

SEQ ID NO: 465340 - DNA, 20 bp, Artificial
  CRISPR gRNA sequence
agaagcagaatagaaagatt

SEQ ID NO: 465341 - DNA, 20 bp, Artificial
  CRISPR gRNA sequence
gatttggaaaattcactgcc

SEQ ID NO: 465342 - DNA, 20 bp, Artificial
  CRISPR gRNA sequence
tcactgcctagccatataaa

SEQ ID NO: 465343 - DNA, 20 bp, Artificial
  CRISPR gRNA sequence
ctagccatataaaaagtgaa

SEQ ID NO: 465344 - DNA, 20 bp, Artificial
  CRISPR gRNA sequence
tagccatataaaaagtgaaa

SEQ ID NO: 465345 - DNA, 20 bp, Artificial
  CRISPR gRNA sequence
aaaaagtgaaaaggcatgaa

SEQ ID NO: 465346 - DNA, 20 bp, Artificial
  CRISPR gRNA sequence
aaaagtgaaaaggcatgaat

SEQ ID NO: 465347 - DNA, 20 bp, Artificial
  CRISPR gRNA sequence
aagtgaaaaggcatgaatgg

SEQ ID NO: 465348 - DNA, 20 bp, Artificial
  CRISPR gRNA sequence
catgaatgggagaaaatact

SEQ ID NO: 465349 - DNA, 20 bp, Artificial
  CRISPR gRNA sequence
atgaatgggagaaaatacta

SEQ ID NO: 465350 - DNA, 20 bp, Artificial
  CRISPR gRNA sequence
tgaatgggagaaaatactaa

SEQ ID NO: 465351 - DNA, 20 bp, Artificial
  CRISPR gRNA sequence
gggagaaaatactaagggtg

SEQ ID NO: 465352 - DNA, 20 bp, Artificial
  CRISPR gRNA sequence
aaaatactaagggtgtggcc

SEQ ID NO: 465353 - DNA, 20 bp, Artificial
  CRISPR gRNA sequence
tggcctagtgaccattgtta

SEQ ID NO: 465354 - DNA, 20 bp, Artificial
  CRISPR gRNA sequence
gcctagtgaccattgttaaa

SEQ ID NO: 465355 - DNA, 20 bp, Artificial
  CRISPR gRNA sequence
cattgttaaagagattaata

SEQ ID NO: 465356 - DNA, 20 bp, Artificial
  CRISPR gRNA sequence
gttaaagagattaatatgga

SEQ ID NO: 465357 - DNA, 20 bp, Artificial
  CRISPR gRNA sequence
aaagagattaatatggatag

SEQ ID NO: 465358 - DNA, 20 bp, Artificial
  CRISPR gRNA sequence
aagagattaatatggataga

SEQ ID NO: 465359 - DNA, 20 bp, Artificial
  CRISPR gRNA sequence
agagattaatatggatagaa

SEQ ID NO: 465360 - DNA, 20 bp, Artificial
  CRISPR gRNA sequence
agattaatatggatagaagg

SEQ ID NO: 465361 - DNA, 20 bp, Artificial
  CRISPR gRNA sequence
aatatggatagaagggagtg

SEQ ID NO: 465362 - DNA, 20 bp, Artificial
  CRISPR gRNA sequence
aagggagtgaagtactattc

SEQ ID NO: 465363 - DNA, 20 bp, Artificial
  CRISPR gRNA sequence
ggagtgaagtactattcaag

SEQ ID NO: 465364 - DNA, 20 bp, Artificial
  CRISPR gRNA sequence
gaagtactattcaagaagtt

SEQ ID NO: 465365 - DNA, 20 bp, Artificial
  CRISPR gRNA sequence
ctattcaagaagttgagaaa

SEQ ID NO: 465366 - DNA, 20 bp, Artificial
  CRISPR gRNA sequence
tattcaagaagttgagaaaa

SEQ ID NO: 465367 - DNA, 20 bp, Artificial
  CRISPR gRNA sequence
aagttgagaaaaaggccctg

SEQ ID NO: 465368 - DNA, 20 bp, Artificial
  CRISPR gRNA sequence
agttgagaaaaaggccctga

SEQ ID NO: 465369 - DNA, 20 bp, Artificial
  CRISPR gRNA sequence
aaggccctgaaggcatttca

SEQ ID NO: 465370 - DNA, 20 bp, Artificial
  CRISPR gRNA sequence
gaaggcatttcaaagccttt

SEQ ID NO: 465371 - DNA, 20 bp, Artificial
  CRISPR gRNA sequence
aaggcatttcaaagcctttg

SEQ ID NO: 465372 - DNA, 20 bp, Artificial
  CRISPR gRNA sequence
tgaggctgcccctcccatca

SEQ ID NO: 465373 - DNA, 20 bp, Artificial
  CRISPR gRNA sequence
gaggctgcccctcccatcat

SEQ ID NO: 465374 - DNA, 20 bp, Artificial
  CRISPR gRNA sequence
tgcccctcccatcataggct

SEQ ID NO: 465375 - DNA, 20 bp, Artificial
  CRISPR gRNA sequence
cccctcccatcataggctca

SEQ ID NO: 465376 - DNA, 20 bp, Artificial
  CRISPR gRNA sequence
cccatcataggctcagagct

SEQ ID NO: 465377 - DNA, 20 bp, Artificial
  CRISPR gRNA sequence
catcataggctcagagctca

SEQ ID NO: 465378 - DNA, 20 bp, Artificial
  CRISPR gRNA sequence
atcataggctcagagctcag

SEQ ID NO: 465379 - DNA, 20 bp, Artificial
  CRISPR gRNA sequence
tcataggctcagagctcaga

SEQ ID NO: 465380 - DNA, 20 bp, Artificial
  CRISPR gRNA sequence
ctcagagggcaaattgattt

SEQ ID NO: 465381 - DNA, 20 bp, Artificial
  CRISPR gRNA sequence
tcagagggcaaattgatttc

SEQ ID NO: 465382 - DNA, 20 bp, Artificial
  CRISPR gRNA sequence
cagagggcaaattgatttca

SEQ ID NO: 465383 - DNA, 20 bp, Artificial
  CRISPR gRNA sequence
agagggcaaattgatttcag

SEQ ID NO: 465384 - DNA, 20 bp, Artificial
  CRISPR gRNA sequence
aaattgatttcaggggaaac

SEQ ID NO: 465385 - DNA, 20 bp, Artificial
  CRISPR gRNA sequence
ggaaactagaatgcccttta

SEQ ID NO: 465386 - DNA, 20 bp, Artificial
  CRISPR gRNA sequence
gaaactagaatgccctttac

SEQ ID NO: 465387 - DNA, 20 bp, Artificial
  CRISPR gRNA sequence
ccctttacaggcttgctgcc

SEQ ID NO: 465388 - DNA, 20 bp, Artificial
  CRISPR gRNA sequence
cttgctgcccagatctgcct

SEQ ID NO: 465389 - DNA, 20 bp, Artificial
  CRISPR gRNA sequence
ttgctgcccagatctgcctc

SEQ ID NO: 465390 - DNA, 20 bp, Artificial
  CRISPR gRNA sequence
ggtttctgttctctgaattc

SEQ ID NO: 465391 - DNA, 20 bp, Artificial
  CRISPR gRNA sequence
ctgttctctgaattccagca

SEQ ID NO: 465392 - DNA, 20 bp, Artificial
  CRISPR gRNA sequence
aattccagcacagtgctcct

SEQ ID NO: 465393 - DNA, 20 bp, Artificial
  CRISPR gRNA sequence
acagtgctccttagctgctc

SEQ ID NO: 465394 - DNA, 20 bp, Artificial
  CRISPR gRNA sequence
ctccttagctgctccagcca

SEQ ID NO: 465395 - DNA, 20 bp, Artificial
  CRISPR gRNA sequence
agctgctccagccatggctc

SEQ ID NO: 465396 - DNA, 20 bp, Artificial
  CRISPR gRNA sequence
gctccagccatggctcaagt

SEQ ID NO: 465397 - DNA, 20 bp, Artificial
  CRISPR gRNA sequence
agccatggctcaagtgagcc

SEQ ID NO: 465398 - DNA, 20 bp, Artificial
  CRISPR gRNA sequence
gccatggctcaagtgagccc

SEQ ID NO: 465399 - DNA, 20 bp, Artificial
  CRISPR gRNA sequence
ggctcaagtgagcccaggtg

SEQ ID NO: 465400 - DNA, 20 bp, Artificial
  CRISPR gRNA sequence
agttcaacccaccactccat

SEQ ID NO: 465401 - DNA, 20 bp, Artificial
  CRISPR gRNA sequence
gttcaacccaccactccata

SEQ ID NO: 465402 - DNA, 20 bp, Artificial
  CRISPR gRNA sequence
accactccataaggtgcaat

SEQ ID NO: 465403 - DNA, 20 bp, Artificial
  CRISPR gRNA sequence
ctccataaggtgcaattggt

SEQ ID NO: 465404 - DNA, 20 bp, Artificial
  CRISPR gRNA sequence
aaggtgcaattggtaagcct

SEQ ID NO: 465405 - DNA, 20 bp, Artificial
  CRISPR gRNA sequence
gtgcaattggtaagccttgg

SEQ ID NO: 465406 - DNA, 20 bp, Artificial
  CRISPR gRNA sequence
cttggtggcacccacttgct

SEQ ID NO: 465407 - DNA, 20 bp, Artificial
  CRISPR gRNA sequence
gcacccacttgctaagtgtg

SEQ ID NO: 465408 - DNA, 20 bp, Artificial
  CRISPR gRNA sequence
cacccacttgctaagtgtgc

SEQ ID NO: 465409 - DNA, 20 bp, Artificial
  CRISPR gRNA sequence
cacttgctaagtgtgcaggc

SEQ ID NO: 465410 - DNA, 20 bp, Artificial
  CRISPR gRNA sequence
ttgctaagtgtgcaggctag

SEQ ID NO: 465411 - DNA, 20 bp, Artificial
  CRISPR gRNA sequence
tgtgcaggctagcagaatgc

SEQ ID NO: 465412 - DNA, 20 bp, Artificial
  CRISPR gRNA sequence
tgcaggctagcagaatgcaa

SEQ ID NO: 465413 - DNA, 20 bp, Artificial
  CRISPR gRNA sequence
gcaggctagcagaatgcaag

SEQ ID NO: 465414 - DNA, 20 bp, Artificial
  CRISPR gRNA sequence
ctagcagaatgcaagaggtg

SEQ ID NO: 465415 - DNA, 20 bp, Artificial
  CRISPR gRNA sequence
ggaacacaacttcctccatg

SEQ ID NO: 465416 - DNA, 20 bp, Artificial
  CRISPR gRNA sequence
cttcctccatgtagatttca

SEQ ID NO: 465417 - DNA, 20 bp, Artificial
  CRISPR gRNA sequence
ttcctccatgtagatttcaa

SEQ ID NO: 465418 - DNA, 20 bp, Artificial
  CRISPR gRNA sequence
gtagatttcaaaggatgttg

SEQ ID NO: 465419 - DNA, 20 bp, Artificial
  CRISPR gRNA sequence
atttcaaaggatgttgtgga

SEQ ID NO: 465420 - DNA, 20 bp, Artificial
  CRISPR gRNA sequence
aaggatgttgtggacagcct

SEQ ID NO: 465421 - DNA, 20 bp, Artificial
  CRISPR gRNA sequence
aggatgttgtggacagcctg

SEQ ID NO: 465422 - DNA, 20 bp, Artificial
  CRISPR gRNA sequence
ggatgttgtggacagcctga

SEQ ID NO: 465423 - DNA, 20 bp, Artificial
  CRISPR gRNA sequence
ttgtggacagcctgagggcc

SEQ ID NO: 465424 - DNA, 20 bp, Artificial
  CRISPR gRNA sequence
tgtggacagcctgagggccc

SEQ ID NO: 465425 - DNA, 20 bp, Artificial
  CRISPR gRNA sequence
ggacagcctgagggcccagg

SEQ ID NO: 465426 - DNA, 20 bp, Artificial
  CRISPR gRNA sequence
acagcctgagggcccaggaa

SEQ ID NO: 465427 - DNA, 20 bp, Artificial
  CRISPR gRNA sequence
ggaagagtccactcccatgt

SEQ ID NO: 465428 - DNA, 20 bp, Artificial
  CRISPR gRNA sequence
tccactcccatgtcagtgcc

SEQ ID NO: 465429 - DNA, 20 bp, Artificial
  CRISPR gRNA sequence
actcccatgtcagtgcctag

SEQ ID NO: 465430 - DNA, 20 bp, Artificial
  CRISPR gRNA sequence
tcccatgtcagtgcctagta

SEQ ID NO: 465431 - DNA, 20 bp, Artificial
  CRISPR gRNA sequence
gtcagtgcctagtagagcca

SEQ ID NO: 465432 - DNA, 20 bp, Artificial
  CRISPR gRNA sequence
tcagtgcctagtagagccat

SEQ ID NO: 465433 - DNA, 20 bp, Artificial
  CRISPR gRNA sequence
agtgcctagtagagccatgg

SEQ ID NO: 465434 - DNA, 20 bp, Artificial
  CRISPR gRNA sequence
gcctagtagagccatgggag

SEQ ID NO: 465435 - DNA, 20 bp, Artificial
  CRISPR gRNA sequence
catgggagtggactgccact

SEQ ID NO: 465436 - DNA, 20 bp, Artificial
  CRISPR gRNA sequence
gtggactgccactgagaccc

SEQ ID NO: 465437 - DNA, 20 bp, Artificial
  CRISPR gRNA sequence
ccactgagaccccagaactg

SEQ ID NO: 465438 - DNA, 20 bp, Artificial
  CRISPR gRNA sequence
actgagaccccagaactgtg

SEQ ID NO: 465439 - DNA, 20 bp, Artificial
  CRISPR gRNA sequence
ccccagaactgtggagctat

SEQ ID NO: 465440 - DNA, 20 bp, Artificial
  CRISPR gRNA sequence
actgtggagctattagcctg

SEQ ID NO: 465441 - DNA, 20 bp, Artificial
  CRISPR gRNA sequence
gagctattagcctgaagcat

SEQ ID NO: 465442 - DNA, 20 bp, Artificial
  CRISPR gRNA sequence
attagcctgaagcattagcc

SEQ ID NO: 465443 - DNA, 20 bp, Artificial
  CRISPR gRNA sequence
ttagcctgaagcattagcct

SEQ ID NO: 465444 - DNA, 20 bp, Artificial
  CRISPR gRNA sequence
agcctgaagcattagcctgg

SEQ ID NO: 465445 - DNA, 20 bp, Artificial
  CRISPR gRNA sequence
cctgaagcattagcctggga

SEQ ID NO: 465446 - DNA, 20 bp, Artificial
  CRISPR gRNA sequence
gcattagcctgggagagctg

SEQ ID NO: 465447 - DNA, 20 bp, Artificial
  CRISPR gRNA sequence
cattagcctgggagagctgc

SEQ ID NO: 465448 - DNA, 20 bp, Artificial
  CRISPR gRNA sequence
tagcctgggagagctgcagg

SEQ ID NO: 465449 - DNA, 20 bp, Artificial
  CRISPR gRNA sequence
agcctgggagagctgcaggt

SEQ ID NO: 465450 - DNA, 20 bp, Artificial
  CRISPR gRNA sequence
cctgggagagctgcaggtag

SEQ ID NO: 465451 - DNA, 20 bp, Artificial
  CRISPR gRNA sequence
ggtaggagtctccaacttgt

SEQ ID NO: 465452 - DNA, 20 bp, Artificial
  CRISPR gRNA sequence
tctccaacttgtgagtgctg

SEQ ID NO: 465453 - DNA, 20 bp, Artificial
  CRISPR gRNA sequence
tgagtgctgaagcatcaacc

SEQ ID NO: 465454 - DNA, 20 bp, Artificial
  CRISPR gRNA sequence
gctgaagcatcaaccaagcc

SEQ ID NO: 465455 - DNA, 20 bp, Artificial
  CRISPR gRNA sequence
atgccattttatttctctgt

SEQ ID NO: 465456 - DNA, 20 bp, Artificial
  CRISPR gRNA sequence
tgccattttatttctctgtt

SEQ ID NO: 465457 - DNA, 20 bp, Artificial
  CRISPR gRNA sequence
tttatttctctgttgggttt

SEQ ID NO: 465458 - DNA, 20 bp, Artificial
  CRISPR gRNA sequence
tgttgggttttggacttact

SEQ ID NO: 465459 - DNA, 20 bp, Artificial
  CRISPR gRNA sequence
gttgggttttggacttactt

SEQ ID NO: 465460 - DNA, 20 bp, Artificial
  CRISPR gRNA sequence
ttttgcctatttctcccttt

SEQ ID NO: 465461 - DNA, 20 bp, Artificial
  CRISPR gRNA sequence
cctatttctcccttttggaa

SEQ ID NO: 465462 - DNA, 20 bp, Artificial
  CRISPR gRNA sequence
ctatttctcccttttggaat

SEQ ID NO: 465463 - DNA, 20 bp, Artificial
  CRISPR gRNA sequence
tctgtcctaccactatattt

SEQ ID NO: 465464 - DNA, 20 bp, Artificial
  CRISPR gRNA sequence
gtcctaccactatattttgg

SEQ ID NO: 465465 - DNA, 20 bp, Artificial
  CRISPR gRNA sequence
ctaccactatattttggaag

SEQ ID NO: 465466 - DNA, 20 bp, Artificial
  CRISPR gRNA sequence
tgttttgatttacatgatca

SEQ ID NO: 465467 - DNA, 20 bp, Artificial
  CRISPR gRNA sequence
ttgatttacatgatcatagt

SEQ ID NO: 465468 - DNA, 20 bp, Artificial
  CRISPR gRNA sequence
gatttacatgatcatagttg

SEQ ID NO: 465469 - DNA, 20 bp, Artificial
  CRISPR gRNA sequence
atttacatgatcatagttgg

SEQ ID NO: 465470 - DNA, 20 bp, Artificial
  CRISPR gRNA sequence
tttacatgatcatagttgga

SEQ ID NO: 465471 - DNA, 20 bp, Artificial
  CRISPR gRNA sequence
ccttgaatcttacccatatc

SEQ ID NO: 465472 - DNA, 20 bp, Artificial
  CRISPR gRNA sequence
aatcttacccatatctggtt

SEQ ID NO: 465473 - DNA, 20 bp, Artificial
  CRISPR gRNA sequence
tacccatatctggtttagat

SEQ ID NO: 465474 - DNA, 20 bp, Artificial
  CRISPR gRNA sequence
tttagataagactctgaatt

SEQ ID NO: 465475 - DNA, 20 bp, Artificial
  CRISPR gRNA sequence
ctgcaataaattaaaacttt

SEQ ID NO: 465476 - DNA, 20 bp, Artificial
  CRISPR gRNA sequence
tgcaataaattaaaactttt

SEQ ID NO: 465477 - DNA, 20 bp, Artificial
  CRISPR gRNA sequence
gcaataaattaaaacttttg

SEQ ID NO: 465478 - DNA, 20 bp, Artificial
  CRISPR gRNA sequence
ttaaaacttttggggctatt

SEQ ID NO: 465479 - DNA, 20 bp, Artificial
  CRISPR gRNA sequence
aacttttggggctattgaga

SEQ ID NO: 465480 - DNA, 20 bp, Artificial
  CRISPR gRNA sequence
gaatgtattttgtatgtgaa

SEQ ID NO: 465481 - DNA, 20 bp, Artificial
  CRISPR gRNA sequence
tttgtatgtgaaaagaacat

SEQ ID NO: 465482 - DNA, 20 bp, Artificial
  CRISPR gRNA sequence
tgtgaaaagaacatgagttt

SEQ ID NO: 465483 - DNA, 20 bp, Artificial
  CRISPR gRNA sequence
gtgaaaagaacatgagtttt

SEQ ID NO: 465484 - DNA, 20 bp, Artificial
  CRISPR gRNA sequence
tgaaaagaacatgagttttg

SEQ ID NO: 465485 - DNA, 20 bp, Artificial
  CRISPR gRNA sequence
gaaaagaacatgagttttgg

SEQ ID NO: 465486 - DNA, 20 bp, Artificial
  CRISPR gRNA sequence
gaacatgagttttgggggac

SEQ ID NO: 465487 - DNA, 20 bp, Artificial
  CRISPR gRNA sequence
aacatgagttttgggggacc

SEQ ID NO: 465488 - DNA, 20 bp, Artificial
  CRISPR gRNA sequence
acatgagttttgggggacca

SEQ ID NO: 465489 - DNA, 20 bp, Artificial
  CRISPR gRNA sequence
catgagttttgggggaccag

SEQ ID NO: 465490 - DNA, 20 bp, Artificial
  CRISPR gRNA sequence
gagttttgggggaccagggg

SEQ ID NO: 465491 - DNA, 20 bp, Artificial
  CRISPR gRNA sequence
ggaccaggggcagaatgcta

SEQ ID NO: 465492 - DNA, 20 bp, Artificial
  CRISPR gRNA sequence
aaattttattgctattgtaa

SEQ ID NO: 465493 - DNA, 20 bp, Artificial
  CRISPR gRNA sequence
tgctattgtaacagttttgt

SEQ ID NO: 465494 - DNA, 20 bp, Artificial
  CRISPR gRNA sequence
gctattgtaacagttttgtg

SEQ ID NO: 465495 - DNA, 20 bp, Artificial
  CRISPR gRNA sequence
attgtaacagttttgtgagg

SEQ ID NO: 465496 - DNA, 20 bp, Artificial
  CRISPR gRNA sequence
ttttgtgaggtggaaccttt

SEQ ID NO: 465497 - DNA, 20 bp, Artificial
  CRISPR gRNA sequence
ttgtgaggtggaacctttaa

SEQ ID NO: 465498 - DNA, 20 bp, Artificial
  CRISPR gRNA sequence
aggtggaacctttaagagat

SEQ ID NO: 465499 - DNA, 20 bp, Artificial
  CRISPR gRNA sequence
gtggaacctttaagagatca

SEQ ID NO: 465500 - DNA, 20 bp, Artificial
  CRISPR gRNA sequence
tggaacctttaagagatcag

SEQ ID NO: 465501 - DNA, 20 bp, Artificial
  CRISPR gRNA sequence
atgtattaatgcccttattg

SEQ ID NO: 465502 - DNA, 20 bp, Artificial
  CRISPR gRNA sequence
tgtattaatgcccttattgt

SEQ ID NO: 465503 - DNA, 20 bp, Artificial
  CRISPR gRNA sequence
taatgcccttattgtaggaa

SEQ ID NO: 465504 - DNA, 20 bp, Artificial
  CRISPR gRNA sequence
taggaatggattcgttatca

SEQ ID NO: 465505 - DNA, 20 bp, Artificial
  CRISPR gRNA sequence
aggaatggattcgttatcac

SEQ ID NO: 465506 - DNA, 20 bp, Artificial
  CRISPR gRNA sequence
gaatggattcgttatcacgg

SEQ ID NO: 465507 - DNA, 20 bp, Artificial
  CRISPR gRNA sequence
tggattcgttatcacgggag

SEQ ID NO: 465508 - DNA, 20 bp, Artificial
  CRISPR gRNA sequence
ggattcgttatcacgggagt

SEQ ID NO: 465509 - DNA, 20 bp, Artificial
  CRISPR gRNA sequence
cgggagtaggcacctgataa

SEQ ID NO: 465510 - DNA, 20 bp, Artificial
  CRISPR gRNA sequence
gggagtaggcacctgataaa

SEQ ID NO: 465511 - DNA, 20 bp, Artificial
  CRISPR gRNA sequence
cctgataaaaggataaattt

SEQ ID NO: 465512 - DNA, 20 bp, Artificial
  CRISPR gRNA sequence
cactttctgctttctgccat

SEQ ID NO: 465513 - DNA, 20 bp, Artificial
  CRISPR gRNA sequence
ctttctgccatgagataatg

SEQ ID NO: 465514 - DNA, 20 bp, Artificial
  CRISPR gRNA sequence
ccatgagataatgcagcaca

SEQ ID NO: 465515 - DNA, 20 bp, Artificial
  CRISPR gRNA sequence
catgagataatgcagcacaa

SEQ ID NO: 465516 - DNA, 20 bp, Artificial
  CRISPR gRNA sequence
tgcagcacaaaggcctttgc

SEQ ID NO: 465517 - DNA, 20 bp, Artificial
  CRISPR gRNA sequence
caaaggcctttgctagatgc

SEQ ID NO: 465518 - DNA, 20 bp, Artificial
  CRISPR gRNA sequence
agatgctggcaccatgctct

SEQ ID NO: 465519 - DNA, 20 bp, Artificial
  CRISPR gRNA sequence
caccatgctcttggacttcc

SEQ ID NO: 465520 - DNA, 20 bp, Artificial
  CRISPR gRNA sequence
ctcttggacttcccagccta

SEQ ID NO: 465521 - DNA, 20 bp, Artificial
  CRISPR gRNA sequence
cttggacttcccagcctaca

SEQ ID NO: 465522 - DNA, 20 bp, Artificial
  CRISPR gRNA sequence
ttcccagcctacagagccat

SEQ ID NO: 465523 - DNA, 20 bp, Artificial
  CRISPR gRNA sequence
attcaaaaattatccaatct

SEQ ID NO: 465524 - DNA, 20 bp, Artificial
  CRISPR gRNA sequence
ttcaaaaattatccaatctc

SEQ ID NO: 465525 - DNA, 20 bp, Artificial
  CRISPR gRNA sequence
tctcaggtattctgttatac

SEQ ID NO: 465526 - DNA, 20 bp, Artificial
  CRISPR gRNA sequence
caggtattctgttatactag

SEQ ID NO: 465527 - DNA, 20 bp, Artificial
  CRISPR gRNA sequence
tctgttatactagcagaaaa

SEQ ID NO: 465528 - DNA, 20 bp, Artificial
  CRISPR gRNA sequence
atactagcagaaaacagact

SEQ ID NO: 465529 - DNA, 20 bp, Artificial
  CRISPR gRNA sequence
tagcagaaaacagactaaga

SEQ ID NO: 465530 - DNA, 20 bp, Artificial
  CRISPR gRNA sequence
gtgtctcatgtgtccgtgtg

SEQ ID NO: 465531 - DNA, 20 bp, Artificial
  CRISPR gRNA sequence
gtctcatgtgtccgtgtgta

SEQ ID NO: 465532 - DNA, 20 bp, Artificial
  CRISPR gRNA sequence
cgtgtgtagagaccaccaaa

SEQ ID NO: 465533 - DNA, 20 bp, Artificial
  CRISPR gRNA sequence
gtgtgtagagaccaccaaac

SEQ ID NO: 465534 - DNA, 20 bp, Artificial
  CRISPR gRNA sequence
ccaccaaacaggctttgtgt

SEQ ID NO: 465535 - DNA, 20 bp, Artificial
  CRISPR gRNA sequence
acaggctttgtgtgagcaac

SEQ ID NO: 465536 - DNA, 20 bp, Artificial
  CRISPR gRNA sequence
caggctttgtgtgagcaaca

SEQ ID NO: 465537 - DNA, 20 bp, Artificial
  CRISPR gRNA sequence
aggctgtttatttcaccttg

SEQ ID NO: 465538 - DNA, 20 bp, Artificial
  CRISPR gRNA sequence
ggctgtttatttcaccttgc

SEQ ID NO: 465539 - DNA, 20 bp, Artificial
  CRISPR gRNA sequence
tgtttatttcaccttgcagg

SEQ ID NO: 465540 - DNA, 20 bp, Artificial
  CRISPR gRNA sequence
gtttatttcaccttgcaggc

SEQ ID NO: 465541 - DNA, 20 bp, Artificial
  CRISPR gRNA sequence
tttcaccttgcaggcgggct

SEQ ID NO: 465542 - DNA, 20 bp, Artificial
  CRISPR gRNA sequence
gcaggcgggctgagtccaaa

SEQ ID NO: 465543 - DNA, 20 bp, Artificial
  CRISPR gRNA sequence
aggcgggctgagtccaaaaa

SEQ ID NO: 465544 - DNA, 20 bp, Artificial
  CRISPR gRNA sequence
gcgggctgagtccaaaaaga

SEQ ID NO: 465545 - DNA, 20 bp, Artificial
  CRISPR gRNA sequence
gctgagtccaaaaagagagt

SEQ ID NO: 465546 - DNA, 20 bp, Artificial
  CRISPR gRNA sequence
aaaagagagtcagcaaatga

SEQ ID NO: 465547 - DNA, 20 bp, Artificial
  CRISPR gRNA sequence
gagagtcagcaaatgatggt

SEQ ID NO: 465548 - DNA, 20 bp, Artificial
  CRISPR gRNA sequence
aatgatggtgagattatcat

SEQ ID NO: 465549 - DNA, 20 bp, Artificial
  CRISPR gRNA sequence
gagattatcattagtactta

SEQ ID NO: 465550 - DNA, 20 bp, Artificial
  CRISPR gRNA sequence
agattatcattagtacttat

SEQ ID NO: 465551 - DNA, 20 bp, Artificial
  CRISPR gRNA sequence
tcattagtacttataggttt

SEQ ID NO: 465552 - DNA, 20 bp, Artificial
  CRISPR gRNA sequence
cattagtacttataggtttt

SEQ ID NO: 465553 - DNA, 20 bp, Artificial
  CRISPR gRNA sequence
agtacttataggttttggga

SEQ ID NO: 465554 - DNA, 20 bp, Artificial
  CRISPR gRNA sequence
gtacttataggttttgggat

SEQ ID NO: 465555 - DNA, 20 bp, Artificial
  CRISPR gRNA sequence
cttataggttttgggatagg

SEQ ID NO: 465556 - DNA, 20 bp, Artificial
  CRISPR gRNA sequence
ataggttttgggataggcag

SEQ ID NO: 465557 - DNA, 20 bp, Artificial
  CRISPR gRNA sequence
aggttttgggataggcagtg

SEQ ID NO: 465558 - DNA, 20 bp, Artificial
  CRISPR gRNA sequence
ttgggataggcagtggagtt

SEQ ID NO: 465559 - DNA, 20 bp, Artificial
  CRISPR gRNA sequence
gggataggcagtggagttaa

SEQ ID NO: 465560 - DNA, 20 bp, Artificial
  CRISPR gRNA sequence
tggagttaagagcaatgttt

SEQ ID NO: 465561 - DNA, 20 bp, Artificial
  CRISPR gRNA sequence
ggagttaagagcaatgtttt

SEQ ID NO: 465562 - DNA, 20 bp, Artificial
  CRISPR gRNA sequence
gagttaagagcaatgttttg

SEQ ID NO: 465563 - DNA, 20 bp, Artificial
  CRISPR gRNA sequence
agttaagagcaatgttttgg

SEQ ID NO: 465564 - DNA, 20 bp, Artificial
  CRISPR gRNA sequence
taagagcaatgttttggggg

SEQ ID NO: 465565 - DNA, 20 bp, Artificial
  CRISPR gRNA sequence
aagagcaatgttttgggggc

SEQ ID NO: 465566 - DNA, 20 bp, Artificial
  CRISPR gRNA sequence
agagcaatgttttgggggca

SEQ ID NO: 465567 - DNA, 20 bp, Artificial
  CRISPR gRNA sequence
gagcaatgttttgggggcag

SEQ ID NO: 465568 - DNA, 20 bp, Artificial
  CRISPR gRNA sequence
agcaatgttttgggggcagg

SEQ ID NO: 465569 - DNA, 20 bp, Artificial
  CRISPR gRNA sequence
aatgttttgggggcaggggg

SEQ ID NO: 465570 - DNA, 20 bp, Artificial
  CRISPR gRNA sequence
atctcacaaaatacattctc

SEQ ID NO: 465571 - DNA, 20 bp, Artificial
  CRISPR gRNA sequence
tctcacaaaatacattctca

SEQ ID NO: 465572 - DNA, 20 bp, Artificial
  CRISPR gRNA sequence
ctcacaaaatacattctcaa

SEQ ID NO: 465573 - DNA, 20 bp, Artificial
  CRISPR gRNA sequence
acaaaatacattctcaaggg

SEQ ID NO: 465574 - DNA, 20 bp, Artificial
  CRISPR gRNA sequence
caaaatacattctcaagggt

SEQ ID NO: 465575 - DNA, 20 bp, Artificial
  CRISPR gRNA sequence
aaaatacattctcaagggtg

SEQ ID NO: 465576 - DNA, 20 bp, Artificial
  CRISPR gRNA sequence
aatacattctcaagggtggg

SEQ ID NO: 465577 - DNA, 20 bp, Artificial
  CRISPR gRNA sequence
caagggtggggagaattaca

SEQ ID NO: 465578 - DNA, 20 bp, Artificial
  CRISPR gRNA sequence
gaattacaaagaaacttctt

SEQ ID NO: 465579 - DNA, 20 bp, Artificial
  CRISPR gRNA sequence
aattacaaagaaacttctta

SEQ ID NO: 465580 - DNA, 20 bp, Artificial
  CRISPR gRNA sequence
attacaaagaaacttcttaa

SEQ ID NO: 465581 - DNA, 20 bp, Artificial
  CRISPR gRNA sequence
acaaagaaacttcttaaggg

SEQ ID NO: 465582 - DNA, 20 bp, Artificial
  CRISPR gRNA sequence
caaagaaacttcttaagggt

SEQ ID NO: 465583 - DNA, 20 bp, Artificial
  CRISPR gRNA sequence
aaagaaacttcttaagggtg

SEQ ID NO: 465584 - DNA, 20 bp, Artificial
  CRISPR gRNA sequence
aagaaacttcttaagggtgg

SEQ ID NO: 465585 - DNA, 20 bp, Artificial
  CRISPR gRNA sequence
gaaacttcttaagggtgggg

SEQ ID NO: 465586 - DNA, 20 bp, Artificial
  CRISPR gRNA sequence
taagggtgggggagattaca

SEQ ID NO: 465587 - DNA, 20 bp, Artificial
  CRISPR gRNA sequence
agattacaaagtacattgat

SEQ ID NO: 465588 - DNA, 20 bp, Artificial
  CRISPR gRNA sequence
tacaaagtacattgatcagt

SEQ ID NO: 465589 - DNA, 20 bp, Artificial
  CRISPR gRNA sequence
acaaagtacattgatcagtt

SEQ ID NO: 465590 - DNA, 20 bp, Artificial
  CRISPR gRNA sequence
caaagtacattgatcagtta

SEQ ID NO: 465591 - DNA, 20 bp, Artificial
  CRISPR gRNA sequence
agtacattgatcagttaggg

SEQ ID NO: 465592 - DNA, 20 bp, Artificial
  CRISPR gRNA sequence
gtacattgatcagttagggt

SEQ ID NO: 465593 - DNA, 20 bp, Artificial
  CRISPR gRNA sequence
tacattgatcagttagggtg

SEQ ID NO: 465594 - DNA, 20 bp, Artificial
  CRISPR gRNA sequence
attgatcagttagggtgggg

SEQ ID NO: 465595 - DNA, 20 bp, Artificial
  CRISPR gRNA sequence
ggggaagaaacaaatcacaa

SEQ ID NO: 465596 - DNA, 20 bp, Artificial
  CRISPR gRNA sequence
gaagaaacaaatcacaatgg

SEQ ID NO: 465597 - DNA, 20 bp, Artificial
  CRISPR gRNA sequence
tcacaatggtggaatgtcat

SEQ ID NO: 465598 - DNA, 20 bp, Artificial
  CRISPR gRNA sequence
atggtggaatgtcatcagtt

SEQ ID NO: 465599 - DNA, 20 bp, Artificial
  CRISPR gRNA sequence
tggtggaatgtcatcagtta

SEQ ID NO: 465600 - DNA, 20 bp, Artificial
  CRISPR gRNA sequence
ggctattttcacttcttttg

SEQ ID NO: 465601 - DNA, 20 bp, Artificial
  CRISPR gRNA sequence
tcacttcttttgtggatctt

SEQ ID NO: 465602 - DNA, 20 bp, Artificial
  CRISPR gRNA sequence
ttgtggatcttcagttgctt

SEQ ID NO: 465603 - DNA, 20 bp, Artificial
  CRISPR gRNA sequence
tgtggatcttcagttgcttc

SEQ ID NO: 465604 - DNA, 20 bp, Artificial
  CRISPR gRNA sequence
ttcagttgcttcaggccatc

SEQ ID NO: 465605 - DNA, 20 bp, Artificial
  CRISPR gRNA sequence
gccatctggatgtatacgtg

SEQ ID NO: 465606 - DNA, 20 bp, Artificial
  CRISPR gRNA sequence
ccatctggatgtatacgtgc

SEQ ID NO: 465607 - DNA, 20 bp, Artificial
  CRISPR gRNA sequence
ggatgtatacgtgcaggtca

SEQ ID NO: 465608 - DNA, 20 bp, Artificial
  CRISPR gRNA sequence
gatgtatacgtgcaggtcac

SEQ ID NO: 465609 - DNA, 20 bp, Artificial
  CRISPR gRNA sequence
atgtatacgtgcaggtcaca

SEQ ID NO: 465610 - DNA, 20 bp, Artificial
  CRISPR gRNA sequence
gcaggtcacagggtatatga

SEQ ID NO: 465611 - DNA, 20 bp, Artificial
  CRISPR gRNA sequence
tcacagggtatatgatggct

SEQ ID NO: 465612 - DNA, 20 bp, Artificial
  CRISPR gRNA sequence
gggtatatgatggcttagct

SEQ ID NO: 465613 - DNA, 20 bp, Artificial
  CRISPR gRNA sequence
ggtatatgatggcttagctt

SEQ ID NO: 465614 - DNA, 20 bp, Artificial
  CRISPR gRNA sequence
gatggcttagcttgggctca

SEQ ID NO: 465615 - DNA, 20 bp, Artificial
  CRISPR gRNA sequence
atggcttagcttgggctcaa

SEQ ID NO: 465616 - DNA, 20 bp, Artificial
  CRISPR gRNA sequence
gcttgggctcaaaggcctga

SEQ ID NO: 465617 - DNA, 20 bp, Artificial
  CRISPR gRNA sequence
gggctcaaaggcctgacaga

SEQ ID NO: 465618 - DNA, 20 bp, Artificial
  CRISPR gRNA sequence
gctcaaaggcctgacagaca

SEQ ID NO: 465619 - DNA, 20 bp, Artificial
  CRISPR gRNA sequence
ctcaaaggcctgacagacag

SEQ ID NO: 465620 - DNA, 20 bp, Artificial
  CRISPR gRNA sequence
attatatgcctaatatgtat

SEQ ID NO: 465621 - DNA, 20 bp, Artificial
  CRISPR gRNA sequence
atatgtatgagacattctgc

SEQ ID NO: 465622 - DNA, 20 bp, Artificial
  CRISPR gRNA sequence
gtatgagacattctgctagt

SEQ ID NO: 465623 - DNA, 20 bp, Artificial
  CRISPR gRNA sequence
tatgagacattctgctagta

SEQ ID NO: 465624 - DNA, 20 bp, Artificial
  CRISPR gRNA sequence
tgctagtaaggcttaattac

SEQ ID NO: 465625 - DNA, 20 bp, Artificial
  CRISPR gRNA sequence
aaggcttaattactagaaat

SEQ ID NO: 465626 - DNA, 20 bp, Artificial
  CRISPR gRNA sequence
aggcttaattactagaaatt

SEQ ID NO: 465627 - DNA, 20 bp, Artificial
  CRISPR gRNA sequence
ggcttaattactagaaattg

SEQ ID NO: 465628 - DNA, 20 bp, Artificial
  CRISPR gRNA sequence
gcttaattactagaaattgg

SEQ ID NO: 465629 - DNA, 20 bp, Artificial
  CRISPR gRNA sequence
cttaattactagaaattggg

SEQ ID NO: 465630 - DNA, 20 bp, Artificial
  CRISPR gRNA sequence
aaaattaccaaataatgctt

SEQ ID NO: 465631 - DNA, 20 bp, Artificial
  CRISPR gRNA sequence
ataatgcttgagaactattg

SEQ ID NO: 465632 - DNA, 20 bp, Artificial
  CRISPR gRNA sequence
ctattgaagtcacatatata

SEQ ID NO: 465633 - DNA, 20 bp, Artificial
  CRISPR gRNA sequence
tcacatatatatggtacttc

SEQ ID NO: 465634 - DNA, 20 bp, Artificial
  CRISPR gRNA sequence
catatatatggtacttccag

SEQ ID NO: 465635 - DNA, 20 bp, Artificial
  CRISPR gRNA sequence
cagaagaacatatttgattt

SEQ ID NO: 465636 - DNA, 20 bp, Artificial
  CRISPR gRNA sequence
ttagttttgtttttatcttt

SEQ ID NO: 465637 - DNA, 20 bp, Artificial
  CRISPR gRNA sequence
tagttttgtttttatctttt

SEQ ID NO: 465638 - DNA, 20 bp, Artificial
  CRISPR gRNA sequence
agttttgtttttatctttta

SEQ ID NO: 465639 - DNA, 20 bp, Artificial
  CRISPR gRNA sequence
ttgtttttatcttttaggga

SEQ ID NO: 465640 - DNA, 20 bp, Artificial
  CRISPR gRNA sequence
ggaaagaatcatgtgatgta

SEQ ID NO: 465641 - DNA, 20 bp, Artificial
  CRISPR gRNA sequence
gtgatgtacagctttatata

SEQ ID NO: 465642 - DNA, 20 bp, Artificial
  CRISPR gRNA sequence
gatgtacagctttatataaa

SEQ ID NO: 465643 - DNA, 20 bp, Artificial
  CRISPR gRNA sequence
acaatctgaacactccatct

SEQ ID NO: 465644 - DNA, 20 bp, Artificial
  CRISPR gRNA sequence
atctgaacactccatcttag

SEQ ID NO: 465645 - DNA, 20 bp, Artificial
  CRISPR gRNA sequence
tctgaacactccatcttagc

SEQ ID NO: 465646 - DNA, 20 bp, Artificial
  CRISPR gRNA sequence
tgaacactccatcttagcag

SEQ ID NO: 465647 - DNA, 20 bp, Artificial
  CRISPR gRNA sequence
agcaggagatccctttgaac

SEQ ID NO: 465648 - DNA, 20 bp, Artificial
  CRISPR gRNA sequence
cctgtgaaatactgtgctaa

SEQ ID NO: 465649 - DNA, 20 bp, Artificial
  CRISPR gRNA sequence
ctgtgaaatactgtgctaac

SEQ ID NO: 465650 - DNA, 20 bp, Artificial
  CRISPR gRNA sequence
ctaacaggcctcatgtgact

SEQ ID NO: 465651 - DNA, 20 bp, Artificial
  CRISPR gRNA sequence
ggcctcatgtgacttggtgc

SEQ ID NO: 465652 - DNA, 20 bp, Artificial
  CRISPR gRNA sequence
gtgacttggtgcaagctcaa

SEQ ID NO: 465653 - DNA, 20 bp, Artificial
  CRISPR gRNA sequence
aacaacatgtgtaaaacttg

SEQ ID NO: 465654 - DNA, 20 bp, Artificial
  CRISPR gRNA sequence
acatgtgtaaaacttgaaga

SEQ ID NO: 465655 - DNA, 20 bp, Artificial
  CRISPR gRNA sequence
aaacttgaagatagacaaac

SEQ ID NO: 465656 - DNA, 20 bp, Artificial
  CRISPR gRNA sequence
ttgaagatagacaaacaagt

SEQ ID NO: 465657 - DNA, 20 bp, Artificial
  CRISPR gRNA sequence
aagatagacaaacaagttgg

SEQ ID NO: 465658 - DNA, 20 bp, Artificial
  CRISPR gRNA sequence
agatagacaaacaagttgga

SEQ ID NO: 465659 - DNA, 20 bp, Artificial
  CRISPR gRNA sequence
tagacaaacaagttggaagg

SEQ ID NO: 465660 - DNA, 20 bp, Artificial
  CRISPR gRNA sequence
gacaaacaagttggaaggaa

SEQ ID NO: 465661 - DNA, 20 bp, Artificial
  CRISPR gRNA sequence
aaacaagttggaaggaagag

SEQ ID NO: 465662 - DNA, 20 bp, Artificial
  CRISPR gRNA sequence
tttcattctacattttgaac

SEQ ID NO: 465663 - DNA, 20 bp, Artificial
  CRISPR gRNA sequence
ccagtgcttcctaatgacaa

SEQ ID NO: 465664 - DNA, 20 bp, Artificial
  CRISPR gRNA sequence
cagtgcttcctaatgacaat

SEQ ID NO: 465665 - DNA, 20 bp, Artificial
  CRISPR gRNA sequence
accgctgttctgcaaatttt

SEQ ID NO: 465666 - DNA, 20 bp, Artificial
  CRISPR gRNA sequence
tttcagtctaatctcattga

SEQ ID NO: 465667 - DNA, 20 bp, Artificial
  CRISPR gRNA sequence
ctcaacaactctttatgtga

SEQ ID NO: 465668 - DNA, 20 bp, Artificial
  CRISPR gRNA sequence
tcaacaactctttatgtgac

SEQ ID NO: 465669 - DNA, 20 bp, Artificial
  CRISPR gRNA sequence
caactctttatgtgacaggt

SEQ ID NO: 465670 - DNA, 20 bp, Artificial
  CRISPR gRNA sequence
acaggtgagttctcaacacc

SEQ ID NO: 465671 - DNA, 20 bp, Artificial
  CRISPR gRNA sequence
tatttttcttataatgtttc

SEQ ID NO: 465672 - DNA, 20 bp, Artificial
  CRISPR gRNA sequence
atttttcttataatgtttcc

SEQ ID NO: 465673 - DNA, 20 bp, Artificial
  CRISPR gRNA sequence
tttcttataatgtttccagg

SEQ ID NO: 465674 - DNA, 20 bp, Artificial
  CRISPR gRNA sequence
tcttataatgtttccaggaa

SEQ ID NO: 465675 - DNA, 20 bp, Artificial
  CRISPR gRNA sequence
cttataatgtttccaggaag

SEQ ID NO: 465676 - DNA, 20 bp, Artificial
  CRISPR gRNA sequence
ttataatgtttccaggaaga

SEQ ID NO: 465677 - DNA, 20 bp, Artificial
  CRISPR gRNA sequence
tataatgtttccaggaagag

SEQ ID NO: 465678 - DNA, 20 bp, Artificial
  CRISPR gRNA sequence
ataatgtttccaggaagagg

SEQ ID NO: 465679 - DNA, 20 bp, Artificial
  CRISPR gRNA sequence
taatgtttccaggaagaggg

SEQ ID NO: 465680 - DNA, 20 bp, Artificial
  CRISPR gRNA sequence
tttccaggaagaggggggtt

SEQ ID NO: 465681 - DNA, 20 bp, Artificial
  CRISPR gRNA sequence
agaggggggttcagtttctc

SEQ ID NO: 465682 - DNA, 20 bp, Artificial
  CRISPR gRNA sequence
agtttctcaagtgattatgt

SEQ ID NO: 465683 - DNA, 20 bp, Artificial
  CRISPR gRNA sequence
tctcaagtgattatgttaga

SEQ ID NO: 465684 - DNA, 20 bp, Artificial
  CRISPR gRNA sequence
tgttagaaagccaactccta

SEQ ID NO: 465685 - DNA, 20 bp, Artificial
  CRISPR gRNA sequence
ctgaaatctgctacacctca

SEQ ID NO: 465686 - DNA, 20 bp, Artificial
  CRISPR gRNA sequence
cctcacagattgttatgtgc

SEQ ID NO: 465687 - DNA, 20 bp, Artificial
  CRISPR gRNA sequence
gtgtgtgtatgtgtgcgttt

SEQ ID NO: 465688 - DNA, 20 bp, Artificial
  CRISPR gRNA sequence
tgtgtgtatgtgtgcgtttg

SEQ ID NO: 465689 - DNA, 20 bp, Artificial
  CRISPR gRNA sequence
tgtatgtgtgcgtttgaggt

SEQ ID NO: 465690 - DNA, 20 bp, Artificial
  CRISPR gRNA sequence
tgtgtgcgtttgaggtgagt

SEQ ID NO: 465691 - DNA, 20 bp, Artificial
  CRISPR gRNA sequence
tgcgtttgaggtgagtgaga

SEQ ID NO: 465692 - DNA, 20 bp, Artificial
  CRISPR gRNA sequence
cgtttgaggtgagtgagata

SEQ ID NO: 465693 - DNA, 20 bp, Artificial
  CRISPR gRNA sequence
gtttgaggtgagtgagatag

SEQ ID NO: 465694 - DNA, 20 bp, Artificial
  CRISPR gRNA sequence
ttgaggtgagtgagatagag

SEQ ID NO: 465695 - DNA, 20 bp, Artificial
  CRISPR gRNA sequence
gaggtgagtgagatagagga

SEQ ID NO: 465696 - DNA, 20 bp, Artificial
  CRISPR gRNA sequence
gtgagtgagatagaggagag

SEQ ID NO: 465697 - DNA, 20 bp, Artificial
  CRISPR gRNA sequence
gagtgagatagaggagagta

SEQ ID NO: 465698 - DNA, 20 bp, Artificial
  CRISPR gRNA sequence
gatagaggagagtagagaaa

SEQ ID NO: 465699 - DNA, 20 bp, Artificial
  CRISPR gRNA sequence
gaggagagtagagaaataga

SEQ ID NO: 465700 - DNA, 20 bp, Artificial
  CRISPR gRNA sequence
agtagagaaatagatagtaa

SEQ ID NO: 465701 - DNA, 20 bp, Artificial
  CRISPR gRNA sequence
aaagttattgtttttgactt

SEQ ID NO: 465702 - DNA, 20 bp, Artificial
  CRISPR gRNA sequence
aagttattgtttttgacttt

SEQ ID NO: 465703 - DNA, 20 bp, Artificial
  CRISPR gRNA sequence
agttattgtttttgacttta

SEQ ID NO: 465704 - DNA, 20 bp, Artificial
  CRISPR gRNA sequence
gattataaaatttatttgat

SEQ ID NO: 465705 - DNA, 20 bp, Artificial
  CRISPR gRNA sequence
aatttatttgataagtccaa

SEQ ID NO: 465706 - DNA, 20 bp, Artificial
  CRISPR gRNA sequence
ttatttgataagtccaaaag

SEQ ID NO: 465707 - DNA, 20 bp, Artificial
  CRISPR gRNA sequence
gaaatattgaaaaaattata

SEQ ID NO: 465708 - DNA, 20 bp, Artificial
  CRISPR gRNA sequence
aattataaagtgaataccta

SEQ ID NO: 465709 - DNA, 20 bp, Artificial
  CRISPR gRNA sequence
tgaatacctatagttgcgaa

SEQ ID NO: 465710 - DNA, 20 bp, Artificial
  CRISPR gRNA sequence
ttgttcattacaatttcttg

SEQ ID NO: 465711 - DNA, 20 bp, Artificial
  CRISPR gRNA sequence
atttcttgaagttatgtttg

SEQ ID NO: 465712 - DNA, 20 bp, Artificial
  CRISPR gRNA sequence
gaagttatgtttgtggtgct

SEQ ID NO: 465713 - DNA, 20 bp, Artificial
  CRISPR gRNA sequence
aagttatgtttgtggtgctt

SEQ ID NO: 465714 - DNA, 20 bp, Artificial
  CRISPR gRNA sequence
ggcaattaaacacttcttaa

SEQ ID NO: 465715 - DNA, 20 bp, Artificial
  CRISPR gRNA sequence
aaacacttcttaatagttca

SEQ ID NO: 465716 - DNA, 20 bp, Artificial
  CRISPR gRNA sequence
ttaatagttcacagtttgtt

SEQ ID NO: 465717 - DNA, 20 bp, Artificial
  CRISPR gRNA sequence
aatagttcacagtttgttta

SEQ ID NO: 465718 - DNA, 20 bp, Artificial
  CRISPR gRNA sequence
atagttcacagtttgtttag

SEQ ID NO: 465719 - DNA, 20 bp, Artificial
  CRISPR gRNA sequence
cagtttgtttagaggaaaaa

SEQ ID NO: 465720 - DNA, 20 bp, Artificial
  CRISPR gRNA sequence
caaacaactaactgacttcc

SEQ ID NO: 465721 - DNA, 20 bp, Artificial
  CRISPR gRNA sequence
ctgacttcctagtgattttc

SEQ ID NO: 465722 - DNA, 20 bp, Artificial
  CRISPR gRNA sequence
tgacttcctagtgattttct

SEQ ID NO: 465723 - DNA, 20 bp, Artificial
  CRISPR gRNA sequence
agtgattttctgggaatatt

SEQ ID NO: 465724 - DNA, 20 bp, Artificial
  CRISPR gRNA sequence
tgattttctgggaatattca

SEQ ID NO: 465725 - DNA, 20 bp, Artificial
  CRISPR gRNA sequence
ctctcttccctgttccccga

SEQ ID NO: 465726 - DNA, 20 bp, Artificial
  CRISPR gRNA sequence
ctcttccctgttccccgaaa

SEQ ID NO: 465727 - DNA, 20 bp, Artificial
  CRISPR gRNA sequence
tcttccctgttccccgaaag

SEQ ID NO: 465728 - DNA, 20 bp, Artificial
  CRISPR gRNA sequence
tttaatatgctttgacaact

SEQ ID NO: 465729 - DNA, 20 bp, Artificial
  CRISPR gRNA sequence
ttaatatgctttgacaactg

SEQ ID NO: 465730 - DNA, 20 bp, Artificial
  CRISPR gRNA sequence
atatgctttgacaactgagg

SEQ ID NO: 465731 - DNA, 20 bp, Artificial
  CRISPR gRNA sequence
tatgctttgacaactgagga

SEQ ID NO: 465732 - DNA, 20 bp, Artificial
  CRISPR gRNA sequence
ctttgacaactgaggaagga

SEQ ID NO: 465733 - DNA, 20 bp, Artificial
  CRISPR gRNA sequence
gacaactgaggaaggacaga

SEQ ID NO: 465734 - DNA, 20 bp, Artificial
  CRISPR gRNA sequence
aactgaggaaggacagatag

SEQ ID NO: 465735 - DNA, 20 bp, Artificial
  CRISPR gRNA sequence
aggaaggacagatagaagtt

SEQ ID NO: 465736 - DNA, 20 bp, Artificial
  CRISPR gRNA sequence
ggacagatagaagttaagct

SEQ ID NO: 465737 - DNA, 20 bp, Artificial
  CRISPR gRNA sequence
gacagatagaagttaagctt

SEQ ID NO: 465738 - DNA, 20 bp, Artificial
  CRISPR gRNA sequence
acagatagaagttaagcttg

SEQ ID NO: 465739 - DNA, 20 bp, Artificial
  CRISPR gRNA sequence
aagttaagcttggggaaacc

SEQ ID NO: 465740 - DNA, 20 bp, Artificial
  CRISPR gRNA sequence
ataaaacatgaaaaaataca

SEQ ID NO: 465741 - DNA, 20 bp, Artificial
  CRISPR gRNA sequence
taaaacatgaaaaaatacat

SEQ ID NO: 465742 - DNA, 20 bp, Artificial
  CRISPR gRNA sequence
aaaacatgaaaaaatacata

SEQ ID NO: 465743 - DNA, 20 bp, Artificial
  CRISPR gRNA sequence
aaacatgaaaaaatacatag

SEQ ID NO: 465744 - DNA, 20 bp, Artificial
  CRISPR gRNA sequence
aacatgaaaaaatacatagg

SEQ ID NO: 465745 - DNA, 20 bp, Artificial
  CRISPR gRNA sequence
acatgaaaaaatacataggg

SEQ ID NO: 465746 - DNA, 20 bp, Artificial
  CRISPR gRNA sequence
catgaaaaaatacatagggg

SEQ ID NO: 465747 - DNA, 20 bp, Artificial
  CRISPR gRNA sequence
tgaaaaaatacatagggggg

SEQ ID NO: 465748 - DNA, 20 bp, Artificial
  CRISPR gRNA sequence
aaaaatacatagggggggag

SEQ ID NO: 465749 - DNA, 20 bp, Artificial
  CRISPR gRNA sequence
aaaatacatagggggggagt

SEQ ID NO: 465750 - DNA, 20 bp, Artificial
  CRISPR gRNA sequence
tacatagggggggagtaggt

SEQ ID NO: 465751 - DNA, 20 bp, Artificial
  CRISPR gRNA sequence
catagggggggagtaggtaa

SEQ ID NO: 465752 - DNA, 20 bp, Artificial
  CRISPR gRNA sequence
aggtaagagtaaaaaatact

SEQ ID NO: 465753 - DNA, 20 bp, Artificial
  CRISPR gRNA sequence
cttggtttataaaaatttta

SEQ ID NO: 465754 - DNA, 20 bp, Artificial
  CRISPR gRNA sequence
atagccaacatcatattcaa

SEQ ID NO: 465755 - DNA, 20 bp, Artificial
  CRISPR gRNA sequence
aacatcatattcaatggtga

SEQ ID NO: 465756 - DNA, 20 bp, Artificial
  CRISPR gRNA sequence
acatcatattcaatggtgaa

SEQ ID NO: 465757 - DNA, 20 bp, Artificial
  CRISPR gRNA sequence
atattcaatggtgaaaggct

SEQ ID NO: 465758 - DNA, 20 bp, Artificial
  CRISPR gRNA sequence
attcaatggtgaaaggctta

SEQ ID NO: 465759 - DNA, 20 bp, Artificial
  CRISPR gRNA sequence
aggcttagagctttccccct

SEQ ID NO: 465760 - DNA, 20 bp, Artificial
  CRISPR gRNA sequence
tagagctttccccctaagaa

SEQ ID NO: 465761 - DNA, 20 bp, Artificial
  CRISPR gRNA sequence
agagctttccccctaagaac

SEQ ID NO: 465762 - DNA, 20 bp, Artificial
  CRISPR gRNA sequence
ttccccctaagaacaggaac

SEQ ID NO: 465763 - DNA, 20 bp, Artificial
  CRISPR gRNA sequence
ctaagaacaggaacaagaca

SEQ ID NO: 465764 - DNA, 20 bp, Artificial
  CRISPR gRNA sequence
taacattaaactgaaaattc

SEQ ID NO: 465765 - DNA, 20 bp, Artificial
  CRISPR gRNA sequence
attaaactgaaaattctagc

SEQ ID NO: 465766 - DNA, 20 bp, Artificial
  CRISPR gRNA sequence
taaactgaaaattctagcca

SEQ ID NO: 465767 - DNA, 20 bp, Artificial
  CRISPR gRNA sequence
aaaattctagccagagcaaa

SEQ ID NO: 465768 - DNA, 20 bp, Artificial
  CRISPR gRNA sequence
aaattctagccagagcaaac

SEQ ID NO: 465769 - DNA, 20 bp, Artificial
  CRISPR gRNA sequence
tctagccagagcaaacaggc

SEQ ID NO: 465770 - DNA, 20 bp, Artificial
  CRISPR gRNA sequence
cagagcaaacaggcaagaac

SEQ ID NO: 465771 - DNA, 20 bp, Artificial
  CRISPR gRNA sequence
caggcaagaacaagaaataa

SEQ ID NO: 465772 - DNA, 20 bp, Artificial
  CRISPR gRNA sequence
gaaataaaagatatctaact

SEQ ID NO: 465773 - DNA, 20 bp, Artificial
  CRISPR gRNA sequence
agatatctaacttagaaaaa

SEQ ID NO: 465774 - DNA, 20 bp, Artificial
  CRISPR gRNA sequence
tatctaacttagaaaaaaag

SEQ ID NO: 465775 - DNA, 20 bp, Artificial
  CRISPR gRNA sequence
aagaagtaaaactttattca

SEQ ID NO: 465776 - DNA, 20 bp, Artificial
  CRISPR gRNA sequence
agtaaaactttattcacaga

SEQ ID NO: 465777 - DNA, 20 bp, Artificial
  CRISPR gRNA sequence
agatggcatgaacttatgtg

SEQ ID NO: 465778 - DNA, 20 bp, Artificial
  CRISPR gRNA sequence
aaatttgtttaaaactatta

SEQ ID NO: 465779 - DNA, 20 bp, Artificial
  CRISPR gRNA sequence
ttaaagctaatacatgaatt

SEQ ID NO: 465780 - DNA, 20 bp, Artificial
  CRISPR gRNA sequence
tttagcaattccacatgata

SEQ ID NO: 465781 - DNA, 20 bp, Artificial
  CRISPR gRNA sequence
ttagcaattccacatgatac

SEQ ID NO: 465782 - DNA, 20 bp, Artificial
  CRISPR gRNA sequence
caggatcaacacacaaaaat

SEQ ID NO: 465783 - DNA, 20 bp, Artificial
  CRISPR gRNA sequence
tcagtgatatttctatacac

SEQ ID NO: 465784 - DNA, 20 bp, Artificial
  CRISPR gRNA sequence
ctagcaataaacaatccaca

SEQ ID NO: 465785 - DNA, 20 bp, Artificial
  CRISPR gRNA sequence
aacaatccacaaagaaaatt

SEQ ID NO: 465786 - DNA, 20 bp, Artificial
  CRISPR gRNA sequence
acaatccacaaagaaaatta

SEQ ID NO: 465787 - DNA, 20 bp, Artificial
  CRISPR gRNA sequence
cacaaagaaaattaaggaaa

SEQ ID NO: 465788 - DNA, 20 bp, Artificial
  CRISPR gRNA sequence
ggaaacagttccatttacaa

SEQ ID NO: 465789 - DNA, 20 bp, Artificial
  CRISPR gRNA sequence
tcaaaatgaataaaatattt

SEQ ID NO: 465790 - DNA, 20 bp, Artificial
  CRISPR gRNA sequence
tttaagtacaaatttaacca

SEQ ID NO: 465791 - DNA, 20 bp, Artificial
  CRISPR gRNA sequence
taagtacaaatttaaccaaa

SEQ ID NO: 465792 - DNA, 20 bp, Artificial
  CRISPR gRNA sequence
aagtacaaatttaaccaaag

SEQ ID NO: 465793 - DNA, 20 bp, Artificial
  CRISPR gRNA sequence
aaatttaaccaaagaggtat

SEQ ID NO: 465794 - DNA, 20 bp, Artificial
  CRISPR gRNA sequence
atttaaccaaagaggtataa

SEQ ID NO: 465795 - DNA, 20 bp, Artificial
  CRISPR gRNA sequence
taagagttgtacactgaaca

SEQ ID NO: 465796 - DNA, 20 bp, Artificial
  CRISPR gRNA sequence
agttgtacactgaacaaaga

SEQ ID NO: 465797 - DNA, 20 bp, Artificial
  CRISPR gRNA sequence
tacactgaacaaagaaagca

SEQ ID NO: 465798 - DNA, 20 bp, Artificial
  CRISPR gRNA sequence
aacaaagaaagcatggctga

SEQ ID NO: 465799 - DNA, 20 bp, Artificial
  CRISPR gRNA sequence
agcatggctgaaagaaattc

SEQ ID NO: 465800 - DNA, 20 bp, Artificial
  CRISPR gRNA sequence
agaatatgtaaataaatgca

SEQ ID NO: 465801 - DNA, 20 bp, Artificial
  CRISPR gRNA sequence
gcaaagacattctgtattca

SEQ ID NO: 465802 - DNA, 20 bp, Artificial
  CRISPR gRNA sequence
attctgtattcatggactga

SEQ ID NO: 465803 - DNA, 20 bp, Artificial
  CRISPR gRNA sequence
ctgaaagatgtaatattgta

SEQ ID NO: 465804 - DNA, 20 bp, Artificial
  CRISPR gRNA sequence
aagatgtaatattgtaaaga

SEQ ID NO: 465805 - DNA, 20 bp, Artificial
  CRISPR gRNA sequence
taaagatagcaatattcccc

SEQ ID NO: 465806 - DNA, 20 bp, Artificial
  CRISPR gRNA sequence
aaagatagcaatattcccca

SEQ ID NO: 465807 - DNA, 20 bp, Artificial
  CRISPR gRNA sequence
atattccccaaggtgatcta

SEQ ID NO: 465808 - DNA, 20 bp, Artificial
  CRISPR gRNA sequence
ggtgatctacagattcaatg

SEQ ID NO: 465809 - DNA, 20 bp, Artificial
  CRISPR gRNA sequence
cagttccactaaaatcctaa

SEQ ID NO: 465810 - DNA, 20 bp, Artificial
  CRISPR gRNA sequence
acagctttttgttgctattg

SEQ ID NO: 465811 - DNA, 20 bp, Artificial
  CRISPR gRNA sequence
ttgctattgcagaaataaaa

SEQ ID NO: 465812 - DNA, 20 bp, Artificial
  CRISPR gRNA sequence
ctgatcctaaaattcacatt

SEQ ID NO: 465813 - DNA, 20 bp, Artificial
  CRISPR gRNA sequence
aaattcacattgagttgcaa

SEQ ID NO: 465814 - DNA, 20 bp, Artificial
  CRISPR gRNA sequence
acattgagttgcaacagacc

SEQ ID NO: 465815 - DNA, 20 bp, Artificial
  CRISPR gRNA sequence
ttgccaaaacaatcttgaaa

SEQ ID NO: 465816 - DNA, 20 bp, Artificial
  CRISPR gRNA sequence
cttgaaaaagaacaaaactg

SEQ ID NO: 465817 - DNA, 20 bp, Artificial
  CRISPR gRNA sequence
aaaagaacaaaactgaagct

SEQ ID NO: 465818 - DNA, 20 bp, Artificial
  CRISPR gRNA sequence
caaaacttactacaaaatga

SEQ ID NO: 465819 - DNA, 20 bp, Artificial
  CRISPR gRNA sequence
gacagttaaaaaaaaaaaaa

SEQ ID NO: 465820 - DNA, 20 bp, Artificial
  CRISPR gRNA sequence
ttaaaaaaaaaaaaaaagaa

SEQ ID NO: 465821 - DNA, 20 bp, Artificial
  CRISPR gRNA sequence
aaaaaagaatagtattgtca

SEQ ID NO: 465822 - DNA, 20 bp, Artificial
  CRISPR gRNA sequence
aagaatagtattgtcatgga

SEQ ID NO: 465823 - DNA, 20 bp, Artificial
  CRISPR gRNA sequence
agtattgtcatggatagaca

SEQ ID NO: 465824 - DNA, 20 bp, Artificial
  CRISPR gRNA sequence
tattgtcatggatagacaaa

SEQ ID NO: 465825 - DNA, 20 bp, Artificial
  CRISPR gRNA sequence
gacaaagagatcaatgtaaa

SEQ ID NO: 465826 - DNA, 20 bp, Artificial
  CRISPR gRNA sequence
agatcaatgtaaatagaatt

SEQ ID NO: 465827 - DNA, 20 bp, Artificial
  CRISPR gRNA sequence
atcaatgtaaatagaattga

SEQ ID NO: 465828 - DNA, 20 bp, Artificial
  CRISPR gRNA sequence
tgtaaatagaattgagagtc

SEQ ID NO: 465829 - DNA, 20 bp, Artificial
  CRISPR gRNA sequence
gaataaactccatacatccg

SEQ ID NO: 465830 - DNA, 20 bp, Artificial
  CRISPR gRNA sequence
gtagtcaattgatttttgat

SEQ ID NO: 465831 - DNA, 20 bp, Artificial
  CRISPR gRNA sequence
tagtcaattgatttttgata

SEQ ID NO: 465832 - DNA, 20 bp, Artificial
  CRISPR gRNA sequence
agtcaattgatttttgataa

SEQ ID NO: 465833 - DNA, 20 bp, Artificial
  CRISPR gRNA sequence
tgatttttgataagggtacc

SEQ ID NO: 465834 - DNA, 20 bp, Artificial
  CRISPR gRNA sequence
ataagggtaccaagattatt

SEQ ID NO: 465835 - DNA, 20 bp, Artificial
  CRISPR gRNA sequence
agggtaccaagattattcag

SEQ ID NO: 465836 - DNA, 20 bp, Artificial
  CRISPR gRNA sequence
gggtaccaagattattcagt

SEQ ID NO: 465837 - DNA, 20 bp, Artificial
  CRISPR gRNA sequence
ggtaccaagattattcagtg

SEQ ID NO: 465838 - DNA, 20 bp, Artificial
  CRISPR gRNA sequence
ccaagattattcagtgggga

SEQ ID NO: 465839 - DNA, 20 bp, Artificial
  CRISPR gRNA sequence
attattcagtggggaaagaa

SEQ ID NO: 465840 - DNA, 20 bp, Artificial
  CRISPR gRNA sequence
gaaagaatagtctcaataaa

SEQ ID NO: 465841 - DNA, 20 bp, Artificial
  CRISPR gRNA sequence
atagtctcaataaatggtgc

SEQ ID NO: 465842 - DNA, 20 bp, Artificial
  CRISPR gRNA sequence
tagtctcaataaatggtgcc

SEQ ID NO: 465843 - DNA, 20 bp, Artificial
  CRISPR gRNA sequence
ataaatggtgccaggataat

SEQ ID NO: 465844 - DNA, 20 bp, Artificial
  CRISPR gRNA sequence
aattggatattcatatgtaa

SEQ ID NO: 465845 - DNA, 20 bp, Artificial
  CRISPR gRNA sequence
ctcatctcactccatatttt

SEQ ID NO: 465846 - DNA, 20 bp, Artificial
  CRISPR gRNA sequence
atattttaagcaatcaaaat

SEQ ID NO: 465847 - DNA, 20 bp, Artificial
  CRISPR gRNA sequence
tttaagcaatcaaaataagt

SEQ ID NO: 465848 - DNA, 20 bp, Artificial
  CRISPR gRNA sequence
tcaaaataagtcagacattt

SEQ ID NO: 465849 - DNA, 20 bp, Artificial
  CRISPR gRNA sequence
aaataagtcagacatttaag

SEQ ID NO: 465850 - DNA, 20 bp, Artificial
  CRISPR gRNA sequence
taagtcagacatttaagtag

SEQ ID NO: 465851 - DNA, 20 bp, Artificial
  CRISPR gRNA sequence
agtcagacatttaagtagaa

SEQ ID NO: 465852 - DNA, 20 bp, Artificial
  CRISPR gRNA sequence
acaataaaactctgatttct

SEQ ID NO: 465853 - DNA, 20 bp, Artificial
  CRISPR gRNA sequence
caataaaactctgatttctt

SEQ ID NO: 465854 - DNA, 20 bp, Artificial
  CRISPR gRNA sequence
ataaaactctgatttcttag

SEQ ID NO: 465855 - DNA, 20 bp, Artificial
  CRISPR gRNA sequence
tgatttcttaggagaaaaca

SEQ ID NO: 465856 - DNA, 20 bp, Artificial
  CRISPR gRNA sequence
gatttcttaggagaaaacat

SEQ ID NO: 465857 - DNA, 20 bp, Artificial
  CRISPR gRNA sequence
atttcttaggagaaaacata

SEQ ID NO: 465858 - DNA, 20 bp, Artificial
  CRISPR gRNA sequence
gggataaatgtttctgatct

SEQ ID NO: 465859 - DNA, 20 bp, Artificial
  CRISPR gRNA sequence
aatgtttctgatcttggatt

SEQ ID NO: 465860 - DNA, 20 bp, Artificial
  CRISPR gRNA sequence
gtttctgatcttggatttag

SEQ ID NO: 465861 - DNA, 20 bp, Artificial
  CRISPR gRNA sequence
tggatttagcagtgttttct

SEQ ID NO: 465862 - DNA, 20 bp, Artificial
  CRISPR gRNA sequence
tttcttagctatgattacaa

SEQ ID NO: 465863 - DNA, 20 bp, Artificial
  CRISPR gRNA sequence
atcaacaataacaccaaaaa

SEQ ID NO: 465864 - DNA, 20 bp, Artificial
  CRISPR gRNA sequence
aacaccaaaaatagataaat

SEQ ID NO: 465865 - DNA, 20 bp, Artificial
  CRISPR gRNA sequence
taaacacttctgtgcatcaa

SEQ ID NO: 465866 - DNA, 20 bp, Artificial
  CRISPR gRNA sequence
tactaaaattcaacaacaaa

SEQ ID NO: 465867 - DNA, 20 bp, Artificial
  CRISPR gRNA sequence
aaattcaacaacaaatagac

SEQ ID NO: 465868 - DNA, 20 bp, Artificial
  CRISPR gRNA sequence
tggcaacctaattttaaaat

SEQ ID NO: 465869 - DNA, 20 bp, Artificial
  CRISPR gRNA sequence
acctaattttaaaatgagca

SEQ ID NO: 465870 - DNA, 20 bp, Artificial
  CRISPR gRNA sequence
cctaattttaaaatgagcaa

SEQ ID NO: 465871 - DNA, 20 bp, Artificial
  CRISPR gRNA sequence
aaatgagcaaaggacttgaa

SEQ ID NO: 465872 - DNA, 20 bp, Artificial
  CRISPR gRNA sequence
cttgaatagacatttcatca

SEQ ID NO: 465873 - DNA, 20 bp, Artificial
  CRISPR gRNA sequence
catcaaagaaaatatacaaa

SEQ ID NO: 465874 - DNA, 20 bp, Artificial
  CRISPR gRNA sequence
aaaaaaatgctcaatgtcat

SEQ ID NO: 465875 - DNA, 20 bp, Artificial
  CRISPR gRNA sequence
tgctcaatgtcattagttac

SEQ ID NO: 465876 - DNA, 20 bp, Artificial
  CRISPR gRNA sequence
ctcaatgtcattagttactg

SEQ ID NO: 465877 - DNA, 20 bp, Artificial
  CRISPR gRNA sequence
tactggagaaatgcaaatca

SEQ ID NO: 465878 - DNA, 20 bp, Artificial
  CRISPR gRNA sequence
agaaatgcaaatcaaagtca

SEQ ID NO: 465879 - DNA, 20 bp, Artificial
  CRISPR gRNA sequence
cttcacacccatcgaatgac

SEQ ID NO: 465880 - DNA, 20 bp, Artificial
  CRISPR gRNA sequence
tagaataaaaaaaaaaaaca

SEQ ID NO: 465881 - DNA, 20 bp, Artificial
  CRISPR gRNA sequence
aaaaaaacacagaaaataat

SEQ ID NO: 465882 - DNA, 20 bp, Artificial
  CRISPR gRNA sequence
acacagaaaataataagtgt

SEQ ID NO: 465883 - DNA, 20 bp, Artificial
  CRISPR gRNA sequence
agaaaataataagtgttagc

SEQ ID NO: 465884 - DNA, 20 bp, Artificial
  CRISPR gRNA sequence
gaaaataataagtgttagca

SEQ ID NO: 465885 - DNA, 20 bp, Artificial
  CRISPR gRNA sequence
taagtgttagcaaggatgtg

SEQ ID NO: 465886 - DNA, 20 bp, Artificial
  CRISPR gRNA sequence
ttagcaaggatgtgaagaaa

SEQ ID NO: 465887 - DNA, 20 bp, Artificial
  CRISPR gRNA sequence
tagaaaccctatccattgct

SEQ ID NO: 465888 - DNA, 20 bp, Artificial
  CRISPR gRNA sequence
agaaaccctatccattgctg

SEQ ID NO: 465889 - DNA, 20 bp, Artificial
  CRISPR gRNA sequence
aaaccctatccattgctgag

SEQ ID NO: 465890 - DNA, 20 bp, Artificial
  CRISPR gRNA sequence
ttgctgaggagaatgtaaaa

SEQ ID NO: 465891 - DNA, 20 bp, Artificial
  CRISPR gRNA sequence
gaggagaatgtaaaatggtg

SEQ ID NO: 465892 - DNA, 20 bp, Artificial
  CRISPR gRNA sequence
gtaaaatggtgcagtcactt

SEQ ID NO: 465893 - DNA, 20 bp, Artificial
  CRISPR gRNA sequence
aatggtgcagtcactttaga

SEQ ID NO: 465894 - DNA, 20 bp, Artificial
  CRISPR gRNA sequence
ggtgcagtcactttagaaag

SEQ ID NO: 465895 - DNA, 20 bp, Artificial
  CRISPR gRNA sequence
cactttagaaagtggtctaa

SEQ ID NO: 465896 - DNA, 20 bp, Artificial
  CRISPR gRNA sequence
taacagttcctcaaaatcaa

SEQ ID NO: 465897 - DNA, 20 bp, Artificial
  CRISPR gRNA sequence
aagataaaacctacttgtca

SEQ ID NO: 465898 - DNA, 20 bp, Artificial
  CRISPR gRNA sequence
aacctacttgtcacagtacc

SEQ ID NO: 465899 - DNA, 20 bp, Artificial
  CRISPR gRNA sequence
gtacccagtaattctattcc

SEQ ID NO: 465900 - DNA, 20 bp, Artificial
  CRISPR gRNA sequence
tacccagtaattctattcct

SEQ ID NO: 465901 - DNA, 20 bp, Artificial
  CRISPR gRNA sequence
ttgttcctgaatgtttatca

SEQ ID NO: 465902 - DNA, 20 bp, Artificial
  CRISPR gRNA sequence
tatcacagcactattcacaa

SEQ ID NO: 465903 - DNA, 20 bp, Artificial
  CRISPR gRNA sequence
gcactattcacaatagccaa

SEQ ID NO: 465904 - DNA, 20 bp, Artificial
  CRISPR gRNA sequence
cactattcacaatagccaaa

SEQ ID NO: 465905 - DNA, 20 bp, Artificial
  CRISPR gRNA sequence
tattcacaatagccaaaagg

SEQ ID NO: 465906 - DNA, 20 bp, Artificial
  CRISPR gRNA sequence
gtagaaacaacctaaatgtt

SEQ ID NO: 465907 - DNA, 20 bp, Artificial
  CRISPR gRNA sequence
ctaaatgttcagctgatgaa

SEQ ID NO: 465908 - DNA, 20 bp, Artificial
  CRISPR gRNA sequence
gttcagctgatgaatggata

SEQ ID NO: 465909 - DNA, 20 bp, Artificial
  CRISPR gRNA sequence
ttcagctgatgaatggataa

SEQ ID NO: 465910 - DNA, 20 bp, Artificial
  CRISPR gRNA sequence
atgaatggataaaggaaatg

SEQ ID NO: 465911 - DNA, 20 bp, Artificial
  CRISPR gRNA sequence
aaatgtagtttatccacaca

SEQ ID NO: 465912 - DNA, 20 bp, Artificial
  CRISPR gRNA sequence
tccacacacggaatattatt

SEQ ID NO: 465913 - DNA, 20 bp, Artificial
  CRISPR gRNA sequence
gaatattattcagtcatgaa

SEQ ID NO: 465914 - DNA, 20 bp, Artificial
  CRISPR gRNA sequence
aatattattcagtcatgaaa

SEQ ID NO: 465915 - DNA, 20 bp, Artificial
  CRISPR gRNA sequence
ttcagtcatgaaaaggaatg

SEQ ID NO: 465916 - DNA, 20 bp, Artificial
  CRISPR gRNA sequence
gctacaacattgatgaacct

SEQ ID NO: 465917 - DNA, 20 bp, Artificial
  CRISPR gRNA sequence
acaacattgatgaacctcag

SEQ ID NO: 465918 - DNA, 20 bp, Artificial
  CRISPR gRNA sequence
aacctcagaagcattacgct

SEQ ID NO: 465919 - DNA, 20 bp, Artificial
  CRISPR gRNA sequence
agaagcattacgctaagtaa

SEQ ID NO: 465920 - DNA, 20 bp, Artificial
  CRISPR gRNA sequence
agcattacgctaagtaaaag

SEQ ID NO: 465921 - DNA, 20 bp, Artificial
  CRISPR gRNA sequence
acgctaagtaaaagaagaaa

SEQ ID NO: 465922 - DNA, 20 bp, Artificial
  CRISPR gRNA sequence
cgctaagtaaaagaagaaaa

SEQ ID NO: 465923 - DNA, 20 bp, Artificial
  CRISPR gRNA sequence
attatatgaaatatccaaaa

SEQ ID NO: 465924 - DNA, 20 bp, Artificial
  CRISPR gRNA sequence
ttatatgaaatatccaaaat

SEQ ID NO: 465925 - DNA, 20 bp, Artificial
  CRISPR gRNA sequence
atccaaaataggcaaatcca

SEQ ID NO: 465926 - DNA, 20 bp, Artificial
  CRISPR gRNA sequence
ccaaaataggcaaatccata

SEQ ID NO: 465927 - DNA, 20 bp, Artificial
  CRISPR gRNA sequence
aataggcaaatccatagaga

SEQ ID NO: 465928 - DNA, 20 bp, Artificial
  CRISPR gRNA sequence
ggcaaatccatagagacaga

SEQ ID NO: 465929 - DNA, 20 bp, Artificial
  CRISPR gRNA sequence
aaatccatagagacagaaag

SEQ ID NO: 465930 - DNA, 20 bp, Artificial
  CRISPR gRNA sequence
catagagacagaaagtagct

SEQ ID NO: 465931 - DNA, 20 bp, Artificial
  CRISPR gRNA sequence
agagacagaaagtagcttgg

SEQ ID NO: 465932 - DNA, 20 bp, Artificial
  CRISPR gRNA sequence
gaaagtagcttggtggttgc

SEQ ID NO: 465933 - DNA, 20 bp, Artificial
  CRISPR gRNA sequence
aaagtagcttggtggttgcc

SEQ ID NO: 465934 - DNA, 20 bp, Artificial
  CRISPR gRNA sequence
aagtagcttggtggttgcca

SEQ ID NO: 465935 - DNA, 20 bp, Artificial
  CRISPR gRNA sequence
agtagcttggtggttgccag

SEQ ID NO: 465936 - DNA, 20 bp, Artificial
  CRISPR gRNA sequence
cttggtggttgccaggggct

SEQ ID NO: 465937 - DNA, 20 bp, Artificial
  CRISPR gRNA sequence
ttggtggttgccaggggctg

SEQ ID NO: 465938 - DNA, 20 bp, Artificial
  CRISPR gRNA sequence
tgccaggggctgaggaaata

SEQ ID NO: 465939 - DNA, 20 bp, Artificial
  CRISPR gRNA sequence
aatgtgacatgactactaaa

SEQ ID NO: 465940 - DNA, 20 bp, Artificial
  CRISPR gRNA sequence
atgtgacatgactactaaat

SEQ ID NO: 465941 - DNA, 20 bp, Artificial
  CRISPR gRNA sequence
tgacatgactactaaatagg

SEQ ID NO: 465942 - DNA, 20 bp, Artificial
  CRISPR gRNA sequence
acatgactactaaataggta

SEQ ID NO: 465943 - DNA, 20 bp, Artificial
  CRISPR gRNA sequence
catgactactaaataggtag

SEQ ID NO: 465944 - DNA, 20 bp, Artificial
  CRISPR gRNA sequence
atgactactaaataggtaga

SEQ ID NO: 465945 - DNA, 20 bp, Artificial
  CRISPR gRNA sequence
ataggtagagggcttccttt

SEQ ID NO: 465946 - DNA, 20 bp, Artificial
  CRISPR gRNA sequence
taggtagagggcttcctttt

SEQ ID NO: 465947 - DNA, 20 bp, Artificial
  CRISPR gRNA sequence
aggtagagggcttccttttg

SEQ ID NO: 465948 - DNA, 20 bp, Artificial
  CRISPR gRNA sequence
tgataaatatgttctgaatc

SEQ ID NO: 465949 - DNA, 20 bp, Artificial
  CRISPR gRNA sequence
tatgttctgaatctagatcg

SEQ ID NO: 465950 - DNA, 20 bp, Artificial
  CRISPR gRNA sequence
tcacgtttgcaaaacattgt

SEQ ID NO: 465951 - DNA, 20 bp, Artificial
  CRISPR gRNA sequence
tacattttaaatgattaaat

SEQ ID NO: 465952 - DNA, 20 bp, Artificial
  CRISPR gRNA sequence
taccacaataaaaatatatt

SEQ ID NO: 465953 - DNA, 20 bp, Artificial
  CRISPR gRNA sequence
ataaaaatatatttggatca

SEQ ID NO: 465954 - DNA, 20 bp, Artificial
  CRISPR gRNA sequence
aaaatatatttggatcaaag

SEQ ID NO: 465955 - DNA, 20 bp, Artificial
  CRISPR gRNA sequence
aatatatttggatcaaagaa

SEQ ID NO: 465956 - DNA, 20 bp, Artificial
  CRISPR gRNA sequence
gaagagtgccctttaattat

SEQ ID NO: 465957 - DNA, 20 bp, Artificial
  CRISPR gRNA sequence
tttaattataagaaataatg

SEQ ID NO: 465958 - DNA, 20 bp, Artificial
  CRISPR gRNA sequence
taattataagaaataatgtg

SEQ ID NO: 465959 - DNA, 20 bp, Artificial
  CRISPR gRNA sequence
tgctcataaattgaccctta

SEQ ID NO: 465960 - DNA, 20 bp, Artificial
  CRISPR gRNA sequence
aaattgacccttaaagttac

SEQ ID NO: 465961 - DNA, 20 bp, Artificial
  CRISPR gRNA sequence
aattgacccttaaagttact

SEQ ID NO: 465962 - DNA, 20 bp, Artificial
  CRISPR gRNA sequence
tgacccttaaagttactggg

SEQ ID NO: 465963 - DNA, 20 bp, Artificial
  CRISPR gRNA sequence
gacccttaaagttactggga

SEQ ID NO: 465964 - DNA, 20 bp, Artificial
  CRISPR gRNA sequence
cccttaaagttactgggaag

SEQ ID NO: 465965 - DNA, 20 bp, Artificial
  CRISPR gRNA sequence
ctgggaaggagaaatttcaa

SEQ ID NO: 465966 - DNA, 20 bp, Artificial
  CRISPR gRNA sequence
gggaaggagaaatttcaaaa

SEQ ID NO: 465967 - DNA, 20 bp, Artificial
  CRISPR gRNA sequence
ggaaggagaaatttcaaaag

SEQ ID NO: 465968 - DNA, 20 bp, Artificial
  CRISPR gRNA sequence
gaaggagaaatttcaaaaga

SEQ ID NO: 465969 - DNA, 20 bp, Artificial
  CRISPR gRNA sequence
tcaaaagagggttattgcaa

SEQ ID NO: 465970 - DNA, 20 bp, Artificial
  CRISPR gRNA sequence
aaagagggttattgcaatag

SEQ ID NO: 465971 - DNA, 20 bp, Artificial
  CRISPR gRNA sequence
gggttattgcaatagcagca

SEQ ID NO: 465972 - DNA, 20 bp, Artificial
  CRISPR gRNA sequence
atagcagcatggctgaactc

SEQ ID NO: 465973 - DNA, 20 bp, Artificial
  CRISPR gRNA sequence
actctggatgcaacctcgta

SEQ ID NO: 465974 - DNA, 20 bp, Artificial
  CRISPR gRNA sequence
ggatgcaacctcgtacagtt

SEQ ID NO: 465975 - DNA, 20 bp, Artificial
  CRISPR gRNA sequence
cgtacagtttagttccttta

SEQ ID NO: 465976 - DNA, 20 bp, Artificial
  CRISPR gRNA sequence
tactttatatgcttactttt

SEQ ID NO: 465977 - DNA, 20 bp, Artificial
  CRISPR gRNA sequence
agtgtctttcaactccctta

SEQ ID NO: 465978 - DNA, 20 bp, Artificial
  CRISPR gRNA sequence
gtctttcaactcccttaaag

SEQ ID NO: 465979 - DNA, 20 bp, Artificial
  CRISPR gRNA sequence
tcaactcccttaaagtagcc

SEQ ID NO: 465980 - DNA, 20 bp, Artificial
  CRISPR gRNA sequence
tcccttaaagtagcccagtg

SEQ ID NO: 465981 - DNA, 20 bp, Artificial
  CRISPR gRNA sequence
cccttaaagtagcccagtga

SEQ ID NO: 465982 - DNA, 20 bp, Artificial
  CRISPR gRNA sequence
gaaattcttttaaaatgctt

SEQ ID NO: 465983 - DNA, 20 bp, Artificial
  CRISPR gRNA sequence
aaattcttttaaaatgcttt

SEQ ID NO: 465984 - DNA, 20 bp, Artificial
  CRISPR gRNA sequence
tcttttaaaatgctttaggt

SEQ ID NO: 465985 - DNA, 20 bp, Artificial
  CRISPR gRNA sequence
ggttagtttaaaatttctta

SEQ ID NO: 465986 - DNA, 20 bp, Artificial
  CRISPR gRNA sequence
tagtttaaaatttcttacag

SEQ ID NO: 465987 - DNA, 20 bp, Artificial
  CRISPR gRNA sequence
cagcaccatgaaaaaatgca

SEQ ID NO: 465988 - DNA, 20 bp, Artificial
  CRISPR gRNA sequence
caccatgaaaaaatgcatag

SEQ ID NO: 465989 - DNA, 20 bp, Artificial
  CRISPR gRNA sequence
tgaaaaaatgcatagcagtt

SEQ ID NO: 465990 - DNA, 20 bp, Artificial
  CRISPR gRNA sequence
aaaaatgcatagcagtttag

SEQ ID NO: 465991 - DNA, 20 bp, Artificial
  CRISPR gRNA sequence
aatgcatagcagtttagcag

SEQ ID NO: 465992 - DNA, 20 bp, Artificial
  CRISPR gRNA sequence
caaccctcaattatgaaata

SEQ ID NO: 465993 - DNA, 20 bp, Artificial
  CRISPR gRNA sequence
ccctcaattatgaaatatag

SEQ ID NO: 465994 - DNA, 20 bp, Artificial
  CRISPR gRNA sequence
tgaaatatagaagaaatcga

SEQ ID NO: 465995 - DNA, 20 bp, Artificial
  CRISPR gRNA sequence
aatatagaagaaatcgatgg

SEQ ID NO: 465996 - DNA, 20 bp, Artificial
  CRISPR gRNA sequence
tatagaagaaatcgatggca

SEQ ID NO: 465997 - DNA, 20 bp, Artificial
  CRISPR gRNA sequence
gaagaaatcgatggcagagt

SEQ ID NO: 465998 - DNA, 20 bp, Artificial
  CRISPR gRNA sequence
aagaaatcgatggcagagtt

SEQ ID NO: 465999 - DNA, 20 bp, Artificial
  CRISPR gRNA sequence
agaaatcgatggcagagtta

SEQ ID NO: 466000 - DNA, 20 bp, Artificial
  CRISPR gRNA sequence
ggactctgcttttgcaaata

SEQ ID NO: 466001 - DNA, 20 bp, Artificial
  CRISPR gRNA sequence
gcttttgcaaatatagcgtg

SEQ ID NO: 466002 - DNA, 20 bp, Artificial
  CRISPR gRNA sequence
tgcaaatatagcgtgaagct

SEQ ID NO: 466003 - DNA, 20 bp, Artificial
  CRISPR gRNA sequence
tatagcgtgaagctcggtgc

SEQ ID NO: 466004 - DNA, 20 bp, Artificial
  CRISPR gRNA sequence
acttgtgaccatccatgcac

SEQ ID NO: 466005 - DNA, 20 bp, Artificial
  CRISPR gRNA sequence
cactggcttataaacctctt

SEQ ID NO: 466006 - DNA, 20 bp, Artificial
  CRISPR gRNA sequence
actggcttataaacctcttc

SEQ ID NO: 466007 - DNA, 20 bp, Artificial
  CRISPR gRNA sequence
gcttataaacctcttcagga

SEQ ID NO: 466008 - DNA, 20 bp, Artificial
  CRISPR gRNA sequence
tataaacctcttcaggatgg

SEQ ID NO: 466009 - DNA, 20 bp, Artificial
  CRISPR gRNA sequence
aacatctttgctctgtatga

SEQ ID NO: 466010 - DNA, 20 bp, Artificial
  CRISPR gRNA sequence
tctttgctctgtatgatgga

SEQ ID NO: 466011 - DNA, 20 bp, Artificial
  CRISPR gRNA sequence
ttgctctgtatgatggatgg

SEQ ID NO: 466012 - DNA, 20 bp, Artificial
  CRISPR gRNA sequence
tgctctgtatgatggatggc

SEQ ID NO: 466013 - DNA, 20 bp, Artificial
  CRISPR gRNA sequence
gctctgtatgatggatggca

SEQ ID NO: 466014 - DNA, 20 bp, Artificial
  CRISPR gRNA sequence
atgatggatggcagggtacc

SEQ ID NO: 466015 - DNA, 20 bp, Artificial
  CRISPR gRNA sequence
atggcagggtacctggcaca

SEQ ID NO: 466016 - DNA, 20 bp, Artificial
  CRISPR gRNA sequence
gcagggtacctggcacatgg

SEQ ID NO: 466017 - DNA, 20 bp, Artificial
  CRISPR gRNA sequence
cagggtacctggcacatggt

SEQ ID NO: 466018 - DNA, 20 bp, Artificial
  CRISPR gRNA sequence
agggtacctggcacatggta

SEQ ID NO: 466019 - DNA, 20 bp, Artificial
  CRISPR gRNA sequence
gggtacctggcacatggtag

SEQ ID NO: 466020 - DNA, 20 bp, Artificial
  CRISPR gRNA sequence
atttctttgtaaatgaatta

SEQ ID NO: 466021 - DNA, 20 bp, Artificial
  CRISPR gRNA sequence
tgtaaatgaattaaagaaca

SEQ ID NO: 466022 - DNA, 20 bp, Artificial
  CRISPR gRNA sequence
taaagaacatagtatatgca

SEQ ID NO: 466023 - DNA, 20 bp, Artificial
  CRISPR gRNA sequence
aaaaattgtcttcatcaacc

SEQ ID NO: 466024 - DNA, 20 bp, Artificial
  CRISPR gRNA sequence
aaattgtcttcatcaacctg

SEQ ID NO: 466025 - DNA, 20 bp, Artificial
  CRISPR gRNA sequence
ttgtcttcatcaacctggag

SEQ ID NO: 466026 - DNA, 20 bp, Artificial
  CRISPR gRNA sequence
tgtcttcatcaacctggaga

SEQ ID NO: 466027 - DNA, 20 bp, Artificial
  CRISPR gRNA sequence
aacctggagaaggctatatt

SEQ ID NO: 466028 - DNA, 20 bp, Artificial
  CRISPR gRNA sequence
acctggagaaggctatatta

SEQ ID NO: 466029 - DNA, 20 bp, Artificial
  CRISPR gRNA sequence
aaggctatattaaggatgta

SEQ ID NO: 466030 - DNA, 20 bp, Artificial
  CRISPR gRNA sequence
tgtatggaatgaacactttc

SEQ ID NO: 466031 - DNA, 20 bp, Artificial
  CRISPR gRNA sequence
tggaatgaacactttctgga

SEQ ID NO: 466032 - DNA, 20 bp, Artificial
  CRISPR gRNA sequence
cattattaattcacattaat

SEQ ID NO: 466033 - DNA, 20 bp, Artificial
  CRISPR gRNA sequence
aacaaatactattttttaaa

SEQ ID NO: 466034 - DNA, 20 bp, Artificial
  CRISPR gRNA sequence
acaaatactattttttaaac

SEQ ID NO: 466035 - DNA, 20 bp, Artificial
  CRISPR gRNA sequence
gtaaaataaattacaaaaat

SEQ ID NO: 466036 - DNA, 20 bp, Artificial
  CRISPR gRNA sequence
taaaataaattacaaaaata

SEQ ID NO: 466037 - DNA, 20 bp, Artificial
  CRISPR gRNA sequence
aatctgcaaaatattaattc

SEQ ID NO: 466038 - DNA, 20 bp, Artificial
  CRISPR gRNA sequence
atatatactattgaataaat

SEQ ID NO: 466039 - DNA, 20 bp, Artificial
  CRISPR gRNA sequence
gtataataaaattaaatttt

SEQ ID NO: 466040 - DNA, 20 bp, Artificial
  CRISPR gRNA sequence
tataataaaattaaattttg

SEQ ID NO: 466041 - DNA, 20 bp, Artificial
  CRISPR gRNA sequence
aaattaaattttgaggcatt

SEQ ID NO: 466042 - DNA, 20 bp, Artificial
  CRISPR gRNA sequence
ggcattgagtccaccttcct

SEQ ID NO: 466043 - DNA, 20 bp, Artificial
  CRISPR gRNA sequence
attgagtccaccttccttgg

SEQ ID NO: 466044 - DNA, 20 bp, Artificial
  CRISPR gRNA sequence
tgagtccaccttccttggaa

SEQ ID NO: 466045 - DNA, 20 bp, Artificial
  CRISPR gRNA sequence
gtccaccttccttggaagag

SEQ ID NO: 466046 - DNA, 20 bp, Artificial
  CRISPR gRNA sequence
aagagaagccttgtgtaatt

SEQ ID NO: 466047 - DNA, 20 bp, Artificial
  CRISPR gRNA sequence
tgtaattcagtctttcttta

SEQ ID NO: 466048 - DNA, 20 bp, Artificial
  CRISPR gRNA sequence
gtaattcagtctttctttat

SEQ ID NO: 466049 - DNA, 20 bp, Artificial
  CRISPR gRNA sequence
gaactaatctacttctatac

SEQ ID NO: 466050 - DNA, 20 bp, Artificial
  CRISPR gRNA sequence
ttctatacgagacatgaatt

SEQ ID NO: 466051 - DNA, 20 bp, Artificial
  CRISPR gRNA sequence
tacgagacatgaatttagcc

SEQ ID NO: 466052 - DNA, 20 bp, Artificial
  CRISPR gRNA sequence
acgagacatgaatttagcca

SEQ ID NO: 466053 - DNA, 20 bp, Artificial
  CRISPR gRNA sequence
gacatgaatttagccaaggt

SEQ ID NO: 466054 - DNA, 20 bp, Artificial
  CRISPR gRNA sequence
atttagccaaggtcagatga

SEQ ID NO: 466055 - DNA, 20 bp, Artificial
  CRISPR gRNA sequence
tttagccaaggtcagatgaa

SEQ ID NO: 466056 - DNA, 20 bp, Artificial
  CRISPR gRNA sequence
gccaaggtcagatgaaaggt

SEQ ID NO: 466057 - DNA, 20 bp, Artificial
  CRISPR gRNA sequence
aaggtcagatgaaaggtcag

SEQ ID NO: 466058 - DNA, 20 bp, Artificial
  CRISPR gRNA sequence
aataattaattgtgatacaa

SEQ ID NO: 466059 - DNA, 20 bp, Artificial
  CRISPR gRNA sequence
tacaaaagtctgttacacaa

SEQ ID NO: 466060 - DNA, 20 bp, Artificial
  CRISPR gRNA sequence
aaaagtctgttacacaaaag

SEQ ID NO: 466061 - DNA, 20 bp, Artificial
  CRISPR gRNA sequence
tttctgctctatcccatatt

SEQ ID NO: 466062 - DNA, 20 bp, Artificial
  CRISPR gRNA sequence
ttctgctctatcccatattt

SEQ ID NO: 466063 - DNA, 20 bp, Artificial
  CRISPR gRNA sequence
tgggtcattcatgatgacta

SEQ ID NO: 466064 - DNA, 20 bp, Artificial
  CRISPR gRNA sequence
tgatgactaaagataatctg

SEQ ID NO: 466065 - DNA, 20 bp, Artificial
  CRISPR gRNA sequence
aagataatctgtagtttgta

SEQ ID NO: 466066 - DNA, 20 bp, Artificial
  CRISPR gRNA sequence
tgtagtttgtaaagtgcata

SEQ ID NO: 466067 - DNA, 20 bp, Artificial
  CRISPR gRNA sequence
gtagtttgtaaagtgcataa

SEQ ID NO: 466068 - DNA, 20 bp, Artificial
  CRISPR gRNA sequence
gtgcataaaggtgcctgttc

SEQ ID NO: 466069 - DNA, 20 bp, Artificial
  CRISPR gRNA sequence
tgcataaaggtgcctgttct

SEQ ID NO: 466070 - DNA, 20 bp, Artificial
  CRISPR gRNA sequence
gcataaaggtgcctgttcta

SEQ ID NO: 466071 - DNA, 20 bp, Artificial
  CRISPR gRNA sequence
aggtgcctgttctagggatc

SEQ ID NO: 466072 - DNA, 20 bp, Artificial
  CRISPR gRNA sequence
gcctgttctagggatcaagt

SEQ ID NO: 466073 - DNA, 20 bp, Artificial
  CRISPR gRNA sequence
cctgttctagggatcaagtt

SEQ ID NO: 466074 - DNA, 20 bp, Artificial
  CRISPR gRNA sequence
ctgttctagggatcaagttg

SEQ ID NO: 466075 - DNA, 20 bp, Artificial
  CRISPR gRNA sequence
ctagggatcaagttggggct

SEQ ID NO: 466076 - DNA, 20 bp, Artificial
  CRISPR gRNA sequence
gatcaagttggggctgagat

SEQ ID NO: 466077 - DNA, 20 bp, Artificial
  CRISPR gRNA sequence
atcaagttggggctgagatt

SEQ ID NO: 466078 - DNA, 20 bp, Artificial
  CRISPR gRNA sequence
tcaacaatctatctattttg

SEQ ID NO: 466079 - DNA, 20 bp, Artificial
  CRISPR gRNA sequence
aacaatctatctattttgtg

SEQ ID NO: 466080 - DNA, 20 bp, Artificial
  CRISPR gRNA sequence
acaatctatctattttgtgg

SEQ ID NO: 466081 - DNA, 20 bp, Artificial
  CRISPR gRNA sequence
tctatctattttgtggagga

SEQ ID NO: 466082 - DNA, 20 bp, Artificial
  CRISPR gRNA sequence
tggaggaaagaacccaactt

SEQ ID NO: 466083 - DNA, 20 bp, Artificial
  CRISPR gRNA sequence
ggaggaaagaacccaacttt

SEQ ID NO: 466084 - DNA, 20 bp, Artificial
  CRISPR gRNA sequence
gaggaaagaacccaacttta

SEQ ID NO: 466085 - DNA, 20 bp, Artificial
  CRISPR gRNA sequence
aggaaagaacccaactttag

SEQ ID NO: 466086 - DNA, 20 bp, Artificial
  CRISPR gRNA sequence
aagaacccaactttagggga

SEQ ID NO: 466087 - DNA, 20 bp, Artificial
  CRISPR gRNA sequence
agaacccaactttaggggaa

SEQ ID NO: 466088 - DNA, 20 bp, Artificial
  CRISPR gRNA sequence
gaacccaactttaggggaaa

SEQ ID NO: 466089 - DNA, 20 bp, Artificial
  CRISPR gRNA sequence
ccctcctaaatcctgtgcct

SEQ ID NO: 466090 - DNA, 20 bp, Artificial
  CRISPR gRNA sequence
cctcctaaatcctgtgcctt

SEQ ID NO: 466091 - DNA, 20 bp, Artificial
  CRISPR gRNA sequence
ctcctaaatcctgtgccttg

SEQ ID NO: 466092 - DNA, 20 bp, Artificial
  CRISPR gRNA sequence
tcctaaatcctgtgccttgg

SEQ ID NO: 466093 - DNA, 20 bp, Artificial
  CRISPR gRNA sequence
cctaaatcctgtgccttggg

SEQ ID NO: 466094 - DNA, 20 bp, Artificial
  CRISPR gRNA sequence
ctgtgccttggggggtttta

SEQ ID NO: 466095 - DNA, 20 bp, Artificial
  CRISPR gRNA sequence
ttggggggttttatggaaca

SEQ ID NO: 466096 - DNA, 20 bp, Artificial
  CRISPR gRNA sequence
tttatggaacaaagtatgtg

SEQ ID NO: 466097 - DNA, 20 bp, Artificial
  CRISPR gRNA sequence
aacaaagtatgtgaagtatg

SEQ ID NO: 466098 - DNA, 20 bp, Artificial
  CRISPR gRNA sequence
aaagtatgtgaagtatgaag

SEQ ID NO: 466099 - DNA, 20 bp, Artificial
  CRISPR gRNA sequence
tgtgaagtatgaagtggtga

SEQ ID NO: 466100 - DNA, 20 bp, Artificial
  CRISPR gRNA sequence
tgaagtatgaagtggtgaaa

SEQ ID NO: 466101 - DNA, 20 bp, Artificial
  CRISPR gRNA sequence
gtatgaagtggtgaaagaga

SEQ ID NO: 466102 - DNA, 20 bp, Artificial
  CRISPR gRNA sequence
agtggtgaaagagaaagtct

SEQ ID NO: 466103 - DNA, 20 bp, Artificial
  CRISPR gRNA sequence
tggtgaaagagaaagtctaa

SEQ ID NO: 466104 - DNA, 20 bp, Artificial
  CRISPR gRNA sequence
gagaaagtctaagagctaaa

SEQ ID NO: 466105 - DNA, 20 bp, Artificial
  CRISPR gRNA sequence
agaaagtctaagagctaaat

SEQ ID NO: 466106 - DNA, 20 bp, Artificial
  CRISPR gRNA sequence
aaagtctaagagctaaatag

SEQ ID NO: 466107 - DNA, 20 bp, Artificial
  CRISPR gRNA sequence
agagctaaataggagacatg

SEQ ID NO: 466108 - DNA, 20 bp, Artificial
  CRISPR gRNA sequence
gagctaaataggagacatga

SEQ ID NO: 466109 - DNA, 20 bp, Artificial
  CRISPR gRNA sequence
agctaaataggagacatgaa

SEQ ID NO: 466110 - DNA, 20 bp, Artificial
  CRISPR gRNA sequence
ggagacatgaagggccttgt

SEQ ID NO: 466111 - DNA, 20 bp, Artificial
  CRISPR gRNA sequence
tttgaacatttctactctct

SEQ ID NO: 466112 - DNA, 20 bp, Artificial
  CRISPR gRNA sequence
cctatcactcccttccttat

SEQ ID NO: 466113 - DNA, 20 bp, Artificial
  CRISPR gRNA sequence
attaatgctcttgatcctca

SEQ ID NO: 466114 - DNA, 20 bp, Artificial
  CRISPR gRNA sequence
ttgatcctcatggaaaatcc

SEQ ID NO: 466115 - DNA, 20 bp, Artificial
  CRISPR gRNA sequence
gatcctcatggaaaatccca

SEQ ID NO: 466116 - DNA, 20 bp, Artificial
  CRISPR gRNA sequence
aaatcccagagaattttctt

SEQ ID NO: 466117 - DNA, 20 bp, Artificial
  CRISPR gRNA sequence
tttcctccaattgcttctat

SEQ ID NO: 466118 - DNA, 20 bp, Artificial
  CRISPR gRNA sequence
attccaattaattctatgat

SEQ ID NO: 466119 - DNA, 20 bp, Artificial
  CRISPR gRNA sequence
atgattggactctttgtctt

SEQ ID NO: 466120 - DNA, 20 bp, Artificial
  CRISPR gRNA sequence
tctttagtatttccccattt

SEQ ID NO: 466121 - DNA, 20 bp, Artificial
  CRISPR gRNA sequence
ttccccattttggtcaattt

SEQ ID NO: 466122 - DNA, 20 bp, Artificial
  CRISPR gRNA sequence
cataacaacactctcttgca

SEQ ID NO: 466123 - DNA, 20 bp, Artificial
  CRISPR gRNA sequence
actctcttgcatagcatccc

SEQ ID NO: 466124 - DNA, 20 bp, Artificial
  CRISPR gRNA sequence
ctcttgcatagcatccccag

SEQ ID NO: 466125 - DNA, 20 bp, Artificial
  CRISPR gRNA sequence
atccccagtggtcacaatat

SEQ ID NO: 466126 - DNA, 20 bp, Artificial
  CRISPR gRNA sequence
tccccagtggtcacaatatt

SEQ ID NO: 466127 - DNA, 20 bp, Artificial
  CRISPR gRNA sequence
ttgggctcatctttgttaac

SEQ ID NO: 466128 - DNA, 20 bp, Artificial
  CRISPR gRNA sequence
tctttgttaaccagcattca

SEQ ID NO: 466129 - DNA, 20 bp, Artificial
  CRISPR gRNA sequence
ccagcattcaaagtcttcca

SEQ ID NO: 466130 - DNA, 20 bp, Artificial
  CRISPR gRNA sequence
gtttgatcccaccacctttc

SEQ ID NO: 466131 - DNA, 20 bp, Artificial
  CRISPR gRNA sequence
ccacctttctagattgtttc

SEQ ID NO: 466132 - DNA, 20 bp, Artificial
  CRISPR gRNA sequence
ttgtttctggattccatata

SEQ ID NO: 466133 - DNA, 20 bp, Artificial
  CRISPR gRNA sequence
catatacagcctctcaattg

SEQ ID NO: 466134 - DNA, 20 bp, Artificial
  CRISPR gRNA sequence
gcctctcaattgcagcctga

SEQ ID NO: 466135 - DNA, 20 bp, Artificial
  CRISPR gRNA sequence
tatgctgctcttgccacttg

SEQ ID NO: 466136 - DNA, 20 bp, Artificial
  CRISPR gRNA sequence
tgctgctcttgccacttgta

SEQ ID NO: 466137 - DNA, 20 bp, Artificial
  CRISPR gRNA sequence
cattcatctgtctccaccta

SEQ ID NO: 466138 - DNA, 20 bp, Artificial
  CRISPR gRNA sequence
tctacccctcctttcaatct

SEQ ID NO: 466139 - DNA, 20 bp, Artificial
  CRISPR gRNA sequence
tcaatctcagctaattttcc

SEQ ID NO: 466140 - DNA, 20 bp, Artificial
  CRISPR gRNA sequence
agctaattttccaagttctt

SEQ ID NO: 466141 - DNA, 20 bp, Artificial
  CRISPR gRNA sequence
gctaattttccaagttctta

SEQ ID NO: 466142 - DNA, 20 bp, Artificial
  CRISPR gRNA sequence
aattttccaagttcttaagg

SEQ ID NO: 466143 - DNA, 20 bp, Artificial
  CRISPR gRNA sequence
gaagcttttcatgatcacct

SEQ ID NO: 466144 - DNA, 20 bp, Artificial
  CRISPR gRNA sequence
aagcttttcatgatcacctg

SEQ ID NO: 466145 - DNA, 20 bp, Artificial
  CRISPR gRNA sequence
agcttttcatgatcacctga

SEQ ID NO: 466146 - DNA, 20 bp, Artificial
  CRISPR gRNA sequence
gcttttcatgatcacctgag

SEQ ID NO: 466147 - DNA, 20 bp, Artificial
  CRISPR gRNA sequence
tttcatgatcacctgagggg

SEQ ID NO: 466148 - DNA, 20 bp, Artificial
  CRISPR gRNA sequence
ttcatgatcacctgagggga

SEQ ID NO: 466149 - DNA, 20 bp, Artificial
  CRISPR gRNA sequence
tcatgatcacctgaggggaa

SEQ ID NO: 466150 - DNA, 20 bp, Artificial
  CRISPR gRNA sequence
taccaatttttatgccattt

SEQ ID NO: 466151 - DNA, 20 bp, Artificial
  CRISPR gRNA sequence
tttatcatttcctttcactg

SEQ ID NO: 466152 - DNA, 20 bp, Artificial
  CRISPR gRNA sequence
cctttcactgtagtaatgtg

SEQ ID NO: 466153 - DNA, 20 bp, Artificial
  CRISPR gRNA sequence
taatgtgtggaaatgtcttt

SEQ ID NO: 466154 - DNA, 20 bp, Artificial
  CRISPR gRNA sequence
aatgtgtggaaatgtctttt

SEQ ID NO: 466155 - DNA, 20 bp, Artificial
  CRISPR gRNA sequence
atgtcttttaggtcccatga

SEQ ID NO: 466156 - DNA, 20 bp, Artificial
  CRISPR gRNA sequence
catgaaagattataatgtcc

SEQ ID NO: 466157 - DNA, 20 bp, Artificial
  CRISPR gRNA sequence
gaaagattataatgtcctgg

SEQ ID NO: 466158 - DNA, 20 bp, Artificial
  CRISPR gRNA sequence
aaagattataatgtcctgga

SEQ ID NO: 466159 - DNA, 20 bp, Artificial
  CRISPR gRNA sequence
attataatgtcctggaaggc

SEQ ID NO: 466160 - DNA, 20 bp, Artificial
  CRISPR gRNA sequence
tcttttaacttccttcacaa

SEQ ID NO: 466161 - DNA, 20 bp, Artificial
  CRISPR gRNA sequence
cttttaacttccttcacaaa

SEQ ID NO: 466162 - DNA, 20 bp, Artificial
  CRISPR gRNA sequence
ttcacaaaaggtaaattgtt

SEQ ID NO: 466163 - DNA, 20 bp, Artificial
  CRISPR gRNA sequence
tcacaaaaggtaaattgttt

SEQ ID NO: 466164 - DNA, 20 bp, Artificial
  CRISPR gRNA sequence
actttaatttaaactctgtg

SEQ ID NO: 466165 - DNA, 20 bp, Artificial
  CRISPR gRNA sequence
gatttaaaactaatttaatc

SEQ ID NO: 466166 - DNA, 20 bp, Artificial
  CRISPR gRNA sequence
atttaaaactaatttaatct

SEQ ID NO: 466167 - DNA, 20 bp, Artificial
  CRISPR gRNA sequence
tctaggtgtgcatttttctt

SEQ ID NO: 466168 - DNA, 20 bp, Artificial
  CRISPR gRNA sequence
gtgtgcatttttctttagtg

SEQ ID NO: 466169 - DNA, 20 bp, Artificial
  CRISPR gRNA sequence
tgcatttttctttagtgaag

SEQ ID NO: 466170 - DNA, 20 bp, Artificial
  CRISPR gRNA sequence
agtggtgaaaacaaaaataa

SEQ ID NO: 466171 - DNA, 20 bp, Artificial
  CRISPR gRNA sequence
gtggtgaaaacaaaaataac

SEQ ID NO: 466172 - DNA, 20 bp, Artificial
  CRISPR gRNA sequence
tggtgaaaacaaaaataaca

SEQ ID NO: 466173 - DNA, 20 bp, Artificial
  CRISPR gRNA sequence
gtgaaaacaaaaataacagg

SEQ ID NO: 466174 - DNA, 20 bp, Artificial
  CRISPR gRNA sequence
tgaaaacaaaaataacaggg

SEQ ID NO: 466175 - DNA, 20 bp, Artificial
  CRISPR gRNA sequence
gaaaacaaaaataacaggga

SEQ ID NO: 466176 - DNA, 20 bp, Artificial
  CRISPR gRNA sequence
aaaaataacagggagggtca

SEQ ID NO: 466177 - DNA, 20 bp, Artificial
  CRISPR gRNA sequence
ccttttccttctgaacctga

SEQ ID NO: 466178 - DNA, 20 bp, Artificial
  CRISPR gRNA sequence
cttctgaacctgaaagtgct

SEQ ID NO: 466179 - DNA, 20 bp, Artificial
  CRISPR gRNA sequence
ctgaaagtgctcagtgaact

SEQ ID NO: 466180 - DNA, 20 bp, Artificial
  CRISPR gRNA sequence
gtgctcagtgaactaagtat

SEQ ID NO: 466181 - DNA, 20 bp, Artificial
  CRISPR gRNA sequence
tgctcagtgaactaagtata

SEQ ID NO: 466182 - DNA, 20 bp, Artificial
  CRISPR gRNA sequence
cagtgaactaagtataaggt

SEQ ID NO: 466183 - DNA, 20 bp, Artificial
  CRISPR gRNA sequence
agtgaactaagtataaggtg

SEQ ID NO: 466184 - DNA, 20 bp, Artificial
  CRISPR gRNA sequence
tgaactaagtataaggtgag

SEQ ID NO: 466185 - DNA, 20 bp, Artificial
  CRISPR gRNA sequence
gtgaggagaaaaatatattt

SEQ ID NO: 466186 - DNA, 20 bp, Artificial
  CRISPR gRNA sequence
tatattttggaaatatgttt

SEQ ID NO: 466187 - DNA, 20 bp, Artificial
  CRISPR gRNA sequence
atattttggaaatatgttta

SEQ ID NO: 466188 - DNA, 20 bp, Artificial
  CRISPR gRNA sequence
taaggaccatgcttttcata

SEQ ID NO: 466189 - DNA, 20 bp, Artificial
  CRISPR gRNA sequence
tgcttttcataaagaaattt

SEQ ID NO: 466190 - DNA, 20 bp, Artificial
  CRISPR gRNA sequence
cttttcataaagaaattttg

SEQ ID NO: 466191 - DNA, 20 bp, Artificial
  CRISPR gRNA sequence
ttttcataaagaaattttgg

SEQ ID NO: 466192 - DNA, 20 bp, Artificial
  CRISPR gRNA sequence
tcctgtgaaatatatttccg

SEQ ID NO: 466193 - DNA, 20 bp, Artificial
  CRISPR gRNA sequence
atatatttccgaagtgattt

SEQ ID NO: 466194 - DNA, 20 bp, Artificial
  CRISPR gRNA sequence
ggacattttcttgtttttat

SEQ ID NO: 466195 - DNA, 20 bp, Artificial
  CRISPR gRNA sequence
ttcttttgctgtttatgttc

SEQ ID NO: 466196 - DNA, 20 bp, Artificial
  CRISPR gRNA sequence
gctgtttatgttcaagttaa

SEQ ID NO: 466197 - DNA, 20 bp, Artificial
  CRISPR gRNA sequence
ttcaagttaaaagttcatgt

SEQ ID NO: 466198 - DNA, 20 bp, Artificial
  CRISPR gRNA sequence
gttaaaagttcatgtaagaa

SEQ ID NO: 466199 - DNA, 20 bp, Artificial
  CRISPR gRNA sequence
ttaaaagttcatgtaagaac

SEQ ID NO: 466200 - DNA, 20 bp, Artificial
  CRISPR gRNA sequence
atgtaagaacaggactgtga

SEQ ID NO: 466201 - DNA, 20 bp, Artificial
  CRISPR gRNA sequence
gtaagaacaggactgtgaca

SEQ ID NO: 466202 - DNA, 20 bp, Artificial
  CRISPR gRNA sequence
gaacaggactgtgacagagt

SEQ ID NO: 466203 - DNA, 20 bp, Artificial
  CRISPR gRNA sequence
aacaggactgtgacagagtt

SEQ ID NO: 466204 - DNA, 20 bp, Artificial
  CRISPR gRNA sequence
acaggactgtgacagagttg

SEQ ID NO: 466205 - DNA, 20 bp, Artificial
  CRISPR gRNA sequence
actgtgacagagttggggct

SEQ ID NO: 466206 - DNA, 20 bp, Artificial
  CRISPR gRNA sequence
agttggggcttggatgctct

SEQ ID NO: 466207 - DNA, 20 bp, Artificial
  CRISPR gRNA sequence
gttggggcttggatgctctt

SEQ ID NO: 466208 - DNA, 20 bp, Artificial
  CRISPR gRNA sequence
gggcttggatgctcttggga

SEQ ID NO: 466209 - DNA, 20 bp, Artificial
  CRISPR gRNA sequence
ttgggaaagcactattctcc

SEQ ID NO: 466210 - DNA, 20 bp, Artificial
  CRISPR gRNA sequence
agcactattctcccagaatg

SEQ ID NO: 466211 - DNA, 20 bp, Artificial
  CRISPR gRNA sequence
tattctcccagaatgaagaa

SEQ ID NO: 466212 - DNA, 20 bp, Artificial
  CRISPR gRNA sequence
agaaaagcaccttgcacaac

SEQ ID NO: 466213 - DNA, 20 bp, Artificial
  CRISPR gRNA sequence
gcaccttgcacaacaagcca

SEQ ID NO: 466214 - DNA, 20 bp, Artificial
  CRISPR gRNA sequence
tgcacaacaagccaaagtcc

SEQ ID NO: 466215 - DNA, 20 bp, Artificial
  CRISPR gRNA sequence
gcacaacaagccaaagtcct

SEQ ID NO: 466216 - DNA, 20 bp, Artificial
  CRISPR gRNA sequence
cacaacaagccaaagtccta

SEQ ID NO: 466217 - DNA, 20 bp, Artificial
  CRISPR gRNA sequence
acaacaagccaaagtcctag

SEQ ID NO: 466218 - DNA, 20 bp, Artificial
  CRISPR gRNA sequence
aagccaaagtcctaggggaa

SEQ ID NO: 466219 - DNA, 20 bp, Artificial
  CRISPR gRNA sequence
agtcctaggggaaaagttga

SEQ ID NO: 466220 - DNA, 20 bp, Artificial
  CRISPR gRNA sequence
tcctaggggaaaagttgaca

SEQ ID NO: 466221 - DNA, 20 bp, Artificial
  CRISPR gRNA sequence
aggggaaaagttgacagagc

SEQ ID NO: 466222 - DNA, 20 bp, Artificial
  CRISPR gRNA sequence
ggggaaaagttgacagagct

SEQ ID NO: 466223 - DNA, 20 bp, Artificial
  CRISPR gRNA sequence
gggaaaagttgacagagctg

SEQ ID NO: 466224 - DNA, 20 bp, Artificial
  CRISPR gRNA sequence
aagttgacagagctggggaa

SEQ ID NO: 466225 - DNA, 20 bp, Artificial
  CRISPR gRNA sequence
acagcccttgaaacatccat

SEQ ID NO: 466226 - DNA, 20 bp, Artificial
  CRISPR gRNA sequence
cacccttcccaaacttccct

SEQ ID NO: 466227 - DNA, 20 bp, Artificial
  CRISPR gRNA sequence
cttcccaaacttcccttggt

SEQ ID NO: 466228 - DNA, 20 bp, Artificial
  CRISPR gRNA sequence
aaacttcccttggtcagttt

SEQ ID NO: 466229 - DNA, 20 bp, Artificial
  CRISPR gRNA sequence
cccttggtcagtttcagatt

SEQ ID NO: 466230 - DNA, 20 bp, Artificial
  CRISPR gRNA sequence
ttcagattaagaacttcccc

SEQ ID NO: 466231 - DNA, 20 bp, Artificial
  CRISPR gRNA sequence
tcagattaagaacttcccca

SEQ ID NO: 466232 - DNA, 20 bp, Artificial
  CRISPR gRNA sequence
attaagaacttccccaaggc

SEQ ID NO: 466233 - DNA, 20 bp, Artificial
  CRISPR gRNA sequence
ttaagaacttccccaaggct

SEQ ID NO: 466234 - DNA, 20 bp, Artificial
  CRISPR gRNA sequence
aacttccccaaggctgggcg

SEQ ID NO: 466235 - DNA, 20 bp, Artificial
  CRISPR gRNA sequence
ttccccaaggctgggcgtgg

SEQ ID NO: 466236 - DNA, 20 bp, Artificial
  CRISPR gRNA sequence
gtggctcacatctgtaatcc

SEQ ID NO: 466237 - DNA, 20 bp, Artificial
  CRISPR gRNA sequence
catctgtaatcctagcactt

SEQ ID NO: 466238 - DNA, 20 bp, Artificial
  CRISPR gRNA sequence
atctgtaatcctagcacttt

SEQ ID NO: 466239 - DNA, 20 bp, Artificial
  CRISPR gRNA sequence
ctgtaatcctagcactttgg

SEQ ID NO: 466240 - DNA, 20 bp, Artificial
  CRISPR gRNA sequence
tgtaatcctagcactttggg

SEQ ID NO: 466241 - DNA, 20 bp, Artificial
  CRISPR gRNA sequence
tcctagcactttgggaggcc

SEQ ID NO: 466242 - DNA, 20 bp, Artificial
  CRISPR gRNA sequence
ccaagacgaacaaatcactt

SEQ ID NO: 466243 - DNA, 20 bp, Artificial
  CRISPR gRNA sequence
caagacgaacaaatcacttg

SEQ ID NO: 466244 - DNA, 20 bp, Artificial
  CRISPR gRNA sequence
acgaacaaatcacttgaggt

SEQ ID NO: 466245 - DNA, 20 bp, Artificial
  CRISPR gRNA sequence
cgaacaaatcacttgaggtc

SEQ ID NO: 466246 - DNA, 20 bp, Artificial
  CRISPR gRNA sequence
aacaaatcacttgaggtcag

SEQ ID NO: 466247 - DNA, 20 bp, Artificial
  CRISPR gRNA sequence
tcacttgaggtcaggagttt

SEQ ID NO: 466248 - DNA, 20 bp, Artificial
  CRISPR gRNA sequence
tgaggtcaggagtttgagat

SEQ ID NO: 466249 - DNA, 20 bp, Artificial
  CRISPR gRNA sequence
tcaggagtttgagatcagcc

SEQ ID NO: 466250 - DNA, 20 bp, Artificial
  CRISPR gRNA sequence
tgagatcagcctggtcaaca

SEQ ID NO: 466251 - DNA, 20 bp, Artificial
  CRISPR gRNA sequence
taaaaatacaaaaaataaac

SEQ ID NO: 466252 - DNA, 20 bp, Artificial
  CRISPR gRNA sequence
aaaaatacaaaaaataaact

SEQ ID NO: 466253 - DNA, 20 bp, Artificial
  CRISPR gRNA sequence
tacaaaaaataaactgggca

SEQ ID NO: 466254 - DNA, 20 bp, Artificial
  CRISPR gRNA sequence
aaaaaataaactgggcacgg

SEQ ID NO: 466255 - DNA, 20 bp, Artificial
  CRISPR gRNA sequence
aaaaataaactgggcacggt

SEQ ID NO: 466256 - DNA, 20 bp, Artificial
  CRISPR gRNA sequence
aaataaactgggcacggtgg

SEQ ID NO: 466257 - DNA, 20 bp, Artificial
  CRISPR gRNA sequence
aataaactgggcacggtggg

SEQ ID NO: 466258 - DNA, 20 bp, Artificial
  CRISPR gRNA sequence
cgcctgtaatcccaactact

SEQ ID NO: 466259 - DNA, 20 bp, Artificial
  CRISPR gRNA sequence
gcctgtaatcccaactactc

SEQ ID NO: 466260 - DNA, 20 bp, Artificial
  CRISPR gRNA sequence
ctgtaatcccaactactcag

SEQ ID NO: 466261 - DNA, 20 bp, Artificial
  CRISPR gRNA sequence
tgtaatcccaactactcagg

SEQ ID NO: 466262 - DNA, 20 bp, Artificial
  CRISPR gRNA sequence
cccaactactcaggaggctg

SEQ ID NO: 466263 - DNA, 20 bp, Artificial
  CRISPR gRNA sequence
aactactcaggaggctgaag

SEQ ID NO: 466264 - DNA, 20 bp, Artificial
  CRISPR gRNA sequence
actactcaggaggctgaagc

SEQ ID NO: 466265 - DNA, 20 bp, Artificial
  CRISPR gRNA sequence
tactcaggaggctgaagcag

SEQ ID NO: 466266 - DNA, 20 bp, Artificial
  CRISPR gRNA sequence
gcaggagaatcacttgaacc

SEQ ID NO: 466267 - DNA, 20 bp, Artificial
  CRISPR gRNA sequence
caggagaatcacttgaaccc

SEQ ID NO: 466268 - DNA, 20 bp, Artificial
  CRISPR gRNA sequence
ggagaatcacttgaacccag

SEQ ID NO: 466269 - DNA, 20 bp, Artificial
  CRISPR gRNA sequence
gagaatcacttgaacccagg

SEQ ID NO: 466270 - DNA, 20 bp, Artificial
  CRISPR gRNA sequence
aatcacttgaacccaggagg

SEQ ID NO: 466271 - DNA, 20 bp, Artificial
  CRISPR gRNA sequence
tcacttgaacccaggaggtg

SEQ ID NO: 466272 - DNA, 20 bp, Artificial
  CRISPR gRNA sequence
cacttgaacccaggaggtgg

SEQ ID NO: 466273 - DNA, 20 bp, Artificial
  CRISPR gRNA sequence
aacccaggaggtggaggctg

SEQ ID NO: 466274 - DNA, 20 bp, Artificial
  CRISPR gRNA sequence
ggtggaggctgcagtgaacc

SEQ ID NO: 466275 - DNA, 20 bp, Artificial
  CRISPR gRNA sequence
gagattgcaccactgcactc

SEQ ID NO: 466276 - DNA, 20 bp, Artificial
  CRISPR gRNA sequence
tgcaccactgcactccagcc

SEQ ID NO: 466277 - DNA, 20 bp, Artificial
  CRISPR gRNA sequence
gcaccactgcactccagcct

SEQ ID NO: 466278 - DNA, 20 bp, Artificial
  CRISPR gRNA sequence
ctgcactccagcctgggtga

SEQ ID NO: 466279 - DNA, 20 bp, Artificial
  CRISPR gRNA sequence
gcactccagcctgggtgata

SEQ ID NO: 466280 - DNA, 20 bp, Artificial
  CRISPR gRNA sequence
tccagcctgggtgatagagc

SEQ ID NO: 466281 - DNA, 20 bp, Artificial
  CRISPR gRNA sequence
caaaaaaaaaaaaaaaaaaa

SEQ ID NO: 466282 - DNA, 20 bp, Artificial
  CRISPR gRNA sequence
aaaaaaaaaaaaaaaaaaag

SEQ ID NO: 466283 - DNA, 20 bp, Artificial
  CRISPR gRNA sequence
aaaaaaaaaaaaaaaagaag

SEQ ID NO: 466284 - DNA, 20 bp, Artificial
  CRISPR gRNA sequence
aaaaaaaagaagaagaaaaa

SEQ ID NO: 466285 - DNA, 20 bp, Artificial
  CRISPR gRNA sequence
caaaatgtgatcattatctg

SEQ ID NO: 466286 - DNA, 20 bp, Artificial
  CRISPR gRNA sequence
aatgtgatcattatctgtgg

SEQ ID NO: 466287 - DNA, 20 bp, Artificial
  CRISPR gRNA sequence
atgtgatcattatctgtggc

SEQ ID NO: 466288 - DNA, 20 bp, Artificial
  CRISPR gRNA sequence
gatcattatctgtggcagga

SEQ ID NO: 466289 - DNA, 20 bp, Artificial
  CRISPR gRNA sequence
cattatctgtggcaggaaag

SEQ ID NO: 466290 - DNA, 20 bp, Artificial
  CRISPR gRNA sequence
attatctgtggcaggaaagt

SEQ ID NO: 466291 - DNA, 20 bp, Artificial
  CRISPR gRNA sequence
ctgtggcaggaaagtgggtg

SEQ ID NO: 466292 - DNA, 20 bp, Artificial
  CRISPR gRNA sequence
gtggcaggaaagtgggtgtg

SEQ ID NO: 466293 - DNA, 20 bp, Artificial
  CRISPR gRNA sequence
caggaaagtgggtgtggagt

SEQ ID NO: 466294 - DNA, 20 bp, Artificial
  CRISPR gRNA sequence
ggaaagtgggtgtggagtga

SEQ ID NO: 466295 - DNA, 20 bp, Artificial
  CRISPR gRNA sequence
gaaagtgggtgtggagtgag

SEQ ID NO: 466296 - DNA, 20 bp, Artificial
  CRISPR gRNA sequence
aaagtgggtgtggagtgaga

SEQ ID NO: 466297 - DNA, 20 bp, Artificial
  CRISPR gRNA sequence
gtgggtgtggagtgagaggg

SEQ ID NO: 466298 - DNA, 20 bp, Artificial
  CRISPR gRNA sequence
tgggtgtggagtgagagggc

SEQ ID NO: 466299 - DNA, 20 bp, Artificial
  CRISPR gRNA sequence
gtgtggagtgagagggcagg

SEQ ID NO: 466300 - DNA, 20 bp, Artificial
  CRISPR gRNA sequence
gagagggcaggaagtccttg

SEQ ID NO: 466301 - DNA, 20 bp, Artificial
  CRISPR gRNA sequence
agagggcaggaagtccttgt

SEQ ID NO: 466302 - DNA, 20 bp, Artificial
  CRISPR gRNA sequence
tgtgggcttccaccctgatt

SEQ ID NO: 466303 - DNA, 20 bp, Artificial
  CRISPR gRNA sequence
tgggcttccaccctgatttg

SEQ ID NO: 466304 - DNA, 20 bp, Artificial
  CRISPR gRNA sequence
gaatgtgcctcttcttattc

SEQ ID NO: 466305 - DNA, 20 bp, Artificial
  CRISPR gRNA sequence
aatgtgcctcttcttattcc

SEQ ID NO: 466306 - DNA, 20 bp, Artificial
  CRISPR gRNA sequence
cctcttcttattccaggtgc

SEQ ID NO: 466307 - DNA, 20 bp, Artificial
  CRISPR gRNA sequence
tcttcttattccaggtgcca

SEQ ID NO: 466308 - DNA, 20 bp, Artificial
  CRISPR gRNA sequence
gtgccagagatatcattgtg

SEQ ID NO: 466309 - DNA, 20 bp, Artificial
  CRISPR gRNA sequence
tatactgtgtccttatgctt

SEQ ID NO: 466310 - DNA, 20 bp, Artificial
  CRISPR gRNA sequence
atactgtgtccttatgctta

SEQ ID NO: 466311 - DNA, 20 bp, Artificial
  CRISPR gRNA sequence
gtgtccttatgcttaaggaa

SEQ ID NO: 466312 - DNA, 20 bp, Artificial
  CRISPR gRNA sequence
tgtccttatgcttaaggaat

SEQ ID NO: 466313 - DNA, 20 bp, Artificial
  CRISPR gRNA sequence
gtccttatgcttaaggaatg

SEQ ID NO: 466314 - DNA, 20 bp, Artificial
  CRISPR gRNA sequence
cttatgcttaaggaatgggg

SEQ ID NO: 466315 - DNA, 20 bp, Artificial
  CRISPR gRNA sequence
tatgcttaaggaatggggaa

SEQ ID NO: 466316 - DNA, 20 bp, Artificial
  CRISPR gRNA sequence
atgcttaaggaatggggaag

SEQ ID NO: 466317 - DNA, 20 bp, Artificial
  CRISPR gRNA sequence
gaatggggaagaggtgatca

SEQ ID NO: 466318 - DNA, 20 bp, Artificial
  CRISPR gRNA sequence
tggggaagaggtgatcaaag

SEQ ID NO: 466319 - DNA, 20 bp, Artificial
  CRISPR gRNA sequence
gaagaggtgatcaaagcaga

SEQ ID NO: 466320 - DNA, 20 bp, Artificial
  CRISPR gRNA sequence
gtgatcaaagcagacagaca

SEQ ID NO: 466321 - DNA, 20 bp, Artificial
  CRISPR gRNA sequence
caaagattgcgttgtattta

SEQ ID NO: 466322 - DNA, 20 bp, Artificial
  CRISPR gRNA sequence
gcgttgtatttacagtcttt

SEQ ID NO: 466323 - DNA, 20 bp, Artificial
  CRISPR gRNA sequence
tgtatttacagtctttcagt

SEQ ID NO: 466324 - DNA, 20 bp, Artificial
  CRISPR gRNA sequence
ctttcagtgagcttcaaaat

SEQ ID NO: 466325 - DNA, 20 bp, Artificial
  CRISPR gRNA sequence
agtgagcttcaaaataagcc

SEQ ID NO: 466326 - DNA, 20 bp, Artificial
  CRISPR gRNA sequence
ttactttgtgtcaatgatcg

SEQ ID NO: 466327 - DNA, 20 bp, Artificial
  CRISPR gRNA sequence
tactttgtgtcaatgatcgt

SEQ ID NO: 466328 - DNA, 20 bp, Artificial
  CRISPR gRNA sequence
actttgtgtcaatgatcgtg

SEQ ID NO: 466329 - DNA, 20 bp, Artificial
  CRISPR gRNA sequence
aaattgtgcttactgatctt

SEQ ID NO: 466330 - DNA, 20 bp, Artificial
  CRISPR gRNA sequence
tgtgcttactgatcttgaga

SEQ ID NO: 466331 - DNA, 20 bp, Artificial
  CRISPR gRNA sequence
ctgatcttgagatagattgt

SEQ ID NO: 466332 - DNA, 20 bp, Artificial
  CRISPR gRNA sequence
agatagattgttggattctc

SEQ ID NO: 466333 - DNA, 20 bp, Artificial
  CRISPR gRNA sequence
tagattgttggattctctgg

SEQ ID NO: 466334 - DNA, 20 bp, Artificial
  CRISPR gRNA sequence
ctctggtagtgtgcaaacac

SEQ ID NO: 466335 - DNA, 20 bp, Artificial
  CRISPR gRNA sequence
caaacactggaatcctcccc

SEQ ID NO: 466336 - DNA, 20 bp, Artificial
  CRISPR gRNA sequence
aaacactggaatcctcccca

SEQ ID NO: 466337 - DNA, 20 bp, Artificial
  CRISPR gRNA sequence
actggaatcctccccaaggc

SEQ ID NO: 466338 - DNA, 20 bp, Artificial
  CRISPR gRNA sequence
atcctccccaaggctagctc

SEQ ID NO: 466339 - DNA, 20 bp, Artificial
  CRISPR gRNA sequence
cccaaggctagctctggttt

SEQ ID NO: 466340 - DNA, 20 bp, Artificial
  CRISPR gRNA sequence
agctctggttttggacacgt

SEQ ID NO: 466341 - DNA, 20 bp, Artificial
  CRISPR gRNA sequence
ctctggttttggacacgtga

SEQ ID NO: 466342 - DNA, 20 bp, Artificial
  CRISPR gRNA sequence
atcattttctcaatcaattt

SEQ ID NO: 466343 - DNA, 20 bp, Artificial
  CRISPR gRNA sequence
tttaccttgtttctctattt

SEQ ID NO: 466344 - DNA, 20 bp, Artificial
  CRISPR gRNA sequence
tttcagaacaaactcaaaat

SEQ ID NO: 466345 - DNA, 20 bp, Artificial
  CRISPR gRNA sequence
agaacaaactcaaaataagt

SEQ ID NO: 466346 - DNA, 20 bp, Artificial
  CRISPR gRNA sequence
gaacaaactcaaaataagtt

SEQ ID NO: 466347 - DNA, 20 bp, Artificial
  CRISPR gRNA sequence
aacaaactcaaaataagtta

SEQ ID NO: 466348 - DNA, 20 bp, Artificial
  CRISPR gRNA sequence
acaaactcaaaataagttag

SEQ ID NO: 466349 - DNA, 20 bp, Artificial
  CRISPR gRNA sequence
caaactcaaaataagttagg

SEQ ID NO: 466350 - DNA, 20 bp, Artificial
  CRISPR gRNA sequence
aactcaaaataagttagggg

SEQ ID NO: 466351 - DNA, 20 bp, Artificial
  CRISPR gRNA sequence
aataagttagggggagtttt

SEQ ID NO: 466352 - DNA, 20 bp, Artificial
  CRISPR gRNA sequence
gttttgagtttgttctgaaa

SEQ ID NO: 466353 - DNA, 20 bp, Artificial
  CRISPR gRNA sequence
tttgagtttgttctgaaata

SEQ ID NO: 466354 - DNA, 20 bp, Artificial
  CRISPR gRNA sequence
tttgttctgaaatagagaaa

SEQ ID NO: 466355 - DNA, 20 bp, Artificial
  CRISPR gRNA sequence
agaaacagtttgttctgaat

SEQ ID NO: 466356 - DNA, 20 bp, Artificial
  CRISPR gRNA sequence
tttatttgatcaaactaatc

SEQ ID NO: 466357 - DNA, 20 bp, Artificial
  CRISPR gRNA sequence
caaactaatcaagtaaaatt

SEQ ID NO: 466358 - DNA, 20 bp, Artificial
  CRISPR gRNA sequence
aaactaatcaagtaaaatta

SEQ ID NO: 466359 - DNA, 20 bp, Artificial
  CRISPR gRNA sequence
tcaagtaaaattaaggaaat

SEQ ID NO: 466360 - DNA, 20 bp, Artificial
  CRISPR gRNA sequence
caagtaaaattaaggaaatt

SEQ ID NO: 466361 - DNA, 20 bp, Artificial
  CRISPR gRNA sequence
ttaaggaaattaggtttttt

SEQ ID NO: 466362 - DNA, 20 bp, Artificial
  CRISPR gRNA sequence
aggaaattaggtttttttgg

SEQ ID NO: 466363 - DNA, 20 bp, Artificial
  CRISPR gRNA sequence
ttaggtttttttggtggtta

SEQ ID NO: 466364 - DNA, 20 bp, Artificial
  CRISPR gRNA sequence
tttggtggttaaagaaataa

SEQ ID NO: 466365 - DNA, 20 bp, Artificial
  CRISPR gRNA sequence
ggtggttaaagaaataacag

SEQ ID NO: 466366 - DNA, 20 bp, Artificial
  CRISPR gRNA sequence
gttaaagaaataacagaagt

SEQ ID NO: 466367 - DNA, 20 bp, Artificial
  CRISPR gRNA sequence
gaagttggatcttcttgatc

SEQ ID NO: 466368 - DNA, 20 bp, Artificial
  CRISPR gRNA sequence
gttggatcttcttgatccag

SEQ ID NO: 466369 - DNA, 20 bp, Artificial
  CRISPR gRNA sequence
tccagcagatctgtttgtat

SEQ ID NO: 466370 - DNA, 20 bp, Artificial
  CRISPR gRNA sequence
ccagcagatctgtttgtatt

SEQ ID NO: 466371 - DNA, 20 bp, Artificial
  CRISPR gRNA sequence
cagcagatctgtttgtatta

SEQ ID NO: 466372 - DNA, 20 bp, Artificial
  CRISPR gRNA sequence
ttgtattagggtatctgttg

SEQ ID NO: 466373 - DNA, 20 bp, Artificial
  CRISPR gRNA sequence
ggtatctgttgtagaaacct

SEQ ID NO: 466374 - DNA, 20 bp, Artificial
  CRISPR gRNA sequence
cttagtccccattgctatcc

SEQ ID NO: 466375 - DNA, 20 bp, Artificial
  CRISPR gRNA sequence
tgctatccaagaccctcccc

SEQ ID NO: 466376 - DNA, 20 bp, Artificial
  CRISPR gRNA sequence
gctatccaagaccctccccc

SEQ ID NO: 466377 - DNA, 20 bp, Artificial
  CRISPR gRNA sequence
atccaagaccctcccccagg

SEQ ID NO: 466378 - DNA, 20 bp, Artificial
  CRISPR gRNA sequence
ctcccccaggcagctgtttc

SEQ ID NO: 466379 - DNA, 20 bp, Artificial
  CRISPR gRNA sequence
gcagctgtttctggcactcc

SEQ ID NO: 466380 - DNA, 20 bp, Artificial
  CRISPR gRNA sequence
gctgtttctggcactcctgg

SEQ ID NO: 466381 - DNA, 20 bp, Artificial
  CRISPR gRNA sequence
gtttctggcactcctggcag

SEQ ID NO: 466382 - DNA, 20 bp, Artificial
  CRISPR gRNA sequence
tggcactcctggcagtggtt

SEQ ID NO: 466383 - DNA, 20 bp, Artificial
  CRISPR gRNA sequence
tggctgctcgctaacctaaa

SEQ ID NO: 466384 - DNA, 20 bp, Artificial
  CRISPR gRNA sequence
ctgctcgctaacctaaacag

SEQ ID NO: 466385 - DNA, 20 bp, Artificial
  CRISPR gRNA sequence
aacagcagctgcaacatcaa

SEQ ID NO: 466386 - DNA, 20 bp, Artificial
  CRISPR gRNA sequence
aaccactttttgtgcaactt

SEQ ID NO: 466387 - DNA, 20 bp, Artificial
  CRISPR gRNA sequence
atcatttttaccccaaacct

SEQ ID NO: 466388 - DNA, 20 bp, Artificial
  CRISPR gRNA sequence
ttaccccaaacctaagcatc

SEQ ID NO: 466389 - DNA, 20 bp, Artificial
  CRISPR gRNA sequence
taacattataatataattaa

SEQ ID NO: 466390 - DNA, 20 bp, Artificial
  CRISPR gRNA sequence
atagaattttttttttgttt

SEQ ID NO: 466391 - DNA, 20 bp, Artificial
  CRISPR gRNA sequence
aattttttttttgtttgaga

SEQ ID NO: 466392 - DNA, 20 bp, Artificial
  CRISPR gRNA sequence
ttttttttttgtttgagatg

SEQ ID NO: 466393 - DNA, 20 bp, Artificial
  CRISPR gRNA sequence
tggagtcttactctgtcacc

SEQ ID NO: 466394 - DNA, 20 bp, Artificial
  CRISPR gRNA sequence
ggagtcttactctgtcaccc

SEQ ID NO: 466395 - DNA, 20 bp, Artificial
  CRISPR gRNA sequence
cttactctgtcacccaggct

SEQ ID NO: 466396 - DNA, 20 bp, Artificial
  CRISPR gRNA sequence
tctgtcacccaggctgagtg

SEQ ID NO: 466397 - DNA, 20 bp, Artificial
  CRISPR gRNA sequence
gtcacccaggctgagtgcag

SEQ ID NO: 466398 - DNA, 20 bp, Artificial
  CRISPR gRNA sequence
tgagtgcagtggtaccatct

SEQ ID NO: 466399 - DNA, 20 bp, Artificial
  CRISPR gRNA sequence
ggtaccatctcggttcaccg

SEQ ID NO: 466400 - DNA, 20 bp, Artificial
  CRISPR gRNA sequence
caccgaagtctccacctacc

SEQ ID NO: 466401 - DNA, 20 bp, Artificial
  CRISPR gRNA sequence
agtctccacctaccgagttc

SEQ ID NO: 466402 - DNA, 20 bp, Artificial
  CRISPR gRNA sequence
ttcaagcgattctcctgtct

SEQ ID NO: 466403 - DNA, 20 bp, Artificial
  CRISPR gRNA sequence
gtctcagcctcccatgtacc

SEQ ID NO: 466404 - DNA, 20 bp, Artificial
  CRISPR gRNA sequence
tctcagcctcccatgtacct

SEQ ID NO: 466405 - DNA, 20 bp, Artificial
  CRISPR gRNA sequence
ctcccatgtacctgggatta

SEQ ID NO: 466406 - DNA, 20 bp, Artificial
  CRISPR gRNA sequence
tcccatgtacctgggattac

SEQ ID NO: 466407 - DNA, 20 bp, Artificial
  CRISPR gRNA sequence
ttacaggtgcataccacgcc

SEQ ID NO: 466408 - DNA, 20 bp, Artificial
  CRISPR gRNA sequence
ccagctaatttttgtatttt

SEQ ID NO: 466409 - DNA, 20 bp, Artificial
  CRISPR gRNA sequence
gctaatttttgtatttttag

SEQ ID NO: 466410 - DNA, 20 bp, Artificial
  CRISPR gRNA sequence
taatttttgtatttttagta

SEQ ID NO: 466411 - DNA, 20 bp, Artificial
  CRISPR gRNA sequence
ttttgtatttttagtagaga

SEQ ID NO: 466412 - DNA, 20 bp, Artificial
  CRISPR gRNA sequence
tttgtatttttagtagagac

SEQ ID NO: 466413 - DNA, 20 bp, Artificial
  CRISPR gRNA sequence
ttgtatttttagtagagacg

SEQ ID NO: 466414 - DNA, 20 bp, Artificial
  CRISPR gRNA sequence
gagacggggtttcaccattt

SEQ ID NO: 466415 - DNA, 20 bp, Artificial
  CRISPR gRNA sequence
tttcaccattttggccatgc

SEQ ID NO: 466416 - DNA, 20 bp, Artificial
  CRISPR gRNA sequence
ggtctcgaactcctgatctc

SEQ ID NO: 466417 - DNA, 20 bp, Artificial
  CRISPR gRNA sequence
ctcaagtgatccgcctacct

SEQ ID NO: 466418 - DNA, 20 bp, Artificial
  CRISPR gRNA sequence
ccgcctacctcggcctccca

SEQ ID NO: 466419 - DNA, 20 bp, Artificial
  CRISPR gRNA sequence
cctcggcctcccaaagtgct

SEQ ID NO: 466420 - DNA, 20 bp, Artificial
  CRISPR gRNA sequence
ctcccaaagtgctgagatta

SEQ ID NO: 466421 - DNA, 20 bp, Artificial
  CRISPR gRNA sequence
tcccaaagtgctgagattac

SEQ ID NO: 466422 - DNA, 20 bp, Artificial
  CRISPR gRNA sequence
agtgctgagattacaggtgt

SEQ ID NO: 466423 - DNA, 20 bp, Artificial
  CRISPR gRNA sequence
agattacaggtgtgagccac

SEQ ID NO: 466424 - DNA, 20 bp, Artificial
  CRISPR gRNA sequence
gattacaggtgtgagccacc

SEQ ID NO: 466425 - DNA, 20 bp, Artificial
  CRISPR gRNA sequence
acaggtgtgagccaccaggc

SEQ ID NO: 466426 - DNA, 20 bp, Artificial
  CRISPR gRNA sequence
tgagccaccaggccagacct

SEQ ID NO: 466427 - DNA, 20 bp, Artificial
  CRISPR gRNA sequence
gaccttagaatatcttactc

SEQ ID NO: 466428 - DNA, 20 bp, Artificial
  CRISPR gRNA sequence
acaacaacaacaacaacaac

SEQ ID NO: 466429 - DNA, 20 bp, Artificial
  CRISPR gRNA sequence
taatgcacacaaatataaaa

SEQ ID NO: 466430 - DNA, 20 bp, Artificial
  CRISPR gRNA sequence
caaatataaaaaagtttcat

SEQ ID NO: 466431 - DNA, 20 bp, Artificial
  CRISPR gRNA sequence
aaatataaaaaagtttcata

SEQ ID NO: 466432 - DNA, 20 bp, Artificial
  CRISPR gRNA sequence
ataaggtcatacttaaccat

SEQ ID NO: 466433 - DNA, 20 bp, Artificial
  CRISPR gRNA sequence
ggtcatacttaaccataaga

SEQ ID NO: 466434 - DNA, 20 bp, Artificial
  CRISPR gRNA sequence
tcatacttaaccataagaca

SEQ ID NO: 466435 - DNA, 20 bp, Artificial
  CRISPR gRNA sequence
gagtttctccattgacactt

SEQ ID NO: 466436 - DNA, 20 bp, Artificial
  CRISPR gRNA sequence
tctccattgacactttggtc

SEQ ID NO: 466437 - DNA, 20 bp, Artificial
  CRISPR gRNA sequence
ggataatgttttgttgcact

SEQ ID NO: 466438 - DNA, 20 bp, Artificial
  CRISPR gRNA sequence
taatgttttgttgcactaag

SEQ ID NO: 466439 - DNA, 20 bp, Artificial
  CRISPR gRNA sequence
aatgttttgttgcactaagt

SEQ ID NO: 466440 - DNA, 20 bp, Artificial
  CRISPR gRNA sequence
atgttttgttgcactaagtg

SEQ ID NO: 466441 - DNA, 20 bp, Artificial
  CRISPR gRNA sequence
tgttttgttgcactaagtgg

SEQ ID NO: 466442 - DNA, 20 bp, Artificial
  CRISPR gRNA sequence
agtgggggttgcatcctgta

SEQ ID NO: 466443 - DNA, 20 bp, Artificial
  CRISPR gRNA sequence
gggttgcatcctgtatagtg

SEQ ID NO: 466444 - DNA, 20 bp, Artificial
  CRISPR gRNA sequence
ggttgcatcctgtatagtgt

SEQ ID NO: 466445 - DNA, 20 bp, Artificial
  CRISPR gRNA sequence
gttgcatcctgtatagtgta

SEQ ID NO: 466446 - DNA, 20 bp, Artificial
  CRISPR gRNA sequence
cctgtatagtgtagggtgtt

SEQ ID NO: 466447 - DNA, 20 bp, Artificial
  CRISPR gRNA sequence
gtatagtgtagggtgtttag

SEQ ID NO: 466448 - DNA, 20 bp, Artificial
  CRISPR gRNA sequence
agggtgtttagcagaatccc

SEQ ID NO: 466449 - DNA, 20 bp, Artificial
  CRISPR gRNA sequence
aatccccggcttctactcac

SEQ ID NO: 466450 - DNA, 20 bp, Artificial
  CRISPR gRNA sequence
ggcttctactcactggttgc

SEQ ID NO: 466451 - DNA, 20 bp, Artificial
  CRISPR gRNA sequence
tccctccccctaccttgtta

SEQ ID NO: 466452 - DNA, 20 bp, Artificial
  CRISPR gRNA sequence
gttacagccaaaaatgtctc

SEQ ID NO: 466453 - DNA, 20 bp, Artificial
  CRISPR gRNA sequence
gccacacatgttccctgctt

SEQ ID NO: 466454 - DNA, 20 bp, Artificial
  CRISPR gRNA sequence
ctgcttgagaaccactgctc

SEQ ID NO: 466455 - DNA, 20 bp, Artificial
  CRISPR gRNA sequence
ttgtttcacaacctgctaat

SEQ ID NO: 466456 - DNA, 20 bp, Artificial
  CRISPR gRNA sequence
taatgagctgtgaacaactg

SEQ ID NO: 466457 - DNA, 20 bp, Artificial
  CRISPR gRNA sequence
tgtgaacaactgcagacaaa

SEQ ID NO: 466458 - DNA, 20 bp, Artificial
  CRISPR gRNA sequence
gtgaacaactgcagacaaac

SEQ ID NO: 466459 - DNA, 20 bp, Artificial
  CRISPR gRNA sequence
tgaacaactgcagacaaaca

SEQ ID NO: 466460 - DNA, 20 bp, Artificial
  CRISPR gRNA sequence
tgcgtattaacattgatcaa

SEQ ID NO: 466461 - DNA, 20 bp, Artificial
  CRISPR gRNA sequence
tgatcaatagtaatgcgcat

SEQ ID NO: 466462 - DNA, 20 bp, Artificial
  CRISPR gRNA sequence
cgcattagctgtgtgccatg

SEQ ID NO: 466463 - DNA, 20 bp, Artificial
  CRISPR gRNA sequence
cattagctgtgtgccatgca

SEQ ID NO: 466464 - DNA, 20 bp, Artificial
  CRISPR gRNA sequence
gtgccatgcagagcactttt

SEQ ID NO: 466465 - DNA, 20 bp, Artificial
  CRISPR gRNA sequence
tgccatgcagagcactttta

SEQ ID NO: 466466 - DNA, 20 bp, Artificial
  CRISPR gRNA sequence
agcacttttaaggctatcaa

SEQ ID NO: 466467 - DNA, 20 bp, Artificial
  CRISPR gRNA sequence
tatcaaaagtatttgatatt

SEQ ID NO: 466468 - DNA, 20 bp, Artificial
  CRISPR gRNA sequence
tcaaaagtatttgatatttg

SEQ ID NO: 466469 - DNA, 20 bp, Artificial
  CRISPR gRNA sequence
tgatatttggagattctgat

SEQ ID NO: 466470 - DNA, 20 bp, Artificial
  CRISPR gRNA sequence
tggagattctgataagttac

SEQ ID NO: 466471 - DNA, 20 bp, Artificial
  CRISPR gRNA sequence
attctgataagttacgagac

SEQ ID NO: 466472 - DNA, 20 bp, Artificial
  CRISPR gRNA sequence
ttctgataagttacgagaca

SEQ ID NO: 466473 - DNA, 20 bp, Artificial
  CRISPR gRNA sequence
gataagttacgagacaagga

SEQ ID NO: 466474 - DNA, 20 bp, Artificial
  CRISPR gRNA sequence
ataagttacgagacaaggaa

SEQ ID NO: 466475 - DNA, 20 bp, Artificial
  CRISPR gRNA sequence
aaggaaaggacattgtgttg

SEQ ID NO: 466476 - DNA, 20 bp, Artificial
  CRISPR gRNA sequence
atttcctgttacaaacatgt

SEQ ID NO: 466477 - DNA, 20 bp, Artificial
  CRISPR gRNA sequence
tgttacaaacatgttggctt

SEQ ID NO: 466478 - DNA, 20 bp, Artificial
  CRISPR gRNA sequence
gagttcccattgccactcac

SEQ ID NO: 466479 - DNA, 20 bp, Artificial
  CRISPR gRNA sequence
cactcactagctatctgact

SEQ ID NO: 466480 - DNA, 20 bp, Artificial
  CRISPR gRNA sequence
ctcactagctatctgacttg

SEQ ID NO: 466481 - DNA, 20 bp, Artificial
  CRISPR gRNA sequence
atctgacttggagcaactct

SEQ ID NO: 466482 - DNA, 20 bp, Artificial
  CRISPR gRNA sequence
tctgacttggagcaactctt

SEQ ID NO: 466483 - DNA, 20 bp, Artificial
  CRISPR gRNA sequence
gcaactcttgggacaaaata

SEQ ID NO: 466484 - DNA, 20 bp, Artificial
  CRISPR gRNA sequence
ttgggacaaaataaagacaa

SEQ ID NO: 466485 - DNA, 20 bp, Artificial
  CRISPR gRNA sequence
agacaatggttttcctactt

SEQ ID NO: 466486 - DNA, 20 bp, Artificial
  CRISPR gRNA sequence
cctacttaagtgatgaatat

SEQ ID NO: 466487 - DNA, 20 bp, Artificial
  CRISPR gRNA sequence
tacttaagtgatgaatatga

SEQ ID NO: 466488 - DNA, 20 bp, Artificial
  CRISPR gRNA sequence
taagtgatgaatatgagagt

SEQ ID NO: 466489 - DNA, 20 bp, Artificial
  CRISPR gRNA sequence
tgagagttagatactgtaaa

SEQ ID NO: 466490 - DNA, 20 bp, Artificial
  CRISPR gRNA sequence
agttagatactgtaaataga

SEQ ID NO: 466491 - DNA, 20 bp, Artificial
  CRISPR gRNA sequence
gttagatactgtaaatagaa

SEQ ID NO: 466492 - DNA, 20 bp, Artificial
  CRISPR gRNA sequence
gtaaatagaaaggcttaatg

SEQ ID NO: 466493 - DNA, 20 bp, Artificial
  CRISPR gRNA sequence
cttaatgaagtaccttctga

SEQ ID NO: 466494 - DNA, 20 bp, Artificial
  CRISPR gRNA sequence
accttctgacagttatcatg

SEQ ID NO: 466495 - DNA, 20 bp, Artificial
  CRISPR gRNA sequence
ttatcatgaagattgttctg

SEQ ID NO: 466496 - DNA, 20 bp, Artificial
  CRISPR gRNA sequence
tcatgaagattgttctgtgg

SEQ ID NO: 466497 - DNA, 20 bp, Artificial
  CRISPR gRNA sequence
ctgtggaagattaactctat

SEQ ID NO: 466498 - DNA, 20 bp, Artificial
  CRISPR gRNA sequence
agattaactctatcagaata

SEQ ID NO: 466499 - DNA, 20 bp, Artificial
  CRISPR gRNA sequence
agaataaagaatttctgcaa

SEQ ID NO: 466500 - DNA, 20 bp, Artificial
  CRISPR gRNA sequence
ctgcaaaagataaattatcg

SEQ ID NO: 466501 - DNA, 20 bp, Artificial
  CRISPR gRNA sequence
gcaaaagataaattatcgca

SEQ ID NO: 466502 - DNA, 20 bp, Artificial
  CRISPR gRNA sequence
atcgcagagccacgtctgct

SEQ ID NO: 466503 - DNA, 20 bp, Artificial
  CRISPR gRNA sequence
cagagccacgtctgctcagc

SEQ ID NO: 466504 - DNA, 20 bp, Artificial
  CRISPR gRNA sequence
gccacgtctgctcagcaaga

SEQ ID NO: 466505 - DNA, 20 bp, Artificial
  CRISPR gRNA sequence
cgtctgctcagcaagaaagc

SEQ ID NO: 466506 - DNA, 20 bp, Artificial
  CRISPR gRNA sequence
tctgctcagcaagaaagcaa

SEQ ID NO: 466507 - DNA, 20 bp, Artificial
  CRISPR gRNA sequence
ctgctcagcaagaaagcaag

SEQ ID NO: 466508 - DNA, 20 bp, Artificial
  CRISPR gRNA sequence
ctcagcaagaaagcaagagg

SEQ ID NO: 466509 - DNA, 20 bp, Artificial
  CRISPR gRNA sequence
caagaaagcaagaggtggct

SEQ ID NO: 466510 - DNA, 20 bp, Artificial
  CRISPR gRNA sequence
aagaaagcaagaggtggctg

SEQ ID NO: 466511 - DNA, 20 bp, Artificial
  CRISPR gRNA sequence
agaaagcaagaggtggctga

SEQ ID NO: 466512 - DNA, 20 bp, Artificial
  CRISPR gRNA sequence
caagaggtggctgagggcac

SEQ ID NO: 466513 - DNA, 20 bp, Artificial
  CRISPR gRNA sequence
aagaggtggctgagggcact

SEQ ID NO: 466514 - DNA, 20 bp, Artificial
  CRISPR gRNA sequence
ctgagggcactgggattctt

SEQ ID NO: 466515 - DNA, 20 bp, Artificial
  CRISPR gRNA sequence
tgagggcactgggattcttg

SEQ ID NO: 466516 - DNA, 20 bp, Artificial
  CRISPR gRNA sequence
attcttgaggaatgcctctg

SEQ ID NO: 466517 - DNA, 20 bp, Artificial
  CRISPR gRNA sequence
ttcttgaggaatgcctctga

SEQ ID NO: 466518 - DNA, 20 bp, Artificial
  CRISPR gRNA sequence
tcttgaggaatgcctctgaa

SEQ ID NO: 466519 - DNA, 20 bp, Artificial
  CRISPR gRNA sequence
cttgaggaatgcctctgaag

SEQ ID NO: 466520 - DNA, 20 bp, Artificial
  CRISPR gRNA sequence
gaatgcctctgaaggggaaa

SEQ ID NO: 466521 - DNA, 20 bp, Artificial
  CRISPR gRNA sequence
atgcctctgaaggggaaatg

SEQ ID NO: 466522 - DNA, 20 bp, Artificial
  CRISPR gRNA sequence
tgcctctgaaggggaaatgg

SEQ ID NO: 466523 - DNA, 20 bp, Artificial
  CRISPR gRNA sequence
tgaaggggaaatggaggcat

SEQ ID NO: 466524 - DNA, 20 bp, Artificial
  CRISPR gRNA sequence
gcctgaaatctccttcactc

SEQ ID NO: 466525 - DNA, 20 bp, Artificial
  CRISPR gRNA sequence
tcactcaagttctgacaatg

SEQ ID NO: 466526 - DNA, 20 bp, Artificial
  CRISPR gRNA sequence
actcaagttctgacaatgca

SEQ ID NO: 466527 - DNA, 20 bp, Artificial
  CRISPR gRNA sequence
ctcaagttctgacaatgcag

SEQ ID NO: 466528 - DNA, 20 bp, Artificial
  CRISPR gRNA sequence
tcaagttctgacaatgcaga

SEQ ID NO: 466529 - DNA, 20 bp, Artificial
  CRISPR gRNA sequence
caagttctgacaatgcagag

SEQ ID NO: 466530 - DNA, 20 bp, Artificial
  CRISPR gRNA sequence
ccgctgatcccaatatatct

SEQ ID NO: 466531 - DNA, 20 bp, Artificial
  CRISPR gRNA sequence
tcagatttcctaactctctt

SEQ ID NO: 466532 - DNA, 20 bp, Artificial
  CRISPR gRNA sequence
tttagcatttactaacattc

SEQ ID NO: 466533 - DNA, 20 bp, Artificial
  CRISPR gRNA sequence
actaacattccagatgtaaa

SEQ ID NO: 466534 - DNA, 20 bp, Artificial
  CRISPR gRNA sequence
tccagatgtaaaaagtgcct

SEQ ID NO: 466535 - DNA, 20 bp, Artificial
  CRISPR gRNA sequence
gtgcctcagaacgaccctcc

SEQ ID NO: 466536 - DNA, 20 bp, Artificial
  CRISPR gRNA sequence
tgcctcagaacgaccctcca

SEQ ID NO: 466537 - DNA, 20 bp, Artificial
  CRISPR gRNA sequence
acgaccctccaaggacgaaa

SEQ ID NO: 466538 - DNA, 20 bp, Artificial
  CRISPR gRNA sequence
ccctccaaggacgaaatggc

SEQ ID NO: 466539 - DNA, 20 bp, Artificial
  CRISPR gRNA sequence
tccaaggacgaaatggcaag

SEQ ID NO: 466540 - DNA, 20 bp, Artificial
  CRISPR gRNA sequence
acgaaatggcaagcagaccc

SEQ ID NO: 466541 - DNA, 20 bp, Artificial
  CRISPR gRNA sequence
cctgtatcgtttacttcctt

SEQ ID NO: 466542 - DNA, 20 bp, Artificial
  CRISPR gRNA sequence
ctgtatcgtttacttccttt

SEQ ID NO: 466543 - DNA, 20 bp, Artificial
  CRISPR gRNA sequence
tgtatcgtttacttcctttg

SEQ ID NO: 466544 - DNA, 20 bp, Artificial
  CRISPR gRNA sequence
gtatcgtttacttcctttgg

SEQ ID NO: 466545 - DNA, 20 bp, Artificial
  CRISPR gRNA sequence
tatcgtttacttcctttggg

SEQ ID NO: 466546 - DNA, 20 bp, Artificial
  CRISPR gRNA sequence
ttctgcctgttctgctgcct

SEQ ID NO: 466547 - DNA, 20 bp, Artificial
  CRISPR gRNA sequence
tgcctgttctgctgcctgag

SEQ ID NO: 466548 - DNA, 20 bp, Artificial
  CRISPR gRNA sequence
gcctgttctgctgcctgaga

SEQ ID NO: 466549 - DNA, 20 bp, Artificial
  CRISPR gRNA sequence
ctgctgcctgagaaggcacc

SEQ ID NO: 466550 - DNA, 20 bp, Artificial
  CRISPR gRNA sequence
tgctgcctgagaaggcacca

SEQ ID NO: 466551 - DNA, 20 bp, Artificial
  CRISPR gRNA sequence
tgcctgagaaggcaccaagg

SEQ ID NO: 466552 - DNA, 20 bp, Artificial
  CRISPR gRNA sequence
gcctgagaaggcaccaaggt

SEQ ID NO: 466553 - DNA, 20 bp, Artificial
  CRISPR gRNA sequence
ttctattttccctctgcccc

SEQ ID NO: 466554 - DNA, 20 bp, Artificial
  CRISPR gRNA sequence
tgcccccagtaccacacatt

SEQ ID NO: 466555 - DNA, 20 bp, Artificial
  CRISPR gRNA sequence
gcccccagtaccacacattt

SEQ ID NO: 466556 - DNA, 20 bp, Artificial
  CRISPR gRNA sequence
cccccagtaccacacatttg

SEQ ID NO: 466557 - DNA, 20 bp, Artificial
  CRISPR gRNA sequence
tttggggccattcttatttc

SEQ ID NO: 466558 - DNA, 20 bp, Artificial
  CRISPR gRNA sequence
ttggggccattcttatttct

SEQ ID NO: 466559 - DNA, 20 bp, Artificial
  CRISPR gRNA sequence
tggggccattcttatttctg

SEQ ID NO: 466560 - DNA, 20 bp, Artificial
  CRISPR gRNA sequence
cattcttatttctggggcta

SEQ ID NO: 466561 - DNA, 20 bp, Artificial
  CRISPR gRNA sequence
attcttatttctggggctaa

SEQ ID NO: 466562 - DNA, 20 bp, Artificial
  CRISPR gRNA sequence
ttctggggctaaaggatttt

SEQ ID NO: 466563 - DNA, 20 bp, Artificial
  CRISPR gRNA sequence
tttcccaatcctgtaaacca

SEQ ID NO: 466564 - DNA, 20 bp, Artificial
  CRISPR gRNA sequence
aaccatggataatgatttcc

SEQ ID NO: 466565 - DNA, 20 bp, Artificial
  CRISPR gRNA sequence
catggataatgatttcctag

SEQ ID NO: 466566 - DNA, 20 bp, Artificial
  CRISPR gRNA sequence
caactcatatttgcgctaaa

SEQ ID NO: 466567 - DNA, 20 bp, Artificial
  CRISPR gRNA sequence
atttgcgctaaaaagctaaa

SEQ ID NO: 466568 - DNA, 20 bp, Artificial
  CRISPR gRNA sequence
tttgcgctaaaaagctaaat

SEQ ID NO: 466569 - DNA, 20 bp, Artificial
  CRISPR gRNA sequence
cgctaaaaagctaaataggt

SEQ ID NO: 466570 - DNA, 20 bp, Artificial
  CRISPR gRNA sequence
aaaaagctaaataggttggt

SEQ ID NO: 466571 - DNA, 20 bp, Artificial
  CRISPR gRNA sequence
aaaagctaaataggttggtt

SEQ ID NO: 466572 - DNA, 20 bp, Artificial
  CRISPR gRNA sequence
aaagctaaataggttggttg

SEQ ID NO: 466573 - DNA, 20 bp, Artificial
  CRISPR gRNA sequence
aggttggttggggctccctt

SEQ ID NO: 466574 - DNA, 20 bp, Artificial
  CRISPR gRNA sequence
gttggggctcccttgagtca

SEQ ID NO: 466575 - DNA, 20 bp, Artificial
  CRISPR gRNA sequence
ttggggctcccttgagtcac

SEQ ID NO: 466576 - DNA, 20 bp, Artificial
  CRISPR gRNA sequence
ggggctcccttgagtcacgg

SEQ ID NO: 466577 - DNA, 20 bp, Artificial
  CRISPR gRNA sequence
ggctcccttgagtcacggga

SEQ ID NO: 466578 - DNA, 20 bp, Artificial
  CRISPR gRNA sequence
gctcccttgagtcacgggag

SEQ ID NO: 466579 - DNA, 20 bp, Artificial
  CRISPR gRNA sequence
agaggcatgctcaccacgca

SEQ ID NO: 466580 - DNA, 20 bp, Artificial
  CRISPR gRNA sequence
gctcaccacgcacagtattc

SEQ ID NO: 466581 - DNA, 20 bp, Artificial
  CRISPR gRNA sequence
accacgcacagtattccagc

SEQ ID NO: 466582 - DNA, 20 bp, Artificial
  CRISPR gRNA sequence
cacgcacagtattccagcta

SEQ ID NO: 466583 - DNA, 20 bp, Artificial
  CRISPR gRNA sequence
cagtattccagctagagttg

SEQ ID NO: 466584 - DNA, 20 bp, Artificial
  CRISPR gRNA sequence
attccagctagagttgtggc

SEQ ID NO: 466585 - DNA, 20 bp, Artificial
  CRISPR gRNA sequence
agctagagttgtggcgagca

SEQ ID NO: 466586 - DNA, 20 bp, Artificial
  CRISPR gRNA sequence
ggcgagcatagcacattgct

SEQ ID NO: 466587 - DNA, 20 bp, Artificial
  CRISPR gRNA sequence
cattctctttgcatcaatct

SEQ ID NO: 466588 - DNA, 20 bp, Artificial
  CRISPR gRNA sequence
attctctttgcatcaatctt

SEQ ID NO: 466589 - DNA, 20 bp, Artificial
  CRISPR gRNA sequence
catcaatcttaggtttgtgt

SEQ ID NO: 466590 - DNA, 20 bp, Artificial
  CRISPR gRNA sequence
aatcttaggtttgtgtgaga

SEQ ID NO: 466591 - DNA, 20 bp, Artificial
  CRISPR gRNA sequence
tcttaggtttgtgtgagaaa

SEQ ID NO: 466592 - DNA, 20 bp, Artificial
  CRISPR gRNA sequence
agagctcttctaaaccttaa

SEQ ID NO: 466593 - DNA, 20 bp, Artificial
  CRISPR gRNA sequence
gagctcttctaaaccttaac

SEQ ID NO: 466594 - DNA, 20 bp, Artificial
  CRISPR gRNA sequence
cttctaaaccttaacaggat

SEQ ID NO: 466595 - DNA, 20 bp, Artificial
  CRISPR gRNA sequence
ctaaaccttaacaggattgg

SEQ ID NO: 466596 - DNA, 20 bp, Artificial
  CRISPR gRNA sequence
tggaagttgaaacaatctct

SEQ ID NO: 466597 - DNA, 20 bp, Artificial
  CRISPR gRNA sequence
ttgaaacaatctctcagatc

SEQ ID NO: 466598 - DNA, 20 bp, Artificial
  CRISPR gRNA sequence
tttgtattatcctcttttca

SEQ ID NO: 466599 - DNA, 20 bp, Artificial
  CRISPR gRNA sequence
cacacacccttatgtaactg

SEQ ID NO: 466600 - DNA, 20 bp, Artificial
  CRISPR gRNA sequence
aactgaagaaccaatgtccc

SEQ ID NO: 466601 - DNA, 20 bp, Artificial
  CRISPR gRNA sequence
ctgaagaaccaatgtcccca

SEQ ID NO: 466602 - DNA, 20 bp, Artificial
  CRISPR gRNA sequence
aataatgcatatgaaaaatg

SEQ ID NO: 466603 - DNA, 20 bp, Artificial
  CRISPR gRNA sequence
ataatgcatatgaaaaatgt

SEQ ID NO: 466604 - DNA, 20 bp, Artificial
  CRISPR gRNA sequence
gcatatgaaaaatgtgggtt

SEQ ID NO: 466605 - DNA, 20 bp, Artificial
  CRISPR gRNA sequence
aaatgtgggtttggctatga

SEQ ID NO: 466606 - DNA, 20 bp, Artificial
  CRISPR gRNA sequence
aatgtgggtttggctatgat

SEQ ID NO: 466607 - DNA, 20 bp, Artificial
  CRISPR gRNA sequence
gggtttggctatgatgggaa

SEQ ID NO: 466608 - DNA, 20 bp, Artificial
  CRISPR gRNA sequence
taattcctttctacttttgc

SEQ ID NO: 466609 - DNA, 20 bp, Artificial
  CRISPR gRNA sequence
atgtcatgaccaaatatgtt

SEQ ID NO: 466610 - DNA, 20 bp, Artificial
  CRISPR gRNA sequence
catgaccaaatatgttaagt

SEQ ID NO: 466611 - DNA, 20 bp, Artificial
  CRISPR gRNA sequence
tgaccaaatatgttaagtaa

SEQ ID NO: 466612 - DNA, 20 bp, Artificial
  CRISPR gRNA sequence
accaaatatgttaagtaaga

SEQ ID NO: 466613 - DNA, 20 bp, Artificial
  CRISPR gRNA sequence
ccaaatatgttaagtaagag

SEQ ID NO: 466614 - DNA, 20 bp, Artificial
  CRISPR gRNA sequence
atatgttaagtaagagagga

SEQ ID NO: 466615 - DNA, 20 bp, Artificial
  CRISPR gRNA sequence
ttaagtaagagaggaaagca

SEQ ID NO: 466616 - DNA, 20 bp, Artificial
  CRISPR gRNA sequence
aagtaagagaggaaagcata

SEQ ID NO: 466617 - DNA, 20 bp, Artificial
  CRISPR gRNA sequence
aagcatagagaattctgatc

SEQ ID NO: 466618 - DNA, 20 bp, Artificial
  CRISPR gRNA sequence
agagaattctgatctagctt

SEQ ID NO: 466619 - DNA, 20 bp, Artificial
  CRISPR gRNA sequence
agctttggcctgaactactt

SEQ ID NO: 466620 - DNA, 20 bp, Artificial
  CRISPR gRNA sequence
cattcctgttttcacaacac

SEQ ID NO: 466621 - DNA, 20 bp, Artificial
  CRISPR gRNA sequence
tgttttcacaacaccagcta

SEQ ID NO: 466622 - DNA, 20 bp, Artificial
  CRISPR gRNA sequence
tcacaacaccagctacagtg

SEQ ID NO: 466623 - DNA, 20 bp, Artificial
  CRISPR gRNA sequence
caccagctacagtgtagcta

SEQ ID NO: 466624 - DNA, 20 bp, Artificial
  CRISPR gRNA sequence
acagtgtagctatagaaact

SEQ ID NO: 466625 - DNA, 20 bp, Artificial
  CRISPR gRNA sequence
tgtagctatagaaactgagc

SEQ ID NO: 466626 - DNA, 20 bp, Artificial
  CRISPR gRNA sequence
gctatagaaactgagctaga

SEQ ID NO: 466627 - DNA, 20 bp, Artificial
  CRISPR gRNA sequence
tatagaaactgagctagata

SEQ ID NO: 466628 - DNA, 20 bp, Artificial
  CRISPR gRNA sequence
aacacttattctgtgtgaca

SEQ ID NO: 466629 - DNA, 20 bp, Artificial
  CRISPR gRNA sequence
acacttattctgtgtgacac

SEQ ID NO: 466630 - DNA, 20 bp, Artificial
  CRISPR gRNA sequence
acacaggaataacctttgac

SEQ ID NO: 466631 - DNA, 20 bp, Artificial
  CRISPR gRNA sequence
cacaggaataacctttgact

SEQ ID NO: 466632 - DNA, 20 bp, Artificial
  CRISPR gRNA sequence
aataacctttgactgggcaa

SEQ ID NO: 466633 - DNA, 20 bp, Artificial
  CRISPR gRNA sequence
tgactgggcaaaagtgcttc

SEQ ID NO: 466634 - DNA, 20 bp, Artificial
  CRISPR gRNA sequence
caaaagtgcttctggtattt

SEQ ID NO: 466635 - DNA, 20 bp, Artificial
  CRISPR gRNA sequence
aaagtgcttctggtattttg

SEQ ID NO: 466636 - DNA, 20 bp, Artificial
  CRISPR gRNA sequence
tgcttctggtattttggagt

SEQ ID NO: 466637 - DNA, 20 bp, Artificial
  CRISPR gRNA sequence
tattttggagtgagaacttc

SEQ ID NO: 466638 - DNA, 20 bp, Artificial
  CRISPR gRNA sequence
ttttggagtgagaacttctg

SEQ ID NO: 466639 - DNA, 20 bp, Artificial
  CRISPR gRNA sequence
gagtgagaacttctggagtt

SEQ ID NO: 466640 - DNA, 20 bp, Artificial
  CRISPR gRNA sequence
ctggagttcagaaccttctc

SEQ ID NO: 466641 - DNA, 20 bp, Artificial
  CRISPR gRNA sequence
agaaccttctctggattctg

SEQ ID NO: 466642 - DNA, 20 bp, Artificial
  CRISPR gRNA sequence
attcttcatctgcaactcca

SEQ ID NO: 466643 - DNA, 20 bp, Artificial
  CRISPR gRNA sequence
caactccatggctctttcta

SEQ ID NO: 466644 - DNA, 20 bp, Artificial
  CRISPR gRNA sequence
tatctttcatcatctttctt

SEQ ID NO: 466645 - DNA, 20 bp, Artificial
  CRISPR gRNA sequence
atcatctttcttgagactgc

SEQ ID NO: 466646 - DNA, 20 bp, Artificial
  CRISPR gRNA sequence
gagactgctggaacctctct

SEQ ID NO: 466647 - DNA, 20 bp, Artificial
  CRISPR gRNA sequence
tggaacctctctcagaactt

SEQ ID NO: 466648 - DNA, 20 bp, Artificial
  CRISPR gRNA sequence
cctctctcagaacttcagaa

SEQ ID NO: 466649 - DNA, 20 bp, Artificial
  CRISPR gRNA sequence
ctctctcagaacttcagaaa

SEQ ID NO: 466650 - DNA, 20 bp, Artificial
  CRISPR gRNA sequence
ctctcagaacttcagaaaag

SEQ ID NO: 466651 - DNA, 20 bp, Artificial
  CRISPR gRNA sequence
cagaacttcagaaaaggagt

SEQ ID NO: 466652 - DNA, 20 bp, Artificial
  CRISPR gRNA sequence
agaacttcagaaaaggagtc

SEQ ID NO: 466653 - DNA, 20 bp, Artificial
  CRISPR gRNA sequence
gaacttcagaaaaggagtca

SEQ ID NO: 466654 - DNA, 20 bp, Artificial
  CRISPR gRNA sequence
cttttgatttaccacatcca

SEQ ID NO: 466655 - DNA, 20 bp, Artificial
  CRISPR gRNA sequence
ttaccacatccaaagtgaac

SEQ ID NO: 466656 - DNA, 20 bp, Artificial
  CRISPR gRNA sequence
taccacatccaaagtgaact

SEQ ID NO: 466657 - DNA, 20 bp, Artificial
  CRISPR gRNA sequence
cacatccaaagtgaactagg

SEQ ID NO: 466658 - DNA, 20 bp, Artificial
  CRISPR gRNA sequence
atccaaagtgaactaggtag

SEQ ID NO: 466659 - DNA, 20 bp, Artificial
  CRISPR gRNA sequence
tccaaagtgaactaggtagt

SEQ ID NO: 466660 - DNA, 20 bp, Artificial
  CRISPR gRNA sequence
caaagtgaactaggtagtag

SEQ ID NO: 466661 - DNA, 20 bp, Artificial
  CRISPR gRNA sequence
aactaggtagtaggagatct

SEQ ID NO: 466662 - DNA, 20 bp, Artificial
  CRISPR gRNA sequence
agtaggagatcttggctaca

SEQ ID NO: 466663 - DNA, 20 bp, Artificial
  CRISPR gRNA sequence
gtaggagatcttggctacat

SEQ ID NO: 466664 - DNA, 20 bp, Artificial
  CRISPR gRNA sequence
gatcttggctacataggtga

SEQ ID NO: 466665 - DNA, 20 bp, Artificial
  CRISPR gRNA sequence
atcttggctacataggtgac

SEQ ID NO: 466666 - DNA, 20 bp, Artificial
  CRISPR gRNA sequence
tggctacataggtgacagga

SEQ ID NO: 466667 - DNA, 20 bp, Artificial
  CRISPR gRNA sequence
ctacataggtgacaggacag

SEQ ID NO: 466668 - DNA, 20 bp, Artificial
  CRISPR gRNA sequence
tgacaggacagcagcatttc

SEQ ID NO: 466669 - DNA, 20 bp, Artificial
  CRISPR gRNA sequence
acagcagcatttctggcatt

SEQ ID NO: 466670 - DNA, 20 bp, Artificial
  CRISPR gRNA sequence
agcatttctggcattgagta

SEQ ID NO: 466671 - DNA, 20 bp, Artificial
  CRISPR gRNA sequence
cattgagtatggaatgtccc

SEQ ID NO: 466672 - DNA, 20 bp, Artificial
  CRISPR gRNA sequence
ttgagtatggaatgtcccca

SEQ ID NO: 466673 - DNA, 20 bp, Artificial
  CRISPR gRNA sequence
gtatggaatgtccccagagc

SEQ ID NO: 466674 - DNA, 20 bp, Artificial
  CRISPR gRNA sequence
tatggaatgtccccagagca

SEQ ID NO: 466675 - DNA, 20 bp, Artificial
  CRISPR gRNA sequence
gtccccagagcaaggacttc

SEQ ID NO: 466676 - DNA, 20 bp, Artificial
  CRISPR gRNA sequence
aaggacttccagtctcttcc

SEQ ID NO: 466677 - DNA, 20 bp, Artificial
  CRISPR gRNA sequence
gtctcttccaagtgatatac

SEQ ID NO: 466678 - DNA, 20 bp, Artificial
  CRISPR gRNA sequence
tagatccctccccttccttt

SEQ ID NO: 466679 - DNA, 20 bp, Artificial
  CRISPR gRNA sequence
ccttccttttagatatgcca

SEQ ID NO: 466680 - DNA, 20 bp, Artificial
  CRISPR gRNA sequence
cttccttttagatatgccat

SEQ ID NO: 466681 - DNA, 20 bp, Artificial
  CRISPR gRNA sequence
ttccttttagatatgccatg

SEQ ID NO: 466682 - DNA, 20 bp, Artificial
  CRISPR gRNA sequence
agatatgccatggggctatg

SEQ ID NO: 466683 - DNA, 20 bp, Artificial
  CRISPR gRNA sequence
atggggctatgtggactgaa

SEQ ID NO: 466684 - DNA, 20 bp, Artificial
  CRISPR gRNA sequence
tggactgaaaagtgatgaac

SEQ ID NO: 466685 - DNA, 20 bp, Artificial
  CRISPR gRNA sequence
gactgaaaagtgatgaacca

SEQ ID NO: 466686 - DNA, 20 bp, Artificial
  CRISPR gRNA sequence
ctgaaaagtgatgaaccaga

SEQ ID NO: 466687 - DNA, 20 bp, Artificial
  CRISPR gRNA sequence
gaaaagtgatgaaccagaga

SEQ ID NO: 466688 - DNA, 20 bp, Artificial
  CRISPR gRNA sequence
aaagtgatgaaccagagaga

SEQ ID NO: 466689 - DNA, 20 bp, Artificial
  CRISPR gRNA sequence
tgatgaaccagagagagagc

SEQ ID NO: 466690 - DNA, 20 bp, Artificial
  CRISPR gRNA sequence
gaaccagagagagagctggt

SEQ ID NO: 466691 - DNA, 20 bp, Artificial
  CRISPR gRNA sequence
cagtgtgaattatcacaaac

SEQ ID NO: 466692 - DNA, 20 bp, Artificial
  CRISPR gRNA sequence
tatcacaaacaagtgtgtgc

SEQ ID NO: 466693 - DNA, 20 bp, Artificial
  CRISPR gRNA sequence
atcacaaacaagtgtgtgct

SEQ ID NO: 466694 - DNA, 20 bp, Artificial
  CRISPR gRNA sequence
aaacaagtgtgtgctaggca

SEQ ID NO: 466695 - DNA, 20 bp, Artificial
  CRISPR gRNA sequence
gctaggcaaagcaaattaac

SEQ ID NO: 466696 - DNA, 20 bp, Artificial
  CRISPR gRNA sequence
aaaactaacaacactatccc

SEQ ID NO: 466697 - DNA, 20 bp, Artificial
  CRISPR gRNA sequence
acactatccctggcattcaa

SEQ ID NO: 466698 - DNA, 20 bp, Artificial
  CRISPR gRNA sequence
cactatccctggcattcaac

SEQ ID NO: 466699 - DNA, 20 bp, Artificial
  CRISPR gRNA sequence
tccctggcattcaacaggat

SEQ ID NO: 466700 - DNA, 20 bp, Artificial
  CRISPR gRNA sequence
ggcattcaacaggataagca

SEQ ID NO: 466701 - DNA, 20 bp, Artificial
  CRISPR gRNA sequence
gcattcaacaggataagcat

SEQ ID NO: 466702 - DNA, 20 bp, Artificial
  CRISPR gRNA sequence
ttcaacaggataagcatggg

SEQ ID NO: 466703 - DNA, 20 bp, Artificial
  CRISPR gRNA sequence
acaggataagcatgggtggc

SEQ ID NO: 466704 - DNA, 20 bp, Artificial
  CRISPR gRNA sequence
caggataagcatgggtggca

SEQ ID NO: 466705 - DNA, 20 bp, Artificial
  CRISPR gRNA sequence
gataagcatgggtggcaagg

SEQ ID NO: 466706 - DNA, 20 bp, Artificial
  CRISPR gRNA sequence
ttctttttctttttgtcttc

SEQ ID NO: 466707 - DNA, 20 bp, Artificial
  CRISPR gRNA sequence
tctttttctttttgtcttcc

SEQ ID NO: 466708 - DNA, 20 bp, Artificial
  CRISPR gRNA sequence
tttctttttgtcttccagga

SEQ ID NO: 466709 - DNA, 20 bp, Artificial
  CRISPR gRNA sequence
gcaaaatgaactctctgaca

SEQ ID NO: 466710 - DNA, 20 bp, Artificial
  CRISPR gRNA sequence
aaatgaactctctgacacag

SEQ ID NO: 466711 - DNA, 20 bp, Artificial
  CRISPR gRNA sequence
aatgaactctctgacacagc

SEQ ID NO: 466712 - DNA, 20 bp, Artificial
  CRISPR gRNA sequence
gaactctctgacacagcagg

SEQ ID NO: 466713 - DNA, 20 bp, Artificial
  CRISPR gRNA sequence
aactctctgacacagcagga

SEQ ID NO: 466714 - DNA, 20 bp, Artificial
  CRISPR gRNA sequence
actctctgacacagcaggaa

SEQ ID NO: 466715 - DNA, 20 bp, Artificial
  CRISPR gRNA sequence
agcaggaagggaaattaacc

SEQ ID NO: 466716 - DNA, 20 bp, Artificial
  CRISPR gRNA sequence
ggaagggaaattaacctggt

SEQ ID NO: 466717 - DNA, 20 bp, Artificial
  CRISPR gRNA sequence
ttaacctggtaagcttgatg

SEQ ID NO: 466718 - DNA, 20 bp, Artificial
  CRISPR gRNA sequence
atttatataacaccatgtgc

SEQ ID NO: 466719 - DNA, 20 bp, Artificial
  CRISPR gRNA sequence
tttatataacaccatgtgcc

SEQ ID NO: 466720 - DNA, 20 bp, Artificial
  CRISPR gRNA sequence
tatatatatatatatataca

SEQ ID NO: 466721 - DNA, 20 bp, Artificial
  CRISPR gRNA sequence
tttgcattctgctctctatg

SEQ ID NO: 466722 - DNA, 20 bp, Artificial
  CRISPR gRNA sequence
attctgctctctatgcagca

SEQ ID NO: 466723 - DNA, 20 bp, Artificial
  CRISPR gRNA sequence
tctatgcagcaaagactctt

SEQ ID NO: 466724 - DNA, 20 bp, Artificial
  CRISPR gRNA sequence
ctatgcagcaaagactcttt

SEQ ID NO: 466725 - DNA, 20 bp, Artificial
  CRISPR gRNA sequence
tatgcagcaaagactcttta

SEQ ID NO: 466726 - DNA, 20 bp, Artificial
  CRISPR gRNA sequence
aaagactctttagggttaac

SEQ ID NO: 466727 - DNA, 20 bp, Artificial
  CRISPR gRNA sequence
gggttaacaagtctcgtaat

SEQ ID NO: 466728 - DNA, 20 bp, Artificial
  CRISPR gRNA sequence
ttaacaagtctcgtaataag

SEQ ID NO: 466729 - DNA, 20 bp, Artificial
  CRISPR gRNA sequence
tctcgtaataagtggttctt

SEQ ID NO: 466730 - DNA, 20 bp, Artificial
  CRISPR gRNA sequence
cgtaataagtggttctttgg

SEQ ID NO: 466731 - DNA, 20 bp, Artificial
  CRISPR gRNA sequence
agtggttctttggaagttca

SEQ ID NO: 466732 - DNA, 20 bp, Artificial
  CRISPR gRNA sequence
ggttctttggaagttcatgg

SEQ ID NO: 466733 - DNA, 20 bp, Artificial
  CRISPR gRNA sequence
gttctttggaagttcatgga

SEQ ID NO: 466734 - DNA, 20 bp, Artificial
  CRISPR gRNA sequence
ctttggaagttcatggaagg

SEQ ID NO: 466735 - DNA, 20 bp, Artificial
  CRISPR gRNA sequence
gaagttcatggaaggcagtc

SEQ ID NO: 466736 - DNA, 20 bp, Artificial
  CRISPR gRNA sequence
atggaaggcagtctagatcc

SEQ ID NO: 466737 - DNA, 20 bp, Artificial
  CRISPR gRNA sequence
aaggcagtctagatccaaga

SEQ ID NO: 466738 - DNA, 20 bp, Artificial
  CRISPR gRNA sequence
agtctagatccaagacagaa

SEQ ID NO: 466739 - DNA, 20 bp, Artificial
  CRISPR gRNA sequence
tagatccaagacagaaaagt

SEQ ID NO: 466740 - DNA, 20 bp, Artificial
  CRISPR gRNA sequence
gatccaagacagaaaagtca

SEQ ID NO: 466741 - DNA, 20 bp, Artificial
  CRISPR gRNA sequence
ctctgctcttgcctgttatg

SEQ ID NO: 466742 - DNA, 20 bp, Artificial
  CRISPR gRNA sequence
tcttgcctgttatgtggctt

SEQ ID NO: 466743 - DNA, 20 bp, Artificial
  CRISPR gRNA sequence
cttgcctgttatgtggcttc

SEQ ID NO: 466744 - DNA, 20 bp, Artificial
  CRISPR gRNA sequence
attttttatgtaaacacctt

SEQ ID NO: 466745 - DNA, 20 bp, Artificial
  CRISPR gRNA sequence
ttttttatgtaaacacctta

SEQ ID NO: 466746 - DNA, 20 bp, Artificial
  CRISPR gRNA sequence
taaacaccttaaggtctttc

SEQ ID NO: 466747 - DNA, 20 bp, Artificial
  CRISPR gRNA sequence
acaccttaaggtctttctgg

SEQ ID NO: 466748 - DNA, 20 bp, Artificial
  CRISPR gRNA sequence
accttaaggtctttctggaa

SEQ ID NO: 466749 - DNA, 20 bp, Artificial
  CRISPR gRNA sequence
cttaaggtctttctggaaga

SEQ ID NO: 466750 - DNA, 20 bp, Artificial
  CRISPR gRNA sequence
aaggtctttctggaagagag

SEQ ID NO: 466751 - DNA, 20 bp, Artificial
  CRISPR gRNA sequence
aggtctttctggaagagagt

SEQ ID NO: 466752 - DNA, 20 bp, Artificial
  CRISPR gRNA sequence
ggtctttctggaagagagta

SEQ ID NO: 466753 - DNA, 20 bp, Artificial
  CRISPR gRNA sequence
tctttctggaagagagtagg

SEQ ID NO: 466754 - DNA, 20 bp, Artificial
  CRISPR gRNA sequence
agagagtagggagctgatga

SEQ ID NO: 466755 - DNA, 20 bp, Artificial
  CRISPR gRNA sequence
aaataacctcataaaatgat

SEQ ID NO: 466756 - DNA, 20 bp, Artificial
  CRISPR gRNA sequence
tgattagatatcttcataaa

SEQ ID NO: 466757 - DNA, 20 bp, Artificial
  CRISPR gRNA sequence
gatatcttcataaatagcac

SEQ ID NO: 466758 - DNA, 20 bp, Artificial
  CRISPR gRNA sequence
cataaatagcaccagcaaaa

SEQ ID NO: 466759 - DNA, 20 bp, Artificial
  CRISPR gRNA sequence
taaatagcaccagcaaaata

SEQ ID NO: 466760 - DNA, 20 bp, Artificial
  CRISPR gRNA sequence
caaaatagagacatgatctt

SEQ ID NO: 466761 - DNA, 20 bp, Artificial
  CRISPR gRNA sequence
tagagacatgatctttggct

SEQ ID NO: 466762 - DNA, 20 bp, Artificial
  CRISPR gRNA sequence
tctttggcttagttattaca

SEQ ID NO: 466763 - DNA, 20 bp, Artificial
  CRISPR gRNA sequence
tttggcttagttattacaca

SEQ ID NO: 466764 - DNA, 20 bp, Artificial
  CRISPR gRNA sequence
ttggcttagttattacacag

SEQ ID NO: 466765 - DNA, 20 bp, Artificial
  CRISPR gRNA sequence
agttattacacagaggtccc

SEQ ID NO: 466766 - DNA, 20 bp, Artificial
  CRISPR gRNA sequence
gaggtccctggcaatgtgta

SEQ ID NO: 466767 - DNA, 20 bp, Artificial
  CRISPR gRNA sequence
aggtccctggcaatgtgtat

SEQ ID NO: 466768 - DNA, 20 bp, Artificial
  CRISPR gRNA sequence
gcaatgtgtatgggctcatc

SEQ ID NO: 466769 - DNA, 20 bp, Artificial
  CRISPR gRNA sequence
caatgtgtatgggctcatca

SEQ ID NO: 466770 - DNA, 20 bp, Artificial
  CRISPR gRNA sequence
tgtgtatgggctcatcaagg

SEQ ID NO: 466771 - DNA, 20 bp, Artificial
  CRISPR gRNA sequence
gtgtatgggctcatcaagga

SEQ ID NO: 466772 - DNA, 20 bp, Artificial
  CRISPR gRNA sequence
tgtatgggctcatcaaggaa

SEQ ID NO: 466773 - DNA, 20 bp, Artificial
  CRISPR gRNA sequence
tcatcaaggaagggaccact

SEQ ID NO: 466774 - DNA, 20 bp, Artificial
  CRISPR gRNA sequence
ggaagggaccactcagacta

SEQ ID NO: 466775 - DNA, 20 bp, Artificial
  CRISPR gRNA sequence
gaagggaccactcagactaa

SEQ ID NO: 466776 - DNA, 20 bp, Artificial
  CRISPR gRNA sequence
gggaccactcagactaaagg

SEQ ID NO: 466777 - DNA, 20 bp, Artificial
  CRISPR gRNA sequence
ggaccactcagactaaagga

SEQ ID NO: 466778 - DNA, 20 bp, Artificial
  CRISPR gRNA sequence
gaccactcagactaaaggaa

SEQ ID NO: 466779 - DNA, 20 bp, Artificial
  CRISPR gRNA sequence
agactaaaggaagggaattt

SEQ ID NO: 466780 - DNA, 20 bp, Artificial
  CRISPR gRNA sequence
actaaaggaagggaattttg

SEQ ID NO: 466781 - DNA, 20 bp, Artificial
  CRISPR gRNA sequence
ttggagtcaatctttcctat

SEQ ID NO: 466782 - DNA, 20 bp, Artificial
  CRISPR gRNA sequence
tggagtcaatctttcctata

SEQ ID NO: 466783 - DNA, 20 bp, Artificial
  CRISPR gRNA sequence
tcaatctttcctataaggtt

SEQ ID NO: 466784 - DNA, 20 bp, Artificial
  CRISPR gRNA sequence
taaggtttggaatgtaaatg

SEQ ID NO: 466785 - DNA, 20 bp, Artificial
  CRISPR gRNA sequence
aaggtttggaatgtaaatgt

SEQ ID NO: 466786 - DNA, 20 bp, Artificial
  CRISPR gRNA sequence
taaatgtaggcttttctttt

SEQ ID NO: 466787 - DNA, 20 bp, Artificial
  CRISPR gRNA sequence
ttcttttgagttgaatgttg

SEQ ID NO: 466788 - DNA, 20 bp, Artificial
  CRISPR gRNA sequence
cttttgagttgaatgttgtg

SEQ ID NO: 466789 - DNA, 20 bp, Artificial
  CRISPR gRNA sequence
gttgaatgttgtggagatat

SEQ ID NO: 466790 - DNA, 20 bp, Artificial
  CRISPR gRNA sequence
tggagatattagaactaaaa

SEQ ID NO: 466791 - DNA, 20 bp, Artificial
  CRISPR gRNA sequence
ttagaactaaaaaagaatgc

SEQ ID NO: 466792 - DNA, 20 bp, Artificial
  CRISPR gRNA sequence
actaaaaaagaatgcaagat

SEQ ID NO: 466793 - DNA, 20 bp, Artificial
  CRISPR gRNA sequence
ctaaaaaagaatgcaagatg

SEQ ID NO: 466794 - DNA, 20 bp, Artificial
  CRISPR gRNA sequence
aagatgaggcaatatatttg

SEQ ID NO: 466795 - DNA, 20 bp, Artificial
  CRISPR gRNA sequence
gaggcaatatatttgtggaa

SEQ ID NO: 466796 - DNA, 20 bp, Artificial
  CRISPR gRNA sequence
atttgtggaaaagcattctg

SEQ ID NO: 466797 - DNA, 20 bp, Artificial
  CRISPR gRNA sequence
gctctctaattaaaactaaa

SEQ ID NO: 466798 - DNA, 20 bp, Artificial
  CRISPR gRNA sequence
aaaactaaacagtcataaat

SEQ ID NO: 466799 - DNA, 20 bp, Artificial
  CRISPR gRNA sequence
gtcataaatgagatactgca

SEQ ID NO: 466800 - DNA, 20 bp, Artificial
  CRISPR gRNA sequence
tcataaatgagatactgcaa

SEQ ID NO: 466801 - DNA, 20 bp, Artificial
  CRISPR gRNA sequence
atgtgtgtgtgtgtttcaat

SEQ ID NO: 466802 - DNA, 20 bp, Artificial
  CRISPR gRNA sequence
tgtgtgtgtgtgtttcaata

SEQ ID NO: 466803 - DNA, 20 bp, Artificial
  CRISPR gRNA sequence
tgtgtgtgtgtttcaataag

SEQ ID NO: 466804 - DNA, 20 bp, Artificial
  CRISPR gRNA sequence
gtgtgtgtgtttcaataagg

SEQ ID NO: 466805 - DNA, 20 bp, Artificial
  CRISPR gRNA sequence
tgtgtttcaataaggaggaa

SEQ ID NO: 466806 - DNA, 20 bp, Artificial
  CRISPR gRNA sequence
aataaggaggaatagtgata

SEQ ID NO: 466807 - DNA, 20 bp, Artificial
  CRISPR gRNA sequence
aaggaggaatagtgataaag

SEQ ID NO: 466808 - DNA, 20 bp, Artificial
  CRISPR gRNA sequence
gaggaatagtgataaagaag

SEQ ID NO: 466809 - DNA, 20 bp, Artificial
  CRISPR gRNA sequence
ccctcttaaaaattccacaa

SEQ ID NO: 466810 - DNA, 20 bp, Artificial
  CRISPR gRNA sequence
cacaaaagacaaaatcgata

SEQ ID NO: 466811 - DNA, 20 bp, Artificial
  CRISPR gRNA sequence
attctatatataatattaaa

SEQ ID NO: 466812 - DNA, 20 bp, Artificial
  CRISPR gRNA sequence
ggcattcaacattccccacc

SEQ ID NO: 466813 - DNA, 20 bp, Artificial
  CRISPR gRNA sequence
caagctgcttaattttaaac

SEQ ID NO: 466814 - DNA, 20 bp, Artificial
  CRISPR gRNA sequence
caacttgacaaacttctatt

SEQ ID NO: 466815 - DNA, 20 bp, Artificial
  CRISPR gRNA sequence
aacttctattaagttttcat

SEQ ID NO: 466816 - DNA, 20 bp, Artificial
  CRISPR gRNA sequence
tattaagttttcattagcat

SEQ ID NO: 466817 - DNA, 20 bp, Artificial
  CRISPR gRNA sequence
taagttttcattagcatcag

SEQ ID NO: 466818 - DNA, 20 bp, Artificial
  CRISPR gRNA sequence
aagttttcattagcatcagt

SEQ ID NO: 466819 - DNA, 20 bp, Artificial
  CRISPR gRNA sequence
tagcatcagtaggcactgtg

SEQ ID NO: 466820 - DNA, 20 bp, Artificial
  CRISPR gRNA sequence
agcatcagtaggcactgtgt

SEQ ID NO: 466821 - DNA, 20 bp, Artificial
  CRISPR gRNA sequence
gcatcagtaggcactgtgta

SEQ ID NO: 466822 - DNA, 20 bp, Artificial
  CRISPR gRNA sequence
taggcactgtgtagggtgct

SEQ ID NO: 466823 - DNA, 20 bp, Artificial
  CRISPR gRNA sequence
aggcactgtgtagggtgcta

SEQ ID NO: 466824 - DNA, 20 bp, Artificial
  CRISPR gRNA sequence
taaggctttgttccctcaaa

SEQ ID NO: 466825 - DNA, 20 bp, Artificial
  CRISPR gRNA sequence
aaggctttgttccctcaaat

SEQ ID NO: 466826 - DNA, 20 bp, Artificial
  CRISPR gRNA sequence
aggctttgttccctcaaata

SEQ ID NO: 466827 - DNA, 20 bp, Artificial
  CRISPR gRNA sequence
taaatattattttctttcta

SEQ ID NO: 466828 - DNA, 20 bp, Artificial
  CRISPR gRNA sequence
aaatttcacttgattacaat

SEQ ID NO: 466829 - DNA, 20 bp, Artificial
  CRISPR gRNA sequence
aatttcacttgattacaata

SEQ ID NO: 466830 - DNA, 20 bp, Artificial
  CRISPR gRNA sequence
tcacttgattacaataaggc

SEQ ID NO: 466831 - DNA, 20 bp, Artificial
  CRISPR gRNA sequence
cacttgattacaataaggcc

SEQ ID NO: 466832 - DNA, 20 bp, Artificial
  CRISPR gRNA sequence
acttgattacaataaggcca

SEQ ID NO: 466833 - DNA, 20 bp, Artificial
  CRISPR gRNA sequence
ttgattacaataaggccagg

SEQ ID NO: 466834 - DNA, 20 bp, Artificial
  CRISPR gRNA sequence
agggagctatgaaattattt

SEQ ID NO: 466835 - DNA, 20 bp, Artificial
  CRISPR gRNA sequence
atctaaataatttactgtgc

SEQ ID NO: 466836 - DNA, 20 bp, Artificial
  CRISPR gRNA sequence
tttactgtgcaagtaaaacc

SEQ ID NO: 466837 - DNA, 20 bp, Artificial
  CRISPR gRNA sequence
ttactgtgcaagtaaaaccc

SEQ ID NO: 466838 - DNA, 20 bp, Artificial
  CRISPR gRNA sequence
tgtgcaagtaaaacccaggt

SEQ ID NO: 466839 - DNA, 20 bp, Artificial
  CRISPR gRNA sequence
aagtaaaacccaggttggtt

SEQ ID NO: 466840 - DNA, 20 bp, Artificial
  CRISPR gRNA sequence
aacccaggttggttaagctg

SEQ ID NO: 466841 - DNA, 20 bp, Artificial
  CRISPR gRNA sequence
gctgtggacattgttcttcc

SEQ ID NO: 466842 - DNA, 20 bp, Artificial
  CRISPR gRNA sequence
ctgtggacattgttcttcct

SEQ ID NO: 466843 - DNA, 20 bp, Artificial
  CRISPR gRNA sequence
tggacattgttcttcctggg

SEQ ID NO: 466844 - DNA, 20 bp, Artificial
  CRISPR gRNA sequence
ggacattgttcttcctgggt

SEQ ID NO: 466845 - DNA, 20 bp, Artificial
  CRISPR gRNA sequence
attgttcttcctgggtaggc

SEQ ID NO: 466846 - DNA, 20 bp, Artificial
  CRISPR gRNA sequence
gctggataaattatgatttg

SEQ ID NO: 466847 - DNA, 20 bp, Artificial
  CRISPR gRNA sequence
tgatttgaagcttaattcaa

SEQ ID NO: 466848 - DNA, 20 bp, Artificial
  CRISPR gRNA sequence
gatttgaagcttaattcaaa

SEQ ID NO: 466849 - DNA, 20 bp, Artificial
  CRISPR gRNA sequence
atttgaagcttaattcaaaa

SEQ ID NO: 466850 - DNA, 20 bp, Artificial
  CRISPR gRNA sequence
tttctgtatgtgcaattgtc

SEQ ID NO: 466851 - DNA, 20 bp, Artificial
  CRISPR gRNA sequence
ttctgtatgtgcaattgtct

SEQ ID NO: 466852 - DNA, 20 bp, Artificial
  CRISPR gRNA sequence
tgtatgtgcaattgtctggg

SEQ ID NO: 466853 - DNA, 20 bp, Artificial
  CRISPR gRNA sequence
tgtctgggaagtttgtttta

SEQ ID NO: 466854 - DNA, 20 bp, Artificial
  CRISPR gRNA sequence
taaagcgtttttgctattaa

SEQ ID NO: 466855 - DNA, 20 bp, Artificial
  CRISPR gRNA sequence
aaagcgtttttgctattaac

SEQ ID NO: 466856 - DNA, 20 bp, Artificial
  CRISPR gRNA sequence
ttgctattaacaggaatttg

SEQ ID NO: 466857 - DNA, 20 bp, Artificial
  CRISPR gRNA sequence
tgaagatttttgccccattt

SEQ ID NO: 466858 - DNA, 20 bp, Artificial
  CRISPR gRNA sequence
tttgccccatttcagttgtc

SEQ ID NO: 466859 - DNA, 20 bp, Artificial
  CRISPR gRNA sequence
atttcagttgtctagcattt

SEQ ID NO: 466860 - DNA, 20 bp, Artificial
  CRISPR gRNA sequence
gcatttcagaaaataatcaa

SEQ ID NO: 466861 - DNA, 20 bp, Artificial
  CRISPR gRNA sequence
catttcagaaaataatcaaa

SEQ ID NO: 466862 - DNA, 20 bp, Artificial
  CRISPR gRNA sequence
aggataccatattataccct

SEQ ID NO: 466863 - DNA, 20 bp, Artificial
  CRISPR gRNA sequence
ggataccatattataccctt

SEQ ID NO: 466864 - DNA, 20 bp, Artificial
  CRISPR gRNA sequence
gataccatattatacccttg

SEQ ID NO: 466865 - DNA, 20 bp, Artificial
  CRISPR gRNA sequence
aatatttcttaacataaaac

SEQ ID NO: 466866 - DNA, 20 bp, Artificial
  CRISPR gRNA sequence
ttcttaacataaaactagtt

SEQ ID NO: 466867 - DNA, 20 bp, Artificial
  CRISPR gRNA sequence
tcttaacataaaactagttt

SEQ ID NO: 466868 - DNA, 20 bp, Artificial
  CRISPR gRNA sequence
taaaactagtttgggaactg

SEQ ID NO: 466869 - DNA, 20 bp, Artificial
  CRISPR gRNA sequence
aaactagtttgggaactgtg

SEQ ID NO: 466870 - DNA, 20 bp, Artificial
  CRISPR gRNA sequence
tgggaactgtggagaaatca

SEQ ID NO: 466871 - DNA, 20 bp, Artificial
  CRISPR gRNA sequence
actgtggagaaatcaaagta

SEQ ID NO: 466872 - DNA, 20 bp, Artificial
  CRISPR gRNA sequence
tggagaaatcaaagtacaga

SEQ ID NO: 466873 - DNA, 20 bp, Artificial
  CRISPR gRNA sequence
ggagaaatcaaagtacagaa

SEQ ID NO: 466874 - DNA, 20 bp, Artificial
  CRISPR gRNA sequence
atcaaagtacagaaaggaac

SEQ ID NO: 466875 - DNA, 20 bp, Artificial
  CRISPR gRNA sequence
aggaactggtataaacatga

SEQ ID NO: 466876 - DNA, 20 bp, Artificial
  CRISPR gRNA sequence
ggaactggtataaacatgac

SEQ ID NO: 466877 - DNA, 20 bp, Artificial
  CRISPR gRNA sequence
ctggtataaacatgacagga

SEQ ID NO: 466878 - DNA, 20 bp, Artificial
  CRISPR gRNA sequence
tggtataaacatgacaggaa

SEQ ID NO: 466879 - DNA, 20 bp, Artificial
  CRISPR gRNA sequence
aaacatgacaggaaaggaac

SEQ ID NO: 466880 - DNA, 20 bp, Artificial
  CRISPR gRNA sequence
aggaactggtacaaatgtaa

SEQ ID NO: 466881 - DNA, 20 bp, Artificial
  CRISPR gRNA sequence
ggaactggtacaaatgtaac

SEQ ID NO: 466882 - DNA, 20 bp, Artificial
  CRISPR gRNA sequence
aatgtaacaggtacatataa

SEQ ID NO: 466883 - DNA, 20 bp, Artificial
  CRISPR gRNA sequence
acaggtacatataaaagcca

SEQ ID NO: 466884 - DNA, 20 bp, Artificial
  CRISPR gRNA sequence
gctctgatcttaatccaaaa

SEQ ID NO: 466885 - DNA, 20 bp, Artificial
  CRISPR gRNA sequence
ttaatccaaaacggtccttt

SEQ ID NO: 466886 - DNA, 20 bp, Artificial
  CRISPR gRNA sequence
taatccaaaacggtcctttg

SEQ ID NO: 466887 - DNA, 20 bp, Artificial
  CRISPR gRNA sequence
aatccaaaacggtcctttga

SEQ ID NO: 466888 - DNA, 20 bp, Artificial
  CRISPR gRNA sequence
aacggtcctttgagggtata

SEQ ID NO: 466889 - DNA, 20 bp, Artificial
  CRISPR gRNA sequence
ccactgaattgtacacttaa

SEQ ID NO: 466890 - DNA, 20 bp, Artificial
  CRISPR gRNA sequence
cactgaattgtacacttaaa

SEQ ID NO: 466891 - DNA, 20 bp, Artificial
  CRISPR gRNA sequence
actgaattgtacacttaaaa

SEQ ID NO: 466892 - DNA, 20 bp, Artificial
  CRISPR gRNA sequence
acttaaaagggtgaatttta

SEQ ID NO: 466893 - DNA, 20 bp, Artificial
  CRISPR gRNA sequence
ttgtatactgtaacctgcca

SEQ ID NO: 466894 - DNA, 20 bp, Artificial
  CRISPR gRNA sequence
tgtatactgtaacctgccat

SEQ ID NO: 466895 - DNA, 20 bp, Artificial
  CRISPR gRNA sequence
gtaacctgccataggaatgt

SEQ ID NO: 466896 - DNA, 20 bp, Artificial
  CRISPR gRNA sequence
taacctgccataggaatgta

SEQ ID NO: 466897 - DNA, 20 bp, Artificial
  CRISPR gRNA sequence
cctgccataggaatgtaagg

SEQ ID NO: 466898 - DNA, 20 bp, Artificial
  CRISPR gRNA sequence
ctgccataggaatgtaaggt

SEQ ID NO: 466899 - DNA, 20 bp, Artificial
  CRISPR gRNA sequence
taaggtgggattgctgtttc

SEQ ID NO: 466900 - DNA, 20 bp, Artificial
  CRISPR gRNA sequence
catctctatccaccacattg

SEQ ID NO: 466901 - DNA, 20 bp, Artificial
  CRISPR gRNA sequence
tccaccacattgtggtgcat

SEQ ID NO: 466902 - DNA, 20 bp, Artificial
  CRISPR gRNA sequence
attgtggtgcattggccttg

SEQ ID NO: 466903 - DNA, 20 bp, Artificial
  CRISPR gRNA sequence
tgcattggccttgtggcacc

SEQ ID NO: 466904 - DNA, 20 bp, Artificial
  CRISPR gRNA sequence
gtggcacccagccactttga

SEQ ID NO: 466905 - DNA, 20 bp, Artificial
  CRISPR gRNA sequence
tggcacccagccactttgac

SEQ ID NO: 466906 - DNA, 20 bp, Artificial
  CRISPR gRNA sequence
ggcacccagccactttgacg

SEQ ID NO: 466907 - DNA, 20 bp, Artificial
  CRISPR gRNA sequence
gccactttgacggggtgcca

SEQ ID NO: 466908 - DNA, 20 bp, Artificial
  CRISPR gRNA sequence
actttgacggggtgccacag

SEQ ID NO: 466909 - DNA, 20 bp, Artificial
  CRISPR gRNA sequence
ctttgacggggtgccacagc

SEQ ID NO: 466910 - DNA, 20 bp, Artificial
  CRISPR gRNA sequence
tttgacggggtgccacagca

SEQ ID NO: 466911 - DNA, 20 bp, Artificial
  CRISPR gRNA sequence
ttgacggggtgccacagcag

SEQ ID NO: 466912 - DNA, 20 bp, Artificial
  CRISPR gRNA sequence
gtgccacagcaggggtgctg

SEQ ID NO: 466913 - DNA, 20 bp, Artificial
  CRISPR gRNA sequence
gccacagcaggggtgctgca

SEQ ID NO: 466914 - DNA, 20 bp, Artificial
  CRISPR gRNA sequence
cattttaacaaaatttttca

SEQ ID NO: 466915 - DNA, 20 bp, Artificial
  CRISPR gRNA sequence
acaaaatttttcatggaaat

SEQ ID NO: 466916 - DNA, 20 bp, Artificial
  CRISPR gRNA sequence
catggaaatgagccatttct

SEQ ID NO: 466917 - DNA, 20 bp, Artificial
  CRISPR gRNA sequence
atggaaatgagccatttctt

SEQ ID NO: 466918 - DNA, 20 bp, Artificial
  CRISPR gRNA sequence
aatgagccatttcttgggat

SEQ ID NO: 466919 - DNA, 20 bp, Artificial
  CRISPR gRNA sequence
tgagccatttcttgggatga

SEQ ID NO: 466920 - DNA, 20 bp, Artificial
  CRISPR gRNA sequence
ccatttcttgggatgagaga

SEQ ID NO: 466921 - DNA, 20 bp, Artificial
  CRISPR gRNA sequence
catttcttgggatgagagac

SEQ ID NO: 466922 - DNA, 20 bp, Artificial
  CRISPR gRNA sequence
atttcttgggatgagagaca

SEQ ID NO: 466923 - DNA, 20 bp, Artificial
  CRISPR gRNA sequence
gagacagggaacccaattga

SEQ ID NO: 466924 - DNA, 20 bp, Artificial
  CRISPR gRNA sequence
agacagggaacccaattgac

SEQ ID NO: 466925 - DNA, 20 bp, Artificial
  CRISPR gRNA sequence
acccaattgacaggcttaaa

SEQ ID NO: 466926 - DNA, 20 bp, Artificial
  CRISPR gRNA sequence
acaggcttaaacagattgaa

SEQ ID NO: 466927 - DNA, 20 bp, Artificial
  CRISPR gRNA sequence
aaacagattgaaaagtatca

SEQ ID NO: 466928 - DNA, 20 bp, Artificial
  CRISPR gRNA sequence
aacagattgaaaagtatcac

SEQ ID NO: 466929 - DNA, 20 bp, Artificial
  CRISPR gRNA sequence
aggatctttgttgatatatt

SEQ ID NO: 466930 - DNA, 20 bp, Artificial
  CRISPR gRNA sequence
ggatctttgttgatatattg

SEQ ID NO: 466931 - DNA, 20 bp, Artificial
  CRISPR gRNA sequence
tgttgatatattgaggacta

SEQ ID NO: 466932 - DNA, 20 bp, Artificial
  CRISPR gRNA sequence
gttgatatattgaggactaa

SEQ ID NO: 466933 - DNA, 20 bp, Artificial
  CRISPR gRNA sequence
gaggactaaaggctattttt

SEQ ID NO: 466934 - DNA, 20 bp, Artificial
  CRISPR gRNA sequence
ctatttttcagttcacttga

SEQ ID NO: 466935 - DNA, 20 bp, Artificial
  CRISPR gRNA sequence
gttcacttgacagtcttctt

SEQ ID NO: 466936 - DNA, 20 bp, Artificial
  CRISPR gRNA sequence
tgccacctactgacctcaac

SEQ ID NO: 466937 - DNA, 20 bp, Artificial
  CRISPR gRNA sequence
gccacctactgacctcaacc

SEQ ID NO: 466938 - DNA, 20 bp, Artificial
  CRISPR gRNA sequence
gacctcaaccaggctctttt

SEQ ID NO: 466939 - DNA, 20 bp, Artificial
  CRISPR gRNA sequence
ctcaaccaggctcttttcag

SEQ ID NO: 466940 - DNA, 20 bp, Artificial
  CRISPR gRNA sequence
caaccaggctcttttcagtg

SEQ ID NO: 466941 - DNA, 20 bp, Artificial
  CRISPR gRNA sequence
caggctcttttcagtggagt

SEQ ID NO: 466942 - DNA, 20 bp, Artificial
  CRISPR gRNA sequence
aggctcttttcagtggagtt

SEQ ID NO: 466943 - DNA, 20 bp, Artificial
  CRISPR gRNA sequence
gctcttttcagtggagttgg

SEQ ID NO: 466944 - DNA, 20 bp, Artificial
  CRISPR gRNA sequence
gttgggagtactttttatct

SEQ ID NO: 466945 - DNA, 20 bp, Artificial
  CRISPR gRNA sequence
gagtactttttatcttagcc

SEQ ID NO: 466946 - DNA, 20 bp, Artificial
  CRISPR gRNA sequence
tactttttatcttagccaag

SEQ ID NO: 466947 - DNA, 20 bp, Artificial
  CRISPR gRNA sequence
caagcagcctctgcctcttt

SEQ ID NO: 466948 - DNA, 20 bp, Artificial
  CRISPR gRNA sequence
ctctgcctctttcagtcgct

SEQ ID NO: 466949 - DNA, 20 bp, Artificial
  CRISPR gRNA sequence
ctcagccttactgttatttt

SEQ ID NO: 466950 - DNA, 20 bp, Artificial
  CRISPR gRNA sequence
tcagccttactgttattttt

SEQ ID NO: 466951 - DNA, 20 bp, Artificial
  CRISPR gRNA sequence
gccttactgttatttttggg

SEQ ID NO: 466952 - DNA, 20 bp, Artificial
  CRISPR gRNA sequence
tttttgggcagccaccacat

SEQ ID NO: 466953 - DNA, 20 bp, Artificial
  CRISPR gRNA sequence
tttgggcagccaccacatca

SEQ ID NO: 466954 - DNA, 20 bp, Artificial
  CRISPR gRNA sequence
ttgggcagccaccacatcag

SEQ ID NO: 466955 - DNA, 20 bp, Artificial
  CRISPR gRNA sequence
tgggcagccaccacatcaga

SEQ ID NO: 466956 - DNA, 20 bp, Artificial
  CRISPR gRNA sequence
gcagccaccacatcagaggg

SEQ ID NO: 466957 - DNA, 20 bp, Artificial
  CRISPR gRNA sequence
atcagagggtggcactgtat

SEQ ID NO: 466958 - DNA, 20 bp, Artificial
  CRISPR gRNA sequence
tcagagggtggcactgtatc

SEQ ID NO: 466959 - DNA, 20 bp, Artificial
  CRISPR gRNA sequence
ctgtatcaggaattcttaca

SEQ ID NO: 466960 - DNA, 20 bp, Artificial
  CRISPR gRNA sequence
ggaattcttacatagcttct

SEQ ID NO: 466961 - DNA, 20 bp, Artificial
  CRISPR gRNA sequence
gaattcttacatagcttctc

SEQ ID NO: 466962 - DNA, 20 bp, Artificial
  CRISPR gRNA sequence
aattcttacatagcttctca

SEQ ID NO: 466963 - DNA, 20 bp, Artificial
  CRISPR gRNA sequence
ttacatagcttctcagggta

SEQ ID NO: 466964 - DNA, 20 bp, Artificial
  CRISPR gRNA sequence
atagcttctcagggtaaagc

SEQ ID NO: 466965 - DNA, 20 bp, Artificial
  CRISPR gRNA sequence
agccagacatgcttgcatga

SEQ ID NO: 466966 - DNA, 20 bp, Artificial
  CRISPR gRNA sequence
ccagacatgcttgcatgata

SEQ ID NO: 466967 - DNA, 20 bp, Artificial
  CRISPR gRNA sequence
ttgcatgatagagctctgcc

SEQ ID NO: 466968 - DNA, 20 bp, Artificial
  CRISPR gRNA sequence
tgcatgatagagctctgcca

SEQ ID NO: 466969 - DNA, 20 bp, Artificial
  CRISPR gRNA sequence
tctgccaaggaaatctgcca

SEQ ID NO: 466970 - DNA, 20 bp, Artificial
  CRISPR gRNA sequence
cctactgcacacatcacaat

SEQ ID NO: 466971 - DNA, 20 bp, Artificial
  CRISPR gRNA sequence
ctactgcacacatcacaatg

SEQ ID NO: 466972 - DNA, 20 bp, Artificial
  CRISPR gRNA sequence
acatcacaatgaggatgaca

SEQ ID NO: 466973 - DNA, 20 bp, Artificial
  CRISPR gRNA sequence
catcacaatgaggatgacaa

SEQ ID NO: 466974 - DNA, 20 bp, Artificial
  CRISPR gRNA sequence
caatgaggatgacaaaggac

SEQ ID NO: 466975 - DNA, 20 bp, Artificial
  CRISPR gRNA sequence
ggatgacaaaggaccagaca

SEQ ID NO: 466976 - DNA, 20 bp, Artificial
  CRISPR gRNA sequence
acaaagtatgttgactttca

SEQ ID NO: 466977 - DNA, 20 bp, Artificial
  CRISPR gRNA sequence
agtatgttgactttcaaaga

SEQ ID NO: 466978 - DNA, 20 bp, Artificial
  CRISPR gRNA sequence
atgttgactttcaaagacag

SEQ ID NO: 466979 - DNA, 20 bp, Artificial
  CRISPR gRNA sequence
acagtggacttgatacctta

SEQ ID NO: 466980 - DNA, 20 bp, Artificial
  CRISPR gRNA sequence
cagtggacttgataccttaa

SEQ ID NO: 466981 - DNA, 20 bp, Artificial
  CRISPR gRNA sequence
gtggacttgataccttaaag

SEQ ID NO: 466982 - DNA, 20 bp, Artificial
  CRISPR gRNA sequence
acttgataccttaaaggagt

SEQ ID NO: 466983 - DNA, 20 bp, Artificial
  CRISPR gRNA sequence
cttgataccttaaaggagtt

SEQ ID NO: 466984 - DNA, 20 bp, Artificial
  CRISPR gRNA sequence
ataccttaaaggagttaggc

SEQ ID NO: 466985 - DNA, 20 bp, Artificial
  CRISPR gRNA sequence
aaggagttaggccagatgtc

SEQ ID NO: 466986 - DNA, 20 bp, Artificial
  CRISPR gRNA sequence
gttaggccagatgtcaagaa

SEQ ID NO: 466987 - DNA, 20 bp, Artificial
  CRISPR gRNA sequence
atgtcaagaacggaaatcga

SEQ ID NO: 466988 - DNA, 20 bp, Artificial
  CRISPR gRNA sequence
tgtcaagaacggaaatcgat

SEQ ID NO: 466989 - DNA, 20 bp, Artificial
  CRISPR gRNA sequence
ttgaatttaaaaaactgaaa

SEQ ID NO: 466990 - DNA, 20 bp, Artificial
  CRISPR gRNA sequence
taaaaaactgaaatagcccc

SEQ ID NO: 466991 - DNA, 20 bp, Artificial
  CRISPR gRNA sequence
aatgaacacatcttctttgt

SEQ ID NO: 466992 - DNA, 20 bp, Artificial
  CRISPR gRNA sequence
atgaacacatcttctttgtc

SEQ ID NO: 466993 - DNA, 20 bp, Artificial
  CRISPR gRNA sequence
ttgtcaggtgaacctttgta

SEQ ID NO: 466994 - DNA, 20 bp, Artificial
  CRISPR gRNA sequence
tgtcaggtgaacctttgtat

SEQ ID NO: 466995 - DNA, 20 bp, Artificial
  CRISPR gRNA sequence
caggtgaacctttgtatagg

SEQ ID NO: 466996 - DNA, 20 bp, Artificial
  CRISPR gRNA sequence
aggtgaacctttgtataggt

SEQ ID NO: 466997 - DNA, 20 bp, Artificial
  CRISPR gRNA sequence
gtgaacctttgtataggtag

SEQ ID NO: 466998 - DNA, 20 bp, Artificial
  CRISPR gRNA sequence
aacctttgtataggtaggag

SEQ ID NO: 466999 - DNA, 20 bp, Artificial
  CRISPR gRNA sequence
gagcggctaataaataactg

SEQ ID NO: 467000 - DNA, 20 bp, Artificial
  CRISPR gRNA sequence
gcggctaataaataactgaa

SEQ ID NO: 467001 - DNA, 20 bp, Artificial
  CRISPR gRNA sequence
ctaataaataactgaagagt

SEQ ID NO: 467002 - DNA, 20 bp, Artificial
  CRISPR gRNA sequence
actgaagagtgagaaaacat

SEQ ID NO: 467003 - DNA, 20 bp, Artificial
  CRISPR gRNA sequence
ctgaagagtgagaaaacatc

SEQ ID NO: 467004 - DNA, 20 bp, Artificial
  CRISPR gRNA sequence
ttacaaattcacctctttct

SEQ ID NO: 467005 - DNA, 20 bp, Artificial
  CRISPR gRNA sequence
caaattcacctctttcttag

SEQ ID NO: 467006 - DNA, 20 bp, Artificial
  CRISPR gRNA sequence
acctctttcttagaagctct

SEQ ID NO: 467007 - DNA, 20 bp, Artificial
  CRISPR gRNA sequence
cttagaagctctaagatatt

SEQ ID NO: 467008 - DNA, 20 bp, Artificial
  CRISPR gRNA sequence
atatttggctatatttgaaa

SEQ ID NO: 467009 - DNA, 20 bp, Artificial
  CRISPR gRNA sequence
ttggctatatttgaaacggt

SEQ ID NO: 467010 - DNA, 20 bp, Artificial
  CRISPR gRNA sequence
aacggtaagaattttcttgc

SEQ ID NO: 467011 - DNA, 20 bp, Artificial
  CRISPR gRNA sequence
acggtaagaattttcttgcc

SEQ ID NO: 467012 - DNA, 20 bp, Artificial
  CRISPR gRNA sequence
ggtaagaattttcttgccgg

SEQ ID NO: 467013 - DNA, 20 bp, Artificial
  CRISPR gRNA sequence
aagaattttcttgccgggag

SEQ ID NO: 467014 - DNA, 20 bp, Artificial
  CRISPR gRNA sequence
aattttcttgccgggagtgg

SEQ ID NO: 467015 - DNA, 20 bp, Artificial
  CRISPR gRNA sequence
cgtctataatcctcgcactt

SEQ ID NO: 467016 - DNA, 20 bp, Artificial
  CRISPR gRNA sequence
gtctataatcctcgcacttt

SEQ ID NO: 467017 - DNA, 20 bp, Artificial
  CRISPR gRNA sequence
ctataatcctcgcactttgg

SEQ ID NO: 467018 - DNA, 20 bp, Artificial
  CRISPR gRNA sequence
tataatcctcgcactttggg

SEQ ID NO: 467019 - DNA, 20 bp, Artificial
  CRISPR gRNA sequence
tcctcgcactttgggaggcc

SEQ ID NO: 467020 - DNA, 20 bp, Artificial
  CRISPR gRNA sequence
cctcgcactttgggaggccg

SEQ ID NO: 467021 - DNA, 20 bp, Artificial
  CRISPR gRNA sequence
cgcactttgggaggccgagg

SEQ ID NO: 467022 - DNA, 20 bp, Artificial
  CRISPR gRNA sequence
gcactttgggaggccgaggc

SEQ ID NO: 467023 - DNA, 20 bp, Artificial
  CRISPR gRNA sequence
ctttgggaggccgaggcggg

SEQ ID NO: 467024 - DNA, 20 bp, Artificial
  CRISPR gRNA sequence
ggccgaggcgggcggatcac

SEQ ID NO: 467025 - DNA, 20 bp, Artificial
  CRISPR gRNA sequence
gccgaggcgggcggatcacg

SEQ ID NO: 467026 - DNA, 20 bp, Artificial
  CRISPR gRNA sequence
aggcgggcggatcacgaggt

SEQ ID NO: 467027 - DNA, 20 bp, Artificial
  CRISPR gRNA sequence
ggcgggcggatcacgaggtc

SEQ ID NO: 467028 - DNA, 20 bp, Artificial
  CRISPR gRNA sequence
cgggcggatcacgaggtcag

SEQ ID NO: 467029 - DNA, 20 bp, Artificial
  CRISPR gRNA sequence
gatcacgaggtcaggagatc

SEQ ID NO: 467030 - DNA, 20 bp, Artificial
  CRISPR gRNA sequence
tcaggagatcgagaccatcc

SEQ ID NO: 467031 - DNA, 20 bp, Artificial
  CRISPR gRNA sequence
cgagaccatcctggctaaaa

SEQ ID NO: 467032 - DNA, 20 bp, Artificial
  CRISPR gRNA sequence
ctaaaaatacaaaaaaaaat

SEQ ID NO: 467033 - DNA, 20 bp, Artificial
  CRISPR gRNA sequence
aaatacaaaaaaaaattagc

SEQ ID NO: 467034 - DNA, 20 bp, Artificial
  CRISPR gRNA sequence
aatacaaaaaaaaattagcc

SEQ ID NO: 467035 - DNA, 20 bp, Artificial
  CRISPR gRNA sequence
caaaaaaaaattagccgggc

SEQ ID NO: 467036 - DNA, 20 bp, Artificial
  CRISPR gRNA sequence
aaaaaaaaattagccgggcg

SEQ ID NO: 467037 - DNA, 20 bp, Artificial
  CRISPR gRNA sequence
aaaaaattagccgggcgagg

SEQ ID NO: 467038 - DNA, 20 bp, Artificial
  CRISPR gRNA sequence
aaattagccgggcgaggtgg

SEQ ID NO: 467039 - DNA, 20 bp, Artificial
  CRISPR gRNA sequence
aattagccgggcgaggtggc

SEQ ID NO: 467040 - DNA, 20 bp, Artificial
  CRISPR gRNA sequence
ggcgaggtggcgggcgcctg

SEQ ID NO: 467041 - DNA, 20 bp, Artificial
  CRISPR gRNA sequence
gtggcgggcgcctgtagtcc

SEQ ID NO: 467042 - DNA, 20 bp, Artificial
  CRISPR gRNA sequence
cgcctgtagtcccagctact

SEQ ID NO: 467043 - DNA, 20 bp, Artificial
  CRISPR gRNA sequence
gcctgtagtcccagctactc

SEQ ID NO: 467044 - DNA, 20 bp, Artificial
  CRISPR gRNA sequence
ctgtagtcccagctactcgg

SEQ ID NO: 467045 - DNA, 20 bp, Artificial
  CRISPR gRNA sequence
tgtagtcccagctactcggg

SEQ ID NO: 467046 - DNA, 20 bp, Artificial
  CRISPR gRNA sequence
tcccagctactcgggaggct

SEQ ID NO: 467047 - DNA, 20 bp, Artificial
  CRISPR gRNA sequence
cccagctactcgggaggctg

SEQ ID NO: 467048 - DNA, 20 bp, Artificial
  CRISPR gRNA sequence
agctactcgggaggctgagg

SEQ ID NO: 467049 - DNA, 20 bp, Artificial
  CRISPR gRNA sequence
gctactcgggaggctgaggc

SEQ ID NO: 467050 - DNA, 20 bp, Artificial
  CRISPR gRNA sequence
tactcgggaggctgaggcag

SEQ ID NO: 467051 - DNA, 20 bp, Artificial
  CRISPR gRNA sequence
gggaggctgaggcaggagaa

SEQ ID NO: 467052 - DNA, 20 bp, Artificial
  CRISPR gRNA sequence
tgaggcaggagaatggcgtg

SEQ ID NO: 467053 - DNA, 20 bp, Artificial
  CRISPR gRNA sequence
gcaggagaatggcgtgaagc

SEQ ID NO: 467054 - DNA, 20 bp, Artificial
  CRISPR gRNA sequence
caggagaatggcgtgaagcc

SEQ ID NO: 467055 - DNA, 20 bp, Artificial
  CRISPR gRNA sequence
ggagaatggcgtgaagccgg

SEQ ID NO: 467056 - DNA, 20 bp, Artificial
  CRISPR gRNA sequence
gagaatggcgtgaagccggg

SEQ ID NO: 467057 - DNA, 20 bp, Artificial
  CRISPR gRNA sequence
aatggcgtgaagccgggagg

SEQ ID NO: 467058 - DNA, 20 bp, Artificial
  CRISPR gRNA sequence
tggcgtgaagccgggaggcg

SEQ ID NO: 467059 - DNA, 20 bp, Artificial
  CRISPR gRNA sequence
aagccgggaggcggagcttg

SEQ ID NO: 467060 - DNA, 20 bp, Artificial
  CRISPR gRNA sequence
cgggaggcggagcttgcggt

SEQ ID NO: 467061 - DNA, 20 bp, Artificial
  CRISPR gRNA sequence
ggcggagcttgcggtgagcc

SEQ ID NO: 467062 - DNA, 20 bp, Artificial
  CRISPR gRNA sequence
gagatcgcaccactgcactc

SEQ ID NO: 467063 - DNA, 20 bp, Artificial
  CRISPR gRNA sequence
cgcaccactgcactccagcc

SEQ ID NO: 467064 - DNA, 20 bp, Artificial
  CRISPR gRNA sequence
gcaccactgcactccagcct

SEQ ID NO: 467065 - DNA, 20 bp, Artificial
  CRISPR gRNA sequence
ctgcactccagcctgggcta

SEQ ID NO: 467066 - DNA, 20 bp, Artificial
  CRISPR gRNA sequence
tgcactccagcctgggctat

SEQ ID NO: 467067 - DNA, 20 bp, Artificial
  CRISPR gRNA sequence
ctccagcctgggctataggc

SEQ ID NO: 467068 - DNA, 20 bp, Artificial
  CRISPR gRNA sequence
tctcaaaaaaaaaaaaaaaa

SEQ ID NO: 467069 - DNA, 20 bp, Artificial
  CRISPR gRNA sequence
caaaaaaaaaaaaaaaaaag

SEQ ID NO: 467070 - DNA, 20 bp, Artificial
  CRISPR gRNA sequence
aaagaagaattttcttttga

SEQ ID NO: 467071 - DNA, 20 bp, Artificial
  CRISPR gRNA sequence
aagaagaattttcttttgat

SEQ ID NO: 467072 - DNA, 20 bp, Artificial
  CRISPR gRNA sequence
cttttgataggaataacaac

SEQ ID NO: 467073 - DNA, 20 bp, Artificial
  CRISPR gRNA sequence
taacaactggaatactgttt

SEQ ID NO: 467074 - DNA, 20 bp, Artificial
  CRISPR gRNA sequence
actgttttggaactttttct

SEQ ID NO: 467075 - DNA, 20 bp, Artificial
  CRISPR gRNA sequence
tgacatcaattttttaattt

SEQ ID NO: 467076 - DNA, 20 bp, Artificial
  CRISPR gRNA sequence
gacatcaattttttaattta

SEQ ID NO: 467077 - DNA, 20 bp, Artificial
  CRISPR gRNA sequence
caaattataataatatatct

SEQ ID NO: 467078 - DNA, 20 bp, Artificial
  CRISPR gRNA sequence
atttattgtttctgccctct

SEQ ID NO: 467079 - DNA, 20 bp, Artificial
  CRISPR gRNA sequence
tttattgtttctgccctctt

SEQ ID NO: 467080 - DNA, 20 bp, Artificial
  CRISPR gRNA sequence
ttattgtttctgccctctta

SEQ ID NO: 467081 - DNA, 20 bp, Artificial
  CRISPR gRNA sequence
tattgtttctgccctcttag

SEQ ID NO: 467082 - DNA, 20 bp, Artificial
  CRISPR gRNA sequence
attgtttctgccctcttagg

SEQ ID NO: 467083 - DNA, 20 bp, Artificial
  CRISPR gRNA sequence
atcatgttataaactgcctg

SEQ ID NO: 467084 - DNA, 20 bp, Artificial
  CRISPR gRNA sequence
taaactgcctgaagttttca

SEQ ID NO: 467085 - DNA, 20 bp, Artificial
  CRISPR gRNA sequence
aaactgcctgaagttttcat

SEQ ID NO: 467086 - DNA, 20 bp, Artificial
  CRISPR gRNA sequence
ttttgctttttccatcaatt

SEQ ID NO: 467087 - DNA, 20 bp, Artificial
  CRISPR gRNA sequence
tttgctttttccatcaattt

SEQ ID NO: 467088 - DNA, 20 bp, Artificial
  CRISPR gRNA sequence
gggctatgctttttatcttg

SEQ ID NO: 467089 - DNA, 20 bp, Artificial
  CRISPR gRNA sequence
ggctatgctttttatcttga

SEQ ID NO: 467090 - DNA, 20 bp, Artificial
  CRISPR gRNA sequence
gctatgctttttatcttgaa

SEQ ID NO: 467091 - DNA, 20 bp, Artificial
  CRISPR gRNA sequence
ctatgctttttatcttgaag

SEQ ID NO: 467092 - DNA, 20 bp, Artificial
  CRISPR gRNA sequence
tatgctttttatcttgaagg

SEQ ID NO: 467093 - DNA, 20 bp, Artificial
  CRISPR gRNA sequence
aaaatgttctgtgacctcaa

SEQ ID NO: 467094 - DNA, 20 bp, Artificial
  CRISPR gRNA sequence
tctgtgacctcaaaagtgac

SEQ ID NO: 467095 - DNA, 20 bp, Artificial
  CRISPR gRNA sequence
ctcaaaagtgaccagtaata

SEQ ID NO: 467096 - DNA, 20 bp, Artificial
  CRISPR gRNA sequence
taaagcacaaaataactatt

SEQ ID NO: 467097 - DNA, 20 bp, Artificial
  CRISPR gRNA sequence
aaagcacaaaataactattt

SEQ ID NO: 467098 - DNA, 20 bp, Artificial
  CRISPR gRNA sequence
aagcacaaaataactattta

SEQ ID NO: 467099 - DNA, 20 bp, Artificial
  CRISPR gRNA sequence
agcacaaaataactatttag

SEQ ID NO: 467100 - DNA, 20 bp, Artificial
  CRISPR gRNA sequence
ataactatttaggggtgaca

SEQ ID NO: 467101 - DNA, 20 bp, Artificial
  CRISPR gRNA sequence
ggggtgacatagtgattctc

SEQ ID NO: 467102 - DNA, 20 bp, Artificial
  CRISPR gRNA sequence
atcctttaataattgaaatt

SEQ ID NO: 467103 - DNA, 20 bp, Artificial
  CRISPR gRNA sequence
aataattgaaatttagctga

SEQ ID NO: 467104 - DNA, 20 bp, Artificial
  CRISPR gRNA sequence
ttgaaatttagctgaaagtg

SEQ ID NO: 467105 - DNA, 20 bp, Artificial
  CRISPR gRNA sequence
ttagctgaaagtgtagatgt

SEQ ID NO: 467106 - DNA, 20 bp, Artificial
  CRISPR gRNA sequence
gctgaaagtgtagatgtcag

SEQ ID NO: 467107 - DNA, 20 bp, Artificial
  CRISPR gRNA sequence
tgaaagtgtagatgtcagca

SEQ ID NO: 467108 - DNA, 20 bp, Artificial
  CRISPR gRNA sequence
tagatgtcagcagagtatgt

SEQ ID NO: 467109 - DNA, 20 bp, Artificial
  CRISPR gRNA sequence
agatgtcagcagagtatgtg

SEQ ID NO: 467110 - DNA, 20 bp, Artificial
  CRISPR gRNA sequence
tcagcagagtatgtgaggaa

SEQ ID NO: 467111 - DNA, 20 bp, Artificial
  CRISPR gRNA sequence
gcagagtatgtgaggaacag

SEQ ID NO: 467112 - DNA, 20 bp, Artificial
  CRISPR gRNA sequence
cagtagattatttctcacaa

SEQ ID NO: 467113 - DNA, 20 bp, Artificial
  CRISPR gRNA sequence
caatggacatgactccattt

SEQ ID NO: 467114 - DNA, 20 bp, Artificial
  CRISPR gRNA sequence
ccatttaagcttttcattca

SEQ ID NO: 467115 - DNA, 20 bp, Artificial
  CRISPR gRNA sequence
ctaatgaatatgcactacca

SEQ ID NO: 467116 - DNA, 20 bp, Artificial
  CRISPR gRNA sequence
atatgcactaccatggccgt

SEQ ID NO: 467117 - DNA, 20 bp, Artificial
  CRISPR gRNA sequence
aaccatctttttttctattg

SEQ ID NO: 467118 - DNA, 20 bp, Artificial
  CRISPR gRNA sequence
accatctttttttctattgt

SEQ ID NO: 467119 - DNA, 20 bp, Artificial
  CRISPR gRNA sequence
tgtaggttgatgctcacctt

SEQ ID NO: 467120 - DNA, 20 bp, Artificial
  CRISPR gRNA sequence
taggttgatgctcaccttaa

SEQ ID NO: 467121 - DNA, 20 bp, Artificial
  CRISPR gRNA sequence
ttgatgctcaccttaagagt

SEQ ID NO: 467122 - DNA, 20 bp, Artificial
  CRISPR gRNA sequence
tcaccttaagagtgagcaaa

SEQ ID NO: 467123 - DNA, 20 bp, Artificial
  CRISPR gRNA sequence
ccttaagagtgagcaaacag

SEQ ID NO: 467124 - DNA, 20 bp, Artificial
  CRISPR gRNA sequence
aagagtgagcaaacagaagc

SEQ ID NO: 467125 - DNA, 20 bp, Artificial
  CRISPR gRNA sequence
gagcaaacagaagcaagcac

SEQ ID NO: 467126 - DNA, 20 bp, Artificial
  CRISPR gRNA sequence
agcaaacagaagcaagcacc

SEQ ID NO: 467127 - DNA, 20 bp, Artificial
  CRISPR gRNA sequence
aagcaccaggcaaaattccc

SEQ ID NO: 467128 - DNA, 20 bp, Artificial
  CRISPR gRNA sequence
aaattcccaagtactgctat

SEQ ID NO: 467129 - DNA, 20 bp, Artificial
  CRISPR gRNA sequence
caagtactgctatcagaaac

SEQ ID NO: 467130 - DNA, 20 bp, Artificial
  CRISPR gRNA sequence
aatgaccctgacctttgttt

SEQ ID NO: 467131 - DNA, 20 bp, Artificial
  CRISPR gRNA sequence
atgaccctgacctttgtttc

SEQ ID NO: 467132 - DNA, 20 bp, Artificial
  CRISPR gRNA sequence
ctgacctttgtttcaggatg

SEQ ID NO: 467133 - DNA, 20 bp, Artificial
  CRISPR gRNA sequence
tgacctttgtttcaggatgc

SEQ ID NO: 467134 - DNA, 20 bp, Artificial
  CRISPR gRNA sequence
cctttgtttcaggatgcagg

SEQ ID NO: 467135 - DNA, 20 bp, Artificial
  CRISPR gRNA sequence
ctttgtttcaggatgcagga

SEQ ID NO: 467136 - DNA, 20 bp, Artificial
  CRISPR gRNA sequence
tttgtttcaggatgcaggaa

SEQ ID NO: 467137 - DNA, 20 bp, Artificial
  CRISPR gRNA sequence
caggatgcaggaagggtctg

SEQ ID NO: 467138 - DNA, 20 bp, Artificial
  CRISPR gRNA sequence
agtttattctaatccatgcc

SEQ ID NO: 467139 - DNA, 20 bp, Artificial
  CRISPR gRNA sequence
ttattctaatccatgcctgg

SEQ ID NO: 467140 - DNA, 20 bp, Artificial
  CRISPR gRNA sequence
atgcctggaagaaaacaaac

SEQ ID NO: 467141 - DNA, 20 bp, Artificial
  CRISPR gRNA sequence
tgcctggaagaaaacaaacc

SEQ ID NO: 467142 - DNA, 20 bp, Artificial
  CRISPR gRNA sequence
tccctgaaccattctgtcat

SEQ ID NO: 467143 - DNA, 20 bp, Artificial
  CRISPR gRNA sequence
tctgtcattggaccgaactc

SEQ ID NO: 467144 - DNA, 20 bp, Artificial
  CRISPR gRNA sequence
cattggaccgaactcaagac

SEQ ID NO: 467145 - DNA, 20 bp, Artificial
  CRISPR gRNA sequence
ggaccgaactcaagactggc

SEQ ID NO: 467146 - DNA, 20 bp, Artificial
  CRISPR gRNA sequence
aagactggcaagaaatgtaa

SEQ ID NO: 467147 - DNA, 20 bp, Artificial
  CRISPR gRNA sequence
actggcaagaaatgtaaaag

SEQ ID NO: 467148 - DNA, 20 bp, Artificial
  CRISPR gRNA sequence
aaatgtaaaagaagcaccaa

SEQ ID NO: 467149 - DNA, 20 bp, Artificial
  CRISPR gRNA sequence
gaatatgcatccatatgtgt

SEQ ID NO: 467150 - DNA, 20 bp, Artificial
  CRISPR gRNA sequence
aatatgcatccatatgtgtg

SEQ ID NO: 467151 - DNA, 20 bp, Artificial
  CRISPR gRNA sequence
tatgcatccatatgtgtgag

SEQ ID NO: 467152 - DNA, 20 bp, Artificial
  CRISPR gRNA sequence
atccatatgtgtgaggagtt

SEQ ID NO: 467153 - DNA, 20 bp, Artificial
  CRISPR gRNA sequence
aagtctgtttctgactccaa

SEQ ID NO: 467154 - DNA, 20 bp, Artificial
  CRISPR gRNA sequence
agtctgtttctgactccaac

SEQ ID NO: 467155 - DNA, 20 bp, Artificial
  CRISPR gRNA sequence
gtctgtttctgactccaaca

SEQ ID NO: 467156 - DNA, 20 bp, Artificial
  CRISPR gRNA sequence
aacagggaccattgaatgat

SEQ ID NO: 467157 - DNA, 20 bp, Artificial
  CRISPR gRNA sequence
agcatgttgacatcattgtc

SEQ ID NO: 467158 - DNA, 20 bp, Artificial
  CRISPR gRNA sequence
gcatgttgacatcattgtct

SEQ ID NO: 467159 - DNA, 20 bp, Artificial
  CRISPR gRNA sequence
acatcattgtctgggctcaa

SEQ ID NO: 467160 - DNA, 20 bp, Artificial
  CRISPR gRNA sequence
catcattgtctgggctcaac

SEQ ID NO: 467161 - DNA, 20 bp, Artificial
  CRISPR gRNA sequence
caaataatatttctcaattt

SEQ ID NO: 467162 - DNA, 20 bp, Artificial
  CRISPR gRNA sequence
caatttgagaatttttactt

SEQ ID NO: 467163 - DNA, 20 bp, Artificial
  CRISPR gRNA sequence
tactttagaaatgttcatgt

SEQ ID NO: 467164 - DNA, 20 bp, Artificial
  CRISPR gRNA sequence
gaaatgttcatgttagtgct

SEQ ID NO: 467165 - DNA, 20 bp, Artificial
  CRISPR gRNA sequence
aaatgttcatgttagtgctt

SEQ ID NO: 467166 - DNA, 20 bp, Artificial
  CRISPR gRNA sequence
catgttagtgcttgggtctt

SEQ ID NO: 467167 - DNA, 20 bp, Artificial
  CRISPR gRNA sequence
atgttagtgcttgggtctta

SEQ ID NO: 467168 - DNA, 20 bp, Artificial
  CRISPR gRNA sequence
tgttagtgcttgggtcttaa

SEQ ID NO: 467169 - DNA, 20 bp, Artificial
  CRISPR gRNA sequence
gcttgggtcttaagggtcca

SEQ ID NO: 467170 - DNA, 20 bp, Artificial
  CRISPR gRNA sequence
cttgggtcttaagggtccat

SEQ ID NO: 467171 - DNA, 20 bp, Artificial
  CRISPR gRNA sequence
taaatgattaaaatttctct

SEQ ID NO: 467172 - DNA, 20 bp, Artificial
  CRISPR gRNA sequence
atttctctcagaaacttatt

SEQ ID NO: 467173 - DNA, 20 bp, Artificial
  CRISPR gRNA sequence
tttctctcagaaacttattt

SEQ ID NO: 467174 - DNA, 20 bp, Artificial
  CRISPR gRNA sequence
tctctcagaaacttatttgg

SEQ ID NO: 467175 - DNA, 20 bp, Artificial
  CRISPR gRNA sequence
tttgggagctttttatatta

SEQ ID NO: 467176 - DNA, 20 bp, Artificial
  CRISPR gRNA sequence
taacaaaatctctccaaaac

SEQ ID NO: 467177 - DNA, 20 bp, Artificial
  CRISPR gRNA sequence
ccaaaactggttgacatcat

SEQ ID NO: 467178 - DNA, 20 bp, Artificial
  CRISPR gRNA sequence
aaactggttgacatcatgag

SEQ ID NO: 467179 - DNA, 20 bp, Artificial
  CRISPR gRNA sequence
ctggttgacatcatgagtag

SEQ ID NO: 467180 - DNA, 20 bp, Artificial
  CRISPR gRNA sequence
tgacatcatgagtagcagaa

SEQ ID NO: 467181 - DNA, 20 bp, Artificial
  CRISPR gRNA sequence
catcatgagtagcagaatag

SEQ ID NO: 467182 - DNA, 20 bp, Artificial
  CRISPR gRNA sequence
aatagtagaacgtttaaact

SEQ ID NO: 467183 - DNA, 20 bp, Artificial
  CRISPR gRNA sequence
caaactcgatcttgcctttg

SEQ ID NO: 467184 - DNA, 20 bp, Artificial
  CRISPR gRNA sequence
gatcttgcctttgaagctat

SEQ ID NO: 467185 - DNA, 20 bp, Artificial
  CRISPR gRNA sequence
ttgcctttgaagctattgga

SEQ ID NO: 467186 - DNA, 20 bp, Artificial
  CRISPR gRNA sequence
gaagctattggaaagacttg

SEQ ID NO: 467187 - DNA, 20 bp, Artificial
  CRISPR gRNA sequence
aagctattggaaagacttgt

SEQ ID NO: 467188 - DNA, 20 bp, Artificial
  CRISPR gRNA sequence
agctattggaaagacttgta

SEQ ID NO: 467189 - DNA, 20 bp, Artificial
  CRISPR gRNA sequence
ttggaaagacttgtagggaa

SEQ ID NO: 467190 - DNA, 20 bp, Artificial
  CRISPR gRNA sequence
ggaaagacttgtagggaaaa

SEQ ID NO: 467191 - DNA, 20 bp, Artificial
  CRISPR gRNA sequence
gaaagacttgtagggaaaag

SEQ ID NO: 467192 - DNA, 20 bp, Artificial
  CRISPR gRNA sequence
gaggtttgtgttacctgcat

SEQ ID NO: 467193 - DNA, 20 bp, Artificial
  CRISPR gRNA sequence
tgactaaccaaccataaata

SEQ ID NO: 467194 - DNA, 20 bp, Artificial
  CRISPR gRNA sequence
cagtaatgattgtatatttc

SEQ ID NO: 467195 - DNA, 20 bp, Artificial
  CRISPR gRNA sequence
aatgattgtatatttcaagt

SEQ ID NO: 467196 - DNA, 20 bp, Artificial
  CRISPR gRNA sequence
tcaagtcagtcttccaaaat

SEQ ID NO: 467197 - DNA, 20 bp, Artificial
  CRISPR gRNA sequence
ataagaaatttttgctgtgt

SEQ ID NO: 467198 - DNA, 20 bp, Artificial
  CRISPR gRNA sequence
aatttttgctgtgtcagtct

SEQ ID NO: 467199 - DNA, 20 bp, Artificial
  CRISPR gRNA sequence
ttgctgtgtcagtctaagaa

SEQ ID NO: 467200 - DNA, 20 bp, Artificial
  CRISPR gRNA sequence
aatggtgtttcttaaatgca

SEQ ID NO: 467201 - DNA, 20 bp, Artificial
  CRISPR gRNA sequence
atggtgtttcttaaatgcaa

SEQ ID NO: 467202 - DNA, 20 bp, Artificial
  CRISPR gRNA sequence
ggtgtttcttaaatgcaaag

SEQ ID NO: 467203 - DNA, 20 bp, Artificial
  CRISPR gRNA sequence
atgcaaaggagaaatcattt

SEQ ID NO: 467204 - DNA, 20 bp, Artificial
  CRISPR gRNA sequence
tgcaaaggagaaatcatttt

SEQ ID NO: 467205 - DNA, 20 bp, Artificial
  CRISPR gRNA sequence
aatcattttaggcttgatgt

SEQ ID NO: 467206 - DNA, 20 bp, Artificial
  CRISPR gRNA sequence
aagaaaatgaaaataataaa

SEQ ID NO: 467207 - DNA, 20 bp, Artificial
  CRISPR gRNA sequence
taaatggtgcaataaaaata

SEQ ID NO: 467208 - DNA, 20 bp, Artificial
  CRISPR gRNA sequence
aaaatatagaatataccaat

SEQ ID NO: 467209 - DNA, 20 bp, Artificial
  CRISPR gRNA sequence
tagaatataccaattggata

SEQ ID NO: 467210 - DNA, 20 bp, Artificial
  CRISPR gRNA sequence
agaatataccaattggatat

SEQ ID NO: 467211 - DNA, 20 bp, Artificial
  CRISPR gRNA sequence
gaatataccaattggatata

SEQ ID NO: 467212 - DNA, 20 bp, Artificial
  CRISPR gRNA sequence
tataccaattggatataggg

SEQ ID NO: 467213 - DNA, 20 bp, Artificial
  CRISPR gRNA sequence
gggtagatgttccacatacc

SEQ ID NO: 467214 - DNA, 20 bp, Artificial
  CRISPR gRNA sequence
aatgcttatatctactctgt

SEQ ID NO: 467215 - DNA, 20 bp, Artificial
  CRISPR gRNA sequence
atctactctgttagattgat

SEQ ID NO: 467216 - DNA, 20 bp, Artificial
  CRISPR gRNA sequence
gttagattgataagcaaata

SEQ ID NO: 467217 - DNA, 20 bp, Artificial
  CRISPR gRNA sequence
ttagattgataagcaaatat

SEQ ID NO: 467218 - DNA, 20 bp, Artificial
  CRISPR gRNA sequence
taagcaaatataggtattaa

SEQ ID NO: 467219 - DNA, 20 bp, Artificial
  CRISPR gRNA sequence
agcaaatataggtattaatg

SEQ ID NO: 467220 - DNA, 20 bp, Artificial
  CRISPR gRNA sequence
aaatataggtattaatggag

SEQ ID NO: 467221 - DNA, 20 bp, Artificial
  CRISPR gRNA sequence
ttaatggagcagtcaacgta

SEQ ID NO: 467222 - DNA, 20 bp, Artificial
  CRISPR gRNA sequence
tcaacgtatagcacatttat

SEQ ID NO: 467223 - DNA, 20 bp, Artificial
  CRISPR gRNA sequence
caacgtatagcacatttatg

SEQ ID NO: 467224 - DNA, 20 bp, Artificial
  CRISPR gRNA sequence
gtatagcacatttatgagga

SEQ ID NO: 467225 - DNA, 20 bp, Artificial
  CRISPR gRNA sequence
tagcacatttatgaggaaag

SEQ ID NO: 467226 - DNA, 20 bp, Artificial
  CRISPR gRNA sequence
gcacatttatgaggaaagta

SEQ ID NO: 467227 - DNA, 20 bp, Artificial
  CRISPR gRNA sequence
tgaggaaagtagagactcac

SEQ ID NO: 467228 - DNA, 20 bp, Artificial
  CRISPR gRNA sequence
gaggaaagtagagactcact

SEQ ID NO: 467229 - DNA, 20 bp, Artificial
  CRISPR gRNA sequence
tagagactcactgggtcaca

SEQ ID NO: 467230 - DNA, 20 bp, Artificial
  CRISPR gRNA sequence
cactgggtcacatagactaa

SEQ ID NO: 467231 - DNA, 20 bp, Artificial
  CRISPR gRNA sequence
gggtcacatagactaatgga

SEQ ID NO: 467232 - DNA, 20 bp, Artificial
  CRISPR gRNA sequence
ggtcacatagactaatggat

SEQ ID NO: 467233 - DNA, 20 bp, Artificial
  CRISPR gRNA sequence
ctgctgaattaatatactta

SEQ ID NO: 467234 - DNA, 20 bp, Artificial
  CRISPR gRNA sequence
tgctgaattaatatacttat

SEQ ID NO: 467235 - DNA, 20 bp, Artificial
  CRISPR gRNA sequence
tatacttatgggcatctgaa

SEQ ID NO: 467236 - DNA, 20 bp, Artificial
  CRISPR gRNA sequence
tgggcatctgaatagtttaa

SEQ ID NO: 467237 - DNA, 20 bp, Artificial
  CRISPR gRNA sequence
catctgaatagtttaaaagt

SEQ ID NO: 467238 - DNA, 20 bp, Artificial
  CRISPR gRNA sequence
tgaatagtttaaaagttagt

SEQ ID NO: 467239 - DNA, 20 bp, Artificial
  CRISPR gRNA sequence
agtttaaaagttagtcagaa

SEQ ID NO: 467240 - DNA, 20 bp, Artificial
  CRISPR gRNA sequence
gtttaaaagttagtcagaat

SEQ ID NO: 467241 - DNA, 20 bp, Artificial
  CRISPR gRNA sequence
ttagtcagaataggtatcac

SEQ ID NO: 467242 - DNA, 20 bp, Artificial
  CRISPR gRNA sequence
tagtcagaataggtatcact

SEQ ID NO: 467243 - DNA, 20 bp, Artificial
  CRISPR gRNA sequence
cagaataggtatcactgggc

SEQ ID NO: 467244 - DNA, 20 bp, Artificial
  CRISPR gRNA sequence
taggtatcactgggcaagtg

SEQ ID NO: 467245 - DNA, 20 bp, Artificial
  CRISPR gRNA sequence
tatcactgggcaagtgaaga

SEQ ID NO: 467246 - DNA, 20 bp, Artificial
  CRISPR gRNA sequence
ctgcttcatgcttgacttga

SEQ ID NO: 467247 - DNA, 20 bp, Artificial
  CRISPR gRNA sequence
ttcatgcttgacttgatagc

SEQ ID NO: 467248 - DNA, 20 bp, Artificial
  CRISPR gRNA sequence
cttgacttgatagcaagtta

SEQ ID NO: 467249 - DNA, 20 bp, Artificial
  CRISPR gRNA sequence
gcaagttaaagtgcaattaa

SEQ ID NO: 467250 - DNA, 20 bp, Artificial
  CRISPR gRNA sequence
ttaaagtgcaattaatggaa

SEQ ID NO: 467251 - DNA, 20 bp, Artificial
  CRISPR gRNA sequence
aaagtgcaattaatggaatg

SEQ ID NO: 467252 - DNA, 20 bp, Artificial
  CRISPR gRNA sequence
aagtgcaattaatggaatgg

SEQ ID NO: 467253 - DNA, 20 bp, Artificial
  CRISPR gRNA sequence
taatggaatggaggaaaacc

SEQ ID NO: 467254 - DNA, 20 bp, Artificial
  CRISPR gRNA sequence
gaaaacccagaatatttaat

SEQ ID NO: 467255 - DNA, 20 bp, Artificial
  CRISPR gRNA sequence
cagaatatttaattggtctg

SEQ ID NO: 467256 - DNA, 20 bp, Artificial
  CRISPR gRNA sequence
agaatatttaattggtctgt

SEQ ID NO: 467257 - DNA, 20 bp, Artificial
  CRISPR gRNA sequence
gaatatttaattggtctgta

SEQ ID NO: 467258 - DNA, 20 bp, Artificial
  CRISPR gRNA sequence
aatatttaattggtctgtag

SEQ ID NO: 467259 - DNA, 20 bp, Artificial
  CRISPR gRNA sequence
atcttgctgttcttcttact

SEQ ID NO: 467260 - DNA, 20 bp, Artificial
  CRISPR gRNA sequence
tcttgctgttcttcttacta

SEQ ID NO: 467261 - DNA, 20 bp, Artificial
  CRISPR gRNA sequence
tgttcttcttactaaggaat

SEQ ID NO: 467262 - DNA, 20 bp, Artificial
  CRISPR gRNA sequence
gttcttcttactaaggaatc

SEQ ID NO: 467263 - DNA, 20 bp, Artificial
  CRISPR gRNA sequence
ttcttcttactaaggaatca

SEQ ID NO: 467264 - DNA, 20 bp, Artificial
  CRISPR gRNA sequence
gaatcagggcaaatcatctg

SEQ ID NO: 467265 - DNA, 20 bp, Artificial
  CRISPR gRNA sequence
tcatctgtagtgacatattt

SEQ ID NO: 467266 - DNA, 20 bp, Artificial
  CRISPR gRNA sequence
atcatttattttaaaatact

SEQ ID NO: 467267 - DNA, 20 bp, Artificial
  CRISPR gRNA sequence
tcatttattttaaaatactg

SEQ ID NO: 467268 - DNA, 20 bp, Artificial
  CRISPR gRNA sequence
attttaaaatactgaggttg

SEQ ID NO: 467269 - DNA, 20 bp, Artificial
  CRISPR gRNA sequence
tactgaggttgcagccactt

SEQ ID NO: 467270 - DNA, 20 bp, Artificial
  CRISPR gRNA sequence
ctgaggttgcagccacttaa

SEQ ID NO: 467271 - DNA, 20 bp, Artificial
  CRISPR gRNA sequence
gttgcagccacttaagagta

SEQ ID NO: 467272 - DNA, 20 bp, Artificial
  CRISPR gRNA sequence
gccacttaagagtatagcaa

SEQ ID NO: 467273 - DNA, 20 bp, Artificial
  CRISPR gRNA sequence
cttaagagtatagcaaaaga

SEQ ID NO: 467274 - DNA, 20 bp, Artificial
  CRISPR gRNA sequence
agtatagcaaaagatggatt

SEQ ID NO: 467275 - DNA, 20 bp, Artificial
  CRISPR gRNA sequence
aaaagatggattcagatttt

SEQ ID NO: 467276 - DNA, 20 bp, Artificial
  CRISPR gRNA sequence
tcagatttttggactttcca

SEQ ID NO: 467277 - DNA, 20 bp, Artificial
  CRISPR gRNA sequence
ttggactttccaaagtactt

SEQ ID NO: 467278 - DNA, 20 bp, Artificial
  CRISPR gRNA sequence
gagttaaactatttcaaaaa

SEQ ID NO: 467279 - DNA, 20 bp, Artificial
  CRISPR gRNA sequence
tagcctataattttattcaa

SEQ ID NO: 467280 - DNA, 20 bp, Artificial
  CRISPR gRNA sequence
ataattttattcaacagttt

SEQ ID NO: 467281 - DNA, 20 bp, Artificial
  CRISPR gRNA sequence
taattttattcaacagtttg

SEQ ID NO: 467282 - DNA, 20 bp, Artificial
  CRISPR gRNA sequence
tttgaggctattcgaattct

SEQ ID NO: 467283 - DNA, 20 bp, Artificial
  CRISPR gRNA sequence
ttgaggctattcgaattctc

SEQ ID NO: 467284 - DNA, 20 bp, Artificial
  CRISPR gRNA sequence
gctgctactgaataatgtaa

SEQ ID NO: 467285 - DNA, 20 bp, Artificial
  CRISPR gRNA sequence
aatgtaatagtcttcataca

SEQ ID NO: 467286 - DNA, 20 bp, Artificial
  CRISPR gRNA sequence
gtaatagtcttcatacaaag

SEQ ID NO: 467287 - DNA, 20 bp, Artificial
  CRISPR gRNA sequence
tagtcttcatacaaagtgga

SEQ ID NO: 467288 - DNA, 20 bp, Artificial
  CRISPR gRNA sequence
ttcatacaaagtggatagca

SEQ ID NO: 467289 - DNA, 20 bp, Artificial
  CRISPR gRNA sequence
tcatacaaagtggatagcaa

SEQ ID NO: 467290 - DNA, 20 bp, Artificial
  CRISPR gRNA sequence
atccatttcaacaaatatgt

SEQ ID NO: 467291 - DNA, 20 bp, Artificial
  CRISPR gRNA sequence
tttcaacaaatatgtgagct

SEQ ID NO: 467292 - DNA, 20 bp, Artificial
  CRISPR gRNA sequence
gtgagctgagctgctgcaca

SEQ ID NO: 467293 - DNA, 20 bp, Artificial
  CRISPR gRNA sequence
tgagctgagctgctgcacaa

SEQ ID NO: 467294 - DNA, 20 bp, Artificial
  CRISPR gRNA sequence
gtgtgtgtgtgtgtgtgtgt

SEQ ID NO: 467295 - DNA, 20 bp, Artificial
  CRISPR gRNA sequence
tgtgtgtgtgtgtgtgtgtt

SEQ ID NO: 467296 - DNA, 20 bp, Artificial
  CRISPR gRNA sequence
gtgtgtgtgtgtgtgttagg

SEQ ID NO: 467297 - DNA, 20 bp, Artificial
  CRISPR gRNA sequence
tgtgtgtgtgtgtgttaggt

SEQ ID NO: 467298 - DNA, 20 bp, Artificial
  CRISPR gRNA sequence
gtgtgtgtgtgtgttaggtg

SEQ ID NO: 467299 - DNA, 20 bp, Artificial
  CRISPR gRNA sequence
tgtgtgtgtgttaggtgggg

SEQ ID NO: 467300 - DNA, 20 bp, Artificial
  CRISPR gRNA sequence
gtgtgtgtgttaggtggggt

SEQ ID NO: 467301 - DNA, 20 bp, Artificial
  CRISPR gRNA sequence
ttaggtggggtgggtgacaa

SEQ ID NO: 467302 - DNA, 20 bp, Artificial
  CRISPR gRNA sequence
ggggtgggtgacaacagaaa

SEQ ID NO: 467303 - DNA, 20 bp, Artificial
  CRISPR gRNA sequence
tgacaacagaaatggtgcac

SEQ ID NO: 467304 - DNA, 20 bp, Artificial
  CRISPR gRNA sequence
tcaaattgacattatatttt

SEQ ID NO: 467305 - DNA, 20 bp, Artificial
  CRISPR gRNA sequence
atattttcagtttgcttatg

SEQ ID NO: 467306 - DNA, 20 bp, Artificial
  CRISPR gRNA sequence
gcttatgaagctcaaaatac

SEQ ID NO: 467307 - DNA, 20 bp, Artificial
  CRISPR gRNA sequence
ttatgaagctcaaaatacta

SEQ ID NO: 467308 - DNA, 20 bp, Artificial
  CRISPR gRNA sequence
gctcaaaatactagagtaaa

SEQ ID NO: 467309 - DNA, 20 bp, Artificial
  CRISPR gRNA sequence
ctcaaaatactagagtaaat

SEQ ID NO: 467310 - DNA, 20 bp, Artificial
  CRISPR gRNA sequence
ctagagtaaatgggtcatta

SEQ ID NO: 467311 - DNA, 20 bp, Artificial
  CRISPR gRNA sequence
gaaaataatatgtgaaatta

SEQ ID NO: 467312 - DNA, 20 bp, Artificial
  CRISPR gRNA sequence
aaataatatgtgaaattatg

SEQ ID NO: 467313 - DNA, 20 bp, Artificial
  CRISPR gRNA sequence
atatgtgaaattatggagtt

SEQ ID NO: 467314 - DNA, 20 bp, Artificial
  CRISPR gRNA sequence
aattatggagtttagaatac

SEQ ID NO: 467315 - DNA, 20 bp, Artificial
  CRISPR gRNA sequence
tatggagtttagaatacaag

SEQ ID NO: 467316 - DNA, 20 bp, Artificial
  CRISPR gRNA sequence
atggagtttagaatacaagt

SEQ ID NO: 467317 - DNA, 20 bp, Artificial
  CRISPR gRNA sequence
tggagtttagaatacaagtg

SEQ ID NO: 467318 - DNA, 20 bp, Artificial
  CRISPR gRNA sequence
aagtggggtatatatacaaa

SEQ ID NO: 467319 - DNA, 20 bp, Artificial
  CRISPR gRNA sequence
atatacaaaaagacaaaact

SEQ ID NO: 467320 - DNA, 20 bp, Artificial
  CRISPR gRNA sequence
tatacaaaaagacaaaactg

SEQ ID NO: 467321 - DNA, 20 bp, Artificial
  CRISPR gRNA sequence
aagacaaaactgaggttttg

SEQ ID NO: 467322 - DNA, 20 bp, Artificial
  CRISPR gRNA sequence
acaaaactgaggttttgtgg

SEQ ID NO: 467323 - DNA, 20 bp, Artificial
  CRISPR gRNA sequence
aaaactgaggttttgtggtg

SEQ ID NO: 467324 - DNA, 20 bp, Artificial
  CRISPR gRNA sequence
aactgaggttttgtggtgga

SEQ ID NO: 467325 - DNA, 20 bp, Artificial
  CRISPR gRNA sequence
tgtggtggagagattttctt

SEQ ID NO: 467326 - DNA, 20 bp, Artificial
  CRISPR gRNA sequence
gagattttcttaagtaacac

SEQ ID NO: 467327 - DNA, 20 bp, Artificial
  CRISPR gRNA sequence
tcttaagtaacactggcatt

SEQ ID NO: 467328 - DNA, 20 bp, Artificial
  CRISPR gRNA sequence
gtaacactggcattaagttt

SEQ ID NO: 467329 - DNA, 20 bp, Artificial
  CRISPR gRNA sequence
ggcattaagttttagctcct

SEQ ID NO: 467330 - DNA, 20 bp, Artificial
  CRISPR gRNA sequence
aagttttagctccttagatt

SEQ ID NO: 467331 - DNA, 20 bp, Artificial
  CRISPR gRNA sequence
agttttagctccttagattt

SEQ ID NO: 467332 - DNA, 20 bp, Artificial
  CRISPR gRNA sequence
gttttagctccttagatttg

SEQ ID NO: 467333 - DNA, 20 bp, Artificial
  CRISPR gRNA sequence
ttttagctccttagatttgg

SEQ ID NO: 467334 - DNA, 20 bp, Artificial
  CRISPR gRNA sequence
gggggtgcaaatattctttt

SEQ ID NO: 467335 - DNA, 20 bp, Artificial
  CRISPR gRNA sequence
gttattttgccaattacacc

SEQ ID NO: 467336 - DNA, 20 bp, Artificial
  CRISPR gRNA sequence
ccaattacacctagaatttc

SEQ ID NO: 467337 - DNA, 20 bp, Artificial
  CRISPR gRNA sequence
gaatttcaagcaaccaattc

SEQ ID NO: 467338 - DNA, 20 bp, Artificial
  CRISPR gRNA sequence
ttcaagcaaccaattcgaga

SEQ ID NO: 467339 - DNA, 20 bp, Artificial
  CRISPR gRNA sequence
tcaagcaaccaattcgagat

SEQ ID NO: 467340 - DNA, 20 bp, Artificial
  CRISPR gRNA sequence
caattcgagataggctgttt

SEQ ID NO: 467341 - DNA, 20 bp, Artificial
  CRISPR gRNA sequence
tcgagataggctgttttagc

SEQ ID NO: 467342 - DNA, 20 bp, Artificial
  CRISPR gRNA sequence
cgagataggctgttttagcc

SEQ ID NO: 467343 - DNA, 20 bp, Artificial
  CRISPR gRNA sequence
ttttagccaggctgcatttg

SEQ ID NO: 467344 - DNA, 20 bp, Artificial
  CRISPR gRNA sequence
catttgtggacaacttatgt

SEQ ID NO: 467345 - DNA, 20 bp, Artificial
  CRISPR gRNA sequence
tgtggacaacttatgtaaga

SEQ ID NO: 467346 - DNA, 20 bp, Artificial
  CRISPR gRNA sequence
cttatgtaagaaagacatgt

SEQ ID NO: 467347 - DNA, 20 bp, Artificial
  CRISPR gRNA sequence
gtaagaaagacatgttagaa

SEQ ID NO: 467348 - DNA, 20 bp, Artificial
  CRISPR gRNA sequence
catgttagaatagctgcttg

SEQ ID NO: 467349 - DNA, 20 bp, Artificial
  CRISPR gRNA sequence
gcttgtggtattcttaaaaa

SEQ ID NO: 467350 - DNA, 20 bp, Artificial
  CRISPR gRNA sequence
ggtattcttaaaaatagaaa

SEQ ID NO: 467351 - DNA, 20 bp, Artificial
  CRISPR gRNA sequence
gtattcttaaaaatagaaac

SEQ ID NO: 467352 - DNA, 20 bp, Artificial
  CRISPR gRNA sequence
aaaaatagaaacaggaaata

SEQ ID NO: 467353 - DNA, 20 bp, Artificial
  CRISPR gRNA sequence
aaaatagaaacaggaaatat

SEQ ID NO: 467354 - DNA, 20 bp, Artificial
  CRISPR gRNA sequence
aaatagaaacaggaaatatg

SEQ ID NO: 467355 - DNA, 20 bp, Artificial
  CRISPR gRNA sequence
atagaaacaggaaatatggg

SEQ ID NO: 467356 - DNA, 20 bp, Artificial
  CRISPR gRNA sequence
tagaaacaggaaatatgggg

SEQ ID NO: 467357 - DNA, 20 bp, Artificial
  CRISPR gRNA sequence
aaatatggggaggatacatt

SEQ ID NO: 467358 - DNA, 20 bp, Artificial
  CRISPR gRNA sequence
acatttagctgtcctcttat

SEQ ID NO: 467359 - DNA, 20 bp, Artificial
  CRISPR gRNA sequence
gatgaacacacgaaattgaa

SEQ ID NO: 467360 - DNA, 20 bp, Artificial
  CRISPR gRNA sequence
catgattctctcaaacttaa

SEQ ID NO: 467361 - DNA, 20 bp, Artificial
  CRISPR gRNA sequence
tgtcttatttaaaatatcct

SEQ ID NO: 467362 - DNA, 20 bp, Artificial
  CRISPR gRNA sequence
aatatccttagtatgtctta

SEQ ID NO: 467363 - DNA, 20 bp, Artificial
  CRISPR gRNA sequence
ccttagtatgtcttatagta

SEQ ID NO: 467364 - DNA, 20 bp, Artificial
  CRISPR gRNA sequence
ctgataatgatttcatctct

SEQ ID NO: 467365 - DNA, 20 bp, Artificial
  CRISPR gRNA sequence
gtttttattccttttcaaaa

SEQ ID NO: 467366 - DNA, 20 bp, Artificial
  CRISPR gRNA sequence
attccttttcaaaatggtgt

SEQ ID NO: 467367 - DNA, 20 bp, Artificial
  CRISPR gRNA sequence
tccttttcaaaatggtgtca

SEQ ID NO: 467368 - DNA, 20 bp, Artificial
  CRISPR gRNA sequence
ctacttcactattatttaca

SEQ ID NO: 467369 - DNA, 20 bp, Artificial
  CRISPR gRNA sequence
atttacatggcttatttcat

SEQ ID NO: 467370 - DNA, 20 bp, Artificial
  CRISPR gRNA sequence
tggcttatttcattagttta

SEQ ID NO: 467371 - DNA, 20 bp, Artificial
  CRISPR gRNA sequence
gcttatttcattagtttata

SEQ ID NO: 467372 - DNA, 20 bp, Artificial
  CRISPR gRNA sequence
cttatttcattagtttatag

SEQ ID NO: 467373 - DNA, 20 bp, Artificial
  CRISPR gRNA sequence
ttatttcattagtttataga

SEQ ID NO: 467374 - DNA, 20 bp, Artificial
  CRISPR gRNA sequence
cattagtttatagagggttt

SEQ ID NO: 467375 - DNA, 20 bp, Artificial
  CRISPR gRNA sequence
tttatagagggtttgagaaa

SEQ ID NO: 467376 - DNA, 20 bp, Artificial
  CRISPR gRNA sequence
ggtttgagaaaaagaatatg

SEQ ID NO: 467377 - DNA, 20 bp, Artificial
  CRISPR gRNA sequence
agaatatgtagataatttaa

SEQ ID NO: 467378 - DNA, 20 bp, Artificial
  CRISPR gRNA sequence
aatggtttttcacaaatttt

SEQ ID NO: 467379 - DNA, 20 bp, Artificial
  CRISPR gRNA sequence
agcttgtgattgtgctcaat

SEQ ID NO: 467380 - DNA, 20 bp, Artificial
  CRISPR gRNA sequence
ttgtgattgtgctcaatgag

SEQ ID NO: 467381 - DNA, 20 bp, Artificial
  CRISPR gRNA sequence
tgtgattgtgctcaatgaga

SEQ ID NO: 467382 - DNA, 20 bp, Artificial
  CRISPR gRNA sequence
ttgtgctcaatgagaaggta

SEQ ID NO: 467383 - DNA, 20 bp, Artificial
  CRISPR gRNA sequence
aaacttatttgaaatcaatt

SEQ ID NO: 467384 - DNA, 20 bp, Artificial
  CRISPR gRNA sequence
attttgtaccccaaaatgtg

SEQ ID NO: 467385 - DNA, 20 bp, Artificial
  CRISPR gRNA sequence
ccaaaatgtgtggacatgaa

SEQ ID NO: 467386 - DNA, 20 bp, Artificial
  CRISPR gRNA sequence
ttaaaccccctgacacataa

SEQ ID NO: 467387 - DNA, 20 bp, Artificial
  CRISPR gRNA sequence
cgggtcgcttttatgtgtca

SEQ ID NO: 467388 - DNA, 20 bp, Artificial
  CRISPR gRNA sequence
ttttatgtgtcagggggttt

SEQ ID NO: 467389 - DNA, 20 bp, Artificial
  CRISPR gRNA sequence
ctattcatgtccacacattt

SEQ ID NO: 467390 - DNA, 20 bp, Artificial
  CRISPR gRNA sequence
ccatgtaaataatagtgaag

SEQ ID NO: 467391 - DNA, 20 bp, Artificial
  CRISPR gRNA sequence
tctctgacaccattttgaaa

SEQ ID NO: 467392 - DNA, 20 bp, Artificial
  CRISPR gRNA sequence
tctttactataagacatact

SEQ ID NO: 467393 - DNA, 20 bp, Artificial
  CRISPR gRNA sequence
tattttgcttttaagtttga

SEQ ID NO: 467394 - DNA, 20 bp, Artificial
  CRISPR gRNA sequence
tatttcctgtttctattttt

SEQ ID NO: 467395 - DNA, 20 bp, Artificial
  CRISPR gRNA sequence
cctggctaaaacagcctatc

SEQ ID NO: 467396 - DNA, 20 bp, Artificial
  CRISPR gRNA sequence
gcaaaataacagtgactcaa

SEQ ID NO: 467397 - DNA, 20 bp, Artificial
  CRISPR gRNA sequence
cagctcacatatttgttgaa

SEQ ID NO: 467398 - DNA, 20 bp, Artificial
  CRISPR gRNA sequence
attattcagtagcagcacct

SEQ ID NO: 467399 - DNA, 20 bp, Artificial
  CRISPR gRNA sequence
cagtagcagcacctgagaat

SEQ ID NO: 467400 - DNA, 20 bp, Artificial
  CRISPR gRNA sequence
attcgaatagcctcaaactg

SEQ ID NO: 467401 - DNA, 20 bp, Artificial
  CRISPR gRNA sequence
actttggaaagtccaaaaat

SEQ ID NO: 467402 - DNA, 20 bp, Artificial
  CRISPR gRNA sequence
aacagcaagatgcagatgtg

SEQ ID NO: 467403 - DNA, 20 bp, Artificial
  CRISPR gRNA sequence
ctacagaccaattaaatatt

SEQ ID NO: 467404 - DNA, 20 bp, Artificial
  CRISPR gRNA sequence
ccattagtctatgtgaccca

SEQ ID NO: 467405 - DNA, 20 bp, Artificial
  CRISPR gRNA sequence
atatttgcttatcaatctaa

SEQ ID NO: 467406 - DNA, 20 bp, Artificial
  CRISPR gRNA sequence
aattgggacattttgttttc

SEQ ID NO: 467407 - DNA, 20 bp, Artificial
  CRISPR gRNA sequence
caatagcttcaaaggcaaga

SEQ ID NO: 467408 - DNA, 20 bp, Artificial
  CRISPR gRNA sequence
ggcaagatcgagtttgtata

SEQ ID NO: 467409 - DNA, 20 bp, Artificial
  CRISPR gRNA sequence
gatcattcaatggtccctgt

SEQ ID NO: 467410 - DNA, 20 bp, Artificial
  CRISPR gRNA sequence
agacttaactcctcacacat

SEQ ID NO: 467411 - DNA, 20 bp, Artificial
  CRISPR gRNA sequence
ttttacatttcttgccagtc

SEQ ID NO: 467412 - DNA, 20 bp, Artificial
  CRISPR gRNA sequence
tcttgagttcggtccaatga

SEQ ID NO: 467413 - DNA, 20 bp, Artificial
  CRISPR gRNA sequence
tggtttgttttcttccaggc

SEQ ID NO: 467414 - DNA, 20 bp, Artificial
  CRISPR gRNA sequence
gttttcttccaggcatggat

SEQ ID NO: 467415 - DNA, 20 bp, Artificial
  CRISPR gRNA sequence
ctgcatcctgaaacaaaggt

SEQ ID NO: 467416 - DNA, 20 bp, Artificial
  CRISPR gRNA sequence
agtttctgatagcagtactt

SEQ ID NO: 467417 - DNA, 20 bp, Artificial
  CRISPR gRNA sequence
tgcatattcattagcaaact

SEQ ID NO: 467418 - DNA, 20 bp, Artificial
  CRISPR gRNA sequence
ctatgaatgaaaagcttaaa

SEQ ID NO: 467419 - DNA, 20 bp, Artificial
  CRISPR gRNA sequence
cagctaaatttcaattatta

SEQ ID NO: 467420 - DNA, 20 bp, Artificial
  CRISPR gRNA sequence
tattaaaggatgaaaggctt

SEQ ID NO: 467421 - DNA, 20 bp, Artificial
  CRISPR gRNA sequence
ttcaggcagtttataacatg

SEQ ID NO: 467422 - DNA, 20 bp, Artificial
  CRISPR gRNA sequence
gaatagtatttaatgcagtt

SEQ ID NO: 467423 - DNA, 20 bp, Artificial
  CRISPR gRNA sequence
cagtttagaataaaaagatt

SEQ ID NO: 467424 - DNA, 20 bp, Artificial
  CRISPR gRNA sequence
gggcagaaacaataaatatt

SEQ ID NO: 467425 - DNA, 20 bp, Artificial
  CRISPR gRNA sequence
ttttttttttttttttgaga

SEQ ID NO: 467426 - DNA, 20 bp, Artificial
  CRISPR gRNA sequence
gtcttgcctatagcccaggc

SEQ ID NO: 467427 - DNA, 20 bp, Artificial
  CRISPR gRNA sequence
cattctcctgcctcagcctc

SEQ ID NO: 467428 - DNA, 20 bp, Artificial
  CRISPR gRNA sequence
ttttgtatttttagtagaga

SEQ ID NO: 467429 - DNA, 20 bp, Artificial
  CRISPR gRNA sequence
cggggtttcaccattttagc

SEQ ID NO: 467430 - DNA, 20 bp, Artificial
  CRISPR gRNA sequence
gcctcggcctcccaaagtgc

SEQ ID NO: 467431 - DNA, 20 bp, Artificial
  CRISPR gRNA sequence
ttagagcttctaagaaagag

SEQ ID NO: 467432 - DNA, 20 bp, Artificial
  CRISPR gRNA sequence
cctcattgtgatgtgtgcag

SEQ ID NO: 467433 - DNA, 20 bp, Artificial
  CRISPR gRNA sequence
tttaccctgagaagctatgt

SEQ ID NO: 467434 - DNA, 20 bp, Artificial
  CRISPR gRNA sequence
aatctgtttaagcctgtcaa

SEQ ID NO: 467435 - DNA, 20 bp, Artificial
  CRISPR gRNA sequence
ccatgaaaaattttgttaaa

SEQ ID NO: 467436 - DNA, 20 bp, Artificial
  CRISPR gRNA sequence
gtggcaccccgtcaaagtgg

SEQ ID NO: 467437 - DNA, 20 bp, Artificial
  CRISPR gRNA sequence
ggccaatgcaccacaatgtg

SEQ ID NO: 467438 - DNA, 20 bp, Artificial
  CRISPR gRNA sequence
tataccctcaaaggaccgtt

SEQ ID NO: 467439 - DNA, 20 bp, Artificial
  CRISPR gRNA sequence
gttaagaaatatttagcccc

SEQ ID NO: 467440 - DNA, 20 bp, Artificial
  CRISPR gRNA sequence
cacatacagaaaataccctt

SEQ ID NO: 467441 - DNA, 20 bp, Artificial
  CRISPR gRNA sequence
atgtccacagcttaaccaac

SEQ ID NO: 467442 - DNA, 20 bp, Artificial
  CRISPR gRNA sequence
cttaatagaagtttgtcaag

SEQ ID NO: 467443 - DNA, 20 bp, Artificial
  CRISPR gRNA sequence
taaaattaagcagcttggtg

SEQ ID NO: 467444 - DNA, 20 bp, Artificial
  CRISPR gRNA sequence
aagcagcttggtggggaatg

SEQ ID NO: 467445 - DNA, 20 bp, Artificial
  CRISPR gRNA sequence
atgccatttaatattatata

SEQ ID NO: 467446 - DNA, 20 bp, Artificial
  CRISPR gRNA sequence
tgtatcgattttgtcttttg

SEQ ID NO: 467447 - DNA, 20 bp, Artificial
  CRISPR gRNA sequence
gtcttttgtggaatttttaa

SEQ ID NO: 467448 - DNA, 20 bp, Artificial
  CRISPR gRNA sequence
tagttttaattagagagctt

SEQ ID NO: 467449 - DNA, 20 bp, Artificial
  CRISPR gRNA sequence
caaaattcccttcctttagt

SEQ ID NO: 467450 - DNA, 20 bp, Artificial
  CRISPR gRNA sequence
atcattttatgaggttattt

SEQ ID NO: 467451 - DNA, 20 bp, Artificial
  CRISPR gRNA sequence
ggtgtttacataaaaaataa

SEQ ID NO: 467452 - DNA, 20 bp, Artificial
  CRISPR gRNA sequence
agccacataacaggcaagag

SEQ ID NO: 467453 - DNA, 20 bp, Artificial
  CRISPR gRNA sequence
cagtctctgacttttctgtc

SEQ ID NO: 467454 - DNA, 20 bp, Artificial
  CRISPR gRNA sequence
tacgagacttgttaacccta

SEQ ID NO: 467455 - DNA, 20 bp, Artificial
  CRISPR gRNA sequence
agtctttgctgcatagagag

SEQ ID NO: 467456 - DNA, 20 bp, Artificial
  CRISPR gRNA sequence
caaaattcacatttttaaaa

SEQ ID NO: 467457 - DNA, 20 bp, Artificial
  CRISPR gRNA sequence
atatatatatatatagtaca

SEQ ID NO: 467458 - DNA, 20 bp, Artificial
  CRISPR gRNA sequence
catggtgttatataaattca

SEQ ID NO: 467459 - DNA, 20 bp, Artificial
  CRISPR gRNA sequence
tttcccttcctgctgtgtca

SEQ ID NO: 467460 - DNA, 20 bp, Artificial
  CRISPR gRNA sequence
aagaaaaagaagtaatcaaa

SEQ ID NO: 467461 - DNA, 20 bp, Artificial
  CRISPR gRNA sequence
tgccacccatgcttatcctg

SEQ ID NO: 467462 - DNA, 20 bp, Artificial
  CRISPR gRNA sequence
tgcttatcctgttgaatgcc

SEQ ID NO: 467463 - DNA, 20 bp, Artificial
  CRISPR gRNA sequence
gcatatctaaaaggaagggg

SEQ ID NO: 467464 - DNA, 20 bp, Artificial
  CRISPR gRNA sequence
ctcctactacctagttcact

SEQ ID NO: 467465 - DNA, 20 bp, Artificial
  CRISPR gRNA sequence
agaggccatagaaagagcca

SEQ ID NO: 467466 - DNA, 20 bp, Artificial
  CRISPR gRNA sequence
gagccatggagttgcagatg

SEQ ID NO: 467467 - DNA, 20 bp, Artificial
  CRISPR gRNA sequence
tggagttgcagatgaagaat

SEQ ID NO: 467468 - DNA, 20 bp, Artificial
  CRISPR gRNA sequence
gatgaagaattggggtaaga

SEQ ID NO: 467469 - DNA, 20 bp, Artificial
  CRISPR gRNA sequence
tggggtaagagagaattctt

SEQ ID NO: 467470 - DNA, 20 bp, Artificial
  CRISPR gRNA sequence
aaggttattcctgtgtcaca

SEQ ID NO: 467471 - DNA, 20 bp, Artificial
  CRISPR gRNA sequence
gtagctggtgttgtgaaaac

SEQ ID NO: 467472 - DNA, 20 bp, Artificial
  CRISPR gRNA sequence
ttgtgaaaacaggaatgtga

SEQ ID NO: 467473 - DNA, 20 bp, Artificial
  CRISPR gRNA sequence
agttcaggccaaagctagat

SEQ ID NO: 467474 - DNA, 20 bp, Artificial
  CRISPR gRNA sequence
atatttggtcatgacattga

SEQ ID NO: 467475 - DNA, 20 bp, Artificial
  CRISPR gRNA sequence
gagttcttgcaaaagtagaa

SEQ ID NO: 467476 - DNA, 20 bp, Artificial
  CRISPR gRNA sequence
atttttcatatgcattattg

SEQ ID NO: 467477 - DNA, 20 bp, Artificial
  CRISPR gRNA sequence
catatgcattattgttgggt

SEQ ID NO: 467478 - DNA, 20 bp, Artificial
  CRISPR gRNA sequence
cattggttcttcagttacat

SEQ ID NO: 467479 - DNA, 20 bp, Artificial
  CRISPR gRNA sequence
cagttacataagggtgtgtg

SEQ ID NO: 467480 - DNA, 20 bp, Artificial
  CRISPR gRNA sequence
atgtggtgtggctgtgaaaa

SEQ ID NO: 467481 - DNA, 20 bp, Artificial
  CRISPR gRNA sequence
aaacctaagattgatgcaaa

SEQ ID NO: 467482 - DNA, 20 bp, Artificial
  CRISPR gRNA sequence
atgctcgccacaactctagc

SEQ ID NO: 467483 - DNA, 20 bp, Artificial
  CRISPR gRNA sequence
tttagctttttagcgcaaat

SEQ ID NO: 467484 - DNA, 20 bp, Artificial
  CRISPR gRNA sequence
aaatcattatccatggttta

SEQ ID NO: 467485 - DNA, 20 bp, Artificial
  CRISPR gRNA sequence
aatcctttagccccagaaat

SEQ ID NO: 467486 - DNA, 20 bp, Artificial
  CRISPR gRNA sequence
acaggcagaaacaggtagtg

SEQ ID NO: 467487 - DNA, 20 bp, Artificial
  CRISPR gRNA sequence
gaagtaaacgatacaggagc

SEQ ID NO: 467488 - DNA, 20 bp, Artificial
  CRISPR gRNA sequence
tgcttgccatttcgtccttg

SEQ ID NO: 467489 - DNA, 20 bp, Artificial
  CRISPR gRNA sequence
tctgaggcactttttacatc

SEQ ID NO: 467490 - DNA, 20 bp, Artificial
  CRISPR gRNA sequence
gaatgttagtaaatgctaaa

SEQ ID NO: 467491 - DNA, 20 bp, Artificial
  CRISPR gRNA sequence
ttaggaaatctgagatatat

SEQ ID NO: 467492 - DNA, 20 bp, Artificial
  CRISPR gRNA sequence
cccctctgcattgtcagaac

SEQ ID NO: 467493 - DNA, 20 bp, Artificial
  CRISPR gRNA sequence
ccccttcagaggcattcctc

SEQ ID NO: 467494 - DNA, 20 bp, Artificial
  CRISPR gRNA sequence
gcagaaattctttattctga

SEQ ID NO: 467495 - DNA, 20 bp, Artificial
  CRISPR gRNA sequence
cattgtctttattttgtccc

SEQ ID NO: 467496 - DNA, 20 bp, Artificial
  CRISPR gRNA sequence
tgctccaagtcagatagcta

SEQ ID NO: 467497 - DNA, 20 bp, Artificial
  CRISPR gRNA sequence
ttccttgtctcgtaacttat

SEQ ID NO: 467498 - DNA, 20 bp, Artificial
  CRISPR gRNA sequence
ttttaaaaaatgaaacagaa

SEQ ID NO: 467499 - DNA, 20 bp, Artificial
  CRISPR gRNA sequence
cagaagaggatagaaatcat

SEQ ID NO: 467500 - DNA, 20 bp, Artificial
  CRISPR gRNA sequence
gggagggaggctggcaacca

SEQ ID NO: 467501 - DNA, 20 bp, Artificial
  CRISPR gRNA sequence
gcaaccagtgagtagaagcc

SEQ ID NO: 467502 - DNA, 20 bp, Artificial
  CRISPR gRNA sequence
gctaaacaccctacactata

SEQ ID NO: 467503 - DNA, 20 bp, Artificial
  CRISPR gRNA sequence
tttttatatttgtgtgcatt

SEQ ID NO: 467504 - DNA, 20 bp, Artificial
  CRISPR gRNA sequence
tgttgttgttttttttaatt

SEQ ID NO: 467505 - DNA, 20 bp, Artificial
  CRISPR gRNA sequence
taacacagtatgaaaaatac

SEQ ID NO: 467506 - DNA, 20 bp, Artificial
  CRISPR gRNA sequence
actttgggaggccgaggtag

SEQ ID NO: 467507 - DNA, 20 bp, Artificial
  CRISPR gRNA sequence
taggcggatcacttgagatc

SEQ ID NO: 467508 - DNA, 20 bp, Artificial
  CRISPR gRNA sequence
tacatgggaggctgagacag

SEQ ID NO: 467509 - DNA, 20 bp, Artificial
  CRISPR gRNA sequence
atggtaccactgcactcagc

SEQ ID NO: 467510 - DNA, 20 bp, Artificial
  CRISPR gRNA sequence
actgcactcagcctgggtga

SEQ ID NO: 467511 - DNA, 20 bp, Artificial
  CRISPR gRNA sequence
tttggctagatgcttaggtt

SEQ ID NO: 467512 - DNA, 20 bp, Artificial
  CRISPR gRNA sequence
caaaaagtggtttggttatt

SEQ ID NO: 467513 - DNA, 20 bp, Artificial
  CRISPR gRNA sequence
cgagcagccaaaccactgcc

SEQ ID NO: 467514 - DNA, 20 bp, Artificial
  CRISPR gRNA sequence
ccagaaacagctgcctgggg

SEQ ID NO: 467515 - DNA, 20 bp, Artificial
  CRISPR gRNA sequence
cagctgcctgggggagggtc

SEQ ID NO: 467516 - DNA, 20 bp, Artificial
  CRISPR gRNA sequence
ccctaatacaaacagatctg

SEQ ID NO: 467517 - DNA, 20 bp, Artificial
  CRISPR gRNA sequence
aaaactccccctaacttatt

SEQ ID NO: 467518 - DNA, 20 bp, Artificial
  CRISPR gRNA sequence
aaattgattgagaaaatgat

SEQ ID NO: 467519 - DNA, 20 bp, Artificial
  CRISPR gRNA sequence
aaaccagagctagccttggg

SEQ ID NO: 467520 - DNA, 20 bp, Artificial
  CRISPR gRNA sequence
ccagtgtttgcacactacca

SEQ ID NO: 467521 - DNA, 20 bp, Artificial
  CRISPR gRNA sequence
acaatgatatctctggcacc

SEQ ID NO: 467522 - DNA, 20 bp, Artificial
  CRISPR gRNA sequence
attcagcaggtgctccaaat

SEQ ID NO: 467523 - DNA, 20 bp, Artificial
  CRISPR gRNA sequence
ttttttttttttttttgaga

SEQ ID NO: 467524 - DNA, 20 bp, Artificial
  CRISPR gRNA sequence
tctcgctctatcacccaggc

SEQ ID NO: 467525 - DNA, 20 bp, Artificial
  CRISPR gRNA sequence
ttcactgcagcctccacctc

SEQ ID NO: 467526 - DNA, 20 bp, Artificial
  CRISPR gRNA sequence
gattctcctgcttcagcctc

SEQ ID NO: 467527 - DNA, 20 bp, Artificial
  CRISPR gRNA sequence
gcttcagcctcctgagtagt

SEQ ID NO: 467528 - DNA, 20 bp, Artificial
  CRISPR gRNA sequence
ttttgtatttttagtagaga

SEQ ID NO: 467529 - DNA, 20 bp, Artificial
  CRISPR gRNA sequence
gtcttggcctcccaaagtgc

SEQ ID NO: 467530 - DNA, 20 bp, Artificial
  CRISPR gRNA sequence
ctgaccaagggaagtttggg

SEQ ID NO: 467531 - DNA, 20 bp, Artificial
  CRISPR gRNA sequence
aagggtgaagtggcaggcca

SEQ ID NO: 467532 - DNA, 20 bp, Artificial
  CRISPR gRNA sequence
ggtgcttttcttcattctgg

SEQ ID NO: 467533 - DNA, 20 bp, Artificial
  CRISPR gRNA sequence
ctttcaggttcagaaggaaa

SEQ ID NO: 467534 - DNA, 20 bp, Artificial
  CRISPR gRNA sequence
aaattagttttaaatccaca

SEQ ID NO: 467535 - DNA, 20 bp, Artificial
  CRISPR gRNA sequence
tggcataaaaattggtaaaa

SEQ ID NO: 467536 - DNA, 20 bp, Artificial
  CRISPR gRNA sequence
aattagctgagattgaaagg

SEQ ID NO: 467537 - DNA, 20 bp, Artificial
  CRISPR gRNA sequence
gctgagattgaaaggagggg

SEQ ID NO: 467538 - DNA, 20 bp, Artificial
  CRISPR gRNA sequence
atttccataggtggagacag

SEQ ID NO: 467539 - DNA, 20 bp, Artificial
  CRISPR gRNA sequence
ccataggtggagacagatga

SEQ ID NO: 467540 - DNA, 20 bp, Artificial
  CRISPR gRNA sequence
tgcaattgagaggctgtata

SEQ ID NO: 467541 - DNA, 20 bp, Artificial
  CRISPR gRNA sequence
gaaacaatctagaaaggtgg

SEQ ID NO: 467542 - DNA, 20 bp, Artificial
  CRISPR gRNA sequence
ggatcaaactgtggaagact

SEQ ID NO: 467543 - DNA, 20 bp, Artificial
  CRISPR gRNA sequence
agcccaatattgtgaccact

SEQ ID NO: 467544 - DNA, 20 bp, Artificial
  CRISPR gRNA sequence
ccactggggatgctatgcaa

SEQ ID NO: 467545 - DNA, 20 bp, Artificial
  CRISPR gRNA sequence
atggggaaatactaaagaca

SEQ ID NO: 467546 - DNA, 20 bp, Artificial
  CRISPR gRNA sequence
aaagacaaagagtccaatca

SEQ ID NO: 467547 - DNA, 20 bp, Artificial
  CRISPR gRNA sequence
agtccaatcatagaattaat

SEQ ID NO: 467548 - DNA, 20 bp, Artificial
  CRISPR gRNA sequence
caattggaggaaacacatca

SEQ ID NO: 467549 - DNA, 20 bp, Artificial
  CRISPR gRNA sequence
ggaggaaacacatcacagag

SEQ ID NO: 467550 - DNA, 20 bp, Artificial
  CRISPR gRNA sequence
gtggaatgttgtggagagac

SEQ ID NO: 467551 - DNA, 20 bp, Artificial
  CRISPR gRNA sequence
ggaagccaaagaaaattctc

SEQ ID NO: 467552 - DNA, 20 bp, Artificial
  CRISPR gRNA sequence
aattctctgggattttccat

SEQ ID NO: 467553 - DNA, 20 bp, Artificial
  CRISPR gRNA sequence
attaacaaactgataaggaa

SEQ ID NO: 467554 - DNA, 20 bp, Artificial
  CRISPR gRNA sequence
ataaggaagggagtgatagg

SEQ ID NO: 467555 - DNA, 20 bp, Artificial
  CRISPR gRNA sequence
gggagtgataggaaggatag

SEQ ID NO: 467556 - DNA, 20 bp, Artificial
  CRISPR gRNA sequence
ataggtgagtaggaaactaa

SEQ ID NO: 467557 - DNA, 20 bp, Artificial
  CRISPR gRNA sequence
ccataaaaccccccaaggca

SEQ ID NO: 467558 - DNA, 20 bp, Artificial
  CRISPR gRNA sequence
ccaaggcacaggatttagga

SEQ ID NO: 467559 - DNA, 20 bp, Artificial
  CRISPR gRNA sequence
ttattccctttcccctaaag

SEQ ID NO: 467560 - DNA, 20 bp, Artificial
  CRISPR gRNA sequence
acagattatctttagtcatc

SEQ ID NO: 467561 - DNA, 20 bp, Artificial
  CRISPR gRNA sequence
catcatgaatgacccaaata

SEQ ID NO: 467562 - DNA, 20 bp, Artificial
  CRISPR gRNA sequence
ttagttcccataaagaaaga

SEQ ID NO: 467563 - DNA, 20 bp, Artificial
  CRISPR gRNA sequence
ttcaatagtatatatcattc

SEQ ID NO: 467564 - DNA, 20 bp, Artificial
  CRISPR gRNA sequence
caatattttgtctcattaat

SEQ ID NO: 467565 - DNA, 20 bp, Artificial
  CRISPR gRNA sequence
agaggtttataagccagtgc

SEQ ID NO: 467566 - DNA, 20 bp, Artificial
  CRISPR gRNA sequence
tcacgctatatttgcaaaag

SEQ ID NO: 467567 - DNA, 20 bp, Artificial
  CRISPR gRNA sequence
ttcttctatatttcataatt

SEQ ID NO: 467568 - DNA, 20 bp, Artificial
  CRISPR gRNA sequence
actaacctaaagcattttaa

SEQ ID NO: 467569 - DNA, 20 bp, Artificial
  CRISPR gRNA sequence
agcattttaaaagaatttca

SEQ ID NO: 467570 - DNA, 20 bp, Artificial
  CRISPR gRNA sequence
ccttcactgggctactttaa

SEQ ID NO: 467571 - DNA, 20 bp, Artificial
  CRISPR gRNA sequence
tgtaaaatgtatgcattcaa

SEQ ID NO: 467572 - DNA, 20 bp, Artificial
  CRISPR gRNA sequence
aaactgtacgaggttgcatc

SEQ ID NO: 467573 - DNA, 20 bp, Artificial
  CRISPR gRNA sequence
ttctccttcccagtaacttt

SEQ ID NO: 467574 - DNA, 20 bp, Artificial
  CRISPR gRNA sequence
ccaagctactttctgtctct

SEQ ID NO: 467575 - DNA, 20 bp, Artificial
  CRISPR gRNA sequence
tctctatggatttgcctatt

SEQ ID NO: 467576 - DNA, 20 bp, Artificial
  CRISPR gRNA sequence
ttttggatatttcatataat

SEQ ID NO: 467577 - DNA, 20 bp, Artificial
  CRISPR gRNA sequence
tacttcattccttttcatga

SEQ ID NO: 467578 - DNA, 20 bp, Artificial
  CRISPR gRNA sequence
gactgaataatattccgtgt

SEQ ID NO: 467579 - DNA, 20 bp, Artificial
  CRISPR gRNA sequence
gtttctaccttttggctatt

SEQ ID NO: 467580 - DNA, 20 bp, Artificial
  CRISPR gRNA sequence
aacatatattttaatttcat

SEQ ID NO: 467581 - DNA, 20 bp, Artificial
  CRISPR gRNA sequence
tttcatttgagtatttacct

SEQ ID NO: 467582 - DNA, 20 bp, Artificial
  CRISPR gRNA sequence
tttgagtatttacctaggaa

SEQ ID NO: 467583 - DNA, 20 bp, Artificial
  CRISPR gRNA sequence
tttacctaggaatagaatta

SEQ ID NO: 467584 - DNA, 20 bp, Artificial
  CRISPR gRNA sequence
attttacattctcctcagca

SEQ ID NO: 467585 - DNA, 20 bp, Artificial
  CRISPR gRNA sequence
acattctcctcagcaatgga

SEQ ID NO: 467586 - DNA, 20 bp, Artificial
  CRISPR gRNA sequence
ttttttattctagtcattcg

SEQ ID NO: 467587 - DNA, 20 bp, Artificial
  CRISPR gRNA sequence
agtcattcgatgggtgtgaa

SEQ ID NO: 467588 - DNA, 20 bp, Artificial
  CRISPR gRNA sequence
ggttgccagtctatttgttg

SEQ ID NO: 467589 - DNA, 20 bp, Artificial
  CRISPR gRNA sequence
tatgttttctcctaagaaat

SEQ ID NO: 467590 - DNA, 20 bp, Artificial
  CRISPR gRNA sequence
tattttgattgcttaaaata

SEQ ID NO: 467591 - DNA, 20 bp, Artificial
  CRISPR gRNA sequence
cttaaaatatggagtgagat

SEQ ID NO: 467592 - DNA, 20 bp, Artificial
  CRISPR gRNA sequence
tcaaattaattcttttacat

SEQ ID NO: 467593 - DNA, 20 bp, Artificial
  CRISPR gRNA sequence
ttgagactattctttcccca

SEQ ID NO: 467594 - DNA, 20 bp, Artificial
  CRISPR gRNA sequence
ttatcaaaaatcaattgact

SEQ ID NO: 467595 - DNA, 20 bp, Artificial
  CRISPR gRNA sequence
atcaattgactacggatgta

SEQ ID NO: 467596 - DNA, 20 bp, Artificial
  CRISPR gRNA sequence
tcaagattgttttggcaatt

SEQ ID NO: 467597 - DNA, 20 bp, Artificial
  CRISPR gRNA sequence
tgggtctgttgcaactcaat

SEQ ID NO: 467598 - DNA, 20 bp, Artificial
  CRISPR gRNA sequence
ttgcaactcaatgtgaattt

SEQ ID NO: 467599 - DNA, 20 bp, Artificial
  CRISPR gRNA sequence
caatagcaacaaaaagctgt

SEQ ID NO: 467600 - DNA, 20 bp, Artificial
  CRISPR gRNA sequence
aggattttagtggaactgca

SEQ ID NO: 467601 - DNA, 20 bp, Artificial
  CRISPR gRNA sequence
tgaatctgtagatcaccttg

SEQ ID NO: 467602 - DNA, 20 bp, Artificial
  CRISPR gRNA sequence
aatattacatctttcagtcc

SEQ ID NO: 467603 - DNA, 20 bp, Artificial
  CRISPR gRNA sequence
catctttcagtccatgaata

SEQ ID NO: 467604 - DNA, 20 bp, Artificial
  CRISPR gRNA sequence
ttgcatttatttacatattc

SEQ ID NO: 467605 - DNA, 20 bp, Artificial
  CRISPR gRNA sequence
ctgtttccttaattttcttt

SEQ ID NO: 467606 - DNA, 20 bp, Artificial
  CRISPR gRNA sequence
tgtgttgatcctgtatcatg

SEQ ID NO: 467607 - DNA, 20 bp, Artificial
  CRISPR gRNA sequence
atagttttaaacaaattttt

SEQ ID NO: 467608 - DNA, 20 bp, Artificial
  CRISPR gRNA sequence
cacataagttcatgccatct

SEQ ID NO: 467609 - DNA, 20 bp, Artificial
  CRISPR gRNA sequence
tcttgcctgtttgctctggc

SEQ ID NO: 467610 - DNA, 20 bp, Artificial
  CRISPR gRNA sequence
taaatggaaatggcaaaagc

SEQ ID NO: 467611 - DNA, 20 bp, Artificial
  CRISPR gRNA sequence
aagctctaagcctttcacca

SEQ ID NO: 467612 - DNA, 20 bp, Artificial
  CRISPR gRNA sequence
cagggaagagagatgaagct

SEQ ID NO: 467613 - DNA, 20 bp, Artificial
  CRISPR gRNA sequence
gcagatttcagatgtgctat

SEQ ID NO: 467614 - DNA, 20 bp, Artificial
  CRISPR gRNA sequence
gagaactcacctgtcacata

SEQ ID NO: 467615 - DNA, 20 bp, Artificial
  CRISPR gRNA sequence
acctgtcacataaagagttg

SEQ ID NO: 467616 - DNA, 20 bp, Artificial
  CRISPR gRNA sequence
ggaagcactggttcaaaatg

SEQ ID NO: 467617 - DNA, 20 bp, Artificial
  CRISPR gRNA sequence
cacagggcattctagttcaa

SEQ ID NO: 467618 - DNA, 20 bp, Artificial
  CRISPR gRNA sequence
aaagggatctcctgctaaga

SEQ ID NO: 467619 - DNA, 20 bp, Artificial
  CRISPR gRNA sequence
tagtaattaagccttactag

SEQ ID NO: 467620 - DNA, 20 bp, Artificial
  CRISPR gRNA sequence
ttgtaattctccccaccctt

SEQ ID NO: 467621 - DNA, 20 bp, Artificial
  CRISPR gRNA sequence
tctgttttctgctagtataa

SEQ ID NO: 467622 - DNA, 20 bp, Artificial
  CRISPR gRNA sequence
gtataacagaatacctgaga

SEQ ID NO: 467623 - DNA, 20 bp, Artificial
  CRISPR gRNA sequence
tacctgagattggataattt

SEQ ID NO: 467624 - DNA, 20 bp, Artificial
  CRISPR gRNA sequence
aggtgcctactcccgtgata

SEQ ID NO: 467625 - DNA, 20 bp, Artificial
  CRISPR gRNA sequence
aatagcaataaaatttcaac

SEQ ID NO: 467626 - DNA, 20 bp, Artificial
  CRISPR gRNA sequence
ccaaaagttttaatttattg

SEQ ID NO: 467627 - DNA, 20 bp, Artificial
  CRISPR gRNA sequence
tcaattcaaaacactaaatt

SEQ ID NO: 467628 - DNA, 20 bp, Artificial
  CRISPR gRNA sequence
gagtcttatctaaaccagat

SEQ ID NO: 467629 - DNA, 20 bp, Artificial
  CRISPR gRNA sequence
ggctaatagctccacagttc

SEQ ID NO: 467630 - DNA, 20 bp, Artificial
  CRISPR gRNA sequence
gctctactaggcactgacat

SEQ ID NO: 467631 - DNA, 20 bp, Artificial
  CRISPR gRNA sequence
ctagcctgcacacttagcaa

SEQ ID NO: 467632 - DNA, 20 bp, Artificial
  CRISPR gRNA sequence
ggcttaccaattgcacctta

SEQ ID NO: 467633 - DNA, 20 bp, Artificial
  CRISPR gRNA sequence
caattgcaccttatggagtg

SEQ ID NO: 467634 - DNA, 20 bp, Artificial
  CRISPR gRNA sequence
gcagctaaggagcactgtgc

SEQ ID NO: 467635 - DNA, 20 bp, Artificial
  CRISPR gRNA sequence
agggcctttttctcaacttc

SEQ ID NO: 467636 - DNA, 20 bp, Artificial
  CRISPR gRNA sequence
actttttatatggctaggca

SEQ ID NO: 467637 - DNA, 20 bp, Artificial
  CRISPR gRNA sequence
tatttcttccaccagatatc

SEQ ID NO: 467638 - DNA, 20 bp, Artificial
  CRISPR gRNA sequence
gttcttagcaactgtatgac

SEQ ID NO: 467639 - DNA, 20 bp, Artificial
  CRISPR gRNA sequence
actcattttcatgcattctt

SEQ ID NO: 467640 - DNA, 20 bp, Artificial
  CRISPR gRNA sequence
agatgtacagtatcatacat

SEQ ID NO: 467641 - DNA, 20 bp, Artificial
  CRISPR gRNA sequence
ccaaggagcaaattttgacc

SEQ ID NO: 467642 - DNA, 20 bp, Artificial
  CRISPR gRNA sequence
acccttcctgctcacatctc

SEQ ID NO: 467643 - DNA, 20 bp, Artificial
  CRISPR gRNA sequence
acatctcatgaatctctgct

SEQ ID NO: 467644 - DNA, 20 bp, Artificial
  CRISPR gRNA sequence
tcagaataatagaaacctga

SEQ ID NO: 467645 - DNA, 20 bp, Artificial
  CRISPR gRNA sequence
agaaacctgattgagtttcc

SEQ ID NO: 467646 - DNA, 20 bp, Artificial
  CRISPR gRNA sequence
ctgattgagtttccaggaat

SEQ ID NO: 467647 - DNA, 20 bp, Artificial
  CRISPR gRNA sequence
caaactgaaaggtaagttat

SEQ ID NO: 467648 - DNA, 20 bp, Artificial
  CRISPR gRNA sequence
ttttcaaaaaaatgaagaga

SEQ ID NO: 467649 - DNA, 20 bp, Artificial
  CRISPR gRNA sequence
tttaccaaaaggaagtgtac

SEQ ID NO: 467650 - DNA, 20 bp, Artificial
  CRISPR gRNA sequence
taacttcccttttcattttc

SEQ ID NO: 467651 - DNA, 20 bp, Artificial
  CRISPR gRNA sequence
tggagcctctaagtctgtgc

SEQ ID NO: 467652 - DNA, 20 bp, Artificial
  CRISPR gRNA sequence
acaaagatcttttaccctca

SEQ ID NO: 467653 - DNA, 20 bp, Artificial
  CRISPR gRNA sequence
ccatttaattggtaagcccc

SEQ ID NO: 467654 - DNA, 20 bp, Artificial
  CRISPR gRNA sequence
tttttttttttttttgagac

SEQ ID NO: 467655 - DNA, 20 bp, Artificial
  CRISPR gRNA sequence
ttcactcttgttgcacaggc

SEQ ID NO: 467656 - DNA, 20 bp, Artificial
  CRISPR gRNA sequence
ctcaccgtaacctctgcctc

SEQ ID NO: 467657 - DNA, 20 bp, Artificial
  CRISPR gRNA sequence
gattctcctgcctcagcctc

SEQ ID NO: 467658 - DNA, 20 bp, Artificial
  CRISPR gRNA sequence
gcctcagcctcccgggtaac

SEQ ID NO: 467659 - DNA, 20 bp, Artificial
  CRISPR gRNA sequence
ttttgtatttttagtaaaga

SEQ ID NO: 467660 - DNA, 20 bp, Artificial
  CRISPR gRNA sequence
atctcggcctcccaaagtgc

SEQ ID NO: 467661 - DNA, 20 bp, Artificial
  CRISPR gRNA sequence
cttgagccaccacacctggc

SEQ ID NO: 467662 - DNA, 20 bp, Artificial
  CRISPR gRNA sequence
ttaccttctagacacttttc

SEQ ID NO: 467663 - DNA, 20 bp, Artificial
  CRISPR gRNA sequence
tgctggttgttaggaagcct

SEQ ID NO: 467664 - DNA, 20 bp, Artificial
  CRISPR gRNA sequence
aagcctaggaataaatcaga

SEQ ID NO: 467665 - DNA, 20 bp, Artificial
  CRISPR gRNA sequence
ccttctaatgggaaataaaa

SEQ ID NO: 467666 - DNA, 20 bp, Artificial
  CRISPR gRNA sequence
taaaaatgaatggcaattgg

SEQ ID NO: 467667 - DNA, 20 bp, Artificial
  CRISPR gRNA sequence
actttgggaggccgagggag

SEQ ID NO: 467668 - DNA, 20 bp, Artificial
  CRISPR gRNA sequence
gaggtggatcacctgaggtc

SEQ ID NO: 467669 - DNA, 20 bp, Artificial
  CRISPR gRNA sequence
tactcaagaggctgaggcag

SEQ ID NO: 467670 - DNA, 20 bp, Artificial
  CRISPR gRNA sequence
aaagatacaaacaactttgc

SEQ ID NO: 467671 - DNA, 20 bp, Artificial
  CRISPR gRNA sequence
tatacttgagctgaaccttg

SEQ ID NO: 467672 - DNA, 20 bp, Artificial
  CRISPR gRNA sequence
cttgagctgaaccttggtga

SEQ ID NO: 467673 - DNA, 20 bp, Artificial
  CRISPR gRNA sequence
tgggacagaggaggtatttt

SEQ ID NO: 467674 - DNA, 20 bp, Artificial
  CRISPR gRNA sequence
acggaaaagtcttagggacc

SEQ ID NO: 467675 - DNA, 20 bp, Artificial
  CRISPR gRNA sequence
tttagatcattgatacacaa

SEQ ID NO: 467676 - DNA, 20 bp, Artificial
  CRISPR gRNA sequence
actggttgtttcagaacaaa

SEQ ID NO: 467677 - DNA, 20 bp, Artificial
  CRISPR gRNA sequence
aaatggaataagcattaggc

SEQ ID NO: 467678 - DNA, 20 bp, Artificial
  CRISPR gRNA sequence
aatacaatgcctaattttgg

SEQ ID NO: 467679 - DNA, 20 bp, Artificial
  CRISPR gRNA sequence
ttcaaatgctaacacattga

SEQ ID NO: 467680 - DNA, 20 bp, Artificial
  CRISPR gRNA sequence
gtttcttcaaaataagatga

SEQ ID NO: 467681 - DNA, 20 bp, Artificial
  CRISPR gRNA sequence
gctccggagcagtgcgcaaa

SEQ ID NO: 467682 - DNA, 20 bp, Artificial
  CRISPR gRNA sequence
agcagtgcgcaaagtgggtt

SEQ ID NO: 467683 - DNA, 20 bp, Artificial
  CRISPR gRNA sequence
gtggcatcactgattcacaa

SEQ ID NO: 467684 - DNA, 20 bp, Artificial
  CRISPR gRNA sequence
ttcctaaatattcttatcag

SEQ ID NO: 467685 - DNA, 20 bp, Artificial
  CRISPR gRNA sequence
acaaccacactgactggcac

SEQ ID NO: 467686 - DNA, 20 bp, Artificial
  CRISPR gRNA sequence
gactggcacaggaatttttc

SEQ ID NO: 467687 - DNA, 20 bp, Artificial
  CRISPR gRNA sequence
caggaatttttcttgaatgg

SEQ ID NO: 467688 - DNA, 20 bp, Artificial
  CRISPR gRNA sequence
aatggaggaatgaaccgatg

SEQ ID NO: 467689 - DNA, 20 bp, Artificial
  CRISPR gRNA sequence
gcaagcaggcattagaaatc

SEQ ID NO: 467690 - DNA, 20 bp, Artificial
  CRISPR gRNA sequence
ctcgctcttgttgcccaggc

SEQ ID NO: 467691 - DNA, 20 bp, Artificial
  CRISPR gRNA sequence
gcctcagcctccccggtggc

SEQ ID NO: 467692 - DNA, 20 bp, Artificial
  CRISPR gRNA sequence
ttttgtatttttagtaggga

SEQ ID NO: 467693 - DNA, 20 bp, Artificial
  CRISPR gRNA sequence
gcctctgcctcacaaagtgc

SEQ ID NO: 467694 - DNA, 20 bp, Artificial
  CRISPR gRNA sequence
tcacaaagtgctgggattac

SEQ ID NO: 467695 - DNA, 20 bp, Artificial
  CRISPR gRNA sequence
acaccccttttctgcctgtt

SEQ ID NO: 467696 - DNA, 20 bp, Artificial
  CRISPR gRNA sequence
caaataaatatttcccgaag

SEQ ID NO: 467697 - DNA, 20 bp, Artificial
  CRISPR gRNA sequence
tatttatgtattttttgaga

SEQ ID NO: 467698 - DNA, 20 bp, Artificial
  CRISPR gRNA sequence
tttgctcttgttgcccaggc

SEQ ID NO: 467699 - DNA, 20 bp, Artificial
  CRISPR gRNA sequence
gttcactgcaacctccatcc

SEQ ID NO: 467700 - DNA, 20 bp, Artificial
  CRISPR gRNA sequence
aaaataaatacatgcagtaa

SEQ ID NO: 467701 - DNA, 20 bp, Artificial
  CRISPR gRNA sequence
cagcactttgggaggccgag

SEQ ID NO: 467702 - DNA, 20 bp, Artificial
  CRISPR gRNA sequence
actttgggaggccgaggcga

SEQ ID NO: 467703 - DNA, 20 bp, Artificial
  CRISPR gRNA sequence
tgctcggcagactgaggcag

SEQ ID NO: 467704 - DNA, 20 bp, Artificial
  CRISPR gRNA sequence
tcgcgccactgcactccagc

SEQ ID NO: 467705 - DNA, 20 bp, Artificial
  CRISPR gRNA sequence
tccagcctgggtgacagagc

SEQ ID NO: 467706 - DNA, 20 bp, Artificial
  CRISPR gRNA sequence
aaaaaacaaaccaacaaaca

SEQ ID NO: 467707 - DNA, 20 bp, Artificial
  CRISPR gRNA sequence
atgatattttattttaggtc

SEQ ID NO: 467708 - DNA, 20 bp, Artificial
  CRISPR gRNA sequence
ccagaaaagaaatatagaca

SEQ ID NO: 467709 - DNA, 20 bp, Artificial
  CRISPR gRNA sequence
agttgtccaataactaataa

SEQ ID NO: 467710 - DNA, 20 bp, Artificial
  CRISPR gRNA sequence
gtattattgtttatttaaaa

SEQ ID NO: 467711 - DNA, 20 bp, Artificial
  CRISPR gRNA sequence
aaaattgaatgttgaaaggc

SEQ ID NO: 467712 - DNA, 20 bp, Artificial
  CRISPR gRNA sequence
aaagtgtccttggaggaaac

SEQ ID NO: 467713 - DNA, 20 bp, Artificial
  CRISPR gRNA sequence
atcaaaatgaacacaagtag

SEQ ID NO: 467714 - DNA, 20 bp, Artificial
  CRISPR gRNA sequence
ctgtataactgggaagttct

SEQ ID NO: 467715 - DNA, 20 bp, Artificial
  CRISPR gRNA sequence
tctctgagttaacttgcaag

SEQ ID NO: 467716 - DNA, 20 bp, Artificial
  CRISPR gRNA sequence
cttagaccaaaaatattttg

SEQ ID NO: 467717 - DNA, 20 bp, Artificial
  CRISPR gRNA sequence
actttgggaggccagggcgg

SEQ ID NO: 467718 - DNA, 20 bp, Artificial
  CRISPR gRNA sequence
cgggcggatcaccagaggtc

SEQ ID NO: 467719 - DNA, 20 bp, Artificial
  CRISPR gRNA sequence
attaaaaaatacaaaattag

SEQ ID NO: 467720 - DNA, 20 bp, Artificial
  CRISPR gRNA sequence
tactcaggaggctgaggcag

SEQ ID NO: 467721 - DNA, 20 bp, Artificial
  CRISPR gRNA sequence
ggagccacttgttcacaccc

SEQ ID NO: 467722 - DNA, 20 bp, Artificial
  CRISPR gRNA sequence
acttgttcacacccaggagt

SEQ ID NO: 467723 - DNA, 20 bp, Artificial
  CRISPR gRNA sequence
tagatttttgttgtattatt

SEQ ID NO: 467724 - DNA, 20 bp, Artificial
  CRISPR gRNA sequence
gaggaagacagtctttctgg

SEQ ID NO: 467725 - DNA, 20 bp, Artificial
  CRISPR gRNA sequence
gccatgaagttcaattgatt

SEQ ID NO: 467726 - DNA, 20 bp, Artificial
  CRISPR gRNA sequence
ttccatgacactgccttaat

SEQ ID NO: 467727 - DNA, 20 bp, Artificial
  CRISPR gRNA sequence
tggatctcattctgtttcat

SEQ ID NO: 467728 - DNA, 20 bp, Artificial
  CRISPR gRNA sequence
ttttttttttttttttgaga

SEQ ID NO: 467729 - DNA, 20 bp, Artificial
  CRISPR gRNA sequence
tctcgctctgtcgcccaggc

SEQ ID NO: 467730 - DNA, 20 bp, Artificial
  CRISPR gRNA sequence
ctccgctcactgcaagcctc

SEQ ID NO: 467731 - DNA, 20 bp, Artificial
  CRISPR gRNA sequence
cattctcctgcctcagcctc

SEQ ID NO: 467732 - DNA, 20 bp, Artificial
  CRISPR gRNA sequence
ttttgtatttttagtagaga

SEQ ID NO: 467733 - DNA, 20 bp, Artificial
  CRISPR gRNA sequence
cggggttttacccggttaac

SEQ ID NO: 467734 - DNA, 20 bp, Artificial
  CRISPR gRNA sequence
gcctcgggctcccaaagtgc

SEQ ID NO: 467735 - DNA, 20 bp, Artificial
  CRISPR gRNA sequence
ttttgttgttgttgttgaga

SEQ ID NO: 467736 - DNA, 20 bp, Artificial
  CRISPR gRNA sequence
tctcgctctgtcacccaggc

SEQ ID NO: 467737 - DNA, 20 bp, Artificial
  CRISPR gRNA sequence
ctcactgcaacctccaccca

SEQ ID NO: 467738 - DNA, 20 bp, Artificial
  CRISPR gRNA sequence
cctcagcctctggagcagct

SEQ ID NO: 467739 - DNA, 20 bp, Artificial
  CRISPR gRNA sequence
ggcacctgccactgcgcccg

SEQ ID NO: 467740 - DNA, 20 bp, Artificial
  CRISPR gRNA sequence
tttatatttttagtagagat

SEQ ID NO: 467741 - DNA, 20 bp, Artificial
  CRISPR gRNA sequence
ggcctgatttatgtccactc

SEQ ID NO: 467742 - DNA, 20 bp, Artificial
  CRISPR gRNA sequence
tgatttatgtccactcaggg

SEQ ID NO: 467743 - DNA, 20 bp, Artificial
  CRISPR gRNA sequence
cacagatcagctgatcagaa

SEQ ID NO: 467744 - DNA, 20 bp, Artificial
  CRISPR gRNA sequence
agtgtagttgctgagctgaa

SEQ ID NO: 467745 - DNA, 20 bp, Artificial
  CRISPR gRNA sequence
atcagccatttaaaaaaaaa

SEQ ID NO: 467746 - DNA, 20 bp, Artificial
  CRISPR gRNA sequence
aaaaaaagagggttatgatt

SEQ ID NO: 467747 - DNA, 20 bp, Artificial
  CRISPR gRNA sequence
tatcatgaggaaaatctcac

SEQ ID NO: 467748 - DNA, 20 bp, Artificial
  CRISPR gRNA sequence
ggttgcaaccattcaaataa

SEQ ID NO: 467749 - DNA, 20 bp, Artificial
  CRISPR gRNA sequence
caaataaatgaatgactgta

SEQ ID NO: 467750 - DNA, 20 bp, Artificial
  CRISPR gRNA sequence
aacttgagctaagaaagtgt

SEQ ID NO: 467751 - DNA, 20 bp, Artificial
  CRISPR gRNA sequence
taattttctgtgacatcaac

SEQ ID NO: 467752 - DNA, 20 bp, Artificial
  CRISPR gRNA sequence
catgctggggaggctacaga

SEQ ID NO: 467753 - DNA, 20 bp, Artificial
  CRISPR gRNA sequence
tctgccttactttagaaggc

SEQ ID NO: 467754 - DNA, 20 bp, Artificial
  CRISPR gRNA sequence
ctcaaatcttcccttgaaat

SEQ ID NO: 467755 - DNA, 20 bp, Artificial
  CRISPR gRNA sequence
ttcccttgaaattagagttt

SEQ ID NO: 467756 - DNA, 20 bp, Artificial
  CRISPR gRNA sequence
cagccatggaaccatacttc

SEQ ID NO: 467757 - DNA, 20 bp, Artificial
  CRISPR gRNA sequence
gaaatgtggtgacatgaggt

SEQ ID NO: 467758 - DNA, 20 bp, Artificial
  CRISPR gRNA sequence
gtgacatgaggttagggtgg

SEQ ID NO: 467759 - DNA, 20 bp, Artificial
  CRISPR gRNA sequence
cagatattctcagaagtact

SEQ ID NO: 467760 - DNA, 20 bp, Artificial
  CRISPR gRNA sequence
aaaaccctgtgattgttctc

SEQ ID NO: 467761 - DNA, 20 bp, Artificial
  CRISPR gRNA sequence
agacaatacagatcacagac

SEQ ID NO: 467762 - DNA, 20 bp, Artificial
  CRISPR gRNA sequence
gtagatttaacttattctct

SEQ ID NO: 467763 - DNA, 20 bp, Artificial
  CRISPR gRNA sequence
caagaagagccattttctcc

SEQ ID NO: 467764 - DNA, 20 bp, Artificial
  CRISPR gRNA sequence
aactggaaagtattaatgcc

SEQ ID NO: 467765 - DNA, 20 bp, Artificial
  CRISPR gRNA sequence
aaagcaatttcttctacagt

SEQ ID NO: 467766 - DNA, 20 bp, Artificial
  CRISPR gRNA sequence
ttcctctccttgagatattt

SEQ ID NO: 467767 - DNA, 20 bp, Artificial
  CRISPR gRNA sequence
tacatttaggagatcacctc

SEQ ID NO: 467768 - DNA, 20 bp, Artificial
  CRISPR gRNA sequence
catcttaacacgaggaaaaa

SEQ ID NO: 467769 - DNA, 20 bp, Artificial
  CRISPR gRNA sequence
ccctcacaatgattttatga

SEQ ID NO: 467770 - DNA, 20 bp, Artificial
  CRISPR gRNA sequence
atttttttaagttgaggaaa

SEQ ID NO: 467771 - DNA, 20 bp, Artificial
  CRISPR gRNA sequence
gttgaggaaactgggtatta

SEQ ID NO: 467772 - DNA, 20 bp, Artificial
  CRISPR gRNA sequence
gatcaccagctggtaggagg

SEQ ID NO: 467773 - DNA, 20 bp, Artificial
  CRISPR gRNA sequence
aagcacaagctcttatccag

SEQ ID NO: 467774 - DNA, 20 bp, Artificial
  CRISPR gRNA sequence
gatattattatgttttctga

SEQ ID NO: 467775 - DNA, 20 bp, Artificial
  CRISPR gRNA sequence
ttattatgttttctgatagg

SEQ ID NO: 467776 - DNA, 20 bp, Artificial
  CRISPR gRNA sequence
ttagggaaatcacacagaag

SEQ ID NO: 467777 - DNA, 20 bp, Artificial
  CRISPR gRNA sequence
tgtccagaggtgtaaagcct

SEQ ID NO: 467778 - DNA, 20 bp, Artificial
  CRISPR gRNA sequence
ttacccccaacaaccattct

SEQ ID NO: 467779 - DNA, 20 bp, Artificial
  CRISPR gRNA sequence
aggcttgccttggtcaaaac

SEQ ID NO: 467780 - DNA, 20 bp, Artificial
  CRISPR gRNA sequence
gactttgcttctctaggcca

SEQ ID NO: 467781 - DNA, 20 bp, Artificial
  CRISPR gRNA sequence
ccctgtctactctgtgtaac

SEQ ID NO: 467782 - DNA, 20 bp, Artificial
  CRISPR gRNA sequence
gtctactctgtgtaacaagg

SEQ ID NO: 467783 - DNA, 20 bp, Artificial
  CRISPR gRNA sequence
tcaacatgtaattatcgccc

SEQ ID NO: 467784 - DNA, 20 bp, Artificial
  CRISPR gRNA sequence
aaaagcttctagtcaactta

SEQ ID NO: 467785 - DNA, 20 bp, Artificial
  CRISPR gRNA sequence
aaattttccacctttgtcac

SEQ ID NO: 467786 - DNA, 20 bp, Artificial
  CRISPR gRNA sequence
agctgttgacagtagcatca

SEQ ID NO: 467787 - DNA, 20 bp, Artificial
  CRISPR gRNA sequence
gcatttgatcagaaaccaac

SEQ ID NO: 467788 - DNA, 20 bp, Artificial
  CRISPR gRNA sequence
ctaaatattgacttcagtgg

SEQ ID NO: 467789 - DNA, 20 bp, Artificial
  CRISPR gRNA sequence
ctaaacaatacttatgtgga

SEQ ID NO: 467790 - DNA, 20 bp, Artificial
  CRISPR gRNA sequence
gcctcccttgtagccaaata

SEQ ID NO: 467791 - DNA, 20 bp, Artificial
  CRISPR gRNA sequence
ataggccatttgtgatgtgt

SEQ ID NO: 467792 - DNA, 20 bp, Artificial
  CRISPR gRNA sequence
tcttctggactctgttctaa

SEQ ID NO: 467793 - DNA, 20 bp, Artificial
  CRISPR gRNA sequence
taaatcaggtccataaccat

SEQ ID NO: 467794 - DNA, 20 bp, Artificial
  CRISPR gRNA sequence
ttgagcttattttgaggtaa

SEQ ID NO: 467795 - DNA, 20 bp, Artificial
  CRISPR gRNA sequence
tattttgaggtaagagaatg

SEQ ID NO: 467796 - DNA, 20 bp, Artificial
  CRISPR gRNA sequence
attagcttttcttggtgacc

SEQ ID NO: 467797 - DNA, 20 bp, Artificial
  CRISPR gRNA sequence
ttttcttggtgaccaaggat

SEQ ID NO: 467798 - DNA, 20 bp, Artificial
  CRISPR gRNA sequence
cagagcaaaaaggcaaccta

SEQ ID NO: 467799 - DNA, 20 bp, Artificial
  CRISPR gRNA sequence
tctgaaaaaggcctaatatc

SEQ ID NO: 467800 - DNA, 20 bp, Artificial
  CRISPR gRNA sequence
accgcatcaaaaagtgggca

SEQ ID NO: 467801 - DNA, 20 bp, Artificial
  CRISPR gRNA sequence
tctctgtttttttttggaga

SEQ ID NO: 467802 - DNA, 20 bp, Artificial
  CRISPR gRNA sequence
gtctcactctgttacccagc

SEQ ID NO: 467803 - DNA, 20 bp, Artificial
  CRISPR gRNA sequence
ctcactgcaacttcagtctc

SEQ ID NO: 467804 - DNA, 20 bp, Artificial
  CRISPR gRNA sequence
ttttgtatttttagtacaga

SEQ ID NO: 467805 - DNA, 20 bp, Artificial
  CRISPR gRNA sequence
tcctcagcttcctgaagtgc

SEQ ID NO: 467806 - DNA, 20 bp, Artificial
  CRISPR gRNA sequence
actttgggaggccgagacag

SEQ ID NO: 467807 - DNA, 20 bp, Artificial
  CRISPR gRNA sequence
agtcccagctactcgggagg

SEQ ID NO: 467808 - DNA, 20 bp, Artificial
  CRISPR gRNA sequence
tactcgggaggctgagttag

SEQ ID NO: 467809 - DNA, 20 bp, Artificial
  CRISPR gRNA sequence
tttatgccaccaacaaacat

SEQ ID NO: 467810 - DNA, 20 bp, Artificial
  CRISPR gRNA sequence
agataacatctcacgccagt

SEQ ID NO: 467811 - DNA, 20 bp, Artificial
  CRISPR gRNA sequence
taggtgctggcaagtctgtg

SEQ ID NO: 467812 - DNA, 20 bp, Artificial
  CRISPR gRNA sequence
tggcaagtctgtggagaatt

SEQ ID NO: 467813 - DNA, 20 bp, Artificial
  CRISPR gRNA sequence
aatgcttttacacggttggt

SEQ ID NO: 467814 - DNA, 20 bp, Artificial
  CRISPR gRNA sequence
ttgacccagcaatcccgtta

SEQ ID NO: 467815 - DNA, 20 bp, Artificial
  CRISPR gRNA sequence
gttactgggtatatactcaa

SEQ ID NO: 467816 - DNA, 20 bp, Artificial
  CRISPR gRNA sequence
aatatggtacatatacaccg

SEQ ID NO: 467817 - DNA, 20 bp, Artificial
  CRISPR gRNA sequence
aatactatgcagccataaaa

SEQ ID NO: 467818 - DNA, 20 bp, Artificial
  CRISPR gRNA sequence
atcatgccctttgcagggac

SEQ ID NO: 467819 - DNA, 20 bp, Artificial
  CRISPR gRNA sequence
cataagtggaagttgaaaat

SEQ ID NO: 467820 - DNA, 20 bp, Artificial
  CRISPR gRNA sequence
gaatatatggacacagagag

SEQ ID NO: 467821 - DNA, 20 bp, Artificial
  CRISPR gRNA sequence
acacaaaccagagcctgttg

SEQ ID NO: 467822 - DNA, 20 bp, Artificial
  CRISPR gRNA sequence
gggagaggagagggaactta

SEQ ID NO: 467823 - DNA, 20 bp, Artificial
  CRISPR gRNA sequence
gaggagagggaacttagagg

SEQ ID NO: 467824 - DNA, 20 bp, Artificial
  CRISPR gRNA sequence
tagaagaaataaagaaaaaa

SEQ ID NO: 467825 - DNA, 20 bp, Artificial
  CRISPR gRNA sequence
aaagagtagataataatatc

SEQ ID NO: 467826 - DNA, 20 bp, Artificial
  CRISPR gRNA sequence
ttagctaaatatacacagca

SEQ ID NO: 467827 - DNA, 20 bp, Artificial
  CRISPR gRNA sequence
gcactattctaagtgtttta

SEQ ID NO: 467828 - DNA, 20 bp, Artificial
  CRISPR gRNA sequence
aaaccattaaatggcagaca

SEQ ID NO: 467829 - DNA, 20 bp, Artificial
  CRISPR gRNA sequence
agacataggatactaatcca

SEQ ID NO: 467830 - DNA, 20 bp, Artificial
  CRISPR gRNA sequence
taatccatggagtctggctt

SEQ ID NO: 467831 - DNA, 20 bp, Artificial
  CRISPR gRNA sequence
ttcaagaagtcctgtaacca

SEQ ID NO: 467832 - DNA, 20 bp, Artificial
  CRISPR gRNA sequence
gctacaaaacctgaacttca

SEQ ID NO: 467833 - DNA, 20 bp, Artificial
  CRISPR gRNA sequence
gtagagcaaaacaatctgtg

SEQ ID NO: 467834 - DNA, 20 bp, Artificial
  CRISPR gRNA sequence
cactgtattctcaaaagagc

SEQ ID NO: 467835 - DNA, 20 bp, Artificial
  CRISPR gRNA sequence
tttcccttactgaaccagac

SEQ ID NO: 467836 - DNA, 20 bp, Artificial
  CRISPR gRNA sequence
tgttcctgcctgcctaaaag

SEQ ID NO: 467837 - DNA, 20 bp, Artificial
  CRISPR gRNA sequence
tggttgatcctcaactgaac

SEQ ID NO: 467838 - DNA, 20 bp, Artificial
  CRISPR gRNA sequence
gcagcctcagacaaatggtc

SEQ ID NO: 467839 - DNA, 20 bp, Artificial
  CRISPR gRNA sequence
tcactcctaggaacaaggac

SEQ ID NO: 467840 - DNA, 20 bp, Artificial
  CRISPR gRNA sequence
caagtctttccctttttttt

SEQ ID NO: 467841 - DNA, 20 bp, Artificial
  CRISPR gRNA sequence
ctcactgcaacctctgcctc

SEQ ID NO: 467842 - DNA, 20 bp, Artificial
  CRISPR gRNA sequence
tattctcctgtctcggcctc

SEQ ID NO: 467843 - DNA, 20 bp, Artificial
  CRISPR gRNA sequence
ttttatatttttagtagaga

SEQ ID NO: 467844 - DNA, 20 bp, Artificial
  CRISPR gRNA sequence
tcccagccatatttcatttt

SEQ ID NO: 467845 - DNA, 20 bp, Artificial
  CRISPR gRNA sequence
tcattgttcttaatttcata

SEQ ID NO: 467846 - DNA, 20 bp, Artificial
  CRISPR gRNA sequence
acttacaaacataaagatgt

SEQ ID NO: 467847 - DNA, 20 bp, Artificial
  CRISPR gRNA sequence
ctgataaatgtgtgcttgta

SEQ ID NO: 467848 - DNA, 20 bp, Artificial
  CRISPR gRNA sequence
gcttgtagggaataataaga

SEQ ID NO: 467849 - DNA, 20 bp, Artificial
  CRISPR gRNA sequence
actttgggaggctgaggcag

SEQ ID NO: 467850 - DNA, 20 bp, Artificial
  CRISPR gRNA sequence
ttgatggcaagaaaagagaa

SEQ ID NO: 467851 - DNA, 20 bp, Artificial
  CRISPR gRNA sequence
ctcaggctgccacactgatg

SEQ ID NO: 467852 - DNA, 20 bp, Artificial
  CRISPR gRNA sequence
gatagctcgttcttcccaaa

SEQ ID NO: 467853 - DNA, 20 bp, Artificial
  CRISPR gRNA sequence
tcttcccaaactgagtgcag

SEQ ID NO: 467854 - DNA, 20 bp, Artificial
  CRISPR gRNA sequence
tagagtgttgcagtgctcag

SEQ ID NO: 467855 - DNA, 20 bp, Artificial
  CRISPR gRNA sequence
tcagttgggtaggacagatg

SEQ ID NO: 467856 - DNA, 20 bp, Artificial
  CRISPR gRNA sequence
taggacagatgttggataat

SEQ ID NO: 467857 - DNA, 20 bp, Artificial
  CRISPR gRNA sequence
tactagggacgctgaggcag

SEQ ID NO: 467858 - DNA, 20 bp, Artificial
  CRISPR gRNA sequence
aaattgaacccgggaggaag

SEQ ID NO: 467859 - DNA, 20 bp, Artificial
  CRISPR gRNA sequence
tcgattgaacccgggaggca

SEQ ID NO: 467860 - DNA, 20 bp, Artificial
  CRISPR gRNA sequence
aggcagaggatgcagtgagg

SEQ ID NO: 467861 - DNA, 20 bp, Artificial
  CRISPR gRNA sequence
tcacgccattgcactccagc

SEQ ID NO: 467862 - DNA, 20 bp, Artificial
  CRISPR gRNA sequence
gcttttcctcttgataatat

SEQ ID NO: 467863 - DNA, 20 bp, Artificial
  CRISPR gRNA sequence
tgcctgtataaagtctttgc

SEQ ID NO: 467864 - DNA, 20 bp, Artificial
  CRISPR gRNA sequence
gtggctaaatatcatctttg

SEQ ID NO: 467865 - DNA, 20 bp, Artificial
  CRISPR gRNA sequence
atttagaggtaatattattt

SEQ ID NO: 467866 - DNA, 20 bp, Artificial
  CRISPR gRNA sequence
cgatgcctatgattaggcag

SEQ ID NO: 467867 - DNA, 20 bp, Artificial
  CRISPR gRNA sequence
ccgtactaagttcagcaagg

SEQ ID NO: 467868 - DNA, 20 bp, Artificial
  CRISPR gRNA sequence
acctaagcaggtgccttacc

SEQ ID NO: 467869 - DNA, 20 bp, Artificial
  CRISPR gRNA sequence
atgttccagatgtccagata

SEQ ID NO: 467870 - DNA, 20 bp, Artificial
  CRISPR gRNA sequence
agaaggctttgcttcgtctt

SEQ ID NO: 467871 - DNA, 20 bp, Artificial
  CRISPR gRNA sequence
gcttcgtcttctgagtgctg

SEQ ID NO: 467872 - DNA, 20 bp, Artificial
  CRISPR gRNA sequence
gtcttctgagtgctgcagag

SEQ ID NO: 467873 - DNA, 20 bp, Artificial
  CRISPR gRNA sequence
agagagaggtggtaagagag

SEQ ID NO: 467874 - DNA, 20 bp, Artificial
  CRISPR gRNA sequence
gagaggagagtaggaagagc

SEQ ID NO: 467875 - DNA, 20 bp, Artificial
  CRISPR gRNA sequence
attgctcatttcactgaaca

SEQ ID NO: 467876 - DNA, 20 bp, Artificial
  CRISPR gRNA sequence
aagaagcaaaaaccacagaa

SEQ ID NO: 467877 - DNA, 20 bp, Artificial
  CRISPR gRNA sequence
agttatttcacagatgccac

SEQ ID NO: 467878 - DNA, 20 bp, Artificial
  CRISPR gRNA sequence
cttggaactgggaaattatt

SEQ ID NO: 467879 - DNA, 20 bp, Artificial
  CRISPR gRNA sequence
atttctggttttatttctca

SEQ ID NO: 467880 - DNA, 20 bp, Artificial
  CRISPR gRNA sequence
cggtgtaacgtttatacgaa

SEQ ID NO: 467881 - DNA, 20 bp, Artificial
  CRISPR gRNA sequence
ttgatggtaggaaaagagaa

SEQ ID NO: 467882 - DNA, 20 bp, Artificial
  CRISPR gRNA sequence
ctctggctgccatactgata

SEQ ID NO: 467883 - DNA, 20 bp, Artificial
  CRISPR gRNA sequence
gatagctcgttctttccaaa

SEQ ID NO: 467884 - DNA, 20 bp, Artificial
  CRISPR gRNA sequence
tctttccaaactgagtgcag

SEQ ID NO: 467885 - DNA, 20 bp, Artificial
  CRISPR gRNA sequence
tagagtgctgcagtgctcag

SEQ ID NO: 467886 - DNA, 20 bp, Artificial
  CRISPR gRNA sequence
tcagttgggtaggacagttg

SEQ ID NO: 467887 - DNA, 20 bp, Artificial
  CRISPR gRNA sequence
taggacagttgttggataat

SEQ ID NO: 467888 - DNA, 20 bp, Artificial
  CRISPR gRNA sequence
aatctctatacttgcttcat

SEQ ID NO: 467889 - DNA, 20 bp, Artificial
  CRISPR gRNA sequence
ttcattgggatgtatgcctt

SEQ ID NO: 467890 - DNA, 20 bp, Artificial
  CRISPR gRNA sequence
ttgcttctattttgttgaaa

SEQ ID NO: 467891 - DNA, 20 bp, Artificial
  CRISPR gRNA sequence
aattgaacacagaaaataag

SEQ ID NO: 467892 - DNA, 20 bp, Artificial
  CRISPR gRNA sequence
attatcaagaggaaaagcct

SEQ ID NO: 467893 - DNA, 20 bp, Artificial
  CRISPR gRNA sequence
tttttttatttttttgagac

SEQ ID NO: 467894 - DNA, 20 bp, Artificial
  CRISPR gRNA sequence
tttgctctcgtcacccaggc

SEQ ID NO: 467895 - DNA, 20 bp, Artificial
  CRISPR gRNA sequence
ctcactgcatcctctgcctc

SEQ ID NO: 467896 - DNA, 20 bp, Artificial
  CRISPR gRNA sequence
tcaatcgattcttcttcctc

SEQ ID NO: 467897 - DNA, 20 bp, Artificial
  CRISPR gRNA sequence
gcctcagcgtccctagtagc

SEQ ID NO: 467898 - DNA, 20 bp, Artificial
  CRISPR gRNA sequence
ttgtatttttagtagagatg

SEQ ID NO: 467899 - DNA, 20 bp, Artificial
  CRISPR gRNA sequence
ttaagaaagtcagccaagct

SEQ ID NO: 467900 - DNA, 20 bp, Artificial
  CRISPR gRNA sequence
gcctcagcctcccaaagtgc

SEQ ID NO: 467901 - DNA, 20 bp, Artificial
  CRISPR gRNA sequence
taattttaaactgtgtagtt

SEQ ID NO: 467902 - DNA, 20 bp, Artificial
  CRISPR gRNA sequence
ggaatatgtctctatgatgc

SEQ ID NO: 467903 - DNA, 20 bp, Artificial
  CRISPR gRNA sequence
ctaggtgcttagatggttga

SEQ ID NO: 467904 - DNA, 20 bp, Artificial
  CRISPR gRNA sequence
tacagtcacatagctacaac

SEQ ID NO: 467905 - DNA, 20 bp, Artificial
  CRISPR gRNA sequence
atagatttcttccccatttg

SEQ ID NO: 467906 - DNA, 20 bp, Artificial
  CRISPR gRNA sequence
tctctatgaaattaagaaca

SEQ ID NO: 467907 - DNA, 20 bp, Artificial
  CRISPR gRNA sequence
gtgctaaaccacattgatgg

SEQ ID NO: 467908 - DNA, 20 bp, Artificial
  CRISPR gRNA sequence
agtgaacttggctgttagaa

SEQ ID NO: 467909 - DNA, 20 bp, Artificial
  CRISPR gRNA sequence
aagactgtagatgcaataat

SEQ ID NO: 467910 - DNA, 20 bp, Artificial
  CRISPR gRNA sequence
caacctctatgtaattaaat

SEQ ID NO: 467911 - DNA, 20 bp, Artificial
  CRISPR gRNA sequence
aacattattatttaaaatag

SEQ ID NO: 467912 - DNA, 20 bp, Artificial
  CRISPR gRNA sequence
tatatttagcccaaaatata

SEQ ID NO: 467913 - DNA, 20 bp, Artificial
  CRISPR gRNA sequence
cgggcagatcacctgaggtc

SEQ ID NO: 467914 - DNA, 20 bp, Artificial
  CRISPR gRNA sequence
actaaaaatataaaaatttg

SEQ ID NO: 467915 - DNA, 20 bp, Artificial
  CRISPR gRNA sequence
tactcgggaggccgagacag

SEQ ID NO: 467916 - DNA, 20 bp, Artificial
  CRISPR gRNA sequence
caaaaaaaaaagggaaagac

SEQ ID NO: 467917 - DNA, 20 bp, Artificial
  CRISPR gRNA sequence
gatatataccagttgatata

SEQ ID NO: 467918 - DNA, 20 bp, Artificial
  CRISPR gRNA sequence
cattaaataccttatatctt

SEQ ID NO: 467919 - DNA, 20 bp, Artificial
  CRISPR gRNA sequence
tcctgtgatttacttaattg

SEQ ID NO: 467920 - DNA, 20 bp, Artificial
  CRISPR gRNA sequence
agatccgtgtccttgttcct

SEQ ID NO: 467921 - DNA, 20 bp, Artificial
  CRISPR gRNA sequence
ccctagaccctagttcagtt

SEQ ID NO: 467922 - DNA, 20 bp, Artificial
  CRISPR gRNA sequence
agttcagttgaggatcaacc

SEQ ID NO: 467923 - DNA, 20 bp, Artificial
  CRISPR gRNA sequence
aggaacactgcagttaatgt

SEQ ID NO: 467924 - DNA, 20 bp, Artificial
  CRISPR gRNA sequence
caccaacaccatatatgatg

SEQ ID NO: 467925 - DNA, 20 bp, Artificial
  CRISPR gRNA sequence
acctgtattctggctctttt

SEQ ID NO: 467926 - DNA, 20 bp, Artificial
  CRISPR gRNA sequence
actacaaactggccatatct

SEQ ID NO: 467927 - DNA, 20 bp, Artificial
  CRISPR gRNA sequence
ttattgaaatgtgcatatgg

SEQ ID NO: 467928 - DNA, 20 bp, Artificial
  CRISPR gRNA sequence
catatattaaataaatgttt

SEQ ID NO: 467929 - DNA, 20 bp, Artificial
  CRISPR gRNA sequence
ttctgtggttacaggacttc

SEQ ID NO: 467930 - DNA, 20 bp, Artificial
  CRISPR gRNA sequence
accttgtgctcattgcagcc

SEQ ID NO: 467931 - DNA, 20 bp, Artificial
  CRISPR gRNA sequence
ctacttaatttccattattt

SEQ ID NO: 467932 - DNA, 20 bp, Artificial
  CRISPR gRNA sequence
ttgtgagtttcatctttatg

SEQ ID NO: 467933 - DNA, 20 bp, Artificial
  CRISPR gRNA sequence
tttcatctttatgtagagtt

SEQ ID NO: 467934 - DNA, 20 bp, Artificial
  CRISPR gRNA sequence
ggactctaaagccagactcc

SEQ ID NO: 467935 - DNA, 20 bp, Artificial
  CRISPR gRNA sequence
tttctcatctaaaaaaatgg

SEQ ID NO: 467936 - DNA, 20 bp, Artificial
  CRISPR gRNA sequence
aaggttgttgtgactattaa

SEQ ID NO: 467937 - DNA, 20 bp, Artificial
  CRISPR gRNA sequence
aattaattctgtaaaacact

SEQ ID NO: 467938 - DNA, 20 bp, Artificial
  CRISPR gRNA sequence
atagtcctgttaaagtaaca

SEQ ID NO: 467939 - DNA, 20 bp, Artificial
  CRISPR gRNA sequence
agtaacattgggtgacaatt

SEQ ID NO: 467940 - DNA, 20 bp, Artificial
  CRISPR gRNA sequence
atcaaccacaaataaaaatt

SEQ ID NO: 467941 - DNA, 20 bp, Artificial
  CRISPR gRNA sequence
tttcttctaaaaaaggaaaa

SEQ ID NO: 467942 - DNA, 20 bp, Artificial
  CRISPR gRNA sequence
ctcattttcaacttccactt

SEQ ID NO: 467943 - DNA, 20 bp, Artificial
  CRISPR gRNA sequence
tgttcctgtgttagtttgct

SEQ ID NO: 467944 - DNA, 20 bp, Artificial
  CRISPR gRNA sequence
agtctatcattgatgggcat

SEQ ID NO: 467945 - DNA, 20 bp, Artificial
  CRISPR gRNA sequence
gtgtgcatgtgtctttatag

SEQ ID NO: 467946 - DNA, 20 bp, Artificial
  CRISPR gRNA sequence
gtagaatgatttatattcct

SEQ ID NO: 467947 - DNA, 20 bp, Artificial
  CRISPR gRNA sequence
tttgagtatatacccagtaa

SEQ ID NO: 467948 - DNA, 20 bp, Artificial
  CRISPR gRNA sequence
tatacccagtaacgggattg

SEQ ID NO: 467949 - DNA, 20 bp, Artificial
  CRISPR gRNA sequence
gtatttctggttctagatcg

SEQ ID NO: 467950 - DNA, 20 bp, Artificial
  CRISPR gRNA sequence
tcttctttttttttttgaga

SEQ ID NO: 467951 - DNA, 20 bp, Artificial
  CRISPR gRNA sequence
tgtcgctctgtcgcccaggc

SEQ ID NO: 467952 - DNA, 20 bp, Artificial
  CRISPR gRNA sequence
cattctcctaactcagcctc

SEQ ID NO: 467953 - DNA, 20 bp, Artificial
  CRISPR gRNA sequence
gaaggtttcaccgtgttagt

SEQ ID NO: 467954 - DNA, 20 bp, Artificial
  CRISPR gRNA sequence
gtctcggcctcccaaagtgc

SEQ ID NO: 467955 - DNA, 20 bp, Artificial
  CRISPR gRNA sequence
ttgagaagtgtctgtttagg

SEQ ID NO: 467956 - DNA, 20 bp, Artificial
  CRISPR gRNA sequence
acttcaggaagctgaggagg

SEQ ID NO: 467957 - DNA, 20 bp, Artificial
  CRISPR gRNA sequence
agggcgggtcatttgaggtc

SEQ ID NO: 467958 - DNA, 20 bp, Artificial
  CRISPR gRNA sequence
agctacttgggaggctgagg

SEQ ID NO: 467959 - DNA, 20 bp, Artificial
  CRISPR gRNA sequence
gttgcaccactgcactccag

SEQ ID NO: 467960 - DNA, 20 bp, Artificial
  CRISPR gRNA sequence
actgcactccagctgggtaa

SEQ ID NO: 467961 - DNA, 20 bp, Artificial
  CRISPR gRNA sequence
atttaagtttcttgtaaatt

SEQ ID NO: 467962 - DNA, 20 bp, Artificial
  CRISPR gRNA sequence
ggatattaggcctttttcag

SEQ ID NO: 467963 - DNA, 20 bp, Artificial
  CRISPR gRNA sequence
ggttgcctttttgctctgat

SEQ ID NO: 467964 - DNA, 20 bp, Artificial
  CRISPR gRNA sequence
aagaaaagctaatagtgctt

SEQ ID NO: 467965 - DNA, 20 bp, Artificial
  CRISPR gRNA sequence
agtgcttgagaatcatgcgc

SEQ ID NO: 467966 - DNA, 20 bp, Artificial
  CRISPR gRNA sequence
gcttgagttgtattgtgtca

SEQ ID NO: 467967 - DNA, 20 bp, Artificial
  CRISPR gRNA sequence
aatttgagattcacttagaa

SEQ ID NO: 467968 - DNA, 20 bp, Artificial
  CRISPR gRNA sequence
tcacttagaacagagtccag

SEQ ID NO: 467969 - DNA, 20 bp, Artificial
  CRISPR gRNA sequence
ggcattgagatttttatctg

SEQ ID NO: 467970 - DNA, 20 bp, Artificial
  CRISPR gRNA sequence
cctctataatattagaagat

SEQ ID NO: 467971 - DNA, 20 bp, Artificial
  CRISPR gRNA sequence
caagggctttgaaaatgcca

SEQ ID NO: 467972 - DNA, 20 bp, Artificial
  CRISPR gRNA sequence
tctcagtgtgatgtctgtgg

SEQ ID NO: 467973 - DNA, 20 bp, Artificial
  CRISPR gRNA sequence
agaaactcatccttgttaca

SEQ ID NO: 467974 - DNA, 20 bp, Artificial
  CRISPR gRNA sequence
acagagtagacagggctcta

SEQ ID NO: 467975 - DNA, 20 bp, Artificial
  CRISPR gRNA sequence
ctctaaggagtgcaatgcat

SEQ ID NO: 467976 - DNA, 20 bp, Artificial
  CRISPR gRNA sequence
gaagcaaagtcagtgaccag

SEQ ID NO: 467977 - DNA, 20 bp, Artificial
  CRISPR gRNA sequence
tgctggttaatatatttctg

SEQ ID NO: 467978 - DNA, 20 bp, Artificial
  CRISPR gRNA sequence
aaaagaagagcatgcttata

SEQ ID NO: 467979 - DNA, 20 bp, Artificial
  CRISPR gRNA sequence
tatgcaccactgctgatccc

SEQ ID NO: 467980 - DNA, 20 bp, Artificial
  CRISPR gRNA sequence
tgatccctagaatggttgtt

SEQ ID NO: 467981 - DNA, 20 bp, Artificial
  CRISPR gRNA sequence
ttgggggtaatttttcacag

SEQ ID NO: 467982 - DNA, 20 bp, Artificial
  CRISPR gRNA sequence
tatgtgccaagcatagtgct

SEQ ID NO: 467983 - DNA, 20 bp, Artificial
  CRISPR gRNA sequence
ttgctttcacaacaacccta

SEQ ID NO: 467984 - DNA, 20 bp, Artificial
  CRISPR gRNA sequence
ctggataagagcttgtgctt

SEQ ID NO: 467985 - DNA, 20 bp, Artificial
  CRISPR gRNA sequence
tgctttggagttagccacac

SEQ ID NO: 467986 - DNA, 20 bp, Artificial
  CRISPR gRNA sequence
ttccctcataaaatcattgt

SEQ ID NO: 467987 - DNA, 20 bp, Artificial
  CRISPR gRNA sequence
ctttttttcctcgtgttaag

SEQ ID NO: 467988 - DNA, 20 bp, Artificial
  CRISPR gRNA sequence
cgtgttaagatggatctagg

SEQ ID NO: 467989 - DNA, 20 bp, Artificial
  CRISPR gRNA sequence
agtatatagataatgtgagg

SEQ ID NO: 467990 - DNA, 20 bp, Artificial
  CRISPR gRNA sequence
gtacctgtgggcaagtggca

SEQ ID NO: 467991 - DNA, 20 bp, Artificial
  CRISPR gRNA sequence
gaaaaagcaatgacaaatac

SEQ ID NO: 467992 - DNA, 20 bp, Artificial
  CRISPR gRNA sequence
gattttagacaaaacaagtt

SEQ ID NO: 467993 - DNA, 20 bp, Artificial
  CRISPR gRNA sequence
cttaaagaaaaatttcataa

SEQ ID NO: 467994 - DNA, 20 bp, Artificial
  CRISPR gRNA sequence
aagatatgtttttataagaa

SEQ ID NO: 467995 - DNA, 20 bp, Artificial
  CRISPR gRNA sequence
aatatcaggtgatatccaca

SEQ ID NO: 467996 - DNA, 20 bp, Artificial
  CRISPR gRNA sequence
tgtactcgtgagaacaatca

SEQ ID NO: 467997 - DNA, 20 bp, Artificial
  CRISPR gRNA sequence
caggtattcctagtacttct

SEQ ID NO: 467998 - DNA, 20 bp, Artificial
  CRISPR gRNA sequence
ttctgagaatatctgactta

SEQ ID NO: 467999 - DNA, 20 bp, Artificial
  CRISPR gRNA sequence
atggagtggtttatttacca

SEQ ID NO: 468000 - DNA, 20 bp, Artificial
  CRISPR gRNA sequence
gacattacataatacattaa

SEQ ID NO: 468001 - DNA, 20 bp, Artificial
  CRISPR gRNA sequence
gtcaccacatttctgatttt

SEQ ID NO: 468002 - DNA, 20 bp, Artificial
  CRISPR gRNA sequence
atgatgggaaagtatgctac

SEQ ID NO: 468003 - DNA, 20 bp, Artificial
  CRISPR gRNA sequence
catggctgctattgctgtgt

SEQ ID NO: 468004 - DNA, 20 bp, Artificial
  CRISPR gRNA sequence
atgtacaaaccactgcctta

SEQ ID NO: 468005 - DNA, 20 bp, Artificial
  CRISPR gRNA sequence
agtaaggcagaacataccat

SEQ ID NO: 468006 - DNA, 20 bp, Artificial
  CRISPR gRNA sequence
atctggatgcctttttgctc

SEQ ID NO: 468007 - DNA, 20 bp, Artificial
  CRISPR gRNA sequence
cattacagtcattcatttat

SEQ ID NO: 468008 - DNA, 20 bp, Artificial
  CRISPR gRNA sequence
tgaagtttccataaatttgt

SEQ ID NO: 468009 - DNA, 20 bp, Artificial
  CRISPR gRNA sequence
gcaactacacttgctcagct

SEQ ID NO: 468010 - DNA, 20 bp, Artificial
  CRISPR gRNA sequence
tgatcagctgatctgtgtag

SEQ ID NO: 468011 - DNA, 20 bp, Artificial
  CRISPR gRNA sequence
tctgtgtagctggatggcca

SEQ ID NO: 468012 - DNA, 20 bp, Artificial
  CRISPR gRNA sequence
aatatttttaatatccaccc

SEQ ID NO: 468013 - DNA, 20 bp, Artificial
  CRISPR gRNA sequence
ataaatcaggccttttcaaa

SEQ ID NO: 468014 - DNA, 20 bp, Artificial
  CRISPR gRNA sequence
tgaacacatatgtagttata

SEQ ID NO: 468015 - DNA, 20 bp, Artificial
  CRISPR gRNA sequence
taaagagtgatgcatgtcgg

SEQ ID NO: 468016 - DNA, 20 bp, Artificial
  CRISPR gRNA sequence
tagcactttgggaggccaag

SEQ ID NO: 468017 - DNA, 20 bp, Artificial
  CRISPR gRNA sequence
actttgggaggccaaggcgg

SEQ ID NO: 468018 - DNA, 20 bp, Artificial
  CRISPR gRNA sequence
ggcgggtggatcacaaggtc

SEQ ID NO: 468019 - DNA, 20 bp, Artificial
  CRISPR gRNA sequence
agaccagcctggccaacatg

SEQ ID NO: 468020 - DNA, 20 bp, Artificial
  CRISPR gRNA sequence
tgctccagaggctgaggcag

SEQ ID NO: 468021 - DNA, 20 bp, Artificial
  CRISPR gRNA sequence
agcagaattgcttgaacccg

SEQ ID NO: 468022 - DNA, 20 bp, Artificial
  CRISPR gRNA sequence
tcgcgccactgcactccagc

SEQ ID NO: 468023 - DNA, 20 bp, Artificial
  CRISPR gRNA sequence
ctcaacaacaacaacaaaaa

SEQ ID NO: 468024 - DNA, 20 bp, Artificial
  CRISPR gRNA sequence
atagcatcagacatttgcta

SEQ ID NO: 468025 - DNA, 20 bp, Artificial
  CRISPR gRNA sequence
tcagacatttgctagggagt

SEQ ID NO: 468026 - DNA, 20 bp, Artificial
  CRISPR gRNA sequence
ttgctagggagtggggatat

SEQ ID NO: 468027 - DNA, 20 bp, Artificial
  CRISPR gRNA sequence
actttgggagcccgaggcgg

SEQ ID NO: 468028 - DNA, 20 bp, Artificial
  CRISPR gRNA sequence
atcgagaccatcctggttaa

SEQ ID NO: 468029 - DNA, 20 bp, Artificial
  CRISPR gRNA sequence
tactcaggaggctgaggcag

SEQ ID NO: 468030 - DNA, 20 bp, Artificial
  CRISPR gRNA sequence
gaaactgtgacagtgatgtg

SEQ ID NO: 468031 - DNA, 20 bp, Artificial
  CRISPR gRNA sequence
gagggaaacaaggccaagtt

SEQ ID NO: 468032 - DNA, 20 bp, Artificial
  CRISPR gRNA sequence
tgacaataatccacatgaaa

SEQ ID NO: 468033 - DNA, 20 bp, Artificial
  CRISPR gRNA sequence
tatggaagacattttccatc

SEQ ID NO: 468034 - DNA, 20 bp, Artificial
  CRISPR gRNA sequence
caattgaacttcatggctga

SEQ ID NO: 468035 - DNA, 20 bp, Artificial
  CRISPR gRNA sequence
gaggaggaccaaatttgcct

SEQ ID NO: 468036 - DNA, 20 bp, Artificial
  CRISPR gRNA sequence
gaaagactgtcttcctcttg

SEQ ID NO: 468037 - DNA, 20 bp, Artificial
  CRISPR gRNA sequence
tactaatgtgtcaaggacag

SEQ ID NO: 468038 - DNA, 20 bp, Artificial
  CRISPR gRNA sequence
acagtgggatatccagactc

SEQ ID NO: 468039 - DNA, 20 bp, Artificial
  CRISPR gRNA sequence
aagtggctccattgtctgta

SEQ ID NO: 468040 - DNA, 20 bp, Artificial
  CRISPR gRNA sequence
ttcgctcttgttgcccaggc

SEQ ID NO: 468041 - DNA, 20 bp, Artificial
  CRISPR gRNA sequence
ctcaccgcaacctccgcctc

SEQ ID NO: 468042 - DNA, 20 bp, Artificial
  CRISPR gRNA sequence
tattctcctgcctcagcctc

SEQ ID NO: 468043 - DNA, 20 bp, Artificial
  CRISPR gRNA sequence
gcctcagcctcctgagtagc

SEQ ID NO: 468044 - DNA, 20 bp, Artificial
  CRISPR gRNA sequence
tttgtattttttaatagaga

SEQ ID NO: 468045 - DNA, 20 bp, Artificial
  CRISPR gRNA sequence
gccctggcctcccaaagtgc

SEQ ID NO: 468046 - DNA, 20 bp, Artificial
  CRISPR gRNA sequence
aaagtgctgggattacaggc

SEQ ID NO: 468047 - DNA, 20 bp, Artificial
  CRISPR gRNA sequence
tctaaatactatggttactg

SEQ ID NO: 468048 - DNA, 20 bp, Artificial
  CRISPR gRNA sequence
gatagcaaatttataaagtc

SEQ ID NO: 468049 - DNA, 20 bp, Artificial
  CRISPR gRNA sequence
aaataaacaataataccaca

SEQ ID NO: 468050 - DNA, 20 bp, Artificial
  CRISPR gRNA sequence
tgtcatttggtgcaaacttc

SEQ ID NO: 468051 - DNA, 20 bp, Artificial
  CRISPR gRNA sequence
ttaaaatttaaaacagtgaa

SEQ ID NO: 468052 - DNA, 20 bp, Artificial
  CRISPR gRNA sequence
ttacctaaattgtatctttg

SEQ ID NO: 468053 - DNA, 20 bp, Artificial
  CRISPR gRNA sequence
attatatcagactataacta

SEQ ID NO: 468054 - DNA, 20 bp, Artificial
  CRISPR gRNA sequence
tcaaagttcatactgtttag

SEQ ID NO: 468055 - DNA, 20 bp, Artificial
  CRISPR gRNA sequence
ttaggtggatataaaaatga

SEQ ID NO: 468056 - DNA, 20 bp, Artificial
  CRISPR gRNA sequence
atatttttatgtatagagaa

SEQ ID NO: 468057 - DNA, 20 bp, Artificial
  CRISPR gRNA sequence
tcatcggtaccacctgatcg

SEQ ID NO: 468058 - DNA, 20 bp, Artificial
  CRISPR gRNA sequence
gataaaaattttaaacatga

SEQ ID NO: 468059 - DNA, 20 bp, Artificial
  CRISPR gRNA sequence
aaacctatagtgacttaaca

SEQ ID NO: 468060 - DNA, 20 bp, Artificial
  CRISPR gRNA sequence
cattatataagagcctgggg

SEQ ID NO: 468061 - DNA, 20 bp, Artificial
  CRISPR gRNA sequence
tctcgctctgtcacccaggc

SEQ ID NO: 468062 - DNA, 20 bp, Artificial
  CRISPR gRNA sequence
ctcattggaagctccgcctc

SEQ ID NO: 468063 - DNA, 20 bp, Artificial
  CRISPR gRNA sequence
ttttgtatttttagtagaga

SEQ ID NO: 468064 - DNA, 20 bp, Artificial
  CRISPR gRNA sequence
cggggtttcaccgtgttagc

SEQ ID NO: 468065 - DNA, 20 bp, Artificial
  CRISPR gRNA sequence
aaaatttcctgtcatcagat

SEQ ID NO: 468066 - DNA, 20 bp, Artificial
  CRISPR gRNA sequence
acagcagagataataagagc

SEQ ID NO: 468067 - DNA, 20 bp, Artificial
  CRISPR gRNA sequence
tacttgggaggctgaggcag

SEQ ID NO: 468068 - DNA, 20 bp, Artificial
  CRISPR gRNA sequence
caggagaatcgcttgaaccc

SEQ ID NO: 468069 - DNA, 20 bp, Artificial
  CRISPR gRNA sequence
aaataactgataattggaag

SEQ ID NO: 468070 - DNA, 20 bp, Artificial
  CRISPR gRNA sequence
tttgataagacaaacttttg

SEQ ID NO: 468071 - DNA, 20 bp, Artificial
  CRISPR gRNA sequence
tgtgtcctaagtatcataag

SEQ ID NO: 468072 - DNA, 20 bp, Artificial
  CRISPR gRNA sequence
taattcagaacaggcagaaa

SEQ ID NO: 468073 - DNA, 20 bp, Artificial
  CRISPR gRNA sequence
aagcttgtcagatggacaat

SEQ ID NO: 468074 - DNA, 20 bp, Artificial
  CRISPR gRNA sequence
cagcactttgtgaggcagag

SEQ ID NO: 468075 - DNA, 20 bp, Artificial
  CRISPR gRNA sequence
actttgtgaggcagaggcgg

SEQ ID NO: 468076 - DNA, 20 bp, Artificial
  CRISPR gRNA sequence
cgggtggatcacctgaggtc

SEQ ID NO: 468077 - DNA, 20 bp, Artificial
  CRISPR gRNA sequence
aaaattagccgggcgtggtt

SEQ ID NO: 468078 - DNA, 20 bp, Artificial
  CRISPR gRNA sequence
caccggggaggctgaggcag

SEQ ID NO: 468079 - DNA, 20 bp, Artificial
  CRISPR gRNA sequence
aataaattaattaaaaaaaa

SEQ ID NO: 468080 - DNA, 20 bp, Artificial
  CRISPR gRNA sequence
ataccttgtttgtgcacaga

SEQ ID NO: 468081 - DNA, 20 bp, Artificial
  CRISPR gRNA sequence
atgatcattatcctgctgat

SEQ ID NO: 468082 - DNA, 20 bp, Artificial
  CRISPR gRNA sequence
aatgtttccataatcctatt

SEQ ID NO: 468083 - DNA, 20 bp, Artificial
  CRISPR gRNA sequence
gaaaggtaatatattgtgat

SEQ ID NO: 468084 - DNA, 20 bp, Artificial
  CRISPR gRNA sequence
tgtgtgtgtttgtgtggtca

SEQ ID NO: 468085 - DNA, 20 bp, Artificial
  CRISPR gRNA sequence
gtttgtgtggtcaggggatg

SEQ ID NO: 468086 - DNA, 20 bp, Artificial
  CRISPR gRNA sequence
tttgaaacagacatgttcaa

SEQ ID NO: 468087 - DNA, 20 bp, Artificial
  CRISPR gRNA sequence
aggcattgtattttctcatg

SEQ ID NO: 468088 - DNA, 20 bp, Artificial
  CRISPR gRNA sequence
ctttttttttttttttgaga

SEQ ID NO: 468089 - DNA, 20 bp, Artificial
  CRISPR gRNA sequence
tcttactgtgttgcccaggc

SEQ ID NO: 468090 - DNA, 20 bp, Artificial
  CRISPR gRNA sequence
ctcactggaacctccagttc

SEQ ID NO: 468091 - DNA, 20 bp, Artificial
  CRISPR gRNA sequence
aattctcctgcctcagcctc

SEQ ID NO: 468092 - DNA, 20 bp, Artificial
  CRISPR gRNA sequence
gcctcagcctcttgagtagc

SEQ ID NO: 468093 - DNA, 20 bp, Artificial
  CRISPR gRNA sequence
ccctcggcctcccaaagtgc

SEQ ID NO: 468094 - DNA, 20 bp, Artificial
  CRISPR gRNA sequence
tgagctgatcacctcaggtt

SEQ ID NO: 468095 - DNA, 20 bp, Artificial
  CRISPR gRNA sequence
tacccgggaggctgaggcag

SEQ ID NO: 468096 - DNA, 20 bp, Artificial
  CRISPR gRNA sequence
tgcattccagcctgtgcaac

SEQ ID NO: 468097 - DNA, 20 bp, Artificial
  CRISPR gRNA sequence
aattaaatggtaaactcttt

SEQ ID NO: 468098 - DNA, 20 bp, Artificial
  CRISPR gRNA sequence
aagggaagttaggaggctga

SEQ ID NO: 468099 - DNA, 20 bp, Artificial
  CRISPR gRNA sequence
aggaacggacttctggaaac

SEQ ID NO: 468100 - DNA, 20 bp, Artificial
  CRISPR gRNA sequence
ttctaaacttttggaagcaa

SEQ ID NO: 468101 - DNA, 20 bp, Artificial
  CRISPR gRNA sequence
attcatgagatgtgagcagg

SEQ ID NO: 468102 - DNA, 20 bp, Artificial
  CRISPR gRNA sequence
gagcaggaagggtttttaag

SEQ ID NO: 468103 - DNA, 20 bp, Artificial
  CRISPR gRNA sequence
gaagggtttttaagtaggat

SEQ ID NO: 468104 - DNA, 20 bp, Artificial
  CRISPR gRNA sequence
tgtgaggaaatagataaaat

SEQ ID NO: 468105 - DNA, 20 bp, Artificial
  CRISPR gRNA sequence
atgagaatatttatgctggc

SEQ ID NO: 468106 - DNA, 20 bp, Artificial
  CRISPR gRNA sequence
aaataaggtgaaaccttgtt

SEQ ID NO: 468107 - DNA, 20 bp, Artificial
  CRISPR gRNA sequence
atagacatgtatgagaaact

SEQ ID NO: 468108 - DNA, 20 bp, Artificial
  CRISPR gRNA sequence
agctgtctttgtatttaaaa

SEQ ID NO: 468109 - DNA, 20 bp, Artificial
  CRISPR gRNA sequence
gatactgtacatctattcag

SEQ ID NO: 468110 - DNA, 20 bp, Artificial
  CRISPR gRNA sequence
attcagaagaatgcatgaaa

SEQ ID NO: 468111 - DNA, 20 bp, Artificial
  CRISPR gRNA sequence
aaaggctaagaaagaactgt

SEQ ID NO: 468112 - DNA, 20 bp, Artificial
  CRISPR gRNA sequence
aatttaaaagaaaatacttt

SEQ ID NO: 468113 - DNA, 20 bp, Artificial
  CRISPR gRNA sequence
agaaacaagccattggaaac

SEQ ID NO: 468114 - DNA, 20 bp, Artificial
  CRISPR gRNA sequence
agaaattaagagcaataatt

SEQ ID NO: 468115 - DNA, 20 bp, Artificial
  CRISPR gRNA sequence
ggaaaaaaatgacttaaaaa

SEQ ID NO: 468116 - DNA, 20 bp, Artificial
  CRISPR gRNA sequence
atttataattaaaagagaag

SEQ ID NO: 468117 - DNA, 20 bp, Artificial
  CRISPR gRNA sequence
catataaaaagtgaaaaggc

SEQ ID NO: 468118 - DNA, 20 bp, Artificial
  CRISPR gRNA sequence
catgaatgggagaaaatact

SEQ ID NO: 468119 - DNA, 20 bp, Artificial
  CRISPR gRNA sequence
ccattgttaaagagattaat

SEQ ID NO: 468120 - DNA, 20 bp, Artificial
  CRISPR gRNA sequence
agagattaatatggatagaa

SEQ ID NO: 468121 - DNA, 20 bp, Artificial
  CRISPR gRNA sequence
aaattgatttcaggggaaac

SEQ ID NO: 468122 - DNA, 20 bp, Artificial
  CRISPR gRNA sequence
ctgcctcaggtttctgttct

SEQ ID NO: 468123 - DNA, 20 bp, Artificial
  CRISPR gRNA sequence
ttgctaagtgtgcaggctag

SEQ ID NO: 468124 - DNA, 20 bp, Artificial
  CRISPR gRNA sequence
cttcctccatgtagatttca

SEQ ID NO: 468125 - DNA, 20 bp, Artificial
  CRISPR gRNA sequence
ggacagcctgagggcccagg

SEQ ID NO: 468126 - DNA, 20 bp, Artificial
  CRISPR gRNA sequence
tcagtgcctagtagagccat

SEQ ID NO: 468127 - DNA, 20 bp, Artificial
  CRISPR gRNA sequence
agcctgggagagctgcaggt

SEQ ID NO: 468128 - DNA, 20 bp, Artificial
  CRISPR gRNA sequence
caggtaggagtctccaactt

SEQ ID NO: 468129 - DNA, 20 bp, Artificial
  CRISPR gRNA sequence
aatgccattttatttctctg

SEQ ID NO: 468130 - DNA, 20 bp, Artificial
  CRISPR gRNA sequence
ttttgcctatttctcccttt

SEQ ID NO: 468131 - DNA, 20 bp, Artificial
  CRISPR gRNA sequence
ctatttctcccttttggaat

SEQ ID NO: 468132 - DNA, 20 bp, Artificial
  CRISPR gRNA sequence
tttacatgatcatagttgga

SEQ ID NO: 468133 - DNA, 20 bp, Artificial
  CRISPR gRNA sequence
tggagggaatttgcttcata

SEQ ID NO: 468134 - DNA, 20 bp, Artificial
  CRISPR gRNA sequence
gcttcataatgaatcgtgcc

SEQ ID NO: 468135 - DNA, 20 bp, Artificial
  CRISPR gRNA sequence
tatctggtttagataagact

SEQ ID NO: 468136 - DNA, 20 bp, Artificial
  CRISPR gRNA sequence
aagactctgaatttagtgtt

SEQ ID NO: 468137 - DNA, 20 bp, Artificial
  CRISPR gRNA sequence
aacttttggggctattgaga

SEQ ID NO: 468138 - DNA, 20 bp, Artificial
  CRISPR gRNA sequence
tttggggctattgagatgga

SEQ ID NO: 468139 - DNA, 20 bp, Artificial
  CRISPR gRNA sequence
attttgtatgtgaaaagaac

SEQ ID NO: 468140 - DNA, 20 bp, Artificial
  CRISPR gRNA sequence
gagttttgggggaccagggg

SEQ ID NO: 468141 - DNA, 20 bp, Artificial
  CRISPR gRNA sequence
caggggcagaatgctatggt

SEQ ID NO: 468142 - DNA, 20 bp, Artificial
  CRISPR gRNA sequence
cctttaagagatcagaggtt

SEQ ID NO: 468143 - DNA, 20 bp, Artificial
  CRISPR gRNA sequence
tgtattaatgcccttattgt

SEQ ID NO: 468144 - DNA, 20 bp, Artificial
  CRISPR gRNA sequence
ttaatgcccttattgtagga

SEQ ID NO: 468145 - DNA, 20 bp, Artificial
  CRISPR gRNA sequence
aggaatggattcgttatcac

SEQ ID NO: 468146 - DNA, 20 bp, Artificial
  CRISPR gRNA sequence
cgggagtaggcacctgataa

SEQ ID NO: 468147 - DNA, 20 bp, Artificial
  CRISPR gRNA sequence
tatttcaccttgcaggcggg

SEQ ID NO: 468148 - DNA, 20 bp, Artificial
  CRISPR gRNA sequence
aggcgggctgagtccaaaaa

SEQ ID NO: 468149 - DNA, 20 bp, Artificial
  CRISPR gRNA sequence
tcattagtacttataggttt

SEQ ID NO: 468150 - DNA, 20 bp, Artificial
  CRISPR gRNA sequence
ataggttttgggataggcag

SEQ ID NO: 468151 - DNA, 20 bp, Artificial
  CRISPR gRNA sequence
agagcaatgttttgggggca

SEQ ID NO: 468152 - DNA, 20 bp, Artificial
  CRISPR gRNA sequence
caatgttttgggggcagggg

SEQ ID NO: 468153 - DNA, 20 bp, Artificial
  CRISPR gRNA sequence
atctcacaaaatacattctc

SEQ ID NO: 468154 - DNA, 20 bp, Artificial
  CRISPR gRNA sequence
aatacattctcaagggtggg

SEQ ID NO: 468155 - DNA, 20 bp, Artificial
  CRISPR gRNA sequence
gaattacaaagaaacttctt

SEQ ID NO: 468156 - DNA, 20 bp, Artificial
  CRISPR gRNA sequence
tacaaagtacattgatcagt

SEQ ID NO: 468157 - DNA, 20 bp, Artificial
  CRISPR gRNA sequence
gaagaaacaaatcacaatgg

SEQ ID NO: 468158 - DNA, 20 bp, Artificial
  CRISPR gRNA sequence
aggctattttcacttctttt

SEQ ID NO: 468159 - DNA, 20 bp, Artificial
  CRISPR gRNA sequence
cttcagttgcttcaggccat

SEQ ID NO: 468160 - DNA, 20 bp, Artificial
  CRISPR gRNA sequence
ggatgtatacgtgcaggtca

SEQ ID NO: 468161 - DNA, 20 bp, Artificial
  CRISPR gRNA sequence
gctcaaaggcctgacagaca

SEQ ID NO: 468162 - DNA, 20 bp, Artificial
  CRISPR gRNA sequence
ggcttaattactagaaattg

SEQ ID NO: 468163 - DNA, 20 bp, Artificial
  CRISPR gRNA sequence
ttgtttttatcttttaggga

SEQ ID NO: 468164 - DNA, 20 bp, Artificial
  CRISPR gRNA sequence
agcaggagatccctttgaac

SEQ ID NO: 468165 - DNA, 20 bp, Artificial
  CRISPR gRNA sequence
accagtgcttcctaatgaca

SEQ ID NO: 468166 - DNA, 20 bp, Artificial
  CRISPR gRNA sequence
aacaactctttatgtgacag

SEQ ID NO: 468167 - DNA, 20 bp, Artificial
  CRISPR gRNA sequence
tataatgtttccaggaagag

SEQ ID NO: 468168 - DNA, 20 bp, Artificial
  CRISPR gRNA sequence
tgtgtatgtgtgcgtttgag

SEQ ID NO: 468169 - DNA, 20 bp, Artificial
  CRISPR gRNA sequence
ttgaggtgagtgagatagag

SEQ ID NO: 468170 - DNA, 20 bp, Artificial
  CRISPR gRNA sequence
aagttattgtttttgacttt

SEQ ID NO: 468171 - DNA, 20 bp, Artificial
  CRISPR gRNA sequence
aatattgaaaaaattataaa

SEQ ID NO: 468172 - DNA, 20 bp, Artificial
  CRISPR gRNA sequence
taaagtgaatacctatagtt

SEQ ID NO: 468173 - DNA, 20 bp, Artificial
  CRISPR gRNA sequence
tgacttcctagtgattttct

SEQ ID NO: 468174 - DNA, 20 bp, Artificial
  CRISPR gRNA sequence
ttaagcttggggaaaccaag

SEQ ID NO: 468175 - DNA, 20 bp, Artificial
  CRISPR gRNA sequence
catgaaaaaatacatagggg

SEQ ID NO: 468176 - DNA, 20 bp, Artificial
  CRISPR gRNA sequence
tacatagggggggagtaggt

SEQ ID NO: 468177 - DNA, 20 bp, Artificial
  CRISPR gRNA sequence
cctaagaacaggaacaagac

SEQ ID NO: 468178 - DNA, 20 bp, Artificial
  CRISPR gRNA sequence
aaaactattaaagctaatac

SEQ ID NO: 468179 - DNA, 20 bp, Artificial
  CRISPR gRNA sequence
tttagcaattccacatgata

SEQ ID NO: 468180 - DNA, 20 bp, Artificial
  CRISPR gRNA sequence
ccatttacaatagcatcaaa

SEQ ID NO: 468181 - DNA, 20 bp, Artificial
  CRISPR gRNA sequence
aaatttaaccaaagaggtat

SEQ ID NO: 468182 - DNA, 20 bp, Artificial
  CRISPR gRNA sequence
agcatggctgaaagaaattc

SEQ ID NO: 468183 - DNA, 20 bp, Artificial
  CRISPR gRNA sequence
agctgatcctaaaattcaca

SEQ ID NO: 468184 - DNA, 20 bp, Artificial
  CRISPR gRNA sequence
acattgagttgcaacagacc

SEQ ID NO: 468185 - DNA, 20 bp, Artificial
  CRISPR gRNA sequence
gacagttaaaaaaaaaaaaa

SEQ ID NO: 468186 - DNA, 20 bp, Artificial
  CRISPR gRNA sequence
aaaaaaagaatagtattgtc

SEQ ID NO: 468187 - DNA, 20 bp, Artificial
  CRISPR gRNA sequence
gacaaagagatcaatgtaaa

SEQ ID NO: 468188 - DNA, 20 bp, Artificial
  CRISPR gRNA sequence
agatcaatgtaaatagaatt

SEQ ID NO: 468189 - DNA, 20 bp, Artificial
  CRISPR gRNA sequence
tgtaaatagaattgagagtc

SEQ ID NO: 468190 - DNA, 20 bp, Artificial
  CRISPR gRNA sequence
gtagtcaattgatttttgat

SEQ ID NO: 468191 - DNA, 20 bp, Artificial
  CRISPR gRNA sequence
ccaagattattcagtgggga

SEQ ID NO: 468192 - DNA, 20 bp, Artificial
  CRISPR gRNA sequence
atagtctcaataaatggtgc

SEQ ID NO: 468193 - DNA, 20 bp, Artificial
  CRISPR gRNA sequence
aataaatggtgccaggataa

SEQ ID NO: 468194 - DNA, 20 bp, Artificial
  CRISPR gRNA sequence
aattggatattcatatgtaa

SEQ ID NO: 468195 - DNA, 20 bp, Artificial
  CRISPR gRNA sequence
gatttcttaggagaaaacat

SEQ ID NO: 468196 - DNA, 20 bp, Artificial
  CRISPR gRNA sequence
agggataaatgtttctgatc

SEQ ID NO: 468197 - DNA, 20 bp, Artificial
  CRISPR gRNA sequence
ttttaaaatgagcaaaggac

SEQ ID NO: 468198 - DNA, 20 bp, Artificial
  CRISPR gRNA sequence
gaaaacccacttcacaccca

SEQ ID NO: 468199 - DNA, 20 bp, Artificial
  CRISPR gRNA sequence
cttcacacccatcgaatgac

SEQ ID NO: 468200 - DNA, 20 bp, Artificial
  CRISPR gRNA sequence
agaaaataataagtgttagc

SEQ ID NO: 468201 - DNA, 20 bp, Artificial
  CRISPR gRNA sequence
aaaccctatccattgctgag

SEQ ID NO: 468202 - DNA, 20 bp, Artificial
  CRISPR gRNA sequence
gttcacacaaaaccttgttc

SEQ ID NO: 468203 - DNA, 20 bp, Artificial
  CRISPR gRNA sequence
acaacctaaatgttcagctg

SEQ ID NO: 468204 - DNA, 20 bp, Artificial
  CRISPR gRNA sequence
cctaaatgttcagctgatga

SEQ ID NO: 468205 - DNA, 20 bp, Artificial
  CRISPR gRNA sequence
aaatgtagtttatccacaca

SEQ ID NO: 468206 - DNA, 20 bp, Artificial
  CRISPR gRNA sequence
aatattattcagtcatgaaa

SEQ ID NO: 468207 - DNA, 20 bp, Artificial
  CRISPR gRNA sequence
tgccaggggctgaggaaata

SEQ ID NO: 468208 - DNA, 20 bp, Artificial
  CRISPR gRNA sequence
ataggtagagggcttccttt

SEQ ID NO: 468209 - DNA, 20 bp, Artificial
  CRISPR gRNA sequence
tttggggtgataaatatgtt

SEQ ID NO: 468210 - DNA, 20 bp, Artificial
  CRISPR gRNA sequence
agtcacgtttgcaaaacatt

SEQ ID NO: 468211 - DNA, 20 bp, Artificial
  CRISPR gRNA sequence
ttaccacaataaaaatatat

SEQ ID NO: 468212 - DNA, 20 bp, Artificial
  CRISPR gRNA sequence
aaaatatatttggatcaaag

SEQ ID NO: 468213 - DNA, 20 bp, Artificial
  CRISPR gRNA sequence
tttaattataagaaataatg

SEQ ID NO: 468214 - DNA, 20 bp, Artificial
  CRISPR gRNA sequence
gggaaggagaaatttcaaaa

SEQ ID NO: 468215 - DNA, 20 bp, Artificial
  CRISPR gRNA sequence
aatagcagcatggctgaact

SEQ ID NO: 468216 - DNA, 20 bp, Artificial
  CRISPR gRNA sequence
cctttatggacatcattcac

SEQ ID NO: 468217 - DNA, 20 bp, Artificial
  CRISPR gRNA sequence
gttactttatatgcttactt

SEQ ID NO: 468218 - DNA, 20 bp, Artificial
  CRISPR gRNA sequence
cccttaaagtagcccagtga

SEQ ID NO: 468219 - DNA, 20 bp, Artificial
  CRISPR gRNA sequence
aatatagaagaaatcgatgg

SEQ ID NO: 468220 - DNA, 20 bp, Artificial
  CRISPR gRNA sequence
cactggcttataaacctctt

SEQ ID NO: 468221 - DNA, 20 bp, Artificial
  CRISPR gRNA sequence
aaacatctttgctctgtatg

SEQ ID NO: 468222 - DNA, 20 bp, Artificial
  CRISPR gRNA sequence
ttgctctgtatgatggatgg

SEQ ID NO: 468223 - DNA, 20 bp, Artificial
  CRISPR gRNA sequence
cactaaatatttctttgtaa

SEQ ID NO: 468224 - DNA, 20 bp, Artificial
  CRISPR gRNA sequence
aacctggagaaggctatatt

SEQ ID NO: 468225 - DNA, 20 bp, Artificial
  CRISPR gRNA sequence
aaggctatattaaggatgta

SEQ ID NO: 468226 - DNA, 20 bp, Artificial
  CRISPR gRNA sequence
tggaatgaacactttctgga

SEQ ID NO: 468227 - DNA, 20 bp, Artificial
  CRISPR gRNA sequence
cacattaatgagacaaaata

SEQ ID NO: 468228 - DNA, 20 bp, Artificial
  CRISPR gRNA sequence
aatctgcaaaatattaattc

SEQ ID NO: 468229 - DNA, 20 bp, Artificial
  CRISPR gRNA sequence
ttctagaatgatatatacta

SEQ ID NO: 468230 - DNA, 20 bp, Artificial
  CRISPR gRNA sequence
taaaattaaattttgaggca

SEQ ID NO: 468231 - DNA, 20 bp, Artificial
  CRISPR gRNA sequence
aatctacttctatacgagac

SEQ ID NO: 468232 - DNA, 20 bp, Artificial
  CRISPR gRNA sequence
atttctgctctatcccatat

SEQ ID NO: 468233 - DNA, 20 bp, Artificial
  CRISPR gRNA sequence
tgcataaaggtgcctgttct

SEQ ID NO: 468234 - DNA, 20 bp, Artificial
  CRISPR gRNA sequence
gatcaagttggggctgagat

SEQ ID NO: 468235 - DNA, 20 bp, Artificial
  CRISPR gRNA sequence
gaacccaactttaggggaaa

SEQ ID NO: 468236 - DNA, 20 bp, Artificial
  CRISPR gRNA sequence
ctcctaaatcctgtgccttg

SEQ ID NO: 468237 - DNA, 20 bp, Artificial
  CRISPR gRNA sequence
gatcctcatggaaaatccca

SEQ ID NO: 468238 - DNA, 20 bp, Artificial
  CRISPR gRNA sequence
accacctttctagattgttt

SEQ ID NO: 468239 - DNA, 20 bp, Artificial
  CRISPR gRNA sequence
ttcatgatcacctgagggga

SEQ ID NO: 468240 - DNA, 20 bp, Artificial
  CRISPR gRNA sequence
attataatgtcctggaaggc

SEQ ID NO: 468241 - DNA, 20 bp, Artificial
  CRISPR gRNA sequence
tcacaaaaggtaaattgttt

SEQ ID NO: 468242 - DNA, 20 bp, Artificial
  CRISPR gRNA sequence
aactttaatttaaactctgt

SEQ ID NO: 468243 - DNA, 20 bp, Artificial
  CRISPR gRNA sequence
gtgaaaacaaaaataacagg

SEQ ID NO: 468244 - DNA, 20 bp, Artificial
  CRISPR gRNA sequence
atgtaagaacaggactgtga

SEQ ID NO: 468245 - DNA, 20 bp, Artificial
  CRISPR gRNA sequence
gactgtgacagagttggggc

SEQ ID NO: 468246 - DNA, 20 bp, Artificial
  CRISPR gRNA sequence
ttgggaaagcactattctcc

SEQ ID NO: 468247 - DNA, 20 bp, Artificial
  CRISPR gRNA sequence
cgaacaaatcacttgaggtc

SEQ ID NO: 468248 - DNA, 20 bp, Artificial
  CRISPR gRNA sequence
tactcaggaggctgaagcag

SEQ ID NO: 468249 - DNA, 20 bp, Artificial
  CRISPR gRNA sequence
ttgcaccactgcactccagc

SEQ ID NO: 468250 - DNA, 20 bp, Artificial
  CRISPR gRNA sequence
tcattatctgtggcaggaaa

SEQ ID NO: 468251 - DNA, 20 bp, Artificial
  CRISPR gRNA sequence
ctgtggcaggaaagtgggtg

SEQ ID NO: 468252 - DNA, 20 bp, Artificial
  CRISPR gRNA sequence
accctgatttggagcacctg

SEQ ID NO: 468253 - DNA, 20 bp, Artificial
  CRISPR gRNA sequence
atactgtgtccttatgctta

SEQ ID NO: 468254 - DNA, 20 bp, Artificial
  CRISPR gRNA sequence
ttactttgtgtcaatgatcg

SEQ ID NO: 468255 - DNA, 20 bp, Artificial
  CRISPR gRNA sequence
actgatcttgagatagattg

SEQ ID NO: 468256 - DNA, 20 bp, Artificial
  CRISPR gRNA sequence
ctctggtagtgtgcaaacac

SEQ ID NO: 468257 - DNA, 20 bp, Artificial
  CRISPR gRNA sequence
agctctggttttggacacgt

SEQ ID NO: 468258 - DNA, 20 bp, Artificial
  CRISPR gRNA sequence
caaactcaaaataagttagg

SEQ ID NO: 468259 - DNA, 20 bp, Artificial
  CRISPR gRNA sequence
aaaataagttagggggagtt

SEQ ID NO: 468260 - DNA, 20 bp, Artificial
  CRISPR gRNA sequence
aaatagagaaacagtttgtt

SEQ ID NO: 468261 - DNA, 20 bp, Artificial
  CRISPR gRNA sequence
ggttaaagaaataacagaag

SEQ ID NO: 468262 - DNA, 20 bp, Artificial
  CRISPR gRNA sequence
tccagcagatctgtttgtat

SEQ ID NO: 468263 - DNA, 20 bp, Artificial
  CRISPR gRNA sequence
agacaacatttgttaccact

SEQ ID NO: 468264 - DNA, 20 bp, Artificial
  CRISPR gRNA sequence
taacattataatataattaa

SEQ ID NO: 468265 - DNA, 20 bp, Artificial
  CRISPR gRNA sequence
aattttttttttgtttgaga

SEQ ID NO: 468266 - DNA, 20 bp, Artificial
  CRISPR gRNA sequence
gtcttactctgtcacccagg

SEQ ID NO: 468267 - DNA, 20 bp, Artificial
  CRISPR gRNA sequence
ttcaccgaagtctccaccta

SEQ ID NO: 468268 - DNA, 20 bp, Artificial
  CRISPR gRNA sequence
gtctcagcctcccatgtacc

SEQ ID NO: 468269 - DNA, 20 bp, Artificial
  CRISPR gRNA sequence
ttttgtatttttagtagaga

SEQ ID NO: 468270 - DNA, 20 bp, Artificial
  CRISPR gRNA sequence
tgagccaccaggccagacct

SEQ ID NO: 468271 - DNA, 20 bp, Artificial
  CRISPR gRNA sequence
ggtcatacttaaccataaga

SEQ ID NO: 468272 - DNA, 20 bp, Artificial
  CRISPR gRNA sequence
ttctccattgacactttggt

SEQ ID NO: 468273 - DNA, 20 bp, Artificial
  CRISPR gRNA sequence
aatgttttgttgcactaagt

SEQ ID NO: 468274 - DNA, 20 bp, Artificial
  CRISPR gRNA sequence
gggttgcatcctgtatagtg

SEQ ID NO: 468275 - DNA, 20 bp, Artificial
  CRISPR gRNA sequence
gtatagtgtagggtgtttag

SEQ ID NO: 468276 - DNA, 20 bp, Artificial
  CRISPR gRNA sequence
ggacattgtgttgaagaaac

SEQ ID NO: 468277 - DNA, 20 bp, Artificial
  CRISPR gRNA sequence
cctgttacaaacatgttggc

SEQ ID NO: 468278 - DNA, 20 bp, Artificial
  CRISPR gRNA sequence
atggttttcctacttaagtg

SEQ ID NO: 468279 - DNA, 20 bp, Artificial
  CRISPR gRNA sequence
cctacttaagtgatgaatat

SEQ ID NO: 468280 - DNA, 20 bp, Artificial
  CRISPR gRNA sequence
ctgtggaagattaactctat

SEQ ID NO: 468281 - DNA, 20 bp, Artificial
  CRISPR gRNA sequence
agattaactctatcagaata

SEQ ID NO: 468282 - DNA, 20 bp, Artificial
  CRISPR gRNA sequence
caagaggtggctgagggcac

SEQ ID NO: 468283 - DNA, 20 bp, Artificial
  CRISPR gRNA sequence
tgagggcactgggattcttg

SEQ ID NO: 468284 - DNA, 20 bp, Artificial
  CRISPR gRNA sequence
ctcaagttctgacaatgcag

SEQ ID NO: 468285 - DNA, 20 bp, Artificial
  CRISPR gRNA sequence
gtatcgtttacttcctttgg

SEQ ID NO: 468286 - DNA, 20 bp, Artificial
  CRISPR gRNA sequence
ctgcctgagaaggcaccaag

SEQ ID NO: 468287 - DNA, 20 bp, Artificial
  CRISPR gRNA sequence
cattcttatttctggggcta

SEQ ID NO: 468288 - DNA, 20 bp, Artificial
  CRISPR gRNA sequence
ctttcccaatcctgtaaacc

SEQ ID NO: 468289 - DNA, 20 bp, Artificial
  CRISPR gRNA sequence
ataggttggttggggctccc

SEQ ID NO: 468290 - DNA, 20 bp, Artificial
  CRISPR gRNA sequence
accacgcacagtattccagc

SEQ ID NO: 468291 - DNA, 20 bp, Artificial
  CRISPR gRNA sequence
agagctcttctaaaccttaa

SEQ ID NO: 468292 - DNA, 20 bp, Artificial
  CRISPR gRNA sequence
attataaacatatgcttgac

SEQ ID NO: 468293 - DNA, 20 bp, Artificial
  CRISPR gRNA sequence
caataatgcatatgaaaaat

SEQ ID NO: 468294 - DNA, 20 bp, Artificial
  CRISPR gRNA sequence
aatgtgggtttggctatgat

SEQ ID NO: 468295 - DNA, 20 bp, Artificial
  CRISPR gRNA sequence
aagtaagagaggaaagcata

SEQ ID NO: 468296 - DNA, 20 bp, Artificial
  CRISPR gRNA sequence
acacttattctgtgtgacac

SEQ ID NO: 468297 - DNA, 20 bp, Artificial
  CRISPR gRNA sequence
caaaagtgcttctggtattt

SEQ ID NO: 468298 - DNA, 20 bp, Artificial
  CRISPR gRNA sequence
tattttggagtgagaacttc

SEQ ID NO: 468299 - DNA, 20 bp, Artificial
  CRISPR gRNA sequence
tctggagttcagaaccttct

SEQ ID NO: 468300 - DNA, 20 bp, Artificial
  CRISPR gRNA sequence
agaaccttctctggattctg

SEQ ID NO: 468301 - DNA, 20 bp, Artificial
  CRISPR gRNA sequence
ctctctcagaacttcagaaa

SEQ ID NO: 468302 - DNA, 20 bp, Artificial
  CRISPR gRNA sequence
agaacttcagaaaaggagtc

SEQ ID NO: 468303 - DNA, 20 bp, Artificial
  CRISPR gRNA sequence
ggacagcagcatttctggca

SEQ ID NO: 468304 - DNA, 20 bp, Artificial
  CRISPR gRNA sequence
agcatttctggcattgagta

SEQ ID NO: 468305 - DNA, 20 bp, Artificial
  CRISPR gRNA sequence
cagagagagagctggtcagt

SEQ ID NO: 468306 - DNA, 20 bp, Artificial
  CRISPR gRNA sequence
acactatccctggcattcaa

SEQ ID NO: 468307 - DNA, 20 bp, Artificial
  CRISPR gRNA sequence
tggcattcaacaggataagc

SEQ ID NO: 468308 - DNA, 20 bp, Artificial
  CRISPR gRNA sequence
tgtgtttatttatttattca

SEQ ID NO: 468309 - DNA, 20 bp, Artificial
  CRISPR gRNA sequence
atagacccatttttaaaaat

SEQ ID NO: 468310 - DNA, 20 bp, Artificial
  CRISPR gRNA sequence
tctatgcagcaaagactctt

SEQ ID NO: 468311 - DNA, 20 bp, Artificial
  CRISPR gRNA sequence
accttaaggtctttctggaa

SEQ ID NO: 468312 - DNA, 20 bp, Artificial
  CRISPR gRNA sequence
agagagtagggagctgatga

SEQ ID NO: 468313 - DNA, 20 bp, Artificial
  CRISPR gRNA sequence
gaccactcagactaaaggaa

SEQ ID NO: 468314 - DNA, 20 bp, Artificial
  CRISPR gRNA sequence
agactaaaggaagggaattt

SEQ ID NO: 468315 - DNA, 20 bp, Artificial
  CRISPR gRNA sequence
tcaatctttcctataaggtt

SEQ ID NO: 468316 - DNA, 20 bp, Artificial
  CRISPR gRNA sequence
tgtaaatgtaggcttttctt

SEQ ID NO: 468317 - DNA, 20 bp, Artificial
  CRISPR gRNA sequence
atgtaggcttttcttttgag

SEQ ID NO: 468318 - DNA, 20 bp, Artificial
  CRISPR gRNA sequence
tggagatattagaactaaaa

SEQ ID NO: 468319 - DNA, 20 bp, Artificial
  CRISPR gRNA sequence
gtgtgtgtgtttcaataagg

SEQ ID NO: 468320 - DNA, 20 bp, Artificial
  CRISPR gRNA sequence
tagcatcagtaggcactgtg

SEQ ID NO: 468321 - DNA, 20 bp, Artificial
  CRISPR gRNA sequence
agctgtggacattgttcttc

SEQ ID NO: 468322 - DNA, 20 bp, Artificial
  CRISPR gRNA sequence
cattgttcttcctgggtagg

SEQ ID NO: 468323 - DNA, 20 bp, Artificial
  CRISPR gRNA sequence
tgatttgaagcttaattcaa

SEQ ID NO: 468324 - DNA, 20 bp, Artificial
  CRISPR gRNA sequence
aaagcgtttttgctattaac

SEQ ID NO: 468325 - DNA, 20 bp, Artificial
  CRISPR gRNA sequence
gcatttcagaaaataatcaa

SEQ ID NO: 468326 - DNA, 20 bp, Artificial
  CRISPR gRNA sequence
ttaatccaaaacggtccttt

SEQ ID NO: 468327 - DNA, 20 bp, Artificial
  CRISPR gRNA sequence
tgcttgcctaataaaaacca

SEQ ID NO: 468328 - DNA, 20 bp, Artificial
  CRISPR gRNA sequence
ccactgaattgtacacttaa

SEQ ID NO: 468329 - DNA, 20 bp, Artificial
  CRISPR gRNA sequence
tgaattgtacacttaaaagg

SEQ ID NO: 468330 - DNA, 20 bp, Artificial
  CRISPR gRNA sequence
aagggtgaattttatggcat

SEQ ID NO: 468331 - DNA, 20 bp, Artificial
  CRISPR gRNA sequence
tgtatactgtaacctgccat

SEQ ID NO: 468332 - DNA, 20 bp, Artificial
  CRISPR gRNA sequence
cctgccataggaatgtaagg

SEQ ID NO: 468333 - DNA, 20 bp, Artificial
  CRISPR gRNA sequence
gtggcacccagccactttga

SEQ ID NO: 468334 - DNA, 20 bp, Artificial
  CRISPR gRNA sequence
ctttgacggggtgccacagc

SEQ ID NO: 468335 - DNA, 20 bp, Artificial
  CRISPR gRNA sequence
catggaaatgagccatttct

SEQ ID NO: 468336 - DNA, 20 bp, Artificial
  CRISPR gRNA sequence
aaacagattgaaaagtatca

SEQ ID NO: 468337 - DNA, 20 bp, Artificial
  CRISPR gRNA sequence
ctcaaccaggctcttttcag

SEQ ID NO: 468338 - DNA, 20 bp, Artificial
  CRISPR gRNA sequence
aggctcttttcagtggagtt

SEQ ID NO: 468339 - DNA, 20 bp, Artificial
  CRISPR gRNA sequence
tttgggcagccaccacatca

SEQ ID NO: 468340 - DNA, 20 bp, Artificial
  CRISPR gRNA sequence
tcagagggtggcactgtatc

SEQ ID NO: 468341 - DNA, 20 bp, Artificial
  CRISPR gRNA sequence
ggaattcttacatagcttct

SEQ ID NO: 468342 - DNA, 20 bp, Artificial
  CRISPR gRNA sequence
cctactgcacacatcacaat

SEQ ID NO: 468343 - DNA, 20 bp, Artificial
  CRISPR gRNA sequence
cagtggacttgataccttaa

SEQ ID NO: 468344 - DNA, 20 bp, Artificial
  CRISPR gRNA sequence
cggaaatcgatgggcaaaac

SEQ ID NO: 468345 - DNA, 20 bp, Artificial
  CRISPR gRNA sequence
taaaaaactgaaatagcccc

SEQ ID NO: 468346 - DNA, 20 bp, Artificial
  CRISPR gRNA sequence
gagcggctaataaataactg

SEQ ID NO: 468347 - DNA, 20 bp, Artificial
  CRISPR gRNA sequence
ttggctatatttgaaacggt

SEQ ID NO: 468348 - DNA, 20 bp, Artificial
  CRISPR gRNA sequence
acggtaagaattttcttgcc

SEQ ID NO: 468349 - DNA, 20 bp, Artificial
  CRISPR gRNA sequence
actttgggaggccgaggcgg

SEQ ID NO: 468350 - DNA, 20 bp, Artificial
  CRISPR gRNA sequence
tactcgggaggctgaggcag

SEQ ID NO: 468351 - DNA, 20 bp, Artificial
  CRISPR gRNA sequence
caaaaaaaaaaaaaaaaaag

SEQ ID NO: 468352 - DNA, 20 bp, Artificial
  CRISPR gRNA sequence
aagaagaattttcttttgat

SEQ ID NO: 468353 - DNA, 20 bp, Artificial
  CRISPR gRNA sequence
cttttgataggaataacaac

SEQ ID NO: 468354 - DNA, 20 bp, Artificial
  CRISPR gRNA sequence
ttattgtttctgccctctta

SEQ ID NO: 468355 - DNA, 20 bp, Artificial
  CRISPR gRNA sequence
taaactgcctgaagttttca

SEQ ID NO: 468356 - DNA, 20 bp, Artificial
  CRISPR gRNA sequence
ctatgctttttatcttgaag

SEQ ID NO: 468357 - DNA, 20 bp, Artificial
  CRISPR gRNA sequence
aaagcacaaaataactattt

SEQ ID NO: 468358 - DNA, 20 bp, Artificial
  CRISPR gRNA sequence
gctgaaagtgtagatgtcag

SEQ ID NO: 468359 - DNA, 20 bp, Artificial
  CRISPR gRNA sequence
ttttcattcatagtttgcta

SEQ ID NO: 468360 - DNA, 20 bp, Artificial
  CRISPR gRNA sequence
tgtaggttgatgctcacctt

SEQ ID NO: 468361 - DNA, 20 bp, Artificial
  CRISPR gRNA sequence
caagtactgctatcagaaac

SEQ ID NO: 468362 - DNA, 20 bp, Artificial
  CRISPR gRNA sequence
aatgaccctgacctttgttt

SEQ ID NO: 468363 - DNA, 20 bp, Artificial
  CRISPR gRNA sequence
cctttgtttcaggatgcagg

SEQ ID NO: 468364 - DNA, 20 bp, Artificial
  CRISPR gRNA sequence
aaatgtaaaagaagcaccaa

SEQ ID NO: 468365 - DNA, 20 bp, Artificial
  CRISPR gRNA sequence
aatatgcatccatatgtgtg

SEQ ID NO: 468366 - DNA, 20 bp, Artificial
  CRISPR gRNA sequence
tctgactccaacagggacca

SEQ ID NO: 468367 - DNA, 20 bp, Artificial
  CRISPR gRNA sequence
acatcattgtctgggctcaa

SEQ ID NO: 468368 - DNA, 20 bp, Artificial
  CRISPR gRNA sequence
caaataatatttctcaattt

SEQ ID NO: 468369 - DNA, 20 bp, Artificial
  CRISPR gRNA sequence
agaaatgttcatgttagtgc

SEQ ID NO: 468370 - DNA, 20 bp, Artificial
  CRISPR gRNA sequence
catgttagtgcttgggtctt

SEQ ID NO: 468371 - DNA, 20 bp, Artificial
  CRISPR gRNA sequence
gcttgggtcttaagggtcca

SEQ ID NO: 468372 - DNA, 20 bp, Artificial
  CRISPR gRNA sequence
gagctttttatattatagcc

SEQ ID NO: 468373 - DNA, 20 bp, Artificial
  CRISPR gRNA sequence
ctccaaaactggttgacatc

SEQ ID NO: 468374 - DNA, 20 bp, Artificial
  CRISPR gRNA sequence
ctggttgacatcatgagtag

SEQ ID NO: 468375 - DNA, 20 bp, Artificial
  CRISPR gRNA sequence
aatttttgctgtgtcagtct

SEQ ID NO: 468376 - DNA, 20 bp, Artificial
  CRISPR gRNA sequence
taaatggtgcaataaaaata

SEQ ID NO: 468377 - DNA, 20 bp, Artificial
  CRISPR gRNA sequence
aaaaatatagaatataccaa

SEQ ID NO: 468378 - DNA, 20 bp, Artificial
  CRISPR gRNA sequence
tagaatataccaattggata

SEQ ID NO: 468379 - DNA, 20 bp, Artificial
  CRISPR gRNA sequence
atgaggaaagtagagactca

SEQ ID NO: 468380 - DNA, 20 bp, Artificial
  CRISPR gRNA sequence
tcactgggtcacatagacta

SEQ ID NO: 468381 - DNA, 20 bp, Artificial
  CRISPR gRNA sequence
ggtcacatagactaatggat

SEQ ID NO: 468382 - DNA, 20 bp, Artificial
  CRISPR gRNA sequence
aggaatgtgacataatgctg

SEQ ID NO: 468383 - DNA, 20 bp, Artificial
  CRISPR gRNA sequence
attaatatacttatgggcat

SEQ ID NO: 468384 - DNA, 20 bp, Artificial
  CRISPR gRNA sequence
tgaatagtttaaaagttagt

SEQ ID NO: 468385 - DNA, 20 bp, Artificial
  CRISPR gRNA sequence
gcaagttaaagtgcaattaa

SEQ ID NO: 468386 - DNA, 20 bp, Artificial
  CRISPR gRNA sequence
taatggaatggaggaaaacc

SEQ ID NO: 468387 - DNA, 20 bp, Artificial
  CRISPR gRNA sequence
agaatatttaattggtctgt

SEQ ID NO: 468388 - DNA, 20 bp, Artificial
  CRISPR gRNA sequence
tcttgctgttcttcttacta

SEQ ID NO: 468389 - DNA, 20 bp, Artificial
  CRISPR gRNA sequence
tactgaggttgcagccactt

SEQ ID NO: 468390 - DNA, 20 bp, Artificial
  CRISPR gRNA sequence
acttaagagtatagcaaaag

SEQ ID NO: 468391 - DNA, 20 bp, Artificial
  CRISPR gRNA sequence
ttttggactttccaaagtac

SEQ ID NO: 468392 - DNA, 20 bp, Artificial
  CRISPR gRNA sequence
attcaacagtttgaggctat

SEQ ID NO: 468393 - DNA, 20 bp, Artificial
  CRISPR gRNA sequence
cgaattctcaggtgctgcta

SEQ ID NO: 468394 - DNA, 20 bp, Artificial
  CRISPR gRNA sequence
tgtaatagtcttcatacaaa

SEQ ID NO: 468395 - DNA, 20 bp, Artificial
  CRISPR gRNA sequence
tgagctgagctgctgcacaa

SEQ ID NO: 468396 - DNA, 20 bp, Artificial
  CRISPR gRNA sequence
gtgtgtgtgtgtgtgttagg

SEQ ID NO: 468397 - DNA, 20 bp, Artificial
  CRISPR gRNA sequence
gtgtgtgtgtgttaggtggg

SEQ ID NO: 468398 - DNA, 20 bp, Artificial
  CRISPR gRNA sequence
gcttatgaagctcaaaatac

SEQ ID NO: 468399 - DNA, 20 bp, Artificial
  CRISPR gRNA sequence
agctcaaaatactagagtaa

SEQ ID NO: 468400 - DNA, 20 bp, Artificial
  CRISPR gRNA sequence
gaaaataatatgtgaaatta

SEQ ID NO: 468401 - DNA, 20 bp, Artificial
  CRISPR gRNA sequence
atatgtgaaattatggagtt

SEQ ID NO: 468402 - DNA, 20 bp, Artificial
  CRISPR gRNA sequence
tatggagtttagaatacaag

SEQ ID NO: 468403 - DNA, 20 bp, Artificial
  CRISPR gRNA sequence
agttttagctccttagattt

SEQ ID NO: 468404 - DNA, 20 bp, Artificial
  CRISPR gRNA sequence
ttgggggtgcaaatattctt

SEQ ID NO: 468405 - DNA, 20 bp, Artificial
  CRISPR gRNA sequence
gttattttgccaattacacc

SEQ ID NO: 468406 - DNA, 20 bp, Artificial
  CRISPR gRNA sequence
cttatgtaagaaagacatgt

SEQ ID NO: 468407 - DNA, 20 bp, Artificial
  CRISPR gRNA sequence
atagaaacaggaaatatggg

SEQ ID NO: 468408 - DNA, 20 bp, Artificial
  CRISPR gRNA sequence
gcttatttcattagtttata

SEQ ID NO: 468409 - DNA, 20 bp, Artificial
  CRISPR gRNA sequence
tttatagagggtttgagaaa

SEQ ID NO: 468410 - DNA, 20 bp, Artificial
  CRISPR gRNA sequence
gtaccccaaaatgtgtggac

SEQ ID NO: 468411 - DNA, 20 bp, Artificial
  CRISPR gRNA sequence
ccaaaatgtgtggacatgaa

SEQ ID NO: 468412 - DNA, 20 bp, Artificial
  CRISPR gRNA sequence
ccctgacacataaaagcgac

SEQ ID NO: 468413 - DNA, 20 bp, Artificial
  CRISPR gRNA sequence
cgggtcgcttttatgtgtca

SEQ ID NO: 468414 - DNA, 20 bp, Artificial
  CRISPR gRNA sequence
gggtacaaaatcagatgcca

SEQ ID NO: 468415 - DNA, 20 bp, Artificial
  CRISPR gRNA sequence
agatgccaaattgatttcaa

SEQ ID NO: 468416 - DNA, 20 bp, Artificial
  CRISPR gRNA sequence
ccttctcattgagcacaatc

SEQ ID NO: 468417 - DNA, 20 bp, Artificial
  CRISPR gRNA sequence
ttgaaaaggaataaaaacat

SEQ ID NO: 468418 - DNA, 20 bp, Artificial
  CRISPR gRNA sequence
ggaataaaaacataaatgat

SEQ ID NO: 468419 - DNA, 20 bp, Artificial
  CRISPR gRNA sequence
ttttaaataagacagaaata

SEQ ID NO: 468420 - DNA, 20 bp, Artificial
  CRISPR gRNA sequence
aagacagaaatattttgctt

SEQ ID NO: 468421 - DNA, 20 bp, Artificial
  CRISPR gRNA sequence
aaatgtatcctccccatatt

SEQ ID NO: 468422 - DNA, 20 bp, Artificial
  CRISPR gRNA sequence
aaaacagcctatctcgaatt

SEQ ID NO: 468423 - DNA, 20 bp, Artificial
  CRISPR gRNA sequence
aaatctctccaccacaaaac

SEQ ID NO: 468424 - DNA, 20 bp, Artificial
  CRISPR gRNA sequence
gacccatttactctagtatt

SEQ ID NO: 468425 - DNA, 20 bp, Artificial
  CRISPR gRNA sequence
gaaaatataatgtcaatttg

SEQ ID NO: 468426 - DNA, 20 bp, Artificial
  CRISPR gRNA sequence
tcagctcacatatttgttga

SEQ ID NO: 468427 - DNA, 20 bp, Artificial
  CRISPR gRNA sequence
aaattataggctatttttga

SEQ ID NO: 468428 - DNA, 20 bp, Artificial
  CRISPR gRNA sequence
caacctcagtattttaaaat

SEQ ID NO: 468429 - DNA, 20 bp, Artificial
  CRISPR gRNA sequence
aaactaaaatatgtcactac

SEQ ID NO: 468430 - DNA, 20 bp, Artificial
  CRISPR gRNA sequence
atgtcactacagatgatttg

SEQ ID NO: 468431 - DNA, 20 bp, Artificial
  CRISPR gRNA sequence
ctacagaccaattaaatatt

SEQ ID NO: 468432 - DNA, 20 bp, Artificial
  CRISPR gRNA sequence
tgctatcaagtcaagcatga

SEQ ID NO: 468433 - DNA, 20 bp, Artificial
  CRISPR gRNA sequence
actgctccattaatacctat

SEQ ID NO: 468434 - DNA, 20 bp, Artificial
  CRISPR gRNA sequence
ctaacagagtagatataagc

SEQ ID NO: 468435 - DNA, 20 bp, Artificial
  CRISPR gRNA sequence
attttcttacatcaagccta

SEQ ID NO: 468436 - DNA, 20 bp, Artificial
  CRISPR gRNA sequence
tggttagtcaaattgggaca

SEQ ID NO: 468437 - DNA, 20 bp, Artificial
  CRISPR gRNA sequence
ttttccctacaagtctttcc

SEQ ID NO: 468438 - DNA, 20 bp, Artificial
  CRISPR gRNA sequence
caatagcttcaaaggcaaga

SEQ ID NO: 468439 - DNA, 20 bp, Artificial
  CRISPR gRNA sequence
gtatattgggtaaaatgtag

SEQ ID NO: 468440 - DNA, 20 bp, Artificial
  CRISPR gRNA sequence
ttctgctactcatgatgtca

SEQ ID NO: 468441 - DNA, 20 bp, Artificial
  CRISPR gRNA sequence
catgatgtcaaccagttttg

SEQ ID NO: 468442 - DNA, 20 bp, Artificial
  CRISPR gRNA sequence
ataatataaaaagctcccaa

SEQ ID NO: 468443 - DNA, 20 bp, Artificial
  CRISPR gRNA sequence
catatggatgcatattctgt

SEQ ID NO: 468444 - DNA, 20 bp, Artificial
  CRISPR gRNA sequence
tcagggaagcataaacaatg

SEQ ID NO: 468445 - DNA, 20 bp, Artificial
  CRISPR gRNA sequence
ggaagcataaacaatgcctg

SEQ ID NO: 468446 - DNA, 20 bp, Artificial
  CRISPR gRNA sequence
ctggtttgttttcttccagg

SEQ ID NO: 468447 - DNA, 20 bp, Artificial
  CRISPR gRNA sequence
tcagggtcattatcataaat

SEQ ID NO: 468448 - DNA, 20 bp, Artificial
  CRISPR gRNA sequence
cagtacttgggaattttgcc

SEQ ID NO: 468449 - DNA, 20 bp, Artificial
  CRISPR gRNA sequence
acttgggaattttgcctggt

SEQ ID NO: 468450 - DNA, 20 bp, Artificial
  CRISPR gRNA sequence
gaattttgcctggtgcttgc

SEQ ID NO: 468451 - DNA, 20 bp, Artificial
  CRISPR gRNA sequence
caacctacaatagaaaaaaa

SEQ ID NO: 468452 - DNA, 20 bp, Artificial
  CRISPR gRNA sequence
tcattagcaaactatgaatg

SEQ ID NO: 468453 - DNA, 20 bp, Artificial
  CRISPR gRNA sequence
atttcaattattaaaggatg

SEQ ID NO: 468454 - DNA, 20 bp, Artificial
  CRISPR gRNA sequence
gtcacccctaaatagttatt

SEQ ID NO: 468455 - DNA, 20 bp, Artificial
  CRISPR gRNA sequence
aatatcctatgaaaacttca

SEQ ID NO: 468456 - DNA, 20 bp, Artificial
  CRISPR gRNA sequence
acatgatgaatagtatttaa

SEQ ID NO: 468457 - DNA, 20 bp, Artificial
  CRISPR gRNA sequence
atttaatgcagtttagaata

SEQ ID NO: 468458 - DNA, 20 bp, Artificial
  CRISPR gRNA sequence
ccttaaattaaaaaattgat

SEQ ID NO: 468459 - DNA, 20 bp, Artificial
  CRISPR gRNA sequence
tgatgtcagttttggaaaga

SEQ ID NO: 468460 - DNA, 20 bp, Artificial
  CRISPR gRNA sequence
gctcaccgcaagctccgcct

SEQ ID NO: 468461 - DNA, 20 bp, Artificial
  CRISPR gRNA sequence
ttttgtatttttagtagaga

SEQ ID NO: 468462 - DNA, 20 bp, Artificial
  CRISPR gRNA sequence
cgcctcggcctcccaaagtg

SEQ ID NO: 468463 - DNA, 20 bp, Artificial
  CRISPR gRNA sequence
actcccggcaagaaaattct

SEQ ID NO: 468464 - DNA, 20 bp, Artificial
  CRISPR gRNA sequence
tcaaatatagccaaatatct

SEQ ID NO: 468465 - DNA, 20 bp, Artificial
  CRISPR gRNA sequence
acaaaaagtaaaattagtcc

SEQ ID NO: 468466 - DNA, 20 bp, Artificial
  CRISPR gRNA sequence
gtgttcattctaggggctat

SEQ ID NO: 468467 - DNA, 20 bp, Artificial
  CRISPR gRNA sequence
gctatttcagttttttaaat

SEQ ID NO: 468468 - DNA, 20 bp, Artificial
  CRISPR gRNA sequence
ttttaaattcaagttttgcc

SEQ ID NO: 468469 - DNA, 20 bp, Artificial
  CRISPR gRNA sequence
gtgtgcagtaggatgtctat

SEQ ID NO: 468470 - DNA, 20 bp, Artificial
  CRISPR gRNA sequence
agctctatcatgcaagcatg

SEQ ID NO: 468471 - DNA, 20 bp, Artificial
  CRISPR gRNA sequence
gagcgactgaaagaggcaga

SEQ ID NO: 468472 - DNA, 20 bp, Artificial
  CRISPR gRNA sequence
agatcctgtgatacttttca

SEQ ID NO: 468473 - DNA, 20 bp, Artificial
  CRISPR gRNA sequence
ttaaaatttgtatttatagt

SEQ ID NO: 468474 - DNA, 20 bp, Artificial
  CRISPR gRNA sequence
cccttttaagtgtacaattc

SEQ ID NO: 468475 - DNA, 20 bp, Artificial
  CRISPR gRNA sequence
agcactttataccctcaaag

SEQ ID NO: 468476 - DNA, 20 bp, Artificial
  CRISPR gRNA sequence
ttataccctcaaaggaccgt

SEQ ID NO: 468477 - DNA, 20 bp, Artificial
  CRISPR gRNA sequence
ggaccgttttggattaagat

SEQ ID NO: 468478 - DNA, 20 bp, Artificial
  CRISPR gRNA sequence
ttttggattaagatcagagc

SEQ ID NO: 468479 - DNA, 20 bp, Artificial
  CRISPR gRNA sequence
ttgtaccagttcctttcctg

SEQ ID NO: 468480 - DNA, 20 bp, Artificial
  CRISPR gRNA sequence
tataccagttcctttctgta

SEQ ID NO: 468481 - DNA, 20 bp, Artificial
  CRISPR gRNA sequence
gatttctccacagttcccaa

SEQ ID NO: 468482 - DNA, 20 bp, Artificial
  CRISPR gRNA sequence
aagggtataatatggtatcc

SEQ ID NO: 468483 - DNA, 20 bp, Artificial
  CRISPR gRNA sequence
caaattcctgttaatagcaa

SEQ ID NO: 468484 - DNA, 20 bp, Artificial
  CRISPR gRNA sequence
acagaaaatacccttttgaa

SEQ ID NO: 468485 - DNA, 20 bp, Artificial
  CRISPR gRNA sequence
tacccaggaagaacaatgtc

SEQ ID NO: 468486 - DNA, 20 bp, Artificial
  CRISPR gRNA sequence
atgtccacagcttaaccaac

SEQ ID NO: 468487 - DNA, 20 bp, Artificial
  CRISPR gRNA sequence
tttacttgcacagtaaatta

SEQ ID NO: 468488 - DNA, 20 bp, Artificial
  CRISPR gRNA sequence
gatgctaatgaaaacttaat

SEQ ID NO: 468489 - DNA, 20 bp, Artificial
  CRISPR gRNA sequence
gtcaagttgagtgtatttgg

SEQ ID NO: 468490 - DNA, 20 bp, Artificial
  CRISPR gRNA sequence
tttggtctggtttaaaatta

SEQ ID NO: 468491 - DNA, 20 bp, Artificial
  CRISPR gRNA sequence
atatatagaattattggctg

SEQ ID NO: 468492 - DNA, 20 bp, Artificial
  CRISPR gRNA sequence
ctttgcagtatctcatttat

SEQ ID NO: 468493 - DNA, 20 bp, Artificial
  CRISPR gRNA sequence
cagtatctcatttatgactg

SEQ ID NO: 468494 - DNA, 20 bp, Artificial
  CRISPR gRNA sequence
tgactgtttagttttaatta

SEQ ID NO: 468495 - DNA, 20 bp, Artificial
  CRISPR gRNA sequence
gttttaattagagagcttca

SEQ ID NO: 468496 - DNA, 20 bp, Artificial
  CRISPR gRNA sequence
ttacattccaaaccttatag

SEQ ID NO: 468497 - DNA, 20 bp, Artificial
  CRISPR gRNA sequence
tctcttccagaaagacctta

SEQ ID NO: 468498 - DNA, 20 bp, Artificial
  CRISPR gRNA sequence
cataacaggcaagagcagag

SEQ ID NO: 468499 - DNA, 20 bp, Artificial
  CRISPR gRNA sequence
cacagtataacacaaattgc

SEQ ID NO: 468500 - DNA, 20 bp, Artificial
  CRISPR gRNA sequence
catttgtttcaacagctaca

SEQ ID NO: 468501 - DNA, 20 bp, Artificial
  CRISPR gRNA sequence
ctgctgtgtcagagagttca

SEQ ID NO: 468502 - DNA, 20 bp, Artificial
  CRISPR gRNA sequence
gaagtaaaccaccttgccac

SEQ ID NO: 468503 - DNA, 20 bp, Artificial
  CRISPR gRNA sequence
tgaatgccagggatagtgtt

SEQ ID NO: 468504 - DNA, 20 bp, Artificial
  CRISPR gRNA sequence
ccagggatagtgttgttagt

SEQ ID NO: 468505 - DNA, 20 bp, Artificial
  CRISPR gRNA sequence
ttgttagttttggcttgtta

SEQ ID NO: 468506 - DNA, 20 bp, Artificial
  CRISPR gRNA sequence
atttgctttgcctagcacac

SEQ ID NO: 468507 - DNA, 20 bp, Artificial
  CRISPR gRNA sequence
cactttggatgtggtaaatc

SEQ ID NO: 468508 - DNA, 20 bp, Artificial
  CRISPR gRNA sequence
ataagtgttgctctatctag

SEQ ID NO: 468509 - DNA, 20 bp, Artificial
  CRISPR gRNA sequence
caaagctagatcagaattct

SEQ ID NO: 468510 - DNA, 20 bp, Artificial
  CRISPR gRNA sequence
ggtaagaattcaggtcaagc

SEQ ID NO: 468511 - DNA, 20 bp, Artificial
  CRISPR gRNA sequence
tcagttacataagggtgtgt

SEQ ID NO: 468512 - DNA, 20 bp, Artificial
  CRISPR gRNA sequence
taaagcagatatcttgatct

SEQ ID NO: 468513 - DNA, 20 bp, Artificial
  CRISPR gRNA sequence
gcagatatcttgatctgaga

SEQ ID NO: 468514 - DNA, 20 bp, Artificial
  CRISPR gRNA sequence
gtttcaacttccaatcctgt

SEQ ID NO: 468515 - DNA, 20 bp, Artificial
  CRISPR gRNA sequence
gagctctttctcacacaaac

SEQ ID NO: 468516 - DNA, 20 bp, Artificial
  CRISPR gRNA sequence
agggagccccaaccaaccta

SEQ ID NO: 468517 - DNA, 20 bp, Artificial
  CRISPR gRNA sequence
tcttctaggaaatcattatc

SEQ ID NO: 468518 - DNA, 20 bp, Artificial
  CRISPR gRNA sequence
gaaatcattatccatggttt

SEQ ID NO: 468519 - DNA, 20 bp, Artificial
  CRISPR gRNA sequence
taaacgatacaggagccagg

SEQ ID NO: 468520 - DNA, 20 bp, Artificial
  CRISPR gRNA sequence
cattgtcagaacttgagtga

SEQ ID NO: 468521 - DNA, 20 bp, Artificial
  CRISPR gRNA sequence
tcccagtgccctcagccacc

SEQ ID NO: 468522 - DNA, 20 bp, Artificial
  CRISPR gRNA sequence
ggcaatgggaactcaagcca

SEQ ID NO: 468523 - DNA, 20 bp, Artificial
  CRISPR gRNA sequence
acatgtttgtaacaggaaat

SEQ ID NO: 468524 - DNA, 20 bp, Artificial
  CRISPR gRNA sequence
aatgttaatacgcattgagg

SEQ ID NO: 468525 - DNA, 20 bp, Artificial
  CRISPR gRNA sequence
ggcaaccagtgagtagaagc

SEQ ID NO: 468526 - DNA, 20 bp, Artificial
  CRISPR gRNA sequence
gatctggttgttgttgttgt

SEQ ID NO: 468527 - DNA, 20 bp, Artificial
  CRISPR gRNA sequence
atgggaggctgagacaggag

SEQ ID NO: 468528 - DNA, 20 bp, Artificial
  CRISPR gRNA sequence
ttaattatattataatgtta

SEQ ID NO: 468529 - DNA, 20 bp, Artificial
  CRISPR gRNA sequence
taatgttattttgtttggct

SEQ ID NO: 468530 - DNA, 20 bp, Artificial
  CRISPR gRNA sequence
tattttgtttggctagatgc

SEQ ID NO: 468531 - DNA, 20 bp, Artificial
  CRISPR gRNA sequence
gatgcttaggtttggggtaa

SEQ ID NO: 468532 - DNA, 20 bp, Artificial
  CRISPR gRNA sequence
gcaactgaagttgcacaaaa

SEQ ID NO: 468533 - DNA, 20 bp, Artificial
  CRISPR gRNA sequence
ttgtctattgatgttgcagc

SEQ ID NO: 468534 - DNA, 20 bp, Artificial
  CRISPR gRNA sequence
tcttggatagcaatggggac

SEQ ID NO: 468535 - DNA, 20 bp, Artificial
  CRISPR gRNA sequence
aacctaatttccttaatttt

SEQ ID NO: 468536 - DNA, 20 bp, Artificial
  CRISPR gRNA sequence
aatttccttaattttacttg

SEQ ID NO: 468537 - DNA, 20 bp, Artificial
  CRISPR gRNA sequence
aataaaactaattcagaaca

SEQ ID NO: 468538 - DNA, 20 bp, Artificial
  CRISPR gRNA sequence
aaaactccccctaacttatt

SEQ ID NO: 468539 - DNA, 20 bp, Artificial
  CRISPR gRNA sequence
gaaacaaggtaaataactga

SEQ ID NO: 468540 - DNA, 20 bp, Artificial
  CRISPR gRNA sequence
aaaaccagagctagccttgg

SEQ ID NO: 468541 - DNA, 20 bp, Artificial
  CRISPR gRNA sequence
gctagccttggggaggattc

SEQ ID NO: 468542 - DNA, 20 bp, Artificial
  CRISPR gRNA sequence
cattgacacaaagtaaatat

SEQ ID NO: 468543 - DNA, 20 bp, Artificial
  CRISPR gRNA sequence
atacaacgcaatctttgtct

SEQ ID NO: 468544 - DNA, 20 bp, Artificial
  CRISPR gRNA sequence
agcctccacctcctgggttc

SEQ ID NO: 468545 - DNA, 20 bp, Artificial
  CRISPR gRNA sequence
ctcctgggttcaagtgattc

SEQ ID NO: 468546 - DNA, 20 bp, Artificial
  CRISPR gRNA sequence
tgcttcagcctcctgagtag

SEQ ID NO: 468547 - DNA, 20 bp, Artificial
  CRISPR gRNA sequence
tacaggcgcctcccaccgtg

SEQ ID NO: 468548 - DNA, 20 bp, Artificial
  CRISPR gRNA sequence
ttttgtatttttagtagaga

SEQ ID NO: 468549 - DNA, 20 bp, Artificial
  CRISPR gRNA sequence
gatctcaaactcctgacctc

SEQ ID NO: 468550 - DNA, 20 bp, Artificial
  CRISPR gRNA sequence
cgtcttggcctcccaaagtg

SEQ ID NO: 468551 - DNA, 20 bp, Artificial
  CRISPR gRNA sequence
ttaatctgaaactgaccaag

SEQ ID NO: 468552 - DNA, 20 bp, Artificial
  CRISPR gRNA sequence
gggtgaagtggcaggccaat

SEQ ID NO: 468553 - DNA, 20 bp, Artificial
  CRISPR gRNA sequence
gtcaacttttcccctaggac

SEQ ID NO: 468554 - DNA, 20 bp, Artificial
  CRISPR gRNA sequence
ggactttggcttgttgtgca

SEQ ID NO: 468555 - DNA, 20 bp, Artificial
  CRISPR gRNA sequence
ttttcttcattctgggagaa

SEQ ID NO: 468556 - DNA, 20 bp, Artificial
  CRISPR gRNA sequence
tctttgaccctccctgttat

SEQ ID NO: 468557 - DNA, 20 bp, Artificial
  CRISPR gRNA sequence
tcactaaagaaaaatgcaca

SEQ ID NO: 468558 - DNA, 20 bp, Artificial
  CRISPR gRNA sequence
aaaatgcacacctagattaa

SEQ ID NO: 468559 - DNA, 20 bp, Artificial
  CRISPR gRNA sequence
aaattagttttaaatccaca

SEQ ID NO: 468560 - DNA, 20 bp, Artificial
  CRISPR gRNA sequence
cttcccctcaggtgatcatg

SEQ ID NO: 468561 - DNA, 20 bp, Artificial
  CRISPR gRNA sequence
ttaagaacttggaaaattag

SEQ ID NO: 468562 - DNA, 20 bp, Artificial
  CRISPR gRNA sequence
aggaagataatgatggtgcg

SEQ ID NO: 468563 - DNA, 20 bp, Artificial
  CRISPR gRNA sequence
aggaagccaaagaaaattct

SEQ ID NO: 468564 - DNA, 20 bp, Artificial
  CRISPR gRNA sequence
tccataaaaccccccaaggc

SEQ ID NO: 468565 - DNA, 20 bp, Artificial
  CRISPR gRNA sequence
gttctttcctccacaaaata

SEQ ID NO: 468566 - DNA, 20 bp, Artificial
  CRISPR gRNA sequence
cctttatgcactttacaaac

SEQ ID NO: 468567 - DNA, 20 bp, Artificial
  CRISPR gRNA sequence
aaattcatgtctcgtataga

SEQ ID NO: 468568 - DNA, 20 bp, Artificial
  CRISPR gRNA sequence
taaagaaagactgaattaca

SEQ ID NO: 468569 - DNA, 20 bp, Artificial
  CRISPR gRNA sequence
tcattctagaattaatattt

SEQ ID NO: 468570 - DNA, 20 bp, Artificial
  CRISPR gRNA sequence
ttatttttgtaatttatttt

SEQ ID NO: 468571 - DNA, 20 bp, Artificial
  CRISPR gRNA sequence
caggttgatgaagacaattt

SEQ ID NO: 468572 - DNA, 20 bp, Artificial
  CRISPR gRNA sequence
ccatccatcatacagagcaa

SEQ ID NO: 468573 - DNA, 20 bp, Artificial
  CRISPR gRNA sequence
cagagcaaagatgtttaaga

SEQ ID NO: 468574 - DNA, 20 bp, Artificial
  CRISPR gRNA sequence
agacacagcttccatcctga

SEQ ID NO: 468575 - DNA, 20 bp, Artificial
  CRISPR gRNA sequence
atggtcacaagtaactagca

SEQ ID NO: 468576 - DNA, 20 bp, Artificial
  CRISPR gRNA sequence
agcagagtccctaactctgc

SEQ ID NO: 468577 - DNA, 20 bp, Artificial
  CRISPR gRNA sequence
aagcattttaaaagaatttc

SEQ ID NO: 468578 - DNA, 20 bp, Artificial
  CRISPR gRNA sequence
aatggcatgtaagatactca

SEQ ID NO: 468579 - DNA, 20 bp, Artificial
  CRISPR gRNA sequence
ttttgcaaacgtgactacga

SEQ ID NO: 468580 - DNA, 20 bp, Artificial
  CRISPR gRNA sequence
accaagctactttctgtctc

SEQ ID NO: 468581 - DNA, 20 bp, Artificial
  CRISPR gRNA sequence
ttttcttcttttacttagcg

SEQ ID NO: 468582 - DNA, 20 bp, Artificial
  CRISPR gRNA sequence
attcatcagctgaacattta

SEQ ID NO: 468583 - DNA, 20 bp, Artificial
  CRISPR gRNA sequence
ctgtgataaacattcaggaa

SEQ ID NO: 468584 - DNA, 20 bp, Artificial
  CRISPR gRNA sequence
attactgggtactgtgacaa

SEQ ID NO: 468585 - DNA, 20 bp, Artificial
  CRISPR gRNA sequence
tgtgacaagtaggttttatc

SEQ ID NO: 468586 - DNA, 20 bp, Artificial
  CRISPR gRNA sequence
acattctcctcagcaatgga

SEQ ID NO: 468587 - DNA, 20 bp, Artificial
  CRISPR gRNA sequence
ttgctaacacttattatttt

SEQ ID NO: 468588 - DNA, 20 bp, Artificial
  CRISPR gRNA sequence
agtcattcgatgggtgtgaa

SEQ ID NO: 468589 - DNA, 20 bp, Artificial
  CRISPR gRNA sequence
gaagtgggttttcactgtga

SEQ ID NO: 468590 - DNA, 20 bp, Artificial
  CRISPR gRNA sequence
tgacattgagcatttttttc

SEQ ID NO: 468591 - DNA, 20 bp, Artificial
  CRISPR gRNA sequence
tagtatcttttgatgcacag

SEQ ID NO: 468592 - DNA, 20 bp, Artificial
  CRISPR gRNA sequence
ttatctatttttggtgttat

SEQ ID NO: 468593 - DNA, 20 bp, Artificial
  CRISPR gRNA sequence
atttttggtgttattgttga

SEQ ID NO: 468594 - DNA, 20 bp, Artificial
  CRISPR gRNA sequence
aagatcagaaacatttatcc

SEQ ID NO: 468595 - DNA, 20 bp, Artificial
  CRISPR gRNA sequence
tatgttttctcctaagaaat

SEQ ID NO: 468596 - DNA, 20 bp, Artificial
  CRISPR gRNA sequence
ctcctaagaaatcagagttt

SEQ ID NO: 468597 - DNA, 20 bp, Artificial
  CRISPR gRNA sequence
agttttattgttttatataa

SEQ ID NO: 468598 - DNA, 20 bp, Artificial
  CRISPR gRNA sequence
gttttatataatgcagtttt

SEQ ID NO: 468599 - DNA, 20 bp, Artificial
  CRISPR gRNA sequence
ctacttaaatgtctgactta

SEQ ID NO: 468600 - DNA, 20 bp, Artificial
  CRISPR gRNA sequence
ttaaatgtctgacttatttt

SEQ ID NO: 468601 - DNA, 20 bp, Artificial
  CRISPR gRNA sequence
atcaattgactacggatgta

SEQ ID NO: 468602 - DNA, 20 bp, Artificial
  CRISPR gRNA sequence
tttttaactgtcattttgta

SEQ ID NO: 468603 - DNA, 20 bp, Artificial
  CRISPR gRNA sequence
aagttttgaaatagggaagt

SEQ ID NO: 468604 - DNA, 20 bp, Artificial
  CRISPR gRNA sequence
tgaaatagggaagtcttagc

SEQ ID NO: 468605 - DNA, 20 bp, Artificial
  CRISPR gRNA sequence
agcttcagttttgttctttt

SEQ ID NO: 468606 - DNA, 20 bp, Artificial
  CRISPR gRNA sequence
tcagttttgttctttttcaa

SEQ ID NO: 468607 - DNA, 20 bp, Artificial
  CRISPR gRNA sequence
aactcaatgtgaattttagg

SEQ ID NO: 468608 - DNA, 20 bp, Artificial
  CRISPR gRNA sequence
gcaatagcaacaaaaagctg

SEQ ID NO: 468609 - DNA, 20 bp, Artificial
  CRISPR gRNA sequence
tattcttgaatttctttcag

SEQ ID NO: 468610 - DNA, 20 bp, Artificial
  CRISPR gRNA sequence
tttgatgctattgtaaatgg

SEQ ID NO: 468611 - DNA, 20 bp, Artificial
  CRISPR gRNA sequence
actgtttccttaattttctt

SEQ ID NO: 468612 - DNA, 20 bp, Artificial
  CRISPR gRNA sequence
tttccttaattttctttgtg

SEQ ID NO: 468613 - DNA, 20 bp, Artificial
  CRISPR gRNA sequence
ttgctagtgtatagaaatat

SEQ ID NO: 468614 - DNA, 20 bp, Artificial
  CRISPR gRNA sequence
tggaattgctaaattcatgt

SEQ ID NO: 468615 - DNA, 20 bp, Artificial
  CRISPR gRNA sequence
taaattcatgtattagcttt

SEQ ID NO: 468616 - DNA, 20 bp, Artificial
  CRISPR gRNA sequence
aagttcatgccatctgtgaa

SEQ ID NO: 468617 - DNA, 20 bp, Artificial
  CRISPR gRNA sequence
atcttttatttcttgttctt

SEQ ID NO: 468618 - DNA, 20 bp, Artificial
  CRISPR gRNA sequence
tgtttgctctggctagaatt

SEQ ID NO: 468619 - DNA, 20 bp, Artificial
  CRISPR gRNA sequence
ctccccccctatgtattttt

SEQ ID NO: 468620 - DNA, 20 bp, Artificial
  CRISPR gRNA sequence
atgtattttttcatgtttta

SEQ ID NO: 468621 - DNA, 20 bp, Artificial
  CRISPR gRNA sequence
ttttttcatgttttattcag

SEQ ID NO: 468622 - DNA, 20 bp, Artificial
  CRISPR gRNA sequence
ttttattcagcttggtttcc

SEQ ID NO: 468623 - DNA, 20 bp, Artificial
  CRISPR gRNA sequence
aaatcactaggaagtcagtt

SEQ ID NO: 468624 - DNA, 20 bp, Artificial
  CRISPR gRNA sequence
taggaagtcagttagttgtt

SEQ ID NO: 468625 - DNA, 20 bp, Artificial
  CRISPR gRNA sequence
acaaactgtgaactattaag

SEQ ID NO: 468626 - DNA, 20 bp, Artificial
  CRISPR gRNA sequence
cataacaatctgtgaggtgt

SEQ ID NO: 468627 - DNA, 20 bp, Artificial
  CRISPR gRNA sequence
atttcagatgtgctatagga

SEQ ID NO: 468628 - DNA, 20 bp, Artificial
  CRISPR gRNA sequence
tgtcacataaagagttgttg

SEQ ID NO: 468629 - DNA, 20 bp, Artificial
  CRISPR gRNA sequence
gagttgttgagtggctttca

SEQ ID NO: 468630 - DNA, 20 bp, Artificial
  CRISPR gRNA sequence
atgttcttctcttccttcca

SEQ ID NO: 468631 - DNA, 20 bp, Artificial
  CRISPR gRNA sequence
tccaacttgtttgtctatct

SEQ ID NO: 468632 - DNA, 20 bp, Artificial
  CRISPR gRNA sequence
gttttacacatgttgttcca

SEQ ID NO: 468633 - DNA, 20 bp, Artificial
  CRISPR gRNA sequence
tctcctgctaagatggagtg

SEQ ID NO: 468634 - DNA, 20 bp, Artificial
  CRISPR gRNA sequence
tttatataaagctgtacatc

SEQ ID NO: 468635 - DNA, 20 bp, Artificial
  CRISPR gRNA sequence
acatattaggcatataataa

SEQ ID NO: 468636 - DNA, 20 bp, Artificial
  CRISPR gRNA sequence
taactgatgacattccacca

SEQ ID NO: 468637 - DNA, 20 bp, Artificial
  CRISPR gRNA sequence
gatgacattccaccattgtg

SEQ ID NO: 468638 - DNA, 20 bp, Artificial
  CRISPR gRNA sequence
tgtaatctcccccaccctta

SEQ ID NO: 468639 - DNA, 20 bp, Artificial
  CRISPR gRNA sequence
agccttgttgctcacacaaa

SEQ ID NO: 468640 - DNA, 20 bp, Artificial
  CRISPR gRNA sequence
acacatgagacactgtctta

SEQ ID NO: 468641 - DNA, 20 bp, Artificial
  CRISPR gRNA sequence
ctgctagtataacagaatac

SEQ ID NO: 468642 - DNA, 20 bp, Artificial
  CRISPR gRNA sequence
ttggataatttttgaatcac

SEQ ID NO: 468643 - DNA, 20 bp, Artificial
  CRISPR gRNA sequence
cattccatctcaatagcccc

SEQ ID NO: 468644 - DNA, 20 bp, Artificial
  CRISPR gRNA sequence
cttatctaaaccagatatgg

SEQ ID NO: 468645 - DNA, 20 bp, Artificial
  CRISPR gRNA sequence
agatatgggtaagattcaag

SEQ ID NO: 468646 - DNA, 20 bp, Artificial
  CRISPR gRNA sequence
agagaaataaaatggcattg

SEQ ID NO: 468647 - DNA, 20 bp, Artificial
  CRISPR gRNA sequence
atggcattgctgggcttggt

SEQ ID NO: 468648 - DNA, 20 bp, Artificial
  CRISPR gRNA sequence
tacctgcagctctcccaggc

SEQ ID NO: 468649 - DNA, 20 bp, Artificial
  CRISPR gRNA sequence
acttagcaagtgggtgccac

SEQ ID NO: 468650 - DNA, 20 bp, Artificial
  CRISPR gRNA sequence
agcaagcctgtaaagggcat

SEQ ID NO: 468651 - DNA, 20 bp, Artificial
  CRISPR gRNA sequence
atgatgggaggggcagcctc

SEQ ID NO: 468652 - DNA, 20 bp, Artificial
  CRISPR gRNA sequence
gaattttccaaatctttcta

SEQ ID NO: 468653 - DNA, 20 bp, Artificial
  CRISPR gRNA sequence
aagtagccacacagcagcct

SEQ ID NO: 468654 - DNA, 20 bp, Artificial
  CRISPR gRNA sequence
acacagcagcctaaatgctt

SEQ ID NO: 468655 - DNA, 20 bp, Artificial
  CRISPR gRNA sequence
cctgaattattgctcttaat

SEQ ID NO: 468656 - DNA, 20 bp, Artificial
  CRISPR gRNA sequence
atgacaagaatggcctttac

SEQ ID NO: 468657 - DNA, 20 bp, Artificial
  CRISPR gRNA sequence
tggcctttactccagtttcc

SEQ ID NO: 468658 - DNA, 20 bp, Artificial
  CRISPR gRNA sequence
ctttactccagtttccaatg

SEQ ID NO: 468659 - DNA, 20 bp, Artificial
  CRISPR gRNA sequence
ccttttagttatgcacttgg

SEQ ID NO: 468660 - DNA, 20 bp, Artificial
  CRISPR gRNA sequence
ttctttcttagcctttcttt

SEQ ID NO: 468661 - DNA, 20 bp, Artificial
  CRISPR gRNA sequence
aaaggccttgcctgtgatca

SEQ ID NO: 468662 - DNA, 20 bp, Artificial
  CRISPR gRNA sequence
ccaaggagcaaattttgacc

SEQ ID NO: 468663 - DNA, 20 bp, Artificial
  CRISPR gRNA sequence
tcatacatgtctatccagaa

SEQ ID NO: 468664 - DNA, 20 bp, Artificial
  CRISPR gRNA sequence
ctctgctcagaataatagaa

SEQ ID NO: 468665 - DNA, 20 bp, Artificial
  CRISPR gRNA sequence
tcagaataatagaaacctga

SEQ ID NO: 468666 - DNA, 20 bp, Artificial
  CRISPR gRNA sequence
cttaatatttatttatttat

SEQ ID NO: 468667 - DNA, 20 bp, Artificial
  CRISPR gRNA sequence
actttaagacttcttaattc

SEQ ID NO: 468668 - DNA, 20 bp, Artificial
  CRISPR gRNA sequence
ttcttaattcagttgcttcc

SEQ ID NO: 468669 - DNA, 20 bp, Artificial
  CRISPR gRNA sequence
tgaaaggtaagttataagga

SEQ ID NO: 468670 - DNA, 20 bp, Artificial
  CRISPR gRNA sequence
gcagaaaggtcaagtgaaac

SEQ ID NO: 468671 - DNA, 20 bp, Artificial
  CRISPR gRNA sequence
attttcttggataagtcaat

SEQ ID NO: 468672 - DNA, 20 bp, Artificial
  CRISPR gRNA sequence
acaaagatcttttaccctca

SEQ ID NO: 468673 - DNA, 20 bp, Artificial
  CRISPR gRNA sequence
tttttttttttttttgagac

SEQ ID NO: 468674 - DNA, 20 bp, Artificial
  CRISPR gRNA sequence
ctcaccgtaacctctgcctc

SEQ ID NO: 468675 - DNA, 20 bp, Artificial
  CRISPR gRNA sequence
aacctctgcctcccgggttt

SEQ ID NO: 468676 - DNA, 20 bp, Artificial
  CRISPR gRNA sequence
tgcctcagcctcccgggtaa

SEQ ID NO: 468677 - DNA, 20 bp, Artificial
  CRISPR gRNA sequence
aggcgcccaccaccacgccc

SEQ ID NO: 468678 - DNA, 20 bp, Artificial
  CRISPR gRNA sequence
attttgtatttttagtaaag

SEQ ID NO: 468679 - DNA, 20 bp, Artificial
  CRISPR gRNA sequence
catctcggcctcccaaagtg

SEQ ID NO: 468680 - DNA, 20 bp, Artificial
  CRISPR gRNA sequence
cctcccaaagtgctgggatt

SEQ ID NO: 468681 - DNA, 20 bp, Artificial
  CRISPR gRNA sequence
atataccagtctttatttct

SEQ ID NO: 468682 - DNA, 20 bp, Artificial
  CRISPR gRNA sequence
agataggatgtctgcatttg

SEQ ID NO: 468683 - DNA, 20 bp, Artificial
  CRISPR gRNA sequence
gaggtggatcacctgaggtc

SEQ ID NO: 468684 - DNA, 20 bp, Artificial
  CRISPR gRNA sequence
tcaagaggctgaggcaggag

SEQ ID NO: 468685 - DNA, 20 bp, Artificial
  CRISPR gRNA sequence
aaggttaacttcagccgggg

SEQ ID NO: 468686 - DNA, 20 bp, Artificial
  CRISPR gRNA sequence
ttagggaccaggaatctcat

SEQ ID NO: 468687 - DNA, 20 bp, Artificial
  CRISPR gRNA sequence
tcattgatacacaactggat

SEQ ID NO: 468688 - DNA, 20 bp, Artificial
  CRISPR gRNA sequence
ttagtgatatggagaccact

SEQ ID NO: 468689 - DNA, 20 bp, Artificial
  CRISPR gRNA sequence
aaatggaataagcattaggc

SEQ ID NO: 468690 - DNA, 20 bp, Artificial
  CRISPR gRNA sequence
gcattaggcaggagtttaaa

SEQ ID NO: 468691 - DNA, 20 bp, Artificial
  CRISPR gRNA sequence
gagactattcatttgaacat

SEQ ID NO: 468692 - DNA, 20 bp, Artificial
  CRISPR gRNA sequence
ttgagcgaatttgatagtcc

SEQ ID NO: 468693 - DNA, 20 bp, Artificial
  CRISPR gRNA sequence
gtcccccagttttgctggtc

SEQ ID NO: 468694 - DNA, 20 bp, Artificial
  CRISPR gRNA sequence
agtttcttcaaaataagatg

SEQ ID NO: 468695 - DNA, 20 bp, Artificial
  CRISPR gRNA sequence
ggttaggggtggagaaaaga

SEQ ID NO: 468696 - DNA, 20 bp, Artificial
  CRISPR gRNA sequence
gctttttgtgttggtggcat

SEQ ID NO: 468697 - DNA, 20 bp, Artificial
  CRISPR gRNA sequence
ggtggcatcactgattcaca

SEQ ID NO: 468698 - DNA, 20 bp, Artificial
  CRISPR gRNA sequence
ggaatgaaccgatgatgaat

SEQ ID NO: 468699 - DNA, 20 bp, Artificial
  CRISPR gRNA sequence
tatctctcagaggctaacac

SEQ ID NO: 468700 - DNA, 20 bp, Artificial
  CRISPR gRNA sequence
agcctccgcctcccaggttc

SEQ ID NO: 468701 - DNA, 20 bp, Artificial
  CRISPR gRNA sequence
tgcctcagcctccccggtgg

SEQ ID NO: 468702 - DNA, 20 bp, Artificial
  CRISPR gRNA sequence
ttttgtatttttagtaggga

SEQ ID NO: 468703 - DNA, 20 bp, Artificial
  CRISPR gRNA sequence
cgcctctgcctcacaaagtg

SEQ ID NO: 468704 - DNA, 20 bp, Artificial
  CRISPR gRNA sequence
caattctaattgtccatctg

SEQ ID NO: 468705 - DNA, 20 bp, Artificial
  CRISPR gRNA sequence
gacacacaaagctatccccc

SEQ ID NO: 468706 - DNA, 20 bp, Artificial
  CRISPR gRNA sequence
cgaagaggaataactatcac

SEQ ID NO: 468707 - DNA, 20 bp, Artificial
  CRISPR gRNA sequence
tcaacttccaattatcagtt

SEQ ID NO: 468708 - DNA, 20 bp, Artificial
  CRISPR gRNA sequence
tatttatgtattttttgaga

SEQ ID NO: 468709 - DNA, 20 bp, Artificial
  CRISPR gRNA sequence
caacctccatccccgggttc

SEQ ID NO: 468710 - DNA, 20 bp, Artificial
  CRISPR gRNA sequence
attcctgctcttattatctc

SEQ ID NO: 468711 - DNA, 20 bp, Artificial
  CRISPR gRNA sequence
caggaaattttcaatgctaa

SEQ ID NO: 468712 - DNA, 20 bp, Artificial
  CRISPR gRNA sequence
aatggcgtgaacccgcgagg

SEQ ID NO: 468713 - DNA, 20 bp, Artificial
  CRISPR gRNA sequence
atatcccttgttaagtcact

SEQ ID NO: 468714 - DNA, 20 bp, Artificial
  CRISPR gRNA sequence
ctataggtttagaaattctt

SEQ ID NO: 468715 - DNA, 20 bp, Artificial
  CRISPR gRNA sequence
ataaaaccatacaaatgaaa

SEQ ID NO: 468716 - DNA, 20 bp, Artificial
  CRISPR gRNA sequence
atccacctaaacagtatgaa

SEQ ID NO: 468717 - DNA, 20 bp, Artificial
  CRISPR gRNA sequence
ctttagttatagtctgatat

SEQ ID NO: 468718 - DNA, 20 bp, Artificial
  CRISPR gRNA sequence
tagttgtccaataactaata

SEQ ID NO: 468719 - DNA, 20 bp, Artificial
  CRISPR gRNA sequence
taactactaaattgtaacac

SEQ ID NO: 468720 - DNA, 20 bp, Artificial
  CRISPR gRNA sequence
ctaaagttttattttctaaa

SEQ ID NO: 468721 - DNA, 20 bp, Artificial
  CRISPR gRNA sequence
atgaaataaagttgccaagc

SEQ ID NO: 468722 - DNA, 20 bp, Artificial
  CRISPR gRNA sequence
aagccgaagattttatatat

SEQ ID NO: 468723 - DNA, 20 bp, Artificial
  CRISPR gRNA sequence
atcacagtttgtatcctttt

SEQ ID NO: 468724 - DNA, 20 bp, Artificial
  CRISPR gRNA sequence
taaacacaaataaaaattca

SEQ ID NO: 468725 - DNA, 20 bp, Artificial
  CRISPR gRNA sequence
caaaaatgaaacagctcctg

SEQ ID NO: 468726 - DNA, 20 bp, Artificial
  CRISPR gRNA sequence
ctcagcattctctgtggtat

SEQ ID NO: 468727 - DNA, 20 bp, Artificial
  CRISPR gRNA sequence
gttaacttgcaagtagaatg

SEQ ID NO: 468728 - DNA, 20 bp, Artificial
  CRISPR gRNA sequence
atactacaaatgtgctaatt

SEQ ID NO: 468729 - DNA, 20 bp, Artificial
  CRISPR gRNA sequence
tatttcacctctgacattgt

SEQ ID NO: 468730 - DNA, 20 bp, Artificial
  CRISPR gRNA sequence
cgggcggatcaccagaggtc

SEQ ID NO: 468731 - DNA, 20 bp, Artificial
  CRISPR gRNA sequence
tcaggaggctgaggcaggag

SEQ ID NO: 468732 - DNA, 20 bp, Artificial
  CRISPR gRNA sequence
aaaaaaggaaatcaactttt

SEQ ID NO: 468733 - DNA, 20 bp, Artificial
  CRISPR gRNA sequence
ccttgacacattagtaacga

SEQ ID NO: 468734 - DNA, 20 bp, Artificial
  CRISPR gRNA sequence
caccacttttcaattttgcc

SEQ ID NO: 468735 - DNA, 20 bp, Artificial
  CRISPR gRNA sequence
ttggatatgatataatctct

SEQ ID NO: 468736 - DNA, 20 bp, Artificial
  CRISPR gRNA sequence
ttctggctgggtcaatcagg

SEQ ID NO: 468737 - DNA, 20 bp, Artificial
  CRISPR gRNA sequence
ttccatcagccatgaagttc

SEQ ID NO: 468738 - DNA, 20 bp, Artificial
  CRISPR gRNA sequence
ggatggaaaatgtcttccat

SEQ ID NO: 468739 - DNA, 20 bp, Artificial
  CRISPR gRNA sequence
ctgccttaatttggatctca

SEQ ID NO: 468740 - DNA, 20 bp, Artificial
  CRISPR gRNA sequence
ttggatctcattctgtttca

SEQ ID NO: 468741 - DNA, 20 bp, Artificial
  CRISPR gRNA sequence
cttctacattccaaacttgg

SEQ ID NO: 468742 - DNA, 20 bp, Artificial
  CRISPR gRNA sequence
tcaattctccacatcactgt

SEQ ID NO: 468743 - DNA, 20 bp, Artificial
  CRISPR gRNA sequence
ctccacatcactgtcacagt

SEQ ID NO: 468744 - DNA, 20 bp, Artificial
  CRISPR gRNA sequence
ttttgtatttttagtagaga

SEQ ID NO: 468745 - DNA, 20 bp, Artificial
  CRISPR gRNA sequence
cgcctcgggctcccaaagtg

SEQ ID NO: 468746 - DNA, 20 bp, Artificial
  CRISPR gRNA sequence
accgcactgggcctagccca

SEQ ID NO: 468747 - DNA, 20 bp, Artificial
  CRISPR gRNA sequence
ttttatatttttagtagaga

SEQ ID NO: 468748 - DNA, 20 bp, Artificial
  CRISPR gRNA sequence
ctttataactacatatgtgt

SEQ ID NO: 468749 - DNA, 20 bp, Artificial
  CRISPR gRNA sequence
aaagctagactttacaagta

SEQ ID NO: 468750 - DNA, 20 bp, Artificial
  CRISPR gRNA sequence
caagtattcagtttgaaaag

SEQ ID NO: 468751 - DNA, 20 bp, Artificial
  CRISPR gRNA sequence
ccatttaaaaaaaaagaggg

SEQ ID NO: 468752 - DNA, 20 bp, Artificial
  CRISPR gRNA sequence
atttcttatttttaaatacc

SEQ ID NO: 468753 - DNA, 20 bp, Artificial
  CRISPR gRNA sequence
ttatttttaaataccatatg

SEQ ID NO: 468754 - DNA, 20 bp, Artificial
  CRISPR gRNA sequence
tatcatgaggaaaatctcac

SEQ ID NO: 468755 - DNA, 20 bp, Artificial
  CRISPR gRNA sequence
aaatgaatgactgtaatgaa

SEQ ID NO: 468756 - DNA, 20 bp, Artificial
  CRISPR gRNA sequence
aacttgagctaagaaagtgt

SEQ ID NO: 468757 - DNA, 20 bp, Artificial
  CRISPR gRNA sequence
gtttaacatagaaattaaac

SEQ ID NO: 468758 - DNA, 20 bp, Artificial
  CRISPR gRNA sequence
aatgattttttgagaaacta

SEQ ID NO: 468759 - DNA, 20 bp, Artificial
  CRISPR gRNA sequence
ataattttctgtgacatcaa

SEQ ID NO: 468760 - DNA, 20 bp, Artificial
  CRISPR gRNA sequence
tctgtgacatcaaccaggat

SEQ ID NO: 468761 - DNA, 20 bp, Artificial
  CRISPR gRNA sequence
ctcaaatcttcccttgaaat

SEQ ID NO: 468762 - DNA, 20 bp, Artificial
  CRISPR gRNA sequence
gtttagggatcccataaggc

SEQ ID NO: 468763 - DNA, 20 bp, Artificial
  CRISPR gRNA sequence
acacaaacatatgttaaaat

SEQ ID NO: 468764 - DNA, 20 bp, Artificial
  CRISPR gRNA sequence
ttgttactttaaggaaaacc

SEQ ID NO: 468765 - DNA, 20 bp, Artificial
  CRISPR gRNA sequence
ctcagtcccttctgtaaaat

SEQ ID NO: 468766 - DNA, 20 bp, Artificial
  CRISPR gRNA sequence
acaaggatgtagtatgcaat

SEQ ID NO: 468767 - DNA, 20 bp, Artificial
  CRISPR gRNA sequence
ttcatttatgaaatttttct

SEQ ID NO: 468768 - DNA, 20 bp, Artificial
  CRISPR gRNA sequence
aagactttaagctctgtatc

SEQ ID NO: 468769 - DNA, 20 bp, Artificial
  CRISPR gRNA sequence
ctctgtatctcttgatttta

SEQ ID NO: 468770 - DNA, 20 bp, Artificial
  CRISPR gRNA sequence
catgtttgaaataattctga

SEQ ID NO: 468771 - DNA, 20 bp, Artificial
  CRISPR gRNA sequence
tcagtcattctagtatttgt

SEQ ID NO: 468772 - DNA, 20 bp, Artificial
  CRISPR gRNA sequence
ttgctttttccgacatttag

SEQ ID NO: 468773 - DNA, 20 bp, Artificial
  CRISPR gRNA sequence
atgaggtcagatgcccaatg

SEQ ID NO: 468774 - DNA, 20 bp, Artificial
  CRISPR gRNA sequence
acttttagataccaaacatg

SEQ ID NO: 468775 - DNA, 20 bp, Artificial
  CRISPR gRNA sequence
attgtttcatttgaccctca

SEQ ID NO: 468776 - DNA, 20 bp, Artificial
  CRISPR gRNA sequence
tataggaaatattcttagca

SEQ ID NO: 468777 - DNA, 20 bp, Artificial
  CRISPR gRNA sequence
acataaagtaccagatatta

SEQ ID NO: 468778 - DNA, 20 bp, Artificial
  CRISPR gRNA sequence
tacagaaatatattaaccag

SEQ ID NO: 468779 - DNA, 20 bp, Artificial
  CRISPR gRNA sequence
ctttgtcctttgataatttt

SEQ ID NO: 468780 - DNA, 20 bp, Artificial
  CRISPR gRNA sequence
gtcctttgataattttctaa

SEQ ID NO: 468781 - DNA, 20 bp, Artificial
  CRISPR gRNA sequence
tctaccctactggtcactga

SEQ ID NO: 468782 - DNA, 20 bp, Artificial
  CRISPR gRNA sequence
tgactttgcttctctaggcc

SEQ ID NO: 468783 - DNA, 20 bp, Artificial
  CRISPR gRNA sequence
gtctactctgtgtaacaagg

SEQ ID NO: 468784 - DNA, 20 bp, Artificial
  CRISPR gRNA sequence
tgtaacaaggatgagtttct

SEQ ID NO: 468785 - DNA, 20 bp, Artificial
  CRISPR gRNA sequence
aattatcgcccttgaatagt

SEQ ID NO: 468786 - DNA, 20 bp, Artificial
  CRISPR gRNA sequence
acttaatgagtcctaaagaa

SEQ ID NO: 468787 - DNA, 20 bp, Artificial
  CRISPR gRNA sequence
agaacaatgatttagagaga

SEQ ID NO: 468788 - DNA, 20 bp, Artificial
  CRISPR gRNA sequence
taaattttccacctttgtca

SEQ ID NO: 468789 - DNA, 20 bp, Artificial
  CRISPR gRNA sequence
tctaaatattgacttcagtg

SEQ ID NO: 468790 - DNA, 20 bp, Artificial
  CRISPR gRNA sequence
aaggattgttacttgtgatg

SEQ ID NO: 468791 - DNA, 20 bp, Artificial
  CRISPR gRNA sequence
cttgtgatgttcagattaag

SEQ ID NO: 468792 - DNA, 20 bp, Artificial
  CRISPR gRNA sequence
gattaagtgtggcttatgta

SEQ ID NO: 468793 - DNA, 20 bp, Artificial
  CRISPR gRNA sequence
attctaccacagacatcaca

SEQ ID NO: 468794 - DNA, 20 bp, Artificial
  CRISPR gRNA sequence
tgatgtgtgtgagttccagg

SEQ ID NO: 468795 - DNA, 20 bp, Artificial
  CRISPR gRNA sequence
agagctctgccagctaaact

SEQ ID NO: 468796 - DNA, 20 bp, Artificial
  CRISPR gRNA sequence
taccagaaaggtacaaaata

SEQ ID NO: 468797 - DNA, 20 bp, Artificial
  CRISPR gRNA sequence
tgacacaatacaactcaagc

SEQ ID NO: 468798 - DNA, 20 bp, Artificial
  CRISPR gRNA sequence
gcgcatgattctcaagcact

SEQ ID NO: 468799 - DNA, 20 bp, Artificial
  CRISPR gRNA sequence
tgaccaaggataagagtaga

SEQ ID NO: 468800 - DNA, 20 bp, Artificial
  CRISPR gRNA sequence
agaatttacaagaaacttaa

SEQ ID NO: 468801 - DNA, 20 bp, Artificial
  CRISPR gRNA sequence
ggatatgaacacacagttct

SEQ ID NO: 468802 - DNA, 20 bp, Artificial
  CRISPR gRNA sequence
ttttgtatttttagtacaga

SEQ ID NO: 468803 - DNA, 20 bp, Artificial
  CRISPR gRNA sequence
acctcaaatgacccgccctc

SEQ ID NO: 468804 - DNA, 20 bp, Artificial
  CRISPR gRNA sequence
ctcctcagcttcctgaagtg

SEQ ID NO: 468805 - DNA, 20 bp, Artificial
  CRISPR gRNA sequence
aatggcatgagcccgggagg

SEQ ID NO: 468806 - DNA, 20 bp, Artificial
  CRISPR gRNA sequence
gaggcagagcttgcagtgag

SEQ ID NO: 468807 - DNA, 20 bp, Artificial
  CRISPR gRNA sequence
acatctcacgccagtcagaa

SEQ ID NO: 468808 - DNA, 20 bp, Artificial
  CRISPR gRNA sequence
gcaagtctgtggagaattag

SEQ ID NO: 468809 - DNA, 20 bp, Artificial
  CRISPR gRNA sequence
ctataaagacacatgcacac

SEQ ID NO: 468810 - DNA, 20 bp, Artificial
  CRISPR gRNA sequence
tgtacatttctgcacatgta

SEQ ID NO: 468811 - DNA, 20 bp, Artificial
  CRISPR gRNA sequence
aactccaaatttttatttgt

SEQ ID NO: 468812 - DNA, 20 bp, Artificial
  CRISPR gRNA sequence
ggcatgccatgcactattct

SEQ ID NO: 468813 - DNA, 20 bp, Artificial
  CRISPR gRNA sequence
ttaatagtcacaacaacctt

SEQ ID NO: 468814 - DNA, 20 bp, Artificial
  CRISPR gRNA sequence
tagatgagaaaactgagaac

SEQ ID NO: 468815 - DNA, 20 bp, Artificial
  CRISPR gRNA sequence
taggatactaatccatggag

SEQ ID NO: 468816 - DNA, 20 bp, Artificial
  CRISPR gRNA sequence
tgatcttagccactatacca

SEQ ID NO: 468817 - DNA, 20 bp, Artificial
  CRISPR gRNA sequence
gcttctccaaggaaaaaaga

SEQ ID NO: 468818 - DNA, 20 bp, Artificial
  CRISPR gRNA sequence
agaaaatgattattttttgg

SEQ ID NO: 468819 - DNA, 20 bp, Artificial
  CRISPR gRNA sequence
agtcccaatgaggcaagata

SEQ ID NO: 468820 - DNA, 20 bp, Artificial
  CRISPR gRNA sequence
tgagcacaaggttaatcttt

SEQ ID NO: 468821 - DNA, 20 bp, Artificial
  CRISPR gRNA sequence
ttttttgacccaaagatatg

SEQ ID NO: 468822 - DNA, 20 bp, Artificial
  CRISPR gRNA sequence
tctgtgtgggatgtggaaca

SEQ ID NO: 468823 - DNA, 20 bp, Artificial
  CRISPR gRNA sequence
ctttcccttactgaaccaga

SEQ ID NO: 468824 - DNA, 20 bp, Artificial
  CRISPR gRNA sequence
cccttactgaaccagactag

SEQ ID NO: 468825 - DNA, 20 bp, Artificial
  CRISPR gRNA sequence
tgtatgccacacactgaggg

SEQ ID NO: 468826 - DNA, 20 bp, Artificial
  CRISPR gRNA sequence
ataaagaaggaccttaaaca

SEQ ID NO: 468827 - DNA, 20 bp, Artificial
  CRISPR gRNA sequence
gaacaaggacacggatctca

SEQ ID NO: 468828 - DNA, 20 bp, Artificial
  CRISPR gRNA sequence
ccaagatataaggtatttaa

SEQ ID NO: 468829 - DNA, 20 bp, Artificial
  CRISPR gRNA sequence
aaatgttccttctcttaacc

SEQ ID NO: 468830 - DNA, 20 bp, Artificial
  CRISPR gRNA sequence
ttttatatttttagtagaga

SEQ ID NO: 468831 - DNA, 20 bp, Artificial
  CRISPR gRNA sequence
acctcaggtgatctgcccgt

SEQ ID NO: 468832 - DNA, 20 bp, Artificial
  CRISPR gRNA sequence
catatttcattttctgaata

SEQ ID NO: 468833 - DNA, 20 bp, Artificial
  CRISPR gRNA sequence
aaaaataccactaacattta

SEQ ID NO: 468834 - DNA, 20 bp, Artificial
  CRISPR gRNA sequence
aggtcttaccccaccatcaa

SEQ ID NO: 468835 - DNA, 20 bp, Artificial
  CRISPR gRNA sequence
ttgttcttaatttcatagag

SEQ ID NO: 468836 - DNA, 20 bp, Artificial
  CRISPR gRNA sequence
ctagatacttacaaacataa

SEQ ID NO: 468837 - DNA, 20 bp, Artificial
  CRISPR gRNA sequence
tagagacatattccaaacta

SEQ ID NO: 468838 - DNA, 20 bp, Artificial
  CRISPR gRNA sequence
ctttccatagaacctcagtg

SEQ ID NO: 468839 - DNA, 20 bp, Artificial
  CRISPR gRNA sequence
cagtagccaaactgataaat

SEQ ID NO: 468840 - DNA, 20 bp, Artificial
  CRISPR gRNA sequence
tgcccaacatgcattgcatc

SEQ ID NO: 468841 - DNA, 20 bp, Artificial
  CRISPR gRNA sequence
ttgaacccgggaggaagaag

SEQ ID NO: 468842 - DNA, 20 bp, Artificial
  CRISPR gRNA sequence
aaaataaaacctgaaaaatc

SEQ ID NO: 468843 - DNA, 20 bp, Artificial
  CRISPR gRNA sequence
aagcttctgatgagccactc

SEQ ID NO: 468844 - DNA, 20 bp, Artificial
  CRISPR gRNA sequence
acatcccaatgaagcaagta

SEQ ID NO: 468845 - DNA, 20 bp, Artificial
  CRISPR gRNA sequence
aaccatggagatatgtataa

SEQ ID NO: 468846 - DNA, 20 bp, Artificial
  CRISPR gRNA sequence
cactgcagcactctactgca

SEQ ID NO: 468847 - DNA, 20 bp, Artificial
  CRISPR gRNA sequence
gcatttttgcaagaagtagt

SEQ ID NO: 468848 - DNA, 20 bp, Artificial
  CRISPR gRNA sequence
gttctcttttcctaccatca

SEQ ID NO: 468849 - DNA, 20 bp, Artificial
  CRISPR gRNA sequence
ccaagctattgatgcgatgc

SEQ ID NO: 468850 - DNA, 20 bp, Artificial
  CRISPR gRNA sequence
aggtgaatactatgttctaa

SEQ ID NO: 468851 - DNA, 20 bp, Artificial
  CRISPR gRNA sequence
tgtcttcggtaagcaaatgt

SEQ ID NO: 468852 - DNA, 20 bp, Artificial
  CRISPR gRNA sequence
tcggtaagcaaatgtaacag

SEQ ID NO: 468853 - DNA, 20 bp, Artificial
  CRISPR gRNA sequence
atgtaacagcttggtttcat

SEQ ID NO: 468854 - DNA, 20 bp, Artificial
  CRISPR gRNA sequence
gatgttccagatgtccagat

SEQ ID NO: 468855 - DNA, 20 bp, Artificial
  CRISPR gRNA sequence
atggaaaaactgctcaagta

SEQ ID NO: 468856 - DNA, 20 bp, Artificial
  CRISPR gRNA sequence
aaaactgctcaagtagaagg

SEQ ID NO: 468857 - DNA, 20 bp, Artificial
  CRISPR gRNA sequence
tctgagtgctgcagagttgg

SEQ ID NO: 468858 - DNA, 20 bp, Artificial
  CRISPR gRNA sequence
gaggagagtaggaagagcct

SEQ ID NO: 468859 - DNA, 20 bp, Artificial
  CRISPR gRNA sequence
gacgatgtggtactctgttc

SEQ ID NO: 468860 - DNA, 20 bp, Artificial
  CRISPR gRNA sequence
gtggtactctgttctgtggt

SEQ ID NO: 468861 - DNA, 20 bp, Artificial
  CRISPR gRNA sequence
taacttctccttccgctcta

SEQ ID NO: 468862 - DNA, 20 bp, Artificial
  CRISPR gRNA sequence
accacgtttttgccccaggt

SEQ ID NO: 468863 - DNA, 20 bp, Artificial
  CRISPR gRNA sequence
gtattgttgcagtctttaag

SEQ ID NO: 468864 - DNA, 20 bp, Artificial
  CRISPR gRNA sequence
caacttaaagactgcaacaa

SEQ ID NO: 468865 - DNA, 20 bp, Artificial
  CRISPR gRNA sequence
tgcaacaatacagatttctt

SEQ ID NO: 468866 - DNA, 20 bp, Artificial
  CRISPR gRNA sequence
gaaggagaagttaaggactg

SEQ ID NO: 468867 - DNA, 20 bp, Artificial
  CRISPR gRNA sequence
ctgagctgctttgcagatca

SEQ ID NO: 468868 - DNA, 20 bp, Artificial
  CRISPR gRNA sequence
gaagcaaagccttctacttg

SEQ ID NO: 468869 - DNA, 20 bp, Artificial
  CRISPR gRNA sequence
ggaaatgaagacattgcctg

SEQ ID NO: 468870 - DNA, 20 bp, Artificial
  CRISPR gRNA sequence
tggaacatccatggtaaggc

SEQ ID NO: 468871 - DNA, 20 bp, Artificial
  CRISPR gRNA sequence
aggcacctgcttaggttatt

SEQ ID NO: 468872 - DNA, 20 bp, Artificial
  CRISPR gRNA sequence
ttgctgaacttagtacggtg

SEQ ID NO: 468873 - DNA, 20 bp, Artificial
  CRISPR gRNA sequence
agatgaaaccaagctgttac

SEQ ID NO: 468874 - DNA, 20 bp, Artificial
  CRISPR gRNA sequence
ctaatcataggcatcgcatc

SEQ ID NO: 468875 - DNA, 20 bp, Artificial
  CRISPR gRNA sequence
cctctaaataaaatctctat

SEQ ID NO: 468876 - DNA, 20 bp, Artificial
  CRISPR gRNA sequence
tgggatgtatgccttgagaa

SEQ ID NO: 468877 - DNA, 20 bp, Artificial
  CRISPR gRNA sequence
ataggagcagaacttttcgt

SEQ ID NO: 468878 - DNA, 20 bp, Artificial
  CRISPR gRNA sequence
caattgaacacagaaaataa

SEQ ID NO: 468879 - DNA, 20 bp, Artificial
  CRISPR gRNA sequence
caatttcttttttattgtaa

SEQ ID NO: 468880 - DNA, 20 bp, Artificial
  CRISPR gRNA sequence
aagcctatgagtggctcatc

SEQ ID NO: 468881 - DNA, 20 bp, Artificial
  CRISPR gRNA sequence
atgagtggctcatcagaagc

SEQ ID NO: 468882 - DNA, 20 bp, Artificial
  CRISPR gRNA sequence
catcagaagcttctgatttt

SEQ ID NO: 468883 - DNA, 20 bp, Artificial
  CRISPR gRNA sequence
tttttttatttttttgagac

SEQ ID NO: 468884 - DNA, 20 bp, Artificial
  CRISPR gRNA sequence
atcctctgcctcccgggttc

SEQ ID NO: 468885 - DNA, 20 bp, Artificial
  CRISPR gRNA sequence
tgcctcagcgtccctagtag

SEQ ID NO: 468886 - DNA, 20 bp, Artificial
  CRISPR gRNA sequence
cactgcaacactctactgca

SEQ ID NO: 468887 - DNA, 20 bp, Artificial
  CRISPR gRNA sequence
gcattttcgcaagaagtagt

SEQ ID NO: 468888 - DNA, 20 bp, Artificial
  CRISPR gRNA sequence
gttctcttttcttgccatca

SEQ ID NO: 468889 - DNA, 20 bp, Artificial
  CRISPR gRNA sequence
tgcctcagcctcccaaagtg

SEQ ID NO: 468890 - DNA, 20 bp, Artificial
  CRISPR gRNA sequence
caggtatgagccaccatgcc

SEQ ID NO: 468891 - DNA, 20 bp, Artificial
  CRISPR gRNA sequence
ccaccatgcccagtgatttt

SEQ ID NO: 468892 - DNA, 20 bp, Artificial
  CRISPR gRNA sequence
ttccctacaagcacacattt

SEQ ID NO: 468893 - DNA, 20 bp, Artificial
  CRISPR gRNA sequence
ctatctataattttaaactg

SEQ ID NO: 468894 - DNA, 20 bp, Artificial
  CRISPR gRNA sequence
ccttagttactcaaacatct

SEQ ID NO: 468895 - DNA, 20 bp, Artificial
  CRISPR gRNA sequence
tatctagtattaagtcaact

SEQ ID NO: 468896 - DNA, 20 bp, Artificial
  CRISPR gRNA sequence
actggagtcaaatattatta

SEQ ID NO: 468897 - DNA, 20 bp, Artificial
  CRISPR gRNA sequence
tctctatgaaattaagaaca

SEQ ID NO: 468898 - DNA, 20 bp, Artificial
  CRISPR gRNA sequence
ctctgccacttactgtatgg

SEQ ID NO: 468899 - DNA, 20 bp, Artificial
  CRISPR gRNA sequence
attaagtctcttctcttctc

SEQ ID NO: 468900 - DNA, 20 bp, Artificial
  CRISPR gRNA sequence
tctatgtaattaaatgagaa

SEQ ID NO: 468901 - DNA, 20 bp, Artificial
  CRISPR gRNA sequence
aacattattatttaaaatag

SEQ ID NO: 468902 - DNA, 20 bp, Artificial
  CRISPR gRNA sequence
cgggcagatcacctgaggtc

SEQ ID NO: 468903 - DNA, 20 bp, Artificial
  CRISPR gRNA sequence
tcgggaggccgagacaggag

SEQ ID NO: 468904 - DNA, 20 bp, Artificial
  CRISPR gRNA sequence
agatatataccagttgatat

SEQ ID NO: 468905 - DNA, 20 bp, Artificial
  CRISPR gRNA sequence
acattaaataccttatatct

SEQ ID NO: 468906 - DNA, 20 bp, Artificial
  CRISPR gRNA sequence
ccttatatcttggggatttc

SEQ ID NO: 468907 - DNA, 20 bp, Artificial
  CRISPR gRNA sequence
tctttacagtaatacatttt

SEQ ID NO: 468908 - DNA, 20 bp, Artificial
  CRISPR gRNA sequence
cagtgtttaaagatagcctt

SEQ ID NO: 468909 - DNA, 20 bp, Artificial
  CRISPR gRNA sequence
tgtaatgttctctacaaact

SEQ ID NO: 468910 - DNA, 20 bp, Artificial
  CRISPR gRNA sequence
ggtccttctttattacaaaa

SEQ ID NO: 468911 - DNA, 20 bp, Artificial
  CRISPR gRNA sequence
cttctttattacaaaagtat

SEQ ID NO: 468912 - DNA, 20 bp, Artificial
  CRISPR gRNA sequence
aaagtatgcttgcttacttt

SEQ ID NO: 468913 - DNA, 20 bp, Artificial
  CRISPR gRNA sequence
ttgcccctcagtgtgtggca

SEQ ID NO: 468914 - DNA, 20 bp, Artificial
  CRISPR gRNA sequence
tagttcagttgaggatcaac

SEQ ID NO: 468915 - DNA, 20 bp, Artificial
  CRISPR gRNA sequence
tgcagaataaaggcagttgg

SEQ ID NO: 468916 - DNA, 20 bp, Artificial
  CRISPR gRNA sequence
gaataaaggcagttggaact

SEQ ID NO: 468917 - DNA, 20 bp, Artificial
  CRISPR gRNA sequence
aaaggcagttggaactgttt

SEQ ID NO: 468918 - DNA, 20 bp, Artificial
  CRISPR gRNA sequence
gtttgattgattactggtta

SEQ ID NO: 468919 - DNA, 20 bp, Artificial
  CRISPR gRNA sequence
gggctatgtctccattttgg

SEQ ID NO: 468920 - DNA, 20 bp, Artificial
  CRISPR gRNA sequence
tggtccagtatggtccatgg

SEQ ID NO: 468921 - DNA, 20 bp, Artificial
  CRISPR gRNA sequence
acaccgtgttccacatccca

SEQ ID NO: 468922 - DNA, 20 bp, Artificial
  CRISPR gRNA sequence
cgtgttccacatcccacaca

SEQ ID NO: 468923 - DNA, 20 bp, Artificial
  CRISPR gRNA sequence
aaaatatcattccttgaagt

SEQ ID NO: 468924 - DNA, 20 bp, Artificial
  CRISPR gRNA sequence
atctttataaggcatatttc

SEQ ID NO: 468925 - DNA, 20 bp, Artificial
  CRISPR gRNA sequence
atgcctgccatatattaaat

SEQ ID NO: 468926 - DNA, 20 bp, Artificial
  CRISPR gRNA sequence
acttcttgaattaaagcatg

SEQ ID NO: 468927 - DNA, 20 bp, Artificial
  CRISPR gRNA sequence
atatacttttcctatcacag

SEQ ID NO: 468928 - DNA, 20 bp, Artificial
  CRISPR gRNA sequence
cacagagaagtttttaaatt

SEQ ID NO: 468929 - DNA, 20 bp, Artificial
  CRISPR gRNA sequence
tgcttcctctgtcctactac

SEQ ID NO: 468930 - DNA, 20 bp, Artificial
  CRISPR gRNA sequence
ctacttaatttccattattt

SEQ ID NO: 468931 - DNA, 20 bp, Artificial
  CRISPR gRNA sequence
gggactctaaagccagactc

SEQ ID NO: 468932 - DNA, 20 bp, Artificial
  CRISPR gRNA sequence
gtatcctatgtctgccattt

SEQ ID NO: 468933 - DNA, 20 bp, Artificial
  CRISPR gRNA sequence
tgactataaaatctctggtt

SEQ ID NO: 468934 - DNA, 20 bp, Artificial
  CRISPR gRNA sequence
ttcttttagtccaacatttc

SEQ ID NO: 468935 - DNA, 20 bp, Artificial
  CRISPR gRNA sequence
ggatacatgtgcagaaatgt

SEQ ID NO: 468936 - DNA, 20 bp, Artificial
  CRISPR gRNA sequence
cataggtatacgtgtgccat

SEQ ID NO: 468937 - DNA, 20 bp, Artificial
  CRISPR gRNA sequence
ggtatacgtgtgccatgatg

SEQ ID NO: 468938 - DNA, 20 bp, Artificial
  CRISPR gRNA sequence
ccccctactccccaacaggc

SEQ ID NO: 468939 - DNA, 20 bp, Artificial
  CRISPR gRNA sequence
cacttatgagtgagaacatg

SEQ ID NO: 468940 - DNA, 20 bp, Artificial
  CRISPR gRNA sequence
atgagtgagaacatgcagtg

SEQ ID NO: 468941 - DNA, 20 bp, Artificial
  CRISPR gRNA sequence
gtttggttttctgttcctgt

SEQ ID NO: 468942 - DNA, 20 bp, Artificial
  CRISPR gRNA sequence
ggttttctgttcctgtgtta

SEQ ID NO: 468943 - DNA, 20 bp, Artificial
  CRISPR gRNA sequence
tgtgttagtttgcttaggat

SEQ ID NO: 468944 - DNA, 20 bp, Artificial
  CRISPR gRNA sequence
gtttgcttaggatgatggct

SEQ ID NO: 468945 - DNA, 20 bp, Artificial
  CRISPR gRNA sequence
gtgcatgtgtctttatagta

SEQ ID NO: 468946 - DNA, 20 bp, Artificial
  CRISPR gRNA sequence
ctttgagtatatacccagta

SEQ ID NO: 468947 - DNA, 20 bp, Artificial
  CRISPR gRNA sequence
tccacagacttgccagcacc

SEQ ID NO: 468948 - DNA, 20 bp, Artificial
  CRISPR gRNA sequence
ggcgtgagatgttatctcct

SEQ ID NO: 468949 - DNA, 20 bp, Artificial
  CRISPR gRNA sequence
gagatgttatctccttgtgg

SEQ ID NO: 468950 - DNA, 20 bp, Artificial
  CRISPR gRNA sequence
ttctctgaccatcagtgatg

SEQ ID NO: 468951 - DNA, 20 bp, Artificial
  CRISPR gRNA sequence
gtgatgttgagcttttattc

SEQ ID NO: 468952 - DNA, 20 bp, Artificial
  CRISPR gRNA sequence
ttttttgtatttttagtaca

SEQ ID NO: 468953 - DNA, 20 bp, Artificial
  CRISPR gRNA sequence
tgtctcggcctcccaaagtg

SEQ ID NO: 468954 - DNA, 20 bp, Artificial
  CRISPR gRNA sequence
agtgtcttcttttgagaagt

SEQ ID NO: 468955 - DNA, 20 bp, Artificial
  CRISPR gRNA sequence
tacttgggaggctgaggcag

SEQ ID NO: 468956 - DNA, 20 bp, Artificial
  CRISPR gRNA sequence
ctttgcccactttttgatgc

SEQ ID NO: 468957 - DNA, 20 bp, Artificial
  CRISPR gRNA sequence
gcccactttttgatgcggtt

SEQ ID NO: 468958 - DNA, 20 bp, Artificial
  CRISPR gRNA sequence
tttttttcttgtaaacttat

SEQ ID NO: 468959 - DNA, 20 bp, Artificial
  CRISPR gRNA sequence
tattaggcctttttcagatg

SEQ ID NO: 468960 - DNA, 20 bp, Artificial
  CRISPR gRNA sequence
ggttgcctttttgctctgat

SEQ ID NO: 468961 - DNA, 20 bp, Artificial
  CRISPR gRNA sequence
cttttgctgtgcagaagttc

SEQ ID NO: 468962 - DNA, 20 bp, Artificial
  CRISPR gRNA sequence
gaagttcttcagtttgttgc

SEQ ID NO: 468963 - DNA, 20 bp, Artificial
  CRISPR gRNA sequence
tggtcaccaagaaaagctaa

SEQ ID NO: 468964 - DNA, 20 bp, Artificial
  CRISPR gRNA sequence
gctaatagtgcttgagaatc

SEQ ID NO: 468965 - DNA, 20 bp, Artificial
  CRISPR gRNA sequence
gtgtcagtgaattgtatcat

SEQ ID NO: 468966 - DNA, 20 bp, Artificial
  CRISPR gRNA sequence
agtgaattgtatcatatgcg

SEQ ID NO: 468967 - DNA, 20 bp, Artificial
  CRISPR gRNA sequence
gtatactctcatggttatgg

SEQ ID NO: 468968 - DNA, 20 bp, Artificial
  CRISPR gRNA sequence
catggttatggacctgattt

SEQ ID NO: 468969 - DNA, 20 bp, Artificial
  CRISPR gRNA sequence
atgtttatctcaatggaaga

SEQ ID NO: 468970 - DNA, 20 bp, Artificial
  CRISPR gRNA sequence
atgcagaggtgtcatacaat

SEQ ID NO: 468971 - DNA, 20 bp, Artificial
  CRISPR gRNA sequence
agatcagtcccaggaaaaca

SEQ ID NO: 468972 - DNA, 20 bp, Artificial
  CRISPR gRNA sequence
ctacaagggaggctggggca

SEQ ID NO: 468973 - DNA, 20 bp, Artificial
  CRISPR gRNA sequence
attaatattggaagacattt

SEQ ID NO: 468974 - DNA, 20 bp, Artificial
  CRISPR gRNA sequence
gcagattctgtccacataag

SEQ ID NO: 468975 - DNA, 20 bp, Artificial
  CRISPR gRNA sequence
aagtattgtttagtatcttc

SEQ ID NO: 468976 - DNA, 20 bp, Artificial
  CRISPR gRNA sequence
caatatttagaaatactcat

SEQ ID NO: 468977 - DNA, 20 bp, Artificial
  CRISPR gRNA sequence
cactcactgatgctactgtc

SEQ ID NO: 468978 - DNA, 20 bp, Artificial
  CRISPR gRNA sequence
tgctgtctacatttgctgcc

SEQ ID NO: 468979 - DNA, 20 bp, Artificial
  CRISPR gRNA sequence
taggactcattaagttgact

SEQ ID NO: 468980 - DNA, 20 bp, Artificial
  CRISPR gRNA sequence
gtaatgaagaagtcctgaaa

SEQ ID NO: 468981 - DNA, 20 bp, Artificial
  CRISPR gRNA sequence
cttagaaaattatcaaagga

SEQ ID NO: 468982 - DNA, 20 bp, Artificial
  CRISPR gRNA sequence
gacaaagtttttttcaatat

SEQ ID NO: 468983 - DNA, 20 bp, Artificial
  CRISPR gRNA sequence
tgctggttaatatatttctg

SEQ ID NO: 468984 - DNA, 20 bp, Artificial
  CRISPR gRNA sequence
ctctcccacataaaagaaga

SEQ ID NO: 468985 - DNA, 20 bp, Artificial
  CRISPR gRNA sequence
atttttcacagcagagtctt

SEQ ID NO: 468986 - DNA, 20 bp, Artificial
  CRISPR gRNA sequence
ccatcttgtctttaccattc

SEQ ID NO: 468987 - DNA, 20 bp, Artificial
  CRISPR gRNA sequence
tggacaatgactcaacttct

SEQ ID NO: 468988 - DNA, 20 bp, Artificial
  CRISPR gRNA sequence
aatatttcctatatgttctc

SEQ ID NO: 468989 - DNA, 20 bp, Artificial
  CRISPR gRNA sequence
tcacaacaaccctactggat

SEQ ID NO: 468990 - DNA, 20 bp, Artificial
  CRISPR gRNA sequence
caaccctactggataagagc

SEQ ID NO: 468991 - DNA, 20 bp, Artificial
  CRISPR gRNA sequence
ccagctggtgatcttgggca

SEQ ID NO: 468992 - DNA, 20 bp, Artificial
  CRISPR gRNA sequence
gtggcttatattctctaata

SEQ ID NO: 468993 - DNA, 20 bp, Artificial
  CRISPR gRNA sequence
tgagggtcaaatgaaacaat

SEQ ID NO: 468994 - DNA, 20 bp, Artificial
  CRISPR gRNA sequence
aagtggcaaagaatgtgtag

SEQ ID NO: 468995 - DNA, 20 bp, Artificial
  CRISPR gRNA sequence
ggaaatgacatggggacttt

SEQ ID NO: 468996 - DNA, 20 bp, Artificial
  CRISPR gRNA sequence
gcaatgacaaatactagaat

SEQ ID NO: 468997 - DNA, 20 bp, Artificial
  CRISPR gRNA sequence
catgataaaatcaagagata

SEQ ID NO: 468998 - DNA, 20 bp, Artificial
  CRISPR gRNA sequence
gaaattctaactgtagaaga

SEQ ID NO: 468999 - DNA, 20 bp, Artificial
  CRISPR gRNA sequence
tcataaatgaatataagaag

SEQ ID NO: 469000 - DNA, 20 bp, Artificial
  CRISPR gRNA sequence
gaagatatgtttttataaga

SEQ ID NO: 469001 - DNA, 20 bp, Artificial
  CRISPR gRNA sequence
taagaggaaataataataaa

SEQ ID NO: 469002 - DNA, 20 bp, Artificial
  CRISPR gRNA sequence
tgtgaaaatgctctcaattt

SEQ ID NO: 469003 - DNA, 20 bp, Artificial
  CRISPR gRNA sequence
tctcaattttcttgtttcat

SEQ ID NO: 469004 - DNA, 20 bp, Artificial
  CRISPR gRNA sequence
ttttaaataatgggcataaa

SEQ ID NO: 469005 - DNA, 20 bp, Artificial
  CRISPR gRNA sequence
gtgtgtgtgtgtgtgtgtgt

SEQ ID NO: 469006 - DNA, 20 bp, Artificial
  CRISPR gRNA sequence
tctatgatctgtatctttag

SEQ ID NO: 469007 - DNA, 20 bp, Artificial
  CRISPR gRNA sequence
acagaagggactgagggcca

SEQ ID NO: 469008 - DNA, 20 bp, Artificial
  CRISPR gRNA sequence
tgtactcgtgagaacaatca

SEQ ID NO: 469009 - DNA, 20 bp, Artificial
  CRISPR gRNA sequence
agtcacttttacaaaagaag

SEQ ID NO: 469010 - DNA, 20 bp, Artificial
  CRISPR gRNA sequence
aaagaagctctgattttaac

SEQ ID NO: 469011 - DNA, 20 bp, Artificial
  CRISPR gRNA sequence
tgagaatatctgacttatgg

SEQ ID NO: 469012 - DNA, 20 bp, Artificial
  CRISPR gRNA sequence
ctaacctcatgtcaccacat

SEQ ID NO: 469013 - DNA, 20 bp, Artificial
  CRISPR gRNA sequence
gattttgtgagtgtatgtga

SEQ ID NO: 469014 - DNA, 20 bp, Artificial
  CRISPR gRNA sequence
atgatgggaaagtatgctac

SEQ ID NO: 469015 - DNA, 20 bp, Artificial
  CRISPR gRNA sequence
tgggttttctgatgtcgtcc

SEQ ID NO: 469016 - DNA, 20 bp, Artificial
  CRISPR gRNA sequence
ccatggctgctattgctgtg

SEQ ID NO: 469017 - DNA, 20 bp, Artificial
  CRISPR gRNA sequence
ccctaaactctaatttcaag

SEQ ID NO: 469018 - DNA, 20 bp, Artificial
  CRISPR gRNA sequence
tttcaagggaagatttgaga

SEQ ID NO: 469019 - DNA, 20 bp, Artificial
  CRISPR gRNA sequence
tagcctccccagcatgcgtc

SEQ ID NO: 469020 - DNA, 20 bp, Artificial
  CRISPR gRNA sequence
ccccagcatgcgtctgaagt

SEQ ID NO: 469021 - DNA, 20 bp, Artificial
  CRISPR gRNA sequence
agcatgcgtctgaagttttg

SEQ ID NO: 469022 - DNA, 20 bp, Artificial
  CRISPR gRNA sequence
gtctgaagttttggtttgct

SEQ ID NO: 469023 - DNA, 20 bp, Artificial
  CRISPR gRNA sequence
ggttgatgtcacagaaaatt

SEQ ID NO: 469024 - DNA, 20 bp, Artificial
  CRISPR gRNA sequence
attataccgttagtaatcat

SEQ ID NO: 469025 - DNA, 20 bp, Artificial
  CRISPR gRNA sequence
ttttagtttctcaaaaaatc

SEQ ID NO: 469026 - DNA, 20 bp, Artificial
  CRISPR gRNA sequence
ttgaatggttgcaaccactt

SEQ ID NO: 469027 - DNA, 20 bp, Artificial
  CRISPR gRNA sequence
ggagacatagtgaaactcag

SEQ ID NO: 469028 - DNA, 20 bp, Artificial
  CRISPR gRNA sequence
aaccctctttttttttaaat

SEQ ID NO: 469029 - DNA, 20 bp, Artificial
  CRISPR gRNA sequence
tctttttttttaaatggctg

SEQ ID NO: 469030 - DNA, 20 bp, Artificial
  CRISPR gRNA sequence
tgggagttacgagactatac

SEQ ID NO: 469031 - DNA, 20 bp, Artificial
  CRISPR gRNA sequence
caaactgaatacttgtaaag

SEQ ID NO: 469032 - DNA, 20 bp, Artificial
  CRISPR gRNA sequence
gccttttagcccacctctct

SEQ ID NO: 469033 - DNA, 20 bp, Artificial
  CRISPR gRNA sequence
tccagaggctgaggcagcag

SEQ ID NO: 469034 - DNA, 20 bp, Artificial
  CRISPR gRNA sequence
agtggggatatgagggtatg

SEQ ID NO: 469035 - DNA, 20 bp, Artificial
  CRISPR gRNA sequence
aggagaatggcgtgaacccg

SEQ ID NO: 469036 - DNA, 20 bp, Artificial
  CRISPR gRNA sequence
cccgggaggcttgcagtgag

SEQ ID NO: 469037 - DNA, 20 bp, Artificial
  CRISPR gRNA sequence
gtggagggagggaaacaagg

SEQ ID NO: 469038 - DNA, 20 bp, Artificial
  CRISPR gRNA sequence
ggctccccaggttctggcta

SEQ ID NO: 469039 - DNA, 20 bp, Artificial
  CRISPR gRNA sequence
aggaccaaatttgcctgggg

SEQ ID NO: 469040 - DNA, 20 bp, Artificial
  CRISPR gRNA sequence
ggggttggcttggaggaaga

SEQ ID NO: 469041 - DNA, 20 bp, Artificial
  CRISPR gRNA sequence
atcttcccccatgaagcctt

SEQ ID NO: 469042 - DNA, 20 bp, Artificial
  CRISPR gRNA sequence
ttgagggatctgaaagctct

SEQ ID NO: 469043 - DNA, 20 bp, Artificial
  CRISPR gRNA sequence
tgaatttaaaaacaactaaa

SEQ ID NO: 469044 - DNA, 20 bp, Artificial
  CRISPR gRNA sequence
tttcctttttttttttttga

SEQ ID NO: 469045 - DNA, 20 bp, Artificial
  CRISPR gRNA sequence
tgcctcagcctcctgagtag

SEQ ID NO: 469046 - DNA, 20 bp, Artificial
  CRISPR gRNA sequence
tttgtattttttaatagaga

SEQ ID NO: 469047 - DNA, 20 bp, Artificial
  CRISPR gRNA sequence
cgccctggcctcccaaagtg

SEQ ID NO: 469048 - DNA, 20 bp, Artificial
  CRISPR gRNA sequence
ggcatgagtcaccacgcccg

SEQ ID NO: 469049 - DNA, 20 bp, Artificial
  CRISPR gRNA sequence
tctaaatactatggttactg

SEQ ID NO: 469050 - DNA, 20 bp, Artificial
  CRISPR gRNA sequence
tttataaagtccaggatcac

SEQ ID NO: 469051 - DNA, 20 bp, Artificial
  CRISPR gRNA sequence
agacaaagaagcagaacagg

SEQ ID NO: 469052 - DNA, 20 bp, Artificial
  CRISPR gRNA sequence
caaacttcttgaatttttat

SEQ ID NO: 469053 - DNA, 20 bp, Artificial
  CRISPR gRNA sequence
aaactgtgatatataaaatc

SEQ ID NO: 469054 - DNA, 20 bp, Artificial
  CRISPR gRNA sequence
ctttatttcatgcataaaat

SEQ ID NO: 469055 - DNA, 20 bp, Artificial
  CRISPR gRNA sequence
atttcatgcataaaatgtta

SEQ ID NO: 469056 - DNA, 20 bp, Artificial
  CRISPR gRNA sequence
tacaattgaaatttttttaa

SEQ ID NO: 469057 - DNA, 20 bp, Artificial
  CRISPR gRNA sequence
aaattgtatctttgcagaat

SEQ ID NO: 469058 - DNA, 20 bp, Artificial
  CRISPR gRNA sequence
aactaaagaatcaaagttca

SEQ ID NO: 469059 - DNA, 20 bp, Artificial
  CRISPR gRNA sequence
tactgtttaggtggatataa

SEQ ID NO: 469060 - DNA, 20 bp, Artificial
  CRISPR gRNA sequence
ttaaaacattttttcatttg

SEQ ID NO: 469061 - DNA, 20 bp, Artificial
  CRISPR gRNA sequence
tcttttctggccattttatt

SEQ ID NO: 469062 - DNA, 20 bp, Artificial
  CRISPR gRNA sequence
attttattacttgttttatc

SEQ ID NO: 469063 - DNA, 20 bp, Artificial
  CRISPR gRNA sequence
cgtggaatatatataccact

SEQ ID NO: 469064 - DNA, 20 bp, Artificial
  CRISPR gRNA sequence
ataagagcctgggggggagt

SEQ ID NO: 469065 - DNA, 20 bp, Artificial
  CRISPR gRNA sequence
ggggagtagaagtttttatt

SEQ ID NO: 469066 - DNA, 20 bp, Artificial
  CRISPR gRNA sequence
gaagtttttattctttgttt

SEQ ID NO: 469067 - DNA, 20 bp, Artificial
  CRISPR gRNA sequence
tttttattctttgtttgttg

SEQ ID NO: 469068 - DNA, 20 bp, Artificial
  CRISPR gRNA sequence
gccaccacgcccggctaatt

SEQ ID NO: 469069 - DNA, 20 bp, Artificial
  CRISPR gRNA sequence
ttttgtatttttagtagaga

SEQ ID NO: 469070 - DNA, 20 bp, Artificial
  CRISPR gRNA sequence
gtgagccaccgtgcccggcc

SEQ ID NO: 469071 - DNA, 20 bp, Artificial
  CRISPR gRNA sequence
aatttcctgtcatcagatat

SEQ ID NO: 469072 - DNA, 20 bp, Artificial
  CRISPR gRNA sequence
ttgggaggctgaggcaggag

SEQ ID NO: 469073 - DNA, 20 bp, Artificial
  CRISPR gRNA sequence
gataagacaaacttttgggg

SEQ ID NO: 469074 - DNA, 20 bp, Artificial
  CRISPR gRNA sequence
caggcagaaaaggggtgtta

SEQ ID NO: 469075 - DNA, 20 bp, Artificial
  CRISPR gRNA sequence
cggggaggctgaggcaggag

SEQ ID NO: 469076 - DNA, 20 bp, Artificial
  CRISPR gRNA sequence
agataggaggtattataata

SEQ ID NO: 469077 - DNA, 20 bp, Artificial
  CRISPR gRNA sequence
tttgtgcacagagggagtac

SEQ ID NO: 469078 - DNA, 20 bp, Artificial
  CRISPR gRNA sequence
gagtactcttgatttctaat

SEQ ID NO: 469079 - DNA, 20 bp, Artificial
  CRISPR gRNA sequence
ataagaatatttaggaactg

SEQ ID NO: 469080 - DNA, 20 bp, Artificial
  CRISPR gRNA sequence
aatagaaattgcaggctaga

SEQ ID NO: 469081 - DNA, 20 bp, Artificial
  CRISPR gRNA sequence
ttgcaggctagaagtggttt

SEQ ID NO: 469082 - DNA, 20 bp, Artificial
  CRISPR gRNA sequence
attaaggaaggtgaagttgt

SEQ ID NO: 469083 - DNA, 20 bp, Artificial
  CRISPR gRNA sequence
attttctcatggtggataag

SEQ ID NO: 469084 - DNA, 20 bp, Artificial
  CRISPR gRNA sequence
gcaaagtttaaactcctgcc

SEQ ID NO: 469085 - DNA, 20 bp, Artificial
  CRISPR gRNA sequence
atcaatgatctaaatctatc

SEQ ID NO: 469086 - DNA, 20 bp, Artificial
  CRISPR gRNA sequence
ctcctctgtcccatgcactg

SEQ ID NO: 469087 - DNA, 20 bp, Artificial
  CRISPR gRNA sequence
gctcaagtatagcctttcca

SEQ ID NO: 469088 - DNA, 20 bp, Artificial
  CRISPR gRNA sequence
ccttctgcagacccatgcaa

SEQ ID NO: 469089 - DNA, 20 bp, Artificial
  CRISPR gRNA sequence
tgcctcagcctcttgagtag

SEQ ID NO: 469090 - DNA, 20 bp, Artificial
  CRISPR gRNA sequence
ttttgtatttttagtaaaga

SEQ ID NO: 469091 - DNA, 20 bp, Artificial
  CRISPR gRNA sequence
tccctcggcctcccaaagtg

SEQ ID NO: 469092 - DNA, 20 bp, Artificial
  CRISPR gRNA sequence
gcgtgagccaccatgcccgg

SEQ ID NO: 469093 - DNA, 20 bp, Artificial
  CRISPR gRNA sequence
tccacaaatgcagacatcct

SEQ ID NO: 469094 - DNA, 20 bp, Artificial
  CRISPR gRNA sequence
acatcctatctgatttattc

SEQ ID NO: 469095 - DNA, 20 bp, Artificial
  CRISPR gRNA sequence
aaccagcatgcaacgtccct

SEQ ID NO: 469096 - DNA, 20 bp, Artificial
  CRISPR gRNA sequence
agcatgcaacgtccctcaag

SEQ ID NO: 469097 - DNA, 20 bp, Artificial
  CRISPR gRNA sequence
ataaagactggtatatagta

SEQ ID NO: 469098 - DNA, 20 bp, Artificial
  CRISPR gRNA sequence
agaaaagtgtctagaaggta

SEQ ID NO: 469099 - DNA, 20 bp, Artificial
  CRISPR gRNA sequence
ccgggaggctgaggcaggag

SEQ ID NO: 469100 - DNA, 20 bp, Artificial
  CRISPR gRNA sequence
ccctctttgttagatactcc

SEQ ID NO: 469101 - DNA, 20 bp, Artificial
  CRISPR gRNA sequence
atctttgtctataaccatct

SEQ ID NO: 469102 - DNA, 20 bp, Artificial
  CRISPR gRNA sequence
aggaacggacttctggaaac

SEQ ID NO: 469103 - DNA, 20 bp, Artificial
  CRISPR gRNA sequence
ctcatccttataacttacct

SEQ ID NO: 469104 - DNA, 20 bp, Artificial
  CRISPR gRNA sequence
ccttataacttacctttcag

SEQ ID NO: 469105 - DNA, 20 bp, Artificial
  CRISPR gRNA sequence
attaagaagtcttaaagtga

SEQ ID NO: 469106 - DNA, 20 bp, Artificial
  CRISPR gRNA sequence
tctgcaggtcctttttctca

SEQ ID NO: 469107 - DNA, 20 bp, Artificial
  CRISPR gRNA sequence
tctgattcctggaaactcaa

SEQ ID NO: 469108 - DNA, 20 bp, Artificial
  CRISPR gRNA sequence
caggtttctattattctgag

SEQ ID NO: 469109 - DNA, 20 bp, Artificial
  CRISPR gRNA sequence
attcatgagatgtgagcagg

SEQ ID NO: 469110 - DNA, 20 bp, Artificial
  CRISPR gRNA sequence
agctgtctttgtatttaaaa

SEQ ID NO: 469111 - DNA, 20 bp, Artificial
  CRISPR gRNA sequence
aagaaaatacttttaggatc

SEQ ID NO: 469112 - DNA, 20 bp, Artificial
  CRISPR gRNA sequence
attaaaagagaagcagaata

SEQ ID NO: 469113 - DNA, 20 bp, Artificial
  CRISPR gRNA sequence
tggcctagtgaccattgtta

SEQ ID NO: 469114 - DNA, 20 bp, Artificial
  CRISPR gRNA sequence
ggctcagagctcagagggca

SEQ ID NO: 469115 - DNA, 20 bp, Artificial
  CRISPR gRNA sequence
gggaaactagaatgcccttt

SEQ ID NO: 469116 - DNA, 20 bp, Artificial
  CRISPR gRNA sequence
gcttgctgcccagatctgcc

SEQ ID NO: 469117 - DNA, 20 bp, Artificial
  CRISPR gRNA sequence
gtggaacacaacttcctcca

SEQ ID NO: 469118 - DNA, 20 bp, Artificial
  CRISPR gRNA sequence
aatgccattttatttctctg

SEQ ID NO: 469119 - DNA, 20 bp, Artificial
  CRISPR gRNA sequence
ctatattttggaagtagata

SEQ ID NO: 469120 - DNA, 20 bp, Artificial
  CRISPR gRNA sequence
ttttggaagtagataacttg

SEQ ID NO: 469121 - DNA, 20 bp, Artificial
  CRISPR gRNA sequence
catgatcatagttggaggga

SEQ ID NO: 469122 - DNA, 20 bp, Artificial
  CRISPR gRNA sequence
tgccttgaatcttacccata

SEQ ID NO: 469123 - DNA, 20 bp, Artificial
  CRISPR gRNA sequence
tttagataagactctgaatt

SEQ ID NO: 469124 - DNA, 20 bp, Artificial
  CRISPR gRNA sequence
actctgaatttagtgttttg

SEQ ID NO: 469125 - DNA, 20 bp, Artificial
  CRISPR gRNA sequence
attttgtatgtgaaaagaac

SEQ ID NO: 469126 - DNA, 20 bp, Artificial
  CRISPR gRNA sequence
ggggaccaggggcagaatgc

SEQ ID NO: 469127 - DNA, 20 bp, Artificial
  CRISPR gRNA sequence
tgaaattttattgctattgt

SEQ ID NO: 469128 - DNA, 20 bp, Artificial
  CRISPR gRNA sequence
attaatgcccttattgtagg

SEQ ID NO: 469129 - DNA, 20 bp, Artificial
  CRISPR gRNA sequence
cttgtgtgctcccttccact

SEQ ID NO: 469130 - DNA, 20 bp, Artificial
  CRISPR gRNA sequence
ccatgagccaaataaaactt

SEQ ID NO: 469131 - DNA, 20 bp, Artificial
  CRISPR gRNA sequence
ccgtgtgtagagaccaccaa

SEQ ID NO: 469132 - DNA, 20 bp, Artificial
  CRISPR gRNA sequence
aggctttgtgtgagcaacaa

SEQ ID NO: 469133 - DNA, 20 bp, Artificial
  CRISPR gRNA sequence
aagagagtcagcaaatgatg

SEQ ID NO: 469134 - DNA, 20 bp, Artificial
  CRISPR gRNA sequence
tgagattatcattagtactt

SEQ ID NO: 469135 - DNA, 20 bp, Artificial
  CRISPR gRNA sequence
ataggcagtggagttaagag

SEQ ID NO: 469136 - DNA, 20 bp, Artificial
  CRISPR gRNA sequence
aagaaacttcttaagggtgg

SEQ ID NO: 469137 - DNA, 20 bp, Artificial
  CRISPR gRNA sequence
cacttcttttgtggatcttc

SEQ ID NO: 469138 - DNA, 20 bp, Artificial
  CRISPR gRNA sequence
gtgcaggtcacagggtatat

SEQ ID NO: 469139 - DNA, 20 bp, Artificial
  CRISPR gRNA sequence
ggtcacagggtatatgatgg

SEQ ID NO: 469140 - DNA, 20 bp, Artificial
  CRISPR gRNA sequence
ggctcaaaggcctgacagac

SEQ ID NO: 469141 - DNA, 20 bp, Artificial
  CRISPR gRNA sequence
ggcctgacagacagaggatt

SEQ ID NO: 469142 - DNA, 20 bp, Artificial
  CRISPR gRNA sequence
tgtatgagacattctgctag

SEQ ID NO: 469143 - DNA, 20 bp, Artificial
  CRISPR gRNA sequence
ttaattactagaaattgggg

SEQ ID NO: 469144 - DNA, 20 bp, Artificial
  CRISPR gRNA sequence
tgtttttgaaaattaccaaa

SEQ ID NO: 469145 - DNA, 20 bp, Artificial
  CRISPR gRNA sequence
tggtacttccagaagaacat

SEQ ID NO: 469146 - DNA, 20 bp, Artificial
  CRISPR gRNA sequence
tccagaagaacatatttgat

SEQ ID NO: 469147 - DNA, 20 bp, Artificial
  CRISPR gRNA sequence
aagaacatatttgattttag

SEQ ID NO: 469148 - DNA, 20 bp, Artificial
  CRISPR gRNA sequence
agggaaagaatcatgtgatg

SEQ ID NO: 469149 - DNA, 20 bp, Artificial
  CRISPR gRNA sequence
tttcattctacattttgaac

SEQ ID NO: 469150 - DNA, 20 bp, Artificial
  CRISPR gRNA sequence
accatctgatatttttctta

SEQ ID NO: 469151 - DNA, 20 bp, Artificial
  CRISPR gRNA sequence
tgtttccaggaagagggggg

SEQ ID NO: 469152 - DNA, 20 bp, Artificial
  CRISPR gRNA sequence
agaggggggttcagtttctc

SEQ ID NO: 469153 - DNA, 20 bp, Artificial
  CRISPR gRNA sequence
atctgaaatctgctacacct

SEQ ID NO: 469154 - DNA, 20 bp, Artificial
  CRISPR gRNA sequence
gtacatatgtgtgtgtatgt

SEQ ID NO: 469155 - DNA, 20 bp, Artificial
  CRISPR gRNA sequence
gagaaatagatagtaaaagt

SEQ ID NO: 469156 - DNA, 20 bp, Artificial
  CRISPR gRNA sequence
aaagttattgtttttgactt

SEQ ID NO: 469157 - DNA, 20 bp, Artificial
  CRISPR gRNA sequence
acctatagttgcgaatagct

SEQ ID NO: 469158 - DNA, 20 bp, Artificial
  CRISPR gRNA sequence
atagttgcgaatagctctgt

SEQ ID NO: 469159 - DNA, 20 bp, Artificial
  CRISPR gRNA sequence
tgtgattgcttgtccttctt

SEQ ID NO: 469160 - DNA, 20 bp, Artificial
  CRISPR gRNA sequence
ttcattacaatttcttgaag

SEQ ID NO: 469161 - DNA, 20 bp, Artificial
  CRISPR gRNA sequence
atttcttgaagttatgtttg

SEQ ID NO: 469162 - DNA, 20 bp, Artificial
  CRISPR gRNA sequence
ttaaacacttcttaatagtt

SEQ ID NO: 469163 - DNA, 20 bp, Artificial
  CRISPR gRNA sequence
acacttcttaatagttcaca

SEQ ID NO: 469164 - DNA, 20 bp, Artificial
  CRISPR gRNA sequence
caaacaactaactgacttcc

SEQ ID NO: 469165 - DNA, 20 bp, Artificial
  CRISPR gRNA sequence
agtgattttctgggaatatt

SEQ ID NO: 469166 - DNA, 20 bp, Artificial
  CRISPR gRNA sequence
ttccccgaaagaggccttta

SEQ ID NO: 469167 - DNA, 20 bp, Artificial
  CRISPR gRNA sequence
tgaggaaggacagatagaag

SEQ ID NO: 469168 - DNA, 20 bp, Artificial
  CRISPR gRNA sequence
gtaggtaagagtaaaaaata

SEQ ID NO: 469169 - DNA, 20 bp, Artificial
  CRISPR gRNA sequence
caacatcatattcaatggtg

SEQ ID NO: 469170 - DNA, 20 bp, Artificial
  CRISPR gRNA sequence
atattcaatggtgaaaggct

SEQ ID NO: 469171 - DNA, 20 bp, Artificial
  CRISPR gRNA sequence
aacaggaacaagacatggat

SEQ ID NO: 469172 - DNA, 20 bp, Artificial
  CRISPR gRNA sequence
gtgtagaaaaattcttaaaa

SEQ ID NO: 469173 - DNA, 20 bp, Artificial
  CRISPR gRNA sequence
caatattccccaaggtgatc

SEQ ID NO: 469174 - DNA, 20 bp, Artificial
  CRISPR gRNA sequence
tgcagttccactaaaatcct

SEQ ID NO: 469175 - DNA, 20 bp, Artificial
  CRISPR gRNA sequence
aactccatacatccgtagtc

SEQ ID NO: 469176 - DNA, 20 bp, Artificial
  CRISPR gRNA sequence
attgatttttgataagggta

SEQ ID NO: 469177 - DNA, 20 bp, Artificial
  CRISPR gRNA sequence
cattatataaaacaataaaa

SEQ ID NO: 469178 - DNA, 20 bp, Artificial
  CRISPR gRNA sequence
ttaggagaaaacatagggat

SEQ ID NO: 469179 - DNA, 20 bp, Artificial
  CRISPR gRNA sequence
tagggataaatgtttctgat

SEQ ID NO: 469180 - DNA, 20 bp, Artificial
  CRISPR gRNA sequence
gtttctgatcttggatttag

SEQ ID NO: 469181 - DNA, 20 bp, Artificial
  CRISPR gRNA sequence
atttagcagtgttttcttag

SEQ ID NO: 469182 - DNA, 20 bp, Artificial
  CRISPR gRNA sequence
tcacacaaaaccttgttcct

SEQ ID NO: 469183 - DNA, 20 bp, Artificial
  CRISPR gRNA sequence
tgatgaatggataaaggaaa

SEQ ID NO: 469184 - DNA, 20 bp, Artificial
  CRISPR gRNA sequence
gaagaaaaaggttacataca

SEQ ID NO: 469185 - DNA, 20 bp, Artificial
  CRISPR gRNA sequence
aaaggttacatacaatgtga

SEQ ID NO: 469186 - DNA, 20 bp, Artificial
  CRISPR gRNA sequence
gcaaatccatagagacagaa

SEQ ID NO: 469187 - DNA, 20 bp, Artificial
  CRISPR gRNA sequence
acatgactactaaataggta

SEQ ID NO: 469188 - DNA, 20 bp, Artificial
  CRISPR gRNA sequence
gttctgaatctagatcgtag

SEQ ID NO: 469189 - DNA, 20 bp, Artificial
  CRISPR gRNA sequence
gccatttaattgtacatttt

SEQ ID NO: 469190 - DNA, 20 bp, Artificial
  CRISPR gRNA sequence
tttaattataagaaataatg

SEQ ID NO: 469191 - DNA, 20 bp, Artificial
  CRISPR gRNA sequence
gaactctggatgcaacctcg

SEQ ID NO: 469192 - DNA, 20 bp, Artificial
  CRISPR gRNA sequence
taaaattaatttgttacttt

SEQ ID NO: 469193 - DNA, 20 bp, Artificial
  CRISPR gRNA sequence
aatccattgaaattctttta

SEQ ID NO: 469194 - DNA, 20 bp, Artificial
  CRISPR gRNA sequence
attcttttaaaatgctttag

SEQ ID NO: 469195 - DNA, 20 bp, Artificial
  CRISPR gRNA sequence
agcaccatgaaaaaatgcat

SEQ ID NO: 469196 - DNA, 20 bp, Artificial
  CRISPR gRNA sequence
atcgatggcagagttaggga

SEQ ID NO: 469197 - DNA, 20 bp, Artificial
  CRISPR gRNA sequence
ttacttgtgaccatccatgc

SEQ ID NO: 469198 - DNA, 20 bp, Artificial
  CRISPR gRNA sequence
catgatgactaaagataatc

SEQ ID NO: 469199 - DNA, 20 bp, Artificial
  CRISPR gRNA sequence
ttctagggatcaagttgggg

SEQ ID NO: 469200 - DNA, 20 bp, Artificial
  CRISPR gRNA sequence
ctcctaaatcctgtgccttg

SEQ ID NO: 469201 - DNA, 20 bp, Artificial
  CRISPR gRNA sequence
taggagacatgaagggcctt

SEQ ID NO: 469202 - DNA, 20 bp, Artificial
  CRISPR gRNA sequence
tttttgaacatttctactct

SEQ ID NO: 469203 - DNA, 20 bp, Artificial
  CRISPR gRNA sequence
ttcctatcactcccttcctt

SEQ ID NO: 469204 - DNA, 20 bp, Artificial
  CRISPR gRNA sequence
gaaaatcccagagaattttc

SEQ ID NO: 469205 - DNA, 20 bp, Artificial
  CRISPR gRNA sequence
ccacaacattccactctgtg

SEQ ID NO: 469206 - DNA, 20 bp, Artificial
  CRISPR gRNA sequence
ctctgtgatgtgtttcctcc

SEQ ID NO: 469207 - DNA, 20 bp, Artificial
  CRISPR gRNA sequence
ctaaataattccaattaatt

SEQ ID NO: 469208 - DNA, 20 bp, Artificial
  CRISPR gRNA sequence
aaccagcattcaaagtcttc

SEQ ID NO: 469209 - DNA, 20 bp, Artificial
  CRISPR gRNA sequence
cagtttgatcccaccacctt

SEQ ID NO: 469210 - DNA, 20 bp, Artificial
  CRISPR gRNA sequence
ttgatcccaccacctttcta

SEQ ID NO: 469211 - DNA, 20 bp, Artificial
  CRISPR gRNA sequence
caccacctttctagattgtt

SEQ ID NO: 469212 - DNA, 20 bp, Artificial
  CRISPR gRNA sequence
ctaattttccaagttcttaa

SEQ ID NO: 469213 - DNA, 20 bp, Artificial
  CRISPR gRNA sequence
aaatgtcttttaggtcccat

SEQ ID NO: 469214 - DNA, 20 bp, Artificial
  CRISPR gRNA sequence
aacttccttcacaaaaggta

SEQ ID NO: 469215 - DNA, 20 bp, Artificial
  CRISPR gRNA sequence
taactttaatttaaactctg

SEQ ID NO: 469216 - DNA, 20 bp, Artificial
  CRISPR gRNA sequence
gagaaaaatatattttggaa

SEQ ID NO: 469217 - DNA, 20 bp, Artificial
  CRISPR gRNA sequence
tttggaaatatgtttaagga

SEQ ID NO: 469218 - DNA, 20 bp, Artificial
  CRISPR gRNA sequence
tcctgtgaaatatatttccg

SEQ ID NO: 469219 - DNA, 20 bp, Artificial
  CRISPR gRNA sequence
cgaagtgattttggacattt

SEQ ID NO: 469220 - DNA, 20 bp, Artificial
  CRISPR gRNA sequence
ttttataagtgactttcttt

SEQ ID NO: 469221 - DNA, 20 bp, Artificial
  CRISPR gRNA sequence
gaacaggactgtgacagagt

SEQ ID NO: 469222 - DNA, 20 bp, Artificial
  CRISPR gRNA sequence
cccttcccaaacttcccttg

SEQ ID NO: 469223 - DNA, 20 bp, Artificial
  CRISPR gRNA sequence
ccaaacttcccttggtcagt

SEQ ID NO: 469224 - DNA, 20 bp, Artificial
  CRISPR gRNA sequence
cgaacaaatcacttgaggtc

SEQ ID NO: 469225 - DNA, 20 bp, Artificial
  CRISPR gRNA sequence
gaggtggaggctgcagtgaa

SEQ ID NO: 469226 - DNA, 20 bp, Artificial
  CRISPR gRNA sequence
tgagagggcaggaagtcctt

SEQ ID NO: 469227 - DNA, 20 bp, Artificial
  CRISPR gRNA sequence
gaagtccttgtgggcttcca

SEQ ID NO: 469228 - DNA, 20 bp, Artificial
  CRISPR gRNA sequence
gtgcagactatactgtgtcc

SEQ ID NO: 469229 - DNA, 20 bp, Artificial
  CRISPR gRNA sequence
aggtgatcaaagcagacaga

SEQ ID NO: 469230 - DNA, 20 bp, Artificial
  CRISPR gRNA sequence
gttgtatttacagtctttca

SEQ ID NO: 469231 - DNA, 20 bp, Artificial
  CRISPR gRNA sequence
tggggttgatgttccacaaa

SEQ ID NO: 469232 - DNA, 20 bp, Artificial
  CRISPR gRNA sequence
attgtgcttactgatcttga

SEQ ID NO: 469233 - DNA, 20 bp, Artificial
  CRISPR gRNA sequence
tactgatcttgagatagatt

SEQ ID NO: 469234 - DNA, 20 bp, Artificial
  CRISPR gRNA sequence
gaatcctccccaaggctagc

SEQ ID NO: 469235 - DNA, 20 bp, Artificial
  CRISPR gRNA sequence
caatcaatttcagttattta

SEQ ID NO: 469236 - DNA, 20 bp, Artificial
  CRISPR gRNA sequence
caaactcaaaataagttagg

SEQ ID NO: 469237 - DNA, 20 bp, Artificial
  CRISPR gRNA sequence
aaaataagttagggggagtt

SEQ ID NO: 469238 - DNA, 20 bp, Artificial
  CRISPR gRNA sequence
agtttgttctgaaatagaga

SEQ ID NO: 469239 - DNA, 20 bp, Artificial
  CRISPR gRNA sequence
agagaaacagtttgttctga

SEQ ID NO: 469240 - DNA, 20 bp, Artificial
  CRISPR gRNA sequence
atcaagtaaaattaaggaaa

SEQ ID NO: 469241 - DNA, 20 bp, Artificial
  CRISPR gRNA sequence
ggatcttcttgatccagcag

SEQ ID NO: 469242 - DNA, 20 bp, Artificial
  CRISPR gRNA sequence
tccaagaccctcccccaggc

SEQ ID NO: 469243 - DNA, 20 bp, Artificial
  CRISPR gRNA sequence
ctgtttctggcactcctggc

SEQ ID NO: 469244 - DNA, 20 bp, Artificial
  CRISPR gRNA sequence
tataattaatagaatttttt

SEQ ID NO: 469245 - DNA, 20 bp, Artificial
  CRISPR gRNA sequence
agtctccacctaccgagttc

SEQ ID NO: 469246 - DNA, 20 bp, Artificial
  CRISPR gRNA sequence
tgtctcagcctcccatgtac

SEQ ID NO: 469247 - DNA, 20 bp, Artificial
  CRISPR gRNA sequence
ttttgtatttttagtagaga

SEQ ID NO: 469248 - DNA, 20 bp, Artificial
  CRISPR gRNA sequence
tacctcggcctcccaaagtg

SEQ ID NO: 469249 - DNA, 20 bp, Artificial
  CRISPR gRNA sequence
cataatgcacacaaatataa

SEQ ID NO: 469250 - DNA, 20 bp, Artificial
  CRISPR gRNA sequence
ggtcatacttaaccataaga

SEQ ID NO: 469251 - DNA, 20 bp, Artificial
  CRISPR gRNA sequence
cattgacactttggtctgga

SEQ ID NO: 469252 - DNA, 20 bp, Artificial
  CRISPR gRNA sequence
gttgcatcctgtatagtgta

SEQ ID NO: 469253 - DNA, 20 bp, Artificial
  CRISPR gRNA sequence
gtagggtgtttagcagaatc

SEQ ID NO: 469254 - DNA, 20 bp, Artificial
  CRISPR gRNA sequence
cagacattgccacacatgtt

SEQ ID NO: 469255 - DNA, 20 bp, Artificial
  CRISPR gRNA sequence
ctagtgtgtgtgatgcattc

SEQ ID NO: 469256 - DNA, 20 bp, Artificial
  CRISPR gRNA sequence
ttctgatgatttctatcctc

SEQ ID NO: 469257 - DNA, 20 bp, Artificial
  CRISPR gRNA sequence
atgctatttgtgacatacta

SEQ ID NO: 469258 - DNA, 20 bp, Artificial
  CRISPR gRNA sequence
tatcaaaagtatttgatatt

SEQ ID NO: 469259 - DNA, 20 bp, Artificial
  CRISPR gRNA sequence
gaatttcctgttacaaacat

SEQ ID NO: 469260 - DNA, 20 bp, Artificial
  CRISPR gRNA sequence
tcttgggacaaaataaagac

SEQ ID NO: 469261 - DNA, 20 bp, Artificial
  CRISPR gRNA sequence
gagttagatactgtaaatag

SEQ ID NO: 469262 - DNA, 20 bp, Artificial
  CRISPR gRNA sequence
gtaccttctgacagttatca

SEQ ID NO: 469263 - DNA, 20 bp, Artificial
  CRISPR gRNA sequence
tatcatgaagattgttctgt

SEQ ID NO: 469264 - DNA, 20 bp, Artificial
  CRISPR gRNA sequence
gcaagaggtggctgagggca

SEQ ID NO: 469265 - DNA, 20 bp, Artificial
  CRISPR gRNA sequence
tgccgctgatcccaatatat

SEQ ID NO: 469266 - DNA, 20 bp, Artificial
  CRISPR gRNA sequence
caagcagaccctggctcctg

SEQ ID NO: 469267 - DNA, 20 bp, Artificial
  CRISPR gRNA sequence
tgtatcgtttacttcctttg

SEQ ID NO: 469268 - DNA, 20 bp, Artificial
  CRISPR gRNA sequence
gattgcctctactcatcact

SEQ ID NO: 469269 - DNA, 20 bp, Artificial
  CRISPR gRNA sequence
ccattcttatttctggggct

SEQ ID NO: 469270 - DNA, 20 bp, Artificial
  CRISPR gRNA sequence
atttctggggctaaaggatt

SEQ ID NO: 469271 - DNA, 20 bp, Artificial
  CRISPR gRNA sequence
aaggatttttagtttcttcc

SEQ ID NO: 469272 - DNA, 20 bp, Artificial
  CRISPR gRNA sequence
ccaatcctgtaaaccatgga

SEQ ID NO: 469273 - DNA, 20 bp, Artificial
  CRISPR gRNA sequence
tcattctctttgcatcaatc

SEQ ID NO: 469274 - DNA, 20 bp, Artificial
  CRISPR gRNA sequence
aagagctcttctaaacctta

SEQ ID NO: 469275 - DNA, 20 bp, Artificial
  CRISPR gRNA sequence
acaatctctcagatcaagat

SEQ ID NO: 469276 - DNA, 20 bp, Artificial
  CRISPR gRNA sequence
tttctattgccattataaac

SEQ ID NO: 469277 - DNA, 20 bp, Artificial
  CRISPR gRNA sequence
caataatgcatatgaaaaat

SEQ ID NO: 469278 - DNA, 20 bp, Artificial
  CRISPR gRNA sequence
gaaagcatagagaattctga

SEQ ID NO: 469279 - DNA, 20 bp, Artificial
  CRISPR gRNA sequence
ctagctttggcctgaactac

SEQ ID NO: 469280 - DNA, 20 bp, Artificial
  CRISPR gRNA sequence
tctcctccatcctctcacat

SEQ ID NO: 469281 - DNA, 20 bp, Artificial
  CRISPR gRNA sequence
aataacctttgactgggcaa

SEQ ID NO: 469282 - DNA, 20 bp, Artificial
  CRISPR gRNA sequence
ttctggagttcagaaccttc

SEQ ID NO: 469283 - DNA, 20 bp, Artificial
  CRISPR gRNA sequence
aaaggagtcagggataaatc

SEQ ID NO: 469284 - DNA, 20 bp, Artificial
  CRISPR gRNA sequence
aggataagcatgggtggcaa

SEQ ID NO: 469285 - DNA, 20 bp, Artificial
  CRISPR gRNA sequence
tgggtggcaaggtggtttac

SEQ ID NO: 469286 - DNA, 20 bp, Artificial
  CRISPR gRNA sequence
acttctgctttctttactcc

SEQ ID NO: 469287 - DNA, 20 bp, Artificial
  CRISPR gRNA sequence
caggaagggaaattaacctg

SEQ ID NO: 469288 - DNA, 20 bp, Artificial
  CRISPR gRNA sequence
caaatgcaatttgtgttata

SEQ ID NO: 469289 - DNA, 20 bp, Artificial
  CRISPR gRNA sequence
gactctgctcttgcctgtta

SEQ ID NO: 469290 - DNA, 20 bp, Artificial
  CRISPR gRNA sequence
aacccacaaataacctcata

SEQ ID NO: 469291 - DNA, 20 bp, Artificial
  CRISPR gRNA sequence
agcaaaatagagacatgatc

SEQ ID NO: 469292 - DNA, 20 bp, Artificial
  CRISPR gRNA sequence
tttggagtcaatctttccta

SEQ ID NO: 469293 - DNA, 20 bp, Artificial
  CRISPR gRNA sequence
ataaggtttggaatgtaaat

SEQ ID NO: 469294 - DNA, 20 bp, Artificial
  CRISPR gRNA sequence
caaaggaacttgatgtgtgt

SEQ ID NO: 469295 - DNA, 20 bp, Artificial
  CRISPR gRNA sequence
gcattcaacattccccacca

SEQ ID NO: 469296 - DNA, 20 bp, Artificial
  CRISPR gRNA sequence
ctcaacttgacaaacttcta

SEQ ID NO: 469297 - DNA, 20 bp, Artificial
  CRISPR gRNA sequence
gtaggcactgtgtagggtgc

SEQ ID NO: 469298 - DNA, 20 bp, Artificial
  CRISPR gRNA sequence
taaataataataaaaatttc

SEQ ID NO: 469299 - DNA, 20 bp, Artificial
  CRISPR gRNA sequence
tcctgggtaggctggataaa

SEQ ID NO: 469300 - DNA, 20 bp, Artificial
  CRISPR gRNA sequence
aggctggataaattatgatt

SEQ ID NO: 469301 - DNA, 20 bp, Artificial
  CRISPR gRNA sequence
tctgtatgtgcaattgtctg

SEQ ID NO: 469302 - DNA, 20 bp, Artificial
  CRISPR gRNA sequence
tatgtgcaattgtctgggaa

SEQ ID NO: 469303 - DNA, 20 bp, Artificial
  CRISPR gRNA sequence
tgtctgggaagtttgtttta

SEQ ID NO: 469304 - DNA, 20 bp, Artificial
  CRISPR gRNA sequence
ttttgctattaacaggaatt

SEQ ID NO: 469305 - DNA, 20 bp, Artificial
  CRISPR gRNA sequence
taaatatttcttaacataaa

SEQ ID NO: 469306 - DNA, 20 bp, Artificial
  CRISPR gRNA sequence
aacggtcctttgagggtata

SEQ ID NO: 469307 - DNA, 20 bp, Artificial
  CRISPR gRNA sequence
tactataaatacaaatttta

SEQ ID NO: 469308 - DNA, 20 bp, Artificial
  CRISPR gRNA sequence
acctgccataggaatgtaag

SEQ ID NO: 469309 - DNA, 20 bp, Artificial
  CRISPR gRNA sequence
ataggaatgtaaggtgggat

SEQ ID NO: 469310 - DNA, 20 bp, Artificial
  CRISPR gRNA sequence
tgtaaggtgggattgctgtt

SEQ ID NO: 469311 - DNA, 20 bp, Artificial
  CRISPR gRNA sequence
agagacagggaacccaattg

SEQ ID NO: 469312 - DNA, 20 bp, Artificial
  CRISPR gRNA sequence
gaacccaattgacaggctta

SEQ ID NO: 469313 - DNA, 20 bp, Artificial
  CRISPR gRNA sequence
cactgtatcaggaattctta

SEQ ID NO: 469314 - DNA, 20 bp, Artificial
  CRISPR gRNA sequence
gcttctcagggtaaagccag

SEQ ID NO: 469315 - DNA, 20 bp, Artificial
  CRISPR gRNA sequence
acatcaggactaattttact

SEQ ID NO: 469316 - DNA, 20 bp, Artificial
  CRISPR gRNA sequence
aatggcgtgaagccgggagg

SEQ ID NO: 469317 - DNA, 20 bp, Artificial
  CRISPR gRNA sequence
gataggaataacaactggaa

SEQ ID NO: 469318 - DNA, 20 bp, Artificial
  CRISPR gRNA sequence
atactgttttggaacttttt

SEQ ID NO: 469319 - DNA, 20 bp, Artificial
  CRISPR gRNA sequence
cttggctaactcataatatt

SEQ ID NO: 469320 - DNA, 20 bp, Artificial
  CRISPR gRNA sequence
gccctcttagggggtatttg

SEQ ID NO: 469321 - DNA, 20 bp, Artificial
  CRISPR gRNA sequence
tcatcatgttataaactgcc

SEQ ID NO: 469322 - DNA, 20 bp, Artificial
  CRISPR gRNA sequence
tgaagttttcataggatatt

SEQ ID NO: 469323 - DNA, 20 bp, Artificial
  CRISPR gRNA sequence
gctttttccatcaatttggg

SEQ ID NO: 469324 - DNA, 20 bp, Artificial
  CRISPR gRNA sequence
gctatgctttttatcttgaa

SEQ ID NO: 469325 - DNA, 20 bp, Artificial
  CRISPR gRNA sequence
ataactatttaggggtgaca

SEQ ID NO: 469326 - DNA, 20 bp, Artificial
  CRISPR gRNA sequence
cagcagagtatgtgaggaac

SEQ ID NO: 469327 - DNA, 20 bp, Artificial
  CRISPR gRNA sequence
cacaatggacatgactccat

SEQ ID NO: 469328 - DNA, 20 bp, Artificial
  CRISPR gRNA sequence
ctccatttaagcttttcatt

SEQ ID NO: 469329 - DNA, 20 bp, Artificial
  CRISPR gRNA sequence
tttatgataatgaccctgac

SEQ ID NO: 469330 - DNA, 20 bp, Artificial
  CRISPR gRNA sequence
ttcaggatgcaggaagggtc

SEQ ID NO: 469331 - DNA, 20 bp, Artificial
  CRISPR gRNA sequence
ctggaagaaaacaaaccagg

SEQ ID NO: 469332 - DNA, 20 bp, Artificial
  CRISPR gRNA sequence
gaaaacaaaccaggcattgt

SEQ ID NO: 469333 - DNA, 20 bp, Artificial
  CRISPR gRNA sequence
ccatatgtgtgaggagttaa

SEQ ID NO: 469334 - DNA, 20 bp, Artificial
  CRISPR gRNA sequence
tactttagaaatgttcatgt

SEQ ID NO: 469335 - DNA, 20 bp, Artificial
  CRISPR gRNA sequence
gtcttaagggtccataggat

SEQ ID NO: 469336 - DNA, 20 bp, Artificial
  CRISPR gRNA sequence
tttctctcagaaacttattt

SEQ ID NO: 469337 - DNA, 20 bp, Artificial
  CRISPR gRNA sequence
tcatgagtagcagaatagta

SEQ ID NO: 469338 - DNA, 20 bp, Artificial
  CRISPR gRNA sequence
tggaaagacttgtagggaaa

SEQ ID NO: 469339 - DNA, 20 bp, Artificial
  CRISPR gRNA sequence
ctaaccaaccataaatacag

SEQ ID NO: 469340 - DNA, 20 bp, Artificial
  CRISPR gRNA sequence
ttgctgtgtcagtctaagaa

SEQ ID NO: 469341 - DNA, 20 bp, Artificial
  CRISPR gRNA sequence
aatgcaaaggagaaatcatt

SEQ ID NO: 469342 - DNA, 20 bp, Artificial
  CRISPR gRNA sequence
gttccacatacctggcaaac

SEQ ID NO: 469343 - DNA, 20 bp, Artificial
  CRISPR gRNA sequence
caaatgcttatatctactct

SEQ ID NO: 469344 - DNA, 20 bp, Artificial
  CRISPR gRNA sequence
aatatacttatgggcatctg

SEQ ID NO: 469345 - DNA, 20 bp, Artificial
  CRISPR gRNA sequence
ggtatcactgggcaagtgaa

SEQ ID NO: 469346 - DNA, 20 bp, Artificial
  CRISPR gRNA sequence
gggcaagtgaagatagctta

SEQ ID NO: 469347 - DNA, 20 bp, Artificial
  CRISPR gRNA sequence
tgaagatagcttaaactgct

SEQ ID NO: 469348 - DNA, 20 bp, Artificial
  CRISPR gRNA sequence
taattggtctgtaggggtca

SEQ ID NO: 469349 - DNA, 20 bp, Artificial
  CRISPR gRNA sequence
aatcatctgtagtgacatat

SEQ ID NO: 469350 - DNA, 20 bp, Artificial
  CRISPR gRNA sequence
cacttaagagtatagcaaaa

SEQ ID NO: 469351 - DNA, 20 bp, Artificial
  CRISPR gRNA sequence
agagtatagcaaaagatgga

SEQ ID NO: 469352 - DNA, 20 bp, Artificial
  CRISPR gRNA sequence
aatagcctataattttattc

SEQ ID NO: 469353 - DNA, 20 bp, Artificial
  CRISPR gRNA sequence
gatcaaattgacattatatt

SEQ ID NO: 469354 - DNA, 20 bp, Artificial
  CRISPR gRNA sequence
aaattgacattatattttca

SEQ ID NO: 469355 - DNA, 20 bp, Artificial
  CRISPR gRNA sequence
gaaaataatatgtgaaatta

SEQ ID NO: 469356 - DNA, 20 bp, Artificial
  CRISPR gRNA sequence
tatatacaaaaagacaaaac

SEQ ID NO: 469357 - DNA, 20 bp, Artificial
  CRISPR gRNA sequence
aaaactgaggttttgtggtg

SEQ ID NO: 469358 - DNA, 20 bp, Artificial
  CRISPR gRNA sequence
tttcttaagtaacactggca

SEQ ID NO: 469359 - DNA, 20 bp, Artificial
  CRISPR gRNA sequence
ctggcattaagttttagctc

SEQ ID NO: 469360 - DNA, 20 bp, Artificial
  CRISPR gRNA sequence
caagcaaccaattcgagata

SEQ ID NO: 469361 - DNA, 20 bp, Artificial
  CRISPR gRNA sequence
taagaaagacatgttagaat

SEQ ID NO: 469362 - DNA, 20 bp, Artificial
  CRISPR gRNA sequence
cacgaaattgaacagttcct

SEQ ID NO: 469363 - DNA, 20 bp, Artificial
  CRISPR gRNA sequence
tatagtaaagataatgctga

SEQ ID NO: 469364 - DNA, 20 bp, Artificial
  CRISPR gRNA sequence
aagatgtattaatatatttg

SEQ ID NO: 469365 - DNA, 20 bp, Artificial
  CRISPR gRNA sequence
ttgccaaaatcacaaatcat

SEQ ID NO: 469366 - DNA, 20 bp, Artificial
  CRISPR gRNA sequence
ctctacttcactattattta

SEQ ID NO: 469367 - DNA, 20 bp, Artificial
  CRISPR gRNA sequence
ttatttacatggcttatttc

SEQ ID NO: 469368 - DNA, 20 bp, Artificial
  CRISPR gRNA sequence
gcttatttcattagtttata

SEQ ID NO: 469369 - DNA, 20 bp, Artificial
  CRISPR gRNA sequence
aaagaatatgtagataattt

SEQ ID NO: 469370 - DNA, 20 bp, Artificial
  CRISPR gRNA sequence
ttaatggtttttcacaaatt

SEQ ID NO: 469371 - DNA, 20 bp, Artificial
  CRISPR gRNA sequence
gtttttcacaaattttaagc

SEQ ID NO: 469372 - DNA, 20 bp, Artificial
  CRISPR gRNA sequence
ttatttgaaatcaatttggc

SEQ ID NO: 469373 - DNA, 20 bp, Artificial
  CRISPR gRNA sequence
atgtgtggacatgaatagaa

SEQ ID NO: 469374 - DNA, 20 bp, Artificial
  CRISPR gRNA sequence
cttttatgtgtcagggggtt

SEQ ID NO: 469375 - DNA, 20 bp, Artificial
  CRISPR gRNA sequence
ctaaggatattttaaataag

SEQ ID NO: 469376 - DNA, 20 bp, Artificial
  CRISPR gRNA sequence
atattttgcttttaagtttg

SEQ ID NO: 469377 - DNA, 20 bp, Artificial
  CRISPR gRNA sequence
atatttcctgtttctatttt

SEQ ID NO: 469378 - DNA, 20 bp, Artificial
  CRISPR gRNA sequence
ggcaaaataacagtgactca

SEQ ID NO: 469379 - DNA, 20 bp, Artificial
  CRISPR gRNA sequence
aacttaatgccagtgttact

SEQ ID NO: 469380 - DNA, 20 bp, Artificial
  CRISPR gRNA sequence
cattattcagtagcagcacc

SEQ ID NO: 469381 - DNA, 20 bp, Artificial
  CRISPR gRNA sequence
aatgatttctcctttgcatt

SEQ ID NO: 469382 - DNA, 20 bp, Artificial
  CRISPR gRNA sequence
agctcccaaataagtttctg

SEQ ID NO: 469383 - DNA, 20 bp, Artificial
  CRISPR gRNA sequence
taaagtaaaaattctcaaat

SEQ ID NO: 469384 - DNA, 20 bp, Artificial
  CRISPR gRNA sequence
ttcaatggtccctgttggag

SEQ ID NO: 469385 - DNA, 20 bp, Artificial
  CRISPR gRNA sequence
gtcttgagttcggtccaatg

SEQ ID NO: 469386 - DNA, 20 bp, Artificial
  CRISPR gRNA sequence
tgttttcttccaggcatgga

SEQ ID NO: 469387 - DNA, 20 bp, Artificial
  CRISPR gRNA sequence
aaggtgagcatcaacctaca
